United States Patent 7,250,496 (BIOINFORMATICALLY DETECTABLE GROUP OF NOVEL REGULATORY GENES AND USES THEREOF) - sequence listing, part 31

SEQ ID NO: 1329363 - RNA, 21 nt, Human
acuguuucugccccaugggga

SEQ ID NO: 1329364 - RNA, 19 nt, Human
agaacaacaaacacaagag

SEQ ID NO: 1329365 - RNA, 19 nt, Human
agagccaaacaucaaaaaa

SEQ ID NO: 1329366 - RNA, 20 nt, Human
agcaaagagaagcaacaaac

SEQ ID NO: 1329367 - RNA, 24 nt, Human
agcacgagagaggcugagaaagga

SEQ ID NO: 1329368 - RNA, 23 nt, Human
aggaaugugugcaugaacagaaa

SEQ ID NO: 1329369 - RNA, 23 nt, Human
agggagcagauccagcaaaaaca

SEQ ID NO: 1329370 - RNA, 19 nt, Human
agggccacaccccaugccu

SEQ ID NO: 1329371 - RNA, 20 nt, Human
agggguguuaggcacaggug

SEQ ID NO: 1329372 - RNA, 19 nt, Human
aggguaccaccaaagucca

SEQ ID NO: 1329373 - RNA, 25 nt, Human
aucuuccuccagccccuuuucucuu

SEQ ID NO: 1329374 - RNA, 21 nt, Human
augaaagaauagcaaagagaa

SEQ ID NO: 1329375 - RNA, 27 nt, Human
auggaaagccaguggaaacaaggacca

SEQ ID NO: 1329376 - RNA, 25 nt, Human
auggcaaugaggaucccgccgcauc

SEQ ID NO: 1329377 - RNA, 19 nt, Human
caaaaaaaucacccuggaa

SEQ ID NO: 1329378 - RNA, 22 nt, Human
caaaaacacucccccaggggcc

SEQ ID NO: 1329379 - RNA, 22 nt, Human
caaacuccaggcucuucuaccu

SEQ ID NO: 1329380 - RNA, 25 nt, Human
caagagccaaacaucaaaaaaauca

SEQ ID NO: 1329381 - RNA, 19 nt, Human
caagccaggaaggcagggg

SEQ ID NO: 1329382 - RNA, 22 nt, Human
caauuccucuggccagaaaccu

SEQ ID NO: 1329383 - RNA, 19 nt, Human
caccaccaccgcauucugc

SEQ ID NO: 1329384 - RNA, 20 nt, Human
cacccuggaagagcagggag

SEQ ID NO: 1329385 - RNA, 25 nt, Human
cacuuuguuccaaaaaguaguggag

SEQ ID NO: 1329386 - RNA, 19 nt, Human
cagaaggggugucaggggc

SEQ ID NO: 1329387 - RNA, 18 nt, Human
cagcaaaaacacuccccc

SEQ ID NO: 1329388 - RNA, 23 nt, Human
cagcaucucucaccuacugucuu

SEQ ID NO: 1329389 - RNA, 23 nt, Human
cagccacacuccugggccuccag

SEQ ID NO: 1329390 - RNA, 23 nt, Human
cagccccuuuucucuugcagcca

SEQ ID NO: 1329391 - RNA, 20 nt, Human
cagcggcgggggauggaggc

SEQ ID NO: 1329392 - RNA, 24 nt, Human
caggagccacuguuucugccccau

SEQ ID NO: 1329393 - RNA, 24 nt, Human
caguacaaaagacccccaccacca

SEQ ID NO: 1329394 - RNA, 28 nt, Human
caugccugccuuccccaccccauggagg

SEQ ID NO: 1329395 - RNA, 26 nt, Human
ccaaacaucaaaaaaaucacccugga

SEQ ID NO: 1329396 - RNA, 25 nt, Human
ccaagagccaaacaucaaaaaaauc

SEQ ID NO: 1329397 - RNA, 23 nt, Human
ccacaccccaugccugccuuccc

SEQ ID NO: 1329398 - RNA, 19 nt, Human
ccacacuccugggccucca

SEQ ID NO: 1329399 - RNA, 22 nt, Human
ccacacuccugggccuccagaa

SEQ ID NO: 1329400 - RNA, 25 nt, Human
ccacaggcugugacagggccucacu

SEQ ID NO: 1329401 - RNA, 20 nt, Human
ccacuaggucuuugccacug

SEQ ID NO: 1329402 - RNA, 22 nt, Human
ccacuguaucuugagcuggggg

SEQ ID NO: 1329403 - RNA, 21 nt, Human
ccagaaggggugucaggggca

SEQ ID NO: 1329404 - RNA, 19 nt, Human
ccaggaaggcaggggaaua

SEQ ID NO: 1329405 - RNA, 21 nt, Human
ccaucgcccagaagggguguc

SEQ ID NO: 1329406 - RNA, 20 nt, Human
cccagaggcugcucuccucc

SEQ ID NO: 1329407 - RNA, 24 nt, Human
cccaggagccacuguuucugcccc

SEQ ID NO: 1329408 - RNA, 23 nt, Human
ccccaaaucaccaagaaacugcc

SEQ ID NO: 1329409 - RNA, 23 nt, Human
ccccuacccacaggcugugacag

SEQ ID NO: 1329410 - RNA, 21 nt, Human
ccuaaagcugucucccagagc

SEQ ID NO: 1329411 - RNA, 23 nt, Human
ccuaacuucuccgagggccacac

SEQ ID NO: 1329412 - RNA, 22 nt, Human
ccucaucaggccccaggcccau

SEQ ID NO: 1329413 - RNA, 29 nt, Human
ccuccagccccuuuucucuuggggccgcc

SEQ ID NO: 1329414 - RNA, 22 nt, Human
ccuuugaguaccauggcaauga

SEQ ID NO: 1329415 - RNA, 21 nt, Human
cgagagggagcagauccagca

SEQ ID NO: 1329416 - RNA, 21 nt, Human
cgagggccacaccccaugccu

SEQ ID NO: 1329417 - RNA, 20 nt, Human
cggggugggggugggggguu

SEQ ID NO: 1329418 - RNA, 22 nt, Human
cucaaagguugucagcuccacc

SEQ ID NO: 1329419 - RNA, 23 nt, Human
cucccagagcccauaaaagggcu

SEQ ID NO: 1329420 - RNA, 19 nt, Human
cucuccucccagccucaaa

SEQ ID NO: 1329421 - RNA, 22 nt, Human
cucuucugccugcccaccucaa

SEQ ID NO: 1329422 - RNA, 22 nt, Human
cugcaccaucgcccagaagggg

SEQ ID NO: 1329423 - RNA, 20 nt, Human
gaaaaggagaacgagcagcg

SEQ ID NO: 1329424 - RNA, 19 nt, Human
gaaagaauagcaaagagaa

SEQ ID NO: 1329425 - RNA, 20 nt, Human
gagcagcggggugggggugg

SEQ ID NO: 1329426 - RNA, 23 nt, Human
gagcagggucuucucuccucaug

SEQ ID NO: 1329427 - RNA, 24 nt, Human
gaggaagcaaaggaguggguagaa

SEQ ID NO: 1329428 - RNA, 21 nt, Human
gaggcugagaaaggaccagug

SEQ ID NO: 1329429 - RNA, 27 nt, Human
gaguugagcagcggggugggggugggg

SEQ ID NO: 1329430 - RNA, 18 nt, Human
gcaaagagaagcaacaaa

SEQ ID NO: 1329431 - RNA, 19 nt, Human
gcagccacacuccugggcc

SEQ ID NO: 1329432 - RNA, 22 nt, Human
gcagcggggugggggugggggg

SEQ ID NO: 1329433 - RNA, 23 nt, Human
gcccaagaggauaugaaagaaua

SEQ ID NO: 1329434 - RNA, 26 nt, Human
gcccaggcccccgagcugcagcaacc

SEQ ID NO: 1329435 - RNA, 22 nt, Human
gcucccaggagccacuguuucu

SEQ ID NO: 1329436 - RNA, 19 nt, Human
gcugcaccaucgcccagaa

SEQ ID NO: 1329437 - RNA, 19 nt, Human
ggaaaauccccauuuauuc

SEQ ID NO: 1329438 - RNA, 22 nt, Human
ggaaagccaguggaaacaagga

SEQ ID NO: 1329439 - RNA, 24 nt, Human
ggaaggaguuggguaagucuugga

SEQ ID NO: 1329440 - RNA, 25 nt, Human
ggaccaagagccaaacaucaaaaaa

SEQ ID NO: 1329441 - RNA, 19 nt, Human
ggaggaaaugagguauagg

SEQ ID NO: 1329442 - RNA, 23 nt, Human
ggaucccgccgcauccccuaccc

SEQ ID NO: 1329443 - RNA, 23 nt, Human
ggaucuuccuccagccccuuuuc

SEQ ID NO: 1329444 - RNA, 21 nt, Human
gggcauccaucaucagcagag

SEQ ID NO: 1329445 - RNA, 19 nt, Human
gggcugcaccaucgcccag

SEQ ID NO: 1329446 - RNA, 18 nt, Human
gggcugggggaggagggu

SEQ ID NO: 1329447 - RNA, 18 nt, Human
ggggauggaaagccagug

SEQ ID NO: 1329448 - RNA, 20 nt, Human
gggggauggaggcgcccuug

SEQ ID NO: 1329449 - RNA, 20 nt, Human
ggggguaggggaccacuagg

SEQ ID NO: 1329450 - RNA, 18 nt, Human
ggguaccaccaaagucca

SEQ ID NO: 1329451 - RNA, 24 nt, Human
gggucuucucuccucaugccagga

SEQ ID NO: 1329452 - RNA, 18 nt, Human
gggugggggugggggguu

SEQ ID NO: 1329453 - RNA, 18 nt, Human
gguaccaccaaaguccag

SEQ ID NO: 1329454 - RNA, 19 nt, Human
gugggggguugccaucuac

SEQ ID NO: 1329455 - RNA, 24 nt, Human
guugagcagcgggguggggguggg

SEQ ID NO: 1329456 - RNA, 19 nt, Human
uaaaaaauaaaaaaagaca

SEQ ID NO: 1329457 - RNA, 20 nt, Human
uaacacuugacuccaaaaac

SEQ ID NO: 1329458 - RNA, 22 nt, Human
uaacuucuccgagggccacacc

SEQ ID NO: 1329459 - RNA, 18 nt, Human
uagcaaagagaagcaaca

SEQ ID NO: 1329460 - RNA, 20 nt, Human
uagcggcagcggcgggggau

SEQ ID NO: 1329461 - RNA, 24 nt, Human
uagcggcagcggcgggggauggag

SEQ ID NO: 1329462 - RNA, 20 nt, Human
uagugugagggacacuggga

SEQ ID NO: 1329463 - RNA, 22 nt, Human
uagugugagggacacugggaac

SEQ ID NO: 1329464 - RNA, 22 nt, Human
uaucuugagcugggggacuccu

SEQ ID NO: 1329465 - RNA, 24 nt, Human
ucaccaagaaacugccauaaccag

SEQ ID NO: 1329466 - RNA, 20 nt, Human
ucaccaggcccaagaggaua

SEQ ID NO: 1329467 - RNA, 18 nt, Human
ucaggggcagcccaggcc

SEQ ID NO: 1329468 - RNA, 19 nt, Human
uccaaaaacuaaggcugga

SEQ ID NO: 1329469 - RNA, 23 nt, Human
ucccaggagccacuguuucugcc

SEQ ID NO: 1329470 - RNA, 21 nt, Human
uccuggaucucuguagaucuc

SEQ ID NO: 1329471 - RNA, 22 nt, Human
uccugggccuccagaaauagcc

SEQ ID NO: 1329472 - RNA, 23 nt, Human
ucuccgagggccacaccccaugc

SEQ ID NO: 1329473 - RNA, 22 nt, Human
ucucugagggggaaggaguugg

SEQ ID NO: 1329474 - RNA, 24 nt, Human
ucuuccuccagccccuuuucucuu

SEQ ID NO: 1329475 - RNA, 21 nt, Human
ucuugcagccacacuccuggg

SEQ ID NO: 1329476 - RNA, 22 nt, Human
ugaagccccaaaucaccaagaa

SEQ ID NO: 1329477 - RNA, 19 nt, Human
ugagagagcgagagggagc

SEQ ID NO: 1329478 - RNA, 21 nt, Human
ugagcagcggggugggggugg

SEQ ID NO: 1329479 - RNA, 22 nt, Human
ugagcagcgggguggggguggg

SEQ ID NO: 1329480 - RNA, 18 nt, Human
ugagggggaaggaguugg

SEQ ID NO: 1329481 - RNA, 21 nt, Human
ugagguauagggcucugcgcc

SEQ ID NO: 1329482 - RNA, 20 nt, Human
ugcaccaucgcccagaaggg

SEQ ID NO: 1329483 - RNA, 18 nt, Human
ugcagccacacuccuggg

SEQ ID NO: 1329484 - RNA, 19 nt, Human
ugccauaaccaggaacucu

SEQ ID NO: 1329485 - RNA, 18 nt, Human
ugccaucacuuuguucca

SEQ ID NO: 1329486 - RNA, 18 nt, Human
ugcccuccggaucuuccu

SEQ ID NO: 1329487 - RNA, 19 nt, Human
ugcccuccggaucuuccuc

SEQ ID NO: 1329488 - RNA, 24 nt, Human
uggcaagaccccaauuccucuggc

SEQ ID NO: 1329489 - RNA, 21 nt, Human
uggcaggcagugcuuaaaaaa

SEQ ID NO: 1329490 - RNA, 23 nt, Human
ugggggaggaggguaccaccaaa

SEQ ID NO: 1329491 - RNA, 21 nt, Human
uggguagaaaaaggggaaaau

SEQ ID NO: 1329492 - RNA, 19 nt, Human
ugguaugaagaagauacgu

SEQ ID NO: 1329493 - RNA, 20 nt, Human
uugaagccccaaaucaccaa

SEQ ID NO: 1329494 - RNA, 21 nt, Human
uugacuccaaaaacuaaggcu

SEQ ID NO: 1329495 - RNA, 21 nt, Human
uugcagccacacuccugggcc

SEQ ID NO: 1329496 - RNA, 23 nt, Human
acuguugugaacacuugcuuuca

SEQ ID NO: 1329497 - RNA, 18 nt, Human
agagugaggggagcuuga

SEQ ID NO: 1329498 - RNA, 22 nt, Human
aguauggaagaaucgaaagaga

SEQ ID NO: 1329499 - RNA, 18 nt, Human
aucuuccucagggucgcu

SEQ ID NO: 1329500 - RNA, 23 nt, Human
auggcaaugggaaaagcagaugg

SEQ ID NO: 1329501 - RNA, 23 nt, Human
cgcuaacaucgaacucuuggcac

SEQ ID NO: 1329502 - RNA, 21 nt, Human
cgggagcagucugacucugau

SEQ ID NO: 1329503 - RNA, 33 nt, Human; identical to SEQ ID NO: 379763

SEQ ID NO: 1329504 - RNA, 24 nt, Human
gaacucuuggcacacuaagaaaaa

SEQ ID NO: 1329505 - RNA, 18 nt, Human
ggaaacagagugagggga

SEQ ID NO: 1329506 - RNA, 23 nt, Human
gggcaugugucguaucccugagg

SEQ ID NO: 1329507 - RNA, 20 nt, Human
gugugugugugugugugugu

SEQ ID NO: 1329508 - RNA, 21 nt, Human
gugugugugugugugugugug

SEQ ID NO: 1329509 - RNA, 21 nt, Human
gugugugugugugugugugug

SEQ ID NO: 1329510 - RNA, 19 nt, Human
uaaacacucagaacugccc

SEQ ID NO: 1329511 - RNA, 23 nt, Human
uaacagaaugacacaguguaaga

SEQ ID NO: 1329512 - RNA, 22 nt, Human
uacacaaaccaaaauaugcauu

SEQ ID NO: 1329513 - RNA, 18 nt, Human
uacugguacuuggugugu

SEQ ID NO: 1329514 - RNA, 19 nt, Human
uccaaagagaaaaucagac

SEQ ID NO: 1329515 - RNA, 19 nt, Human
ugaccaggacgcauggcaa

SEQ ID NO: 1329516 - RNA, 25 nt, Human
uggaagaauccaaagagaaaaucag

SEQ ID NO: 1329517 - RNA, 25 nt, Human
uggauacacaaaccaaaauaugcau

SEQ ID NO: 1329518 - RNA, 21 nt, Human
uggcaaugggaaaagcagaug

SEQ ID NO: 1329519 - RNA, 18 nt, Human
ugggaaaagcagauggca

SEQ ID NO: 1329520 - RNA, 23 nt, Human
ugguacuuggugugugugugugu

SEQ ID NO: 1329521 - RNA, 22 nt, Human
uggugugugugugugugugugu

SEQ ID NO: 1329522 - RNA, 22 nt, Human
ugguuugugugcgugugugugu

SEQ ID NO: 1329523 - RNA, 22 nt, Human
uguggugugguuugugugcgug

SEQ ID NO: 1329524 - RNA, 19 nt, Human
ugugugugugugguguggu

SEQ ID NO: 1329525 - RNA, 25 nt, Human
uguguguguguggugugguuugugu

SEQ ID NO: 1329526 - RNA, 18 nt, Human
ugugugugugugugugug

SEQ ID NO: 1329527 - RNA, 18 nt, Human
ugugugugugugugugug

SEQ ID NO: 1329528 - RNA, 18 nt, Human
ugugugugugugugugug

SEQ ID NO: 1329529 - RNA, 18 nt, Human
ugugugugugugugugug

SEQ ID NO: 1329530 - RNA, 18 nt, Human
ugugugugugugugugug

SEQ ID NO: 1329531 - RNA, 18 nt, Human
ugugugugugugugugug

SEQ ID NO: 1329532 - RNA, 18 nt, Human
ugugugugugugugugug

SEQ ID NO: 1329533 - RNA, 18 nt, Human
ugugugugugugugugug

SEQ ID NO: 1329534 - RNA, 18 nt, Human
ugugugugugugugugug

SEQ ID NO: 1329535 - RNA, 18 nt, Human
ugugugugugugugugug

SEQ ID NO: 1329536 - RNA, 18 nt, Human
ugugugugugugugugug

SEQ ID NO: 1329537 - RNA, 18 nt, Human
ugugugugugugugugug

SEQ ID NO: 1329538 - RNA, 22 nt, Human
uguguguguguguguguggugu

SEQ ID NO: 1329539 - RNA, 20 nt, Human
ugugugugugugugugugug

SEQ ID NO: 1329540 - RNA, 21 nt, Human
ugugugugugugugugugugu

SEQ ID NO: 1329541 - RNA, 21 nt, Human
ugugugugugugugugugugu

SEQ ID NO: 1329542 - RNA, 21 nt, Human
ugugugugugugugugugugu

SEQ ID NO: 1329543 - RNA, 21 nt, Human
ugugugugugugugugugugu

SEQ ID NO: 1329544 - RNA, 21 nt, Human
ugugugugugugugugugugu

SEQ ID NO: 1329545 - RNA, 21 nt, Human
ugugugugugugugugugugu

SEQ ID NO: 1329546 - RNA, 21 nt, Human
ugugugugugugugugugugu

SEQ ID NO: 1329547 - RNA, 21 nt, Human
ugugugugugugugugugugu

SEQ ID NO: 1329548 - RNA, 21 nt, Human
ugugugugugugugugugugu

SEQ ID NO: 1329549 - RNA, 21 nt, Human
ugugugugugugugugugugu

SEQ ID NO: 1329550 - RNA, 21 nt, Human
ugugugugugugugugugugu

SEQ ID NO: 1329551 - RNA, 21 nt, Human
ugugugugugugugugugugu

SEQ ID NO: 1329552 - RNA, 21 nt, Human
ugugugugugugugugugugu

SEQ ID NO: 1329553 - RNA, 21 nt, Human
ugugugugugugugugugugu

SEQ ID NO: 1329554 - RNA, 21 nt, Human
ugugugugugugugugugugu

SEQ ID NO: 1329555 - RNA, 21 nt, Human
ugugugugugugugugugugu

SEQ ID NO: 1329556 - RNA, 21 nt, Human
ugugugugugugugugugugu

SEQ ID NO: 1329557 - RNA, 21 nt, Human
ugugugugugugugugugugu

SEQ ID NO: 1329558 - RNA, 21 nt, Human
ugugugugugugugugugugu

SEQ ID NO: 1329559 - RNA, 21 nt, Human
ugugugugugugugugugugu

SEQ ID NO: 1329560 - RNA, 21 nt, Human
ugugugugugugugugugugu

SEQ ID NO: 1329561 - RNA, 21 nt, Human
ugugugugugugugugugugu

SEQ ID NO: 1329562 - RNA, 22 nt, Human
ugugugugugugugugugugug

SEQ ID NO: 1329563 - RNA, 22 nt, Human
ugugugugugugugugugugug

SEQ ID NO: 1329564 - RNA, 22 nt, Human
ugugugugugugugugugugug

SEQ ID NO: 1329565 - RNA, 22 nt, Human
ugugugugugugugugugugug

SEQ ID NO: 1329566 - RNA, 22 nt, Human
ugugugugugugugugugugug

SEQ ID NO: 1329567 - RNA, 22 nt, Human
ugugugugugugugugugugug

SEQ ID NO: 1329568 - RNA, 22 nt, Human
ugugugugugugugugugugug

SEQ ID NO: 1329569 - RNA, 22 nt, Human
ugugugugugugugugugugug

SEQ ID NO: 1329570 - RNA, 22 nt, Human
ugugugugugugugugugugug

SEQ ID NO: 1329571 - RNA, 22 nt, Human
uuaaacacucagaacugcccuc

SEQ ID NO: 1329572 - RNA, 18 nt, Human
uugcuaugcaccugauga

SEQ ID NO: 1329573 - RNA, 18 nt, Human
uuggugugugugugugug

SEQ ID NO: 1329574 - RNA, 24 nt, Human
acucuggaccagccaccaggugcc

SEQ ID NO: 1329575 - RNA, 20 nt, Human
acucuuuuggccacuauuga

SEQ ID NO: 1329576 - RNA, 19 nt, Human
agaguccuucccugggacu

SEQ ID NO: 1329577 - RNA, 24 nt, Human
caauuagaguccucgacucucagu

SEQ ID NO: 1329578 - RNA, 22 nt, Human
caccaggugccuuggcugcccu

SEQ ID NO: 1329579 - RNA, 27 nt, Human
cagccaaucagaguccuuccccgacuc

SEQ ID NO: 1329580 - RNA, 18 nt, Human
cagccaccaggugccuug

SEQ ID NO: 1329581 - RNA, 18 nt, Human
cagccaggugcccagccu

SEQ ID NO: 1329582 - RNA, 23 nt, Human
ccccgacucuggaccagccacca

SEQ ID NO: 1329583 - RNA, 22 nt, Human
ccuggcucagccaaucagaguc

SEQ ID NO: 1329584 - RNA, 21 nt, Human
cgcuggggucagauggacccu

SEQ ID NO: 1329585 - RNA, 20 nt, Human
cucgaagaugccucuucauc

SEQ ID NO: 1329586 - RNA, 19 nt, Human
cuggaccagccaccaggug

SEQ ID NO: 1329587 - RNA, 22 nt, Human
cuuaacccuggcucagccaauc

SEQ ID NO: 1329588 - RNA, 20 nt, Human
gacagccaggugcccagccc

SEQ ID NO: 1329589 - RNA, 21 nt, Human
gggaccacccaaucagagucc

SEQ ID NO: 1329590 - RNA, 23 nt, Human
guggaguccuugucuuuagagga

SEQ ID NO: 1329591 - RNA, 18 nt, Human
ucagaguccuuccccgac

SEQ ID NO: 1329592 - RNA, 21 nt, Human
ugauuggcuacguucuucccu

SEQ ID NO: 1329593 - RNA, 23 nt, Human
ugccuuggcugcccuuugguggc

SEQ ID NO: 1329594 - RNA, 19 nt, Human
ugggacuuaacccuggcuc

SEQ ID NO: 1329595 - RNA, 22 nt, Human
uucaagacccacuaauuggccu

SEQ ID NO: 1329596 - RNA, 21 nt, Human
uucccugggacuuaacccugg

SEQ ID NO: 1329597 - RNA, 21 nt, Human
uugcagcagaacuggcuggag

SEQ ID NO: 1329598 - RNA, 21 nt, Human
uuggcugcccuuugguggcaa

SEQ ID NO: 1329599 - RNA, 19 nt, Human
accaccugccgagacccca

SEQ ID NO: 1329600 - RNA, 21 nt, Human
caccugccgagaccccagagc

SEQ ID NO: 1329601 - RNA, 22 nt, Human
ggaccaccugccgagaccccag

SEQ ID NO: 1329602 - RNA, 21 nt, Human
ucagccuuguccgccuggagc

SEQ ID NO: 1329603 - RNA, 21 nt, Human
ugccgagaccccagagcuggc

SEQ ID NO: 1329604 - RNA, 24 nt, Human
aagaaaaaggauuuuuaaaaaaca

SEQ ID NO: 1329605 - RNA, 23 nt, Human
aaguguccagacccugggucuuu

SEQ ID NO: 1329606 - RNA, 20 nt, Human
acccugggucuuucccuccc

SEQ ID NO: 1329607 - RNA, 19 nt, Human
aggguuuuguguuggagga

SEQ ID NO: 1329608 - RNA, 25 nt, Human
agucuuggguggguguacaggccag

SEQ ID NO: 1329609 - RNA, 24 nt, Human
auggauaacgugccggggcugacc

SEQ ID NO: 1329610 - RNA, 23 nt, Human
caaauauaugugcaaaugccccc

SEQ ID NO: 1329611 - RNA, 21 nt, Human
caagauaccaucuccugcugc

SEQ ID NO: 1329612 - RNA, 20 nt, Human
ccaguggcgggguagccgcc

SEQ ID NO: 1329613 - RNA, 18 nt, Human
cccuagaacuugagaaaa

SEQ ID NO: 1329614 - RNA, 22 nt, Human
ccuauggauaacgugccggggc

SEQ ID NO: 1329615 - RNA, 21 nt, Human
cugaaggcccccagccgcugg

SEQ ID NO: 1329616 - RNA, 22 nt, Human
cugaaucguugguuggcuguug

SEQ ID NO: 1329617 - RNA, 22 nt, Human
cuguuguggccaagauaccauc

SEQ ID NO: 1329618 - RNA, 23 nt, Human
gagcuggggccaguggcauucuc

SEQ ID NO: 1329619 - RNA, 25 nt, Human
gcccccagccgcugguggcgugagg

SEQ ID NO: 1329620 - RNA, 18 nt, Human
ggccaguggcgggguagc

SEQ ID NO: 1329621 - RNA, 18 nt, Human
gggagugagcacccgggu

SEQ ID NO: 1329622 - RNA, 21 nt, Human
gggcaagagcuggggccagug

SEQ ID NO: 1329623 - RNA, 18 nt, Human
ggggugagcccaguggcc

SEQ ID NO: 1329624 - RNA, 19 nt, Human
guggcguuugggggugagc

SEQ ID NO: 1329625 - RNA, 21 nt, Human
gugguucugaaggcccccagc

SEQ ID NO: 1329626 - RNA, 24 nt, Human
guugguuggcuguuguggccaaga

SEQ ID NO: 1329627 - RNA, 24 nt, Human
uacaaauauaugugcaaaugcccc

SEQ ID NO: 1329628 - RNA, 23 nt, Human
ucugugauuggacagucuuucuu

SEQ ID NO: 1329629 - RNA, 19 nt, Human
ugaaggcccccagccgcug

SEQ ID NO: 1329630 - RNA, 21 nt, Human
ugcaggagucuugggugggug

SEQ ID NO: 1329631 - RNA, 26 nt, Human
ugcuugcgggggagugagcacccggg

SEQ ID NO: 1329632 - RNA, 19 nt, Human
uggaagggggcaggcuugg

SEQ ID NO: 1329633 - RNA, 20 nt, Human
uggaagggggcaggcuugga

SEQ ID NO: 1329634 - RNA, 24 nt, Human
uggaagggggcaggcuugggacag

SEQ ID NO: 1329635 - RNA, 20 nt, Human
uggcguuugggggugagccc

SEQ ID NO: 1329636 - RNA, 23 nt, Human
uggcguuugggggugagcccagu

SEQ ID NO: 1329637 - RNA, 24 nt, Human
uggcguuugggggugagcccagug

SEQ ID NO: 1329638 - RNA, 18 nt, Human
ugggaauggaagggggca

SEQ ID NO: 1329639 - RNA, 21 nt, Human
ugggaauggaagggggcaggc

SEQ ID NO: 1329640 - RNA, 20 nt, Human
ugggggcaagagcuggggcc

SEQ ID NO: 1329641 - RNA, 20 nt, Human
ugggggugagcccaguggcc

SEQ ID NO: 1329642 - RNA, 18 nt, Human
uugguuggcuguuguggc

SEQ ID NO: 1329643 - RNA, 22 nt, Human
uuuaaaaaacagucaaaagguu

SEQ ID NO: 1329644 - RNA, 24 nt, Human
uuugggggugagcccaguggccuu

SEQ ID NO: 1329645 - RNA, 18 nt, Human
acagcugggagggcagga

SEQ ID NO: 1329646 - RNA, 22 nt, Human
acgcagcuguuccuccgugggg

SEQ ID NO: 1329647 - RNA, 19 nt, Human
aggaaguccccgucagcuc

SEQ ID NO: 1329648 - RNA, 20 nt, Human
aggagccagggcugagaacg

SEQ ID NO: 1329649 - RNA, 20 nt, Human
aggagugcugggcaggcagg

SEQ ID NO: 1329650 - RNA, 22 nt, Human
aggcaggagccagggcugagaa

SEQ ID NO: 1329651 - RNA, 19 nt, Human
aggcaggagccggggcuga

SEQ ID NO: 1329652 - RNA, 22 nt, Human
aggcaggagccggggcugagaa

SEQ ID NO: 1329653 - RNA, 19 nt, Human
aggugcuugggcugcccgg

SEQ ID NO: 1329654 - RNA, 22 nt, Human
aucccaucugggucgacagcug

SEQ ID NO: 1329655 - RNA, 26 nt, Human
augcaacuucagggcauccucaaagg

SEQ ID NO: 1329656 - RNA, 18 nt, Human
augcucucaaacagcacg

SEQ ID NO: 1329657 - RNA, 22 nt, Human
cacugagcacucaugcaacuuc

SEQ ID NO: 1329658 - RNA, 21 nt, Human
cagcugggagggcaggacugg

SEQ ID NO: 1329659 - RNA, 22 nt, Human
caggaggagggcugagagcccc

SEQ ID NO: 1329660 - RNA, 18 nt, Human
cccagguggaguaggggc

SEQ ID NO: 1329661 - RNA, 20 nt, Human
ccccgagaucccaggugacc

SEQ ID NO: 1329662 - RNA, 21 nt, Human
cccucgggguccacgagcagc

SEQ ID NO: 1329663 - RNA, 22 nt, Human
ccuccgugggggccacaggggc

SEQ ID NO: 1329664 - RNA, 22 nt, Human
ccuuccccugcucccaggugga

SEQ ID NO: 1329665 - RNA, 22 nt, Human
cugccgcccggcggcucauccg

SEQ ID NO: 1329666 - RNA, 19 nt, Human
cugggagggcaggacuggg

SEQ ID NO: 1329667 - RNA, 21 nt, Human
cugggccacugguccuccaag

SEQ ID NO: 1329668 - RNA, 22 nt, Human
gaggcagcggugguucggccug

SEQ ID NO: 1329669 - RNA, 18 nt, Human
gagugcugggcaggcagg

SEQ ID NO: 1329670 - RNA, 19 nt, Human
ggaccagagcugggagaaa

SEQ ID NO: 1329671 - RNA, 20 nt, Human
ggacuggggggaagcugcug

SEQ ID NO: 1329672 - RNA, 23 nt, Human
ggacuggggggaagcugcugggc

SEQ ID NO: 1329673 - RNA, 18 nt, Human
ggcaggcagggggcaagc

SEQ ID NO: 1329674 - RNA, 19 nt, Human
ggccaggcaaccacguccu

SEQ ID NO: 1329675 - RNA, 19 nt, Human
gugcugggcaggcaggggg

SEQ ID NO: 1329676 - RNA, 27 nt, Human
uacuccugccgggaccagagcugggag

SEQ ID NO: 1329677 - RNA, 18 nt, Human
uaggggccucacgacugc

SEQ ID NO: 1329678 - RNA, 22 nt, Human
uccaggaggagggcugagagcc

SEQ ID NO: 1329679 - RNA, 22 nt, Human
ucgacagcugggagggcaggac

SEQ ID NO: 1329680 - RNA, 20 nt, Human
ucgcacaaggaaguccccgu

SEQ ID NO: 1329681 - RNA, 21 nt, Human
ugacaggcaggagccggggcu

SEQ ID NO: 1329682 - RNA, 18 nt, Human
ugacgcagcuguuccucc

SEQ ID NO: 1329683 - RNA, 22 nt, Human
ugagaacaggcaggagccaggg

SEQ ID NO: 1329684 - RNA, 18 nt, Human
ugccgggaccagagcugg

SEQ ID NO: 1329685 - RNA, 21 nt, Human
ugccgggaccagagcugggag

SEQ ID NO: 1329686 - RNA, 22 nt, Human
ugcucccagguggaguaggggc

SEQ ID NO: 1329687 - RNA, 23 nt, Human
uggcugaugcucucaaacagcac

SEQ ID NO: 1329688 - RNA, 21 nt, Human
ugggggccacaggggcccggc

SEQ ID NO: 1329689 - RNA, 20 nt, Human
ugguucggccugaccaggau

SEQ ID NO: 1329690 - RNA, 20 nt, Human
aaccagcccagggguucugc

SEQ ID NO: 1329691 - RNA, 24 nt, Human
agacacaagcuggucaccugagca

SEQ ID NO: 1329692 - RNA, 19 nt, Human
aggagaaaggaggggaggc

SEQ ID NO: 1329693 - RNA, 21 nt, Human
aggaggagaaaggaggggagg

SEQ ID NO: 1329694 - RNA, 18 nt, Human
agggguucugcgauuucc

SEQ ID NO: 1329695 - RNA, 23 nt, Human
agguagccaaggggaggaggagg

SEQ ID NO: 1329696 - RNA, 23 nt, Human
auaauaaaccagcccagggguuc

SEQ ID NO: 1329697 - RNA, 20 nt, Human
auagaauuccagaggccgac

SEQ ID NO: 1329698 - RNA, 27 nt, Human
caacagccaggccugacuccaaaugaa

SEQ ID NO: 1329699 - RNA, 28 nt, Human
caagcccgaauagaauuccagaggccga

SEQ ID NO: 1329700 - RNA, 19 nt, Human
cagccaagcuucugaagcc

SEQ ID NO: 1329701 - RNA, 23 nt, Human
ccagggguucugcgauuucuccu

SEQ ID NO: 1329702 - RNA, 25 nt, Human
ccucccagagacacaagcuggucac

SEQ ID NO: 1329703 - RNA, 25 nt, Human
ccugagcaacagccaggccugacuc

SEQ ID NO: 1329704 - RNA, 21 nt, Human
gaacagccaagcuucugaagc

SEQ ID NO: 1329705 - RNA, 18 nt, Human
gaggagaaaggaggggag

SEQ ID NO: 1329706 - RNA, 22 nt, Human
ggaggaggaggagaaaggaggg

SEQ ID NO: 1329707 - RNA, 19 nt, Human
uaauaaaccagcccagggg

SEQ ID NO: 1329708 - RNA, 23 nt, Human
uaauaaaccagcccagggguucu

SEQ ID NO: 1329709 - RNA, 21 nt, Human
uagaauuccagaggccgacac

SEQ ID NO: 1329710 - RNA, 22 nt, Human
uccaaagagagccgucgcaggu

SEQ ID NO: 1329711 - RNA, 25 nt, Human
uccagagggagguagccaaggggag

SEQ ID NO: 1329712 - RNA, 19 nt, Human
ucccauguaaaagaugcua

SEQ ID NO: 1329713 - RNA, 21 nt, Human
ucccauguaaaagaugcuagc

SEQ ID NO: 1329714 - RNA, 20 nt, Human
ugaaugccaaccccaagcug

SEQ ID NO: 1329715 - RNA, 25 nt, Human
ugacuuccgggaugugcgguuggag

SEQ ID NO: 1329716 - RNA, 21 nt, Human
ugccaaccccaagcugggguu

SEQ ID NO: 1329717 - RNA, 21 nt, Human
uggagaacacagaggccaagc

SEQ ID NO: 1329718 - RNA, 18 nt, Human
uggucaccugagcaacag

SEQ ID NO: 1329719 - RNA, 24 nt, Human
uucacaaaaauucauuucucugau

SEQ ID NO: 1329720 - RNA, 22 nt, Human
uucagaacagccaagcuucuga

SEQ ID NO: 1329721 - RNA, 21 nt, Human
uucuggaucaucgcgccgggu

SEQ ID NO: 1329722 - RNA, 22 nt, Human
aacaugcaaucuauacauaaaa

SEQ ID NO: 1329723 - RNA, 20 nt, Human
acccccucgugcuccccaac

SEQ ID NO: 1329724 - RNA, 20 nt, Human
cauuucaacaugcaaucuau

SEQ ID NO: 1329725 - RNA, 19 nt, Human
ccccuccccuuccugguuc

SEQ ID NO: 1329726 - RNA, 18 nt, Human
ccccucgugcuccccaac

SEQ ID NO: 1329727 - RNA, 24 nt, Human
cccuuccugguucagguccugcuc

SEQ ID NO: 1329728 - RNA, 21 nt, Human
ccggccuccugccccuggguc

SEQ ID NO: 1329729 - RNA, 22 nt, Human
cgccccuccccuuccugguuca

SEQ ID NO: 1329730 - RNA, 23 nt, Human
cgccucgagccacccccucgugc

SEQ ID NO: 1329731 - RNA, 20 nt, Human
cucccgccucgagccacccc

SEQ ID NO: 1329732 - RNA, 18 nt, Human
cuccugggacucagcgcu

SEQ ID NO: 1329733 - RNA, 18 nt, Human
cugccccugggucuuccu

SEQ ID NO: 1329734 - RNA, 19 nt, Human
ggacucagcgcugcgccuc

SEQ ID NO: 1329735 - RNA, 22 nt, Human
ucagguccugcuccugggacuc

SEQ ID NO: 1329736 - RNA, 22 nt, Human
ucccgccucgagccacccccuc

SEQ ID NO: 1329737 - RNA, 20 nt, Human
ugaccagagaaaccacugca

SEQ ID NO: 1329738 - RNA, 21 nt, Human
ugaccagagaaaccacugcau

SEQ ID NO: 1329739 - RNA, 21 nt, Human
ugcuauuucuuccugccccuc

SEQ ID NO: 1329740 - RNA, 26 nt, Human
uggaccgugagugaccagagaaacca

SEQ ID NO: 1329741 - RNA, 24 nt, Human
ugugcggggaggaggaggcaggac

SEQ ID NO: 1329742 - RNA, 19 nt, Human
uuccugcuauuucuuccug

SEQ ID NO: 1329743 - RNA, 18 nt, Human
aggcugacgagagcuggg

SEQ ID NO: 1329744 - RNA, 18 nt, Human
ggagauggccagcaggag

SEQ ID NO: 1329745 - RNA, 20 nt, Human
ggaggcugacgagagcuggg

SEQ ID NO: 1329746 - RNA, 22 nt, Human
aaaaaauuuaaaaaaucagcca

SEQ ID NO: 1329747 - RNA, 21 nt, Human
aaaacgccuuucugagcauuu

SEQ ID NO: 1329748 - RNA, 22 nt, Human
aaaagcauguuuaaguguacac

SEQ ID NO: 1329749 - RNA, 24 nt, Human
aaaagcuaaaacuaugaaggcagu

SEQ ID NO: 1329750 - RNA, 21 nt, Human
aaacaaaacgccuuucugagc

SEQ ID NO: 1329751 - RNA, 21 nt, Human
aaacaagacacaaaaaucagg

SEQ ID NO: 1329752 - RNA, 26 nt, Human
aaacaagacacaaaaaucaggcugaa

SEQ ID NO: 1329753 - RNA, 21 nt, Human
aaauaacugagacaccaaacu

SEQ ID NO: 1329754 - RNA, 18 nt, Human
aaauuauuguacccaaga

SEQ ID NO: 1329755 - RNA, 21 nt, Human
aacauagcaagacuccauucu

SEQ ID NO: 1329756 - RNA, 23 nt, Human
aaccaguccaaaaucugauccuc

SEQ ID NO: 1329757 - RNA, 18 nt, Human
aacccacaaacaagacac

SEQ ID NO: 1329758 - RNA, 23 nt, Human
aacccacaaacaagacacaaaaa

SEQ ID NO: 1329759 - RNA, 18 nt, Human
aaggacacaccccagagc

SEQ ID NO: 1329760 - RNA, 20 nt, Human
aaggacacaccccagagccc

SEQ ID NO: 1329761 - RNA, 25 nt, Human
aaugcaaagacacagguggaaaaga

SEQ ID NO: 1329762 - RNA, 23 nt, Human
aauuaccaaaaaaaaaaaaaaaa

SEQ ID NO: 1329763 - RNA, 23 nt, Human
aauuauuguacccaagaggcaaa

SEQ ID NO: 1329764 - RNA, 24 nt, Human
acaagacacaaaaaucaggcugaa

SEQ ID NO: 1329765 - RNA, 20 nt, Human
acaauggagaaaacauccac

SEQ ID NO: 1329766 - RNA, 20 nt, Human
acuucgaaaauguuuuuaga

SEQ ID NO: 1329767 - RNA, 20 nt, Human
acuuugggugauaauggauu

SEQ ID NO: 1329768 - RNA, 20 nt, Human
agaaaagccagugugaaagg

SEQ ID NO: 1329769 - RNA, 21 nt, Human
agagaugaaggugaagagaaa

SEQ ID NO: 1329770 - RNA, 19 nt, Human
agaguaaacucuaauguaa

SEQ ID NO: 1329771 - RNA, 20 nt, Human
agcaccuguagucccagcug

SEQ ID NO: 1329772 - RNA, 22 nt, Human
agccugggcaacauagcaagac

SEQ ID NO: 1329773 - RNA, 24 nt, Human
agccugggcaacauagcaagacuc

SEQ ID NO: 1329774 - RNA, 24 nt, Human
agcuauguaugacaaacgacaaaa

SEQ ID NO: 1329775 - RNA, 24 nt, Human
agcuggucuuuuagcugguauagg

SEQ ID NO: 1329776 - RNA, 24 nt, Human
agcuguucaggaggcugagguggg

SEQ ID NO: 1329777 - RNA, 21 nt, Human
aggaggcugaggugggagggu

SEQ ID NO: 1329778 - RNA, 23 nt, Human
aggaguucaagaccagccugggc

SEQ ID NO: 1329779 - RNA, 19 nt, Human
aggcugaggugggaggguc

SEQ ID NO: 1329780 - RNA, 19 nt, Human
agggagguggagcacaggg

SEQ ID NO: 1329781 - RNA, 20 nt, Human
aggugggagggucacuuaag

SEQ ID NO: 1329782 - RNA, 18 nt, Human
agugaugaagaaaagggc

SEQ ID NO: 1329783 - RNA, 24 nt, Human
auaaaggacacaccccagagccca

SEQ ID NO: 1329784 - RNA, 18 nt, Human
auaaaguguaguacaucc

SEQ ID NO: 1329785 - RNA, 24 nt, Human
auagaacaagaaccugucucaaaa

SEQ ID NO: 1329786 - RNA, 26 nt, Human
aucagccacacaugguggcaagcacc

SEQ ID NO: 1329787 - RNA, 24 nt, Human
aucaugccauugcacuccagccug

SEQ ID NO: 1329788 - RNA, 19 nt, Human
augcuuguaaucccagcac

SEQ ID NO: 1329789 - RNA, 23 nt, Human
auugcacuccagccuggggauag

SEQ ID NO: 1329790 - RNA, 23 nt, Human
auugccauaacuuaaaagcaacc

SEQ ID NO: 1329791 - RNA, 26 nt, Human
caaacaagacacaaaaaucaggcugu

SEQ ID NO: 1329792 - RNA, 22 nt, Human
caaagacacagguggaaaagau

SEQ ID NO: 1329793 - RNA, 22 nt, Human
caagacacaaaaaucaggcuga

SEQ ID NO: 1329794 - RNA, 24 nt, Human
caagacacaaaaaucaggcugaac

SEQ ID NO: 1329795 - RNA, 19 nt, Human
caagaggcaaaaaacauca

SEQ ID NO: 1329796 - RNA, 24 nt, Human
caaguucgagccagcucuacagua

SEQ ID NO: 1329797 - RNA, 19 nt, Human
caauauggaguugacugau

SEQ ID NO: 1329798 - RNA, 22 nt, Human
cacaaacaagacacaaaaauca

SEQ ID NO: 1329799 - RNA, 18 nt, Human
cacaugguggcaagcacc

SEQ ID NO: 1329800 - RNA, 24 nt, Human
caccuguagucccagcuguucagg

SEQ ID NO: 1329801 - RNA, 22 nt, Human
cagaaaauuauuguacccaaga

SEQ ID NO: 1329802 - RNA, 25 nt, Human
cagaggucaaggcugcaagugagcc

SEQ ID NO: 1329803 - RNA, 19 nt, Human
cagcacuuugggaggccag

SEQ ID NO: 1329804 - RNA, 21 nt, Human
cagcacuuugggaggccagug

SEQ ID NO: 1329805 - RNA, 24 nt, Human
cagcucauaaaggacacaccccag

SEQ ID NO: 1329806 - RNA, 24 nt, Human
cagcuguucaggaggcugaggugg

SEQ ID NO: 1329807 - RNA, 24 nt, Human
cauagcaagacuccauucuacaaa

SEQ ID NO: 1329808 - RNA, 22 nt, Human
cauccauucuggcugggcaugg

SEQ ID NO: 1329809 - RNA, 24 nt, Human
caugaucaugccauugcacuccag

SEQ ID NO: 1329810 - RNA, 18 nt, Human
cauugcacuccagccugg

SEQ ID NO: 1329811 - RNA, 19 nt, Human
cauugcacuccagccuggg

SEQ ID NO: 1329812 - RNA, 19 nt, Human
cauugcacuccagccuggg

SEQ ID NO: 1329813 - RNA, 22 nt, Human
cauugcacuccagccuggggau

SEQ ID NO: 1329814 - RNA, 23 nt, Human
cauugcacuccagccuggggaua

SEQ ID NO: 1329815 - RNA, 24 nt, Human
cauugcacuccagccuggggauag

SEQ ID NO: 1329816 - RNA, 24 nt, Human
cauugcacuccagccuggggauag

SEQ ID NO: 1329817 - RNA, 23 nt, Human
ccagaggucaaggcugcaaguga

SEQ ID NO: 1329818 - RNA, 21 nt, Human
ccagauauuaucuucaguacc

SEQ ID NO: 1329819 - RNA, 19 nt, Human
ccaugaucaugccauugca

SEQ ID NO: 1329820 - RNA, 19 nt, Human
ccauugcacuccagccugg

SEQ ID NO: 1329821 - RNA, 20 nt, Human
ccauugcacuccagccuggg

SEQ ID NO: 1329822 - RNA, 23 nt, Human
ccauugcacuccagccuggggau

SEQ ID NO: 1329823 - RNA, 25 nt, Human
ccauugcacuccagccuggggauag

SEQ ID NO: 1329824 - RNA, 20 nt, Human
cccacaaaauuugucucacu

SEQ ID NO: 1329825 - RNA, 21 nt, Human
ccccagagcccaaaugucacu

SEQ ID NO: 1329826 - RNA, 24 nt, Human
ccucccacaaaauuugucucacua

SEQ ID NO: 1329827 - RNA, 24 nt, Human
ccugggcaacauagcaagacucca

SEQ ID NO: 1329828 - RNA, 21 nt, Human
cuaaaacuaugaaggcaguaa

SEQ ID NO: 1329829 - RNA, 23 nt, Human
cuaaacccacaaacaagacacaa

SEQ ID NO: 1329830 - RNA, 20 nt, Human
cuagaaaagcuaaaacuaug

SEQ ID NO: 1329831 - RNA, 24 nt, Human
cucaugcuuguaaucccagcacuu

SEQ ID NO: 1329832 - RNA, 23 nt, Human
cugauccucuugaaacaaaacgc

SEQ ID NO: 1329833 - RNA, 23 nt, Human
cugcuugaacccaggaguucaag

SEQ ID NO: 1329834 - RNA, 18 nt, Human
cuggcugggcaugguggc

SEQ ID NO: 1329835 - RNA, 18 nt, Human
cuucugcaauaagcugag

SEQ ID NO: 1329836 - RNA, 23 nt, Human
cuugaacccaggaguucaagacc

SEQ ID NO: 1329837 - RNA, 21 nt, Human
gaaaagcuaaaacuaugaagg

SEQ ID NO: 1329838 - RNA, 22 nt, Human
gaaccugucucaaaaaaaaaaa

SEQ ID NO: 1329839 - RNA, 18 nt, Human
gaacucucuguacuuucc

SEQ ID NO: 1329840 - RNA, 21 nt, Human
gaagaaaagggcgaaaaaugc

SEQ ID NO: 1329841 - RNA, 24 nt, Human
gcaaaaaacaucauaugugaacaa

SEQ ID NO: 1329842 - RNA, 18 nt, Human
gcacuuugggaggccagu

SEQ ID NO: 1329843 - RNA, 19 nt, Human
gcugcaagugagccaugau

SEQ ID NO: 1329844 - RNA, 21 nt, Human
gcugggcaugguggcucaugc

SEQ ID NO: 1329845 - RNA, 22 nt, Human
gcuugaacccaggaguucaaga

SEQ ID NO: 1329846 - RNA, 18 nt, Human
ggagguuggagggaggug

SEQ ID NO: 1329847 - RNA, 23 nt, Human
ggcaugguggcucaugcuuguaa

SEQ ID NO: 1329848 - RNA, 24 nt, Human
gguacauaggaacucucuguacuu

SEQ ID NO: 1329849 - RNA, 24 nt, Human
gguggcucaugcuuguaaucccag

SEQ ID NO: 1329850 - RNA, 19 nt, Human
gguuggagggagguggagc

SEQ ID NO: 1329851 - RNA, 21 nt, Human
gguugugcaugugugaggaag

SEQ ID NO: 1329852 - RNA, 22 nt, Human
guaaagcaaccagugguugcca

SEQ ID NO: 1329853 - RNA, 22 nt, Human
uaaacccacaaacaagacacaa

SEQ ID NO: 1329854 - RNA, 23 nt, Human
uaaaggacacaccccagagccca

SEQ ID NO: 1329855 - RNA, 21 nt, Human
uaacuuaaaagcaaccaagau

SEQ ID NO: 1329856 - RNA, 21 nt, Human
uaagaagaaauaagguaugaa

SEQ ID NO: 1329857 - RNA, 22 nt, Human
uaagguuuguuuucacagauuu

SEQ ID NO: 1329858 - RNA, 23 nt, Human
uaauuauguuggcagaauguuau

SEQ ID NO: 1329859 - RNA, 21 nt, Human
uaauugccauaacuuaaaagc

SEQ ID NO: 1329860 - RNA, 18 nt, Human
uacaauaccaagaguaaa

SEQ ID NO: 1329861 - RNA, 21 nt, Human
uacacagcucauaaaggacac

SEQ ID NO: 1329862 - RNA, 25 nt, Human
uacacagcucauaaaggacacaccc

SEQ ID NO: 1329863 - RNA, 19 nt, Human
uacauaaauacaaugggau

SEQ ID NO: 1329864 - RNA, 26 nt, Human
uagaacaagaaccugucucaaaaaaa

SEQ ID NO: 1329865 - RNA, 24 nt, Human
uagaagcuuuauucauaauugcca

SEQ ID NO: 1329866 - RNA, 20 nt, Human
uagaauaauggauaaagugu

SEQ ID NO: 1329867 - RNA, 23 nt, Human
uauaucaggcuucuguauauaau

SEQ ID NO: 1329868 - RNA, 24 nt, Human
uaucuguacaaaccaguccaaaau

SEQ ID NO: 1329869 - RNA, 22 nt, Human
ucaauacagagguugugcaugu

SEQ ID NO: 1329870 - RNA, 21 nt, Human
ucagagaugaaggugaagaga

SEQ ID NO: 1329871 - RNA, 23 nt, Human
ucaugccauugcacuccagccug

SEQ ID NO: 1329872 - RNA, 22 nt, Human
ucaugcuuguaaucccagcacu

SEQ ID NO: 1329873 - RNA, 25 nt, Human
uccaaaaucugauccucuugaaaca

SEQ ID NO: 1329874 - RNA, 20 nt, Human
ucuaaacccacaaacaagac

SEQ ID NO: 1329875 - RNA, 22 nt, Human
ucucaaaaaaaaaaauuaccaa

SEQ ID NO: 1329876 - RNA, 23 nt, Human
ucuggagaauaaaagccucccac

SEQ ID NO: 1329877 - RNA, 24 nt, Human
ucuggcugggcaugguggcucaug

SEQ ID NO: 1329878 - RNA, 18 nt, Human
ugaaacaaaacgccuuuc

SEQ ID NO: 1329879 - RNA, 21 nt, Human
ugaaacaaaacgccuuucuga

SEQ ID NO: 1329880 - RNA, 23 nt, Human
ugaaacaaaacgccuuucugagc

SEQ ID NO: 1329881 - RNA, 23 nt, Human
ugaacccaggaguucaagaccag

SEQ ID NO: 1329882 - RNA, 21 nt, Human
ugaagcuggucuuuuagcugg

SEQ ID NO: 1329883 - RNA, 21 nt, Human
ugaaggcaguaaagcaaccag

SEQ ID NO: 1329884 - RNA, 19 nt, Human
ugaagugaugaagaaaagg

SEQ ID NO: 1329885 - RNA, 20 nt, Human
ugacaaacgacaaaauuacu

SEQ ID NO: 1329886 - RNA, 21 nt, Human
ugagaaaagccagugugaaag

SEQ ID NO: 1329887 - RNA, 21 nt, Human
ugaggagagagaaacuuuuca

SEQ ID NO: 1329888 - RNA, 28 nt, Human
ugaggagagagaaacuuuucaaucguuu

SEQ ID NO: 1329889 - RNA, 18 nt, Human
ugaggugggagggucacu

SEQ ID NO: 1329890 - RNA, 18 nt, Human
ugccaagaguugggaggg

SEQ ID NO: 1329891 - RNA, 20 nt, Human
ugccaagaguugggagggag

SEQ ID NO: 1329892 - RNA, 23 nt, Human
ugcuuguaaucccagcacuuugg

SEQ ID NO: 1329893 - RNA, 23 nt, Human
ugcuuguaaucccagcacuuugg

SEQ ID NO: 1329894 - RNA, 24 nt, Human
ugcuuguaaucccagcacuuuggg

SEQ ID NO: 1329895 - RNA, 24 nt, Human
uggaagaaaagaaauaauaugaug

SEQ ID NO: 1329896 - RNA, 25 nt, Human
uggaagaaaagaaauaauaugauga

SEQ ID NO: 1329897 - RNA, 22 nt, Human
uggcaagcaccuguagucccag

SEQ ID NO: 1329898 - RNA, 22 nt, Human
uggcucaugcuuguaaucccag

SEQ ID NO: 1329899 - RNA, 24 nt, Human
uggcucaugcuuguaaucccagca

SEQ ID NO: 1329900 - RNA, 23 nt, Human
uggcugggcaugguggcucaugc

SEQ ID NO: 1329901 - RNA, 24 nt, Human
uggcugggcaugguggcucaugcu

SEQ ID NO: 1329902 - RNA, 22 nt, Human
uggggauagaacaagaaccugu

SEQ ID NO: 1329903 - RNA, 23 nt, Human
uggggauagaacaagaaccuguc

SEQ ID NO: 1329904 - RNA, 21 nt, Human
uggucuuuuagcugguauagg

SEQ ID NO: 1329905 - RNA, 23 nt, Human
ugguggcaagcaccuguaguccc

SEQ ID NO: 1329906 - RNA, 24 nt, Human
ugguggcaagcaccuguaguccca

SEQ ID NO: 1329907 - RNA, 24 nt, Human
ugguggcucaugcuuguaauccca

SEQ ID NO: 1329908 - RNA, 18 nt, Human
uguaaucccagcacuuug

SEQ ID NO: 1329909 - RNA, 27 nt, Human
uguacacagcucauaaaggacacaccc

SEQ ID NO: 1329910 - RNA, 21 nt, Human
uguccugaagcuggucuuuua

SEQ ID NO: 1329911 - RNA, 19 nt, Human
ugugaacaauggagaaaac

SEQ ID NO: 1329912 - RNA, 21 nt, Human
uguucugagauuuaaugucuc

SEQ ID NO: 1329913 - RNA, 22 nt, Human
uuagcugguauaggcugugauc

SEQ ID NO: 1329914 - RNA, 18 nt, Human
uucaggaggcugaggugg

SEQ ID NO: 1329915 - RNA, 23 nt, Human
uugcaccucagaaaauuauugua

SEQ ID NO: 1329916 - RNA, 22 nt, Human
uuggcagaauguuaucacaugu

SEQ ID NO: 1329917 - RNA, 20 nt, Human
uuugcugugaaccccaaauc

SEQ ID NO: 1329918 - RNA, 23 nt, Human
aaaaaaaaaccaaaaaaaaaacc

SEQ ID NO: 1329919 - RNA, 23 nt, Human
aaaaaaaaccaaaaaaaaaaccg

SEQ ID NO: 1329920 - RNA, 20 nt, Human
aaaaaaaccaaaaaaaaaac

SEQ ID NO: 1329921 - RNA, 21 nt, Human
aaaaagcaaaccucugcccuu

SEQ ID NO: 1329922 - RNA, 18 nt, Human
aaaccaaaaaaaaaaccg

SEQ ID NO: 1329923 - RNA, 19 nt, Human
aaagaaguggggaggccaa

SEQ ID NO: 1329924 - RNA, 19 nt, Human
aaccaaaaaaaaaaccgcu

SEQ ID NO: 1329925 - RNA, 23 nt, Human
aagaggaaaguaaaaaaaaaaac

SEQ ID NO: 1329926 - RNA, 26 nt, Human
aagcaagagaaauucagaaguuucuu

SEQ ID NO: 1329927 - RNA, 25 nt, Human
aaggaaaggcugaaaaggugggggg

SEQ ID NO: 1329928 - RNA, 23 nt, Human
aaguaguugggaccagaguaugc

SEQ ID NO: 1329929 - RNA, 23 nt, Human
aauucagaaguuucuuuugcuga

SEQ ID NO: 1329930 - RNA, 20 nt, Human
acccccuuuuuuuccuucua

SEQ ID NO: 1329931 - RNA, 21 nt, Human
acuacagucaugccuuuugcc

SEQ ID NO: 1329932 - RNA, 26 nt, Human
agaaaggaaaggcugaaaaggugggg

SEQ ID NO: 1329933 - RNA, 21 nt, Human
agaaauaauguagggguuggc

SEQ ID NO: 1329934 - RNA, 18 nt, Human
agaggaaagaagugggga

SEQ ID NO: 1329935 - RNA, 22 nt, Human
agaggaaagaaguggggaggcc

SEQ ID NO: 1329936 - RNA, 21 nt, Human
agauguguccagcaggccauu

SEQ ID NO: 1329937 - RNA, 23 nt, Human
agccgaacauucagagaacaagg

SEQ ID NO: 1329938 - RNA, 21 nt, Human
agccugaggcugaggacggcu

SEQ ID NO: 1329939 - RNA, 23 nt, Human
agcuuccuuucuuccuuuccuuc

SEQ ID NO: 1329940 - RNA, 24 nt, Human
aggaaagaaguggggaggccaaaa

SEQ ID NO: 1329941 - RNA, 19 nt, Human
aggaaaggcugaaaaggug

SEQ ID NO: 1329942 - RNA, 18 nt, Human
aggagagagauagcaggg

SEQ ID NO: 1329943 - RNA, 20 nt, Human
aggaguucagacacaacaag

SEQ ID NO: 1329944 - RNA, 19 nt, Human
aggaugcauucgcuuguca

SEQ ID NO: 1329945 - RNA, 24 nt, Human
aguaaaaaaaaaaaccaaaaaaaa

SEQ ID NO: 1329946 - RNA, 19 nt, Human
aguagaugaccaaauuugc

SEQ ID NO: 1329947 - RNA, 21 nt, Human
agugauggauggagaaacugg

SEQ ID NO: 1329948 - RNA, 23 nt, Human
agugauggauggagaaacuggga

SEQ ID NO: 1329949 - RNA, 25 nt, Human
auacugccggguguuccucagggcc

SEQ ID NO: 1329950 - RNA, 18 nt, Human
aucagacuuugcuuuugc

SEQ ID NO: 1329951 - RNA, 21 nt, Human
aucuuuguccucuccuaccag

SEQ ID NO: 1329952 - RNA, 20 nt, Human
auucgcuugucauuuccccu

SEQ ID NO: 1329953 - RNA, 24 nt, Human
auugcacuagauuguccccaaggu

SEQ ID NO: 1329954 - RNA, 21 nt, Human
caaaaaaaaaaccgcuccagu

SEQ ID NO: 1329955 - RNA, 21 nt, Human
caacagcagugauggauggag

SEQ ID NO: 1329956 - RNA, 21 nt, Human
caaggaguagaugaaaacgaa

SEQ ID NO: 1329957 - RNA, 23 nt, Human
caaggugugaacgccaguguggg

SEQ ID NO: 1329958 - RNA, 21 nt, Human
caccuaucgaaggccaugugc

SEQ ID NO: 1329959 - RNA, 24 nt, Human
cagcuuccuuucuuccuuuccuuc

SEQ ID NO: 1329960 - RNA, 23 nt, Human
caggaaaaauaaacacaguucuc

SEQ ID NO: 1329961 - RNA, 19 nt, Human
cauccaucuuuguccucuc

SEQ ID NO: 1329962 - RNA, 19 nt, Human
ccccaaaaagcaaaccucu

SEQ ID NO: 1329963 - RNA, 22 nt, Human
ccccaaaaagcaaaccucugcc

SEQ ID NO: 1329964 - RNA, 20 nt, Human
ccccccaaaaagcaaaccuc

SEQ ID NO: 1329965 - RNA, 22 nt, Human
ccccccaaaaagcaaaccucug

SEQ ID NO: 1329966 - RNA, 20 nt, Human
cccccuccacccccuuuuuu

SEQ ID NO: 1329967 - RNA, 26 nt, Human
cccccuccacccccuuuuuuuccuuc

SEQ ID NO: 1329968 - RNA, 20 nt, Human
cccucccucccuuuccucuc

SEQ ID NO: 1329969 - RNA, 23 nt, Human
ccggguguuccucagggccugcu

SEQ ID NO: 1329970 - RNA, 22 nt, Human
ccucagggccugcuuuuacccc

SEQ ID NO: 1329971 - RNA, 23 nt, Human
ccucccucccuuuccucucguua

SEQ ID NO: 1329972 - RNA, 23 nt, Human
ccucgggaagcuuccccuucucu

SEQ ID NO: 1329973 - RNA, 21 nt, Human
ccugaccccugaguuagugga

SEQ ID NO: 1329974 - RNA, 22 nt, Human
ccugaccccugaguuaguggac

SEQ ID NO: 1329975 - RNA, 19 nt, Human
ccuuccucaggaaccucgg

SEQ ID NO: 1329976 - RNA, 18 nt, Human
cggcuggccccucagaua

SEQ ID NO: 1329977 - RNA, 21 nt, Human
cucaauaaccuuucaugucuu

SEQ ID NO: 1329978 - RNA, 19 nt, Human
cucacggcuggccccucag

SEQ ID NO: 1329979 - RNA, 22 nt, Human
cucacggcuggccccucagaua

SEQ ID NO: 1329980 - RNA, 23 nt, Human
cucuuuuuucucuuuucuccugu

SEQ ID NO: 1329981 - RNA, 23 nt, Human
cugagguuggugagauugcagga

SEQ ID NO: 1329982 - RNA, 21 nt, Human
cuggacaccucuaauguuuuc

SEQ ID NO: 1329983 - RNA, 22 nt, Human
cuggacaccucuaauguuuucc

SEQ ID NO: 1329984 - RNA, 22 nt, Human
cuggcuuccuuccucaggaacc

SEQ ID NO: 1329985 - RNA, 18 nt, Human
cuuggaguguccaucuua

SEQ ID NO: 1329986 - RNA, 18 nt, Human
gaacucagugacagagac

SEQ ID NO: 1329987 - RNA, 20 nt, Human
gacgccguguccugcagugu

SEQ ID NO: 1329988 - RNA, 23 nt, Human
gagaacaaggaguagaugaaaac

SEQ ID NO: 1329989 - RNA, 18 nt, Human
gagcaguuucuaccaccu

SEQ ID NO: 1329990 - RNA, 24 nt, Human
gaggaaaguaaaaaaaaaaaccaa

SEQ ID NO: 1329991 - RNA, 26 nt, Human
gaggauaacggagaggcuucuuuggc

SEQ ID NO: 1329992 - RNA, 20 nt, Human
gaguagaugaccaaauuugc

SEQ ID NO: 1329993 - RNA, 20 nt, Human
gauuuuggggaaagcaagag

SEQ ID NO: 1329994 - RNA, 19 nt, Human
gcugagaggaaagaagugg

SEQ ID NO: 1329995 - RNA, 19 nt, Human
gcuuuugcuguacuggaca

SEQ ID NO: 1329996 - RNA, 24 nt, Human
ggaaagcaagagaaauucagaagu

SEQ ID NO: 1329997 - RNA, 19 nt, Human
ggcugaggacggcucugag

SEQ ID NO: 1329998 - RNA, 20 nt, Human
gggaaagcaagagaaauuca

SEQ ID NO: 1329999 - RNA, 22 nt, Human
gggcugagaggaaagaaguggg

SEQ ID NO: 1330000 - RNA, 20 nt, Human
ggggaggccaaaaggagaga

SEQ ID NO: 1330001 - RNA, 23 nt, Human
gggggucauuuagagaaaggaaa

SEQ ID NO: 1330002 - RNA, 24 nt, Human
gguuugaaauguuuacuauuuggc

SEQ ID NO: 1330003 - RNA, 23 nt, Human
guagaugaccaaauuugcagauu

SEQ ID NO: 1330004 - RNA, 19 nt, Human
guauuucacuuaacuggcu

SEQ ID NO: 1330005 - RNA, 20 nt, Human
gucauuuagagaaaggaaag

SEQ ID NO: 1330006 - RNA, 20 nt, Human
guccugguagccaacacugu

SEQ ID NO: 1330007 - RNA, 25 nt, Human
gucuauacugaguuguuaacccccc

SEQ ID NO: 1330008 - RNA, 22 nt, Human
gugacagagacuguguggccca

SEQ ID NO: 1330009 - RNA, 19 nt, Human
guggcccaggagguuugaa

SEQ ID NO: 1330010 - RNA, 25 nt, Human
guguggcccaggagguuugaaaugu

SEQ ID NO: 1330011 - RNA, 20 nt, Human
uaaagguuucuuagcuggca

SEQ ID NO: 1330012 - RNA, 18 nt, Human
uaaccccccaaaaagcaa

SEQ ID NO: 1330013 - RNA, 18 nt, Human
uaccccaccagucuggcu

SEQ ID NO: 1330014 - RNA, 19 nt, Human
uagcagggcagugaaaaga

SEQ ID NO: 1330015 - RNA, 20 nt, Human
uagcuuggaguguccaucuu

SEQ ID NO: 1330016 - RNA, 20 nt, Human
uagcuuggaguguccaucuu

SEQ ID NO: 1330017 - RNA, 20 nt, Human
uauacugaguuguuaacccc

SEQ ID NO: 1330018 - RNA, 19 nt, Human
uccugcagugugccacaca

SEQ ID NO: 1330019 - RNA, 18 nt, Human
uccuuuccuucccucccu

SEQ ID NO: 1330020 - RNA, 22 nt, Human
ucuccugucuucuuucucuuuc

SEQ ID NO: 1330021 - RNA, 23 nt, Human
ucuccugucuucuuucucuuuca

SEQ ID NO: 1330022 - RNA, 24 nt, Human
ucuuagggugaucugggggucauu

SEQ ID NO: 1330023 - RNA, 22 nt, Human
ucuucuuucucuuucagcuuuu

SEQ ID NO: 1330024 - RNA, 23 nt, Human
ucuuuggcccuugaccccaguuu

SEQ ID NO: 1330025 - RNA, 27 nt, Human
ucuuuggcccuugaccccaguuucacu

SEQ ID NO: 1330026 - RNA, 22 nt, Human
ugaaaagaugcuuguuggcuua

SEQ ID NO: 1330027 - RNA, 19 nt, Human
ugaaaagguggggggggga

SEQ ID NO: 1330028 - RNA, 25 nt, Human
ugaagaggaaaguaaaaaaaaaaac

SEQ ID NO: 1330029 - RNA, 19 nt, Human
ugagaaugcuagcuuuucu

SEQ ID NO: 1330030 - RNA, 19 nt, Human
ugagcuaggugucuaagau

SEQ ID NO: 1330031 - RNA, 21 nt, Human
ugaggaauaaacaccaagagc

SEQ ID NO: 1330032 - RNA, 20 nt, Human
ugaucugugucccccuccac

SEQ ID NO: 1330033 - RNA, 20 nt, Human
ugauggauggagaaacuggg

SEQ ID NO: 1330034 - RNA, 25 nt, Human
ugcacuagauuguccccaagguuuc

SEQ ID NO: 1330035 - RNA, 23 nt, Human
ugcuguuuggucuauacugaguu

SEQ ID NO: 1330036 - RNA, 21 nt, Human
uggaaagagggcugagaggaa

SEQ ID NO: 1330037 - RNA, 19 nt, Human
uggaaaguaguugggacca

SEQ ID NO: 1330038 - RNA, 18 nt, Human
uggcagagaaugccuggc

SEQ ID NO: 1330039 - RNA, 20 nt, Human
uggcauggaaagagggcuga

SEQ ID NO: 1330040 - RNA, 22 nt, Human
uggcgagcaggagggcggcgcu

SEQ ID NO: 1330041 - RNA, 19 nt, Human
uggcucaaggaaaacauca

SEQ ID NO: 1330042 - RNA, 18 nt, Human
ugggaggaggaggaguuc

SEQ ID NO: 1330043 - RNA, 25 nt, Human
uggggauggggguuggguugauuuu

SEQ ID NO: 1330044 - RNA, 18 nt, Human
ugggggggggaagcaaca

SEQ ID NO: 1330045 - RNA, 18 nt, Human
uggugagauugcaggaag

SEQ ID NO: 1330046 - RNA, 29 nt, Human
uguacuggacaccucuaauguuuuccucu

SEQ ID NO: 1330047 - RNA, 22 nt, Human
uguagggguuggcaaacuacag

SEQ ID NO: 1330048 - RNA, 18 nt, Human
ugucugugugugugugug

SEQ ID NO: 1330049 - RNA, 20 nt, Human
uguggcccaggagguuugaa

SEQ ID NO: 1330050 - RNA, 22 nt, Human
uguguggcccaggagguuugaa

SEQ ID NO: 1330051 - RNA, 20 nt, Human
uguuacacauaucuucugug

SEQ ID NO: 1330052 - RNA, 20 nt, Human
uuagcaguuuccacguuccc

SEQ ID NO: 1330053 - RNA, 19 nt, Human
uucagugaucugugucccc

SEQ ID NO: 1330054 - RNA, 22 nt, Human
uuccugaccccugaguuagugg

SEQ ID NO: 1330055 - RNA, 22 nt, Human
uucuugguauugugcauucauu

SEQ ID NO: 1330056 - RNA, 21 nt, Human
uucuuuggcccuugaccccag

SEQ ID NO: 1330057 - RNA, 21 nt, Human
uuucaaguguauugcagggag

SEQ ID NO: 1330058 - RNA, 21 nt, Human
uuugcagauuuuggggaaagc

SEQ ID NO: 1330059 - RNA, 19 nt, Human
uuugguggaaaguaguugg

SEQ ID NO: 1330060 - RNA, 19 nt, Human
aaaaaaaaaagaaaagaag

SEQ ID NO: 1330061 - RNA, 19 nt, Human
aaaaagaaccugagaaaca

SEQ ID NO: 1330062 - RNA, 22 nt, Human
aaaacugguaaaaaugagacaa

SEQ ID NO: 1330063 - RNA, 20 nt, Human
aaaagauaaaacaaaaagga

SEQ ID NO: 1330064 - RNA, 18 nt, Human
aaaauuagcugggcgugg

SEQ ID NO: 1330065 - RNA, 24 nt, Human
aaacagcagcagaguauaauccca

SEQ ID NO: 1330066 - RNA, 26 nt, Human
aaacuuuuuuuuagaauaaaaaaagg

SEQ ID NO: 1330067 - RNA, 25 nt, Human
aaauaaugaggagugaccgguaccc

SEQ ID NO: 1330068 - RNA, 22 nt, Human
aacaaaaaggaggaggcacaaa

SEQ ID NO: 1330069 - RNA, 21 nt, Human
aacacauguauuuucucugua

SEQ ID NO: 1330070 - RNA, 19 nt, Human
aacauggugaaacaccauc

SEQ ID NO: 1330071 - RNA, 20 nt, Human
aacauggugaaacaccaucu

SEQ ID NO: 1330072 - RNA, 21 nt, Human
aacauggugaaacaccaucuc

SEQ ID NO: 1330073 - RNA, 21 nt, Human
aaccugagaaacaaccugacu

SEQ ID NO: 1330074 - RNA, 20 nt, Human
aagaaaagaagguuuagcua

SEQ ID NO: 1330075 - RNA, 18 nt, Human
aagcuugcccacgaccgc

SEQ ID NO: 1330076 - RNA, 25 nt, Human
aaucaaucaauacauauaugugugu

SEQ ID NO: 1330077 - RNA, 24 nt, Human
aauuguuugaacucgggaggcgga

SEQ ID NO: 1330078 - RNA, 23 nt, Human
acacacacaugugcguacacaca

SEQ ID NO: 1330079 - RNA, 18 nt, Human
acaccacugcacuccagc

SEQ ID NO: 1330080 - RNA, 20 nt, Human
acaccacugcacuccagccu

SEQ ID NO: 1330081 - RNA, 21 nt, Human
acacuaugagagcugaaauaa

SEQ ID NO: 1330082 - RNA, 21 nt, Human
acagaaacauauauguauagu

SEQ ID NO: 1330083 - RNA, 24 nt, Human
acagagugagacuccaucucaaaa

SEQ ID NO: 1330084 - RNA, 19 nt, Human
acauggugaaacaccaucu

SEQ ID NO: 1330085 - RNA, 20 nt, Human
acaugugcguacacacagaa

SEQ ID NO: 1330086 - RNA, 18 nt, Human
accacuuuaagcaguaga

SEQ ID NO: 1330087 - RNA, 24 nt, Human
acuccagccuggaagacagaguga

SEQ ID NO: 1330088 - RNA, 24 nt, Human
acucgggaggcggaggcugcagug

SEQ ID NO: 1330089 - RNA, 18 nt, Human
acugcacuccagccugga

SEQ ID NO: 1330090 - RNA, 24 nt, Human
acugcacuccagccuggaagacag

SEQ ID NO: 1330091 - RNA, 22 nt, Human
agaaacaaccugacuugacaua

SEQ ID NO: 1330092 - RNA, 24 nt, Human
agaaacaauaaauagcgcuucagc

SEQ ID NO: 1330093 - RNA, 30 nt, Human
agacaaguaugcauacacacacaugugcgg

SEQ ID NO: 1330094 - RNA, 24 nt, Human
agauaacaagcagaaaggaacuca

SEQ ID NO: 1330095 - RNA, 18 nt, Human
agccuggaagacagagug

SEQ ID NO: 1330096 - RNA, 19 nt, Human
agccuggccaacaugguga

SEQ ID NO: 1330097 - RNA, 23 nt, Human
agcugggcgugguggcacgcgcc

SEQ ID NO: 1330098 - RNA, 24 nt, Human
aggcaggagaauuguuugaacucg

SEQ ID NO: 1330099 - RNA, 21 nt, Human
aggccaaggcggguggaucac

SEQ ID NO: 1330100 - RNA, 21 nt, Human
aggcccagcgcucccggcccg

SEQ ID NO: 1330101 - RNA, 19 nt, Human
aggcggaggcugcagugag

SEQ ID NO: 1330102 - RNA, 24 nt, Human
aggcggaggcugcagugagccaag

SEQ ID NO: 1330103 - RNA, 25 nt, Human
aggcggguggaucaccaaggucagg

SEQ ID NO: 1330104 - RNA, 21 nt, Human
aggcugaggcaggagaauugu

SEQ ID NO: 1330105 - RNA, 24 nt, Human
aggcugaggcaggagaauuguuug

SEQ ID NO: 1330106 - RNA, 23 nt, Human
aggggaaacacagagucagguuc

SEQ ID NO: 1330107 - RNA, 19 nt, Human
agugagcaggugaauucuc

SEQ ID NO: 1330108 - RNA, 19 nt, Human
agugauuuguauuugucug

SEQ ID NO: 1330109 - RNA, 21 nt, Human
auaaaacaaaaaggaggaggc

SEQ ID NO: 1330110 - RNA, 21 nt, Human
auaauuuuuuaaaagauaaaa

SEQ ID NO: 1330111 - RNA, 23 nt, Human
auagaaugcacaaauaaugagga

SEQ ID NO: 1330112 - RNA, 24 nt, Human
aucacaccacugcacuccagccug

SEQ ID NO: 1330113 - RNA, 22 nt, Human
aucccagcacuuugggaggcca

SEQ ID NO: 1330114 - RNA, 24 nt, Human
augcauacacacacaugugcguac

SEQ ID NO: 1330115 - RNA, 19 nt, Human
augccuguaaucccagcac

SEQ ID NO: 1330116 - RNA, 23 nt, Human
augucacaauuucccguuugagc

SEQ ID NO: 1330117 - RNA, 24 nt, Human
caacauggugaaacaccaucucua

SEQ ID NO: 1330118 - RNA, 18 nt, Human
caagagcagccuggccaa

SEQ ID NO: 1330119 - RNA, 24 nt, Human
caagagcagccuggccaacauggu

SEQ ID NO: 1330120 - RNA, 25 nt, Human
caaggcggguggaucaccaagguca

SEQ ID NO: 1330121 - RNA, 24 nt, Human
caaggcuggacacgguggcucaug

SEQ ID NO: 1330122 - RNA, 26 nt, Human
caccacugcacuccagccuggaagac

SEQ ID NO: 1330123 - RNA, 23 nt, Human
cacuccaaaugcacccaaucuca

SEQ ID NO: 1330124 - RNA, 23 nt, Human
cacuccaaaugcacccaaucuca

SEQ ID NO: 1330125 - RNA, 22 nt, Human
cacuccagccuggaagacagag

SEQ ID NO: 1330126 - RNA, 23 nt, Human
cacuccagccuggaagacagagu

SEQ ID NO: 1330127 - RNA, 24 nt, Human
cacuccagccuggaagacagagug

SEQ ID NO: 1330128 - RNA, 18 nt, Human
cacugcacuccagccugg

SEQ ID NO: 1330129 - RNA, 19 nt, Human
cacugcacuccagccugga

SEQ ID NO: 1330130 - RNA, 25 nt, Human
cacugcacuccagccuggaagacag

SEQ ID NO: 1330131 - RNA, 22 nt, Human
cagaaaggaacucaaugacuca

SEQ ID NO: 1330132 - RNA, 24 nt, Human
cagcacuuugggaggccaaggcgg

SEQ ID NO: 1330133 - RNA, 19 nt, Human
cagcagaguauaaucccau

SEQ ID NO: 1330134 - RNA, 20 nt, Human
cagcagcagaguauaauccc

SEQ ID NO: 1330135 - RNA, 21 nt, Human
caggcccagcgcucccggccc

SEQ ID NO: 1330136 - RNA, 20 nt, Human
caugccuguaaucccagcac

SEQ ID NO: 1330137 - RNA, 24 nt, Human
caugccuguaaucccagcacuuug

SEQ ID NO: 1330138 - RNA, 22 nt, Human
ccaaaaaagaaccugagaaaca

SEQ ID NO: 1330139 - RNA, 19 nt, Human
ccacugcacuccagccugg

SEQ ID NO: 1330140 - RNA, 20 nt, Human
ccacugcacuccagccugga

SEQ ID NO: 1330141 - RNA, 21 nt, Human
ccacugcacuccagccuggaa

SEQ ID NO: 1330142 - RNA, 24 nt, Human
ccacugcacuccagccuggaagac

SEQ ID NO: 1330143 - RNA, 25 nt, Human
ccacugcacuccagccuggaagaca

SEQ ID NO: 1330144 - RNA, 21 nt, Human
ccaucucaaaaaaaaaaagaa

SEQ ID NO: 1330145 - RNA, 21 nt, Human
cccgcuggguaaccgucccag

SEQ ID NO: 1330146 - RNA, 22 nt, Human
ccuggaacagccauaaagacac

SEQ ID NO: 1330147 - RNA, 19 nt, Human
ccuggccaacauggugaaa

SEQ ID NO: 1330148 - RNA, 24 nt, Human
ccuggccaacauggugaaacacca

SEQ ID NO: 1330149 - RNA, 22 nt, Human
ccuguaaucccagcacuuuggg

SEQ ID NO: 1330150 - RNA, 22 nt, Human
ccuguaaucccagcugcuaggg

SEQ ID NO: 1330151 - RNA, 23 nt, Human
cgccuguaaucccagcugcuagg

SEQ ID NO: 1330152 - RNA, 23 nt, Human
cggguggaucaccaaggucagga

SEQ ID NO: 1330153 - RNA, 24 nt, Human
cucaugccuguaaucccagcacuu

SEQ ID NO: 1330154 - RNA, 19 nt, Human
cuccaaaugcacccaaucu

SEQ ID NO: 1330155 - RNA, 19 nt, Human
cuccaucucaaaaaaaaaa

SEQ ID NO: 1330156 - RNA, 19 nt, Human
cugcuaguuacucgcugug

SEQ ID NO: 1330157 - RNA, 20 nt, Human
cuucccggcaggcccagcgc

SEQ ID NO: 1330158 - RNA, 24 nt, Human
cuuggaagaauuggaacacccaga

SEQ ID NO: 1330159 - RNA, 19 nt, Human
gaacacccagaacugcuag

SEQ ID NO: 1330160 - RNA, 24 nt, Human
gacagagugagacuccaucucaaa

SEQ ID NO: 1330161 - RNA, 23 nt, Human
gagaauuguuugaacucgggagg

SEQ ID NO: 1330162 - RNA, 18 nt, Human
gaggcugcagugagccaa

SEQ ID NO: 1330163 - RNA, 19 nt, Human
gaggcugcagugagccaag

SEQ ID NO: 1330164 - RNA, 23 nt, Human
gaucaccaaggucaggaguucaa

SEQ ID NO: 1330165 - RNA, 25 nt, Human
gaucaccaaggucaggaguucaaga

SEQ ID NO: 1330166 - RNA, 23 nt, Human
gcacuccagccuggaagacagag

SEQ ID NO: 1330167 - RNA, 24 nt, Human
gccaacauggugaaacaccaucuc

SEQ ID NO: 1330168 - RNA, 20 nt, Human
gccaagaucacaccacugca

SEQ ID NO: 1330169 - RNA, 22 nt, Human
gcuggacacgguggcucaugcc

SEQ ID NO: 1330170 - RNA, 24 nt, Human
ggacacgguggcucaugccuguaa

SEQ ID NO: 1330171 - RNA, 20 nt, Human
ggaggcugcagugagccaag

SEQ ID NO: 1330172 - RNA, 24 nt, Human
ggaggcugcagugagccaagauca

SEQ ID NO: 1330173 - RNA, 21 nt, Human
ggcacgcgccuguaaucccag

SEQ ID NO: 1330174 - RNA, 24 nt, Human
ggcggguggaucaccaaggucagg

SEQ ID NO: 1330175 - RNA, 21 nt, Human
gggaggcugaggcaggagaau

SEQ ID NO: 1330176 - RNA, 24 nt, Human
gggcgugguggcacgcgccuguaa

SEQ ID NO: 1330177 - RNA, 24 nt, Human
gguggaucaccaaggucaggaguu

SEQ ID NO: 1330178 - RNA, 24 nt, Human
gguggcacgcgccuguaaucccag

SEQ ID NO: 1330179 - RNA, 23 nt, Human
gguggcucaugccuguaauccca

SEQ ID NO: 1330180 - RNA, 24 nt, Human
gguggcucaugccuguaaucccag

SEQ ID NO: 1330181 - RNA, 25 nt, Human
guauagaaugcacaaauaaugagga

SEQ ID NO: 1330182 - RNA, 24 nt, Human
guggaucaccaaggucaggaguuc

SEQ ID NO: 1330183 - RNA, 23 nt, Human
guggcacgcgccuguaaucccag

SEQ ID NO: 1330184 - RNA, 19 nt, Human
guuacaaauaaauuuuagu

SEQ ID NO: 1330185 - RNA, 25 nt, Human
uaaaacaaaaaggaggaggcacaac

SEQ ID NO: 1330186 - RNA, 21 nt, Human
uaaaagauaaaacaaaaagga

SEQ ID NO: 1330187 - RNA, 19 nt, Human
uaaaaugucacaauuuccc

SEQ ID NO: 1330188 - RNA, 20 nt, Human
uacacacauagaaaagaaau

SEQ ID NO: 1330189 - RNA, 23 nt, Human
uacacuaugagagcugaaauaag

SEQ ID NO: 1330190 - RNA, 25 nt, Human
uaccacaauaccagaaauucuccaa

SEQ ID NO: 1330191 - RNA, 24 nt, Human
uaccaugaaguauaaccucccaaa

SEQ ID NO: 1330192 - RNA, 21 nt, Human
uacucuauuaccacaauacca

SEQ ID NO: 1330193 - RNA, 25 nt, Human
uagaaugcacaaauaaugaggagug

SEQ ID NO: 1330194 - RNA, 20 nt, Human
uagcugggcgugguggcacg

SEQ ID NO: 1330195 - RNA, 19 nt, Human
uauauauauuuacacacau

SEQ ID NO: 1330196 - RNA, 22 nt, Human
uaugcauacacacacaugugcg

SEQ ID NO: 1330197 - RNA, 22 nt, Human
uaugcauacacacacaugugcg

SEQ ID NO: 1330198 - RNA, 22 nt, Human
ucaaaaaauaaaaaagaucauu

SEQ ID NO: 1330199 - RNA, 20 nt, Human
ucaagagcagccuggccaac

SEQ ID NO: 1330200 - RNA, 22 nt, Human
ucaagagcagccuggccaacau

SEQ ID NO: 1330201 - RNA, 23 nt, Human
ucacaccacugcacuccagccug

SEQ ID NO: 1330202 - RNA, 22 nt, Human
ucaccaaggucaggaguucaag

SEQ ID NO: 1330203 - RNA, 22 nt, Human
ucaugccuguaaucccagcacu

SEQ ID NO: 1330204 - RNA, 23 nt, Human
uccagccuggaagacagagugag

SEQ ID NO: 1330205 - RNA, 24 nt, Human
uccagccuggaagacagagugaga

SEQ ID NO: 1330206 - RNA, 19 nt, Human
uccaucucaaaaaaaaaaa

SEQ ID NO: 1330207 - RNA, 24 nt, Human
uccaucucaaaaaaaaaaagaaaa

SEQ ID NO: 1330208 - RNA, 22 nt, Human
ucccugaaugaccaugaaagca

SEQ ID NO: 1330209 - RNA, 18 nt, Human
ucuauuaccacaauacca

SEQ ID NO: 1330210 - RNA, 21 nt, Human
ucucuacuaaaaguacaaaaa

SEQ ID NO: 1330211 - RNA, 20 nt, Human
ugaaacaccaucucuacuaa

SEQ ID NO: 1330212 - RNA, 21 nt, Human
ugaaacaccaucucuacuaaa

SEQ ID NO: 1330213 - RNA, 19 nt, Human
ugaaacacugcuccuaggg

SEQ ID NO: 1330214 - RNA, 22 nt, Human
ugacaagaaaauaaaacuggua

SEQ ID NO: 1330215 - RNA, 24 nt, Human
ugaggcaggagaauuguuugaacu

SEQ ID NO: 1330216 - RNA, 25 nt, Human
ugaggcaggagaauuguuugaacuc

SEQ ID NO: 1330217 - RNA, 20 nt, Human
ugaguuuauuuaacacaugu

SEQ ID NO: 1330218 - RNA, 19 nt, Human
ugcauacacacacaugugc

SEQ ID NO: 1330219 - RNA, 25 nt, Human
ugcauacacacacaugugcguacac

SEQ ID NO: 1330220 - RNA, 18 nt, Human
ugccucauuugacuucag

SEQ ID NO: 1330221 - RNA, 23 nt, Human
ugccuguaaucccagcacuuugg

SEQ ID NO: 1330222 - RNA, 22 nt, Human
ugcguacacacagaaacauaua

SEQ ID NO: 1330223 - RNA, 27 nt, Human
ugcguacacacagaaacauauauguag

SEQ ID NO: 1330224 - RNA, 19 nt, Human
ugcuagggaggcugaggca

SEQ ID NO: 1330225 - RNA, 22 nt, Human
uggaagaauuggaacacccaga

SEQ ID NO: 1330226 - RNA, 23 nt, Human
uggaucaccaaggucaggaguuc

SEQ ID NO: 1330227 - RNA, 21 nt, Human
uggcacgcgccuguaauccca

SEQ ID NO: 1330228 - RNA, 18 nt, Human
uggccaacauggugaaac

SEQ ID NO: 1330229 - RNA, 22 nt, Human
uggcucaugccuguaaucccag

SEQ ID NO: 1330230 - RNA, 24 nt, Human
uggcucaugccuguaaucccagca

SEQ ID NO: 1330231 - RNA, 24 nt, Human
ugggaacauauaaaucagaaucuu

SEQ ID NO: 1330232 - RNA, 18 nt, Human
ugggaaugggucaaaaaa

SEQ ID NO: 1330233 - RNA, 24 nt, Human
ugggaggccaaggcggguggauca

SEQ ID NO: 1330234 - RNA, 24 nt, Human
ugguggcacgcgccuguaauccca

SEQ ID NO: 1330235 - RNA, 19 nt, Human
ugugaucuuggaagaauuu

SEQ ID NO: 1330236 - RNA, 26 nt, Human
ugugcguacacacagaaacauauaug

SEQ ID NO: 1330237 - RNA, 18 nt, Human
uuagcugggcgugguggc

SEQ ID NO: 1330238 - RNA, 20 nt, Human
uuagcugggcgugguggcac

SEQ ID NO: 1330239 - RNA, 24 nt, Human
uuguuugaacucgggaggcggagg

SEQ ID NO: 1330240 - RNA, 25 nt, Human
uuuaauacacauugcugauuccuua

SEQ ID NO: 1330241 - RNA, 22 nt, Human
uuuagugagcaggugaauucuc

SEQ ID NO: 1330242 - RNA, 23 nt, Human
uuucucuguaagguaagccacag

SEQ ID NO: 1330243 - RNA, 19 nt, Human
aacucagggccaaguacaa

SEQ ID NO: 1330244 - RNA, 18 nt, Human
agacuugagagcagccag

SEQ ID NO: 1330245 - RNA, 19 nt, Human
agcagccaguggguaagac

SEQ ID NO: 1330246 - RNA, 24 nt, Human
aggaggaggugcucggacauugga

SEQ ID NO: 1330247 - RNA, 19 nt, Human
cacaggaggaggugcucgg

SEQ ID NO: 1330248 - RNA, 18 nt, Human
cagcugauggcugagacu

SEQ ID NO: 1330249 - RNA, 26 nt, Human
caugaacaaaccaucaguaguuauua

SEQ ID NO: 1330250 - RNA, 23 nt, Human
cauuggaggaguacuuccaacug

SEQ ID NO: 1330251 - RNA, 23 nt, Human
cgaguggauaggauuauaggcca

SEQ ID NO: 1330252 - RNA, 22 nt, Human
gauuauaggccacaggaggagg

SEQ ID NO: 1330253 - RNA, 22 nt, Human
ggagcccaagaaauaggagaug

SEQ ID NO: 1330254 - RNA, 19 nt, Human
uaaggagcccaagaaauag

SEQ ID NO: 1330255 - RNA, 18 nt, Human
ugaaagcaggauuucuuu

SEQ ID NO: 1330256 - RNA, 19 nt, Human
ugcagcugauggcugagac

SEQ ID NO: 1330257 - RNA, 24 nt, Human
uuuggagggcugugcagcugaugg

SEQ ID NO: 1330258 - RNA, 23 nt, Human
caaaacaucagcaguucccacaa

SEQ ID NO: 1330259 - RNA, 18 nt, Human
cacaaggcccacuuccaa

SEQ ID NO: 1330260 - RNA, 20 nt, Human
caccuucccucuuucuuuug

SEQ ID NO: 1330261 - RNA, 20 nt, Human
ccaagcagaaacuuaaaagc

SEQ ID NO: 1330262 - RNA, 26 nt, Human
ccaccuucccucuuucuuuugucaaa

SEQ ID NO: 1330263 - RNA, 20 nt, Human
ccuucccucuuucuuuuguc

SEQ ID NO: 1330264 - RNA, 21 nt, Human
ucaacucuuauuuagugucua

SEQ ID NO: 1330265 - RNA, 18 nt, Human
ucuucauccaucauauuu

SEQ ID NO: 1330266 - RNA, 21 nt, Human
ugcacaaggcccacuuccaag

SEQ ID NO: 1330267 - RNA, 23 nt, Human
ugugcacaaggcccacuuccaag

SEQ ID NO: 1330268 - RNA, 20 nt, Human
uuccaccuucccucuuucuc

SEQ ID NO: 1330269 - RNA, 24 nt, Human
aaauaauucuccaucuggagccca

SEQ ID NO: 1330270 - RNA, 24 nt, Human
acagcaaauaauucuccaucugga

SEQ ID NO: 1330271 - RNA, 21 nt, Human
cugaaguaaugggaugcucau

SEQ ID NO: 1330272 - RNA, 18 nt, Human
uaucacacaagcguaaag

SEQ ID NO: 1330273 - RNA, 30 nt, Human
uaucacacaagcguaaaguaugaaacggcg

SEQ ID NO: 1330274 - RNA, 24 nt, Human
ucucaaauaccugguaccuccccg

SEQ ID NO: 1330275 - RNA, 18 nt, Human
ugaaacgauccaacagca

SEQ ID NO: 1330276 - RNA, 24 nt, Human
ugagguugugaauuguacaguggg

SEQ ID NO: 1330277 - RNA, 22 nt, Human
uguauuuacucaaguuccagga

SEQ ID NO: 1330278 - RNA, 20 nt, Human
uucaccagcagauaaaauaa

SEQ ID NO: 1330279 - RNA, 24 nt, Human
uucaccagcagauaaaauaagauc

SEQ ID NO: 1330280 - RNA, 24 nt, Human
aaaaaagacuuaaaaaaauaucau

SEQ ID NO: 1330281 - RNA, 27 nt, Human
aaaaagaaaauacagcauaauaaaaaa

SEQ ID NO: 1330282 - RNA, 19 nt, Human
aaaaauaaccacaaugaau

SEQ ID NO: 1330283 - RNA, 26 nt, Human
aaacauacgcuucucaauuaaaugua

SEQ ID NO: 1330284 - RNA, 21 nt, Human
aacauucucuuaccacccaaa

SEQ ID NO: 1330285 - RNA, 22 nt, Human
aacuguauagcucuuacaagac

SEQ ID NO: 1330286 - RNA, 22 nt, Human
aagaaaaaaaaauaguguuuua

SEQ ID NO: 1330287 - RNA, 26 nt, Human
aagaaaagggauaauucacuauaaca

SEQ ID NO: 1330288 - RNA, 24 nt, Human
aagaggcacauuagcaacuacuug

SEQ ID NO: 1330289 - RNA, 26 nt, Human
aagcaaaaaaggaaaaugagggaccc

SEQ ID NO: 1330290 - RNA, 23 nt, Human
aagcaaaaaaggaaaaugauuga

SEQ ID NO: 1330291 - RNA, 21 nt, Human
aaguaaagccuacacuaugua

SEQ ID NO: 1330292 - RNA, 25 nt, Human
aauauaaacaauaauuaaaaaauaa

SEQ ID NO: 1330293 - RNA, 22 nt, Human
acaaaacccaugcaauuuuacc

SEQ ID NO: 1330294 - RNA, 25 nt, Human
acacucacacgcgcacaaaaaggcg

SEQ ID NO: 1330295 - RNA, 21 nt, Human
acauugguuauauugcccaac

SEQ ID NO: 1330296 - RNA, 23 nt, Human
accaaguuacugucaauccaaaa

SEQ ID NO: 1330297 - RNA, 24 nt, Human
acccaaaugccucaacuuauacau

SEQ ID NO: 1330298 - RNA, 23 nt, Human
accuuauuuuuuugguccuccaa

SEQ ID NO: 1330299 - RNA, 22 nt, Human
acgcuggggcccacacucacac

SEQ ID NO: 1330300 - RNA, 22 nt, Human
agacugacuaccuagacaaaaa

SEQ ID NO: 1330301 - RNA, 21 nt, Human
agagagggagacagggggagg

SEQ ID NO: 1330302 - RNA, 21 nt, Human
agagagggagacagggggagg

SEQ ID NO: 1330303 - RNA, 22 nt, Human
agauaaauaccaacauguucuc

SEQ ID NO: 1330304 - RNA, 18 nt, Human
agcagaagguguuccaga

SEQ ID NO: 1330305 - RNA, 21 nt, Human
agcggccagcagagcgagcgg

SEQ ID NO: 1330306 - RNA, 19 nt, Human
agggaagaagcaaaaaagg

SEQ ID NO: 1330307 - RNA, 18 nt, Human
agggggaggggguggcgg

SEQ ID NO: 1330308 - RNA, 20 nt, Human
agggggaggggguggcgguu

SEQ ID NO: 1330309 - RNA, 21 nt, Human
aguaccuacaaaacccaugca

SEQ ID NO: 1330310 - RNA, 18 nt, Human
auaaaaauaaccacaaug

SEQ ID NO: 1330311 - RNA, 24 nt, Human
auaaacaauaauuaaaaaauaaaa

SEQ ID NO: 1330312 - RNA, 22 nt, Human
auauacuauggaauaucauaca

SEQ ID NO: 1330313 - RNA, 20 nt, Human
caaaagaaaaaaaaauagug

SEQ ID NO: 1330314 - RNA, 18 nt, Human
caccccggcuccccgguc

SEQ ID NO: 1330315 - RNA, 21 nt, Human
caccccggcuccccgguccgc

SEQ ID NO: 1330316 - RNA, 23 nt, Human
caccccggcuccccgguccgcgg

SEQ ID NO: 1330317 - RNA, 19 nt, Human
cagacugacuaccuagaca

SEQ ID NO: 1330318 - RNA, 18 nt, Human
cagcccgcgcucuccucc

SEQ ID NO: 1330319 - RNA, 21 nt, Human
cccaaagaaucuagaucgaca

SEQ ID NO: 1330320 - RNA, 23 nt, Human
cccccauuaucugaagagccugu

SEQ ID NO: 1330321 - RNA, 18 nt, Human
ccccgccgacugcgcccg

SEQ ID NO: 1330322 - RNA, 26 nt, Human
ccccgcuccaagcaccccggcucccc

SEQ ID NO: 1330323 - RNA, 19 nt, Human
cccgggcaagcgccagccc

SEQ ID NO: 1330324 - RNA, 22 nt, Human
ccgccuuccgcccggaacccac

SEQ ID NO: 1330325 - RNA, 21 nt, Human
ccuccuccuccuccugguccc

SEQ ID NO: 1330326 - RNA, 27 nt, Human
cgccagcccacgccuggcgucccccgc

SEQ ID NO: 1330327 - RNA, 21 nt, Human
cgccuuccgcccggaacccac

SEQ ID NO: 1330328 - RNA, 18 nt, Human
cggcggcgggggccccgg

SEQ ID NO: 1330329 - RNA, 22 nt, Human
cgggcaagcgccagcccgcgcu

SEQ ID NO: 1330330 - RNA, 23 nt, Human
cuauaacauucucuuaccaccca

SEQ ID NO: 1330331 - RNA, 20 nt, Human
cuccuccuccuccuccuccu

SEQ ID NO: 1330332 - RNA, 20 nt, Human
cuccuccuccuccuccuccu

SEQ ID NO: 1330333 - RNA, 23 nt, Human
cuccuccuccuccuccugguccc

SEQ ID NO: 1330334 - RNA, 23 nt, Human
cugcgcgccgggccuccgccuuc

SEQ ID NO: 1330335 - RNA, 20 nt, Human
cugcggcggccgccuccucc

SEQ ID NO: 1330336 - RNA, 19 nt, Human
cugcugacuggaucugugg

SEQ ID NO: 1330337 - RNA, 24 nt, Human
cuggggcccacacucacacgcgca

SEQ ID NO: 1330338 - RNA, 19 nt, Human
cuuaggaacaauauucuuc

SEQ ID NO: 1330339 - RNA, 19 nt, Human
cuucaaaaugacaaauuga

SEQ ID NO: 1330340 - RNA, 23 nt, Human
gaaccaccaauugcaacucccug

SEQ ID NO: 1330341 - RNA, 22 nt, Human
gaacccacccccgggagggcac

SEQ ID NO: 1330342 - RNA, 18 nt, Human
gaauaucauacaaaguaa

SEQ ID NO: 1330343 - RNA, 24 nt, Human
gacuggaucugugguaucacuuga

SEQ ID NO: 1330344 - RNA, 23 nt, Human
gagagggagacagggggaggggg

SEQ ID NO: 1330345 - RNA, 18 nt, Human
gcacaggaaguacgacuc

SEQ ID NO: 1330346 - RNA, 21 nt, Human
gcccacacucacacgcgcaca

SEQ ID NO: 1330347 - RNA, 24 nt, Human
ggcccacacucacacgcgcacaaa

SEQ ID NO: 1330348 - RNA, 19 nt, Human
ggucccgccgccagcccac

SEQ ID NO: 1330349 - RNA, 21 nt, Human
guaugagauucuggauguuag

SEQ ID NO: 1330350 - RNA, 23 nt, Human
uaaaaaacauacgcuucucaaag

SEQ ID NO: 1330351 - RNA, 23 nt, Human
uaaaaaauaaaaagaaaauacag

SEQ ID NO: 1330352 - RNA, 27 nt, Human
uaaaaagaaaauacagcauaauaaaaa

SEQ ID NO: 1330353 - RNA, 24 nt, Human
uacaugauggcuuuuaaggcccug

SEQ ID NO: 1330354 - RNA, 20 nt, Human
uaccaacauguucucauuuu

SEQ ID NO: 1330355 - RNA, 24 nt, Human
uaccuagacaaaaaaaaaaaagac

SEQ ID NO: 1330356 - RNA, 22 nt, Human
uacuauggaauaucauacaaag

SEQ ID NO: 1330357 - RNA, 19 nt, Human
uagacaaaaaaaaaaaaga

SEQ ID NO: 1330358 - RNA, 22 nt, Human
uagcagaagguguuccagaggc

SEQ ID NO: 1330359 - RNA, 24 nt, Human
uauaacauucucuuaccacccaaa

SEQ ID NO: 1330360 - RNA, 20 nt, Human
uaucugaagagccugugaaa

SEQ ID NO: 1330361 - RNA, 26 nt, Human
uaucugaagagccugugaaaccaauu

SEQ ID NO: 1330362 - RNA, 21 nt, Human
ucacacgcgcacaaaaaggcg

SEQ ID NO: 1330363 - RNA, 25 nt, Human
ucacuauaacauucucuuaccaccc

SEQ ID NO: 1330364 - RNA, 22 nt, Human
ucauuucuucuagauuccaaaa

SEQ ID NO: 1330365 - RNA, 20 nt, Human
uccaaaaguaccuacaaaac

SEQ ID NO: 1330366 - RNA, 23 nt, Human
uccaaaaguaccuacaaaaccca

SEQ ID NO: 1330367 - RNA, 18 nt, Human
uccagaggcaaguaaggu

SEQ ID NO: 1330368 - RNA, 20 nt, Human
ucccccgcuccaagcacccc

SEQ ID NO: 1330369 - RNA, 18 nt, Human
uccccgccgacugcgccc

SEQ ID NO: 1330370 - RNA, 22 nt, Human
ucccgccgccagcccacgccug

SEQ ID NO: 1330371 - RNA, 21 nt, Human
ucccugaaccuggacuugacc

SEQ ID NO: 1330372 - RNA, 20 nt, Human
uccuccaauagucaagaaaa

SEQ ID NO: 1330373 - RNA, 21 nt, Human
ucuuaagaauaacaaaugaac

SEQ ID NO: 1330374 - RNA, 18 nt, Human
ugaagagccugugaaacc

SEQ ID NO: 1330375 - RNA, 22 nt, Human
ugaauaaguauuuguguaauau

SEQ ID NO: 1330376 - RNA, 22 nt, Human
ugaccaggaaaagaugaaccac

SEQ ID NO: 1330377 - RNA, 21 nt, Human
ugaccaggaaaagaugaaccc

SEQ ID NO: 1330378 - RNA, 22 nt, Human
ugggagacaugguuuuuggaaa

SEQ ID NO: 1330379 - RNA, 26 nt, Human
ugguccuccaauagucaagacccguc

SEQ ID NO: 1330380 - RNA, 23 nt, Human
uggugcaacggaaaauauuuguu

SEQ ID NO: 1330381 - RNA, 21 nt, Human
uguauagcucuuacaagacca

SEQ ID NO: 1330382 - RNA, 24 nt, Human
uguauagcucuuacaagaccagca

SEQ ID NO: 1330383 - RNA, 19 nt, Human
ugugcagaagccaaaucac

SEQ ID NO: 1330384 - RNA, 20 nt, Human
ugugcagaagccaaaucacc

SEQ ID NO: 1330385 - RNA, 19 nt, Human
uguuacacuuuacugguaa

SEQ ID NO: 1330386 - RNA, 22 nt, Human
uucacuauaacauucucuuacc

SEQ ID NO: 1330387 - RNA, 19 nt, Human
uucaucuuuuauaguugua

SEQ ID NO: 1330388 - RNA, 20 nt, Human
uucuugauuuauacccccau

SEQ ID NO: 1330389 - RNA, 21 nt, Human
uugaacacuggacacuguacc

SEQ ID NO: 1330390 - RNA, 21 nt, Human
uugaugcauuugguuagacua

SEQ ID NO: 1330391 - RNA, 22 nt, Human
uuggugcuccuccuaacugugc

SEQ ID NO: 1330392 - RNA, 24 nt, Human
uuucgcacaggaaguacgacucgg

SEQ ID NO: 1330393 - RNA, 25 nt, Human
uuugaccaggaaaagaugaaccacc

SEQ ID NO: 1330394 - RNA, 21 nt, Human
aaaauaacgaaacugccccag

SEQ ID NO: 1330395 - RNA, 18 nt, Human
aaaggccuaacaaccagu

SEQ ID NO: 1330396 - RNA, 24 nt, Human
aaccaguaagauaauuuuagacaa

SEQ ID NO: 1330397 - RNA, 23 nt, Human
acagcauggaaacacccaauguc

SEQ ID NO: 1330398 - RNA, 20 nt, Human
agacuucccuagagaggccc

SEQ ID NO: 1330399 - RNA, 21 nt, Human
agccuacagcauggaaacacc

SEQ ID NO: 1330400 - RNA, 19 nt, Human
aggcauuggggaucagcuu

SEQ ID NO: 1330401 - RNA, 24 nt, Human
aucacacaucaaagaccuagacuc

SEQ ID NO: 1330402 - RNA, 24 nt, Human
caaaauaacgaaacugccccagua

SEQ ID NO: 1330403 - RNA, 24 nt, Human
caaccagacuucccuagagaggcc

SEQ ID NO: 1330404 - RNA, 24 nt, Human
cacccaaugucugcucuagccuau

SEQ ID NO: 1330405 - RNA, 21 nt, Human
caccuguguucuuccugaggg

SEQ ID NO: 1330406 - RNA, 19 nt, Human
cagcauggaaacacccaau

SEQ ID NO: 1330407 - RNA, 24 nt, Human
cagccacacccuggucacagcaga

SEQ ID NO: 1330408 - RNA, 20 nt, Human
caggagaaggggucaugggg

SEQ ID NO: 1330409 - RNA, 21 nt, Human
caggagccuauucaggcucua

SEQ ID NO: 1330410 - RNA, 21 nt, Human
ccacacacaucagaaagggua

SEQ ID NO: 1330411 - RNA, 21 nt, Human
ccaggaaaggcaagcaugagg

SEQ ID NO: 1330412 - RNA, 21 nt, Human
cuauucaggcucuacaaccag

SEQ ID NO: 1330413 - RNA, 22 nt, Human
cucugagacaccaaaggccuaa

SEQ ID NO: 1330414 - RNA, 24 nt, Human
gagaggccccgugccaguuagucc

SEQ ID NO: 1330415 - RNA, 20 nt, Human
gagcuggggacaggagaagg

SEQ ID NO: 1330416 - RNA, 18 nt, Human
ggaaaggcaagcaugagg

SEQ ID NO: 1330417 - RNA, 20 nt, Human
ggaucuacugcucguccagu

SEQ ID NO: 1330418 - RNA, 21 nt, Human
gggaugggagcuggggacagg

SEQ ID NO: 1330419 - RNA, 23 nt, Human
ggggccaggaaaggcaagcauga

SEQ ID NO: 1330420 - RNA, 21 nt, Human
ggggcugggccugggggccag

SEQ ID NO: 1330421 - RNA, 19 nt, Human
ggucauggggccaggagcc

SEQ ID NO: 1330422 - RNA, 23 nt, Human
guucuuccugaggggugggggca

SEQ ID NO: 1330423 - RNA, 18 nt, Human
guugcacauguagguugg

SEQ ID NO: 1330424 - RNA, 18 nt, Human
uaaaaaggggcugggccu

SEQ ID NO: 1330425 - RNA, 19 nt, Human
uagagguggaccugucccu

SEQ ID NO: 1330426 - RNA, 25 nt, Human
uauaaacaaauaaaagauuaaauca

SEQ ID NO: 1330427 - RNA, 18 nt, Human
ucaaagaccuagacuccu

SEQ ID NO: 1330428 - RNA, 19 nt, Human
ucacacaucaaagaccuag

SEQ ID NO: 1330429 - RNA, 20 nt, Human
ugcacauguagguuggaggu

SEQ ID NO: 1330430 - RNA, 18 nt, Human
ugggaugggagcugggga

SEQ ID NO: 1330431 - RNA, 20 nt, Human
ugggccugggggccaggaaa

SEQ ID NO: 1330432 - RNA, 21 nt, Human
uggggccaggagccuauucag

SEQ ID NO: 1330433 - RNA, 20 nt, Human
ugggggccaggaaaggcaag

SEQ ID NO: 1330434 - RNA, 23 nt, Human
uuaacccacaacugggaugggag

SEQ ID NO: 1330435 - RNA, 21 nt, Human
uuccuuggagcugcaggcugc

SEQ ID NO: 1330436 - RNA, 22 nt, Human
uuggagguagcccaggugucag

SEQ ID NO: 1330437 - RNA, 20 nt, Human
aaauguuugcugacuugaaa

SEQ ID NO: 1330438 - RNA, 21 nt, Human
auuggagcaucacagccggug

SEQ ID NO: 1330439 - RNA, 20 nt, Human
cggccgcccggcgcccuggg

SEQ ID NO: 1330440 - RNA, 18 nt, Human
cggcgcccugggcucgcc

SEQ ID NO: 1330441 - RNA, 18 nt, Human
cgugggggagggaggccg

SEQ ID NO: 1330442 - RNA, 21 nt, Human
cugggcucgccgcugcucggg

SEQ ID NO: 1330443 - RNA, 23 nt, Human
ggcccuccggccucucggcccag

SEQ ID NO: 1330444 - RNA, 19 nt, Human
uaagccagaccagccuccc

SEQ ID NO: 1330445 - RNA, 21 nt, Human
ucccggccgcccggcgcccug

SEQ ID NO: 1330446 - RNA, 23 nt, Human
ucccggccgcccggcgcccuggg

SEQ ID NO: 1330447 - RNA, 21 nt, Human
ucucggcccagcuaagccaga

SEQ ID NO: 1330448 - RNA, 18 nt, Human
ugcggcaaggauggggug

SEQ ID NO: 1330449 - RNA, 23 nt, Human
ugggguguugcauagagagucag

SEQ ID NO: 1330450 - RNA, 18 nt, Human
acacagcaaaucgccaaa

SEQ ID NO: 1330451 - RNA, 19 nt, Human
acaugccacauacacagca

SEQ ID NO: 1330452 - RNA, 21 nt, Human
acccaaauuuggaccaucagu

SEQ ID NO: 1330453 - RNA, 24 nt, Human
auuuauugucuauuuauuuuuggu

SEQ ID NO: 1330454 - RNA, 21 nt, Human
cacauacacagcaaaucgcca

SEQ ID NO: 1330455 - RNA, 18 nt, Human
ccacuuuguccuucuccu

SEQ ID NO: 1330456 - RNA, 22 nt, Human
cccacaagacaugcaguaacag

SEQ ID NO: 1330457 - RNA, 21 nt, Human
cccucuccacuuuguccuucu

SEQ ID NO: 1330458 - RNA, 20 nt, Human
ccucccucuccacuuugucc

SEQ ID NO: 1330459 - RNA, 21 nt, Human
ccucuaaacgguugcuccgga

SEQ ID NO: 1330460 - RNA, 22 nt, Human
gcuccaucuccucccucuccac

SEQ ID NO: 1330461 - RNA, 18 nt, Human
gcugagcacauuacaguu

SEQ ID NO: 1330462 - RNA, 23 nt, Human
ggcagaugaguuaacaggaggga

SEQ ID NO: 1330463 - RNA, 19 nt, Human
ucacauaagagauugcucc

SEQ ID NO: 1330464 - RNA, 26 nt, Human
ucacauaagagauugcuccaucuccu

SEQ ID NO: 1330465 - RNA, 22 nt, Human
uccaaucaguccuucucuccca

SEQ ID NO: 1330466 - RNA, 18 nt, Human
ucccaaguauuuucaucu

SEQ ID NO: 1330467 - RNA, 19 nt, Human
ucccagggucacagggugc

SEQ ID NO: 1330468 - RNA, 20 nt, Human
ucuaaacgguugcuccggag

SEQ ID NO: 1330469 - RNA, 19 nt, Human
ucuccucccucuccacuuu

SEQ ID NO: 1330470 - RNA, 21 nt, Human
ugcuccaucuccucccucucc

SEQ ID NO: 1330471 - RNA, 18 nt, Human
uggauuccuguugccauu

SEQ ID NO: 1330472 - RNA, 20 nt, Human
uuccucuaaacgguugcucc

SEQ ID NO: 1330473 - RNA, 18 nt, Human
uugaaccagguguuaggu

SEQ ID NO: 1330474 - RNA, 23 nt, Human
aaaaaggcaacaccuguggagga

SEQ ID NO: 1330475 - RNA, 18 nt, Human
aaacaggcaagcuguccc

SEQ ID NO: 1330476 - RNA, 20 nt, Human
aaagagcagcagagagcgau

SEQ ID NO: 1330477 - RNA, 18 nt, Human
aaagagcuagcugacacc

SEQ ID NO: 1330478 - RNA, 25 nt, Human
aaaggucccaaacaguuccagaccc

SEQ ID NO: 1330479 - RNA, 24 nt, Human
aaaguucaaagcagucugcaucua

SEQ ID NO: 1330480 - RNA, 22 nt, Human
aaccaugagaaaggaaggguca

SEQ ID NO: 1330481 - RNA, 20 nt, Human
aagaaugggaaccugcccac

SEQ ID NO: 1330482 - RNA, 22 nt, Human
aagacucccacccauagcacaa

SEQ ID NO: 1330483 - RNA, 19 nt, Human
aagcagcagaucugugcca

SEQ ID NO: 1330484 - RNA, 20 nt, Human
aagcagcagaucugugccau

SEQ ID NO: 1330485 - RNA, 24 nt, Human
aagccaaacaggcacuugccuaaa

SEQ ID NO: 1330486 - RNA, 23 nt, Human
aagcugaggagccuggcugagag

SEQ ID NO: 1330487 - RNA, 24 nt, Human
aagcugaggagccuggcugagagg

SEQ ID NO: 1330488 - RNA, 22 nt, Human
aagcuuaaaguucucccuccag

SEQ ID NO: 1330489 - RNA, 20 nt, Human
aaggucccaaacaguuccag

SEQ ID NO: 1330490 - RNA, 26 nt, Human
acagcauaagacuggaaagcccccaa

SEQ ID NO: 1330491 - RNA, 18 nt, Human
accaaggcuucucacagc

SEQ ID NO: 1330492 - RNA, 18 nt, Human
acccagagcccucuacuu

SEQ ID NO: 1330493 - RNA, 26 nt, Human
acccgucccaccccacccucaggggc

SEQ ID NO: 1330494 - RNA, 23 nt, Human
agaaaggagcgggcucggaccga

SEQ ID NO: 1330495 - RNA, 22 nt, Human
agaaauauaacccuuuaaaagc

SEQ ID NO: 1330496 - RNA, 21 nt, Human
agaagcaaaagaaccaggucc

SEQ ID NO: 1330497 - RNA, 22 nt, Human
agaaugugggcaccugcaccca

SEQ ID NO: 1330498 - RNA, 19 nt, Human
agacuggaaagcccccaag

SEQ ID NO: 1330499 - RNA, 21 nt, Human
agagaaaccaauguccaaggg

SEQ ID NO: 1330500 - RNA, 20 nt, Human
agagcccucuacuucugggg

SEQ ID NO: 1330501 - RNA, 20 nt, Human
agaggcuguuucaggaauag

SEQ ID NO: 1330502 - RNA, 21 nt, Human
agagugggcguggaggggccc

SEQ ID NO: 1330503 - RNA, 21 nt, Human
agaucucaaagaucuagacaa

SEQ ID NO: 1330504 - RNA, 21 nt, Human
agaucugugccauuaagggcu

SEQ ID NO: 1330505 - RNA, 21 nt, Human
agccacagaucucaaagaucu

SEQ ID NO: 1330506 - RNA, 18 nt, Human
agcuagcugacacccaca

SEQ ID NO: 1330507 - RNA, 21 nt, Human
aggaagggcauggggcaaaag

SEQ ID NO: 1330508 - RNA, 23 nt, Human
aggagugagcgcgugagcagcgg

SEQ ID NO: 1330509 - RNA, 19 nt, Human
agggaguggccuucuuagg

SEQ ID NO: 1330510 - RNA, 21 nt, Human
auauaacccuuuaaaagcaag

SEQ ID NO: 1330511 - RNA, 19 nt, Human
augcggcagccucuccucc

SEQ ID NO: 1330512 - RNA, 21 nt, Human
auuuuaagucagcacaaacau

SEQ ID NO: 1330513 - RNA, 22 nt, Human
caaaagaaccagguccuuccca

SEQ ID NO: 1330514 - RNA, 24 nt, Human
caaagcagucugcaucuagggaac

SEQ ID NO: 1330515 - RNA, 19 nt, Human
caagaaaugggcacccaga

SEQ ID NO: 1330516 - RNA, 24 nt, Human
caagggaagagugggcguggaggg

SEQ ID NO: 1330517 - RNA, 21 nt, Human
caccacccgucccaccccacc

SEQ ID NO: 1330518 - RNA, 21 nt, Human
caccagaggcccugaggccug

SEQ ID NO: 1330519 - RNA, 18 nt, Human
cacccagggcccauacca

SEQ ID NO: 1330520 - RNA, 23 nt, Human
cacccagggcccauaccacgucc

SEQ ID NO: 1330521 - RNA, 21 nt, Human
caccccaacccaugaucccau

SEQ ID NO: 1330522 - RNA, 25 nt, Human
cacccccucccccgcacgcaagguc

SEQ ID NO: 1330523 - RNA, 19 nt, Human
cacccgucccaccccaccc

SEQ ID NO: 1330524 - RNA, 21 nt, Human
cacuaccauuaaauaacaggg

SEQ ID NO: 1330525 - RNA, 18 nt, Human
cacuccucaagcccucac

SEQ ID NO: 1330526 - RNA, 20 nt, Human
cagacaaagcucucauuagc

SEQ ID NO: 1330527 - RNA, 22 nt, Human
cagcacagcugccgaaacuuga

SEQ ID NO: 1330528 - RNA, 22 nt, Human
cagcagcagcacagcugccgaa

SEQ ID NO: 1330529 - RNA, 23 nt, Human
cagcauaagacuggaaagccccc

SEQ ID NO: 1330530 - RNA, 25 nt, Human
cagcauaagacuggaaagcccccaa

SEQ ID NO: 1330531 - RNA, 24 nt, Human
caggacauccccaaaaggucccaa

SEQ ID NO: 1330532 - RNA, 22 nt, Human
caggguucuccauuauuuuuuc

SEQ ID NO: 1330533 - RNA, 24 nt, Human
ccaaagaaugggaaccugcccacc

SEQ ID NO: 1330534 - RNA, 19 nt, Human
ccaaagagaaauauaaccc

SEQ ID NO: 1330535 - RNA, 23 nt, Human
ccaagggcacccugucccugcug

SEQ ID NO: 1330536 - RNA, 19 nt, Human
ccacagaaauggugcuggg

SEQ ID NO: 1330537 - RNA, 27 nt, Human
ccaggcccagggccaagagcgccuccu

SEQ ID NO: 1330538 - RNA, 24 nt, Human
ccagguccuucccaggguucucca

SEQ ID NO: 1330539 - RNA, 25 nt, Human
cccaaagaaugggaaccugcccacc

SEQ ID NO: 1330540 - RNA, 22 nt, Human
cccaaguuggggcuaagaaggc

SEQ ID NO: 1330541 - RNA, 20 nt, Human
cccaccccacccucaggggc

SEQ ID NO: 1330542 - RNA, 21 nt, Human
cccagggaagcacuauagaga

SEQ ID NO: 1330543 - RNA, 22 nt, Human
ccccaaagaaugggaaccugcc

SEQ ID NO: 1330544 - RNA, 21 nt, Human
cccccauggcugaagccacag

SEQ ID NO: 1330545 - RNA, 21 nt, Human
ccccuuccucuuuuaagcacc

SEQ ID NO: 1330546 - RNA, 22 nt, Human
cccucugccauaaguuggccuc

SEQ ID NO: 1330547 - RNA, 21 nt, Human
ccucacaaagggcugcugccu

SEQ ID NO: 1330548 - RNA, 28 nt, Human
ccucccagccccaaagaaugggaaccug

SEQ ID NO: 1330549 - RNA, 22 nt, Human
ccucugaguggcugugcagcuc

SEQ ID NO: 1330550 - RNA, 19 nt, Human
ccugagggcaccuauuaaa

SEQ ID NO: 1330551 - RNA, 18 nt, Human
ccugccugcaguggagag

SEQ ID NO: 1330552 - RNA, 27 nt, Human
ccugcuaggacaccgacuaucccccaa

SEQ ID NO: 1330553 - RNA, 21 nt, Human
ccuucggacucuuugccuccu

SEQ ID NO: 1330554 - RNA, 25 nt, Human
cgagcacccccucccccgcacgcaa

SEQ ID NO: 1330555 - RNA, 22 nt, Human
cuagcugacacccacagcauaa

SEQ ID NO: 1330556 - RNA, 24 nt, Human
cuaggcccacagaaauggugcugg

SEQ ID NO: 1330557 - RNA, 20 nt, Human
cuccagguguccaaagugcu

SEQ ID NO: 1330558 - RNA, 22 nt, Human
cucugccauaaguuggccucag

SEQ ID NO: 1330559 - RNA, 19 nt, Human
cugaucagacaaagcucuc

SEQ ID NO: 1330560 - RNA, 19 nt, Human
cugauggacccaggacuga

SEQ ID NO: 1330561 - RNA, 20 nt, Human
cugucccugcugccaagccc

SEQ ID NO: 1330562 - RNA, 18 nt, Human
cuuggugagagaggcugu

SEQ ID NO: 1330563 - RNA, 20 nt, Human
cuuuguucccaaguuggggc

SEQ ID NO: 1330564 - RNA, 22 nt, Human
gaaccugcccaccaguggcacc

SEQ ID NO: 1330565 - RNA, 24 nt, Human
gaagcagcagaucugugccauuaa

SEQ ID NO: 1330566 - RNA, 19 nt, Human
gagcagcccauccagcagc

SEQ ID NO: 1330567 - RNA, 22 nt, Human
gagccaccagaggcccugaggc

SEQ ID NO: 1330568 - RNA, 23 nt, Human
gaggagccuggcugagagggcgu

SEQ ID NO: 1330569 - RNA, 23 nt, Human
gcacccccucccccgcacgcaag

SEQ ID NO: 1330570 - RNA, 22 nt, Human
gcagaaugcggcagccucuccu

SEQ ID NO: 1330571 - RNA, 24 nt, Human
gcagaaugugggcaccugcaccca

SEQ ID NO: 1330572 - RNA, 23 nt, Human
gcagcaaaucccaggccuuccca

SEQ ID NO: 1330573 - RNA, 21 nt, Human
gcagccaaaaugacuaaaacc

SEQ ID NO: 1330574 - RNA, 19 nt, Human
gcagcccauccagcagcag

SEQ ID NO: 1330575 - RNA, 18 nt, Human
gcccagggaagcacuaua

SEQ ID NO: 1330576 - RNA, 21 nt, Human
gcuuggcccagggaagcacua

SEQ ID NO: 1330577 - RNA, 23 nt, Human
ggaaagggaccucugaguggcug

SEQ ID NO: 1330578 - RNA, 22 nt, Human
ggacaccgacuaucccccacuu

SEQ ID NO: 1330579 - RNA, 21 nt, Human
ggacagggcucucuggcaugg

SEQ ID NO: 1330580 - RNA, 22 nt, Human
ggacccaggacugaucagacaa

SEQ ID NO: 1330581 - RNA, 21 nt, Human
ggagggaguggccuucuuagg

SEQ ID NO: 1330582 - RNA, 21 nt, Human
ggcacccagagcccucuacuu

SEQ ID NO: 1330583 - RNA, 18 nt, Human
ggcauggggcaaaagcuc

SEQ ID NO: 1330584 - RNA, 22 nt, Human
ggccagagccaccagaggcccu

SEQ ID NO: 1330585 - RNA, 18 nt, Human
ggccuggggaaaugagac

SEQ ID NO: 1330586 - RNA, 24 nt, Human
ggcuggugucagcuuggcccaggg

SEQ ID NO: 1330587 - RNA, 22 nt, Human
gggaagcacuauagagagggcu

SEQ ID NO: 1330588 - RNA, 22 nt, Human
gggagggaguggccuucuuagg

SEQ ID NO: 1330589 - RNA, 21 nt, Human
gggagggguggggucccuggc

SEQ ID NO: 1330590 - RNA, 19 nt, Human
gggcguggaggggcccugc

SEQ ID NO: 1330591 - RNA, 24 nt, Human
gggcuuacaguuccccgagaagca

SEQ ID NO: 1330592 - RNA, 20 nt, Human
gguucugggggcccagaaca

SEQ ID NO: 1330593 - RNA, 20 nt, Human
gucccaaacaguuccagacc

SEQ ID NO: 1330594 - RNA, 23 nt, Human
guccccuuccucuuuuaagcacc

SEQ ID NO: 1330595 - RNA, 19 nt, Human
guggcugugcagcuccacc

SEQ ID NO: 1330596 - RNA, 21 nt, Human
uaaccaaauuguacagcuuua

SEQ ID NO: 1330597 - RNA, 22 nt, Human
uacagaaaggagcgggcucgga

SEQ ID NO: 1330598 - RNA, 23 nt, Human
uacaggagagaagacuguaauuu

SEQ ID NO: 1330599 - RNA, 21 nt, Human
uaccuuuaaagccaaacaggc

SEQ ID NO: 1330600 - RNA, 21 nt, Human
uaggacaggugccaaccuguc

SEQ ID NO: 1330601 - RNA, 19 nt, Human
ucacaaagggcugcugccc

SEQ ID NO: 1330602 - RNA, 20 nt, Human
ucaccugagcaccccaaccc

SEQ ID NO: 1330603 - RNA, 18 nt, Human
ucagcagggcccugcagc

SEQ ID NO: 1330604 - RNA, 19 nt, Human
ucaggagugagcgcgugag

SEQ ID NO: 1330605 - RNA, 19 nt, Human
ucaguggggugggagggag

SEQ ID NO: 1330606 - RNA, 18 nt, Human
uccaggcuacagcuaaaa

SEQ ID NO: 1330607 - RNA, 22 nt, Human
ucccaccccacccucaggggcu

SEQ ID NO: 1330608 - RNA, 22 nt, Human
ucccugcugccaagcccaccag

SEQ ID NO: 1330609 - RNA, 20 nt, Human
ucucauuagcagaauguggg

SEQ ID NO: 1330610 - RNA, 24 nt, Human
ucuccagguguccaaagugcuggu

SEQ ID NO: 1330611 - RNA, 23 nt, Human
ugaggaaagcaugaaggaaugag

SEQ ID NO: 1330612 - RNA, 21 nt, Human
ugaggagcagcagaaugcggc

SEQ ID NO: 1330613 - RNA, 18 nt, Human
ugaggagccuggcugaga

SEQ ID NO: 1330614 - RNA, 22 nt, Human
ugagggccauauucuaggccca

SEQ ID NO: 1330615 - RNA, 26 nt, Human
ugaucagacaaagcucucauuagcag

SEQ ID NO: 1330616 - RNA, 24 nt, Human
ugcagcuuugcucgcugugaggag

SEQ ID NO: 1330617 - RNA, 21 nt, Human
ugcagucagcccuguggugcc

SEQ ID NO: 1330618 - RNA, 18 nt, Human
ugccaggccccuugaugg

SEQ ID NO: 1330619 - RNA, 18 nt, Human
ugcggcagccucuccucc

SEQ ID NO: 1330620 - RNA, 26 nt, Human
uggaaagcccccaagaaaugggcacc

SEQ ID NO: 1330621 - RNA, 20 nt, Human
uggaaagggaccucugagug

SEQ ID NO: 1330622 - RNA, 22 nt, Human
uggaaagggaccucugaguggc

SEQ ID NO: 1330623 - RNA, 21 nt, Human
uggaggaagggcauggggcaa

SEQ ID NO: 1330624 - RNA, 22 nt, Human
uggcagggacagggcucucugg

SEQ ID NO: 1330625 - RNA, 21 nt, Human
uggcauggggcagggagaaag

SEQ ID NO: 1330626 - RNA, 22 nt, Human
uggccaucuguuagaagcagca

SEQ ID NO: 1330627 - RNA, 18 nt, Human
ugggaggagcagcccauc

SEQ ID NO: 1330628 - RNA, 20 nt, Human
uggggaaaugagacccugag

SEQ ID NO: 1330629 - RNA, 18 nt, Human
ugggggcccagaacaggg

SEQ ID NO: 1330630 - RNA, 19 nt, Human
uggggugggagggaguggc

SEQ ID NO: 1330631 - RNA, 21 nt, Human
ugggugcagcuuugcucgcug

SEQ ID NO: 1330632 - RNA, 24 nt, Human
ugucacgugccaacaggugccugg

SEQ ID NO: 1330633 - RNA, 18 nt, Human
uguggaggaagggcaugg

SEQ ID NO: 1330634 - RNA, 24 nt, Human
uuaaaagcaagucuguguguccuc

SEQ ID NO: 1330635 - RNA, 21 nt, Human
uuaccaaggcuucucacagcu

SEQ ID NO: 1330636 - RNA, 20 nt, Human
uucacuuuauauauauggau

SEQ ID NO: 1330637 - RNA, 20 nt, Human
uuuaaggaccaggaaaugag

SEQ ID NO: 1330638 - RNA, 20 nt, Human
uuucaggaauaggacaggug

SEQ ID NO: 1330639 - RNA, 19 nt, Human
acccacucuccuccauccc

SEQ ID NO: 1330640 - RNA, 28 nt, Human
acccacucuccuccaucccgcccuccaa

SEQ ID NO: 1330641 - RNA, 29 nt, Human
aggggcaggugcccggacauccccaaggg

SEQ ID NO: 1330642 - RNA, 25 nt, Human
caccaccaccagcgugccggccgcc

SEQ ID NO: 1330643 - RNA, 25 nt, Human
cagcaccaccaccaccagcgugccu

SEQ ID NO: 1330644 - RNA, 19 nt, Human
cagcaggcugguggccggg

SEQ ID NO: 1330645 - RNA, 20 nt, Human
cagcaggcugguggccgggg

SEQ ID NO: 1330646 - RNA, 20 nt, Human
cagcgugccggccgccagcc

SEQ ID NO: 1330647 - RNA, 22 nt, Human
cagcugcgccggcgggggcggc

SEQ ID NO: 1330648 - RNA, 24 nt, Human
cagugcccgucgcugaaguggucc

SEQ ID NO: 1330649 - RNA, 22 nt, Human
ccucacccacucuccuccaucc

SEQ ID NO: 1330650 - RNA, 22 nt, Human
cgcguccgggcgccuccucacc

SEQ ID NO: 1330651 - RNA, 22 nt, Human
cgggcgccuccucacccacucu

SEQ ID NO: 1330652 - RNA, 22 nt, Human
cucacccacucuccuccauccc

SEQ ID NO: 1330653 - RNA, 20 nt, Human
cuccaucccgcccuccaaaa

SEQ ID NO: 1330654 - RNA, 23 nt, Human
cuccgcguccgggcgccuccuca

SEQ ID NO: 1330655 - RNA, 24 nt, Human
cucuccuccaucccgcccuccaaa

SEQ ID NO: 1330656 - RNA, 25 nt, Human
cucuccuccaucccgcccuccaaaa

SEQ ID NO: 1330657 - RNA, 24 nt, Human
gcaccaccaccaccagcgugccgg

SEQ ID NO: 1330658 - RNA, 20 nt, Human
gccggggggcggcggacugg

SEQ ID NO: 1330659 - RNA, 23 nt, Human
gccuccucacccacucuccucca

SEQ ID NO: 1330660 - RNA, 21 nt, Human
gcuccacggucucaccugcgg

SEQ ID NO: 1330661 - RNA, 21 nt, Human
ggggguugcacuggccuuccg

SEQ ID NO: 1330662 - RNA, 24 nt, Human
uacuggucguacaggggguugcac

SEQ ID NO: 1330663 - RNA, 19 nt, Human
uccacggucucaccugcgg

SEQ ID NO: 1330664 - RNA, 18 nt, Human
ugcccggacaucaggcag

SEQ ID NO: 1330665 - RNA, 19 nt, Human
uugcacuggccuuccgcac

SEQ ID NO: 1330666 - RNA, 21 nt, Human
agcauagcccaggaaucugua

SEQ ID NO: 1330667 - RNA, 24 nt, Human
aggcccccugcuuaagagcagccc

SEQ ID NO: 1330668 - RNA, 24 nt, Human
augaaccaagagcugcgaagccca

SEQ ID NO: 1330669 - RNA, 25 nt, Human
caaaugcaacucgcggcccccgguu

SEQ ID NO: 1330670 - RNA, 18 nt, Human
cacugaugacccacacga

SEQ ID NO: 1330671 - RNA, 18 nt, Human
cagccccugacaauuucc

SEQ ID NO: 1330672 - RNA, 24 nt, Human
cagccccugacaauuucccuucuu

SEQ ID NO: 1330673 - RNA, 25 nt, Human
caggcccccugcuuaagagcagccc

SEQ ID NO: 1330674 - RNA, 21 nt, Human
caucugcucccaguucugcuc

SEQ ID NO: 1330675 - RNA, 19 nt, Human
ccacacacugaugacccac

SEQ ID NO: 1330676 - RNA, 21 nt, Human
cccccagcccgggcagggguu

SEQ ID NO: 1330677 - RNA, 18 nt, Human
ccccgccgcgcggaccgg

SEQ ID NO: 1330678 - RNA, 21 nt, Human
ccgccgccgcugccgcugcgc

SEQ ID NO: 1330679 - RNA, 21 nt, Human
ccgccggcggccgccgcugcc

SEQ ID NO: 1330680 - RNA, 22 nt, Human
ccgcuccgccgccuccuccggc

SEQ ID NO: 1330681 - RNA, 22 nt, Human
ccgcugccgcugcgcuggccgc

SEQ ID NO: 1330682 - RNA, 20 nt, Human
ccgcugcgcuggccgcugug

SEQ ID NO: 1330683 - RNA, 21 nt, Human
ccgcugcgcuggccgcugugg

SEQ ID NO: 1330684 - RNA, 24 nt, Human
ccugacaauuucccuucuucaccu

SEQ ID NO: 1330685 - RNA, 20 nt, Human
cgcccggggcgcaggagcag

SEQ ID NO: 1330686 - RNA, 18 nt, Human
cgccgccgcugccgcugc

SEQ ID NO: 1330687 - RNA, 18 nt, Human
cgccgccgcugccgcugc

SEQ ID NO: 1330688 - RNA, 19 nt, Human
cgcgcggaccggagcccgg

SEQ ID NO: 1330689 - RNA, 18 nt, Human
cgcuggccgcuguggcug

SEQ ID NO: 1330690 - RNA, 21 nt, Human
cgggcaucugcucccaguucu

SEQ ID NO: 1330691 - RNA, 19 nt, Human
cggggaccgggguguccgg

SEQ ID NO: 1330692 - RNA, 26 nt, Human
cguggacccgcuggcugcgcgcuccu

SEQ ID NO: 1330693 - RNA, 26 nt, Human
cuccaaaggcuacuucauugcgcucc

SEQ ID NO: 1330694 - RNA, 29 nt, Human
cuccucgccgcuccgccgccuccuccgau

SEQ ID NO: 1330695 - RNA, 19 nt, Human
cugcgcgcuccugcuccuc

SEQ ID NO: 1330696 - RNA, 23 nt, Human
gaccacacacugaugacccacac

SEQ ID NO: 1330697 - RNA, 19 nt, Human
gagcccccagcccgggcag

SEQ ID NO: 1330698 - RNA, 18 nt, Human
gcgggccgggcggcuggg

SEQ ID NO: 1330699 - RNA, 18 nt, Human
ggaagcgcgcccggggcg

SEQ ID NO: 1330700 - RNA, 19 nt, Human
ggccgggcggcuggggugc

SEQ ID NO: 1330701 - RNA, 19 nt, Human
gggcagggguguggaaggu

SEQ ID NO: 1330702 - RNA, 19 nt, Human
uacaaugaaccaagagcug

SEQ ID NO: 1330703 - RNA, 26 nt, Human
uacaaugaaccaagagcugcgaagcc

SEQ ID NO: 1330704 - RNA, 19 nt, Human
uacacagaauuucucuggg

SEQ ID NO: 1330705 - RNA, 19 nt, Human
uacacagugcuugaggucu

SEQ ID NO: 1330706 - RNA, 20 nt, Human
ucccgccggcggccgccgcu

SEQ ID NO: 1330707 - RNA, 20 nt, Human
uccgacgggcccucucccuu

SEQ ID NO: 1330708 - RNA, 23 nt, Human
ucgccgcuccgccgccuccuccg

SEQ ID NO: 1330709 - RNA, 22 nt, Human
ucugggguugagagccaagagc

SEQ ID NO: 1330710 - RNA, 18 nt, Human
ucuguggcagcauagccc

SEQ ID NO: 1330711 - RNA, 23 nt, Human
ucuguggcagcauagcccaggaa

SEQ ID NO: 1330712 - RNA, 21 nt, Human
ugcucccaguucugcucuccg

SEQ ID NO: 1330713 - RNA, 24 nt, Human
ugcugaccacacacugaugaccca

SEQ ID NO: 1330714 - RNA, 21 nt, Human
uggggugcgagcggugauggu

SEQ ID NO: 1330715 - RNA, 18 nt, Human
uugagagccaagagccgu

SEQ ID NO: 1330716 - RNA, 21 nt, Human
uugcugggucaugggcuacac

SEQ ID NO: 1330717 - RNA, 24 nt, Human
aaagugcugggauuacaggcguga

SEQ ID NO: 1330718 - RNA, 23 nt, Human
aaccucgcgacuccuuagccccu

SEQ ID NO: 1330719 - RNA, 19 nt, Human
aagugcugggauuacaggc

SEQ ID NO: 1330720 - RNA, 19 nt, Human
aagugcugggauuacaggc

SEQ ID NO: 1330721 - RNA, 26 nt, Human
aagugcugggauuacaggcgugagcc

SEQ ID NO: 1330722 - RNA, 23 nt, Human
accucagccucccaaagugcugg

SEQ ID NO: 1330723 - RNA, 25 nt, Human
agaaugucuccccguuuggguuggu

SEQ ID NO: 1330724 - RNA, 18 nt, Human
agucugcggcuccgcucu

SEQ ID NO: 1330725 - RNA, 19 nt, Human
agugauccacccaccucag

SEQ ID NO: 1330726 - RNA, 18 nt, Human
agugcugggauuacaggc

SEQ ID NO: 1330727 - RNA, 19 nt, Human
aucauuggagggaugucac

SEQ ID NO: 1330728 - RNA, 24 nt, Human
caaagugcugggauuacaggcgug

SEQ ID NO: 1330729 - RNA, 18 nt, Human
caccaugcccggcuccau

SEQ ID NO: 1330730 - RNA, 22 nt, Human
cacccaccucagccucccaaag

SEQ ID NO: 1330731 - RNA, 23 nt, Human
cacccaccucagccucccaaagu

SEQ ID NO: 1330732 - RNA, 23 nt, Human
cauaaacuugacacuuuugaagc

SEQ ID NO: 1330733 - RNA, 20 nt, Human
ccaaagugcugggauuacag

SEQ ID NO: 1330734 - RNA, 22 nt, Human
ccaaagugcugggauuacaggc

SEQ ID NO: 1330735 - RNA, 22 nt, Human
ccaaagugcugggauuacaggc

SEQ ID NO: 1330736 - RNA, 24 nt, Human
ccaaagugcugggauuacaggcgu

SEQ ID NO: 1330737 - RNA, 22 nt, Human
ccaccaugcccggcuccauagu

SEQ ID NO: 1330738 - RNA, 26 nt, Human
ccacccaccucagccucccaaagugc

SEQ ID NO: 1330739 - RNA, 25 nt, Human
ccacgcuccgccgccucgcccugga

SEQ ID NO: 1330740 - RNA, 20 nt, Human
ccagcacaccugacccuggc

SEQ ID NO: 1330741 - RNA, 21 nt, Human
ccagcacaccugacccuggcc

SEQ ID NO: 1330742 - RNA, 21 nt, Human
ccauuccuggccuuuuguucc

SEQ ID NO: 1330743 - RNA, 18 nt, Human
ccccgcuccagcacaccu

SEQ ID NO: 1330744 - RNA, 19 nt, Human
ccugccacgcuccgccgcc

SEQ ID NO: 1330745 - RNA, 18 nt, Human
ccugggcucaagugaucc

SEQ ID NO: 1330746 - RNA, 22 nt, Human
ccugggcucaagugauccaccc

SEQ ID NO: 1330747 - RNA, 24 nt, Human
ccugggcucaagugauccacccac

SEQ ID NO: 1330748 - RNA, 23 nt, Human
cgauacacuaccauuaacuaaau

SEQ ID NO: 1330749 - RNA, 22 nt, Human
cgcccuggaacccgggcccgga

SEQ ID NO: 1330750 - RNA, 19 nt, Human
cggcgccggcgcauggacc

SEQ ID NO: 1330751 - RNA, 25 nt, Human
cgugagccaccaugcccggcuccau

SEQ ID NO: 1330752 - RNA, 18 nt, Human
cguguuacccaggcuggu

SEQ ID NO: 1330753 - RNA, 23 nt, Human
cguguuacccaggcugguuacaa

SEQ ID NO: 1330754 - RNA, 21 nt, Human
cucaagugauccacccaccuc

SEQ ID NO: 1330755 - RNA, 24 nt, Human
cucaagugauccacccaccucagc

SEQ ID NO: 1330756 - RNA, 20 nt, Human
cucacgagacagcggccaug

SEQ ID NO: 1330757 - RNA, 21 nt, Human
cuccugggcucaagugaucca

SEQ ID NO: 1330758 - RNA, 18 nt, Human
cugccggggccgcgccgg

SEQ ID NO: 1330759 - RNA, 19 nt, Human
gaacccgggcccggacccc

SEQ ID NO: 1330760 - RNA, 18 nt, Human
gaccccgcuccagcacac

SEQ ID NO: 1330761 - RNA, 18 nt, Human
gauuacaggcgugagcca

SEQ ID NO: 1330762 - RNA, 21 nt, Human
gauuacaggcgugagccacca

SEQ ID NO: 1330763 - RNA, 24 nt, Human
gauuacaggcgugagccaccaugc

SEQ ID NO: 1330764 - RNA, 20 nt, Human
gcagccccucaaucugugug

SEQ ID NO: 1330765 - RNA, 19 nt, Human
gcgugagccaccaugcccg

SEQ ID NO: 1330766 - RNA, 20 nt, Human
gcuccgccgccucgcccugg

SEQ ID NO: 1330767 - RNA, 24 nt, Human
ggauuacaggcgugagccaccaug

SEQ ID NO: 1330768 - RNA, 20 nt, Human
ggcucaagugauccacccac

SEQ ID NO: 1330769 - RNA, 18 nt, Human
gggcucaagugauccacc

SEQ ID NO: 1330770 - RNA, 24 nt, Human
gucugcggcuccgcucugcccccg

SEQ ID NO: 1330771 - RNA, 24 nt, Human
gugauccacccaccucagccuccc

SEQ ID NO: 1330772 - RNA, 21 nt, Human
gugugucuuucauaaacuuga

SEQ ID NO: 1330773 - RNA, 23 nt, Human
uacaggcgugagccaccaugccc

SEQ ID NO: 1330774 - RNA, 18 nt, Human
ucagccucccaaagugcu

SEQ ID NO: 1330775 - RNA, 21 nt, Human
uccacccaccucagccuccca

SEQ ID NO: 1330776 - RNA, 24 nt, Human
ucccaaagugcugggauuacaggc

SEQ ID NO: 1330777 - RNA, 18 nt, Human
uccugggcucaagugauc

SEQ ID NO: 1330778 - RNA, 19 nt, Human
ucguguuacccaggcuggu

SEQ ID NO: 1330779 - RNA, 20 nt, Human
ucucacacugcauuuagcua

SEQ ID NO: 1330780 - RNA, 24 nt, Human
ugauccacccaccucagccuccca

SEQ ID NO: 1330781 - RNA, 24 nt, Human
ugcugggauuacaggcgugagcca

SEQ ID NO: 1330782 - RNA, 21 nt, Human
uggaacccgggcccggacccc

SEQ ID NO: 1330783 - RNA, 18 nt, Human
ugggauuacaggcgugag

SEQ ID NO: 1330784 - RNA, 22 nt, Human
ugggauuacaggcgugagccac

SEQ ID NO: 1330785 - RNA, 23 nt, Human
ugggauuacaggcgugagccacc

SEQ ID NO: 1330786 - RNA, 24 nt, Human
ugggauuacaggcgugagccacca

SEQ ID NO: 1330787 - RNA, 25 nt, Human
ugggauuacaggcgugagccaccau

SEQ ID NO: 1330788 - RNA, 23 nt, Human
ugggggaaccucgcgacuccuua

SEQ ID NO: 1330789 - RNA, 24 nt, Human
ugggguuuugucguguuacccagg

SEQ ID NO: 1330790 - RNA, 31 nt, Human
ugucguguuacccaggcugguuacaaacucc

SEQ ID NO: 1330791 - RNA, 19 nt, Human
ugucuucuuugucuccucc

SEQ ID NO: 1330792 - RNA, 23 nt, Human
uugccugccacgcuccgccgccu

SEQ ID NO: 1330793 - RNA, 19 nt, Human
uuucauaaacuugacacuu

SEQ ID NO: 1330794 - RNA, 22 nt, Human
aaccacugcacuaccugacuca

SEQ ID NO: 1330795 - RNA, 19 nt, Human
aaccagaccucaucagccc

SEQ ID NO: 1330796 - RNA, 22 nt, Human
aagcaggacaugacaugguccg

SEQ ID NO: 1330797 - RNA, 22 nt, Human
agaccagacuaggcgaggcggg

SEQ ID NO: 1330798 - RNA, 18 nt, Human
agacgccagguccggugg

SEQ ID NO: 1330799 - RNA, 18 nt, Human
agaggaaccagaccucau

SEQ ID NO: 1330800 - RNA, 22 nt, Human
agcugccgaaggccaagacgcc

SEQ ID NO: 1330801 - RNA, 18 nt, Human
aggcgaggcgggcggggc

SEQ ID NO: 1330802 - RNA, 23 nt, Human
agugaaugagcucucaggaggga

SEQ ID NO: 1330803 - RNA, 26 nt, Human
caaagacaccaucggaacuggagacc

SEQ ID NO: 1330804 - RNA, 21 nt, Human
cacaacaugaaagaaauggug

SEQ ID NO: 1330805 - RNA, 19 nt, Human
cacacuauggcugcccucu

SEQ ID NO: 1330806 - RNA, 21 nt, Human
cacccaccccgcaccggcgac

SEQ ID NO: 1330807 - RNA, 24 nt, Human
cacccaccccgcaccggcgacucc

SEQ ID NO: 1330808 - RNA, 21 nt, Human
caccgcucagccccuggggcu

SEQ ID NO: 1330809 - RNA, 19 nt, Human
cagaacccacaacaugaaa

SEQ ID NO: 1330810 - RNA, 22 nt, Human
cagagcccguggccaaggcggg

SEQ ID NO: 1330811 - RNA, 23 nt, Human
cagcacccaccccgcaccggcga

SEQ ID NO: 1330812 - RNA, 18 nt, Human
cagccccuggggcuggcu

SEQ ID NO: 1330813 - RNA, 24 nt, Human
caucaaagacaccaucggaacagc

SEQ ID NO: 1330814 - RNA, 18 nt, Human
ccccgcaccggcgacucc

SEQ ID NO: 1330815 - RNA, 22 nt, Human
cccgcagcacccaccccgcacc

SEQ ID NO: 1330816 - RNA, 19 nt, Human
ccucuagcuuggaaaugaa

SEQ ID NO: 1330817 - RNA, 20 nt, Human
ccugaacaccuuaggcuggu

SEQ ID NO: 1330818 - RNA, 21 nt, Human
cgaggccaggucuccagcugg

SEQ ID NO: 1330819 - RNA, 20 nt, Human
cgcagcacccaccccgcacc

SEQ ID NO: 1330820 - RNA, 21 nt, Human
cucccagaacccacaacauga

SEQ ID NO: 1330821 - RNA, 21 nt, Human
cucucaggagggaggauggug

SEQ ID NO: 1330822 - RNA, 20 nt, Human
cuggccuccagagcccgugg

SEQ ID NO: 1330823 - RNA, 19 nt, Human
gaaucggcucuggaagcua

SEQ ID NO: 1330824 - RNA, 18 nt, Human
gagcccguggccaaggcg

SEQ ID NO: 1330825 - RNA, 20 nt, Human
gagcgcagcgggcggcgagc

SEQ ID NO: 1330826 - RNA, 22 nt, Human
gaggaggcgcguccggccuucc

SEQ ID NO: 1330827 - RNA, 20 nt, Human
gcgacggagccgggaucggu

SEQ ID NO: 1330828 - RNA, 22 nt, Human
gcggacgguugaccaccagcca

SEQ ID NO: 1330829 - RNA, 19 nt, Human
ggcccacaguggacuuggu

SEQ ID NO: 1330830 - RNA, 18 nt, Human
ggcggggcggagugaaug

SEQ ID NO: 1330831 - RNA, 19 nt, Human
gggcggcgagcgggaggca

SEQ ID NO: 1330832 - RNA, 18 nt, Human
ggggcugcggcaagaagc

SEQ ID NO: 1330833 - RNA, 18 nt, Human
gucccacgaggcacugcg

SEQ ID NO: 1330834 - RNA, 19 nt, Human
uacaaccacugcacuaccu

SEQ ID NO: 1330835 - RNA, 23 nt, Human
ucagcccaacaucaaagacacca

SEQ ID NO: 1330836 - RNA, 20 nt, Human
uccugaacaccuuaggcugg

SEQ ID NO: 1330837 - RNA, 21 nt, Human
ucggugccucagcguucgggc

SEQ ID NO: 1330838 - RNA, 19 nt, Human
ucuggugcggagagggccc

SEQ ID NO: 1330839 - RNA, 19 nt, Human
ugacaugguccggugugac

SEQ ID NO: 1330840 - RNA, 20 nt, Human
ugacaugguccggugugacg

SEQ ID NO: 1330841 - RNA, 20 nt, Human
ugaggagcgcagcgggcggc

SEQ ID NO: 1330842 - RNA, 23 nt, Human
ugcccucugggcucccagaaccc

SEQ ID NO: 1330843 - RNA, 20 nt, Human
ugccgaaggccaagacgcca

SEQ ID NO: 1330844 - RNA, 24 nt, Human
ugccgaaggccaagacgccagguc

SEQ ID NO: 1330845 - RNA, 21 nt, Human
uggccaaggcgggccucgcgg

SEQ ID NO: 1330846 - RNA, 20 nt, Human
uggggcgagaccagacuagg

SEQ ID NO: 1330847 - RNA, 19 nt, Human
ugggguggacgugcccacc

SEQ ID NO: 1330848 - RNA, 25 nt, Human
uggugcggagagggcccacagugga

SEQ ID NO: 1330849 - RNA, 25 nt, Human
ugguggggcugcggcaagaagcggg

SEQ ID NO: 1330850 - RNA, 18 nt, Human
uguuucuuuacuuccucc

SEQ ID NO: 1330851 - RNA, 28 nt, Human
aaagaggacagaugguuuuccuuaauag

SEQ ID NO: 1330852 - RNA, 19 nt, Human
agagcucuuuucauuugac

SEQ ID NO: 1330853 - RNA, 24 nt, Human
aggugcagucuucaguuugggcug

SEQ ID NO: 1330854 - RNA, 19 nt, Human
auggagacacuguuggugg

SEQ ID NO: 1330855 - RNA, 18 nt, Human
cacugcugauguaguggu

SEQ ID NO: 1330856 - RNA, 21 nt, Human
cagaugggacagaagguucuu

SEQ ID NO: 1330857 - RNA, 20 nt, Human
cagggggcugcuuggccuug

SEQ ID NO: 1330858 - RNA, 23 nt, Human
ccacagagacuacagacaguggu

SEQ ID NO: 1330859 - RNA, 26 nt, Human
ccucagggggcugcuuggccuuggcu

SEQ ID NO: 1330860 - RNA, 21 nt, Human
cuagagcucuuuucauuugac

SEQ ID NO: 1330861 - RNA, 21 nt, Human
cugcagagguuuuccagaucc

SEQ ID NO: 1330862 - RNA, 21 nt, Human
cuuugcucucugaacugggac

SEQ ID NO: 1330863 - RNA, 23 nt, Human
cuuuuuaggcucaggugccuugg

SEQ ID NO: 1330864 - RNA, 22 nt, Human
gaacugggaccaggaugugaaa

SEQ ID NO: 1330865 - RNA, 20 nt, Human
ggaauaucagguuuuguugu

SEQ ID NO: 1330866 - RNA, 23 nt, Human
gggauuaaaaccacagagacuac

SEQ ID NO: 1330867 - RNA, 19 nt, Human
gugcagucuucaguuuggg

SEQ ID NO: 1330868 - RNA, 21 nt, Human
uaaaaccacagagacuacaga

SEQ ID NO: 1330869 - RNA, 18 nt, Human
uacaaggucagugguugg

SEQ ID NO: 1330870 - RNA, 19 nt, Human
uaccuccguuaaaugagga

SEQ ID NO: 1330871 - RNA, 18 nt, Human
uagaaucaaaugggcuga

SEQ ID NO: 1330872 - RNA, 22 nt, Human
ucagggggcugcuuggccuugg

SEQ ID NO: 1330873 - RNA, 19 nt, Human
ucagguuuuguuguugcug

SEQ ID NO: 1330874 - RNA, 19 nt, Human
ucugccucagggggcugcu

SEQ ID NO: 1330875 - RNA, 19 nt, Human
ucugcuguggcugugggga

SEQ ID NO: 1330876 - RNA, 22 nt, Human
ucuuugggaggggcuggcuugg

SEQ ID NO: 1330877 - RNA, 18 nt, Human
ugacaguucaaacagagc

SEQ ID NO: 1330878 - RNA, 22 nt, Human
ugaugaugaagauacaagguca

SEQ ID NO: 1330879 - RNA, 23 nt, Human
ugcaacagaaguucagugguauu

SEQ ID NO: 1330880 - RNA, 22 nt, Human
ugcuuugguuuaucaucagcaa

SEQ ID NO: 1330881 - RNA, 18 nt, Human
uggaaaacucugugaggg

SEQ ID NO: 1330882 - RNA, 19 nt, Human
uggagccagauccccgccu

SEQ ID NO: 1330883 - RNA, 22 nt, Human
uggcuuuuuaggcucaggugcc

SEQ ID NO: 1330884 - RNA, 20 nt, Human
ugggaggggcuggcuuggac

SEQ ID NO: 1330885 - RNA, 21 nt, Human
uggggaugauuugcucacugc

SEQ ID NO: 1330886 - RNA, 20 nt, Human
uuugacaguucaaacagagc

SEQ ID NO: 1330887 - RNA, 18 nt, Human
uuuggagcuuggaauauc

SEQ ID NO: 1330888 - RNA, 20 nt, Human
uuugggcuggggugaugacg

SEQ ID NO: 1330889 - RNA, 23 nt, Human
auauauaaaagcaaucaaucaaa

SEQ ID NO: 1330890 - RNA, 22 nt, Human
uacagaggcacuucaacagcua

SEQ ID NO: 1330891 - RNA, 19 nt, Human
aaaaagacuucugcacccc

SEQ ID NO: 1330892 - RNA, 20 nt, Human
aaaccccccagacaaggggg

SEQ ID NO: 1330893 - RNA, 20 nt, Human
aagaucacggaaaaaucacc

SEQ ID NO: 1330894 - RNA, 19 nt, Human
acgcaaucgcaggugggga

SEQ ID NO: 1330895 - RNA, 21 nt, Human
acuccaagaagccacugaggg

SEQ ID NO: 1330896 - RNA, 22 nt, Human
agguggggaacucggccugggc

SEQ ID NO: 1330897 - RNA, 24 nt, Human
aggugguugagagcacagucacag

SEQ ID NO: 1330898 - RNA, 20 nt, Human
auaaaaaccccccagacaag

SEQ ID NO: 1330899 - RNA, 23 nt, Human
auaaaaagacuucugcaccccca

SEQ ID NO: 1330900 - RNA, 22 nt, Human
auacauauauaugauaugcgca

SEQ ID NO: 1330901 - RNA, 20 nt, Human
auagagauaaaaagacuucu

SEQ ID NO: 1330902 - RNA, 21 nt, Human
auaugcgcaucuauauaugua

SEQ ID NO: 1330903 - RNA, 18 nt, Human
caaaagcaccacagagac

SEQ ID NO: 1330904 - RNA, 21 nt, Human
cacagagacagcucgggccag

SEQ ID NO: 1330905 - RNA, 27 nt, Human
caccacagagacagcucgggccaacuu

SEQ ID NO: 1330906 - RNA, 27 nt, Human
cacugagggugggugugaguggguucu

SEQ ID NO: 1330907 - RNA, 21 nt, Human
cagcagacucuuggugggugu

SEQ ID NO: 1330908 - RNA, 22 nt, Human
ccacagagacagcucgggccag

SEQ ID NO: 1330909 - RNA, 23 nt, Human
ccaggcccgacgcugagguacgc

SEQ ID NO: 1330910 - RNA, 19 nt, Human
ccccagacaaggggggggg

SEQ ID NO: 1330911 - RNA, 24 nt, Human
ccccccagacaagggggggggaca

SEQ ID NO: 1330912 - RNA, 24 nt, Human
cccccgaagacucaaucuugauuu

SEQ ID NO: 1330913 - RNA, 22 nt, Human
cccgacagccguaguuucuucu

SEQ ID NO: 1330914 - RNA, 19 nt, Human
cccgcccccagguaugagg

SEQ ID NO: 1330915 - RNA, 21 nt, Human
ccgacagccguaguuucuucu

SEQ ID NO: 1330916 - RNA, 22 nt, Human
ccucccuccucugaauggaagc

SEQ ID NO: 1330917 - RNA, 23 nt, Human
ccuccuguccucccuccucugaa

SEQ ID NO: 1330918 - RNA, 18 nt, Human
ccucugaauggaagcagg

SEQ ID NO: 1330919 - RNA, 24 nt, Human
cuccaagaagccacugaggguggg

SEQ ID NO: 1330920 - RNA, 21 nt, Human
cucggccugggcucucuuggc

SEQ ID NO: 1330921 - RNA, 21 nt, Human
cugcacccccaacccgccccc

SEQ ID NO: 1330922 - RNA, 22 nt, Human
cuuaagaggugacuccaagaag

SEQ ID NO: 1330923 - RNA, 21 nt, Human
gaagcaggugguugagagcac

SEQ ID NO: 1330924 - RNA, 20 nt, Human
gaaguggggguaagggaggg

SEQ ID NO: 1330925 - RNA, 20 nt, Human
gacuccaagaagccacugag

SEQ ID NO: 1330926 - RNA, 18 nt, Human
gagggcaaaagcaccaca

SEQ ID NO: 1330927 - RNA, 20 nt, Human
gcacccccaacccgccccca

SEQ ID NO: 1330928 - RNA, 20 nt, Human
gggaacggguagcaaagggg

SEQ ID NO: 1330929 - RNA, 19 nt, Human
gggaaguggggguaaggga

SEQ ID NO: 1330930 - RNA, 28 nt, Human
guacuuaagaggugacuccaagaagcca

SEQ ID NO: 1330931 - RNA, 19 nt, Human
uaaaaacaaagagaaaaua

SEQ ID NO: 1330932 - RNA, 24 nt, Human
uagaguuuuaaaaacaaagagaaa

SEQ ID NO: 1330933 - RNA, 25 nt, Human
uauagagauaaaaagacuucugcac

SEQ ID NO: 1330934 - RNA, 23 nt, Human
uauuuguucgacgcaaucgcagg

SEQ ID NO: 1330935 - RNA, 21 nt, Human
ucacggaaaaaucacccgaca

SEQ ID NO: 1330936 - RNA, 21 nt, Human
ucucuuggcagguguguccag

SEQ ID NO: 1330937 - RNA, 21 nt, Human
ucugcacccccaacccgcccc

SEQ ID NO: 1330938 - RNA, 23 nt, Human
ugacuccaagaagccacugaggg

SEQ ID NO: 1330939 - RNA, 21 nt, Human
ugagggcaaaagcaccacaga

SEQ ID NO: 1330940 - RNA, 20 nt, Human
ugagggugggugugaguggg

SEQ ID NO: 1330941 - RNA, 18 nt, Human
ugcacccccaacccgccc

SEQ ID NO: 1330942 - RNA, 21 nt, Human
ugcacccccaacccgccccca

SEQ ID NO: 1330943 - RNA, 24 nt, Human
ugcuugggggaacggguagcaaag

SEQ ID NO: 1330944 - RNA, 23 nt, Human
uggaccauaaauacauauauaug

SEQ ID NO: 1330945 - RNA, 18 nt, Human
uggcagguguguccagca

SEQ ID NO: 1330946 - RNA, 18 nt, Human
uggggaaguggggguaag

SEQ ID NO: 1330947 - RNA, 22 nt, Human
uggggaaguggggguaagggag

SEQ ID NO: 1330948 - RNA, 23 nt, Human
uggggccagaucccaagugagua

SEQ ID NO: 1330949 - RNA, 21 nt, Human
ugggggaacggguagcaaagg

SEQ ID NO: 1330950 - RNA, 22 nt, Human
uuaagaucacggaaaaaucacc

SEQ ID NO: 1330951 - RNA, 18 nt, Human
uucugagguuuggaccau

SEQ ID NO: 1330952 - RNA, 22 nt, Human
uucugcacccccaacccgcccc

SEQ ID NO: 1330953 - RNA, 19 nt, Human
uugagagcacagucacagc

SEQ ID NO: 1330954 - RNA, 21 nt, Human
uugggggaacggguagcaaag

SEQ ID NO: 1330955 - RNA, 27 nt, Human
aaacuauagagugaagauaucagccaa

SEQ ID NO: 1330956 - RNA, 24 nt, Human
aaauagccugauaaauuacuagac

SEQ ID NO: 1330957 - RNA, 24 nt, Human
aaauuacuagacagccugcacuca

SEQ ID NO: 1330958 - RNA, 20 nt, Human
aacacaaagaugacaccagg

SEQ ID NO: 1330959 - RNA, 22 nt, Human
aacauaacaauuuaccaaacug

SEQ ID NO: 1330960 - RNA, 23 nt, Human
aagaugacaccaggaaaagauaa

SEQ ID NO: 1330961 - RNA, 22 nt, Human
aagcacuucaucaguagaaaua

SEQ ID NO: 1330962 - RNA, 20 nt, Human
aagcagucuucuucacaaug

SEQ ID NO: 1330963 - RNA, 22 nt, Human
acaaagauuuguuucucagaca

SEQ ID NO: 1330964 - RNA, 18 nt, Human
acacaauuuuuuuuguca

SEQ ID NO: 1330965 - RNA, 21 nt, Human
agcaagauccaaguucccuca

SEQ ID NO: 1330966 - RNA, 21 nt, Human
agcaccuaaguguugaggggu

SEQ ID NO: 1330967 - RNA, 24 nt, Human
agcaucuauuccauaaacuguacu

SEQ ID NO: 1330968 - RNA, 19 nt, Human
agggguuaaauaaccagca

SEQ ID NO: 1330969 - RNA, 18 nt, Human
auaagcagucuucuucac

SEQ ID NO: 1330970 - RNA, 19 nt, Human
augaaaucagacagcaaca

SEQ ID NO: 1330971 - RNA, 25 nt, Human
cacaguaucuucacucugagauaag

SEQ ID NO: 1330972 - RNA, 20 nt, Human
cagaugucauaauuguuaac

SEQ ID NO: 1330973 - RNA, 19 nt, Human
cagcaagauccaaguuccc

SEQ ID NO: 1330974 - RNA, 24 nt, Human
ccuugcugcaagcugguuuucuug

SEQ ID NO: 1330975 - RNA, 26 nt, Human
cuccuuuagcuucaaaguuggagggu

SEQ ID NO: 1330976 - RNA, 24 nt, Human
cuuuuauuuccaauucagugacug

SEQ ID NO: 1330977 - RNA, 27 nt, Human
guaaaguuguuccauuguggccuaaaa

SEQ ID NO: 1330978 - RNA, 24 nt, Human
gucauguugcaaccuuuuauuucc

SEQ ID NO: 1330979 - RNA, 19 nt, Human
gugaagauaucagccacag

SEQ ID NO: 1330980 - RNA, 23 nt, Human
guugcaaccuuuuauuuccaauu

SEQ ID NO: 1330981 - RNA, 23 nt, Human
uaaagaguuucccuccccaaucu

SEQ ID NO: 1330982 - RNA, 21 nt, Human
uaugaaaucagacagcaacaa

SEQ ID NO: 1330983 - RNA, 27 nt, Human
ucagguucuuuuaaccucuuuuuaauu

SEQ ID NO: 1330984 - RNA, 19 nt, Human
ucauguugcaaccuuuuau

SEQ ID NO: 1330985 - RNA, 23 nt, Human
ugaaaucagacagcaacaaugac

SEQ ID NO: 1330986 - RNA, 19 nt, Human
ugaagcacuucaucaguag

SEQ ID NO: 1330987 - RNA, 19 nt, Human
ugaauggugcugguaaaua

SEQ ID NO: 1330988 - RNA, 20 nt, Human
ugacaaguuaugaaguaguu

SEQ ID NO: 1330989 - RNA, 21 nt, Human
uggcagcaagauccaaguucc

SEQ ID NO: 1330990 - RNA, 21 nt, Human
ugggcaacacaaagaugacac

SEQ ID NO: 1330991 - RNA, 23 nt, Human
uugcugcaagcugguuuucuuga

SEQ ID NO: 1330992 - RNA, 20 nt, Human
uuugaacuaugauuuaguag

SEQ ID NO: 1330993 - RNA, 22 nt, Human
uuugaacuaugauuuaguagcc

SEQ ID NO: 1330994 - RNA, 22 nt, Human
uuuuuuugucauguugcaaccu

SEQ ID NO: 1330995 - RNA, 23 nt, Human
aaaauacgaaaacaaaauuagcc

SEQ ID NO: 1330996 - RNA, 23 nt, Human
aaaauagcauuaucaaaauggca

SEQ ID NO: 1330997 - RNA, 18 nt, Human
aaagcagcacaguguaac

SEQ ID NO: 1330998 - RNA, 24 nt, Human
aacagagcgagacucugucucaaa

SEQ ID NO: 1330999 - RNA, 19 nt, Human
aacauggugaaaccccguc

SEQ ID NO: 1331000 - RNA, 20 nt, Human
aacauggugaaaccccgucu

SEQ ID NO: 1331001 - RNA, 21 nt, Human
aacauggugaaaccccgucuc

SEQ ID NO: 1331002 - RNA, 21 nt, Human
aacuaacuucuagugaaccua

SEQ ID NO: 1331003 - RNA, 21 nt, Human
aagagaaagacagagaaagga

SEQ ID NO: 1331004 - RNA, 24 nt, Human
aauaaaugcugaugcuccacacaa

SEQ ID NO: 1331005 - RNA, 24 nt, Human
aaucuggguaacagagcgagacuc

SEQ ID NO: 1331006 - RNA, 18 nt, Human
acacagugauaacuacuc

SEQ ID NO: 1331007 - RNA, 25 nt, Human
acagaacuuuguuguuaacugugga

SEQ ID NO: 1331008 - RNA, 21 nt, Human
acagagcgagacucugucuca

SEQ ID NO: 1331009 - RNA, 24 nt, Human
acagagcgagacucugucucaaaa

SEQ ID NO: 1331010 - RNA, 30 nt, Human; identical to SEQ ID NO: 778035

SEQ ID NO: 1331011 - RNA, 24 nt, Human
acaguaaaaagaucacuacauaga

SEQ ID NO: 1331012 - RNA, 21 nt, Human
acccaaggagaaagcaucagg

SEQ ID NO: 1331013 - RNA, 22 nt, Human
accccgucucuacuaaaaauac

SEQ ID NO: 1331014 - RNA, 28 nt, Human
acucugucucaaaaaaaaaaaaaaaaaa

SEQ ID NO: 1331015 - RNA, 18 nt, Human
acugcacuccaaucuggg

SEQ ID NO: 1331016 - RNA, 24 nt, Human
acugcacuccaaucuggguaacag

SEQ ID NO: 1331017 - RNA, 23 nt, Human
acuuauuuugcuuaauacaagug

SEQ ID NO: 1331018 - RNA, 20 nt, Human
agaaaaugcaaaauuuagca

SEQ ID NO: 1331019 - RNA, 21 nt, Human
agagaaaaugcaaaauuuagc

SEQ ID NO: 1331020 - RNA, 21 nt, Human
agagaaagacagagaaaggaa

SEQ ID NO: 1331021 - RNA, 19 nt, Human
agaggaaaugcuggguuuc

SEQ ID NO: 1331022 - RNA, 22 nt, Human
agcaucaacaaaacccagcacc

SEQ ID NO: 1331023 - RNA, 23 nt, Human
agcucugacaccucacuaccucu

SEQ ID NO: 1331024 - RNA, 23 nt, Human
agcuuuugggaggcugaggcggg

SEQ ID NO: 1331025 - RNA, 23 nt, Human
aggcauuuaaaaagaacuuaauc

SEQ ID NO: 1331026 - RNA, 24 nt, Human
aggcggagcuugcagugagcggag

SEQ ID NO: 1331027 - RNA, 24 nt, Human
aggcgggagaguggcgugaacccg

SEQ ID NO: 1331028 - RNA, 24 nt, Human
aggcgggcggaucacgaggucaag

SEQ ID NO: 1331029 - RNA, 21 nt, Human
aggcugaggcgggcggaucac

SEQ ID NO: 1331030 - RNA, 22 nt, Human
aggcugaggcgggcggaucacg

SEQ ID NO: 1331031 - RNA, 21 nt, Human
agggagcuuuguguaagugcu

SEQ ID NO: 1331032 - RNA, 22 nt, Human
aucaacaaaacccagcaccaag

SEQ ID NO: 1331033 - RNA, 19 nt, Human
aucccucucauccucuuuc

SEQ ID NO: 1331034 - RNA, 21 nt, Human
auccuggccaacauggugaaa

SEQ ID NO: 1331035 - RNA, 24 nt, Human
aucgcgccacugcacuccaaucug

SEQ ID NO: 1331036 - RNA, 21 nt, Human
augcaaaauuuagcauguaau

SEQ ID NO: 1331037 - RNA, 23 nt, Human
augcuggguuucugggugcuggc

SEQ ID NO: 1331038 - RNA, 23 nt, Human
auggcgggcgccuguagucccag

SEQ ID NO: 1331039 - RNA, 18 nt, Human
auuaaggaacuggcucug

SEQ ID NO: 1331040 - RNA, 20 nt, Human
auugcacucuugcuuugggc

SEQ ID NO: 1331041 - RNA, 24 nt, Human
auuuagcauguaauuguacugugu

SEQ ID NO: 1331042 - RNA, 22 nt, Human
caaaagaaaaagaccguguggc

SEQ ID NO: 1331043 - RNA, 18 nt, Human
caaaauggcaaaggcaca

SEQ ID NO: 1331044 - RNA, 25 nt, Human
caaagcagcacaguguaacagaggc

SEQ ID NO: 1331045 - RNA, 24 nt, Human
caacauggugaaaccccgucucua

SEQ ID NO: 1331046 - RNA, 24 nt, Human
caagaccauccuggccaacauggu

SEQ ID NO: 1331047 - RNA, 21 nt, Human
cacaguaguauugggacaaga

SEQ ID NO: 1331048 - RNA, 23 nt, Human
cacgccuguaaucccagcuuuug

SEQ ID NO: 1331049 - RNA, 23 nt, Human
cacuccaaucuggguaacagagc

SEQ ID NO: 1331050 - RNA, 23 nt, Human
cacugcacuccaaucuggguaac

SEQ ID NO: 1331051 - RNA, 24 nt, Human
cacugcacuccaaucuggguaaca

SEQ ID NO: 1331052 - RNA, 21 nt, Human
cagcaucaacaaaacccagca

SEQ ID NO: 1331053 - RNA, 22 nt, Human
cagcaucaacaaaacccagcac

SEQ ID NO: 1331054 - RNA, 21 nt, Human
cagcuaaucuaccaggaguac

SEQ ID NO: 1331055 - RNA, 21 nt, Human
cagcuuuugggaggcugaggc

SEQ ID NO: 1331056 - RNA, 23 nt, Human
cagcuuuugggaggcugaggcgg

SEQ ID NO: 1331057 - RNA, 18 nt, Human
ccacugcacuccaaucug

SEQ ID NO: 1331058 - RNA, 20 nt, Human
ccacugcacuccaaucuggg

SEQ ID NO: 1331059 - RNA, 24 nt, Human
ccacugcacuccaaucuggguaac

SEQ ID NO: 1331060 - RNA, 18 nt, Human
ccagaggaguaagauaau

SEQ ID NO: 1331061 - RNA, 23 nt, Human
ccagcaccaaguguuuugguggc

SEQ ID NO: 1331062 - RNA, 20 nt, Human
ccagcaucaacaaaacccag

SEQ ID NO: 1331063 - RNA, 18 nt, Human
ccagggacacagggaaga

SEQ ID NO: 1331064 - RNA, 24 nt, Human
ccaucccucucauccucuuucuca

SEQ ID NO: 1331065 - RNA, 23 nt, Human
ccccugagggguagugguuucug

SEQ ID NO: 1331066 - RNA, 19 nt, Human
ccucucauccucuuucuca

SEQ ID NO: 1331067 - RNA, 22 nt, Human
ccuggccaacauggugaaaccc

SEQ ID NO: 1331068 - RNA, 23 nt, Human
ccuggccaacauggugaaacccc

SEQ ID NO: 1331069 - RNA, 24 nt, Human
ccuggccaacauggugaaaccccg

SEQ ID NO: 1331070 - RNA, 19 nt, Human
ccuguagucccagcuaguc

SEQ ID NO: 1331071 - RNA, 21 nt, Human
ccuguagucccagcuagucgg

SEQ ID NO: 1331072 - RNA, 22 nt, Human
ccuguagucccagcuagucggg

SEQ ID NO: 1331073 - RNA, 21 nt, Human
cgaaaacaaaauuagccgggc

SEQ ID NO: 1331074 - RNA, 22 nt, Human
cgccuguaaucccagcuuuugg

SEQ ID NO: 1331075 - RNA, 23 nt, Human
cgccuguaaucccagcuuuuggg

SEQ ID NO: 1331076 - RNA, 21 nt, Human
cuacaaaagaaaaagaccgug

SEQ ID NO: 1331077 - RNA, 23 nt, Human
cucaaaaaaaaaaaaaaaaaaaa

SEQ ID NO: 1331078 - RNA, 20 nt, Human
cucacgccuguaaucccagc

SEQ ID NO: 1331079 - RNA, 20 nt, Human
cucacgccuguaaucccagc

SEQ ID NO: 1331080 - RNA, 20 nt, Human
cuccaccuuaaugcuggaac

SEQ ID NO: 1331081 - RNA, 19 nt, Human
cucugucucaaaaaaaaaa

SEQ ID NO: 1331082 - RNA, 19 nt, Human
cugaugcuuggccgggcgc

SEQ ID NO: 1331083 - RNA, 23 nt, Human
cugauuuacucacuuaaagcuuc

SEQ ID NO: 1331084 - RNA, 21 nt, Human
cuggguaacagagcgagacuc

SEQ ID NO: 1331085 - RNA, 25 nt, Human
cugugaaaaaaaggaagggaggugu

SEQ ID NO: 1331086 - RNA, 21 nt, Human
cuguuuaagcaaagcagcaca

SEQ ID NO: 1331087 - RNA, 18 nt, Human
cuuaauaaauucuuaguu

SEQ ID NO: 1331088 - RNA, 21 nt, Human
cuugcagugagcggagaucgc

SEQ ID NO: 1331089 - RNA, 19 nt, Human
cuuuguguaagugcucugc

SEQ ID NO: 1331090 - RNA, 21 nt, Human
gagaaagacagagaaaggaag

SEQ ID NO: 1331091 - RNA, 20 nt, Human
gcaaagacagcugaggggaa

SEQ ID NO: 1331092 - RNA, 24 nt, Human
gcaaagcagcacaguguaacagag

SEQ ID NO: 1331093 - RNA, 24 nt, Human
gccaacauggugaaaccccgucuc

SEQ ID NO: 1331094 - RNA, 24 nt, Human
gccacugcacuccaaucuggguaa

SEQ ID NO: 1331095 - RNA, 23 nt, Human
gccuguagucccagcuagucggg

SEQ ID NO: 1331096 - RNA, 20 nt, Human
gcggagaucgcgccacugca

SEQ ID NO: 1331097 - RNA, 23 nt, Human
gcugugcagaaauuuucuuggag

SEQ ID NO: 1331098 - RNA, 24 nt, Human
gcuuugggcuaaaaccuugugaag

SEQ ID NO: 1331099 - RNA, 25 nt, Human
gcuuuuggcaucuguagaacucuaa

SEQ ID NO: 1331100 - RNA, 20 nt, Human
ggaaaggacaagaagcuaca

SEQ ID NO: 1331101 - RNA, 23 nt, Human
ggagaucgcgccacugcacucca

SEQ ID NO: 1331102 - RNA, 18 nt, Human
ggagcuugcagugagcgg

SEQ ID NO: 1331103 - RNA, 24 nt, Human
ggagcuugcagugagcggagaucg

SEQ ID NO: 1331104 - RNA, 20 nt, Human
ggaguucuccaccuuaaugc

SEQ ID NO: 1331105 - RNA, 21 nt, Human
ggccgggcgcgguggcucacg

SEQ ID NO: 1331106 - RNA, 23 nt, Human
ggcgcgguggcucacgccuguaa

SEQ ID NO: 1331107 - RNA, 18 nt, Human
ggcgugauggcgggcgcc

SEQ ID NO: 1331108 - RNA, 21 nt, Human
ggcucacgccuguaaucccag

SEQ ID NO: 1331109 - RNA, 20 nt, Human
gggacaagaagcaaaacauu

SEQ ID NO: 1331110 - RNA, 19 nt, Human
gggcagcaccccacucaga

SEQ ID NO: 1331111 - RNA, 19 nt, Human
gggcggaucacgaggucaa

SEQ ID NO: 1331112 - RNA, 24 nt, Human
gggcgugauggcgggcgccuguag

SEQ ID NO: 1331113 - RNA, 23 nt, Human
gguggcucacgccuguaauccca

SEQ ID NO: 1331114 - RNA, 24 nt, Human
gguggcucacgccuguaaucccag

SEQ ID NO: 1331115 - RNA, 18 nt, Human
gucaagagaucaagacca

SEQ ID NO: 1331116 - RNA, 19 nt, Human
gucacauuauaccagcauc

SEQ ID NO: 1331117 - RNA, 20 nt, Human
gugcucgcuacagccaggcc

SEQ ID NO: 1331118 - RNA, 18 nt, Human
uaaaaaagggaagggagg

SEQ ID NO: 1331119 - RNA, 26 nt, Human
uaaaaauacgaaaacaaaauuagccg

SEQ ID NO: 1331120 - RNA, 21 nt, Human
uaaaauaaaugcugaugcucc

SEQ ID NO: 1331121 - RNA, 23 nt, Human
uaaagaaguagaaaaguugucag

SEQ ID NO: 1331122 - RNA, 25 nt, Human
uaacuaacuucuagugaaccuagau

SEQ ID NO: 1331123 - RNA, 19 nt, Human
uaauuugcauuucuaaggc

SEQ ID NO: 1331124 - RNA, 26 nt, Human
uacaaaagaaaaagaccguguggcaa

SEQ ID NO: 1331125 - RNA, 18 nt, Human
uagaaaaaugagcuaggu

SEQ ID NO: 1331126 - RNA, 21 nt, Human
uagaaaaaugagcuagguuua

SEQ ID NO: 1331127 - RNA, 23 nt, Human
uagaggaaaugcuggguuucugg

SEQ ID NO: 1331128 - RNA, 23 nt, Human
uagcggaaaguucauuucucugu

SEQ ID NO: 1331129 - RNA, 19 nt, Human
uagucccagcuagucggga

SEQ ID NO: 1331130 - RNA, 23 nt, Human
uauauagagaaaaugcaaaauuu

SEQ ID NO: 1331131 - RNA, 20 nt, Human
uauguccaaagagggagcuu

SEQ ID NO: 1331132 - RNA, 24 nt, Human
uauuucauucaaauaauuauguuu

SEQ ID NO: 1331133 - RNA, 23 nt, Human
ucaaaaaaaaaaaaaaaaaaaaa

SEQ ID NO: 1331134 - RNA, 20 nt, Human
ucaagaccauccuggccaac

SEQ ID NO: 1331135 - RNA, 22 nt, Human
ucaagaccauccuggccaacau

SEQ ID NO: 1331136 - RNA, 19 nt, Human
ucacagcugaccaucccuc

SEQ ID NO: 1331137 - RNA, 24 nt, Human
ucacgaggucaagagaucaagacc

SEQ ID NO: 1331138 - RNA, 22 nt, Human
ucagaauauaaaggcacaguca

SEQ ID NO: 1331139 - RNA, 19 nt, Human
uccagaugugcaacaaggc

SEQ ID NO: 1331140 - RNA, 23 nt, Human
ucgacgugggguauguccaaaga

SEQ ID NO: 1331141 - RNA, 18 nt, Human
ucuaccaggaguacccag

SEQ ID NO: 1331142 - RNA, 24 nt, Human
ucuccuagaaaaaugagcuagguu

SEQ ID NO: 1331143 - RNA, 22 nt, Human
ucucuacuaaaaauacgaaaac

SEQ ID NO: 1331144 - RNA, 18 nt, Human
ucuggguaacagagcgag

SEQ ID NO: 1331145 - RNA, 23 nt, Human
ucugucucaaaaaaaaaaaaaaa

SEQ ID NO: 1331146 - RNA, 23 nt, Human
ucuuucucacucucccuuuuugg

SEQ ID NO: 1331147 - RNA, 22 nt, Human
ugaaaaaaaggaagggaggugu

SEQ ID NO: 1331148 - RNA, 19 nt, Human
ugaagcaaagacagcugag

SEQ ID NO: 1331149 - RNA, 20 nt, Human
ugagaggggaaaagcugauu

SEQ ID NO: 1331150 - RNA, 22 nt, Human
ugagcggagaucgcgccacugc

SEQ ID NO: 1331151 - RNA, 24 nt, Human
ugaggcgggagaguggcgugaacc

SEQ ID NO: 1331152 - RNA, 24 nt, Human
ugaggcgggcggaucacgagguca

SEQ ID NO: 1331153 - RNA, 18 nt, Human
ugauggaaaguacagcuu

SEQ ID NO: 1331154 - RNA, 18 nt, Human
ugauggacuaacccucca

SEQ ID NO: 1331155 - RNA, 24 nt, Human
ugauggcgggcgccuguaguccca

SEQ ID NO: 1331156 - RNA, 18 nt, Human
ugcagaaauuuucuugga

SEQ ID NO: 1331157 - RNA, 18 nt, Human
ugcucgcuacagccaggc

SEQ ID NO: 1331158 - RNA, 20 nt, Human
ugcuuugcauauaucuuaaa

SEQ ID NO: 1331159 - RNA, 19 nt, Human
uggaaaguacagcuuuugg

SEQ ID NO: 1331160 - RNA, 21 nt, Human
uggaaccagagaggaaggagc

SEQ ID NO: 1331161 - RNA, 25 nt, Human
uggaaccagagaggaaggagcucca

SEQ ID NO: 1331162 - RNA, 19 nt, Human
uggacuaacccuccagagg

SEQ ID NO: 1331163 - RNA, 25 nt, Human
uggcaucuguagaacucuaauuuca

SEQ ID NO: 1331164 - RNA, 24 nt, Human
uggccaacauggugaaaccccguc

SEQ ID NO: 1331165 - RNA, 21 nt, Human
uggcucacgccuguaauccca

SEQ ID NO: 1331166 - RNA, 22 nt, Human
uggcucacgccuguaaucccag

SEQ ID NO: 1331167 - RNA, 18 nt, Human
ugggacaagaagcaaaac

SEQ ID NO: 1331168 - RNA, 19 nt, Human
ugggaggcugaggcgggcg

SEQ ID NO: 1331169 - RNA, 24 nt, Human
ugggaggcugaggcgggcggauca

SEQ ID NO: 1331170 - RNA, 24 nt, Human
uggggguaaaggugccuacaucuu

SEQ ID NO: 1331171 - RNA, 20 nt, Human
ugguugagggaaaugacaau

SEQ ID NO: 1331172 - RNA, 18 nt, Human
ugugaagcaaagacagcu

SEQ ID NO: 1331173 - RNA, 22 nt, Human
uuaaagaaguagaaaaguuguc

SEQ ID NO: 1331174 - RNA, 18 nt, Human
uucucuguggcuuuggga

SEQ ID NO: 1331175 - RNA, 19 nt, Human
uugcagugagcggagaucg

SEQ ID NO: 1331176 - RNA, 22 nt, Human
uugcagugagcggagaucgcgc

SEQ ID NO: 1331177 - RNA, 25 nt, Human
uugggaggcugaggcgggcggauca

SEQ ID NO: 1331178 - RNA, 18 nt, Human
uuuaauagaggaaaugcu

SEQ ID NO: 1331179 - RNA, 21 nt, Human
uuuaucugaaagcaaccccug

SEQ ID NO: 1331180 - RNA, 21 nt, Human
uuuuggucuucccucuucucc

SEQ ID NO: 1331181 - RNA, 21 nt, Human
cuggccugcuccagugcccug

SEQ ID NO: 1331182 - RNA, 21 nt, Human
uacgauguucuccuaguggug

SEQ ID NO: 1331183 - RNA, 21 nt, Human
caagguucaguucauccuuca

SEQ ID NO: 1331184 - RNA, 19 nt, Human
ccgggagcgccgccugagc

SEQ ID NO: 1331185 - RNA, 18 nt, Human
uagugaauuuucucuucu

SEQ ID NO: 1331186 - RNA, 21 nt, Human
uagugaauuuucucuucuuuu

SEQ ID NO: 1331187 - RNA, 21 nt, Human
ucaagauuugcaguacuguuc

SEQ ID NO: 1331188 - RNA, 23 nt, Human
ucaguucauccuucaacuucauc

SEQ ID NO: 1331189 - RNA, 22 nt, Human
acccccccuuuuccuccccaac

SEQ ID NO: 1331190 - RNA, 20 nt, Human
agugacagaaaaguaugaga

SEQ ID NO: 1331191 - RNA, 21 nt, Human
cacccccccuuuuccucccca

SEQ ID NO: 1331192 - RNA, 23 nt, Human
ccaccaaaauucuuguaaaugaa

SEQ ID NO: 1331193 - RNA, 20 nt, Human
ccccaaagucugcaaaacac

SEQ ID NO: 1331194 - RNA, 18 nt, Human
cccccuuuuccuccccaa

SEQ ID NO: 1331195 - RNA, 18 nt, Human
cggggcagcagcgcuagg

SEQ ID NO: 1331196 - RNA, 21 nt, Human
cggggcagcagcgcuagggcu

SEQ ID NO: 1331197 - RNA, 20 nt, Human
cugcccgggaccuggccacc

SEQ ID NO: 1331198 - RNA, 24 nt, Human
cuggccaccaggaagcggggcagc

SEQ ID NO: 1331199 - RNA, 20 nt, Human
cuugcagaagcuuccaggcc

SEQ ID NO: 1331200 - RNA, 22 nt, Human
gccaccaggaagcggggcagca

SEQ ID NO: 1331201 - RNA, 23 nt, Human
gccuucacccccccuuuuccucc

SEQ ID NO: 1331202 - RNA, 19 nt, Human
ggcaggcuuacagugacag

SEQ ID NO: 1331203 - RNA, 18 nt, Human
gugauucuugccuucacc

SEQ ID NO: 1331204 - RNA, 26 nt, Human
uacagugacagaaaaguaugagaaua

SEQ ID NO: 1331205 - RNA, 22 nt, Human
uagaccgcuccccaaagucugc

SEQ ID NO: 1331206 - RNA, 20 nt, Human
uagaugcccaccaaaauucu

SEQ ID NO: 1331207 - RNA, 29 nt, Human
ucacccccccuuuuccuccccaacgagaa

SEQ ID NO: 1331208 - RNA, 26 nt, Human
uccccaaagucugcaaaacacugccu

SEQ ID NO: 1331209 - RNA, 23 nt, Human
ucuugcucuggcauuccugcagg

SEQ ID NO: 1331210 - RNA, 19 nt, Human
ugacagaaaaguaugagaa

SEQ ID NO: 1331211 - RNA, 21 nt, Human
uguaaaugaagcaggacccga

SEQ ID NO: 1331212 - RNA, 25 nt, Human
uucacaaugaugaaccaucccuuuu

SEQ ID NO: 1331213 - RNA, 23 nt, Human
uucacccccccuuuuccucccca

SEQ ID NO: 1331214 - RNA, 25 nt, Human
uucacccccccuuuuccuccccaac

SEQ ID NO: 1331215 - RNA, 21 nt, Human
aaucuugccucucagucccac

SEQ ID NO: 1331216 - RNA, 20 nt, Human
aggaacacaggcacauucag

SEQ ID NO: 1331217 - RNA, 24 nt, Human
aggcacauucaggugccuuugcag

SEQ ID NO: 1331218 - RNA, 18 nt, Human
agggucaugguggacaug

SEQ ID NO: 1331219 - RNA, 19 nt, Human
auggacaggacaccugggg

SEQ ID NO: 1331220 - RNA, 24 nt, Human
caaaucuugccucucagucccaca

SEQ ID NO: 1331221 - RNA, 24 nt, Human
cacagaacccagacaccaaccugg

SEQ ID NO: 1331222 - RNA, 21 nt, Human
caccugggguggggaagggag

SEQ ID NO: 1331223 - RNA, 21 nt, Human
cauggcaagaauuugaaaaag

SEQ ID NO: 1331224 - RNA, 20 nt, Human
cauucaggugccuuugcaga

SEQ ID NO: 1331225 - RNA, 22 nt, Human
ccagacaccaaccuggacacag

SEQ ID NO: 1331226 - RNA, 21 nt, Human
ccagcagcacgcauguggcca

SEQ ID NO: 1331227 - RNA, 19 nt, Human
cccagacaccaaccuggac

SEQ ID NO: 1331228 - RNA, 24 nt, Human
ccccaccuccucauauuaugccua

SEQ ID NO: 1331229 - RNA, 18 nt, Human
ccucuauggagcaggaau

SEQ ID NO: 1331230 - RNA, 25 nt, Human
ccucucauggcaagaauuugaaaaa

SEQ ID NO: 1331231 - RNA, 18 nt, Human
ccugaccugaguggaggc

SEQ ID NO: 1331232 - RNA, 21 nt, Human
cgugaacaaaucuugccucuc

SEQ ID NO: 1331233 - RNA, 19 nt, Human
cucagccucaccucuaugg

SEQ ID NO: 1331234 - RNA, 20 nt, Human
cucagucccacacaaggcag

SEQ ID NO: 1331235 - RNA, 21 nt, Human
cucauggcaagaauuugaaaa

SEQ ID NO: 1331236 - RNA, 22 nt, Human
cuccagcagcacgcauguggcc

SEQ ID NO: 1331237 - RNA, 18 nt, Human
gaacaaaucuugccucuc

SEQ ID NO: 1331238 - RNA, 20 nt, Human
gaacacaggucagcaugagg

SEQ ID NO: 1331239 - RNA, 22 nt, Human
gggguggguuggucuccccacc

SEQ ID NO: 1331240 - RNA, 23 nt, Human
ggguggguuggucuccccaccuc

SEQ ID NO: 1331241 - RNA, 23 nt, Human
gucaggguuuuugaagucacaaa

SEQ ID NO: 1331242 - RNA, 23 nt, Human
gucaugguggacauggggguggg

SEQ ID NO: 1331243 - RNA, 22 nt, Human
gugaacaaaucuugccucucag

SEQ ID NO: 1331244 - RNA, 20 nt, Human
ucagaagagcuggacucaga

SEQ ID NO: 1331245 - RNA, 18 nt, Human
ucccugaggagggaacag

SEQ ID NO: 1331246 - RNA, 18 nt, Human
ugaccugaguggaggcug

SEQ ID NO: 1331247 - RNA, 19 nt, Human
ugacuucugguccugaccu

SEQ ID NO: 1331248 - RNA, 19 nt, Human
ugagggacucagaagagcu

SEQ ID NO: 1331249 - RNA, 21 nt, Human
ugagggacucagaagagcugg

SEQ ID NO: 1331250 - RNA, 21 nt, Human
ugggguggggaagggagcaca

SEQ ID NO: 1331251 - RNA, 24 nt, Human
uggguuggucuccccaccuccuca

SEQ ID NO: 1331252 - RNA, 19 nt, Human
ugguccugaccugagugga

SEQ ID NO: 1331253 - RNA, 18 nt, Human
ugucucucaaauuuuagg

SEQ ID NO: 1331254 - RNA, 23 nt, Human
aagaaaacguccugugagaggcc

SEQ ID NO: 1331255 - RNA, 21 nt, Human
aaucuugccucucagucccac

SEQ ID NO: 1331256 - RNA, 19 nt, Human
acagggucaugguggacac

SEQ ID NO: 1331257 - RNA, 21 nt, Human
agaaagagaagucaggguucu

SEQ ID NO: 1331258 - RNA, 19 nt, Human
agaggccaggaagguagca

SEQ ID NO: 1331259 - RNA, 20 nt, Human
agggucaugguggacacggg

SEQ ID NO: 1331260 - RNA, 22 nt, Human
augaacaaaucuugccucucag

SEQ ID NO: 1331261 - RNA, 24 nt, Human
caaaucuugccucucagucccaca

SEQ ID NO: 1331262 - RNA, 21 nt, Human
caugaacaaaucuugccucuc

SEQ ID NO: 1331263 - RNA, 23 nt, Human
cucacauuaugccuauagggaca

SEQ ID NO: 1331264 - RNA, 20 nt, Human
cucagucccacacaaggcag

SEQ ID NO: 1331265 - RNA, 21 nt, Human
gaacagggucaugguggacac

SEQ ID NO: 1331266 - RNA, 25 nt, Human
gaauguaggucaguguggggaacag

SEQ ID NO: 1331267 - RNA, 19 nt, Human
gggaaggaauguaggucag

SEQ ID NO: 1331268 - RNA, 23 nt, Human
gucaggguucuugaagucacaaa

SEQ ID NO: 1331269 - RNA, 25 nt, Human
uccccaccaccucacauuaugccua

SEQ ID NO: 1331270 - RNA, 22 nt, Human
ugaacaaaucuugccucucagu

SEQ ID NO: 1331271 - RNA, 23 nt, Human
ugagaggccaggaagguagcagg

SEQ ID NO: 1331272 - RNA, 23 nt, Human
ugugagaggccaggaagguagca

SEQ ID NO: 1331273 - RNA, 24 nt, Human
uguggggaacagggucauggugga

SEQ ID NO: 1331274 - RNA, 21 nt, Human
caggccccgugagaagcuaug

SEQ ID NO: 1331275 - RNA, 24 nt, Human
cguuccuguaggaagaacuagaga

SEQ ID NO: 1331276 - RNA, 22 nt, Human
gagccaggccccgugagaagcu

SEQ ID NO: 1331277 - RNA, 24 nt, Human
uaaaagcagaaauaaggaaaaugc

SEQ ID NO: 1331278 - RNA, 21 nt, Human
uaagagaacugagacaugugg

SEQ ID NO: 1331279 - RNA, 27 nt, Human
uaagagaacugagacauguggaggccg

SEQ ID NO: 1331280 - RNA, 19 nt, Human
uccgagaggaccugauggu

SEQ ID NO: 1331281 - RNA, 20 nt, Human
ugagcgaguuggugggguca

SEQ ID NO: 1331282 - RNA, 22 nt, Human
uguaggaagaacuagagauucc

SEQ ID NO: 1331283 - RNA, 23 nt, Human
ugucaggcgugagcgaguuggug

SEQ ID NO: 1331284 - RNA, 29 nt, Human
aaacuagaggcagaaauaagagggacccc

SEQ ID NO: 1331285 - RNA, 21 nt, Human
aacuagaggcagaaauaagau

SEQ ID NO: 1331286 - RNA, 25 nt, Human
aaggaaccugggggguuuaagggaa

SEQ ID NO: 1331287 - RNA, 23 nt, Human
aagugaccacugaggcccagagc

SEQ ID NO: 1331288 - RNA, 20 nt, Human
aaguggaaccuggaugcugg

SEQ ID NO: 1331289 - RNA, 20 nt, Human
acagcaaaaugaucuuaggc

SEQ ID NO: 1331290 - RNA, 26 nt, Human
accagcaggaggugggaaaagagccc

SEQ ID NO: 1331291 - RNA, 22 nt, Human
accauuacccuucucuccauuc

SEQ ID NO: 1331292 - RNA, 18 nt, Human
acucugugcccagcacug

SEQ ID NO: 1331293 - RNA, 18 nt, Human
agagagugcagagcuggg

SEQ ID NO: 1331294 - RNA, 28 nt, Human
agcaugugacacacacaaagugggcaac

SEQ ID NO: 1331295 - RNA, 23 nt, Human
aggcccagagccguuggaacagg

SEQ ID NO: 1331296 - RNA, 24 nt, Human
aggggcaccuggacagagguuggg

SEQ ID NO: 1331297 - RNA, 18 nt, Human
aggguggaggacuuaaaa

SEQ ID NO: 1331298 - RNA, 18 nt, Human
auccuuaguucagagagg

SEQ ID NO: 1331299 - RNA, 18 nt, Human
auggaaggcaacuacagc

SEQ ID NO: 1331300 - RNA, 21 nt, Human
auucaacaagucuuuauugag

SEQ ID NO: 1331301 - RNA, 18 nt, Human
auuccagagagugcagag

SEQ ID NO: 1331302 - RNA, 19 nt, Human
auugaucagugaucacagc

SEQ ID NO: 1331303 - RNA, 19 nt, Human
caaaacuagaggcagaaau

SEQ ID NO: 1331304 - RNA, 24 nt, Human
caagugaccacugaggcccagagc

SEQ ID NO: 1331305 - RNA, 18 nt, Human
caaugguggucaagugac

SEQ ID NO: 1331306 - RNA, 19 nt, Human
cacacacaaagugggcagc

SEQ ID NO: 1331307 - RNA, 18 nt, Human
cacccugcuggggaaccc

SEQ ID NO: 1331308 - RNA, 23 nt, Human
cacccugcuggggaacccgguca

SEQ ID NO: 1331309 - RNA, 20 nt, Human
cacucucuccuaggaaagug

SEQ ID NO: 1331310 - RNA, 23 nt, Human
cacugagugagauuucagggggc

SEQ ID NO: 1331311 - RNA, 22 nt, Human
cagcaugugacacacacaaagu

SEQ ID NO: 1331312 - RNA, 20 nt, Human
cagcgcgcacccugcuaugg

SEQ ID NO: 1331313 - RNA, 22 nt, Human
cagcgcgcacccugcuaugguu

SEQ ID NO: 1331314 - RNA, 20 nt, Human
caugugacacacacaaagug

SEQ ID NO: 1331315 - RNA, 25 nt, Human
cauucaacaagucuuuauugagcac

SEQ ID NO: 1331316 - RNA, 21 nt, Human
ccaaagaagugaagcaucuga

SEQ ID NO: 1331317 - RNA, 20 nt, Human
ccacuggauguuugucuugg

SEQ ID NO: 1331318 - RNA, 23 nt, Human
ccaucuccacucucuccuaggaa

SEQ ID NO: 1331319 - RNA, 24 nt, Human
cccaucuccacucucuccuaggaa

SEQ ID NO: 1331320 - RNA, 20 nt, Human
ccccaaagccguguaugucu

SEQ ID NO: 1331321 - RNA, 20 nt, Human
ccccaaagccguguaugucu

SEQ ID NO: 1331322 - RNA, 21 nt, Human
ccccccauugagaguccugga

SEQ ID NO: 1331323 - RNA, 26 nt, Human
ccccucacaaggaccaaucuagagau

SEQ ID NO: 1331324 - RNA, 19 nt, Human
cccugcuccaggugcuuag

SEQ ID NO: 1331325 - RNA, 18 nt, Human
ccguguaugucuggaucc

SEQ ID NO: 1331326 - RNA, 24 nt, Human
ccuaagaccacagauagcuccagg

SEQ ID NO: 1331327 - RNA, 21 nt, Human
ccucauggacuccagggucag

SEQ ID NO: 1331328 - RNA, 26 nt, Human
ccuccugcugccuuccuuucccuguc

SEQ ID NO: 1331329 - RNA, 21 nt, Human
ccugcugccuuccuuucccug

SEQ ID NO: 1331330 - RNA, 22 nt, Human
ccuuuuaugccgucaguauauu

SEQ ID NO: 1331331 - RNA, 18 nt, Human
cuaagaccacagauagcu

SEQ ID NO: 1331332 - RNA, 24 nt, Human
cuacucugugcccagcacugcacu

SEQ ID NO: 1331333 - RNA, 23 nt, Human
cuuguggccuccugcugccuucc

SEQ ID NO: 1331334 - RNA, 18 nt, Human
gaagacauguuacucccu

SEQ ID NO: 1331335 - RNA, 21 nt, Human
gaaggaaccugggggguuuaa

SEQ ID NO: 1331336 - RNA, 20 nt, Human
gaaguucccucgggaaacca

SEQ ID NO: 1331337 - RNA, 19 nt, Human
gacauguuacucccucucu

SEQ ID NO: 1331338 - RNA, 21 nt, Human
gcaagaaggaaccuggggggu

SEQ ID NO: 1331339 - RNA, 26 nt, Human
gccagagacagaggcuuaacacccug

SEQ ID NO: 1331340 - RNA, 21 nt, Human
gcugggggcagaugucagggg

SEQ ID NO: 1331341 - RNA, 18 nt, Human
ggaugaacaggggcuggc

SEQ ID NO: 1331342 - RNA, 22 nt, Human
ggcuauggaaauaugcucagcc

SEQ ID NO: 1331343 - RNA, 22 nt, Human
ggcugggggcagaugucagggc

SEQ ID NO: 1331344 - RNA, 18 nt, Human
gggcaagaaaaugcugca

SEQ ID NO: 1331345 - RNA, 18 nt, Human
gggcugggggcagauguc

SEQ ID NO: 1331346 - RNA, 21 nt, Human
gguaggucuguuuaaaaugcc

SEQ ID NO: 1331347 - RNA, 23 nt, Human
guggaggacuuaaaacuuggaug

SEQ ID NO: 1331348 - RNA, 20 nt, Human
gugggcuuguggccuccugc

SEQ ID NO: 1331349 - RNA, 26 nt, Human
guucacuggugaggacuucuucuccu

SEQ ID NO: 1331350 - RNA, 18 nt, Human
uaaaaccauuacccuucu

SEQ ID NO: 1331351 - RNA, 21 nt, Human
uacccuucucuccauuccuga

SEQ ID NO: 1331352 - RNA, 18 nt, Human
uacucugugcccagcacu

SEQ ID NO: 1331353 - RNA, 21 nt, Human
ucacuggugaggacuucuucu

SEQ ID NO: 1331354 - RNA, 26 nt, Human
ucagugaucacagcuuguaccccaaa

SEQ ID NO: 1331355 - RNA, 22 nt, Human
uccaggcuuuaaauggccuggg

SEQ ID NO: 1331356 - RNA, 20 nt, Human
ucccguccccccauugagag

SEQ ID NO: 1331357 - RNA, 18 nt, Human
uccuaggaaaguggaacc

SEQ ID NO: 1331358 - RNA, 19 nt, Human
uccuggaggacuugcucuc

SEQ ID NO: 1331359 - RNA, 22 nt, Human
ucgggcccuuauuccagagagu

SEQ ID NO: 1331360 - RNA, 22 nt, Human
ucucuuagaacaggguggagga

SEQ ID NO: 1331361 - RNA, 21 nt, Human
ucucuugacaugaagaccugg

SEQ ID NO: 1331362 - RNA, 19 nt, Human
ucuuaaaacuccccucaca

SEQ ID NO: 1331363 - RNA, 19 nt, Human
ugaggacuucuucuccugg

SEQ ID NO: 1331364 - RNA, 19 nt, Human
ugcaagaaggaaccugggg

SEQ ID NO: 1331365 - RNA, 22 nt, Human
ugccagggaaggugggcagcag

SEQ ID NO: 1331366 - RNA, 23 nt, Human
uggacagagguuggguccguggg

SEQ ID NO: 1331367 - RNA, 22 nt, Human
uggacuccagggucagaaguuc

SEQ ID NO: 1331368 - RNA, 21 nt, Human
uggaugcugguagggccagag

SEQ ID NO: 1331369 - RNA, 22 nt, Human
uggaugugcugaucaagagcaa

SEQ ID NO: 1331370 - RNA, 21 nt, Human
uggggagguggcuaccagugg

SEQ ID NO: 1331371 - RNA, 20 nt, Human
ugggguccccugcuccaggu

SEQ ID NO: 1331372 - RNA, 26 nt, Human
ugggguccccugcuccaggugcuuag

SEQ ID NO: 1331373 - RNA, 20 nt, Human
uggguaaggacaagacuggg

SEQ ID NO: 1331374 - RNA, 24 nt, Human
ugguucugcccuuuuaugccguca

SEQ ID NO: 1331375 - RNA, 23 nt, Human
ugugcaagaaggaaccugggggg

SEQ ID NO: 1331376 - RNA, 19 nt, Human
uuccaaagaagugaagcag

SEQ ID NO: 1331377 - RNA, 20 nt, Human
uugagcaccuacucugugcc

SEQ ID NO: 1331378 - RNA, 18 nt, Human
uuggaugugcugaucaag

SEQ ID NO: 1331379 - RNA, 21 nt, Human
aaaaauaccccaacuuuagga

SEQ ID NO: 1331380 - RNA, 22 nt, Human
aaacagcccaaggugaagcuca

SEQ ID NO: 1331381 - RNA, 24 nt, Human
aaagauccucaaaggucuguguua

SEQ ID NO: 1331382 - RNA, 21 nt, Human
aaagcacuaggagaaagcaug

SEQ ID NO: 1331383 - RNA, 20 nt, Human
aacagacaucccuauuuccu

SEQ ID NO: 1331384 - RNA, 20 nt, Human
aagacuuuuuagaaagauga

SEQ ID NO: 1331385 - RNA, 20 nt, Human
aaguagauaugcucaagaaa

SEQ ID NO: 1331386 - RNA, 20 nt, Human
aaguagcugggauuacaggc

SEQ ID NO: 1331387 - RNA, 26 nt, Human
aaguagcugggauuacaggcgcaugc

SEQ ID NO: 1331388 - RNA, 23 nt, Human
acagaguggcugggccugacccc

SEQ ID NO: 1331389 - RNA, 23 nt, Human
accagacuggagugcaauggcgu

SEQ ID NO: 1331390 - RNA, 25 nt, Human
acuaggagaaagcaugcaaaacagc

SEQ ID NO: 1331391 - RNA, 27 nt, Human
acucugucaaccagacuggagugcaau

SEQ ID NO: 1331392 - RNA, 19 nt, Human
acuggagugcaauggcgug

SEQ ID NO: 1331393 - RNA, 24 nt, Human
acuucaauagaaaguaagcuaaaa

SEQ ID NO: 1331394 - RNA, 25 nt, Human
agaaaaaaauaacacuaaauaagga

SEQ ID NO: 1331395 - RNA, 22 nt, Human
agaagagauggguuuuugccau

SEQ ID NO: 1331396 - RNA, 24 nt, Human
agaguaaaggugccaggggaaggg

SEQ ID NO: 1331397 - RNA, 24 nt, Human
agcauaaauagguauuugugaaug

SEQ ID NO: 1331398 - RNA, 19 nt, Human
agccacauccagggagcca

SEQ ID NO: 1331399 - RNA, 23 nt, Human
agcuacagaaaguccugacuauc

SEQ ID NO: 1331400 - RNA, 18 nt, Human
aggcccaggagagaacag

SEQ ID NO: 1331401 - RNA, 19 nt, Human
agggagccaaggauauagu

SEQ ID NO: 1331402 - RNA, 18 nt, Human
agggcugaugaaagagga

SEQ ID NO: 1331403 - RNA, 18 nt, Human
aggggaagggcugaggcu

SEQ ID NO: 1331404 - RNA, 19 nt, Human
aguagcugggauuacaggc

SEQ ID NO: 1331405 - RNA, 21 nt, Human
agugcaauggcgugaucucag

SEQ ID NO: 1331406 - RNA, 24 nt, Human
agugcaauggcgugaucucagcuc

SEQ ID NO: 1331407 - RNA, 21 nt, Human
auaagacaagguggcuccuuc

SEQ ID NO: 1331408 - RNA, 20 nt, Human
aucccuauuuccuuccuagg

SEQ ID NO: 1331409 - RNA, 20 nt, Human
auggguuuuugccauguugg

SEQ ID NO: 1331410 - RNA, 23 nt, Human
caacugauauaagaacuaagaaa

SEQ ID NO: 1331411 - RNA, 25 nt, Human
caagaucagaagggacacuaacacc

SEQ ID NO: 1331412 - RNA, 22 nt, Human
cacaacacuaaucacugucccc

SEQ ID NO: 1331413 - RNA, 23 nt, Human
cacaccauguacucuaaaaugag

SEQ ID NO: 1331414 - RNA, 21 nt, Human
cacauccagggagccaaggau

SEQ ID NO: 1331415 - RNA, 18 nt, Human
caccauguacucuaaaau

SEQ ID NO: 1331416 - RNA, 23 nt, Human
cacucugucaaccagacuggagu

SEQ ID NO: 1331417 - RNA, 18 nt, Human
cacuguugggugauagaa

SEQ ID NO: 1331418 - RNA, 25 nt, Human
cacuucacugugcccccugcugccc

SEQ ID NO: 1331419 - RNA, 20 nt, Human
cacuuugacagcuucccucu

SEQ ID NO: 1331420 - RNA, 22 nt, Human
cagcucacugcaaccuccuccu

SEQ ID NO: 1331421 - RNA, 23 nt, Human
cagguuccuucacacauaauuuc

SEQ ID NO: 1331422 - RNA, 22 nt, Human
caugcuaaaaugaaugcaucca

SEQ ID NO: 1331423 - RNA, 24 nt, Human
cauguuggccaggcuggucucaaa

SEQ ID NO: 1331424 - RNA, 19 nt, Human
ccagcuuacucuucucucc

SEQ ID NO: 1331425 - RNA, 22 nt, Human
ccagcuuacucuucucucccuc

SEQ ID NO: 1331426 - RNA, 23 nt, Human
ccagcuuacucuucucucccucc

SEQ ID NO: 1331427 - RNA, 19 nt, Human
ccauguuggccaggcuggu

SEQ ID NO: 1331428 - RNA, 22 nt, Human
ccauguuggccaggcuggucuc

SEQ ID NO: 1331429 - RNA, 20 nt, Human
cccaacccaggucuggcuuc

SEQ ID NO: 1331430 - RNA, 19 nt, Human
cccagggcacaggggucag

SEQ ID NO: 1331431 - RNA, 20 nt, Human
cccagguucaagcaauucuc

SEQ ID NO: 1331432 - RNA, 23 nt, Human
ccccacugcagggugugugccca

SEQ ID NO: 1331433 - RNA, 19 nt, Human
cccugcaccucccggcuac

SEQ ID NO: 1331434 - RNA, 19 nt, Human
ccgaaguagcugggauuac

SEQ ID NO: 1331435 - RNA, 23 nt, Human
ccgaaguagcugggauuacaggc

SEQ ID NO: 1331436 - RNA, 23 nt, Human
ccgaaguagcugggauuacaggc

SEQ ID NO: 1331437 - RNA, 22 nt, Human
ccucccagguucaagcaauucu

SEQ ID NO: 1331438 - RNA, 18 nt, Human
ccuccucccagguucaag

SEQ ID NO: 1331439 - RNA, 22 nt, Human
ccugcagcccagugcccagggc

SEQ ID NO: 1331440 - RNA, 25 nt, Human
cuaauuaaagaagacugagaagccc

SEQ ID NO: 1331441 - RNA, 20 nt, Human
cuacuucaauagaaaguaag

SEQ ID NO: 1331442 - RNA, 19 nt, Human
cuagggcccuucacuccuc

SEQ ID NO: 1331443 - RNA, 19 nt, Human
cucaagugauuugcccacc

SEQ ID NO: 1331444 - RNA, 23 nt, Human
cucacugcaaccuccuccuccca

SEQ ID NO: 1331445 - RNA, 24 nt, Human
cucacugcaaccuccuccucccag

SEQ ID NO: 1331446 - RNA, 22 nt, Human
cuccaaccugcagcccagugcc

SEQ ID NO: 1331447 - RNA, 20 nt, Human
cucccagguucaagcaauuc

SEQ ID NO: 1331448 - RNA, 21 nt, Human
cucucuacaggcccaggagag

SEQ ID NO: 1331449 - RNA, 23 nt, Human
cugcaaccuccuccucccagguu

SEQ ID NO: 1331450 - RNA, 24 nt, Human
cugcaaccuccuccucccagguuc

SEQ ID NO: 1331451 - RNA, 24 nt, Human
cuggagugcaauggcgugaucuca

SEQ ID NO: 1331452 - RNA, 23 nt, Human
cuuacucuucucucccucccaga

SEQ ID NO: 1331453 - RNA, 20 nt, Human
cuucagcacuucacugugcc

SEQ ID NO: 1331454 - RNA, 19 nt, Human
cuugucuccuuccacuucu

SEQ ID NO: 1331455 - RNA, 21 nt, Human
gaacuuaaagaauauuuggga

SEQ ID NO: 1331456 - RNA, 20 nt, Human
gaagcuacagaaaguccuga

SEQ ID NO: 1331457 - RNA, 25 nt, Human
gacccaacccaggucuggcuucugu

SEQ ID NO: 1331458 - RNA, 22 nt, Human
gaccucaagugauuugcccacc

SEQ ID NO: 1331459 - RNA, 20 nt, Human
gaggaagggcgaagaguaaa

SEQ ID NO: 1331460 - RNA, 19 nt, Human
gaguauguguuauccccac

SEQ ID NO: 1331461 - RNA, 20 nt, Human
gauagaguggcaggccagaa

SEQ ID NO: 1331462 - RNA, 22 nt, Human
gaucagaagggacacuaacacc

SEQ ID NO: 1331463 - RNA, 18 nt, Human
gauuacaggcgcaugcca

SEQ ID NO: 1331464 - RNA, 24 nt, Human
gauuacaggcgcaugccaccaugc

SEQ ID NO: 1331465 - RNA, 23 nt, Human
gcacugugguccaagaguguggu

SEQ ID NO: 1331466 - RNA, 20 nt, Human
gccagguauuagaagguucc

SEQ ID NO: 1331467 - RNA, 20 nt, Human
gccauguuggccaggcuggu

SEQ ID NO: 1331468 - RNA, 22 nt, Human
gcucacugcaaccuccuccucc

SEQ ID NO: 1331469 - RNA, 22 nt, Human
gcuuacucuucucucccuccca

SEQ ID NO: 1331470 - RNA, 24 nt, Human
ggagacagagguuuacaaaaggaa

SEQ ID NO: 1331471 - RNA, 23 nt, Human
ggcuugucuccuuccacuucuuu

SEQ ID NO: 1331472 - RNA, 22 nt, Human
ggguuuuugccauguuggccag

SEQ ID NO: 1331473 - RNA, 23 nt, Human
ggguuuuugccauguuggccagg

SEQ ID NO: 1331474 - RNA, 18 nt, Human
guaaaggugccaggggaa

SEQ ID NO: 1331475 - RNA, 20 nt, Human
uaauuuuuauauuuuuuaga

SEQ ID NO: 1331476 - RNA, 24 nt, Human
uagaagagauggguuuuugccaug

SEQ ID NO: 1331477 - RNA, 18 nt, Human
uagaagaugugggaaucc

SEQ ID NO: 1331478 - RNA, 19 nt, Human
uagggcccuucacuccucc

SEQ ID NO: 1331479 - RNA, 23 nt, Human
uaucacuggaacucaguuaaaau

SEQ ID NO: 1331480 - RNA, 20 nt, Human
uaugguuuugagagaucuuc

SEQ ID NO: 1331481 - RNA, 22 nt, Human
uaugguuuugagagaucuucuu

SEQ ID NO: 1331482 - RNA, 22 nt, Human
ucaagaaagcuaucccaaggac

SEQ ID NO: 1331483 - RNA, 18 nt, Human
ucacugcaaccuccuccc

SEQ ID NO: 1331484 - RNA, 18 nt, Human
ucacugcaaccuccuccu

SEQ ID NO: 1331485 - RNA, 24 nt, Human
ucacugcaaccuccuccucccagg

SEQ ID NO: 1331486 - RNA, 25 nt, Human
ucagcucacugcaaccuccuccucc

SEQ ID NO: 1331487 - RNA, 20 nt, Human
ucagggcugaugaaagagga

SEQ ID NO: 1331488 - RNA, 18 nt, Human
ucauucaggaguagauua

SEQ ID NO: 1331489 - RNA, 19 nt, Human
uccaauauuguccaacuag

SEQ ID NO: 1331490 - RNA, 20 nt, Human
uccaccaugccaggaggaag

SEQ ID NO: 1331491 - RNA, 19 nt, Human
ucccaaggacaggguugca

SEQ ID NO: 1331492 - RNA, 21 nt, Human
ucccagguucaagcaauucuc

SEQ ID NO: 1331493 - RNA, 21 nt, Human
ucccagguucaagcaauucuc

SEQ ID NO: 1331494 - RNA, 24 nt, Human
uccgaaguagcugggauuacaggc

SEQ ID NO: 1331495 - RNA, 25 nt, Human
ucuacaggcccaggagagaacagcu

SEQ ID NO: 1331496 - RNA, 24 nt, Human
ucucacucugucaaccagacugga

SEQ ID NO: 1331497 - RNA, 18 nt, Human
ucucagggcugaugaaag

SEQ ID NO: 1331498 - RNA, 21 nt, Human
ucuguggauuuugauuaucua

SEQ ID NO: 1331499 - RNA, 23 nt, Human
ugaagcucacuuggcagcugaga

SEQ ID NO: 1331500 - RNA, 25 nt, Human
ugaaggauacaaauggagccgaaaa

SEQ ID NO: 1331501 - RNA, 18 nt, Human
ugaccucaagugauuugc

SEQ ID NO: 1331502 - RNA, 22 nt, Human
ugaccucaagugauuugcccac

SEQ ID NO: 1331503 - RNA, 20 nt, Human
ugacucaaccuccgaaguag

SEQ ID NO: 1331504 - RNA, 24 nt, Human
ugacucaaccuccgaaguagcugg

SEQ ID NO: 1331505 - RNA, 22 nt, Human
ugagaaaaaaauaacacuaaau

SEQ ID NO: 1331506 - RNA, 23 nt, Human
ugagucucacucugucaaccaga

SEQ ID NO: 1331507 - RNA, 21 nt, Human
ugauagaguggcaggccagaa

SEQ ID NO: 1331508 - RNA, 18 nt, Human
ugccaggaggaagggcga

SEQ ID NO: 1331509 - RNA, 19 nt, Human
ugccaggggaagggcugag

SEQ ID NO: 1331510 - RNA, 24 nt, Human
ugccauguuggccaggcuggucuc

SEQ ID NO: 1331511 - RNA, 26 nt, Human
ugccauguuggccaggcuggucucaa

SEQ ID NO: 1331512 - RNA, 19 nt, Human
ugcccagcacacuuugaca

SEQ ID NO: 1331513 - RNA, 24 nt, Human
ugcuaaaaugaaugcauccaagga

SEQ ID NO: 1331514 - RNA, 22 nt, Human
ugcuacugcagccuaaugacuu

SEQ ID NO: 1331515 - RNA, 19 nt, Human
uggagugcaauggcgugau

SEQ ID NO: 1331516 - RNA, 24 nt, Human
uggagugcaauggcgugaucucag

SEQ ID NO: 1331517 - RNA, 19 nt, Human
uggcagcugagagugaguu

SEQ ID NO: 1331518 - RNA, 24 nt, Human
uggccaggcuggucucaaacucuu

SEQ ID NO: 1331519 - RNA, 24 nt, Human
uggcgugaucucagcucacugcaa

SEQ ID NO: 1331520 - RNA, 21 nt, Human
ugggauuacaggcgcaugcca

SEQ ID NO: 1331521 - RNA, 22 nt, Human
ugggauuacaggcgcaugccac

SEQ ID NO: 1331522 - RNA, 24 nt, Human
ugggauuacaggcgcaugccacca

SEQ ID NO: 1331523 - RNA, 25 nt, Human
ugggauuacaggcgcaugccaccau

SEQ ID NO: 1331524 - RNA, 20 nt, Human
uggguuuuugccauguuggc

SEQ ID NO: 1331525 - RNA, 24 nt, Human
uggguuuuugccauguuggccagg

SEQ ID NO: 1331526 - RNA, 23 nt, Human
uguaaauacgggguaagguacau

SEQ ID NO: 1331527 - RNA, 18 nt, Human
ugucauaucacuggaacu

SEQ ID NO: 1331528 - RNA, 18 nt, Human
uuacucuucucucccucc

SEQ ID NO: 1331529 - RNA, 24 nt, Human
uuagaagagauggguuuuugccau

SEQ ID NO: 1331530 - RNA, 18 nt, Human
uuaggagguuaaggucac

SEQ ID NO: 1331531 - RNA, 18 nt, Human
uucaauagaaaguaagcu

SEQ ID NO: 1331532 - RNA, 27 nt, Human
uucagacuuaagacuuuuuagaaagau

SEQ ID NO: 1331533 - RNA, 24 nt, Human
uuccguuuucucuauaaauaguuc

SEQ ID NO: 1331534 - RNA, 19 nt, Human
uucgccaggacccaaccca

SEQ ID NO: 1331535 - RNA, 24 nt, Human
uugccauguuggccaggcuggucu

SEQ ID NO: 1331536 - RNA, 18 nt, Human
uuuaagaaauagaagcca

SEQ ID NO: 1331537 - RNA, 23 nt, Human
uuuugccauguuggccaggcugg

SEQ ID NO: 1331538 - RNA, 23 nt, Human
uuuuugccauguuggccaggcug

SEQ ID NO: 1331539 - RNA, 24 nt, Human
uuuuuuucuaacuucugugagauu

SEQ ID NO: 1331540 - RNA, 23 nt, Human
aaagggagcuggauuuagaccuc

SEQ ID NO: 1331541 - RNA, 18 nt, Human
aaccuguuccuucuccca

SEQ ID NO: 1331542 - RNA, 25 nt, Human
acaaacuccaaaagggagggaacgc

SEQ ID NO: 1331543 - RNA, 23 nt, Human
agaauggcacaaacuccaaaagg

SEQ ID NO: 1331544 - RNA, 19 nt, Human
agggagcuggauuuagacc

SEQ ID NO: 1331545 - RNA, 21 nt, Human
caaacuccaaaagggagcugg

SEQ ID NO: 1331546 - RNA, 19 nt, Human
ccagaagcuccuggaauga

SEQ ID NO: 1331547 - RNA, 22 nt, Human
cuccucugaauuuugcaaccug

SEQ ID NO: 1331548 - RNA, 18 nt, Human
gcugcugcucaaaucgga

SEQ ID NO: 1331549 - RNA, 23 nt, Human
uccaaaagggagcuggauuuaga

SEQ ID NO: 1331550 - RNA, 21 nt, Human
uccccauguagauaacgggau

SEQ ID NO: 1331551 - RNA, 22 nt, Human
uccuggaaugagcaggucuggc

SEQ ID NO: 1331552 - RNA, 19 nt, Human
uggaaugagcaggucuggc

SEQ ID NO: 1331553 - RNA, 21 nt, Human
uggcacaaacuccaaaaggga

SEQ ID NO: 1331554 - RNA, 19 nt, Human
uguuccuucucccagaagc

SEQ ID NO: 1331555 - RNA, 19 nt, Human
acaagaguagcgcuggcug

SEQ ID NO: 1331556 - RNA, 20 nt, Human
acaccccagacucaucuccc

SEQ ID NO: 1331557 - RNA, 22 nt, Human
acaccccagacucaucucccuc

SEQ ID NO: 1331558 - RNA, 18 nt, Human
acagagccacagccacac

SEQ ID NO: 1331559 - RNA, 19 nt, Human
agaguccuucuggggcuuc

SEQ ID NO: 1331560 - RNA, 20 nt, Human
aggcucugcugggaauggug

SEQ ID NO: 1331561 - RNA, 20 nt, Human
aggcucugcugggaauggug

SEQ ID NO: 1331562 - RNA, 19 nt, Human
aggcucugcuggggauagu

SEQ ID NO: 1331563 - RNA, 19 nt, Human
aggcucugcuggggauagu

SEQ ID NO: 1331564 - RNA, 19 nt, Human
aggcucugcuggggauggu

SEQ ID NO: 1331565 - RNA, 19 nt, Human
aggcucugcuggggauggu

SEQ ID NO: 1331566 - RNA, 19 nt, Human
aggcucugcuggggauggu

SEQ ID NO: 1331567 - RNA, 18 nt, Human
agucuuuucuccauguuc

SEQ ID NO: 1331568 - RNA, 21 nt, Human
aguuuuuucugacucuucugg

SEQ ID NO: 1331569 - RNA, 21 nt, Human
augauuaucuguagagcuuuu

SEQ ID NO: 1331570 - RNA, 22 nt, Human
caaaugggguccuuuguccauu

SEQ ID NO: 1331571 - RNA, 22 nt, Human
caaaugggguccuuuguccauu

SEQ ID NO: 1331572 - RNA, 22 nt, Human
caaaugggguccuuuguccauu

SEQ ID NO: 1331573 - RNA, 22 nt, Human
caaaugggguccuuuuuccauu

SEQ ID NO: 1331574 - RNA, 22 nt, Human
cagcggauucuuuauguguggu

SEQ ID NO: 1331575 - RNA, 25 nt, Human
caguggaguccuuucugcguguucu

SEQ ID NO: 1331576 - RNA, 25 nt, Human
caguggaguccuuucuucguguucu

SEQ ID NO: 1331577 - RNA, 25 nt, Human
cagugggguccuuucuccauguucu

SEQ ID NO: 1331578 - RNA, 25 nt, Human
cagugggguccuuucuccguguucu

SEQ ID NO: 1331579 - RNA, 25 nt, Human
cagugggguccuuucuccguguucu

SEQ ID NO: 1331580 - RNA, 19 nt, Human
cauguucuguagacucugu

SEQ ID NO: 1331581 - RNA, 25 nt, Human
ccaaaggucuuccaguuuuaucuga

SEQ ID NO: 1331582 - RNA, 18 nt, Human
ccaaggccugcaggccca

SEQ ID NO: 1331583 - RNA, 23 nt, Human
ccacagccacaccccagacucau

SEQ ID NO: 1331584 - RNA, 22 nt, Human
cccuugguugcuggaguuuucu

SEQ ID NO: 1331585 - RNA, 23 nt, Human
ccugcaggcccaggagcagcacc

SEQ ID NO: 1331586 - RNA, 18 nt, Human
ccugccccccaagaagcu

SEQ ID NO: 1331587 - RNA, 19 nt, Human
ccuggagugaggggaaaua

SEQ ID NO: 1331588 - RNA, 20 nt, Human
ccuggagugaggggaaauau

SEQ ID NO: 1331589 - RNA, 20 nt, Human
ccuuucucuauuuucuguag

SEQ ID NO: 1331590 - RNA, 20 nt, Human
ccuuucucuauuuucuguag

SEQ ID NO: 1331591 - RNA, 20 nt, Human
ccuuucucuauuuucuguag

SEQ ID NO: 1331592 - RNA, 20 nt, Human
ccuuucucuauuuucuguag

SEQ ID NO: 1331593 - RNA, 20 nt, Human
ccuuucucuauuuucuguag

SEQ ID NO: 1331594 - RNA, 20 nt, Human
ccuuucucuauuuucuguag

SEQ ID NO: 1331595 - RNA, 20 nt, Human
ccuuucucuauuuucuguag

SEQ ID NO: 1331596 - RNA, 24 nt, Human
cuauguucuguagacucugcugca

SEQ ID NO: 1331597 - RNA, 20 nt, Human
cucauuggccaguggagucc

SEQ ID NO: 1331598 - RNA, 20 nt, Human
cucauuggccaguggagucc

SEQ ID NO: 1331599 - RNA, 20 nt, Human
cucugcugggaauagugugg

SEQ ID NO: 1331600 - RNA, 25 nt, Human
cugcuggggauagugugguguucuc

SEQ ID NO: 1331601 - RNA, 25 nt, Human
cugcuggggauagugugguguucuc

SEQ ID NO: 1331602 - RNA, 25 nt, Human
cugcuggggauagugugguguucuc

SEQ ID NO: 1331603 - RNA, 25 nt, Human
cugcuggggaugaugugguguucuc

SEQ ID NO: 1331604 - RNA, 25 nt, Human
cugcuggggauggugugguguucuc

SEQ ID NO: 1331605 - RNA, 25 nt, Human
cugcuggggauggugugguguucuc

SEQ ID NO: 1331606 - RNA, 20 nt, Human
cuggaaaagaugugcuuuuu

SEQ ID NO: 1331607 - RNA, 21 nt, Human
cuggcaggccuucuugauacc

SEQ ID NO: 1331608 - RNA, 18 nt, Human
cuucucauuggccaaugg

SEQ ID NO: 1331609 - RNA, 19 nt, Human
cuucucauuggccaaugga

SEQ ID NO: 1331610 - RNA, 23 nt, Human
cuucucauuggccaauggagucc

SEQ ID NO: 1331611 - RNA, 20 nt, Human
cuuuaugugugguaguggag

SEQ ID NO: 1331612 - RNA, 21 nt, Human
gacucaucucccuccggaacu

SEQ ID NO: 1331613 - RNA, 21 nt, Human
gacugucguuucuccauguuc

SEQ ID NO: 1331614 - RNA, 20 nt, Human
gagccacagccacaccccag

SEQ ID NO: 1331615 - RNA, 22 nt, Human
gaguccuuucugcguguucugu

SEQ ID NO: 1331616 - RNA, 24 nt, Human
gcagaacaaugugaucaaaaggga

SEQ ID NO: 1331617 - RNA, 25 nt, Human
gccacagccacaccccagacucauc

SEQ ID NO: 1331618 - RNA, 21 nt, Human
gccuguaggcuugucaguugg

SEQ ID NO: 1331619 - RNA, 20 nt, Human
gcguguucuguaggcucugc

SEQ ID NO: 1331620 - RNA, 21 nt, Human
gcucugcugggaauggugugg

SEQ ID NO: 1331621 - RNA, 21 nt, Human
gcucugcugggaauggugugg

SEQ ID NO: 1331622 - RNA, 20 nt, Human
gggaauggugcgguguucuc

SEQ ID NO: 1331623 - RNA, 23 nt, Human
gggaauggugcgguguucucauu

SEQ ID NO: 1331624 - RNA, 23 nt, Human
gguguucucauuggccaguggag

SEQ ID NO: 1331625 - RNA, 23 nt, Human
gguguucucauuggccaguggag

SEQ ID NO: 1331626 - RNA, 20 nt, Human
guccuuuuuccauuuucugu

SEQ ID NO: 1331627 - RNA, 24 nt, Human
guggagucagcaggaucaacagag

SEQ ID NO: 1331628 - RNA, 22 nt, Human
uaaaugggguccuuucuccauu

SEQ ID NO: 1331629 - RNA, 24 nt, Human
uccauuuucuguaggcucugcuag

SEQ ID NO: 1331630 - RNA, 24 nt, Human
uccauuuucuguaggcucugcuag

SEQ ID NO: 1331631 - RNA, 24 nt, Human
uccauuuucuguaggcucugcuga

SEQ ID NO: 1331632 - RNA, 24 nt, Human
uccauuuucuguaggcucugcugg

SEQ ID NO: 1331633 - RNA, 24 nt, Human
uccauuuucuguaggcucugcugg

SEQ ID NO: 1331634 - RNA, 24 nt, Human
uccauuuucuguaggcucugcugg

SEQ ID NO: 1331635 - RNA, 24 nt, Human
uccauuuucuguaggcucugcugg

SEQ ID NO: 1331636 - RNA, 24 nt, Human
uccauuuucuguaggcugugcugg

SEQ ID NO: 1331637 - RNA, 21 nt, Human
uccccaguuuucugauauucu

SEQ ID NO: 1331638 - RNA, 18 nt, Human
uccggaacuggcaggccu

SEQ ID NO: 1331639 - RNA, 24 nt, Human
ucuauuuucuguaggcccugcugg

SEQ ID NO: 1331640 - RNA, 24 nt, Human
ucuauuuucuguaggcccugcugg

SEQ ID NO: 1331641 - RNA, 22 nt, Human
ucuauuuucuguaggcucugcc

SEQ ID NO: 1331642 - RNA, 24 nt, Human
ucuauuuucuguaggcucugcugg

SEQ ID NO: 1331643 - RNA, 24 nt, Human
ucuauuuucuguaggcucugcugg

SEQ ID NO: 1331644 - RNA, 24 nt, Human
ucuauuuucuguaggcucugcugg

SEQ ID NO: 1331645 - RNA, 24 nt, Human
ucuauuuucuguaggcucugcugg

SEQ ID NO: 1331646 - RNA, 24 nt, Human
ucuauuuucuguaggcucugcugg

SEQ ID NO: 1331647 - RNA, 24 nt, Human
ucuauuuucuguaggcucugcugg

SEQ ID NO: 1331648 - RNA, 24 nt, Human
ucuauuuucuguaggcucugcugg

SEQ ID NO: 1331649 - RNA, 24 nt, Human
ucuauuuucuguaggcucugcugg

SEQ ID NO: 1331650 - RNA, 24 nt, Human
ucucauuggccaauguagucuuuu

SEQ ID NO: 1331651 - RNA, 22 nt, Human
ucucauuggcugaugguguccu

SEQ ID NO: 1331652 - RNA, 19 nt, Human
ucuguaggcccugcugggg

SEQ ID NO: 1331653 - RNA, 22 nt, Human
ucuucagaagugggaggagccu

SEQ ID NO: 1331654 - RNA, 24 nt, Human
ugagacagaguccuucuggggcuu

SEQ ID NO: 1331655 - RNA, 19 nt, Human
ugaucucauuggccagugg

SEQ ID NO: 1331656 - RNA, 19 nt, Human
ugauguggucuucucauug

SEQ ID NO: 1331657 - RNA, 19 nt, Human
ugauguggucuucucauug

SEQ ID NO: 1331658 - RNA, 19 nt, Human
ugauguggucuucucauug

SEQ ID NO: 1331659 - RNA, 19 nt, Human
ugaugugguuuucucauug

SEQ ID NO: 1331660 - RNA, 19 nt, Human
ugaugugguuuucucauug

SEQ ID NO: 1331661 - RNA, 27 nt, Human
ugcugaggaugauguggucgagccccu

SEQ ID NO: 1331662 - RNA, 27 nt, Human
ugcugaggaugauguggucgagccccu

SEQ ID NO: 1331663 - RNA, 27 nt, Human
ugcugaggaugauguggucgagccccu

SEQ ID NO: 1331664 - RNA, 27 nt, Human
ugcugaggaugauguggucgagccccu

SEQ ID NO: 1331665 - RNA, 26 nt, Human
ugcugaggaugauguggucgagcccu

SEQ ID NO: 1331666 - RNA, 26 nt, Human
ugcugaggaugauguggucgagcccu

SEQ ID NO: 1331667 - RNA, 26 nt, Human
ugcugaggaugauguggucgagcccu

SEQ ID NO: 1331668 - RNA, 26 nt, Human
ugcugaggaugauguggucgagcccu

SEQ ID NO: 1331669 - RNA, 27 nt, Human
ugcuggggaugauguggucgagccccu

SEQ ID NO: 1331670 - RNA, 27 nt, Human
ugcuggggaugauguggucgagccccu

SEQ ID NO: 1331671 - RNA, 26 nt, Human
ugcuggggaugauguggucgagcccu

SEQ ID NO: 1331672 - RNA, 24 nt, Human
ugcuggggaugauguggucuucuc

SEQ ID NO: 1331673 - RNA, 20 nt, Human
ugcuggggaugguguggccu

SEQ ID NO: 1331674 - RNA, 24 nt, Human
ugcuggggaugguguggucuucuc

SEQ ID NO: 1331675 - RNA, 24 nt, Human
ugcuggggaugguguggucuucuc

SEQ ID NO: 1331676 - RNA, 24 nt, Human
ugcuggggaugguguggucuucuc

SEQ ID NO: 1331677 - RNA, 24 nt, Human
ugcuggggauggugugguguucuc

SEQ ID NO: 1331678 - RNA, 23 nt, Human
ugcuuggucugugaauugccuga

SEQ ID NO: 1331679 - RNA, 19 nt, Human
uggaaggaaguuguagucu

SEQ ID NO: 1331680 - RNA, 19 nt, Human
uggaauguaguagcaccug

SEQ ID NO: 1331681 - RNA, 25 nt, Human
uggccaaaggaguccugucuccauu

SEQ ID NO: 1331682 - RNA, 22 nt, Human
uggccaauggggucauuucuuc

SEQ ID NO: 1331683 - RNA, 22 nt, Human
uggccgauggggucauuucuuc

SEQ ID NO: 1331684 - RNA, 22 nt, Human
uggcguuauauguuuuuuucca

SEQ ID NO: 1331685 - RNA, 19 nt, Human
ugguguggccuucucauug

SEQ ID NO: 1331686 - RNA, 19 nt, Human
ugguguggucuucucauug

SEQ ID NO: 1331687 - RNA, 19 nt, Human
ugguguggucuucucauug

SEQ ID NO: 1331688 - RNA, 19 nt, Human
ugguguggucuucucauug

SEQ ID NO: 1331689 - RNA, 19 nt, Human
ugguguggucuucucauug

SEQ ID NO: 1331690 - RNA, 19 nt, Human
ugguguggucuucucauug

SEQ ID NO: 1331691 - RNA, 19 nt, Human
ugguguggucuucucauug

SEQ ID NO: 1331692 - RNA, 19 nt, Human
ugguguggucuucucauug

SEQ ID NO: 1331693 - RNA, 23 nt, Human
uguaguuuuugucaggagcuugu

SEQ ID NO: 1331694 - RNA, 24 nt, Human
uguuggggauguugugguguucuc

SEQ ID NO: 1331695 - RNA, 25 nt, Human
uuacuggggauggugugguguucuc

SEQ ID NO: 1331696 - RNA, 23 nt, Human
uuccccaguuuucugauauucuu

SEQ ID NO: 1331697 - RNA, 24 nt, Human
uucuccauguucuguaggcuuuac

SEQ ID NO: 1331698 - RNA, 22 nt, Human
uugcuggagaugguauggucuu

SEQ ID NO: 1331699 - RNA, 22 nt, Human
uuucuuguuaccguugauuugc

SEQ ID NO: 1331700 - RNA, 20 nt, Human
uuugcuggggaugguguggc

SEQ ID NO: 1331701 - RNA, 19 nt, Human
uuuugcucuugggugcugg

SEQ ID NO: 1331702 - RNA, 21 nt, Human
aaaguggccugcccagacuau

SEQ ID NO: 1331703 - RNA, 24 nt, Human
aaaucgaaagcggccgccugcuca

SEQ ID NO: 1331704 - RNA, 19 nt, Human
agacuauuuugguagcaag

SEQ ID NO: 1331705 - RNA, 23 nt, Human
agcaagcguggaaaucagaucug

SEQ ID NO: 1331706 - RNA, 21 nt, Human
aggaagucugcauuaucacga

SEQ ID NO: 1331707 - RNA, 20 nt, Human
auccuguguuuguacuccag

SEQ ID NO: 1331708 - RNA, 18 nt, Human
cacaccaaagcaucagcc

SEQ ID NO: 1331709 - RNA, 22 nt, Human
caccacagagagaagaaaaggg

SEQ ID NO: 1331710 - RNA, 21 nt, Human
cagagugcuggccacaccaaa

SEQ ID NO: 1331711 - RNA, 22 nt, Human
caguaaggaauuacaaauccug

SEQ ID NO: 1331712 - RNA, 20 nt, Human
cgccuacuuccaaaaguggc

SEQ ID NO: 1331713 - RNA, 24 nt, Human
cucaaggcaaauuucaaguaacuc

SEQ ID NO: 1331714 - RNA, 22 nt, Human
cuuccaaaaguggccugcccag

SEQ ID NO: 1331715 - RNA, 19 nt, Human
gaaagcgaaaucgaaagcg

SEQ ID NO: 1331716 - RNA, 22 nt, Human
gcagcugccuacucugcagcug

SEQ ID NO: 1331717 - RNA, 23 nt, Human
ggaagucugcauuaucacgagga

SEQ ID NO: 1331718 - RNA, 19 nt, Human
uagcaagcguggaaaucag

SEQ ID NO: 1331719 - RNA, 24 nt, Human
uagcugaucaucuuuccguacauu

SEQ ID NO: 1331720 - RNA, 22 nt, Human
uaggggaaagcgaaaucgaaag

SEQ ID NO: 1331721 - RNA, 18 nt, Human
ucugcagcugugguucuc

SEQ ID NO: 1331722 - RNA, 21 nt, Human
ugagaaucucgggagcagccc

SEQ ID NO: 1331723 - RNA, 22 nt, Human
uggaaaggagguaacacacuca

SEQ ID NO: 1331724 - RNA, 22 nt, Human
uuacaguaaggaauuacaaauc

SEQ ID NO: 1331725 - RNA, 23 nt, Human
uucaaguaacucauccuggaggc

SEQ ID NO: 1331726 - RNA, 22 nt, Human
aaaaacaauuuguuuugaaaac

SEQ ID NO: 1331727 - RNA, 21 nt, Human
aaaaccuaauaacaaguauca

SEQ ID NO: 1331728 - RNA, 23 nt, Human
aaaauuacaacugagacagugag

SEQ ID NO: 1331729 - RNA, 19 nt, Human
aaacaagaaucuaccauac

SEQ ID NO: 1331730 - RNA, 25 nt, Human
aaacauuuagcacuguuaauggaca

SEQ ID NO: 1331731 - RNA, 19 nt, Human
aaaggacuuuggucuuccc

SEQ ID NO: 1331732 - RNA, 21 nt, Human
aacauuugaaaacaccaucgc

SEQ ID NO: 1331733 - RNA, 23 nt, Human
aaccuaauaacaaguaucauuca

SEQ ID NO: 1331734 - RNA, 23 nt, Human
aagagccaaggaagcugugguuu

SEQ ID NO: 1331735 - RNA, 22 nt, Human
aagcacccauaaauaauggcaa

SEQ ID NO: 1331736 - RNA, 21 nt, Human
aauagcagcccuuuccaaaac

SEQ ID NO: 1331737 - RNA, 20 nt, Human
aaucuauaaaguguuuccuu

SEQ ID NO: 1331738 - RNA, 22 nt, Human
aaucuuuucuucucuguguuga

SEQ ID NO: 1331739 - RNA, 23 nt, Human
acugcaauccacuuggggagacu

SEQ ID NO: 1331740 - RNA, 25 nt, Human
agaacaaauucacuacaaauuuuca

SEQ ID NO: 1331741 - RNA, 23 nt, Human
aggaagcugugguuucgcauuug

SEQ ID NO: 1331742 - RNA, 23 nt, Human
aggcuucaguuuuccaccuccag

SEQ ID NO: 1331743 - RNA, 19 nt, Human
agguagucgccaucucaaa

SEQ ID NO: 1331744 - RNA, 24 nt, Human
aucgcaaaauuacaacugagacag

SEQ ID NO: 1331745 - RNA, 25 nt, Human
auuacaacugagacagugagagauc

SEQ ID NO: 1331746 - RNA, 21 nt, Human
caaaaaacuaaaacuauagca

SEQ ID NO: 1331747 - RNA, 22 nt, Human
caaaaccuaauaacaaguauca

SEQ ID NO: 1331748 - RNA, 24 nt, Human
caagaggacagcuucgacucccuc

SEQ ID NO: 1331749 - RNA, 21 nt, Human
caaggcccggcaagccaaagg

SEQ ID NO: 1331750 - RNA, 23 nt, Human
cacacagccggcuuugcaugccc

SEQ ID NO: 1331751 - RNA, 23 nt, Human
cacugcuauagaaaucuauaaag

SEQ ID NO: 1331752 - RNA, 24 nt, Human
cagaaucaaggcccggcaagccaa

SEQ ID NO: 1331753 - RNA, 22 nt, Human
cagagcuuuccuuagacuaaaa

SEQ ID NO: 1331754 - RNA, 19 nt, Human
cagcguguggccacguggu

SEQ ID NO: 1331755 - RNA, 21 nt, Human
cagcuggaggcugcaagauuc

SEQ ID NO: 1331756 - RNA, 21 nt, Human
cauggcgcccagcaggaaugg

SEQ ID NO: 1331757 - RNA, 22 nt, Human
ccaaaacaaacccgcuuccugc

SEQ ID NO: 1331758 - RNA, 22 nt, Human
ccagagggcauauucaaaaaca

SEQ ID NO: 1331759 - RNA, 21 nt, Human
ccauaaauaauggcaagaaca

SEQ ID NO: 1331760 - RNA, 19 nt, Human
ccauacagaaagguagucg

SEQ ID NO: 1331761 - RNA, 27 nt, Human
ccauccagaaauuaagccaacacaaga

SEQ ID NO: 1331762 - RNA, 25 nt, Human
cccaagauagccauuugguugugcc

SEQ ID NO: 1331763 - RNA, 23 nt, Human
ccccuguacucuauggaucagcu

SEQ ID NO: 1331764 - RNA, 22 nt, Human
cccgcgcccggagagucgggac

SEQ ID NO: 1331765 - RNA, 21 nt, Human
cccuagauaacuacuauaggu

SEQ ID NO: 1331766 - RNA, 20 nt, Human
ccuccaaaaaacuaaaacua

SEQ ID NO: 1331767 - RNA, 19 nt, Human
cgacuaaucaacuuuccca

SEQ ID NO: 1331768 - RNA, 18 nt, Human
cgcacaugaaagcaccca

SEQ ID NO: 1331769 - RNA, 24 nt, Human
cgcgccggcagaggcuucagccug

SEQ ID NO: 1331770 - RNA, 21 nt, Human
cuaaaacuauagcaaggcuuc

SEQ ID NO: 1331771 - RNA, 19 nt, Human
cuaaccuccaagcuguccu

SEQ ID NO: 1331772 - RNA, 18 nt, Human
cucaaaaucugagaaagc

SEQ ID NO: 1331773 - RNA, 20 nt, Human
cucacugguccccuacccac

SEQ ID NO: 1331774 - RNA, 21 nt, Human
cucaucuggucuuguggcccc

SEQ ID NO: 1331775 - RNA, 21 nt, Human
cuccaaaaaacuaaaacuaua

SEQ ID NO: 1331776 - RNA, 22 nt, Human
cucccucugauuucaucuccga

SEQ ID NO: 1331777 - RNA, 19 nt, Human
cuccucaggauaacaucac

SEQ ID NO: 1331778 - RNA, 18 nt, Human
cucgcacaugaaagcacc

SEQ ID NO: 1331779 - RNA, 20 nt, Human
cucgccauaaaaccuuacua

SEQ ID NO: 1331780 - RNA, 24 nt, Human
cuguccuuguucauuccuggucgu

SEQ ID NO: 1331781 - RNA, 19 nt, Human
cugugcguuaucacaucaa

SEQ ID NO: 1331782 - RNA, 20 nt, Human
cuuaaaaacugcaauccacu

SEQ ID NO: 1331783 - RNA, 22 nt, Human
cuucagccuggagcucagggug

SEQ ID NO: 1331784 - RNA, 19 nt, Human
cuuuucuucucuguguuga

SEQ ID NO: 1331785 - RNA, 24 nt, Human
gaucauaacccuccaaaaaacuaa

SEQ ID NO: 1331786 - RNA, 21 nt, Human
gcaaaaagagccaaggaagcu

SEQ ID NO: 1331787 - RNA, 20 nt, Human
gcaaaauuacaacugagaca

SEQ ID NO: 1331788 - RNA, 21 nt, Human
gcaagauucuaaaccuccccc

SEQ ID NO: 1331789 - RNA, 20 nt, Human
ggagcucaggguggcgggca

SEQ ID NO: 1331790 - RNA, 27 nt, Human
ggcagaggcuucagccuggagcucagg

SEQ ID NO: 1331791 - RNA, 23 nt, Human
ggcaugauguugaagccccacuu

SEQ ID NO: 1331792 - RNA, 23 nt, Human
ggcuucagccuggagcucagggu

SEQ ID NO: 1331793 - RNA, 23 nt, Human
gguagaugaaucuuuucuucucu

SEQ ID NO: 1331794 - RNA, 23 nt, Human
guacaacagcuguuaccaaaacc

SEQ ID NO: 1331795 - RNA, 23 nt, Human
gugcgcgccggcagaggcuucag

SEQ ID NO: 1331796 - RNA, 23 nt, Human
uaaaaccuuacuauguaacacug

SEQ ID NO: 1331797 - RNA, 23 nt, Human
uaacacugcuauagaaaucuaua

SEQ ID NO: 1331798 - RNA, 27 nt, Human
uaaccaauuccaucuugcuucuaaccu

SEQ ID NO: 1331799 - RNA, 22 nt, Human
uaagccaacacaagaggacaac

SEQ ID NO: 1331800 - RNA, 23 nt, Human
uaauaacaaguaucauucaaagc

SEQ ID NO: 1331801 - RNA, 24 nt, Human
uacaacagcuguuaccaaaaccua

SEQ ID NO: 1331802 - RNA, 28 nt, Human
uagcaaggcuucaguuuuccaccuccag

SEQ ID NO: 1331803 - RNA, 21 nt, Human
uauuagaggaaaauaacucag

SEQ ID NO: 1331804 - RNA, 30 nt, Human; identical to SEQ ID NO: 1275747

SEQ ID NO: 1331805 - RNA, 19 nt, Human
ucacuacaaauuuucaaaa

SEQ ID NO: 1331806 - RNA, 21 nt, Human
ucagagcuuuccuuagacuaa

SEQ ID NO: 1331807 - RNA, 23 nt, Human
ucagagcuuuccuuagacuaaaa

SEQ ID NO: 1331808 - RNA, 19 nt, Human
ucaggauaacaucacuauu

SEQ ID NO: 1331809 - RNA, 22 nt, Human
uccgcagaaucaaggcccggca

SEQ ID NO: 1331810 - RNA, 20 nt, Human
ucgccaucucaaaacucuca

SEQ ID NO: 1331811 - RNA, 18 nt, Human
ucucaaaaucugagaaag

SEQ ID NO: 1331812 - RNA, 24 nt, Human
ucuuguggcccccauccagaaauu

SEQ ID NO: 1331813 - RNA, 23 nt, Human
ugaaaacaccaucgcaaaauuac

SEQ ID NO: 1331814 - RNA, 21 nt, Human
ugaaacaaagacaauagcagc

SEQ ID NO: 1331815 - RNA, 24 nt, Human
ugaaagcacccauaaauaauggca

SEQ ID NO: 1331816 - RNA, 18 nt, Human
ugaagcuuucucuucuaa

SEQ ID NO: 1331817 - RNA, 24 nt, Human
ugaucauaacccuccaaaaaacua

SEQ ID NO: 1331818 - RNA, 23 nt, Human
uggcaagaacaaauucacuacaa

SEQ ID NO: 1331819 - RNA, 25 nt, Human
uggcagcagcguguggccacguggu

SEQ ID NO: 1331820 - RNA, 21 nt, Human
uguggcccccauccagaaauu

SEQ ID NO: 1331821 - RNA, 20 nt, Human
uuagcacuguuaauggacag

SEQ ID NO: 1331822 - RNA, 21 nt, Human
uucuaaaccucccccaauugc

SEQ ID NO: 1331823 - RNA, 23 nt, Human
uucuuucuugcuugaucuucgau

SEQ ID NO: 1331824 - RNA, 21 nt, Human
uugaucuucgauaauacuggg

SEQ ID NO: 1331825 - RNA, 23 nt, Human
uugaucuucgauaauacugggaa

SEQ ID NO: 1331826 - RNA, 19 nt, Human
uuucaaauuuucagagcuu

SEQ ID NO: 1331827 - RNA, 21 nt, Human
aaacagaaaguaacaccagaa

SEQ ID NO: 1331828 - RNA, 21 nt, Human
aaaugucacugacuccugaaa

SEQ ID NO: 1331829 - RNA, 22 nt, Human
aaguucacagcuacauccucaa

SEQ ID NO: 1331830 - RNA, 22 nt, Human
aauaacuaauauaagagacaga

SEQ ID NO: 1331831 - RNA, 18 nt, Human
agacagaaggaccagccu

SEQ ID NO: 1331832 - RNA, 18 nt, Human
agcuacauccucaaaugu

SEQ ID NO: 1331833 - RNA, 27 nt, Human
aggaaaaacagaaaguaaccgguaccc

SEQ ID NO: 1331834 - RNA, 23 nt, Human
caaugucuuuggggaaucucaca

SEQ ID NO: 1331835 - RNA, 28 nt, Human
guucacagcuacauccucaaaugucacu

SEQ ID NO: 1331836 - RNA, 21 nt, Human
uaggaaaaacagaaaguaaca

SEQ ID NO: 1331837 - RNA, 26 nt, Human
uaggaaaaacagaaaguaacaccaga

SEQ ID NO: 1331838 - RNA, 21 nt, Human
uauuaggaagugauugauaaa

SEQ ID NO: 1331839 - RNA, 18 nt, Human
aagcagcaccaggagcgg

SEQ ID NO: 1331840 - RNA, 24 nt, Human
caaacgagcacacaagcagcacca

SEQ ID NO: 1331841 - RNA, 19 nt, Human
ucagcugccgcuucacaaa

SEQ ID NO: 1331842 - RNA, 24 nt, Human
uccucagcugccgcuucacaaaag

SEQ ID NO: 1331843 - RNA, 20 nt, Human
acagccaagucucccuugcc

SEQ ID NO: 1331844 - RNA, 21 nt, Human
caacugguccauccaccuccc

SEQ ID NO: 1331845 - RNA, 21 nt, Human
cacagccaagucucccuugcc

SEQ ID NO: 1331846 - RNA, 22 nt, Human
cacagccaagucucccuugccc

SEQ ID NO: 1331847 - RNA, 23 nt, Human
cacagccaagucucccuugcccc

SEQ ID NO: 1331848 - RNA, 22 nt, Human
caccacagccuaccugccccuc

SEQ ID NO: 1331849 - RNA, 23 nt, Human
caccagcccaccccaggggacac

SEQ ID NO: 1331850 - RNA, 18 nt, Human
cagccuaccugccccucc

SEQ ID NO: 1331851 - RNA, 24 nt, Human
caguggaccuugccuccaucucac

SEQ ID NO: 1331852 - RNA, 20 nt, Human
caugccacucugaagcccac

SEQ ID NO: 1331853 - RNA, 19 nt, Human
ccagcccaccccaggggac

SEQ ID NO: 1331854 - RNA, 19 nt, Human
ccccaggggacaccaacug

SEQ ID NO: 1331855 - RNA, 23 nt, Human
cucacagccaagucucccuugcc

SEQ ID NO: 1331856 - RNA, 21 nt, Human
cuccugccucacagccaaguc

SEQ ID NO: 1331857 - RNA, 18 nt, Human
cuggcaccacagccuacc

SEQ ID NO: 1331858 - RNA, 24 nt, Human
gacaccaacugguccauccaccuc

SEQ ID NO: 1331859 - RNA, 18 nt, Human
gaccuugccuccaucuca

SEQ ID NO: 1331860 - RNA, 21 nt, Human
guccauguugagccuuccuca

SEQ ID NO: 1331861 - RNA, 22 nt, Human
guugagccuuccucaaaggcag

SEQ ID NO: 1331862 - RNA, 18 nt, Human
ucugaagcccacaccauu

SEQ ID NO: 1331863 - RNA, 19 nt, Human
ucuuccccagagccccaca

SEQ ID NO: 1331864 - RNA, 19 nt, Human
ugccaugccacucugaagc

SEQ ID NO: 1331865 - RNA, 19 nt, Human
ugccccuccugccucacag

SEQ ID NO: 1331866 - RNA, 21 nt, Human
uguccauguugagccuuccuc

SEQ ID NO: 1331867 - RNA, 22 nt, Human
uugccaugccacucugaagccc

SEQ ID NO: 1331868 - RNA, 18 nt, Human
aacaucuccuuggcugcc

SEQ ID NO: 1331869 - RNA, 21 nt, Human
augaccccagggccccugggc

SEQ ID NO: 1331870 - RNA, 20 nt, Human
caccuucagacucccagcua

SEQ ID NO: 1331871 - RNA, 24 nt, Human
uccaagaacaacaucuccuuggcu

SEQ ID NO: 1331872 - RNA, 19 nt, Human
ugcccaugaccccagggcc

SEQ ID NO: 1331873 - RNA, 20 nt, Human
ugcucucugcccaugacccc

SEQ ID NO: 1331874 - RNA, 19 nt, Human
aacacaggucagugugagg

SEQ ID NO: 1331875 - RNA, 18 nt, Human
aagugcugggauuacagg

SEQ ID NO: 1331876 - RNA, 19 nt, Human
aagugcugggauuacaggc

SEQ ID NO: 1331877 - RNA, 21 nt, Human
aagugcugggauuacaggcau

SEQ ID NO: 1331878 - RNA, 22 nt, Human
aagugcugggauuacaggcaug

SEQ ID NO: 1331879 - RNA, 23 nt, Human
aagugcugggauuacaggcauga

SEQ ID NO: 1331880 - RNA, 26 nt, Human
aagugcugggauuacaggcaugagcu

SEQ ID NO: 1331881 - RNA, 19 nt, Human
acagacagauucagaggcc

SEQ ID NO: 1331882 - RNA, 19 nt, Human
acccaggcuggagugcagu

SEQ ID NO: 1331883 - RNA, 18 nt, Human
acccugucacccaggcug

SEQ ID NO: 1331884 - RNA, 25 nt, Human
acccugucacccaggcuggagugca

SEQ ID NO: 1331885 - RNA, 18 nt, Human
acgggguuucaccguguu

SEQ ID NO: 1331886 - RNA, 19 nt, Human
acgggguuucaccguguua

SEQ ID NO: 1331887 - RNA, 20 nt, Human
acgggguuucaccguguuag

SEQ ID NO: 1331888 - RNA, 24 nt, Human
acgggguuucaccguguuagccag

SEQ ID NO: 1331889 - RNA, 19 nt, Human
agaaaagagaacagggaag

SEQ ID NO: 1331890 - RNA, 21 nt, Human
agaaaagagaacagggaagga

SEQ ID NO: 1331891 - RNA, 21 nt, Human
aggaacacaggucagugugag

SEQ ID NO: 1331892 - RNA, 20 nt, Human
agggaaggaacacaggucag

SEQ ID NO: 1331893 - RNA, 19 nt, Human
aguagcugggacuacaggc

SEQ ID NO: 1331894 - RNA, 23 nt, Human
aguagcugggacuacaggcccgu

SEQ ID NO: 1331895 - RNA, 23 nt, Human
cacccugucacccaggcuggagu

SEQ ID NO: 1331896 - RNA, 24 nt, Human
cacccugucacccaggcuggagug

SEQ ID NO: 1331897 - RNA, 27 nt, Human
cacccugucacccaggcuggagugcag

SEQ ID NO: 1331898 - RNA, 18 nt, Human
caccguguuagccaggau

SEQ ID NO: 1331899 - RNA, 24 nt, Human
caccguguuagccaggaugguuuc

SEQ ID NO: 1331900 - RNA, 21 nt, Human
cacugcaaccuccgccucccg

SEQ ID NO: 1331901 - RNA, 23 nt, Human
cacugcaaccuccgccucccggg

SEQ ID NO: 1331902 - RNA, 18 nt, Human
ccgcacucugcccagguu

SEQ ID NO: 1331903 - RNA, 23 nt, Human
ccgccuccugaguagcugggacu

SEQ ID NO: 1331904 - RNA, 19 nt, Human
ccuaagugcugggauuaca

SEQ ID NO: 1331905 - RNA, 22 nt, Human
ccuaagugcugggauuacaggc

SEQ ID NO: 1331906 - RNA, 23 nt, Human
ccuaagugcugggauuacaggca

SEQ ID NO: 1331907 - RNA, 24 nt, Human
ccuaagugcugggauuacaggcau

SEQ ID NO: 1331908 - RNA, 18 nt, Human
ccucgugaucugcccucc

SEQ ID NO: 1331909 - RNA, 21 nt, Human
ccucgugaucugcccuccucg

SEQ ID NO: 1331910 - RNA, 20 nt, Human
ccucugcgcccagcuaauuu

SEQ ID NO: 1331911 - RNA, 23 nt, Human
ccugaguagcugggacuacaggc

SEQ ID NO: 1331912 - RNA, 24 nt, Human
ccugccuccgccuccugaguagcu

SEQ ID NO: 1331913 - RNA, 24 nt, Human
ccugucacccaggcuggagugcag

SEQ ID NO: 1331914 - RNA, 21 nt, Human
cgcacacaaggcagcugugca

SEQ ID NO: 1331915 - RNA, 19 nt, Human
cgccucccggguugacgcc

SEQ ID NO: 1331916 - RNA, 24 nt, Human
cgggguuucaccguguuagccagg

SEQ ID NO: 1331917 - RNA, 22 nt, Human
cuaagugcugggauuacaggca

SEQ ID NO: 1331918 - RNA, 23 nt, Human
cucacauugugcuaacagggaca

SEQ ID NO: 1331919 - RNA, 24 nt, Human
cucacugcaaccuccgccucccgg

SEQ ID NO: 1331920 - RNA, 22 nt, Human
cuccugaccucgugaucugccc

SEQ ID NO: 1331921 - RNA, 23 nt, Human
cugcaaccuccgccucccggguu

SEQ ID NO: 1331922 - RNA, 20 nt, Human
cuggagugcagucgcacaau

SEQ ID NO: 1331923 - RNA, 18 nt, Human
gaacacaggucaguguga

SEQ ID NO: 1331924 - RNA, 19 nt, Human
gaccucgugaucugcccuc

SEQ ID NO: 1331925 - RNA, 22 nt, Human
gaccucgugaucugcccuccuc

SEQ ID NO: 1331926 - RNA, 24 nt, Human
gaccucgugaucugcccuccucgg

SEQ ID NO: 1331927 - RNA, 24 nt, Human
gagacgggguuucaccguguuagc

SEQ ID NO: 1331928 - RNA, 26 nt, Human
gaguagcugggacuacaggcccgugc

SEQ ID NO: 1331929 - RNA, 19 nt, Human
gauuacaggcaugagcugc

SEQ ID NO: 1331930 - RNA, 23 nt, Human
gauuacaggcaugagcugccgca

SEQ ID NO: 1331931 - RNA, 21 nt, Human
gcaaccuccgccucccggguu

SEQ ID NO: 1331932 - RNA, 23 nt, Human
gcccagcuaauuuuuuguauuuu

SEQ ID NO: 1331933 - RNA, 19 nt, Human
ggaaauccugcaucucagu

SEQ ID NO: 1331934 - RNA, 20 nt, Human
ggaaauccugcaucucaguc

SEQ ID NO: 1331935 - RNA, 19 nt, Human
ggauuacaggcaugagcug

SEQ ID NO: 1331936 - RNA, 23 nt, Human
gggguuucaccguguuagccagg

SEQ ID NO: 1331937 - RNA, 20 nt, Human
gguuucgaucuccugaccuc

SEQ ID NO: 1331938 - RNA, 23 nt, Human
guagagacgggguuucaccgugu

SEQ ID NO: 1331939 - RNA, 24 nt, Human
uaagugcugggauuacaggcauga

SEQ ID NO: 1331940 - RNA, 25 nt, Human
uaauuuuuuguauuuuuuaguagag

SEQ ID NO: 1331941 - RNA, 21 nt, Human
uacaggcaugagcugccgcac

SEQ ID NO: 1331942 - RNA, 21 nt, Human
uagaaaagagaacagggaagg

SEQ ID NO: 1331943 - RNA, 21 nt, Human
uaguagagacgggguuucacc

SEQ ID NO: 1331944 - RNA, 24 nt, Human
uaguagagacgggguuucaccgug

SEQ ID NO: 1331945 - RNA, 26 nt, Human
uaguagagacgggguuucaccguguu

SEQ ID NO: 1331946 - RNA, 26 nt, Human
uaguagagacgggguuucaccguugg

SEQ ID NO: 1331947 - RNA, 21 nt, Human
ucacccaggcuggagugcagu

SEQ ID NO: 1331948 - RNA, 22 nt, Human
ucacccugucacccaggcugga

SEQ ID NO: 1331949 - RNA, 23 nt, Human
ucacccugucacccaggcuggag

SEQ ID NO: 1331950 - RNA, 24 nt, Human
ucacccugucacccaggcuggagu

SEQ ID NO: 1331951 - RNA, 24 nt, Human
ucaccguguuagccaggaugguuu

SEQ ID NO: 1331952 - RNA, 23 nt, Human
ucacugcaaccuccgccucccgg

SEQ ID NO: 1331953 - RNA, 24 nt, Human
ucacugcaaccuccgccucccggg

SEQ ID NO: 1331954 - RNA, 25 nt, Human
ucacugcaaccuccgccucccgggu

SEQ ID NO: 1331955 - RNA, 25 nt, Human
ucacugcaaccuccgccucccgggu

SEQ ID NO: 1331956 - RNA, 24 nt, Human
ucccggguugacgccauucuccug

SEQ ID NO: 1331957 - RNA, 24 nt, Human
ucccuaagugcugggauuacaggc

SEQ ID NO: 1331958 - RNA, 24 nt, Human
uccugaguagcugggacuacaggc

SEQ ID NO: 1331959 - RNA, 24 nt, Human
ucgcacaauccuggcucacugcaa

SEQ ID NO: 1331960 - RNA, 20 nt, Human
ugcaaaaagagaagccagag

SEQ ID NO: 1331961 - RNA, 24 nt, Human
ugcaaaaagagaagccagaguccc

SEQ ID NO: 1331962 - RNA, 23 nt, Human
ugccuccgccuccugaguagcug

SEQ ID NO: 1331963 - RNA, 24 nt, Human
ugccuccgccuccugaguagcugg

SEQ ID NO: 1331964 - RNA, 22 nt, Human
ugccucugcgcccagcuaauuu

SEQ ID NO: 1331965 - RNA, 24 nt, Human
ugccucugcgcccagcuaauuuuu

SEQ ID NO: 1331966 - RNA, 20 nt, Human
ugcugggauuacaggcauga

SEQ ID NO: 1331967 - RNA, 24 nt, Human
uggagugcagucgcacaauccugg

SEQ ID NO: 1331968 - RNA, 18 nt, Human
ugggauuacaggcaugag

SEQ ID NO: 1331969 - RNA, 19 nt, Human
ugggauuacaggcaugagc

SEQ ID NO: 1331970 - RNA, 21 nt, Human
ugggauuacaggcaugagcug

SEQ ID NO: 1331971 - RNA, 22 nt, Human
ugggauuacaggcaugagcugc

SEQ ID NO: 1331972 - RNA, 23 nt, Human
ugggauuacaggcaugagcugcc

SEQ ID NO: 1331973 - RNA, 24 nt, Human
ugggauuacaggcaugagcugccg

SEQ ID NO: 1331974 - RNA, 24 nt, Human
ugggauuacaggcaugagcugccg

SEQ ID NO: 1331975 - RNA, 25 nt, Human
ugggauuacaggcaugagcugccgc

SEQ ID NO: 1331976 - RNA, 21 nt, Human
ugugaggaagggggucauggu

SEQ ID NO: 1331977 - RNA, 18 nt, Human
uuaguagagacgggguuu

SEQ ID NO: 1331978 - RNA, 22 nt, Human
uuaguagagacgggguuucacc

SEQ ID NO: 1331979 - RNA, 24 nt, Human
uuaguagagacgggguuucaccgu

SEQ ID NO: 1331980 - RNA, 18 nt, Human
uugcaaaaagagaagcca

SEQ ID NO: 1331981 - RNA, 22 nt, Human
uuucacccugucacccaggcug

SEQ ID NO: 1331982 - RNA, 24 nt, Human
uuucacccugucacccaggcugga

SEQ ID NO: 1331983 - RNA, 19 nt, Human
uuucaccguguuagccagg

SEQ ID NO: 1331984 - RNA, 24 nt, Human
uuuuuaguagagacgggguuucac

SEQ ID NO: 1331985 - RNA, 27 nt, Human
uuuuuauuuuucaauuuuuauuuuuug

SEQ ID NO: 1331986 - RNA, 22 nt, Human
uuuuuguauuuuuuaguagaga

SEQ ID NO: 1331987 - RNA, 23 nt, Human
uuuuuuaguagagacgggguuuc

SEQ ID NO: 1331988 - RNA, 25 nt, Human
uuuuuuguauuuuuuaguagagacg

SEQ ID NO: 1331989 - RNA, 18 nt, Human
aaaaaagaagggagaaga

SEQ ID NO: 1331990 - RNA, 22 nt, Human
aacugacugccccccggggcag

SEQ ID NO: 1331991 - RNA, 20 nt, Human
agaguccugggugccgaccu

SEQ ID NO: 1331992 - RNA, 24 nt, Human
aggaaggaggcgcgcgugggagga

SEQ ID NO: 1331993 - RNA, 24 nt, Human
aggcgagaggaugaugcggggugg

SEQ ID NO: 1331994 - RNA, 24 nt, Human
agggggcggcggagcggagggcgg

SEQ ID NO: 1331995 - RNA, 24 nt, Human
agugcaaaagcgggcgagaaggga

SEQ ID NO: 1331996 - RNA, 21 nt, Human
caaagauacugggagggaaga

SEQ ID NO: 1331997 - RNA, 20 nt, Human
caccuggagggggcggcgga

SEQ ID NO: 1331998 - RNA, 18 nt, Human
cagauguucuccgcaacc

SEQ ID NO: 1331999 - RNA, 23 nt, Human
cagcgagggaagaaaagaguaau

SEQ ID NO: 1332000 - RNA, 22 nt, Human
cagcuguuagccuggaacagcc

SEQ ID NO: 1332001 - RNA, 21 nt, Human
caguggcaccgagagggcgcc

SEQ ID NO: 1332002 - RNA, 20 nt, Human
caguucaucuggggaagggg

SEQ ID NO: 1332003 - RNA, 22 nt, Human
cccacagcuguuagccuggaac

SEQ ID NO: 1332004 - RNA, 26 nt, Human
cccacagcuguuagccuggaacagcc

SEQ ID NO: 1332005 - RNA, 24 nt, Human
cccaggucaguccaaaagcaaaga

SEQ ID NO: 1332006 - RNA, 20 nt, Human
cccccggggcagcccccgcc

SEQ ID NO: 1332007 - RNA, 23 nt, Human
cccgggacccuagaggaggcggg

SEQ ID NO: 1332008 - RNA, 25 nt, Human
cccgggcuugaccuuaguggaaagc

SEQ ID NO: 1332009 - RNA, 24 nt, Human
cccuccaggagcgaggcgagagga

SEQ ID NO: 1332010 - RNA, 19 nt, Human
cccucuggcccgagagccu

SEQ ID NO: 1332011 - RNA, 21 nt, Human
cccucuggcccgagagccugu

SEQ ID NO: 1332012 - RNA, 21 nt, Human
ccgcaaccuuccggaagugga

SEQ ID NO: 1332013 - RNA, 19 nt, Human
ccgccgagcucccgccgcc

SEQ ID NO: 1332014 - RNA, 20 nt, Human
ccgccgagcucccgccgccu

SEQ ID NO: 1332015 - RNA, 24 nt, Human
ccucaacugacugccccccggggc

SEQ ID NO: 1332016 - RNA, 23 nt, Human
ccuccgccgagcucccgccgccu

SEQ ID NO: 1332017 - RNA, 18 nt, Human
cgagaagggaaacccaag

SEQ ID NO: 1332018 - RNA, 18 nt, Human
cgaggaccggauguggcg

SEQ ID NO: 1332019 - RNA, 24 nt, Human
cggggcuagcaggugacgucagcg

SEQ ID NO: 1332020 - RNA, 22 nt, Human
cugaggcuauacuacaaagccc

SEQ ID NO: 1332021 - RNA, 22 nt, Human
gacaaggacuuuuggggggagg

SEQ ID NO: 1332022 - RNA, 20 nt, Human
gagagggcgccccggcggcg

SEQ ID NO: 1332023 - RNA, 23 nt, Human
gagcugguugugguguuuuccag

SEQ ID NO: 1332024 - RNA, 21 nt, Human
gcaaagauacugggagggaag

SEQ ID NO: 1332025 - RNA, 20 nt, Human
gcccucuggcccgagagccu

SEQ ID NO: 1332026 - RNA, 21 nt, Human
gcgagaagggaaacccaagcg

SEQ ID NO: 1332027 - RNA, 20 nt, Human
gcggcgauggaaggcggacg

SEQ ID NO: 1332028 - RNA, 24 nt, Human
gcggcggcgauggaaggcggacgg

SEQ ID NO: 1332029 - RNA, 22 nt, Human
ggaacgaugauaaggagcaggu

SEQ ID NO: 1332030 - RNA, 23 nt, Human
ggaaggaggcgcgcgugggagga

SEQ ID NO: 1332031 - RNA, 24 nt, Human
ggacaaggacuuuuggggggaggu

SEQ ID NO: 1332032 - RNA, 19 nt, Human
ggagagggggcguggacac

SEQ ID NO: 1332033 - RNA, 19 nt, Human
ggagggaagauggcgcugg

SEQ ID NO: 1332034 - RNA, 19 nt, Human
ggcgagaagggaaacccaa

SEQ ID NO: 1332035 - RNA, 19 nt, Human
gggaaggggcuacaaagca

SEQ ID NO: 1332036 - RNA, 25 nt, Human
gggcgagaagggaaacccaagcggg

SEQ ID NO: 1332037 - RNA, 21 nt, Human
gggcgccccggcggcgaggaa

SEQ ID NO: 1332038 - RNA, 19 nt, Human
uaagugcaaaagcgggcga

SEQ ID NO: 1332039 - RNA, 25 nt, Human
uacagaucauaagugcaaaagcggg

SEQ ID NO: 1332040 - RNA, 18 nt, Human
uacccccaggucagucca

SEQ ID NO: 1332041 - RNA, 25 nt, Human
uaccuugcgcucccgggagaaccua

SEQ ID NO: 1332042 - RNA, 24 nt, Human
ucaccuggagggggcggcggagcg

SEQ ID NO: 1332043 - RNA, 21 nt, Human
ugagagccaguggcaccgaga

SEQ ID NO: 1332044 - RNA, 23 nt, Human
ugagagccaguggcaccgagagg

SEQ ID NO: 1332045 - RNA, 20 nt, Human
ugagaguccugggugccgac

SEQ ID NO: 1332046 - RNA, 19 nt, Human
ugaggagcugguuguggug

SEQ ID NO: 1332047 - RNA, 20 nt, Human
ugccccccggggcagccccc

SEQ ID NO: 1332048 - RNA, 19 nt, Human
ugcuggacuacaccggggg

SEQ ID NO: 1332049 - RNA, 22 nt, Human
ugcuggacuacaccgggggcac

SEQ ID NO: 1332050 - RNA, 18 nt, Human
uggagggggcggcggagc

SEQ ID NO: 1332051 - RNA, 21 nt, Human
ugggagggaagauggcgcugg

SEQ ID NO: 1332052 - RNA, 22 nt, Human
ugggguggcagaggggagauac

SEQ ID NO: 1332053 - RNA, 22 nt, Human
uucggaggagggggggcgcgug

SEQ ID NO: 1332054 - RNA, 19 nt, Human
aauguauagaaggaaaagg

SEQ ID NO: 1332055 - RNA, 24 nt, Human
agcuuuauuccaaaaauaauuuua

SEQ ID NO: 1332056 - RNA, 22 nt, Human
cagaggccuggagcccucggcu

SEQ ID NO: 1332057 - RNA, 23 nt, Human
cagcuaccuugggaccucuagga

SEQ ID NO: 1332058 - RNA, 22 nt, Human
cuggagccucagcuucgcaagu

SEQ ID NO: 1332059 - RNA, 26 nt, Human
ggccuggagcccucggcuggagccuc

SEQ ID NO: 1332060 - RNA, 22 nt, Human
guauagaaggaaaaggagcugg

SEQ ID NO: 1332061 - RNA, 22 nt, Human
gucagcuaccuugggaccucua

SEQ ID NO: 1332062 - RNA, 19 nt, Human
ucagaggccuggagcccuc

SEQ ID NO: 1332063 - RNA, 21 nt, Human
ugcucccggcccugaagcguc

SEQ ID NO: 1332064 - RNA, 27 nt, Human
uguauagaaggaaaaggagcugguuga

SEQ ID NO: 1332065 - RNA, 21 nt, Human
uuaauagguauuaaauaaugu

SEQ ID NO: 1332066 - RNA, 18 nt, Human
aaacaagaaaagcccuga

SEQ ID NO: 1332067 - RNA, 18 nt, Human
aacaagaaaagcccugac

SEQ ID NO: 1332068 - RNA, 19 nt, Human
acaagaaaagcccugacgc

SEQ ID NO: 1332069 - RNA, 18 nt, Human
caagaaaagcccugacgc

SEQ ID NO: 1332070 - RNA, 21 nt, Human
ccccgcccagucccgcccgcc

SEQ ID NO: 1332071 - RNA, 20 nt, Human
cccgcccagucccgcccgcc

SEQ ID NO: 1332072 - RNA, 20 nt, Human
cccgccgagguccgugucca

SEQ ID NO: 1332073 - RNA, 24 nt, Human
ccgcccgccgagguccguguccaa

SEQ ID NO: 1332074 - RNA, 19 nt, Human
gauccuccucgcgcacccc

SEQ ID NO: 1332075 - RNA, 18 nt, Human
ggcuccuggagauugagg

SEQ ID NO: 1332076 - RNA, 22 nt, Human
gggaaagauggugaaaaaaugc

SEQ ID NO: 1332077 - RNA, 23 nt, Human
ggugaaaaaaugcgaggaaaaga

SEQ ID NO: 1332078 - RNA, 30 nt, Human; identical to SEQ ID NO: 1328529

SEQ ID NO: 1332079 - RNA, 20 nt, Human
ugaugccccgccccgcccag

SEQ ID NO: 1332080 - RNA, 20 nt, Human
aaaugcagacacacagauaa

SEQ ID NO: 1332081 - RNA, 18 nt, Human
aauuagccaggcauggug

SEQ ID NO: 1332082 - RNA, 22 nt, Human
acacacagagcagguaguugua

SEQ ID NO: 1332083 - RNA, 26 nt, Human
acagagugaggcccugucccuacaaa

SEQ ID NO: 1332084 - RNA, 20 nt, Human
accacugcaaaacuccaucu

SEQ ID NO: 1332085 - RNA, 24 nt, Human
accagcuugugcaacagagugagg

SEQ ID NO: 1332086 - RNA, 22 nt, Human
accaggucuugggugcccaggu

SEQ ID NO: 1332087 - RNA, 21 nt, Human
acccaccccggggcacgcaca

SEQ ID NO: 1332088 - RNA, 22 nt, Human
accccccuccccccuccccccc

SEQ ID NO: 1332089 - RNA, 23 nt, Human
accccccuccccccucccccccc

SEQ ID NO: 1332090 - RNA, 25 nt, Human
accccccuccccccuccccccccac

SEQ ID NO: 1332091 - RNA, 21 nt, Human
acccgcccucccuccuuaucu

SEQ ID NO: 1332092 - RNA, 19 nt, Human
agagauacagggaccuugc

SEQ ID NO: 1332093 - RNA, 22 nt, Human
agaggucacacuggacccagag

SEQ ID NO: 1332094 - RNA, 18 nt, Human
agcagcuccccucugucu

SEQ ID NO: 1332095 - RNA, 22 nt, Human
agcauuuugggaggccaaggca

SEQ ID NO: 1332096 - RNA, 24 nt, Human
aggaauugaaggcugcaaugagcu

SEQ ID NO: 1332097 - RNA, 18 nt, Human
aggcaggaggauugccug

SEQ ID NO: 1332098 - RNA, 24 nt, Human
aggcaggaggauugccugagccca

SEQ ID NO: 1332099 - RNA, 21 nt, Human
aggcugaggcaggaggauugc

SEQ ID NO: 1332100 - RNA, 24 nt, Human
aggcugaggcaggaggauugccug

SEQ ID NO: 1332101 - RNA, 24 nt, Human
aggugcaguggcucacaccuguaa

SEQ ID NO: 1332102 - RNA, 24 nt, Human
aguggcucacaccuguaaucucag

SEQ ID NO: 1332103 - RNA, 18 nt, Human
auccugcucuuggcucuu

SEQ ID NO: 1332104 - RNA, 19 nt, Human
augucugagguggccacaa

SEQ ID NO: 1332105 - RNA, 24 nt, Human
caagugaauaugcguaccccccuc

SEQ ID NO: 1332106 - RNA, 22 nt, Human
cacaaccuaaucucuguguacc

SEQ ID NO: 1332107 - RNA, 24 nt, Human
cacaccuguaaucucagcauuuug

SEQ ID NO: 1332108 - RNA, 22 nt, Human
cacauggaaaugcccugggaac

SEQ ID NO: 1332109 - RNA, 19 nt, Human
caccccggggcacgcacag

SEQ ID NO: 1332110 - RNA, 24 nt, Human
caccuguaaucucagcauuuuggg

SEQ ID NO: 1332111 - RNA, 18 nt, Human
cagagugaggcccugucc

SEQ ID NO: 1332112 - RNA, 20 nt, Human
cagauggaguccagcaugga

SEQ ID NO: 1332113 - RNA, 24 nt, Human
cagcauuuugggaggccaaggcag

SEQ ID NO: 1332114 - RNA, 24 nt, Human
cagcauuuugggaggccaaggcag

SEQ ID NO: 1332115 - RNA, 24 nt, Human
cagcuacucaggaggcugaggcag

SEQ ID NO: 1332116 - RNA, 18 nt, Human
caggucuugggugcccag

SEQ ID NO: 1332117 - RNA, 21 nt, Human
caggucuugggugcccagguc

SEQ ID NO: 1332118 - RNA, 23 nt, Human
ccacacucccucuccaaaaaaua

SEQ ID NO: 1332119 - RNA, 23 nt, Human
ccagagccugcagaggucacacu

SEQ ID NO: 1332120 - RNA, 19 nt, Human
ccauagcaugcuggcaccc

SEQ ID NO: 1332121 - RNA, 23 nt, Human
ccaucuaaaaaaaaaauggccau

SEQ ID NO: 1332122 - RNA, 23 nt, Human
cccauagcaugcuggcacccgcc

SEQ ID NO: 1332123 - RNA, 22 nt, Human
ccccccuccccccccacacaca

SEQ ID NO: 1332124 - RNA, 24 nt, Human
ccccccuccccccccacacacaga

SEQ ID NO: 1332125 - RNA, 19 nt, Human
ccccccuccccccuccccc

SEQ ID NO: 1332126 - RNA, 22 nt, Human
cccccuccccccucccccccca

SEQ ID NO: 1332127 - RNA, 22 nt, Human
ccccucugucuuccaagaccug

SEQ ID NO: 1332128 - RNA, 22 nt, Human
cccucccuccuuaucucuccca

SEQ ID NO: 1332129 - RNA, 22 nt, Human
cccucccuccuuaucucuccca

SEQ ID NO: 1332130 - RNA, 21 nt, Human
ccuccacccugauggguaguc

SEQ ID NO: 1332131 - RNA, 19 nt, Human
ccuccaccucauccugcuc

SEQ ID NO: 1332132 - RNA, 18 nt, Human
ccuggagcacauggaaau

SEQ ID NO: 1332133 - RNA, 21 nt, Human
ccuugccuggggcaaaaagga

SEQ ID NO: 1332134 - RNA, 24 nt, Human
cguaccccccuccccccucccccc

SEQ ID NO: 1332135 - RNA, 21 nt, Human
cucacaccuguaaucucagca

SEQ ID NO: 1332136 - RNA, 21 nt, Human
cucacaccuguaaucucagca

SEQ ID NO: 1332137 - RNA, 19 nt, Human
cucauccugcucuuggcuc

SEQ ID NO: 1332138 - RNA, 19 nt, Human
cuccccccuccccccccac

SEQ ID NO: 1332139 - RNA, 22 nt, Human
cucuguguaccacaggccucac

SEQ ID NO: 1332140 - RNA, 19 nt, Human
cugaaacccaugacugcug

SEQ ID NO: 1332141 - RNA, 23 nt, Human
cugacacuggagaaacccaauug

SEQ ID NO: 1332142 - RNA, 21 nt, Human
cuguagucccagcuacucagg

SEQ ID NO: 1332143 - RNA, 18 nt, Human
gaaaggaaaccaggucuu

SEQ ID NO: 1332144 - RNA, 24 nt, Human
gaaagucuuucccuugggaaacca

SEQ ID NO: 1332145 - RNA, 23 nt, Human
gaauaugcguaccccccuccccc

SEQ ID NO: 1332146 - RNA, 22 nt, Human
gacuucaagugaauaugcguac

SEQ ID NO: 1332147 - RNA, 18 nt, Human
gagcagguaguuguaacg

SEQ ID NO: 1332148 - RNA, 19 nt, Human
gauugcaccacugcaaaac

SEQ ID NO: 1332149 - RNA, 19 nt, Human
gcugcaaugagcuaugauu

SEQ ID NO: 1332150 - RNA, 20 nt, Human
ggaaaacaugugcaacuggg

SEQ ID NO: 1332151 - RNA, 20 nt, Human
ggagcacucagggagaugag

SEQ ID NO: 1332152 - RNA, 22 nt, Human
ggaggauugccugagcccagga

SEQ ID NO: 1332153 - RNA, 22 nt, Human
ggcaaaaaggauuagaaaaugc

SEQ ID NO: 1332154 - RNA, 18 nt, Human
ggcgaggugcaguggcuc

SEQ ID NO: 1332155 - RNA, 21 nt, Human
ggcgaggugcaguggcucaca

SEQ ID NO: 1332156 - RNA, 20 nt, Human
gggaaaccagggagcacuca

SEQ ID NO: 1332157 - RNA, 23 nt, Human
ggggcaaaaaggauuagaaaaug

SEQ ID NO: 1332158 - RNA, 20 nt, Human
gugcagcucuucugggcggg

SEQ ID NO: 1332159 - RNA, 18 nt, Human
gugcaguggcucacaccu

SEQ ID NO: 1332160 - RNA, 21 nt, Human
uaagugguggaagauggagca

SEQ ID NO: 1332161 - RNA, 18 nt, Human
uaccacaggccucacgca

SEQ ID NO: 1332162 - RNA, 22 nt, Human
uagauaagcaucuuugugagag

SEQ ID NO: 1332163 - RNA, 22 nt, Human
uagcaugcuggcacccgcccuc

SEQ ID NO: 1332164 - RNA, 20 nt, Human
uagccucuaaagcagcuccc

SEQ ID NO: 1332165 - RNA, 23 nt, Human
uagcuaaaugagcaauauaguau

SEQ ID NO: 1332166 - RNA, 23 nt, Human
ucaaagcaacuuagccucuaaag

SEQ ID NO: 1332167 - RNA, 18 nt, Human
ucaaggaggccaggaguu

SEQ ID NO: 1332168 - RNA, 21 nt, Human
ucaaggaggccaggaguucaa

SEQ ID NO: 1332169 - RNA, 18 nt, Human
ucacaucacagacuuucu

SEQ ID NO: 1332170 - RNA, 24 nt, Human
ucagagcugcuguuccagagccug

SEQ ID NO: 1332171 - RNA, 25 nt, Human
ucagagcugcuguuccagagccugc

SEQ ID NO: 1332172 - RNA, 21 nt, Human
uccaucuaaaaaaaaaauggc

SEQ ID NO: 1332173 - RNA, 20 nt, Human
uccccccuccccccccacac

SEQ ID NO: 1332174 - RNA, 22 nt, Human
ucccuacaaaaaauucuaaaaa

SEQ ID NO: 1332175 - RNA, 20 nt, Human
ucuacugcugugaguugggg

SEQ ID NO: 1332176 - RNA, 18 nt, Human
ucucaaacaaagcuggga

SEQ ID NO: 1332177 - RNA, 21 nt, Human
ucucugcugagggcucugucc

SEQ ID NO: 1332178 - RNA, 23 nt, Human
ucuuugguuugcugacacuggag

SEQ ID NO: 1332179 - RNA, 18 nt, Human
ugaaacccaugacugcug

SEQ ID NO: 1332180 - RNA, 25 nt, Human
ugaauaugcguaccccccucccccc

SEQ ID NO: 1332181 - RNA, 20 nt, Human
ugaggcaggaggauugccug

SEQ ID NO: 1332182 - RNA, 24 nt, Human
ugaggcaggaggauugccugagcc

SEQ ID NO: 1332183 - RNA, 25 nt, Human
ugaggcaggaggauugccugagccc

SEQ ID NO: 1332184 - RNA, 19 nt, Human
ugaguuggggugaacccac

SEQ ID NO: 1332185 - RNA, 22 nt, Human
ugcaaugagcuaugauugcacc

SEQ ID NO: 1332186 - RNA, 21 nt, Human
ugcagcucuucugggcgggga

SEQ ID NO: 1332187 - RNA, 24 nt, Human
ugccugagcccaggaauugaaggc

SEQ ID NO: 1332188 - RNA, 21 nt, Human
ugcugaaacccaugacugcug

SEQ ID NO: 1332189 - RNA, 23 nt, Human
uggagguuuucuccuauaacuga

SEQ ID NO: 1332190 - RNA, 22 nt, Human
uggcacccgcccucccuccuua

SEQ ID NO: 1332191 - RNA, 21 nt, Human
uggcucacaccuguaaucuca

SEQ ID NO: 1332192 - RNA, 24 nt, Human
uggcucacaccuguaaucucagca

SEQ ID NO: 1332193 - RNA, 18 nt, Human
uggcuguguuggccccac

SEQ ID NO: 1332194 - RNA, 21 nt, Human
ugggaggggucuccugggaug

SEQ ID NO: 1332195 - RNA, 24 nt, Human
ugggaugaaugaaaggaaaccagg

SEQ ID NO: 1332196 - RNA, 22 nt, Human
uggggagguuagauaagcaucu

SEQ ID NO: 1332197 - RNA, 21 nt, Human
uggguagucaggccuggagca

SEQ ID NO: 1332198 - RNA, 24 nt, Human
ugguuugcugacacuggagaaacc

SEQ ID NO: 1332199 - RNA, 22 nt, Human
uguaacgccuccaccucauccu

SEQ ID NO: 1332200 - RNA, 18 nt, Human
ugucucagagauacaggg

SEQ ID NO: 1332201 - RNA, 21 nt, Human
ugugcaacagagugaggcccu

SEQ ID NO: 1332202 - RNA, 19 nt, Human
ugugcuggacucagaauug

SEQ ID NO: 1332203 - RNA, 20 nt, Human
ugugcuggacucagaauugg

SEQ ID NO: 1332204 - RNA, 21 nt, Human
uguggugguuucacuucaaga

SEQ ID NO: 1332205 - RNA, 22 nt, Human
uguguaccacaggccucacgca

SEQ ID NO: 1332206 - RNA, 18 nt, Human
uucaagauuuucaggauc

SEQ ID NO: 1332207 - RNA, 24 nt, Human
uucaaggaggccaggaguucaaga

SEQ ID NO: 1332208 - RNA, 20 nt, Human
uucuagaguaagcuuuuagg

SEQ ID NO: 1332209 - RNA, 24 nt, Human
uugccugagcccaggaauugaagg

SEQ ID NO: 1332210 - RNA, 23 nt, Human
uugcugacacuggagaaacccaa

SEQ ID NO: 1332211 - RNA, 22 nt, Human
uuggauuuuacuguggagauuu

SEQ ID NO: 1332212 - RNA, 23 nt, Human
acucuuuugggaaggagggaaac

SEQ ID NO: 1332213 - RNA, 18 nt, Human
augcacacacacaacagu

SEQ ID NO: 1332214 - RNA, 18 nt, Human
cuuguuugugcccaaggc

SEQ ID NO: 1332215 - RNA, 19 nt, Human
ggcaugcacacacacaaca

SEQ ID NO: 1332216 - RNA, 19 nt, Human
ugggaaggagggaaacuga

SEQ ID NO: 1332217 - RNA, 27 nt, Human
uuugugcccaaggcaugcacacacaca

SEQ ID NO: 1332218 - RNA, 23 nt, Human
acccacuucuccaggauccuccc

SEQ ID NO: 1332219 - RNA, 19 nt, Human
auccucccagcccccaggc

SEQ ID NO: 1332220 - RNA, 20 nt, Human
ccaggauccucccagccccc

SEQ ID NO: 1332221 - RNA, 21 nt, Human
ccaggauccucccagccccca

SEQ ID NO: 1332222 - RNA, 20 nt, Human
cccaggcuggcuuucccucc

SEQ ID NO: 1332223 - RNA, 21 nt, Human
cccccaggcuggcuuucccuc

SEQ ID NO: 1332224 - RNA, 22 nt, Human
gcucuagauucugucuccagcc

SEQ ID NO: 1332225 - RNA, 24 nt, Human
gggcaaccccaggauggggaaggg

SEQ ID NO: 1332226 - RNA, 23 nt, Human
uagagcagaauucagacucagcu

SEQ ID NO: 1332227 - RNA, 19 nt, Human
uccccaaccgcgagagccc

SEQ ID NO: 1332228 - RNA, 18 nt, Human
uccucccagcccccaggc

SEQ ID NO: 1332229 - RNA, 18 nt, Human
ucuguccccacccacuuc

SEQ ID NO: 1332230 - RNA, 21 nt, Human
uuccccaaccgcgagagcccc

SEQ ID NO: 1332231 - RNA, 19 nt, Human
aaccucaccgagagcccaa

SEQ ID NO: 1332232 - RNA, 21 nt, Human
agaagaggagagagagaggcc

SEQ ID NO: 1332233 - RNA, 21 nt, Human
agaggccagagccuggggaug

SEQ ID NO: 1332234 - RNA, 25 nt, Human
agccaggugcucugcauggcaaggu

SEQ ID NO: 1332235 - RNA, 21 nt, Human
agcccaaacucucaccuacag

SEQ ID NO: 1332236 - RNA, 23 nt, Human
agccuuuuccuucucccaaccuc

SEQ ID NO: 1332237 - RNA, 22 nt, Human
aucugucuuuaucgccuccccc

SEQ ID NO: 1332238 - RNA, 19 nt, Human
cacccccuggcccauaagc

SEQ ID NO: 1332239 - RNA, 20 nt, Human
cagggaccacaagccagcac

SEQ ID NO: 1332240 - RNA, 18 nt, Human
ccagcacagaggcgaccu

SEQ ID NO: 1332241 - RNA, 23 nt, Human
ccagcacagaggcgaccuccucc

SEQ ID NO: 1332242 - RNA, 20 nt, Human
cccaacccuuccacucugcu

SEQ ID NO: 1332243 - RNA, 20 nt, Human
ccccaacccuuccacucugc

SEQ ID NO: 1332244 - RNA, 18 nt, Human
cccccaacccuuccacuc

SEQ ID NO: 1332245 - RNA, 21 nt, Human
cccccaacccuuccacucugc

SEQ ID NO: 1332246 - RNA, 23 nt, Human
ccugcagccgggucagagugagc

SEQ ID NO: 1332247 - RNA, 23 nt, Human
ccuggcccauaagccuuuuccuu

SEQ ID NO: 1332248 - RNA, 21 nt, Human
cucccucccacccccuggccc

SEQ ID NO: 1332249 - RNA, 20 nt, Human
cuggcccauaagccuuuucc

SEQ ID NO: 1332250 - RNA, 21 nt, Human
cuguuccugcuucucuuuuca

SEQ ID NO: 1332251 - RNA, 23 nt, Human
gaaagaaaaaugguaauacggaa

SEQ ID NO: 1332252 - RNA, 19 nt, Human
gagagagagaggccagagc

SEQ ID NO: 1332253 - RNA, 25 nt, Human
gcugugcccauucucccucccaccc

SEQ ID NO: 1332254 - RNA, 21 nt, Human
ggcuugggggaagggcagcuc

SEQ ID NO: 1332255 - RNA, 20 nt, Human
gggcuugggggaagggcagc

SEQ ID NO: 1332256 - RNA, 23 nt, Human
gguugcccucaggguccuccuug

SEQ ID NO: 1332257 - RNA, 20 nt, Human
guggaguauuuuacuguucc

SEQ ID NO: 1332258 - RNA, 19 nt, Human
gugguugcccucagggucc

SEQ ID NO: 1332259 - RNA, 21 nt, Human
guucugguccccuugagucuu

SEQ ID NO: 1332260 - RNA, 21 nt, Human
ucccaaccucaccgagagccc

SEQ ID NO: 1332261 - RNA, 21 nt, Human
ucccaaccucaccgagagccc

SEQ ID NO: 1332262 - RNA, 22 nt, Human
ucccaaccucaccgagagccca

SEQ ID NO: 1332263 - RNA, 18 nt, Human
uccgggguuggcuccuuc

SEQ ID NO: 1332264 - RNA, 18 nt, Human
uccugcuucucuuuucac

SEQ ID NO: 1332265 - RNA, 23 nt, Human
ucucccaaccucaccgagagccc

SEQ ID NO: 1332266 - RNA, 24 nt, Human
ucucccaaccucaccgagagccca

SEQ ID NO: 1332267 - RNA, 21 nt, Human
ucugucuuuaucgccuccccc

SEQ ID NO: 1332268 - RNA, 27 nt, Human
ugaaagaaaaaugguaauacggaaaca

SEQ ID NO: 1332269 - RNA, 19 nt, Human
uggcagaugagaagccagg

SEQ ID NO: 1332270 - RNA, 19 nt, Human
uggcccauaagccuuuucc

SEQ ID NO: 1332271 - RNA, 24 nt, Human
uggcugugcccauucucccuccca

SEQ ID NO: 1332272 - RNA, 18 nt, Human
ugggcuugggggaagggc

SEQ ID NO: 1332273 - RNA, 18 nt, Human
ugggggaagggcagcucc

SEQ ID NO: 1332274 - RNA, 24 nt, Human
ugguugcccucaggguccuccuug

SEQ ID NO: 1332275 - RNA, 20 nt, Human
ugucagggaccacaagccag

SEQ ID NO: 1332276 - RNA, 19 nt, Human
ugucuuuaucgccuccccc

SEQ ID NO: 1332277 - RNA, 18 nt, Human
uuccugcagccgggucag

SEQ ID NO: 1332278 - RNA, 22 nt, Human
uuccugcagccgggucagagug

SEQ ID NO: 1332279 - RNA, 19 nt, Human
uugcccucaggguccuccu

SEQ ID NO: 1332280 - RNA, 19 nt, Human
uuuacuguuccugcuucuc

SEQ ID NO: 1332281 - RNA, 24 nt, Human
uuuuacuguuccugcuucucuuuu

SEQ ID NO: 1332282 - RNA, 19 nt, Human
aaccucaccgagagcccaa

SEQ ID NO: 1332283 - RNA, 21 nt, Human
agaagaggagagagagaggcc

SEQ ID NO: 1332284 - RNA, 21 nt, Human
agaggccagagccuggggaug

SEQ ID NO: 1332285 - RNA, 25 nt, Human
agccaggugcucugcauggcaaggu

SEQ ID NO: 1332286 - RNA, 21 nt, Human
agcccaaacucucaccuacag

SEQ ID NO: 1332287 - RNA, 23 nt, Human
agccuuuuccuucucccaaccuc

SEQ ID NO: 1332288 - RNA, 19 nt, Human
cacccccuggcccauaagc

SEQ ID NO: 1332289 - RNA, 25 nt, Human
cccugcgugucucaguuucucuccu

SEQ ID NO: 1332290 - RNA, 23 nt, Human
ccugcagccgggucagagugagc

SEQ ID NO: 1332291 - RNA, 23 nt, Human
ccuggcccauaagccuuuuccuu

SEQ ID NO: 1332292 - RNA, 21 nt, Human
cucccucccacccccuggccc

SEQ ID NO: 1332293 - RNA, 20 nt, Human
cuggcccauaagccuuuucc

SEQ ID NO: 1332294 - RNA, 19 nt, Human
gagagagagaggccagagc

SEQ ID NO: 1332295 - RNA, 23 nt, Human
gguugcccucaggguccuccuug

SEQ ID NO: 1332296 - RNA, 19 nt, Human
gugguugcccucagggucc

SEQ ID NO: 1332297 - RNA, 21 nt, Human
guucugguccccuugagucuu

SEQ ID NO: 1332298 - RNA, 21 nt, Human
ucccaaccucaccgagagccc

SEQ ID NO: 1332299 - RNA, 21 nt, Human
ucccaaccucaccgagagccc

SEQ ID NO: 1332300 - RNA, 22 nt, Human
ucccaaccucaccgagagccca

SEQ ID NO: 1332301 - RNA, 18 nt, Human
uccgggguuggcuccuuc

SEQ ID NO: 1332302 - RNA, 23 nt, Human
ucucccaaccucaccgagagccc

SEQ ID NO: 1332303 - RNA, 24 nt, Human
ucucccaaccucaccgagagccca

SEQ ID NO: 1332304 - RNA, 19 nt, Human
uggcagaugagaagccagg

SEQ ID NO: 1332305 - RNA, 19 nt, Human
uggcccauaagccuuuucc

SEQ ID NO: 1332306 - RNA, 21 nt, Human
ugucagggaccacaagcccug

SEQ ID NO: 1332307 - RNA, 18 nt, Human
uuccugcagccgggucag

SEQ ID NO: 1332308 - RNA, 22 nt, Human
uuccugcagccgggucagagug

SEQ ID NO: 1332309 - RNA, 19 nt, Human
uugcccucaggguccuccu

SEQ ID NO: 1332310 - RNA, 20 nt, Human
aaaaaacauaaucaaaagaa

SEQ ID NO: 1332311 - RNA, 24 nt, Human
aaaacauaaucaaaagaaggcaca

SEQ ID NO: 1332312 - RNA, 22 nt, Human
aagaaggcacagaggccagggg

SEQ ID NO: 1332313 - RNA, 19 nt, Human
aagcccccaauucucuuuu

SEQ ID NO: 1332314 - RNA, 26 nt, Human
aagcuguaggccccagugaguucugg

SEQ ID NO: 1332315 - RNA, 22 nt, Human
aaggaggggguaauaaagggau

SEQ ID NO: 1332316 - RNA, 19 nt, Human
acccuaagcccccaauucu

SEQ ID NO: 1332317 - RNA, 27 nt, Human
agaggccagggggcuacaugggaacag

SEQ ID NO: 1332318 - RNA, 19 nt, Human
agaugucagggaucaaagc

SEQ ID NO: 1332319 - RNA, 20 nt, Human
agcauucuggccagaaccaa

SEQ ID NO: 1332320 - RNA, 18 nt, Human
aggaaggccuaaggucca

SEQ ID NO: 1332321 - RNA, 24 nt, Human
agggagcuggcuccauggggaggg

SEQ ID NO: 1332322 - RNA, 18 nt, Human
aggggagagaggguggag

SEQ ID NO: 1332323 - RNA, 23 nt, Human
aggggguaauaaagggauugggg

SEQ ID NO: 1332324 - RNA, 22 nt, Human
auaguagggcgauuacagacac

SEQ ID NO: 1332325 - RNA, 23 nt, Human
caaacauaaauagagggagcugg

SEQ ID NO: 1332326 - RNA, 18 nt, Human
cacacauuccugaauccc

SEQ ID NO: 1332327 - RNA, 22 nt, Human
cacggaaaacaugucugagcca

SEQ ID NO: 1332328 - RNA, 18 nt, Human
cagugaguucuggaggcc

SEQ ID NO: 1332329 - RNA, 24 nt, Human
ccccaggauaccccggucucccaa

SEQ ID NO: 1332330 - RNA, 19 nt, Human
cccccaggauaccccgguc

SEQ ID NO: 1332331 - RNA, 19 nt, Human
cccuaagcccccaauucuc

SEQ ID NO: 1332332 - RNA, 23 nt, Human
ccugcagcauucuggccagaacc

SEQ ID NO: 1332333 - RNA, 21 nt, Human
cuccccuggggagcagaggcu

SEQ ID NO: 1332334 - RNA, 20 nt, Human
gauuacagacacaacucccc

SEQ ID NO: 1332335 - RNA, 20 nt, Human
gcauucuggccagaaccaaa

SEQ ID NO: 1332336 - RNA, 23 nt, Human
ggagcuggcuccauggggagggc

SEQ ID NO: 1332337 - RNA, 23 nt, Human
ggcucccuggucuccagauucca

SEQ ID NO: 1332338 - RNA, 18 nt, Human
ggcugggcuccgugucuc

SEQ ID NO: 1332339 - RNA, 22 nt, Human
gggguaauaaagggauuggggc

SEQ ID NO: 1332340 - RNA, 18 nt, Human
gguguccuuuccagggga

SEQ ID NO: 1332341 - RNA, 26 nt, Human
gucaauuucuaggugaggucuucuca

SEQ ID NO: 1332342 - RNA, 23 nt, Human
guguccuuuccaggggagagagg

SEQ ID NO: 1332343 - RNA, 20 nt, Human
uaagcccccaauucucuuuu

SEQ ID NO: 1332344 - RNA, 21 nt, Human
uacauugggucccccaggaua

SEQ ID NO: 1332345 - RNA, 19 nt, Human
uccaggggagagagggugg

SEQ ID NO: 1332346 - RNA, 22 nt, Human
ucugagccaaggcagcuccuac

SEQ ID NO: 1332347 - RNA, 19 nt, Human
ugagaggaagagaaccugc

SEQ ID NO: 1332348 - RNA, 19 nt, Human
ugagaggaagagaaccugc

SEQ ID NO: 1332349 - RNA, 21 nt, Human
ugagccagaagagguugaggg

SEQ ID NO: 1332350 - RNA, 22 nt, Human
uggagagaggaaggccuaaggu

SEQ ID NO: 1332351 - RNA, 24 nt, Human
uggggcaggggaggcguucugagu

SEQ ID NO: 1332352 - RNA, 20 nt, Human
ugguugccagcacuucacug

SEQ ID NO: 1332353 - RNA, 21 nt, Human
ugucagggaucaaagcuguag

SEQ ID NO: 1332354 - RNA, 18 nt, Human
ugucugaaggagggggua

SEQ ID NO: 1332355 - RNA, 20 nt, Human
acuugccaaggaccacaacu

SEQ ID NO: 1332356 - RNA, 21 nt, Human
aggacagaugcugcuggagga

SEQ ID NO: 1332357 - RNA, 18 nt, Human
aggaggccaaggggccag

SEQ ID NO: 1332358 - RNA, 20 nt, Human
aggaggccaaggggccagcu

SEQ ID NO: 1332359 - RNA, 22 nt, Human
caacugccagggaccucgagca

SEQ ID NO: 1332360 - RNA, 19 nt, Human
cccugaggagagaggacag

SEQ ID NO: 1332361 - RNA, 21 nt, Human
gccaaggaccacaacugccag

SEQ ID NO: 1332362 - RNA, 22 nt, Human
gucaccagauggggauggggag

SEQ ID NO: 1332363 - RNA, 20 nt, Human
ucccugaggagagaggacag

SEQ ID NO: 1332364 - RNA, 26 nt, Human
ucucuaggaggccaaggggccagcuu

SEQ ID NO: 1332365 - RNA, 18 nt, Human
ugccaaggaccacaacug

SEQ ID NO: 1332366 - RNA, 19 nt, Human
ugccucccugaggagagag

SEQ ID NO: 1332367 - RNA, 22 nt, Human
ugcugcuggaggagaugucagg

SEQ ID NO: 1332368 - RNA, 22 nt, Human
ugcuugccucccugaggagaga

SEQ ID NO: 1332369 - RNA, 21 nt, Human
uggguggaggaggaaggacuc

SEQ ID NO: 1332370 - RNA, 22 nt, Human
uguagccaggccuuuggucacc

SEQ ID NO: 1332371 - RNA, 19 nt, Human
uuggggucuuuugaagagg

SEQ ID NO: 1332372 - RNA, 20 nt, Human
agcuggaagucuccagcuuc

SEQ ID NO: 1332373 - RNA, 18 nt, Human
agcuggugcucugugugc

SEQ ID NO: 1332374 - RNA, 19 nt, Human
agcuggugcucugugugcc

SEQ ID NO: 1332375 - RNA, 21 nt, Human
caacucagcucccauuguacc

SEQ ID NO: 1332376 - RNA, 19 nt, Human
ccagcuucucccuccaaca

SEQ ID NO: 1332377 - RNA, 21 nt, Human
ccagcuucucccuccaacaac

SEQ ID NO: 1332378 - RNA, 19 nt, Human
cuugagugggagcuggagc

SEQ ID NO: 1332379 - RNA, 21 nt, Human
gagcuggagcuggaagucucc

SEQ ID NO: 1332380 - RNA, 22 nt, Human
ucccuccaacaacucagcuccc

SEQ ID NO: 1332381 - RNA, 20 nt, Human
ugagugggagcuggagcugg

SEQ ID NO: 1332382 - RNA, 18 nt, Human
aaaaaaaaacugaaggug

SEQ ID NO: 1332383 - RNA, 25 nt, Human
aaaaaaaacugaaggugggagaaaa

SEQ ID NO: 1332384 - RNA, 22 nt, Human
aacugcugccccaagggaccuc

SEQ ID NO: 1332385 - RNA, 25 nt, Human
aagcaaaaauaacagcuggugaauc

SEQ ID NO: 1332386 - RNA, 27 nt, Human
aagcaaaaauaacagcuggugaaucca

SEQ ID NO: 1332387 - RNA, 20 nt, Human
aaggugggagaaaaguaaaa

SEQ ID NO: 1332388 - RNA, 25 nt, Human
aaggugucccagaaacuggggaggc

SEQ ID NO: 1332389 - RNA, 22 nt, Human
acacugccugagcuaccagccc

SEQ ID NO: 1332390 - RNA, 23 nt, Human
acacugccugagcuaccagcccu

SEQ ID NO: 1332391 - RNA, 21 nt, Human
accacucucuuacugcagagg

SEQ ID NO: 1332392 - RNA, 21 nt, Human
accauccacacccccacaauc

SEQ ID NO: 1332393 - RNA, 18 nt, Human
accccaaguuucacucac

SEQ ID NO: 1332394 - RNA, 20 nt, Human
acccuggguuucccaaccac

SEQ ID NO: 1332395 - RNA, 22 nt, Human
acucaccaaggccacaccccaa

SEQ ID NO: 1332396 - RNA, 22 nt, Human
acucucuucacccuuugccccc

SEQ ID NO: 1332397 - RNA, 24 nt, Human
agaaucucagaucugacaaggccu

SEQ ID NO: 1332398 - RNA, 24 nt, Human
agacgcggccuccacaaggucaga

SEQ ID NO: 1332399 - RNA, 28 nt, Human
agcaaacuccagccagcagcguucgucc

SEQ ID NO: 1332400 - RNA, 22 nt, Human
agcagagacgcggccuccacaa

SEQ ID NO: 1332401 - RNA, 20 nt, Human
agccagcagcguucgucccu

SEQ ID NO: 1332402 - RNA, 24 nt, Human
aggucugucuauccugcccugguc

SEQ ID NO: 1332403 - RNA, 19 nt, Human
aguccuacucugaauucag

SEQ ID NO: 1332404 - RNA, 21 nt, Human
agugagcaaaccccuagcccc

SEQ ID NO: 1332405 - RNA, 20 nt, Human
aguuugcuuccucuucaguu

SEQ ID NO: 1332406 - RNA, 24 nt, Human
auccgcccugcaggcucccuguca

SEQ ID NO: 1332407 - RNA, 23 nt, Human
auucaccauccacacccccacaa

SEQ ID NO: 1332408 - RNA, 23 nt, Human
cacaccccaaggugucccagaaa

SEQ ID NO: 1332409 - RNA, 23 nt, Human
cacacugccugagcuaccagccc

SEQ ID NO: 1332410 - RNA, 24 nt, Human
cacccccacaaucugagauuccaa

SEQ ID NO: 1332411 - RNA, 20 nt, Human
cacccuuugcccccacccca

SEQ ID NO: 1332412 - RNA, 19 nt, Human
cacgcagcagagacgcggc

SEQ ID NO: 1332413 - RNA, 20 nt, Human
cagaagccagagucuuucug

SEQ ID NO: 1332414 - RNA, 21 nt, Human
cagagaguccucucugcguuu

SEQ ID NO: 1332415 - RNA, 20 nt, Human
cagcaaacuccagccagcaa

SEQ ID NO: 1332416 - RNA, 22 nt, Human
cagcagagacgcggccuccaca

SEQ ID NO: 1332417 - RNA, 19 nt, Human
cagcagcguucgucccuug

SEQ ID NO: 1332418 - RNA, 22 nt, Human
cagccagcagcguucgucccuu

SEQ ID NO: 1332419 - RNA, 23 nt, Human
cagcccuucugcacuggcccucc

SEQ ID NO: 1332420 - RNA, 18 nt, Human
caggaagguggccccagg

SEQ ID NO: 1332421 - RNA, 24 nt, Human
cauaaacacaaacacccuaaauag

SEQ ID NO: 1332422 - RNA, 31 nt, Human
caucauacuuuuuuuuuuuuuugcuuuuaaa

SEQ ID NO: 1332423 - RNA, 24 nt, Human
cauucaccauccacacccccacaa

SEQ ID NO: 1332424 - RNA, 19 nt, Human
ccagcaggcagcaccccaa

SEQ ID NO: 1332425 - RNA, 18 nt, Human
cccacacucucuucaccc

SEQ ID NO: 1332426 - RNA, 24 nt, Human
cccaugaucaccagauccgccuug

SEQ ID NO: 1332427 - RNA, 20 nt, Human
ccccaagggaccucaaggaa

SEQ ID NO: 1332428 - RNA, 20 nt, Human
ccccaguuacgaagcaaagc

SEQ ID NO: 1332429 - RNA, 19 nt, Human
cccccaaauucugaggcug

SEQ ID NO: 1332430 - RNA, 21 nt, Human
ccccuagcccccaagugggga

SEQ ID NO: 1332431 - RNA, 19 nt, Human
cccgcgaacacgcagcaga

SEQ ID NO: 1332432 - RNA, 21 nt, Human
cccuauccagacccccuaauc

SEQ ID NO: 1332433 - RNA, 20 nt, Human
cccugcacccucguacucgg

SEQ ID NO: 1332434 - RNA, 22 nt, Human
cccugcaggcucccugucaccu

SEQ ID NO: 1332435 - RNA, 20 nt, Human
ccucguacucggguuucuuc

SEQ ID NO: 1332436 - RNA, 19 nt, Human
ccugcacuguccccacucc

SEQ ID NO: 1332437 - RNA, 19 nt, Human
ccugggucaccaccagaga

SEQ ID NO: 1332438 - RNA, 20 nt, Human
ccuggguuucccaaccacuc

SEQ ID NO: 1332439 - RNA, 21 nt, Human
ccuucccagcaggcagcaccc

SEQ ID NO: 1332440 - RNA, 20 nt, Human
ccuucugcacuggcccuccu

SEQ ID NO: 1332441 - RNA, 21 nt, Human
cgaagcaaagcgcgggccuac

SEQ ID NO: 1332442 - RNA, 18 nt, Human
cgcagcagagacgcggcc

SEQ ID NO: 1332443 - RNA, 20 nt, Human
cgcagcagagacgcggccuc

SEQ ID NO: 1332444 - RNA, 23 nt, Human
cgggcgcugugcgcggggaccgc

SEQ ID NO: 1332445 - RNA, 22 nt, Human
cuaaagcccacacucucuucac

SEQ ID NO: 1332446 - RNA, 27 nt, Human
cuaccagcccuucugcacuggcccucc

SEQ ID NO: 1332447 - RNA, 24 nt, Human
cuagcccccaaguggggacuacag

SEQ ID NO: 1332448 - RNA, 18 nt, Human
cucaaggaauaggaauuc

SEQ ID NO: 1332449 - RNA, 22 nt, Human
cucucuucacccuuugccccca

SEQ ID NO: 1332450 - RNA, 20 nt, Human
cucuggcucccaugaucacc

SEQ ID NO: 1332451 - RNA, 19 nt, Human
cugagugagcaaaccccua

SEQ ID NO: 1332452 - RNA, 18 nt, Human
cugcacccucguacucgg

SEQ ID NO: 1332453 - RNA, 23 nt, Human
cugcacuggcccuccugccaaua

SEQ ID NO: 1332454 - RNA, 23 nt, Human
cugcacuguccccacucccucug

SEQ ID NO: 1332455 - RNA, 22 nt, Human
cugcaggcucccugucaccugu

SEQ ID NO: 1332456 - RNA, 20 nt, Human
cuguguaugaaggggggccc

SEQ ID NO: 1332457 - RNA, 21 nt, Human
cuucccagcaggcagcacccc

SEQ ID NO: 1332458 - RNA, 18 nt, Human
cuucgggaccuacgcguc

SEQ ID NO: 1332459 - RNA, 18 nt, Human
cuucugcacuggcccucc

SEQ ID NO: 1332460 - RNA, 19 nt, Human
cuuuuaaaaaguggaggug

SEQ ID NO: 1332461 - RNA, 21 nt, Human
cuuuuuuuuuuuuuugcuuuu

SEQ ID NO: 1332462 - RNA, 20 nt, Human
gacccccuaauccacuugcc

SEQ ID NO: 1332463 - RNA, 19 nt, Human
gagcaaaccccuagccccc

SEQ ID NO: 1332464 - RNA, 23 nt, Human
gcacuggcccuccugccaauacu

SEQ ID NO: 1332465 - RNA, 22 nt, Human
gcagcagagacgcggccuccac

SEQ ID NO: 1332466 - RNA, 25 nt, Human
gccucacacuuuucuccuaaagccc

SEQ ID NO: 1332467 - RNA, 19 nt, Human
gcucccugucaccuguggg

SEQ ID NO: 1332468 - RNA, 22 nt, Human
ggaagguggccccagguccuag

SEQ ID NO: 1332469 - RNA, 21 nt, Human
ggcaggaagguggccccaggu

SEQ ID NO: 1332470 - RNA, 25 nt, Human
gggcaggaagguggccccagguccu

SEQ ID NO: 1332471 - RNA, 18 nt, Human
ggguuucuuccccauccc

SEQ ID NO: 1332472 - RNA, 18 nt, Human
guaaugggcccccaaauu

SEQ ID NO: 1332473 - RNA, 22 nt, Human
guggagguggaaaaaaaaaaaa

SEQ ID NO: 1332474 - RNA, 23 nt, Human
uaaagcgggcaggaagguggccc

SEQ ID NO: 1332475 - RNA, 21 nt, Human
uaaaggggggcauacccaaau

SEQ ID NO: 1332476 - RNA, 22 nt, Human
uaagauguccucagagaucccc

SEQ ID NO: 1332477 - RNA, 24 nt, Human
uaauccacuugccuagcagcccca

SEQ ID NO: 1332478 - RNA, 23 nt, Human
uaaugggcccccaaauucugagg

SEQ ID NO: 1332479 - RNA, 20 nt, Human
uaggagguggaaugaaagug

SEQ ID NO: 1332480 - RNA, 22 nt, Human
uauccugcccuggucuccucca

SEQ ID NO: 1332481 - RNA, 23 nt, Human
ucagacucucaggaucuccucag

SEQ ID NO: 1332482 - RNA, 20 nt, Human
ucaguucugggguaaagggg

SEQ ID NO: 1332483 - RNA, 21 nt, Human
uccaagaaucucagaucugac

SEQ ID NO: 1332484 - RNA, 19 nt, Human
uccaagagcagugcccuca

SEQ ID NO: 1332485 - RNA, 21 nt, Human
uccaagagcagugcccucacu

SEQ ID NO: 1332486 - RNA, 23 nt, Human
uccauaaacacaaacacccuaaa

SEQ ID NO: 1332487 - RNA, 25 nt, Human
uccauaaacacaaacacccuaaaua

SEQ ID NO: 1332488 - RNA, 25 nt, Human
ucccagaaacuggggaggcagugcu

SEQ ID NO: 1332489 - RNA, 23 nt, Human
uccccaucccugaggucccuaug

SEQ ID NO: 1332490 - RNA, 23 nt, Human
uccuaaagcccacacucucuuca

SEQ ID NO: 1332491 - RNA, 22 nt, Human
uccuccaccccaggagaguuuu

SEQ ID NO: 1332492 - RNA, 24 nt, Human
ucucaggaucuccucagaagccag

SEQ ID NO: 1332493 - RNA, 22 nt, Human
ucucugaauagucaugcagccu

SEQ ID NO: 1332494 - RNA, 21 nt, Human
ugagcaaaccccuagccccca

SEQ ID NO: 1332495 - RNA, 18 nt, Human
ugcacuguccccacuccc

SEQ ID NO: 1332496 - RNA, 22 nt, Human
ugccucacacuuuucuccuaaa

SEQ ID NO: 1332497 - RNA, 21 nt, Human
uggaaaaaaaaaaaaaacuga

SEQ ID NO: 1332498 - RNA, 19 nt, Human
uggagguggaaaaaaaaaa

SEQ ID NO: 1332499 - RNA, 22 nt, Human
uggaucguguagucuuuaacug

SEQ ID NO: 1332500 - RNA, 19 nt, Human
uggcaaguaguuugcuucc

SEQ ID NO: 1332501 - RNA, 18 nt, Human
uggccccagguccuaggu

SEQ ID NO: 1332502 - RNA, 24 nt, Human
uggccccagguccuaggugcuccu

SEQ ID NO: 1332503 - RNA, 21 nt, Human
uggcccgcgaacacgcagcag

SEQ ID NO: 1332504 - RNA, 24 nt, Human
uggcccgcgaacacgcagcagaga

SEQ ID NO: 1332505 - RNA, 18 nt, Human
uggcucccaugaucaccu

SEQ ID NO: 1332506 - RNA, 19 nt, Human
uggggcccuauccagaccc

SEQ ID NO: 1332507 - RNA, 23 nt, Human
ugggguguguaaugggcccccaa

SEQ ID NO: 1332508 - RNA, 24 nt, Human
uguaaugggcccccaaauucugag

SEQ ID NO: 1332509 - RNA, 24 nt, Human
uguccccacucccucuggcuccca

SEQ ID NO: 1332510 - RNA, 19 nt, Human
uucaaagguagagaggacc

SEQ ID NO: 1332511 - RNA, 21 nt, Human
uugcuuccucuucaguucugg

SEQ ID NO: 1332512 - RNA, 21 nt, Human
uuucuuccccaucccugaggu

SEQ ID NO: 1332513 - RNA, 22 nt, Human
aacacaagcucaaucagaccua

SEQ ID NO: 1332514 - RNA, 21 nt, Human
aaucagaccuacuugcaccca

SEQ ID NO: 1332515 - RNA, 25 nt, Human
acaacacaagcucaaucagaccuac

SEQ ID NO: 1332516 - RNA, 22 nt, Human
accccacacccagcuccuccag

SEQ ID NO: 1332517 - RNA, 21 nt, Human
caccacaccaucccggaacaa

SEQ ID NO: 1332518 - RNA, 19 nt, Human
caccccacacccagcuccu

SEQ ID NO: 1332519 - RNA, 21 nt, Human
cagcccaacgcaccccacacc

SEQ ID NO: 1332520 - RNA, 24 nt, Human
cagcccaacgcaccccacacccag

SEQ ID NO: 1332521 - RNA, 20 nt, Human
caggccccccauuucuuucc

SEQ ID NO: 1332522 - RNA, 23 nt, Human
cagggacucucuccccuagaccc

SEQ ID NO: 1332523 - RNA, 21 nt, Human
cauccccucuuccaccacacc

SEQ ID NO: 1332524 - RNA, 20 nt, Human
ccacacccagcuccuccagc

SEQ ID NO: 1332525 - RNA, 23 nt, Human
ccaccacaccaucccggaacaag

SEQ ID NO: 1332526 - RNA, 21 nt, Human
ccaggccccccauuucuuucc

SEQ ID NO: 1332527 - RNA, 21 nt, Human
cccaaacuaggccuccccacc

SEQ ID NO: 1332528 - RNA, 22 nt, Human
cccaacgcaccccacacccagc

SEQ ID NO: 1332529 - RNA, 22 nt, Human
cccaccccacaauaaaaaucug

SEQ ID NO: 1332530 - RNA, 22 nt, Human
ccccacacccagcuccuccagc

SEQ ID NO: 1332531 - RNA, 19 nt, Human
cccccauuucuuucccuca

SEQ ID NO: 1332532 - RNA, 22 nt, Human
ccccucuuccaccacaccaucc

SEQ ID NO: 1332533 - RNA, 19 nt, Human
ccuagacccagggcugucc

SEQ ID NO: 1332534 - RNA, 23 nt, Human
cucaucccaccccacaauaaaaa

SEQ ID NO: 1332535 - RNA, 23 nt, Human
cucccgggcuggaucagagagcc

SEQ ID NO: 1332536 - RNA, 19 nt, Human
cuccuccagcucgguccuc

SEQ ID NO: 1332537 - RNA, 22 nt, Human
gaacaagugcuccaggauuccc

SEQ ID NO: 1332538 - RNA, 19 nt, Human
ggaaguggccgucccuggg

SEQ ID NO: 1332539 - RNA, 28 nt, Human
ggaggggguugagggagucccaggaggg

SEQ ID NO: 1332540 - RNA, 19 nt, Human
gggcuggaucagagagccg

SEQ ID NO: 1332541 - RNA, 18 nt, Human
ggggcugggaccggggaa

SEQ ID NO: 1332542 - RNA, 22 nt, Human
uaaaaaucugacccaggccccc

SEQ ID NO: 1332543 - RNA, 24 nt, Human
ucaaucagaccuacuugcacccaa

SEQ ID NO: 1332544 - RNA, 23 nt, Human
uccagcucgguccucucccgggc

SEQ ID NO: 1332545 - RNA, 26 nt, Human
uccccaccagcccaacgcaccccacc

SEQ ID NO: 1332546 - RNA, 24 nt, Human
uccccucuuccaccacaccauccc

SEQ ID NO: 1332547 - RNA, 22 nt, Human
ucccgggcuggaucagagagcc

SEQ ID NO: 1332548 - RNA, 21 nt, Human
ucuccccuagacccagggcug

SEQ ID NO: 1332549 - RNA, 18 nt, Human
ugcuccaggauucccugc

SEQ ID NO: 1332550 - RNA, 22 nt, Human
ugcuccaggauucccugcccac

SEQ ID NO: 1332551 - RNA, 24 nt, Human
uggagaaaauggaggggguugagg

SEQ ID NO: 1332552 - RNA, 20 nt, Human
ugggggaacugggaggggcu

SEQ ID NO: 1332553 - RNA, 23 nt, Human
uguccauuggguagcaaugugga

SEQ ID NO: 1332554 - RNA, 23 nt, Human
uguccuacucaucccaccccaca

SEQ ID NO: 1332555 - RNA, 20 nt, Human
uucccugcccacuggccauu

SEQ ID NO: 1332556 - RNA, 18 nt, Human
aaaacaaccccccugaac

SEQ ID NO: 1332557 - RNA, 24 nt, Human
accggacgcggcggcaaggaccug

SEQ ID NO: 1332558 - RNA, 21 nt, Human
caaccccccugaacugggccc

SEQ ID NO: 1332559 - RNA, 23 nt, Human
ccccugaacugggcccagacccu

SEQ ID NO: 1332560 - RNA, 21 nt, Human
cccugaacugggcccagaccc

SEQ ID NO: 1332561 - RNA, 19 nt, Human
ccuuaagcuccuggaaccu

SEQ ID NO: 1332562 - RNA, 22 nt, Human
cgaaaacaaccccccugaacug

SEQ ID NO: 1332563 - RNA, 21 nt, Human
gaaccucaguuuuuccuuccg

SEQ ID NO: 1332564 - RNA, 26 nt, Human
gcgaaaacaaccccccugaacugggc

SEQ ID NO: 1332565 - RNA, 22 nt, Human
uaagcuccuggaaccucaguuu

SEQ ID NO: 1332566 - RNA, 23 nt, Human
ucgaauggcgacaauggcugucu

SEQ ID NO: 1332567 - RNA, 21 nt, Human
ugaacugggcccagacccuua

SEQ ID NO: 1332568 - RNA, 24 nt, Human
aacagaaaccccuuggggccugag

SEQ ID NO: 1332569 - RNA, 21 nt, Human
agagaauagaaacagaaaccc

SEQ ID NO: 1332570 - RNA, 24 nt, Human
cacagccauccgccucaagguggg

SEQ ID NO: 1332571 - RNA, 20 nt, Human
cagcugggaauucugggcag

SEQ ID NO: 1332572 - RNA, 21 nt, Human
cgugcacaggcagaggcugug

SEQ ID NO: 1332573 - RNA, 21 nt, Human
cucaagguggggaugaaagga

SEQ ID NO: 1332574 - RNA, 19 nt, Human
gacaggcugacacagacag

SEQ ID NO: 1332575 - RNA, 20 nt, Human
gacaggcugacacagacagc

SEQ ID NO: 1332576 - RNA, 19 nt, Human
gaggcugugggucagugca

SEQ ID NO: 1332577 - RNA, 21 nt, Human
ggacaggcugacacagacagc

SEQ ID NO: 1332578 - RNA, 19 nt, Human
uaaaaaagcucuaaaguca

SEQ ID NO: 1332579 - RNA, 19 nt, Human
ucagugcaggaaguagggu

SEQ ID NO: 1332580 - RNA, 20 nt, Human
ugaaaggagaugaccuggug

SEQ ID NO: 1332581 - RNA, 20 nt, Human
ugaaaggagaugaccuggug

SEQ ID NO: 1332582 - RNA, 18 nt, Human
ugaccugguggcugcgug

SEQ ID NO: 1332583 - RNA, 21 nt, Human
ugggcagggacaagcaggcgu

SEQ ID NO: 1332584 - RNA, 19 nt, Human
uucaugugcuucucuugag

SEQ ID NO: 1332585 - RNA, 23 nt, Human
uugagacgaagggaaaaguggua

SEQ ID NO: 1332586 - RNA, 21 nt, Human
aaaguggccugcccagacuau

SEQ ID NO: 1332587 - RNA, 19 nt, Human
agacuauuuugguagcaag

SEQ ID NO: 1332588 - RNA, 18 nt, Human
agcaagcguggaaaucag

SEQ ID NO: 1332589 - RNA, 23 nt, Human
agcaagcguggaaaucagaucug

SEQ ID NO: 1332590 - RNA, 21 nt, Human
aggaagucugcauuaucacga

SEQ ID NO: 1332591 - RNA, 18 nt, Human
cacaccaaagcaucagcc

SEQ ID NO: 1332592 - RNA, 22 nt, Human
caccacagagagaagaaaaggg

SEQ ID NO: 1332593 - RNA, 21 nt, Human
cagagugcuggccacaccaaa

SEQ ID NO: 1332594 - RNA, 22 nt, Human
caguaaggaauuacaaauccug

SEQ ID NO: 1332595 - RNA, 18 nt, Human
ccuguguuuguacuccag

SEQ ID NO: 1332596 - RNA, 26 nt, Human
cgaaaucgaaagcggccgccugcuca

SEQ ID NO: 1332597 - RNA, 20 nt, Human
cgccuacuuccaaaaguggc

SEQ ID NO: 1332598 - RNA, 24 nt, Human
cucaaggcaaauuucaaguaacuc

SEQ ID NO: 1332599 - RNA, 22 nt, Human
cuuccaaaaguggccugcccag

SEQ ID NO: 1332600 - RNA, 22 nt, Human
gcagcugccuacucugcagcug

SEQ ID NO: 1332601 - RNA, 23 nt, Human
ggaagucugcauuaucacgagga

SEQ ID NO: 1332602 - RNA, 24 nt, Human
ggggaaagcgaaaucgaaagcggc

SEQ ID NO: 1332603 - RNA, 20 nt, Human
uaacgccuacuuccaaaagu

SEQ ID NO: 1332604 - RNA, 24 nt, Human
uagcugaucaucuuuccguacauu

SEQ ID NO: 1332605 - RNA, 22 nt, Human
uaggggaaagcgaaaucgaaag

SEQ ID NO: 1332606 - RNA, 18 nt, Human
ucugcagcugugguucuc

SEQ ID NO: 1332607 - RNA, 21 nt, Human
ugagaaucucgggagcagccc

SEQ ID NO: 1332608 - RNA, 21 nt, Human
uggaaaggagguaacacacuc

SEQ ID NO: 1332609 - RNA, 22 nt, Human
uuacaguaaggaauuacaaauc

SEQ ID NO: 1332610 - RNA, 18 nt, Human
uucagagugcuggccaca

SEQ ID NO: 1332611 - RNA, 22 nt, Human
aaggugacagugagggguucuu

SEQ ID NO: 1332612 - RNA, 19 nt, Human
aagugagaagaaaagcuga

SEQ ID NO: 1332613 - RNA, 18 nt, Human
agauggaguuuguagggc

SEQ ID NO: 1332614 - RNA, 18 nt, Human
caugaagugagaagaaaa

SEQ ID NO: 1332615 - RNA, 21 nt, Human
ggaguaguuuucacaugaagu

SEQ ID NO: 1332616 - RNA, 19 nt, Human
ggauaaggacagagcuuga

SEQ ID NO: 1332617 - RNA, 23 nt, Human
ggauaaggacagagcuugaaggg

SEQ ID NO: 1332618 - RNA, 21 nt, Human
gguauucucgggaaggugaca

SEQ ID NO: 1332619 - RNA, 22 nt, Human
guccucuucuguucagauauuu

SEQ ID NO: 1332620 - RNA, 24 nt, Human
ucagccacuggaguaguuuucaca

SEQ ID NO: 1332621 - RNA, 21 nt, Human
ucagucagccacuggaguagu

SEQ ID NO: 1332622 - RNA, 22 nt, Human
ucuauaauugaugacugugagc

SEQ ID NO: 1332623 - RNA, 20 nt, Human
ucuuaggguauucucgggaa

SEQ ID NO: 1332624 - RNA, 19 nt, Human
ugaagggucagcaauucag

SEQ ID NO: 1332625 - RNA, 21 nt, Human
aaguggagacaaguuuauuga

SEQ ID NO: 1332626 - RNA, 22 nt, Human
acuccgaggggauccguaagag

SEQ ID NO: 1332627 - RNA, 21 nt, Human
agugagacugaggaucuggua

SEQ ID NO: 1332628 - RNA, 22 nt, Human
caaguuuauugaggagcuugac

SEQ ID NO: 1332629 - RNA, 26 nt, Human
caccccucuucugcccuagcuugaga

SEQ ID NO: 1332630 - RNA, 20 nt, Human
caggccccugggugucuccc

SEQ ID NO: 1332631 - RNA, 19 nt, Human
ccuugucgccgcggccucg

SEQ ID NO: 1332632 - RNA, 21 nt, Human
cgcccgggaugcggaggucug

SEQ ID NO: 1332633 - RNA, 18 nt, Human
cgccgcggccucgccgcc

SEQ ID NO: 1332634 - RNA, 18 nt, Human
cgggaccagcgcacccug

SEQ ID NO: 1332635 - RNA, 19 nt, Human
cggucgaggcaugcugcgg

SEQ ID NO: 1332636 - RNA, 19 nt, Human
cugcagccagugagggccc

SEQ ID NO: 1332637 - RNA, 23 nt, Human
cugcccuagcuugagagaacaac

SEQ ID NO: 1332638 - RNA, 20 nt, Human
cuucugcccuagcuugagag

SEQ ID NO: 1332639 - RNA, 22 nt, Human
cuugacaccccucuucugcccu

SEQ ID NO: 1332640 - RNA, 23 nt, Human
gccuuuccuguggccccaggcac

SEQ ID NO: 1332641 - RNA, 20 nt, Human
gcgggccaggccccugggug

SEQ ID NO: 1332642 - RNA, 27 nt, Human
ggcgggccaggccccugggggacucuc

SEQ ID NO: 1332643 - RNA, 24 nt, Human
uaaggaaacagaucagcugcagcc

SEQ ID NO: 1332644 - RNA, 25 nt, Human
uaaggaaacagaucagcugcagcca

SEQ ID NO: 1332645 - RNA, 19 nt, Human
ucgccgcggccucgccgcc

SEQ ID NO: 1332646 - RNA, 25 nt, Human
ucucccauaucgcugucuuuaguga

SEQ ID NO: 1332647 - RNA, 19 nt, Human
ugagcgcgcgaccgggacc

SEQ ID NO: 1332648 - RNA, 24 nt, Human
ugagggccccugcguugggccugg

SEQ ID NO: 1332649 - RNA, 25 nt, Human
ugggugucucccauaucgcugucuu

SEQ ID NO: 1332650 - RNA, 21 nt, Human
aaguggagacaaguuuauuga

SEQ ID NO: 1332651 - RNA, 20 nt, Human
acucucagcucugaagccag

SEQ ID NO: 1332652 - RNA, 21 nt, Human
agugagacugaggaucuggua

SEQ ID NO: 1332653 - RNA, 22 nt, Human
caaguuuauugaggagcuugac

SEQ ID NO: 1332654 - RNA, 26 nt, Human
caccccucuucugcccuagcuugaga

SEQ ID NO: 1332655 - RNA, 19 nt, Human
cacuguguuggggcgaggc

SEQ ID NO: 1332656 - RNA, 23 nt, Human
cagcagggucuggcagccucugg

SEQ ID NO: 1332657 - RNA, 20 nt, Human
caggccccugggugucuccc

SEQ ID NO: 1332658 - RNA, 26 nt, Human
ccaggaauuucccauagcagcaccgg

SEQ ID NO: 1332659 - RNA, 22 nt, Human
ccagguuugugguguucugggg

SEQ ID NO: 1332660 - RNA, 23 nt, Human
ccccaggcacucucagcucugaa

SEQ ID NO: 1332661 - RNA, 22 nt, Human
ccugcugugggcagggcucugc

SEQ ID NO: 1332662 - RNA, 19 nt, Human
cgacaccgcaggaugccca

SEQ ID NO: 1332663 - RNA, 19 nt, Human
cugcagccagugagggccc

SEQ ID NO: 1332664 - RNA, 18 nt, Human
cuggggguccuggugaag

SEQ ID NO: 1332665 - RNA, 20 nt, Human
cuucugcccuagcuugagag

SEQ ID NO: 1332666 - RNA, 21 nt, Human
cuugacaccccucuucugccc

SEQ ID NO: 1332667 - RNA, 22 nt, Human
gcagcagggucuggcagccucu

SEQ ID NO: 1332668 - RNA, 21 nt, Human
gcccuagcuugagagaacaac

SEQ ID NO: 1332669 - RNA, 23 nt, Human
gccuuuccuguggccccaggcac

SEQ ID NO: 1332670 - RNA, 20 nt, Human
gcgggccaggccccugggug

SEQ ID NO: 1332671 - RNA, 18 nt, Human
gcugugggcagggcucug

SEQ ID NO: 1332672 - RNA, 27 nt, Human
ggcgggccaggccccugggggacucuc

SEQ ID NO: 1332673 - RNA, 18 nt, Human
gucuggcagccucugggc

SEQ ID NO: 1332674 - RNA, 21 nt, Human
guggccccaggcacucucagc

SEQ ID NO: 1332675 - RNA, 24 nt, Human
uaaggaaacagaucagcugcagcc

SEQ ID NO: 1332676 - RNA, 25 nt, Human
uaaggaaacagaucagcugcagcca

SEQ ID NO: 1332677 - RNA, 22 nt, Human
uccagguuugugguguucuggg

SEQ ID NO: 1332678 - RNA, 19 nt, Human
ucccauagcagcaccgguc

SEQ ID NO: 1332679 - RNA, 19 nt, Human
ucccuggagauguccuucc

SEQ ID NO: 1332680 - RNA, 19 nt, Human
uccuggugaagaccacacu

SEQ ID NO: 1332681 - RNA, 24 nt, Human
ucgacaccgcaggaugcccaggaa

SEQ ID NO: 1332682 - RNA, 20 nt, Human
ucuccagguuugugguguuc

SEQ ID NO: 1332683 - RNA, 24 nt, Human
ucucccauaucgcugucuuuagug

SEQ ID NO: 1332684 - RNA, 21 nt, Human
ucugaagccaggcuauugcuc

SEQ ID NO: 1332685 - RNA, 22 nt, Human
ucuggcagccucugggcucucc

SEQ ID NO: 1332686 - RNA, 24 nt, Human
ugagggccccugcguugggccugg

SEQ ID NO: 1332687 - RNA, 19 nt, Human
ugggcucuccagguuugug

SEQ ID NO: 1332688 - RNA, 25 nt, Human
ugggugucucccauaucgcugucuu

SEQ ID NO: 1332689 - RNA, 19 nt, Human
uucacagucucaaaauauu

SEQ ID NO: 1332690 - RNA, 22 nt, Human
aaaaacaauuuguuuugaaaac

SEQ ID NO: 1332691 - RNA, 23 nt, Human
aaaauuacaacugagacagugag

SEQ ID NO: 1332692 - RNA, 19 nt, Human
aaacaagaaucuaccauac

SEQ ID NO: 1332693 - RNA, 25 nt, Human
aaacauuuagcacuguuaauggaca

SEQ ID NO: 1332694 - RNA, 19 nt, Human
aaaggacuuuggucuuccc

SEQ ID NO: 1332695 - RNA, 21 nt, Human
aacauuugaaaacaccaucgc

SEQ ID NO: 1332696 - RNA, 23 nt, Human
aaccuaauaacaaguaucauuca

SEQ ID NO: 1332697 - RNA, 23 nt, Human
aagagccaaggaagcugugguuu

SEQ ID NO: 1332698 - RNA, 22 nt, Human
aagcacccauaaauaauggcaa

SEQ ID NO: 1332699 - RNA, 21 nt, Human
aauagcagcccuuuccaaaac

SEQ ID NO: 1332700 - RNA, 20 nt, Human
aaucuauaaaguguuuccuu

SEQ ID NO: 1332701 - RNA, 22 nt, Human
aaucuuuucuucucuguguuga

SEQ ID NO: 1332702 - RNA, 23 nt, Human
acugcaauccacuuggggagacu

SEQ ID NO: 1332703 - RNA, 25 nt, Human
agaacaaauucacuacaaauuuuca

SEQ ID NO: 1332704 - RNA, 18 nt, Human
agcacuguuaauggacag

SEQ ID NO: 1332705 - RNA, 19 nt, Human
aggaagcugugguuucgca

SEQ ID NO: 1332706 - RNA, 19 nt, Human
aggcccggcaagccaaagg

SEQ ID NO: 1332707 - RNA, 23 nt, Human
aggcuucaguuuuccaccuccag

SEQ ID NO: 1332708 - RNA, 19 nt, Human
agguagucgccaucucaaa

SEQ ID NO: 1332709 - RNA, 24 nt, Human
aucgcaaaauuacaacugagacag

SEQ ID NO: 1332710 - RNA, 25 nt, Human
auuacaacugagacagugagagauc

SEQ ID NO: 1332711 - RNA, 21 nt, Human
caaaaaacuaaaacuauagca

SEQ ID NO: 1332712 - RNA, 22 nt, Human
caaaaccuaauaacaaguauca

SEQ ID NO: 1332713 - RNA, 24 nt, Human
caagaggacagcuucgacucccuc

SEQ ID NO: 1332714 - RNA, 23 nt, Human
cacacagccggcuuugcaugccc

SEQ ID NO: 1332715 - RNA, 23 nt, Human
cacugcuauagaaaucuauaaag

SEQ ID NO: 1332716 - RNA, 24 nt, Human
cagaaucaaggcccggcaagccaa

SEQ ID NO: 1332717 - RNA, 22 nt, Human
cagagcuuuccuuagacuaaaa

SEQ ID NO: 1332718 - RNA, 19 nt, Human
cagcguguggccacguggu

SEQ ID NO: 1332719 - RNA, 21 nt, Human
cagcuggaggcugcaagauuc

SEQ ID NO: 1332720 - RNA, 21 nt, Human
cauggcgcccagcaggaaugg

SEQ ID NO: 1332721 - RNA, 22 nt, Human
ccaaaacaaacccgcuuccugc

SEQ ID NO: 1332722 - RNA, 22 nt, Human
ccagagggcauauucaaaaaca

SEQ ID NO: 1332723 - RNA, 21 nt, Human
ccauaaauaauggcaagaaca

SEQ ID NO: 1332724 - RNA, 19 nt, Human
ccauacagaaagguagucg

SEQ ID NO: 1332725 - RNA, 27 nt, Human
ccauccagaaauuaagccaacacaaga

SEQ ID NO: 1332726 - RNA, 25 nt, Human
cccaagauagccauuugguugugcc

SEQ ID NO: 1332727 - RNA, 23 nt, Human
ccccuguacucuauggaucagcu

SEQ ID NO: 1332728 - RNA, 22 nt, Human
cccgcgcccggagagucgggac

SEQ ID NO: 1332729 - RNA, 21 nt, Human
cccuagauaacuacuauaggu

SEQ ID NO: 1332730 - RNA, 20 nt, Human
ccuccaaaaaacuaaaacua

SEQ ID NO: 1332731 - RNA, 21 nt, Human
ccuuaaaaacugcaauccacu

SEQ ID NO: 1332732 - RNA, 19 nt, Human
cgacuaaucaacuuuccca

SEQ ID NO: 1332733 - RNA, 21 nt, Human
cgcaaaauuacaacugagaca

SEQ ID NO: 1332734 - RNA, 18 nt, Human
cgcacaugaaagcaccca

SEQ ID NO: 1332735 - RNA, 24 nt, Human
cgcgccggcagaggcuucagccug

SEQ ID NO: 1332736 - RNA, 21 nt, Human
cuaaaacuauagcaaggcuuc

SEQ ID NO: 1332737 - RNA, 19 nt, Human
cuaaccuccaagcuguccu

SEQ ID NO: 1332738 - RNA, 20 nt, Human
cucacugguccccuacccac

SEQ ID NO: 1332739 - RNA, 21 nt, Human
cucaucuggucuuguggcccc

SEQ ID NO: 1332740 - RNA, 21 nt, Human
cuccaaaaaacuaaaacuaua

SEQ ID NO: 1332741 - RNA, 22 nt, Human
cucccucugauuucaucuccga

SEQ ID NO: 1332742 - RNA, 19 nt, Human
cuccucaggauaacaucac

SEQ ID NO: 1332743 - RNA, 18 nt, Human
cucgcacaugaaagcacc

SEQ ID NO: 1332744 - RNA, 20 nt, Human
cucgccauaaaaccuuacua

SEQ ID NO: 1332745 - RNA, 24 nt, Human
cuguccuuguucauuccuggucgu

SEQ ID NO: 1332746 - RNA, 19 nt, Human
cugugcguuaucacaucaa

SEQ ID NO: 1332747 - RNA, 18 nt, Human
cuucagccuggagcucag

SEQ ID NO: 1332748 - RNA, 22 nt, Human
cuucagccuggagcucagggug

SEQ ID NO: 1332749 - RNA, 19 nt, Human
cuuuucuucucuguguuga

SEQ ID NO: 1332750 - RNA, 24 nt, Human
gaucauaacccuccaaaaaacuaa

SEQ ID NO: 1332751 - RNA, 21 nt, Human
gcaaaaagagccaaggaagcu

SEQ ID NO: 1332752 - RNA, 21 nt, Human
gcaagauucuaaaccuccccc

SEQ ID NO: 1332753 - RNA, 20 nt, Human
ggagcucaggguggcgggca

SEQ ID NO: 1332754 - RNA, 27 nt, Human
ggcagaggcuucagccuggagcucagg

SEQ ID NO: 1332755 - RNA, 23 nt, Human
ggcaugauguugaagccccacuu

SEQ ID NO: 1332756 - RNA, 23 nt, Human
gguagaugaaucuuuucuucucu

SEQ ID NO: 1332757 - RNA, 23 nt, Human
guacaacagcuguuaccaaaacc

SEQ ID NO: 1332758 - RNA, 23 nt, Human
gugcgcgccggcagaggcuucag

SEQ ID NO: 1332759 - RNA, 23 nt, Human
uaaaaccuuacuauguaacacug

SEQ ID NO: 1332760 - RNA, 23 nt, Human
uaacacugcuauagaaaucuaua

SEQ ID NO: 1332761 - RNA, 27 nt, Human
uaaccaauuccaucuugcuucuaaccu

SEQ ID NO: 1332762 - RNA, 22 nt, Human
uaagccaacacaagaggacaac

SEQ ID NO: 1332763 - RNA, 23 nt, Human
uaauaacaaguaucauucaaagc

SEQ ID NO: 1332764 - RNA, 24 nt, Human
uacaacagcuguuaccaaaaccua

SEQ ID NO: 1332765 - RNA, 25 nt, Human
uaccaaaaccuaauaacaaguauca

SEQ ID NO: 1332766 - RNA, 28 nt, Human
uagcaaggcuucaguuuuccaccuccag

SEQ ID NO: 1332767 - RNA, 23 nt, Human
uagucgccaucucaaaacucuca

SEQ ID NO: 1332768 - RNA, 21 nt, Human
uauuagaggaaaauaacucag

SEQ ID NO: 1332769 - RNA, 30 nt, Human; identical to SEQ ID NO: 1275747

SEQ ID NO: 1332770 - RNA, 19 nt, Human
ucacuacaaauuuucaaaa

SEQ ID NO: 1332771 - RNA, 21 nt, Human
ucagagcuuuccuuagacuaa

SEQ ID NO: 1332772 - RNA, 23 nt, Human
ucagagcuuuccuuagacuaaaa

SEQ ID NO: 1332773 - RNA, 19 nt, Human
ucaggauaacaucacuauu

SEQ ID NO: 1332774 - RNA, 22 nt, Human
uccgcagaaucaaggcccggca

SEQ ID NO: 1332775 - RNA, 18 nt, Human
ucucaaaaucugagaaag

SEQ ID NO: 1332776 - RNA, 24 nt, Human
ucuuguggcccccauccagaaauu

SEQ ID NO: 1332777 - RNA, 23 nt, Human
ugaaaacaccaucgcaaaauuac

SEQ ID NO: 1332778 - RNA, 21 nt, Human
ugaaacaaagacaauagcagc

SEQ ID NO: 1332779 - RNA, 24 nt, Human
ugaaagcacccauaaauaauggca

SEQ ID NO: 1332780 - RNA, 18 nt, Human
ugaagcuuucucuucuaa

SEQ ID NO: 1332781 - RNA, 24 nt, Human
ugaucauaacccuccaaaaaacua

SEQ ID NO: 1332782 - RNA, 23 nt, Human
uggcaagaacaaauucacuacaa

SEQ ID NO: 1332783 - RNA, 25 nt, Human
uggcagcagcguguggccacguggu

SEQ ID NO: 1332784 - RNA, 21 nt, Human
uucuaaaccucccccaauugc

SEQ ID NO: 1332785 - RNA, 23 nt, Human
uucuuucuugcuugaucuucgau

SEQ ID NO: 1332786 - RNA, 21 nt, Human
uugaucuucgauaauacuggg

SEQ ID NO: 1332787 - RNA, 23 nt, Human
uugaucuucgauaauacugggaa

SEQ ID NO: 1332788 - RNA, 19 nt, Human
uuucaaauuuucagagcuu

SEQ ID NO: 1332789 - RNA, 21 nt, Human
aaacagaaaguaacaccagaa

SEQ ID NO: 1332790 - RNA, 21 nt, Human
aaaugucacugacuccugaaa

SEQ ID NO: 1332791 - RNA, 22 nt, Human
aaguucacagcuacauccucaa

SEQ ID NO: 1332792 - RNA, 18 nt, Human
agacagaaggaccagccu

SEQ ID NO: 1332793 - RNA, 18 nt, Human
agcuacauccucaaaugu

SEQ ID NO: 1332794 - RNA, 27 nt, Human
aggaaaaacagaaaguaaccgguaccc

SEQ ID NO: 1332795 - RNA, 23 nt, Human
caaugucuuuggggaaucucaca

SEQ ID NO: 1332796 - RNA, 21 nt, Human
uaggaaaaacagaaaguaaca

SEQ ID NO: 1332797 - RNA, 26 nt, Human
uaggaaaaacagaaaguaacaccaga

SEQ ID NO: 1332798 - RNA, 21 nt, Human
uauuaggaagugauugauaaa

SEQ ID NO: 1332799 - RNA, 27 nt, Human
uucacagcuacauccucaaaugucacu

SEQ ID NO: 1332800 - RNA, 22 nt, Human
aaaaaauaccccaacuuuagga

SEQ ID NO: 1332801 - RNA, 21 nt, Human
aaacagacaucccuauuuccu

SEQ ID NO: 1332802 - RNA, 22 nt, Human
aaacagcccaaggugaagcuca

SEQ ID NO: 1332803 - RNA, 24 nt, Human
aaagauccucaaaggucuguguua

SEQ ID NO: 1332804 - RNA, 20 nt, Human
aagacuuuuuagaaagauga

SEQ ID NO: 1332805 - RNA, 20 nt, Human
aaguagauaugcucaagaaa

SEQ ID NO: 1332806 - RNA, 20 nt, Human
aaguagcugggauuacaggc

SEQ ID NO: 1332807 - RNA, 26 nt, Human
aaguagcugggauuacaggcgcaugc

SEQ ID NO: 1332808 - RNA, 23 nt, Human
acagaguggcugggccugacccc

SEQ ID NO: 1332809 - RNA, 23 nt, Human
accagacuggagugcaauggcgu

SEQ ID NO: 1332810 - RNA, 25 nt, Human
acuaggagaaagcaugcaaaacagc

SEQ ID NO: 1332811 - RNA, 27 nt, Human
acucugucaaccagacuggagugcaau

SEQ ID NO: 1332812 - RNA, 19 nt, Human
acuggagugcaauggcgug

SEQ ID NO: 1332813 - RNA, 24 nt, Human
acuucaauagaaaguaagcuaaaa

SEQ ID NO: 1332814 - RNA, 25 nt, Human
agaaaaaaauaacacuaaauaagga

SEQ ID NO: 1332815 - RNA, 24 nt, Human
agaguaaaggugccaggggaaggg

SEQ ID NO: 1332816 - RNA, 19 nt, Human
agccacauccagggagcca

SEQ ID NO: 1332817 - RNA, 23 nt, Human
agcuacagaaaguccugacuauc

SEQ ID NO: 1332818 - RNA, 18 nt, Human
aggcccaggagagaacag

SEQ ID NO: 1332819 - RNA, 19 nt, Human
agggagccaaggauauagu

SEQ ID NO: 1332820 - RNA, 18 nt, Human
aggggaagggcugaggcu

SEQ ID NO: 1332821 - RNA, 19 nt, Human
aguagcugggauuacaggc

SEQ ID NO: 1332822 - RNA, 21 nt, Human
agugcaauggcgugaucucag

SEQ ID NO: 1332823 - RNA, 24 nt, Human
agugcaauggcgugaucucagcuc

SEQ ID NO: 1332824 - RNA, 21 nt, Human
auaagacaagguggcuccuuc

SEQ ID NO: 1332825 - RNA, 20 nt, Human
aucccuauuuccuuccuagg

SEQ ID NO: 1332826 - RNA, 20 nt, Human
auggguuuuugccauguugg

SEQ ID NO: 1332827 - RNA, 18 nt, Human
auuccaaauuucaugagg

SEQ ID NO: 1332828 - RNA, 20 nt, Human
caaccuccuccucccagguu

SEQ ID NO: 1332829 - RNA, 23 nt, Human
caacugauauaagaacuaagaaa

SEQ ID NO: 1332830 - RNA, 25 nt, Human
caagaucagaagggacacuaacacc

SEQ ID NO: 1332831 - RNA, 22 nt, Human
cacaacacuaaucacugucccc

SEQ ID NO: 1332832 - RNA, 23 nt, Human
cacaccauguacucuaaaaugag

SEQ ID NO: 1332833 - RNA, 21 nt, Human
cacauccagggagccaaggau

SEQ ID NO: 1332834 - RNA, 18 nt, Human
caccauguacucuaaaau

SEQ ID NO: 1332835 - RNA, 23 nt, Human
cacucugucaaccagacuggagu

SEQ ID NO: 1332836 - RNA, 18 nt, Human
cacuguugggugauagaa

SEQ ID NO: 1332837 - RNA, 25 nt, Human
cacuucacugugcccccugcugccc

SEQ ID NO: 1332838 - RNA, 20 nt, Human
cacuuugacagcuucccucu

SEQ ID NO: 1332839 - RNA, 25 nt, Human
cagcauaaauagguauuugugaaug

SEQ ID NO: 1332840 - RNA, 22 nt, Human
cagcucacugcaaccuccuccu

SEQ ID NO: 1332841 - RNA, 23 nt, Human
cagguuccuucacacauaauuuc

SEQ ID NO: 1332842 - RNA, 22 nt, Human
caugcuaaaaugaaugcaucca

SEQ ID NO: 1332843 - RNA, 24 nt, Human
cauguuggccaggcuggucucaaa

SEQ ID NO: 1332844 - RNA, 19 nt, Human
ccagcuuacucuucucucc

SEQ ID NO: 1332845 - RNA, 22 nt, Human
ccagcuuacucuucucucccuc

SEQ ID NO: 1332846 - RNA, 23 nt, Human
ccagcuuacucuucucucccucc

SEQ ID NO: 1332847 - RNA, 19 nt, Human
ccauguuggccaggcuggu

SEQ ID NO: 1332848 - RNA, 20 nt, Human
cccaacccaggucuggcuuc

SEQ ID NO: 1332849 - RNA, 19 nt, Human
cccagggcacaggggucag

SEQ ID NO: 1332850 - RNA, 20 nt, Human
cccagguucaagcaauucuc

SEQ ID NO: 1332851 - RNA, 23 nt, Human
ccccacugcagggugugugccca

SEQ ID NO: 1332852 - RNA, 19 nt, Human
cccugcaccucccggcuac

SEQ ID NO: 1332853 - RNA, 19 nt, Human
ccgaaguagcugggauuac

SEQ ID NO: 1332854 - RNA, 23 nt, Human
ccgaaguagcugggauuacaggc

SEQ ID NO: 1332855 - RNA, 24 nt, Human
ccgaaguagcugggauuacaggcg

SEQ ID NO: 1332856 - RNA, 22 nt, Human
ccucccagguucaagcaauucu

SEQ ID NO: 1332857 - RNA, 18 nt, Human
ccuccucccagguucaag

SEQ ID NO: 1332858 - RNA, 22 nt, Human
ccugcagcccagugcccagggc

SEQ ID NO: 1332859 - RNA, 25 nt, Human
cuaauuaaagaagacugagaagccc

SEQ ID NO: 1332860 - RNA, 20 nt, Human
cuacuucaauagaaaguaag

SEQ ID NO: 1332861 - RNA, 19 nt, Human
cuagggcccuucacuccuc

SEQ ID NO: 1332862 - RNA, 19 nt, Human
cucaagugauuugcccacc

SEQ ID NO: 1332863 - RNA, 23 nt, Human
cucacugcaaccuccuccuccca

SEQ ID NO: 1332864 - RNA, 24 nt, Human
cucacugcaaccuccuccucccag

SEQ ID NO: 1332865 - RNA, 22 nt, Human
cuccaaccugcagcccagugcc

SEQ ID NO: 1332866 - RNA, 20 nt, Human
cucccagguucaagcaauuc

SEQ ID NO: 1332867 - RNA, 21 nt, Human
cucucuacaggcccaggagag

SEQ ID NO: 1332868 - RNA, 24 nt, Human
cugcaaccuccuccucccagguuc

SEQ ID NO: 1332869 - RNA, 23 nt, Human
cuuacucuucucucccucccaga

SEQ ID NO: 1332870 - RNA, 18 nt, Human
cuugucuccuuccacuuc

SEQ ID NO: 1332871 - RNA, 21 nt, Human
gaacuuaaagaauauuuggga

SEQ ID NO: 1332872 - RNA, 20 nt, Human
gaagcuacagaaaguccuga

SEQ ID NO: 1332873 - RNA, 25 nt, Human
gacccaacccaggucuggcuucugu

SEQ ID NO: 1332874 - RNA, 22 nt, Human
gaccucaagugauuugcccacc

SEQ ID NO: 1332875 - RNA, 20 nt, Human
gaggaagggcgaagaguaaa

SEQ ID NO: 1332876 - RNA, 21 nt, Human
gaguauguguuauccccacuc

SEQ ID NO: 1332877 - RNA, 21 nt, Human
gagugcaauggcgugaucuca

SEQ ID NO: 1332878 - RNA, 20 nt, Human
gauagaguggcaggccagaa

SEQ ID NO: 1332879 - RNA, 18 nt, Human
gauuacaggcgcaugcca

SEQ ID NO: 1332880 - RNA, 24 nt, Human
gauuacaggcgcaugccaccaugc

SEQ ID NO: 1332881 - RNA, 22 nt, Human
gcaaccuccuccucccagguuc

SEQ ID NO: 1332882 - RNA, 23 nt, Human
gcacugugguccaagaguguggu

SEQ ID NO: 1332883 - RNA, 20 nt, Human
gccagguauuagaagguucc

SEQ ID NO: 1332884 - RNA, 20 nt, Human
gccauguuggccaggcuggu

SEQ ID NO: 1332885 - RNA, 22 nt, Human
gcucacugcaaccuccuccucc

SEQ ID NO: 1332886 - RNA, 22 nt, Human
gcuuacucuucucucccuccca

SEQ ID NO: 1332887 - RNA, 24 nt, Human
ggagacagagguuuacaaaaggaa

SEQ ID NO: 1332888 - RNA, 23 nt, Human
ggcuugucuccuuccacuucuuu

SEQ ID NO: 1332889 - RNA, 22 nt, Human
ggguuuuugccauguuggccag

SEQ ID NO: 1332890 - RNA, 23 nt, Human
ggguuuuugccauguuggccagg

SEQ ID NO: 1332891 - RNA, 18 nt, Human
guaaaggugccaggggaa

SEQ ID NO: 1332892 - RNA, 18 nt, Human
guagcugggauuacaggc

SEQ ID NO: 1332893 - RNA, 22 nt, Human
uaaagcacuaggagaaagcaug

SEQ ID NO: 1332894 - RNA, 20 nt, Human
uaauuuuuauauuuuuuaga

SEQ ID NO: 1332895 - RNA, 24 nt, Human
uagaagagauggguuuuugccaug

SEQ ID NO: 1332896 - RNA, 18 nt, Human
uagaagaugugggaaucc

SEQ ID NO: 1332897 - RNA, 19 nt, Human
uagggcccuucacuccucc

SEQ ID NO: 1332898 - RNA, 23 nt, Human
uaucacuggaacucaguuaaaau

SEQ ID NO: 1332899 - RNA, 20 nt, Human
uaugguuuugagagaucuuc

SEQ ID NO: 1332900 - RNA, 22 nt, Human
uaugguuuugagagaucuucuu

SEQ ID NO: 1332901 - RNA, 22 nt, Human
ucaagaaagcuaucccaaggac

SEQ ID NO: 1332902 - RNA, 18 nt, Human
ucacugcaaccuccuccc

SEQ ID NO: 1332903 - RNA, 18 nt, Human
ucacugcaaccuccuccu

SEQ ID NO: 1332904 - RNA, 24 nt, Human
ucacugcaaccuccuccucccagg

SEQ ID NO: 1332905 - RNA, 25 nt, Human
ucagcucacugcaaccuccuccucc

SEQ ID NO: 1332906 - RNA, 20 nt, Human
ucagggcugaugaaagagga

SEQ ID NO: 1332907 - RNA, 21 nt, Human
ucagggcugaugaaagaggau

SEQ ID NO: 1332908 - RNA, 18 nt, Human
ucauucaggaguagauua

SEQ ID NO: 1332909 - RNA, 19 nt, Human
uccaauauuguccaacuag

SEQ ID NO: 1332910 - RNA, 20 nt, Human
uccaccaugccaggaggaag

SEQ ID NO: 1332911 - RNA, 19 nt, Human
ucccaaggacaggguugca

SEQ ID NO: 1332912 - RNA, 21 nt, Human
ucccagguucaagcaauucuc

SEQ ID NO: 1332913 - RNA, 21 nt, Human
ucccagguucaagcaauucuc

SEQ ID NO: 1332914 - RNA, 24 nt, Human
uccgaaguagcugggauuacaggc

SEQ ID NO: 1332915 - RNA, 25 nt, Human
ucuacaggcccaggagagaacagcu

SEQ ID NO: 1332916 - RNA, 24 nt, Human
ucucacucugucaaccagacugga

SEQ ID NO: 1332917 - RNA, 18 nt, Human
ucucagggcugaugaaag

SEQ ID NO: 1332918 - RNA, 21 nt, Human
ucuguggauuuugauuaucua

SEQ ID NO: 1332919 - RNA, 23 nt, Human
ugaagcucacuuggcagcugaga

SEQ ID NO: 1332920 - RNA, 25 nt, Human
ugaaggauacaaauggagccgaaaa

SEQ ID NO: 1332921 - RNA, 18 nt, Human
ugaccucaagugauuugc

SEQ ID NO: 1332922 - RNA, 22 nt, Human
ugaccucaagugauuugcccac

SEQ ID NO: 1332923 - RNA, 20 nt, Human
ugacucaaccuccgaaguag

SEQ ID NO: 1332924 - RNA, 24 nt, Human
ugacucaaccuccgaaguagcugg

SEQ ID NO: 1332925 - RNA, 22 nt, Human
ugagaaaaaaauaacacuaaau

SEQ ID NO: 1332926 - RNA, 23 nt, Human
ugagucucacucugucaaccaga

SEQ ID NO: 1332927 - RNA, 18 nt, Human
ugccaggaggaagggcga

SEQ ID NO: 1332928 - RNA, 19 nt, Human
ugccaggggaagggcugag

SEQ ID NO: 1332929 - RNA, 24 nt, Human
ugccauguuggccaggcuggucuc

SEQ ID NO: 1332930 - RNA, 27 nt, Human
ugccauguuggccaggcuggucucaaa

SEQ ID NO: 1332931 - RNA, 19 nt, Human
ugcccagcacacuuugaca

SEQ ID NO: 1332932 - RNA, 24 nt, Human
ugcuaaaaugaaugcauccaagga

SEQ ID NO: 1332933 - RNA, 22 nt, Human
ugcuacugcagccuaaugacuu

SEQ ID NO: 1332934 - RNA, 19 nt, Human
uggagugcaauggcgugau

SEQ ID NO: 1332935 - RNA, 24 nt, Human
uggagugcaauggcgugaucucag

SEQ ID NO: 1332936 - RNA, 19 nt, Human
uggcagcugagagugaguu

SEQ ID NO: 1332937 - RNA, 24 nt, Human
uggccaggcuggucucaaacucuu

SEQ ID NO: 1332938 - RNA, 24 nt, Human
uggcgugaucucagcucacugcaa

SEQ ID NO: 1332939 - RNA, 21 nt, Human
ugggauuacaggcgcaugcca

SEQ ID NO: 1332940 - RNA, 22 nt, Human
ugggauuacaggcgcaugccac

SEQ ID NO: 1332941 - RNA, 24 nt, Human
ugggauuacaggcgcaugccacca

SEQ ID NO: 1332942 - RNA, 25 nt, Human
ugggauuacaggcgcaugccaccau

SEQ ID NO: 1332943 - RNA, 20 nt, Human
uggguuuuugccauguuggc

SEQ ID NO: 1332944 - RNA, 24 nt, Human
uggguuuuugccauguuggccagg

SEQ ID NO: 1332945 - RNA, 23 nt, Human
uguaaauacgggguaagguacau

SEQ ID NO: 1332946 - RNA, 18 nt, Human
ugucauaucacuggaacu

SEQ ID NO: 1332947 - RNA, 18 nt, Human
uuacucuucucucccucc

SEQ ID NO: 1332948 - RNA, 24 nt, Human
uuagaagagauggguuuuugccau

SEQ ID NO: 1332949 - RNA, 18 nt, Human
uuaggagguuaaggucac

SEQ ID NO: 1332950 - RNA, 18 nt, Human
uucaauagaaaguaagcu

SEQ ID NO: 1332951 - RNA, 27 nt, Human
uucagacuuaagacuuuuuagaaagau

SEQ ID NO: 1332952 - RNA, 24 nt, Human
uuccguuuucucuauaaauaguuc

SEQ ID NO: 1332953 - RNA, 19 nt, Human
uucgccaggacccaaccca

SEQ ID NO: 1332954 - RNA, 24 nt, Human
uugccauguuggccaggcuggucu

SEQ ID NO: 1332955 - RNA, 18 nt, Human
uuuaagaaauagaagcca

SEQ ID NO: 1332956 - RNA, 23 nt, Human
uuuugccauguuggccaggcugg

SEQ ID NO: 1332957 - RNA, 24 nt, Human
uuuuuagaagagauggguuuuugc

SEQ ID NO: 1332958 - RNA, 23 nt, Human
uuuuugccauguuggccaggcug

SEQ ID NO: 1332959 - RNA, 24 nt, Human
uuuuuuucuaacuucugugagauu

SEQ ID NO: 1332960 - RNA, 23 nt, Human
aaacgaaaaggaaugggaaugag

SEQ ID NO: 1332961 - RNA, 19 nt, Human
aacuagacuucugacgcug

SEQ ID NO: 1332962 - RNA, 19 nt, Human
aaucaacuguguuccaaaa

SEQ ID NO: 1332963 - RNA, 20 nt, Human
aaugacaguaacaaacaaga

SEQ ID NO: 1332964 - RNA, 19 nt, Human
acacgcugcacaacugaca

SEQ ID NO: 1332965 - RNA, 25 nt, Human
acagcugccuauaaaacuagacuuc

SEQ ID NO: 1332966 - RNA, 24 nt, Human
caacugacaucacaggacagcugc

SEQ ID NO: 1332967 - RNA, 23 nt, Human
cacucaucuccuucagcauccca

SEQ ID NO: 1332968 - RNA, 19 nt, Human
cagguccaaacaaugaagg

SEQ ID NO: 1332969 - RNA, 23 nt, Human
cccacagaugaagcacauguucc

SEQ ID NO: 1332970 - RNA, 19 nt, Human
cugauucuaaacgaaaagg

SEQ ID NO: 1332971 - RNA, 26 nt, Human
gcugcacaacugacaucacaggacag

SEQ ID NO: 1332972 - RNA, 22 nt, Human
uaaaacuagacuucugacgcug

SEQ ID NO: 1332973 - RNA, 18 nt, Human
uaauaaugagguggcaca

SEQ ID NO: 1332974 - RNA, 21 nt, Human
uagauaauaaugagguggcac

SEQ ID NO: 1332975 - RNA, 18 nt, Human
uauaaaacuagacuucug

SEQ ID NO: 1332976 - RNA, 20 nt, Human
uauauuugaaacucaaggaa

SEQ ID NO: 1332977 - RNA, 18 nt, Human
ugaauauugugaugugac

SEQ ID NO: 1332978 - RNA, 18 nt, Human
ugacaguaacaaacaaga

SEQ ID NO: 1332979 - RNA, 24 nt, Human
ugggaaugacaguaacaaacaaga

SEQ ID NO: 1332980 - RNA, 22 nt, Human
uuuuugaacugccacauucacu

SEQ ID NO: 1332981 - RNA, 19 nt, Human
aacacaggucagugugagg

SEQ ID NO: 1332982 - RNA, 18 nt, Human
aagugcugggauuacagg

SEQ ID NO: 1332983 - RNA, 19 nt, Human
aagugcugggauuacaggc

SEQ ID NO: 1332984 - RNA, 21 nt, Human
aagugcugggauuacaggcau

SEQ ID NO: 1332985 - RNA, 23 nt, Human
aagugcugggauuacaggcauga

SEQ ID NO: 1332986 - RNA, 26 nt, Human
aagugcugggauuacaggcaugagcu

SEQ ID NO: 1332987 - RNA, 19 nt, Human
acagacagauucagaggcc

SEQ ID NO: 1332988 - RNA, 19 nt, Human
acccaggcuggagugcagu

SEQ ID NO: 1332989 - RNA, 18 nt, Human
acccugucacccaggcug

SEQ ID NO: 1332990 - RNA, 24 nt, Human
acccugucacccaggcuggagugc

SEQ ID NO: 1332991 - RNA, 18 nt, Human
acgggguuucaccguguu

SEQ ID NO: 1332992 - RNA, 19 nt, Human
acgggguuucaccguguua

SEQ ID NO: 1332993 - RNA, 20 nt, Human
acgggguuucaccguguuag

SEQ ID NO: 1332994 - RNA, 24 nt, Human
acgggguuucaccguguuagccag

SEQ ID NO: 1332995 - RNA, 19 nt, Human
agaaaagagaacagggaag

SEQ ID NO: 1332996 - RNA, 21 nt, Human
agaaaagagaacagggaagga

SEQ ID NO: 1332997 - RNA, 21 nt, Human
aggaacacaggucagugugag

SEQ ID NO: 1332998 - RNA, 21 nt, Human
aguagagacgggguuucaccg

SEQ ID NO: 1332999 - RNA, 19 nt, Human
aguagcugggacuacaggc

SEQ ID NO: 1333000 - RNA, 23 nt, Human
aguagcugggacuacaggcccgu

SEQ ID NO: 1333001 - RNA, 18 nt, Human
agugcugggauuacaggc

SEQ ID NO: 1333002 - RNA, 22 nt, Human
cacccugucacccaggcuggag

SEQ ID NO: 1333003 - RNA, 23 nt, Human
cacccugucacccaggcuggagu

SEQ ID NO: 1333004 - RNA, 27 nt, Human
cacccugucacccaggcuggagugcag

SEQ ID NO: 1333005 - RNA, 18 nt, Human
caccguguuagccaggau

SEQ ID NO: 1333006 - RNA, 21 nt, Human
caccguguuagccaggauggu

SEQ ID NO: 1333007 - RNA, 24 nt, Human
caccguguuagccaggaugguuuc

SEQ ID NO: 1333008 - RNA, 21 nt, Human
cacugcaaccuccgccucccg

SEQ ID NO: 1333009 - RNA, 23 nt, Human
cacugcaaccuccgccucccggg

SEQ ID NO: 1333010 - RNA, 18 nt, Human
ccgcacucugcccagguu

SEQ ID NO: 1333011 - RNA, 23 nt, Human
ccgccuccugaguagcugggacu

SEQ ID NO: 1333012 - RNA, 19 nt, Human
ccuaagugcugggauuaca

SEQ ID NO: 1333013 - RNA, 22 nt, Human
ccuaagugcugggauuacaggc

SEQ ID NO: 1333014 - RNA, 23 nt, Human
ccuaagugcugggauuacaggca

SEQ ID NO: 1333015 - RNA, 24 nt, Human
ccuaagugcugggauuacaggcau

SEQ ID NO: 1333016 - RNA, 19 nt, Human
ccuccgccuccugaguagc

SEQ ID NO: 1333017 - RNA, 18 nt, Human
ccucgugaucugcccucc

SEQ ID NO: 1333018 - RNA, 21 nt, Human
ccucgugaucugcccuccucg

SEQ ID NO: 1333019 - RNA, 20 nt, Human
ccucugcgcccagcuaauuu

SEQ ID NO: 1333020 - RNA, 23 nt, Human
ccugaguagcugggacuacaggc

SEQ ID NO: 1333021 - RNA, 24 nt, Human
ccugucacccaggcuggagugcag

SEQ ID NO: 1333022 - RNA, 21 nt, Human
cgcacacaaggcagcugugca

SEQ ID NO: 1333023 - RNA, 19 nt, Human
cgccucccggguugacgcc

SEQ ID NO: 1333024 - RNA, 24 nt, Human
cgggguuucaccguguuagccagg

SEQ ID NO: 1333025 - RNA, 22 nt, Human
cuaagugcugggauuacaggca

SEQ ID NO: 1333026 - RNA, 24 nt, Human
cuaagugcugggauuacaggcaug

SEQ ID NO: 1333027 - RNA, 23 nt, Human
cucacauugugcuaacagggaca

SEQ ID NO: 1333028 - RNA, 24 nt, Human
cucacugcaaccuccgccucccgg

SEQ ID NO: 1333029 - RNA, 22 nt, Human
cuccugaccucgugaucugccc

SEQ ID NO: 1333030 - RNA, 23 nt, Human
cugcaaccuccgccucccggguu

SEQ ID NO: 1333031 - RNA, 23 nt, Human
cugccuccgccuccugaguagcu

SEQ ID NO: 1333032 - RNA, 20 nt, Human
cuggagugcagucgcacaau

SEQ ID NO: 1333033 - RNA, 18 nt, Human
gaacacaggucaguguga

SEQ ID NO: 1333034 - RNA, 19 nt, Human
gaccucgugaucugcccuc

SEQ ID NO: 1333035 - RNA, 22 nt, Human
gaccucgugaucugcccuccuc

SEQ ID NO: 1333036 - RNA, 24 nt, Human
gaccucgugaucugcccuccucgg

SEQ ID NO: 1333037 - RNA, 24 nt, Human
gagacgggguuucaccguguuagc

SEQ ID NO: 1333038 - RNA, 26 nt, Human
gaguagcugggacuacaggcccgugc

SEQ ID NO: 1333039 - RNA, 19 nt, Human
gauuacaggcaugagcugc

SEQ ID NO: 1333040 - RNA, 23 nt, Human
gauuacaggcaugagcugccgca

SEQ ID NO: 1333041 - RNA, 22 nt, Human
gcacaauccuggcucacugcaa

SEQ ID NO: 1333042 - RNA, 23 nt, Human
gcccagcuaauuuuuuguauuuu

SEQ ID NO: 1333043 - RNA, 19 nt, Human
ggaaauccugcaucucagu

SEQ ID NO: 1333044 - RNA, 19 nt, Human
ggaaauccugcaucucagu

SEQ ID NO: 1333045 - RNA, 19 nt, Human
ggauuacaggcaugagcug

SEQ ID NO: 1333046 - RNA, 19 nt, Human
gggaaggaacacaggucag

SEQ ID NO: 1333047 - RNA, 23 nt, Human
gggguuucaccguguuagccagg

SEQ ID NO: 1333048 - RNA, 20 nt, Human
gguuucgaucuccugaccuc

SEQ ID NO: 1333049 - RNA, 23 nt, Human
guagagacgggguuucaccgugu

SEQ ID NO: 1333050 - RNA, 24 nt, Human
uaagugcugggauuacaggcauga

SEQ ID NO: 1333051 - RNA, 25 nt, Human
uaauuuuuuguauuuuuuaguagag

SEQ ID NO: 1333052 - RNA, 26 nt, Human
uaauuuuuuguauuuuuuaguagaga

SEQ ID NO: 1333053 - RNA, 21 nt, Human
uacaggcaugagcugccgcac

SEQ ID NO: 1333054 - RNA, 21 nt, Human
uagaaaagagaacagggaagg

SEQ ID NO: 1333055 - RNA, 21 nt, Human
uaguagagacgggguuucacc

SEQ ID NO: 1333056 - RNA, 24 nt, Human
uaguagagacgggguuucaccgug

SEQ ID NO: 1333057 - RNA, 26 nt, Human
uaguagagacgggguuucaccguguu

SEQ ID NO: 1333058 - RNA, 22 nt, Human
ucacccaggcuggagugcaguc

SEQ ID NO: 1333059 - RNA, 22 nt, Human
ucacccugucacccaggcugga

SEQ ID NO: 1333060 - RNA, 24 nt, Human
ucacccugucacccaggcuggagu

SEQ ID NO: 1333061 - RNA, 24 nt, Human
ucaccguguuagccaggaugguuu

SEQ ID NO: 1333062 - RNA, 23 nt, Human
ucacugcaaccuccgccucccgg

SEQ ID NO: 1333063 - RNA, 24 nt, Human
ucacugcaaccuccgccucccggg

SEQ ID NO: 1333064 - RNA, 25 nt, Human
ucacugcaaccuccgccucccgggu

SEQ ID NO: 1333065 - RNA, 26 nt, Human
ucacugcaaccuccgccucccggguu

SEQ ID NO: 1333066 - RNA, 24 nt, Human
ucccggguugacgccauucuccug

SEQ ID NO: 1333067 - RNA, 24 nt, Human
ucccuaagugcugggauuacaggc

SEQ ID NO: 1333068 - RNA, 24 nt, Human
uccugaguagcugggacuacaggc

SEQ ID NO: 1333069 - RNA, 24 nt, Human
ugcaaaaagagaagccagaguccc

SEQ ID NO: 1333070 - RNA, 19 nt, Human
ugcaaaaagagaagccagg

SEQ ID NO: 1333071 - RNA, 24 nt, Human
ugccuccgccuccugaguagcugg

SEQ ID NO: 1333072 - RNA, 22 nt, Human
ugccucugcgcccagcuaauuu

SEQ ID NO: 1333073 - RNA, 24 nt, Human
ugccucugcgcccagcuaauuuuu

SEQ ID NO: 1333074 - RNA, 20 nt, Human
ugcugggauuacaggcauga

SEQ ID NO: 1333075 - RNA, 24 nt, Human
uggagugcagucgcacaauccugg

SEQ ID NO: 1333076 - RNA, 18 nt, Human
ugggauuacaggcaugag

SEQ ID NO: 1333077 - RNA, 18 nt, Human
ugggauuacaggcaugag

SEQ ID NO: 1333078 - RNA, 19 nt, Human
ugggauuacaggcaugagc

SEQ ID NO: 1333079 - RNA, 22 nt, Human
ugggauuacaggcaugagcugc

SEQ ID NO: 1333080 - RNA, 23 nt, Human
ugggauuacaggcaugagcugcc

SEQ ID NO: 1333081 - RNA, 24 nt, Human
ugggauuacaggcaugagcugccg

SEQ ID NO: 1333082 - RNA, 24 nt, Human
ugggauuacaggcaugagcugccg

SEQ ID NO: 1333083 - RNA, 25 nt, Human
ugggauuacaggcaugagcugccgc

SEQ ID NO: 1333084 - RNA, 21 nt, Human
ugugaggaagggggucauggu

SEQ ID NO: 1333085 - RNA, 18 nt, Human
uuaguagagacgggguuu

SEQ ID NO: 1333086 - RNA, 22 nt, Human
uuaguagagacgggguuucacc

SEQ ID NO: 1333087 - RNA, 24 nt, Human
uuaguagagacgggguuucaccgu

SEQ ID NO: 1333088 - RNA, 24 nt, Human
uucacccugucacccaggcuggag

SEQ ID NO: 1333089 - RNA, 18 nt, Human
uugcaaaaagagaagcca

SEQ ID NO: 1333090 - RNA, 22 nt, Human
uuucacccugucacccaggcug

SEQ ID NO: 1333091 - RNA, 24 nt, Human
uuucacccugucacccaggcugga

SEQ ID NO: 1333092 - RNA, 19 nt, Human
uuucaccguguuagccagg

SEQ ID NO: 1333093 - RNA, 24 nt, Human
uuuuuaguagagacgggguuucac

SEQ ID NO: 1333094 - RNA, 27 nt, Human
uuuuuauuuuuuaauuuuuauuuuuug

SEQ ID NO: 1333095 - RNA, 22 nt, Human
uuuuuguauuuuuuaguagaga

SEQ ID NO: 1333096 - RNA, 23 nt, Human
uuuuuuaguagagacgggguuuc

SEQ ID NO: 1333097 - RNA, 25 nt, Human
uuuuuuguauuuuuuaguagagacg

SEQ ID NO: 1333098 - RNA, 22 nt, Human
aaacaacaagacgcuugacuug

SEQ ID NO: 1333099 - RNA, 18 nt, Human
aagcagcaccaggagcgg

SEQ ID NO: 1333100 - RNA, 25 nt, Human
aagcagcaccaggagcggcagaaga

SEQ ID NO: 1333101 - RNA, 25 nt, Human
agcaccaggagcggcagaagaagga

SEQ ID NO: 1333102 - RNA, 21 nt, Human
aggcggcagcaguggacaagg

SEQ ID NO: 1333103 - RNA, 24 nt, Human
caaacgagcacacaagcagcacca

SEQ ID NO: 1333104 - RNA, 24 nt, Human
caagcagcaccaggagcggcagaa

SEQ ID NO: 1333105 - RNA, 20 nt, Human
cacaagcagcaccaggagcg

SEQ ID NO: 1333106 - RNA, 24 nt, Human
cacaagcagcaccaggagcggcag

SEQ ID NO: 1333107 - RNA, 18 nt, Human
caggagcggcagaagaag

SEQ ID NO: 1333108 - RNA, 23 nt, Human
caggagcggcagaagaaggaggc

SEQ ID NO: 1333109 - RNA, 18 nt, Human
caguaaaggaauggggaa

SEQ ID NO: 1333110 - RNA, 18 nt, Human
caugccacuaauggagaa

SEQ ID NO: 1333111 - RNA, 20 nt, Human
gagaaaggggguauuuucac

SEQ ID NO: 1333112 - RNA, 19 nt, Human
gagcaugccacuaauggag

SEQ ID NO: 1333113 - RNA, 21 nt, Human
gaggcggcagcaguggacaag

SEQ ID NO: 1333114 - RNA, 21 nt, Human
gaggcggcagcaguggacaag

SEQ ID NO: 1333115 - RNA, 21 nt, Human
gcagaagaaggaggcggcagc

SEQ ID NO: 1333116 - RNA, 18 nt, Human
gcggcagcaguggacaag

SEQ ID NO: 1333117 - RNA, 20 nt, Human
ggaaaacuaucuaggauucu

SEQ ID NO: 1333118 - RNA, 23 nt, Human
gguauuuucacagaaucaguauu

SEQ ID NO: 1333119 - RNA, 19 nt, Human
uaaaauucuccaauugaac

SEQ ID NO: 1333120 - RNA, 19 nt, Human
uaagagcugaaugagcaug

SEQ ID NO: 1333121 - RNA, 19 nt, Human
ucagcugccgcuucacaaa

SEQ ID NO: 1333122 - RNA, 24 nt, Human
uccucagcugccgcuucacaaaag

SEQ ID NO: 1333123 - RNA, 21 nt, Human
ugcauguaacagcuaaguaca

SEQ ID NO: 1333124 - RNA, 19 nt, Human
uggggaagggggaaaugaa

SEQ ID NO: 1333125 - RNA, 23 nt, Human
uguuguuguuuuuuuguuguugu

SEQ ID NO: 1333126 - RNA, 20 nt, Human
uuguuguuguuguuaaaaca

SEQ ID NO: 1333127 - RNA, 19 nt, Human
uuguuguuuuuuuguuguu

SEQ ID NO: 1333128 - RNA, 23 nt, Human
uuucacagaaucaguauuuuucc

SEQ ID NO: 1333129 - RNA, 22 nt, Human
uuuguuguuguuguuaaaacag

SEQ ID NO: 1333130 - RNA, 23 nt, Human
uuuuguuguuguuguuaaaacag

SEQ ID NO: 1333131 - RNA, 24 nt, Human
uuuuuuuguuguuguuguuaaaac

SEQ ID NO: 1333132 - RNA, 18 nt, Human
aagcagcaccaggagcgg

SEQ ID NO: 1333133 - RNA, 24 nt, Human
caaacgagcacacaagcagcacca

SEQ ID NO: 1333134 - RNA, 20 nt, Human
cacaagcagcaccaggagcg

SEQ ID NO: 1333135 - RNA, 21 nt, Human
ucagcugccgcuucacaaaag

SEQ ID NO: 1333136 - RNA, 24 nt, Human
uccucagcugccgcuucacaaaag

SEQ ID NO: 1333137 - RNA, 19 nt, Human
aauguauagaaggaaaagg

SEQ ID NO: 1333138 - RNA, 24 nt, Human
agcuuuauuccaaaaauaauuuua

SEQ ID NO: 1333139 - RNA, 22 nt, Human
cagaggccuggagcccucggcu

SEQ ID NO: 1333140 - RNA, 23 nt, Human
cagcuaccuugggaccucuagga

SEQ ID NO: 1333141 - RNA, 22 nt, Human
cuggagccucagcuucgcaagu

SEQ ID NO: 1333142 - RNA, 26 nt, Human
ggccuggagcccucggcuggagccuc

SEQ ID NO: 1333143 - RNA, 22 nt, Human
gucagcuaccuugggaccucua

SEQ ID NO: 1333144 - RNA, 19 nt, Human
ucagaggccuggagcccuc

SEQ ID NO: 1333145 - RNA, 21 nt, Human
ugcucccggcccugaagcguc

SEQ ID NO: 1333146 - RNA, 23 nt, Human
uguauagaaggaaaaggagcugg

SEQ ID NO: 1333147 - RNA, 27 nt, Human
uguauagaaggaaaaggagcugguuga

SEQ ID NO: 1333148 - RNA, 21 nt, Human
uuaauagguauuaaauaaugu

SEQ ID NO: 1333149 - RNA, 21 nt, Human
caacugguccauccaccuccc

SEQ ID NO: 1333150 - RNA, 21 nt, Human
cacagccaagucucccuugcc

SEQ ID NO: 1333151 - RNA, 22 nt, Human
cacagccaagucucccuugccc

SEQ ID NO: 1333152 - RNA, 23 nt, Human
cacagccaagucucccuugcccc

SEQ ID NO: 1333153 - RNA, 22 nt, Human
caccacagccuaccugccccuc

SEQ ID NO: 1333154 - RNA, 21 nt, Human
caccagcccaccccaggggac

SEQ ID NO: 1333155 - RNA, 23 nt, Human
caccagcccaccccaggggacac

SEQ ID NO: 1333156 - RNA, 18 nt, Human
cagccuaccugccccucc

SEQ ID NO: 1333157 - RNA, 25 nt, Human
caguggaccuugccuccaucucacc

SEQ ID NO: 1333158 - RNA, 20 nt, Human
caugccacucugaagcccac

SEQ ID NO: 1333159 - RNA, 19 nt, Human
ccaugccacucugaagccc

SEQ ID NO: 1333160 - RNA, 19 nt, Human
ccccaggggacaccaacug

SEQ ID NO: 1333161 - RNA, 23 nt, Human
cucacagccaagucucccuugcc

SEQ ID NO: 1333162 - RNA, 21 nt, Human
cuccugccucacagccaaguc

SEQ ID NO: 1333163 - RNA, 18 nt, Human
cuggcaccacagccuacc

SEQ ID NO: 1333164 - RNA, 24 nt, Human
gacaccaacugguccauccaccuc

SEQ ID NO: 1333165 - RNA, 18 nt, Human
gaccuugccuccaucuca

SEQ ID NO: 1333166 - RNA, 21 nt, Human
guccauguugagccuuccuca

SEQ ID NO: 1333167 - RNA, 22 nt, Human
guugagccuuccucaaaggcag

SEQ ID NO: 1333168 - RNA, 18 nt, Human
ucugaagcccacaccauu

SEQ ID NO: 1333169 - RNA, 19 nt, Human
ucuuccccagagccccaca

SEQ ID NO: 1333170 - RNA, 19 nt, Human
ugccaugccacucugaagc

SEQ ID NO: 1333171 - RNA, 19 nt, Human
ugccccuccugccucacag

SEQ ID NO: 1333172 - RNA, 21 nt, Human
uguccauguugagccuuccuc

SEQ ID NO: 1333173 - RNA, 22 nt, Human
aaacaaacaccugaucaaacca

SEQ ID NO: 1333174 - RNA, 24 nt, Human
aaacagaaauugcaaguaggaacc

SEQ ID NO: 1333175 - RNA, 18 nt, Human
aaaccuucccucuuaaac

SEQ ID NO: 1333176 - RNA, 19 nt, Human
aaagugcuaggauuauagg

SEQ ID NO: 1333177 - RNA, 19 nt, Human
aaagugcuaggauuauagg

SEQ ID NO: 1333178 - RNA, 24 nt, Human
aaagugcugggauuacagguguga

SEQ ID NO: 1333179 - RNA, 21 nt, Human
aacaaacaccugaucaaacca

SEQ ID NO: 1333180 - RNA, 19 nt, Human
aaccccggguauuuacccc

SEQ ID NO: 1333181 - RNA, 18 nt, Human
aaccucaggugauccacc

SEQ ID NO: 1333182 - RNA, 26 nt, Human
aagcaugaaaacaacauuuaucuccu

SEQ ID NO: 1333183 - RNA, 20 nt, Human
aaggagagaagguugggguu

SEQ ID NO: 1333184 - RNA, 20 nt, Human
aaguagcugggauuacaggc

SEQ ID NO: 1333185 - RNA, 26 nt, Human
aaguagcugggauuacaggccucugc

SEQ ID NO: 1333186 - RNA, 18 nt, Human
aagugcugggauuacagg

SEQ ID NO: 1333187 - RNA, 19 nt, Human
aagugcugggauuacaggu

SEQ ID NO: 1333188 - RNA, 26 nt, Human
aagugcugggauuacaggugugagcu

SEQ ID NO: 1333189 - RNA, 23 nt, Human
aaugaugaaugcuuuccaaaaga

SEQ ID NO: 1333190 - RNA, 19 nt, Human
aauggagggaccagcugga

SEQ ID NO: 1333191 - RNA, 24 nt, Human
aauuuuauauuuuuaguagagaug

SEQ ID NO: 1333192 - RNA, 21 nt, Human
acaccccuccccuuuuaaaau

SEQ ID NO: 1333193 - RNA, 18 nt, Human
accaagcaugaaaacaac

SEQ ID NO: 1333194 - RNA, 18 nt, Human
accauguuggccaggcug

SEQ ID NO: 1333195 - RNA, 18 nt, Human
accauguuggccaggcug

SEQ ID NO: 1333196 - RNA, 18 nt, Human
acgagguuucaccguguu

SEQ ID NO: 1333197 - RNA, 20 nt, Human
acgagguuucaccguguuag

SEQ ID NO: 1333198 - RNA, 22 nt, Human
acucuuguugcccaggcuggag

SEQ ID NO: 1333199 - RNA, 23 nt, Human
acugcaaucucugaacauaaauu

SEQ ID NO: 1333200 - RNA, 20 nt, Human
agaauggacacuguguuacc

SEQ ID NO: 1333201 - RNA, 22 nt, Human
agacuugaaaguugaaaucacu

SEQ ID NO: 1333202 - RNA, 21 nt, Human
agagugcugggauuacaggug

SEQ ID NO: 1333203 - RNA, 24 nt, Human
agagugcugggauuacagguguga

SEQ ID NO: 1333204 - RNA, 19 nt, Human
agcaauagauaacaaacac

SEQ ID NO: 1333205 - RNA, 20 nt, Human
agccacaggugcaguaagga

SEQ ID NO: 1333206 - RNA, 25 nt, Human
agccugguaaauucuagucagaccg

SEQ ID NO: 1333207 - RNA, 21 nt, Human
agcuggccuucuuugguuugg

SEQ ID NO: 1333208 - RNA, 21 nt, Human
agcugggacuacaggggcccg

SEQ ID NO: 1333209 - RNA, 19 nt, Human
aggcccaguuguaaaauuu

SEQ ID NO: 1333210 - RNA, 25 nt, Human
aggcuggagugcaguggugcgaucu

SEQ ID NO: 1333211 - RNA, 21 nt, Human
agggacuccaucauugcaagu

SEQ ID NO: 1333212 - RNA, 24 nt, Human
aggugauccaccugccucggccuc

SEQ ID NO: 1333213 - RNA, 22 nt, Human
aguagagaugggguuucaccau

SEQ ID NO: 1333214 - RNA, 18 nt, Human
aguagcugggacuacagg

SEQ ID NO: 1333215 - RNA, 21 nt, Human
agugcaguggugcgaucucag

SEQ ID NO: 1333216 - RNA, 23 nt, Human
agugcaguggugcgaucucagcu

SEQ ID NO: 1333217 - RNA, 24 nt, Human
agugcaguggugcgaucucagcuc

SEQ ID NO: 1333218 - RNA, 23 nt, Human
agugcaguggugcggucuugguu

SEQ ID NO: 1333219 - RNA, 24 nt, Human
agugcaguggugcggucuugguuc

SEQ ID NO: 1333220 - RNA, 22 nt, Human
agugcugggauuacagguguga

SEQ ID NO: 1333221 - RNA, 24 nt, Human
aguggugcgaucucagcucacugc

SEQ ID NO: 1333222 - RNA, 22 nt, Human
auauaaagcuauuuuaucuaca

SEQ ID NO: 1333223 - RNA, 22 nt, Human
aucuuccucucuuaguagccca

SEQ ID NO: 1333224 - RNA, 21 nt, Human
auggaaagcaggcccaaauca

SEQ ID NO: 1333225 - RNA, 18 nt, Human
augggguuucaccauguu

SEQ ID NO: 1333226 - RNA, 22 nt, Human
augggguuucaccauguuggcc

SEQ ID NO: 1333227 - RNA, 22 nt, Human
augggguuucaccauguuggcc

SEQ ID NO: 1333228 - RNA, 23 nt, Human
augggguuucaccauguuggcca

SEQ ID NO: 1333229 - RNA, 24 nt, Human
augggguuucaccauguuggccag

SEQ ID NO: 1333230 - RNA, 24 nt, Human
augggguuucaccauguuggccag

SEQ ID NO: 1333231 - RNA, 19 nt, Human
auuauaggagugugucacc

SEQ ID NO: 1333232 - RNA, 23 nt, Human
caaaauggcggccccaucauccc

SEQ ID NO: 1333233 - RNA, 25 nt, Human
caaagugcuaggauuauaggagugu

SEQ ID NO: 1333234 - RNA, 24 nt, Human
caaagugcugggauuacaggugug

SEQ ID NO: 1333235 - RNA, 22 nt, Human
caagcaauucuccugccucagc

SEQ ID NO: 1333236 - RNA, 27 nt, Human
caagcaauucuccugccucagccuccc

SEQ ID NO: 1333237 - RNA, 23 nt, Human
caagcaugaaaacaacauuuauc

SEQ ID NO: 1333238 - RNA, 24 nt, Human
caccaggccuagcuaauuuuugua

SEQ ID NO: 1333239 - RNA, 21 nt, Human
caccauguuggccaggcuggu

SEQ ID NO: 1333240 - RNA, 21 nt, Human
caccauguuggccaggcuggu

SEQ ID NO: 1333241 - RNA, 22 nt, Human
caccauguuggccaggcugguc

SEQ ID NO: 1333242 - RNA, 27 nt, Human
caccauguuggccaggcuggucuggaa

SEQ ID NO: 1333243 - RNA, 24 nt, Human
caccauguuggccaggcugguuuc

SEQ ID NO: 1333244 - RNA, 31 nt, Human; identical to SEQ ID NO: 466129

SEQ ID NO: 1333245 - RNA, 21 nt, Human
cacccacaucggccucccaaa

SEQ ID NO: 1333246 - RNA, 23 nt, Human
caccccuccccuuuuaaaauccc

SEQ ID NO: 1333247 - RNA, 18 nt, Human
caccguguuagccaggau

SEQ ID NO: 1333248 - RNA, 24 nt, Human
caccguguuagccaggauggucuc

SEQ ID NO: 1333249 - RNA, 23 nt, Human
caccugccucggccucccaaagu

SEQ ID NO: 1333250 - RNA, 18 nt, Human
cacugcaaccucugccuc

SEQ ID NO: 1333251 - RNA, 21 nt, Human
cacugcaaccucugccuccca

SEQ ID NO: 1333252 - RNA, 26 nt, Human
cacuggccuuuuuuuuuuuuuuugag

SEQ ID NO: 1333253 - RNA, 23 nt, Human
cacuguguuaccaagcaugaaaa

SEQ ID NO: 1333254 - RNA, 22 nt, Human
cagagugcugggauuacaggug

SEQ ID NO: 1333255 - RNA, 24 nt, Human
cagagugcugggauuacaggugug

SEQ ID NO: 1333256 - RNA, 18 nt, Human
cagcaauagauaacaaac

SEQ ID NO: 1333257 - RNA, 20 nt, Human
cagccuccugaguagcuggg

SEQ ID NO: 1333258 - RNA, 22 nt, Human
caggugauccaccugccucggc

SEQ ID NO: 1333259 - RNA, 22 nt, Human
caggugcaguaaggagccgaca

SEQ ID NO: 1333260 - RNA, 20 nt, Human
caguaaggagccgacaaaau

SEQ ID NO: 1333261 - RNA, 26 nt, Human
caguaggucucucaacagugggcuua

SEQ ID NO: 1333262 - RNA, 24 nt, Human
cauguuggccaggcuggucuggaa

SEQ ID NO: 1333263 - RNA, 23 nt, Human
cauguuggccaggcugguuucaa

SEQ ID NO: 1333264 - RNA, 25 nt, Human
ccaaagugcuaggauuauaggagug

SEQ ID NO: 1333265 - RNA, 21 nt, Human
ccaaagugcugggauuacagg

SEQ ID NO: 1333266 - RNA, 21 nt, Human
ccaaagugcugggauuacagg

SEQ ID NO: 1333267 - RNA, 24 nt, Human
ccaaagugcugggauuacaggugu

SEQ ID NO: 1333268 - RNA, 19 nt, Human
ccacaucggccucccaaag

SEQ ID NO: 1333269 - RNA, 21 nt, Human
ccagacaacuggcugcuucac

SEQ ID NO: 1333270 - RNA, 21 nt, Human
ccagagugcugggauuacagg

SEQ ID NO: 1333271 - RNA, 21 nt, Human
ccagagugcugggauuacagg

SEQ ID NO: 1333272 - RNA, 24 nt, Human
ccagagugcugggauuacaggugu

SEQ ID NO: 1333273 - RNA, 25 nt, Human
cccaaguagcugggauuacaggccu

SEQ ID NO: 1333274 - RNA, 23 nt, Human
ccccagacaacuggcugcuucac

SEQ ID NO: 1333275 - RNA, 18 nt, Human
ccccgguucacgccaucc

SEQ ID NO: 1333276 - RNA, 22 nt, Human
ccccuuuucucucggaaguccc

SEQ ID NO: 1333277 - RNA, 19 nt, Human
cccuguucguacaccccuc

SEQ ID NO: 1333278 - RNA, 23 nt, Human
ccgacaaaauggcacccuccgag

SEQ ID NO: 1333279 - RNA, 18 nt, Human
ccgcuggaggcccaguug

SEQ ID NO: 1333280 - RNA, 23 nt, Human
ccgcuucagccuccugaguagcu

SEQ ID NO: 1333281 - RNA, 24 nt, Human
ccuaaccucaggugauccacccac

SEQ ID NO: 1333282 - RNA, 23 nt, Human
ccuauuaaaccuucccucuuaaa

SEQ ID NO: 1333283 - RNA, 24 nt, Human
ccuauuaucuucauaaacugagaa

SEQ ID NO: 1333284 - RNA, 21 nt, Human
ccuccagcugccccuuuucuc

SEQ ID NO: 1333285 - RNA, 24 nt, Human
ccucccagauucaagcaauucucc

SEQ ID NO: 1333286 - RNA, 25 nt, Human
ccucgcgacuccucgcguguguccg

SEQ ID NO: 1333287 - RNA, 21 nt, Human
ccucuguagcuaugaaugucc

SEQ ID NO: 1333288 - RNA, 22 nt, Human
ccugaccccgugauccgcccac

SEQ ID NO: 1333289 - RNA, 21 nt, Human
ccugaccucaggugauccacc

SEQ ID NO: 1333290 - RNA, 23 nt, Human
ccugaccucaggugauccaccug

SEQ ID NO: 1333291 - RNA, 23 nt, Human
ccugaccucaggugauccaccug

SEQ ID NO: 1333292 - RNA, 23 nt, Human
ccugaguagcugggacuacaggg

SEQ ID NO: 1333293 - RNA, 23 nt, Human
ccugccucagccucccaaguagc

SEQ ID NO: 1333294 - RNA, 24 nt, Human
ccugccucagccucccaaguagcu

SEQ ID NO: 1333295 - RNA, 20 nt, Human
cgacaaaauggcacccuccg

SEQ ID NO: 1333296 - RNA, 23 nt, Human
cgacaaaauggcacccuccgaga

SEQ ID NO: 1333297 - RNA, 24 nt, Human
cgagguuucaccguguuagccagg

SEQ ID NO: 1333298 - RNA, 24 nt, Human
cgcccaggcuggagugcaguggug

SEQ ID NO: 1333299 - RNA, 22 nt, Human
cggccagccuucccagcuaugu

SEQ ID NO: 1333300 - RNA, 21 nt, Human
cguacaccccuccccuuuuaa

SEQ ID NO: 1333301 - RNA, 25 nt, Human
cuaauacucuuauaauuucuuaugc

SEQ ID NO: 1333302 - RNA, 24 nt, Human
cuaauuuuauauuuuuaguagaga

SEQ ID NO: 1333303 - RNA, 24 nt, Human
cucacugcaaccucugccucccag

SEQ ID NO: 1333304 - RNA, 24 nt, Human
cucagccucccaaguagcugggau

SEQ ID NO: 1333305 - RNA, 20 nt, Human
cuccugaccccgugauccgc

SEQ ID NO: 1333306 - RNA, 25 nt, Human
cuccugccucagccucccaaguagc

SEQ ID NO: 1333307 - RNA, 19 nt, Human
cucgcccucccagagugcu

SEQ ID NO: 1333308 - RNA, 22 nt, Human
cucgggguugucaucacggucc

SEQ ID NO: 1333309 - RNA, 18 nt, Human
cugacuucuucacuuugu

SEQ ID NO: 1333310 - RNA, 23 nt, Human
cugcaaccucugccucccagauu

SEQ ID NO: 1333311 - RNA, 24 nt, Human
cugcaaccucugccucccagauuc

SEQ ID NO: 1333312 - RNA, 23 nt, Human
cugccucggccucccaaagugcu

SEQ ID NO: 1333313 - RNA, 21 nt, Human
cuguucguacaccccuccccu

SEQ ID NO: 1333314 - RNA, 23 nt, Human
cuguuuuccuuucucuuucuuuu

SEQ ID NO: 1333315 - RNA, 24 nt, Human
cuuacucuuguugcccaggcugga

SEQ ID NO: 1333316 - RNA, 24 nt, Human
cuuguugcccaggcuggagugcag

SEQ ID NO: 1333317 - RNA, 18 nt, Human
cuuuguacuguuucucuu

SEQ ID NO: 1333318 - RNA, 19 nt, Human
gaaagauagucuaugccuu

SEQ ID NO: 1333319 - RNA, 19 nt, Human
gacacaggaguuaagaaga

SEQ ID NO: 1333320 - RNA, 22 nt, Human
gaccccgugauccgcccaccuc

SEQ ID NO: 1333321 - RNA, 24 nt, Human
gaccucaggugauccaccugccuc

SEQ ID NO: 1333322 - RNA, 18 nt, Human
gacgccgccuccucaagc

SEQ ID NO: 1333323 - RNA, 18 nt, Human
gagaugggguuucaccau

SEQ ID NO: 1333324 - RNA, 24 nt, Human
gagaugggguuucaccauguuggc

SEQ ID NO: 1333325 - RNA, 25 nt, Human
gagccgacaaaauggcacccuccga

SEQ ID NO: 1333326 - RNA, 19 nt, Human
gagcuguuuuccuuucucu

SEQ ID NO: 1333327 - RNA, 26 nt, Human
gaguagcugggacuacaggggcccgc

SEQ ID NO: 1333328 - RNA, 18 nt, Human
gauuacaggugugagcca

SEQ ID NO: 1333329 - RNA, 22 nt, Human
gauuacaggugugagccagggc

SEQ ID NO: 1333330 - RNA, 22 nt, Human
gauuacaggugugagccagggc

SEQ ID NO: 1333331 - RNA, 18 nt, Human
gauuacaggugugagcua

SEQ ID NO: 1333332 - RNA, 21 nt, Human
gauuacaggugugagcuaccg

SEQ ID NO: 1333333 - RNA, 24 nt, Human
gauuacaggugugagcuaccgugc

SEQ ID NO: 1333334 - RNA, 22 nt, Human
gauuauaggagugugucaccau

SEQ ID NO: 1333335 - RNA, 22 nt, Human
gcaaccucugccucccagauuc

SEQ ID NO: 1333336 - RNA, 22 nt, Human
gcaagcuccgccuccccgguuc

SEQ ID NO: 1333337 - RNA, 19 nt, Human
gcacagcgggacauagacc

SEQ ID NO: 1333338 - RNA, 21 nt, Human
gcaucagagcucuuggguggc

SEQ ID NO: 1333339 - RNA, 19 nt, Human
gcccaggcuggagugcagu

SEQ ID NO: 1333340 - RNA, 20 nt, Human
gcccaggcuggagugcagug

SEQ ID NO: 1333341 - RNA, 23 nt, Human
gcccaggcuggagugcaguggug

SEQ ID NO: 1333342 - RNA, 22 nt, Human
gccuagcuaauuuuuguauuuu

SEQ ID NO: 1333343 - RNA, 25 nt, Human
gcucugucgcccaggcuggagugca

SEQ ID NO: 1333344 - RNA, 23 nt, Human
gcuggucuggaacuccuaaccuc

SEQ ID NO: 1333345 - RNA, 23 nt, Human
gcugguuucaaacuccugaccuc

SEQ ID NO: 1333346 - RNA, 23 nt, Human
gcuuaggguggggcggccagccu

SEQ ID NO: 1333347 - RNA, 23 nt, Human
gcuucagccuccugaguagcugg

SEQ ID NO: 1333348 - RNA, 27 nt, Human
ggagagaagguugggguuuguuuuuga

SEQ ID NO: 1333349 - RNA, 24 nt, Human
ggcugguuucaaacuccugaccuc

SEQ ID NO: 1333350 - RNA, 22 nt, Human
gggguuucaccauguuggccag

SEQ ID NO: 1333351 - RNA, 22 nt, Human
gggguuucaccauguuggccag

SEQ ID NO: 1333352 - RNA, 18 nt, Human
ggguuucaccauguuggc

SEQ ID NO: 1333353 - RNA, 23 nt, Human
guagagaugggguuucaccaugu

SEQ ID NO: 1333354 - RNA, 18 nt, Human
guagcugggauuacaggc

SEQ ID NO: 1333355 - RNA, 24 nt, Human
gugauccacccacaucggccuccc

SEQ ID NO: 1333356 - RNA, 24 nt, Human
gugauccaccugccucggccuccc

SEQ ID NO: 1333357 - RNA, 24 nt, Human
gugauccgcccaccucgcccuccc

SEQ ID NO: 1333358 - RNA, 21 nt, Human
gugcucagcucacaaguguuc

SEQ ID NO: 1333359 - RNA, 24 nt, Human
guuuuuuuguauuuuuaguagaga

SEQ ID NO: 1333360 - RNA, 24 nt, Human
uaaaacacaggcagaguagauuua

SEQ ID NO: 1333361 - RNA, 19 nt, Human
uaaacaaacaccugaucaa

SEQ ID NO: 1333362 - RNA, 23 nt, Human
uaaacaaacaccugaucaaacca

SEQ ID NO: 1333363 - RNA, 18 nt, Human
uaacaaagagcagccugu

SEQ ID NO: 1333364 - RNA, 20 nt, Human
uaacagggacuccaucauug

SEQ ID NO: 1333365 - RNA, 23 nt, Human
uaagaagaaauuacuuagguaga

SEQ ID NO: 1333366 - RNA, 24 nt, Human
uaagguuuguuuuuuuuaauuaaa

SEQ ID NO: 1333367 - RNA, 22 nt, Human
uaauaagacuugaaaguugaaa

SEQ ID NO: 1333368 - RNA, 18 nt, Human
uaauuugccauccggcug

SEQ ID NO: 1333369 - RNA, 22 nt, Human
uaauuuuuguauuuuuaguaga

SEQ ID NO: 1333370 - RNA, 22 nt, Human
uacaccagagcaaauuaaagug

SEQ ID NO: 1333371 - RNA, 23 nt, Human
uacaggggcccgccaccacgccc

SEQ ID NO: 1333372 - RNA, 22 nt, Human
uacaggugugagccagggcgcc

SEQ ID NO: 1333373 - RNA, 23 nt, Human
uacaggugugagccagggcgccu

SEQ ID NO: 1333374 - RNA, 19 nt, Human
uaccccagacaacuggcug

SEQ ID NO: 1333375 - RNA, 24 nt, Human
uacucuuguugcccaggcuggagu

SEQ ID NO: 1333376 - RNA, 21 nt, Human
uagaaaacaaacagaaauugc

SEQ ID NO: 1333377 - RNA, 22 nt, Human
uagaaaugggguuucaccaugu

SEQ ID NO: 1333378 - RNA, 20 nt, Human
uagaaugaugaaugcuuucc

SEQ ID NO: 1333379 - RNA, 22 nt, Human
uagagaugggguuucaccaugu

SEQ ID NO: 1333380 - RNA, 21 nt, Human
uagcccagaaaccccagguuc

SEQ ID NO: 1333381 - RNA, 22 nt, Human
uaggauuauaggagugugucac

SEQ ID NO: 1333382 - RNA, 24 nt, Human
uaggauuauaggagugugucacca

SEQ ID NO: 1333383 - RNA, 24 nt, Human
uaguagaaaugggguuucaccaug

SEQ ID NO: 1333384 - RNA, 26 nt, Human
uaguagaaaugggguuucaccauguu

SEQ ID NO: 1333385 - RNA, 21 nt, Human
uaguagagacgagguuucacc

SEQ ID NO: 1333386 - RNA, 24 nt, Human
uaguagagacgagguuucaccgug

SEQ ID NO: 1333387 - RNA, 26 nt, Human
uaguagagacgagguuucaccguguu

SEQ ID NO: 1333388 - RNA, 24 nt, Human
uaguagagaugggguuucaccaug

SEQ ID NO: 1333389 - RNA, 26 nt, Human
uaguagagaugggguuucaccauguu

SEQ ID NO: 1333390 - RNA, 24 nt, Human
uauguaaacaaacaccugaucaaa

SEQ ID NO: 1333391 - RNA, 19 nt, Human
uauguauguguguguguau

SEQ ID NO: 1333392 - RNA, 18 nt, Human
uauugcccuucgaagcau

SEQ ID NO: 1333393 - RNA, 24 nt, Human
ucaccguguuagccaggauggucu

SEQ ID NO: 1333394 - RNA, 18 nt, Human
ucacugcaaccucugccu

SEQ ID NO: 1333395 - RNA, 19 nt, Human
ucacugcaaccucugccuc

SEQ ID NO: 1333396 - RNA, 23 nt, Human
ucacugcaaccucugccucccag

SEQ ID NO: 1333397 - RNA, 24 nt, Human
ucacugcaaccucugccucccaga

SEQ ID NO: 1333398 - RNA, 18 nt, Human
ucacugcaagcuccgccu

SEQ ID NO: 1333399 - RNA, 19 nt, Human
ucacugcaagcuccgccuc

SEQ ID NO: 1333400 - RNA, 19 nt, Human
ucacugcaagcuccgccuc

SEQ ID NO: 1333401 - RNA, 24 nt, Human
ucacugcaagcuccgccuccccgg

SEQ ID NO: 1333402 - RNA, 25 nt, Human
ucacuuugugaaucaguccuucaca

SEQ ID NO: 1333403 - RNA, 18 nt, Human
ucagccucccaaguagcu

SEQ ID NO: 1333404 - RNA, 20 nt, Human
ucagccucccaaguagcugg

SEQ ID NO: 1333405 - RNA, 23 nt, Human
ucagccuccugaguagcugggac

SEQ ID NO: 1333406 - RNA, 27 nt, Human
ucagcucacugcaaccucugccuccca

SEQ ID NO: 1333407 - RNA, 21 nt, Human
ucaggugauccaccugccucg

SEQ ID NO: 1333408 - RNA, 18 nt, Human
ucaguugguaaccgggaa

SEQ ID NO: 1333409 - RNA, 20 nt, Human
uccaagcuuuguuguuccau

SEQ ID NO: 1333410 - RNA, 18 nt, Human
ucccaaagugcuaggauu

SEQ ID NO: 1333411 - RNA, 23 nt, Human
ucccaaagugcugggauuacagg

SEQ ID NO: 1333412 - RNA, 24 nt, Human
ucccaaguagcugggauuacaggc

SEQ ID NO: 1333413 - RNA, 23 nt, Human
ucccagagugcugggauuacagg

SEQ ID NO: 1333414 - RNA, 21 nt, Human
ucccagauucaagcaauucuc

SEQ ID NO: 1333415 - RNA, 24 nt, Human
ucccagauucaagcaauucuccug

SEQ ID NO: 1333416 - RNA, 21 nt, Human
uccccaggugacugcccucug

SEQ ID NO: 1333417 - RNA, 23 nt, Human
uccccaggugacugcccucugac

SEQ ID NO: 1333418 - RNA, 21 nt, Human
uccccgguucacgccauccug

SEQ ID NO: 1333419 - RNA, 25 nt, Human
uccugaguagcugggacuacagggg

SEQ ID NO: 1333420 - RNA, 18 nt, Human
uccuuggaguuuucccca

SEQ ID NO: 1333421 - RNA, 18 nt, Human
uccuugugacacaggagu

SEQ ID NO: 1333422 - RNA, 21 nt, Human
uccuuguggcuuacucccugu

SEQ ID NO: 1333423 - RNA, 24 nt, Human
ucgcccaggcuggagugcaguggu

SEQ ID NO: 1333424 - RNA, 23 nt, Human
ucggaaguccccucucucacuag

SEQ ID NO: 1333425 - RNA, 18 nt, Human
ucggccucccaaagugcu

SEQ ID NO: 1333426 - RNA, 18 nt, Human
ucggccucccaaagugcu

SEQ ID NO: 1333427 - RNA, 19 nt, Human
ucuauccuguaaacugucc

SEQ ID NO: 1333428 - RNA, 21 nt, Human
ucucggaaguccccucucuca

SEQ ID NO: 1333429 - RNA, 20 nt, Human
ucugaacauaaauugugaag

SEQ ID NO: 1333430 - RNA, 24 nt, Human
ucugucgcccaggcuggagugcag

SEQ ID NO: 1333431 - RNA, 24 nt, Human
ucuuacucuuguugcccaggcugg

SEQ ID NO: 1333432 - RNA, 25 nt, Human
ucuuacucuuguugcccaggcugga

SEQ ID NO: 1333433 - RNA, 22 nt, Human
ucuucaucaucacuugcugcuu

SEQ ID NO: 1333434 - RNA, 23 nt, Human
ucuugcucugucgcccaggcugg

SEQ ID NO: 1333435 - RNA, 24 nt, Human
ucuugcucugucgcccaggcugga

SEQ ID NO: 1333436 - RNA, 22 nt, Human
ucuuguugcccaggcuggagug

SEQ ID NO: 1333437 - RNA, 18 nt, Human
ugaaauaugcccuggucu

SEQ ID NO: 1333438 - RNA, 23 nt, Human
ugaccccgugauccgcccaccuc

SEQ ID NO: 1333439 - RNA, 24 nt, Human
ugaccucaggugauccaccugccu

SEQ ID NO: 1333440 - RNA, 18 nt, Human
ugagauaaggacugaaau

SEQ ID NO: 1333441 - RNA, 22 nt, Human
ugagauggagucuugcucuguc

SEQ ID NO: 1333442 - RNA, 18 nt, Human
ugaggcuuggaaagauag

SEQ ID NO: 1333443 - RNA, 24 nt, Human
ugauccgcccaccucgcccuccca

SEQ ID NO: 1333444 - RNA, 22 nt, Human
ugcaguggugcgaucucagcuc

SEQ ID NO: 1333445 - RNA, 18 nt, Human
ugcccaggcuggagugca

SEQ ID NO: 1333446 - RNA, 21 nt, Human
ugcccaggcuggagugcagug

SEQ ID NO: 1333447 - RNA, 24 nt, Human
ugcccaggcuggagugcaguggug

SEQ ID NO: 1333448 - RNA, 24 nt, Human
ugccucagccucccaaguagcugg

SEQ ID NO: 1333449 - RNA, 21 nt, Human
ugccucggccucccaaagugc

SEQ ID NO: 1333450 - RNA, 24 nt, Human
ugccucggccucccaaagugcuag

SEQ ID NO: 1333451 - RNA, 19 nt, Human
ugccuucgcuuugugaucu

SEQ ID NO: 1333452 - RNA, 24 nt, Human
ugcucugucgcccaggcuggagug

SEQ ID NO: 1333453 - RNA, 20 nt, Human
ugcugggauuacagguguga

SEQ ID NO: 1333454 - RNA, 24 nt, Human
ugcugggauuacaggugugagcca

SEQ ID NO: 1333455 - RNA, 22 nt, Human
uggaaaaucuguuguuuagugu

SEQ ID NO: 1333456 - RNA, 23 nt, Human
uggagucuugcucugucgcccag

SEQ ID NO: 1333457 - RNA, 24 nt, Human
uggagucuugcucugucgcccagg

SEQ ID NO: 1333458 - RNA, 23 nt, Human
uggagugcaguggugcgaucuca

SEQ ID NO: 1333459 - RNA, 24 nt, Human
uggagugcaguggugcgaucucag

SEQ ID NO: 1333460 - RNA, 20 nt, Human
uggagugcaguggugcgguc

SEQ ID NO: 1333461 - RNA, 23 nt, Human
uggagugcaguggugcggucuug

SEQ ID NO: 1333462 - RNA, 24 nt, Human
uggagugcaguggugcggucuugg

SEQ ID NO: 1333463 - RNA, 24 nt, Human
uggcaugggauggcaaaccccggg

SEQ ID NO: 1333464 - RNA, 24 nt, Human
uggccaggcuggucuggaacuccu

SEQ ID NO: 1333465 - RNA, 24 nt, Human
uggccaggcugguuucaaacuccu

SEQ ID NO: 1333466 - RNA, 21 nt, Human
uggcccagguuuaguuuauac

SEQ ID NO: 1333467 - RNA, 20 nt, Human
uggccuuuuuuuuuuuuuuu

SEQ ID NO: 1333468 - RNA, 19 nt, Human
uggcugcucugggaguguc

SEQ ID NO: 1333469 - RNA, 21 nt, Human
ugggacuacaggggcccgcca

SEQ ID NO: 1333470 - RNA, 22 nt, Human
ugggacuacaggggcccgccac

SEQ ID NO: 1333471 - RNA, 24 nt, Human
ugggacuacaggggcccgccacca

SEQ ID NO: 1333472 - RNA, 19 nt, Human
ugggauuacaggccucugc

SEQ ID NO: 1333473 - RNA, 21 nt, Human
ugggauuacaggccucugcca

SEQ ID NO: 1333474 - RNA, 22 nt, Human
ugggauuacaggccucugccac

SEQ ID NO: 1333475 - RNA, 24 nt, Human
ugggauuacaggccucugccacca

SEQ ID NO: 1333476 - RNA, 18 nt, Human
ugggauuacaggugugag

SEQ ID NO: 1333477 - RNA, 18 nt, Human
ugggauuacaggugugag

SEQ ID NO: 1333478 - RNA, 19 nt, Human
ugggauuacaggugugagc

SEQ ID NO: 1333479 - RNA, 20 nt, Human
ugggauuacaggugugagcc

SEQ ID NO: 1333480 - RNA, 21 nt, Human
ugggauuacaggugugagcca

SEQ ID NO: 1333481 - RNA, 21 nt, Human
ugggauuacaggugugagcca

SEQ ID NO: 1333482 - RNA, 23 nt, Human
ugggauuacaggugugagccagg

SEQ ID NO: 1333483 - RNA, 27 nt, Human
ugggauuacaggugugagccagggcgc

SEQ ID NO: 1333484 - RNA, 21 nt, Human
ugggauuacaggugugagcua

SEQ ID NO: 1333485 - RNA, 22 nt, Human
ugggauuacaggugugagcuac

SEQ ID NO: 1333486 - RNA, 23 nt, Human
ugggauuacaggugugagcuacc

SEQ ID NO: 1333487 - RNA, 23 nt, Human
ugggauuacaggugugagcuacc

SEQ ID NO: 1333488 - RNA, 24 nt, Human
ugggauuacaggugugagcuaccg

SEQ ID NO: 1333489 - RNA, 24 nt, Human
ugggguuucaccauguuggccagg

SEQ ID NO: 1333490 - RNA, 24 nt, Human
ugggguuucaccauguuggccagg

SEQ ID NO: 1333491 - RNA, 23 nt, Human
uggucuggaacuccuaaccucag

SEQ ID NO: 1333492 - RNA, 24 nt, Human
uggugcgaucucagcucacugcaa

SEQ ID NO: 1333493 - RNA, 21 nt, Human
ugguuuggguggcaaggagag

SEQ ID NO: 1333494 - RNA, 23 nt, Human
uguaaacaaacaccugaucaaac

SEQ ID NO: 1333495 - RNA, 24 nt, Human
uguaaacaaacaccugaucaaacc

SEQ ID NO: 1333496 - RNA, 19 nt, Human
uguauguaugugugugugu

SEQ ID NO: 1333497 - RNA, 20 nt, Human
uguauguguguguguaugug

SEQ ID NO: 1333498 - RNA, 21 nt, Human
uguauuuuuaguagaaauggg

SEQ ID NO: 1333499 - RNA, 19 nt, Human
uguccuuggaguuuucccc

SEQ ID NO: 1333500 - RNA, 21 nt, Human
ugugggaagucagggacccug

SEQ ID NO: 1333501 - RNA, 19 nt, Human
uguguauguaugugugugu

SEQ ID NO: 1333502 - RNA, 21 nt, Human
uguguauguaugugugugugu

SEQ ID NO: 1333503 - RNA, 22 nt, Human
uguguauguaugugugugugua

SEQ ID NO: 1333504 - RNA, 23 nt, Human
uguguauguauguguguguguaa

SEQ ID NO: 1333505 - RNA, 23 nt, Human
uguguauguauguguguguguau

SEQ ID NO: 1333506 - RNA, 19 nt, Human
uguguguauguaugugugu

SEQ ID NO: 1333507 - RNA, 19 nt, Human
uguguguauguaugugugu

SEQ ID NO: 1333508 - RNA, 23 nt, Human
uguguguauguaugugugugugu

SEQ ID NO: 1333509 - RNA, 21 nt, Human
uguguguguauguaugugugu

SEQ ID NO: 1333510 - RNA, 22 nt, Human
uguguguguauguaugugugug

SEQ ID NO: 1333511 - RNA, 19 nt, Human
uguguuuguguguguaugu

SEQ ID NO: 1333512 - RNA, 19 nt, Human
uguucguacaccccucccc

SEQ ID NO: 1333513 - RNA, 18 nt, Human
uuaaaacuucaacaauaa

SEQ ID NO: 1333514 - RNA, 18 nt, Human
uuaauacuguguuugugu

SEQ ID NO: 1333515 - RNA, 26 nt, Human
uuaauacuuuuauaauuucuuacacc

SEQ ID NO: 1333516 - RNA, 21 nt, Human
uuacuuagguagacagugagg

SEQ ID NO: 1333517 - RNA, 18 nt, Human
uuaguagaaaugggguuu

SEQ ID NO: 1333518 - RNA, 22 nt, Human
uuaguagaaaugggguuucacc

SEQ ID NO: 1333519 - RNA, 24 nt, Human
uuaguagaaaugggguuucaccau

SEQ ID NO: 1333520 - RNA, 22 nt, Human
uuaguagagacgagguuucacc

SEQ ID NO: 1333521 - RNA, 24 nt, Human
uuaguagagacgagguuucaccgu

SEQ ID NO: 1333522 - RNA, 18 nt, Human
uuaguagagaugggguuu

SEQ ID NO: 1333523 - RNA, 22 nt, Human
uuaguagagaugggguuucacc

SEQ ID NO: 1333524 - RNA, 24 nt, Human
uuaguagagaugggguuucaccau

SEQ ID NO: 1333525 - RNA, 21 nt, Human
uucaagcaauucuccugccuc

SEQ ID NO: 1333526 - RNA, 24 nt, Human
uucaagcaauucuccugccucagc

SEQ ID NO: 1333527 - RNA, 24 nt, Human
uucagccuccugaguagcugggac

SEQ ID NO: 1333528 - RNA, 24 nt, Human
uucauggacauuuagcaguucccc

SEQ ID NO: 1333529 - RNA, 23 nt, Human
uucauggauauuuaucacuuccc

SEQ ID NO: 1333530 - RNA, 21 nt, Human
uuccuuggagacucuugaugg

SEQ ID NO: 1333531 - RNA, 24 nt, Human
uucggcucaucugccuccagcugc

SEQ ID NO: 1333532 - RNA, 18 nt, Human
uucuuuggucucgaaccc

SEQ ID NO: 1333533 - RNA, 18 nt, Human
uugagauaaggacugaaa

SEQ ID NO: 1333534 - RNA, 21 nt, Human
uugagauggagucuugcucug

SEQ ID NO: 1333535 - RNA, 24 nt, Human
uugcaaguaggaaccuuauauagg

SEQ ID NO: 1333536 - RNA, 22 nt, Human
uugcaaguuuuccuuggagacu

SEQ ID NO: 1333537 - RNA, 24 nt, Human
uugcccaggcuggagugcaguggu

SEQ ID NO: 1333538 - RNA, 24 nt, Human
uugcucugucgcccaggcuggagu

SEQ ID NO: 1333539 - RNA, 21 nt, Human
uuggagacucuugauggccca

SEQ ID NO: 1333540 - RNA, 25 nt, Human
uuguacuguuucucuuuauuucuca

SEQ ID NO: 1333541 - RNA, 23 nt, Human
uuguauuuuuaguagaaaugggg

SEQ ID NO: 1333542 - RNA, 24 nt, Human
uuguguguguauguaugugugugu

SEQ ID NO: 1333543 - RNA, 21 nt, Human
uuuaucuacauggaaaaucug

SEQ ID NO: 1333544 - RNA, 24 nt, Human
uuucaccauguuggccaggcuggu

SEQ ID NO: 1333545 - RNA, 24 nt, Human
uuucaccauguuggccaggcuggu

SEQ ID NO: 1333546 - RNA, 19 nt, Human
uuucaccguguuagccagg

SEQ ID NO: 1333547 - RNA, 18 nt, Human
uuuccuuucucuuucuuu

SEQ ID NO: 1333548 - RNA, 23 nt, Human
uuuguguguguauguaugugugu

SEQ ID NO: 1333549 - RNA, 19 nt, Human
uuuuauauuuuuaguagag

SEQ ID NO: 1333550 - RNA, 20 nt, Human
uuuuauauuuuuaguagaga

SEQ ID NO: 1333551 - RNA, 24 nt, Human
uuuuuaguagaaaugggguuucac

SEQ ID NO: 1333552 - RNA, 24 nt, Human
uuuuuaguagagacgagguuucac

SEQ ID NO: 1333553 - RNA, 24 nt, Human
uuuuuaguagagaugggguuucac

SEQ ID NO: 1333554 - RNA, 18 nt, Human
uuuuuguauuuuuaguag

SEQ ID NO: 1333555 - RNA, 21 nt, Human
uuuuuguauuuuuaguagaga

SEQ ID NO: 1333556 - RNA, 21 nt, Human
uuuuuuguauuuuuaguagag

SEQ ID NO: 1333557 - RNA, 24 nt, Human
uuuuuuguauuuuuaguagagacg

SEQ ID NO: 1333558 - RNA, 24 nt, Human
uuuuuuuuuuuugagauggagucu

SEQ ID NO: 1333559 - RNA, 22 nt, Human
uuuuuuuuuuuuuugagaugga

SEQ ID NO: 1333560 - RNA, 18 nt, Human
aaacaagaaaagcccuga

SEQ ID NO: 1333561 - RNA, 19 nt, Human
acaagaaaagcccugacgc

SEQ ID NO: 1333562 - RNA, 18 nt, Human
caagaaaagcccugacgc

SEQ ID NO: 1333563 - RNA, 20 nt, Human
cccgcccagucccgcccgcc

SEQ ID NO: 1333564 - RNA, 20 nt, Human
cccgccgagguccgugucca

SEQ ID NO: 1333565 - RNA, 24 nt, Human
ccgcccgccgagguccguguccaa

SEQ ID NO: 1333566 - RNA, 19 nt, Human
gauccuccucgcgcacccc

SEQ ID NO: 1333567 - RNA, 22 nt, Human
gggaaagauggugaaaaaaugc

SEQ ID NO: 1333568 - RNA, 23 nt, Human
ggugaaaaaaugcgaggaaaaga

SEQ ID NO: 1333569 - RNA, 30 nt, Human; identical to SEQ ID NO: 1328529

SEQ ID NO: 1333570 - RNA, 23 nt, Human
uauuaaacaagaaaagcccugac

SEQ ID NO: 1333571 - RNA, 20 nt, Human
ugaugccccgccccgcccag

SEQ ID NO: 1333572 - RNA, 23 nt, Human
uuggcuccuggagauugagggaa

SEQ ID NO: 1333573 - RNA, 20 nt, Human
aaaugcagacacacagauaa

SEQ ID NO: 1333574 - RNA, 18 nt, Human
aauuagccaggcauggug

SEQ ID NO: 1333575 - RNA, 26 nt, Human
acagagugaggcccugucccuacaaa

SEQ ID NO: 1333576 - RNA, 20 nt, Human
accacugcaaaacuccaucu

SEQ ID NO: 1333577 - RNA, 22 nt, Human
accaggucuugggugcccaggu

SEQ ID NO: 1333578 - RNA, 21 nt, Human
acccaccccggggcacgcaca

SEQ ID NO: 1333579 - RNA, 21 nt, Human
accccccuccccccucccccc

SEQ ID NO: 1333580 - RNA, 23 nt, Human
accccccuccccccucccccccc

SEQ ID NO: 1333581 - RNA, 23 nt, Human
accccccuccccccucccccccc

SEQ ID NO: 1333582 - RNA, 25 nt, Human
accccccuccccccuccccccccac

SEQ ID NO: 1333583 - RNA, 21 nt, Human
acccgcccucccuccuuaucu

SEQ ID NO: 1333584 - RNA, 19 nt, Human
agagauacagggaccuugc

SEQ ID NO: 1333585 - RNA, 22 nt, Human
agaggucacacuggacccagag

SEQ ID NO: 1333586 - RNA, 22 nt, Human
agcauuuugggaggccaaggca

SEQ ID NO: 1333587 - RNA, 24 nt, Human
aggaauugaaggcugcaaugagcu

SEQ ID NO: 1333588 - RNA, 18 nt, Human
aggcaggaggauugccug

SEQ ID NO: 1333589 - RNA, 24 nt, Human
aggcaggaggauugccugagccca

SEQ ID NO: 1333590 - RNA, 21 nt, Human
aggcugaggcaggaggauugc

SEQ ID NO: 1333591 - RNA, 24 nt, Human
aggcugaggcaggaggauugccug

SEQ ID NO: 1333592 - RNA, 24 nt, Human
aggugcaguggcucacaccuguaa

SEQ ID NO: 1333593 - RNA, 24 nt, Human
aguggcucacaccuguaaucucag

SEQ ID NO: 1333594 - RNA, 18 nt, Human
auccugcucuuggcucuu

SEQ ID NO: 1333595 - RNA, 18 nt, Human
augucugagguggccaca

SEQ ID NO: 1333596 - RNA, 24 nt, Human
caagugaauaugcguaccccccuc

SEQ ID NO: 1333597 - RNA, 22 nt, Human
cacaaccuaaucucuguguacc

SEQ ID NO: 1333598 - RNA, 23 nt, Human
cacacacagagcagguaguugua

SEQ ID NO: 1333599 - RNA, 24 nt, Human
cacaccuguaaucucagcauuuug

SEQ ID NO: 1333600 - RNA, 22 nt, Human
cacauggaaaugcccugggaac

SEQ ID NO: 1333601 - RNA, 19 nt, Human
caccccggggcacgcacag

SEQ ID NO: 1333602 - RNA, 23 nt, Human
caccuguaaucucagcauuuugg

SEQ ID NO: 1333603 - RNA, 24 nt, Human
caccuguaaucucagcauuuuggg

SEQ ID NO: 1333604 - RNA, 18 nt, Human
cagagugaggcccugucc

SEQ ID NO: 1333605 - RNA, 20 nt, Human
cagauggaguccagcaugga

SEQ ID NO: 1333606 - RNA, 24 nt, Human
cagcauuuugggaggccaaggcag

SEQ ID NO: 1333607 - RNA, 25 nt, Human
cagcauuuugggaggccaaggcagg

SEQ ID NO: 1333608 - RNA, 24 nt, Human
cagcuacucaggaggcugaggcag

SEQ ID NO: 1333609 - RNA, 18 nt, Human
caggucuugggugcccag

SEQ ID NO: 1333610 - RNA, 21 nt, Human
caggucuugggugcccagguc

SEQ ID NO: 1333611 - RNA, 23 nt, Human
ccacacucccucuccaaaaaaua

SEQ ID NO: 1333612 - RNA, 23 nt, Human
ccagagccugcagaggucacacu

SEQ ID NO: 1333613 - RNA, 22 nt, Human
ccagcuugugcaacagagugag

SEQ ID NO: 1333614 - RNA, 19 nt, Human
ccauagcaugcuggcaccc

SEQ ID NO: 1333615 - RNA, 23 nt, Human
ccaucuaaaaaaaaaauggccau

SEQ ID NO: 1333616 - RNA, 23 nt, Human
cccauagcaugcuggcacccgcc

SEQ ID NO: 1333617 - RNA, 22 nt, Human
ccccccuccccccccacacaca

SEQ ID NO: 1333618 - RNA, 24 nt, Human
ccccccuccccccccacacacaga

SEQ ID NO: 1333619 - RNA, 19 nt, Human
ccccccuccccccuccccc

SEQ ID NO: 1333620 - RNA, 22 nt, Human
cccccuccccccucccccccca

SEQ ID NO: 1333621 - RNA, 22 nt, Human
ccccucugucuuccaagaccug

SEQ ID NO: 1333622 - RNA, 22 nt, Human
cccucccuccuuaucucuccca

SEQ ID NO: 1333623 - RNA, 23 nt, Human
cccucccuccuuaucucucccaa

SEQ ID NO: 1333624 - RNA, 21 nt, Human
ccuccacccugauggguaguc

SEQ ID NO: 1333625 - RNA, 19 nt, Human
ccuccaccucauccugcuc

SEQ ID NO: 1333626 - RNA, 18 nt, Human
ccuggagcacauggaaau

SEQ ID NO: 1333627 - RNA, 21 nt, Human
ccuugccuggggcaaaaagga

SEQ ID NO: 1333628 - RNA, 21 nt, Human
cucacaccuguaaucucagca

SEQ ID NO: 1333629 - RNA, 21 nt, Human
cucacaccuguaaucucagca

SEQ ID NO: 1333630 - RNA, 19 nt, Human
cucauccugcucuuggcuc

SEQ ID NO: 1333631 - RNA, 18 nt, Human
cuccccccucccccccca

SEQ ID NO: 1333632 - RNA, 22 nt, Human
cucuguguaccacaggccucac

SEQ ID NO: 1333633 - RNA, 19 nt, Human
cugaaacccaugacugcug

SEQ ID NO: 1333634 - RNA, 23 nt, Human
cugacacuggagaaacccaauug

SEQ ID NO: 1333635 - RNA, 21 nt, Human
cuguagucccagcuacucagg

SEQ ID NO: 1333636 - RNA, 18 nt, Human
gaaaggaaaccaggucuu

SEQ ID NO: 1333637 - RNA, 24 nt, Human
gaaagucuuucccuugggaaacca

SEQ ID NO: 1333638 - RNA, 23 nt, Human
gaauaugcguaccccccuccccc

SEQ ID NO: 1333639 - RNA, 22 nt, Human
gacuucaagugaauaugcguac

SEQ ID NO: 1333640 - RNA, 18 nt, Human
gagcagguaguuguaacg

SEQ ID NO: 1333641 - RNA, 19 nt, Human
gauugcaccacugcaaaac

SEQ ID NO: 1333642 - RNA, 19 nt, Human
gccacaggaugguggauuc

SEQ ID NO: 1333643 - RNA, 19 nt, Human
gcugcaaugagcuaugauu

SEQ ID NO: 1333644 - RNA, 20 nt, Human
ggaaaacaugugcaacuggg

SEQ ID NO: 1333645 - RNA, 20 nt, Human
ggagcacucagggagaugag

SEQ ID NO: 1333646 - RNA, 22 nt, Human
ggaggauugccugagcccagga

SEQ ID NO: 1333647 - RNA, 22 nt, Human
ggcaaaaaggauuagaaaaugc

SEQ ID NO: 1333648 - RNA, 18 nt, Human
ggcgaggugcaguggcuc

SEQ ID NO: 1333649 - RNA, 20 nt, Human
gggaaaccagggagcacuca

SEQ ID NO: 1333650 - RNA, 20 nt, Human
gugcagcucuucugggcggg

SEQ ID NO: 1333651 - RNA, 18 nt, Human
gugcaguggcucacaccu

SEQ ID NO: 1333652 - RNA, 21 nt, Human
uaaagcagcuccccucugucu

SEQ ID NO: 1333653 - RNA, 21 nt, Human
uaagugguggaagauggagca

SEQ ID NO: 1333654 - RNA, 18 nt, Human
uaccacaggccucacgca

SEQ ID NO: 1333655 - RNA, 22 nt, Human
uagauaagcaucuuugugagag

SEQ ID NO: 1333656 - RNA, 22 nt, Human
uagcaugcuggcacccgcccuc

SEQ ID NO: 1333657 - RNA, 20 nt, Human
uagccucuaaagcagcuccc

SEQ ID NO: 1333658 - RNA, 23 nt, Human
uagcuaaaugagcaauauaguau

SEQ ID NO: 1333659 - RNA, 23 nt, Human
ucaaagcaacuuagccucuaaag

SEQ ID NO: 1333660 - RNA, 18 nt, Human
ucaaggaggccaggaguu

SEQ ID NO: 1333661 - RNA, 21 nt, Human
ucaaggaggccaggaguucaa

SEQ ID NO: 1333662 - RNA, 18 nt, Human
ucacaucacagacuuucu

SEQ ID NO: 1333663 - RNA, 24 nt, Human
ucagagcugcuguuccagagccug

SEQ ID NO: 1333664 - RNA, 25 nt, Human
ucagagcugcuguuccagagccugc

SEQ ID NO: 1333665 - RNA, 21 nt, Human
uccaucuaaaaaaaaaauggc

SEQ ID NO: 1333666 - RNA, 20 nt, Human
uccccccuccccccccacac

SEQ ID NO: 1333667 - RNA, 22 nt, Human
ucccuacaaaaaauucuaaaaa

SEQ ID NO: 1333668 - RNA, 20 nt, Human
ucuacugcugugaguugggg

SEQ ID NO: 1333669 - RNA, 18 nt, Human
ucucaaacaaagcuggga

SEQ ID NO: 1333670 - RNA, 21 nt, Human
ucucugcugagggcucugucc

SEQ ID NO: 1333671 - RNA, 24 nt, Human
ucuggcgaggugcaguggcucaca

SEQ ID NO: 1333672 - RNA, 23 nt, Human
ucuuugguuugcugacacuggag

SEQ ID NO: 1333673 - RNA, 25 nt, Human
ugaauaugcguaccccccucccccc

SEQ ID NO: 1333674 - RNA, 20 nt, Human
ugaggcaggaggauugccug

SEQ ID NO: 1333675 - RNA, 24 nt, Human
ugaggcaggaggauugccugagcc

SEQ ID NO: 1333676 - RNA, 25 nt, Human
ugaggcaggaggauugccugagccc

SEQ ID NO: 1333677 - RNA, 19 nt, Human
ugagguggccacaggaugg

SEQ ID NO: 1333678 - RNA, 19 nt, Human
ugaguuggggugaacccac

SEQ ID NO: 1333679 - RNA, 22 nt, Human
ugcaaugagcuaugauugcacc

SEQ ID NO: 1333680 - RNA, 21 nt, Human
ugcagcucuucugggcgggga

SEQ ID NO: 1333681 - RNA, 24 nt, Human
ugccugagcccaggaauugaaggc

SEQ ID NO: 1333682 - RNA, 21 nt, Human
ugcugaaacccaugacugcug

SEQ ID NO: 1333683 - RNA, 23 nt, Human
uggagguuuucuccuauaacuga

SEQ ID NO: 1333684 - RNA, 22 nt, Human
uggcacccgcccucccuccuua

SEQ ID NO: 1333685 - RNA, 21 nt, Human
uggcucacaccuguaaucuca

SEQ ID NO: 1333686 - RNA, 24 nt, Human
uggcucacaccuguaaucucagca

SEQ ID NO: 1333687 - RNA, 18 nt, Human
uggcuguguuggccccac

SEQ ID NO: 1333688 - RNA, 21 nt, Human
ugggaggggucuccugggaug

SEQ ID NO: 1333689 - RNA, 24 nt, Human
ugggaugaaugaaaggaaaccagg

SEQ ID NO: 1333690 - RNA, 22 nt, Human
uggggagguuagauaagcaucu

SEQ ID NO: 1333691 - RNA, 21 nt, Human
uggguagucaggccuggagca

SEQ ID NO: 1333692 - RNA, 24 nt, Human
ugguuugcugacacuggagaaacc

SEQ ID NO: 1333693 - RNA, 22 nt, Human
uguaacgccuccaccucauccu

SEQ ID NO: 1333694 - RNA, 18 nt, Human
ugucucagagauacaggg

SEQ ID NO: 1333695 - RNA, 21 nt, Human
ugugcaacagagugaggcccu

SEQ ID NO: 1333696 - RNA, 19 nt, Human
ugugcuggacucagaauug

SEQ ID NO: 1333697 - RNA, 20 nt, Human
ugugcuggacucagaauugg

SEQ ID NO: 1333698 - RNA, 21 nt, Human
uguggugguuucacuucaaga

SEQ ID NO: 1333699 - RNA, 22 nt, Human
uguguaccacaggccucacgca

SEQ ID NO: 1333700 - RNA, 18 nt, Human
uucaagauuuucaggauc

SEQ ID NO: 1333701 - RNA, 24 nt, Human
uucaaggaggccaggaguucaaga

SEQ ID NO: 1333702 - RNA, 20 nt, Human
uucuagaguaagcuuuuagg

SEQ ID NO: 1333703 - RNA, 24 nt, Human
uugccugagcccaggaauugaagg

SEQ ID NO: 1333704 - RNA, 23 nt, Human
uugcugacacuggagaaacccaa

SEQ ID NO: 1333705 - RNA, 22 nt, Human
uuggauuuuacuguggagauuu

SEQ ID NO: 1333706 - RNA, 25 nt, Human
uuuggauuuuacuguggagauuuug

SEQ ID NO: 1333707 - RNA, 23 nt, Human
acucuuuugggaaggagggaaac

SEQ ID NO: 1333708 - RNA, 18 nt, Human
augcacacacacaacagu

SEQ ID NO: 1333709 - RNA, 18 nt, Human
cuuguuugugcccaaggc

SEQ ID NO: 1333710 - RNA, 19 nt, Human
ugggaaggagggaaacuga

SEQ ID NO: 1333711 - RNA, 25 nt, Human
ugugcccaaggcaugcacacacaca

SEQ ID NO: 1333712 - RNA, 19 nt, Human
acaggggaccagagagaga

SEQ ID NO: 1333713 - RNA, 18 nt, Human
agccaaugaagggggacu

SEQ ID NO: 1333714 - RNA, 19 nt, Human
aggagccaaugaaggggga

SEQ ID NO: 1333715 - RNA, 22 nt, Human
aggcggagcagcuaguugggga

SEQ ID NO: 1333716 - RNA, 24 nt, Human
ccaaugaagggggacugaggcgga

SEQ ID NO: 1333717 - RNA, 20 nt, Human
ugacacaggggaccagagag

SEQ ID NO: 1333718 - RNA, 19 nt, Human
uuucuuucuucuuuccuuu

SEQ ID NO: 1333719 - RNA, 20 nt, Human
aaaaaacauaaucaaaagaa

SEQ ID NO: 1333720 - RNA, 24 nt, Human
aaaacauaaucaaaagaaggcaca

SEQ ID NO: 1333721 - RNA, 22 nt, Human
aagaaggcacagaggccagggg

SEQ ID NO: 1333722 - RNA, 19 nt, Human
aagcccccaauucucuuuu

SEQ ID NO: 1333723 - RNA, 26 nt, Human
aagcuguaggccccagugaguucugg

SEQ ID NO: 1333724 - RNA, 22 nt, Human
aaggaggggguaauaaagggau

SEQ ID NO: 1333725 - RNA, 20 nt, Human
acccuaagcccccaauucuc

SEQ ID NO: 1333726 - RNA, 27 nt, Human
agaggccagggggcuacaugggaacag

SEQ ID NO: 1333727 - RNA, 19 nt, Human
agaugucagggaucaaagc

SEQ ID NO: 1333728 - RNA, 20 nt, Human
agcauucuggccagaaccaa

SEQ ID NO: 1333729 - RNA, 18 nt, Human
aggaaggccuaaggucca

SEQ ID NO: 1333730 - RNA, 24 nt, Human
agggagcuggcuccauggggaggg

SEQ ID NO: 1333731 - RNA, 18 nt, Human
aggggagagaggguggag

SEQ ID NO: 1333732 - RNA, 23 nt, Human
aggggguaauaaagggauugggg

SEQ ID NO: 1333733 - RNA, 22 nt, Human
auaguagggcgauuacagacac

SEQ ID NO: 1333734 - RNA, 23 nt, Human
caaacauaaauagagggagcugg

SEQ ID NO: 1333735 - RNA, 19 nt, Human
ccagugaguucuggaggcc

SEQ ID NO: 1333736 - RNA, 24 nt, Human
ccccaggauaccccggucucccaa

SEQ ID NO: 1333737 - RNA, 19 nt, Human
cccccaggauaccccgguc

SEQ ID NO: 1333738 - RNA, 19 nt, Human
cccuaagcccccaauucuc

SEQ ID NO: 1333739 - RNA, 23 nt, Human
ccugcagcauucuggccagaacc

SEQ ID NO: 1333740 - RNA, 20 nt, Human
cggaaaacaugucugagcca

SEQ ID NO: 1333741 - RNA, 20 nt, Human
gauuacagacacaacucccc

SEQ ID NO: 1333742 - RNA, 23 nt, Human
gcagcauucuggccagaaccaaa

SEQ ID NO: 1333743 - RNA, 23 nt, Human
ggagcuggcuccauggggagggc

SEQ ID NO: 1333744 - RNA, 23 nt, Human
ggcucccuggucuccagauucca

SEQ ID NO: 1333745 - RNA, 18 nt, Human
ggcugggcuccgugucuc

SEQ ID NO: 1333746 - RNA, 22 nt, Human
gggguaauaaagggauuggggc

SEQ ID NO: 1333747 - RNA, 26 nt, Human
gucaauuucuaggugaggucuucuca

SEQ ID NO: 1333748 - RNA, 20 nt, Human
uaagcccccaauucucuuuu

SEQ ID NO: 1333749 - RNA, 21 nt, Human
uacauugggucccccaggaua

SEQ ID NO: 1333750 - RNA, 19 nt, Human
uccaggggagagagggugg

SEQ ID NO: 1333751 - RNA, 19 nt, Human
uccccuggggagcagaggc

SEQ ID NO: 1333752 - RNA, 20 nt, Human
uccuuuccaggggagagagg

SEQ ID NO: 1333753 - RNA, 22 nt, Human
ucugagccaaggcagcuccuac

SEQ ID NO: 1333754 - RNA, 19 nt, Human
ugagaggaagagaaccugc

SEQ ID NO: 1333755 - RNA, 19 nt, Human
ugagaggaagagaaccugc

SEQ ID NO: 1333756 - RNA, 21 nt, Human
ugagccagaagagguugaggg

SEQ ID NO: 1333757 - RNA, 22 nt, Human
uggagagaggaaggccuaaggu

SEQ ID NO: 1333758 - RNA, 24 nt, Human
uggggcaggggaggcguucugagu

SEQ ID NO: 1333759 - RNA, 20 nt, Human
ugguugccagcacuucacug

SEQ ID NO: 1333760 - RNA, 21 nt, Human
ugucagggaucaaagcuguag

SEQ ID NO: 1333761 - RNA, 18 nt, Human
ugucugaaggagggggua

SEQ ID NO: 1333762 - RNA, 21 nt, Human
aggacagaugcugcuggagga

SEQ ID NO: 1333763 - RNA, 18 nt, Human
aggaggccaaggggccag

SEQ ID NO: 1333764 - RNA, 20 nt, Human
aggaggccaaggggccagcu

SEQ ID NO: 1333765 - RNA, 22 nt, Human
caacugccagggaccucgagca

SEQ ID NO: 1333766 - RNA, 21 nt, Human
cacuugccaaggaccacaacu

SEQ ID NO: 1333767 - RNA, 19 nt, Human
cccugaggagagaggacag

SEQ ID NO: 1333768 - RNA, 21 nt, Human
gccaaggaccacaacugccag

SEQ ID NO: 1333769 - RNA, 22 nt, Human
gucaccagauggggauggggag

SEQ ID NO: 1333770 - RNA, 18 nt, Human
ucccugaggagagaggac

SEQ ID NO: 1333771 - RNA, 20 nt, Human
ucccugaggagagaggacag

SEQ ID NO: 1333772 - RNA, 26 nt, Human
ucucuaggaggccaaggggccagcuu

SEQ ID NO: 1333773 - RNA, 18 nt, Human
ugccaaggaccacaacug

SEQ ID NO: 1333774 - RNA, 19 nt, Human
ugccucccugaggagagag

SEQ ID NO: 1333775 - RNA, 22 nt, Human
ugcugcuggaggagaugucagg

SEQ ID NO: 1333776 - RNA, 22 nt, Human
ugcuugccucccugaggagaga

SEQ ID NO: 1333777 - RNA, 21 nt, Human
uggguggaggaggaaggacuc

SEQ ID NO: 1333778 - RNA, 22 nt, Human
uguagccaggccuuuggucacc

SEQ ID NO: 1333779 - RNA, 19 nt, Human
uuggggucuuuugaagagg

SEQ ID NO: 1333780 - RNA, 21 nt, Human
aacucagcucccauuguaccc

SEQ ID NO: 1333781 - RNA, 20 nt, Human
agcuggaagucuccagcuuc

SEQ ID NO: 1333782 - RNA, 18 nt, Human
agcuggugcucugugugc

SEQ ID NO: 1333783 - RNA, 19 nt, Human
agcuggugcucugugugcc

SEQ ID NO: 1333784 - RNA, 21 nt, Human
caacucagcucccauuguacc

SEQ ID NO: 1333785 - RNA, 19 nt, Human
ccagcuucucccuccaaca

SEQ ID NO: 1333786 - RNA, 19 nt, Human
cuugagugggagcuggagc

SEQ ID NO: 1333787 - RNA, 21 nt, Human
gagcuggagcuggaagucucc

SEQ ID NO: 1333788 - RNA, 22 nt, Human
uccagcuucucccuccaacaac

SEQ ID NO: 1333789 - RNA, 22 nt, Human
ucccuccaacaacucagcuccc

SEQ ID NO: 1333790 - RNA, 20 nt, Human
ugagugggagcuggagcugg

SEQ ID NO: 1333791 - RNA, 18 nt, Human
uacaagccuugagagaca

SEQ ID NO: 1333792 - RNA, 20 nt, Human
uuuacaagccuugagagaca

SEQ ID NO: 1333793 - RNA, 22 nt, Human
aacccaucaacccgucauggaa

SEQ ID NO: 1333794 - RNA, 23 nt, Human
aagaaaacguccugugagaggcc

SEQ ID NO: 1333795 - RNA, 21 nt, Human
aaucuugccucucagucccac

SEQ ID NO: 1333796 - RNA, 19 nt, Human
acagggucaugguggacac

SEQ ID NO: 1333797 - RNA, 19 nt, Human
acccgucauggaaauaauu

SEQ ID NO: 1333798 - RNA, 21 nt, Human
agaaagagaagucaggguucu

SEQ ID NO: 1333799 - RNA, 19 nt, Human
agaggccaggaagguagca

SEQ ID NO: 1333800 - RNA, 20 nt, Human
agggucaugguggacacggg

SEQ ID NO: 1333801 - RNA, 22 nt, Human
augaacaaaucuugccucucag

SEQ ID NO: 1333802 - RNA, 24 nt, Human
caaaucuugccucucagucccaca

SEQ ID NO: 1333803 - RNA, 22 nt, Human
caacccgucauggaaauaauuu

SEQ ID NO: 1333804 - RNA, 21 nt, Human
caugaacaaaucuugccucuc

SEQ ID NO: 1333805 - RNA, 23 nt, Human
cucacauuaugccuauagggaca

SEQ ID NO: 1333806 - RNA, 25 nt, Human
gaauguaggucaguguggggaacag

SEQ ID NO: 1333807 - RNA, 19 nt, Human
gggaaggaauguaggucag

SEQ ID NO: 1333808 - RNA, 21 nt, Human
ggggaacagggucauggugga

SEQ ID NO: 1333809 - RNA, 23 nt, Human
gucaggguucuugaagucacaaa

SEQ ID NO: 1333810 - RNA, 25 nt, Human
uccccaccaccucacauuaugccua

SEQ ID NO: 1333811 - RNA, 21 nt, Human
ucucagucccacacaaggcag

SEQ ID NO: 1333812 - RNA, 22 nt, Human
ugaacaaaucuugccucucagu

SEQ ID NO: 1333813 - RNA, 23 nt, Human
ugagaggccaggaagguagcagg

SEQ ID NO: 1333814 - RNA, 18 nt, Human
ugucucucaaauuuuagg

SEQ ID NO: 1333815 - RNA, 23 nt, Human
ugugagaggccaggaagguagca

SEQ ID NO: 1333816 - RNA, 19 nt, Human
uuacagcucagugcaccau

SEQ ID NO: 1333817 - RNA, 21 nt, Human
uuacagcucagugcaccauga

SEQ ID NO: 1333818 - RNA, 19 nt, Human
auccucccagcccccaggc

SEQ ID NO: 1333819 - RNA, 25 nt, Human
cacccacuucuccaggauccuccca

SEQ ID NO: 1333820 - RNA, 20 nt, Human
ccaggauccucccagccccc

SEQ ID NO: 1333821 - RNA, 21 nt, Human
ccaggauccucccagccccca

SEQ ID NO: 1333822 - RNA, 20 nt, Human
cccaggcuggcuuucccucc

SEQ ID NO: 1333823 - RNA, 21 nt, Human
cccccaggcuggcuuucccuc

SEQ ID NO: 1333824 - RNA, 24 nt, Human
gggcaaccccaggauggggaaggg

SEQ ID NO: 1333825 - RNA, 23 nt, Human
uagagcagaauucagacucagcu

SEQ ID NO: 1333826 - RNA, 18 nt, Human
ucagccaucuauguuccc

SEQ ID NO: 1333827 - RNA, 19 nt, Human
uccccaaccgcgagagccc

SEQ ID NO: 1333828 - RNA, 19 nt, Human
ucuguccccacccacuucu

SEQ ID NO: 1333829 - RNA, 21 nt, Human
uuccccaaccgcgagagcccc

SEQ ID NO: 1333830 - RNA, 21 nt, Human
aacucguccauuccuucucca

SEQ ID NO: 1333831 - RNA, 26 nt, Human
aacucguccauuccuucuccaacucu

SEQ ID NO: 1333832 - RNA, 25 nt, Human
acagaacaacagggcuguuucaaga

SEQ ID NO: 1333833 - RNA, 20 nt, Human
accaccacccccgcccccau

SEQ ID NO: 1333834 - RNA, 19 nt, Human
acucucuucaccaccaccc

SEQ ID NO: 1333835 - RNA, 20 nt, Human
aggaagcugugccaagucug

SEQ ID NO: 1333836 - RNA, 23 nt, Human
agugucuccauccacccccuaca

SEQ ID NO: 1333837 - RNA, 20 nt, Human
caacucucuucaccaccacc

SEQ ID NO: 1333838 - RNA, 22 nt, Human
caagcguggggcggguggcugg

SEQ ID NO: 1333839 - RNA, 25 nt, Human
caccacagccaaagugauaagaagu

SEQ ID NO: 1333840 - RNA, 20 nt, Human
caccaccacccccgccccca

SEQ ID NO: 1333841 - RNA, 22 nt, Human
cacccccgcccccaucuccacu

SEQ ID NO: 1333842 - RNA, 19 nt, Human
cacuaggcggcaccacagc

SEQ ID NO: 1333843 - RNA, 23 nt, Human
cagaauggggaccucauucuauc

SEQ ID NO: 1333844 - RNA, 19 nt, Human
caguagcccgagcccuccc

SEQ ID NO: 1333845 - RNA, 20 nt, Human
ccaacucucuucaccaccac

SEQ ID NO: 1333846 - RNA, 18 nt, Human
ccccggaguccacugugg

SEQ ID NO: 1333847 - RNA, 25 nt, Human
cccgagcccucccauucuccacucc

SEQ ID NO: 1333848 - RNA, 23 nt, Human
ccucccauucuccacuccuucga

SEQ ID NO: 1333849 - RNA, 22 nt, Human
cgagcccucccauucuccacuc

SEQ ID NO: 1333850 - RNA, 24 nt, Human
cgagcccucccauucuccacuccu

SEQ ID NO: 1333851 - RNA, 22 nt, Human
cucaguagcccgagcccuccca

SEQ ID NO: 1333852 - RNA, 22 nt, Human
cucucuucaccaccacccccgc

SEQ ID NO: 1333853 - RNA, 20 nt, Human
cugugccaagucuguaggag

SEQ ID NO: 1333854 - RNA, 23 nt, Human
gacccaauuccacuaagucaaga

SEQ ID NO: 1333855 - RNA, 21 nt, Human
gauaugagggguugggagaga

SEQ ID NO: 1333856 - RNA, 23 nt, Human
gccccggaguccacuguggauac

SEQ ID NO: 1333857 - RNA, 20 nt, Human
gcuugcguggugguuccagu

SEQ ID NO: 1333858 - RNA, 19 nt, Human
ggagcaccaccgcuccccg

SEQ ID NO: 1333859 - RNA, 21 nt, Human
gguugggagagaagggggacg

SEQ ID NO: 1333860 - RNA, 18 nt, Human
uaggaagcugugccaagu

SEQ ID NO: 1333861 - RNA, 18 nt, Human
uaggcggcaccacagcca

SEQ ID NO: 1333862 - RNA, 18 nt, Human
ucaguagcccgagcccuc

SEQ ID NO: 1333863 - RNA, 22 nt, Human
uccaacucucuucaccaccacc

SEQ ID NO: 1333864 - RNA, 23 nt, Human
uccuucuccaacucucuucacca

SEQ ID NO: 1333865 - RNA, 22 nt, Human
ucuaugcuccgaaguccgugga

SEQ ID NO: 1333866 - RNA, 19 nt, Human
ugacccaggcuggcguugc

SEQ ID NO: 1333867 - RNA, 20 nt, Human
ugacccaggcuggcguugcu

SEQ ID NO: 1333868 - RNA, 18 nt, Human
ugauggacugugacccag

SEQ ID NO: 1333869 - RNA, 21 nt, Human
ugccaagucuguaggagcccc

SEQ ID NO: 1333870 - RNA, 22 nt, Human
ugcuccgaaguccguggagcac

SEQ ID NO: 1333871 - RNA, 18 nt, Human
ugcuuaaagagugcgggg

SEQ ID NO: 1333872 - RNA, 20 nt, Human
ugggagagaagggggacgug

SEQ ID NO: 1333873 - RNA, 24 nt, Human
ugggagagaagggggacgugggaa

SEQ ID NO: 1333874 - RNA, 21 nt, Human
uggggcggguggcuggagauu

SEQ ID NO: 1333875 - RNA, 22 nt, Human
ugguuccagucugcuaaauauu

SEQ ID NO: 1333876 - RNA, 25 nt, Human
uguaggaagcugugccaagucugua

SEQ ID NO: 1333877 - RNA, 18 nt, Human
uuagaagugucuccaucc

SEQ ID NO: 1333878 - RNA, 22 nt, Human
uucaccaccacccccgccccca

SEQ ID NO: 1333879 - RNA, 26 nt, Human
uucaccaccacccccgcccccaucuc

SEQ ID NO: 1333880 - RNA, 20 nt, Human
uucccuugcugauaugaggg

SEQ ID NO: 1333881 - RNA, 26 nt, Human
uucuccacuccuucgacccaauucca

SEQ ID NO: 1333882 - RNA, 18 nt, Human
uugcucgucucuggauuu

SEQ ID NO: 1333883 - RNA, 21 nt, Human
caggccccgugagaagcuaug

SEQ ID NO: 1333884 - RNA, 24 nt, Human
cguuccuguaggaagaacuagaga

SEQ ID NO: 1333885 - RNA, 22 nt, Human
gagccaggccccgugagaagcu

SEQ ID NO: 1333886 - RNA, 24 nt, Human
uaaaagcagaaauaaggaaaaugc

SEQ ID NO: 1333887 - RNA, 27 nt, Human
uaagagaacugagacauguggaggccg

SEQ ID NO: 1333888 - RNA, 19 nt, Human
uccgagaggaccugauggu

SEQ ID NO: 1333889 - RNA, 19 nt, Human
ugagcgaguuggugggguc

SEQ ID NO: 1333890 - RNA, 20 nt, Human
ugagcgaguuggugggguca

SEQ ID NO: 1333891 - RNA, 22 nt, Human
uguaggaagaacuagagauucc

SEQ ID NO: 1333892 - RNA, 23 nt, Human
ugucaggcgugagcgaguuggug

SEQ ID NO: 1333893 - RNA, 19 nt, Human
aaccucaccgagagcccaa

SEQ ID NO: 1333894 - RNA, 21 nt, Human
agaagaggagagagagaggcc

SEQ ID NO: 1333895 - RNA, 21 nt, Human
agaggccagagccuggggaug

SEQ ID NO: 1333896 - RNA, 25 nt, Human
agccaggugcucugcauggcaaggu

SEQ ID NO: 1333897 - RNA, 21 nt, Human
agcccaaacucucaccuacag

SEQ ID NO: 1333898 - RNA, 22 nt, Human
aucugucuuuaucgccuccccc

SEQ ID NO: 1333899 - RNA, 19 nt, Human
cacccccuggcccauaagc

SEQ ID NO: 1333900 - RNA, 20 nt, Human
cagggaccacaagccagcac

SEQ ID NO: 1333901 - RNA, 18 nt, Human
ccagcacagaggcgaccu

SEQ ID NO: 1333902 - RNA, 20 nt, Human
cccaacccuuccacucugcu

SEQ ID NO: 1333903 - RNA, 20 nt, Human
ccccaacccuuccacucugc

SEQ ID NO: 1333904 - RNA, 21 nt, Human
cccccaacccuuccacucugc

SEQ ID NO: 1333905 - RNA, 23 nt, Human
ccugcagccgggucagagugagc

SEQ ID NO: 1333906 - RNA, 23 nt, Human
ccuggcccauaagccuuuuccuu

SEQ ID NO: 1333907 - RNA, 21 nt, Human
cucccucccacccccuggccc

SEQ ID NO: 1333908 - RNA, 20 nt, Human
cuggcccauaagccuuuucc

SEQ ID NO: 1333909 - RNA, 21 nt, Human
cuguuccugcuucucuuuuca

SEQ ID NO: 1333910 - RNA, 23 nt, Human
gaaagaaaaaugguaauacggaa

SEQ ID NO: 1333911 - RNA, 19 nt, Human
gagagagagaggccagagc

SEQ ID NO: 1333912 - RNA, 24 nt, Human
gccagcacagaggcgaccuccucc

SEQ ID NO: 1333913 - RNA, 22 nt, Human
gccuuuuccuucucccaaccuc

SEQ ID NO: 1333914 - RNA, 25 nt, Human
gcugugcccauucucccucccaccc

SEQ ID NO: 1333915 - RNA, 21 nt, Human
ggcuugggggaagggcagcuc

SEQ ID NO: 1333916 - RNA, 20 nt, Human
gggcuugggggaagggcagc

SEQ ID NO: 1333917 - RNA, 23 nt, Human
gguugcccucaggguccuccuug

SEQ ID NO: 1333918 - RNA, 20 nt, Human
guggaguauuuuacuguucc

SEQ ID NO: 1333919 - RNA, 19 nt, Human
gugguugcccucagggucc

SEQ ID NO: 1333920 - RNA, 20 nt, Human
guuccugcuucucuuuucac

SEQ ID NO: 1333921 - RNA, 21 nt, Human
guucugguccccuugagucuu

SEQ ID NO: 1333922 - RNA, 21 nt, Human
ucccaaccucaccgagagccc

SEQ ID NO: 1333923 - RNA, 21 nt, Human
ucccaaccucaccgagagccc

SEQ ID NO: 1333924 - RNA, 22 nt, Human
ucccaaccucaccgagagccca

SEQ ID NO: 1333925 - RNA, 20 nt, Human
ucccccaacccuuccacucu

SEQ ID NO: 1333926 - RNA, 18 nt, Human
uccgggguuggcuccuuc

SEQ ID NO: 1333927 - RNA, 23 nt, Human
ucucccaaccucaccgagagccc

SEQ ID NO: 1333928 - RNA, 24 nt, Human
ucucccaaccucaccgagagccca

SEQ ID NO: 1333929 - RNA, 21 nt, Human
ucugucuuuaucgccuccccc

SEQ ID NO: 1333930 - RNA, 27 nt, Human
ugaaagaaaaaugguaauacggaaaca

SEQ ID NO: 1333931 - RNA, 19 nt, Human
uggcagaugagaagccagg

SEQ ID NO: 1333932 - RNA, 19 nt, Human
uggcccauaagccuuuucc

SEQ ID NO: 1333933 - RNA, 24 nt, Human
uggcugugcccauucucccuccca

SEQ ID NO: 1333934 - RNA, 18 nt, Human
ugggcuugggggaagggc

SEQ ID NO: 1333935 - RNA, 20 nt, Human
ugucagggaccacaagccag

SEQ ID NO: 1333936 - RNA, 19 nt, Human
ugucuuuaucgccuccccc

SEQ ID NO: 1333937 - RNA, 18 nt, Human
uuccugcagccgggucag

SEQ ID NO: 1333938 - RNA, 22 nt, Human
uuccugcagccgggucagagug

SEQ ID NO: 1333939 - RNA, 19 nt, Human
uugcccucaggguccuccu

SEQ ID NO: 1333940 - RNA, 19 nt, Human
uugggggaagggcagcucc

SEQ ID NO: 1333941 - RNA, 19 nt, Human
uuuacuguuccugcuucuc

SEQ ID NO: 1333942 - RNA, 19 nt, Human
aaccucaccgagagcccaa

SEQ ID NO: 1333943 - RNA, 21 nt, Human
agaagaggagagagagaggcc

SEQ ID NO: 1333944 - RNA, 21 nt, Human
agaggccagagccuggggaug

SEQ ID NO: 1333945 - RNA, 25 nt, Human
agccaggugcucugcauggcaaggu

SEQ ID NO: 1333946 - RNA, 21 nt, Human
agcccaaacucucaccuacag

SEQ ID NO: 1333947 - RNA, 23 nt, Human
agccuuuuccuucucccaaccuc

SEQ ID NO: 1333948 - RNA, 19 nt, Human
cacccccuggcccauaagc

SEQ ID NO: 1333949 - RNA, 25 nt, Human
cccugcgugucucaguuucucuccu

SEQ ID NO: 1333950 - RNA, 23 nt, Human
ccugcagccgggucagagugagc

SEQ ID NO: 1333951 - RNA, 23 nt, Human
ccuggcccauaagccuuuuccuu

SEQ ID NO: 1333952 - RNA, 21 nt, Human
cucccucccacccccuggccc

SEQ ID NO: 1333953 - RNA, 20 nt, Human
cuggcccauaagccuuuucc

SEQ ID NO: 1333954 - RNA, 19 nt, Human
gagagagagaggccagagc

SEQ ID NO: 1333955 - RNA, 23 nt, Human
gguugcccucaggguccuccuug

SEQ ID NO: 1333956 - RNA, 19 nt, Human
gugguugcccucagggucc

SEQ ID NO: 1333957 - RNA, 21 nt, Human
guucugguccccuugagucuu

SEQ ID NO: 1333958 - RNA, 21 nt, Human
ucccaaccucaccgagagccc

SEQ ID NO: 1333959 - RNA, 21 nt, Human
ucccaaccucaccgagagccc

SEQ ID NO: 1333960 - RNA, 22 nt, Human
ucccaaccucaccgagagccca

SEQ ID NO: 1333961 - RNA, 18 nt, Human
uccgggguuggcuccuuc

SEQ ID NO: 1333962 - RNA, 23 nt, Human
ucucccaaccucaccgagagccc

SEQ ID NO: 1333963 - RNA, 24 nt, Human
ucucccaaccucaccgagagccca

SEQ ID NO: 1333964 - RNA, 19 nt, Human
uggcagaugagaagccagg

SEQ ID NO: 1333965 - RNA, 19 nt, Human
uggcccauaagccuuuucc

SEQ ID NO: 1333966 - RNA, 24 nt, Human
ugguugcccucaggguccuccuug

SEQ ID NO: 1333967 - RNA, 21 nt, Human
ugucagggaccacaagcccug

SEQ ID NO: 1333968 - RNA, 22 nt, Human
uuccugcagccgggucagagug

SEQ ID NO: 1333969 - RNA, 19 nt, Human
uugcccucaggguccuccu

SEQ ID NO: 1333970 - RNA, 20 nt, Human
aaaggaacaggaaggggguu

SEQ ID NO: 1333971 - RNA, 21 nt, Human
aaccucaggccccucaguaac

SEQ ID NO: 1333972 - RNA, 23 nt, Human
aaggcgccgcggaggaacucagg

SEQ ID NO: 1333973 - RNA, 22 nt, Human
acacauucccugcggucuucga

SEQ ID NO: 1333974 - RNA, 19 nt, Human
agaacccgagaccaacuga

SEQ ID NO: 1333975 - RNA, 21 nt, Human
aggggguuccgggacacagga

SEQ ID NO: 1333976 - RNA, 19 nt, Human
aggucagggcccacaaagg

SEQ ID NO: 1333977 - RNA, 20 nt, Human
augaagcucauccuccacug

SEQ ID NO: 1333978 - RNA, 19 nt, Human
cacaggauccggcuucucu

SEQ ID NO: 1333979 - RNA, 21 nt, Human
cacuuuaugaagcucauccuc

SEQ ID NO: 1333980 - RNA, 21 nt, Human
cagggcccacaaaggaacagg

SEQ ID NO: 1333981 - RNA, 24 nt, Human
cauucccugcggucuucgagaacu

SEQ ID NO: 1333982 - RNA, 25 nt, Human
cccggcggccagcccaguucucccu

SEQ ID NO: 1333983 - RNA, 21 nt, Human
ccgcgcuucacgcucugauuc

SEQ ID NO: 1333984 - RNA, 18 nt, Human
ccgcggaggaacucaggg

SEQ ID NO: 1333985 - RNA, 23 nt, Human
ccugcggucuucgagaacuuucc

SEQ ID NO: 1333986 - RNA, 20 nt, Human
cgcggaggaacucagggccc

SEQ ID NO: 1333987 - RNA, 23 nt, Human
cgcggaggaacucagggcccacg

SEQ ID NO: 1333988 - RNA, 21 nt, Human
cuagaacccgagaccaacuga

SEQ ID NO: 1333989 - RNA, 19 nt, Human
cucuagaacccgagaccaa

SEQ ID NO: 1333990 - RNA, 19 nt, Human
cuggugguggugcgggccc

SEQ ID NO: 1333991 - RNA, 18 nt, Human
cuucgagaacuuuccuca

SEQ ID NO: 1333992 - RNA, 21 nt, Human
cuuggaguccaggaaggaucc

SEQ ID NO: 1333993 - RNA, 20 nt, Human
gaacccgagaccaacugaua

SEQ ID NO: 1333994 - RNA, 19 nt, Human
gcccaggaaccucaggccc

SEQ ID NO: 1333995 - RNA, 19 nt, Human
ggaggaacucagggcccac

SEQ ID NO: 1333996 - RNA, 20 nt, Human
gugguggugcgggcccagga

SEQ ID NO: 1333997 - RNA, 23 nt, Human
ucagggcgcccacagcccugugc

SEQ ID NO: 1333998 - RNA, 24 nt, Human
uccaggaaggauccuggagaucuc

SEQ ID NO: 1333999 - RNA, 21 nt, Human
ucucgccgcggcuguggaagc

SEQ ID NO: 1334000 - RNA, 21 nt, Human
ucuuggaguccaggaaggauc

SEQ ID NO: 1334001 - RNA, 22 nt, Human
ugacccuggugguggugcgggc

SEQ ID NO: 1334002 - RNA, 21 nt, Human
ugguggugcgggcccaggaac

SEQ ID NO: 1334003 - RNA, 24 nt, Human
ucuugcuuccagcaucagccugga

SEQ ID NO: 1334004 - RNA, 19 nt, Human
aagcaccgggugaaaagag

SEQ ID NO: 1334005 - RNA, 18 nt, Human
agaagcaccgggugaaaa

SEQ ID NO: 1334006 - RNA, 22 nt, Human
agcugcuuugggacgccugggu

SEQ ID NO: 1334007 - RNA, 25 nt, Human
auggcggcccccagcugcuuuggga

SEQ ID NO: 1334008 - RNA, 18 nt, Human
caaaauggcggcccccag

SEQ ID NO: 1334009 - RNA, 19 nt, Human
caccgggugaaaagagcuc

SEQ ID NO: 1334010 - RNA, 20 nt, Human
cagaagugggcugcccugcg

SEQ ID NO: 1334011 - RNA, 24 nt, Human
cgguugggccccaggcaggaaguu

SEQ ID NO: 1334012 - RNA, 21 nt, Human
gacgaugagggaaggcgaaga

SEQ ID NO: 1334013 - RNA, 21 nt, Human
gccccaggcaggaaguuucug

SEQ ID NO: 1334014 - RNA, 22 nt, Human
uacggcaaaauggcggccccca

SEQ ID NO: 1334015 - RNA, 23 nt, Human
ucuugccuuuuugcuccacaugg

SEQ ID NO: 1334016 - RNA, 21 nt, Human
ugccguacggcaaaauggcgg

SEQ ID NO: 1334017 - RNA, 19 nt, Human
ugcuuugggacgccugggu

SEQ ID NO: 1334018 - RNA, 22 nt, Human
ugcuuugggacgccuggguucg

SEQ ID NO: 1334019 - RNA, 24 nt, Human
uggcggagucguagaagcaccggg

SEQ ID NO: 1334020 - RNA, 21 nt, Human
uggucuuggucuugccuuuuu

SEQ ID NO: 1334021 - RNA, 21 nt, Human
uguugugcgcugagggcgcuu

SEQ ID NO: 1334022 - RNA, 24 nt, Human
uuccagcgccaaacaccaggguac

SEQ ID NO: 1334023 - RNA, 20 nt, Human
uuuuugcuccacaugguggu

SEQ ID NO: 1334024 - RNA, 22 nt, Human
aacacaagcucaaucagaccua

SEQ ID NO: 1334025 - RNA, 25 nt, Human
acaacacaagcucaaucagaccuac

SEQ ID NO: 1334026 - RNA, 22 nt, Human
accccacacccagcuccuccag

SEQ ID NO: 1334027 - RNA, 20 nt, Human
aucccaccccacaauaaaaa

SEQ ID NO: 1334028 - RNA, 21 nt, Human
caccacaccaucccggaacaa

SEQ ID NO: 1334029 - RNA, 19 nt, Human
caccccacacccagcuccu

SEQ ID NO: 1334030 - RNA, 21 nt, Human
cagcccaacgcaccccacacc

SEQ ID NO: 1334031 - RNA, 24 nt, Human
cagcccaacgcaccccacacccag

SEQ ID NO: 1334032 - RNA, 20 nt, Human
caggccccccauuucuuucc

SEQ ID NO: 1334033 - RNA, 23 nt, Human
cagggacucucuccccuagaccc

SEQ ID NO: 1334034 - RNA, 21 nt, Human
cauccccucuuccaccacacc

SEQ ID NO: 1334035 - RNA, 20 nt, Human
ccacacccagcuccuccagc

SEQ ID NO: 1334036 - RNA, 23 nt, Human
ccaccacaccaucccggaacaag

SEQ ID NO: 1334037 - RNA, 21 nt, Human
ccaggccccccauuucuuucc

SEQ ID NO: 1334038 - RNA, 21 nt, Human
cccaaacuaggccuccccacc

SEQ ID NO: 1334039 - RNA, 22 nt, Human
cccaacgcaccccacacccagc

SEQ ID NO: 1334040 - RNA, 22 nt, Human
cccaccccacaauaaaaaucug

SEQ ID NO: 1334041 - RNA, 22 nt, Human
ccccacacccagcuccuccagc

SEQ ID NO: 1334042 - RNA, 19 nt, Human
cccccauuucuuucccuca

SEQ ID NO: 1334043 - RNA, 21 nt, Human
cccucuuccaccacaccaucc

SEQ ID NO: 1334044 - RNA, 19 nt, Human
cuccuccagcucgguccuc

SEQ ID NO: 1334045 - RNA, 22 nt, Human
cucuccccuagacccagggcug

SEQ ID NO: 1334046 - RNA, 22 nt, Human
gaacaagugcuccaggauuccc

SEQ ID NO: 1334047 - RNA, 22 nt, Human
gagaaaauggaggggguugagg

SEQ ID NO: 1334048 - RNA, 22 nt, Human
gcccaacgcaccccacacccag

SEQ ID NO: 1334049 - RNA, 19 nt, Human
ggaaguggccgucccuggg

SEQ ID NO: 1334050 - RNA, 28 nt, Human
ggaggggguugagggagucccaggaggg

SEQ ID NO: 1334051 - RNA, 18 nt, Human
ggggcugggaccggggaa

SEQ ID NO: 1334052 - RNA, 22 nt, Human
uaaaaaucugacccaggccccc

SEQ ID NO: 1334053 - RNA, 23 nt, Human
ucaaucagaccuacuugcaccca

SEQ ID NO: 1334054 - RNA, 24 nt, Human
ucaaucagaccuacuugcacccaa

SEQ ID NO: 1334055 - RNA, 23 nt, Human
uccagcucgguccucucccuggc

SEQ ID NO: 1334056 - RNA, 26 nt, Human
uccccaccagcccaacgcaccccacc

SEQ ID NO: 1334057 - RNA, 24 nt, Human
uccccucuuccaccacaccauccc

SEQ ID NO: 1334058 - RNA, 24 nt, Human
ucuccccuagacccagggcugucc

SEQ ID NO: 1334059 - RNA, 18 nt, Human
ugcuccaggauucccugc

SEQ ID NO: 1334060 - RNA, 22 nt, Human
ugcuccaggauucccugcccac

SEQ ID NO: 1334061 - RNA, 20 nt, Human
ugggggaacugggaggggcu

SEQ ID NO: 1334062 - RNA, 23 nt, Human
uguccauuggguagcaaugugga

SEQ ID NO: 1334063 - RNA, 23 nt, Human
uguccuacucaucccaccccaca

SEQ ID NO: 1334064 - RNA, 20 nt, Human
uucccugcccacuggccauu

SEQ ID NO: 1334065 - RNA, 23 nt, Human
aauaacagacauucaaauacauc

SEQ ID NO: 1334066 - RNA, 20 nt, Human
acaaccgggguccccccacc

SEQ ID NO: 1334067 - RNA, 24 nt, Human
acaggaugugagggagugugauag

SEQ ID NO: 1334068 - RNA, 22 nt, Human
agaauuuccaagggaugguaac

SEQ ID NO: 1334069 - RNA, 20 nt, Human
agggagugugauagguggug

SEQ ID NO: 1334070 - RNA, 21 nt, Human
caaauaagcauccacacagga

SEQ ID NO: 1334071 - RNA, 21 nt, Human
caaccgggguccccccacccc

SEQ ID NO: 1334072 - RNA, 23 nt, Human
caaccgggguccccccacccccc

SEQ ID NO: 1334073 - RNA, 21 nt, Human
cacaaccgggguccccccacc

SEQ ID NO: 1334074 - RNA, 20 nt, Human
cacacaggaagaagaauguu

SEQ ID NO: 1334075 - RNA, 23 nt, Human
caccccccaccccgucccucccu

SEQ ID NO: 1334076 - RNA, 25 nt, Human
caguaaucuuuuuccaaacuggccc

SEQ ID NO: 1334077 - RNA, 19 nt, Human
ccaccccgucccucccugc

SEQ ID NO: 1334078 - RNA, 25 nt, Human
ccccaccccccaccccgucccuccc

SEQ ID NO: 1334079 - RNA, 18 nt, Human
ccccaccccgucccuccc

SEQ ID NO: 1334080 - RNA, 19 nt, Human
ccccaccccgucccucccu

SEQ ID NO: 1334081 - RNA, 20 nt, Human
ccccaccccgucccucccug

SEQ ID NO: 1334082 - RNA, 24 nt, Human
ccccaccccgucccucccugcaaa

SEQ ID NO: 1334083 - RNA, 22 nt, Human
cccccaccccccaccccguccc

SEQ ID NO: 1334084 - RNA, 19 nt, Human
cccccaccccgucccuccc

SEQ ID NO: 1334085 - RNA, 22 nt, Human
cgccuucgcuucaguuuggaaa

SEQ ID NO: 1334086 - RNA, 19 nt, Human
gaaacguccagauuacgca

SEQ ID NO: 1334087 - RNA, 20 nt, Human
gccuaguuuuccugagucca

SEQ ID NO: 1334088 - RNA, 22 nt, Human
gggguccccccaccccccaccc

SEQ ID NO: 1334089 - RNA, 18 nt, Human
uacauguagaggcauccu

SEQ ID NO: 1334090 - RNA, 24 nt, Human
uagguggugcaugagacuccuucu

SEQ ID NO: 1334091 - RNA, 20 nt, Human
uccaaagucagaaacaggau

SEQ ID NO: 1334092 - RNA, 19 nt, Human
uccacacaggaagaagaau

SEQ ID NO: 1334093 - RNA, 19 nt, Human
uccccccaccccccacccc

SEQ ID NO: 1334094 - RNA, 18 nt, Human
ugagggagugugauaggu

SEQ ID NO: 1334095 - RNA, 22 nt, Human
ugagggagugugauagguggug

SEQ ID NO: 1334096 - RNA, 22 nt, Human
ugaguccauuccaaagucagaa

SEQ ID NO: 1334097 - RNA, 20 nt, Human
ugcuucaguucuaaaaagaa

SEQ ID NO: 1334098 - RNA, 19 nt, Human
uuaaagaggggccuaguuu

SEQ ID NO: 1334099 - RNA, 19 nt, Human
agaggggcgcggugcggga

SEQ ID NO: 1334100 - RNA, 22 nt, Human
aggaggagccgggccauucgaa

SEQ ID NO: 1334101 - RNA, 21 nt, Human
cccacgcggagagggcagccg

SEQ ID NO: 1334102 - RNA, 18 nt, Human
gcgcggugcgggaggcgg

SEQ ID NO: 1334103 - RNA, 18 nt, Human
gcggagagggcagccgga

SEQ ID NO: 1334104 - RNA, 23 nt, Human
ggcgcggugcgggaggcgggggu

SEQ ID NO: 1334105 - RNA, 26 nt, Human
ggugacaggaggagccgggccauucg

SEQ ID NO: 1334106 - RNA, 22 nt, Human
ggugagugaacaguuuugguca

SEQ ID NO: 1334107 - RNA, 21 nt, Human
gugcgggaggcggggguaggg

SEQ ID NO: 1334108 - RNA, 20 nt, Human
uagucccuuccacggugagu

SEQ ID NO: 1334109 - RNA, 20 nt, Human
ucagcaccugcgcggccaaa

SEQ ID NO: 1334110 - RNA, 20 nt, Human
ugacaggaggagccgggcca

SEQ ID NO: 1334111 - RNA, 23 nt, Human
ugagugaacaguuuuggucagaa

SEQ ID NO: 1334112 - RNA, 20 nt, Human
uggcuacugaaugcugcccu

SEQ ID NO: 1334113 - RNA, 18 nt, Human
uggugacaggaggagccg

SEQ ID NO: 1334114 - RNA, 23 nt, Human
aaagggagcuggauuuagaccuc

SEQ ID NO: 1334115 - RNA, 18 nt, Human
aaccuguuccuucuccca

SEQ ID NO: 1334116 - RNA, 25 nt, Human
acaaacuccaaaagggagggaacgc

SEQ ID NO: 1334117 - RNA, 23 nt, Human
agaauggcacaaacuccaaaagg

SEQ ID NO: 1334118 - RNA, 19 nt, Human
agggagcuggauuuagacc

SEQ ID NO: 1334119 - RNA, 21 nt, Human
caaacuccaaaagggagcugg

SEQ ID NO: 1334120 - RNA, 19 nt, Human
ccagaagcuccuggaauga

SEQ ID NO: 1334121 - RNA, 22 nt, Human
cuccucugaauuuugcaaccug

SEQ ID NO: 1334122 - RNA, 18 nt, Human
gcugcugcucaaaucgga

SEQ ID NO: 1334123 - RNA, 23 nt, Human
uccaaaagggagcuggauuuaga

SEQ ID NO: 1334124 - RNA, 21 nt, Human
uccccauguagauaacgggau

SEQ ID NO: 1334125 - RNA, 22 nt, Human
uccuggaaugagcaggucuggc

SEQ ID NO: 1334126 - RNA, 19 nt, Human
uggaaugagcaggucuggc

SEQ ID NO: 1334127 - RNA, 21 nt, Human
uggcacaaacuccaaaaggga

SEQ ID NO: 1334128 - RNA, 19 nt, Human
uguuccuucucccagaagc

SEQ ID NO: 1334129 - RNA, 21 nt, Human
aaaugggguccuuuguccauu

SEQ ID NO: 1334130 - RNA, 19 nt, Human
acaagaguagcgcuggcug

SEQ ID NO: 1334131 - RNA, 22 nt, Human
acaccccagacucaucucccuc

SEQ ID NO: 1334132 - RNA, 18 nt, Human
acagagccacagccacac

SEQ ID NO: 1334133 - RNA, 19 nt, Human
agaguccuucuggggcuuc

SEQ ID NO: 1334134 - RNA, 20 nt, Human
aggcucugcugggaauggug

SEQ ID NO: 1334135 - RNA, 19 nt, Human
aggcucugcuggggauagu

SEQ ID NO: 1334136 - RNA, 19 nt, Human
aggcucugcuggggauggu

SEQ ID NO: 1334137 - RNA, 19 nt, Human
aggcucugcuggggauggu

SEQ ID NO: 1334138 - RNA, 19 nt, Human
aggcucugcuggggauggu

SEQ ID NO: 1334139 - RNA, 18 nt, Human
agucuuuucuccauguuc

SEQ ID NO: 1334140 - RNA, 21 nt, Human
aguuuuuucugacucuucugg

SEQ ID NO: 1334141 - RNA, 21 nt, Human
augauuaucuguagagcuuuu

SEQ ID NO: 1334142 - RNA, 22 nt, Human
caaaugggguccuuuguccauu

SEQ ID NO: 1334143 - RNA, 22 nt, Human
caaaugggguccuuuguccauu

SEQ ID NO: 1334144 - RNA, 22 nt, Human
caaaugggguccuuuuuccauu

SEQ ID NO: 1334145 - RNA, 22 nt, Human
cagcggauucuuuauguguggu

SEQ ID NO: 1334146 - RNA, 25 nt, Human
caguggaguccuuucugcguguucu

SEQ ID NO: 1334147 - RNA, 25 nt, Human
caguggaguccuuucuucguguucu

SEQ ID NO: 1334148 - RNA, 25 nt, Human
cagugggguccuuucuccauguucu

SEQ ID NO: 1334149 - RNA, 25 nt, Human
cagugggguccuuucuccguguucu

SEQ ID NO: 1334150 - RNA, 25 nt, Human
cagugggguccuuucuccguguucu

SEQ ID NO: 1334151 - RNA, 19 nt, Human
cauguucuguagacucugu

SEQ ID NO: 1334152 - RNA, 25 nt, Human
ccaaaggucuuccaguuuuaucuga

SEQ ID NO: 1334153 - RNA, 18 nt, Human
ccaaggccugcaggccca

SEQ ID NO: 1334154 - RNA, 22 nt, Human
ccacaccccagacucaucuccc

SEQ ID NO: 1334155 - RNA, 23 nt, Human
ccacagccacaccccagacucau

SEQ ID NO: 1334156 - RNA, 22 nt, Human
cccuugguugcuggaguuuucu

SEQ ID NO: 1334157 - RNA, 23 nt, Human
ccugcaggcccaggagcagcacc

SEQ ID NO: 1334158 - RNA, 18 nt, Human
ccugccccccaagaagcu

SEQ ID NO: 1334159 - RNA, 19 nt, Human
ccuggagugaggggaaaua

SEQ ID NO: 1334160 - RNA, 20 nt, Human
ccuggagugaggggaaauau

SEQ ID NO: 1334161 - RNA, 20 nt, Human
ccuuucucuauuuucuguag

SEQ ID NO: 1334162 - RNA, 20 nt, Human
ccuuucucuauuuucuguag

SEQ ID NO: 1334163 - RNA, 20 nt, Human
ccuuucucuauuuucuguag

SEQ ID NO: 1334164 - RNA, 20 nt, Human
ccuuucucuauuuucuguag

SEQ ID NO: 1334165 - RNA, 20 nt, Human
ccuuucucuauuuucuguag

SEQ ID NO: 1334166 - RNA, 20 nt, Human
ccuuucucuauuuucuguag

SEQ ID NO: 1334167 - RNA, 20 nt, Human
ccuuucucuauuuucuguag

SEQ ID NO: 1334168 - RNA, 20 nt, Human
ccuuucucuauuuucuguag

SEQ ID NO: 1334169 - RNA, 24 nt, Human
cuauguucuguagacucugcugca

SEQ ID NO: 1334170 - RNA, 20 nt, Human
cucauuggccaguggagucc

SEQ ID NO: 1334171 - RNA, 20 nt, Human
cucugcugggaauagugugg

SEQ ID NO: 1334172 - RNA, 20 nt, Human
cucugcugggaauggugugg

SEQ ID NO: 1334173 - RNA, 25 nt, Human
cugcuggggauagugugguguucuc

SEQ ID NO: 1334174 - RNA, 25 nt, Human
cugcuggggauagugugguguucuc

SEQ ID NO: 1334175 - RNA, 25 nt, Human
cugcuggggauagugugguguucuc

SEQ ID NO: 1334176 - RNA, 25 nt, Human
cugcuggggaugaugugguguucuc

SEQ ID NO: 1334177 - RNA, 25 nt, Human
cugcuggggauggugugguguucuc

SEQ ID NO: 1334178 - RNA, 25 nt, Human
cugcuggggauggugugguguucuc

SEQ ID NO: 1334179 - RNA, 20 nt, Human
cuggaaaagaugugcuuuuu

SEQ ID NO: 1334180 - RNA, 21 nt, Human
cuggcaggccuucuugauacc

SEQ ID NO: 1334181 - RNA, 19 nt, Human
cuucucauuggccaaugga

SEQ ID NO: 1334182 - RNA, 23 nt, Human
cuucucauuggccaauggagucc

SEQ ID NO: 1334183 - RNA, 20 nt, Human
cuuuaugugugguaguggag

SEQ ID NO: 1334184 - RNA, 21 nt, Human
gacucaucucccuccggaacu

SEQ ID NO: 1334185 - RNA, 21 nt, Human
gacugucguuucuccauguuc

SEQ ID NO: 1334186 - RNA, 20 nt, Human
gagccacagccacaccccag

SEQ ID NO: 1334187 - RNA, 22 nt, Human
gaguccuuucugcguguucugu

SEQ ID NO: 1334188 - RNA, 25 nt, Human
gccacagccacaccccagacucauc

SEQ ID NO: 1334189 - RNA, 21 nt, Human
gccuguaggcuugucaguugg

SEQ ID NO: 1334190 - RNA, 20 nt, Human
gcguguucuguaggcucugc

SEQ ID NO: 1334191 - RNA, 21 nt, Human
gcucugcugggaauggugugg

SEQ ID NO: 1334192 - RNA, 20 nt, Human
gggaauggugcgguguucuc

SEQ ID NO: 1334193 - RNA, 23 nt, Human
gggaauggugcgguguucucauu

SEQ ID NO: 1334194 - RNA, 23 nt, Human
gguguucucauuggccaguggag

SEQ ID NO: 1334195 - RNA, 23 nt, Human
gguguucucauuggccaguggag

SEQ ID NO: 1334196 - RNA, 20 nt, Human
guccuuuuuccauuuucugu

SEQ ID NO: 1334197 - RNA, 25 nt, Human
gugcuggggauggugugguguucuc

SEQ ID NO: 1334198 - RNA, 24 nt, Human
guggagucagcaggaucaacagag

SEQ ID NO: 1334199 - RNA, 22 nt, Human
uaaaugggguccuuucuccauu

SEQ ID NO: 1334200 - RNA, 24 nt, Human
uccauuuucuguaggcucugcuag

SEQ ID NO: 1334201 - RNA, 24 nt, Human
uccauuuucuguaggcucugcuag

SEQ ID NO: 1334202 - RNA, 24 nt, Human
uccauuuucuguaggcucugcuga

SEQ ID NO: 1334203 - RNA, 24 nt, Human
uccauuuucuguaggcucugcugg

SEQ ID NO: 1334204 - RNA, 24 nt, Human
uccauuuucuguaggcucugcugg

SEQ ID NO: 1334205 - RNA, 24 nt, Human
uccauuuucuguaggcucugcugg

SEQ ID NO: 1334206 - RNA, 24 nt, Human
uccauuuucuguaggcucugcugg

SEQ ID NO: 1334207 - RNA, 24 nt, Human
uccauuuucuguaggcugugcugg

SEQ ID NO: 1334208 - RNA, 21 nt, Human
uccccaguuuucugauauucu

SEQ ID NO: 1334209 - RNA, 18 nt, Human
uccggaacuggcaggccu

SEQ ID NO: 1334210 - RNA, 24 nt, Human
ucuauuuucuguaggcccugcugg

SEQ ID NO: 1334211 - RNA, 24 nt, Human
ucuauuuucuguaggcccugcugg

SEQ ID NO: 1334212 - RNA, 22 nt, Human
ucuauuuucuguaggcucugcc

SEQ ID NO: 1334213 - RNA, 24 nt, Human
ucuauuuucuguaggcucugcugg

SEQ ID NO: 1334214 - RNA, 24 nt, Human
ucuauuuucuguaggcucugcugg

SEQ ID NO: 1334215 - RNA, 24 nt, Human
ucuauuuucuguaggcucugcugg

SEQ ID NO: 1334216 - RNA, 24 nt, Human
ucuauuuucuguaggcucugcugg

SEQ ID NO: 1334217 - RNA, 24 nt, Human
ucuauuuucuguaggcucugcugg

SEQ ID NO: 1334218 - RNA, 24 nt, Human
ucuauuuucuguaggcucugcugg

SEQ ID NO: 1334219 - RNA, 24 nt, Human
ucuauuuucuguaggcucugcugg

SEQ ID NO: 1334220 - RNA, 24 nt, Human
ucuauuuucuguaggcucugcugg

SEQ ID NO: 1334221 - RNA, 24 nt, Human
ucuauuuucuguaggcucugcugg

SEQ ID NO: 1334222 - RNA, 24 nt, Human
ucucauuggccaauguagucuuuu

SEQ ID NO: 1334223 - RNA, 21 nt, Human
ucucauuggccaguggagucc

SEQ ID NO: 1334224 - RNA, 22 nt, Human
ucucauuggcugaugguguccu

SEQ ID NO: 1334225 - RNA, 19 nt, Human
ucuguaggcccugcugggg

SEQ ID NO: 1334226 - RNA, 22 nt, Human
ucuucagaagugggaggagccu

SEQ ID NO: 1334227 - RNA, 20 nt, Human
ucuucucauuggccaauggg

SEQ ID NO: 1334228 - RNA, 24 nt, Human
ugagacagaguccuucuggggcuu

SEQ ID NO: 1334229 - RNA, 19 nt, Human
ugaucucauuggccagugg

SEQ ID NO: 1334230 - RNA, 19 nt, Human
ugauguggucuucucauug

SEQ ID NO: 1334231 - RNA, 19 nt, Human
ugauguggucuucucauug

SEQ ID NO: 1334232 - RNA, 19 nt, Human
ugauguggucuucucauug

SEQ ID NO: 1334233 - RNA, 19 nt, Human
ugaugugguuuucucauug

SEQ ID NO: 1334234 - RNA, 19 nt, Human
ugaugugguuuucucauug

SEQ ID NO: 1334235 - RNA, 25 nt, Human
ugcagaacaaugugaucaaaaggga

SEQ ID NO: 1334236 - RNA, 27 nt, Human
ugcugaggaugauguggucgagccccu

SEQ ID NO: 1334237 - RNA, 27 nt, Human
ugcugaggaugauguggucgagccccu

SEQ ID NO: 1334238 - RNA, 27 nt, Human
ugcugaggaugauguggucgagccccu

SEQ ID NO: 1334239 - RNA, 27 nt, Human
ugcugaggaugauguggucgagccccu

SEQ ID NO: 1334240 - RNA, 26 nt, Human
ugcugaggaugauguggucgagcccu

SEQ ID NO: 1334241 - RNA, 26 nt, Human
ugcugaggaugauguggucgagcccu

SEQ ID NO: 1334242 - RNA, 27 nt, Human
ugcuggggaugauguggucgagccccu

SEQ ID NO: 1334243 - RNA, 27 nt, Human
ugcuggggaugauguggucgagccccu

SEQ ID NO: 1334244 - RNA, 26 nt, Human
ugcuggggaugauguggucgagcccu

SEQ ID NO: 1334245 - RNA, 24 nt, Human
ugcuggggaugauguggucuucuc

SEQ ID NO: 1334246 - RNA, 20 nt, Human
ugcuggggaugguguggccu

SEQ ID NO: 1334247 - RNA, 24 nt, Human
ugcuggggaugguguggucuucuc

SEQ ID NO: 1334248 - RNA, 24 nt, Human
ugcuggggaugguguggucuucuc

SEQ ID NO: 1334249 - RNA, 24 nt, Human
ugcuggggaugguguggucuucuc

SEQ ID NO: 1334250 - RNA, 23 nt, Human
ugcuuggucugugaauugccuga

SEQ ID NO: 1334251 - RNA, 19 nt, Human
uggaaggaaguuguagucu

SEQ ID NO: 1334252 - RNA, 19 nt, Human
uggaauguaguagcaccug

SEQ ID NO: 1334253 - RNA, 25 nt, Human
uggccaaaggaguccugucuccauu

SEQ ID NO: 1334254 - RNA, 22 nt, Human
uggccaauggggucauuucuuc

SEQ ID NO: 1334255 - RNA, 22 nt, Human
uggcguuauauguuuuuuucca

SEQ ID NO: 1334256 - RNA, 19 nt, Human
ugguguggccuucucauug

SEQ ID NO: 1334257 - RNA, 19 nt, Human
ugguguggucuucucauug

SEQ ID NO: 1334258 - RNA, 19 nt, Human
ugguguggucuucucauug

SEQ ID NO: 1334259 - RNA, 19 nt, Human
ugguguggucuucucauug

SEQ ID NO: 1334260 - RNA, 19 nt, Human
ugguguggucuucucauug

SEQ ID NO: 1334261 - RNA, 19 nt, Human
ugguguggucuucucauug

SEQ ID NO: 1334262 - RNA, 19 nt, Human
ugguguggucuucucauug

SEQ ID NO: 1334263 - RNA, 19 nt, Human
ugguguggucuucucauug

SEQ ID NO: 1334264 - RNA, 23 nt, Human
uguaguuuuugucaggagcuugu

SEQ ID NO: 1334265 - RNA, 24 nt, Human
uguuggggauguugugguguucuc

SEQ ID NO: 1334266 - RNA, 25 nt, Human
uuacuggggauggugugguguucuc

SEQ ID NO: 1334267 - RNA, 23 nt, Human
uuccccaguuuucugauauucuu

SEQ ID NO: 1334268 - RNA, 24 nt, Human
uucuccauguucuguaggcuuuac

SEQ ID NO: 1334269 - RNA, 22 nt, Human
uugcuggagaugguauggucuu

SEQ ID NO: 1334270 - RNA, 23 nt, Human
uuggcugauggggucauuucuuc

SEQ ID NO: 1334271 - RNA, 22 nt, Human
uuucuuguuaccguugauuugc

SEQ ID NO: 1334272 - RNA, 20 nt, Human
uuugcuggggaugguguggc

SEQ ID NO: 1334273 - RNA, 19 nt, Human
uuuugcucuugggugcugg

SEQ ID NO: 1334274 - RNA, 24 nt, Human
aaaaaaagcauaugaagcagauaa

SEQ ID NO: 1334275 - RNA, 24 nt, Human
aaaaaccuaauuguauuucaaagc

SEQ ID NO: 1334276 - RNA, 23 nt, Human
aaaaagacaaaaugagcuguuaa

SEQ ID NO: 1334277 - RNA, 26 nt, Human
aaaaagacaaaaugagcuguuaagug

SEQ ID NO: 1334278 - RNA, 24 nt, Human
aaaccagaauucuuguagaaaaua

SEQ ID NO: 1334279 - RNA, 25 nt, Human
aaaccuacagccaaaguuucuucca

SEQ ID NO: 1334280 - RNA, 18 nt, Human
aaauaaaaaccuacagcc

SEQ ID NO: 1334281 - RNA, 19 nt, Human
aagagaaaacauguccuaa

SEQ ID NO: 1334282 - RNA, 18 nt, Human
aaucaccuaagacauuug

SEQ ID NO: 1334283 - RNA, 19 nt, Human
acacacuuaaguacaacug

SEQ ID NO: 1334284 - RNA, 19 nt, Human
acacugaaauguauuuggu

SEQ ID NO: 1334285 - RNA, 19 nt, Human
acauacaauuguaagugcu

SEQ ID NO: 1334286 - RNA, 21 nt, Human
acccagugcuaaaccuuacag

SEQ ID NO: 1334287 - RNA, 22 nt, Human
agaaacuuuguuguauauaugg

SEQ ID NO: 1334288 - RNA, 20 nt, Human
agaaccuguuaaaaacagac

SEQ ID NO: 1334289 - RNA, 22 nt, Human
agacaaaaugagcuguuaagug

SEQ ID NO: 1334290 - RNA, 24 nt, Human
agagaaaaugugucccuauggagg

SEQ ID NO: 1334291 - RNA, 21 nt, Human
agcaaaguacaaagacuaaug

SEQ ID NO: 1334292 - RNA, 24 nt, Human
agcuuuugggaauguaagcaaagu

SEQ ID NO: 1334293 - RNA, 20 nt, Human
aggugauuuauaacuuaaaa

SEQ ID NO: 1334294 - RNA, 18 nt, Human
auaaaauguaccugcuua

SEQ ID NO: 1334295 - RNA, 25 nt, Human
auaaaguguucagaaaggccauuuu

SEQ ID NO: 1334296 - RNA, 23 nt, Human
auagaaccuguuaaaaacagacu

SEQ ID NO: 1334297 - RNA, 23 nt, Human
auuuuggagaagaccauuaaugg

SEQ ID NO: 1334298 - RNA, 22 nt, Human
caaaauauuuuggagaagacca

SEQ ID NO: 1334299 - RNA, 24 nt, Human
cacaugaaagaacagcauaacauu

SEQ ID NO: 1334300 - RNA, 23 nt, Human
cagaaaaggagauauuuauuuau

SEQ ID NO: 1334301 - RNA, 19 nt, Human
cagaggauaccccuagaca

SEQ ID NO: 1334302 - RNA, 20 nt, Human
ccaggggccuaagagggaaa

SEQ ID NO: 1334303 - RNA, 19 nt, Human
ccagugcuaaaccuuacag

SEQ ID NO: 1334304 - RNA, 23 nt, Human
ccuacagccaaaguuucuuccag

SEQ ID NO: 1334305 - RNA, 20 nt, Human
cugcuggggcgaucccgggc

SEQ ID NO: 1334306 - RNA, 23 nt, Human
cugguaauaaugaauuauccaag

SEQ ID NO: 1334307 - RNA, 18 nt, Human
cugucuuuuuacuuuguc

SEQ ID NO: 1334308 - RNA, 18 nt, Human
gaaagaacagcauaacau

SEQ ID NO: 1334309 - RNA, 25 nt, Human
gaaagaacagcauaacauuaaucau

SEQ ID NO: 1334310 - RNA, 21 nt, Human
gaaaucacucucugguuauca

SEQ ID NO: 1334311 - RNA, 18 nt, Human
gaauuauccaagucagca

SEQ ID NO: 1334312 - RNA, 19 nt, Human
gcccaauacucauuuauuu

SEQ ID NO: 1334313 - RNA, 21 nt, Human
gguaauaaugaauuauccaag

SEQ ID NO: 1334314 - RNA, 21 nt, Human
guucugcaaguguugcagagg

SEQ ID NO: 1334315 - RNA, 23 nt, Human
uaaaaaaagcauaugaagcagau

SEQ ID NO: 1334316 - RNA, 20 nt, Human
uaaaaaccuacagccaaagu

SEQ ID NO: 1334317 - RNA, 21 nt, Human
uaaaauuacaaacacccucca

SEQ ID NO: 1334318 - RNA, 25 nt, Human
uaaaucaccuaagacauuugcaaaa

SEQ ID NO: 1334319 - RNA, 24 nt, Human
uaacugccgcauuuacaaaaaagu

SEQ ID NO: 1334320 - RNA, 23 nt, Human
uaacuggaaauuaaucaucuccu

SEQ ID NO: 1334321 - RNA, 19 nt, Human
uaagaaucgugaaaauguc

SEQ ID NO: 1334322 - RNA, 24 nt, Human
uaaucaucuccuuugauuuauguu

SEQ ID NO: 1334323 - RNA, 21 nt, Human
uacauuuuauaaaauguaccu

SEQ ID NO: 1334324 - RNA, 20 nt, Human
uaccauaaaauuacaaacac

SEQ ID NO: 1334325 - RNA, 23 nt, Human
uaccauaaaauuacaaacacccu

SEQ ID NO: 1334326 - RNA, 19 nt, Human
uagauggcagaaacuuugu

SEQ ID NO: 1334327 - RNA, 21 nt, Human
uauaucuguacccugcuuuau

SEQ ID NO: 1334328 - RNA, 18 nt, Human
uauuguaguauuuuuaaa

SEQ ID NO: 1334329 - RNA, 23 nt, Human
uccgcguuuccucucuggacucc

SEQ ID NO: 1334330 - RNA, 25 nt, Human
ucucugguuaucauuauugcucauc

SEQ ID NO: 1334331 - RNA, 19 nt, Human
ucuuuuuacuuugucuaua

SEQ ID NO: 1334332 - RNA, 19 nt, Human
ugaaagaacagcauaacau

SEQ ID NO: 1334333 - RNA, 19 nt, Human
ugagggguucuauacccca

SEQ ID NO: 1334334 - RNA, 21 nt, Human
ugcauauguaaauagagaaaa

SEQ ID NO: 1334335 - RNA, 21 nt, Human
ugcggaaucaaugucuuuuaa

SEQ ID NO: 1334336 - RNA, 18 nt, Human
ugcuggggcgaucccggg

SEQ ID NO: 1334337 - RNA, 25 nt, Human
ugguguugcaauuaggcccaauacu

SEQ ID NO: 1334338 - RNA, 19 nt, Human
uguaaaugaaaucacucuc

SEQ ID NO: 1334339 - RNA, 19 nt, Human
uguaacugccgcauuuaca

SEQ ID NO: 1334340 - RNA, 19 nt, Human
uguagaaaauaaaaaccua

SEQ ID NO: 1334341 - RNA, 18 nt, Human
ugugucccuauggaggag

SEQ ID NO: 1334342 - RNA, 22 nt, Human
uguugagggguucuauacccca

SEQ ID NO: 1334343 - RNA, 21 nt, Human
uuaagauggcuguuuauaagu

SEQ ID NO: 1334344 - RNA, 18 nt, Human
uuacuugcacagaaagug

SEQ ID NO: 1334345 - RNA, 21 nt, Human
uucaaaaagcuagauggcaga

SEQ ID NO: 1334346 - RNA, 21 nt, Human
uucaugaugaaguuaaauuac

SEQ ID NO: 1334347 - RNA, 24 nt, Human
uucuuggccaauuaagguaauuga

SEQ ID NO: 1334348 - RNA, 25 nt, Human
uugcucaucaagaauuccagcauug

SEQ ID NO: 1334349 - RNA, 20 nt, Human
uuguauauugaaaaagacaa

SEQ ID NO: 1334350 - RNA, 21 nt, Human
uuuaaaaaccuugccaguagg

SEQ ID NO: 1334351 - RNA, 22 nt, Human
uuuaagauggcuguuuauaagu

SEQ ID NO: 1334352 - RNA, 21 nt, Human
uuuauucaauccaucauuagg

SEQ ID NO: 1334353 - RNA, 23 nt, Human
uuucauuugaggagacauacaau

SEQ ID NO: 1334354 - RNA, 22 nt, Human
uuuguaacugccgcauuuacaa

SEQ ID NO: 1334355 - RNA, 19 nt, Human
aaacgggcgaggaggaaca

SEQ ID NO: 1334356 - RNA, 20 nt, Human
aacaccaucaaaauggaaug

SEQ ID NO: 1334357 - RNA, 20 nt, Human
aagaaaaggcugacaccgca

SEQ ID NO: 1334358 - RNA, 23 nt, Human
aagaaaaggcugacaccgcaaaa

SEQ ID NO: 1334359 - RNA, 25 nt, Human
acaaaugcucugaagaaaaggcuga

SEQ ID NO: 1334360 - RNA, 21 nt, Human
acaccaucaaaauggaaugaa

SEQ ID NO: 1334361 - RNA, 18 nt, Human
agaggagaucuggguccc

SEQ ID NO: 1334362 - RNA, 22 nt, Human
agcccgagggcgaaaaacgggc

SEQ ID NO: 1334363 - RNA, 21 nt, Human
aggaagaugggcagugucaag

SEQ ID NO: 1334364 - RNA, 18 nt, Human
aggaauuacaguccuuca

SEQ ID NO: 1334365 - RNA, 21 nt, Human
agggcgaaaaacgggcgagga

SEQ ID NO: 1334366 - RNA, 20 nt, Human
agucuugcaacacauggucc

SEQ ID NO: 1334367 - RNA, 21 nt, Human
caaacaaaugcucugaagaaa

SEQ ID NO: 1334368 - RNA, 21 nt, Human
caaacacaggaaaggccccga

SEQ ID NO: 1334369 - RNA, 20 nt, Human
cacccguuucuuccaccccg

SEQ ID NO: 1334370 - RNA, 21 nt, Human
ccccaaggccgguaugucacc

SEQ ID NO: 1334371 - RNA, 18 nt, Human
ccccgaaggcacgcguac

SEQ ID NO: 1334372 - RNA, 25 nt, Human
cccuuaaaauucuauuuuaaauagg

SEQ ID NO: 1334373 - RNA, 23 nt, Human
ccucccuggaaaccgcccggccg

SEQ ID NO: 1334374 - RNA, 23 nt, Human
ccugcgaguccacggauugggac

SEQ ID NO: 1334375 - RNA, 22 nt, Human
ccuuugguuuuuaucagucccu

SEQ ID NO: 1334376 - RNA, 25 nt, Human
cgaaggcacgcguaccccaaggccg

SEQ ID NO: 1334377 - RNA, 24 nt, Human
cugaagaaaaggcugacaccgcaa

SEQ ID NO: 1334378 - RNA, 18 nt, Human
cuggaaaccgcccggccg

SEQ ID NO: 1334379 - RNA, 19 nt, Human
cuuccaccccgaccucauc

SEQ ID NO: 1334380 - RNA, 20 nt, Human
gauccuuugguuuuuaucag

SEQ ID NO: 1334381 - RNA, 22 nt, Human
gucccaaacacaggaaaggccc

SEQ ID NO: 1334382 - RNA, 19 nt, Human
uagcaaugccuccagaucc

SEQ ID NO: 1334383 - RNA, 22 nt, Human
ucaaaaaaagggaaucacccgu

SEQ ID NO: 1334384 - RNA, 22 nt, Human
ucacccggaagggugacggcag

SEQ ID NO: 1334385 - RNA, 25 nt, Human
ucacccggaagggugacggcagccu

SEQ ID NO: 1334386 - RNA, 21 nt, Human
ucagucaaacaaaugcucuga

SEQ ID NO: 1334387 - RNA, 25 nt, Human
ucagucaaacaaaugcucugaagaa

SEQ ID NO: 1334388 - RNA, 22 nt, Human
uccuucuggaugaggaagaugg

SEQ ID NO: 1334389 - RNA, 24 nt, Human
ucuuccaccccgaccucauccauu

SEQ ID NO: 1334390 - RNA, 22 nt, Human
ugaauguuauucucuccagacu

SEQ ID NO: 1334391 - RNA, 18 nt, Human
ugacaccgcaaaacaacu

SEQ ID NO: 1334392 - RNA, 21 nt, Human
uguaaagucugcuagacgugg

SEQ ID NO: 1334393 - RNA, 18 nt, Human
uuaaauaacaccaucaaa

SEQ ID NO: 1334394 - RNA, 20 nt, Human
uucaaaaaaagggaaucacc

SEQ ID NO: 1334395 - RNA, 23 nt, Human
uugaugauuguucccuuaaaauu

SEQ ID NO: 1334396 - RNA, 21 nt, Human
uuuuuuuuuuuuuaaagauca

SEQ ID NO: 1334397 - RNA, 24 nt, Human
uuuuuuuuuuuuuuuuuuuuaaag

SEQ ID NO: 1334398 - RNA, 27 nt, Human
aacucgcugggccgcacgucccccucu

SEQ ID NO: 1334399 - RNA, 27 nt, Human
acugcauuuuaacauaccuggcuaacc

SEQ ID NO: 1334400 - RNA, 19 nt, Human
aggaggaaguccuguaagu

SEQ ID NO: 1334401 - RNA, 22 nt, Human
auacugcauuuuaacauacaua

SEQ ID NO: 1334402 - RNA, 24 nt, Human
cauuaaugaggcuccucaacuuaa

SEQ ID NO: 1334403 - RNA, 23 nt, Human
cccguagcgggugaccccgggac

SEQ ID NO: 1334404 - RNA, 18 nt, Human
cuaguagacugggaacua

SEQ ID NO: 1334405 - RNA, 22 nt, Human
cugggccgcacgucccccucgu

SEQ ID NO: 1334406 - RNA, 24 nt, Human
gggaacuauuccauaaggaggaag

SEQ ID NO: 1334407 - RNA, 24 nt, Human
uaaauccccacuggagaaagcaau

SEQ ID NO: 1334408 - RNA, 20 nt, Human
uaaugaggcuccucaacuuu

SEQ ID NO: 1334409 - RNA, 24 nt, Human
uacuugagcuaguagacugggaac

SEQ ID NO: 1334410 - RNA, 22 nt, Human
ucauuuauucauauauauauuc

SEQ ID NO: 1334411 - RNA, 19 nt, Human
uccauaaggaggaaguccu

SEQ ID NO: 1334412 - RNA, 19 nt, Human
ugacaaagccauuuuucuu

SEQ ID NO: 1334413 - RNA, 23 nt, Human
uggcauuuaaaaauauauucauu

SEQ ID NO: 1334414 - RNA, 22 nt, Human
ugucagaggauaucugaggcug

SEQ ID NO: 1334415 - RNA, 21 nt, Human
uucauuuauucauauauauau

SEQ ID NO: 1334416 - RNA, 22 nt, Human
uugggcagaauuauucuccuga

SEQ ID NO: 1334417 - RNA, 26 nt, Human
uuugggcagaauuauucuccugaaaa

SEQ ID NO: 1334418 - RNA, 23 nt, Human
uuuuuuuuuuuuuuuuuggcauu

SEQ ID NO: 1334419 - RNA, 20 nt, Human
uuuuuuuuuuuuuuuuuugg

SEQ ID NO: 1334420 - RNA, 24 nt, Human
agucaggaaaggaaaaucaauguu

SEQ ID NO: 1334421 - RNA, 21 nt, Human
caacuuccggaagcgauggcc

SEQ ID NO: 1334422 - RNA, 21 nt, Human
ccggaagcgauggccaauccc

SEQ ID NO: 1334423 - RNA, 20 nt, Human
uagucaggaaaggaaaaucc

SEQ ID NO: 1334424 - RNA, 22 nt, Human
uuauagucaggaaaggaaaauc

SEQ ID NO: 1334425 - RNA, 24 nt, Human
aaaacaccuuacaaauccacaggg

SEQ ID NO: 1334426 - RNA, 21 nt, Human
aaaagcccagagacgcgggcg

SEQ ID NO: 1334427 - RNA, 23 nt, Human
aaagcacacuaaagguucuaggg

SEQ ID NO: 1334428 - RNA, 18 nt, Human
aaagguucuaggggcuac

SEQ ID NO: 1334429 - RNA, 21 nt, Human
aacaaacgaagacaccaaaac

SEQ ID NO: 1334430 - RNA, 21 nt, Human
aagccaccuugcaaagcaggu

SEQ ID NO: 1334431 - RNA, 20 nt, Human
aagcccagagacgcgggcga

SEQ ID NO: 1334432 - RNA, 21 nt, Human
acaaacgaagacaccaaaacg

SEQ ID NO: 1334433 - RNA, 18 nt, Human
acagagcaaaagcccaga

SEQ ID NO: 1334434 - RNA, 19 nt, Human
acagagcaaaagcccagag

SEQ ID NO: 1334435 - RNA, 24 nt, Human
acuaaccacuaguuguccugccau

SEQ ID NO: 1334436 - RNA, 24 nt, Human
acuccgcuacucucacuacaucuu

SEQ ID NO: 1334437 - RNA, 22 nt, Human
agccugacagagcaaaagccca

SEQ ID NO: 1334438 - RNA, 23 nt, Human
agccugacagagcaaaagcccag

SEQ ID NO: 1334439 - RNA, 24 nt, Human
augguagcuuucccaaaugaacac

SEQ ID NO: 1334440 - RNA, 21 nt, Human
caaaacgccaccagccugaca

SEQ ID NO: 1334441 - RNA, 22 nt, Human
caaauccacagggaaaucaaag

SEQ ID NO: 1334442 - RNA, 23 nt, Human
caaauccacagggaaaucaaaga

SEQ ID NO: 1334443 - RNA, 22 nt, Human
cacagggaaaucaaagaacaau

SEQ ID NO: 1334444 - RNA, 18 nt, Human
cagagcaaaagcccagag

SEQ ID NO: 1334445 - RNA, 20 nt, Human
cagagcaaaagcccagagac

SEQ ID NO: 1334446 - RNA, 25 nt, Human
cagguaauacaguuauuuccugucc

SEQ ID NO: 1334447 - RNA, 22 nt, Human
cauguuuguucuaaagucaaga

SEQ ID NO: 1334448 - RNA, 23 nt, Human
cauguuuguucuaaagucaagag

SEQ ID NO: 1334449 - RNA, 21 nt, Human
cccaccccuaccccaugcccc

SEQ ID NO: 1334450 - RNA, 22 nt, Human
cccaccccuaccccaugcccca

SEQ ID NO: 1334451 - RNA, 21 nt, Human
ccccaugccccagugccuuau

SEQ ID NO: 1334452 - RNA, 21 nt, Human
cgaagacaccaaaacgccacc

SEQ ID NO: 1334453 - RNA, 23 nt, Human
cuguccugcagaauucaagaacc

SEQ ID NO: 1334454 - RNA, 27 nt, Human
cuuagaauucaguauacuugguggccc

SEQ ID NO: 1334455 - RNA, 25 nt, Human
gaaaaacaccuuacaaauccacagg

SEQ ID NO: 1334456 - RNA, 22 nt, Human
gaacagcuagccuuagaauuca

SEQ ID NO: 1334457 - RNA, 23 nt, Human
gaagacaccaaaacgcuggagac

SEQ ID NO: 1334458 - RNA, 22 nt, Human
gcaaaagcccagagacgcgggc

SEQ ID NO: 1334459 - RNA, 23 nt, Human
guaaaaaagaaaaacaccuuaca

SEQ ID NO: 1334460 - RNA, 22 nt, Human
guagcuuucccaaaugaacacu

SEQ ID NO: 1334461 - RNA, 19 nt, Human
guuuucauuuuuuuugucu

SEQ ID NO: 1334462 - RNA, 19 nt, Human
uaacuaaccacuaguuguc

SEQ ID NO: 1334463 - RNA, 19 nt, Human
ucaaugguagcuuucccaa

SEQ ID NO: 1334464 - RNA, 19 nt, Human
ucagguuuaacagaaauag

SEQ ID NO: 1334465 - RNA, 23 nt, Human
uccuguccugcagaauucaagaa

SEQ ID NO: 1334466 - RNA, 22 nt, Human
ugacagagcaaaagcccagaga

SEQ ID NO: 1334467 - RNA, 22 nt, Human
ugcccuacuauaugucaggaac

SEQ ID NO: 1334468 - RNA, 21 nt, Human
ugguuugugguaccucccaaa

SEQ ID NO: 1334469 - RNA, 23 nt, Human
uguuuguucuaaagucaagaguc

SEQ ID NO: 1334470 - RNA, 21 nt, Human
uucagugauucuuaaagccac

SEQ ID NO: 1334471 - RNA, 22 nt, Human
uuccuguccuaugauuuaaaga

SEQ ID NO: 1334472 - RNA, 21 nt, Human
uuguucuaaagucaagagucc

SEQ ID NO: 1334473 - RNA, 22 nt, Human
ggauguucuuuuucaucaacgu

SEQ ID NO: 1334474 - RNA, 22 nt, Human
accagcuccccaaccacccggc

SEQ ID NO: 1334475 - RNA, 21 nt, Human
cagguguccucucagccgagg

SEQ ID NO: 1334476 - RNA, 18 nt, Human
ccagcuccccaaccaccc

SEQ ID NO: 1334477 - RNA, 21 nt, Human
cccuggagaccagcuccccaa

SEQ ID NO: 1334478 - RNA, 20 nt, Human
cgugagccgugucgggagcg

SEQ ID NO: 1334479 - RNA, 19 nt, Human
cucccgacucacucccugg

SEQ ID NO: 1334480 - RNA, 21 nt, Human
gagaccagcuccccaaccacc

SEQ ID NO: 1334481 - RNA, 19 nt, Human
gcggccagguguccucuca

SEQ ID NO: 1334482 - RNA, 22 nt, Human
ggcaucccgcugcggccaggug

SEQ ID NO: 1334483 - RNA, 19 nt, Human
gggcucccgacucacuccc

SEQ ID NO: 1334484 - RNA, 19 nt, Human
uaucccagccaccgccucc

SEQ ID NO: 1334485 - RNA, 19 nt, Human
ucccuggagaccagcuccc

SEQ ID NO: 1334486 - RNA, 20 nt, Human
ucccuggagaccagcucccc

SEQ ID NO: 1334487 - RNA, 26 nt, Human
ucccuggagaccagcuccccaaccac

SEQ ID NO: 1334488 - RNA, 23 nt, Human
ugcggccagguguccucucagcc

SEQ ID NO: 1334489 - RNA, 18 nt, Human
uuuuuuuuuuuuuuccug

SEQ ID NO: 1334490 - RNA, 23 nt, Human
uuuuuuuuuuuuuuccugcuggg

SEQ ID NO: 1334491 - RNA, 24 nt, Human
uuuuuuuuuuuuuuuuccugcugg

SEQ ID NO: 1334492 - RNA, 20 nt, Human
aaaaaaaccagaacacacua

SEQ ID NO: 1334493 - RNA, 21 nt, Human
aaaaagacaagucacuguaug

SEQ ID NO: 1334494 - RNA, 20 nt, Human
aaagauaaaacucugggugg

SEQ ID NO: 1334495 - RNA, 21 nt, Human
aaagucaccauccaaaugucc

SEQ ID NO: 1334496 - RNA, 19 nt, Human
aacauggagaaaccccauc

SEQ ID NO: 1334497 - RNA, 20 nt, Human
aacauggagaaaccccaucu

SEQ ID NO: 1334498 - RNA, 21 nt, Human
aacauggagaaaccccaucuc

SEQ ID NO: 1334499 - RNA, 24 nt, Human
aagaggaagcaagccaaguguuca

SEQ ID NO: 1334500 - RNA, 24 nt, Human
aagcaagccaaguguucacuggcu

SEQ ID NO: 1334501 - RNA, 24 nt, Human
aagcaggagaaucgcuuaaauccg

SEQ ID NO: 1334502 - RNA, 25 nt, Human
aagcaggagaaucgcuuaaauccgg

SEQ ID NO: 1334503 - RNA, 24 nt, Human
aaucgcuuaaauccgggaggcaga

SEQ ID NO: 1334504 - RNA, 30 nt, Human
aauuacuguuuaauggguacaguuuccauu

SEQ ID NO: 1334505 - RNA, 21 nt, Human
acaagagggaaacuccgucuc

SEQ ID NO: 1334506 - RNA, 25 nt, Human
acaggaaggaaauccugucaccuga

SEQ ID NO: 1334507 - RNA, 24 nt, Human
accccaucucuacuagaaauacaa

SEQ ID NO: 1334508 - RNA, 24 nt, Human
accugaggucgggaguucaagacc

SEQ ID NO: 1334509 - RNA, 21 nt, Human
accuugaggacauuaugcuaa

SEQ ID NO: 1334510 - RNA, 21 nt, Human
accuugaggacauuaugcuaa

SEQ ID NO: 1334511 - RNA, 18 nt, Human
agaaauacaaaauuagcc

SEQ ID NO: 1334512 - RNA, 20 nt, Human
agacagaaagcagaaugggg

SEQ ID NO: 1334513 - RNA, 21 nt, Human
agacagaaagcagaauggugg

SEQ ID NO: 1334514 - RNA, 22 nt, Human
agacagaaagcagaaugguggc

SEQ ID NO: 1334515 - RNA, 24 nt, Human
agagguugcugugagccgagaucg

SEQ ID NO: 1334516 - RNA, 27 nt, Human
agagguugcugugagccgagaucgcgc

SEQ ID NO: 1334517 - RNA, 23 nt, Human
agccaggcaugguggugcaugcc

SEQ ID NO: 1334518 - RNA, 18 nt, Human
aggaaagucaccauccaa

SEQ ID NO: 1334519 - RNA, 23 nt, Human
aggaaggaaauccugucaccuuu

SEQ ID NO: 1334520 - RNA, 21 nt, Human
aggcaaacaacuuuaaugguu

SEQ ID NO: 1334521 - RNA, 21 nt, Human
aggcagagguugcugugagcc

SEQ ID NO: 1334522 - RNA, 24 nt, Human
aggcagagguugcugugagccgag

SEQ ID NO: 1334523 - RNA, 18 nt, Human
aggcagguggaucaccug

SEQ ID NO: 1334524 - RNA, 22 nt, Human
aggcagguggaucaccugaggg

SEQ ID NO: 1334525 - RNA, 22 nt, Human
aggcagguggaucaccugaggu

SEQ ID NO: 1334526 - RNA, 24 nt, Human
aggcaugguggugcaugccuguaa

SEQ ID NO: 1334527 - RNA, 23 nt, Human
agggaagccgaggcccugaauca

SEQ ID NO: 1334528 - RNA, 23 nt, Human
agucgucacgccuguaaucccag

SEQ ID NO: 1334529 - RNA, 24 nt, Human
caacauggaugaaccuugaggaca

SEQ ID NO: 1334530 - RNA, 25 nt, Human
caagccaaguguucacugauggagg

SEQ ID NO: 1334531 - RNA, 24 nt, Human
caaggcagguggaucaccugaggu

SEQ ID NO: 1334532 - RNA, 24 nt, Human
cacacagcauuaugaauguauuaa

SEQ ID NO: 1334533 - RNA, 21 nt, Human
cacagcauuaugaauguauua

SEQ ID NO: 1334534 - RNA, 23 nt, Human
caccugaggucgggaguucaaga

SEQ ID NO: 1334535 - RNA, 24 nt, Human
cacgccuguaaucccagcacuuug

SEQ ID NO: 1334536 - RNA, 24 nt, Human
cagcacuuugggaggccaaggcag

SEQ ID NO: 1334537 - RNA, 25 nt, Human
cagcacuuugggaggccaaggcagg

SEQ ID NO: 1334538 - RNA, 22 nt, Human
cagcauuaugaauguauuaaca

SEQ ID NO: 1334539 - RNA, 24 nt, Human
cagccugaccaacauggagaaacc

SEQ ID NO: 1334540 - RNA, 24 nt, Human
caggugcagucgucacgccuguaa

SEQ ID NO: 1334541 - RNA, 24 nt, Human
cagguggaucaccugaggucggga

SEQ ID NO: 1334542 - RNA, 24 nt, Human
cagucgucacgccuguaaucccag

SEQ ID NO: 1334543 - RNA, 22 nt, Human
ccaaaugauauuccaauuaugc

SEQ ID NO: 1334544 - RNA, 21 nt, Human
ccaauagucaagaggaagccg

SEQ ID NO: 1334545 - RNA, 18 nt, Human
ccacaucccugcuuggca

SEQ ID NO: 1334546 - RNA, 21 nt, Human
ccauccaaauguccacauccc

SEQ ID NO: 1334547 - RNA, 19 nt, Human
cccaccaccaucucagcug

SEQ ID NO: 1334548 - RNA, 21 nt, Human
cccugaaucaucaaagagaag

SEQ ID NO: 1334549 - RNA, 20 nt, Human
ccgaggcccugaaucaucaa

SEQ ID NO: 1334550 - RNA, 24 nt, Human
ccugaccaacauggagaaacccca

SEQ ID NO: 1334551 - RNA, 21 nt, Human
ccuguaaucccagcuacucgg

SEQ ID NO: 1334552 - RNA, 22 nt, Human
ccuguaaucccagcuacucggg

SEQ ID NO: 1334553 - RNA, 23 nt, Human
cgccauuuccagccugggcaaca

SEQ ID NO: 1334554 - RNA, 23 nt, Human
cgccuguaaucccagcacuuugg

SEQ ID NO: 1334555 - RNA, 24 nt, Human
cgccuguaaucccagcacuuuggg

SEQ ID NO: 1334556 - RNA, 22 nt, Human
cgucacgccuguaaucccagca

SEQ ID NO: 1334557 - RNA, 20 nt, Human
cucaaagagauauuugcacc

SEQ ID NO: 1334558 - RNA, 18 nt, Human
cugugagccgagaucgcg

SEQ ID NO: 1334559 - RNA, 23 nt, Human
cuucgaggugguuuggagaggaa

SEQ ID NO: 1334560 - RNA, 24 nt, Human
gaacacacuaaggguuauaggcac

SEQ ID NO: 1334561 - RNA, 23 nt, Human
gaucaccugaggucgggaguuca

SEQ ID NO: 1334562 - RNA, 24 nt, Human
gaucaccugaggucgggaguucaa

SEQ ID NO: 1334563 - RNA, 21 nt, Human
gaucgcgccauuuccagccug

SEQ ID NO: 1334564 - RNA, 18 nt, Human
gcacuuaaaaauggugaa

SEQ ID NO: 1334565 - RNA, 18 nt, Human
gccauuuccagccugggc

SEQ ID NO: 1334566 - RNA, 18 nt, Human
ggcugcgggggcugggag

SEQ ID NO: 1334567 - RNA, 25 nt, Human
ggggaaccacccaggaaagucacca

SEQ ID NO: 1334568 - RNA, 24 nt, Human
ggugguaaaggaauuaaaggcaga

SEQ ID NO: 1334569 - RNA, 24 nt, Human
gguggugcaugccuguaaucccag

SEQ ID NO: 1334570 - RNA, 24 nt, Human
gucgucacgccuguaaucccagca

SEQ ID NO: 1334571 - RNA, 23 nt, Human
guggugcaugccuguaaucccag

SEQ ID NO: 1334572 - RNA, 25 nt, Human
uaaaagaaaaaaaaccagaacacac

SEQ ID NO: 1334573 - RNA, 24 nt, Human
uaagugaaauaagccagucacaaa

SEQ ID NO: 1334574 - RNA, 21 nt, Human
uacugagaauagucaaaacca

SEQ ID NO: 1334575 - RNA, 20 nt, Human
uagaaauacaaaauuagcca

SEQ ID NO: 1334576 - RNA, 18 nt, Human
uauuccaauuaugccccu

SEQ ID NO: 1334577 - RNA, 26 nt, Human
uauuccaauuaugccccugcuucgag

SEQ ID NO: 1334578 - RNA, 22 nt, Human
uauuuugcuaaagauaaaacuc

SEQ ID NO: 1334579 - RNA, 23 nt, Human
ucaccugaggucgggaguucaag

SEQ ID NO: 1334580 - RNA, 18 nt, Human
ucacgccuguaaucccag

SEQ ID NO: 1334581 - RNA, 23 nt, Human
ucacgccuguaaucccagcacuu

SEQ ID NO: 1334582 - RNA, 21 nt, Human
ucagcugguaguaugacgggu

SEQ ID NO: 1334583 - RNA, 20 nt, Human
uccaaauguccacaucccug

SEQ ID NO: 1334584 - RNA, 24 nt, Human
ucgggaggcugaagcaggagaauc

SEQ ID NO: 1334585 - RNA, 18 nt, Human
ucgugagggaagccgagg

SEQ ID NO: 1334586 - RNA, 23 nt, Human
ucuccaaaugauauuccaauuau

SEQ ID NO: 1334587 - RNA, 20 nt, Human
ucucuacuagaaauacaaaa

SEQ ID NO: 1334588 - RNA, 19 nt, Human
ugaagcaggagaaucgcuu

SEQ ID NO: 1334589 - RNA, 25 nt, Human
ugaagcaggagaaucgcuuaaaucc

SEQ ID NO: 1334590 - RNA, 19 nt, Human
ugaaucaucaaagagaagg

SEQ ID NO: 1334591 - RNA, 23 nt, Human
ugaaucaucaaagagaaggagaa

SEQ ID NO: 1334592 - RNA, 18 nt, Human
ugagaauagucaaaacca

SEQ ID NO: 1334593 - RNA, 25 nt, Human
ugagaauagucaaaaccagagagac

SEQ ID NO: 1334594 - RNA, 26 nt, Human
ugagauacugagaauagucaaaacca

SEQ ID NO: 1334595 - RNA, 18 nt, Human
ugagccgagaucgcgcca

SEQ ID NO: 1334596 - RNA, 22 nt, Human
ugauggaggaacagaguguggu

SEQ ID NO: 1334597 - RNA, 22 nt, Human
ugccccugcuucgaggugguuu

SEQ ID NO: 1334598 - RNA, 23 nt, Human
ugccuguaaucccagcuacucgg

SEQ ID NO: 1334599 - RNA, 24 nt, Human
ugccuguaaucccagcuacucggg

SEQ ID NO: 1334600 - RNA, 20 nt, Human
ugcgggggcugggaggagug

SEQ ID NO: 1334601 - RNA, 20 nt, Human
uggaggaacagaguguggua

SEQ ID NO: 1334602 - RNA, 22 nt, Human
uggaggaacagagugugguacg

SEQ ID NO: 1334603 - RNA, 24 nt, Human
uggaucaccugaggucgggaguuc

SEQ ID NO: 1334604 - RNA, 21 nt, Human
uggcugcgggggcugggagga

SEQ ID NO: 1334605 - RNA, 24 nt, Human
uggcugcgggggcugggaggaguu

SEQ ID NO: 1334606 - RNA, 24 nt, Human
ugggaggccaaggcagguggauca

SEQ ID NO: 1334607 - RNA, 21 nt, Human
uggugcaugccuguaauccca

SEQ ID NO: 1334608 - RNA, 24 nt, Human
ugguggugcaugccuguaauccca

SEQ ID NO: 1334609 - RNA, 21 nt, Human
uuaaaagaaaaaaaaccagaa

SEQ ID NO: 1334610 - RNA, 22 nt, Human
uugcugugagccgagaucgcgc

SEQ ID NO: 1334611 - RNA, 23 nt, Human
uuuggagaggaagaggaaagcug

SEQ ID NO: 1334612 - RNA, 21 nt, Human
uuuuaugaguauuuuacgaca

SEQ ID NO: 1334613 - RNA, 24 nt, Human
agaagaggcggcuugcagggcugg

SEQ ID NO: 1334614 - RNA, 24 nt, Human
agagagcucuguccuucucccuuc

SEQ ID NO: 1334615 - RNA, 18 nt, Human
caccagugaccgcagcca

SEQ ID NO: 1334616 - RNA, 18 nt, Human
caccuguccacaccuguc

SEQ ID NO: 1334617 - RNA, 20 nt, Human
cagagccugccgcggcggcc

SEQ ID NO: 1334618 - RNA, 19 nt, Human
cagccagccggggaaaugc

SEQ ID NO: 1334619 - RNA, 24 nt, Human
cagcugcuaacccagggccacucg

SEQ ID NO: 1334620 - RNA, 22 nt, Human
ccagugaccgcagccagccggg

SEQ ID NO: 1334621 - RNA, 18 nt, Human
cccagggccacucggccg

SEQ ID NO: 1334622 - RNA, 24 nt, Human
ccugucacugggccuuucccuggg

SEQ ID NO: 1334623 - RNA, 20 nt, Human
ccuucucccuucuaccgaga

SEQ ID NO: 1334624 - RNA, 23 nt, Human
cgagaagaggcggcuugcagggc

SEQ ID NO: 1334625 - RNA, 20 nt, Human
cgggcgccugagcacugcca

SEQ ID NO: 1334626 - RNA, 22 nt, Human
gcagggcuggcaccuguccaca

SEQ ID NO: 1334627 - RNA, 25 nt, Human
gccgcggcggccgaucuuccugcgc

SEQ ID NO: 1334628 - RNA, 22 nt, Human
gcuggcaccuguccacaccugu

SEQ ID NO: 1334629 - RNA, 24 nt, Human
uaugugcagggccugugcaggagc

SEQ ID NO: 1334630 - RNA, 21 nt, Human
ugagugggagcagaugcccuc

SEQ ID NO: 1334631 - RNA, 22 nt, Human
ugccgcggcggccgaucuuccu

SEQ ID NO: 1334632 - RNA, 20 nt, Human
uugcagggcuggcaccuguc

SEQ ID NO: 1334633 - RNA, 21 nt, Human
aaaaagaaaaaaggagagcaa

SEQ ID NO: 1334634 - RNA, 21 nt, Human
aaaagcacugaaaauguaaug

SEQ ID NO: 1334635 - RNA, 29 nt, Human
aaacaaaagucugacauuuuccgacgacg

SEQ ID NO: 1334636 - RNA, 18 nt, Human
aaagauacacagcagagc

SEQ ID NO: 1334637 - RNA, 21 nt, Human
aaaucacuuuaggguagcuaa

SEQ ID NO: 1334638 - RNA, 20 nt, Human
aacacaauguaaacccuaua

SEQ ID NO: 1334639 - RNA, 20 nt, Human
aacccuauagucuacagaau

SEQ ID NO: 1334640 - RNA, 22 nt, Human
aagaaaaaaggagagcaacuaa

SEQ ID NO: 1334641 - RNA, 23 nt, Human
aagagaagcggaaaaggccugag

SEQ ID NO: 1334642 - RNA, 18 nt, Human
aagcuagugagaaaucaa

SEQ ID NO: 1334643 - RNA, 19 nt, Human
aaggcaauuuucuuccucc

SEQ ID NO: 1334644 - RNA, 20 nt, Human
aaguagucuuaaaugguuaa

SEQ ID NO: 1334645 - RNA, 22 nt, Human
acaaaaaaaagaaaaaaggaga

SEQ ID NO: 1334646 - RNA, 26 nt, Human
agaaauaaaauaugcacgacaaaaaa

SEQ ID NO: 1334647 - RNA, 22 nt, Human
agcagagcagguucacgccugu

SEQ ID NO: 1334648 - RNA, 21 nt, Human
agccuuucggggggugaaggg

SEQ ID NO: 1334649 - RNA, 23 nt, Human
agcugguuuaaauuauaaacccc

SEQ ID NO: 1334650 - RNA, 23 nt, Human
aggcggcggcggccucaaccgag

SEQ ID NO: 1334651 - RNA, 22 nt, Human
caaaauaccaaaguuuagugug

SEQ ID NO: 1334652 - RNA, 24 nt, Human
caaaaugaguuccaaaguuuuucc

SEQ ID NO: 1334653 - RNA, 19 nt, Human
caaauaggaaacacaaagc

SEQ ID NO: 1334654 - RNA, 27 nt, Human
caacaaguguaugaguaaggauuuaaa

SEQ ID NO: 1334655 - RNA, 21 nt, Human
caccccgcaaagauacacagc

SEQ ID NO: 1334656 - RNA, 25 nt, Human
caguggcaauggugcaucaauucuc

SEQ ID NO: 1334657 - RNA, 21 nt, Human
caugaggauaaaauguauggc

SEQ ID NO: 1334658 - RNA, 21 nt, Human
cauuguacaucccucccaaca

SEQ ID NO: 1334659 - RNA, 22 nt, Human
cggcaggccucagcgcaggcca

SEQ ID NO: 1334660 - RNA, 25 nt, Human
cuaauacuaacaauuguuaauuuaa

SEQ ID NO: 1334661 - RNA, 19 nt, Human
gacaaaaaaaagaaaaaag

SEQ ID NO: 1334662 - RNA, 23 nt, Human
gacaaaaaaaagaaaaaaggaga

SEQ ID NO: 1334663 - RNA, 18 nt, Human
gagagggucggaaguggg

SEQ ID NO: 1334664 - RNA, 19 nt, Human
gaguaaggauuuaaaaaug

SEQ ID NO: 1334665 - RNA, 21 nt, Human
gcgcaggccaccccgcaaaga

SEQ ID NO: 1334666 - RNA, 18 nt, Human
gcuacaguucaucacauu

SEQ ID NO: 1334667 - RNA, 21 nt, Human
ggugaaggggcggagccugag

SEQ ID NO: 1334668 - RNA, 20 nt, Human
guagucuuaaaugguuaaaa

SEQ ID NO: 1334669 - RNA, 24 nt, Human
uaaaccccaaaaacaaaagucuga

SEQ ID NO: 1334670 - RNA, 20 nt, Human
uaaccagaaacuacagaaau

SEQ ID NO: 1334671 - RNA, 21 nt, Human
uaaccagaaacuacagaaaua

SEQ ID NO: 1334672 - RNA, 19 nt, Human
uaagggcaagagcuagcca

SEQ ID NO: 1334673 - RNA, 20 nt, Human
uagaggacagcaauauuaca

SEQ ID NO: 1334674 - RNA, 22 nt, Human
uagcauagcugguuuaaauuau

SEQ ID NO: 1334675 - RNA, 26 nt, Human
uauaaaccccaaaaacaaaagucuga

SEQ ID NO: 1334676 - RNA, 22 nt, Human
uaugcacgacaaaaaaaagaaa

SEQ ID NO: 1334677 - RNA, 18 nt, Human
ucacauuugguuuucuua

SEQ ID NO: 1334678 - RNA, 21 nt, Human
uccuuguaaaagcacugaaaa

SEQ ID NO: 1334679 - RNA, 22 nt, Human
ugaauagcccaaaaugaguucc

SEQ ID NO: 1334680 - RNA, 23 nt, Human
ugaauauuuaacaugaauagccc

SEQ ID NO: 1334681 - RNA, 20 nt, Human
ugagacaccggcucccguga

SEQ ID NO: 1334682 - RNA, 20 nt, Human
ugagagggucggaagugggg

SEQ ID NO: 1334683 - RNA, 19 nt, Human
ugaguaaggauuuaaaaau

SEQ ID NO: 1334684 - RNA, 20 nt, Human
ugaguaaggauuuaaaaaug

SEQ ID NO: 1334685 - RNA, 19 nt, Human
uggaacaaaaucuuauuuc

SEQ ID NO: 1334686 - RNA, 19 nt, Human
uggaacaaaaucuuauuuc

SEQ ID NO: 1334687 - RNA, 21 nt, Human
uggagugcguacguggaagcc

SEQ ID NO: 1334688 - RNA, 21 nt, Human
ugggagauucgggaucagagc

SEQ ID NO: 1334689 - RNA, 19 nt, Human
uggggagguaaaagagaag

SEQ ID NO: 1334690 - RNA, 24 nt, Human
uguaauauuucuaccuguuacaaa

SEQ ID NO: 1334691 - RNA, 24 nt, Human
uguacaucccucccaacaagugua

SEQ ID NO: 1334692 - RNA, 19 nt, Human
ugugaggggcgcagacggg

SEQ ID NO: 1334693 - RNA, 24 nt, Human
uuacaaagucugauauuuaaggcc

SEQ ID NO: 1334694 - RNA, 19 nt, Human
uuagaggacagcaauauua

SEQ ID NO: 1334695 - RNA, 22 nt, Human
uucaucacauuugguuuucuua

SEQ ID NO: 1334696 - RNA, 24 nt, Human
uucuaagcuagugagaaaucaauu

SEQ ID NO: 1334697 - RNA, 23 nt, Human
uugaauauuuaacaugaauagcc

SEQ ID NO: 1334698 - RNA, 18 nt, Human
uuuaagcugggaaugacu

SEQ ID NO: 1334699 - RNA, 18 nt, Human
aaaagcacuacauccaca

SEQ ID NO: 1334700 - RNA, 21 nt, Human
aaagauguuaaaacagcccuc

SEQ ID NO: 1334701 - RNA, 24 nt, Human
aaauuaauacuaccaaaucauuac

SEQ ID NO: 1334702 - RNA, 21 nt, Human
aacucacuaaguggacaacau

SEQ ID NO: 1334703 - RNA, 18 nt, Human
aagaauacucauagagcc

SEQ ID NO: 1334704 - RNA, 19 nt, Human
aagauguugguaaagauau

SEQ ID NO: 1334705 - RNA, 23 nt, Human
acaaaauuaauacuaccaaauca

SEQ ID NO: 1334706 - RNA, 18 nt, Human
acccuucuaucccauccc

SEQ ID NO: 1334707 - RNA, 21 nt, Human
agaacagaacaugaacauuuu

SEQ ID NO: 1334708 - RNA, 20 nt, Human
agaauacucauagagccauc

SEQ ID NO: 1334709 - RNA, 22 nt, Human
agacugagaaacagaagagcac

SEQ ID NO: 1334710 - RNA, 21 nt, Human
auaaaagacagcaguuucaca

SEQ ID NO: 1334711 - RNA, 22 nt, Human
caaaacccucuaacaaguauuu

SEQ ID NO: 1334712 - RNA, 24 nt, Human
caaaauaagaaaucaguauaguca

SEQ ID NO: 1334713 - RNA, 22 nt, Human
caaauguccuauacuuuggaaa

SEQ ID NO: 1334714 - RNA, 25 nt, Human
cacccgcccgcgccgcuguugggga

SEQ ID NO: 1334715 - RNA, 23 nt, Human
cacuuuggaaagauacgaucaga

SEQ ID NO: 1334716 - RNA, 21 nt, Human
cagaagagcaccgggacugug

SEQ ID NO: 1334717 - RNA, 22 nt, Human
caggcaucuucauuguaauuuu

SEQ ID NO: 1334718 - RNA, 23 nt, Human
caguagagacaaaacaggcagua

SEQ ID NO: 1334719 - RNA, 21 nt, Human
cauugcaaacccuucuauccc

SEQ ID NO: 1334720 - RNA, 25 nt, Human
cauuguugguacgucauuuucuuua

SEQ ID NO: 1334721 - RNA, 23 nt, Human
cccuucuaucccaucccuuuuca

SEQ ID NO: 1334722 - RNA, 23 nt, Human
ccgaagccgccacuguucccccg

SEQ ID NO: 1334723 - RNA, 20 nt, Human
ccgcgccgcuguuggggagc

SEQ ID NO: 1334724 - RNA, 21 nt, Human
ccuucuaucccaucccuuuuc

SEQ ID NO: 1334725 - RNA, 22 nt, Human
cuuaucagcuaccagcugaacg

SEQ ID NO: 1334726 - RNA, 22 nt, Human
gaagagaaacaaugaccacaaa

SEQ ID NO: 1334727 - RNA, 23 nt, Human
gcaaaaaaggagccguuuuugac

SEQ ID NO: 1334728 - RNA, 18 nt, Human
gcgcaaaaaaggagccgu

SEQ ID NO: 1334729 - RNA, 25 nt, Human
ggggaguggguaacaugauucagag

SEQ ID NO: 1334730 - RNA, 24 nt, Human
gugaacaauuuaagaaaacuucac

SEQ ID NO: 1334731 - RNA, 24 nt, Human
uaaaacagcccuccaccaauaaua

SEQ ID NO: 1334732 - RNA, 24 nt, Human
uaaaagcacuacauccacauuaac

SEQ ID NO: 1334733 - RNA, 26 nt, Human
uaaauuuaucgaagagaaacaaugac

SEQ ID NO: 1334734 - RNA, 19 nt, Human
uaacaaaaaaggaagguaa

SEQ ID NO: 1334735 - RNA, 19 nt, Human
uaagaaaacuucacaagag

SEQ ID NO: 1334736 - RNA, 22 nt, Human
uaagaaaucaguauagucaaga

SEQ ID NO: 1334737 - RNA, 18 nt, Human
uaagcagcaccggaagcc

SEQ ID NO: 1334738 - RNA, 18 nt, Human
uaccaguucuucaaaugu

SEQ ID NO: 1334739 - RNA, 21 nt, Human
uaccaguucuucaaauguccu

SEQ ID NO: 1334740 - RNA, 24 nt, Human
uagaaucccuggaagaauacucau

SEQ ID NO: 1334741 - RNA, 21 nt, Human
uaggugaagaaaauauagaac

SEQ ID NO: 1334742 - RNA, 26 nt, Human
uauagaacagaacaugaacauuuuaa

SEQ ID NO: 1334743 - RNA, 23 nt, Human
ucaguuaaaagagagaauauuaa

SEQ ID NO: 1334744 - RNA, 21 nt, Human
ucgaagagaaacaaugaccac

SEQ ID NO: 1334745 - RNA, 21 nt, Human
ugacuguccuucaccagugag

SEQ ID NO: 1334746 - RNA, 25 nt, Human
ugcaaacccuucuaucccaucccuu

SEQ ID NO: 1334747 - RNA, 21 nt, Human
uggaugagcagcucguagccc

SEQ ID NO: 1334748 - RNA, 19 nt, Human
uggcauugcaaacccuucu

SEQ ID NO: 1334749 - RNA, 20 nt, Human
uguaaaguaaaagcacuaca

SEQ ID NO: 1334750 - RNA, 24 nt, Human
uucaaaacccucuaacaaguauuu

SEQ ID NO: 1334751 - RNA, 26 nt, Human
uuggaaagcagacccgacucuggagc

SEQ ID NO: 1334752 - RNA, 19 nt, Human
uuuaagaaaacuucacaag

SEQ ID NO: 1334753 - RNA, 25 nt, Human
uuuaguaauagugaccaaaauaaga

SEQ ID NO: 1334754 - RNA, 25 nt, Human
uuucacuaggaggcgcaaaaaagga

SEQ ID NO: 1334755 - RNA, 20 nt, Human
uuuucaguuaaaagagagaa

SEQ ID NO: 1334756 - RNA, 22 nt, Human
cccugggucccggaguccgccc

SEQ ID NO: 1334757 - RNA, 23 nt, Human
cggcgcccugggucccggagucc

SEQ ID NO: 1334758 - RNA, 27 nt, Human
cggcucccggcgcccugggucccuccu

SEQ ID NO: 1334759 - RNA, 18 nt, Human
gcccugggucccggaguc

SEQ ID NO: 1334760 - RNA, 23 nt, Human
gcuucgguucggcgacaacgcua

SEQ ID NO: 1334761 - RNA, 19 nt, Human
guagcccgccggcucccgg

SEQ ID NO: 1334762 - RNA, 19 nt, Human
uaacucgacucgcagguag

SEQ ID NO: 1334763 - RNA, 19 nt, Human
uugcauccgagccccgccu

SEQ ID NO: 1334764 - RNA, 19 nt, Human
aaaaaacaccaaccauucc

SEQ ID NO: 1334765 - RNA, 26 nt, Human
aaaaaacaccaaccauucccaaaaac

SEQ ID NO: 1334766 - RNA, 21 nt, Human
aaaaacaccaaccauucccaa

SEQ ID NO: 1334767 - RNA, 21 nt, Human
aacacaaagcaaaaaacacca

SEQ ID NO: 1334768 - RNA, 23 nt, Human
aacacaaagcaaaaaacaccaac

SEQ ID NO: 1334769 - RNA, 21 nt, Human
acaaagcaaaaaacaccaacc

SEQ ID NO: 1334770 - RNA, 23 nt, Human
acuucaaagaguuuaaugaugaa

SEQ ID NO: 1334771 - RNA, 21 nt, Human
agucuuuuggcuuucuuacaa

SEQ ID NO: 1334772 - RNA, 24 nt, Human
auaauacaccaauagacaugacca

SEQ ID NO: 1334773 - RNA, 23 nt, Human
auucccaaaaacuacagauacau

SEQ ID NO: 1334774 - RNA, 20 nt, Human
caaaaaacaccaaccauucc

SEQ ID NO: 1334775 - RNA, 21 nt, Human
caaagcaaaaaacaccaacca

SEQ ID NO: 1334776 - RNA, 23 nt, Human
caaagcaaaaaacaccaaccauu

SEQ ID NO: 1334777 - RNA, 21 nt, Human
caacacaaagcaaaaaacacc

SEQ ID NO: 1334778 - RNA, 23 nt, Human
caauagacaugaccaauaugauc

SEQ ID NO: 1334779 - RNA, 20 nt, Human
caauaugauccuggcaaaau

SEQ ID NO: 1334780 - RNA, 23 nt, Human
cacaaagcaaaaaacaccaacca

SEQ ID NO: 1334781 - RNA, 21 nt, Human
caccaaccauucccaaaaacu

SEQ ID NO: 1334782 - RNA, 26 nt, Human
caccaauagacaugaccaauaugauc

SEQ ID NO: 1334783 - RNA, 26 nt, Human
cuucccaacacaaagcaaaaaacacc

SEQ ID NO: 1334784 - RNA, 23 nt, Human
gaaaacauuggugauacugaaau

SEQ ID NO: 1334785 - RNA, 27 nt, Human
gugauacugaaauaauacaccaauuga

SEQ ID NO: 1334786 - RNA, 30 nt, Human
uaacuucccaacacaaagcaaaaaacaccu

SEQ ID NO: 1334787 - RNA, 22 nt, Human
uaaguuagaaggcagaaaaaua

SEQ ID NO: 1334788 - RNA, 23 nt, Human
uaauacaccaauagacaugacca

SEQ ID NO: 1334789 - RNA, 20 nt, Human
uagaaaaaauaaaacgacug

SEQ ID NO: 1334790 - RNA, 19 nt, Human
uauaaaguguacaugaaaa

SEQ ID NO: 1334791 - RNA, 23 nt, Human
uauauagguuuucucaauaacuu

SEQ ID NO: 1334792 - RNA, 24 nt, Human
ucuagaaaaaauaaaacgacugca

SEQ ID NO: 1334793 - RNA, 18 nt, Human
ugaaaucuggcaaaaguc

SEQ ID NO: 1334794 - RNA, 19 nt, Human
ugaggaacaaugcuuaaaa

SEQ ID NO: 1334795 - RNA, 21 nt, Human
ugagucuauaaguuagaaggc

SEQ ID NO: 1334796 - RNA, 23 nt, Human
uggcaaaaugcacaucucgcugg

SEQ ID NO: 1334797 - RNA, 20 nt, Human
uuacaaauguucugaggaac

SEQ ID NO: 1334798 - RNA, 21 nt, Human
uucucaauaacuucccaacac

SEQ ID NO: 1334799 - RNA, 27 nt, Human
aacuuuccccccaagugcccgccuccg

SEQ ID NO: 1334800 - RNA, 20 nt, Human
acagaauguaaauguacccc

SEQ ID NO: 1334801 - RNA, 23 nt, Human
aguucacccacaaaccccuccca

SEQ ID NO: 1334802 - RNA, 23 nt, Human
auguaccccuaugcaugcauaug

SEQ ID NO: 1334803 - RNA, 19 nt, Human
cacccacaaaccccuccca

SEQ ID NO: 1334804 - RNA, 20 nt, Human
cacccacaaaccccucccag

SEQ ID NO: 1334805 - RNA, 21 nt, Human
cacccacaaaccccucccaga

SEQ ID NO: 1334806 - RNA, 18 nt, Human
cccacaaaccccucccag

SEQ ID NO: 1334807 - RNA, 19 nt, Human
cccacaaaccccucccaga

SEQ ID NO: 1334808 - RNA, 20 nt, Human
cccccaagugcccgccuccg

SEQ ID NO: 1334809 - RNA, 22 nt, Human
ccccgaguucacccacaaaccc

SEQ ID NO: 1334810 - RNA, 19 nt, Human
ccccucccagauggggccc

SEQ ID NO: 1334811 - RNA, 21 nt, Human
cccucccagauggggcccgcc

SEQ ID NO: 1334812 - RNA, 18 nt, Human
ccuaugcaugcauaugua

SEQ ID NO: 1334813 - RNA, 19 nt, Human
uagaagaagcuugguagug

SEQ ID NO: 1334814 - RNA, 21 nt, Human
ucagcgggcgguggaccccga

SEQ ID NO: 1334815 - RNA, 24 nt, Human
ucccagauggggcccgcccaaccc

SEQ ID NO: 1334816 - RNA, 23 nt, Human
aaacaaacagacucacaucuagg

SEQ ID NO: 1334817 - RNA, 18 nt, Human
aaacacaauacaaugaaa

SEQ ID NO: 1334818 - RNA, 26 nt, Human
aaacacaauacaaugaaauggaaaaa

SEQ ID NO: 1334819 - RNA, 18 nt, Human
aagagaggaagaaaucgg

SEQ ID NO: 1334820 - RNA, 22 nt, Human
aagcagucugcagugaaauuca

SEQ ID NO: 1334821 - RNA, 25 nt, Human
acaggagugcagcaauuuagagagu

SEQ ID NO: 1334822 - RNA, 23 nt, Human
acaggcacugccaccuccagugu

SEQ ID NO: 1334823 - RNA, 23 nt, Human
accccaguuccuauuuauauuuc

SEQ ID NO: 1334824 - RNA, 23 nt, Human
agaccaacaauggcaaaacacaa

SEQ ID NO: 1334825 - RNA, 22 nt, Human
agggaaaucaacagaccaacaa

SEQ ID NO: 1334826 - RNA, 22 nt, Human
caaacagacucacaucuaggga

SEQ ID NO: 1334827 - RNA, 18 nt, Human
caacaauggcaaaacaca

SEQ ID NO: 1334828 - RNA, 28 nt, Human
caauugaaaacaaacagacucacaucua

SEQ ID NO: 1334829 - RNA, 18 nt, Human
cacaauacaaugaaaugg

SEQ ID NO: 1334830 - RNA, 24 nt, Human
cagugaaauucaaaaucuggcuca

SEQ ID NO: 1334831 - RNA, 19 nt, Human
cauaaacaggcacugccac

SEQ ID NO: 1334832 - RNA, 21 nt, Human
cauaaacaggcacugccaccu

SEQ ID NO: 1334833 - RNA, 21 nt, Human
ccauggcacuuucaugaccgc

SEQ ID NO: 1334834 - RNA, 19 nt, Human
ccgcgggaagcuccucccc

SEQ ID NO: 1334835 - RNA, 22 nt, Human
ccuaugauuagaagucugaagc

SEQ ID NO: 1334836 - RNA, 22 nt, Human
cuccaauaaauauucuaauauu

SEQ ID NO: 1334837 - RNA, 26 nt, Human
cuccaguguucauccauggcacuuuc

SEQ ID NO: 1334838 - RNA, 21 nt, Human
cuuccuguucuguggcuucuu

SEQ ID NO: 1334839 - RNA, 21 nt, Human
gaccaacaauggcaaaacaca

SEQ ID NO: 1334840 - RNA, 23 nt, Human
gagcaggccgcgggaagcuccuc

SEQ ID NO: 1334841 - RNA, 22 nt, Human
ggcuucuuuuagugcccaaguu

SEQ ID NO: 1334842 - RNA, 20 nt, Human
uaaggcagcaauuucaucug

SEQ ID NO: 1334843 - RNA, 23 nt, Human
uacaagccuaugauuagaagucu

SEQ ID NO: 1334844 - RNA, 19 nt, Human
uacaauaaaggucucaaga

SEQ ID NO: 1334845 - RNA, 19 nt, Human
uacaaugaaauggaaaaau

SEQ ID NO: 1334846 - RNA, 24 nt, Human
uaguacauuuucuuuucuggauuc

SEQ ID NO: 1334847 - RNA, 22 nt, Human
uagugcccaaguuguaucacau

SEQ ID NO: 1334848 - RNA, 20 nt, Human
ucagacaauugaaaacaaac

SEQ ID NO: 1334849 - RNA, 19 nt, Human
ucuagggaaaucaacagac

SEQ ID NO: 1334850 - RNA, 19 nt, Human
ugaaaacaaacagacucac

SEQ ID NO: 1334851 - RNA, 25 nt, Human
ugacaaaaaguauugggaagagggg

SEQ ID NO: 1334852 - RNA, 20 nt, Human
uggcaaaacacaauacaaug

SEQ ID NO: 1334853 - RNA, 23 nt, Human
uggcaaaacacaauacaaugaaa

SEQ ID NO: 1334854 - RNA, 21 nt, Human
uguggcuucuuuuagugccca

SEQ ID NO: 1334855 - RNA, 25 nt, Human
uuacaauaaaggucucaagauuuau

SEQ ID NO: 1334856 - RNA, 18 nt, Human
uuccuguucuguggcuuc

SEQ ID NO: 1334857 - RNA, 20 nt, Human
acuacagucuacugugccac

SEQ ID NO: 1334858 - RNA, 20 nt, Human
agcacaugauggggcugaag

SEQ ID NO: 1334859 - RNA, 21 nt, Human
caaagcacaugauggggcuga

SEQ ID NO: 1334860 - RNA, 19 nt, Human
cuccauggcccaguggcag

SEQ ID NO: 1334861 - RNA, 19 nt, Human
cugcccccgcgagccucac

SEQ ID NO: 1334862 - RNA, 19 nt, Human
gagaacagggaaaggacag

SEQ ID NO: 1334863 - RNA, 19 nt, Human
gcacaugauggggcugaag

SEQ ID NO: 1334864 - RNA, 20 nt, Human
guuuuauuuacacucauccc

SEQ ID NO: 1334865 - RNA, 20 nt, Human
ucuccauggcccaguggcag

SEQ ID NO: 1334866 - RNA, 20 nt, Human
uggcccaguggcaggggcgg

SEQ ID NO: 1334867 - RNA, 22 nt, Human
aaaacugaaaacugcuccagcc

SEQ ID NO: 1334868 - RNA, 19 nt, Human
aaaauaaaauaagcuguaa

SEQ ID NO: 1334869 - RNA, 20 nt, Human
aaacaaauaauaagccacuu

SEQ ID NO: 1334870 - RNA, 19 nt, Human
aaacaggcaccacaguucu

SEQ ID NO: 1334871 - RNA, 24 nt, Human
aaacaggcaccacaguucucuaag

SEQ ID NO: 1334872 - RNA, 18 nt, Human
aacauggauuucaccucu

SEQ ID NO: 1334873 - RNA, 20 nt, Human
aaccauagucaguuuauuac

SEQ ID NO: 1334874 - RNA, 18 nt, Human
aagaaagaaacaauagga

SEQ ID NO: 1334875 - RNA, 25 nt, Human
aagaagaaagaaaaauuacaucaug

SEQ ID NO: 1334876 - RNA, 18 nt, Human
aagaaguaugagacuuuc

SEQ ID NO: 1334877 - RNA, 20 nt, Human
aagguagaauuaucaagaca

SEQ ID NO: 1334878 - RNA, 23 nt, Human
acacaauccaaucgaauucaugc

SEQ ID NO: 1334879 - RNA, 23 nt, Human
accaucacacuauacaccaaguc

SEQ ID NO: 1334880 - RNA, 18 nt, Human
aggcagucccaaacucac

SEQ ID NO: 1334881 - RNA, 22 nt, Human
agugguggggacagcggcgaaa

SEQ ID NO: 1334882 - RNA, 19 nt, Human
auagaaauucaugucuaca

SEQ ID NO: 1334883 - RNA, 23 nt, Human
auagugcaaucagugguaaaaca

SEQ ID NO: 1334884 - RNA, 20 nt, Human
auccauuugguuugcaucau

SEQ ID NO: 1334885 - RNA, 21 nt, Human
auguugccaggcagucccaaa

SEQ ID NO: 1334886 - RNA, 21 nt, Human
auucauggucaagaaugcuuu

SEQ ID NO: 1334887 - RNA, 27 nt, Human
caaaaaaaaguaauccauacaucaaaa

SEQ ID NO: 1334888 - RNA, 27 nt, Human
cacuucuaaaaagcaaaugccuaugga

SEQ ID NO: 1334889 - RNA, 23 nt, Human
cagcaguauuucaggaauuacaa

SEQ ID NO: 1334890 - RNA, 21 nt, Human
cagugguaaaacaaauaguac

SEQ ID NO: 1334891 - RNA, 20 nt, Human
caguuugcuugcugacuucu

SEQ ID NO: 1334892 - RNA, 20 nt, Human
caugacauggaaaaaaucca

SEQ ID NO: 1334893 - RNA, 22 nt, Human
caugcaucacuuccagagauac

SEQ ID NO: 1334894 - RNA, 20 nt, Human
ccauaaguuuaaccuuuuaa

SEQ ID NO: 1334895 - RNA, 18 nt, Human
ccauuugucaauaucauc

SEQ ID NO: 1334896 - RNA, 21 nt, Human
cgaaagcaccucggaaagccc

SEQ ID NO: 1334897 - RNA, 24 nt, Human
cuucuuugcuaauuugcugcuggu

SEQ ID NO: 1334898 - RNA, 20 nt, Human
gaaaagaaaaacauuccaaa

SEQ ID NO: 1334899 - RNA, 20 nt, Human
gaaagaaacaauaggaugua

SEQ ID NO: 1334900 - RNA, 23 nt, Human
gagacaagcuaugaaacaaacua

SEQ ID NO: 1334901 - RNA, 24 nt, Human
gauucagaagaaccacaaaaguuu

SEQ ID NO: 1334902 - RNA, 18 nt, Human
gcaccucggaaagcccag

SEQ ID NO: 1334903 - RNA, 23 nt, Human
gcagcaguauuucaggaauuaca

SEQ ID NO: 1334904 - RNA, 19 nt, Human
gcaucacuuccagagauac

SEQ ID NO: 1334905 - RNA, 25 nt, Human
gggaaaagaaaaacauuccaaauau

SEQ ID NO: 1334906 - RNA, 23 nt, Human
guacauuuuuguuacagacagaa

SEQ ID NO: 1334907 - RNA, 19 nt, Human
gugaaaugacuuuagcacg

SEQ ID NO: 1334908 - RNA, 20 nt, Human
gugaaaugacuuuagcacgu

SEQ ID NO: 1334909 - RNA, 24 nt, Human
guuacagaaaauacacuugaacaa

SEQ ID NO: 1334910 - RNA, 20 nt, Human
uaaaaaaacaaaauagugca

SEQ ID NO: 1334911 - RNA, 22 nt, Human
uaaaguacauuuuuguuacaga

SEQ ID NO: 1334912 - RNA, 20 nt, Human
uaaauacagaugucccuuag

SEQ ID NO: 1334913 - RNA, 23 nt, Human
uaaauacuuacacguaaugaaug

SEQ ID NO: 1334914 - RNA, 20 nt, Human
uaacauggauuucaccucuc

SEQ ID NO: 1334915 - RNA, 25 nt, Human
uaagaaauauaaauguugccaggca

SEQ ID NO: 1334916 - RNA, 23 nt, Human
uaagacuaaaccaucacacuaua

SEQ ID NO: 1334917 - RNA, 23 nt, Human
uaagauuauugaaaaaaggaauc

SEQ ID NO: 1334918 - RNA, 18 nt, Human
uaagucaaaugcaaguac

SEQ ID NO: 1334919 - RNA, 18 nt, Human
uacaccaagucuuuccuu

SEQ ID NO: 1334920 - RNA, 25 nt, Human
uacaucaaaauugggguuuccuugg

SEQ ID NO: 1334921 - RNA, 27 nt, Human
uacaucaaaauugggguuuccuugguu

SEQ ID NO: 1334922 - RNA, 18 nt, Human
uacuauggcuguugaaau

SEQ ID NO: 1334923 - RNA, 23 nt, Human
uagacagauacuuaggagggcag

SEQ ID NO: 1334924 - RNA, 18 nt, Human
uaggagggcagacucccc

SEQ ID NO: 1334925 - RNA, 22 nt, Human
uaguucacuugaguagaagccu

SEQ ID NO: 1334926 - RNA, 21 nt, Human
uauauaaagucaauccucaaa

SEQ ID NO: 1334927 - RNA, 22 nt, Human
uaucuucaauaauacuauucaa

SEQ ID NO: 1334928 - RNA, 24 nt, Human
ucacagauacaucguaagucaaau

SEQ ID NO: 1334929 - RNA, 20 nt, Human
uccaagugaggauauuacuu

SEQ ID NO: 1334930 - RNA, 20 nt, Human
uccauacaucaaaauugggg

SEQ ID NO: 1334931 - RNA, 20 nt, Human
ugaaaaacaaauaauaagcc

SEQ ID NO: 1334932 - RNA, 21 nt, Human
ugaacaaugacagaaacacuu

SEQ ID NO: 1334933 - RNA, 24 nt, Human
ugaauagcccuuuaaaaacagccc

SEQ ID NO: 1334934 - RNA, 23 nt, Human
ugcaaagaacauuuugauagaaa

SEQ ID NO: 1334935 - RNA, 18 nt, Human
ugcaacuguuaaaaaaac

SEQ ID NO: 1334936 - RNA, 30 nt, Human
ugcagugguggggacagcggcgaaagcacc

SEQ ID NO: 1334937 - RNA, 21 nt, Human
ugccauugcaguggacacuuc

SEQ ID NO: 1334938 - RNA, 18 nt, Human
uggggacagcggcgaaag

SEQ ID NO: 1334939 - RNA, 21 nt, Human
uguaaagaacauuacaagcua

SEQ ID NO: 1334940 - RNA, 21 nt, Human
uuaaaaauagucucaucaagg

SEQ ID NO: 1334941 - RNA, 23 nt, Human
uuacagaaaauacacuugaacaa

SEQ ID NO: 1334942 - RNA, 21 nt, Human
uuacagugaaaugacuuuagc

SEQ ID NO: 1334943 - RNA, 20 nt, Human
uuagaugagcaagauuggga

SEQ ID NO: 1334944 - RNA, 23 nt, Human
uucaaaauaaaaagaaaagaaac

SEQ ID NO: 1334945 - RNA, 18 nt, Human
uucacugcuucuuugcua

SEQ ID NO: 1334946 - RNA, 24 nt, Human
uucuaaaaagcaaaugccuaugga

SEQ ID NO: 1334947 - RNA, 24 nt, Human
uuguaaaacuaaagaaaacagcua

SEQ ID NO: 1334948 - RNA, 20 nt, Human
uuuguagacauguuuguaaa

SEQ ID NO: 1334949 - RNA, 18 nt, Human
uuugugcugaauauucuu

SEQ ID NO: 1334950 - RNA, 20 nt, Human
uuuugugcugaauauucuuc

SEQ ID NO: 1334951 - RNA, 18 nt, Human
uuuuuuuuuuuuuuuuug

SEQ ID NO: 1334952 - RNA, 22 nt, Human
uuuuuuuuuuuuuuuuugauag

SEQ ID NO: 1334953 - RNA, 18 nt, Human
aacauccgggcugcccuu

SEQ ID NO: 1334954 - RNA, 25 nt, Human
aauuucuuuuaauguauaggauugu

SEQ ID NO: 1334955 - RNA, 21 nt, Human
acagaauggggcccagggguc

SEQ ID NO: 1334956 - RNA, 21 nt, Human
agugauucuucucuuuucucg

SEQ ID NO: 1334957 - RNA, 25 nt, Human
cagaauggggcccaggggucuucau

SEQ ID NO: 1334958 - RNA, 18 nt, Human
ccagagacucagacgcca

SEQ ID NO: 1334959 - RNA, 22 nt, Human
ccccaacagaauggggcccagg

SEQ ID NO: 1334960 - RNA, 22 nt, Human
gcaguagugagugauucuucuc

SEQ ID NO: 1334961 - RNA, 22 nt, Human
gcuacgccagagacucagacgc

SEQ ID NO: 1334962 - RNA, 18 nt, Human
gugagugauucuucucuu

SEQ ID NO: 1334963 - RNA, 20 nt, Human
ucacccagcccauucggauc

SEQ ID NO: 1334964 - RNA, 21 nt, Human
ucucggguucacuuugaccug

SEQ ID NO: 1334965 - RNA, 18 nt, Human
ugagugauucuucucuuu

SEQ ID NO: 1334966 - RNA, 22 nt, Human
ugauucuucucuuuucucgggu

SEQ ID NO: 1334967 - RNA, 21 nt, Human
uggggcccaggggucuucauc

SEQ ID NO: 1334968 - RNA, 23 nt, Human
aaaaaaaacaaagagaaaccuag

SEQ ID NO: 1334969 - RNA, 24 nt, Human
aaaaaaaacaaagagaaaccuaga

SEQ ID NO: 1334970 - RNA, 23 nt, Human
aaaaacaaagagaaaccuagaua

SEQ ID NO: 1334971 - RNA, 24 nt, Human
aaaaaggauuuuaaauacaaaacc

SEQ ID NO: 1334972 - RNA, 21 nt, Human
aaaauccacuauauuccaagu

SEQ ID NO: 1334973 - RNA, 19 nt, Human
aagguauuuuauuugguau

SEQ ID NO: 1334974 - RNA, 23 nt, Human
acuuuaaaaaaaacaaagagaaa

SEQ ID NO: 1334975 - RNA, 19 nt, Human
agauagaauauauauaaau

SEQ ID NO: 1334976 - RNA, 19 nt, Human
agcauauggacaaaaagga

SEQ ID NO: 1334977 - RNA, 23 nt, Human
agcauuuggaaaaaccaaaaaug

SEQ ID NO: 1334978 - RNA, 19 nt, Human
auauuccaaguuaaacucu

SEQ ID NO: 1334979 - RNA, 18 nt, Human
aucacuuuaaaaaaaaca

SEQ ID NO: 1334980 - RNA, 21 nt, Human
aucaucacuuuaaaaaaaaca

SEQ ID NO: 1334981 - RNA, 22 nt, Human
aucaucacuuuaaaaaaaacaa

SEQ ID NO: 1334982 - RNA, 21 nt, Human
augucauacaaccucuacaug

SEQ ID NO: 1334983 - RNA, 21 nt, Human
auuuggggagaaauuaaaaga

SEQ ID NO: 1334984 - RNA, 22 nt, Human
caacauugucaugugcaaucag

SEQ ID NO: 1334985 - RNA, 24 nt, Human
cacuuuaaaaaaaacaaagagaaa

SEQ ID NO: 1334986 - RNA, 31 nt, Human
cacuuuaaaaaaaacaaagagaaaccuagag

SEQ ID NO: 1334987 - RNA, 22 nt, Human
cagcauuuggaaaaaccaaaaa

SEQ ID NO: 1334988 - RNA, 18 nt, Human
ccaguccaugaaaucauc

SEQ ID NO: 1334989 - RNA, 18 nt, Human
cuuuuaaaugcccagucc

SEQ ID NO: 1334990 - RNA, 20 nt, Human
gcuucuaaaagcccugggga

SEQ ID NO: 1334991 - RNA, 19 nt, Human
ggaaaaaccaaaaauggac

SEQ ID NO: 1334992 - RNA, 21 nt, Human
ggggaggagccucauauagca

SEQ ID NO: 1334993 - RNA, 24 nt, Human
uaaaaugauuagauuugaggauca

SEQ ID NO: 1334994 - RNA, 23 nt, Human
uaaauucucaauugaucgggguu

SEQ ID NO: 1334995 - RNA, 22 nt, Human
uagcucaaugucauacaaccuc

SEQ ID NO: 1334996 - RNA, 23 nt, Human
uauuccaaguuaaacucugaggg

SEQ ID NO: 1334997 - RNA, 23 nt, Human
uauucucugcaaaacuaaauucc

SEQ ID NO: 1334998 - RNA, 22 nt, Human
ucugaggguucugcacuauagc

SEQ ID NO: 1334999 - RNA, 24 nt, Human
uggaccauauuuggggagaaauua

SEQ ID NO: 1335000 - RNA, 19 nt, Human
uggggagaaauuaaaagag

SEQ ID NO: 1335001 - RNA, 21 nt, Human
ugugcaaucagugaauuucag

SEQ ID NO: 1335002 - RNA, 23 nt, Human
ugugcaaucagugaauuucaguu

SEQ ID NO: 1335003 - RNA, 20 nt, Human
uuaaaaaaaacaaagagaaa

SEQ ID NO: 1335004 - RNA, 18 nt, Human
uucauauuggcauucacu

SEQ ID NO: 1335005 - RNA, 22 nt, Human
uuuacauugcacugugaaguuc

SEQ ID NO: 1335006 - RNA, 21 nt, Human
aaacagaagaaauaaauccag

SEQ ID NO: 1335007 - RNA, 20 nt, Human
aaguauacaaagauuaccug

SEQ ID NO: 1335008 - RNA, 24 nt, Human
acaaauauaauccugagcugaaaa

SEQ ID NO: 1335009 - RNA, 24 nt, Human
acauaacuuaacagagcuuguaua

SEQ ID NO: 1335010 - RNA, 25 nt, Human
caagauacuguaaacauaacuuaac

SEQ ID NO: 1335011 - RNA, 18 nt, Human
caggugauggugacuaua

SEQ ID NO: 1335012 - RNA, 26 nt, Human
ccgccgccucguccucaagccgcucc

SEQ ID NO: 1335013 - RNA, 20 nt, Human
ccgccucguccucaagccgc

SEQ ID NO: 1335014 - RNA, 22 nt, Human
ccgccucguccucaagccgcuc

SEQ ID NO: 1335015 - RNA, 22 nt, Human
ccgcggccgccgccucguccuc

SEQ ID NO: 1335016 - RNA, 22 nt, Human
ccugcgccaagugauuuuuuuu

SEQ ID NO: 1335017 - RNA, 22 nt, Human
cuccccgcggccgccgccucgu

SEQ ID NO: 1335018 - RNA, 23 nt, Human
gaguggauaaaaaaaacauaggg

SEQ ID NO: 1335019 - RNA, 22 nt, Human
gcugaaaaacugggauuugggg

SEQ ID NO: 1335020 - RNA, 23 nt, Human
gcugaaaaacugggauuuggggg

SEQ ID NO: 1335021 - RNA, 20 nt, Human
gggggagagccaucuuugca

SEQ ID NO: 1335022 - RNA, 22 nt, Human
guaaacauaacuuaacagagcu

SEQ ID NO: 1335023 - RNA, 21 nt, Human
ucuaaaggaugcuucucuguu

SEQ ID NO: 1335024 - RNA, 21 nt, Human
ugauauucgacugccagagac

SEQ ID NO: 1335025 - RNA, 21 nt, Human
ugauuacaaauauaauccuga

SEQ ID NO: 1335026 - RNA, 20 nt, Human
uugggggagagccaucuuug

SEQ ID NO: 1335027 - RNA, 18 nt, Human
uuucuucuuucacugugg

SEQ ID NO: 1335028 - RNA, 19 nt, Human
aaucuagcuacccuuucug

SEQ ID NO: 1335029 - RNA, 22 nt, Human
acaccacagaacaaaucuugac

SEQ ID NO: 1335030 - RNA, 23 nt, Human
acauggacuaagcucuaaaaggu

SEQ ID NO: 1335031 - RNA, 22 nt, Human
accacagaacaaaucuugacaa

SEQ ID NO: 1335032 - RNA, 19 nt, Human
acugaagagcuuucaaucu

SEQ ID NO: 1335033 - RNA, 26 nt, Human
agaaaaaaauagauucagaaaauaaa

SEQ ID NO: 1335034 - RNA, 21 nt, Human
agacagacuaagaacauccuc

SEQ ID NO: 1335035 - RNA, 22 nt, Human
agcaagaaaaaaauagauucag

SEQ ID NO: 1335036 - RNA, 23 nt, Human
aggaagucugaucaucuccagug

SEQ ID NO: 1335037 - RNA, 24 nt, Human
aggcauuuauuaugccaaguaacg

SEQ ID NO: 1335038 - RNA, 21 nt, Human
aggggcggggcgagcgggggc

SEQ ID NO: 1335039 - RNA, 23 nt, Human
agguauuggggccacacugggcu

SEQ ID NO: 1335040 - RNA, 18 nt, Human
aguggaaaaacaaagcca

SEQ ID NO: 1335041 - RNA, 19 nt, Human
auaagcccaaagugccuca

SEQ ID NO: 1335042 - RNA, 20 nt, Human
auggaaugugcauaccuaca

SEQ ID NO: 1335043 - RNA, 22 nt, Human
auuuacaguuacauagauugcu

SEQ ID NO: 1335044 - RNA, 23 nt, Human
caccuucaaagcuaucacuccaa

SEQ ID NO: 1335045 - RNA, 22 nt, Human
cacugggcucuaaguggaaagc

SEQ ID NO: 1335046 - RNA, 25 nt, Human
cagaaaauaaaaugucuuuuaggca

SEQ ID NO: 1335047 - RNA, 22 nt, Human
cagcgcagcagcguacgggucc

SEQ ID NO: 1335048 - RNA, 21 nt, Human
caugagaauaaugcucuuuua

SEQ ID NO: 1335049 - RNA, 22 nt, Human
cauggacuaagcucuaaaaggu

SEQ ID NO: 1335050 - RNA, 18 nt, Human
cauggccgugugcauacc

SEQ ID NO: 1335051 - RNA, 21 nt, Human
ccagcccuacuuccgggagcc

SEQ ID NO: 1335052 - RNA, 23 nt, Human
ccaggggcggggcgagcgggggc

SEQ ID NO: 1335053 - RNA, 21 nt, Human
cccuacgccagcccuacuucc

SEQ ID NO: 1335054 - RNA, 22 nt, Human
cgaagugcauauuaaaaacuaa

SEQ ID NO: 1335055 - RNA, 21 nt, Human
cgacccgucaccaagggccag

SEQ ID NO: 1335056 - RNA, 21 nt, Human
cgggagccacgucagcgcagc

SEQ ID NO: 1335057 - RNA, 22 nt, Human
cucagcccggccucacuucagc

SEQ ID NO: 1335058 - RNA, 26 nt, Human
cuucuuacaaacaaaaauaaaauuuu

SEQ ID NO: 1335059 - RNA, 24 nt, Human
gaaauuuccccacgaagugcauau

SEQ ID NO: 1335060 - RNA, 18 nt, Human
gaagugcauauuaaaaac

SEQ ID NO: 1335061 - RNA, 18 nt, Human
gggcggggcgagcggggg

SEQ ID NO: 1335062 - RNA, 20 nt, Human
gggcggggcgagcgggggcc

SEQ ID NO: 1335063 - RNA, 26 nt, Human
gugugcauaccuauggaaugugcaua

SEQ ID NO: 1335064 - RNA, 24 nt, Human
uaaaugaacacuuucauuaacuug

SEQ ID NO: 1335065 - RNA, 18 nt, Human
uaagagccucagcccggc

SEQ ID NO: 1335066 - RNA, 22 nt, Human
uaagcucuaaaagguugaguca

SEQ ID NO: 1335067 - RNA, 21 nt, Human
uaccacuggcccuaauuguuu

SEQ ID NO: 1335068 - RNA, 21 nt, Human
uacuuuuccuuuuuauaaaua

SEQ ID NO: 1335069 - RNA, 24 nt, Human
uagaacagcagcaaucucugggua

SEQ ID NO: 1335070 - RNA, 24 nt, Human
uagcaagaaaaaaauagauucaga

SEQ ID NO: 1335071 - RNA, 25 nt, Human
uaguuaauaccacuggcccuaauug

SEQ ID NO: 1335072 - RNA, 19 nt, Human
uaugaaaacuacuuuuccu

SEQ ID NO: 1335073 - RNA, 21 nt, Human
uauuacauggccgugugcaua

SEQ ID NO: 1335074 - RNA, 20 nt, Human
uauuggggccacacugggcu

SEQ ID NO: 1335075 - RNA, 25 nt, Human
ucaagaaucucuucaguuguucccc

SEQ ID NO: 1335076 - RNA, 26 nt, Human
ucagcccggccucacuucagcuuuga

SEQ ID NO: 1335077 - RNA, 23 nt, Human
ucagcgcagcagcguacgggucc

SEQ ID NO: 1335078 - RNA, 21 nt, Human
ucaucuccaguguuuugucuu

SEQ ID NO: 1335079 - RNA, 21 nt, Human
uccauuaccuauguaaaugaa

SEQ ID NO: 1335080 - RNA, 20 nt, Human
uccccauuauagcaagaaaa

SEQ ID NO: 1335081 - RNA, 21 nt, Human
ucuagcuacccuuucuguaaa

SEQ ID NO: 1335082 - RNA, 21 nt, Human
ucuguaaaauaaauagaacag

SEQ ID NO: 1335083 - RNA, 19 nt, Human
ucuucaguuguuccccaau

SEQ ID NO: 1335084 - RNA, 18 nt, Human
ugacaugagaauaaugcu

SEQ ID NO: 1335085 - RNA, 19 nt, Human
uggcacgcaggagcgacaa

SEQ ID NO: 1335086 - RNA, 24 nt, Human
ugguuuaauuuacaguuacauaga

SEQ ID NO: 1335087 - RNA, 24 nt, Human
uguaaauaguagaauuuuauacaa

SEQ ID NO: 1335088 - RNA, 21 nt, Human
ugugcauaccuacaccacaga

SEQ ID NO: 1335089 - RNA, 23 nt, Human
ugugcauaccuacaccacagaac

SEQ ID NO: 1335090 - RNA, 21 nt, Human
uuaaguggaaaaacaaagcca

SEQ ID NO: 1335091 - RNA, 18 nt, Human
uucagaaaauaaaauguc

SEQ ID NO: 1335092 - RNA, 25 nt, Human
uuugucuuaaaaacugcuuuccaaa

SEQ ID NO: 1335093 - RNA, 21 nt, Human
aaaaccugccagaauaagaca

SEQ ID NO: 1335094 - RNA, 20 nt, Human
aaacaaaacuacaagaaaac

SEQ ID NO: 1335095 - RNA, 21 nt, Human
aaacaaaauauauacacagaa

SEQ ID NO: 1335096 - RNA, 19 nt, Human
aaacaaaucagaagagcau

SEQ ID NO: 1335097 - RNA, 25 nt, Human
aaccaaacaaaacuacaagaaaaca

SEQ ID NO: 1335098 - RNA, 19 nt, Human
aaccuauuuguuguuuaga

SEQ ID NO: 1335099 - RNA, 21 nt, Human
aagacaauagaagagcguauc

SEQ ID NO: 1335100 - RNA, 19 nt, Human
aaugugaaagcaaguaaga

SEQ ID NO: 1335101 - RNA, 20 nt, Human
acaaaucugcacuacccaag

SEQ ID NO: 1335102 - RNA, 21 nt, Human
acagaaagaagcucgcacaga

SEQ ID NO: 1335103 - RNA, 24 nt, Human
acagagcaagacucagucucaaaa

SEQ ID NO: 1335104 - RNA, 24 nt, Human
acucauuccuuucuguuuccucug

SEQ ID NO: 1335105 - RNA, 23 nt, Human
acugcacuccagccugaugacag

SEQ ID NO: 1335106 - RNA, 25 nt, Human
acugcacuccagccugaugacagag

SEQ ID NO: 1335107 - RNA, 26 nt, Human
agaaccaaacaaaacuacaagaaaac

SEQ ID NO: 1335108 - RNA, 25 nt, Human
agguaacccuaacuauccgcaaucc

SEQ ID NO: 1335109 - RNA, 24 nt, Human
agugagccacugcacuccagccug

SEQ ID NO: 1335110 - RNA, 19 nt, Human
auaaaacaaaauauauaca

SEQ ID NO: 1335111 - RNA, 22 nt, Human
aucuuuuuuuuuuuuuugucuu

SEQ ID NO: 1335112 - RNA, 22 nt, Human
caaacaaaacuacaagaaaaca

SEQ ID NO: 1335113 - RNA, 24 nt, Human
caaaucugcacuacccaagccucc

SEQ ID NO: 1335114 - RNA, 20 nt, Human
caacaguguagauuacagca

SEQ ID NO: 1335115 - RNA, 21 nt, Human
caagaaaacauuuucaaaacc

SEQ ID NO: 1335116 - RNA, 20 nt, Human
cacggaaaaaaauaaaacaa

SEQ ID NO: 1335117 - RNA, 22 nt, Human
cacuacccaagccuccuugccu

SEQ ID NO: 1335118 - RNA, 22 nt, Human
cacuccagccugaugacagagc

SEQ ID NO: 1335119 - RNA, 18 nt, Human
cacugcacuccagccuga

SEQ ID NO: 1335120 - RNA, 18 nt, Human
cacugcacuccagccuga

SEQ ID NO: 1335121 - RNA, 23 nt, Human
cacugcacuccagccugaugaca

SEQ ID NO: 1335122 - RNA, 24 nt, Human
cacugcacuccagccugaugacag

SEQ ID NO: 1335123 - RNA, 25 nt, Human
cagcaggcguucucuaccuggacuc

SEQ ID NO: 1335124 - RNA, 23 nt, Human
cauuuucaaaaccuuuuuuuuca

SEQ ID NO: 1335125 - RNA, 23 nt, Human
ccaaacaaaacuacaagaaaaca

SEQ ID NO: 1335126 - RNA, 18 nt, Human
ccacugcacuccagccug

SEQ ID NO: 1335127 - RNA, 19 nt, Human
ccacugcacuccagccuga

SEQ ID NO: 1335128 - RNA, 20 nt, Human
ccacugcacuccagccugau

SEQ ID NO: 1335129 - RNA, 23 nt, Human
ccacugcacuccagccugaugac

SEQ ID NO: 1335130 - RNA, 19 nt, Human
ccucacaggugcugggcag

SEQ ID NO: 1335131 - RNA, 21 nt, Human
ccugaugacagagcaagacuc

SEQ ID NO: 1335132 - RNA, 19 nt, Human
ccuuucuguuuccucugga

SEQ ID NO: 1335133 - RNA, 18 nt, Human
ccuuuuuuuucaggcuga

SEQ ID NO: 1335134 - RNA, 21 nt, Human
cgucaggcgcugggaauggca

SEQ ID NO: 1335135 - RNA, 24 nt, Human
cucaaaaugugaaagcaaguaaga

SEQ ID NO: 1335136 - RNA, 18 nt, Human
gaacugacacgucaggcc

SEQ ID NO: 1335137 - RNA, 21 nt, Human
gaagagcauuuauugggaacu

SEQ ID NO: 1335138 - RNA, 18 nt, Human
gacagagcaagacucagu

SEQ ID NO: 1335139 - RNA, 20 nt, Human
gagcaagacucagucucaaa

SEQ ID NO: 1335140 - RNA, 23 nt, Human
gcacuccagccugaugacagagc

SEQ ID NO: 1335141 - RNA, 20 nt, Human
gggaaacaaaucagaagagc

SEQ ID NO: 1335142 - RNA, 19 nt, Human
gguugcagugagccacugc

SEQ ID NO: 1335143 - RNA, 23 nt, Human
uaccuggacucaugauuggauuu

SEQ ID NO: 1335144 - RNA, 21 nt, Human
uagaagagcguaucgucaggc

SEQ ID NO: 1335145 - RNA, 21 nt, Human
uauacacagaaagaagcucgc

SEQ ID NO: 1335146 - RNA, 23 nt, Human
uauacacggaaaaaaauaaaaca

SEQ ID NO: 1335147 - RNA, 21 nt, Human
uauauacacagaaagaagcuc

SEQ ID NO: 1335148 - RNA, 26 nt, Human
uauauacacagaaagaagcucgcaca

SEQ ID NO: 1335149 - RNA, 26 nt, Human
uaucgucaggcgcugggaauggcacc

SEQ ID NO: 1335150 - RNA, 22 nt, Human
ucaaagauugaaauacacaaau

SEQ ID NO: 1335151 - RNA, 18 nt, Human
uccaaggaauaaaauuuc

SEQ ID NO: 1335152 - RNA, 19 nt, Human
ucgagugauuaaaaccuau

SEQ ID NO: 1335153 - RNA, 21 nt, Human
ucgcacagagucaggcgugca

SEQ ID NO: 1335154 - RNA, 24 nt, Human
ucucauaaaagcuacacgauucag

SEQ ID NO: 1335155 - RNA, 19 nt, Human
ucugucacccagguugcag

SEQ ID NO: 1335156 - RNA, 19 nt, Human
ucuuguucugucacccagg

SEQ ID NO: 1335157 - RNA, 19 nt, Human
ucuuguucugucacccagg

SEQ ID NO: 1335158 - RNA, 22 nt, Human
ucuuguucugucacccagguug

SEQ ID NO: 1335159 - RNA, 21 nt, Human
ucuuuuuuuuuuuuuugucuu

SEQ ID NO: 1335160 - RNA, 21 nt, Human
ugaaagcaaguaagagggggg

SEQ ID NO: 1335161 - RNA, 21 nt, Human
ugaaagcaaguaagagggggg

SEQ ID NO: 1335162 - RNA, 21 nt, Human
ugaaagcaaguaagagggggg

SEQ ID NO: 1335163 - RNA, 23 nt, Human
ugaaagcaaguaagaggggggug

SEQ ID NO: 1335164 - RNA, 19 nt, Human
ugcagcaacgucacacacu

SEQ ID NO: 1335165 - RNA, 19 nt, Human
uucaggcugaagaaaucgu

SEQ ID NO: 1335166 - RNA, 18 nt, Human
uugcagugagccacugca

SEQ ID NO: 1335167 - RNA, 22 nt, Human
uuuucaaaaccuuuuuuuucag

SEQ ID NO: 1335168 - RNA, 26 nt, Human
auuauuuuccuucugugaccuuucca

SEQ ID NO: 1335169 - RNA, 19 nt, Human
caagucugaaacaguccca

SEQ ID NO: 1335170 - RNA, 18 nt, Human
ugugaccuuuccaagucg

SEQ ID NO: 1335171 - RNA, 19 nt, Human
ugugaccuuuccaagucug

SEQ ID NO: 1335172 - RNA, 23 nt, Human
aaacaggcuugaaccacaaggau

SEQ ID NO: 1335173 - RNA, 20 nt, Human
aagauggaagaaaacaggcu

SEQ ID NO: 1335174 - RNA, 22 nt, Human
acaaaggcccucagcugggaca

SEQ ID NO: 1335175 - RNA, 24 nt, Human
acagcagaaggcacgaguccugaa

SEQ ID NO: 1335176 - RNA, 18 nt, Human
agaaggagggcgggaagg

SEQ ID NO: 1335177 - RNA, 18 nt, Human
aggaaggagaugucagug

SEQ ID NO: 1335178 - RNA, 23 nt, Human
aggaaggagaugucagugcuuua

SEQ ID NO: 1335179 - RNA, 21 nt, Human
augaaggggucacagagggac

SEQ ID NO: 1335180 - RNA, 19 nt, Human
cacgaguccugaagaugga

SEQ ID NO: 1335181 - RNA, 23 nt, Human
cccgcccucgacacccgccgacg

SEQ ID NO: 1335182 - RNA, 24 nt, Human
cgaggcaacccgcccucgacaccc

SEQ ID NO: 1335183 - RNA, 24 nt, Human
cgcucgcucucucacccggcucua

SEQ ID NO: 1335184 - RNA, 19 nt, Human
cggggaccuggugugugac

SEQ ID NO: 1335185 - RNA, 22 nt, Human
gaagaaaacaggcuugaaccac

SEQ ID NO: 1335186 - RNA, 23 nt, Human
gaagaaaacaggcuugaaccaca

SEQ ID NO: 1335187 - RNA, 20 nt, Human
gaagauggaagaaaacaggc

SEQ ID NO: 1335188 - RNA, 25 nt, Human
gagaacagcagaaggcaccgguacc

SEQ ID NO: 1335189 - RNA, 21 nt, Human
gagaacagcagaaggcacgag

SEQ ID NO: 1335190 - RNA, 21 nt, Human
gaugaaggggucacagaggga

SEQ ID NO: 1335191 - RNA, 22 nt, Human
gccacaaugagaacagcagaag

SEQ ID NO: 1335192 - RNA, 25 nt, Human
gcgaggcaacccgcccucgacaccc

SEQ ID NO: 1335193 - RNA, 20 nt, Human
gcgccgacaccgcggcuucc

SEQ ID NO: 1335194 - RNA, 23 nt, Human
gugacgagaaggagggcgggaag

SEQ ID NO: 1335195 - RNA, 18 nt, Human
uaggaaggagaugucagu

SEQ ID NO: 1335196 - RNA, 22 nt, Human
uaucaaagaugaaggggucaca

SEQ ID NO: 1335197 - RNA, 24 nt, Human
ucagcugggacauuucuuggccac

SEQ ID NO: 1335198 - RNA, 21 nt, Human
ucccaaaauuccuggccuugc

SEQ ID NO: 1335199 - RNA, 24 nt, Human
ugacgagaaggagggcgggaaggg

SEQ ID NO: 1335200 - RNA, 19 nt, Human
uggaagaaaacaggcuuga

SEQ ID NO: 1335201 - RNA, 25 nt, Human
uggaagaaaacaggcuugaaccaca

SEQ ID NO: 1335202 - RNA, 23 nt, Human
uggccacaaugagaacagcagaa

SEQ ID NO: 1335203 - RNA, 19 nt, Human
uggugugugacgagaagga

SEQ ID NO: 1335204 - RNA, 26 nt, Human
ugugacgagaaggagggcgggaaggg

SEQ ID NO: 1335205 - RNA, 18 nt, Human
uuccuggccuugcaccau

SEQ ID NO: 1335206 - RNA, 21 nt, Human
uuuuuuuuuuuuacagaacuc

SEQ ID NO: 1335207 - RNA, 23 nt, Human
uuuuuuuuuuuuuuuuuuuacag

SEQ ID NO: 1335208 - RNA, 18 nt, Human
aaaauccucuccagguuc

SEQ ID NO: 1335209 - RNA, 22 nt, Human
aaacacacagccacacagaaaa

SEQ ID NO: 1335210 - RNA, 19 nt, Human
aacacacagccacacagaa

SEQ ID NO: 1335211 - RNA, 22 nt, Human
acuuugaaaaauccucuccagg

SEQ ID NO: 1335212 - RNA, 23 nt, Human
agacagccagagaggcaggcagc

SEQ ID NO: 1335213 - RNA, 22 nt, Human
agcucacuuccuacuacuucug

SEQ ID NO: 1335214 - RNA, 20 nt, Human
caaacacacagccacacaga

SEQ ID NO: 1335215 - RNA, 25 nt, Human
caaaugacccaacuagucugacauc

SEQ ID NO: 1335216 - RNA, 21 nt, Human
caacuagucugacaucaccaa

SEQ ID NO: 1335217 - RNA, 22 nt, Human
cacagccacacagaaaaugaga

SEQ ID NO: 1335218 - RNA, 19 nt, Human
cacguugagcaccaacuuc

SEQ ID NO: 1335219 - RNA, 18 nt, Human
cagacagccagagaggca

SEQ ID NO: 1335220 - RNA, 19 nt, Human
cagacagccagagaggcag

SEQ ID NO: 1335221 - RNA, 20 nt, Human
caggcagcgagcgcacaagc

SEQ ID NO: 1335222 - RNA, 27 nt, Human
cccaaacacacagccacacagaaaaug

SEQ ID NO: 1335223 - RNA, 23 nt, Human
ccuaccccgacggugcccagaca

SEQ ID NO: 1335224 - RNA, 23 nt, Human
ccuucaaaugacccaacuagucu

SEQ ID NO: 1335225 - RNA, 22 nt, Human
ccuuuggcaaagaauagacccu

SEQ ID NO: 1335226 - RNA, 21 nt, Human
cgagcgcacaagccggcguuu

SEQ ID NO: 1335227 - RNA, 22 nt, Human
cgcguucucggcaucccagucc

SEQ ID NO: 1335228 - RNA, 22 nt, Human
cgcucgcguucucggcauccca

SEQ ID NO: 1335229 - RNA, 22 nt, Human
cucacuuccuacuacuucuguc

SEQ ID NO: 1335230 - RNA, 19 nt, Human
cugcuccuggcucacguug

SEQ ID NO: 1335231 - RNA, 24 nt, Human
cugguccccccuuugguccccugg

SEQ ID NO: 1335232 - RNA, 22 nt, Human
gaaaaauccucuccagguucua

SEQ ID NO: 1335233 - RNA, 18 nt, Human
gaggagccgggacgcugc

SEQ ID NO: 1335234 - RNA, 18 nt, Human
ucccaaacacacagccac

SEQ ID NO: 1335235 - RNA, 22 nt, Human
ucccaguccucaaacagcucgc

SEQ ID NO: 1335236 - RNA, 18 nt, Human
ugagcaggggaggagccg

SEQ ID NO: 1335237 - RNA, 23 nt, Human
ugcccagacaaacccugcucgga

SEQ ID NO: 1335238 - RNA, 21 nt, Human
uuugaaaaauccucuccaggu

SEQ ID NO: 1335239 - RNA, 20 nt, Human
aaggggccaggagcagguca

SEQ ID NO: 1335240 - RNA, 21 nt, Human
aggggccaggagcaggucagg

SEQ ID NO: 1335241 - RNA, 21 nt, Human
caaacccagaggcaaaagggg

SEQ ID NO: 1335242 - RNA, 24 nt, Human
caccaagaagaggcccuccgcucc

SEQ ID NO: 1335243 - RNA, 20 nt, Human
cacgcucccucccagccuag

SEQ ID NO: 1335244 - RNA, 20 nt, Human
cagggcaccaagaagaggcc

SEQ ID NO: 1335245 - RNA, 27 nt, Human
cccauggccagaaacagcccggccagc

SEQ ID NO: 1335246 - RNA, 20 nt, Human
ccggccagccaaggggccag

SEQ ID NO: 1335247 - RNA, 24 nt, Human
ccggccagccaaggggccaggagc

SEQ ID NO: 1335248 - RNA, 23 nt, Human
cgacccauggccagaaacagccc

SEQ ID NO: 1335249 - RNA, 21 nt, Human
cggcgggagcgacccauggcc

SEQ ID NO: 1335250 - RNA, 24 nt, Human
ggcgggagcgacccauggccagaa

SEQ ID NO: 1335251 - RNA, 21 nt, Human
ucccagccuaguccuugcguc

SEQ ID NO: 1335252 - RNA, 24 nt, Human
uccccaaacccagaggcaaaaggg

SEQ ID NO: 1335253 - RNA, 23 nt, Human
uccuugcgucacuguccaugggc

SEQ ID NO: 1335254 - RNA, 21 nt, Human
uggccagaaacagcccggcca

SEQ ID NO: 1335255 - RNA, 24 nt, Human
uugggggcagggcaccaagaagag

SEQ ID NO: 1335256 - RNA, 18 nt, Human
uuuuuuuuuuucucuuug

SEQ ID NO: 1335257 - RNA, 20 nt, Human
uuuuuuuuuuuuuuuucucu

SEQ ID NO: 1335258 - RNA, 23 nt, Human
uuuuuuuuuuuuuuuuucucuuu

SEQ ID NO: 1335259 - RNA, 22 nt, Human
aaaagggagaguuuaaagagaa

SEQ ID NO: 1335260 - RNA, 21 nt, Human
aagggagaguuuaaagagaaa

SEQ ID NO: 1335261 - RNA, 20 nt, Human
acaauggcuaaucuaugagg

SEQ ID NO: 1335262 - RNA, 19 nt, Human
acacacaggcugacggcug

SEQ ID NO: 1335263 - RNA, 22 nt, Human
agcaacggcgacagcaacggaa

SEQ ID NO: 1335264 - RNA, 21 nt, Human
caacuaaugcuaaaauuauaa

SEQ ID NO: 1335265 - RNA, 18 nt, Human
cacacaggcugacggcug

SEQ ID NO: 1335266 - RNA, 23 nt, Human
cauaugcaaagguacacacagug

SEQ ID NO: 1335267 - RNA, 23 nt, Human
caugacuaaaucaacauuuucuc

SEQ ID NO: 1335268 - RNA, 23 nt, Human
ccuuuuauuuugaagcauucacu

SEQ ID NO: 1335269 - RNA, 21 nt, Human
cgacagcaacggcgacagcaa

SEQ ID NO: 1335270 - RNA, 23 nt, Human
cuagaaaauaguuggaaaaauag

SEQ ID NO: 1335271 - RNA, 20 nt, Human
gcccccacaguacaagggcu

SEQ ID NO: 1335272 - RNA, 24 nt, Human
uaaaaugcucuauuuugcuuugag

SEQ ID NO: 1335273 - RNA, 20 nt, Human
uaguaaacaaaaaccaauuu

SEQ ID NO: 1335274 - RNA, 25 nt, Human
uauaacuagaaaauaguuggaaaaa

SEQ ID NO: 1335275 - RNA, 27 nt, Human
ucacaaagcaggccugugccaaggcaa

SEQ ID NO: 1335276 - RNA, 18 nt, Human
uccuccagugaaaagccc

SEQ ID NO: 1335277 - RNA, 27 nt, Human
ucgacagcaacggcgacagcaacggaa

SEQ ID NO: 1335278 - RNA, 19 nt, Human
ugaaggaaauacaccaaaa

SEQ ID NO: 1335279 - RNA, 22 nt, Human
uggaaagcaauugugcaugcaa

SEQ ID NO: 1335280 - RNA, 19 nt, Human
ugugccaaggcaaaaacuc

SEQ ID NO: 1335281 - RNA, 21 nt, Human
uguuuagucuaccuuuuucuc

SEQ ID NO: 1335282 - RNA, 23 nt, Human
uucuauaguauuuauguauugcu

SEQ ID NO: 1335283 - RNA, 24 nt, Human
uucucauaguaaacaaaaaccaau

SEQ ID NO: 1335284 - RNA, 22 nt, Human
uugaaaauaguuggaaaaauag

SEQ ID NO: 1335285 - RNA, 23 nt, Human
uuuuaaaaauuccuuucugcauu

SEQ ID NO: 1335286 - RNA, 23 nt, Human
agccuuggcugaucccagggcca

SEQ ID NO: 1335287 - RNA, 19 nt, Human
aucgcacuacucccucugc

SEQ ID NO: 1335288 - RNA, 24 nt, Human
cacuuuauucccugaaguuaggag

SEQ ID NO: 1335289 - RNA, 20 nt, Human
cagcaaacucuuuauccuuc

SEQ ID NO: 1335290 - RNA, 18 nt, Human
ccagggcucggggccuuc

SEQ ID NO: 1335291 - RNA, 26 nt, Human
cccccgcgcgcaggaucgcacuacuc

SEQ ID NO: 1335292 - RNA, 29 nt, Human
cccgccuugcccuccagcuaguucccccu

SEQ ID NO: 1335293 - RNA, 18 nt, Human
ccuuggcugaucccaggg

SEQ ID NO: 1335294 - RNA, 19 nt, Human
cuuucaggcacacuucugg

SEQ ID NO: 1335295 - RNA, 23 nt, Human
gccauuuguaugcucccuuugca

SEQ ID NO: 1335296 - RNA, 22 nt, Human
gucugggcuuccagggcucggg

SEQ ID NO: 1335297 - RNA, 23 nt, Human
uaggacaauauuccccaccuguu

SEQ ID NO: 1335298 - RNA, 18 nt, Human
ucacagacugccauuugu

SEQ ID NO: 1335299 - RNA, 19 nt, Human
ucccagggccaccagccgc

SEQ ID NO: 1335300 - RNA, 19 nt, Human
ucccccgcgcgcaggaucg

SEQ ID NO: 1335301 - RNA, 23 nt, Human
ucgcacuacucccucugcagucu

SEQ ID NO: 1335302 - RNA, 19 nt, Human
ugcccagcagccaucauac

SEQ ID NO: 1335303 - RNA, 18 nt, Human
uggcccccugggcccacu

SEQ ID NO: 1335304 - RNA, 19 nt, Human
uggcccccugggcccacuu

SEQ ID NO: 1335305 - RNA, 18 nt, Human
uguucccgccuugcccuc

SEQ ID NO: 1335306 - RNA, 23 nt, Human
uucaguguuuucagcaaacucuu

SEQ ID NO: 1335307 - RNA, 20 nt, Human
uuccagggcucggggccuuc

SEQ ID NO: 1335308 - RNA, 18 nt, Human
uuguaugcucccuuugca

SEQ ID NO: 1335309 - RNA, 22 nt, Human
uuguaugcucccuuugcaaccu

SEQ ID NO: 1335310 - RNA, 22 nt, Human
aaaaauaugcuuucuuuuauuc

SEQ ID NO: 1335311 - RNA, 27 nt, Human
aguuuccauuccccuuuccuagauggc

SEQ ID NO: 1335312 - RNA, 18 nt, Human
cagggccaaagugccagc

SEQ ID NO: 1335313 - RNA, 22 nt, Human
ccgaugccugcuugcggccaaa

SEQ ID NO: 1335314 - RNA, 23 nt, Human
ccugaaauuuaaacaguaaccau

SEQ ID NO: 1335315 - RNA, 22 nt, Human
cugaaauuuaaacaguaaccau

SEQ ID NO: 1335316 - RNA, 19 nt, Human
cugugcgcugcuuuguccu

SEQ ID NO: 1335317 - RNA, 18 nt, Human
gcggccaaagcuccuuuc

SEQ ID NO: 1335318 - RNA, 21 nt, Human
gggaaggaagccugugcaauu

SEQ ID NO: 1335319 - RNA, 19 nt, Human
gggaauguauucugccuug

SEQ ID NO: 1335320 - RNA, 25 nt, Human
uaaagaugagccccgcauucucucc

SEQ ID NO: 1335321 - RNA, 22 nt, Human
uaggcccaguucuguuaaagau

SEQ ID NO: 1335322 - RNA, 23 nt, Human
ucagaugggacccgaugccugcu

SEQ ID NO: 1335323 - RNA, 25 nt, Human
ucaguuaguuuacuuguccugaaau

SEQ ID NO: 1335324 - RNA, 26 nt, Human
ucaguuaguuuacuuguccugaaauu

SEQ ID NO: 1335325 - RNA, 18 nt, Human
ucauuggcagggccaaag

SEQ ID NO: 1335326 - RNA, 21 nt, Human
ucucaguuuccauuccccuuu

SEQ ID NO: 1335327 - RNA, 21 nt, Human
ucuccaaaugacaccaggccc

SEQ ID NO: 1335328 - RNA, 19 nt, Human
ugagcuguaaagagauugg

SEQ ID NO: 1335329 - RNA, 21 nt, Human
ugaugucagaggaauauguuc

SEQ ID NO: 1335330 - RNA, 19 nt, Human
uggcgaucacgcugguguc

SEQ ID NO: 1335331 - RNA, 19 nt, Human
ugggaauguauucugccuu

SEQ ID NO: 1335332 - RNA, 21 nt, Human
uguccuggggaaggaagccug

SEQ ID NO: 1335333 - RNA, 18 nt, Human
ccgccgccgccgccucgg

SEQ ID NO: 1335334 - RNA, 26 nt, Human
uaccgccgccgccgccucgggccccu

SEQ ID NO: 1335335 - RNA, 21 nt, Human
ucccaauguacaauuuucacc

SEQ ID NO: 1335336 - RNA, 26 nt, Human
ucgccggcuuuauaccgccgccgccg

SEQ ID NO: 1335337 - RNA, 25 nt, Human
aaggccagaggcugcacuggaggcc

SEQ ID NO: 1335338 - RNA, 18 nt, Human
aaguggccuccaggaggg

SEQ ID NO: 1335339 - RNA, 23 nt, Human
accuggggccagcugugggcacu

SEQ ID NO: 1335340 - RNA, 21 nt, Human
acuuguggccauggccuccuc

SEQ ID NO: 1335341 - RNA, 18 nt, Human
aggaggagacgggauuga

SEQ ID NO: 1335342 - RNA, 20 nt, Human
aggaggagacgggauugaug

SEQ ID NO: 1335343 - RNA, 22 nt, Human
aggcaggaggagacgggauuga

SEQ ID NO: 1335344 - RNA, 19 nt, Human
auccagcagccucccagca

SEQ ID NO: 1335345 - RNA, 21 nt, Human
cacaggcugggaggcgcugga

SEQ ID NO: 1335346 - RNA, 18 nt, Human
cagugggguucaguuugg

SEQ ID NO: 1335347 - RNA, 18 nt, Human
ccagcagccucccagcag

SEQ ID NO: 1335348 - RNA, 22 nt, Human
ccagcagccucccagcagcucc

SEQ ID NO: 1335349 - RNA, 19 nt, Human
cccgaagaaccuccucuuc

SEQ ID NO: 1335350 - RNA, 26 nt, Human
cccgaagaaccuccucuuccgcagcc

SEQ ID NO: 1335351 - RNA, 21 nt, Human
cccgcuuuucuucugcacggg

SEQ ID NO: 1335352 - RNA, 21 nt, Human
cccuggugagaccaaaggcuc

SEQ ID NO: 1335353 - RNA, 23 nt, Human
ccguucccucccgcuuuucuucu

SEQ ID NO: 1335354 - RNA, 24 nt, Human
ccugccagcaacaggaagcccugg

SEQ ID NO: 1335355 - RNA, 19 nt, Human
cgcugggugucccuaugca

SEQ ID NO: 1335356 - RNA, 25 nt, Human
cggagauuauucugccuuggucugg

SEQ ID NO: 1335357 - RNA, 20 nt, Human
cugugguuggccugguguuu

SEQ ID NO: 1335358 - RNA, 23 nt, Human
gagcccacuggugagcuucacug

SEQ ID NO: 1335359 - RNA, 23 nt, Human
gagcuucacugucaccuggcccu

SEQ ID NO: 1335360 - RNA, 21 nt, Human
gauugcaggagaggaggcagg

SEQ ID NO: 1335361 - RNA, 20 nt, Human
gcagccucccagcagcuccg

SEQ ID NO: 1335362 - RNA, 22 nt, Human
gcaggaggagacgggaggucgc

SEQ ID NO: 1335363 - RNA, 22 nt, Human
gccuggggcugguggcggcuuc

SEQ ID NO: 1335364 - RNA, 22 nt, Human
ggccagaggcugcacuggaggc

SEQ ID NO: 1335365 - RNA, 20 nt, Human
ggccauggccuccucggggc

SEQ ID NO: 1335366 - RNA, 22 nt, Human
ggcuguagcgacgcuggcaacc

SEQ ID NO: 1335367 - RNA, 18 nt, Human
gggcacaggcugggaggc

SEQ ID NO: 1335368 - RNA, 22 nt, Human
gggcuuccauugucuacugggu

SEQ ID NO: 1335369 - RNA, 18 nt, Human
gggggccuggggcuggug

SEQ ID NO: 1335370 - RNA, 21 nt, Human
gucccgaagaaccuccucuuc

SEQ ID NO: 1335371 - RNA, 20 nt, Human
uaaaaauccccuucugauau

SEQ ID NO: 1335372 - RNA, 21 nt, Human
uaaaaauccccuucugauaug

SEQ ID NO: 1335373 - RNA, 18 nt, Human
uaaaauaaggccagaggc

SEQ ID NO: 1335374 - RNA, 19 nt, Human
uaaaauaaggccagaggcu

SEQ ID NO: 1335375 - RNA, 22 nt, Human
uaaaauaaggccagaggcugca

SEQ ID NO: 1335376 - RNA, 18 nt, Human
uaaaggagcccacuggug

SEQ ID NO: 1335377 - RNA, 18 nt, Human
ucaccuggcccugcuggc

SEQ ID NO: 1335378 - RNA, 19 nt, Human
ucauccggagauuauucug

SEQ ID NO: 1335379 - RNA, 25 nt, Human
ucuacugggucuguccacaccccag

SEQ ID NO: 1335380 - RNA, 21 nt, Human
ucuccaaguggccuccaggaa

SEQ ID NO: 1335381 - RNA, 19 nt, Human
ucugccuuggucugggcug

SEQ ID NO: 1335382 - RNA, 19 nt, Human
ugagcaagcagugggguuc

SEQ ID NO: 1335383 - RNA, 21 nt, Human
ugccuuggucugggcuguagc

SEQ ID NO: 1335384 - RNA, 20 nt, Human
ugccuugugguccuuucccc

SEQ ID NO: 1335385 - RNA, 24 nt, Human
ugccuugugguccuuuccccuggc

SEQ ID NO: 1335386 - RNA, 21 nt, Human
uggcaaccuggggccagcugu

SEQ ID NO: 1335387 - RNA, 18 nt, Human
ugggaccaaguagugcca

SEQ ID NO: 1335388 - RNA, 18 nt, Human
ugggaggcgcuggacggc

SEQ ID NO: 1335389 - RNA, 19 nt, Human
ugggaggcgcuggacggca

SEQ ID NO: 1335390 - RNA, 24 nt, Human
ugggcacuuguggccauggccucc

SEQ ID NO: 1335391 - RNA, 20 nt, Human
ugggguucaguuugggacca

SEQ ID NO: 1335392 - RNA, 21 nt, Human
uuuuaaaaauccccuucugau

SEQ ID NO: 1335393 - RNA, 18 nt, Human
agacagacagcucccagg

SEQ ID NO: 1335394 - RNA, 21 nt, Human
caguggcagcaggagcuccuu

SEQ ID NO: 1335395 - RNA, 24 nt, Human
ccagugccuuaugguggagccaag

SEQ ID NO: 1335396 - RNA, 20 nt, Human
cuaaugguggacgucuuccu

SEQ ID NO: 1335397 - RNA, 21 nt, Human
cucugaaaggcacuugugagg

SEQ ID NO: 1335398 - RNA, 24 nt, Human
gcaguggcagcaggagcuccuuuu

SEQ ID NO: 1335399 - RNA, 22 nt, Human
ggaaagacagacagcucccagg

SEQ ID NO: 1335400 - RNA, 25 nt, Human
ugauggcauuagguuuauuuugugg

SEQ ID NO: 1335401 - RNA, 23 nt, Human
uggagccaaggguuaagcagaug

SEQ ID NO: 1335402 - RNA, 21 nt, Human
uggcuaaugguggacgucuuc

SEQ ID NO: 1335403 - RNA, 22 nt, Human
ugggaaagcagaauuggggcuc

SEQ ID NO: 1335404 - RNA, 18 nt, Human
uuuuuuuuuuuuuuuuug

SEQ ID NO: 1335405 - RNA, 21 nt, Human
uuuuuuuuuuuuuuuuugccu

SEQ ID NO: 1335406 - RNA, 24 nt, Human
uuuuuuuuuuuuuuuuuugccuga

SEQ ID NO: 1335407 - RNA, 19 nt, Human
agaauaucuguccucugcc

SEQ ID NO: 1335408 - RNA, 22 nt, Human
agucauggauuccaccagagga

SEQ ID NO: 1335409 - RNA, 18 nt, Human
caccacaccccuccaucc

SEQ ID NO: 1335410 - RNA, 21 nt, Human
caugccaggguuuguauguga

SEQ ID NO: 1335411 - RNA, 22 nt, Human
cccuggggccuccaaagguggg

SEQ ID NO: 1335412 - RNA, 27 nt, Human
ccuuugcuccuggggccucccuggggc

SEQ ID NO: 1335413 - RNA, 24 nt, Human
cuccuguguuccaggaacgagggc

SEQ ID NO: 1335414 - RNA, 22 nt, Human
gaagaagccagucauagcuggg

SEQ ID NO: 1335415 - RNA, 22 nt, Human
gaggagcuguauaagggguugg

SEQ ID NO: 1335416 - RNA, 20 nt, Human
gcuccuggggccucccuggg

SEQ ID NO: 1335417 - RNA, 21 nt, Human
ggaccuuugcuccuggggccu

SEQ ID NO: 1335418 - RNA, 23 nt, Human
gggcagucucuccaggagcucug

SEQ ID NO: 1335419 - RNA, 19 nt, Human
uccaggagcucuguggggg

SEQ ID NO: 1335420 - RNA, 23 nt, Human
uccaggagcucuguggggggcgc

SEQ ID NO: 1335421 - RNA, 22 nt, Human
ucccuggggccuccaaaggugg

SEQ ID NO: 1335422 - RNA, 24 nt, Human
uccucugcccccuugaagaagcca

SEQ ID NO: 1335423 - RNA, 23 nt, Human
uggcaaacgugaauggcaggcuc

SEQ ID NO: 1335424 - RNA, 23 nt, Human
uggcaggcucuggggacagccau

SEQ ID NO: 1335425 - RNA, 21 nt, Human
uguccucugcccccuugaaga

SEQ ID NO: 1335426 - RNA, 18 nt, Human
uugaagaagccagucaua

SEQ ID NO: 1335427 - RNA, 26 nt, Human
uugauagaugauaagcugguuuuucu

SEQ ID NO: 1335428 - RNA, 23 nt, Human
uuguagguuaaacauaugaguca

SEQ ID NO: 1335429 - RNA, 18 nt, Human
agaggucuugagaaugaa

SEQ ID NO: 1335430 - RNA, 23 nt, Human
augguaaucaagcuuuguacauc

SEQ ID NO: 1335431 - RNA, 21 nt, Human
caaaugaugaccuaaauuucc

SEQ ID NO: 1335432 - RNA, 23 nt, Human
cacuacaaaaaggagagcaggaa

SEQ ID NO: 1335433 - RNA, 19 nt, Human
cagaaaauaaaacauccca

SEQ ID NO: 1335434 - RNA, 21 nt, Human
caucagaaaauaaaacauccc

SEQ ID NO: 1335435 - RNA, 22 nt, Human
cucaucacuacaaaaaggagag

SEQ ID NO: 1335436 - RNA, 23 nt, Human
uaaaaagagauuaacccugaaaa

SEQ ID NO: 1335437 - RNA, 21 nt, Human
uaagguacacucucuaaagug

SEQ ID NO: 1335438 - RNA, 19 nt, Human
uacaguaguaauuaaggua

SEQ ID NO: 1335439 - RNA, 20 nt, Human
uacaguaguaauuaagguac

SEQ ID NO: 1335440 - RNA, 18 nt, Human
uagaaagacuugguaaug

SEQ ID NO: 1335441 - RNA, 22 nt, Human
uaguaauuaagguacacucucu

SEQ ID NO: 1335442 - RNA, 28 nt, Human
uccgaaaaucaaaugaugaccuaaauuu

SEQ ID NO: 1335443 - RNA, 20 nt, Human
ugaccuaaauuucccuuaau

SEQ ID NO: 1335444 - RNA, 24 nt, Human
ugaccuaaauuucccuuaauuugc

SEQ ID NO: 1335445 - RNA, 22 nt, Human
ugaguccuaguccauucuguuu

SEQ ID NO: 1335446 - RNA, 21 nt, Human
ugaugaccuaaauuucccuua

SEQ ID NO: 1335447 - RNA, 24 nt, Human
ugcccagccucacaauuccuuaca

SEQ ID NO: 1335448 - RNA, 25 nt, Human
uugguaaugauggucaguuccuuuu

SEQ ID NO: 1335449 - RNA, 18 nt, Human
aaaaacaacaaaagaaca

SEQ ID NO: 1335450 - RNA, 20 nt, Human
aaaaagauugacuugccucc

SEQ ID NO: 1335451 - RNA, 20 nt, Human
aaacagucuacaacaucuca

SEQ ID NO: 1335452 - RNA, 26 nt, Human
aaacccgcaacaaaauagaccccggg

SEQ ID NO: 1335453 - RNA, 23 nt, Human
aaacuggcaaaaacaacaaaaga

SEQ ID NO: 1335454 - RNA, 19 nt, Human
aaagcagcauuuuugaugu

SEQ ID NO: 1335455 - RNA, 21 nt, Human
aaagcagcauuuuugaugugg

SEQ ID NO: 1335456 - RNA, 24 nt, Human
aacccgcaacaaaauagaggaaag

SEQ ID NO: 1335457 - RNA, 23 nt, Human
aacccuaauuucccuaccucaac

SEQ ID NO: 1335458 - RNA, 25 nt, Human
aaccucaaagcuauccaucuguuuu

SEQ ID NO: 1335459 - RNA, 21 nt, Human
aacuuauagagagaaaauucc

SEQ ID NO: 1335460 - RNA, 23 nt, Human
aaugacagaaacuuauagagaga

SEQ ID NO: 1335461 - RNA, 18 nt, Human
aauugccaaaaaucaaua

SEQ ID NO: 1335462 - RNA, 21 nt, Human
acccgcaacaaaauagacccc

SEQ ID NO: 1335463 - RNA, 24 nt, Human
acccgcaacaaaauagaccccggc

SEQ ID NO: 1335464 - RNA, 20 nt, Human
acugcccuaaacuggcaaaa

SEQ ID NO: 1335465 - RNA, 18 nt, Human
agccauuaucuucaugcu

SEQ ID NO: 1335466 - RNA, 19 nt, Human
auccaucuguuuuaguggu

SEQ ID NO: 1335467 - RNA, 25 nt, Human
caaaauagaccccggcugucccguc

SEQ ID NO: 1335468 - RNA, 19 nt, Human
caacaaaauagaccccggc

SEQ ID NO: 1335469 - RNA, 20 nt, Human
ccaacuucuuaagcccaugu

SEQ ID NO: 1335470 - RNA, 23 nt, Human
cccauguauggaaacagucuaca

SEQ ID NO: 1335471 - RNA, 27 nt, Human
cccgucagcugccaaccuggcugucuc

SEQ ID NO: 1335472 - RNA, 21 nt, Human
cccuggauuugcugaaaaccc

SEQ ID NO: 1335473 - RNA, 22 nt, Human
ccgcaacaaaauagaccccggc

SEQ ID NO: 1335474 - RNA, 20 nt, Human
ccgucagcugccaaccuggc

SEQ ID NO: 1335475 - RNA, 20 nt, Human
ccuccagaccagcccuggau

SEQ ID NO: 1335476 - RNA, 22 nt, Human
ccucuugaaaucuggaggcaaa

SEQ ID NO: 1335477 - RNA, 25 nt, Human
cuaauauucuuuuuaauggugaucu

SEQ ID NO: 1335478 - RNA, 23 nt, Human
cuccagaccagcccuggauuugc

SEQ ID NO: 1335479 - RNA, 24 nt, Human
cuguccaacuucuuaagcccaugu

SEQ ID NO: 1335480 - RNA, 20 nt, Human
gacacuuaagguaacucugu

SEQ ID NO: 1335481 - RNA, 23 nt, Human
gccaaccuggcugucuccgccac

SEQ ID NO: 1335482 - RNA, 18 nt, Human
ggcaaaaacaacaaaaga

SEQ ID NO: 1335483 - RNA, 25 nt, Human
uaaaauuccaaauguaaaauugcca

SEQ ID NO: 1335484 - RNA, 22 nt, Human
uagagagaaaauuccuucucaa

SEQ ID NO: 1335485 - RNA, 19 nt, Human
uagugguuugagugagcac

SEQ ID NO: 1335486 - RNA, 22 nt, Human
uauuagccauuaucuucaugcu

SEQ ID NO: 1335487 - RNA, 21 nt, Human
ucauucucagaauacuucaaa

SEQ ID NO: 1335488 - RNA, 19 nt, Human
uccaacuucuuaagcccau

SEQ ID NO: 1335489 - RNA, 18 nt, Human
uccagugauaaacugagg

SEQ ID NO: 1335490 - RNA, 22 nt, Human
ucuaaaaccucaaagcuaucca

SEQ ID NO: 1335491 - RNA, 18 nt, Human
ucuuaagcccauguaugg

SEQ ID NO: 1335492 - RNA, 26 nt, Human
ugaaaacccgcaacaaaauagacccc

SEQ ID NO: 1335493 - RNA, 20 nt, Human
ugaaaauacuacagugccuc

SEQ ID NO: 1335494 - RNA, 18 nt, Human
ugauaaacugaacccuaa

SEQ ID NO: 1335495 - RNA, 23 nt, Human
ugauaaacugaacccuaauuucc

SEQ ID NO: 1335496 - RNA, 19 nt, Human
ugccaaaaaucaauaacaa

SEQ ID NO: 1335497 - RNA, 22 nt, Human
ugcccuaaacuggcaaaaacaa

SEQ ID NO: 1335498 - RNA, 24 nt, Human
uggcaaaaacaacaaaagaacaaa

SEQ ID NO: 1335499 - RNA, 22 nt, Human
uguccagugauaaacugaaccc

SEQ ID NO: 1335500 - RNA, 24 nt, Human
uguccagugauaaacugaacccua

SEQ ID NO: 1335501 - RNA, 25 nt, Human
ugugguaggaagauauuuaugacaa

SEQ ID NO: 1335502 - RNA, 20 nt, Human
uuaaaacuaaauuucuccuc

SEQ ID NO: 1335503 - RNA, 20 nt, Human
uucucagaauacuucaaaac

SEQ ID NO: 1335504 - RNA, 18 nt, Human
uuugaugugguaggaaga

SEQ ID NO: 1335505 - RNA, 24 nt, Human
uuuuuuuuuuuuuuugcacuugau

SEQ ID NO: 1335506 - RNA, 18 nt, Human
uuuuuuuuuuuuuuuuug

SEQ ID NO: 1335507 - RNA, 23 nt, Human
uuuuuuuuuuuuuuuuugcacuu

SEQ ID NO: 1335508 - RNA, 18 nt, Human
aaaagcgccuauccacgg

SEQ ID NO: 1335509 - RNA, 22 nt, Human
aacauugucguaaagaacuuuu

SEQ ID NO: 1335510 - RNA, 29 nt, Human
aagaucauuucagaugugccugaaaugag

SEQ ID NO: 1335511 - RNA, 23 nt, Human
aaugauauucaucguuguauaug

SEQ ID NO: 1335512 - RNA, 21 nt, Human
gaucauuucagaugugccuga

SEQ ID NO: 1335513 - RNA, 20 nt, Human
uaaagaacuuuucuggaacu

SEQ ID NO: 1335514 - RNA, 18 nt, Human
uaagaucauuucagaugu

SEQ ID NO: 1335515 - RNA, 19 nt, Human
uacagcagcgcuugcgaga

SEQ ID NO: 1335516 - RNA, 27 nt, Human
uacguagaaaaauaauuuuuaaacauu

SEQ ID NO: 1335517 - RNA, 22 nt, Human
uaggacaacaauuaauaaaagc

SEQ ID NO: 1335518 - RNA, 28 nt, Human
uaggacaacaauuaauaaaaggucaucc

SEQ ID NO: 1335519 - RNA, 20 nt, Human
uccacggcaaaaaugaaaga

SEQ ID NO: 1335520 - RNA, 22 nt, Human
ucugcuagggcacacugcuugg

SEQ ID NO: 1335521 - RNA, 21 nt, Human
ugaagucguuacagcagcgcu

SEQ ID NO: 1335522 - RNA, 19 nt, Human
ugacaaugucagaaauuuc

SEQ ID NO: 1335523 - RNA, 24 nt, Human
ugcugaaucagugacuccugaagu

SEQ ID NO: 1335524 - RNA, 23 nt, Human
uggaugaguuugcuuuuuccauu

SEQ ID NO: 1335525 - RNA, 22 nt, Human
uucacaaaguuaauagugcaga

SEQ ID NO: 1335526 - RNA, 21 nt, Human
uuguauaugacaaugucagaa

SEQ ID NO: 1335527 - RNA, 22 nt, Human
aacaaucaccacaaacuccggc

SEQ ID NO: 1335528 - RNA, 24 nt, Human
aaugugcagguggcaucccugagg

SEQ ID NO: 1335529 - RNA, 21 nt, Human
accacaaacuccggcgaccgc

SEQ ID NO: 1335530 - RNA, 20 nt, Human
acuaaaauagaagguaucug

SEQ ID NO: 1335531 - RNA, 23 nt, Human
acuacaccuacuagaaaaaaaga

SEQ ID NO: 1335532 - RNA, 22 nt, Human
agaauccccccaaaccaggacc

SEQ ID NO: 1335533 - RNA, 27 nt, Human
agaauccccccaaaccaggaccaguau

SEQ ID NO: 1335534 - RNA, 24 nt, Human
agcccuggccccggcccccggcgu

SEQ ID NO: 1335535 - RNA, 20 nt, Human
aggaggagauggcagccggg

SEQ ID NO: 1335536 - RNA, 18 nt, Human
aggaggaggaggaagagg

SEQ ID NO: 1335537 - RNA, 20 nt, Human
aggaggaggaggaagaggag

SEQ ID NO: 1335538 - RNA, 21 nt, Human
aggaggaggcggcggcccagg

SEQ ID NO: 1335539 - RNA, 22 nt, Human
aggaggaggcggcggcccagga

SEQ ID NO: 1335540 - RNA, 21 nt, Human
aggaggcggcggcccaggagg

SEQ ID NO: 1335541 - RNA, 21 nt, Human
aggaggcggcggcggcggcgg

SEQ ID NO: 1335542 - RNA, 19 nt, Human
aggcggcggcggcggcggc

SEQ ID NO: 1335543 - RNA, 19 nt, Human
aucgugguaaaggcuaggc

SEQ ID NO: 1335544 - RNA, 27 nt, Human
augaggaggcggcggcggcggcggcaa

SEQ ID NO: 1335545 - RNA, 23 nt, Human
augcaauuucuuuauuaaaaagc

SEQ ID NO: 1335546 - RNA, 31 nt, Human
auggcagccggggcgguggcggcggcagcaa

SEQ ID NO: 1335547 - RNA, 19 nt, Human
caacauggguaguaauuga

SEQ ID NO: 1335548 - RNA, 21 nt, Human
cagaauccccccaaaccagga

SEQ ID NO: 1335549 - RNA, 21 nt, Human
cagcccaggaggaggcggcag

SEQ ID NO: 1335550 - RNA, 21 nt, Human
cagccggggcgguggcggcgg

SEQ ID NO: 1335551 - RNA, 19 nt, Human
ccaggaggaggagauggca

SEQ ID NO: 1335552 - RNA, 21 nt, Human
cccacggcggccucaccgaag

SEQ ID NO: 1335553 - RNA, 22 nt, Human
cccacggcggccucaccgaagc

SEQ ID NO: 1335554 - RNA, 25 nt, Human
cccagccggggcugggagguccucc

SEQ ID NO: 1335555 - RNA, 18 nt, Human
cccagccggggcugguuc

SEQ ID NO: 1335556 - RNA, 18 nt, Human
ccccacggcccccucccc

SEQ ID NO: 1335557 - RNA, 21 nt, Human
cccccacggcccccuccccuc

SEQ ID NO: 1335558 - RNA, 24 nt, Human
ccccggcguccccgcugcugccca

SEQ ID NO: 1335559 - RNA, 18 nt, Human
cccggaaagcccuggccc

SEQ ID NO: 1335560 - RNA, 19 nt, Human
cccggaaagcccuggcccc

SEQ ID NO: 1335561 - RNA, 22 nt, Human
cccggaaagcccuggccccggc

SEQ ID NO: 1335562 - RNA, 18 nt, Human
cccggacagaguaugaga

SEQ ID NO: 1335563 - RNA, 19 nt, Human
cccuggccccggcccccgg

SEQ ID NO: 1335564 - RNA, 21 nt, Human
ccgagccgcccccacggcccc

SEQ ID NO: 1335565 - RNA, 23 nt, Human
ccgccggaagauggggcccacgg

SEQ ID NO: 1335566 - RNA, 21 nt, Human
ccgccuauggugcacgaggau

SEQ ID NO: 1335567 - RNA, 22 nt, Human
ccggcgaccgccggaagauggg

SEQ ID NO: 1335568 - RNA, 21 nt, Human
ccggggcgguggcggcggcuu

SEQ ID NO: 1335569 - RNA, 18 nt, Human
ccucccagcuggccuccc

SEQ ID NO: 1335570 - RNA, 19 nt, Human
ccugugccgccuauggugc

SEQ ID NO: 1335571 - RNA, 19 nt, Human
cgcugcugcccagccgggg

SEQ ID NO: 1335572 - RNA, 24 nt, Human
cggcccaggaggaggagauggcag

SEQ ID NO: 1335573 - RNA, 25 nt, Human
cggcggcagcaacaaucaccacaaa

SEQ ID NO: 1335574 - RNA, 22 nt, Human
cguccccgcugcugcccagccg

SEQ ID NO: 1335575 - RNA, 22 nt, Human
cugcugcccagccggggcugga

SEQ ID NO: 1335576 - RNA, 24 nt, Human
cuuuacauugucaucuuuuuugau

SEQ ID NO: 1335577 - RNA, 25 nt, Human
cuuuauuagcaacuaaaauagaagg

SEQ ID NO: 1335578 - RNA, 24 nt, Human
gaagaggaggaggcggcggcccag

SEQ ID NO: 1335579 - RNA, 21 nt, Human
gcccuggccccggcccccggc

SEQ ID NO: 1335580 - RNA, 18 nt, Human
gcggcagcggggagggga

SEQ ID NO: 1335581 - RNA, 21 nt, Human
gcggcagcggggaggggauca

SEQ ID NO: 1335582 - RNA, 18 nt, Human
gcggcggcccaggaggag

SEQ ID NO: 1335583 - RNA, 20 nt, Human
gcggcggcggcggcaggagc

SEQ ID NO: 1335584 - RNA, 23 nt, Human
gcggcggcggcggcggcaggagc

SEQ ID NO: 1335585 - RNA, 19 nt, Human
ggaaagcccuggccccggc

SEQ ID NO: 1335586 - RNA, 23 nt, Human
ggaaagcccuggccccggccccc

SEQ ID NO: 1335587 - RNA, 18 nt, Human
ggaagauggggcccacgg

SEQ ID NO: 1335588 - RNA, 18 nt, Human
ggaggaggaagaggagga

SEQ ID NO: 1335589 - RNA, 18 nt, Human
ggaggaggaggaagagga

SEQ ID NO: 1335590 - RNA, 18 nt, Human
ggaggcggcggcggcggc

SEQ ID NO: 1335591 - RNA, 23 nt, Human
uaggcugggaccccggacagagu

SEQ ID NO: 1335592 - RNA, 21 nt, Human
ucaaaaaacugucugccacaa

SEQ ID NO: 1335593 - RNA, 18 nt, Human
uccgccgagccgccccca

SEQ ID NO: 1335594 - RNA, 24 nt, Human
ucgugguaaaggcuaggcugggac

SEQ ID NO: 1335595 - RNA, 28 nt, Human
ugcccagccggggcugguuucgaggccg

SEQ ID NO: 1335596 - RNA, 19 nt, Human
uggcagccggggcgguggc

SEQ ID NO: 1335597 - RNA, 22 nt, Human
uggcagccggggcgguggcggc

SEQ ID NO: 1335598 - RNA, 24 nt, Human
uuuuuuuuuuuuuuuuuuuuuggg

SEQ ID NO: 1335599 - RNA, 24 nt, Human
aagcaaauaacauccaaugucaga

SEQ ID NO: 1335600 - RNA, 19 nt, Human
agggacccgcgcggccucc

SEQ ID NO: 1335601 - RNA, 22 nt, Human
auaagcaaauaacauccaaugu

SEQ ID NO: 1335602 - RNA, 25 nt, Human
caccaacauuaaaacaagagaaugc

SEQ ID NO: 1335603 - RNA, 22 nt, Human
cauauuuauuuucugacaccaa

SEQ ID NO: 1335604 - RNA, 19 nt, Human
cauuucacugugcccucau

SEQ ID NO: 1335605 - RNA, 19 nt, Human
cuuuaaaaauuaagaggaa

SEQ ID NO: 1335606 - RNA, 18 nt, Human
uaaaaaagaaauuaaagg

SEQ ID NO: 1335607 - RNA, 27 nt, Human
uaaaacaagagaaugcucauuccacaa

SEQ ID NO: 1335608 - RNA, 21 nt, Human
ucaccagcaucuuuaaaaauu

SEQ ID NO: 1335609 - RNA, 23 nt, Human
ucggcgcggcgcuuagccuggga

SEQ ID NO: 1335610 - RNA, 24 nt, Human
ucugacaccaacauuaaaacaaga

SEQ ID NO: 1335611 - RNA, 20 nt, Human
ugaggaaauuuucuaaugaa

SEQ ID NO: 1335612 - RNA, 18 nt, Human
aaacgaagccagaagggc

SEQ ID NO: 1335613 - RNA, 23 nt, Human
aaacgaagccagaagggcuugag

SEQ ID NO: 1335614 - RNA, 21 nt, Human
aacuggguguggggaguaugu

SEQ ID NO: 1335615 - RNA, 23 nt, Human
aagaccauaaacgaagccagaag

SEQ ID NO: 1335616 - RNA, 18 nt, Human
aagccucuauucaccccu

SEQ ID NO: 1335617 - RNA, 19 nt, Human
aagggcuugaggaagcaag

SEQ ID NO: 1335618 - RNA, 21 nt, Human
acagaguuucauggagaaacc

SEQ ID NO: 1335619 - RNA, 21 nt, Human
acaggagaggaagcacugcca

SEQ ID NO: 1335620 - RNA, 21 nt, Human
agaagggcuugaggaagcaag

SEQ ID NO: 1335621 - RNA, 22 nt, Human
agccaaagggaaaacauaaaua

SEQ ID NO: 1335622 - RNA, 19 nt, Human
agccucuauucaccccuuc

SEQ ID NO: 1335623 - RNA, 18 nt, Human
aggaagcaagaguccuug

SEQ ID NO: 1335624 - RNA, 18 nt, Human
aucucuuucuuugcucca

SEQ ID NO: 1335625 - RNA, 18 nt, Human
augcugccccacccaguc

SEQ ID NO: 1335626 - RNA, 23 nt, Human
cacaagcauggcaggccuuccug

SEQ ID NO: 1335627 - RNA, 23 nt, Human
caggggauuucuccuccaagucc

SEQ ID NO: 1335628 - RNA, 18 nt, Human
ccagucacagccaaaggg

SEQ ID NO: 1335629 - RNA, 21 nt, Human
ccccacccagucacagccaaa

SEQ ID NO: 1335630 - RNA, 22 nt, Human
ccuugggggaaaauucuuagcg

SEQ ID NO: 1335631 - RNA, 18 nt, Human
cucuauucaccccuucuc

SEQ ID NO: 1335632 - RNA, 19 nt, Human
ggaaaaccauuuucccccu

SEQ ID NO: 1335633 - RNA, 23 nt, Human
ggggaguaugucagaggguuagu

SEQ ID NO: 1335634 - RNA, 21 nt, Human
guccuaugagaucucuuucuu

SEQ ID NO: 1335635 - RNA, 19 nt, Human
uaccccagcaucuuaccuu

SEQ ID NO: 1335636 - RNA, 24 nt, Human
uagaugccucuuuaaaaucagaag

SEQ ID NO: 1335637 - RNA, 22 nt, Human
uaggucuaaccaagcugugcag

SEQ ID NO: 1335638 - RNA, 19 nt, Human
ucaccccuucucaaucccc

SEQ ID NO: 1335639 - RNA, 27 nt, Human
uccuaugagaucucuuucuuugcuccc

SEQ ID NO: 1335640 - RNA, 20 nt, Human
ucucaagccucuauucaccc

SEQ ID NO: 1335641 - RNA, 21 nt, Human
ucucaagccucuauucacccc

SEQ ID NO: 1335642 - RNA, 21 nt, Human
ugccccacccagucacagcca

SEQ ID NO: 1335643 - RNA, 22 nt, Human
uggaaagagccuggaauugaca

SEQ ID NO: 1335644 - RNA, 18 nt, Human
ugugguuauggaaagagc

SEQ ID NO: 1335645 - RNA, 24 nt, Human
uuaaagguuucuccuuaggacuag

SEQ ID NO: 1335646 - RNA, 21 nt, Human
uucaccccuucucaaucccca

SEQ ID NO: 1335647 - RNA, 18 nt, Human
uugacaggagaggaagca

SEQ ID NO: 1335648 - RNA, 21 nt, Human
uuguucaauauugucuucaau

SEQ ID NO: 1335649 - RNA, 18 nt, Human
aagaagcacagaccagcu

SEQ ID NO: 1335650 - RNA, 19 nt, Human
aagauugcgacuguccugg

SEQ ID NO: 1335651 - RNA, 27 nt, Human
auccugugauauccaugucucucagag

SEQ ID NO: 1335652 - RNA, 22 nt, Human
caaaauacugcuuugaauugac

SEQ ID NO: 1335653 - RNA, 19 nt, Human
cacugaaaacagacuaagc

SEQ ID NO: 1335654 - RNA, 22 nt, Human
cagcuaagaagcgcgucaacac

SEQ ID NO: 1335655 - RNA, 24 nt, Human
ccuuaagucacacucugaauucau

SEQ ID NO: 1335656 - RNA, 19 nt, Human
cuccauggccaugugaaac

SEQ ID NO: 1335657 - RNA, 23 nt, Human
cugguaagacuaagcaaaggaag

SEQ ID NO: 1335658 - RNA, 23 nt, Human
cuuuuucuucuugggcacauucu

SEQ ID NO: 1335659 - RNA, 20 nt, Human
uauggaagaagcacagacca

SEQ ID NO: 1335660 - RNA, 21 nt, Human
uccacugaaaacagacuaagc

SEQ ID NO: 1335661 - RNA, 24 nt, Human
uccauggccaugugaaaccggggc

SEQ ID NO: 1335662 - RNA, 24 nt, Human
uccauggccaugugaaacuuaaaa

SEQ ID NO: 1335663 - RNA, 22 nt, Human
ucuccauggccaugugaaacuu

SEQ ID NO: 1335664 - RNA, 25 nt, Human
ugaaacuuaaaacaaagauugcgac

SEQ ID NO: 1335665 - RNA, 19 nt, Human
uuaaaacaaagauugcgac

SEQ ID NO: 1335666 - RNA, 18 nt, Human
uuaauaguggaaauuuuu

SEQ ID NO: 1335667 - RNA, 23 nt, Human
uucccaguucaucaauuaauucc

SEQ ID NO: 1335668 - RNA, 21 nt, Human
uugggcacauucuccauggcc

SEQ ID NO: 1335669 - RNA, 22 nt, Human
uuuaaccaugaugacaaucacu

SEQ ID NO: 1335670 - RNA, 22 nt, Human
aaaacauauucuuccugucuga

SEQ ID NO: 1335671 - RNA, 19 nt, Human
aagaaaggcagaggaacug

SEQ ID NO: 1335672 - RNA, 22 nt, Human
acucaaaaaaagcauaaaacaa

SEQ ID NO: 1335673 - RNA, 21 nt, Human
agaacaucaauuuugaaaugu

SEQ ID NO: 1335674 - RNA, 20 nt, Human
auggaauaguuaaaucaagc

SEQ ID NO: 1335675 - RNA, 23 nt, Human
auguauggguuacaaagugauau

SEQ ID NO: 1335676 - RNA, 18 nt, Human
caagcuaguuaacauaug

SEQ ID NO: 1335677 - RNA, 18 nt, Human
cacacuguacaacagaac

SEQ ID NO: 1335678 - RNA, 22 nt, Human
cacuguacaacagaacucaaaa

SEQ ID NO: 1335679 - RNA, 25 nt, Human
cauaaaacauauucuuccugucuga

SEQ ID NO: 1335680 - RNA, 19 nt, Human
gucucucugauuccuuaaa

SEQ ID NO: 1335681 - RNA, 24 nt, Human
ucauuaauuuuuuuuuuuuuuuuu

SEQ ID NO: 1335682 - RNA, 20 nt, Human
ugagaacaucaauuuugaaa

SEQ ID NO: 1335683 - RNA, 22 nt, Human
ugaugagaacaucaauuuugaa

SEQ ID NO: 1335684 - RNA, 26 nt, Human
uguauaaauguauggguuacaaagug

SEQ ID NO: 1335685 - RNA, 20 nt, Human
uuaaguauaggcaccacacu

SEQ ID NO: 1335686 - RNA, 27 nt, Human
uuguaaauugacaauuuauaauuguau

SEQ ID NO: 1335687 - RNA, 18 nt, Human
uuuuuuuuuuuuuuuuug

SEQ ID NO: 1335688 - RNA, 20 nt, Human
aaauaaaagagggaauuuau

SEQ ID NO: 1335689 - RNA, 22 nt, Human
acagaguaugcuguaaccacaa

SEQ ID NO: 1335690 - RNA, 18 nt, Human
aggaagagaauauccuac

SEQ ID NO: 1335691 - RNA, 19 nt, Human
agguggugcuggcggaucg

SEQ ID NO: 1335692 - RNA, 21 nt, Human
cacgccuuucugaaggacaga

SEQ ID NO: 1335693 - RNA, 21 nt, Human
cagagguucuugcagagauuc

SEQ ID NO: 1335694 - RNA, 23 nt, Human
cccauagcgcgaggcgcggaggc

SEQ ID NO: 1335695 - RNA, 30 nt, Human
cugaaggacagaguaugcuguaaccacaaa

SEQ ID NO: 1335696 - RNA, 18 nt, Human
gcuagaaucacgccuuuc

SEQ ID NO: 1335697 - RNA, 24 nt, Human
ggcgcggaggcgaagcaggaagga

SEQ ID NO: 1335698 - RNA, 21 nt, Human
aaaacaaaugaaaaacaaaaa

SEQ ID NO: 1335699 - RNA, 19 nt, Human
aaacaaaaaucuagcagag

SEQ ID NO: 1335700 - RNA, 20 nt, Human
aaacccagaaucagggacaa

SEQ ID NO: 1335701 - RNA, 26 nt, Human
aaaugaaaaacaaaaaucuagcagag

SEQ ID NO: 1335702 - RNA, 24 nt, Human
aagcauuuaaaacugucagacuuu

SEQ ID NO: 1335703 - RNA, 19 nt, Human
agcagagucccucugcccc

SEQ ID NO: 1335704 - RNA, 21 nt, Human
agcagagucccucugccccuu

SEQ ID NO: 1335705 - RNA, 19 nt, Human
aggaaaagucaccccagcu

SEQ ID NO: 1335706 - RNA, 24 nt, Human
augaaaaacaaaaaucuagcagag

SEQ ID NO: 1335707 - RNA, 19 nt, Human
augaacaccaccuuuucca

SEQ ID NO: 1335708 - RNA, 24 nt, Human
caaaauuaaaaacaaaugaaaaac

SEQ ID NO: 1335709 - RNA, 24 nt, Human
caccccagcuuuucucccagaggc

SEQ ID NO: 1335710 - RNA, 23 nt, Human
ccagaggcuccacugggcuccaa

SEQ ID NO: 1335711 - RNA, 24 nt, Human
ccccuuguaggaaaagucacccca

SEQ ID NO: 1335712 - RNA, 25 nt, Human
cccucugccccuuguaggaaaaguc

SEQ ID NO: 1335713 - RNA, 21 nt, Human
guaaugauuuaacucccacag

SEQ ID NO: 1335714 - RNA, 18 nt, Human
uaaacccagaaucaggga

SEQ ID NO: 1335715 - RNA, 24 nt, Human
uaaugaacaccaccuuuuccagac

SEQ ID NO: 1335716 - RNA, 22 nt, Human
uagcagagucccucugccccuu

SEQ ID NO: 1335717 - RNA, 21 nt, Human
ucuagcagagucccucugccc

SEQ ID NO: 1335718 - RNA, 21 nt, Human
ugaaaaacaaaaaucuagcag

SEQ ID NO: 1335719 - RNA, 23 nt, Human
uuguaggaaaagucaccccagcu

SEQ ID NO: 1335720 - RNA, 21 nt, Human
aguuucuuccuuucuccaggg

SEQ ID NO: 1335721 - RNA, 18 nt, Human
auauuauuccuuaggcac

SEQ ID NO: 1335722 - RNA, 18 nt, Human
caaacacaagucuacaua

SEQ ID NO: 1335723 - RNA, 19 nt, Human
cacaaauccaaagccugcu

SEQ ID NO: 1335724 - RNA, 23 nt, Human
cacaaauccaaagccugcuaaua

SEQ ID NO: 1335725 - RNA, 18 nt, Human
uaagaaauaaacccauag

SEQ ID NO: 1335726 - RNA, 22 nt, Human
ucaccaaagaaucuuuaaucac

SEQ ID NO: 1335727 - RNA, 21 nt, Human
ucuacauaauucagcccagga

SEQ ID NO: 1335728 - RNA, 21 nt, Human
ugccgugguuggaaucguuga

SEQ ID NO: 1335729 - RNA, 18 nt, Human
ugucaaacacaagucuac

SEQ ID NO: 1335730 - RNA, 23 nt, Human
ugucuugguucuuuugcauauua

SEQ ID NO: 1335731 - RNA, 23 nt, Human
uguucuaagaaauaaacccauag

SEQ ID NO: 1335732 - RNA, 22 nt, Human
uuaucuguccaccacagacuua

SEQ ID NO: 1335733 - RNA, 20 nt, Human
uucuuuugcauauuauuccu

SEQ ID NO: 1335734 - RNA, 18 nt, Human
aaaaaagaaaaagcaaaa

SEQ ID NO: 1335735 - RNA, 19 nt, Human
aaaaagcaaaaggcugcug

SEQ ID NO: 1335736 - RNA, 18 nt, Human
aagaaaagcaaccaggag

SEQ ID NO: 1335737 - RNA, 24 nt, Human
aagcaaccaggaggagguaagagc

SEQ ID NO: 1335738 - RNA, 21 nt, Human
aaggaaaaggugaaaagcugg

SEQ ID NO: 1335739 - RNA, 21 nt, Human
aaggggagggaagaaaaaaga

SEQ ID NO: 1335740 - RNA, 18 nt, Human
aaggugaaaagcuggugu

SEQ ID NO: 1335741 - RNA, 21 nt, Human
acccuugauaaggggagggaa

SEQ ID NO: 1335742 - RNA, 21 nt, Human
accgccccggccccucccccc

SEQ ID NO: 1335743 - RNA, 21 nt, Human
agccgccaccgccccggcccc

SEQ ID NO: 1335744 - RNA, 18 nt, Human
agcuggcugguuccuucu

SEQ ID NO: 1335745 - RNA, 18 nt, Human
cagccgccaccgccccgg

SEQ ID NO: 1335746 - RNA, 21 nt, Human
cagccgccaccgccccggccc

SEQ ID NO: 1335747 - RNA, 21 nt, Human
cagguggcacaugacagauca

SEQ ID NO: 1335748 - RNA, 19 nt, Human
cauuuggaaaaacuggcag

SEQ ID NO: 1335749 - RNA, 22 nt, Human
cgccccggccccuccccccggc

SEQ ID NO: 1335750 - RNA, 25 nt, Human
cugaacaguaaggauggcucccuuc

SEQ ID NO: 1335751 - RNA, 20 nt, Human
gcagauaccagauggcagcu

SEQ ID NO: 1335752 - RNA, 21 nt, Human
gcugguuccuucucagccuga

SEQ ID NO: 1335753 - RNA, 23 nt, Human
ggcaagaaaagcaaccaggagga

SEQ ID NO: 1335754 - RNA, 27 nt, Human
ggcaagaaaagcaaccaggaggaggua

SEQ ID NO: 1335755 - RNA, 22 nt, Human
gggaagaaaaaagaaaaagcaa

SEQ ID NO: 1335756 - RNA, 28 nt, Human
guugcugucucugaacaguaaggauggc

SEQ ID NO: 1335757 - RNA, 19 nt, Human
uaaacuuggggugggggca

SEQ ID NO: 1335758 - RNA, 20 nt, Human
uccaguaccggccacagccg

SEQ ID NO: 1335759 - RNA, 22 nt, Human
uccugagucucaaggaaaaggu

SEQ ID NO: 1335760 - RNA, 26 nt, Human
uggcagcucuggguguccuuugaguu

SEQ ID NO: 1335761 - RNA, 18 nt, Human
uggccuguuuuuguuuuu

SEQ ID NO: 1335762 - RNA, 19 nt, Human
uggguaggguacaggucau

SEQ ID NO: 1335763 - RNA, 22 nt, Human
uuuuuuggccuguuuuuguuuu

SEQ ID NO: 1335764 - RNA, 23 nt, Human
uuuuuuuuggccuguuuuuguuu

SEQ ID NO: 1335765 - RNA, 26 nt, Human
uuuuuuuuuuuuuuuggccuguuuuu

SEQ ID NO: 1335766 - RNA, 21 nt, Human
aagcagaggccccgccugagc

SEQ ID NO: 1335767 - RNA, 28 nt, Human
acacauucccauccccaaagcagaggcc

SEQ ID NO: 1335768 - RNA, 22 nt, Human
acccaccucaucucccagcccu

SEQ ID NO: 1335769 - RNA, 22 nt, Human
agaaaaacacauucccaucccc

SEQ ID NO: 1335770 - RNA, 24 nt, Human
agaaaaacacauucccauccccaa

SEQ ID NO: 1335771 - RNA, 20 nt, Human
agaaggaggcagcugcuacc

SEQ ID NO: 1335772 - RNA, 20 nt, Human
agcacaucccuuccugaagc

SEQ ID NO: 1335773 - RNA, 23 nt, Human
agcauggagacgcucugagaaaa

SEQ ID NO: 1335774 - RNA, 23 nt, Human
agcggugguggcggcggcggcgg

SEQ ID NO: 1335775 - RNA, 26 nt, Human
agcuauaaaaacaaguuugggagaaa

SEQ ID NO: 1335776 - RNA, 26 nt, Human
agggcggcaguggcagcggugguggc

SEQ ID NO: 1335777 - RNA, 25 nt, Human
aguggcagcggugguggcggcggcg

SEQ ID NO: 1335778 - RNA, 21 nt, Human
cacaucccuuccugaagcccc

SEQ ID NO: 1335779 - RNA, 18 nt, Human
cauccagugucagcuaac

SEQ ID NO: 1335780 - RNA, 23 nt, Human
cauucccauccccaaagcagagg

SEQ ID NO: 1335781 - RNA, 19 nt, Human
ccagacccaccucaucucc

SEQ ID NO: 1335782 - RNA, 18 nt, Human
ccagggugcccagagcug

SEQ ID NO: 1335783 - RNA, 21 nt, Human
cccauccccaaagcagaggcc

SEQ ID NO: 1335784 - RNA, 25 nt, Human
ccugaagccccuuucuaaguauccu

SEQ ID NO: 1335785 - RNA, 19 nt, Human
cgaaggggauccaaggacc

SEQ ID NO: 1335786 - RNA, 21 nt, Human
cgcucugagaaaagauccaga

SEQ ID NO: 1335787 - RNA, 21 nt, Human
cggcggcggcggcgacaggag

SEQ ID NO: 1335788 - RNA, 23 nt, Human
cuaacacagaacuugccugaaga

SEQ ID NO: 1335789 - RNA, 19 nt, Human
cucaucucccagcccuuca

SEQ ID NO: 1335790 - RNA, 20 nt, Human
cugagaaaagauccagaccc

SEQ ID NO: 1335791 - RNA, 22 nt, Human
cuuccugaagccccuuucuaag

SEQ ID NO: 1335792 - RNA, 23 nt, Human
gaaaaacacauucccauccccaa

SEQ ID NO: 1335793 - RNA, 20 nt, Human
gaccaggguggccagggugc

SEQ ID NO: 1335794 - RNA, 22 nt, Human
gcagcggugguggcggcggcuu

SEQ ID NO: 1335795 - RNA, 20 nt, Human
gccccgccugagcuccccca

SEQ ID NO: 1335796 - RNA, 19 nt, Human
gcggcggcggcgacaggag

SEQ ID NO: 1335797 - RNA, 20 nt, Human
gcggugguggcggcggcggc

SEQ ID NO: 1335798 - RNA, 24 nt, Human
gcucacagagaaggaggcagcugc

SEQ ID NO: 1335799 - RNA, 21 nt, Human
ggaccaggguggccagggugc

SEQ ID NO: 1335800 - RNA, 23 nt, Human
ggcagcggugguggcggcggcgg

SEQ ID NO: 1335801 - RNA, 23 nt, Human
ggcggcgacaggagacaggacac

SEQ ID NO: 1335802 - RNA, 21 nt, Human
gguggccagggugcccagagc

SEQ ID NO: 1335803 - RNA, 19 nt, Human
gguuauuguaugcaaauuc

SEQ ID NO: 1335804 - RNA, 27 nt, Human
guggcagcggugguggcggcggcggcg

SEQ ID NO: 1335805 - RNA, 20 nt, Human
guggcggcggcggcggcgac

SEQ ID NO: 1335806 - RNA, 21 nt, Human
guggcggcggcggcggcgaca

SEQ ID NO: 1335807 - RNA, 20 nt, Human
gugguggcggcggcggcggc

SEQ ID NO: 1335808 - RNA, 20 nt, Human
gugguggcggcggcggcggc

SEQ ID NO: 1335809 - RNA, 26 nt, Human
uagaaaacggaaaugcaaccauagca

SEQ ID NO: 1335810 - RNA, 19 nt, Human
ucagcucacagagaaggag

SEQ ID NO: 1335811 - RNA, 20 nt, Human
uccuagagcgaggcuaggac

SEQ ID NO: 1335812 - RNA, 22 nt, Human
ugagaaaagauccagacccacc

SEQ ID NO: 1335813 - RNA, 23 nt, Human
ugagcucccccauccucagcauc

SEQ ID NO: 1335814 - RNA, 25 nt, Human
ugcccagagcuggggcaauucuuug

SEQ ID NO: 1335815 - RNA, 19 nt, Human
uggcggcggcggcggcgac

SEQ ID NO: 1335816 - RNA, 22 nt, Human
uggcggcggcggcggcgacagg

SEQ ID NO: 1335817 - RNA, 18 nt, Human
ugggagaaaaacacauuc

SEQ ID NO: 1335818 - RNA, 22 nt, Human
ugggagaaaaacacauucccau

SEQ ID NO: 1335819 - RNA, 18 nt, Human
ugguggcggcggcggcgg

SEQ ID NO: 1335820 - RNA, 19 nt, Human
ugguugguuauuguaugca

SEQ ID NO: 1335821 - RNA, 24 nt, Human
uucaagcagagcuauaaaaacaag

SEQ ID NO: 1335822 - RNA, 20 nt, Human
uuuguaaacuucaagguuuc

SEQ ID NO: 1335823 - RNA, 21 nt, Human
aaaggggaugaaacugaagga

SEQ ID NO: 1335824 - RNA, 24 nt, Human
aaggaaccaggacucuggaggaug

SEQ ID NO: 1335825 - RNA, 24 nt, Human
acccacgccgcccccuccuccgcc

SEQ ID NO: 1335826 - RNA, 18 nt, Human
aggaagaguuuugggucc

SEQ ID NO: 1335827 - RNA, 18 nt, Human
caacucugcaggcagaac

SEQ ID NO: 1335828 - RNA, 20 nt, Human
caggaagaguuuugggucca

SEQ ID NO: 1335829 - RNA, 23 nt, Human
cagggucaguacuacgcgggucc

SEQ ID NO: 1335830 - RNA, 21 nt, Human
ccccacccacgccgcccccuc

SEQ ID NO: 1335831 - RNA, 20 nt, Human
ccccuugccguacacuccuc

SEQ ID NO: 1335832 - RNA, 20 nt, Human
cccgcccccacccacgccgc

SEQ ID NO: 1335833 - RNA, 21 nt, Human
cccgcccccgcccccacccac

SEQ ID NO: 1335834 - RNA, 18 nt, Human
cccgcgcgccugccuucc

SEQ ID NO: 1335835 - RNA, 26 nt, Human
cccuccuccgccgccaccacccgagg

SEQ ID NO: 1335836 - RNA, 24 nt, Human
ccgaccucuggcgcguucuaaccc

SEQ ID NO: 1335837 - RNA, 18 nt, Human
ccgggguccagcagggag

SEQ ID NO: 1335838 - RNA, 22 nt, Human
ccgguuuaucgcggccuuccca

SEQ ID NO: 1335839 - RNA, 18 nt, Human
ccucacuaccuggguucg

SEQ ID NO: 1335840 - RNA, 21 nt, Human
ccuccgccgccacugccgcuc

SEQ ID NO: 1335841 - RNA, 18 nt, Human
ccucuuacggaagugaag

SEQ ID NO: 1335842 - RNA, 21 nt, Human
cgcccccgcccccacccacgc

SEQ ID NO: 1335843 - RNA, 20 nt, Human
cggggagcgagaacgcagug

SEQ ID NO: 1335844 - RNA, 21 nt, Human
cuccuccgccgccacugccgc

SEQ ID NO: 1335845 - RNA, 20 nt, Human
cugccacugugcucucuggg

SEQ ID NO: 1335846 - RNA, 18 nt, Human
gaagugaagccggaggug

SEQ ID NO: 1335847 - RNA, 25 nt, Human
gagaacgcagugaacagcaggaacu

SEQ ID NO: 1335848 - RNA, 21 nt, Human
gagcucagcucacaacgaggc

SEQ ID NO: 1335849 - RNA, 25 nt, Human
gcaucccgcccccgcccccacccac

SEQ ID NO: 1335850 - RNA, 19 nt, Human
gcgccccccagacgucaca

SEQ ID NO: 1335851 - RNA, 18 nt, Human
gcgcgcgccgaccucugg

SEQ ID NO: 1335852 - RNA, 18 nt, Human
ggaaggagagaaagggga

SEQ ID NO: 1335853 - RNA, 18 nt, Human
ggaaucacuggccucacu

SEQ ID NO: 1335854 - RNA, 18 nt, Human
ggggagcgagaacgcagu

SEQ ID NO: 1335855 - RNA, 18 nt, Human
guuuaucgcggccuuccc

SEQ ID NO: 1335856 - RNA, 24 nt, Human
uacacuccucuccucuuacggaag

SEQ ID NO: 1335857 - RNA, 24 nt, Human
ucagauauccaauuuuuaauuaau

SEQ ID NO: 1335858 - RNA, 24 nt, Human
uccauggaaggagagaaaggggau

SEQ ID NO: 1335859 - RNA, 21 nt, Human
uccgacgcugccuuuccggga

SEQ ID NO: 1335860 - RNA, 24 nt, Human
uccgccgccacugccgcuccucac

SEQ ID NO: 1335861 - RNA, 20 nt, Human
uccucuuacggaagugaagc

SEQ ID NO: 1335862 - RNA, 19 nt, Human
ucggggcggugcgggugug

SEQ ID NO: 1335863 - RNA, 18 nt, Human
ugaaacugaaggaaccag

SEQ ID NO: 1335864 - RNA, 20 nt, Human
ugacgccacaaaagcgugcc

SEQ ID NO: 1335865 - RNA, 18 nt, Human
ugccacugugcucucugg

SEQ ID NO: 1335866 - RNA, 20 nt, Human
ugccacugugcucucugggg

SEQ ID NO: 1335867 - RNA, 21 nt, Human
uggaagauuugaggcgccccc

SEQ ID NO: 1335868 - RNA, 21 nt, Human
uuacggaagugaagccggagg

SEQ ID NO: 1335869 - RNA, 26 nt, Human
aaaaaaaaaaauuaaaacucaaguua

SEQ ID NO: 1335870 - RNA, 18 nt, Human
aaaaugguuggaggagag

SEQ ID NO: 1335871 - RNA, 23 nt, Human
aagaaaagacagaauuucugaaa

SEQ ID NO: 1335872 - RNA, 19 nt, Human
aaguacugucucugugagg

SEQ ID NO: 1335873 - RNA, 19 nt, Human
aaguugguggcuuuauucu

SEQ ID NO: 1335874 - RNA, 20 nt, Human
agcacuugggaaguuccucc

SEQ ID NO: 1335875 - RNA, 21 nt, Human
aggauggggguaagggaggga

SEQ ID NO: 1335876 - RNA, 22 nt, Human
agguaaaaguugguggcuuuau

SEQ ID NO: 1335877 - RNA, 20 nt, Human
augguagacaagccgggcag

SEQ ID NO: 1335878 - RNA, 22 nt, Human
caaaaugguuggaggagagggu

SEQ ID NO: 1335879 - RNA, 20 nt, Human
cagauccaggcccuagaaaa

SEQ ID NO: 1335880 - RNA, 21 nt, Human
cagggggcagagaucucccuc

SEQ ID NO: 1335881 - RNA, 23 nt, Human
caugccccauccccagcuaggag

SEQ ID NO: 1335882 - RNA, 19 nt, Human
cccccgcgcuacaucccgc

SEQ ID NO: 1335883 - RNA, 18 nt, Human
ccucaauacccugcagcu

SEQ ID NO: 1335884 - RNA, 20 nt, Human
ccugcggccgagcggccccg

SEQ ID NO: 1335885 - RNA, 21 nt, Human
cuaggagaauggaaauggaaa

SEQ ID NO: 1335886 - RNA, 22 nt, Human
cucugccaagaaaaaaaaaaaa

SEQ ID NO: 1335887 - RNA, 24 nt, Human
gcaggcgggcucugcugggggccg

SEQ ID NO: 1335888 - RNA, 20 nt, Human
gcuagguaaaaguugguggc

SEQ ID NO: 1335889 - RNA, 19 nt, Human
ggauggggguaagggaggg

SEQ ID NO: 1335890 - RNA, 23 nt, Human
ggccugcggccgagcggccccga

SEQ ID NO: 1335891 - RNA, 26 nt, Human
uaaauaucuuuccccauuuaaauuuu

SEQ ID NO: 1335892 - RNA, 20 nt, Human
uacaaaguuaaggaugggga

SEQ ID NO: 1335893 - RNA, 22 nt, Human
uacugaauucucuaagagguuu

SEQ ID NO: 1335894 - RNA, 18 nt, Human
uagaaagaugggaccagg

SEQ ID NO: 1335895 - RNA, 19 nt, Human
uccagaagaaaagacagaa

SEQ ID NO: 1335896 - RNA, 23 nt, Human
uccccagcuaggagaauggaaau

SEQ ID NO: 1335897 - RNA, 29 nt, Human
ucucuaagagguuucuucuagaaacagag

SEQ ID NO: 1335898 - RNA, 23 nt, Human
ucuuugaaugccaagucucuucu

SEQ ID NO: 1335899 - RNA, 18 nt, Human
ugcaucaagauacauagc

SEQ ID NO: 1335900 - RNA, 26 nt, Human
ugccaagaaaaaaaaaaaauuaaaac

SEQ ID NO: 1335901 - RNA, 19 nt, Human
uggaaauggaaaguuuauu

SEQ ID NO: 1335902 - RNA, 25 nt, Human
uggaaauggaaaguuuauugcccag

SEQ ID NO: 1335903 - RNA, 24 nt, Human
ugugaaagugggcugaagcuuggu

SEQ ID NO: 1335904 - RNA, 22 nt, Human
uuagccgggcuagguaaaaguu

SEQ ID NO: 1335905 - RNA, 23 nt, Human
uugguggcuuuauucuuccugcu

SEQ ID NO: 1335906 - RNA, 27 nt, Human
uuuuuuuuuuuuuuuuuuuuuuugggg

SEQ ID NO: 1335907 - RNA, 18 nt, Human
aaacaaaagcugccacau

SEQ ID NO: 1335908 - RNA, 20 nt, Human
aagacauuacuggcucuuaa

SEQ ID NO: 1335909 - RNA, 25 nt, Human
aagcugccacauguuuauuaagaca

SEQ ID NO: 1335910 - RNA, 19 nt, Human
caaacaaaagcugccacau

SEQ ID NO: 1335911 - RNA, 22 nt, Human
caaauagucucuuuagaagucu

SEQ ID NO: 1335912 - RNA, 26 nt, Human
cgcuccgguucuccgguccaguuuca

SEQ ID NO: 1335913 - RNA, 18 nt, Human
uggacuucaaauagucuc

SEQ ID NO: 1335914 - RNA, 22 nt, Human
uggaucuauaaaucauuuucca

SEQ ID NO: 1335915 - RNA, 19 nt, Human
ugugacucaacuggacuuc

SEQ ID NO: 1335916 - RNA, 25 nt, Human
aaaaacagcaaaaagugccgguacc

SEQ ID NO: 1335917 - RNA, 19 nt, Human
aacacagacugggacgccg

SEQ ID NO: 1335918 - RNA, 21 nt, Human
acaguaacgauggugugcgca

SEQ ID NO: 1335919 - RNA, 22 nt, Human
aggaacacaucaaugaaaaaaa

SEQ ID NO: 1335920 - RNA, 21 nt, Human
agguagugaaaauugauagca

SEQ ID NO: 1335921 - RNA, 27 nt, Human
auacaaaaaguaaauuagaggggaccc

SEQ ID NO: 1335922 - RNA, 26 nt, Human
caaggcaagcggcaguuacugccccc

SEQ ID NO: 1335923 - RNA, 21 nt, Human
ccaaaaucaguguagauuggc

SEQ ID NO: 1335924 - RNA, 24 nt, Human
cgaaaaacuaggcaaaaacagcaa

SEQ ID NO: 1335925 - RNA, 21 nt, Human
cuacugcggcaaggcaagcgg

SEQ ID NO: 1335926 - RNA, 18 nt, Human
cuagucacagauauagaa

SEQ ID NO: 1335927 - RNA, 21 nt, Human
cuuccauguaaaaccuaguua

SEQ ID NO: 1335928 - RNA, 19 nt, Human
gaaaaacuaggcaaaaaca

SEQ ID NO: 1335929 - RNA, 27 nt, Human
gaaaaacuaggcaaaaacagcaaaaag

SEQ ID NO: 1335930 - RNA, 19 nt, Human
gaacacaucaaugaaaaaa

SEQ ID NO: 1335931 - RNA, 22 nt, Human
ggcgaaaaacuaggcaaaaaca

SEQ ID NO: 1335932 - RNA, 21 nt, Human
ggcuuccauguaaaaccuagu

SEQ ID NO: 1335933 - RNA, 22 nt, Human
guccaacauuaaccaccauucg

SEQ ID NO: 1335934 - RNA, 18 nt, Human
uaagccuacuuauuggca

SEQ ID NO: 1335935 - RNA, 23 nt, Human
uaggacaauuuccuacuuuuuaa

SEQ ID NO: 1335936 - RNA, 23 nt, Human
uaggcaaaaacagcaaaaagugc

SEQ ID NO: 1335937 - RNA, 25 nt, Human
uauaagcaauaaaaucacaaaauca

SEQ ID NO: 1335938 - RNA, 22 nt, Human
uauuggcaagaaacagguuagg

SEQ ID NO: 1335939 - RNA, 22 nt, Human
ucacgcacguuaugacuucagu

SEQ ID NO: 1335940 - RNA, 23 nt, Human
uccaacauuaaccaccauucgau

SEQ ID NO: 1335941 - RNA, 20 nt, Human
ugagaaugcugcugcaacac

SEQ ID NO: 1335942 - RNA, 18 nt, Human
ugauagcaacuuauaagc

SEQ ID NO: 1335943 - RNA, 20 nt, Human
ugcggcaaggcaagcggcag

SEQ ID NO: 1335944 - RNA, 24 nt, Human
ugucaaauaugaguucucuguuau

SEQ ID NO: 1335945 - RNA, 19 nt, Human
uuauaagcaauaaaaucac

SEQ ID NO: 1335946 - RNA, 22 nt, Human
aaauaaccuuuuauuuaaaggu

SEQ ID NO: 1335947 - RNA, 18 nt, Human
aagaaggcugccugguug

SEQ ID NO: 1335948 - RNA, 22 nt, Human
aagaaggcugccugguugugug

SEQ ID NO: 1335949 - RNA, 25 nt, Human
caacuauaucagucaccagguuuuc

SEQ ID NO: 1335950 - RNA, 24 nt, Human
caccagguuuucccaucagagcuu

SEQ ID NO: 1335951 - RNA, 21 nt, Human
gucaagaaggcugccugguug

SEQ ID NO: 1335952 - RNA, 20 nt, Human
ucagagggacaaauaaccuu

SEQ ID NO: 1335953 - RNA, 20 nt, Human
ugaauuccuaaagaaaacau

SEQ ID NO: 1335954 - RNA, 21 nt, Human
uguguguuguauucacuacuc

SEQ ID NO: 1335955 - RNA, 18 nt, Human
uguuguauucacuacucu

SEQ ID NO: 1335956 - RNA, 19 nt, Human
uuagagacuuguauauuuc

SEQ ID NO: 1335957 - RNA, 20 nt, Human
uuagagacuuguauauuuca

SEQ ID NO: 1335958 - RNA, 19 nt, Human
caaaauuaacuggaaaugg

SEQ ID NO: 1335959 - RNA, 22 nt, Human
cagcaauaaucauaaacucuga

SEQ ID NO: 1335960 - RNA, 19 nt, Human
cauaaacucugaacuuggc

SEQ ID NO: 1335961 - RNA, 19 nt, Human
cauuauauagccaaaagau

SEQ ID NO: 1335962 - RNA, 19 nt, Human
cuagcuguccaagcagcaa

SEQ ID NO: 1335963 - RNA, 18 nt, Human
cuccucgagcucagcgag

SEQ ID NO: 1335964 - RNA, 21 nt, Human
gagacuccuucaccagcgccc

SEQ ID NO: 1335965 - RNA, 21 nt, Human
uauauacaguauauguacaca

SEQ ID NO: 1335966 - RNA, 28 nt, Human
uauguacacauauaaacauacacacagu

SEQ ID NO: 1335967 - RNA, 24 nt, Human
uccaagcagcaauaaucauaaacu

SEQ ID NO: 1335968 - RNA, 22 nt, Human
uuagcacaaacuaacuagagga

SEQ ID NO: 1335969 - RNA, 18 nt, Human
aggaagaggcagugagga

SEQ ID NO: 1335970 - RNA, 22 nt, Human
cagccccucagauccgccuccc

SEQ ID NO: 1335971 - RNA, 23 nt, Human
ccagccccucagauccgccuccc

SEQ ID NO: 1335972 - RNA, 19 nt, Human
ccccucagauccgccuccc

SEQ ID NO: 1335973 - RNA, 22 nt, Human
ccccucagauccgccuccccuc

SEQ ID NO: 1335974 - RNA, 18 nt, Human
ccucccaugucacuccag

SEQ ID NO: 1335975 - RNA, 20 nt, Human
cgccuccccucccaugucac

SEQ ID NO: 1335976 - RNA, 19 nt, Human
gccccaacugaggggccug

SEQ ID NO: 1335977 - RNA, 18 nt, Human
gccugcacccagccccuc

SEQ ID NO: 1335978 - RNA, 18 nt, Human
uccccucccaugucacuc

SEQ ID NO: 1335979 - RNA, 19 nt, Human
ugaggagaacaguagucug

SEQ ID NO: 1335980 - RNA, 20 nt, Human
uggaagggagaguucagacu

SEQ ID NO: 1335981 - RNA, 21 nt, Human
aaacaaaacuaccauaugauc

SEQ ID NO: 1335982 - RNA, 22 nt, Human
aagaagcuucagcaaauagccc

SEQ ID NO: 1335983 - RNA, 23 nt, Human
aguaaaacaaaacuaccauauga

SEQ ID NO: 1335984 - RNA, 22 nt, Human
ccaauucuaccaugugccagaa

SEQ ID NO: 1335985 - RNA, 21 nt, Human
ccuccggaggcuagacgguuc

SEQ ID NO: 1335986 - RNA, 21 nt, Human
cgccgcgcuggggaggccccc

SEQ ID NO: 1335987 - RNA, 24 nt, Human
cgccgcgcuggggaggcccccucc

SEQ ID NO: 1335988 - RNA, 22 nt, Human
cggccuggccuccggaggcuag

SEQ ID NO: 1335989 - RNA, 22 nt, Human
gcacucacggccuggccuccgg

SEQ ID NO: 1335990 - RNA, 23 nt, Human
gggccaccaagaagcuucagcaa

SEQ ID NO: 1335991 - RNA, 21 nt, Human
ggggaggcccccucaacccuc

SEQ ID NO: 1335992 - RNA, 23 nt, Human
uaaaacaaaacuaccauaugauc

SEQ ID NO: 1335993 - RNA, 18 nt, Human
uaccaugugccagaaacu

SEQ ID NO: 1335994 - RNA, 24 nt, Human
uauaccucccgcacucacggccug

SEQ ID NO: 1335995 - RNA, 20 nt, Human
uauagagacgaagaaacuga

SEQ ID NO: 1335996 - RNA, 18 nt, Human
ucacacagguagugagug

SEQ ID NO: 1335997 - RNA, 23 nt, Human
ucuaaguguuucacugacggcuc

SEQ ID NO: 1335998 - RNA, 22 nt, Human
ucugucgccuccccacacccgg

SEQ ID NO: 1335999 - RNA, 24 nt, Human
uggccuccggaggcuagacgguuc

SEQ ID NO: 1336000 - RNA, 20 nt, Human
uucacugacggcucacaaca

SEQ ID NO: 1336001 - RNA, 22 nt, Human
uucacugacggcucacaacaau

SEQ ID NO: 1336002 - RNA, 21 nt, Human
uuggcguauaccucccgcacu

SEQ ID NO: 1336003 - RNA, 22 nt, Human
caccugagcggcccgggccgaa

SEQ ID NO: 1336004 - RNA, 24 nt, Human
ccccaggggccccgcucacgcucc

SEQ ID NO: 1336005 - RNA, 19 nt, Human
ccccgcucacgcucccgag

SEQ ID NO: 1336006 - RNA, 21 nt, Human
ccggcccugcuccuccacaag

SEQ ID NO: 1336007 - RNA, 21 nt, Human
ccggcgccggggcgaagaagg

SEQ ID NO: 1336008 - RNA, 22 nt, Human
ccucgcgccggcccugcuccuc

SEQ ID NO: 1336009 - RNA, 22 nt, Human
cgacagaggagcggggaccagg

SEQ ID NO: 1336010 - RNA, 20 nt, Human
cgccggcccugcuccuccac

SEQ ID NO: 1336011 - RNA, 23 nt, Human
cggcccgggccgaagcgccgggc

SEQ ID NO: 1336012 - RNA, 24 nt, Human
cggcccgggccgaagcgccgggca

SEQ ID NO: 1336013 - RNA, 19 nt, Human
cucugcaccugagcggccc

SEQ ID NO: 1336014 - RNA, 19 nt, Human
gagucucgccucgcgccgg

SEQ ID NO: 1336015 - RNA, 20 nt, Human
gccccaggggccccgcucac

SEQ ID NO: 1336016 - RNA, 19 nt, Human
ggcgccggggcgaagaagg

SEQ ID NO: 1336017 - RNA, 24 nt, Human
uaaguuugguaaagagaagauaau

SEQ ID NO: 1336018 - RNA, 26 nt, Human
ucuccgccugcagacuggcccgacag

SEQ ID NO: 1336019 - RNA, 19 nt, Human
uggcccgacagaggagcgg

SEQ ID NO: 1336020 - RNA, 20 nt, Human
ugguaaagagaagauaaugg

SEQ ID NO: 1336021 - RNA, 23 nt, Human
aacugaauuacuccaucauaaaa

SEQ ID NO: 1336022 - RNA, 20 nt, Human
aaguauucuccauccaguuc

SEQ ID NO: 1336023 - RNA, 18 nt, Human
cuaaaagauaaaagugaa

SEQ ID NO: 1336024 - RNA, 23 nt, Human
cucucuucucucuucuuuccuua

SEQ ID NO: 1336025 - RNA, 19 nt, Human
guagugaucuuugucucuc

SEQ ID NO: 1336026 - RNA, 21 nt, Human
uaaccuaaaagcagcauuuau

SEQ ID NO: 1336027 - RNA, 23 nt, Human
ucaguaccagaggugccucuucu

SEQ ID NO: 1336028 - RNA, 27 nt, Human
ucucucuucucucuucuuuccuccugg

SEQ ID NO: 1336029 - RNA, 23 nt, Human
ucucuuaccuaaaagauaaaagu

SEQ ID NO: 1336030 - RNA, 24 nt, Human
ucuguagugaucuuugucucucuu

SEQ ID NO: 1336031 - RNA, 21 nt, Human
ucuucaguaccagaggugccu

SEQ ID NO: 1336032 - RNA, 18 nt, Human
ugauccugaguuguuccu

SEQ ID NO: 1336033 - RNA, 20 nt, Human
uuagccaccuuacccaugcc

SEQ ID NO: 1336034 - RNA, 20 nt, Human
uucucucuucuuuccuuauc

SEQ ID NO: 1336035 - RNA, 21 nt, Human
aaaaaaaggcaguuuagggua

SEQ ID NO: 1336036 - RNA, 19 nt, Human
aaaaaaucuccccuccuuc

SEQ ID NO: 1336037 - RNA, 24 nt, Human
aaaagaccaagauguccagucuug

SEQ ID NO: 1336038 - RNA, 23 nt, Human
aaagaaaaaaaggcaguuuaggg

SEQ ID NO: 1336039 - RNA, 20 nt, Human
aaucacaaucaccuugauua

SEQ ID NO: 1336040 - RNA, 21 nt, Human
acaccccaauuaaaaacuaca

SEQ ID NO: 1336041 - RNA, 22 nt, Human
acacuccacccucagcagaaaa

SEQ ID NO: 1336042 - RNA, 18 nt, Human
acccuggagguagugggg

SEQ ID NO: 1336043 - RNA, 18 nt, Human
accuccucccucccccca

SEQ ID NO: 1336044 - RNA, 19 nt, Human
agaaaaccuccccgccccu

SEQ ID NO: 1336045 - RNA, 24 nt, Human
agagcacugacacagggggagucc

SEQ ID NO: 1336046 - RNA, 21 nt, Human
aggcaggugggaucugucagg

SEQ ID NO: 1336047 - RNA, 21 nt, Human
aggcugcuccugguaaagcuu

SEQ ID NO: 1336048 - RNA, 22 nt, Human
agggaggugagucuugggcagg

SEQ ID NO: 1336049 - RNA, 27 nt, Human
agggaguacugagaaacucagagcuca

SEQ ID NO: 1336050 - RNA, 20 nt, Human
agggcaauggcuaaacuagg

SEQ ID NO: 1336051 - RNA, 23 nt, Human
aggugguggggauaagugcagau

SEQ ID NO: 1336052 - RNA, 19 nt, Human
auaccuccucccucccccc

SEQ ID NO: 1336053 - RNA, 18 nt, Human
aucuccccuccuucccua

SEQ ID NO: 1336054 - RNA, 26 nt, Human
augugggcaauggaccccgggcuggg

SEQ ID NO: 1336055 - RNA, 19 nt, Human
caaaaaagaaaaaaaggca

SEQ ID NO: 1336056 - RNA, 26 nt, Human
caaagcaaaacccuggagguaguggg

SEQ ID NO: 1336057 - RNA, 22 nt, Human
caauauaccuccucccuccccc

SEQ ID NO: 1336058 - RNA, 19 nt, Human
cacaacaagggggucccca

SEQ ID NO: 1336059 - RNA, 23 nt, Human
caccaaaaaugguucccccucag

SEQ ID NO: 1336060 - RNA, 23 nt, Human
caccaucacccgacuguccuccu

SEQ ID NO: 1336061 - RNA, 24 nt, Human
caccaucacccgacuguccuccug

SEQ ID NO: 1336062 - RNA, 23 nt, Human
cacccuccacuucaccuugggga

SEQ ID NO: 1336063 - RNA, 20 nt, Human
caccucaaaaaagaaaaaaa

SEQ ID NO: 1336064 - RNA, 25 nt, Human
cacuccacccucagcagaaaaugau

SEQ ID NO: 1336065 - RNA, 25 nt, Human
cagaauacaccaucacccgacuguc

SEQ ID NO: 1336066 - RNA, 18 nt, Human
cagagaaugugggcaaug

SEQ ID NO: 1336067 - RNA, 19 nt, Human
cagggguccccccuagguu

SEQ ID NO: 1336068 - RNA, 21 nt, Human
ccacaccccaauuaaaaacua

SEQ ID NO: 1336069 - RNA, 21 nt, Human
ccaguaaugccaguucccaaa

SEQ ID NO: 1336070 - RNA, 21 nt, Human
ccauuaauuucaucuccaggg

SEQ ID NO: 1336071 - RNA, 20 nt, Human
cccaaacaugcacuuccuuc

SEQ ID NO: 1336072 - RNA, 19 nt, Human
cccaccagucacugacugg

SEQ ID NO: 1336073 - RNA, 24 nt, Human
ccccaccucaaaaaagaaaaaaag

SEQ ID NO: 1336074 - RNA, 19 nt, Human
ccccaggcccagggguccc

SEQ ID NO: 1336075 - RNA, 23 nt, Human
ccccaggugguggggauaagugc

SEQ ID NO: 1336076 - RNA, 18 nt, Human
cccgccccucccacaccc

SEQ ID NO: 1336077 - RNA, 21 nt, Human
cccuccacuucaccuugggga

SEQ ID NO: 1336078 - RNA, 19 nt, Human
ccucaaaaaagaaaaaaag

SEQ ID NO: 1336079 - RNA, 21 nt, Human
ccucaaaaaagaaaaaaaggc

SEQ ID NO: 1336080 - RNA, 21 nt, Human
ccucccuccccccaccucaaa

SEQ ID NO: 1336081 - RNA, 18 nt, Human
cgacgagaaggagacaga

SEQ ID NO: 1336082 - RNA, 20 nt, Human
cgccccucccacaccccaau

SEQ ID NO: 1336083 - RNA, 28 nt, Human
cgccccucccacaccccaauuaaaaacu

SEQ ID NO: 1336084 - RNA, 24 nt, Human
cgcgccagcuggggaguccgcgug

SEQ ID NO: 1336085 - RNA, 24 nt, Human
cuacaaaaaaaucuccccuccuuc

SEQ ID NO: 1336086 - RNA, 19 nt, Human
cucaccacagcacccucca

SEQ ID NO: 1336087 - RNA, 19 nt, Human
cucccuccccccaccucaa

SEQ ID NO: 1336088 - RNA, 18 nt, Human
cuccugccgucggccugc

SEQ ID NO: 1336089 - RNA, 19 nt, Human
cugacacagggggaguccu

SEQ ID NO: 1336090 - RNA, 20 nt, Human
cuggucaggugggaaggggg

SEQ ID NO: 1336091 - RNA, 23 nt, Human
gaagggaggugagucuugggcag

SEQ ID NO: 1336092 - RNA, 19 nt, Human
gacaggcaggugggaucug

SEQ ID NO: 1336093 - RNA, 19 nt, Human
gagaaggagacagagaaug

SEQ ID NO: 1336094 - RNA, 20 nt, Human
gagaaggagacagagaaugu

SEQ ID NO: 1336095 - RNA, 21 nt, Human
gagggcaccccaggcccaggg

SEQ ID NO: 1336096 - RNA, 22 nt, Human
gagggcaccccaggcccagggg

SEQ ID NO: 1336097 - RNA, 20 nt, Human
gaguacugagaaacucagaa

SEQ ID NO: 1336098 - RNA, 21 nt, Human
gcugcuccugguaaagcuuag

SEQ ID NO: 1336099 - RNA, 18 nt, Human
ggacaggcaggugggauc

SEQ ID NO: 1336100 - RNA, 21 nt, Human
ggagagaaaauauagcccaag

SEQ ID NO: 1336101 - RNA, 24 nt, Human
guagugggguagaccgacgagaag

SEQ ID NO: 1336102 - RNA, 26 nt, Human
uaaaaacuacaaaaaaaucuccccuc

SEQ ID NO: 1336103 - RNA, 18 nt, Human
uaccuccucccucccccc

SEQ ID NO: 1336104 - RNA, 18 nt, Human
uagaaaaccuccccgccc

SEQ ID NO: 1336105 - RNA, 21 nt, Human
uagaaaaccuccccgccccuc

SEQ ID NO: 1336106 - RNA, 22 nt, Human
uagaaaaccuccccgccccucc

SEQ ID NO: 1336107 - RNA, 21 nt, Human
uauaccuccucccucccccca

SEQ ID NO: 1336108 - RNA, 23 nt, Human
uaucacaccaaaaaugguucccc

SEQ ID NO: 1336109 - RNA, 22 nt, Human
uauuagucaaaaucacaaucac

SEQ ID NO: 1336110 - RNA, 19 nt, Human
ucaaacccaccagucacug

SEQ ID NO: 1336111 - RNA, 22 nt, Human
ucaaacccaccagucacugacu

SEQ ID NO: 1336112 - RNA, 21 nt, Human
ucaggugggaagggggguggg

SEQ ID NO: 1336113 - RNA, 23 nt, Human
ucagucaugggcaguggacaggc

SEQ ID NO: 1336114 - RNA, 18 nt, Human
ucaugggcaguggacagg

SEQ ID NO: 1336115 - RNA, 30 nt, Human
uccaauauaccuccucccuccccccaccuu

SEQ ID NO: 1336116 - RNA, 21 nt, Human
uccagaacuggagauggagaa

SEQ ID NO: 1336117 - RNA, 24 nt, Human
uccagaacuggagauggagaaaua

SEQ ID NO: 1336118 - RNA, 25 nt, Human
uccagggcaauggcuaaacuagguc

SEQ ID NO: 1336119 - RNA, 21 nt, Human
uccccgccccucccacacccc

SEQ ID NO: 1336120 - RNA, 18 nt, Human
ucgggugggaugcgcagg

SEQ ID NO: 1336121 - RNA, 23 nt, Human
ucugggaccaaggagaaagggac

SEQ ID NO: 1336122 - RNA, 22 nt, Human
uggacaggcaggugggaucugu

SEQ ID NO: 1336123 - RNA, 23 nt, Human
uggacaggcaggugggaucuguc

SEQ ID NO: 1336124 - RNA, 22 nt, Human
ugggaccaaggagaaagggacc

SEQ ID NO: 1336125 - RNA, 20 nt, Human
ugggaggggcgcgccagcug

SEQ ID NO: 1336126 - RNA, 21 nt, Human
ugggaggggcgcgccagcugg

SEQ ID NO: 1336127 - RNA, 20 nt, Human
ugggguagaccgacgagaag

SEQ ID NO: 1336128 - RNA, 20 nt, Human
ugguagucugacuccuccag

SEQ ID NO: 1336129 - RNA, 21 nt, Human
ugugggcaauggaccccgggc

SEQ ID NO: 1336130 - RNA, 18 nt, Human
uuccaguaaugccaguuc

SEQ ID NO: 1336131 - RNA, 23 nt, Human
uuggggagaggagggaugcuggu

SEQ ID NO: 1336132 - RNA, 23 nt, Human
uuuauagaaaaccuccccgcccc

SEQ ID NO: 1336133 - RNA, 18 nt, Human
aaagcaaaauaaaacaaa

SEQ ID NO: 1336134 - RNA, 26 nt, Human
aacauaccauucucucaaagcaaaau

SEQ ID NO: 1336135 - RNA, 23 nt, Human
aagacaaagcaauuauguacaga

SEQ ID NO: 1336136 - RNA, 22 nt, Human
aauaaaacaaagcuuucuuuaa

SEQ ID NO: 1336137 - RNA, 25 nt, Human
acauaccauucucucaaagcaaaau

SEQ ID NO: 1336138 - RNA, 22 nt, Human
agaaaacaguauaacugaucac

SEQ ID NO: 1336139 - RNA, 22 nt, Human
agaagacaagguuagagaaaua

SEQ ID NO: 1336140 - RNA, 22 nt, Human
agagacaaggguugaggaaaga

SEQ ID NO: 1336141 - RNA, 18 nt, Human
agaguuauggaaccaaua

SEQ ID NO: 1336142 - RNA, 22 nt, Human
aggaaagaguaaaggugcauag

SEQ ID NO: 1336143 - RNA, 20 nt, Human
aguaaaggugcauagaaauc

SEQ ID NO: 1336144 - RNA, 27 nt, Human
caaagcaauuauguacagauagagacc

SEQ ID NO: 1336145 - RNA, 22 nt, Human
caaagcuuucuuuaaucugaaa

SEQ ID NO: 1336146 - RNA, 23 nt, Human
caagguuagagaaauaaccuauc

SEQ ID NO: 1336147 - RNA, 21 nt, Human
caucaagacaaagcaauuaug

SEQ ID NO: 1336148 - RNA, 20 nt, Human
cuauaguuaagaaaacauac

SEQ ID NO: 1336149 - RNA, 22 nt, Human
uaaaguagcuauagaaaacagu

SEQ ID NO: 1336150 - RNA, 18 nt, Human
uaauagauaacuaacggc

SEQ ID NO: 1336151 - RNA, 22 nt, Human
uacagaguuauggaaccaauag

SEQ ID NO: 1336152 - RNA, 19 nt, Human
uaccagaauaagaaaauac

SEQ ID NO: 1336153 - RNA, 19 nt, Human
uauagaaaacaguauaacu

SEQ ID NO: 1336154 - RNA, 24 nt, Human
uauggaaccaauagauagucauga

SEQ ID NO: 1336155 - RNA, 21 nt, Human
ucucucaaagcaaaauaaaac

SEQ ID NO: 1336156 - RNA, 19 nt, Human
ugaggaaagaguaaaggug

SEQ ID NO: 1336157 - RNA, 24 nt, Human
uggaaccaauagauagucaugaua

SEQ ID NO: 1336158 - RNA, 22 nt, Human
uuuuugguaaaacguuagaaga

SEQ ID NO: 1336159 - RNA, 19 nt, Human
aaccccugcuccuccggag

SEQ ID NO: 1336160 - RNA, 23 nt, Human
aaccugaggcccggcauggugag

SEQ ID NO: 1336161 - RNA, 21 nt, Human
aacucaucuccgccaagaucg

SEQ ID NO: 1336162 - RNA, 21 nt, Human
acacaguuucaaagacccggg

SEQ ID NO: 1336163 - RNA, 18 nt, Human
acucccugcaaacacugc

SEQ ID NO: 1336164 - RNA, 18 nt, Human
aggcgggcuggcgggggc

SEQ ID NO: 1336165 - RNA, 19 nt, Human
aggcuggggcugggcugca

SEQ ID NO: 1336166 - RNA, 21 nt, Human
aggggaggcgggcuggcgggg

SEQ ID NO: 1336167 - RNA, 23 nt, Human
aggggggugcggggccuccgggg

SEQ ID NO: 1336168 - RNA, 23 nt, Human
caccgggaccggcuccgcaacgg

SEQ ID NO: 1336169 - RNA, 22 nt, Human
caccugcggccgugaccaaggu

SEQ ID NO: 1336170 - RNA, 19 nt, Human
cagagaugaggacgcucuc

SEQ ID NO: 1336171 - RNA, 24 nt, Human
ccccggaggcugggggcgcgcgcu

SEQ ID NO: 1336172 - RNA, 21 nt, Human
cccugcaaacacugccuggau

SEQ ID NO: 1336173 - RNA, 19 nt, Human
cccuggauguugucgaacc

SEQ ID NO: 1336174 - RNA, 21 nt, Human
ccgcguccucgggggcacagu

SEQ ID NO: 1336175 - RNA, 18 nt, Human
ccgggggcgcagcugccu

SEQ ID NO: 1336176 - RNA, 20 nt, Human
ccuccaugacccugccaccc

SEQ ID NO: 1336177 - RNA, 24 nt, Human
ccuggccgaggccucgcuggcgcc

SEQ ID NO: 1336178 - RNA, 22 nt, Human
cgaagccguccccggaggcugg

SEQ ID NO: 1336179 - RNA, 21 nt, Human
cucaugcucagggcgguggca

SEQ ID NO: 1336180 - RNA, 19 nt, Human
cuccgcaacgggaggcucc

SEQ ID NO: 1336181 - RNA, 18 nt, Human
cuccgggccugggucgcc

SEQ ID NO: 1336182 - RNA, 22 nt, Human
cuccggggccggggucuccucg

SEQ ID NO: 1336183 - RNA, 23 nt, Human
cucuucggauccaaacucaucuc

SEQ ID NO: 1336184 - RNA, 19 nt, Human
gaaaggcucuggcgacgcc

SEQ ID NO: 1336185 - RNA, 19 nt, Human
gaggcuccugcuccgggcc

SEQ ID NO: 1336186 - RNA, 19 nt, Human
gagucgaagaaguccgagg

SEQ ID NO: 1336187 - RNA, 18 nt, Human
gccgccagcguccuccau

SEQ ID NO: 1336188 - RNA, 21 nt, Human
gcggggccuccggggccgggg

SEQ ID NO: 1336189 - RNA, 21 nt, Human
gcgggggccggggagcccgcg

SEQ ID NO: 1336190 - RNA, 23 nt, Human
ggagucagagaugaggacgcucu

SEQ ID NO: 1336191 - RNA, 23 nt, Human
ggauccaaacucaucuccgccaa

SEQ ID NO: 1336192 - RNA, 22 nt, Human
ggccacggguucggggcgcccc

SEQ ID NO: 1336193 - RNA, 19 nt, Human
ggcccaggucgcccgcguc

SEQ ID NO: 1336194 - RNA, 20 nt, Human
ggcugggggcgcgcgcuggc

SEQ ID NO: 1336195 - RNA, 24 nt, Human
gggagucagagaugaggacgcucu

SEQ ID NO: 1336196 - RNA, 27 nt, Human
gggcacagcgaggggaggccgguaccc

SEQ ID NO: 1336197 - RNA, 22 nt, Human
ggucucguucucuucggaucca

SEQ ID NO: 1336198 - RNA, 21 nt, Human
ggugcccgcgggcuccgggcc

SEQ ID NO: 1336199 - RNA, 19 nt, Human
gguguccuggccgaggccu

SEQ ID NO: 1336200 - RNA, 22 nt, Human
gugaccaagguccgugaggaag

SEQ ID NO: 1336201 - RNA, 20 nt, Human
gugcccgcgggcuccgggcc

SEQ ID NO: 1336202 - RNA, 24 nt, Human
uaaggggucaccugcggccggggc

SEQ ID NO: 1336203 - RNA, 19 nt, Human
uccaaacucaucuccgcca

SEQ ID NO: 1336204 - RNA, 19 nt, Human
uccacgaacacggcgccgc

SEQ ID NO: 1336205 - RNA, 20 nt, Human
ucccgggcacagcgagggga

SEQ ID NO: 1336206 - RNA, 21 nt, Human
ucgcugccugggaccucgcgg

SEQ ID NO: 1336207 - RNA, 19 nt, Human
ucuggcgacgccgggggcg

SEQ ID NO: 1336208 - RNA, 25 nt, Human
ugacggaaaugaaggcggagguagu

SEQ ID NO: 1336209 - RNA, 20 nt, Human
ugaggaaggugacagaagcc

SEQ ID NO: 1336210 - RNA, 19 nt, Human
ugaggcccggcauggugag

SEQ ID NO: 1336211 - RNA, 21 nt, Human
ugaguuccuccaugucacauu

SEQ ID NO: 1336212 - RNA, 19 nt, Human
ugccucggggccccuccgc

SEQ ID NO: 1336213 - RNA, 19 nt, Human
ugccucggggccccuccgc

SEQ ID NO: 1336214 - RNA, 19 nt, Human
ugccugggaccucgcgggc

SEQ ID NO: 1336215 - RNA, 21 nt, Human
ugcggggccuccggggccggg

SEQ ID NO: 1336216 - RNA, 18 nt, Human
ugcucagggcgguggcaa

SEQ ID NO: 1336217 - RNA, 18 nt, Human
uggcaaaggggucgucac

SEQ ID NO: 1336218 - RNA, 23 nt, Human
uggcaaaggggucgucacucccu

SEQ ID NO: 1336219 - RNA, 24 nt, Human
uggcugaagauggugcacaccggg

SEQ ID NO: 1336220 - RNA, 23 nt, Human
uuuuuuuuuuugaagcaggaguu

SEQ ID NO: 1336221 - RNA, 23 nt, Human
uuuuuuuuuuuugaagcaggagu

SEQ ID NO: 1336222 - RNA, 27 nt, Human
uuuuuuuuuuuuuuuuuuuuuuugggg

SEQ ID NO: 1336223 - RNA, 23 nt, Human
aaccgauucugacggcgucuacg

SEQ ID NO: 1336224 - RNA, 27 nt, Human
aagaagaggaacaaagguagucaaggg

SEQ ID NO: 1336225 - RNA, 22 nt, Human
aaggacacgcaaccacgcucac

SEQ ID NO: 1336226 - RNA, 19 nt, Human
aagggagcccucugccucc

SEQ ID NO: 1336227 - RNA, 19 nt, Human
acacucgccucccccucca

SEQ ID NO: 1336228 - RNA, 18 nt, Human
acccagccuggcccccag

SEQ ID NO: 1336229 - RNA, 20 nt, Human
acccagccuggcccccagca

SEQ ID NO: 1336230 - RNA, 18 nt, Human
acucgccucccccuccac

SEQ ID NO: 1336231 - RNA, 18 nt, Human
aggccaaguaggcgaagg

SEQ ID NO: 1336232 - RNA, 23 nt, Human
caaaggacacgcaaccacgcuca

SEQ ID NO: 1336233 - RNA, 25 nt, Human
caagggaagcaggggaugggggagg

SEQ ID NO: 1336234 - RNA, 20 nt, Human
cacacucgccucccccucca

SEQ ID NO: 1336235 - RNA, 23 nt, Human
cacugcacaaucccagcaugagc

SEQ ID NO: 1336236 - RNA, 26 nt, Human
cagcaugagcccagacgacugauacu

SEQ ID NO: 1336237 - RNA, 18 nt, Human
ccccagcaaaccuggcug

SEQ ID NO: 1336238 - RNA, 20 nt, Human
ccccagcaaaccuggcuggc

SEQ ID NO: 1336239 - RNA, 20 nt, Human
cccccuccacuucucucuuc

SEQ ID NO: 1336240 - RNA, 23 nt, Human
cccccuccacuucucucuucuca

SEQ ID NO: 1336241 - RNA, 21 nt, Human
cccuccacuucucucuucuca

SEQ ID NO: 1336242 - RNA, 28 nt, Human
ccuccacuucucucuucucaggcuuuug

SEQ ID NO: 1336243 - RNA, 22 nt, Human
ccucccccuccacuucucucuu

SEQ ID NO: 1336244 - RNA, 19 nt, Human
ccugugaggacacccagcc

SEQ ID NO: 1336245 - RNA, 23 nt, Human
cgccgcgauucugucagagacgg

SEQ ID NO: 1336246 - RNA, 24 nt, Human
cgggcccuauuuccuucuccacag

SEQ ID NO: 1336247 - RNA, 21 nt, Human
cucagcgccgggcccuauuuc

SEQ ID NO: 1336248 - RNA, 25 nt, Human
cucagcgccgggcccuauuuccuuc

SEQ ID NO: 1336249 - RNA, 23 nt, Human
cucccccuccacuucucucuucu

SEQ ID NO: 1336250 - RNA, 20 nt, Human
cucucuucucaggcuuuugg

SEQ ID NO: 1336251 - RNA, 19 nt, Human
gccaugucaccucgcccca

SEQ ID NO: 1336252 - RNA, 20 nt, Human
gcccuauuuccuucuccaca

SEQ ID NO: 1336253 - RNA, 18 nt, Human
gcggaggaugggcgggua

SEQ ID NO: 1336254 - RNA, 18 nt, Human
gcugcuggucccccuggg

SEQ ID NO: 1336255 - RNA, 22 nt, Human
ggcccuauuuccuucuccacag

SEQ ID NO: 1336256 - RNA, 19 nt, Human
uagcugcuggucccccugg

SEQ ID NO: 1336257 - RNA, 22 nt, Human
ucacacacucgccucccccucc

SEQ ID NO: 1336258 - RNA, 23 nt, Human
ucacacacucgccucccccucca

SEQ ID NO: 1336259 - RNA, 23 nt, Human
ucagagacggagcgucggagggg

SEQ ID NO: 1336260 - RNA, 24 nt, Human
ucagcgccgggcccuauuuccuuc

SEQ ID NO: 1336261 - RNA, 21 nt, Human
ucaguguucaaagaagaggaa

SEQ ID NO: 1336262 - RNA, 19 nt, Human
ucaugcaugguucuccuug

SEQ ID NO: 1336263 - RNA, 21 nt, Human
ucccagcaugagcccagacga

SEQ ID NO: 1336264 - RNA, 18 nt, Human
ucccccuccacuucucuc

SEQ ID NO: 1336265 - RNA, 19 nt, Human
ucucaggcuuuuggaauug

SEQ ID NO: 1336266 - RNA, 21 nt, Human
ucucucuucucaggcuuuugg

SEQ ID NO: 1336267 - RNA, 19 nt, Human
ugcuggucccccugggaau

SEQ ID NO: 1336268 - RNA, 20 nt, Human
uggcccccagcaaaccuggc

SEQ ID NO: 1336269 - RNA, 19 nt, Human
ugggaaugccacuguacug

SEQ ID NO: 1336270 - RNA, 19 nt, Human
uggguagcugcuggucccc

SEQ ID NO: 1336271 - RNA, 18 nt, Human
uucuccuuggguagcugc

SEQ ID NO: 1336272 - RNA, 19 nt, Human
uugcucccugcgggguucg

SEQ ID NO: 1336273 - RNA, 20 nt, Human
aaccagggcugacccgcgcc

SEQ ID NO: 1336274 - RNA, 23 nt, Human
accagcgccucgcgguaacgacc

SEQ ID NO: 1336275 - RNA, 21 nt, Human
agacccagaagccggcgaacc

SEQ ID NO: 1336276 - RNA, 21 nt, Human
aggcagccgucacaguguguc

SEQ ID NO: 1336277 - RNA, 23 nt, Human
caaagacccagaagccggcgaac

SEQ ID NO: 1336278 - RNA, 18 nt, Human
caaccaccagugcgcggc

SEQ ID NO: 1336279 - RNA, 20 nt, Human
cagaagccggcgaaccaggg

SEQ ID NO: 1336280 - RNA, 23 nt, Human
cagcgccucgcgguaacgaccga

SEQ ID NO: 1336281 - RNA, 23 nt, Human
ccaccagugcgcggcgccgcgac

SEQ ID NO: 1336282 - RNA, 19 nt, Human
gcggcacugacccaaccac

SEQ ID NO: 1336283 - RNA, 22 nt, Human
gcuucaggcagccgucacagug

SEQ ID NO: 1336284 - RNA, 19 nt, Human
uguucaaagacccagaagc

SEQ ID NO: 1336285 - RNA, 19 nt, Human
aaagugcugggauaacugg

SEQ ID NO: 1336286 - RNA, 24 nt, Human
aaagugcugggauaacuggcauga

SEQ ID NO: 1336287 - RNA, 22 nt, Human
acugaggaauacuauguauuua

SEQ ID NO: 1336288 - RNA, 25 nt, Human
acugcacccagcuuagcuucugauu

SEQ ID NO: 1336289 - RNA, 18 nt, Human
aguagagaugggguuuca

SEQ ID NO: 1336290 - RNA, 22 nt, Human
aguagagaugggguuucaccau

SEQ ID NO: 1336291 - RNA, 23 nt, Human
aguagagaugggguuucaccaug

SEQ ID NO: 1336292 - RNA, 24 nt, Human
augaauuaaaaccuuaaaacuggu

SEQ ID NO: 1336293 - RNA, 24 nt, Human
augauuugcccaccucggccuccc

SEQ ID NO: 1336294 - RNA, 18 nt, Human
augggguuucaccauguu

SEQ ID NO: 1336295 - RNA, 20 nt, Human
augggguuucaccauguuag

SEQ ID NO: 1336296 - RNA, 24 nt, Human
augggguuucaccauguuagccag

SEQ ID NO: 1336297 - RNA, 24 nt, Human
caaagugcugggauaacuggcaug

SEQ ID NO: 1336298 - RNA, 21 nt, Human
caccauguuagccaggaaggu

SEQ ID NO: 1336299 - RNA, 22 nt, Human
caccauguuagccaggaagguc

SEQ ID NO: 1336300 - RNA, 24 nt, Human
caccauguuagccaggaaggucuc

SEQ ID NO: 1336301 - RNA, 24 nt, Human
caccucggccucccaaagugcugg

SEQ ID NO: 1336302 - RNA, 19 nt, Human
ccaaagugcugggauaacu

SEQ ID NO: 1336303 - RNA, 24 nt, Human
ccaaagugcugggauaacuggcau

SEQ ID NO: 1336304 - RNA, 18 nt, Human
ccacugcacccagcuuag

SEQ ID NO: 1336305 - RNA, 18 nt, Human
ccacugcacccagcuuag

SEQ ID NO: 1336306 - RNA, 19 nt, Human
ccacugcacccagcuuagc

SEQ ID NO: 1336307 - RNA, 20 nt, Human
cuccugaccucaugauuugc

SEQ ID NO: 1336308 - RNA, 22 nt, Human
gaccucaugauuugcccaccuc

SEQ ID NO: 1336309 - RNA, 18 nt, Human
gagaugggguuucaccau

SEQ ID NO: 1336310 - RNA, 24 nt, Human
gagaugggguuucaccauguuagc

SEQ ID NO: 1336311 - RNA, 23 nt, Human
gauaacuggcaugagccacugca

SEQ ID NO: 1336312 - RNA, 20 nt, Human
ggcaugagccacugcaccca

SEQ ID NO: 1336313 - RNA, 22 nt, Human
gggguuucaccauguuagccag

SEQ ID NO: 1336314 - RNA, 21 nt, Human
guagagaugggguuucaccau

SEQ ID NO: 1336315 - RNA, 23 nt, Human
guagagaugggguuucaccaugu

SEQ ID NO: 1336316 - RNA, 22 nt, Human
uaauuuugaaaaguaauugcug

SEQ ID NO: 1336317 - RNA, 22 nt, Human
uagagaugggguuucaccaugu

SEQ ID NO: 1336318 - RNA, 24 nt, Human
ucccaaagugcugggauaacuggc

SEQ ID NO: 1336319 - RNA, 18 nt, Human
ucggccucccaaagugcu

SEQ ID NO: 1336320 - RNA, 24 nt, Human
ugauuugcccaccucggccuccca

SEQ ID NO: 1336321 - RNA, 19 nt, Human
ugggauaacuggcaugagc

SEQ ID NO: 1336322 - RNA, 22 nt, Human
ugggauaacuggcaugagccac

SEQ ID NO: 1336323 - RNA, 24 nt, Human
ugggauaacuggcaugagccacug

SEQ ID NO: 1336324 - RNA, 24 nt, Human
ugggguuucaccauguuagccagg

SEQ ID NO: 1336325 - RNA, 19 nt, Human
uuucaccauguuagccagg

SEQ ID NO: 1336326 - RNA, 18 nt, Human
aagcccaagagggaacag

SEQ ID NO: 1336327 - RNA, 18 nt, Human
agggaacagcauaaaaau

SEQ ID NO: 1336328 - RNA, 23 nt, Human
cacagaauugucuuugcaugaag

SEQ ID NO: 1336329 - RNA, 20 nt, Human
caguagaagagucaaaggug

SEQ ID NO: 1336330 - RNA, 22 nt, Human
cagugcagcgcgagagggccgg

SEQ ID NO: 1336331 - RNA, 18 nt, Human
cgggagaggacgccggag

SEQ ID NO: 1336332 - RNA, 20 nt, Human
gaacaucaauauaauuacaa

SEQ ID NO: 1336333 - RNA, 18 nt, Human
gaagggggagcgcgccca

SEQ ID NO: 1336334 - RNA, 23 nt, Human
gagacagugcagcgcgagagggc

SEQ ID NO: 1336335 - RNA, 21 nt, Human
gccgggacagucuugcgucgg

SEQ ID NO: 1336336 - RNA, 21 nt, Human
ggaagggggagcgcgcccagc

SEQ ID NO: 1336337 - RNA, 22 nt, Human
ggccgggacagucuugcgucgg

SEQ ID NO: 1336338 - RNA, 23 nt, Human
gggccuccuccacccgcucagga

SEQ ID NO: 1336339 - RNA, 21 nt, Human
uccgggccgggacagucuugc

SEQ ID NO: 1336340 - RNA, 20 nt, Human
ugggccuccuccacccgcuc

SEQ ID NO: 1336341 - RNA, 19 nt, Human
uuuacacaauaugaacauc

SEQ ID NO: 1336342 - RNA, 22 nt, Human
uuuguuagaaaagcagcugcag

SEQ ID NO: 1336343 - RNA, 21 nt, Human
aaaagcagagcuacaaauaug

SEQ ID NO: 1336344 - RNA, 23 nt, Human
aaauacagcgcucucaaacccca

SEQ ID NO: 1336345 - RNA, 19 nt, Human
aauacuguauaugagaaaa

SEQ ID NO: 1336346 - RNA, 22 nt, Human
aauccaguauuagcaccuacaa

SEQ ID NO: 1336347 - RNA, 19 nt, Human
aaugacuaacagacccaua

SEQ ID NO: 1336348 - RNA, 20 nt, Human
acaggacaccccgcgccgcc

SEQ ID NO: 1336349 - RNA, 19 nt, Human
acaggcuguaaaguaacaa

SEQ ID NO: 1336350 - RNA, 21 nt, Human
accccgcgccgccuccucugc

SEQ ID NO: 1336351 - RNA, 19 nt, Human
acccucaccaaaauccugg

SEQ ID NO: 1336352 - RNA, 21 nt, Human
agagcuacaaauauggacuca

SEQ ID NO: 1336353 - RNA, 19 nt, Human
agccaaaagcagagcuaca

SEQ ID NO: 1336354 - RNA, 21 nt, Human
agccaaaagcagagcuacaaa

SEQ ID NO: 1336355 - RNA, 22 nt, Human
agccacagccaacccucaccaa

SEQ ID NO: 1336356 - RNA, 20 nt, Human
agcgacuagaggucacucca

SEQ ID NO: 1336357 - RNA, 23 nt, Human
auggcgaggacaggacaccccgc

SEQ ID NO: 1336358 - RNA, 23 nt, Human
caaaccccaaggauaaacgaaag

SEQ ID NO: 1336359 - RNA, 23 nt, Human
caacagguugaaaaugcagacac

SEQ ID NO: 1336360 - RNA, 22 nt, Human
caagauagaacacuggugaaga

SEQ ID NO: 1336361 - RNA, 24 nt, Human
caagcuuugcacugggcugaccaa

SEQ ID NO: 1336362 - RNA, 22 nt, Human
caaggaaugaagagaaccaaug

SEQ ID NO: 1336363 - RNA, 22 nt, Human
cacagccaacccucaccaaaau

SEQ ID NO: 1336364 - RNA, 23 nt, Human
caccccgcgccgccuccucugcc

SEQ ID NO: 1336365 - RNA, 19 nt, Human
caccuacaauaucucugac

SEQ ID NO: 1336366 - RNA, 25 nt, Human
cagcacguaucauaucuuuccaaca

SEQ ID NO: 1336367 - RNA, 21 nt, Human
cagcagauagaaaggaaugau

SEQ ID NO: 1336368 - RNA, 25 nt, Human
cagccaaaagcagagcuacaaauau

SEQ ID NO: 1336369 - RNA, 24 nt, Human
cauuguguuuucucagaaacuaau

SEQ ID NO: 1336370 - RNA, 19 nt, Human
ccaaaagcagagcuacaaa

SEQ ID NO: 1336371 - RNA, 24 nt, Human
ccaaauacagcgcucucaaacccc

SEQ ID NO: 1336372 - RNA, 26 nt, Human
ccaacccucaccaaaauccuggagaa

SEQ ID NO: 1336373 - RNA, 19 nt, Human
ccaaggaaugaagagaacc

SEQ ID NO: 1336374 - RNA, 22 nt, Human
ccacagccaacccucaccaaaa

SEQ ID NO: 1336375 - RNA, 20 nt, Human
cccaaggaaugaagagaacc

SEQ ID NO: 1336376 - RNA, 25 nt, Human
ccccgcgccgccuccucugcccucc

SEQ ID NO: 1336377 - RNA, 19 nt, Human
cccgcgccgccuccucugc

SEQ ID NO: 1336378 - RNA, 19 nt, Human
cccggcuggaagugggauc

SEQ ID NO: 1336379 - RNA, 18 nt, Human
ccgcgccgccuccucugc

SEQ ID NO: 1336380 - RNA, 21 nt, Human
ccgcgccgccuccucugcccu

SEQ ID NO: 1336381 - RNA, 19 nt, Human
ccggcgccugcugcggccu

SEQ ID NO: 1336382 - RNA, 20 nt, Human
cggccaguggauacaugagg

SEQ ID NO: 1336383 - RNA, 27 nt, Human
cucaaaccccaaggauaaacgaaaggc

SEQ ID NO: 1336384 - RNA, 24 nt, Human
cucaccaaaauccuggagaaaaac

SEQ ID NO: 1336385 - RNA, 22 nt, Human
cucucccaaauacagcgcucuc

SEQ ID NO: 1336386 - RNA, 19 nt, Human
cuuacugauuuuugugaug

SEQ ID NO: 1336387 - RNA, 21 nt, Human
gaacuuggucuggaacuggca

SEQ ID NO: 1336388 - RNA, 23 nt, Human
gauagaacacuggugaagauacg

SEQ ID NO: 1336389 - RNA, 18 nt, Human
ggacaccggcgccugcug

SEQ ID NO: 1336390 - RNA, 18 nt, Human
ggcuggaagugggaucuu

SEQ ID NO: 1336391 - RNA, 18 nt, Human
guacagccaaaagcagag

SEQ ID NO: 1336392 - RNA, 22 nt, Human
gugaaacuuuuaaugguuucuc

SEQ ID NO: 1336393 - RNA, 22 nt, Human
uaaacgaaaggcauaagcagcc

SEQ ID NO: 1336394 - RNA, 23 nt, Human
uaacuggaaauugcauuaaauac

SEQ ID NO: 1336395 - RNA, 23 nt, Human
uaagcagccccgauccuaggaac

SEQ ID NO: 1336396 - RNA, 22 nt, Human
uaauugcuauaauaaaacaaau

SEQ ID NO: 1336397 - RNA, 22 nt, Human
uacaugaggggcccggcuggaa

SEQ ID NO: 1336398 - RNA, 25 nt, Human
uacuguacuugagccaaucauaaga

SEQ ID NO: 1336399 - RNA, 24 nt, Human
uaggggaacaagauagaacacugg

SEQ ID NO: 1336400 - RNA, 19 nt, Human
uccuuggaguaaauggcac

SEQ ID NO: 1336401 - RNA, 20 nt, Human
ucggccaguggauacaugag

SEQ ID NO: 1336402 - RNA, 20 nt, Human
ugaacaagcagcacguauca

SEQ ID NO: 1336403 - RNA, 21 nt, Human
ugaagauacggcuuguugagg

SEQ ID NO: 1336404 - RNA, 23 nt, Human
ugcaaaacgacagccacagccaa

SEQ ID NO: 1336405 - RNA, 23 nt, Human
ugcacugggcugaccaacugugu

SEQ ID NO: 1336406 - RNA, 21 nt, Human
uggaauuuuagaaagugaguc

SEQ ID NO: 1336407 - RNA, 22 nt, Human
uggagaggagguagggacacuc

SEQ ID NO: 1336408 - RNA, 19 nt, Human
uggcagcgugugccacugc

SEQ ID NO: 1336409 - RNA, 20 nt, Human
uguauaugagaaaauucugu

SEQ ID NO: 1336410 - RNA, 19 nt, Human
ugugcacugaauacuguau

SEQ ID NO: 1336411 - RNA, 22 nt, Human
ugugcacugaauacuguauaug

SEQ ID NO: 1336412 - RNA, 18 nt, Human
uuaacacauacuuauggg

SEQ ID NO: 1336413 - RNA, 20 nt, Human
uuaggggaacaagauagaac

SEQ ID NO: 1336414 - RNA, 21 nt, Human
uuuucucagaaacuaaucaaa

SEQ ID NO: 1336415 - RNA, 18 nt, Human
uuuuuuuuuuuuuuuuug

SEQ ID NO: 1336416 - RNA, 22 nt, Human
uuuuuuuuuuuuuuuuuuguuu

SEQ ID NO: 1336417 - RNA, 21 nt, Human
auaaucuaaaaaacaucuguu

SEQ ID NO: 1336418 - RNA, 20 nt, Human
caaauggcgcuggggugaug

SEQ ID NO: 1336419 - RNA, 18 nt, Human
cgcuggggugaugucaga

SEQ ID NO: 1336420 - RNA, 19 nt, Human
cuauugaauucaaguuaug

SEQ ID NO: 1336421 - RNA, 19 nt, Human
gcaaagcgcgauggcuacc

SEQ ID NO: 1336422 - RNA, 19 nt, Human
guacugcuggaaaguugcu

SEQ ID NO: 1336423 - RNA, 18 nt, Human
uagaaagcuaacauugug

SEQ ID NO: 1336424 - RNA, 23 nt, Human
uauggaauuagaaagcuaacauu

SEQ ID NO: 1336425 - RNA, 21 nt, Human
ucccccuucugucgucuucuc

SEQ ID NO: 1336426 - RNA, 20 nt, Human
uggccccaguucgcaucagc

SEQ ID NO: 1336427 - RNA, 20 nt, Human
uucaaauuaaguugauuuaa

SEQ ID NO: 1336428 - RNA, 19 nt, Human
uuugccaaacauuagaguu

SEQ ID NO: 1336429 - RNA, 23 nt, Human
aaaaaacacaagagugugcaaag

SEQ ID NO: 1336430 - RNA, 24 nt, Human
aaaaagugcacucccgauuucuuc

SEQ ID NO: 1336431 - RNA, 25 nt, Human
aagaacagggaagagcugcugaggc

SEQ ID NO: 1336432 - RNA, 21 nt, Human
aagagcugcugaggccaagag

SEQ ID NO: 1336433 - RNA, 19 nt, Human
acuaggugcugggagugug

SEQ ID NO: 1336434 - RNA, 19 nt, Human
agagcugcugaggccaaga

SEQ ID NO: 1336435 - RNA, 19 nt, Human
agaggcuaucaugggcugu

SEQ ID NO: 1336436 - RNA, 18 nt, Human
agcugcugaggccaagag

SEQ ID NO: 1336437 - RNA, 21 nt, Human
augaaugaaauauccaacuga

SEQ ID NO: 1336438 - RNA, 23 nt, Human
caaaaaacacaagagugugcaaa

SEQ ID NO: 1336439 - RNA, 18 nt, Human
caaaaagugcacucccga

SEQ ID NO: 1336440 - RNA, 19 nt, Human
cgaacaaucuacagucaaa

SEQ ID NO: 1336441 - RNA, 24 nt, Human
cuuacaguccauauguauaccaau

SEQ ID NO: 1336442 - RNA, 19 nt, Human
gaucaaaaugucaaccagu

SEQ ID NO: 1336443 - RNA, 18 nt, Human
guaugauguuuacgugug

SEQ ID NO: 1336444 - RNA, 21 nt, Human
guuuguuuuaaguccugaagu

SEQ ID NO: 1336445 - RNA, 22 nt, Human
uacaguccauauguauaccaau

SEQ ID NO: 1336446 - RNA, 22 nt, Human
uagaaucaaagguuaagaacau

SEQ ID NO: 1336447 - RNA, 20 nt, Human
uauuccacaaacauuuacug

SEQ ID NO: 1336448 - RNA, 23 nt, Human
uauuccacaaacauuuacugagc

SEQ ID NO: 1336449 - RNA, 18 nt, Human
ucaacugcugccaccuuu

SEQ ID NO: 1336450 - RNA, 20 nt, Human
ucccuaauaagacagggauu

SEQ ID NO: 1336451 - RNA, 28 nt, Human
uccuucaacugcugccaccuuuguugag

SEQ ID NO: 1336452 - RNA, 22 nt, Human
ucucuauuuucuugaaaagagc

SEQ ID NO: 1336453 - RNA, 21 nt, Human
ugaaagacaccuuacagucca

SEQ ID NO: 1336454 - RNA, 24 nt, Human
ugagcaaaaaacacaagagugugc

SEQ ID NO: 1336455 - RNA, 24 nt, Human
ugagcaaaaaacacaagagugugc

SEQ ID NO: 1336456 - RNA, 20 nt, Human
ugcuugaaaauuuacaaaug

SEQ ID NO: 1336457 - RNA, 23 nt, Human
ugggcuguaaguagaaucaaagg

SEQ ID NO: 1336458 - RNA, 20 nt, Human
ugguuuugagccugauugca

SEQ ID NO: 1336459 - RNA, 18 nt, Human
uguauaccaaugaaugaa

SEQ ID NO: 1336460 - RNA, 24 nt, Human
uucugcaaccugaaagacaccuua

SEQ ID NO: 1336461 - RNA, 23 nt, Human
uuuucugcaaccugaaagacacc

SEQ ID NO: 1336462 - RNA, 25 nt, Human
aaaaaaacaugguggcuccugaaac

SEQ ID NO: 1336463 - RNA, 25 nt, Human
aaaaccuuuaacccaaaauucagaa

SEQ ID NO: 1336464 - RNA, 18 nt, Human
aaacaagacagguuagca

SEQ ID NO: 1336465 - RNA, 21 nt, Human
aacaagacagguuagcaacug

SEQ ID NO: 1336466 - RNA, 21 nt, Human
aagcaauuugcuuugccccag

SEQ ID NO: 1336467 - RNA, 21 nt, Human
aaguguugggagaccaaguuc

SEQ ID NO: 1336468 - RNA, 25 nt, Human
aauuaaaugaaaaaaaauuguacaa

SEQ ID NO: 1336469 - RNA, 23 nt, Human
aauuacccuauuuguagaaaccu

SEQ ID NO: 1336470 - RNA, 24 nt, Human
aauucaaaauacauucaaauucac

SEQ ID NO: 1336471 - RNA, 20 nt, Human
acaauaaguguugggagacc

SEQ ID NO: 1336472 - RNA, 21 nt, Human
acaauaaguguugggagacca

SEQ ID NO: 1336473 - RNA, 18 nt, Human
acugaaaaaaaaacaugg

SEQ ID NO: 1336474 - RNA, 19 nt, Human
acugaaagcuuaaucugcu

SEQ ID NO: 1336475 - RNA, 18 nt, Human
agacagguuagcaacugg

SEQ ID NO: 1336476 - RNA, 18 nt, Human
agcggggcggcggcggcg

SEQ ID NO: 1336477 - RNA, 21 nt, Human
aggcagaaggaauuuagccca

SEQ ID NO: 1336478 - RNA, 19 nt, Human
aggcaucacaacugaaaau

SEQ ID NO: 1336479 - RNA, 18 nt, Human
auagcaccucaucaaaua

SEQ ID NO: 1336480 - RNA, 26 nt, Human
auuucaacuucacucacuuauauuuc

SEQ ID NO: 1336481 - RNA, 19 nt, Human
caaaaugcucccaaguaga

SEQ ID NO: 1336482 - RNA, 25 nt, Human
cacaaacauagcaccucaucaaaua

SEQ ID NO: 1336483 - RNA, 21 nt, Human
cacacagacacacacacauaa

SEQ ID NO: 1336484 - RNA, 22 nt, Human
cacacagacacacacacauaac

SEQ ID NO: 1336485 - RNA, 24 nt, Human
cacacagacacacacacauaacca

SEQ ID NO: 1336486 - RNA, 26 nt, Human
cacauaaccauaaaaugaaggucauc

SEQ ID NO: 1336487 - RNA, 18 nt, Human
cagaaaaugacgcacgac

SEQ ID NO: 1336488 - RNA, 19 nt, Human
cagaaaaugacgcacgacu

SEQ ID NO: 1336489 - RNA, 19 nt, Human
cagggccagcggggcggcg

SEQ ID NO: 1336490 - RNA, 22 nt, Human
cauaaccauaaaaugaagguca

SEQ ID NO: 1336491 - RNA, 23 nt, Human
ccaaagacacacagacacacaca

SEQ ID NO: 1336492 - RNA, 19 nt, Human
ccuccuuccccagccggga

SEQ ID NO: 1336493 - RNA, 26 nt, Human
cggcacgagguuuuuuuuuuuuuuuu

SEQ ID NO: 1336494 - RNA, 22 nt, Human
cuaaaagacuuacuacauagug

SEQ ID NO: 1336495 - RNA, 22 nt, Human
cuaaaugaaguccaauuuuauc

SEQ ID NO: 1336496 - RNA, 19 nt, Human
cuacaagugaacaaacuag

SEQ ID NO: 1336497 - RNA, 18 nt, Human
cucaguuucccuauaagg

SEQ ID NO: 1336498 - RNA, 20 nt, Human
cucccaaguagaaaugacag

SEQ ID NO: 1336499 - RNA, 19 nt, Human
cucgccgcccuccuucccc

SEQ ID NO: 1336500 - RNA, 19 nt, Human
cugaaaaaaaaacauggug

SEQ ID NO: 1336501 - RNA, 20 nt, Human
cuuaguuaaggcaucacaac

SEQ ID NO: 1336502 - RNA, 19 nt, Human
gaaaggauuuuugaauucu

SEQ ID NO: 1336503 - RNA, 22 nt, Human
gacacacagacacacacacaua

SEQ ID NO: 1336504 - RNA, 19 nt, Human
gaccaaguuccaaagacaa

SEQ ID NO: 1336505 - RNA, 20 nt, Human
gauauauacauuauucacca

SEQ ID NO: 1336506 - RNA, 23 nt, Human
gccagcggggcggcggcggccgg

SEQ ID NO: 1336507 - RNA, 20 nt, Human
gcugcagggccagcggggcg

SEQ ID NO: 1336508 - RNA, 22 nt, Human
gcugcagggccagcggggcggc

SEQ ID NO: 1336509 - RNA, 21 nt, Human
gcugguucccaugaucuaaag

SEQ ID NO: 1336510 - RNA, 20 nt, Human
gcuuccccucgugccgaauu

SEQ ID NO: 1336511 - RNA, 18 nt, Human
ggcggcggcggccggagg

SEQ ID NO: 1336512 - RNA, 19 nt, Human
ggcggggggugcacggggc

SEQ ID NO: 1336513 - RNA, 18 nt, Human
gucacaguaacuauaugu

SEQ ID NO: 1336514 - RNA, 23 nt, Human
uaaaaaaauuuccaaaaugucaa

SEQ ID NO: 1336515 - RNA, 23 nt, Human
uaaaaagauacuaaaugaagucc

SEQ ID NO: 1336516 - RNA, 22 nt, Human
uaaaaucauccuaaaagacuua

SEQ ID NO: 1336517 - RNA, 25 nt, Human
uaaaauuaaaaaaauuuccaaaaug

SEQ ID NO: 1336518 - RNA, 18 nt, Human
uaaaguuuaacuuucauc

SEQ ID NO: 1336519 - RNA, 25 nt, Human
uaaauguaaccgaaacaacuauuca

SEQ ID NO: 1336520 - RNA, 22 nt, Human
uaacacugaaaaaaaaacaugg

SEQ ID NO: 1336521 - RNA, 22 nt, Human
uaacauuguaagacaagucuca

SEQ ID NO: 1336522 - RNA, 22 nt, Human
uaagaaaaguuuccaucaggua

SEQ ID NO: 1336523 - RNA, 21 nt, Human
uagaauauauauucugcagca

SEQ ID NO: 1336524 - RNA, 18 nt, Human
uagcaacugguacagcuu

SEQ ID NO: 1336525 - RNA, 20 nt, Human
uagcccgaggcagcggcgac

SEQ ID NO: 1336526 - RNA, 18 nt, Human
uauaaggguaagaaaagu

SEQ ID NO: 1336527 - RNA, 22 nt, Human
uauuucaacuucacucacuuau

SEQ ID NO: 1336528 - RNA, 22 nt, Human
ucaaaaucccuuucuaaagccc

SEQ ID NO: 1336529 - RNA, 27 nt, Human
ucaaauaucugguaaacacuuugcaau

SEQ ID NO: 1336530 - RNA, 19 nt, Human
ucaauaucaauaguguuuu

SEQ ID NO: 1336531 - RNA, 22 nt, Human
ucacaauaaguguugggagacc

SEQ ID NO: 1336532 - RNA, 23 nt, Human
ucacauucuuacagcagccaaaa

SEQ ID NO: 1336533 - RNA, 26 nt, Human
uccaaagacacacagacacacacaca

SEQ ID NO: 1336534 - RNA, 23 nt, Human
uccaaguaauucuguuaaaaaga

SEQ ID NO: 1336535 - RNA, 30 nt, Human
uccccagccgggaccgccgagcccggggcc

SEQ ID NO: 1336536 - RNA, 20 nt, Human
ucccuauaaggguaagaaaa

SEQ ID NO: 1336537 - RNA, 20 nt, Human
ugaaaaaaaauuguacaaaa

SEQ ID NO: 1336538 - RNA, 21 nt, Human
ugaauucugaacuagcagucu

SEQ ID NO: 1336539 - RNA, 22 nt, Human
ugauauguuuuucacaaacaua

SEQ ID NO: 1336540 - RNA, 21 nt, Human
ugccgaauucggcacgagguu

SEQ ID NO: 1336541 - RNA, 19 nt, Human
uucacaaacauagcaccuc

SEQ ID NO: 1336542 - RNA, 20 nt, Human
uugaauuacaugauauguuu

SEQ ID NO: 1336543 - RNA, 24 nt, Human
uugggagaccaaguuccaaagaca

SEQ ID NO: 1336544 - RNA, 25 nt, Human
uuguuuuuuguuuuguuuuuuuuuu

SEQ ID NO: 1336545 - RNA, 22 nt, Human
uuucaggcuaacaauuggcuuc

SEQ ID NO: 1336546 - RNA, 18 nt, Human
uuugaauucugaacuagc

SEQ ID NO: 1336547 - RNA, 23 nt, Human
uuuuguuuguuuuuuuuugcagc

SEQ ID NO: 1336548 - RNA, 27 nt, Human
uuuuuuuuuuuguuuuuuguuuuguuu

SEQ ID NO: 1336549 - RNA, 18 nt, Human
uuuuuuuuuuuuuuuuug

SEQ ID NO: 1336550 - RNA, 25 nt, Human
uuuuuuuuuuuuuuuuuuguuuuuu

SEQ ID NO: 1336551 - RNA, 18 nt, Human
aaaugccacagguuaaaa

SEQ ID NO: 1336552 - RNA, 20 nt, Human
aaaugccacagguuaaaaug

SEQ ID NO: 1336553 - RNA, 18 nt, Human
aagauguguauggacccu

SEQ ID NO: 1336554 - RNA, 23 nt, Human
acaauacagcauguaguagguac

SEQ ID NO: 1336555 - RNA, 19 nt, Human
acaccuccacagcuccaac

SEQ ID NO: 1336556 - RNA, 18 nt, Human
acaguaaaaaguaucuaa

SEQ ID NO: 1336557 - RNA, 18 nt, Human
accacaggcacccacuca

SEQ ID NO: 1336558 - RNA, 21 nt, Human
acccuguuauggccaagcauc

SEQ ID NO: 1336559 - RNA, 19 nt, Human
accgcaguucuggccgcgc

SEQ ID NO: 1336560 - RNA, 24 nt, Human
acgcacgcacgcuccuugcaaccc

SEQ ID NO: 1336561 - RNA, 21 nt, Human
acucaaaaugccaaaaaaaaa

SEQ ID NO: 1336562 - RNA, 22 nt, Human
caacaaaguaaaaauuuuaaaa

SEQ ID NO: 1336563 - RNA, 25 nt, Human
caagcaggagcugaaguuuuuccug

SEQ ID NO: 1336564 - RNA, 24 nt, Human
caaggguauuucccacuccuuucu

SEQ ID NO: 1336565 - RNA, 19 nt, Human
cacggaaaacuuaagugac

SEQ ID NO: 1336566 - RNA, 21 nt, Human
cacggaaaacuuaagugaccg

SEQ ID NO: 1336567 - RNA, 22 nt, Human
cacggaaaacuuaagugaccgc

SEQ ID NO: 1336568 - RNA, 18 nt, Human
cagaagauguguauggac

SEQ ID NO: 1336569 - RNA, 23 nt, Human
cagacgcacgcacgcuccuugca

SEQ ID NO: 1336570 - RNA, 19 nt, Human
cauacaauacagcauguag

SEQ ID NO: 1336571 - RNA, 20 nt, Human
ccaagcaucucaaagaugaa

SEQ ID NO: 1336572 - RNA, 28 nt, Human
ccagacgcacgcacgcuccuugcaaccc

SEQ ID NO: 1336573 - RNA, 23 nt, Human
ccaggaggaaaauuauugggaaa

SEQ ID NO: 1336574 - RNA, 26 nt, Human
cccuauaccagacgcacgcacgcucc

SEQ ID NO: 1336575 - RNA, 26 nt, Human
ccucuuaguucuucaagcaggagcug

SEQ ID NO: 1336576 - RNA, 20 nt, Human
cuccacagcuccaaccacag

SEQ ID NO: 1336577 - RNA, 21 nt, Human
cuccugcauaugaggaggaaa

SEQ ID NO: 1336578 - RNA, 24 nt, Human
cuccugcauaugaggaggaaaugg

SEQ ID NO: 1336579 - RNA, 20 nt, Human
cuucuagucuuuugcgaagu

SEQ ID NO: 1336580 - RNA, 22 nt, Human
gacaccuccacagcuccaacca

SEQ ID NO: 1336581 - RNA, 22 nt, Human
ggaggcauguuaggaaccaaaa

SEQ ID NO: 1336582 - RNA, 22 nt, Human
ggcucuuagcaauuccaauuuu

SEQ ID NO: 1336583 - RNA, 23 nt, Human
gucuccaccaggaggaaaauuau

SEQ ID NO: 1336584 - RNA, 22 nt, Human
uaaggcagaaucucaggaagcc

SEQ ID NO: 1336585 - RNA, 23 nt, Human
uacauguucauucugcaaccuug

SEQ ID NO: 1336586 - RNA, 21 nt, Human
uaccagacgcacgcacgcucc

SEQ ID NO: 1336587 - RNA, 18 nt, Human
uaguagguaccuuuucuu

SEQ ID NO: 1336588 - RNA, 19 nt, Human
uauaccagacgcacgcacg

SEQ ID NO: 1336589 - RNA, 22 nt, Human
ucaaaaugccaaaaaaaaaaau

SEQ ID NO: 1336590 - RNA, 18 nt, Human
ucaaagaugaagagagaa

SEQ ID NO: 1336591 - RNA, 19 nt, Human
ucaauccacugucuccacc

SEQ ID NO: 1336592 - RNA, 20 nt, Human
ucaucuuuuuucaacuacag

SEQ ID NO: 1336593 - RNA, 26 nt, Human
uccacagcuccaaccacaggcaccca

SEQ ID NO: 1336594 - RNA, 28 nt, Human
uccacagcuccaaccacaggcacccacu

SEQ ID NO: 1336595 - RNA, 30 nt, Human
ucguaaccuuucaucaauuaacauuuucuu

SEQ ID NO: 1336596 - RNA, 24 nt, Human
ucuaguuguuuucuuuguguuguu

SEQ ID NO: 1336597 - RNA, 19 nt, Human
ucucaaagaugaagagaga

SEQ ID NO: 1336598 - RNA, 25 nt, Human
ucugagaauuucucuuuuaaugcuu

SEQ ID NO: 1336599 - RNA, 21 nt, Human
ugaccgcaguucuggccgcgc

SEQ ID NO: 1336600 - RNA, 23 nt, Human
ugccaaaaaaaaaaauucaacaa

SEQ ID NO: 1336601 - RNA, 20 nt, Human
ugccacagguuaaaauguca

SEQ ID NO: 1336602 - RNA, 24 nt, Human
ugccacagguuaaaaugucaaguu

SEQ ID NO: 1336603 - RNA, 18 nt, Human
ugcuuggaaccauggcug

SEQ ID NO: 1336604 - RNA, 24 nt, Human
uggcaaacaguaaaaaguaucuaa

SEQ ID NO: 1336605 - RNA, 18 nt, Human
uggcuuucuuacuguuuu

SEQ ID NO: 1336606 - RNA, 23 nt, Human
ugggcucuuagcaauuccaauuu

SEQ ID NO: 1336607 - RNA, 27 nt, Human
ugguaguuccaugcuuggaaccauggc

SEQ ID NO: 1336608 - RNA, 20 nt, Human
uuagaaaagguagccuuuug

SEQ ID NO: 1336609 - RNA, 21 nt, Human
uuugggcucuuagcaauucca

SEQ ID NO: 1336610 - RNA, 27 nt, Human
uuuuaaauugucaucuuuuuucaacua

SEQ ID NO: 1336611 - RNA, 20 nt, Human
uuuuugggaguuaauaucug

SEQ ID NO: 1336612 - RNA, 20 nt, Human
aaaccccgcaagcucuucuc

SEQ ID NO: 1336613 - RNA, 21 nt, Human
aaaguucucagaugcccaaaa

SEQ ID NO: 1336614 - RNA, 28 nt, Human
aaauauucuuuauucugaaaacaauguc

SEQ ID NO: 1336615 - RNA, 19 nt, Human
aaccccgcaagcucuucuc

SEQ ID NO: 1336616 - RNA, 25 nt, Human
aaccccgcaagcucuucucucagcc

SEQ ID NO: 1336617 - RNA, 23 nt, Human
agcaguaucccaagacuccaucu

SEQ ID NO: 1336618 - RNA, 22 nt, Human
caagaacagcggcauacaccgc

SEQ ID NO: 1336619 - RNA, 19 nt, Human
caccgccuccagcccuuca

SEQ ID NO: 1336620 - RNA, 18 nt, Human
cacuccauaacuugguug

SEQ ID NO: 1336621 - RNA, 18 nt, Human
ccaaaaaauuccaaaagu

SEQ ID NO: 1336622 - RNA, 23 nt, Human
ccaaaaaauuccaaaaguuuuaa

SEQ ID NO: 1336623 - RNA, 23 nt, Human
ccaucuggaaacauuuuucuggu

SEQ ID NO: 1336624 - RNA, 19 nt, Human
ccgcaaaccccgcaagcuc

SEQ ID NO: 1336625 - RNA, 21 nt, Human
ccgcaagcucuucucucagcc

SEQ ID NO: 1336626 - RNA, 25 nt, Human
ccuacauucuaaaaccaucuggaaa

SEQ ID NO: 1336627 - RNA, 19 nt, Human
ccuccagcccuucagucgg

SEQ ID NO: 1336628 - RNA, 20 nt, Human
ccuccagcccuucagucggg

SEQ ID NO: 1336629 - RNA, 26 nt, Human
ccucucaugaccagaagcggacggag

SEQ ID NO: 1336630 - RNA, 25 nt, Human
cgcaaaccccgcaagcucuucucuc

SEQ ID NO: 1336631 - RNA, 20 nt, Human
cggcauacaccgccuccagc

SEQ ID NO: 1336632 - RNA, 20 nt, Human
cugaaaguucucagaugccc

SEQ ID NO: 1336633 - RNA, 22 nt, Human
gaaaguucucagaugcccaaaa

SEQ ID NO: 1336634 - RNA, 20 nt, Human
gagguagaguaaagccagca

SEQ ID NO: 1336635 - RNA, 22 nt, Human
gcaagaacagcggcauacaccg

SEQ ID NO: 1336636 - RNA, 23 nt, Human
gcggcauacaccgccuccagccc

SEQ ID NO: 1336637 - RNA, 24 nt, Human
gcuucaggccucugucuccucuca

SEQ ID NO: 1336638 - RNA, 19 nt, Human
guaaaaccugucugaaagu

SEQ ID NO: 1336639 - RNA, 21 nt, Human
gucggggccaucaaccgcaaa

SEQ ID NO: 1336640 - RNA, 18 nt, Human
uaaagccagcaguauccc

SEQ ID NO: 1336641 - RNA, 18 nt, Human
uaauguaucauccucagu

SEQ ID NO: 1336642 - RNA, 22 nt, Human
uaccugaguucucuaaaaccac

SEQ ID NO: 1336643 - RNA, 22 nt, Human
uaucaguagucauuaugaccaa

SEQ ID NO: 1336644 - RNA, 23 nt, Human
uauuaagaauuuuuaggauggga

SEQ ID NO: 1336645 - RNA, 22 nt, Human
ucagaugcccaaaaaauuccaa

SEQ ID NO: 1336646 - RNA, 21 nt, Human
ucauaaguccuacauucuaaa

SEQ ID NO: 1336647 - RNA, 26 nt, Human
ugaaaaauauucuuuauucugaaaac

SEQ ID NO: 1336648 - RNA, 20 nt, Human
ugaaaguucucagaugccca

SEQ ID NO: 1336649 - RNA, 18 nt, Human
ugaaaucacaguucugca

SEQ ID NO: 1336650 - RNA, 23 nt, Human
ugaacaaaauucuacuuuuagau

SEQ ID NO: 1336651 - RNA, 19 nt, Human
ugaacaaauaucauccaca

SEQ ID NO: 1336652 - RNA, 21 nt, Human
ugacccagaugucuuugcuuc

SEQ ID NO: 1336653 - RNA, 21 nt, Human
ugcccaaaaaauuccaaaagu

SEQ ID NO: 1336654 - RNA, 26 nt, Human
ugcccaaaaaauuccaaaaguuuuaa

SEQ ID NO: 1336655 - RNA, 24 nt, Human
uggugaauuggaucauaaguccua

SEQ ID NO: 1336656 - RNA, 23 nt, Human
ugucugaaaguucucagaugccc

SEQ ID NO: 1336657 - RNA, 20 nt, Human
uuuauauggucugaaaucac

SEQ ID NO: 1336658 - RNA, 23 nt, Human
uuuuuuuuuuuuuuugaauuuaa

SEQ ID NO: 1336659 - RNA, 24 nt, Human
uuuuuuuuuuuuuuuuuugaauuu

SEQ ID NO: 1336660 - RNA, 27 nt, Human
uuuuuuuuuuuuuuuuuuuuuuugggg

SEQ ID NO: 1336661 - RNA, 25 nt, Human
aaaaaaaauggaaaggcuucccagc

SEQ ID NO: 1336662 - RNA, 25 nt, Human
aaaaauuagcuaagaauauguuuaa

SEQ ID NO: 1336663 - RNA, 25 nt, Human
aaaacacuccaaacucuaugaaaca

SEQ ID NO: 1336664 - RNA, 23 nt, Human
aaacagacuugaacuauucacua

SEQ ID NO: 1336665 - RNA, 18 nt, Human
aaagcauggccacaugca

SEQ ID NO: 1336666 - RNA, 22 nt, Human
aacacuuuuuaauguaguacau

SEQ ID NO: 1336667 - RNA, 22 nt, Human
aauguaguacauauauaucuua

SEQ ID NO: 1336668 - RNA, 22 nt, Human
acaccccagaguacucagaaga

SEQ ID NO: 1336669 - RNA, 18 nt, Human
acaccuucagccugaaaa

SEQ ID NO: 1336670 - RNA, 27 nt, Human
acagaacccaauagaagacagaaccca

SEQ ID NO: 1336671 - RNA, 22 nt, Human
acagauugcaguaauaugugug

SEQ ID NO: 1336672 - RNA, 21 nt, Human
acaggaacaauaucuuggcac

SEQ ID NO: 1336673 - RNA, 24 nt, Human
acucacuccaacacacacgugugc

SEQ ID NO: 1336674 - RNA, 21 nt, Human
agaaaaauaaaaaggcacaac

SEQ ID NO: 1336675 - RNA, 29 nt, Human
agacacauucucucacucacuccaacacu

SEQ ID NO: 1336676 - RNA, 22 nt, Human
agacuugaacuauucacuaaug

SEQ ID NO: 1336677 - RNA, 22 nt, Human
agaucuuuaacaugcagagaau

SEQ ID NO: 1336678 - RNA, 19 nt, Human
auauguguguguguauaua

SEQ ID NO: 1336679 - RNA, 29 nt, Human
auguguguguguauauauauauuuaaugu

SEQ ID NO: 1336680 - RNA, 18 nt, Human
caaaagauauuuuuugcc

SEQ ID NO: 1336681 - RNA, 22 nt, Human
caacgagucauaugacugaacc

SEQ ID NO: 1336682 - RNA, 19 nt, Human
caacgguaccacaucuugu

SEQ ID NO: 1336683 - RNA, 23 nt, Human
caacugccaccaauuucaaaaac

SEQ ID NO: 1336684 - RNA, 22 nt, Human
caauagaagacagaacccaaca

SEQ ID NO: 1336685 - RNA, 21 nt, Human
caauaugaaauccucuuagga

SEQ ID NO: 1336686 - RNA, 22 nt, Human
cacaacaguaagcuaaagagaa

SEQ ID NO: 1336687 - RNA, 23 nt, Human
cacagaacccaauagaagacaga

SEQ ID NO: 1336688 - RNA, 19 nt, Human
cacauucucucacucacuc

SEQ ID NO: 1336689 - RNA, 20 nt, Human
caccuucagccugaaaacau

SEQ ID NO: 1336690 - RNA, 22 nt, Human
cacuaagucuacaaauuguuca

SEQ ID NO: 1336691 - RNA, 28 nt, Human
cacucacuccaacacacacgugugcaca

SEQ ID NO: 1336692 - RNA, 21 nt, Human
cacuuugcacuuuugugacac

SEQ ID NO: 1336693 - RNA, 24 nt, Human
cagaaagccguuaaaaaaaaaaaa

SEQ ID NO: 1336694 - RNA, 19 nt, Human
cagcccccguacccccuac

SEQ ID NO: 1336695 - RNA, 23 nt, Human
cagcccccguacccccuaccgcc

SEQ ID NO: 1336696 - RNA, 19 nt, Human
caguaaaaccugucaaaac

SEQ ID NO: 1336697 - RNA, 23 nt, Human
caucucaauacacucuuaaacag

SEQ ID NO: 1336698 - RNA, 20 nt, Human
ccaaaacaauuuaaugcuga

SEQ ID NO: 1336699 - RNA, 23 nt, Human
ccaacacacacgugugcacacag

SEQ ID NO: 1336700 - RNA, 18 nt, Human
ccaauagaagacagaacc

SEQ ID NO: 1336701 - RNA, 19 nt, Human
ccagaaaucccccgccucc

SEQ ID NO: 1336702 - RNA, 21 nt, Human
cccccguacccccuaccgccu

SEQ ID NO: 1336703 - RNA, 23 nt, Human
ccgccucuuccuccuccacuccc

SEQ ID NO: 1336704 - RNA, 19 nt, Human
ccguacccccuaccgccuc

SEQ ID NO: 1336705 - RNA, 23 nt, Human
ccguuaaaaaaaaaaaaauggaa

SEQ ID NO: 1336706 - RNA, 21 nt, Human
ccuguaucaaaacacuccaaa

SEQ ID NO: 1336707 - RNA, 22 nt, Human
cgauaguuaagauuguguacac

SEQ ID NO: 1336708 - RNA, 24 nt, Human
cgcuucaacgguaccacaucuugu

SEQ ID NO: 1336709 - RNA, 25 nt, Human
cuaaaguaggaccuaccagaaaucc

SEQ ID NO: 1336710 - RNA, 18 nt, Human
cucacuccaacacacacg

SEQ ID NO: 1336711 - RNA, 24 nt, Human
cucauaacucauacugcugugauu

SEQ ID NO: 1336712 - RNA, 19 nt, Human
cucucacucacuccaacac

SEQ ID NO: 1336713 - RNA, 19 nt, Human
cuuccaguaaaaccuguca

SEQ ID NO: 1336714 - RNA, 21 nt, Human
cuucugggaccagcccccgua

SEQ ID NO: 1336715 - RNA, 24 nt, Human
gaaauuauguauucauccaccccc

SEQ ID NO: 1336716 - RNA, 21 nt, Human
gagaaaauaccagcuccccau

SEQ ID NO: 1336717 - RNA, 24 nt, Human
ggccacaugcacagacacauucuc

SEQ ID NO: 1336718 - RNA, 18 nt, Human
guaauugcuuuaaaacuc

SEQ ID NO: 1336719 - RNA, 25 nt, Human
gugugcacacauacucacaccccag

SEQ ID NO: 1336720 - RNA, 25 nt, Human
uaaaguaggaccuaccagaaauccc

SEQ ID NO: 1336721 - RNA, 25 nt, Human
uaaauuagaaacuaaccacaaauua

SEQ ID NO: 1336722 - RNA, 22 nt, Human
uaacagcaauuuuuaaaguaaa

SEQ ID NO: 1336723 - RNA, 22 nt, Human
uaacaugcagagaaugccaucu

SEQ ID NO: 1336724 - RNA, 19 nt, Human
uaagaugaaaaaccuaggc

SEQ ID NO: 1336725 - RNA, 20 nt, Human
uaagaugaaaaaccuaggca

SEQ ID NO: 1336726 - RNA, 20 nt, Human
uaauguaguacauauauauc

SEQ ID NO: 1336727 - RNA, 19 nt, Human
uacaacugauuuacagaug

SEQ ID NO: 1336728 - RNA, 24 nt, Human
uacaugagaaauuauguauucauc

SEQ ID NO: 1336729 - RNA, 20 nt, Human
uaccacaucuuguccuaaag

SEQ ID NO: 1336730 - RNA, 24 nt, Human
uaccacaucuuguccuaaaguagg

SEQ ID NO: 1336731 - RNA, 21 nt, Human
uagaaaaauaaaaaggcacaa

SEQ ID NO: 1336732 - RNA, 24 nt, Human
uagaaacuaaccacaaauuagggc

SEQ ID NO: 1336733 - RNA, 20 nt, Human
uagaaccaaaacaauuuaau

SEQ ID NO: 1336734 - RNA, 24 nt, Human
uagaaccaaaacaauuuaaugcug

SEQ ID NO: 1336735 - RNA, 22 nt, Human
uaguaguauguuuuccaccacg

SEQ ID NO: 1336736 - RNA, 20 nt, Human
uauaauaauaaauuauagua

SEQ ID NO: 1336737 - RNA, 21 nt, Human
uauauacacacacgccaauca

SEQ ID NO: 1336738 - RNA, 24 nt, Human
uauauauuuauccauauauacaca

SEQ ID NO: 1336739 - RNA, 22 nt, Human
uaugacugaacccagcuaaagc

SEQ ID NO: 1336740 - RNA, 18 nt, Human
uauguauucauccacccc

SEQ ID NO: 1336741 - RNA, 21 nt, Human
ucaaaacacuccaaacucuau

SEQ ID NO: 1336742 - RNA, 22 nt, Human
ucaaaacacuccaaacucuaug

SEQ ID NO: 1336743 - RNA, 26 nt, Human
ucccccgccuccgccaucuucuggga

SEQ ID NO: 1336744 - RNA, 23 nt, Human
ucuaccauuucacauccuuuuca

SEQ ID NO: 1336745 - RNA, 24 nt, Human
ucuucugcucaucacauauacuuc

SEQ ID NO: 1336746 - RNA, 23 nt, Human
ugaaaaaccuaggcauuccacca

SEQ ID NO: 1336747 - RNA, 18 nt, Human
ugcacacauacucacacc

SEQ ID NO: 1336748 - RNA, 26 nt, Human
ugcaguaauauguguguguguauaua

SEQ ID NO: 1336749 - RNA, 19 nt, Human
ugcuuacaaaguugauucu

SEQ ID NO: 1336750 - RNA, 21 nt, Human
uggaguuuccuauaugcucca

SEQ ID NO: 1336751 - RNA, 20 nt, Human
ugggaccagcccccguaccc

SEQ ID NO: 1336752 - RNA, 23 nt, Human
uguauucauccacccccaagacu

SEQ ID NO: 1336753 - RNA, 19 nt, Human
ugugcaaaagcaaugagau

SEQ ID NO: 1336754 - RNA, 21 nt, Human
ugugcaaaagcaaugagauuc

SEQ ID NO: 1336755 - RNA, 22 nt, Human
ugugcacacauacucacacccc

SEQ ID NO: 1336756 - RNA, 20 nt, Human
uguguacacauauucaauau

SEQ ID NO: 1336757 - RNA, 21 nt, Human
uguguacacauauucaauaug

SEQ ID NO: 1336758 - RNA, 26 nt, Human
uguguauauauauauuuauccauaua

SEQ ID NO: 1336759 - RNA, 18 nt, Human
uguguguguauauauaua

SEQ ID NO: 1336760 - RNA, 18 nt, Human
uguguguguauauauaua

SEQ ID NO: 1336761 - RNA, 19 nt, Human
uguguguguauauauauau

SEQ ID NO: 1336762 - RNA, 21 nt, Human
uguuuguuuuuggcuuuccuc

SEQ ID NO: 1336763 - RNA, 21 nt, Human
uuaaaaaaaaaaaaauggaaa

SEQ ID NO: 1336764 - RNA, 23 nt, Human
uuaaaguaaacacaucauagacc

SEQ ID NO: 1336765 - RNA, 27 nt, Human
uuacaaaguugauucuaaaaaauauac

SEQ ID NO: 1336766 - RNA, 23 nt, Human
uuacauauuuaauacguguugcu

SEQ ID NO: 1336767 - RNA, 21 nt, Human
uucauccacccccaagacugc

SEQ ID NO: 1336768 - RNA, 22 nt, Human
uucugggaccagcccccguacc

SEQ ID NO: 1336769 - RNA, 22 nt, Human
uugaaaccagaaguucauuuuc

SEQ ID NO: 1336770 - RNA, 23 nt, Human
uuguuuuuggcuuuccucuuauu

SEQ ID NO: 1336771 - RNA, 20 nt, Human
uuuuuguuuguuuguuuuuu

SEQ ID NO: 1336772 - RNA, 19 nt, Human
aaccaccgaagagcuaagc

SEQ ID NO: 1336773 - RNA, 24 nt, Human
aauaaaaucauaacauaacagcua

SEQ ID NO: 1336774 - RNA, 22 nt, Human
aaugacaggagagguuuaacug

SEQ ID NO: 1336775 - RNA, 29 nt, Human
acaaagaauaaaaucauaacauaacagcu

SEQ ID NO: 1336776 - RNA, 19 nt, Human
caccgaagagcuaagcgac

SEQ ID NO: 1336777 - RNA, 20 nt, Human
caggagagguuuaacugaug

SEQ ID NO: 1336778 - RNA, 23 nt, Human
ccacuuccauuucaauucugaag

SEQ ID NO: 1336779 - RNA, 24 nt, Human
cuaagcgacuuggcccagcugcag

SEQ ID NO: 1336780 - RNA, 22 nt, Human
cuuuauucuaauuaacucacaa

SEQ ID NO: 1336781 - RNA, 21 nt, Human
gacuuggcccagcugcagugg

SEQ ID NO: 1336782 - RNA, 18 nt, Human
uaaggaggccacacaaac

SEQ ID NO: 1336783 - RNA, 25 nt, Human
uagggacacccccacuuccauuuca

SEQ ID NO: 1336784 - RNA, 21 nt, Human
uccggacgugugacaaccacc

SEQ ID NO: 1336785 - RNA, 21 nt, Human
uuggcccagcugcagugguug

SEQ ID NO: 1336786 - RNA, 22 nt, Human
uuuccaucucuccagguugaac

SEQ ID NO: 1336787 - RNA, 18 nt, Human
uuuuuuuuuuuuuuuuug

SEQ ID NO: 1336788 - RNA, 19 nt, Human
uuuuuuuuuuuuuuuuugu

SEQ ID NO: 1336789 - RNA, 19 nt, Human
aaaaaacccaaucaaugac

SEQ ID NO: 1336790 - RNA, 19 nt, Human
aaaaaacccaaucaaugag

SEQ ID NO: 1336791 - RNA, 30 nt, Human
aaaacaaauuaagaauaaagaaaaaacccc

SEQ ID NO: 1336792 - RNA, 24 nt, Human
aaagagacuuuuccgaaccaccga

SEQ ID NO: 1336793 - RNA, 24 nt, Human
aaaguucugagauuacaggcauga

SEQ ID NO: 1336794 - RNA, 20 nt, Human
aacaaagagacuuuuccgaa

SEQ ID NO: 1336795 - RNA, 18 nt, Human
aacuugacauaucaaugg

SEQ ID NO: 1336796 - RNA, 30 nt, Human
aagaauaaagaaaaaacccaaucaaugacc

SEQ ID NO: 1336797 - RNA, 19 nt, Human
aaguaacccauaauggggg

SEQ ID NO: 1336798 - RNA, 18 nt, Human
accauguuggccaggcug

SEQ ID NO: 1336799 - RNA, 22 nt, Human
accccccgcucccaugacugcc

SEQ ID NO: 1336800 - RNA, 24 nt, Human
accuugugauccaccugccucggc

SEQ ID NO: 1336801 - RNA, 27 nt, Human
acucugucgcccaggcuggaggggagu

SEQ ID NO: 1336802 - RNA, 22 nt, Human
agauuacaggcaugagccaccg

SEQ ID NO: 1336803 - RNA, 18 nt, Human
aggcgccugccaccaagc

SEQ ID NO: 1336804 - RNA, 23 nt, Human
aggcuggucucaacuccugaccu

SEQ ID NO: 1336805 - RNA, 19 nt, Human
aguagcugggauuacaggc

SEQ ID NO: 1336806 - RNA, 24 nt, Human
agugauucuccugccucagccucc

SEQ ID NO: 1336807 - RNA, 23 nt, Human
auaaugggggcuucaaagaagaa

SEQ ID NO: 1336808 - RNA, 21 nt, Human
augaaggaaagaaccuggaac

SEQ ID NO: 1336809 - RNA, 22 nt, Human
augggguuucaccauguuggcc

SEQ ID NO: 1336810 - RNA, 22 nt, Human
auuacaggcgccugccaccaag

SEQ ID NO: 1336811 - RNA, 18 nt, Human
auucuccugccucagccu

SEQ ID NO: 1336812 - RNA, 24 nt, Human
caaaguucugagauuacaggcaug

SEQ ID NO: 1336813 - RNA, 18 nt, Human
caacauuaaaugacucgu

SEQ ID NO: 1336814 - RNA, 23 nt, Human
caaccuccaccuccuggguacaa

SEQ ID NO: 1336815 - RNA, 22 nt, Human
caagugaaauccagucucuucc

SEQ ID NO: 1336816 - RNA, 18 nt, Human
caagugauucuccugccu

SEQ ID NO: 1336817 - RNA, 24 nt, Human
caaugaaucuaaaaucgggaacac

SEQ ID NO: 1336818 - RNA, 24 nt, Human
cacaaccccccgcucccaugacug

SEQ ID NO: 1336819 - RNA, 25 nt, Human
caccaagcccagcuaauuuuuugua

SEQ ID NO: 1336820 - RNA, 21 nt, Human
caccauguuggccaggcuggu

SEQ ID NO: 1336821 - RNA, 24 nt, Human
caccauguuggccaggcuggucuc

SEQ ID NO: 1336822 - RNA, 27 nt, Human
caccauguuggccaggcuggucucaac

SEQ ID NO: 1336823 - RNA, 21 nt, Human
caccgcaaccuccaccuccug

SEQ ID NO: 1336824 - RNA, 23 nt, Human
caccgcaaccuccaccuccuggg

SEQ ID NO: 1336825 - RNA, 23 nt, Human
caccugccucggccucccaaagu

SEQ ID NO: 1336826 - RNA, 22 nt, Human
cacucugucgcccaggcuggag

SEQ ID NO: 1336827 - RNA, 21 nt, Human
cagagaggaguccuaauagug

SEQ ID NO: 1336828 - RNA, 20 nt, Human
cagccuccugaguagcuggg

SEQ ID NO: 1336829 - RNA, 21 nt, Human
caggagucggggugcgggcac

SEQ ID NO: 1336830 - RNA, 22 nt, Human
caucgaauagcaaacgcugcca

SEQ ID NO: 1336831 - RNA, 23 nt, Human
cauguuggccaggcuggucucaa

SEQ ID NO: 1336832 - RNA, 24 nt, Human
ccaaaguucugagauuacaggcau

SEQ ID NO: 1336833 - RNA, 19 nt, Human
ccaccgaaccaaaggacuc

SEQ ID NO: 1336834 - RNA, 20 nt, Human
ccaccgaaccaaaggacucc

SEQ ID NO: 1336835 - RNA, 18 nt, Human
ccgcaaccuccaccuccu

SEQ ID NO: 1336836 - RNA, 22 nt, Human
ccgcaaccuccaccuccugggu

SEQ ID NO: 1336837 - RNA, 20 nt, Human
ccgcucccaugacugccaaa

SEQ ID NO: 1336838 - RNA, 24 nt, Human
ccuccuggguacaagugauucucc

SEQ ID NO: 1336839 - RNA, 19 nt, Human
ccugaccuugugauccacc

SEQ ID NO: 1336840 - RNA, 21 nt, Human
ccugaccuugugauccaccug

SEQ ID NO: 1336841 - RNA, 23 nt, Human
ccugaguagcugggauuacaggc

SEQ ID NO: 1336842 - RNA, 24 nt, Human
ccugaguagcugggauuacaggcg

SEQ ID NO: 1336843 - RNA, 23 nt, Human
ccugccucagccuccugaguagc

SEQ ID NO: 1336844 - RNA, 24 nt, Human
ccugccucagccuccugaguagcu

SEQ ID NO: 1336845 - RNA, 23 nt, Human
ccuggguacaagugauucuccuc

SEQ ID NO: 1336846 - RNA, 20 nt, Human
ccuuuuggcaaaaaugcuua

SEQ ID NO: 1336847 - RNA, 19 nt, Human
cgggaacacacauugcagc

SEQ ID NO: 1336848 - RNA, 20 nt, Human
cggggggcuaggacgcgacg

SEQ ID NO: 1336849 - RNA, 19 nt, Human
cuacauuaaacccugcaga

SEQ ID NO: 1336850 - RNA, 24 nt, Human
cucacucugucgcccaggcuggag

SEQ ID NO: 1336851 - RNA, 24 nt, Human
cucagccuccugaguagcugggau

SEQ ID NO: 1336852 - RNA, 21 nt, Human
cucccaaaguucugagauuac

SEQ ID NO: 1336853 - RNA, 24 nt, Human
cuccugaccuugugauccaccugc

SEQ ID NO: 1336854 - RNA, 25 nt, Human
cucggccucccaaaguucugagauu

SEQ ID NO: 1336855 - RNA, 22 nt, Human
cugaguagcugggauuacaggc

SEQ ID NO: 1336856 - RNA, 20 nt, Human
cugccucggccucccaaagu

SEQ ID NO: 1336857 - RNA, 18 nt, Human
cugcuucauuccaagaau

SEQ ID NO: 1336858 - RNA, 22 nt, Human
cuggaggggaguggcacaaucu

SEQ ID NO: 1336859 - RNA, 23 nt, Human
gaauagcaaacgcugccaaagga

SEQ ID NO: 1336860 - RNA, 22 nt, Human
gaccuugugauccaccugccuc

SEQ ID NO: 1336861 - RNA, 22 nt, Human
gaccuugugauccaccugccuc

SEQ ID NO: 1336862 - RNA, 24 nt, Human
gaccuugugauccaccugccucgg

SEQ ID NO: 1336863 - RNA, 20 nt, Human
gacucgcuucucucugacac

SEQ ID NO: 1336864 - RNA, 28 nt, Human
gagaauuaugaaagguugaccgguaccc

SEQ ID NO: 1336865 - RNA, 18 nt, Human
gagaugggguuucaccau

SEQ ID NO: 1336866 - RNA, 24 nt, Human
gagaugggguuucaccauguuggc

SEQ ID NO: 1336867 - RNA, 18 nt, Human
gagggcagagaggagucc

SEQ ID NO: 1336868 - RNA, 26 nt, Human
gaguagcugggauuacaggcgccugc

SEQ ID NO: 1336869 - RNA, 22 nt, Human
gaguugcagaguguguaaagug

SEQ ID NO: 1336870 - RNA, 18 nt, Human
gauuacaggcaugagcca

SEQ ID NO: 1336871 - RNA, 23 nt, Human
gauuacaggcaugagccaccggc

SEQ ID NO: 1336872 - RNA, 18 nt, Human
gauuacaggcgccugcca

SEQ ID NO: 1336873 - RNA, 23 nt, Human
gcccagcuaauuuuuuguauuuu

SEQ ID NO: 1336874 - RNA, 22 nt, Human
ggaacucccuccucagcagcug

SEQ ID NO: 1336875 - RNA, 21 nt, Human
gggaacacacauugcagcccc

SEQ ID NO: 1336876 - RNA, 22 nt, Human
gggguuucaccauguuggccag

SEQ ID NO: 1336877 - RNA, 22 nt, Human
ggguacaagugauucuccugcc

SEQ ID NO: 1336878 - RNA, 18 nt, Human
ggguuucaccauguuggc

SEQ ID NO: 1336879 - RNA, 19 nt, Human
ggucucaacuccugaccuu

SEQ ID NO: 1336880 - RNA, 23 nt, Human
guagagaugggguuucaccaugu

SEQ ID NO: 1336881 - RNA, 18 nt, Human
guagcugggauuacaggc

SEQ ID NO: 1336882 - RNA, 21 nt, Human
guccuacauuaaacccugcag

SEQ ID NO: 1336883 - RNA, 24 nt, Human
gugauccaccugccucggccuccc

SEQ ID NO: 1336884 - RNA, 23 nt, Human
gugauucuccugccucagccucc

SEQ ID NO: 1336885 - RNA, 18 nt, Human
uaaguaagcagaguggau

SEQ ID NO: 1336886 - RNA, 22 nt, Human
uaauuagccucauccucaugac

SEQ ID NO: 1336887 - RNA, 24 nt, Human
uaauuuuuuguauuuuuaguagag

SEQ ID NO: 1336888 - RNA, 23 nt, Human
uacaagugauucuccugccucag

SEQ ID NO: 1336889 - RNA, 24 nt, Human
uacaagugauucuccugccucagc

SEQ ID NO: 1336890 - RNA, 21 nt, Human
uacaggcaugagccaccggcc

SEQ ID NO: 1336891 - RNA, 20 nt, Human
uagaaggagggcagagagga

SEQ ID NO: 1336892 - RNA, 22 nt, Human
uagagaugggguuucaccaugu

SEQ ID NO: 1336893 - RNA, 24 nt, Human
uaguagagaugggguuucaccaug

SEQ ID NO: 1336894 - RNA, 26 nt, Human
uaguagagaugggguuucaccauguu

SEQ ID NO: 1336895 - RNA, 23 nt, Human
uagugagucacaggauuauugaa

SEQ ID NO: 1336896 - RNA, 24 nt, Human
ucaccgcaaccuccaccuccuggg

SEQ ID NO: 1336897 - RNA, 26 nt, Human
ucaccgcaaccuccaccuccugggua

SEQ ID NO: 1336898 - RNA, 20 nt, Human
ucagccuccugaguagcugg

SEQ ID NO: 1336899 - RNA, 24 nt, Human
ucccaaaguucugagauuacaggc

SEQ ID NO: 1336900 - RNA, 24 nt, Human
uccugaguagcugggauuacaggc

SEQ ID NO: 1336901 - RNA, 24 nt, Human
uccuggguacaagugauucuccug

SEQ ID NO: 1336902 - RNA, 21 nt, Human
ucgcccaggcuggaggggagu

SEQ ID NO: 1336903 - RNA, 23 nt, Human
ucucacucugucgcccaggcugg

SEQ ID NO: 1336904 - RNA, 24 nt, Human
ucucacucugucgcccaggcugga

SEQ ID NO: 1336905 - RNA, 26 nt, Human
ucucacucugucgcccaggcuggagg

SEQ ID NO: 1336906 - RNA, 27 nt, Human
ucucacucugucgcccaggcuggaggg

SEQ ID NO: 1336907 - RNA, 24 nt, Human
ucuccugccucagccuccugagua

SEQ ID NO: 1336908 - RNA, 18 nt, Human
ucugucgcccaggcugga

SEQ ID NO: 1336909 - RNA, 20 nt, Human
ugaaggaaagaaccuggaac

SEQ ID NO: 1336910 - RNA, 23 nt, Human
ugaaggaaagaaccuggaaccga

SEQ ID NO: 1336911 - RNA, 23 nt, Human
ugaaggcacuuucccuccuccca

SEQ ID NO: 1336912 - RNA, 19 nt, Human
ugacucguggugauggggu

SEQ ID NO: 1336913 - RNA, 21 nt, Human
ugagauuacaggcaugagcca

SEQ ID NO: 1336914 - RNA, 22 nt, Human
ugagauuacaggcaugagccac

SEQ ID NO: 1336915 - RNA, 23 nt, Human
ugagauuacaggcaugagccacc

SEQ ID NO: 1336916 - RNA, 24 nt, Human
ugagauuacaggcaugagccaccg

SEQ ID NO: 1336917 - RNA, 26 nt, Human
ugagauuacaggcaugagccaccggc

SEQ ID NO: 1336918 - RNA, 23 nt, Human
ugaguuuggagaaggaacaaaga

SEQ ID NO: 1336919 - RNA, 21 nt, Human
ugcagccccuguuugggaaau

SEQ ID NO: 1336920 - RNA, 23 nt, Human
ugccaaaggaguagucccuggau

SEQ ID NO: 1336921 - RNA, 24 nt, Human
ugccucagccuccugaguagcugg

SEQ ID NO: 1336922 - RNA, 24 nt, Human
ugccucggccucccaaaguucuga

SEQ ID NO: 1336923 - RNA, 19 nt, Human
ugcuuugcuuacauaacuc

SEQ ID NO: 1336924 - RNA, 21 nt, Human
uggaaccgaguagccugcuuc

SEQ ID NO: 1336925 - RNA, 21 nt, Human
uggagcaggagucggggugcg

SEQ ID NO: 1336926 - RNA, 24 nt, Human
uggcacaaucucaguucaccgcaa

SEQ ID NO: 1336927 - RNA, 23 nt, Human
uggccaggcuggucucaacuccu

SEQ ID NO: 1336928 - RNA, 21 nt, Human
ugggauuacaggcgccugcca

SEQ ID NO: 1336929 - RNA, 22 nt, Human
ugggauuacaggcgccugccac

SEQ ID NO: 1336930 - RNA, 24 nt, Human
ugggauuacaggcgccugccacca

SEQ ID NO: 1336931 - RNA, 24 nt, Human
ugggguuucaccauguuggccagg

SEQ ID NO: 1336932 - RNA, 24 nt, Human
uguagguagaauucaauggaagaa

SEQ ID NO: 1336933 - RNA, 21 nt, Human
uuagcuauuagcuuugcagug

SEQ ID NO: 1336934 - RNA, 18 nt, Human
uuaguagagaugggguuu

SEQ ID NO: 1336935 - RNA, 22 nt, Human
uuaguagagaugggguuucacc

SEQ ID NO: 1336936 - RNA, 24 nt, Human
uuaguagagaugggguuucaccau

SEQ ID NO: 1336937 - RNA, 21 nt, Human
uucuuuggagguaaguaagca

SEQ ID NO: 1336938 - RNA, 18 nt, Human
uuggaaacuugacauauc

SEQ ID NO: 1336939 - RNA, 24 nt, Human
uuggugacagcuuuaaaaaacaaa

SEQ ID NO: 1336940 - RNA, 23 nt, Human
uuguauuuuuaguagagaugggg

SEQ ID NO: 1336941 - RNA, 23 nt, Human
uuuacauuuuuauauauguugcu

SEQ ID NO: 1336942 - RNA, 24 nt, Human
uuucaccauguuggccaggcuggu

SEQ ID NO: 1336943 - RNA, 24 nt, Human
uuuuuaguagagaugggguuucac

SEQ ID NO: 1336944 - RNA, 21 nt, Human
uuuuuguauuuuuaguagaga

SEQ ID NO: 1336945 - RNA, 24 nt, Human
uuuuuuguauuuuuaguagagaug

SEQ ID NO: 1336946 - RNA, 20 nt, Human
uuuuuuuuuuuuaaaagaag

SEQ ID NO: 1336947 - RNA, 26 nt, Human
uuuuuuuuuuuuuaaaagaagucuca

SEQ ID NO: 1336948 - RNA, 23 nt, Human
uuuuuuuuuuuuuuuuuuaaaag

SEQ ID NO: 1336949 - RNA, 21 nt, Human
aauacaaaacagugaaucaga

SEQ ID NO: 1336950 - RNA, 20 nt, Human
acacugcagcagcagcaaac

SEQ ID NO: 1336951 - RNA, 19 nt, Human
caaaacagugaaucagagc

SEQ ID NO: 1336952 - RNA, 25 nt, Human
cagcagcagcaaacgaguguuagcu

SEQ ID NO: 1336953 - RNA, 18 nt, Human
ccagccugcuccugcagu

SEQ ID NO: 1336954 - RNA, 21 nt, Human
cucugugccagccugcuccug

SEQ ID NO: 1336955 - RNA, 23 nt, Human
cucugugccagccugcuccugca

SEQ ID NO: 1336956 - RNA, 25 nt, Human
cugcagcagcagcaaacgaguguua

SEQ ID NO: 1336957 - RNA, 19 nt, Human
uacaaaacagugaaucaga

SEQ ID NO: 1336958 - RNA, 26 nt, Human
uagcucuaaccaaggagaacacagau

SEQ ID NO: 1336959 - RNA, 23 nt, Human
uauaacccuuuuagaaaauacaa

SEQ ID NO: 1336960 - RNA, 22 nt, Human
ucagagccuaacuucuagcugc

SEQ ID NO: 1336961 - RNA, 20 nt, Human
uccacacugcagcagcagca

SEQ ID NO: 1336962 - RNA, 21 nt, Human
uccucuucucugugccagccu

SEQ ID NO: 1336963 - RNA, 24 nt, Human
ucuaaccaaggagaacacagaucu

SEQ ID NO: 1336964 - RNA, 18 nt, Human
ucucugugccagccugcu

SEQ ID NO: 1336965 - RNA, 23 nt, Human
ugaaucagagccuaacuucuagc

SEQ ID NO: 1336966 - RNA, 22 nt, Human
ugccagccugcuccugcagugc

SEQ ID NO: 1336967 - RNA, 28 nt, Human
ugccagccugcuccugcagugcuuuccc

SEQ ID NO: 1336968 - RNA, 24 nt, Human
uuccacacugcagcagcagcaaac

SEQ ID NO: 1336969 - RNA, 23 nt, Human
uuuuuuuuuuccauuuccacacu

SEQ ID NO: 1336970 - RNA, 22 nt, Human
uuuuuuuuuuuuuuuuccauuu

SEQ ID NO: 1336971 - RNA, 26 nt, Human
uuuuuuuuuuuuuuuuuuuuccauuu

SEQ ID NO: 1336972 - RNA, 24 nt, Human
uuuuuuuuuuuuuuuuuuuuuccu

SEQ ID NO: 1336973 - RNA, 18 nt, Human
caggcgaccucagagcca

SEQ ID NO: 1336974 - RNA, 19 nt, Human
ccagccugucccuucuggg

SEQ ID NO: 1336975 - RNA, 21 nt, Human
cccgcuccacuuccuuuuucu

SEQ ID NO: 1336976 - RNA, 20 nt, Human
ccuccauuuuggaugaaggc

SEQ ID NO: 1336977 - RNA, 20 nt, Human
cgggggccuggcuccuccau

SEQ ID NO: 1336978 - RNA, 21 nt, Human
uaucuuuaaaagugccuuagg

SEQ ID NO: 1336979 - RNA, 19 nt, Human
uccugcacgccacggcugc

SEQ ID NO: 1336980 - RNA, 20 nt, Human
uccugcacgccacggcugca

SEQ ID NO: 1336981 - RNA, 22 nt, Human
uccugcacgccacggcugcacg

SEQ ID NO: 1336982 - RNA, 18 nt, Human
ucuugacugaagcggggg

SEQ ID NO: 1336983 - RNA, 18 nt, Human
ugaagcgggggccuggcu

SEQ ID NO: 1336984 - RNA, 21 nt, Human
ugccuuaggggaacccugucc

SEQ ID NO: 1336985 - RNA, 18 nt, Human
uuuuuuuuuuuuuuuuug

SEQ ID NO: 1336986 - RNA, 21 nt, Human
aggcucuaaugcucuaaggug

SEQ ID NO: 1336987 - RNA, 22 nt, Human
gggagcaccuauagaggcucua

SEQ ID NO: 1336988 - RNA, 19 nt, Human
uaaggugacagugaugagg

SEQ ID NO: 1336989 - RNA, 19 nt, Human
uggggagggcagagauugg

SEQ ID NO: 1336990 - RNA, 21 nt, Human
uggggagggcagagauugggg

SEQ ID NO: 1336991 - RNA, 19 nt, Human
accaccugccacuccuccu

SEQ ID NO: 1336992 - RNA, 22 nt, Human
acccaucgucuuacuacaucua

SEQ ID NO: 1336993 - RNA, 25 nt, Human
acgggcagggcagcacaggccgggu

SEQ ID NO: 1336994 - RNA, 19 nt, Human
acuaacccaauuccccaca

SEQ ID NO: 1336995 - RNA, 22 nt, Human
agagccccacuaacccaauucc

SEQ ID NO: 1336996 - RNA, 21 nt, Human
aggcccagggaggggcaacga

SEQ ID NO: 1336997 - RNA, 18 nt, Human
aggcccaggguaaggcag

SEQ ID NO: 1336998 - RNA, 23 nt, Human
agggggugugugugggagugagu

SEQ ID NO: 1336999 - RNA, 19 nt, Human
aguggcagcugggagcggc

SEQ ID NO: 1337000 - RNA, 26 nt, Human
auacaccccaaaauggcucaaaugcc

SEQ ID NO: 1337001 - RNA, 20 nt, Human
auggaaagcauccccacuau

SEQ ID NO: 1337002 - RNA, 23 nt, Human
caaaauaaaaacugugacuccag

SEQ ID NO: 1337003 - RNA, 22 nt, Human
caaaauggcucaaaugccuucc

SEQ ID NO: 1337004 - RNA, 18 nt, Human
caacugagcucugcaaaa

SEQ ID NO: 1337005 - RNA, 27 nt, Human
caccccagcagacaaucaaucccuaaa

SEQ ID NO: 1337006 - RNA, 22 nt, Human
caccgcuccagagagcagaaaa

SEQ ID NO: 1337007 - RNA, 20 nt, Human
caccggcccccguaucggcc

SEQ ID NO: 1337008 - RNA, 18 nt, Human
cacuacaugccgcagggc

SEQ ID NO: 1337009 - RNA, 20 nt, Human
cagacaaccaccgguucacc

SEQ ID NO: 1337010 - RNA, 24 nt, Human
cagacaaccaccgguucaccgcuc

SEQ ID NO: 1337011 - RNA, 19 nt, Human
cagagccccacuaacccaa

SEQ ID NO: 1337012 - RNA, 23 nt, Human
cagcagacaaucaaucccuaaau

SEQ ID NO: 1337013 - RNA, 22 nt, Human
cauccccacuaucacugcuugu

SEQ ID NO: 1337014 - RNA, 22 nt, Human
ccaccaccugccacuccuccug

SEQ ID NO: 1337015 - RNA, 25 nt, Human
ccaccggcccccguaucggccuccu

SEQ ID NO: 1337016 - RNA, 18 nt, Human
ccagagccccacuaaccc

SEQ ID NO: 1337017 - RNA, 18 nt, Human
cccagagccccacuaacc

SEQ ID NO: 1337018 - RNA, 19 nt, Human
cccagagccccacuaaccc

SEQ ID NO: 1337019 - RNA, 20 nt, Human
ccccacuaacccaauucccc

SEQ ID NO: 1337020 - RNA, 18 nt, Human
cccccuacccccccaccg

SEQ ID NO: 1337021 - RNA, 21 nt, Human
ccccgccaccaccugccacuc

SEQ ID NO: 1337022 - RNA, 23 nt, Human
ccccgccaccaccugccacuccu

SEQ ID NO: 1337023 - RNA, 22 nt, Human
ccccuacccccccaccggcccc

SEQ ID NO: 1337024 - RNA, 23 nt, Human
ccccuacccccccaccggccccc

SEQ ID NO: 1337025 - RNA, 20 nt, Human
cccuuuucuccucucaaccc

SEQ ID NO: 1337026 - RNA, 21 nt, Human
ccgcagacaaccaccgguuca

SEQ ID NO: 1337027 - RNA, 19 nt, Human
ccuccaacugagcucugca

SEQ ID NO: 1337028 - RNA, 22 nt, Human
ccucuccccacuacggaaccca

SEQ ID NO: 1337029 - RNA, 19 nt, Human
cgacugguucccaggccca

SEQ ID NO: 1337030 - RNA, 24 nt, Human
cgccacugacuaccucccuagcaa

SEQ ID NO: 1337031 - RNA, 21 nt, Human
cggcccccguaucggccuccu

SEQ ID NO: 1337032 - RNA, 18 nt, Human
cggccuccuggcccuccg

SEQ ID NO: 1337033 - RNA, 22 nt, Human
cggccuccuggcccuccguccc

SEQ ID NO: 1337034 - RNA, 20 nt, Human
cuaaaauggaaagcaucccc

SEQ ID NO: 1337035 - RNA, 21 nt, Human
cuaaaauggaaagcaucccca

SEQ ID NO: 1337036 - RNA, 24 nt, Human
cucaacccaccccagcagacaauc

SEQ ID NO: 1337037 - RNA, 20 nt, Human
cucuccccacuacggaaccc

SEQ ID NO: 1337038 - RNA, 22 nt, Human
cucugcaaaaccccgccaccac

SEQ ID NO: 1337039 - RNA, 25 nt, Human
cuggguccaccucucaccacucagg

SEQ ID NO: 1337040 - RNA, 30 nt, Human
cuuagaccccgggccuccugaccgccgagg

SEQ ID NO: 1337041 - RNA, 21 nt, Human
cuuugccgcccccuacccccc

SEQ ID NO: 1337042 - RNA, 25 nt, Human
gaagguggggcugaggcccagggua

SEQ ID NO: 1337043 - RNA, 23 nt, Human
gagaggucaugucacuugcacag

SEQ ID NO: 1337044 - RNA, 21 nt, Human
gagcucugcaaaaccccgcca

SEQ ID NO: 1337045 - RNA, 23 nt, Human
gcccugagacgggcagggcagca

SEQ ID NO: 1337046 - RNA, 21 nt, Human
ggaaaaguuuccuaaaaugga

SEQ ID NO: 1337047 - RNA, 23 nt, Human
gggcaacgacuuuggucuacauc

SEQ ID NO: 1337048 - RNA, 20 nt, Human
gguucccaggcccagggagg

SEQ ID NO: 1337049 - RNA, 18 nt, Human
guaccuccccagagcccc

SEQ ID NO: 1337050 - RNA, 22 nt, Human
gucaccucuccccacuacggaa

SEQ ID NO: 1337051 - RNA, 24 nt, Human
gucaccucuccccacuacggaacc

SEQ ID NO: 1337052 - RNA, 20 nt, Human
guccaccucucaccacucag

SEQ ID NO: 1337053 - RNA, 18 nt, Human
uaaaauggaaagcauccc

SEQ ID NO: 1337054 - RNA, 24 nt, Human
uaaggaaggaaugaugcuccuccc

SEQ ID NO: 1337055 - RNA, 22 nt, Human
uaaggcaguaaccucagcagag

SEQ ID NO: 1337056 - RNA, 21 nt, Human
uacaccccaaaauggcucaaa

SEQ ID NO: 1337057 - RNA, 20 nt, Human
uacaucuauacaccccaaaa

SEQ ID NO: 1337058 - RNA, 18 nt, Human
ucaucucuuccccgcaga

SEQ ID NO: 1337059 - RNA, 19 nt, Human
uccaccucucaccacucag

SEQ ID NO: 1337060 - RNA, 23 nt, Human
uccagagagcagaaaaccaaggu

SEQ ID NO: 1337061 - RNA, 20 nt, Human
ucccaggcccagggaggggc

SEQ ID NO: 1337062 - RNA, 25 nt, Human
uccccacuaucacugcuuguuaccc

SEQ ID NO: 1337063 - RNA, 18 nt, Human
ucccuuugccgcccccua

SEQ ID NO: 1337064 - RNA, 22 nt, Human
uccguggccucccucacuuccu

SEQ ID NO: 1337065 - RNA, 21 nt, Human
ucugcaaaaccccgccaccac

SEQ ID NO: 1337066 - RNA, 23 nt, Human
ugucacuugcacaggcucacaca

SEQ ID NO: 1337067 - RNA, 18 nt, Human
ugugggagugagugacgc

SEQ ID NO: 1337068 - RNA, 18 nt, Human
uguuuauugagcaaaggg

SEQ ID NO: 1337069 - RNA, 22 nt, Human
uucccuuuucuccucucaaccc

SEQ ID NO: 1337070 - RNA, 18 nt, Human
uuccuguugcccagcccc

SEQ ID NO: 1337071 - RNA, 23 nt, Human
uuggaagguggggcugaggccca

SEQ ID NO: 1337072 - RNA, 25 nt, Human
uuuaucaucucuuccccgcagacaa

SEQ ID NO: 1337073 - RNA, 21 nt, Human
uuucucuaaucugugguuucu

SEQ ID NO: 1337074 - RNA, 22 nt, Human
uuuuuuuuuuuuuuuuuggagu

SEQ ID NO: 1337075 - RNA, 25 nt, Human
uuuuuuuuuuuuuuuuuuuuugggg

SEQ ID NO: 1337076 - RNA, 20 nt, Human
aacauggugaaaucccgucu

SEQ ID NO: 1337077 - RNA, 21 nt, Human
aacauggugaaaucccgucuc

SEQ ID NO: 1337078 - RNA, 22 nt, Human
aaugcuuaugccuguaauccca

SEQ ID NO: 1337079 - RNA, 21 nt, Human
acccauugauccuugauuagu

SEQ ID NO: 1337080 - RNA, 22 nt, Human
aggcagaucacgaggucaggag

SEQ ID NO: 1337081 - RNA, 24 nt, Human
aggcaggcagaucacgaggucagg

SEQ ID NO: 1337082 - RNA, 26 nt, Human
aggcaggcagaucacgaggucaggag

SEQ ID NO: 1337083 - RNA, 22 nt, Human
auccuggccaacauggugaaau

SEQ ID NO: 1337084 - RNA, 25 nt, Human
caacacuuugggagggccaaggcag

SEQ ID NO: 1337085 - RNA, 24 nt, Human
caacauggugaaaucccgucucua

SEQ ID NO: 1337086 - RNA, 24 nt, Human
caaggcaggcagaucacgagguca

SEQ ID NO: 1337087 - RNA, 22 nt, Human
cacccauugauccuugauuagu

SEQ ID NO: 1337088 - RNA, 22 nt, Human
caucuguagucccagcuacucg

SEQ ID NO: 1337089 - RNA, 21 nt, Human
cccgucucuacuaaaauacaa

SEQ ID NO: 1337090 - RNA, 22 nt, Human
ccuggccaacauggugaaaucc

SEQ ID NO: 1337091 - RNA, 23 nt, Human
ccuggccaacauggugaaauccc

SEQ ID NO: 1337092 - RNA, 24 nt, Human
ccuggccaacauggugaaaucccg

SEQ ID NO: 1337093 - RNA, 20 nt, Human
ccuguaaucccaacacuuug

SEQ ID NO: 1337094 - RNA, 18 nt, Human
cuguagucccagcuacuc

SEQ ID NO: 1337095 - RNA, 23 nt, Human
gagaccauccuggccaacauggu

SEQ ID NO: 1337096 - RNA, 19 nt, Human
gcagaucacgaggucagga

SEQ ID NO: 1337097 - RNA, 24 nt, Human
gccaacauggugaaaucccgucuc

SEQ ID NO: 1337098 - RNA, 19 nt, Human
gccuguaaucccaacacuu

SEQ ID NO: 1337099 - RNA, 19 nt, Human
gcuuaugccuguaauccca

SEQ ID NO: 1337100 - RNA, 22 nt, Human
gcuuaugccuguaaucccaaca

SEQ ID NO: 1337101 - RNA, 22 nt, Human
ggagggccaaggcaggcagauc

SEQ ID NO: 1337102 - RNA, 22 nt, Human
ggcgcaaugcuuaugccuguaa

SEQ ID NO: 1337103 - RNA, 23 nt, Human
gggccaaggcaggcagaucacga

SEQ ID NO: 1337104 - RNA, 24 nt, Human
uagcaugauaucaugucacccauu

SEQ ID NO: 1337105 - RNA, 20 nt, Human
uaugccuguaaucccaacac

SEQ ID NO: 1337106 - RNA, 24 nt, Human
ucacgaggucaggagacggagacc

SEQ ID NO: 1337107 - RNA, 22 nt, Human
ucuguagucccagcuacucgag

SEQ ID NO: 1337108 - RNA, 23 nt, Human
ugccuguaaucccaacacuuugg

SEQ ID NO: 1337109 - RNA, 23 nt, Human
ugccuguaaucccaacacuuugg

SEQ ID NO: 1337110 - RNA, 24 nt, Human
ugccuguaaucccaacacuuuggg

SEQ ID NO: 1337111 - RNA, 23 nt, Human
ugcuuaugccuguaaucccaaca

SEQ ID NO: 1337112 - RNA, 24 nt, Human
uggccaacauggugaaaucccguc

SEQ ID NO: 1337113 - RNA, 24 nt, Human
uucuuuauuucuguugacucuaau

SEQ ID NO: 1337114 - RNA, 22 nt, Human
uugaagccaauuuuuuuuauug

SEQ ID NO: 1337115 - RNA, 26 nt, Human
uuucccagacuuacugaguuauaauu

SEQ ID NO: 1337116 - RNA, 19 nt, Human
uuuucuuuauuucuguuga

SEQ ID NO: 1337117 - RNA, 28 nt, Human
uuuuuuauuguugguguaauuuguuuaa

SEQ ID NO: 1337118 - RNA, 20 nt, Human
uuuuuuuuuuuuuuuuuugg

SEQ ID NO: 1337119 - RNA, 20 nt, Human
aacagcuaggaccuggcuca

SEQ ID NO: 1337120 - RNA, 18 nt, Human
aacaucuucauuacaucu

SEQ ID NO: 1337121 - RNA, 21 nt, Human
aaccuccccuuuccuccccca

SEQ ID NO: 1337122 - RNA, 19 nt, Human
aaccugcccacucacuccu

SEQ ID NO: 1337123 - RNA, 18 nt, Human
aacuauaucugaggacca

SEQ ID NO: 1337124 - RNA, 19 nt, Human
aagggagcccccugccuuc

SEQ ID NO: 1337125 - RNA, 21 nt, Human
accuccccuuuccucccccaa

SEQ ID NO: 1337126 - RNA, 18 nt, Human
agaagcaggugagcccag

SEQ ID NO: 1337127 - RNA, 18 nt, Human
agaagcaggugagcccag

SEQ ID NO: 1337128 - RNA, 20 nt, Human
agcggacagugacgguggag

SEQ ID NO: 1337129 - RNA, 21 nt, Human
agcggacagugacgguggaga

SEQ ID NO: 1337130 - RNA, 22 nt, Human
agggaguggggagcucuguagg

SEQ ID NO: 1337131 - RNA, 20 nt, Human
agugcagggacccaucuccc

SEQ ID NO: 1337132 - RNA, 20 nt, Human
auaacagaugcugcccuacc

SEQ ID NO: 1337133 - RNA, 21 nt, Human
auacacuaccccugcaucccc

SEQ ID NO: 1337134 - RNA, 18 nt, Human
auacuggacaguuucagc

SEQ ID NO: 1337135 - RNA, 22 nt, Human
aucagcccugacccuccaaggc

SEQ ID NO: 1337136 - RNA, 24 nt, Human
auuccccuacuuccuucccccuca

SEQ ID NO: 1337137 - RNA, 24 nt, Human
caaaaaacaggucucucccuaaca

SEQ ID NO: 1337138 - RNA, 18 nt, Human
caccagagcuugugaccu

SEQ ID NO: 1337139 - RNA, 26 nt, Human
caccugugguggccaccugcacagcc

SEQ ID NO: 1337140 - RNA, 19 nt, Human
cacuaccccugcauccccu

SEQ ID NO: 1337141 - RNA, 24 nt, Human
cacuccugacuccggagugcccca

SEQ ID NO: 1337142 - RNA, 25 nt, Human
cacuccugacuccggagugccccag

SEQ ID NO: 1337143 - RNA, 21 nt, Human
cagaccaacagccucucccaa

SEQ ID NO: 1337144 - RNA, 18 nt, Human
cagcagcggacagugacg

SEQ ID NO: 1337145 - RNA, 19 nt, Human
cagcguaaaaaaaugcccu

SEQ ID NO: 1337146 - RNA, 21 nt, Human
caggaccccugguaucagccc

SEQ ID NO: 1337147 - RNA, 22 nt, Human
caggagaagucaguggucagaa

SEQ ID NO: 1337148 - RNA, 18 nt, Human
cagucccugaagauugaa

SEQ ID NO: 1337149 - RNA, 21 nt, Human
cauaacagaugcugcccuacc

SEQ ID NO: 1337150 - RNA, 21 nt, Human
cauccugaauuccuggcagcc

SEQ ID NO: 1337151 - RNA, 23 nt, Human
caucuccccacucucuaaacacu

SEQ ID NO: 1337152 - RNA, 25 nt, Human
ccagccugugguuccugccaccugu

SEQ ID NO: 1337153 - RNA, 26 nt, Human
ccagccugugguuccugccaccugug

SEQ ID NO: 1337154 - RNA, 22 nt, Human
ccagugaaacaaugcaguggag

SEQ ID NO: 1337155 - RNA, 21 nt, Human
cccaugggggcuuccuaggcc

SEQ ID NO: 1337156 - RNA, 18 nt, Human
ccccaaucccucccacuc

SEQ ID NO: 1337157 - RNA, 26 nt, Human
ccccaaucccucccacuccguaucuc

SEQ ID NO: 1337158 - RNA, 21 nt, Human
ccccacucucuaaacacugaa

SEQ ID NO: 1337159 - RNA, 22 nt, Human
ccccagauccucauuagagccc

SEQ ID NO: 1337160 - RNA, 22 nt, Human
cccccaaucccucccacuccgu

SEQ ID NO: 1337161 - RNA, 24 nt, Human
cccccucagcucccauccuagcuu

SEQ ID NO: 1337162 - RNA, 20 nt, Human
ccccugcauccccuccagcc

SEQ ID NO: 1337163 - RNA, 19 nt, Human
ccccuuuccucccccaauc

SEQ ID NO: 1337164 - RNA, 21 nt, Human
ccccuuuccucccccaauccc

SEQ ID NO: 1337165 - RNA, 22 nt, Human
ccuaggccuuucccuccugaca

SEQ ID NO: 1337166 - RNA, 21 nt, Human
ccucagaccaacagccucucc

SEQ ID NO: 1337167 - RNA, 20 nt, Human
ccucuccccaccccagagga

SEQ ID NO: 1337168 - RNA, 21 nt, Human
ccucucggcaggucugggggg

SEQ ID NO: 1337169 - RNA, 22 nt, Human
ccugacuccggagugccccagc

SEQ ID NO: 1337170 - RNA, 18 nt, Human
ccugggugcugcuuuccu

SEQ ID NO: 1337171 - RNA, 18 nt, Human
ccugggugcugcuuuccu

SEQ ID NO: 1337172 - RNA, 18 nt, Human
ccuucccccucagcuccc

SEQ ID NO: 1337173 - RNA, 19 nt, Human
ccuugcauacuggacaguu

SEQ ID NO: 1337174 - RNA, 25 nt, Human
cuccagauuccaaaaaacaggucuc

SEQ ID NO: 1337175 - RNA, 23 nt, Human
cucccucauuuccuccacauuag

SEQ ID NO: 1337176 - RNA, 24 nt, Human
cucuggguuaaauuacagcuguau

SEQ ID NO: 1337177 - RNA, 18 nt, Human
cucugugccagggcccuc

SEQ ID NO: 1337178 - RNA, 21 nt, Human
cugacuccggagugccccagc

SEQ ID NO: 1337179 - RNA, 23 nt, Human
cugccaccugugguggccaccug

SEQ ID NO: 1337180 - RNA, 24 nt, Human
cugcuuuccugguuccucucacuc

SEQ ID NO: 1337181 - RNA, 22 nt, Human
cugugcgugcuucccucuuccc

SEQ ID NO: 1337182 - RNA, 24 nt, Human
cuugaccuucucagcaugagggau

SEQ ID NO: 1337183 - RNA, 21 nt, Human
gacccaucuccccacucucua

SEQ ID NO: 1337184 - RNA, 22 nt, Human
gagaacagcuaggaccuggcuc

SEQ ID NO: 1337185 - RNA, 18 nt, Human
gagaggaaccgugcugug

SEQ ID NO: 1337186 - RNA, 21 nt, Human
gaugccagucaaccugcccac

SEQ ID NO: 1337187 - RNA, 19 nt, Human
gcaccagagcuugugaccu

SEQ ID NO: 1337188 - RNA, 23 nt, Human
gccaagugcagggacccaucucc

SEQ ID NO: 1337189 - RNA, 19 nt, Human
gcugggagaccuccuggac

SEQ ID NO: 1337190 - RNA, 18 nt, Human
gguggagaggcugggcac

SEQ ID NO: 1337191 - RNA, 21 nt, Human
guggccaccugcacagccacc

SEQ ID NO: 1337192 - RNA, 19 nt, Human
uaaaaaaaugcccugcucu

SEQ ID NO: 1337193 - RNA, 19 nt, Human
uaaauccagaaccuucccc

SEQ ID NO: 1337194 - RNA, 23 nt, Human
uaacugcccccucuagccugcag

SEQ ID NO: 1337195 - RNA, 23 nt, Human
uacuuccuucccccucagcuccc

SEQ ID NO: 1337196 - RNA, 18 nt, Human
uagagcccaagacaggga

SEQ ID NO: 1337197 - RNA, 19 nt, Human
uagagcccaagacagggag

SEQ ID NO: 1337198 - RNA, 21 nt, Human
uagagcccaagacagggagcc

SEQ ID NO: 1337199 - RNA, 18 nt, Human
uaggaccuggcucagccc

SEQ ID NO: 1337200 - RNA, 19 nt, Human
ucaaccugcccacucacuc

SEQ ID NO: 1337201 - RNA, 20 nt, Human
ucaggagaagucagugguca

SEQ ID NO: 1337202 - RNA, 21 nt, Human
ucaggagaagucaguggucag

SEQ ID NO: 1337203 - RNA, 18 nt, Human
uccaaggcuuauggagag

SEQ ID NO: 1337204 - RNA, 27 nt, Human
ucccaaccccagauccucauuagagcc

SEQ ID NO: 1337205 - RNA, 21 nt, Human
ucccacuccguaucucccuca

SEQ ID NO: 1337206 - RNA, 21 nt, Human
uccucuccccaccccagagga

SEQ ID NO: 1337207 - RNA, 19 nt, Human
uccuuggauaaagggagcc

SEQ ID NO: 1337208 - RNA, 19 nt, Human
ucuaaagucagcagguggg

SEQ ID NO: 1337209 - RNA, 21 nt, Human
ucucuaaacacugaacggcuc

SEQ ID NO: 1337210 - RNA, 23 nt, Human
ucugaagugcaaucccucaccca

SEQ ID NO: 1337211 - RNA, 25 nt, Human
ucugcauacacuaccccugcauccc

SEQ ID NO: 1337212 - RNA, 28 nt, Human
ucugugcaugcuugugugcauauguaug

SEQ ID NO: 1337213 - RNA, 22 nt, Human
ugacgguggagaggcugggcac

SEQ ID NO: 1337214 - RNA, 18 nt, Human
ugaugugagggaucugga

SEQ ID NO: 1337215 - RNA, 23 nt, Human
ugcauacacuaccccugcauccc

SEQ ID NO: 1337216 - RNA, 24 nt, Human
ugcauacacuaccccugcaucccc

SEQ ID NO: 1337217 - RNA, 20 nt, Human
ugccaaggauggguggcugg

SEQ ID NO: 1337218 - RNA, 22 nt, Human
ugccaaggauggguggcuggga

SEQ ID NO: 1337219 - RNA, 23 nt, Human
ugcccagcguaaaaaaaugcccu

SEQ ID NO: 1337220 - RNA, 19 nt, Human
ugcccucagaccaacagcc

SEQ ID NO: 1337221 - RNA, 24 nt, Human
ugcggagagggcccuggcugagag

SEQ ID NO: 1337222 - RNA, 24 nt, Human
uggagaacagcuaggaccuggcuc

SEQ ID NO: 1337223 - RNA, 23 nt, Human
uggcauuugcccaguggaagguc

SEQ ID NO: 1337224 - RNA, 18 nt, Human
ugggauggagguggggaa

SEQ ID NO: 1337225 - RNA, 24 nt, Human
ugggcacacucaugcacaugcaug

SEQ ID NO: 1337226 - RNA, 19 nt, Human
ugggguagaggucgacuug

SEQ ID NO: 1337227 - RNA, 19 nt, Human
ugggucucuaucagaaguc

SEQ ID NO: 1337228 - RNA, 24 nt, Human
uggguggcugggagaccuccugga

SEQ ID NO: 1337229 - RNA, 20 nt, Human
ugguuccucucacucccagg

SEQ ID NO: 1337230 - RNA, 26 nt, Human
ugguugccaaggauggguggcuggga

SEQ ID NO: 1337231 - RNA, 20 nt, Human
uguaugcauccugaauuccu

SEQ ID NO: 1337232 - RNA, 22 nt, Human
uguaugcccagcguaaaaaaau

SEQ ID NO: 1337233 - RNA, 21 nt, Human
ugugagggaucuggacagggg

SEQ ID NO: 1337234 - RNA, 21 nt, Human
ugugcauauguaugcccagcg

SEQ ID NO: 1337235 - RNA, 19 nt, Human
ugugugcauauguaugccc

SEQ ID NO: 1337236 - RNA, 20 nt, Human
ugugugcauauguaugccca

SEQ ID NO: 1337237 - RNA, 22 nt, Human
ugugugcauauguaugcccagc

SEQ ID NO: 1337238 - RNA, 18 nt, Human
uucccucuucccugcagu

SEQ ID NO: 1337239 - RNA, 18 nt, Human
uuccuaggccuuucccuc

SEQ ID NO: 1337240 - RNA, 21 nt, Human
uuccugggugcugcuuuccug

SEQ ID NO: 1337241 - RNA, 20 nt, Human
uuccugguuccucucacucc

SEQ ID NO: 1337242 - RNA, 19 nt, Human
uuccuucccccucagcucc

SEQ ID NO: 1337243 - RNA, 24 nt, Human
uuucagcuccaucucugggcuucu

SEQ ID NO: 1337244 - RNA, 22 nt, Human
uuucaggcagucauaacugccc

SEQ ID NO: 1337245 - RNA, 20 nt, Human
uuuucagaagcaggugagcc

SEQ ID NO: 1337246 - RNA, 24 nt, Human
agcccccacugaggccccacccag

SEQ ID NO: 1337247 - RNA, 21 nt, Human
agccuccgggcugccuggccu

SEQ ID NO: 1337248 - RNA, 22 nt, Human
aggaaggggaggaggaagagga

SEQ ID NO: 1337249 - RNA, 19 nt, Human
aggggcaggagcugcuccu

SEQ ID NO: 1337250 - RNA, 21 nt, Human
aggggcaugggggcugcaggg

SEQ ID NO: 1337251 - RNA, 18 nt, Human
aggguggggguagccagg

SEQ ID NO: 1337252 - RNA, 21 nt, Human
auugugcugggggucaggcag

SEQ ID NO: 1337253 - RNA, 22 nt, Human
caccugccuggccuguccacag

SEQ ID NO: 1337254 - RNA, 21 nt, Human
cacuggccgccuggaggcacc

SEQ ID NO: 1337255 - RNA, 21 nt, Human
cagcagcccccacugaggccc

SEQ ID NO: 1337256 - RNA, 25 nt, Human
cagcagggagcucguaccuucccuc

SEQ ID NO: 1337257 - RNA, 19 nt, Human
cagcauguugggcaggggc

SEQ ID NO: 1337258 - RNA, 18 nt, Human
cagcccccacugaggccc

SEQ ID NO: 1337259 - RNA, 23 nt, Human
cagcccccacugaggccccaccc

SEQ ID NO: 1337260 - RNA, 22 nt, Human
cagccuccgggcugccuggccu

SEQ ID NO: 1337261 - RNA, 26 nt, Human
caggcagcagcccccacugaggcccc

SEQ ID NO: 1337262 - RNA, 20 nt, Human
cauuuuuauugugcuggggg

SEQ ID NO: 1337263 - RNA, 22 nt, Human
ccacugaggccccacccagccu

SEQ ID NO: 1337264 - RNA, 18 nt, Human
ccagcccaucccaugcca

SEQ ID NO: 1337265 - RNA, 25 nt, Human
ccagccuccgggcugccuggccugu

SEQ ID NO: 1337266 - RNA, 26 nt, Human
ccagccuccgggcugccuggccugug

SEQ ID NO: 1337267 - RNA, 21 nt, Human
ccaggcgggguggccuucucc

SEQ ID NO: 1337268 - RNA, 20 nt, Human
ccccacccagccuccgggcu

SEQ ID NO: 1337269 - RNA, 25 nt, Human
cccccagcauguugggcaggggcug

SEQ ID NO: 1337270 - RNA, 26 nt, Human
cccccagcauguugggcaggggcugg

SEQ ID NO: 1337271 - RNA, 18 nt, Human
cccccggacaggggcagg

SEQ ID NO: 1337272 - RNA, 23 nt, Human
ccccgagguggcuucuggacccc

SEQ ID NO: 1337273 - RNA, 23 nt, Human
ccccgaggugguuucuggacccc

SEQ ID NO: 1337274 - RNA, 28 nt, Human
ccgccuggaggcaccuccugaggcccac

SEQ ID NO: 1337275 - RNA, 18 nt, Human
ccugaggcccaccugccu

SEQ ID NO: 1337276 - RNA, 20 nt, Human
ccugugccaugggucccagg

SEQ ID NO: 1337277 - RNA, 18 nt, Human
cgaggaaggggaggagga

SEQ ID NO: 1337278 - RNA, 24 nt, Human
cgggcugccuggccugugccaugg

SEQ ID NO: 1337279 - RNA, 21 nt, Human
cuccagcagggagcucguacc

SEQ ID NO: 1337280 - RNA, 18 nt, Human
cuccggguggugggggcc

SEQ ID NO: 1337281 - RNA, 28 nt, Human
cucguaccuucccucagcugagggccca

SEQ ID NO: 1337282 - RNA, 18 nt, Human
cugaggccccacccagcc

SEQ ID NO: 1337283 - RNA, 19 nt, Human
cugccuggccuguccacag

SEQ ID NO: 1337284 - RNA, 21 nt, Human
cugccuggccugugccauggg

SEQ ID NO: 1337285 - RNA, 20 nt, Human
cugcuggagcccaggcgugg

SEQ ID NO: 1337286 - RNA, 21 nt, Human
cuggcggaggagaaucaguca

SEQ ID NO: 1337287 - RNA, 19 nt, Human
cuggguggccuggcggagg

SEQ ID NO: 1337288 - RNA, 21 nt, Human
cugugccaugggucccaggcu

SEQ ID NO: 1337289 - RNA, 21 nt, Human
cuugcagccgugcagggccag

SEQ ID NO: 1337290 - RNA, 21 nt, Human
cuugcuggggccucaggccca

SEQ ID NO: 1337291 - RNA, 23 nt, Human
gaggaaggggaggaggaagagga

SEQ ID NO: 1337292 - RNA, 18 nt, Human
gaggggcucaguccagcc

SEQ ID NO: 1337293 - RNA, 23 nt, Human
gcagggagcucguaccuucccuc

SEQ ID NO: 1337294 - RNA, 20 nt, Human
gccuucuccucuggguggcc

SEQ ID NO: 1337295 - RNA, 22 nt, Human
gcuccagcagggagcucguacc

SEQ ID NO: 1337296 - RNA, 18 nt, Human
gcugccuggccugugcca

SEQ ID NO: 1337297 - RNA, 21 nt, Human
gcugcugaugcugcuggagcc

SEQ ID NO: 1337298 - RNA, 21 nt, Human
ggaaggggaggaggaagagga

SEQ ID NO: 1337299 - RNA, 20 nt, Human
ggccgcugcuguguccuggg

SEQ ID NO: 1337300 - RNA, 21 nt, Human
gggcugccuggccugugccau

SEQ ID NO: 1337301 - RNA, 25 nt, Human
gggcugccuggccugugccaugggu

SEQ ID NO: 1337302 - RNA, 20 nt, Human
ggggaggaggaagaggagga

SEQ ID NO: 1337303 - RNA, 22 nt, Human
ggugggggccaccugugccucc

SEQ ID NO: 1337304 - RNA, 22 nt, Human
uauugugcugggggucaggcag

SEQ ID NO: 1337305 - RNA, 25 nt, Human
ucaucccccggacaggggcaggagc

SEQ ID NO: 1337306 - RNA, 22 nt, Human
uccacaggagccucccuugcag

SEQ ID NO: 1337307 - RNA, 23 nt, Human
ucccaggcuccagcagggagcuc

SEQ ID NO: 1337308 - RNA, 19 nt, Human
ucccccggacaggggcagg

SEQ ID NO: 1337309 - RNA, 18 nt, Human
ucccucagcugagggccc

SEQ ID NO: 1337310 - RNA, 19 nt, Human
uccggguggugggggccac

SEQ ID NO: 1337311 - RNA, 22 nt, Human
uccggguggugggggccaccug

SEQ ID NO: 1337312 - RNA, 23 nt, Human
uccugggacuggagauggacccu

SEQ ID NO: 1337313 - RNA, 18 nt, Human
ugaggccccacccagccu

SEQ ID NO: 1337314 - RNA, 19 nt, Human
ugaggccccacccagccuc

SEQ ID NO: 1337315 - RNA, 22 nt, Human
ugccagggucuggggagccucc

SEQ ID NO: 1337316 - RNA, 24 nt, Human
ugccaugggucccaggcuccagcc

SEQ ID NO: 1337317 - RNA, 23 nt, Human
ugccguugggguaaccagggugg

SEQ ID NO: 1337318 - RNA, 22 nt, Human
ugcugaugcugcuggagcccag

SEQ ID NO: 1337319 - RNA, 20 nt, Human
uggagauggacccuagcccu

SEQ ID NO: 1337320 - RNA, 20 nt, Human
uggccaugguggccgcugcu

SEQ ID NO: 1337321 - RNA, 19 nt, Human
uggccuggcggaggagaau

SEQ ID NO: 1337322 - RNA, 23 nt, Human
uggccuucuccucuggguggccu

SEQ ID NO: 1337323 - RNA, 20 nt, Human
uggcggaggagaaucaguca

SEQ ID NO: 1337324 - RNA, 19 nt, Human
ugggaugccguugggguaa

SEQ ID NO: 1337325 - RNA, 24 nt, Human
ugggggccaccugugccuccccgg

SEQ ID NO: 1337326 - RNA, 24 nt, Human
ugggggcugcugaugcugcuggag

SEQ ID NO: 1337327 - RNA, 18 nt, Human
ugggguagccaggguggg

SEQ ID NO: 1337328 - RNA, 21 nt, Human
ugggguagccagggugggggu

SEQ ID NO: 1337329 - RNA, 20 nt, Human
uguccacaggagccucccuu

SEQ ID NO: 1337330 - RNA, 18 nt, Human
uguugggcaggggcaugg

SEQ ID NO: 1337331 - RNA, 21 nt, Human
uucacagagaagaucccagcc

SEQ ID NO: 1337332 - RNA, 18 nt, Human
uugcagccgugcagggcc

SEQ ID NO: 1337333 - RNA, 22 nt, Human
uuuuuuuuuuuuuuucacguuu

SEQ ID NO: 1337334 - RNA, 21 nt, Human
uuuuuuuuuuuuuuuuucacg

SEQ ID NO: 1337335 - RNA, 22 nt, Human
aaacagaaguucaaacauuaaa

SEQ ID NO: 1337336 - RNA, 23 nt, Human
aaacagaguggcaauggguagga

SEQ ID NO: 1337337 - RNA, 19 nt, Human
agaguggcaauggguagga

SEQ ID NO: 1337338 - RNA, 21 nt, Human
agugcaaucaaaaauaaaaau

SEQ ID NO: 1337339 - RNA, 19 nt, Human
aguucaaacauuaaaauuc

SEQ ID NO: 1337340 - RNA, 21 nt, Human
auccuccugcuucucccguua

SEQ ID NO: 1337341 - RNA, 21 nt, Human
caaagccucaaaaaugauauu

SEQ ID NO: 1337342 - RNA, 21 nt, Human
caaccuaaaccugguaaauca

SEQ ID NO: 1337343 - RNA, 24 nt, Human
ccagaaagaguaggggcgagagca

SEQ ID NO: 1337344 - RNA, 23 nt, Human
cccguuacugauuuucuccucuu

SEQ ID NO: 1337345 - RNA, 20 nt, Human
cuccuuaaaucccccaguga

SEQ ID NO: 1337346 - RNA, 19 nt, Human
gaacagaaaaagaaacaca

SEQ ID NO: 1337347 - RNA, 19 nt, Human
gguguguuuuuuuuuuuuu

SEQ ID NO: 1337348 - RNA, 21 nt, Human
guucuuuuucuucauuuuccu

SEQ ID NO: 1337349 - RNA, 21 nt, Human
uaagugcaaucaaaaauaaaa

SEQ ID NO: 1337350 - RNA, 20 nt, Human
uaggaugaaaccuacccauu

SEQ ID NO: 1337351 - RNA, 22 nt, Human
uaucauauguaaucagcuuuug

SEQ ID NO: 1337352 - RNA, 22 nt, Human
ucaauucuccuuaaauccccca

SEQ ID NO: 1337353 - RNA, 21 nt, Human
uccauuuauuauugcugccau

SEQ ID NO: 1337354 - RNA, 18 nt, Human
ucccccagugaugcuuuu

SEQ ID NO: 1337355 - RNA, 19 nt, Human
ucuuaggaauaaaaagcuc

SEQ ID NO: 1337356 - RNA, 20 nt, Human
ugaaauaccacuagauauag

SEQ ID NO: 1337357 - RNA, 19 nt, Human
ugagguaucucucaggaaa

SEQ ID NO: 1337358 - RNA, 18 nt, Human
uggacauccuccugcuuc

SEQ ID NO: 1337359 - RNA, 26 nt, Human
uggcaauggguaggaugaaaccuacc

SEQ ID NO: 1337360 - RNA, 20 nt, Human
uguagaacagaaaaagaaac

SEQ ID NO: 1337361 - RNA, 22 nt, Human
uguagaacagaaaaagaaacac

SEQ ID NO: 1337362 - RNA, 18 nt, Human
uguggcugcgagcguuug

SEQ ID NO: 1337363 - RNA, 19 nt, Human
uucuccuuaaaucccccag

SEQ ID NO: 1337364 - RNA, 26 nt, Human
uugagaguucaugauauucauuguga

SEQ ID NO: 1337365 - RNA, 26 nt, Human
uuuauuauugcugccauuugugggua

SEQ ID NO: 1337366 - RNA, 24 nt, Human
ccucaauagaggcuggacuuccag

SEQ ID NO: 1337367 - RNA, 26 nt, Human
cucuacucugggccucuuucaccucc

SEQ ID NO: 1337368 - RNA, 22 nt, Human
gcuggacuuccagcggaauuca

SEQ ID NO: 1337369 - RNA, 18 nt, Human
ucucuacucugggccucu

SEQ ID NO: 1337370 - RNA, 18 nt, Human
ucucucucucucuacucu

SEQ ID NO: 1337371 - RNA, 26 nt, Human
ugggccucuuucaccuccaaagcccc

SEQ ID NO: 1337372 - RNA, 28 nt, Human
uucaccuccaaagccccgugaggccguc

SEQ ID NO: 1337373 - RNA, 19 nt, Human
aaacaggucuguaaacaug

SEQ ID NO: 1337374 - RNA, 20 nt, Human
aaacaugaucucaucccccc

SEQ ID NO: 1337375 - RNA, 23 nt, Human
aacaugaucucauccccccaucc

SEQ ID NO: 1337376 - RNA, 21 nt, Human
acccagaugguccacgccagu

SEQ ID NO: 1337377 - RNA, 20 nt, Human
agccaggggugcuggccagg

SEQ ID NO: 1337378 - RNA, 21 nt, Human
aggccagaagcaggcagcuga

SEQ ID NO: 1337379 - RNA, 20 nt, Human
aggggcugaggacacccaga

SEQ ID NO: 1337380 - RNA, 24 nt, Human
aucucauccccccaucccuucuuc

SEQ ID NO: 1337381 - RNA, 21 nt, Human
augacaaaacaggucuguaaa

SEQ ID NO: 1337382 - RNA, 18 nt, Human
caaaacaggucuguaaac

SEQ ID NO: 1337383 - RNA, 24 nt, Human
caagugauuaaaaaacuucuuggc

SEQ ID NO: 1337384 - RNA, 23 nt, Human
cagcagacacaggcaggccagaa

SEQ ID NO: 1337385 - RNA, 22 nt, Human
caggaaggcagacucgucccuu

SEQ ID NO: 1337386 - RNA, 22 nt, Human
caggccagaagcaggcagcuga

SEQ ID NO: 1337387 - RNA, 25 nt, Human
caucccuucuuccaaggagcuuccu

SEQ ID NO: 1337388 - RNA, 23 nt, Human
ccaggugaggggcugaggcacaa

SEQ ID NO: 1337389 - RNA, 21 nt, Human
ccaguggccuugaaauuuccc

SEQ ID NO: 1337390 - RNA, 19 nt, Human
ccccaggaggagggagacu

SEQ ID NO: 1337391 - RNA, 24 nt, Human
cugguucguuggcagccccuuccc

SEQ ID NO: 1337392 - RNA, 19 nt, Human
gacucgucccuuuaaccca

SEQ ID NO: 1337393 - RNA, 18 nt, Human
gaggggcugaggcacaag

SEQ ID NO: 1337394 - RNA, 23 nt, Human
ggaggagggagacucuuuggcag

SEQ ID NO: 1337395 - RNA, 19 nt, Human
ggcagccccuuccccagga

SEQ ID NO: 1337396 - RNA, 22 nt, Human
gucugguucguuggcagccccu

SEQ ID NO: 1337397 - RNA, 23 nt, Human
ucacugagucugguucguuggca

SEQ ID NO: 1337398 - RNA, 23 nt, Human
uccacacaccaccugguggcucc

SEQ ID NO: 1337399 - RNA, 18 nt, Human
uccccugcagaagccaga

SEQ ID NO: 1337400 - RNA, 19 nt, Human
ucugucaugacguggucac

SEQ ID NO: 1337401 - RNA, 21 nt, Human
ugaggacacccagauggucca

SEQ ID NO: 1337402 - RNA, 27 nt, Human
ugaggggcugaggcacaagugcuauca

SEQ ID NO: 1337403 - RNA, 23 nt, Human
ugaggucuguagaaaaggggucc

SEQ ID NO: 1337404 - RNA, 19 nt, Human
ugccccacaggggcugagg

SEQ ID NO: 1337405 - RNA, 24 nt, Human
ugcccuggcagguggccaggugag

SEQ ID NO: 1337406 - RNA, 23 nt, Human
ugcggcagcccucccgggggcac

SEQ ID NO: 1337407 - RNA, 24 nt, Human
ugcggcagcccucccgggggcacg

SEQ ID NO: 1337408 - RNA, 22 nt, Human
ugcuaggguugcaggugcccug

SEQ ID NO: 1337409 - RNA, 21 nt, Human
uggcagcaggaugacaaaaga

SEQ ID NO: 1337410 - RNA, 19 nt, Human
uguaaacaugaucucaucc

SEQ ID NO: 1337411 - RNA, 21 nt, Human
uucuuggcagcaggaugacaa

SEQ ID NO: 1337412 - RNA, 21 nt, Human
uugcaggugcccuggcaggug

SEQ ID NO: 1337413 - RNA, 23 nt, Human
aaacagaaaggucagaaaaaaca

SEQ ID NO: 1337414 - RNA, 21 nt, Human
aaauacauguuaaguguacaa

SEQ ID NO: 1337415 - RNA, 22 nt, Human
aagauuuuuauugaagacacau

SEQ ID NO: 1337416 - RNA, 21 nt, Human
acaaaaauguugaaacagaaa

SEQ ID NO: 1337417 - RNA, 19 nt, Human
agaaagcaauuauuuaaaa

SEQ ID NO: 1337418 - RNA, 19 nt, Human
agaaauguuugaaguuaag

SEQ ID NO: 1337419 - RNA, 24 nt, Human
uaaagaaucaggauaacuuaaaua

SEQ ID NO: 1337420 - RNA, 25 nt, Human
uccaaauuacaaaaauguugaaaca

SEQ ID NO: 1337421 - RNA, 18 nt, Human
ugaaacagaaaggucaga

SEQ ID NO: 1337422 - RNA, 21 nt, Human
ugaaacagaaaggucagaaaa

SEQ ID NO: 1337423 - RNA, 26 nt, Human
ugaaacagaaaggucagaaaaaacaa

SEQ ID NO: 1337424 - RNA, 21 nt, Human
uuuuaaagaaucaggauaacu

SEQ ID NO: 1337425 - RNA, 24 nt, Human
uuuuaaagaaucaggauaacuuaa

SEQ ID NO: 1337426 - RNA, 20 nt, Human
aaaaagcuuuauccagcaac

SEQ ID NO: 1337427 - RNA, 25 nt, Human
cacacacacgcacgcccgcuccccg

SEQ ID NO: 1337428 - RNA, 29 nt, Human
ccaacccgacaaguuccagaccccacccc

SEQ ID NO: 1337429 - RNA, 22 nt, Human
ccacgcggcccgggucccccuc

SEQ ID NO: 1337430 - RNA, 21 nt, Human
ccccgccccuuggcgcccucc

SEQ ID NO: 1337431 - RNA, 20 nt, Human
ccccggagccgccgcuccuc

SEQ ID NO: 1337432 - RNA, 23 nt, Human
ccccggagccgccgcuccucccu

SEQ ID NO: 1337433 - RNA, 22 nt, Human
cccgccccuuggcgcccuccau

SEQ ID NO: 1337434 - RNA, 22 nt, Human
ccgccgcuccucccucgcgccc

SEQ ID NO: 1337435 - RNA, 23 nt, Human
ccgccgcuccucccucgcgcccu

SEQ ID NO: 1337436 - RNA, 20 nt, Human
ccgcucccggacucuccccu

SEQ ID NO: 1337437 - RNA, 22 nt, Human
ccgcuccucccucgcgcccucc

SEQ ID NO: 1337438 - RNA, 21 nt, Human
ccucccgcucccggacucucc

SEQ ID NO: 1337439 - RNA, 18 nt, Human
ccucccucgcgcccuccc

SEQ ID NO: 1337440 - RNA, 24 nt, Human
ccucgcgcccucccgcucccggac

SEQ ID NO: 1337441 - RNA, 20 nt, Human
cgacaaguuccagaccccac

SEQ ID NO: 1337442 - RNA, 20 nt, Human
cgcacacacacgcacgcccg

SEQ ID NO: 1337443 - RNA, 28 nt, Human
cgcauucgcacucgcacacacacgcacg

SEQ ID NO: 1337444 - RNA, 19 nt, Human
cgggcgcgggcgcggggcg

SEQ ID NO: 1337445 - RNA, 25 nt, Human
gagccgccgcuccucccucgcgccc

SEQ ID NO: 1337446 - RNA, 20 nt, Human
gccccggagccgccgcuccu

SEQ ID NO: 1337447 - RNA, 18 nt, Human
gcccgcuccccgccccuu

SEQ ID NO: 1337448 - RNA, 18 nt, Human
gcgcccacgcggcccggg

SEQ ID NO: 1337449 - RNA, 21 nt, Human
gcgcgggcgcggggcggcgag

SEQ ID NO: 1337450 - RNA, 20 nt, Human
gggcgcgggcgcggggcggc

SEQ ID NO: 1337451 - RNA, 21 nt, Human
gggggcuccuuccccgcggga

SEQ ID NO: 1337452 - RNA, 18 nt, Human
guagcuccgguuucacuc

SEQ ID NO: 1337453 - RNA, 21 nt, Human
uccccgccccuuggcgcccuc

SEQ ID NO: 1337454 - RNA, 20 nt, Human
ucccggcgcccacgcggccc

SEQ ID NO: 1337455 - RNA, 26 nt, Human
ucggcggcaccgcgggggcuccuucc

SEQ ID NO: 1337456 - RNA, 24 nt, Human
uuggcgcccuccaucccggcgccc

SEQ ID NO: 1337457 - RNA, 19 nt, Human
uuuguagcuccgguuucac

SEQ ID NO: 1337458 - RNA, 24 nt, Human
uuuuuuuuuuuucauuuuuguuuu

SEQ ID NO: 1337459 - RNA, 21 nt, Human
uuuuuuuuuuuuuucauuuuu

SEQ ID NO: 1337460 - RNA, 20 nt, Human
aggcagcagggacggcagcg

SEQ ID NO: 1337461 - RNA, 18 nt, Human
agggacggcagcggcagg

SEQ ID NO: 1337462 - RNA, 23 nt, Human
caaacaccacuuauacacaaaac

SEQ ID NO: 1337463 - RNA, 19 nt, Human
caacagcaacagcuaccgg

SEQ ID NO: 1337464 - RNA, 20 nt, Human
cagcggcaggaaugaggggg

SEQ ID NO: 1337465 - RNA, 27 nt, Human
uacaaacaccacuuauacacaaaacca

SEQ ID NO: 1337466 - RNA, 19 nt, Human
ugauauucuuguuuuuaaa

SEQ ID NO: 1337467 - RNA, 24 nt, Human
uucuuguuuuuaaaaauucuugau

SEQ ID NO: 1337468 - RNA, 19 nt, Human
uuuuuuuuuuuuacugaua

SEQ ID NO: 1337469 - RNA, 21 nt, Human
aauacaaaaagugaaaauaag

SEQ ID NO: 1337470 - RNA, 27 nt, Human
aauacaaaaagugaaaauaaguuuaga

SEQ ID NO: 1337471 - RNA, 25 nt, Human
accagccuuaaccuuagcucaggug

SEQ ID NO: 1337472 - RNA, 25 nt, Human
aggaaaaugggaagauaccgguacc

SEQ ID NO: 1337473 - RNA, 22 nt, Human
auacacauacauaucucaaaac

SEQ ID NO: 1337474 - RNA, 23 nt, Human
auacauuuucaauauaggaaaau

SEQ ID NO: 1337475 - RNA, 19 nt, Human
ccacaagcucuuuagaugg

SEQ ID NO: 1337476 - RNA, 22 nt, Human
ccacacucccuuagccuucgcc

SEQ ID NO: 1337477 - RNA, 24 nt, Human
guuuagaccagccuuaaccuuagc

SEQ ID NO: 1337478 - RNA, 18 nt, Human
uauauauacacauacaua

SEQ ID NO: 1337479 - RNA, 19 nt, Human
uauauauacacauacauau

SEQ ID NO: 1337480 - RNA, 26 nt, Human
uauauauacacauacauaucucaaaa

SEQ ID NO: 1337481 - RNA, 18 nt, Human
uggcucccggagccgccc

SEQ ID NO: 1337482 - RNA, 23 nt, Human
uucaauauaggaaaaugggaaga

SEQ ID NO: 1337483 - RNA, 23 nt, Human
uucagaauaauuaaaaauuugau

SEQ ID NO: 1337484 - RNA, 21 nt, Human
uuuggccacaagcucuuuaga

SEQ ID NO: 1337485 - RNA, 18 nt, Human
agaaacugcaacccucca

SEQ ID NO: 1337486 - RNA, 20 nt, Human
agacauaucagauuccacag

SEQ ID NO: 1337487 - RNA, 24 nt, Human
agaucuuacacugggcaacagucc

SEQ ID NO: 1337488 - RNA, 26 nt, Human
caacagagcagaucgcguuaagcccc

SEQ ID NO: 1337489 - RNA, 27 nt, Human
caacagagcagaucgcguuaagcccca

SEQ ID NO: 1337490 - RNA, 24 nt, Human
cuaucacaucuguuuacaagcaaa

SEQ ID NO: 1337491 - RNA, 20 nt, Human
cuuagaaacugcaacccucc

SEQ ID NO: 1337492 - RNA, 22 nt, Human
cuucccauccaauaugggcuug

SEQ ID NO: 1337493 - RNA, 23 nt, Human
ggugacaugucuuuuuugguggc

SEQ ID NO: 1337494 - RNA, 21 nt, Human
uacaagcaaaguauuacuuug

SEQ ID NO: 1337495 - RNA, 21 nt, Human
uagaaacugcaacccuccaag

SEQ ID NO: 1337496 - RNA, 19 nt, Human
uagguauguaucagaggca

SEQ ID NO: 1337497 - RNA, 24 nt, Human
uaucacaucuguuuacaagcaaag

SEQ ID NO: 1337498 - RNA, 21 nt, Human
ucagaggcaauaauuuccaaa

SEQ ID NO: 1337499 - RNA, 21 nt, Human
uccaaagaugucuucaugucc

SEQ ID NO: 1337500 - RNA, 21 nt, Human
ucuuacacugggcaacagucc

SEQ ID NO: 1337501 - RNA, 18 nt, Human
ugacaugucuuuuuuggu

SEQ ID NO: 1337502 - RNA, 19 nt, Human
uggcaccaagcuacccaag

SEQ ID NO: 1337503 - RNA, 21 nt, Human
uugaggugacaugucuuuuuu

SEQ ID NO: 1337504 - RNA, 20 nt, Human
uugguggccguaaacuuccc

SEQ ID NO: 1337505 - RNA, 26 nt, Human
aacaaugagaugcagauaacaagaga

SEQ ID NO: 1337506 - RNA, 20 nt, Human
aaccucuuuuuuacaaaugu

SEQ ID NO: 1337507 - RNA, 19 nt, Human
aagcaaaaggagaaaaagg

SEQ ID NO: 1337508 - RNA, 19 nt, Human
accucucuuccuuccuucu

SEQ ID NO: 1337509 - RNA, 24 nt, Human
caaaauacaauaaacaaugagaug

SEQ ID NO: 1337510 - RNA, 28 nt, Human
caaaauucccgcaaguuugacuccuucc

SEQ ID NO: 1337511 - RNA, 22 nt, Human
caagagauacaucuaaaaccau

SEQ ID NO: 1337512 - RNA, 19 nt, Human
cauucauaaucccaccacc

SEQ ID NO: 1337513 - RNA, 19 nt, Human
ccucagggaccgaccgccu

SEQ ID NO: 1337514 - RNA, 18 nt, Human
ccuuccuucuuuucuuuc

SEQ ID NO: 1337515 - RNA, 19 nt, Human
ccuuccuucuuuucuuucu

SEQ ID NO: 1337516 - RNA, 18 nt, Human
cgccugcgcugcugaagg

SEQ ID NO: 1337517 - RNA, 19 nt, Human
cuaccucucuuccuuccuu

SEQ ID NO: 1337518 - RNA, 18 nt, Human
cucucuuccuuccuucuu

SEQ ID NO: 1337519 - RNA, 27 nt, Human
cuggcacugaucgggucaguuucuucc

SEQ ID NO: 1337520 - RNA, 22 nt, Human
gaaaaaucauucauaaucccac

SEQ ID NO: 1337521 - RNA, 23 nt, Human
gaacaaggaccagauuaccagga

SEQ ID NO: 1337522 - RNA, 24 nt, Human
ggacaaaggaauaucaggaaaugc

SEQ ID NO: 1337523 - RNA, 18 nt, Human
guucaaaauacaauaaac

SEQ ID NO: 1337524 - RNA, 21 nt, Human
uaaaaagcaagcuauauggua

SEQ ID NO: 1337525 - RNA, 18 nt, Human
uaaaagacagagacuugu

SEQ ID NO: 1337526 - RNA, 19 nt, Human
uaccucucuuccuuccuuc

SEQ ID NO: 1337527 - RNA, 25 nt, Human
uauauguaauauacaaauguacuuu

SEQ ID NO: 1337528 - RNA, 21 nt, Human
uauccagacgggaacaaggac

SEQ ID NO: 1337529 - RNA, 22 nt, Human
uauccagacgggaacaaggacc

SEQ ID NO: 1337530 - RNA, 28 nt, Human
ucaaaauacaauaaacaaugagaugcag

SEQ ID NO: 1337531 - RNA, 22 nt, Human
ucagggaccgaccgccugcgcu

SEQ ID NO: 1337532 - RNA, 20 nt, Human
ucaguuucuuccuccuccuu

SEQ ID NO: 1337533 - RNA, 19 nt, Human
uccuuccuucuuuucuuuc

SEQ ID NO: 1337534 - RNA, 29 nt, Human
ucuaccucucuuccuuccuucuuuucuuu

SEQ ID NO: 1337535 - RNA, 19 nt, Human
ucuuccuccuccuuuucua

SEQ ID NO: 1337536 - RNA, 19 nt, Human
ucuuucuugcuuauucuuc

SEQ ID NO: 1337537 - RNA, 20 nt, Human
ugacuccuuccacgggccuc

SEQ ID NO: 1337538 - RNA, 25 nt, Human
ugggucuugcuggaaacaacagccc

SEQ ID NO: 1337539 - RNA, 20 nt, Human
uguaucugucuaccucucuu

SEQ ID NO: 1337540 - RNA, 19 nt, Human
uuccuuccuucuuuucuuu

SEQ ID NO: 1337541 - RNA, 25 nt, Human
uucuuccuccuccuuuucuagcuuu

SEQ ID NO: 1337542 - RNA, 18 nt, Human
uuuagaauauagaaaaua

SEQ ID NO: 1337543 - RNA, 24 nt, Human
uuucuuccuccuccuuuucuagcu

SEQ ID NO: 1337544 - RNA, 22 nt, Human
uuucuuucuugcuuauucuucu

SEQ ID NO: 1337545 - RNA, 24 nt, Human
agacaaauauuaguuaaaccagaa

SEQ ID NO: 1337546 - RNA, 22 nt, Human
agcugcaccucuggcgucucug

SEQ ID NO: 1337547 - RNA, 20 nt, Human
cgucucugccgcagcaagca

SEQ ID NO: 1337548 - RNA, 24 nt, Human
cugcaccucuggcgucucugccgc

SEQ ID NO: 1337549 - RNA, 22 nt, Human
gcuggagcugcaccucuggcgu

SEQ ID NO: 1337550 - RNA, 23 nt, Human
ggagcugcaccucuggcgucucu

SEQ ID NO: 1337551 - RNA, 24 nt, Human
uuuuuuuuuuuuuuuuuucacuga

SEQ ID NO: 1337552 - RNA, 24 nt, Human
uuuuuuuuuuuuuuuuuuucacug

SEQ ID NO: 1337553 - RNA, 24 nt, Human
aaacaaaacaaaguagagaaacaa

SEQ ID NO: 1337554 - RNA, 26 nt, Human
aaacaaaguagagaaacaacaacaac

SEQ ID NO: 1337555 - RNA, 25 nt, Human
aaacaacaacaacaacaacaacaac

SEQ ID NO: 1337556 - RNA, 27 nt, Human
aaacccucuucuucaucccucuuuccu

SEQ ID NO: 1337557 - RNA, 28 nt, Human
aacaaaguagagaaacaacaacaacaac

SEQ ID NO: 1337558 - RNA, 27 nt, Human
aacaacaacaacaacaacaacaacaac

SEQ ID NO: 1337559 - RNA, 24 nt, Human
aacaacaacaacgauaacaacaac

SEQ ID NO: 1337560 - RNA, 22 nt, Human
aaggcuguuggacaagcaagcu

SEQ ID NO: 1337561 - RNA, 26 nt, Human
acaaaacaaaguagagaaacaacaac

SEQ ID NO: 1337562 - RNA, 19 nt, Human
acaacaacaacaacaacaa

SEQ ID NO: 1337563 - RNA, 19 nt, Human
acaacaacaacaacaacaa

SEQ ID NO: 1337564 - RNA, 19 nt, Human
acaacaacaacaacaacaa

SEQ ID NO: 1337565 - RNA, 19 nt, Human
acaacaacaacaacaacaa

SEQ ID NO: 1337566 - RNA, 26 nt, Human
acaacaacaacaacaacaacgauaac

SEQ ID NO: 1337567 - RNA, 30 nt, Human
acaacaacaacaacgauaacaacaacaaaa

SEQ ID NO: 1337568 - RNA, 25 nt, Human
agacagaaaugaaaaaccauggcuu

SEQ ID NO: 1337569 - RNA, 20 nt, Human
agagaaacaacaacaacaac

SEQ ID NO: 1337570 - RNA, 20 nt, Human
aggcugcuaaaagccuaaaa

SEQ ID NO: 1337571 - RNA, 21 nt, Human
aggcugcuaaaagccuaaaac

SEQ ID NO: 1337572 - RNA, 22 nt, Human
aucccucuuuccugcuuaucac

SEQ ID NO: 1337573 - RNA, 23 nt, Human
caaaagagguaaggaauaugaug

SEQ ID NO: 1337574 - RNA, 18 nt, Human
caacaacaacaacaacaa

SEQ ID NO: 1337575 - RNA, 23 nt, Human
caacaacaacaacaacaacaaca

SEQ ID NO: 1337576 - RNA, 27 nt, Human
caacaacaacaacaacaacaacgauaa

SEQ ID NO: 1337577 - RNA, 22 nt, Human
cacuagagacagaaaugaaaaa

SEQ ID NO: 1337578 - RNA, 23 nt, Human
cccucuucuucaucccucuuucc

SEQ ID NO: 1337579 - RNA, 18 nt, Human
cuaaaacaaaacaaagua

SEQ ID NO: 1337580 - RNA, 20 nt, Human
cuaaccggccaguaaacccu

SEQ ID NO: 1337581 - RNA, 24 nt, Human
cugcagagcgggaaccagcugcgc

SEQ ID NO: 1337582 - RNA, 21 nt, Human
cuggucccgggacugagcgcg

SEQ ID NO: 1337583 - RNA, 19 nt, Human
gcgagaggagagaacgccu

SEQ ID NO: 1337584 - RNA, 24 nt, Human
gucccaggcccagaggcgagagga

SEQ ID NO: 1337585 - RNA, 22 nt, Human
uaaaagccuaaaacaaaacaaa

SEQ ID NO: 1337586 - RNA, 25 nt, Human
uagagacagaaaugaaaaaccaugg

SEQ ID NO: 1337587 - RNA, 19 nt, Human
ucccaggcccagaggcgag

SEQ ID NO: 1337588 - RNA, 26 nt, Human
uuuuuuuuuuucuuuuuuuaguuuuu

SEQ ID NO: 1337589 - RNA, 25 nt, Human
uuuuuuuuuuuuuuuuuuucuuuuu

SEQ ID NO: 1337590 - RNA, 22 nt, Human
aaaaacagacugccaugaaaac

SEQ ID NO: 1337591 - RNA, 26 nt, Human
aaaauaccacauuaaagauauauuua

SEQ ID NO: 1337592 - RNA, 23 nt, Human
aaacaggaugacagucaccaaga

SEQ ID NO: 1337593 - RNA, 21 nt, Human
aacagaaaaugaaacaucaag

SEQ ID NO: 1337594 - RNA, 20 nt, Human
aacauagcgagaucucaucu

SEQ ID NO: 1337595 - RNA, 20 nt, Human
aacauggggaaaccccgucu

SEQ ID NO: 1337596 - RNA, 21 nt, Human
aacauggggaaaccccgucuc

SEQ ID NO: 1337597 - RNA, 19 nt, Human
aaccccuaucucccagauc

SEQ ID NO: 1337598 - RNA, 24 nt, Human
aauggcucaugccuauaaucccag

SEQ ID NO: 1337599 - RNA, 21 nt, Human
acagaacgagaccaucucuaa

SEQ ID NO: 1337600 - RNA, 20 nt, Human
acaucacuguccuccagccu

SEQ ID NO: 1337601 - RNA, 24 nt, Human
accccgucucgacugaaaauacaa

SEQ ID NO: 1337602 - RNA, 20 nt, Human
acgcaauugaaaauaccaca

SEQ ID NO: 1337603 - RNA, 23 nt, Human
acugaaaauacaaaauuagccgg

SEQ ID NO: 1337604 - RNA, 24 nt, Human
acugcacuccauccuggacaacag

SEQ ID NO: 1337605 - RNA, 26 nt, Human
acuguagcucacuucuucaauacauu

SEQ ID NO: 1337606 - RNA, 24 nt, Human
acuguccuccagccuggguaacag

SEQ ID NO: 1337607 - RNA, 20 nt, Human
agaaaaaaauauuaagucug

SEQ ID NO: 1337608 - RNA, 19 nt, Human
agacugccaugaaaaccaa

SEQ ID NO: 1337609 - RNA, 23 nt, Human
agccgggcgugguggcacaugcc

SEQ ID NO: 1337610 - RNA, 22 nt, Human
agcgggcauggugccacaugcc

SEQ ID NO: 1337611 - RNA, 22 nt, Human
aggaaggaaaacuguagcucac

SEQ ID NO: 1337612 - RNA, 24 nt, Human
aggauugcuugaguccaggaguuu

SEQ ID NO: 1337613 - RNA, 21 nt, Human
aggcauaauggcucaugccua

SEQ ID NO: 1337614 - RNA, 18 nt, Human
aggcaugagaaucgccug

SEQ ID NO: 1337615 - RNA, 24 nt, Human
aggcaugagaaucgccugaauccg

SEQ ID NO: 1337616 - RNA, 21 nt, Human
aggccaaggugggaggauugc

SEQ ID NO: 1337617 - RNA, 24 nt, Human
aggccaaggugggaggauugcuug

SEQ ID NO: 1337618 - RNA, 22 nt, Human
aggcgaacagaucaccugaggg

SEQ ID NO: 1337619 - RNA, 22 nt, Human
aggcgaacagaucaccugaggu

SEQ ID NO: 1337620 - RNA, 21 nt, Human
aggcggagguuguggugaccc

SEQ ID NO: 1337621 - RNA, 22 nt, Human
aggugggaggauugcuugaguc

SEQ ID NO: 1337622 - RNA, 23 nt, Human
aggugggaggauugcuugagucc

SEQ ID NO: 1337623 - RNA, 24 nt, Human
agugguucacgccuguaaucccag

SEQ ID NO: 1337624 - RNA, 24 nt, Human
aucacaucacuguccuccagccug

SEQ ID NO: 1337625 - RNA, 22 nt, Human
augaaacaucaaguuaugaaug

SEQ ID NO: 1337626 - RNA, 18 nt, Human
augaauuacaauaaguuu

SEQ ID NO: 1337627 - RNA, 24 nt, Human
augaauuuauuauuuuaaacuaac

SEQ ID NO: 1337628 - RNA, 21 nt, Human
augacagucaccaagaguggu

SEQ ID NO: 1337629 - RNA, 22 nt, Human
caacagaaaaugaaacaucaag

SEQ ID NO: 1337630 - RNA, 21 nt, Human
caaccacugcacuccauccug

SEQ ID NO: 1337631 - RNA, 23 nt, Human
caaccacugcacuccauccugga

SEQ ID NO: 1337632 - RNA, 18 nt, Human
caaccccuaucucccaga

SEQ ID NO: 1337633 - RNA, 26 nt, Human
caaccccuaucucccagaucuuccua

SEQ ID NO: 1337634 - RNA, 21 nt, Human
cacaucacuguccuccagccu

SEQ ID NO: 1337635 - RNA, 24 nt, Human
cacgccuguaaucccagcacuuug

SEQ ID NO: 1337636 - RNA, 23 nt, Human
cacuccauccuggacaacagaac

SEQ ID NO: 1337637 - RNA, 21 nt, Human
cacugcacuccauccuggaca

SEQ ID NO: 1337638 - RNA, 24 nt, Human
cacugcacuccauccuggacaaca

SEQ ID NO: 1337639 - RNA, 19 nt, Human
cacuguccuccagccuggg

SEQ ID NO: 1337640 - RNA, 23 nt, Human
cacuguccuccagccuggguaac

SEQ ID NO: 1337641 - RNA, 24 nt, Human
cagaucaccugaggucgggaauuc

SEQ ID NO: 1337642 - RNA, 22 nt, Human
cagcacuuugggaggccgaggc

SEQ ID NO: 1337643 - RNA, 23 nt, Human
cagcacuuugggaggccgaggcg

SEQ ID NO: 1337644 - RNA, 25 nt, Human
cagcaucgacgccugcucuccgcgg

SEQ ID NO: 1337645 - RNA, 24 nt, Human
cagccugaccaacauggggaaacc

SEQ ID NO: 1337646 - RNA, 24 nt, Human
cagugauuuggaaggccaaggugg

SEQ ID NO: 1337647 - RNA, 25 nt, Human
cauagcgagaucucaucucuacaag

SEQ ID NO: 1337648 - RNA, 24 nt, Human
caugaaaaccaaauccgucagaga

SEQ ID NO: 1337649 - RNA, 25 nt, Human
caugccagcaaccccuaucucccag

SEQ ID NO: 1337650 - RNA, 24 nt, Human
caugccuauaaucccagugauuug

SEQ ID NO: 1337651 - RNA, 18 nt, Human
caugccuguaguccuagc

SEQ ID NO: 1337652 - RNA, 19 nt, Human
ccacugcacuccauccugg

SEQ ID NO: 1337653 - RNA, 19 nt, Human
ccacugcacuccauccugg

SEQ ID NO: 1337654 - RNA, 20 nt, Human
ccacugcacuccauccugga

SEQ ID NO: 1337655 - RNA, 21 nt, Human
ccacugcacuccauccuggac

SEQ ID NO: 1337656 - RNA, 24 nt, Human
ccacugcacuccauccuggacaac

SEQ ID NO: 1337657 - RNA, 19 nt, Human
cccaugguuaaggaaggaa

SEQ ID NO: 1337658 - RNA, 21 nt, Human
cccgagaucacaucacugucc

SEQ ID NO: 1337659 - RNA, 23 nt, Human
ccugaccaacauggggaaacccc

SEQ ID NO: 1337660 - RNA, 24 nt, Human
ccugaccaacauggggaaaccccg

SEQ ID NO: 1337661 - RNA, 24 nt, Human
ccugggcaacauagcgagaucuca

SEQ ID NO: 1337662 - RNA, 22 nt, Human
ccuguaaucccagcacuuuggg

SEQ ID NO: 1337663 - RNA, 22 nt, Human
ccuguaaucugagcuacucggg

SEQ ID NO: 1337664 - RNA, 20 nt, Human
ccuuauuaguuccucccuca

SEQ ID NO: 1337665 - RNA, 24 nt, Human
cgaacagaucaccugaggucggga

SEQ ID NO: 1337666 - RNA, 20 nt, Human
cgaggcgaacagaucaccug

SEQ ID NO: 1337667 - RNA, 25 nt, Human
cucaugccuauaaucccagugauuu

SEQ ID NO: 1337668 - RNA, 21 nt, Human
cuccagccuggguaacaggag

SEQ ID NO: 1337669 - RNA, 21 nt, Human
cuccagccuggguaacaggag

SEQ ID NO: 1337670 - RNA, 21 nt, Human
cucccucaucccaucuuaaaa

SEQ ID NO: 1337671 - RNA, 22 nt, Human
cucuccgcggcuacaacucguu

SEQ ID NO: 1337672 - RNA, 24 nt, Human
cugaauccgggaggcggagguugu

SEQ ID NO: 1337673 - RNA, 25 nt, Human
gagaauauggaagaaacaggaugac

SEQ ID NO: 1337674 - RNA, 20 nt, Human
gaggcggagguuguggugac

SEQ ID NO: 1337675 - RNA, 22 nt, Human
gagucaggcauaauggcucaug

SEQ ID NO: 1337676 - RNA, 18 nt, Human
gaucaccugaggucggga

SEQ ID NO: 1337677 - RNA, 24 nt, Human
gaucaccugaggucgggaauucaa

SEQ ID NO: 1337678 - RNA, 18 nt, Human
gauugcucgagccuggga

SEQ ID NO: 1337679 - RNA, 22 nt, Human
gauugcuugaguccaggaguuu

SEQ ID NO: 1337680 - RNA, 24 nt, Human
gauugcuugaguccaggaguuuga

SEQ ID NO: 1337681 - RNA, 19 nt, Human
gcagauuucauaaguugug

SEQ ID NO: 1337682 - RNA, 18 nt, Human
gcagugguucacgccugu

SEQ ID NO: 1337683 - RNA, 18 nt, Human
gccugggcaacauagcga

SEQ ID NO: 1337684 - RNA, 20 nt, Human
gccugggcaacauagcgaga

SEQ ID NO: 1337685 - RNA, 23 nt, Human
gccugggcaacauagcgagaucu

SEQ ID NO: 1337686 - RNA, 18 nt, Human
ggagguuguggugacccg

SEQ ID NO: 1337687 - RNA, 24 nt, Human
ggagguuguggugacccgagauca

SEQ ID NO: 1337688 - RNA, 20 nt, Human
ggaugaauuuauuauuuuaa

SEQ ID NO: 1337689 - RNA, 22 nt, Human
ggauugcuugaguccaggaguu

SEQ ID NO: 1337690 - RNA, 18 nt, Human
ggccgaggcgaacagauc

SEQ ID NO: 1337691 - RNA, 23 nt, Human
ggcgugguggcacaugccuguaa

SEQ ID NO: 1337692 - RNA, 24 nt, Human
gggugcagugguucacgccuguaa

SEQ ID NO: 1337693 - RNA, 20 nt, Human
uaaaaaaacagacugccaug

SEQ ID NO: 1337694 - RNA, 25 nt, Human
uaaaaaaacagacugccaugaaaac

SEQ ID NO: 1337695 - RNA, 19 nt, Human
uacuucaguggguuuucug

SEQ ID NO: 1337696 - RNA, 22 nt, Human
uagccgggcgugguggcacaug

SEQ ID NO: 1337697 - RNA, 23 nt, Human
uauacagaaaauggagcaaugcc

SEQ ID NO: 1337698 - RNA, 23 nt, Human
ucaacaauagauaguggcucaaa

SEQ ID NO: 1337699 - RNA, 23 nt, Human
ucacaucacuguccuccagccug

SEQ ID NO: 1337700 - RNA, 23 nt, Human
ucacgccuguaaucccagcacuu

SEQ ID NO: 1337701 - RNA, 20 nt, Human
ucacuguccuccagccuggg

SEQ ID NO: 1337702 - RNA, 21 nt, Human
ucacuguccuccagccugggu

SEQ ID NO: 1337703 - RNA, 24 nt, Human
ucacuguccuccagccuggguaac

SEQ ID NO: 1337704 - RNA, 21 nt, Human
ucaggcauaauggcucaugcc

SEQ ID NO: 1337705 - RNA, 26 nt, Human
uccauccuggacaacagaacgagacc

SEQ ID NO: 1337706 - RNA, 22 nt, Human
ucccaucuuaaaauauucaaca

SEQ ID NO: 1337707 - RNA, 18 nt, Human
uccgggaggcggagguug

SEQ ID NO: 1337708 - RNA, 25 nt, Human
uccuccagccuggguaacaggagug

SEQ ID NO: 1337709 - RNA, 24 nt, Human
ucgccugaauccgggaggcggagg

SEQ ID NO: 1337710 - RNA, 24 nt, Human
ucgggaggcugaggcaugagaauc

SEQ ID NO: 1337711 - RNA, 19 nt, Human
ucuccaaaaaaaggaugaa

SEQ ID NO: 1337712 - RNA, 22 nt, Human
ugaaaaccaaaucuuuucuucc

SEQ ID NO: 1337713 - RNA, 23 nt, Human
ugaaaaccaaaucuuuucuuccu

SEQ ID NO: 1337714 - RNA, 22 nt, Human
ugaaaauacaaaauuagccggg

SEQ ID NO: 1337715 - RNA, 23 nt, Human
ugaaaauacaaaauuagccgggc

SEQ ID NO: 1337716 - RNA, 18 nt, Human
ugaagugggaggauugcu

SEQ ID NO: 1337717 - RNA, 24 nt, Human
ugaagugggaggauugcucgagcc

SEQ ID NO: 1337718 - RNA, 19 nt, Human
ugcaggagggugaaguggg

SEQ ID NO: 1337719 - RNA, 23 nt, Human
ugccuguaaucugagcuacucgg

SEQ ID NO: 1337720 - RNA, 24 nt, Human
ugccuguaaucugagcuacucggg

SEQ ID NO: 1337721 - RNA, 24 nt, Human
ugccuguaguccuagcuaugcagg

SEQ ID NO: 1337722 - RNA, 22 nt, Human
uggaagaaacaggaugacaguc

SEQ ID NO: 1337723 - RNA, 22 nt, Human
uggaaggccaaggugggaggau

SEQ ID NO: 1337724 - RNA, 20 nt, Human
uggcacaugccuguaaucug

SEQ ID NO: 1337725 - RNA, 21 nt, Human
uggcucaugccuauaauccca

SEQ ID NO: 1337726 - RNA, 24 nt, Human
uggcucaugccuauaaucccagug

SEQ ID NO: 1337727 - RNA, 24 nt, Human
ugggaggccgaggcgaacagauca

SEQ ID NO: 1337728 - RNA, 25 nt, Human
uggguuuucugucaaugaacaauuu

SEQ ID NO: 1337729 - RNA, 22 nt, Human
uggugccacaugccuguagucc

SEQ ID NO: 1337730 - RNA, 21 nt, Human
ugguggcacaugccuguaauc

SEQ ID NO: 1337731 - RNA, 19 nt, Human
ugguuaaggaaggaaaacu

SEQ ID NO: 1337732 - RNA, 22 nt, Human
ugguucacgccuguaaucccag

SEQ ID NO: 1337733 - RNA, 24 nt, Human
ugguucacgccuguaaucccagca

SEQ ID NO: 1337734 - RNA, 18 nt, Human
uuagccgggcgugguggc

SEQ ID NO: 1337735 - RNA, 20 nt, Human
uuagccgggcgugguggcac

SEQ ID NO: 1337736 - RNA, 24 nt, Human
uuagccgggcgugguggcacaugc

SEQ ID NO: 1337737 - RNA, 23 nt, Human
uuagcgggcauggugccacaugc

SEQ ID NO: 1337738 - RNA, 23 nt, Human
uucaugaaaucagagaauaugga

SEQ ID NO: 1337739 - RNA, 24 nt, Human
uugcucgagccugggagacuacgg

SEQ ID NO: 1337740 - RNA, 21 nt, Human
uugcuugaguccaggaguuug

SEQ ID NO: 1337741 - RNA, 25 nt, Human
uugggaggccgaggcgaacagauca

SEQ ID NO: 1337742 - RNA, 18 nt, Human
uuguaaguuauacauuuu

SEQ ID NO: 1337743 - RNA, 20 nt, Human
uuguggugacccgagaucac

SEQ ID NO: 1337744 - RNA, 22 nt, Human
uuuucugucaaugaacaauuug

SEQ ID NO: 1337745 - RNA, 21 nt, Human
aaaaugccuuuacuaauuucu

SEQ ID NO: 1337746 - RNA, 22 nt, Human
aaacggcaggcuggguuacuca

SEQ ID NO: 1337747 - RNA, 21 nt, Human
aaauaacucccuugcaagaua

SEQ ID NO: 1337748 - RNA, 22 nt, Human
acaucaaauauccccauacagu

SEQ ID NO: 1337749 - RNA, 18 nt, Human
acuacaguaccacacguu

SEQ ID NO: 1337750 - RNA, 20 nt, Human
agcacaggugggacugggag

SEQ ID NO: 1337751 - RNA, 20 nt, Human
agcuuugucauuuuucaaac

SEQ ID NO: 1337752 - RNA, 22 nt, Human
aggaguaacaaaggaacuagga

SEQ ID NO: 1337753 - RNA, 19 nt, Human
aguaacaaaggaacuagga

SEQ ID NO: 1337754 - RNA, 27 nt, Human
aguuccaucagaguacuaguaauccua

SEQ ID NO: 1337755 - RNA, 19 nt, Human
aucaaauauccccauacag

SEQ ID NO: 1337756 - RNA, 24 nt, Human
auccccauacaguuuggguuccac

SEQ ID NO: 1337757 - RNA, 24 nt, Human
auccucccagguauaccccuauua

SEQ ID NO: 1337758 - RNA, 23 nt, Human
caaauauuaagagcacauaauua

SEQ ID NO: 1337759 - RNA, 22 nt, Human
cacgccgccgccuacugaugcc

SEQ ID NO: 1337760 - RNA, 18 nt, Human
cagcacaggugggacugg

SEQ ID NO: 1337761 - RNA, 18 nt, Human
caguuuggguuccacagc

SEQ ID NO: 1337762 - RNA, 22 nt, Human
ccacgcugccagaccccacgcc

SEQ ID NO: 1337763 - RNA, 22 nt, Human
ccccacgccgccgccuacugau

SEQ ID NO: 1337764 - RNA, 18 nt, Human
ccccacgcugccagaccc

SEQ ID NO: 1337765 - RNA, 19 nt, Human
ccucccgcucccacuuccc

SEQ ID NO: 1337766 - RNA, 22 nt, Human
ccugcacugaggaaccugagaa

SEQ ID NO: 1337767 - RNA, 23 nt, Human
cgcccaguucuucucggugcuca

SEQ ID NO: 1337768 - RNA, 22 nt, Human
cucacaggaguaacaaaggaac

SEQ ID NO: 1337769 - RNA, 19 nt, Human
cuccuuuuccccuuuuuau

SEQ ID NO: 1337770 - RNA, 24 nt, Human
cucucacauacaaacggcaggcug

SEQ ID NO: 1337771 - RNA, 22 nt, Human
cugaaaacaucaaauaucccca

SEQ ID NO: 1337772 - RNA, 20 nt, Human
gaaaacaucaaauaucccca

SEQ ID NO: 1337773 - RNA, 23 nt, Human
gaaaacaucaaauauccccauac

SEQ ID NO: 1337774 - RNA, 19 nt, Human
gaccauauuuucuuccucu

SEQ ID NO: 1337775 - RNA, 22 nt, Human
gcucccacuucccaacacgaag

SEQ ID NO: 1337776 - RNA, 22 nt, Human
ggaaaaaaaaagaaaaaaaugc

SEQ ID NO: 1337777 - RNA, 21 nt, Human
ggcccucccgcucccacuucc

SEQ ID NO: 1337778 - RNA, 18 nt, Human
gucuuugcuuauuuucau

SEQ ID NO: 1337779 - RNA, 19 nt, Human
uaaaagauaaaguuucuuc

SEQ ID NO: 1337780 - RNA, 18 nt, Human
uaaguacuaaacagucug

SEQ ID NO: 1337781 - RNA, 18 nt, Human
uagcuuaaaaaaaggaua

SEQ ID NO: 1337782 - RNA, 24 nt, Human
uaguuccaucagaguacuaguaau

SEQ ID NO: 1337783 - RNA, 21 nt, Human
ucacaggaguaacaaaggaac

SEQ ID NO: 1337784 - RNA, 19 nt, Human
uccaucagaguacuaguaa

SEQ ID NO: 1337785 - RNA, 22 nt, Human
ucccaacacgaaguggcgucgg

SEQ ID NO: 1337786 - RNA, 18 nt, Human
ucucacauacaaacggca

SEQ ID NO: 1337787 - RNA, 20 nt, Human
ugaaaacaucaaauaucccc

SEQ ID NO: 1337788 - RNA, 21 nt, Human
ugaaaacaucaaauaucccca

SEQ ID NO: 1337789 - RNA, 25 nt, Human
ugagaaggguaaguacuaaacagug

SEQ ID NO: 1337790 - RNA, 19 nt, Human
ugaggaaccugagaagggu

SEQ ID NO: 1337791 - RNA, 18 nt, Human
ugaggaauagguuuguga

SEQ ID NO: 1337792 - RNA, 19 nt, Human
ugcagaaaaacaucucagg

SEQ ID NO: 1337793 - RNA, 23 nt, Human
uggaccauauuuucuuccucuuu

SEQ ID NO: 1337794 - RNA, 21 nt, Human
uguaguuucauuagcuuaaaa

SEQ ID NO: 1337795 - RNA, 24 nt, Human
uguggucuuugcuuauuuucauga

SEQ ID NO: 1337796 - RNA, 24 nt, Human
uuaguuaugcaggauuuacauuua

SEQ ID NO: 1337797 - RNA, 21 nt, Human
uugcccggcccucccgcuccc

SEQ ID NO: 1337798 - RNA, 20 nt, Human
uugucauuuuucaaaccugu

SEQ ID NO: 1337799 - RNA, 21 nt, Human
uuugucauuuuucaaaccugu

SEQ ID NO: 1337800 - RNA, 25 nt, Human
uuuuuuuuucuccuuuuccccuuuu

SEQ ID NO: 1337801 - RNA, 18 nt, Human
aaaaauauauacacccuc

SEQ ID NO: 1337802 - RNA, 24 nt, Human
aaagguaauaaaggccuugccaga

SEQ ID NO: 1337803 - RNA, 19 nt, Human
aaaguacugguguagcucc

SEQ ID NO: 1337804 - RNA, 22 nt, Human
aaaguacugguguagcuccugg

SEQ ID NO: 1337805 - RNA, 21 nt, Human
aaccccucccaccugcugcua

SEQ ID NO: 1337806 - RNA, 22 nt, Human
aagcaccccgcaccauccaggg

SEQ ID NO: 1337807 - RNA, 19 nt, Human
aagcaggagugugggcagc

SEQ ID NO: 1337808 - RNA, 21 nt, Human
aagcugcagggcaacgggagg

SEQ ID NO: 1337809 - RNA, 20 nt, Human
aagguaauaaaggccuugcc

SEQ ID NO: 1337810 - RNA, 18 nt, Human
aauauauacacccucaua

SEQ ID NO: 1337811 - RNA, 23 nt, Human
acacacacacacacacacacaca

SEQ ID NO: 1337812 - RNA, 23 nt, Human
acacacacacacacacacacaca

SEQ ID NO: 1337813 - RNA, 23 nt, Human
acacacacacacacacacacaca

SEQ ID NO: 1337814 - RNA, 24 nt, Human
acacacacacacacacacacacag

SEQ ID NO: 1337815 - RNA, 23 nt, Human
acacacacacacacacacacacg

SEQ ID NO: 1337816 - RNA, 30 nt, Human
acacacacacacacacacacacggcaacau

SEQ ID NO: 1337817 - RNA, 21 nt, Human
acacacacacacacacacggc

SEQ ID NO: 1337818 - RNA, 19 nt, Human
accccuccccagcacacac

SEQ ID NO: 1337819 - RNA, 22 nt, Human
accccuccccagcacacacaac

SEQ ID NO: 1337820 - RNA, 22 nt, Human
acuuuaucggcuucuucuccac

SEQ ID NO: 1337821 - RNA, 31 nt, Human
agaagacacacacacacacacacacacacag

SEQ ID NO: 1337822 - RNA, 22 nt, Human
agaugucagauguugguugaga

SEQ ID NO: 1337823 - RNA, 21 nt, Human
agcagcugcuuuugcuacggc

SEQ ID NO: 1337824 - RNA, 18 nt, Human
agcagggagggggcaggg

SEQ ID NO: 1337825 - RNA, 22 nt, Human
agcaguagcagggagggggcag

SEQ ID NO: 1337826 - RNA, 19 nt, Human
agccaagacugggccagug

SEQ ID NO: 1337827 - RNA, 21 nt, Human
agcugaggccuguguuucccu

SEQ ID NO: 1337828 - RNA, 26 nt, Human
aggagcaauggggaggggacuucagc

SEQ ID NO: 1337829 - RNA, 21 nt, Human
aggagcugagcagggagugug

SEQ ID NO: 1337830 - RNA, 23 nt, Human
aggcagggggaggguccucuagg

SEQ ID NO: 1337831 - RNA, 20 nt, Human
aggccugagugggggacugc

SEQ ID NO: 1337832 - RNA, 22 nt, Human
aggcugggaagccaggggcugc

SEQ ID NO: 1337833 - RNA, 19 nt, Human
agggagcagaagggggccc

SEQ ID NO: 1337834 - RNA, 24 nt, Human
agggagcagaagggggcccauggg

SEQ ID NO: 1337835 - RNA, 18 nt, Human
aggggcugcagggagagg

SEQ ID NO: 1337836 - RNA, 18 nt, Human
aggggucaggaggaaggc

SEQ ID NO: 1337837 - RNA, 23 nt, Human
agggugguggcagcuggaguucc

SEQ ID NO: 1337838 - RNA, 21 nt, Human
aucagcaguagcagggagggg

SEQ ID NO: 1337839 - RNA, 21 nt, Human
augggagagggagggaguaaa

SEQ ID NO: 1337840 - RNA, 18 nt, Human
caagacagaagggugagc

SEQ ID NO: 1337841 - RNA, 24 nt, Human
cacaaucccacucugcaagacaga

SEQ ID NO: 1337842 - RNA, 20 nt, Human
cacacaacauccacccucaa

SEQ ID NO: 1337843 - RNA, 25 nt, Human
cacacaacauccacccucaauuacc

SEQ ID NO: 1337844 - RNA, 19 nt, Human
cacacacaacauccacccu

SEQ ID NO: 1337845 - RNA, 20 nt, Human
cacacacacacacacacaca

SEQ ID NO: 1337846 - RNA, 20 nt, Human
cacacacacacacacacaca

SEQ ID NO: 1337847 - RNA, 20 nt, Human
cacacacacacacacacaca

SEQ ID NO: 1337848 - RNA, 20 nt, Human
cacacacacacacacacaca

SEQ ID NO: 1337849 - RNA, 20 nt, Human
cacacacacacacacacaca

SEQ ID NO: 1337850 - RNA, 20 nt, Human
cacacacacacacacacaca

SEQ ID NO: 1337851 - RNA, 20 nt, Human
cacacacacacacacacaca

SEQ ID NO: 1337852 - RNA, 20 nt, Human
cacacacacacacacacaca

SEQ ID NO: 1337853 - RNA, 20 nt, Human
cacacacacacacacacaca

SEQ ID NO: 1337854 - RNA, 20 nt, Human
cacacacacacacacacaca

SEQ ID NO: 1337855 - RNA, 20 nt, Human
cacacacacacacacacaca

SEQ ID NO: 1337856 - RNA, 20 nt, Human
cacacacacacacacacaca

SEQ ID NO: 1337857 - RNA, 22 nt, Human
cacacacacacacacacacaca

SEQ ID NO: 1337858 - RNA, 22 nt, Human
cacacacacacacacacacaca

SEQ ID NO: 1337859 - RNA, 22 nt, Human
cacacacacacacacacacaca

SEQ ID NO: 1337860 - RNA, 22 nt, Human
cacacacacacacacacacaca

SEQ ID NO: 1337861 - RNA, 22 nt, Human
cacacacacacacacacacaca

SEQ ID NO: 1337862 - RNA, 22 nt, Human
cacacacacacacacacacaca

SEQ ID NO: 1337863 - RNA, 22 nt, Human
cacacacacacacacacacaca

SEQ ID NO: 1337864 - RNA, 22 nt, Human
cacacacacacacacacacaca

SEQ ID NO: 1337865 - RNA, 26 nt, Human
cacacacacacacacacacacacaca

SEQ ID NO: 1337866 - RNA, 26 nt, Human
cacacacacacacacacacacacaca

SEQ ID NO: 1337867 - RNA, 26 nt, Human
cacacacacacacacacacacacaca

SEQ ID NO: 1337868 - RNA, 26 nt, Human
cacacacacacacacacacacacaca

SEQ ID NO: 1337869 - RNA, 26 nt, Human
cacacacacacacacacacacacaca

SEQ ID NO: 1337870 - RNA, 26 nt, Human
cacacacacacacacacacacacaca

SEQ ID NO: 1337871 - RNA, 26 nt, Human
cacacacacacacacacacacacaca

SEQ ID NO: 1337872 - RNA, 26 nt, Human
cacacacacacacacacacacacaca

SEQ ID NO: 1337873 - RNA, 26 nt, Human
cacacacacacacacacacacacggc

SEQ ID NO: 1337874 - RNA, 19 nt, Human
cacacggcaacauaauauu

SEQ ID NO: 1337875 - RNA, 26 nt, Human
caccaaacagaaggaccccuccccag

SEQ ID NO: 1337876 - RNA, 19 nt, Human
caccauccaggggcagagu

SEQ ID NO: 1337877 - RNA, 19 nt, Human
caccccucaggccuugagg

SEQ ID NO: 1337878 - RNA, 24 nt, Human
cagaaagaagggugagucugugcc

SEQ ID NO: 1337879 - RNA, 23 nt, Human
cagaagggggcccaugggacacu

SEQ ID NO: 1337880 - RNA, 23 nt, Human
cagagcccaucccuggaccuucc

SEQ ID NO: 1337881 - RNA, 18 nt, Human
cagagggugguggcagcu

SEQ ID NO: 1337882 - RNA, 22 nt, Human
cagcacacacaacauccacccu

SEQ ID NO: 1337883 - RNA, 19 nt, Human
cagcagacaacccuagcuc

SEQ ID NO: 1337884 - RNA, 21 nt, Human
cagcagacaacccuagcuccu

SEQ ID NO: 1337885 - RNA, 22 nt, Human
cagcagacaacccuagcuccug

SEQ ID NO: 1337886 - RNA, 21 nt, Human
cagcagccaagacugggccag

SEQ ID NO: 1337887 - RNA, 21 nt, Human
cagcagccaagacugggccag

SEQ ID NO: 1337888 - RNA, 19 nt, Human
cagcaguagcagggagggg

SEQ ID NO: 1337889 - RNA, 23 nt, Human
cagcaguagcagggagggggcag

SEQ ID NO: 1337890 - RNA, 18 nt, Human
cagcauucuuuccugcug

SEQ ID NO: 1337891 - RNA, 19 nt, Human
caggggcagaguagacaag

SEQ ID NO: 1337892 - RNA, 22 nt, Human
caguagcagggagggggcaggg

SEQ ID NO: 1337893 - RNA, 25 nt, Human
ccaaacagaaggaccccuccccagc

SEQ ID NO: 1337894 - RNA, 19 nt, Human
ccacccagcgguuucugca

SEQ ID NO: 1337895 - RNA, 22 nt, Human
ccaggagccccugcaccccuca

SEQ ID NO: 1337896 - RNA, 23 nt, Human
ccaguggcgccuuuacagucucu

SEQ ID NO: 1337897 - RNA, 22 nt, Human
cccaaaaagcaccuuggcucac

SEQ ID NO: 1337898 - RNA, 23 nt, Human
cccaaaaagcaccuuggcucaca

SEQ ID NO: 1337899 - RNA, 19 nt, Human
cccacaaucccacucugca

SEQ ID NO: 1337900 - RNA, 24 nt, Human
cccaccugcugcuacucccugccc

SEQ ID NO: 1337901 - RNA, 22 nt, Human
ccccaaaaagcaccuuggcuca

SEQ ID NO: 1337902 - RNA, 19 nt, Human
ccccugcaccccucaggcc

SEQ ID NO: 1337903 - RNA, 23 nt, Human
cccucaauuaccagaugcacucc

SEQ ID NO: 1337904 - RNA, 23 nt, Human
ccucauagcaggagcagcagcug

SEQ ID NO: 1337905 - RNA, 21 nt, Human
cgcaccauccaggggcagagu

SEQ ID NO: 1337906 - RNA, 23 nt, Human
cggagaccauguuguugguguca

SEQ ID NO: 1337907 - RNA, 21 nt, Human
cuccacgggaaagaugucaac

SEQ ID NO: 1337908 - RNA, 26 nt, Human
cuccccagcacacacaacauccaccc

SEQ ID NO: 1337909 - RNA, 18 nt, Human
cugaggcggcgcugucuc

SEQ ID NO: 1337910 - RNA, 21 nt, Human
cugauacugcucuacccgagc

SEQ ID NO: 1337911 - RNA, 20 nt, Human
cuggcgggucugacuggagc

SEQ ID NO: 1337912 - RNA, 24 nt, Human
gacaaagggagagucuaagagaga

SEQ ID NO: 1337913 - RNA, 18 nt, Human
gacacugucagggcaaga

SEQ ID NO: 1337914 - RNA, 20 nt, Human
gacagaagggugagcagcau

SEQ ID NO: 1337915 - RNA, 18 nt, Human
gagcagggaguguggggg

SEQ ID NO: 1337916 - RNA, 24 nt, Human
gagggugguggcagcuggaguucc

SEQ ID NO: 1337917 - RNA, 18 nt, Human
gcaaagugcuugagugcc

SEQ ID NO: 1337918 - RNA, 18 nt, Human
gcaacgggagggggcugg

SEQ ID NO: 1337919 - RNA, 26 nt, Human
gcaagaaggcaugggaccuccccugg

SEQ ID NO: 1337920 - RNA, 19 nt, Human
gcaccaaacagaaggaccc

SEQ ID NO: 1337921 - RNA, 18 nt, Human
gccugggcaugcagggca

SEQ ID NO: 1337922 - RNA, 19 nt, Human
gcugggggucccugggcag

SEQ ID NO: 1337923 - RNA, 18 nt, Human
gcuugaaggagcaauggg

SEQ ID NO: 1337924 - RNA, 18 nt, Human
ggaggaagagagaauggg

SEQ ID NO: 1337925 - RNA, 23 nt, Human
ggaggacaaagggagagucuaag

SEQ ID NO: 1337926 - RNA, 20 nt, Human
ggagggggcagggagcagaa

SEQ ID NO: 1337927 - RNA, 19 nt, Human
ggagggggcuggggguccc

SEQ ID NO: 1337928 - RNA, 19 nt, Human
ggcaacgggagggggcugg

SEQ ID NO: 1337929 - RNA, 18 nt, Human
ggcaugggacacagcacc

SEQ ID NO: 1337930 - RNA, 19 nt, Human
ggcugcagggagaggacag

SEQ ID NO: 1337931 - RNA, 20 nt, Human
ggcugcagggagaggacagg

SEQ ID NO: 1337932 - RNA, 21 nt, Human
gggaaagaguggugccagaaa

SEQ ID NO: 1337933 - RNA, 20 nt, Human
gggcagaguagacaagggua

SEQ ID NO: 1337934 - RNA, 19 nt, Human
gggcagcacgaggagcuga

SEQ ID NO: 1337935 - RNA, 22 nt, Human
gggcccaugggacacugucagg

SEQ ID NO: 1337936 - RNA, 23 nt, Human
ggguagcaccaaacagaaggacc

SEQ ID NO: 1337937 - RNA, 19 nt, Human
ggugaugggagagggaggg

SEQ ID NO: 1337938 - RNA, 20 nt, Human
ggugaugggagagggaggga

SEQ ID NO: 1337939 - RNA, 23 nt, Human
gucucugccaucccccuccccca

SEQ ID NO: 1337940 - RNA, 26 nt, Human
uaaaaaauauauacacccucauagca

SEQ ID NO: 1337941 - RNA, 31 nt, Human
uaaaagaagacacacacacacacacacacag

SEQ ID NO: 1337942 - RNA, 19 nt, Human
uaaccccucccaccugcug

SEQ ID NO: 1337943 - RNA, 20 nt, Human
uaagagagagggacggagac

SEQ ID NO: 1337944 - RNA, 20 nt, Human
uacagucucugccauccccc

SEQ ID NO: 1337945 - RNA, 21 nt, Human
uaccagaugcacuccugcucc

SEQ ID NO: 1337946 - RNA, 21 nt, Human
uagcaccaaacagaaggaccc

SEQ ID NO: 1337947 - RNA, 19 nt, Human
uagcagggagggggcaggg

SEQ ID NO: 1337948 - RNA, 23 nt, Human
uagcagggagggggcagggagca

SEQ ID NO: 1337949 - RNA, 23 nt, Human
uagcuccugauacugcucuaccc

SEQ ID NO: 1337950 - RNA, 25 nt, Human
uauagggauccaccccaccccagcu

SEQ ID NO: 1337951 - RNA, 24 nt, Human
uccacccagcgguuucugcaauga

SEQ ID NO: 1337952 - RNA, 21 nt, Human
ucccaccugcugcuacucccc

SEQ ID NO: 1337953 - RNA, 18 nt, Human
ucccaguguccgacccag

SEQ ID NO: 1337954 - RNA, 22 nt, Human
ucccccucccccacuuuggggc

SEQ ID NO: 1337955 - RNA, 22 nt, Human
ucccguggagcaggaaguugcu

SEQ ID NO: 1337956 - RNA, 19 nt, Human
uccugggggucccagcccu

SEQ ID NO: 1337957 - RNA, 23 nt, Human
uccugggggucccagcccugacc

SEQ ID NO: 1337958 - RNA, 21 nt, Human
ucuauggggaggacaaaggga

SEQ ID NO: 1337959 - RNA, 22 nt, Human
ugaacagacuuauggguccagg

SEQ ID NO: 1337960 - RNA, 20 nt, Human
ugagcaucuuuuacccucuc

SEQ ID NO: 1337961 - RNA, 18 nt, Human
ugagugccaggugcccaa

SEQ ID NO: 1337962 - RNA, 22 nt, Human
ugagugggggacuugcaagggc

SEQ ID NO: 1337963 - RNA, 22 nt, Human
ugcaagacagaagggugagcag

SEQ ID NO: 1337964 - RNA, 19 nt, Human
ugccagaaagaagggugag

SEQ ID NO: 1337965 - RNA, 22 nt, Human
ugccagaaagaagggugagucu

SEQ ID NO: 1337966 - RNA, 21 nt, Human
ugccaggagccccugcacccc

SEQ ID NO: 1337967 - RNA, 21 nt, Human
ugccccaguauagggauccac

SEQ ID NO: 1337968 - RNA, 19 nt, Human
ugccugccccaguauaggg

SEQ ID NO: 1337969 - RNA, 21 nt, Human
uggacaggugguggagaagaa

SEQ ID NO: 1337970 - RNA, 24 nt, Human
uggacaggugguggagaagaaggc

SEQ ID NO: 1337971 - RNA, 20 nt, Human
uggcuugaaggagcaauggg

SEQ ID NO: 1337972 - RNA, 20 nt, Human
ugggaggacauagaggaagg

SEQ ID NO: 1337973 - RNA, 21 nt, Human
ugggcagcagacaacccuagc

SEQ ID NO: 1337974 - RNA, 20 nt, Human
ugggggacuugcaagggcug

SEQ ID NO: 1337975 - RNA, 24 nt, Human
uggugccagaaagaagggugaguc

SEQ ID NO: 1337976 - RNA, 24 nt, Human
uguccauagaggauuuuugcugca

SEQ ID NO: 1337977 - RNA, 20 nt, Human
uugaaggagcaauggggagg

SEQ ID NO: 1337978 - RNA, 20 nt, Human
uuucccguggagcaggaagu

SEQ ID NO: 1337979 - RNA, 20 nt, Human
acacgccacauaacauaaaa

SEQ ID NO: 1337980 - RNA, 25 nt, Human
auaucgauagacucgagacuggcac

SEQ ID NO: 1337981 - RNA, 25 nt, Human
auggaagacagcaucguuucugaca

SEQ ID NO: 1337982 - RNA, 23 nt, Human
cauaaaacccucgugccgaauuc

SEQ ID NO: 1337983 - RNA, 26 nt, Human
cauaucgauagacucgagacuggcac

SEQ ID NO: 1337984 - RNA, 23 nt, Human
caucuggagauccguauuuaucc

SEQ ID NO: 1337985 - RNA, 24 nt, Human
guauuuauccggcuuccccuucca

SEQ ID NO: 1337986 - RNA, 20 nt, Human
uagacaucuaacacuauuua

SEQ ID NO: 1337987 - RNA, 26 nt, Human
uauuacaacaauuucaucgcauggaa

SEQ ID NO: 1337988 - RNA, 23 nt, Human
ugaauagaaacucuagggggacc

SEQ ID NO: 1337989 - RNA, 27 nt, Human
uggagcacugcaccucuauuuuuuuuu

SEQ ID NO: 1337990 - RNA, 22 nt, Human
aaaaaaaaaaaacaggagagga

SEQ ID NO: 1337991 - RNA, 19 nt, Human
aaaaaaaacaggagaggag

SEQ ID NO: 1337992 - RNA, 23 nt, Human
aaaaaacaaaaacaaacaacccc

SEQ ID NO: 1337993 - RNA, 19 nt, Human
aaaaacagcaggaccaaaa

SEQ ID NO: 1337994 - RNA, 21 nt, Human
aaaacaaaaacaaacaacccc

SEQ ID NO: 1337995 - RNA, 25 nt, Human
aaaacaaaaacaaacaaccccccaa

SEQ ID NO: 1337996 - RNA, 26 nt, Human
aaacaaaaacaaacaaccccccaaag

SEQ ID NO: 1337997 - RNA, 24 nt, Human
aaacagcaggaccaaaauugagca

SEQ ID NO: 1337998 - RNA, 19 nt, Human
aaacaggagaggagggagg

SEQ ID NO: 1337999 - RNA, 19 nt, Human
aaagcaaaaaacaaaaaca

SEQ ID NO: 1338000 - RNA, 28 nt, Human
aaagcaaaaaacaaaaacaaagggaccc

SEQ ID NO: 1338001 - RNA, 23 nt, Human
aagcaaaaaacaaaaacaaacaa

SEQ ID NO: 1338002 - RNA, 24 nt, Human
aagcacacaccaaaugcuguacaa

SEQ ID NO: 1338003 - RNA, 22 nt, Human
aaguggugucucccacagugcc

SEQ ID NO: 1338004 - RNA, 18 nt, Human
aauuagccaggcauggug

SEQ ID NO: 1338005 - RNA, 21 nt, Human
aauucuugcucuacuuaggaa

SEQ ID NO: 1338006 - RNA, 20 nt, Human
aauugcuugaacccaggagg

SEQ ID NO: 1338007 - RNA, 24 nt, Human
aauugcuugaacccaggaggcaga

SEQ ID NO: 1338008 - RNA, 23 nt, Human
acaaaaggcucaucaaaaacagc

SEQ ID NO: 1338009 - RNA, 23 nt, Human
acaaaccaggacaaggaaacaca

SEQ ID NO: 1338010 - RNA, 23 nt, Human
acacaaaccaggacaaggaaaca

SEQ ID NO: 1338011 - RNA, 33 nt, Human
acacacaaacacacacacacacacacacacagu

SEQ ID NO: 1338012 - RNA, 33 nt, Human
acacacacaaacacacacacacacacacacagu

SEQ ID NO: 1338013 - RNA, 28 nt, Human
acacacacacacaaacacacacacacac

SEQ ID NO: 1338014 - RNA, 31 nt, Human; identical to SEQ ID NO: 755644

SEQ ID NO: 1338015 - RNA, 25 nt, Human
acacacacacacacacacaaaccag

SEQ ID NO: 1338016 - RNA, 23 nt, Human
acacacacacacacacacacaca

SEQ ID NO: 1338017 - RNA, 23 nt, Human
acacacacacacacacacacaca

SEQ ID NO: 1338018 - RNA, 23 nt, Human
acacacacacacacacacacaca

SEQ ID NO: 1338019 - RNA, 23 nt, Human
acacacacacacacacacacaca

SEQ ID NO: 1338020 - RNA, 23 nt, Human
acacacacacacacacacacaca

SEQ ID NO: 1338021 - RNA, 25 nt, Human
acacacacacacacacacacacaaa

SEQ ID NO: 1338022 - RNA, 20 nt, Human
acacagauccccucccgccc

SEQ ID NO: 1338023 - RNA, 25 nt, Human
acaccgccaggacacacgacuccag

SEQ ID NO: 1338024 - RNA, 18 nt, Human
acacgacuccagggagcu

SEQ ID NO: 1338025 - RNA, 20 nt, Human
acacugaauaacaaagggaa

SEQ ID NO: 1338026 - RNA, 21 nt, Human
acagacacacacacacaaaca

SEQ ID NO: 1338027 - RNA, 18 nt, Human
acagugacacagaucccc

SEQ ID NO: 1338028 - RNA, 26 nt, Human
acauuuugguuaaagcaaaaaacaaa

SEQ ID NO: 1338029 - RNA, 18 nt, Human
accaaaugcuguacaaau

SEQ ID NO: 1338030 - RNA, 24 nt, Human
accaacauggagaaacccugucuc

SEQ ID NO: 1338031 - RNA, 19 nt, Human
accaggacaaggaaacaca

SEQ ID NO: 1338032 - RNA, 24 nt, Human
acccaggaggcagagguuguggug

SEQ ID NO: 1338033 - RNA, 24 nt, Human
acccugucucuacuaaaaacacaa

SEQ ID NO: 1338034 - RNA, 22 nt, Human
acuucacccagccuuccugggc

SEQ ID NO: 1338035 - RNA, 18 nt, Human
acuuuguauucaggccua

SEQ ID NO: 1338036 - RNA, 22 nt, Human
agaauugcuugaacccaggagg

SEQ ID NO: 1338037 - RNA, 18 nt, Human
agacacacacacacaaac

SEQ ID NO: 1338038 - RNA, 19 nt, Human
agacacacacacacaaaca

SEQ ID NO: 1338039 - RNA, 19 nt, Human
agacagacacacacacaca

SEQ ID NO: 1338040 - RNA, 22 nt, Human
agacagacacacacacacaaac

SEQ ID NO: 1338041 - RNA, 24 nt, Human
agagguuguggugagccaagaucg

SEQ ID NO: 1338042 - RNA, 22 nt, Human
agaucaccugagguugggaguu

SEQ ID NO: 1338043 - RNA, 23 nt, Human
agaucaccugagguugggaguuu

SEQ ID NO: 1338044 - RNA, 22 nt, Human
agcaaaaaacaaaaacaaacaa

SEQ ID NO: 1338045 - RNA, 23 nt, Human
agccaggcaugguggcaugcgcc

SEQ ID NO: 1338046 - RNA, 19 nt, Human
aggacagauggggauaauu

SEQ ID NO: 1338047 - RNA, 19 nt, Human
aggagggagggagagaccu

SEQ ID NO: 1338048 - RNA, 26 nt, Human
aggagggcagaucaccugagguuggg

SEQ ID NO: 1338049 - RNA, 24 nt, Human
aggcagagguuguggugagccaag

SEQ ID NO: 1338050 - RNA, 23 nt, Human
aggcaggagaauugcuugaaccc

SEQ ID NO: 1338051 - RNA, 24 nt, Human
aggcaggagaauugcuugaaccca

SEQ ID NO: 1338052 - RNA, 24 nt, Human
aggcaugguggcaugcgccuauaa

SEQ ID NO: 1338053 - RNA, 20 nt, Human
aggcucaucaaaaacagcag

SEQ ID NO: 1338054 - RNA, 21 nt, Human
aggcugaggcaggagaauugc

SEQ ID NO: 1338055 - RNA, 24 nt, Human
aggcugaggcaggagaauugcuug

SEQ ID NO: 1338056 - RNA, 19 nt, Human
agggaagagaggaguaaga

SEQ ID NO: 1338057 - RNA, 21 nt, Human
agggagagaccuucacugaua

SEQ ID NO: 1338058 - RNA, 23 nt, Human
aguggcucccccuguaaucccag

SEQ ID NO: 1338059 - RNA, 24 nt, Human
auagacagacacacacacacaaac

SEQ ID NO: 1338060 - RNA, 18 nt, Human
aucacacuccagccuggg

SEQ ID NO: 1338061 - RNA, 20 nt, Human
aucaccugagguugggaguu

SEQ ID NO: 1338062 - RNA, 22 nt, Human
aucccagcacucugggaggcca

SEQ ID NO: 1338063 - RNA, 22 nt, Human
augcugagugcagccgcccagc

SEQ ID NO: 1338064 - RNA, 20 nt, Human
caaaaaaaaaaaacaggaga

SEQ ID NO: 1338065 - RNA, 23 nt, Human
caaaaaacaaaaacaaacaaccc

SEQ ID NO: 1338066 - RNA, 20 nt, Human
caaaauagacagacacacac

SEQ ID NO: 1338067 - RNA, 21 nt, Human
caaaauagacagacacacaca

SEQ ID NO: 1338068 - RNA, 18 nt, Human
caaacaaccccccaaagg

SEQ ID NO: 1338069 - RNA, 20 nt, Human
caaaggucacuggcuuggcu

SEQ ID NO: 1338070 - RNA, 24 nt, Human
caacauggagaaacccugucucua

SEQ ID NO: 1338071 - RNA, 24 nt, Human
caaggagggcagaucaccugaggu

SEQ ID NO: 1338072 - RNA, 31 nt, Human; identical to SEQ ID NO: 406582

SEQ ID NO: 1338073 - RNA, 23 nt, Human
cacaaaccaggacaaggaaacac

SEQ ID NO: 1338074 - RNA, 19 nt, Human
cacacaaacacacacacac

SEQ ID NO: 1338075 - RNA, 26 nt, Human
cacacacaaacacacacacacacaca

SEQ ID NO: 1338076 - RNA, 28 nt, Human
cacacacaaaccaggacaaggaaacacc

SEQ ID NO: 1338077 - RNA, 21 nt, Human
cacacacacaaaccaggacaa

SEQ ID NO: 1338078 - RNA, 24 nt, Human
cacacacacacaaacacacacaca

SEQ ID NO: 1338079 - RNA, 20 nt, Human
cacacacacacacacacaca

SEQ ID NO: 1338080 - RNA, 20 nt, Human
cacacacacacacacacaca

SEQ ID NO: 1338081 - RNA, 20 nt, Human
cacacacacacacacacaca

SEQ ID NO: 1338082 - RNA, 20 nt, Human
cacacacacacacacacaca

SEQ ID NO: 1338083 - RNA, 20 nt, Human
cacacacacacacacacaca

SEQ ID NO: 1338084 - RNA, 20 nt, Human
cacacacacacacacacaca

SEQ ID NO: 1338085 - RNA, 20 nt, Human
cacacacacacacacacaca

SEQ ID NO: 1338086 - RNA, 20 nt, Human
cacacacacacacacacaca

SEQ ID NO: 1338087 - RNA, 20 nt, Human
cacacacacacacacacaca

SEQ ID NO: 1338088 - RNA, 20 nt, Human
cacacacacacacacacaca

SEQ ID NO: 1338089 - RNA, 22 nt, Human
cacacacacacacacacacaca

SEQ ID NO: 1338090 - RNA, 22 nt, Human
cacacacacacacacacacaca

SEQ ID NO: 1338091 - RNA, 22 nt, Human
cacacacacacacacacacaca

SEQ ID NO: 1338092 - RNA, 22 nt, Human
cacacacacacacacacacaca

SEQ ID NO: 1338093 - RNA, 26 nt, Human
cacacacacacacacacacacacaca

SEQ ID NO: 1338094 - RNA, 26 nt, Human
cacacacacacacacacacacacaca

SEQ ID NO: 1338095 - RNA, 26 nt, Human
cacacacacacacacacacacacaca

SEQ ID NO: 1338096 - RNA, 26 nt, Human
cacacacacacacacacacacacaca

SEQ ID NO: 1338097 - RNA, 26 nt, Human
cacacacacacacacacacacacaca

SEQ ID NO: 1338098 - RNA, 26 nt, Human
cacacacacacacacacacacacaca

SEQ ID NO: 1338099 - RNA, 26 nt, Human
cacacacacacacacacacacacaca

SEQ ID NO: 1338100 - RNA, 22 nt, Human
cacacugaauaacaaagggaag

SEQ ID NO: 1338101 - RNA, 23 nt, Human
cacaguaccuacagugacacaga

SEQ ID NO: 1338102 - RNA, 18 nt, Human
cacagugaaggaaaguga

SEQ ID NO: 1338103 - RNA, 18 nt, Human
cacaguggcucccccugu

SEQ ID NO: 1338104 - RNA, 21 nt, Human
cacccaggaaggggugaugcu

SEQ ID NO: 1338105 - RNA, 24 nt, Human
cacuccagccugggcaacaagagc

SEQ ID NO: 1338106 - RNA, 28 nt, Human
cagacacacacacacaaacacacacaca

SEQ ID NO: 1338107 - RNA, 20 nt, Human
cagcacucugggaggccaag

SEQ ID NO: 1338108 - RNA, 21 nt, Human
cagcacucugggaggccaagg

SEQ ID NO: 1338109 - RNA, 21 nt, Human
cagccgcccagccagcagggu

SEQ ID NO: 1338110 - RNA, 24 nt, Human
cagccugaccaacauggagaaacc

SEQ ID NO: 1338111 - RNA, 22 nt, Human
caggaaggggugaugcugagug

SEQ ID NO: 1338112 - RNA, 24 nt, Human
caggaccaaaauugagcaggcugg

SEQ ID NO: 1338113 - RNA, 24 nt, Human
caguggcucccccuguaaucccag

SEQ ID NO: 1338114 - RNA, 24 nt, Human
caucacacuccagccugggcaaca

SEQ ID NO: 1338115 - RNA, 19 nt, Human
caucuuugaagugaguuca

SEQ ID NO: 1338116 - RNA, 18 nt, Human
ccacccaggaagggguga

SEQ ID NO: 1338117 - RNA, 23 nt, Human
cccaucacacuccagccugggca

SEQ ID NO: 1338118 - RNA, 24 nt, Human
ccccaaaggacgaugguacgugcu

SEQ ID NO: 1338119 - RNA, 19 nt, Human
ccccuguaaucccagcacu

SEQ ID NO: 1338120 - RNA, 24 nt, Human
ccccuguaaucccagcacucuggg

SEQ ID NO: 1338121 - RNA, 22 nt, Human
ccuacagugacacagauccccu

SEQ ID NO: 1338122 - RNA, 18 nt, Human
ccucaaaaaaaaaaaaca

SEQ ID NO: 1338123 - RNA, 21 nt, Human
ccucaaaaaaaaaaaacagga

SEQ ID NO: 1338124 - RNA, 22 nt, Human
ccugaccaacauggagaaaccc

SEQ ID NO: 1338125 - RNA, 24 nt, Human
ccugaccaacauggagaaacccug

SEQ ID NO: 1338126 - RNA, 22 nt, Human
ccugagguugggaguuugagac

SEQ ID NO: 1338127 - RNA, 18 nt, Human
ccugcaauuuagaugggg

SEQ ID NO: 1338128 - RNA, 18 nt, Human
ccuguaaucccagcacuc

SEQ ID NO: 1338129 - RNA, 21 nt, Human
cgccaggacacacgacuccag

SEQ ID NO: 1338130 - RNA, 23 nt, Human
cggcacaguggcucccccuguaa

SEQ ID NO: 1338131 - RNA, 24 nt, Human
cuacuuaggaacuugggccggauc

SEQ ID NO: 1338132 - RNA, 24 nt, Human
cucuacuuaggaacuugggccgga

SEQ ID NO: 1338133 - RNA, 19 nt, Human
cucugccucaaaaaaaaaa

SEQ ID NO: 1338134 - RNA, 25 nt, Human
gaaacagacaaaaggcucaucaaaa

SEQ ID NO: 1338135 - RNA, 21 nt, Human
gaacuguaguaucuagaaauu

SEQ ID NO: 1338136 - RNA, 20 nt, Human
gaaucaucucagauguucuu

SEQ ID NO: 1338137 - RNA, 22 nt, Human
gacaaaaggcucaucaaaaaca

SEQ ID NO: 1338138 - RNA, 28 nt, Human
gacacacacacacaaacacacacacaca

SEQ ID NO: 1338139 - RNA, 24 nt, Human
gagaaacagacaaaaggcucauca

SEQ ID NO: 1338140 - RNA, 21 nt, Human
gagaaacccugucucuacuaa

SEQ ID NO: 1338141 - RNA, 19 nt, Human
gagcccaucacacuccagc

SEQ ID NO: 1338142 - RNA, 21 nt, Human
gaggcugaggcaggagaauug

SEQ ID NO: 1338143 - RNA, 24 nt, Human
gaucaccugagguugggaguuuga

SEQ ID NO: 1338144 - RNA, 19 nt, Human
gcacaguaccuacagugac

SEQ ID NO: 1338145 - RNA, 22 nt, Human
gcaggagaauugcuugaaccca

SEQ ID NO: 1338146 - RNA, 23 nt, Human
gcuuggcuagaugugaaugaggg

SEQ ID NO: 1338147 - RNA, 20 nt, Human
ggaaagagcuccuuuaacaa

SEQ ID NO: 1338148 - RNA, 19 nt, Human
ggaaggagaaacagacaaa

SEQ ID NO: 1338149 - RNA, 22 nt, Human
ggaggcagagguuguggugagc

SEQ ID NO: 1338150 - RNA, 21 nt, Human
ggagggcagaucaccugaggu

SEQ ID NO: 1338151 - RNA, 19 nt, Human
ggaguuugagaccagccug

SEQ ID NO: 1338152 - RNA, 18 nt, Human
ggccaaggagggcagauc

SEQ ID NO: 1338153 - RNA, 26 nt, Human
gggcagaucaccugagguugggaguu

SEQ ID NO: 1338154 - RNA, 19 nt, Human
gguugggaguuugagacca

SEQ ID NO: 1338155 - RNA, 24 nt, Human
gugaguucaaaaggcaaagaggag

SEQ ID NO: 1338156 - RNA, 24 nt, Human
guggcucccccuguaaucccagca

SEQ ID NO: 1338157 - RNA, 21 nt, Human
guucuaaaaaugagguagaga

SEQ ID NO: 1338158 - RNA, 20 nt, Human
uaaaaacacaaaauuagcca

SEQ ID NO: 1338159 - RNA, 22 nt, Human
uaaaaacacaaaauuagccagg

SEQ ID NO: 1338160 - RNA, 23 nt, Human
uaaaaacacaaaauuagccaggc

SEQ ID NO: 1338161 - RNA, 25 nt, Human
uaaagcaaaaaacaaaaacaaacaa

SEQ ID NO: 1338162 - RNA, 21 nt, Human
uaagcacacaccaaaugcugu

SEQ ID NO: 1338163 - RNA, 19 nt, Human
uaccccagcacaaauggga

SEQ ID NO: 1338164 - RNA, 24 nt, Human
uagacagacacacacacacaaaca

SEQ ID NO: 1338165 - RNA, 18 nt, Human
ucaaaaaaaaaaaacagg

SEQ ID NO: 1338166 - RNA, 18 nt, Human
ucaaaaacagcaggacca

SEQ ID NO: 1338167 - RNA, 24 nt, Human
ucaaaauagacagacacacacaca

SEQ ID NO: 1338168 - RNA, 19 nt, Human
ucagcacagugaaggaaag

SEQ ID NO: 1338169 - RNA, 20 nt, Human
uccacaaacccagagggcuc

SEQ ID NO: 1338170 - RNA, 19 nt, Human
uccagggagcuggcuggag

SEQ ID NO: 1338171 - RNA, 21 nt, Human
ucccgcccauccuggucacac

SEQ ID NO: 1338172 - RNA, 21 nt, Human
ucccuacaagauuugcugcuc

SEQ ID NO: 1338173 - RNA, 20 nt, Human
uccuuuaacaauggccucag

SEQ ID NO: 1338174 - RNA, 28 nt, Human
ucucccacagugccaccagagcaaaggu

SEQ ID NO: 1338175 - RNA, 20 nt, Human
ucucuacuaaaaacacaaaa

SEQ ID NO: 1338176 - RNA, 18 nt, Human
ugacacagauccccuccc

SEQ ID NO: 1338177 - RNA, 23 nt, Human
ugacacagauccccucccgcccc

SEQ ID NO: 1338178 - RNA, 24 nt, Human
ugaccaacauggagaaacccuguc

SEQ ID NO: 1338179 - RNA, 24 nt, Human
ugagaccagccugaccaacaugga

SEQ ID NO: 1338180 - RNA, 24 nt, Human
ugaggcaggagaauugcuugaacc

SEQ ID NO: 1338181 - RNA, 25 nt, Human
ugaggcaggagaauugcuugaaccc

SEQ ID NO: 1338182 - RNA, 23 nt, Human
ugagguagagagagacaugccac

SEQ ID NO: 1338183 - RNA, 20 nt, Human
ugccucaaaaaaaaaaaaca

SEQ ID NO: 1338184 - RNA, 25 nt, Human
ugcgugcacguguggguacaaauaa

SEQ ID NO: 1338185 - RNA, 21 nt, Human
uggcucccccuguaaucccag

SEQ ID NO: 1338186 - RNA, 19 nt, Human
uggcuuauaagcacacacc

SEQ ID NO: 1338187 - RNA, 24 nt, Human
ugggaggccaaggagggcagauca

SEQ ID NO: 1338188 - RNA, 23 nt, Human
uggguacaaauaaauguagacag

SEQ ID NO: 1338189 - RNA, 25 nt, Human
uguaagaugaggccuacaucuuuga

SEQ ID NO: 1338190 - RNA, 22 nt, Human
ugugcuccacaaacccagaggg

SEQ ID NO: 1338191 - RNA, 20 nt, Human
uuaaagcaaaaaacaaaaac

SEQ ID NO: 1338192 - RNA, 20 nt, Human
uucaggccuaaaaaaggagg

SEQ ID NO: 1338193 - RNA, 24 nt, Human
uugcuugaacccaggaggcagagg

SEQ ID NO: 1338194 - RNA, 18 nt, Human
uuguggugagccaagauc

SEQ ID NO: 1338195 - RNA, 23 nt, Human
uuuuuuggaacucacauugaaua

SEQ ID NO: 1338196 - RNA, 18 nt, Human
uuuuuuuuuuuuuuuuug

SEQ ID NO: 1338197 - RNA, 18 nt, Human
uuuuuuuuuuuuuuuuug

SEQ ID NO: 1338198 - RNA, 21 nt, Human
aagaacaguaacagucuugac

SEQ ID NO: 1338199 - RNA, 18 nt, Human
aagaauacugaauuagcu

SEQ ID NO: 1338200 - RNA, 19 nt, Human
acagaacagcagaacucga

SEQ ID NO: 1338201 - RNA, 20 nt, Human
auucuggacacaauucugac

SEQ ID NO: 1338202 - RNA, 23 nt, Human
ccagaauggggaagaauacugaa

SEQ ID NO: 1338203 - RNA, 18 nt, Human
cugcaguaaacuccaacc

SEQ ID NO: 1338204 - RNA, 20 nt, Human
gacuugcagcuaaaaaaggc

SEQ ID NO: 1338205 - RNA, 22 nt, Human
gugacagaagagcacacccuac

SEQ ID NO: 1338206 - RNA, 22 nt, Human
uaaaaaaggcaaaaggucugug

SEQ ID NO: 1338207 - RNA, 20 nt, Human
uacagaacagcagaacucga

SEQ ID NO: 1338208 - RNA, 21 nt, Human
uacucugcaguaaacuccaac

SEQ ID NO: 1338209 - RNA, 24 nt, Human
ucgaagaacaguaacagucuugaa

SEQ ID NO: 1338210 - RNA, 19 nt, Human
ugaagugacagaagagcac

SEQ ID NO: 1338211 - RNA, 21 nt, Human
ugaauaaagcacaagccaaga

SEQ ID NO: 1338212 - RNA, 20 nt, Human
ugagcacauucuggacacaa

SEQ ID NO: 1338213 - RNA, 22 nt, Human
ugcagcuaaaaaaggcaaaagg

SEQ ID NO: 1338214 - RNA, 23 nt, Human
ugucaugagcaaggaaucaaagu

SEQ ID NO: 1338215 - RNA, 22 nt, Human
uuggagcagguuucauucucca

SEQ ID NO: 1338216 - RNA, 24 nt, Human
uuuuuuuuuuuuuuuuuuucuuuu

SEQ ID NO: 1338217 - RNA, 27 nt, Human
uuuuuuuuuuuuuuuuuuuucuuuuaa

SEQ ID NO: 1338218 - RNA, 19 nt, Human
aaagcucauucagaagucu

SEQ ID NO: 1338219 - RNA, 19 nt, Human
aagccugugugcuggaaug

SEQ ID NO: 1338220 - RNA, 19 nt, Human
aaggaacucacccgaauug

SEQ ID NO: 1338221 - RNA, 20 nt, Human
acugcaacauauuggcaccu

SEQ ID NO: 1338222 - RNA, 20 nt, Human
acugcaacauauuggcaccu

SEQ ID NO: 1338223 - RNA, 19 nt, Human
acuuguucuucccugcccc

SEQ ID NO: 1338224 - RNA, 18 nt, Human
auccaggaggaugcaaaa

SEQ ID NO: 1338225 - RNA, 26 nt, Human
cagaagccugugugcuggaaugggcu

SEQ ID NO: 1338226 - RNA, 18 nt, Human
cagcagcagagcugacaa

SEQ ID NO: 1338227 - RNA, 22 nt, Human
caggaggaugcaaaaaccuggu

SEQ ID NO: 1338228 - RNA, 20 nt, Human
cauccagauggcucugagac

SEQ ID NO: 1338229 - RNA, 27 nt, Human
caucccaacuuguucuucccugcccau

SEQ ID NO: 1338230 - RNA, 21 nt, Human
cauguucuagaacauucaugu

SEQ ID NO: 1338231 - RNA, 24 nt, Human
cauucuuagcucugcuucuggaga

SEQ ID NO: 1338232 - RNA, 22 nt, Human
cauuuuccagacgagccaaggg

SEQ ID NO: 1338233 - RNA, 23 nt, Human
ccaacaucagagucugaccagcu

SEQ ID NO: 1338234 - RNA, 19 nt, Human
cccacagaggccagcuacc

SEQ ID NO: 1338235 - RNA, 26 nt, Human
cccccauuuaucaaaucccugucaua

SEQ ID NO: 1338236 - RNA, 22 nt, Human
cccucagagauugcugcagaag

SEQ ID NO: 1338237 - RNA, 21 nt, Human
cccugcccauucuuccucuuc

SEQ ID NO: 1338238 - RNA, 24 nt, Human
ccucagagauugcugcagaagccu

SEQ ID NO: 1338239 - RNA, 21 nt, Human
ccucccaccggcuuuacccuc

SEQ ID NO: 1338240 - RNA, 19 nt, Human
cgccucagggcacuuacaa

SEQ ID NO: 1338241 - RNA, 20 nt, Human
cuuacaauccccacagaggc

SEQ ID NO: 1338242 - RNA, 19 nt, Human
gcccauucuuccucuuccu

SEQ ID NO: 1338243 - RNA, 19 nt, Human
gccuuuuagccagcagaau

SEQ ID NO: 1338244 - RNA, 19 nt, Human
gcucugagacagcagcaga

SEQ ID NO: 1338245 - RNA, 20 nt, Human
gcucugcuucuggagauaag

SEQ ID NO: 1338246 - RNA, 20 nt, Human
gcuucaaggucgcaaguccu

SEQ ID NO: 1338247 - RNA, 20 nt, Human
gggugucgggacacucaucc

SEQ ID NO: 1338248 - RNA, 22 nt, Human
gucugaccagcugggugguccu

SEQ ID NO: 1338249 - RNA, 21 nt, Human
guugcagcaaaagcucauuca

SEQ ID NO: 1338250 - RNA, 20 nt, Human
uaccuacgaugaaucacauc

SEQ ID NO: 1338251 - RNA, 28 nt, Human
uacgaugaaucacaucagugucggggcc

SEQ ID NO: 1338252 - RNA, 22 nt, Human
uacugcaacauauuggcaccuc

SEQ ID NO: 1338253 - RNA, 19 nt, Human
uagaacauucaugucugcc

SEQ ID NO: 1338254 - RNA, 21 nt, Human
ucaaaaugauccaaaguuuuu

SEQ ID NO: 1338255 - RNA, 22 nt, Human
ucagugucggggccgggaaggu

SEQ ID NO: 1338256 - RNA, 24 nt, Human
ucauccaggaggaugcaaaaaccu

SEQ ID NO: 1338257 - RNA, 19 nt, Human
uccaggaggaugcaaaaac

SEQ ID NO: 1338258 - RNA, 22 nt, Human
uccccacagaggccagcuaccc

SEQ ID NO: 1338259 - RNA, 18 nt, Human
uccgggaucgccauguuc

SEQ ID NO: 1338260 - RNA, 20 nt, Human
uccucuuccugccuucacug

SEQ ID NO: 1338261 - RNA, 20 nt, Human
ucucacauccacaaugggac

SEQ ID NO: 1338262 - RNA, 22 nt, Human
ucugccuuuuagccagcagaau

SEQ ID NO: 1338263 - RNA, 24 nt, Human
ugcaaaaaccugguguuuuucuuu

SEQ ID NO: 1338264 - RNA, 19 nt, Human
ugcagcaaaagcucauuca

SEQ ID NO: 1338265 - RNA, 21 nt, Human
ugccaaggcuccgugggcauu

SEQ ID NO: 1338266 - RNA, 23 nt, Human
ugccaaggcuccgugggcauucu

SEQ ID NO: 1338267 - RNA, 23 nt, Human
ugguguuuuucuuuuuuuuuuuu

SEQ ID NO: 1338268 - RNA, 19 nt, Human
ugucaugugccaaggcucc

SEQ ID NO: 1338269 - RNA, 19 nt, Human
ugugcuggaaugggcugcc

SEQ ID NO: 1338270 - RNA, 21 nt, Human
uucucacauccacaaugggac

SEQ ID NO: 1338271 - RNA, 19 nt, Human
uucuuagcucugcuucugg

SEQ ID NO: 1338272 - RNA, 18 nt, Human
uucuuuuuuuuuuuuuug

SEQ ID NO: 1338273 - RNA, 19 nt, Human
uugggccuccuggccugcu

SEQ ID NO: 1338274 - RNA, 18 nt, Human
uuuauaucccucauccag

SEQ ID NO: 1338275 - RNA, 26 nt, Human
uuuucuuuuuuuuuuuuuugcauuuu

SEQ ID NO: 1338276 - RNA, 21 nt, Human
uuuuuuuuuugcagcaaccaa

SEQ ID NO: 1338277 - RNA, 21 nt, Human
uuuuuuuuuuuuuuuuugcag

SEQ ID NO: 1338278 - RNA, 20 nt, Human
uuuuuuuuuuuuuuuuuugg

SEQ ID NO: 1338279 - RNA, 19 nt, Human
aacaagagguggcagcagc

SEQ ID NO: 1338280 - RNA, 21 nt, Human
aagcagggaccgcugugccuc

SEQ ID NO: 1338281 - RNA, 22 nt, Human
agcaagcagggaccgcugugcc

SEQ ID NO: 1338282 - RNA, 21 nt, Human
aucuuuugcccgacgaggaac

SEQ ID NO: 1338283 - RNA, 23 nt, Human
cacucuugaaggaacaggagcug

SEQ ID NO: 1338284 - RNA, 20 nt, Human
caggagccggcccugaguuc

SEQ ID NO: 1338285 - RNA, 20 nt, Human
cagggaccgcugugccuccc

SEQ ID NO: 1338286 - RNA, 23 nt, Human
cccccaaguccgcgggaaccugc

SEQ ID NO: 1338287 - RNA, 22 nt, Human
ccccucagcaagcagggaccgc

SEQ ID NO: 1338288 - RNA, 21 nt, Human
cgggucgggguuggucgcucc

SEQ ID NO: 1338289 - RNA, 22 nt, Human
cucccggcccugagggagaccc

SEQ ID NO: 1338290 - RNA, 25 nt, Human
cuccugcugcacaccgggccggggg

SEQ ID NO: 1338291 - RNA, 18 nt, Human
gcagcgaagagucccugg

SEQ ID NO: 1338292 - RNA, 20 nt, Human
gcgccggggcucagcgggcg

SEQ ID NO: 1338293 - RNA, 24 nt, Human
gcugcaggaggcaaacacaagucu

SEQ ID NO: 1338294 - RNA, 21 nt, Human
ggccuccagcacucuugaagg

SEQ ID NO: 1338295 - RNA, 23 nt, Human
gggcgcccccaaguccgcgggaa

SEQ ID NO: 1338296 - RNA, 21 nt, Human
uaacccgggucgggguugguc

SEQ ID NO: 1338297 - RNA, 19 nt, Human
uaagcaagcuccuacccac

SEQ ID NO: 1338298 - RNA, 19 nt, Human
uaggcccucgcugcccucc

SEQ ID NO: 1338299 - RNA, 18 nt, Human
ucccuggcggcagcggcu

SEQ ID NO: 1338300 - RNA, 21 nt, Human
ucccuggcggcagcggcuccc

SEQ ID NO: 1338301 - RNA, 26 nt, Human
ucccugggaguuuuaacccgggucgg

SEQ ID NO: 1338302 - RNA, 23 nt, Human
uccggguugaggcugcaggaggc

SEQ ID NO: 1338303 - RNA, 21 nt, Human
uggcagcagcgaagagucccu

SEQ ID NO: 1338304 - RNA, 26 nt, Human
uggcagcagcgaagagucccugggag

SEQ ID NO: 1338305 - RNA, 20 nt, Human
ugggaacgggggagagaaca

SEQ ID NO: 1338306 - RNA, 23 nt, Human
ugguaggcccucgcugcccuccg

SEQ ID NO: 1338307 - RNA, 18 nt, Human
uuuuuuuuuuuuuuuuug

SEQ ID NO: 1338308 - RNA, 23 nt, Human
uuuuuuuuuuuuuuuuuggcauu

SEQ ID NO: 1338309 - RNA, 24 nt, Human
uuuuuuuuuuuuuuuuuggcauug

SEQ ID NO: 1338310 - RNA, 22 nt, Human
uuuuuuuuuuuuuuuuuuuggc

SEQ ID NO: 1338311 - RNA, 23 nt, Human
aagaggucaccacccagcuaucc

SEQ ID NO: 1338312 - RNA, 18 nt, Human
cacuagaaacagcagagc

SEQ ID NO: 1338313 - RNA, 27 nt, Human
cagccgccugucuccgcaaggggccgc

SEQ ID NO: 1338314 - RNA, 20 nt, Human
cagggccaggcugguggggu

SEQ ID NO: 1338315 - RNA, 19 nt, Human
ccucugccucagcccccac

SEQ ID NO: 1338316 - RNA, 18 nt, Human
ccugcuguucccagggcc

SEQ ID NO: 1338317 - RNA, 23 nt, Human
cgugcugccggcuuucagccgcc

SEQ ID NO: 1338318 - RNA, 19 nt, Human
cugccucagcccccacuug

SEQ ID NO: 1338319 - RNA, 24 nt, Human
cugcuguucccagggccaggcugg

SEQ ID NO: 1338320 - RNA, 23 nt, Human
ggacugaacucacuuuugcauaa

SEQ ID NO: 1338321 - RNA, 22 nt, Human
ggagcuccuccagcuccaggau

SEQ ID NO: 1338322 - RNA, 23 nt, Human
gggaguaucuggcccaggcugug

SEQ ID NO: 1338323 - RNA, 19 nt, Human
gggauccuggcugccugcc

SEQ ID NO: 1338324 - RNA, 19 nt, Human
gggccaaacuucguccaca

SEQ ID NO: 1338325 - RNA, 19 nt, Human
ggugggguugggccaaggg

SEQ ID NO: 1338326 - RNA, 19 nt, Human
uaagaggucaccacccagc

SEQ ID NO: 1338327 - RNA, 23 nt, Human
ucgugcugccggcuuucagccgc

SEQ ID NO: 1338328 - RNA, 26 nt, Human
ucucagggucacuagaaacagccgua

SEQ ID NO: 1338329 - RNA, 21 nt, Human
ucuccuaugaaaagguugggc

SEQ ID NO: 1338330 - RNA, 18 nt, Human
ucuggcccaggcugugca

SEQ ID NO: 1338331 - RNA, 24 nt, Human
ugaauugggucagggaaauccacc

SEQ ID NO: 1338332 - RNA, 25 nt, Human
ugggccaagggucagggauccuggc

SEQ ID NO: 1338333 - RNA, 21 nt, Human
uggugggguugggccaagggu

SEQ ID NO: 1338334 - RNA, 18 nt, Human
uuuuuuuuuuuuuuuuug

SEQ ID NO: 1338335 - RNA, 21 nt, Human
uuuuuuuuuuuuuuuuugcga

SEQ ID NO: 1338336 - RNA, 24 nt, Human
aaagugcugggaugauaggcauga

SEQ ID NO: 1338337 - RNA, 23 nt, Human
aacuccuaggcucaagggauccu

SEQ ID NO: 1338338 - RNA, 19 nt, Human
aagugcugggaugauaggc

SEQ ID NO: 1338339 - RNA, 24 nt, Human
aauguugcccaggcuggucuuaaa

SEQ ID NO: 1338340 - RNA, 20 nt, Human
acagcccaucuaauacuguu

SEQ ID NO: 1338341 - RNA, 19 nt, Human
acccaggcuggagugcagu

SEQ ID NO: 1338342 - RNA, 23 nt, Human
acccaggcuggagugcaguggug

SEQ ID NO: 1338343 - RNA, 18 nt, Human
acugcaagcucugccucc

SEQ ID NO: 1338344 - RNA, 25 nt, Human
aggcuggagugcaguggugcgaucu

SEQ ID NO: 1338345 - RNA, 19 nt, Human
aguagcugggacuacgggc

SEQ ID NO: 1338346 - RNA, 19 nt, Human
aguagcugggacuacgggc

SEQ ID NO: 1338347 - RNA, 23 nt, Human
agugcaguggugcgaucuuggcu

SEQ ID NO: 1338348 - RNA, 24 nt, Human
agugcaguggugcgaucuuggcuc

SEQ ID NO: 1338349 - RNA, 20 nt, Human
augguguuauaauucuccuu

SEQ ID NO: 1338350 - RNA, 19 nt, Human
auguugcccaggcuggucu

SEQ ID NO: 1338351 - RNA, 23 nt, Human
auguugcccaggcuggucuuaaa

SEQ ID NO: 1338352 - RNA, 24 nt, Human
caaagugcugggaugauaggcaug

SEQ ID NO: 1338353 - RNA, 24 nt, Human
caagggauccucccagcugggccu

SEQ ID NO: 1338354 - RNA, 21 nt, Human
caauguugcccaggcuggucu

SEQ ID NO: 1338355 - RNA, 22 nt, Human
cacaccacucuccugccucagc

SEQ ID NO: 1338356 - RNA, 24 nt, Human
cacccaggcuggagugcaguggug

SEQ ID NO: 1338357 - RNA, 23 nt, Human
cacugcaagcucugccucccggg

SEQ ID NO: 1338358 - RNA, 20 nt, Human
cagccuccugaguagcuggg

SEQ ID NO: 1338359 - RNA, 19 nt, Human
caguggugcgaucuuggcu

SEQ ID NO: 1338360 - RNA, 18 nt, Human
ccaaagugcugggaugau

SEQ ID NO: 1338361 - RNA, 24 nt, Human
ccaaagugcugggaugauaggcau

SEQ ID NO: 1338362 - RNA, 23 nt, Human
cccagcccauuuccuuuuucccu

SEQ ID NO: 1338363 - RNA, 18 nt, Human
cccggguucacaccacuc

SEQ ID NO: 1338364 - RNA, 20 nt, Human
ccuaggcucaagggauccuc

SEQ ID NO: 1338365 - RNA, 23 nt, Human
ccuaggcucaagggauccuccca

SEQ ID NO: 1338366 - RNA, 19 nt, Human
ccucccagcugggccuccc

SEQ ID NO: 1338367 - RNA, 22 nt, Human
ccucccggguucacaccacucu

SEQ ID NO: 1338368 - RNA, 24 nt, Human
ccugaguagcugggacuacgggcu

SEQ ID NO: 1338369 - RNA, 23 nt, Human
ccugccucagccuccugaguagc

SEQ ID NO: 1338370 - RNA, 24 nt, Human
cucacugcaagcucugccucccgg

SEQ ID NO: 1338371 - RNA, 24 nt, Human
cucagccuccugaguagcugggac

SEQ ID NO: 1338372 - RNA, 26 nt, Human
cucuccugccucagccuccugaguag

SEQ ID NO: 1338373 - RNA, 20 nt, Human
cucugucacccaggcuggag

SEQ ID NO: 1338374 - RNA, 23 nt, Human
cucugucacccaggcuggagugc

SEQ ID NO: 1338375 - RNA, 23 nt, Human
cugccucagccuccugaguagcu

SEQ ID NO: 1338376 - RNA, 21 nt, Human
cugggccucccaaagugcugg

SEQ ID NO: 1338377 - RNA, 24 nt, Human
cuugcucugucacccaggcuggag

SEQ ID NO: 1338378 - RNA, 20 nt, Human
gaguagcugggacuacgggc

SEQ ID NO: 1338379 - RNA, 21 nt, Human
gcacaguaccagauauauggu

SEQ ID NO: 1338380 - RNA, 21 nt, Human
gcucacugcaagcucugccuc

SEQ ID NO: 1338381 - RNA, 23 nt, Human
ggagucucccaauguugcccagg

SEQ ID NO: 1338382 - RNA, 22 nt, Human
ggaugauaggcaugaaccacca

SEQ ID NO: 1338383 - RNA, 18 nt, Human
gggcuccugccaccaguu

SEQ ID NO: 1338384 - RNA, 20 nt, Human
uaggcaugaaccaccauucc

SEQ ID NO: 1338385 - RNA, 21 nt, Human
ucacaccacucuccugccuca

SEQ ID NO: 1338386 - RNA, 24 nt, Human
ucacccaggcuggagugcaguggu

SEQ ID NO: 1338387 - RNA, 18 nt, Human
ucacugcaagcucugccu

SEQ ID NO: 1338388 - RNA, 18 nt, Human
ucacugcaagcucugccu

SEQ ID NO: 1338389 - RNA, 24 nt, Human
ucacugcaagcucugccucccggg

SEQ ID NO: 1338390 - RNA, 23 nt, Human
ucagccuccugaguagcugggac

SEQ ID NO: 1338391 - RNA, 24 nt, Human
ucccaaagugcugggaugauaggc

SEQ ID NO: 1338392 - RNA, 21 nt, Human
ucccggguucacaccacucuc

SEQ ID NO: 1338393 - RNA, 24 nt, Human
ucccggguucacaccacucuccug

SEQ ID NO: 1338394 - RNA, 18 nt, Human
uccuaggcucaagggauc

SEQ ID NO: 1338395 - RNA, 24 nt, Human
uccugaguagcugggacuacgggc

SEQ ID NO: 1338396 - RNA, 23 nt, Human
ucucccaauguugcccaggcugg

SEQ ID NO: 1338397 - RNA, 24 nt, Human
ucugucacccaggcuggagugcag

SEQ ID NO: 1338398 - RNA, 23 nt, Human
ucuugcucugucacccaggcugg

SEQ ID NO: 1338399 - RNA, 24 nt, Human
ucuugcucugucacccaggcugga

SEQ ID NO: 1338400 - RNA, 21 nt, Human
ugaaccaccauucccagccca

SEQ ID NO: 1338401 - RNA, 22 nt, Human
ugcaguggugcgaucuuggcuc

SEQ ID NO: 1338402 - RNA, 24 nt, Human
ugcccaggcuggucuuaaacuccu

SEQ ID NO: 1338403 - RNA, 24 nt, Human
ugccucagccuccugaguagcugg

SEQ ID NO: 1338404 - RNA, 19 nt, Human
ugccucccggguucacacc

SEQ ID NO: 1338405 - RNA, 24 nt, Human
uggagucucccaauguugcccagg

SEQ ID NO: 1338406 - RNA, 23 nt, Human
uggagugcaguggugcgaucuug

SEQ ID NO: 1338407 - RNA, 24 nt, Human
uggagugcaguggugcgaucuugg

SEQ ID NO: 1338408 - RNA, 19 nt, Human
uggcucacugcaagcucug

SEQ ID NO: 1338409 - RNA, 22 nt, Human
ugggacuacgggcuccugccac

SEQ ID NO: 1338410 - RNA, 24 nt, Human
ugggacuacgggcuccugccacca

SEQ ID NO: 1338411 - RNA, 24 nt, Human
ugggaugauaggcaugaaccacca

SEQ ID NO: 1338412 - RNA, 23 nt, Human
ugguguuauaauucuccuuugca

SEQ ID NO: 1338413 - RNA, 24 nt, Human
uguagagauggagucucccaaugu

SEQ ID NO: 1338414 - RNA, 24 nt, Human
uucuugcucugucacccaggcugg

SEQ ID NO: 1338415 - RNA, 24 nt, Human
uugcucugucacccaggcuggagu

SEQ ID NO: 1338416 - RNA, 23 nt, Human
uuguagagauggagucucccaau

SEQ ID NO: 1338417 - RNA, 27 nt, Human
uuuuuuauuuuuguagagauggagucu

SEQ ID NO: 1338418 - RNA, 23 nt, Human
aagcagaccuaccgggaacaacu

SEQ ID NO: 1338419 - RNA, 24 nt, Human
aagcagaccuaccgggaacaacuu

SEQ ID NO: 1338420 - RNA, 24 nt, Human
acuuaaugggacaucuuggguaac

SEQ ID NO: 1338421 - RNA, 24 nt, Human
agggaaagcagaccuaccgggaaa

SEQ ID NO: 1338422 - RNA, 21 nt, Human
aggggcacuggacacuaaguc

SEQ ID NO: 1338423 - RNA, 19 nt, Human
agucaaguuggaacgucca

SEQ ID NO: 1338424 - RNA, 24 nt, Human
auaaggcaacagugaauauauaaa

SEQ ID NO: 1338425 - RNA, 19 nt, Human
aucuuggguaacuggauga

SEQ ID NO: 1338426 - RNA, 22 nt, Human
auggcuuaggaaggagacacaa

SEQ ID NO: 1338427 - RNA, 21 nt, Human
caacaaauacauauuuagcca

SEQ ID NO: 1338428 - RNA, 27 nt, Human
caacaaauacauauuuagccauuagaa

SEQ ID NO: 1338429 - RNA, 19 nt, Human
cagaccuaccgggaacaac

SEQ ID NO: 1338430 - RNA, 23 nt, Human
cagcugcccaaagauacaucuac

SEQ ID NO: 1338431 - RNA, 22 nt, Human
ccuaccagguuggaauguccaa

SEQ ID NO: 1338432 - RNA, 24 nt, Human
cuauguauguauuaccuccauucu

SEQ ID NO: 1338433 - RNA, 22 nt, Human
cugcaguuaacauaucuugugu

SEQ ID NO: 1338434 - RNA, 24 nt, Human
cuuaggaaggagacacaaaagaga

SEQ ID NO: 1338435 - RNA, 22 nt, Human
gcaguuaguuguuagauuagcu

SEQ ID NO: 1338436 - RNA, 22 nt, Human
ggaaagcagaaaaguucagcug

SEQ ID NO: 1338437 - RNA, 21 nt, Human
uacauacggcucuuccaggga

SEQ ID NO: 1338438 - RNA, 24 nt, Human
uauugauacuauguauguauuacc

SEQ ID NO: 1338439 - RNA, 18 nt, Human
uccacagaauucaacaca

SEQ ID NO: 1338440 - RNA, 19 nt, Human
uccacagaauucaacacau

SEQ ID NO: 1338441 - RNA, 20 nt, Human
ugaggaaagcagaaaaguuc

SEQ ID NO: 1338442 - RNA, 20 nt, Human
ugcauagaauauauccucuc

SEQ ID NO: 1338443 - RNA, 19 nt, Human
uuaaugggacaucuugggu

SEQ ID NO: 1338444 - RNA, 24 nt, Human
uucagcugcccaaagauacaucua

SEQ ID NO: 1338445 - RNA, 22 nt, Human
uuccagggaaagcagaccuacc

SEQ ID NO: 1338446 - RNA, 24 nt, Human
uuggcaguuaguuguuagauuagc

SEQ ID NO: 1338447 - RNA, 25 nt, Human
uuggcaguuaguuguuagauuagcu

SEQ ID NO: 1338448 - RNA, 19 nt, Human
uuugaggaaagcagaaaag

SEQ ID NO: 1338449 - RNA, 23 nt, Human
uuuuuuuuuuaaaacuaaaacuu

SEQ ID NO: 1338450 - RNA, 19 nt, Human
aagaaugaauuuuguuuac

SEQ ID NO: 1338451 - RNA, 21 nt, Human
acagcaauaucauaauacagc

SEQ ID NO: 1338452 - RNA, 18 nt, Human
auaaaauauucuuagccc

SEQ ID NO: 1338453 - RNA, 22 nt, Human
augaauaaugauuccaaagcuc

SEQ ID NO: 1338454 - RNA, 18 nt, Human
caacucaggcaugcacag

SEQ ID NO: 1338455 - RNA, 20 nt, Human
cauugagguacacuugcggg

SEQ ID NO: 1338456 - RNA, 21 nt, Human
ccaaguccccauucuggugca

SEQ ID NO: 1338457 - RNA, 18 nt, Human
ccccauucuggugcaucu

SEQ ID NO: 1338458 - RNA, 21 nt, Human
cccuacaaacucgccauugag

SEQ ID NO: 1338459 - RNA, 18 nt, Human
gaagaaugucacagcccc

SEQ ID NO: 1338460 - RNA, 21 nt, Human
gcccgaacaccagaccaacua

SEQ ID NO: 1338461 - RNA, 18 nt, Human
uaacaaaagaagcuacac

SEQ ID NO: 1338462 - RNA, 25 nt, Human
uacaaacucgccauugagguacacu

SEQ ID NO: 1338463 - RNA, 23 nt, Human
uccuauuuaacuucugaaucagg

SEQ ID NO: 1338464 - RNA, 22 nt, Human
ucuuuuuuuguccaccauuuuu

SEQ ID NO: 1338465 - RNA, 23 nt, Human
uggauccccagcuuuuucaguuc

SEQ ID NO: 1338466 - RNA, 21 nt, Human
ugguuguaauuaaguccacaa

SEQ ID NO: 1338467 - RNA, 21 nt, Human
uuagcccgaacaccagaccaa

SEQ ID NO: 1338468 - RNA, 24 nt, Human
uuccaaagcuccuauuuaacuucu

SEQ ID NO: 1338469 - RNA, 18 nt, Human
uucuuagcccgaacacca

SEQ ID NO: 1338470 - RNA, 18 nt, Human
uuuuuuuuuuucggaauc

SEQ ID NO: 1338471 - RNA, 23 nt, Human
uuuuuuuuuuuuuuuuucggaau

SEQ ID NO: 1338472 - RNA, 23 nt, Human
uuuuuuuuuuuuuuuuuuuucgg

SEQ ID NO: 1338473 - RNA, 19 nt, Human
aaaaaaaaaaaaaaaagga

SEQ ID NO: 1338474 - RNA, 24 nt, Human
aaaaaaaaaaaaaaaaggaugcag

SEQ ID NO: 1338475 - RNA, 19 nt, Human
aaaaaaagagagggaaaga

SEQ ID NO: 1338476 - RNA, 20 nt, Human
aaaauuacaagacacagcca

SEQ ID NO: 1338477 - RNA, 18 nt, Human
aaacaaagcccgacagcg

SEQ ID NO: 1338478 - RNA, 18 nt, Human
aaacaccagccagcuccc

SEQ ID NO: 1338479 - RNA, 23 nt, Human
aaaccaccauaugcucccaccug

SEQ ID NO: 1338480 - RNA, 23 nt, Human
aaccaccauaugcucccaccugc

SEQ ID NO: 1338481 - RNA, 22 nt, Human
aacgcugcucccuccaggggug

SEQ ID NO: 1338482 - RNA, 20 nt, Human
aagaaggaaacaaagcccga

SEQ ID NO: 1338483 - RNA, 24 nt, Human
aagcgcgguggcucaugccuguaa

SEQ ID NO: 1338484 - RNA, 24 nt, Human
aauugcuugaauccgggaggcgga

SEQ ID NO: 1338485 - RNA, 19 nt, Human
acauggagaaaccccgucu

SEQ ID NO: 1338486 - RNA, 20 nt, Human
acauggagaaaccccgucuc

SEQ ID NO: 1338487 - RNA, 21 nt, Human
accagucugugaaaaccaggc

SEQ ID NO: 1338488 - RNA, 24 nt, Human
accccgucuccacuaaaaauacaa

SEQ ID NO: 1338489 - RNA, 24 nt, Human
acuuugggaggccgaggugggcag

SEQ ID NO: 1338490 - RNA, 21 nt, Human
agaaggaaacaaagcccgaca

SEQ ID NO: 1338491 - RNA, 23 nt, Human
agaucaccugaggucgggaguuc

SEQ ID NO: 1338492 - RNA, 24 nt, Human
agcacuuugggaggccgagguggg

SEQ ID NO: 1338493 - RNA, 21 nt, Human
aggccgaggugggcagaucac

SEQ ID NO: 1338494 - RNA, 21 nt, Human
aggcggagguugcggugagcc

SEQ ID NO: 1338495 - RNA, 24 nt, Human
aggcggagguugcggugagccgag

SEQ ID NO: 1338496 - RNA, 21 nt, Human
aggcugaggcgggagaauugc

SEQ ID NO: 1338497 - RNA, 24 nt, Human
aggcugaggcgggagaauugcuug

SEQ ID NO: 1338498 - RNA, 22 nt, Human
agggucacugggccaggcuguc

SEQ ID NO: 1338499 - RNA, 22 nt, Human
aggugggcagaucaccugaggu

SEQ ID NO: 1338500 - RNA, 26 nt, Human
aggugggcagaucaccugaggucggg

SEQ ID NO: 1338501 - RNA, 24 nt, Human
aucacgccauugcacuccagccug

SEQ ID NO: 1338502 - RNA, 19 nt, Human
augccuguaaucccagcac

SEQ ID NO: 1338503 - RNA, 20 nt, Human
auggagaaaccccgucucca

SEQ ID NO: 1338504 - RNA, 23 nt, Human
auugcacuccagccugggcgaca

SEQ ID NO: 1338505 - RNA, 24 nt, Human
auugcacuccagccugggcgacaa

SEQ ID NO: 1338506 - RNA, 21 nt, Human
caaaauuacaagacacagcca

SEQ ID NO: 1338507 - RNA, 25 nt, Human
cacagcucaaacaccagccagcucc

SEQ ID NO: 1338508 - RNA, 24 nt, Human
cagaucaccugaggucgggaguuc

SEQ ID NO: 1338509 - RNA, 24 nt, Human
cagcacuuugggaggccgaggugg

SEQ ID NO: 1338510 - RNA, 24 nt, Human
cagccugaccgacauggagaaacc

SEQ ID NO: 1338511 - RNA, 18 nt, Human
cagccugcucccuggagc

SEQ ID NO: 1338512 - RNA, 24 nt, Human
cagcuacucgggaggcugaggcgg

SEQ ID NO: 1338513 - RNA, 18 nt, Human
caggaggaaaguaacucc

SEQ ID NO: 1338514 - RNA, 18 nt, Human
caggugcuucugccacag

SEQ ID NO: 1338515 - RNA, 21 nt, Human
cagugaggaacacuuagacac

SEQ ID NO: 1338516 - RNA, 20 nt, Human
caugccuguaaucccagcac

SEQ ID NO: 1338517 - RNA, 24 nt, Human
caugccuguaaucccagcacuuug

SEQ ID NO: 1338518 - RNA, 19 nt, Human
cauugcacuccagccuggg

SEQ ID NO: 1338519 - RNA, 20 nt, Human
cauugcacuccagccugggc

SEQ ID NO: 1338520 - RNA, 21 nt, Human
cauugcacuccagccugggcg

SEQ ID NO: 1338521 - RNA, 22 nt, Human
cauugcacuccagccugggcga

SEQ ID NO: 1338522 - RNA, 24 nt, Human
cauugcacuccagccugggcgaca

SEQ ID NO: 1338523 - RNA, 20 nt, Human
cauuuaaguuauaaucguuc

SEQ ID NO: 1338524 - RNA, 22 nt, Human
ccaacgcugcucccuccagggg

SEQ ID NO: 1338525 - RNA, 26 nt, Human
ccaccugcagccauuguuaaagaaca

SEQ ID NO: 1338526 - RNA, 20 nt, Human
ccauugcacuccagccuggg

SEQ ID NO: 1338527 - RNA, 21 nt, Human
ccauugcacuccagccugggc

SEQ ID NO: 1338528 - RNA, 22 nt, Human
ccauugcacuccagccugggcg

SEQ ID NO: 1338529 - RNA, 24 nt, Human
ccauugcacuccagccugggcgac

SEQ ID NO: 1338530 - RNA, 21 nt, Human
cccgucuccacuaaaaauaca

SEQ ID NO: 1338531 - RNA, 23 nt, Human
ccugaccgacauggagaaacccc

SEQ ID NO: 1338532 - RNA, 24 nt, Human
ccugaccgacauggagaaaccccg

SEQ ID NO: 1338533 - RNA, 22 nt, Human
ccugaggucgggaguucgagac

SEQ ID NO: 1338534 - RNA, 22 nt, Human
ccuguaaucccagcacuuuggg

SEQ ID NO: 1338535 - RNA, 21 nt, Human
ccuguaaucccagcuacucgg

SEQ ID NO: 1338536 - RNA, 22 nt, Human
ccuguaaucccagcuacucggg

SEQ ID NO: 1338537 - RNA, 18 nt, Human
cgacaaaggcaaaaacuc

SEQ ID NO: 1338538 - RNA, 21 nt, Human
cgacaaaggcaaaaacuccgu

SEQ ID NO: 1338539 - RNA, 22 nt, Human
cgacauggagaaaccccgucuc

SEQ ID NO: 1338540 - RNA, 20 nt, Human
cgaggugggcagaucaccug

SEQ ID NO: 1338541 - RNA, 24 nt, Human
cgaggugggcagaucaccugaggu

SEQ ID NO: 1338542 - RNA, 26 nt, Human
cgccauugcacuccagccugggcgac

SEQ ID NO: 1338543 - RNA, 24 nt, Human
cgggaggcggagguugcggugagc

SEQ ID NO: 1338544 - RNA, 18 nt, Human
cucaaaaaaaaaaaaaaa

SEQ ID NO: 1338545 - RNA, 24 nt, Human
cucaaaaaaaaaaaaaaaaggaug

SEQ ID NO: 1338546 - RNA, 24 nt, Human
cucaugccuguaaucccagcacuu

SEQ ID NO: 1338547 - RNA, 20 nt, Human
cuccagggguggugaggccc

SEQ ID NO: 1338548 - RNA, 23 nt, Human
cucccugccaacgcugcucccuc

SEQ ID NO: 1338549 - RNA, 22 nt, Human
cucccuugaggccgcguggcuu

SEQ ID NO: 1338550 - RNA, 19 nt, Human
cuccgucucaaaaaaaaaa

SEQ ID NO: 1338551 - RNA, 25 nt, Human
cugaggcccauccuccucuccaccu

SEQ ID NO: 1338552 - RNA, 23 nt, Human
cugcucccuggagccccaggugc

SEQ ID NO: 1338553 - RNA, 21 nt, Human
cugggcuuuugacaaaaaaag

SEQ ID NO: 1338554 - RNA, 21 nt, Human
cuggggcuugagaugcuccug

SEQ ID NO: 1338555 - RNA, 21 nt, Human
gaacaaauuuacaggucagga

SEQ ID NO: 1338556 - RNA, 20 nt, Human
gaaccagucugugaaaaccg

SEQ ID NO: 1338557 - RNA, 22 nt, Human
gacaaaggcaaaaacuccgucu

SEQ ID NO: 1338558 - RNA, 21 nt, Human
gagaaaccccgucuccacuaa

SEQ ID NO: 1338559 - RNA, 23 nt, Human
gagaccagccugaccgacaugga

SEQ ID NO: 1338560 - RNA, 23 nt, Human
gagaucacgccauugcacuccag

SEQ ID NO: 1338561 - RNA, 24 nt, Human
gaggcgggagaauugcuugaaucc

SEQ ID NO: 1338562 - RNA, 23 nt, Human
gaggugggcagaucaccugaggu

SEQ ID NO: 1338563 - RNA, 22 nt, Human
gagguugcggugagccgagauc

SEQ ID NO: 1338564 - RNA, 24 nt, Human
gaucaccugaggucgggaguucga

SEQ ID NO: 1338565 - RNA, 22 nt, Human
gccauugcacuccagccugggc

SEQ ID NO: 1338566 - RNA, 24 nt, Human
gccauugcacuccagccugggcga

SEQ ID NO: 1338567 - RNA, 19 nt, Human
ggaggcaccucaguauucc

SEQ ID NO: 1338568 - RNA, 24 nt, Human
ggaggggcuggcuugggcccaggg

SEQ ID NO: 1338569 - RNA, 24 nt, Human
ggaggugcgugccuguaaucccag

SEQ ID NO: 1338570 - RNA, 20 nt, Human
ggagguugcggugagccgag

SEQ ID NO: 1338571 - RNA, 22 nt, Human
ggagguugcggugagccgagau

SEQ ID NO: 1338572 - RNA, 23 nt, Human
ggagguugcggugagccgagauc

SEQ ID NO: 1338573 - RNA, 24 nt, Human
ggagguugcggugagccgagauca

SEQ ID NO: 1338574 - RNA, 24 nt, Human
ggcaucucuuucuuucuuucuccu

SEQ ID NO: 1338575 - RNA, 22 nt, Human
ggccaagcgcgguggcucaugg

SEQ ID NO: 1338576 - RNA, 21 nt, Human
ggcucaugccuguaaucccag

SEQ ID NO: 1338577 - RNA, 26 nt, Human
gggcagaucaccugaggucgggaguu

SEQ ID NO: 1338578 - RNA, 23 nt, Human
ggguggugaggccccacccuguc

SEQ ID NO: 1338579 - RNA, 22 nt, Human
ggugaggccccacccugucagu

SEQ ID NO: 1338580 - RNA, 21 nt, Human
ggugcgugccuguaaucccag

SEQ ID NO: 1338581 - RNA, 23 nt, Human
gguggcucaugccuguaauccca

SEQ ID NO: 1338582 - RNA, 24 nt, Human
gguggcucaugccuguaaucccag

SEQ ID NO: 1338583 - RNA, 19 nt, Human
guugcggugagccgagauc

SEQ ID NO: 1338584 - RNA, 22 nt, Human
uaaaaauacaaaauuagccgga

SEQ ID NO: 1338585 - RNA, 23 nt, Human
uaaaaauacaaaauuagccggac

SEQ ID NO: 1338586 - RNA, 19 nt, Human
uaaguuauaaucguucccc

SEQ ID NO: 1338587 - RNA, 21 nt, Human
ucaaaaaaaaaaaaaaaagga

SEQ ID NO: 1338588 - RNA, 23 nt, Human
ucacgccauugcacuccagccug

SEQ ID NO: 1338589 - RNA, 22 nt, Human
ucaugccuguaaucccagcacu

SEQ ID NO: 1338590 - RNA, 20 nt, Human
uccagccugggcgacaaagg

SEQ ID NO: 1338591 - RNA, 24 nt, Human
ucccaggcccuaaaauguucgcuu

SEQ ID NO: 1338592 - RNA, 19 nt, Human
ucccuggagccccaggugc

SEQ ID NO: 1338593 - RNA, 22 nt, Human
ucccuggagccccaggugcuuc

SEQ ID NO: 1338594 - RNA, 19 nt, Human
uccgggaggcggagguugc

SEQ ID NO: 1338595 - RNA, 23 nt, Human
uccgucucaaaaaaaaaaaaaaa

SEQ ID NO: 1338596 - RNA, 24 nt, Human
uccgucucaaaaaaaaaaaaaaaa

SEQ ID NO: 1338597 - RNA, 23 nt, Human
ucgggaggcugaggcgggagaau

SEQ ID NO: 1338598 - RNA, 18 nt, Human
ucucaaaaaaaaaaaaaa

SEQ ID NO: 1338599 - RNA, 22 nt, Human
ucuggcccugauaggaggcagg

SEQ ID NO: 1338600 - RNA, 19 nt, Human
ucuuucuuucuuucucccc

SEQ ID NO: 1338601 - RNA, 21 nt, Human
ugaaaauggauggcgcuuccc

SEQ ID NO: 1338602 - RNA, 18 nt, Human
ugaaagcccuggaggggc

SEQ ID NO: 1338603 - RNA, 21 nt, Human
ugaaagcccuggaggggcugg

SEQ ID NO: 1338604 - RNA, 21 nt, Human
ugacaaaaaaagagagggaaa

SEQ ID NO: 1338605 - RNA, 22 nt, Human
ugagccgagaucacgccauugc

SEQ ID NO: 1338606 - RNA, 21 nt, Human
ugaggaacacuuagacacugc

SEQ ID NO: 1338607 - RNA, 21 nt, Human
ugauaggaggcaggacucggg

SEQ ID NO: 1338608 - RNA, 23 nt, Human
ugccuguaaucccagcacuuugg

SEQ ID NO: 1338609 - RNA, 23 nt, Human
ugccuguaaucccagcuacucgg

SEQ ID NO: 1338610 - RNA, 24 nt, Human
ugccuguaaucccagcuacucggg

SEQ ID NO: 1338611 - RNA, 21 nt, Human
ugcucuuugggcuugagacuu

SEQ ID NO: 1338612 - RNA, 18 nt, Human
ugcuugaauccgggaggc

SEQ ID NO: 1338613 - RNA, 20 nt, Human
uggaggggcuggcuugggcc

SEQ ID NO: 1338614 - RNA, 24 nt, Human
uggaggugcgugccuguaauccca

SEQ ID NO: 1338615 - RNA, 24 nt, Human
uggccaagcgcgguggcucaugcc

SEQ ID NO: 1338616 - RNA, 22 nt, Human
uggcucaugccuguaaucccag

SEQ ID NO: 1338617 - RNA, 24 nt, Human
uggcucaugccuguaaucccagca

SEQ ID NO: 1338618 - RNA, 20 nt, Human
ugggaggccgaggugggcag

SEQ ID NO: 1338619 - RNA, 24 nt, Human
ugggaggccgaggugggcagauca

SEQ ID NO: 1338620 - RNA, 24 nt, Human
ugggcagaucaccugaggucggga

SEQ ID NO: 1338621 - RNA, 21 nt, Human
ugggccaggcugucucccugc

SEQ ID NO: 1338622 - RNA, 22 nt, Human
uggugaggccccacccugucag

SEQ ID NO: 1338623 - RNA, 24 nt, Human
uugaauccgggaggcggagguugc

SEQ ID NO: 1338624 - RNA, 22 nt, Human
uugacaaaaaaagagagggaaa

SEQ ID NO: 1338625 - RNA, 24 nt, Human
uugagaugcuccugaggcccaucc

SEQ ID NO: 1338626 - RNA, 18 nt, Human
uugcggugagccgagauc

SEQ ID NO: 1338627 - RNA, 20 nt, Human
uugcggugagccgagaucac

SEQ ID NO: 1338628 - RNA, 21 nt, Human
uugcggugagccgagaucacg

SEQ ID NO: 1338629 - RNA, 24 nt, Human
uugcuugaauccgggaggcggagg

SEQ ID NO: 1338630 - RNA, 25 nt, Human
uugggaggccgaggugggcagauca

SEQ ID NO: 1338631 - RNA, 24 nt, Human
uuuuuuuuuuuuuuuauuuuccag

SEQ ID NO: 1338632 - RNA, 24 nt, Human
uuuuuuuuuuuuuuuuuuuauuuu

SEQ ID NO: 1338633 - RNA, 26 nt, Human
aagcagguuuauuagggcccuggggc

SEQ ID NO: 1338634 - RNA, 18 nt, Human
aaggccagggccgugaga

SEQ ID NO: 1338635 - RNA, 18 nt, Human
aggccagggccgugagaa

SEQ ID NO: 1338636 - RNA, 21 nt, Human
agggaccuggggauacagagg

SEQ ID NO: 1338637 - RNA, 22 nt, Human
agggaccuggggauacagaggg

SEQ ID NO: 1338638 - RNA, 19 nt, Human
cagaagcccuggcuggaga

SEQ ID NO: 1338639 - RNA, 23 nt, Human
cagguuuauuagggcccuggggc

SEQ ID NO: 1338640 - RNA, 20 nt, Human
caucucagaagcccuggcug

SEQ ID NO: 1338641 - RNA, 22 nt, Human
cccuggcuggagaccuuaggag

SEQ ID NO: 1338642 - RNA, 21 nt, Human
ccuuaggagucaguucuggga

SEQ ID NO: 1338643 - RNA, 23 nt, Human
gagggaccuggggauacagaggg

SEQ ID NO: 1338644 - RNA, 22 nt, Human
gaucuuugggcuuuugccagga

SEQ ID NO: 1338645 - RNA, 24 nt, Human
ggaaauggucuggggggcagggag

SEQ ID NO: 1338646 - RNA, 22 nt, Human
gggcccuggggccaggaaugcc

SEQ ID NO: 1338647 - RNA, 24 nt, Human
gggccgugagaaaaggugacucuc

SEQ ID NO: 1338648 - RNA, 20 nt, Human
guucugggagggaccugggg

SEQ ID NO: 1338649 - RNA, 28 nt, Human
ucucagaagcccuggcuggagaccuuag

SEQ ID NO: 1338650 - RNA, 20 nt, Human
ucuggggggcagggagccuu

SEQ ID NO: 1338651 - RNA, 23 nt, Human
ugagaaaaggugacucuccugag

SEQ ID NO: 1338652 - RNA, 18 nt, Human
uggagaccuuaggaguca

SEQ ID NO: 1338653 - RNA, 24 nt, Human
ugggagggaccuggggauacagag

SEQ ID NO: 1338654 - RNA, 22 nt, Human
uuggggaaauggucuggggaaa

SEQ ID NO: 1338655 - RNA, 19 nt, Human
aaacagcaggccuugaguc

SEQ ID NO: 1338656 - RNA, 22 nt, Human
acauugcuucauuuuuuuuucu

SEQ ID NO: 1338657 - RNA, 18 nt, Human
acuggguuggaaacucca

SEQ ID NO: 1338658 - RNA, 21 nt, Human
auuccagggcuuguucuagaa

SEQ ID NO: 1338659 - RNA, 23 nt, Human
cacauugcuucauuuuuuuuucu

SEQ ID NO: 1338660 - RNA, 22 nt, Human
cccuuggauuuacuggguugga

SEQ ID NO: 1338661 - RNA, 20 nt, Human
ccugugggccggcccaaccc

SEQ ID NO: 1338662 - RNA, 19 nt, Human
gcccuccggaggcuaauca

SEQ ID NO: 1338663 - RNA, 21 nt, Human
gcugaagggcaggccaccaag

SEQ ID NO: 1338664 - RNA, 23 nt, Human
ggaaacuggggcccuccggaggc

SEQ ID NO: 1338665 - RNA, 22 nt, Human
ggacuggggugggauucugggc

SEQ ID NO: 1338666 - RNA, 20 nt, Human
ggcuuguucuagaagcuuau

SEQ ID NO: 1338667 - RNA, 22 nt, Human
gggcaggccaccaagaugggga

SEQ ID NO: 1338668 - RNA, 23 nt, Human
uaaaacaauuuauuaccaaagca

SEQ ID NO: 1338669 - RNA, 24 nt, Human
ucaaggguaggagggguccccccu

SEQ ID NO: 1338670 - RNA, 19 nt, Human
ugcaaauggaaaguucugg

SEQ ID NO: 1338671 - RNA, 25 nt, Human
ugcaaauggaaaguucuggauucca

SEQ ID NO: 1338672 - RNA, 24 nt, Human
uggauuuacuggguuggaaacucc

SEQ ID NO: 1338673 - RNA, 18 nt, Human
uggcaggaaugcacauuc

SEQ ID NO: 1338674 - RNA, 21 nt, Human
uggcaggaaugcacauuccag

SEQ ID NO: 1338675 - RNA, 20 nt, Human
ugggcuucugcagccugacc

SEQ ID NO: 1338676 - RNA, 24 nt, Human
uuccagggcuuguucuagaagcuu

SEQ ID NO: 1338677 - RNA, 22 nt, Human
aaacugccaucaaagagcacag

SEQ ID NO: 1338678 - RNA, 18 nt, Human
aagcagccugaccccagg

SEQ ID NO: 1338679 - RNA, 22 nt, Human
accuuaagagauggaagaaaaa

SEQ ID NO: 1338680 - RNA, 25 nt, Human
caugacaagcacccaaaggugcaaa

SEQ ID NO: 1338681 - RNA, 23 nt, Human
ccaccucccaaacuagcuggucu

SEQ ID NO: 1338682 - RNA, 23 nt, Human
cccaaacuagcuggucuaugagg

SEQ ID NO: 1338683 - RNA, 24 nt, Human
ccugaccccaggcagaucuggguc

SEQ ID NO: 1338684 - RNA, 22 nt, Human
cucucccuuuucuagaucaaaa

SEQ ID NO: 1338685 - RNA, 18 nt, Human
gcuggucuaugaggucag

SEQ ID NO: 1338686 - RNA, 19 nt, Human
gcuggucuaugaggucagg

SEQ ID NO: 1338687 - RNA, 23 nt, Human
ggucagggaccugcugucuucuu

SEQ ID NO: 1338688 - RNA, 21 nt, Human
uaaacgaacaugacaagcacc

SEQ ID NO: 1338689 - RNA, 23 nt, Human
uaaauaaaauuuacaaaaaauaa

SEQ ID NO: 1338690 - RNA, 22 nt, Human
uauucugccgccaccucccaaa

SEQ ID NO: 1338691 - RNA, 28 nt, Human
ucagcccuuauucugccgccaccuccca

SEQ ID NO: 1338692 - RNA, 19 nt, Human
ucagggaccugcugucuuc

SEQ ID NO: 1338693 - RNA, 26 nt, Human
ucccaaacuagcuggucuaugagguc

SEQ ID NO: 1338694 - RNA, 19 nt, Human
ucuccaugccucuccacuc

SEQ ID NO: 1338695 - RNA, 23 nt, Human
ugaaaaauaaacgaacaugacaa

SEQ ID NO: 1338696 - RNA, 18 nt, Human
ugaggcuagagaauggga

SEQ ID NO: 1338697 - RNA, 20 nt, Human
ugccaucaaagagcacaguu

SEQ ID NO: 1338698 - RNA, 19 nt, Human
ugcugcccuagcagccaca

SEQ ID NO: 1338699 - RNA, 19 nt, Human
uggaagaaaaacaaucuga

SEQ ID NO: 1338700 - RNA, 22 nt, Human
uguugcccaggcuccaucuaaa

SEQ ID NO: 1338701 - RNA, 23 nt, Human
uuauucugccgccaccucccaaa

SEQ ID NO: 1338702 - RNA, 20 nt, Human
uucagcgaaauuguaacugu

SEQ ID NO: 1338703 - RNA, 23 nt, Human
uuguugcccaggcuccaucuaaa

SEQ ID NO: 1338704 - RNA, 20 nt, Human
uuucgcucuuguugcccagg

SEQ ID NO: 1338705 - RNA, 23 nt, Human
uuucgcucuuguugcccaggcuc

SEQ ID NO: 1338706 - RNA, 25 nt, Human
uuuuuuuuuuuugagacggaguuuc

SEQ ID NO: 1338707 - RNA, 19 nt, Human
aaaggggacccuggagcug

SEQ ID NO: 1338708 - RNA, 22 nt, Human
aaagugccuccaauccuuacug

SEQ ID NO: 1338709 - RNA, 19 nt, Human
aagagcacagucucugaac

SEQ ID NO: 1338710 - RNA, 22 nt, Human
aagagguggcagugaggucagg

SEQ ID NO: 1338711 - RNA, 21 nt, Human
acagcaggagaccauagggga

SEQ ID NO: 1338712 - RNA, 21 nt, Human
acccaagccacagcaggagac

SEQ ID NO: 1338713 - RNA, 18 nt, Human
agaaggccagggaggagu

SEQ ID NO: 1338714 - RNA, 21 nt, Human
agagcacagucucugaacaag

SEQ ID NO: 1338715 - RNA, 18 nt, Human
agagcugcagggagugag

SEQ ID NO: 1338716 - RNA, 21 nt, Human
agcacccacucaaucugagac

SEQ ID NO: 1338717 - RNA, 22 nt, Human
agcaggggccagcccucaggau

SEQ ID NO: 1338718 - RNA, 19 nt, Human
aggaagacuuagggagcug

SEQ ID NO: 1338719 - RNA, 19 nt, Human
agggaaguguggcaagagc

SEQ ID NO: 1338720 - RNA, 20 nt, Human
agggagcugagagcugcagg

SEQ ID NO: 1338721 - RNA, 24 nt, Human
agggagcugagagcugcagggagu

SEQ ID NO: 1338722 - RNA, 19 nt, Human
aggggacccuggagcuggu

SEQ ID NO: 1338723 - RNA, 21 nt, Human
aggggcagaggguggcugggg

SEQ ID NO: 1338724 - RNA, 19 nt, Human
aggguggcugggggagaag

SEQ ID NO: 1338725 - RNA, 21 nt, Human
aggguggcugggggagaagcu

SEQ ID NO: 1338726 - RNA, 19 nt, Human
aggucaggucagcucagga

SEQ ID NO: 1338727 - RNA, 24 nt, Human
aguggcccaggcucaaggaagcug

SEQ ID NO: 1338728 - RNA, 20 nt, Human
caagaagacaagcuaagcuc

SEQ ID NO: 1338729 - RNA, 23 nt, Human
caagagccaccaugacagccugu

SEQ ID NO: 1338730 - RNA, 19 nt, Human
cacaggcagccgagucacg

SEQ ID NO: 1338731 - RNA, 22 nt, Human
cacccaagccacagcaggagac

SEQ ID NO: 1338732 - RNA, 27 nt, Human
caccuccaccuucugcacaggcagccg

SEQ ID NO: 1338733 - RNA, 20 nt, Human
cacucugcugccacccgacc

SEQ ID NO: 1338734 - RNA, 21 nt, Human
cacugcacagggcuggaaagu

SEQ ID NO: 1338735 - RNA, 23 nt, Human
cagcccucaggaucccaaugcaa

SEQ ID NO: 1338736 - RNA, 19 nt, Human
cagcuggcuccuuggggcu

SEQ ID NO: 1338737 - RNA, 18 nt, Human
caggaagggaaguguggc

SEQ ID NO: 1338738 - RNA, 19 nt, Human
caggaagggaaguguggca

SEQ ID NO: 1338739 - RNA, 20 nt, Human
caggggccagcccucaggau

SEQ ID NO: 1338740 - RNA, 18 nt, Human
caggucagcucaggaagg

SEQ ID NO: 1338741 - RNA, 21 nt, Human
caguccuagaaagaccccagg

SEQ ID NO: 1338742 - RNA, 21 nt, Human
cagugguuuucuguccagucc

SEQ ID NO: 1338743 - RNA, 18 nt, Human
ccagggaggaguggccca

SEQ ID NO: 1338744 - RNA, 20 nt, Human
cccaggaucuacguauggcu

SEQ ID NO: 1338745 - RNA, 18 nt, Human
ccugcagacagcugcagg

SEQ ID NO: 1338746 - RNA, 23 nt, Human
ccuggaggcgggagacgcccggc

SEQ ID NO: 1338747 - RNA, 18 nt, Human
cuaccacaggggcagagg

SEQ ID NO: 1338748 - RNA, 20 nt, Human
cuaugcgcccaccucugccc

SEQ ID NO: 1338749 - RNA, 18 nt, Human
cucagggaacagggagcu

SEQ ID NO: 1338750 - RNA, 20 nt, Human
cuccuuggggcuugcagugg

SEQ ID NO: 1338751 - RNA, 19 nt, Human
cugcagugcccuggggauu

SEQ ID NO: 1338752 - RNA, 23 nt, Human
cuggaaagugccuccaauccuua

SEQ ID NO: 1338753 - RNA, 22 nt, Human
cuggagcauaggucaagcaggg

SEQ ID NO: 1338754 - RNA, 21 nt, Human
cuucaccagggcuugacgggc

SEQ ID NO: 1338755 - RNA, 22 nt, Human
gagaggagauccuggaggcggg

SEQ ID NO: 1338756 - RNA, 20 nt, Human
gagauccuggaggcgggaga

SEQ ID NO: 1338757 - RNA, 22 nt, Human
gagcacagucucugaacaaggg

SEQ ID NO: 1338758 - RNA, 19 nt, Human
gagcuuuaaugggggcagg

SEQ ID NO: 1338759 - RNA, 20 nt, Human
gcacaguccuagaaagaccc

SEQ ID NO: 1338760 - RNA, 18 nt, Human
gcagaggguggcuggggg

SEQ ID NO: 1338761 - RNA, 25 nt, Human
gcccaccucugcccagacucugcag

SEQ ID NO: 1338762 - RNA, 20 nt, Human
gcccagacucugcagugccc

SEQ ID NO: 1338763 - RNA, 19 nt, Human
gcugccacccgaccggugc

SEQ ID NO: 1338764 - RNA, 18 nt, Human
gcuucucagaagagcaca

SEQ ID NO: 1338765 - RNA, 18 nt, Human
ggaaacaggaagacuuag

SEQ ID NO: 1338766 - RNA, 21 nt, Human
ggcacaguccuagaaagaccc

SEQ ID NO: 1338767 - RNA, 19 nt, Human
ggcagggacuaggcugcag

SEQ ID NO: 1338768 - RNA, 19 nt, Human
gggaaacaggaagacuuag

SEQ ID NO: 1338769 - RNA, 19 nt, Human
ggucagcccuuugaggcca

SEQ ID NO: 1338770 - RNA, 22 nt, Human
ggucagcccuuugaggccaggu

SEQ ID NO: 1338771 - RNA, 24 nt, Human
guggcagugaggucaggucagcuc

SEQ ID NO: 1338772 - RNA, 19 nt, Human
uccccacgccgugcccagg

SEQ ID NO: 1338773 - RNA, 21 nt, Human
uccccacgccgugcccaggaa

SEQ ID NO: 1338774 - RNA, 23 nt, Human
uccccacgccgugcccaggaaga

SEQ ID NO: 1338775 - RNA, 24 nt, Human
ucccuggccauccgccugccaccu

SEQ ID NO: 1338776 - RNA, 19 nt, Human
uccgccugccaccuccacc

SEQ ID NO: 1338777 - RNA, 19 nt, Human
uccuuggggcuugcagugg

SEQ ID NO: 1338778 - RNA, 28 nt, Human
uccuuggggcuugcagugguuuucuguc

SEQ ID NO: 1338779 - RNA, 22 nt, Human
ugacaaggguugagggcagggu

SEQ ID NO: 1338780 - RNA, 18 nt, Human
ugaccagggagacggccu

SEQ ID NO: 1338781 - RNA, 19 nt, Human
ugaccagggagacggccua

SEQ ID NO: 1338782 - RNA, 21 nt, Human
ugcaggaaggccuggucugag

SEQ ID NO: 1338783 - RNA, 19 nt, Human
ugccaagaagacaagcuaa

SEQ ID NO: 1338784 - RNA, 24 nt, Human
ugccaagaagacaagcuaagcucc

SEQ ID NO: 1338785 - RNA, 25 nt, Human
ugccaagaagacaagcuaagcuccu

SEQ ID NO: 1338786 - RNA, 25 nt, Human
ugccuccaauccuuacuggagccuu

SEQ ID NO: 1338787 - RNA, 19 nt, Human
ugcgcccaccucugcccag

SEQ ID NO: 1338788 - RNA, 19 nt, Human
uggaggcucuuggcagagg

SEQ ID NO: 1338789 - RNA, 18 nt, Human
uggcaaaggggacccugg

SEQ ID NO: 1338790 - RNA, 20 nt, Human
uggcaagagccaccaugaca

SEQ ID NO: 1338791 - RNA, 21 nt, Human
uggcagccacauaacuggcag

SEQ ID NO: 1338792 - RNA, 21 nt, Human
uggcucccuggccauccgccu

SEQ ID NO: 1338793 - RNA, 19 nt, Human
uggcugggggagaagcuug

SEQ ID NO: 1338794 - RNA, 22 nt, Human
uggcugggggagaagcuugggc

SEQ ID NO: 1338795 - RNA, 20 nt, Human
ugggcagggacuaggcugca

SEQ ID NO: 1338796 - RNA, 24 nt, Human
ugggggcaggugagaggagauccu

SEQ ID NO: 1338797 - RNA, 23 nt, Human
ugguagcaacacugcacagggcu

SEQ ID NO: 1338798 - RNA, 24 nt, Human
uuuuuuuuuuugaguggcagagcu

SEQ ID NO: 1338799 - RNA, 22 nt, Human
uuuuuuuuuuuuuuuugagugg

SEQ ID NO: 1338800 - RNA, 27 nt, Human
uuuuuuuuuuuuuuuuuuuuuuugggg

SEQ ID NO: 1338801 - RNA, 22 nt, Human
aaaaggaaaaaagaaucagcag

SEQ ID NO: 1338802 - RNA, 24 nt, Human
aaaucagaaugaaauaucaaaaug

SEQ ID NO: 1338803 - RNA, 22 nt, Human
aaaucucagcagcucacgcucu

SEQ ID NO: 1338804 - RNA, 23 nt, Human
agacucccaaaucucagcagcuc

SEQ ID NO: 1338805 - RNA, 21 nt, Human
agugaacucuuccaucggcuc

SEQ ID NO: 1338806 - RNA, 22 nt, Human
auaaaaaccuguacaugaccuu

SEQ ID NO: 1338807 - RNA, 19 nt, Human
caagacgaguacccccuuc

SEQ ID NO: 1338808 - RNA, 19 nt, Human
ccaaaucucagcagcucac

SEQ ID NO: 1338809 - RNA, 23 nt, Human
ccacagauggaauagcugggaag

SEQ ID NO: 1338810 - RNA, 19 nt, Human
cccagacccuacugucccu

SEQ ID NO: 1338811 - RNA, 18 nt, Human
ccccuucugucgucuucu

SEQ ID NO: 1338812 - RNA, 20 nt, Human
cggcucagaacuccaagcgg

SEQ ID NO: 1338813 - RNA, 18 nt, Human
cguggccaacauuguuac

SEQ ID NO: 1338814 - RNA, 25 nt, Human
cucuuccaucggcucagaacuccaa

SEQ ID NO: 1338815 - RNA, 20 nt, Human
uaaaauauacguggccaaca

SEQ ID NO: 1338816 - RNA, 20 nt, Human
uauauauuaggaaguccagu

SEQ ID NO: 1338817 - RNA, 22 nt, Human
uauuaggaaguccaguuaauag

SEQ ID NO: 1338818 - RNA, 18 nt, Human
ucaccaagacgaguaccc

SEQ ID NO: 1338819 - RNA, 19 nt, Human
ucccaaaucucagcagcuc

SEQ ID NO: 1338820 - RNA, 23 nt, Human
uggaucccagacccuacuguccc

SEQ ID NO: 1338821 - RNA, 20 nt, Human
uguggguaguuggagagugg

SEQ ID NO: 1338822 - RNA, 25 nt, Human
uuaaaaaaaaaaaaaaggaaaaaag

SEQ ID NO: 1338823 - RNA, 23 nt, Human
uuuaaaaaaaaaaaaaaggaaaa

SEQ ID NO: 1338824 - RNA, 21 nt, Human
uuuggaucccagacccuacug

SEQ ID NO: 1338825 - RNA, 27 nt, Human
aaaaugaaaacacugcagggaagagaa

SEQ ID NO: 1338826 - RNA, 25 nt, Human
aaacaaguguacagacccuagacuc

SEQ ID NO: 1338827 - RNA, 19 nt, Human
aaacagaaaacaggcaaaa

SEQ ID NO: 1338828 - RNA, 23 nt, Human
aaugaaaacacugcagggaagag

SEQ ID NO: 1338829 - RNA, 18 nt, Human
aauuucccuccacaaccc

SEQ ID NO: 1338830 - RNA, 23 nt, Human
acacacagcacacauggggcgua

SEQ ID NO: 1338831 - RNA, 19 nt, Human
acacugcagggaagagaac

SEQ ID NO: 1338832 - RNA, 23 nt, Human
acaggcaggacacacacagcaca

SEQ ID NO: 1338833 - RNA, 21 nt, Human
acaggcuccagggagcaaugg

SEQ ID NO: 1338834 - RNA, 18 nt, Human
accaggacacaucugcau

SEQ ID NO: 1338835 - RNA, 21 nt, Human
acccccaacuccggggacgag

SEQ ID NO: 1338836 - RNA, 18 nt, Human
agagaacaaagucugguc

SEQ ID NO: 1338837 - RNA, 20 nt, Human
agagaacaaagucugguccc

SEQ ID NO: 1338838 - RNA, 21 nt, Human
aggaagaaagggggcagcagc

SEQ ID NO: 1338839 - RNA, 26 nt, Human
aggaagaaagggggcagcagcuccaa

SEQ ID NO: 1338840 - RNA, 20 nt, Human
aggaagagaacaaagucugg

SEQ ID NO: 1338841 - RNA, 20 nt, Human
aggcaggacacacacagcaa

SEQ ID NO: 1338842 - RNA, 19 nt, Human
agggccccacaccccaccu

SEQ ID NO: 1338843 - RNA, 20 nt, Human
aguaauagagggaggaggaa

SEQ ID NO: 1338844 - RNA, 20 nt, Human
aguagggcucugccugaggu

SEQ ID NO: 1338845 - RNA, 23 nt, Human
caaguggcagccagagaggccag

SEQ ID NO: 1338846 - RNA, 24 nt, Human
cacaacagauuugagcuaagacag

SEQ ID NO: 1338847 - RNA, 24 nt, Human
cacacacagcacacauggggcgua

SEQ ID NO: 1338848 - RNA, 23 nt, Human
cacagcacacauggggcguaagg

SEQ ID NO: 1338849 - RNA, 23 nt, Human
cacagcacacauggggcguaagg

SEQ ID NO: 1338850 - RNA, 23 nt, Human
caccacucacgcacacacacaac

SEQ ID NO: 1338851 - RNA, 22 nt, Human
caccugugggaagggcagggcc

SEQ ID NO: 1338852 - RNA, 21 nt, Human
caccuuugguccagauggccc

SEQ ID NO: 1338853 - RNA, 23 nt, Human
cacgcacacacacaacauaacca

SEQ ID NO: 1338854 - RNA, 27 nt, Human
cacgcacacacacaacauaaccaagug

SEQ ID NO: 1338855 - RNA, 18 nt, Human
cagccgaggccaggaaga

SEQ ID NO: 1338856 - RNA, 21 nt, Human
cagcugaguagggcucugccu

SEQ ID NO: 1338857 - RNA, 21 nt, Human
cagguacagcugaguagggcu

SEQ ID NO: 1338858 - RNA, 18 nt, Human
ccaacaggcaugacaggc

SEQ ID NO: 1338859 - RNA, 23 nt, Human
ccacaccccaccuuugguccaga

SEQ ID NO: 1338860 - RNA, 25 nt, Human
ccacaccccaccuuugguccagaug

SEQ ID NO: 1338861 - RNA, 26 nt, Human
ccacauauacaggcaggacacacaca

SEQ ID NO: 1338862 - RNA, 22 nt, Human
ccaccuuugguccagauggccc

SEQ ID NO: 1338863 - RNA, 24 nt, Human
ccacucacgcacacacacaacaua

SEQ ID NO: 1338864 - RNA, 26 nt, Human
ccagaacaccguggacugggguacag

SEQ ID NO: 1338865 - RNA, 19 nt, Human
ccaggacacaucugcauca

SEQ ID NO: 1338866 - RNA, 21 nt, Human
ccauccagggccccacacccc

SEQ ID NO: 1338867 - RNA, 18 nt, Human
cccaaaggaucaaagucc

SEQ ID NO: 1338868 - RNA, 19 nt, Human
cccaaaggaucaaagucca

SEQ ID NO: 1338869 - RNA, 18 nt, Human
cccaggggagaugcgggg

SEQ ID NO: 1338870 - RNA, 22 nt, Human
cccccaccaccccauucuuuga

SEQ ID NO: 1338871 - RNA, 20 nt, Human
cccugggggcagcuaggcug

SEQ ID NO: 1338872 - RNA, 21 nt, Human
cccuggugugacaggcccuac

SEQ ID NO: 1338873 - RNA, 19 nt, Human
ccucgccccgccccgcccc

SEQ ID NO: 1338874 - RNA, 23 nt, Human
ccugcugccagaacaccguggac

SEQ ID NO: 1338875 - RNA, 23 nt, Human
cgagccauggccucaagcagcag

SEQ ID NO: 1338876 - RNA, 19 nt, Human
cgccccggcccggcugguu

SEQ ID NO: 1338877 - RNA, 30 nt, Human
cgccugcacaccacucacgcacacacacag

SEQ ID NO: 1338878 - RNA, 18 nt, Human
cgcgccugcacaccacuc

SEQ ID NO: 1338879 - RNA, 19 nt, Human
cucccucgccccgccccgc

SEQ ID NO: 1338880 - RNA, 18 nt, Human
cugauccccaacaggcau

SEQ ID NO: 1338881 - RNA, 21 nt, Human
cugcaacggguacccccaacu

SEQ ID NO: 1338882 - RNA, 23 nt, Human
cugcaacggguacccccaacucc

SEQ ID NO: 1338883 - RNA, 24 nt, Human
cugcaucacacagaaagcugcgcc

SEQ ID NO: 1338884 - RNA, 18 nt, Human
cuggcaucaggaggcugc

SEQ ID NO: 1338885 - RNA, 22 nt, Human
gaaaacacugcagggaagagaa

SEQ ID NO: 1338886 - RNA, 18 nt, Human
gaagagaacugagugugc

SEQ ID NO: 1338887 - RNA, 19 nt, Human
gacacaucugcaucacaca

SEQ ID NO: 1338888 - RNA, 22 nt, Human
gagaacugagugugcuggugga

SEQ ID NO: 1338889 - RNA, 22 nt, Human
gagcucccugggggcagcuagg

SEQ ID NO: 1338890 - RNA, 23 nt, Human
gcagcagagcucccugggggcag

SEQ ID NO: 1338891 - RNA, 22 nt, Human
gcccccaccucucaggggccac

SEQ ID NO: 1338892 - RNA, 21 nt, Human
gccgaaaccaggacacaucug

SEQ ID NO: 1338893 - RNA, 18 nt, Human
gcucaccugugggaaggg

SEQ ID NO: 1338894 - RNA, 20 nt, Human
gcugguggacaggagcccug

SEQ ID NO: 1338895 - RNA, 25 nt, Human
gggcagcagagcucccugggggcag

SEQ ID NO: 1338896 - RNA, 20 nt, Human
uaagcuggagaagaacucca

SEQ ID NO: 1338897 - RNA, 24 nt, Human
uacagacccuagacucagaaacac

SEQ ID NO: 1338898 - RNA, 24 nt, Human
uacccccaacuccggggacgagcc

SEQ ID NO: 1338899 - RNA, 23 nt, Human
uagacucagaaacacaacagauu

SEQ ID NO: 1338900 - RNA, 19 nt, Human
uagggcucugccugaggug

SEQ ID NO: 1338901 - RNA, 21 nt, Human
uccaacuuggccagaucccaa

SEQ ID NO: 1338902 - RNA, 21 nt, Human
uccacaacccagggguuucag

SEQ ID NO: 1338903 - RNA, 19 nt, Human
ucccuccacaacccagggg

SEQ ID NO: 1338904 - RNA, 24 nt, Human
ucccugcugccagaacaccgugga

SEQ ID NO: 1338905 - RNA, 19 nt, Human
ucccugggggcagcuaggc

SEQ ID NO: 1338906 - RNA, 26 nt, Human
ucugggccagagcugccauccagggc

SEQ ID NO: 1338907 - RNA, 26 nt, Human
ugaaaacacugcagggaagagaacug

SEQ ID NO: 1338908 - RNA, 22 nt, Human
ugaaacagaaaacaggcaaaau

SEQ ID NO: 1338909 - RNA, 24 nt, Human
ugaaacagaaaacaggcaaaaugg

SEQ ID NO: 1338910 - RNA, 19 nt, Human
ugacaggcuccagggagca

SEQ ID NO: 1338911 - RNA, 21 nt, Human
ugagauuuuaggaagcauaau

SEQ ID NO: 1338912 - RNA, 20 nt, Human
ugaggcuggugucgggaagc

SEQ ID NO: 1338913 - RNA, 23 nt, Human
ugaggcuggugucgggaagcagg

SEQ ID NO: 1338914 - RNA, 21 nt, Human
ugaguagggcucugccugagg

SEQ ID NO: 1338915 - RNA, 24 nt, Human
ugaguagggcucugccugaggugu

SEQ ID NO: 1338916 - RNA, 21 nt, Human
ugauccgcgcggccgccccuc

SEQ ID NO: 1338917 - RNA, 18 nt, Human
ugccagaacaccguggac

SEQ ID NO: 1338918 - RNA, 21 nt, Human
ugccugauccccaacaggcau

SEQ ID NO: 1338919 - RNA, 21 nt, Human
uggacacacacagcacacaug

SEQ ID NO: 1338920 - RNA, 22 nt, Human
uggcaaggauuguuccccaccu

SEQ ID NO: 1338921 - RNA, 18 nt, Human
uggcagccagagaggcca

SEQ ID NO: 1338922 - RNA, 23 nt, Human
uggcagccagagaggccagggaa

SEQ ID NO: 1338923 - RNA, 18 nt, Human
uggcccaggugucccugc

SEQ ID NO: 1338924 - RNA, 19 nt, Human
uggcccauuggcccaggug

SEQ ID NO: 1338925 - RNA, 21 nt, Human
ugggcgggcggacgggcggac

SEQ ID NO: 1338926 - RNA, 21 nt, Human
uucuuugaguuuggcuugaga

SEQ ID NO: 1338927 - RNA, 23 nt, Human
uugagcuaagacagcucugguga

SEQ ID NO: 1338928 - RNA, 18 nt, Human
uuuggcuaaaauaaaaug

SEQ ID NO: 1338929 - RNA, 21 nt, Human
aguacugcaacugagcucaga

SEQ ID NO: 1338930 - RNA, 19 nt, Human
uucccgaguacugcaacug

SEQ ID NO: 1338931 - RNA, 21 nt, Human
aacaggaaacacgagaaccca

SEQ ID NO: 1338932 - RNA, 24 nt, Human
aacugaaacaaacaaaaagaauuc

SEQ ID NO: 1338933 - RNA, 21 nt, Human
aaguguaaggaagacaugaaa

SEQ ID NO: 1338934 - RNA, 18 nt, Human
acauugagaagaaagaga

SEQ ID NO: 1338935 - RNA, 19 nt, Human
agaaggcagaugacauuau

SEQ ID NO: 1338936 - RNA, 24 nt, Human
agagcuaaaaguuaucucuaagcc

SEQ ID NO: 1338937 - RNA, 22 nt, Human
auggguuucugagguugguugg

SEQ ID NO: 1338938 - RNA, 21 nt, Human
cagaaaugcuggugauccuga

SEQ ID NO: 1338939 - RNA, 20 nt, Human
ccugaacaggaaacacgaga

SEQ ID NO: 1338940 - RNA, 19 nt, Human
ccugggagaaauuccuaug

SEQ ID NO: 1338941 - RNA, 18 nt, Human
cggcauggacaaggcaga

SEQ ID NO: 1338942 - RNA, 19 nt, Human
cuacagcggugagagugaa

SEQ ID NO: 1338943 - RNA, 24 nt, Human
cugaaacaaacaaaaagaauuccu

SEQ ID NO: 1338944 - RNA, 26 nt, Human
cugaacaggaaacacgagaacccauu

SEQ ID NO: 1338945 - RNA, 23 nt, Human
gaacugaaacuauuacaggugca

SEQ ID NO: 1338946 - RNA, 21 nt, Human
gaagggaauaucggggacggu

SEQ ID NO: 1338947 - RNA, 22 nt, Human
gacuaguaugaacugaaacaaa

SEQ ID NO: 1338948 - RNA, 24 nt, Human
ggaggggagacaauuaucagaguc

SEQ ID NO: 1338949 - RNA, 20 nt, Human
ggguuucugagguugguugg

SEQ ID NO: 1338950 - RNA, 19 nt, Human
uacugugagcuaguucagg

SEQ ID NO: 1338951 - RNA, 21 nt, Human
uauggaggggagacaauuauc

SEQ ID NO: 1338952 - RNA, 26 nt, Human
uauuauuaaaucuucaguaccugaaa

SEQ ID NO: 1338953 - RNA, 21 nt, Human
ugaacaggaaacacgagaacc

SEQ ID NO: 1338954 - RNA, 18 nt, Human
ugacugucagagaaaagg

SEQ ID NO: 1338955 - RNA, 22 nt, Human
ugagaagaaagagagcuaaaag

SEQ ID NO: 1338956 - RNA, 18 nt, Human
ugcccugggcccccgggc

SEQ ID NO: 1338957 - RNA, 19 nt, Human
ugucucaacuagcccuugc

SEQ ID NO: 1338958 - RNA, 22 nt, Human
uguuccauuucccaaugucuca

SEQ ID NO: 1338959 - RNA, 18 nt, Human
uuccuacagcggugagag

SEQ ID NO: 1338960 - RNA, 18 nt, Human
uuccugggagaaauuccu

SEQ ID NO: 1338961 - RNA, 24 nt, Human
uuccuuguguauuugcugguacaa

SEQ ID NO: 1338962 - RNA, 22 nt, Human
aaaaacaauucuuccaggccga

SEQ ID NO: 1338963 - RNA, 19 nt, Human
aaaagaaacagaaaaccuc

SEQ ID NO: 1338964 - RNA, 22 nt, Human
aaagaaacagaaaaccucacau

SEQ ID NO: 1338965 - RNA, 23 nt, Human
aaauagaaaaugaaaacacaaaa

SEQ ID NO: 1338966 - RNA, 24 nt, Human
aacagaaaaccucacauuaaaaaa

SEQ ID NO: 1338967 - RNA, 20 nt, Human
acugguaucaaaacacacau

SEQ ID NO: 1338968 - RNA, 18 nt, Human
aggcaaaaaagaaacaga

SEQ ID NO: 1338969 - RNA, 23 nt, Human
aggcaaaaaagaaacagaaaacc

SEQ ID NO: 1338970 - RNA, 20 nt, Human
aggugcauaucuaaauucua

SEQ ID NO: 1338971 - RNA, 21 nt, Human
augaaguacaauuucuucagu

SEQ ID NO: 1338972 - RNA, 24 nt, Human
auuaaaaaaaaaaaaaaaguuucu

SEQ ID NO: 1338973 - RNA, 19 nt, Human
caaaacacacaucaacagc

SEQ ID NO: 1338974 - RNA, 23 nt, Human
ccaggccgaguguagggcugccg

SEQ ID NO: 1338975 - RNA, 21 nt, Human
ccugaagcugaaucuuaaggc

SEQ ID NO: 1338976 - RNA, 22 nt, Human
cuaaauguuuuccugaagcuga

SEQ ID NO: 1338977 - RNA, 23 nt, Human
gaagaaaaacaauucuuccaggc

SEQ ID NO: 1338978 - RNA, 18 nt, Human
uaaaaaguaaauaaagaa

SEQ ID NO: 1338979 - RNA, 24 nt, Human
uaaacucaggaaaaacuguuaagg

SEQ ID NO: 1338980 - RNA, 22 nt, Human
ucacauuaaaaaaaaaaaaaaa

SEQ ID NO: 1338981 - RNA, 22 nt, Human
ucacauuaaaaaaaaaaaaaaa

SEQ ID NO: 1338982 - RNA, 24 nt, Human
ucacauuaaaaaaaaaaaaaaagu

SEQ ID NO: 1338983 - RNA, 23 nt, Human
ucaggaaaaacuguuaaggggca

SEQ ID NO: 1338984 - RNA, 23 nt, Human
ucuauagcuuaccaauaucuucu

SEQ ID NO: 1338985 - RNA, 23 nt, Human
ugaaguacaauuucuucaguaaa

SEQ ID NO: 1338986 - RNA, 24 nt, Human
aaucacuugaacucagggguugga

SEQ ID NO: 1338987 - RNA, 24 nt, Human
aaucacuugaacucagggguugga

SEQ ID NO: 1338988 - RNA, 22 nt, Human
acuuugaggaaugcaguguagg

SEQ ID NO: 1338989 - RNA, 26 nt, Human
agacaaauaagucuccacuccaauau

SEQ ID NO: 1338990 - RNA, 24 nt, Human
aggcacgguggcucacgccuguaa

SEQ ID NO: 1338991 - RNA, 21 nt, Human
aguacuuugggaggccaaggg

SEQ ID NO: 1338992 - RNA, 19 nt, Human
caaguuuuucacucacuca

SEQ ID NO: 1338993 - RNA, 24 nt, Human
cacgccuguaaucccaguacuuug

SEQ ID NO: 1338994 - RNA, 20 nt, Human
caguacuuugggaggccaag

SEQ ID NO: 1338995 - RNA, 22 nt, Human
caguacuuugggaggccaaggg

SEQ ID NO: 1338996 - RNA, 25 nt, Human
ccuccaaaauaugucuuaaauccau

SEQ ID NO: 1338997 - RNA, 22 nt, Human
ccuuccacaucuaauccuucag

SEQ ID NO: 1338998 - RNA, 23 nt, Human
cgccuguaaucccaguacuuugg

SEQ ID NO: 1338999 - RNA, 24 nt, Human
cgccuguaaucccaguacuuuggg

SEQ ID NO: 1339000 - RNA, 22 nt, Human
cucacgccuguaaucccaguac

SEQ ID NO: 1339001 - RNA, 24 nt, Human
cucacgccuguaaucccaguacuu

SEQ ID NO: 1339002 - RNA, 24 nt, Human
gaggugaaucacuugaacucaggg

SEQ ID NO: 1339003 - RNA, 23 nt, Human
gguggcucacgccuguaauccca

SEQ ID NO: 1339004 - RNA, 24 nt, Human
gguggcucacgccuguaaucccag

SEQ ID NO: 1339005 - RNA, 22 nt, Human
gguguauguccgacaaagaaaa

SEQ ID NO: 1339006 - RNA, 22 nt, Human
ucacgccuguaaucccaguacu

SEQ ID NO: 1339007 - RNA, 23 nt, Human
ucagccaggcacgguggcucacg

SEQ ID NO: 1339008 - RNA, 23 nt, Human
ucagggguuggagagcagccggg

SEQ ID NO: 1339009 - RNA, 23 nt, Human
uccugacaauguuaccuccaaaa

SEQ ID NO: 1339010 - RNA, 23 nt, Human
ugaaucacuugaacucagggguu

SEQ ID NO: 1339011 - RNA, 22 nt, Human
uggcucacgccuguaaucccag

SEQ ID NO: 1339012 - RNA, 22 nt, Human
uggcucacgccuguaaucccag

SEQ ID NO: 1339013 - RNA, 24 nt, Human
uggcucacgccuguaaucccagua

SEQ ID NO: 1339014 - RNA, 24 nt, Human
ugggaggccaagggaggugaauca

SEQ ID NO: 1339015 - RNA, 21 nt, Human
uguggagagacccaaucucuc

SEQ ID NO: 1339016 - RNA, 18 nt, Human
uuuuuuuuuuuuuuuuug

SEQ ID NO: 1339017 - RNA, 20 nt, Human
uuuuuuuuuuuuuuuuuggu

SEQ ID NO: 1339018 - RNA, 21 nt, Human
aaaaaagaaaaagugaaaggg

SEQ ID NO: 1339019 - RNA, 21 nt, Human
aagcaauccuccugucucagc

SEQ ID NO: 1339020 - RNA, 25 nt, Human
aagcaauccuccugucucagccucc

SEQ ID NO: 1339021 - RNA, 19 nt, Human
aaugaaaagagcagugaga

SEQ ID NO: 1339022 - RNA, 18 nt, Human
agacaagaucuuacuaug

SEQ ID NO: 1339023 - RNA, 22 nt, Human
agaggaacagagugaauaucau

SEQ ID NO: 1339024 - RNA, 22 nt, Human
agcagugagauucugggaagga

SEQ ID NO: 1339025 - RNA, 23 nt, Human
agcguggggagccgggggaggga

SEQ ID NO: 1339026 - RNA, 21 nt, Human
agcugacgaaugagaaaaaaa

SEQ ID NO: 1339027 - RNA, 23 nt, Human
agggacaggauaggcagcagcca

SEQ ID NO: 1339028 - RNA, 18 nt, Human
aguagcugggacuacagg

SEQ ID NO: 1339029 - RNA, 19 nt, Human
aguagcugggacuacaggc

SEQ ID NO: 1339030 - RNA, 20 nt, Human
auccuccugucucagccucc

SEQ ID NO: 1339031 - RNA, 24 nt, Human
augaauuccguaaaaaagaaaaag

SEQ ID NO: 1339032 - RNA, 22 nt, Human
augcucaauucagaacuguauc

SEQ ID NO: 1339033 - RNA, 21 nt, Human
caaacucccaaagggcugcca

SEQ ID NO: 1339034 - RNA, 24 nt, Human
caagaucuuacuauguugcccagg

SEQ ID NO: 1339035 - RNA, 19 nt, Human
caccgcuggcccgucccuc

SEQ ID NO: 1339036 - RNA, 20 nt, Human
cagcaggcgcgggcgguugg

SEQ ID NO: 1339037 - RNA, 20 nt, Human
cagccuccugaguagcuggg

SEQ ID NO: 1339038 - RNA, 19 nt, Human
cagcuggcuccuccaagua

SEQ ID NO: 1339039 - RNA, 24 nt, Human
cagggacaggauaggcagcagcca

SEQ ID NO: 1339040 - RNA, 19 nt, Human
caguguaccuagaauuugu

SEQ ID NO: 1339041 - RNA, 19 nt, Human
cauguggcuuuuuucugua

SEQ ID NO: 1339042 - RNA, 18 nt, Human
cauuugagucccacaugu

SEQ ID NO: 1339043 - RNA, 25 nt, Human
cauuuuuguuauuuucuucucugau

SEQ ID NO: 1339044 - RNA, 19 nt, Human
ccauccccgccgcugccug

SEQ ID NO: 1339045 - RNA, 18 nt, Human
ccgccucgccuccgcugc

SEQ ID NO: 1339046 - RNA, 19 nt, Human
ccucagauccagggacagg

SEQ ID NO: 1339047 - RNA, 27 nt, Human
ccucuuguccucucuucccuccuccag

SEQ ID NO: 1339048 - RNA, 23 nt, Human
ccugaguagcugggacuacaggc

SEQ ID NO: 1339049 - RNA, 24 nt, Human
ccugaguagcugggacuacaggcg

SEQ ID NO: 1339050 - RNA, 23 nt, Human
ccugauuccucauucccaggugc

SEQ ID NO: 1339051 - RNA, 19 nt, Human
cgccauccccgccgcugcc

SEQ ID NO: 1339052 - RNA, 19 nt, Human
cggucucuucuugugcacc

SEQ ID NO: 1339053 - RNA, 24 nt, Human
cucagccuccugaguagcugggac

SEQ ID NO: 1339054 - RNA, 23 nt, Human
cuccugggcuuaagcaauccucc

SEQ ID NO: 1339055 - RNA, 22 nt, Human
cucgccauccccgccgcugccu

SEQ ID NO: 1339056 - RNA, 23 nt, Human
cugucucagccuccugaguagcu

SEQ ID NO: 1339057 - RNA, 23 nt, Human
gacuacaggcggauacuacugca

SEQ ID NO: 1339058 - RNA, 21 nt, Human
gagcguggggagccgggggag

SEQ ID NO: 1339059 - RNA, 25 nt, Human
gaguagcugggacuacaggcggaua

SEQ ID NO: 1339060 - RNA, 20 nt, Human
gagucccacauguggcuuuu

SEQ ID NO: 1339061 - RNA, 23 nt, Human
gaugaugaauuccguaaaaaaga

SEQ ID NO: 1339062 - RNA, 20 nt, Human
gauucugggaaggaaaacuc

SEQ ID NO: 1339063 - RNA, 19 nt, Human
gcaagggaaaggccucaga

SEQ ID NO: 1339064 - RNA, 18 nt, Human
gcuccuccaaguacuucu

SEQ ID NO: 1339065 - RNA, 19 nt, Human
gcuggcccgucccucaggc

SEQ ID NO: 1339066 - RNA, 20 nt, Human
ggacuggcuugucucuccca

SEQ ID NO: 1339067 - RNA, 19 nt, Human
gggcuuaagcaauccuccu

SEQ ID NO: 1339068 - RNA, 22 nt, Human
guaaaaaagaaaaagugaaagg

SEQ ID NO: 1339069 - RNA, 27 nt, Human
uaagcaauccuccugucucagccuccu

SEQ ID NO: 1339070 - RNA, 19 nt, Human
uaagugauacuauaauuac

SEQ ID NO: 1339071 - RNA, 24 nt, Human
uaauuacagagcugacgaaugaga

SEQ ID NO: 1339072 - RNA, 23 nt, Human
uacuauguugcccaggugggacu

SEQ ID NO: 1339073 - RNA, 25 nt, Human
uacuauguugcccaggugggacuug

SEQ ID NO: 1339074 - RNA, 20 nt, Human
uauguugcccaggugggacu

SEQ ID NO: 1339075 - RNA, 23 nt, Human
ucagccuccugaguagcugggac

SEQ ID NO: 1339076 - RNA, 24 nt, Human
uccauuuuuguuauuuucuucucu

SEQ ID NO: 1339077 - RNA, 18 nt, Human
ucccaaagggcugccaag

SEQ ID NO: 1339078 - RNA, 21 nt, Human
ucccaggugcacagugcucuc

SEQ ID NO: 1339079 - RNA, 26 nt, Human
uccuccugucucagccuccugaguag

SEQ ID NO: 1339080 - RNA, 24 nt, Human
uccugaguagcugggacuacaggc

SEQ ID NO: 1339081 - RNA, 18 nt, Human
uccugggcuuaagcaauc

SEQ ID NO: 1339082 - RNA, 24 nt, Human
uccugggcuuaagcaauccuccug

SEQ ID NO: 1339083 - RNA, 18 nt, Human
ucuauggcaagggaaagg

SEQ ID NO: 1339084 - RNA, 18 nt, Human
ucugucuuggggccugau

SEQ ID NO: 1339085 - RNA, 19 nt, Human
ucuuacuauguugcccagg

SEQ ID NO: 1339086 - RNA, 22 nt, Human
ucuuacuauguugcccaggugg

SEQ ID NO: 1339087 - RNA, 23 nt, Human
ucuuacuauguugcccagguggg

SEQ ID NO: 1339088 - RNA, 24 nt, Human
ucuuguccucucuucccuccucca

SEQ ID NO: 1339089 - RNA, 18 nt, Human
ugagaaaaaaauucagaa

SEQ ID NO: 1339090 - RNA, 19 nt, Human
ugagaaaaaaauucagaau

SEQ ID NO: 1339091 - RNA, 28 nt, Human
ugagaaaaaaauucagaauuaucuagaa

SEQ ID NO: 1339092 - RNA, 24 nt, Human
ugagcuccugggcuuaagcaaucc

SEQ ID NO: 1339093 - RNA, 19 nt, Human
uggcagcaggcgcgggcgg

SEQ ID NO: 1339094 - RNA, 19 nt, Human
uggcagcaggcgcgggcgg

SEQ ID NO: 1339095 - RNA, 21 nt, Human
uggcuugucucucccacuggu

SEQ ID NO: 1339096 - RNA, 19 nt, Human
ugggacuacaggcggauac

SEQ ID NO: 1339097 - RNA, 21 nt, Human
ugggacuacaggcggauacua

SEQ ID NO: 1339098 - RNA, 24 nt, Human
ugggacuacaggcggauacuacug

SEQ ID NO: 1339099 - RNA, 24 nt, Human
ugucucagccuccugaguagcugg

SEQ ID NO: 1339100 - RNA, 24 nt, Human
uguggauuuccccaagugaaaugu

SEQ ID NO: 1339101 - RNA, 18 nt, Human
uucccaggugcacagugc

SEQ ID NO: 1339102 - RNA, 18 nt, Human
uucugggaaggaaaacuc

SEQ ID NO: 1339103 - RNA, 23 nt, Human
uugagucccacauguggcuuuuu

SEQ ID NO: 1339104 - RNA, 23 nt, Human
uuguggcugccaccaccuuuucu

SEQ ID NO: 1339105 - RNA, 23 nt, Human
uuuacaaacucccaaagggcugc

SEQ ID NO: 1339106 - RNA, 24 nt, Human
aaacagccaaaaucuuaucaagac

SEQ ID NO: 1339107 - RNA, 26 nt, Human
aaauaagcaaaauaaaauaaaaacau

SEQ ID NO: 1339108 - RNA, 22 nt, Human
aacaaauuaccucucuucucuc

SEQ ID NO: 1339109 - RNA, 19 nt, Human
aacaaauuuuagccaauag

SEQ ID NO: 1339110 - RNA, 24 nt, Human
aaccccccacccccaaccccuacc

SEQ ID NO: 1339111 - RNA, 21 nt, Human
aaccccuuccuccauacucua

SEQ ID NO: 1339112 - RNA, 23 nt, Human
aacuccugggcucaagcgauccu

SEQ ID NO: 1339113 - RNA, 21 nt, Human
aagagcacagucucugcaguc

SEQ ID NO: 1339114 - RNA, 21 nt, Human
aagcaccuggcauauagagga

SEQ ID NO: 1339115 - RNA, 23 nt, Human
aagcaccuggcauauagaggaca

SEQ ID NO: 1339116 - RNA, 18 nt, Human
aagcugugucaacagaug

SEQ ID NO: 1339117 - RNA, 19 nt, Human
aaggcgaaaguuguugaga

SEQ ID NO: 1339118 - RNA, 24 nt, Human
aagguguugggauuacaggcguga

SEQ ID NO: 1339119 - RNA, 21 nt, Human
acagaugaaguaggggaaggu

SEQ ID NO: 1339120 - RNA, 18 nt, Human
acagucucugcagucaca

SEQ ID NO: 1339121 - RNA, 22 nt, Human
accccccacccccaaccccuac

SEQ ID NO: 1339122 - RNA, 25 nt, Human
agagaauaguggaaaaccaaacagc

SEQ ID NO: 1339123 - RNA, 25 nt, Human
agcgauccucuugcaucagccuccu

SEQ ID NO: 1339124 - RNA, 21 nt, Human
agcgggugacacagcagguua

SEQ ID NO: 1339125 - RNA, 24 nt, Human
aggaauucccagggagggaaaaug

SEQ ID NO: 1339126 - RNA, 25 nt, Human
aggcuggagugcaguggcgugaucu

SEQ ID NO: 1339127 - RNA, 26 nt, Human
agguguugggauuacaggcgugagcc

SEQ ID NO: 1339128 - RNA, 21 nt, Human
agguucaagugauucuccugc

SEQ ID NO: 1339129 - RNA, 22 nt, Human
agguucaagugauucuccugcc

SEQ ID NO: 1339130 - RNA, 23 nt, Human
agguucaagugauucuccugccu

SEQ ID NO: 1339131 - RNA, 23 nt, Human
aguagcugggacuacaggcacgu

SEQ ID NO: 1339132 - RNA, 24 nt, Human
agugauucuccugccucagccucc

SEQ ID NO: 1339133 - RNA, 19 nt, Human
agugcaguggcgugaucuu

SEQ ID NO: 1339134 - RNA, 21 nt, Human
agugcaguggcgugaucuuag

SEQ ID NO: 1339135 - RNA, 23 nt, Human
agugcaguggcgugaucuuagcu

SEQ ID NO: 1339136 - RNA, 24 nt, Human
agugcaguggcgugaucuuagcuc

SEQ ID NO: 1339137 - RNA, 20 nt, Human
aguuuccucauuugucacac

SEQ ID NO: 1339138 - RNA, 19 nt, Human
auaggauuucccugccucc

SEQ ID NO: 1339139 - RNA, 22 nt, Human
augggguuucaccauguuggcc

SEQ ID NO: 1339140 - RNA, 23 nt, Human
augggguuucaccauguuggcca

SEQ ID NO: 1339141 - RNA, 24 nt, Human
augggguuucaccauguuggccag

SEQ ID NO: 1339142 - RNA, 18 nt, Human
augggguuucacuauguu

SEQ ID NO: 1339143 - RNA, 24 nt, Human
augggguuucacuauguugcuuag

SEQ ID NO: 1339144 - RNA, 18 nt, Human
auucuccugccucagccu

SEQ ID NO: 1339145 - RNA, 24 nt, Human
auuuuuguauuuuuaguagagaug

SEQ ID NO: 1339146 - RNA, 21 nt, Human
caaccccccacccccaacccc

SEQ ID NO: 1339147 - RNA, 25 nt, Human
caaccccccacccccaaccccuacc

SEQ ID NO: 1339148 - RNA, 20 nt, Human
caagugauucuccugccuca

SEQ ID NO: 1339149 - RNA, 22 nt, Human
caagugauucuccugccucagc

SEQ ID NO: 1339150 - RNA, 19 nt, Human
caaucuuuuuuuuuugggg

SEQ ID NO: 1339151 - RNA, 19 nt, Human
caccacgcccggcuaauuu

SEQ ID NO: 1339152 - RNA, 24 nt, Human
caccacgcccggcuaauuuuugua

SEQ ID NO: 1339153 - RNA, 18 nt, Human
caccauguuggccaggau

SEQ ID NO: 1339154 - RNA, 22 nt, Human
caccauguuggccaggaugggc

SEQ ID NO: 1339155 - RNA, 26 nt, Human
caccuccaaucuuuuuuuuuuggggg

SEQ ID NO: 1339156 - RNA, 18 nt, Human
caccucggacuccuaagg

SEQ ID NO: 1339157 - RNA, 24 nt, Human
caccucuguuuaguauuuugagag

SEQ ID NO: 1339158 - RNA, 21 nt, Human
cacugcaaccuccgccuccca

SEQ ID NO: 1339159 - RNA, 18 nt, Human
cagaagcaggaauuccca

SEQ ID NO: 1339160 - RNA, 25 nt, Human
cagccaaaaucuuaucaauaaaacc

SEQ ID NO: 1339161 - RNA, 22 nt, Human
cagccuccugaguggcuggggg

SEQ ID NO: 1339162 - RNA, 22 nt, Human
ccaaccccccacccccaacccc

SEQ ID NO: 1339163 - RNA, 23 nt, Human
ccacugcgcccggcccaucaccu

SEQ ID NO: 1339164 - RNA, 19 nt, Human
ccagcugugggacuugggc

SEQ ID NO: 1339165 - RNA, 20 nt, Human
ccagcugugggacuugggcc

SEQ ID NO: 1339166 - RNA, 18 nt, Human
cccacccccaaccccuac

SEQ ID NO: 1339167 - RNA, 23 nt, Human
cccagguucaagugauucuccuc

SEQ ID NO: 1339168 - RNA, 23 nt, Human
cccagguucaagugauucuccug

SEQ ID NO: 1339169 - RNA, 20 nt, Human
ccccaaccccccacccccaa

SEQ ID NO: 1339170 - RNA, 21 nt, Human
ccccaaccccccacccccaac

SEQ ID NO: 1339171 - RNA, 22 nt, Human
ccccaaccccccacccccaacc

SEQ ID NO: 1339172 - RNA, 23 nt, Human
ccccaaccccccacccccaaccc

SEQ ID NO: 1339173 - RNA, 22 nt, Human
ccccaaccccuaccccaguguu

SEQ ID NO: 1339174 - RNA, 20 nt, Human
ccccacccccaaccccuacc

SEQ ID NO: 1339175 - RNA, 24 nt, Human
cccccaaccccccacccccaaccc

SEQ ID NO: 1339176 - RNA, 21 nt, Human
ccccccacccccaaccccuac

SEQ ID NO: 1339177 - RNA, 24 nt, Human
ccccugagccucaguuuccucauu

SEQ ID NO: 1339178 - RNA, 23 nt, Human
cccgaguagcugggacuacaggc

SEQ ID NO: 1339179 - RNA, 24 nt, Human
cccgaguagcugggacuacaggca

SEQ ID NO: 1339180 - RNA, 18 nt, Human
cccugccucccccaaccc

SEQ ID NO: 1339181 - RNA, 22 nt, Human
ccgcaggcuggagugcaguggc

SEQ ID NO: 1339182 - RNA, 24 nt, Human
ccgccucccagguucaagugauuc

SEQ ID NO: 1339183 - RNA, 24 nt, Human
ccucccagguucaagugauucucc

SEQ ID NO: 1339184 - RNA, 22 nt, Human
ccugaccucgugauccacccac

SEQ ID NO: 1339185 - RNA, 19 nt, Human
ccugggcucaagcgauccu

SEQ ID NO: 1339186 - RNA, 20 nt, Human
ccugggcucaagcgauccuc

SEQ ID NO: 1339187 - RNA, 22 nt, Human
cgccucccagguucaagugauu

SEQ ID NO: 1339188 - RNA, 22 nt, Human
cuaagguguugggauuacaggc

SEQ ID NO: 1339189 - RNA, 24 nt, Human
cuaagguguugggauuacaggcgu

SEQ ID NO: 1339190 - RNA, 24 nt, Human
cucacugcaaccuccgccucccag

SEQ ID NO: 1339191 - RNA, 24 nt, Human
cucagccucccgaguagcugggac

SEQ ID NO: 1339192 - RNA, 19 nt, Human
cucccagguucaagugauu

SEQ ID NO: 1339193 - RNA, 20 nt, Human
cucccccaaccccccacccc

SEQ ID NO: 1339194 - RNA, 26 nt, Human
cucccccaaccccccacccccaaccc

SEQ ID NO: 1339195 - RNA, 18 nt, Human
cuccugaccucgugaucc

SEQ ID NO: 1339196 - RNA, 25 nt, Human
cuccugaccucgugauccacccacc

SEQ ID NO: 1339197 - RNA, 23 nt, Human
cuccugggcucaagcgauccucu

SEQ ID NO: 1339198 - RNA, 20 nt, Human
cugagccucaguuuccucau

SEQ ID NO: 1339199 - RNA, 19 nt, Human
cugaugauaggggcacagg

SEQ ID NO: 1339200 - RNA, 23 nt, Human
cugcaaccuccgccucccagguu

SEQ ID NO: 1339201 - RNA, 24 nt, Human
cugcaaccuccgccucccagguuc

SEQ ID NO: 1339202 - RNA, 23 nt, Human
cugccucagccucccgaguagcu

SEQ ID NO: 1339203 - RNA, 24 nt, Human
cuugcaucagccuccugaguggcu

SEQ ID NO: 1339204 - RNA, 22 nt, Human
gaccucgugauccacccaccuc

SEQ ID NO: 1339205 - RNA, 24 nt, Human
gaccucgugauccacccaccucgg

SEQ ID NO: 1339206 - RNA, 24 nt, Human
gaccucgugauccacccaccucgg

SEQ ID NO: 1339207 - RNA, 20 nt, Human
gagaugggguuucaccaugu

SEQ ID NO: 1339208 - RNA, 24 nt, Human
gagaugggguuucaccauguuggc

SEQ ID NO: 1339209 - RNA, 21 nt, Human
gagccucaguuuccucauuug

SEQ ID NO: 1339210 - RNA, 20 nt, Human
gaguagcugggacuacaggc

SEQ ID NO: 1339211 - RNA, 27 nt, Human
gaguagcugggacuacaggcacguguc

SEQ ID NO: 1339212 - RNA, 19 nt, Human
gaugugggggcugggaggg

SEQ ID NO: 1339213 - RNA, 18 nt, Human
gauuacaggcgugagcca

SEQ ID NO: 1339214 - RNA, 19 nt, Human
gauuacaggcgugagccac

SEQ ID NO: 1339215 - RNA, 22 nt, Human
gauuacaggcgugagccacugc

SEQ ID NO: 1339216 - RNA, 22 nt, Human
gcaaccuccgccucccagguuc

SEQ ID NO: 1339217 - RNA, 23 nt, Human
gcaccuggcauauagaggacaua

SEQ ID NO: 1339218 - RNA, 20 nt, Human
gcaucagccuccugaguggc

SEQ ID NO: 1339219 - RNA, 24 nt, Human
gcaucagccuccugaguggcuggg

SEQ ID NO: 1339220 - RNA, 22 nt, Human
gcccggcuaauuuuuguauuuu

SEQ ID NO: 1339221 - RNA, 20 nt, Human
gccucagccucccgaguagc

SEQ ID NO: 1339222 - RNA, 19 nt, Human
gcuggagugcaguggcgug

SEQ ID NO: 1339223 - RNA, 20 nt, Human
ggaagagcacagucucugca

SEQ ID NO: 1339224 - RNA, 24 nt, Human
ggaagagcacagucucugcaguca

SEQ ID NO: 1339225 - RNA, 21 nt, Human
ggagcggucugugggacucug

SEQ ID NO: 1339226 - RNA, 22 nt, Human
ggcuggagugcaguggcgugau

SEQ ID NO: 1339227 - RNA, 20 nt, Human
ggcugggagggaaagcgggu

SEQ ID NO: 1339228 - RNA, 19 nt, Human
gggaaagcgggugacacag

SEQ ID NO: 1339229 - RNA, 24 nt, Human
gggaaagcgggugacacagcaggu

SEQ ID NO: 1339230 - RNA, 22 nt, Human
gggauggggcgggcuugccggg

SEQ ID NO: 1339231 - RNA, 23 nt, Human
gggcgggcuugccgggugggggu

SEQ ID NO: 1339232 - RNA, 22 nt, Human
ggggaugaagucuuggucuguc

SEQ ID NO: 1339233 - RNA, 22 nt, Human
gggguuucaccauguuggccag

SEQ ID NO: 1339234 - RNA, 23 nt, Human
gggguuucacuauguugcuuagg

SEQ ID NO: 1339235 - RNA, 22 nt, Human
ggguuucacuauguugcuuagg

SEQ ID NO: 1339236 - RNA, 18 nt, Human
gguagagggugaggagga

SEQ ID NO: 1339237 - RNA, 20 nt, Human
gguagagggugaggaggagc

SEQ ID NO: 1339238 - RNA, 24 nt, Human
gguuucaccauguuggccaggaug

SEQ ID NO: 1339239 - RNA, 23 nt, Human
guagagaugggguuucaccaugu

SEQ ID NO: 1339240 - RNA, 21 nt, Human
gugaauaggauuucccugccu

SEQ ID NO: 1339241 - RNA, 23 nt, Human
gugauccacccaccucggacucc

SEQ ID NO: 1339242 - RNA, 24 nt, Human
gugauucuccugccucagccuccc

SEQ ID NO: 1339243 - RNA, 19 nt, Human
guguugggauuacaggcgu

SEQ ID NO: 1339244 - RNA, 21 nt, Human
guguugggauuacaggcguga

SEQ ID NO: 1339245 - RNA, 20 nt, Human
uaaagggucuuaggaauguu

SEQ ID NO: 1339246 - RNA, 18 nt, Human
uaacaaauuaccucucuu

SEQ ID NO: 1339247 - RNA, 20 nt, Human
uaaggacauucaaggcgaaa

SEQ ID NO: 1339248 - RNA, 21 nt, Human
uaagguguugggauuacaggc

SEQ ID NO: 1339249 - RNA, 24 nt, Human
uaauuuuuguauuuuuaguagaga

SEQ ID NO: 1339250 - RNA, 23 nt, Human
uacaggcacgugucaccacgccc

SEQ ID NO: 1339251 - RNA, 19 nt, Human
uacaggcgugagccacugc

SEQ ID NO: 1339252 - RNA, 23 nt, Human
uacaggcgugagccacugcgccc

SEQ ID NO: 1339253 - RNA, 20 nt, Human
uacuaaaaauuaaagaguug

SEQ ID NO: 1339254 - RNA, 22 nt, Human
uagagaugggguuucaccaugu

SEQ ID NO: 1339255 - RNA, 22 nt, Human
uagagggugaggaggagcgguc

SEQ ID NO: 1339256 - RNA, 24 nt, Human
uaguagagaugggguuucaccaug

SEQ ID NO: 1339257 - RNA, 25 nt, Human
uaguagagaugggguuucaccaugu

SEQ ID NO: 1339258 - RNA, 18 nt, Human
uauagguauauauauaua

SEQ ID NO: 1339259 - RNA, 23 nt, Human
uauccccugagccucaguuuccu

SEQ ID NO: 1339260 - RNA, 18 nt, Human
uauguugcuuaggcugga

SEQ ID NO: 1339261 - RNA, 25 nt, Human
uauuauauuuuuggagaugggguuu

SEQ ID NO: 1339262 - RNA, 23 nt, Human
uauuuuuggagaugggguuucac

SEQ ID NO: 1339263 - RNA, 19 nt, Human
ucaagugauucuccugccu

SEQ ID NO: 1339264 - RNA, 22 nt, Human
ucacuauguugcuuaggcugga

SEQ ID NO: 1339265 - RNA, 25 nt, Human
ucacuccaggcccucuguugccugg

SEQ ID NO: 1339266 - RNA, 19 nt, Human
ucacugcaaccuccgccuc

SEQ ID NO: 1339267 - RNA, 23 nt, Human
ucacugcaaccuccgccucccag

SEQ ID NO: 1339268 - RNA, 24 nt, Human
ucacugcaaccuccgccucccagg

SEQ ID NO: 1339269 - RNA, 27 nt, Human
ucacugcaaccuccgccucccagguuc

SEQ ID NO: 1339270 - RNA, 23 nt, Human
ucagccucccgaguagcugggac

SEQ ID NO: 1339271 - RNA, 20 nt, Human
ucagccuccugaguggcugg

SEQ ID NO: 1339272 - RNA, 20 nt, Human
ucaguccucacuccaggccc

SEQ ID NO: 1339273 - RNA, 23 nt, Human
ucauaucauuuuuugcaaucaua

SEQ ID NO: 1339274 - RNA, 20 nt, Human
ucauugcaccugccuuuugg

SEQ ID NO: 1339275 - RNA, 25 nt, Human
ucauuugucacacauagauaauaac

SEQ ID NO: 1339276 - RNA, 21 nt, Human
uccagugcugggcucaccugg

SEQ ID NO: 1339277 - RNA, 21 nt, Human
ucccagguucaagugauucuc

SEQ ID NO: 1339278 - RNA, 24 nt, Human
ucccagguucaagugauucuccug

SEQ ID NO: 1339279 - RNA, 20 nt, Human
ucccccaaccccccaccccc

SEQ ID NO: 1339280 - RNA, 22 nt, Human
ucccccaaccccccacccccaa

SEQ ID NO: 1339281 - RNA, 24 nt, Human
ucccgaguagcugggacuacaggc

SEQ ID NO: 1339282 - RNA, 27 nt, Human
ucccugccucccccaaccccccacccc

SEQ ID NO: 1339283 - RNA, 20 nt, Human
ucccuuuauccccugagccu

SEQ ID NO: 1339284 - RNA, 24 nt, Human
ucccuuuauccccugagccucagu

SEQ ID NO: 1339285 - RNA, 24 nt, Human
uccgcaggcuggagugcaguggcg

SEQ ID NO: 1339286 - RNA, 24 nt, Human
uccuaagguguugggauuacaggc

SEQ ID NO: 1339287 - RNA, 21 nt, Human
uccugggcucaagcgauccuc

SEQ ID NO: 1339288 - RNA, 21 nt, Human
uccugggcucaagcgauccuc

SEQ ID NO: 1339289 - RNA, 24 nt, Human
uccugggcucaagcgauccucuug

SEQ ID NO: 1339290 - RNA, 21 nt, Human
ucuaaggacauucaaggcgaa

SEQ ID NO: 1339291 - RNA, 21 nt, Human
ucuauaauugcaucuuggagc

SEQ ID NO: 1339292 - RNA, 24 nt, Human
ucuccugccucagccucccgagua

SEQ ID NO: 1339293 - RNA, 23 nt, Human
ucuguccgcaggcuggagugcag

SEQ ID NO: 1339294 - RNA, 23 nt, Human
ucuuggucuguccgcaggcugga

SEQ ID NO: 1339295 - RNA, 18 nt, Human
ucuuuuuuuuuugggggg

SEQ ID NO: 1339296 - RNA, 23 nt, Human
ugaccucgugauccacccaccuc

SEQ ID NO: 1339297 - RNA, 21 nt, Human
ugagauguacaggcuucccgg

SEQ ID NO: 1339298 - RNA, 20 nt, Human
ugaguauaaaagcugugucc

SEQ ID NO: 1339299 - RNA, 18 nt, Human
ugcaggagauggggccau

SEQ ID NO: 1339300 - RNA, 22 nt, Human
ugcaguggcgugaucuuagcuc

SEQ ID NO: 1339301 - RNA, 24 nt, Human
ugcaucagccuccugaguggcugg

SEQ ID NO: 1339302 - RNA, 24 nt, Human
ugccucagccucccgaguagcugg

SEQ ID NO: 1339303 - RNA, 18 nt, Human
ugccuggggccuccacug

SEQ ID NO: 1339304 - RNA, 21 nt, Human
ugccuggggccuccacugugc

SEQ ID NO: 1339305 - RNA, 21 nt, Human
ugccuggggccuccacugugc

SEQ ID NO: 1339306 - RNA, 19 nt, Human
ugccuuggcagggagaaac

SEQ ID NO: 1339307 - RNA, 21 nt, Human
uggagaugggguuucacuaug

SEQ ID NO: 1339308 - RNA, 19 nt, Human
uggagugcaguggcgugau

SEQ ID NO: 1339309 - RNA, 23 nt, Human
uggagugcaguggcgugaucuua

SEQ ID NO: 1339310 - RNA, 24 nt, Human
uggagugcaguggcgugaucuuag

SEQ ID NO: 1339311 - RNA, 24 nt, Human
uggcgugaucuuagcucacugcaa

SEQ ID NO: 1339312 - RNA, 22 nt, Human
ugggacuacaggcacgugucac

SEQ ID NO: 1339313 - RNA, 24 nt, Human
ugggacuacaggcacgugucacca

SEQ ID NO: 1339314 - RNA, 18 nt, Human
ugggacuugggcaagucc

SEQ ID NO: 1339315 - RNA, 18 nt, Human
ugggauuacaggcgugag

SEQ ID NO: 1339316 - RNA, 19 nt, Human
ugggauuacaggcgugagc

SEQ ID NO: 1339317 - RNA, 21 nt, Human
ugggauuacaggcgugagcca

SEQ ID NO: 1339318 - RNA, 22 nt, Human
ugggauuacaggcgugagccac

SEQ ID NO: 1339319 - RNA, 22 nt, Human
ugggauuacaggcgugagccac

SEQ ID NO: 1339320 - RNA, 24 nt, Human
ugggauuacaggcgugagccacug

SEQ ID NO: 1339321 - RNA, 26 nt, Human
ugggauuacaggcgugagccacugcg

SEQ ID NO: 1339322 - RNA, 19 nt, Human
ugggcucaagcgauccucu

SEQ ID NO: 1339323 - RNA, 23 nt, Human
ugggggcugggagggaaagcggg

SEQ ID NO: 1339324 - RNA, 24 nt, Human
ugggguuucaccauguuggccagg

SEQ ID NO: 1339325 - RNA, 24 nt, Human
ugggguuucacuauguugcuuagg

SEQ ID NO: 1339326 - RNA, 21 nt, Human
ugguaaggaugugggggcugg

SEQ ID NO: 1339327 - RNA, 22 nt, Human
ugugggacuugggcaagucccu

SEQ ID NO: 1339328 - RNA, 20 nt, Human
ugugucuuucacuguaaauc

SEQ ID NO: 1339329 - RNA, 27 nt, Human
uuagcucacugcaaccuccgccuccca

SEQ ID NO: 1339330 - RNA, 18 nt, Human
uuaguagagaugggguuu

SEQ ID NO: 1339331 - RNA, 22 nt, Human
uuaguagagaugggguuucacc

SEQ ID NO: 1339332 - RNA, 24 nt, Human
uuaguagagaugggguuucaccau

SEQ ID NO: 1339333 - RNA, 21 nt, Human
uucaagugauucuccugccuc

SEQ ID NO: 1339334 - RNA, 23 nt, Human
uucaagugauucuccugccucag

SEQ ID NO: 1339335 - RNA, 24 nt, Human
uucaagugauucuccugccucagc

SEQ ID NO: 1339336 - RNA, 23 nt, Human
uuccuccauacucuaauagcggg

SEQ ID NO: 1339337 - RNA, 23 nt, Human
uucuauaauugcaucuuggagcu

SEQ ID NO: 1339338 - RNA, 21 nt, Human
uuggccaggaugggcuggauc

SEQ ID NO: 1339339 - RNA, 23 nt, Human
uuguauuuuuaguagagaugggg

SEQ ID NO: 1339340 - RNA, 21 nt, Human
uuuauagguauauauauauau

SEQ ID NO: 1339341 - RNA, 19 nt, Human
uuucaccauguuggccagg

SEQ ID NO: 1339342 - RNA, 20 nt, Human
uuucaccauguuggccagga

SEQ ID NO: 1339343 - RNA, 24 nt, Human
uuucacuauguugcuuaggcugga

SEQ ID NO: 1339344 - RNA, 18 nt, Human
uuugccuuggcagggaga

SEQ ID NO: 1339345 - RNA, 22 nt, Human
uuuuauagguauauauauauau

SEQ ID NO: 1339346 - RNA, 31 nt, Human
uuuuauagguauauauauauauuuuuugccu

SEQ ID NO: 1339347 - RNA, 23 nt, Human
uuuuggagaugggguuucacuau

SEQ ID NO: 1339348 - RNA, 24 nt, Human
uuuuggagaugggguuucacuaug

SEQ ID NO: 1339349 - RNA, 24 nt, Human
uuuuuaguagagaugggguuucac

SEQ ID NO: 1339350 - RNA, 24 nt, Human
uuuuuggagaugggguuucacuau

SEQ ID NO: 1339351 - RNA, 20 nt, Human
uuuuuguauuuuuaguagag

SEQ ID NO: 1339352 - RNA, 28 nt, Human
uuuuuuuuuuauagguauauauauauau

SEQ ID NO: 1339353 - RNA, 23 nt, Human
uuuuuuuuuuuuuuuuuuauagg

SEQ ID NO: 1339354 - RNA, 19 nt, Human
aaacaucccaagcaagacu

SEQ ID NO: 1339355 - RNA, 20 nt, Human
aagggagacacugcuacaaa

SEQ ID NO: 1339356 - RNA, 21 nt, Human
acugcagccaccgcggacgcc

SEQ ID NO: 1339357 - RNA, 23 nt, Human
acugcagccaccgcggacgcccg

SEQ ID NO: 1339358 - RNA, 18 nt, Human
agacucgaagagcucgcg

SEQ ID NO: 1339359 - RNA, 24 nt, Human
agcagggagaccgacgggacugca

SEQ ID NO: 1339360 - RNA, 23 nt, Human
auccugccacuccugcacacccu

SEQ ID NO: 1339361 - RNA, 20 nt, Human
augaccccaaaggugcagaa

SEQ ID NO: 1339362 - RNA, 22 nt, Human
caaaaucaccccguggggccaa

SEQ ID NO: 1339363 - RNA, 19 nt, Human
cacacaguccuggguccuc

SEQ ID NO: 1339364 - RNA, 25 nt, Human
cacugcuacaaagcaugaccccaaa

SEQ ID NO: 1339365 - RNA, 22 nt, Human
caggggcugcugaaacauccca

SEQ ID NO: 1339366 - RNA, 19 nt, Human
cauccugccacuccugcac

SEQ ID NO: 1339367 - RNA, 24 nt, Human
cauccugccacuccugcacacccu

SEQ ID NO: 1339368 - RNA, 19 nt, Human
caugaccccaaaggugcag

SEQ ID NO: 1339369 - RNA, 18 nt, Human
ccaagcaagacucgaaga

SEQ ID NO: 1339370 - RNA, 24 nt, Human
cgagcuggauguaggacucccuca

SEQ ID NO: 1339371 - RNA, 22 nt, Human
cgccggacagcagggagaccga

SEQ ID NO: 1339372 - RNA, 22 nt, Human
cucaggcagguaagaaacccac

SEQ ID NO: 1339373 - RNA, 18 nt, Human
cucagguccugcgcccuc

SEQ ID NO: 1339374 - RNA, 22 nt, Human
cuccucuuccuucucaggggcu

SEQ ID NO: 1339375 - RNA, 23 nt, Human
gccggacagcagggagaccgacg

SEQ ID NO: 1339376 - RNA, 23 nt, Human
ucagcgggcccucagcuuccucc

SEQ ID NO: 1339377 - RNA, 22 nt, Human
ucaggcagguaagaaacccaca

SEQ ID NO: 1339378 - RNA, 20 nt, Human
ucccucagguccugcgcccu

SEQ ID NO: 1339379 - RNA, 19 nt, Human
ucccugagguggcucaggc

SEQ ID NO: 1339380 - RNA, 21 nt, Human
ucccugagguggcucaggcag

SEQ ID NO: 1339381 - RNA, 19 nt, Human
uccugcacacccuggacga

SEQ ID NO: 1339382 - RNA, 19 nt, Human
uccugcgcccucagcgggc

SEQ ID NO: 1339383 - RNA, 23 nt, Human
ucuuccuucucaggggcugcuga

SEQ ID NO: 1339384 - RNA, 19 nt, Human
ugaccccaaaggugcagaa

SEQ ID NO: 1339385 - RNA, 18 nt, Human
uuccuccucuuccuucuc

SEQ ID NO: 1339386 - RNA, 23 nt, Human
aagcugcggugacaccaccaaau

SEQ ID NO: 1339387 - RNA, 19 nt, Human
aaguggccuggagcaaaag

SEQ ID NO: 1339388 - RNA, 22 nt, Human
aaguguuggaaauaccccuucc

SEQ ID NO: 1339389 - RNA, 24 nt, Human
acacacacaaguggccuggagcaa

SEQ ID NO: 1339390 - RNA, 24 nt, Human
acaccaccaaauaacauaagcaaa

SEQ ID NO: 1339391 - RNA, 21 nt, Human
acacugccugccuuggacagc

SEQ ID NO: 1339392 - RNA, 20 nt, Human
accaaauaacauaagcaaaa

SEQ ID NO: 1339393 - RNA, 21 nt, Human
acgcaggucugcggccggugg

SEQ ID NO: 1339394 - RNA, 22 nt, Human
acuagauuuuccuugauaaacu

SEQ ID NO: 1339395 - RNA, 19 nt, Human
agaauccccuucccaaucc

SEQ ID NO: 1339396 - RNA, 19 nt, Human
agaccaaggccuggaggga

SEQ ID NO: 1339397 - RNA, 21 nt, Human
agacgccaaguguuggaaaua

SEQ ID NO: 1339398 - RNA, 24 nt, Human
agagccauccacccagaccaucca

SEQ ID NO: 1339399 - RNA, 18 nt, Human
agcaaaagugcaaaaucc

SEQ ID NO: 1339400 - RNA, 18 nt, Human
agcuugagggagcugaug

SEQ ID NO: 1339401 - RNA, 24 nt, Human
aggcuuccaggcccagaauccccu

SEQ ID NO: 1339402 - RNA, 22 nt, Human
agggagcugaugcugagguucu

SEQ ID NO: 1339403 - RNA, 21 nt, Human
agguguguccugaucccaugu

SEQ ID NO: 1339404 - RNA, 19 nt, Human
aguggcuguuucccucuac

SEQ ID NO: 1339405 - RNA, 32 nt, Human
auaagcaaaauuuugcuuuauuaacccaaaga

SEQ ID NO: 1339406 - RNA, 31 nt, Human
auggcagugguacacacacacauacacacag

SEQ ID NO: 1339407 - RNA, 21 nt, Human
caacaguaguccugagacggc

SEQ ID NO: 1339408 - RNA, 23 nt, Human
caauccaacaguaguccugagac

SEQ ID NO: 1339409 - RNA, 20 nt, Human
cacacacacauacacacaca

SEQ ID NO: 1339410 - RNA, 27 nt, Human
cacacacauacacacacaaguggccug

SEQ ID NO: 1339411 - RNA, 23 nt, Human
cacagccccccucugaccucagc

SEQ ID NO: 1339412 - RNA, 23 nt, Human
caccaggacccucucuuuucccu

SEQ ID NO: 1339413 - RNA, 23 nt, Human
cacugcaauuucuuccuacuuaa

SEQ ID NO: 1339414 - RNA, 21 nt, Human
caggaagggcugauggcagca

SEQ ID NO: 1339415 - RNA, 23 nt, Human
caggcccagaauccccuucccaa

SEQ ID NO: 1339416 - RNA, 18 nt, Human
caguaguccugagacggc

SEQ ID NO: 1339417 - RNA, 20 nt, Human
caguggcuguuucccucuac

SEQ ID NO: 1339418 - RNA, 24 nt, Human
cauggugucuugguauaagcugcc

SEQ ID NO: 1339419 - RNA, 19 nt, Human
cauuccgcaggcuguucuc

SEQ ID NO: 1339420 - RNA, 18 nt, Human
ccaaaccagaugacaaac

SEQ ID NO: 1339421 - RNA, 26 nt, Human
ccaaaccagaugacaaacggguauac

SEQ ID NO: 1339422 - RNA, 24 nt, Human
ccaaguguuggaaauaccccuucc

SEQ ID NO: 1339423 - RNA, 19 nt, Human
ccacgcaggucugcggccg

SEQ ID NO: 1339424 - RNA, 20 nt, Human
ccagaccauccacuaaggcc

SEQ ID NO: 1339425 - RNA, 18 nt, Human
cccguccaccagguggca

SEQ ID NO: 1339426 - RNA, 18 nt, Human
cccucugaccucagcucc

SEQ ID NO: 1339427 - RNA, 22 nt, Human
cccuggacggccacgcaggucu

SEQ ID NO: 1339428 - RNA, 20 nt, Human
ccucugaaacugcagccgcc

SEQ ID NO: 1339429 - RNA, 26 nt, Human
ccugugggucgggaagccuguaggac

SEQ ID NO: 1339430 - RNA, 22 nt, Human
cgccaaguguuggaaauacccc

SEQ ID NO: 1339431 - RNA, 20 nt, Human
cggugacaccaccaaauaac

SEQ ID NO: 1339432 - RNA, 19 nt, Human
cuaaggccacagcuggccc

SEQ ID NO: 1339433 - RNA, 28 nt, Human
cucuacggccacagacgcggugguuacc

SEQ ID NO: 1339434 - RNA, 18 nt, Human
cugaaacugcagccgccu

SEQ ID NO: 1339435 - RNA, 18 nt, Human
cugaaacugcagccgccu

SEQ ID NO: 1339436 - RNA, 21 nt, Human
cugcuggugaaagaacucugg

SEQ ID NO: 1339437 - RNA, 19 nt, Human
cuggacaaccuacaguccc

SEQ ID NO: 1339438 - RNA, 21 nt, Human
cuggaugggucugaugcugcu

SEQ ID NO: 1339439 - RNA, 22 nt, Human
cuguagcuggagcaggaagggc

SEQ ID NO: 1339440 - RNA, 21 nt, Human
cugugggcucccuggagcccu

SEQ ID NO: 1339441 - RNA, 18 nt, Human
cuuccacccaccaggacc

SEQ ID NO: 1339442 - RNA, 20 nt, Human
cuucccaauccuuccaccca

SEQ ID NO: 1339443 - RNA, 18 nt, Human
gagcaggaagggcugaug

SEQ ID NO: 1339444 - RNA, 27 nt, Human
gcaaaauuuugcuuuauuaacccaaaa

SEQ ID NO: 1339445 - RNA, 19 nt, Human
gcccaacuguagcuggagc

SEQ ID NO: 1339446 - RNA, 18 nt, Human
gccuuucccguccaccag

SEQ ID NO: 1339447 - RNA, 19 nt, Human
ggacagccuuuucuugcua

SEQ ID NO: 1339448 - RNA, 22 nt, Human
ggacccucucuuuucccugcuu

SEQ ID NO: 1339449 - RNA, 23 nt, Human
ggaggcggggucugcuguccauc

SEQ ID NO: 1339450 - RNA, 25 nt, Human
ggcccagaauccccuucccaauccu

SEQ ID NO: 1339451 - RNA, 18 nt, Human
ggccucugaaacugcagc

SEQ ID NO: 1339452 - RNA, 19 nt, Human
gggcucccuggagcccugg

SEQ ID NO: 1339453 - RNA, 21 nt, Human
guaaacaaaaucagacaacua

SEQ ID NO: 1339454 - RNA, 18 nt, Human
guagccugggccuucugu

SEQ ID NO: 1339455 - RNA, 20 nt, Human
gucagcagaugacaggaggg

SEQ ID NO: 1339456 - RNA, 19 nt, Human
gugguacacacacacauac

SEQ ID NO: 1339457 - RNA, 20 nt, Human
uaaaaugcuccuggaaggga

SEQ ID NO: 1339458 - RNA, 22 nt, Human
uaaaaugcuccuggaagggagc

SEQ ID NO: 1339459 - RNA, 22 nt, Human
uaaacaaaaucagacaacuacc

SEQ ID NO: 1339460 - RNA, 19 nt, Human
uaacucacuggagugacaa

SEQ ID NO: 1339461 - RNA, 20 nt, Human
uaccccuuccuggggcuucu

SEQ ID NO: 1339462 - RNA, 23 nt, Human
uauaagcugcggugacaccacca

SEQ ID NO: 1339463 - RNA, 23 nt, Human
ucauuccgcaggcuguucucggg

SEQ ID NO: 1339464 - RNA, 19 nt, Human
uccaacaguaguccugaga

SEQ ID NO: 1339465 - RNA, 22 nt, Human
uccaucagacggaaaggcuggu

SEQ ID NO: 1339466 - RNA, 21 nt, Human
ucccugcuugucugcuaagag

SEQ ID NO: 1339467 - RNA, 21 nt, Human
ucccugggaccuggcgugugg

SEQ ID NO: 1339468 - RNA, 22 nt, Human
uccuggggcuucuguccauugg

SEQ ID NO: 1339469 - RNA, 20 nt, Human
ucucuggguugucacagucg

SEQ ID NO: 1339470 - RNA, 24 nt, Human
ucucuggguugucacagucgacuu

SEQ ID NO: 1339471 - RNA, 19 nt, Human
ugacaacuuucuucugcag

SEQ ID NO: 1339472 - RNA, 18 nt, Human
ugagacgccaaguguugg

SEQ ID NO: 1339473 - RNA, 24 nt, Human
ugagaggggaaggagcaggcuucc

SEQ ID NO: 1339474 - RNA, 23 nt, Human
ugcaagacuucccugggaccuuu

SEQ ID NO: 1339475 - RNA, 20 nt, Human
ugcugcaguccuguccagcc

SEQ ID NO: 1339476 - RNA, 22 nt, Human
ugcuggaggcggggucugcugu

SEQ ID NO: 1339477 - RNA, 19 nt, Human
uggaagggagcagguggua

SEQ ID NO: 1339478 - RNA, 20 nt, Human
uggagcaggaagggcugaug

SEQ ID NO: 1339479 - RNA, 20 nt, Human
uggagggaacagaagcagca

SEQ ID NO: 1339480 - RNA, 21 nt, Human
uggccuggagcaaaagugcaa

SEQ ID NO: 1339481 - RNA, 20 nt, Human
ugggcuuugaacacucagac

SEQ ID NO: 1339482 - RNA, 23 nt, Human
uggugcuggaggcggggucugcu

SEQ ID NO: 1339483 - RNA, 23 nt, Human
uguagggacacugcuuggugcug

SEQ ID NO: 1339484 - RNA, 22 nt, Human
uguccugcugcaguccugucca

SEQ ID NO: 1339485 - RNA, 18 nt, Human
ugugaagucagcagauga

SEQ ID NO: 1339486 - RNA, 24 nt, Human
ugugaagucagcagaugacaggag

SEQ ID NO: 1339487 - RNA, 24 nt, Human
ugugggguuuguagccugggccuu

SEQ ID NO: 1339488 - RNA, 22 nt, Human
uugcuaacagugggaucucaaa

SEQ ID NO: 1339489 - RNA, 23 nt, Human
uuggauuauuuuaacuagauuuu

SEQ ID NO: 1339490 - RNA, 19 nt, Human
uuucuuccuacuuaaggcu

SEQ ID NO: 1339491 - RNA, 19 nt, Human
uuucuucugcagccuggau

SEQ ID NO: 1339492 - RNA, 22 nt, Human
uuuuuuuuuuuuuuuuucuguu

SEQ ID NO: 1339493 - RNA, 27 nt, Human
uuuuuuuuuuuuuuuuuuuuucugggg

SEQ ID NO: 1339494 - RNA, 21 nt, Human
aaauacugguggaacaagaca

SEQ ID NO: 1339495 - RNA, 20 nt, Human
acucuaagcuugaagacaga

SEQ ID NO: 1339496 - RNA, 21 nt, Human
acugaccagacugcaccauuu

SEQ ID NO: 1339497 - RNA, 24 nt, Human
agcacugaccagacugcaccauuu

SEQ ID NO: 1339498 - RNA, 20 nt, Human
cagacugcaccauuuagccu

SEQ ID NO: 1339499 - RNA, 21 nt, Human
cagauccaaaaacucucccca

SEQ ID NO: 1339500 - RNA, 18 nt, Human
caucucaguacuuggcac

SEQ ID NO: 1339501 - RNA, 22 nt, Human
cauguccaaacccauggcucuc

SEQ ID NO: 1339502 - RNA, 21 nt, Human
ccagauccaaaaacucucccc

SEQ ID NO: 1339503 - RNA, 18 nt, Human
cuaaauuauaaauagcac

SEQ ID NO: 1339504 - RNA, 18 nt, Human
gacagcugagaauguaug

SEQ ID NO: 1339505 - RNA, 19 nt, Human
ggggauaggugguuugggg

SEQ ID NO: 1339506 - RNA, 19 nt, Human
gugggagacucuaagcuug

SEQ ID NO: 1339507 - RNA, 20 nt, Human
uagaccucccacaccagcau

SEQ ID NO: 1339508 - RNA, 22 nt, Human
uagaccucccacaccagcauuu

SEQ ID NO: 1339509 - RNA, 24 nt, Human
uccccauguuuuagaccucccaca

SEQ ID NO: 1339510 - RNA, 22 nt, Human
ucucccgugggagacucuaagc

SEQ ID NO: 1339511 - RNA, 20 nt, Human
aacgcagacuuccccucucc

SEQ ID NO: 1339512 - RNA, 19 nt, Human
agcccguaaggcaagcacu

SEQ ID NO: 1339513 - RNA, 23 nt, Human
caaagcagcuacugaagagagag

SEQ ID NO: 1339514 - RNA, 24 nt, Human
ccaccuugccccgacggcgcgccc

SEQ ID NO: 1339515 - RNA, 22 nt, Human
cccuccuucauccuuucaccuc

SEQ ID NO: 1339516 - RNA, 25 nt, Human
cgcagguaccucuaggucauguucu

SEQ ID NO: 1339517 - RNA, 18 nt, Human
cuuccccucuccgugucc

SEQ ID NO: 1339518 - RNA, 23 nt, Human
gcagacuuccccucuccgugucc

SEQ ID NO: 1339519 - RNA, 23 nt, Human
gcccuggacgcaggaguugagcu

SEQ ID NO: 1339520 - RNA, 18 nt, Human
gcccugggccugaggccc

SEQ ID NO: 1339521 - RNA, 21 nt, Human
guccaaggguucucaggccaa

SEQ ID NO: 1339522 - RNA, 18 nt, Human
ucucaggccaagcucgga

SEQ ID NO: 1339523 - RNA, 18 nt, Human
ugcgggacgugcguggga

SEQ ID NO: 1339524 - RNA, 18 nt, Human
ugggagcuuucaaagcag

SEQ ID NO: 1339525 - RNA, 24 nt, Human
ugggagcuuucaaagcagcuacug

SEQ ID NO: 1339526 - RNA, 20 nt, Human
uucaaagcagcuacugaaga

SEQ ID NO: 1339527 - RNA, 22 nt, Human
aaccuuccucuuccuucauaua

SEQ ID NO: 1339528 - RNA, 20 nt, Human
accgccauguuucacagaag

SEQ ID NO: 1339529 - RNA, 25 nt, Human
aggcaaaaaguuuuucuccuucaau

SEQ ID NO: 1339530 - RNA, 23 nt, Human
cccagccuaccgccauguuucac

SEQ ID NO: 1339531 - RNA, 22 nt, Human
uguuauggucccagccuaccgc

SEQ ID NO: 1339532 - RNA, 21 nt, Human
aaccaaaguagcaaaagcacc

SEQ ID NO: 1339533 - RNA, 24 nt, Human
aaccaaaguagcaaaagcaccccu

SEQ ID NO: 1339534 - RNA, 20 nt, Human
aagcaccccugucccaggug

SEQ ID NO: 1339535 - RNA, 18 nt, Human
aaucugggccucuuccuu

SEQ ID NO: 1339536 - RNA, 18 nt, Human
acacaguuuauuagaggc

SEQ ID NO: 1339537 - RNA, 22 nt, Human
acacaguuuauuagaggccauc

SEQ ID NO: 1339538 - RNA, 21 nt, Human
accaaaguagcaaaagcaccc

SEQ ID NO: 1339539 - RNA, 24 nt, Human
accaaaguagcaaaagcaccccug

SEQ ID NO: 1339540 - RNA, 23 nt, Human
acugacccugaguauugacccug

SEQ ID NO: 1339541 - RNA, 20 nt, Human
agcaccccugucccaggugu

SEQ ID NO: 1339542 - RNA, 20 nt, Human
agcccgaguggcccugaugc

SEQ ID NO: 1339543 - RNA, 24 nt, Human
aggugucagagacuaggguggacc

SEQ ID NO: 1339544 - RNA, 18 nt, Human
aguauugacccugaguga

SEQ ID NO: 1339545 - RNA, 19 nt, Human
agugaccucugagcccgag

SEQ ID NO: 1339546 - RNA, 23 nt, Human
caaaaggguuuuaggccuccccu

SEQ ID NO: 1339547 - RNA, 19 nt, Human
caaccaaaguagcaaaagc

SEQ ID NO: 1339548 - RNA, 22 nt, Human
caaccaaaguagcaaaagcacc

SEQ ID NO: 1339549 - RNA, 24 nt, Human
caccccugucccaggugucagaga

SEQ ID NO: 1339550 - RNA, 21 nt, Human
cccucuggaccucucccagca

SEQ ID NO: 1339551 - RNA, 21 nt, Human
cccugagugaccucugagccc

SEQ ID NO: 1339552 - RNA, 22 nt, Human
cgaguggcccugaugcuuggca

SEQ ID NO: 1339553 - RNA, 26 nt, Human
ggaaggucacuucgaguccgugaagg

SEQ ID NO: 1339554 - RNA, 20 nt, Human
ggauggggucgcgcgccggc

SEQ ID NO: 1339555 - RNA, 18 nt, Human
gggauggggucgcgcgcc

SEQ ID NO: 1339556 - RNA, 25 nt, Human
gugaccucugagcccgaguggcccu

SEQ ID NO: 1339557 - RNA, 20 nt, Human
uaggguggaccccaaggauc

SEQ ID NO: 1339558 - RNA, 20 nt, Human
uaguggggggacucugggac

SEQ ID NO: 1339559 - RNA, 20 nt, Human
ucagaccucaggcaccacca

SEQ ID NO: 1339560 - RNA, 18 nt, Human
ucccaggugucagagacu

SEQ ID NO: 1339561 - RNA, 22 nt, Human
uccguguucacaaucugggccu

SEQ ID NO: 1339562 - RNA, 18 nt, Human
ucucccagcauugaacuc

SEQ ID NO: 1339563 - RNA, 21 nt, Human
ucucccagcauugaacuccug

SEQ ID NO: 1339564 - RNA, 22 nt, Human
ucucccagcauugaacuccugg

SEQ ID NO: 1339565 - RNA, 20 nt, Human
ugaaggaggcaggcaggugu

SEQ ID NO: 1339566 - RNA, 20 nt, Human
ugacccugaguauugacccu

SEQ ID NO: 1339567 - RNA, 19 nt, Human
uggcgggguguuuggccac

SEQ ID NO: 1339568 - RNA, 22 nt, Human
uggcgggguguuuggccacuag

SEQ ID NO: 1339569 - RNA, 20 nt, Human
ugggagguagggauauaugg

SEQ ID NO: 1339570 - RNA, 20 nt, Human
uuccuuauaggaacccucug

SEQ ID NO: 1339571 - RNA, 26 nt, Human
uuggccacuagguggugggagguagg

SEQ ID NO: 1339572 - RNA, 21 nt, Human
aaggguugugagagacccuga

SEQ ID NO: 1339573 - RNA, 20 nt, Human
caaugagcucucucuuuauu

SEQ ID NO: 1339574 - RNA, 25 nt, Human
caucuuuuccuuuuaauaaucuuca

SEQ ID NO: 1339575 - RNA, 19 nt, Human
caugguagaguacuggugc

SEQ ID NO: 1339576 - RNA, 23 nt, Human
ccaaggccauguaaaagauuuau

SEQ ID NO: 1339577 - RNA, 20 nt, Human
ccccgcuacacuuccuucuu

SEQ ID NO: 1339578 - RNA, 25 nt, Human
cccguggcugcgauuacccuagggc

SEQ ID NO: 1339579 - RNA, 19 nt, Human
ccucuagaccaaggccaug

SEQ ID NO: 1339580 - RNA, 25 nt, Human
ccuuaccccgcuacacuuccuucuu

SEQ ID NO: 1339581 - RNA, 23 nt, Human
gagagacccugacggugcauucc

SEQ ID NO: 1339582 - RNA, 19 nt, Human
gagcaauggggcaagaggg

SEQ ID NO: 1339583 - RNA, 18 nt, Human
gaggagagcugggaaagg

SEQ ID NO: 1339584 - RNA, 18 nt, Human
gaggguagaacugcucag

SEQ ID NO: 1339585 - RNA, 19 nt, Human
ggcuggaaggcaggaaguc

SEQ ID NO: 1339586 - RNA, 18 nt, Human
ggggaggagagcugggaa

SEQ ID NO: 1339587 - RNA, 24 nt, Human
gugagacaacaggaaaugacaaag

SEQ ID NO: 1339588 - RNA, 24 nt, Human
uaacaaaacaugauucuaaaagcc

SEQ ID NO: 1339589 - RNA, 24 nt, Human
uacacuuccuucuucuaccccugc

SEQ ID NO: 1339590 - RNA, 22 nt, Human
uagaccaaggccauguaaaaga

SEQ ID NO: 1339591 - RNA, 23 nt, Human
uagagaaguacagaguuacugca

SEQ ID NO: 1339592 - RNA, 18 nt, Human
uccccagugagugccuug

SEQ ID NO: 1339593 - RNA, 18 nt, Human
ucgggcaaaggccgaagu

SEQ ID NO: 1339594 - RNA, 19 nt, Human
ucgggguagcgaugaaucu

SEQ ID NO: 1339595 - RNA, 19 nt, Human
ucuaaaagccugccuccuc

SEQ ID NO: 1339596 - RNA, 19 nt, Human
ugggaugccccaugguaga

SEQ ID NO: 1339597 - RNA, 18 nt, Human
uggggaggagagcuggga

SEQ ID NO: 1339598 - RNA, 22 nt, Human
ugugcagauagagaaguacaga

SEQ ID NO: 1339599 - RNA, 24 nt, Human
uguggaaggucgggcaaaggccgg

SEQ ID NO: 1339600 - RNA, 18 nt, Human
uguguuggguccccagau

SEQ ID NO: 1339601 - RNA, 19 nt, Human
uguuggggaggagagcugg

SEQ ID NO: 1339602 - RNA, 20 nt, Human
uguuggggaggagagcuggg

SEQ ID NO: 1339603 - RNA, 19 nt, Human
uucccauuugauuuucuug

SEQ ID NO: 1339604 - RNA, 18 nt, Human
uugggaggguagaacugc

SEQ ID NO: 1339605 - RNA, 21 nt, Human
uuugcuuccuugcuuccuccc

SEQ ID NO: 1339606 - RNA, 20 nt, Human
uuuguuggggaggagagcug

SEQ ID NO: 1339607 - RNA, 22 nt, Human
uuuuuuuuuuuuuuuuuuacag

SEQ ID NO: 1339608 - RNA, 23 nt, Human
acaaccaacagcgcucccgcccc

SEQ ID NO: 1339609 - RNA, 18 nt, Human
acagcgcucccgccccuu

SEQ ID NO: 1339610 - RNA, 22 nt, Human
acagcgcucccgccccuuuuua

SEQ ID NO: 1339611 - RNA, 23 nt, Human
aggcgccugcagauucuggaggg

SEQ ID NO: 1339612 - RNA, 18 nt, Human
cacagcccgugcccucgc

SEQ ID NO: 1339613 - RNA, 24 nt, Human
cacgcggccagccgcggacuccag

SEQ ID NO: 1339614 - RNA, 23 nt, Human
cagcgcucccgccccuuuuuauu

SEQ ID NO: 1339615 - RNA, 18 nt, Human
cucaugccuucaguccac

SEQ ID NO: 1339616 - RNA, 24 nt, Human
gccauacugcuagagaugagggaa

SEQ ID NO: 1339617 - RNA, 21 nt, Human
ggacuccaggccagcucuguc

SEQ ID NO: 1339618 - RNA, 20 nt, Human
ggccacagcccgugcccucg

SEQ ID NO: 1339619 - RNA, 21 nt, Human
ucaaagggcaucucaugccuu

SEQ ID NO: 1339620 - RNA, 18 nt, Human
ucaguccaccgccuccuc

SEQ ID NO: 1339621 - RNA, 23 nt, Human
uccaccgccuccucgggccacag

SEQ ID NO: 1339622 - RNA, 18 nt, Human
ugagggaagagagcccca

SEQ ID NO: 1339623 - RNA, 19 nt, Human
ugagggaagagagccccaa

SEQ ID NO: 1339624 - RNA, 29 nt, Human
ugcgcacaaccaacagcgcucccgccccu

SEQ ID NO: 1339625 - RNA, 18 nt, Human
uggcagcccgagauccug

SEQ ID NO: 1339626 - RNA, 22 nt, Human
ugucagacaaucaccuacucac

SEQ ID NO: 1339627 - RNA, 21 nt, Human
uuugcuguacacucaaagggc

SEQ ID NO: 1339628 - RNA, 23 nt, Human
uuugcuguacacucaaagggcau

SEQ ID NO: 1339629 - RNA, 27 nt, Human
uuuuuuuuuuuuuuuuuuuuuuugggg

SEQ ID NO: 1339630 - RNA, 23 nt, Human
aaaaaaccuagccaacugcaggc

SEQ ID NO: 1339631 - RNA, 19 nt, Human
aaacauccuugaacagugc

SEQ ID NO: 1339632 - RNA, 21 nt, Human
aagauaccgagguugcuauga

SEQ ID NO: 1339633 - RNA, 25 nt, Human
aagcaaaaacaaauauuaaaaaaac

SEQ ID NO: 1339634 - RNA, 25 nt, Human
aaugaaacaagguuuuuacccuuga

SEQ ID NO: 1339635 - RNA, 22 nt, Human
aaugcauuuuaaagaaacaguu

SEQ ID NO: 1339636 - RNA, 23 nt, Human
acaaauauuaaaaaaaccuagcc

SEQ ID NO: 1339637 - RNA, 21 nt, Human
accuuaaaucuggauuccagu

SEQ ID NO: 1339638 - RNA, 20 nt, Human
agaacuuaaagauaccgagg

SEQ ID NO: 1339639 - RNA, 22 nt, Human
agagaacuggaugucaucaaca

SEQ ID NO: 1339640 - RNA, 23 nt, Human
agagacaaguggaguguugguca

SEQ ID NO: 1339641 - RNA, 24 nt, Human
agagacuguaaaauguauagauaa

SEQ ID NO: 1339642 - RNA, 19 nt, Human
agaggucuagagaacugga

SEQ ID NO: 1339643 - RNA, 23 nt, Human
aggaaaauuagcuuuuuucucuc

SEQ ID NO: 1339644 - RNA, 22 nt, Human
aguuggacaguugccagagaag

SEQ ID NO: 1339645 - RNA, 19 nt, Human
auacaaauuaauuuagaaa

SEQ ID NO: 1339646 - RNA, 21 nt, Human
aucaccuuaaaucuggauucc

SEQ ID NO: 1339647 - RNA, 19 nt, Human
auuugaggagggauugcuc

SEQ ID NO: 1339648 - RNA, 18 nt, Human
caaaggacucaccuaagg

SEQ ID NO: 1339649 - RNA, 19 nt, Human
caaaggagcuaugcuaagu

SEQ ID NO: 1339650 - RNA, 21 nt, Human
caacagucuccucaacccuga

SEQ ID NO: 1339651 - RNA, 26 nt, Human
caaccuuuucaagaaaguuuagugac

SEQ ID NO: 1339652 - RNA, 21 nt, Human
caagacagaaaaucucucaaa

SEQ ID NO: 1339653 - RNA, 18 nt, Human
caagagguucccuacagu

SEQ ID NO: 1339654 - RNA, 20 nt, Human
caaggaaagcccagggaacc

SEQ ID NO: 1339655 - RNA, 22 nt, Human
caccaaaaggcagauuaugcuu

SEQ ID NO: 1339656 - RNA, 20 nt, Human
cacccccuuccuuaacuuuc

SEQ ID NO: 1339657 - RNA, 18 nt, Human
cacuacucugaaaugggu

SEQ ID NO: 1339658 - RNA, 22 nt, Human
caggcaagacagaaaaucucuc

SEQ ID NO: 1339659 - RNA, 26 nt, Human
caggcaagacagaaaaucucucaaac

SEQ ID NO: 1339660 - RNA, 22 nt, Human
caguuuuaaauguacccacccu

SEQ ID NO: 1339661 - RNA, 25 nt, Human
cauuucugcuuagcauauuugagga

SEQ ID NO: 1339662 - RNA, 21 nt, Human
ccaaaggagcuaugcuaagua

SEQ ID NO: 1339663 - RNA, 24 nt, Human
ccaacagucuccucaacccugaau

SEQ ID NO: 1339664 - RNA, 19 nt, Human
ccaacccacauccucaccc

SEQ ID NO: 1339665 - RNA, 25 nt, Human
ccaacccacauccucacccccuucc

SEQ ID NO: 1339666 - RNA, 26 nt, Human
ccacauccucacccccuuccuuaacu

SEQ ID NO: 1339667 - RNA, 26 nt, Human
ccauuuaucaggcacccucuuauuuc

SEQ ID NO: 1339668 - RNA, 21 nt, Human
cccaacagucuccucaacccu

SEQ ID NO: 1339669 - RNA, 21 nt, Human
cccaacccacauccucacccc

SEQ ID NO: 1339670 - RNA, 21 nt, Human
ccccccaacagucuccucaac

SEQ ID NO: 1339671 - RNA, 20 nt, Human
cccucuuauuuccauccuga

SEQ ID NO: 1339672 - RNA, 24 nt, Human
cuccucugcucugaugguuaagga

SEQ ID NO: 1339673 - RNA, 28 nt, Human
cucugguuugggcagaggucggaaagcc

SEQ ID NO: 1339674 - RNA, 20 nt, Human
cugaauugaccaaguaaugc

SEQ ID NO: 1339675 - RNA, 23 nt, Human
cuuucauacauuauaaaugcccc

SEQ ID NO: 1339676 - RNA, 24 nt, Human
gaaaaagacugcaagaaacuuaga

SEQ ID NO: 1339677 - RNA, 22 nt, Human
gagaacuuaaagauaccgaggu

SEQ ID NO: 1339678 - RNA, 21 nt, Human
gauugcucugguuugggcaga

SEQ ID NO: 1339679 - RNA, 20 nt, Human
gcacccucuuauuuccaucc

SEQ ID NO: 1339680 - RNA, 19 nt, Human
gccccccaacagucuccuc

SEQ ID NO: 1339681 - RNA, 22 nt, Human
gcugccccaaagaugaaugaaa

SEQ ID NO: 1339682 - RNA, 20 nt, Human
ggcuuaauguucuggugugu

SEQ ID NO: 1339683 - RNA, 18 nt, Human
ggugguuuucucaagugu

SEQ ID NO: 1339684 - RNA, 25 nt, Human
guagugagucuuuccuccucugcuc

SEQ ID NO: 1339685 - RNA, 21 nt, Human
guggagaacuuaaagauaccg

SEQ ID NO: 1339686 - RNA, 22 nt, Human
gugugcaaagucaagcacaaga

SEQ ID NO: 1339687 - RNA, 19 nt, Human
uaaaaaaaccuagccaacu

SEQ ID NO: 1339688 - RNA, 28 nt, Human
uaaaauguauagauaacaaaauugggua

SEQ ID NO: 1339689 - RNA, 20 nt, Human
uaaacuccuaaaauauaaau

SEQ ID NO: 1339690 - RNA, 19 nt, Human
uaaagauaccgagguugcu

SEQ ID NO: 1339691 - RNA, 21 nt, Human
uaaaugccccccaacagucuc

SEQ ID NO: 1339692 - RNA, 20 nt, Human
uaagaggagaaagaaauaau

SEQ ID NO: 1339693 - RNA, 18 nt, Human
uaagcugagaaaaagacu

SEQ ID NO: 1339694 - RNA, 18 nt, Human
uacaagcaaaaacaaaua

SEQ ID NO: 1339695 - RNA, 23 nt, Human
uagaaaguauuccauuguaaaga

SEQ ID NO: 1339696 - RNA, 24 nt, Human
uagccaacugcaggcuaauaacau

SEQ ID NO: 1339697 - RNA, 19 nt, Human
uaugaucagacgauuacca

SEQ ID NO: 1339698 - RNA, 20 nt, Human
uaugaucagacgauuaccac

SEQ ID NO: 1339699 - RNA, 22 nt, Human
uauucaauuccacacugacucc

SEQ ID NO: 1339700 - RNA, 20 nt, Human
ucaaaagcuucuucaguaga

SEQ ID NO: 1339701 - RNA, 18 nt, Human
ucaguuuauccaaaaucu

SEQ ID NO: 1339702 - RNA, 27 nt, Human
ucauugggugguuuucucaaguguggg

SEQ ID NO: 1339703 - RNA, 23 nt, Human
uccacacaacagaauuauaauga

SEQ ID NO: 1339704 - RNA, 19 nt, Human
uccagaaauaaggaaaugg

SEQ ID NO: 1339705 - RNA, 22 nt, Human
uccagaaauaaggaaauggaau

SEQ ID NO: 1339706 - RNA, 22 nt, Human
ucccaacccacauccucacccc

SEQ ID NO: 1339707 - RNA, 20 nt, Human
uccucugcucugaugguuaa

SEQ ID NO: 1339708 - RNA, 23 nt, Human
ucucaaguguggguuuuagaaaa

SEQ ID NO: 1339709 - RNA, 22 nt, Human
ucuugcuguguccuuaggaaaa

SEQ ID NO: 1339710 - RNA, 24 nt, Human
ugaaaugggugguuuauaugauca

SEQ ID NO: 1339711 - RNA, 22 nt, Human
ugaauugaccaaguaaugcacc

SEQ ID NO: 1339712 - RNA, 21 nt, Human
ugagaaaaagacugcaagaaa

SEQ ID NO: 1339713 - RNA, 18 nt, Human
ugagauuacaagcaaaaa

SEQ ID NO: 1339714 - RNA, 19 nt, Human
ugagauuacaagcaaaaac

SEQ ID NO: 1339715 - RNA, 18 nt, Human
uggcaagcaggaaauugg

SEQ ID NO: 1339716 - RNA, 24 nt, Human
ugggaggacugaguuuaaacagua

SEQ ID NO: 1339717 - RNA, 23 nt, Human
ugguuugggcagaggucuagaga

SEQ ID NO: 1339718 - RNA, 23 nt, Human
uguauagauaacaaaauugggua

SEQ ID NO: 1339719 - RNA, 20 nt, Human
ugucccaacccacauccuca

SEQ ID NO: 1339720 - RNA, 21 nt, Human
ugucccaacccacauccucac

SEQ ID NO: 1339721 - RNA, 21 nt, Human
uguggguuuuagaaaauaucc

SEQ ID NO: 1339722 - RNA, 25 nt, Human
uguggguuuuagaaaauauccuuaa

SEQ ID NO: 1339723 - RNA, 26 nt, Human
uuacaagcaaaaacaaauauuaaaaa

SEQ ID NO: 1339724 - RNA, 19 nt, Human
uuagcccuuaaaauaaaaa

SEQ ID NO: 1339725 - RNA, 27 nt, Human
uuaucaggcacccucuuauuuccaucc

SEQ ID NO: 1339726 - RNA, 21 nt, Human
uucaagaaaguuuagugacuc

SEQ ID NO: 1339727 - RNA, 19 nt, Human
uuccacacugacuccauuu

SEQ ID NO: 1339728 - RNA, 19 nt, Human
uuccaguuggacaguugcc

SEQ ID NO: 1339729 - RNA, 20 nt, Human
uuccuuaacuuucauacauu

SEQ ID NO: 1339730 - RNA, 19 nt, Human
uucuucaguagaauccuga

SEQ ID NO: 1339731 - RNA, 21 nt, Human
uuucacacaaccuuuucaaga

SEQ ID NO: 1339732 - RNA, 20 nt, Human
uuucugcuuagcauauuuga

SEQ ID NO: 1339733 - RNA, 22 nt, Human
aaaccaaggcgagcaguggaaa

SEQ ID NO: 1339734 - RNA, 20 nt, Human
aacauguggcacucagcccc

SEQ ID NO: 1339735 - RNA, 19 nt, Human
acacagcccuggacccccc

SEQ ID NO: 1339736 - RNA, 21 nt, Human
acccaaacuaccccgagcccu

SEQ ID NO: 1339737 - RNA, 27 nt, Human
acccagaaagacacacucacacagccc

SEQ ID NO: 1339738 - RNA, 19 nt, Human
acgguggcaauggggugac

SEQ ID NO: 1339739 - RNA, 22 nt, Human
acugcuggagggacaguccuug

SEQ ID NO: 1339740 - RNA, 23 nt, Human
acuguggggcucagggugggagg

SEQ ID NO: 1339741 - RNA, 19 nt, Human
agaggggauggaccccagg

SEQ ID NO: 1339742 - RNA, 20 nt, Human
agcaggggugggcccugagg

SEQ ID NO: 1339743 - RNA, 20 nt, Human
agcaggggugggcccugagg

SEQ ID NO: 1339744 - RNA, 19 nt, Human
agcaggugagaggcccccc

SEQ ID NO: 1339745 - RNA, 23 nt, Human
agcugggccuccuuccucuuuuc

SEQ ID NO: 1339746 - RNA, 19 nt, Human
aggcgagcaguggaaacac

SEQ ID NO: 1339747 - RNA, 22 nt, Human
agggagcaaggucauaggagca

SEQ ID NO: 1339748 - RNA, 25 nt, Human
agggagcaaggucauaggagcagga

SEQ ID NO: 1339749 - RNA, 22 nt, Human
aggggcagaggagaggggccca

SEQ ID NO: 1339750 - RNA, 22 nt, Human
aguccccaccuccuuggguggc

SEQ ID NO: 1339751 - RNA, 20 nt, Human
caaaccaaggcgagcagugg

SEQ ID NO: 1339752 - RNA, 24 nt, Human
caaugggcacccucuucccaagga

SEQ ID NO: 1339753 - RNA, 26 nt, Human
cacagcugggccuccuuccucuuuuc

SEQ ID NO: 1339754 - RNA, 21 nt, Human
cacccaggguccccaacgucc

SEQ ID NO: 1339755 - RNA, 18 nt, Human
cacccucuucccaaggaa

SEQ ID NO: 1339756 - RNA, 25 nt, Human
caccuggaggccccacccagggucc

SEQ ID NO: 1339757 - RNA, 23 nt, Human
cacguuuuuugucuucacggccu

SEQ ID NO: 1339758 - RNA, 20 nt, Human
cacuggguggguggggcagg

SEQ ID NO: 1339759 - RNA, 20 nt, Human
cagaagccucuguccgggaa

SEQ ID NO: 1339760 - RNA, 20 nt, Human
cagcccaggggcacgguggc

SEQ ID NO: 1339761 - RNA, 20 nt, Human
cagcccuggaccccccuuuu

SEQ ID NO: 1339762 - RNA, 20 nt, Human
cagccugcggggguggaggg

SEQ ID NO: 1339763 - RNA, 18 nt, Human
cagcggaacagcggugga

SEQ ID NO: 1339764 - RNA, 22 nt, Human
cagcggaacagcgguggaggcc

SEQ ID NO: 1339765 - RNA, 21 nt, Human
cagcucuggccuggccauccu

SEQ ID NO: 1339766 - RNA, 19 nt, Human
caggauggggacccugggc

SEQ ID NO: 1339767 - RNA, 20 nt, Human
caggauggggacccugggca

SEQ ID NO: 1339768 - RNA, 20 nt, Human
caguggcucagcuuugggcc

SEQ ID NO: 1339769 - RNA, 18 nt, Human
ccaaugggcacccucuuc

SEQ ID NO: 1339770 - RNA, 22 nt, Human
ccacugggcaggcaccggaaau

SEQ ID NO: 1339771 - RNA, 24 nt, Human
ccagaggucuucuucuugggccgg

SEQ ID NO: 1339772 - RNA, 18 nt, Human
ccaggguccccaacgucc

SEQ ID NO: 1339773 - RNA, 24 nt, Human
cccaaaccaaggcgagcaguggaa

SEQ ID NO: 1339774 - RNA, 23 nt, Human
cccacagcugggccuccuuccuc

SEQ ID NO: 1339775 - RNA, 18 nt, Human
ccccacccagggucccca

SEQ ID NO: 1339776 - RNA, 22 nt, Human
ccccaggggcagaggagagggg

SEQ ID NO: 1339777 - RNA, 21 nt, Human
ccccaugugccuucaggcccg

SEQ ID NO: 1339778 - RNA, 21 nt, Human
ccccccagauccccguucucu

SEQ ID NO: 1339779 - RNA, 21 nt, Human
cccccgccagaggucuucuuc

SEQ ID NO: 1339780 - RNA, 19 nt, Human
cccccucccugcucccaaa

SEQ ID NO: 1339781 - RNA, 24 nt, Human
cccccucccugcucccaaaccaag

SEQ ID NO: 1339782 - RNA, 23 nt, Human
ccccgccagaggucuucuucuug

SEQ ID NO: 1339783 - RNA, 21 nt, Human
ccccguucucucaugggcugg

SEQ ID NO: 1339784 - RNA, 19 nt, Human
cccgagcccuagacccaga

SEQ ID NO: 1339785 - RNA, 19 nt, Human
cccgagcccuagacccaga

SEQ ID NO: 1339786 - RNA, 21 nt, Human
cccgagcccuagacccagaaa

SEQ ID NO: 1339787 - RNA, 22 nt, Human
cccuagacccagaaagacacac

SEQ ID NO: 1339788 - RNA, 25 nt, Human
cccugggcaagaggggauggacccc

SEQ ID NO: 1339789 - RNA, 20 nt, Human
ccgccagaggucuucuucuu

SEQ ID NO: 1339790 - RNA, 22 nt, Human
ccggaaauggccaucugcgggg

SEQ ID NO: 1339791 - RNA, 18 nt, Human
ccucagaagccucugucc

SEQ ID NO: 1339792 - RNA, 18 nt, Human
ccuccuuccucuuuucca

SEQ ID NO: 1339793 - RNA, 22 nt, Human
ccugagacaccuaggcuacugg

SEQ ID NO: 1339794 - RNA, 22 nt, Human
ccuguaccagacagagcagggg

SEQ ID NO: 1339795 - RNA, 21 nt, Human
cgagcccuagacccagaaaga

SEQ ID NO: 1339796 - RNA, 21 nt, Human
cgggagccccgcggcuccugc

SEQ ID NO: 1339797 - RNA, 21 nt, Human
cggggcugcagcggaacagcg

SEQ ID NO: 1339798 - RNA, 28 nt, Human
cggguuugugcuggaccuuagacucagg

SEQ ID NO: 1339799 - RNA, 22 nt, Human
cuagacccagaaagacacacuc

SEQ ID NO: 1339800 - RNA, 23 nt, Human
cuagacccagaaagacacacuca

SEQ ID NO: 1339801 - RNA, 19 nt, Human
cugaagccguggcagaagc

SEQ ID NO: 1339802 - RNA, 20 nt, Human
cugaggcuucauccuugcuc

SEQ ID NO: 1339803 - RNA, 25 nt, Human
cugaggcuucauccuugcucugcaa

SEQ ID NO: 1339804 - RNA, 21 nt, Human
cugcagccugcggggguggag

SEQ ID NO: 1339805 - RNA, 22 nt, Human
cugcggggcccaggggccugag

SEQ ID NO: 1339806 - RNA, 21 nt, Human
cuggguccucugaggcucaga

SEQ ID NO: 1339807 - RNA, 21 nt, Human
cuguggggcucagggugggag

SEQ ID NO: 1339808 - RNA, 23 nt, Human
cuucccaaggaaccgggagcccc

SEQ ID NO: 1339809 - RNA, 22 nt, Human
cuuugggcgcuuuuuugauggg

SEQ ID NO: 1339810 - RNA, 23 nt, Human
gacuguggggcucagggugggag

SEQ ID NO: 1339811 - RNA, 19 nt, Human
gagaggggcccacucagca

SEQ ID NO: 1339812 - RNA, 20 nt, Human
gaggcuggguucugccaggg

SEQ ID NO: 1339813 - RNA, 23 nt, Human
gcacuggguggguggggcaggac

SEQ ID NO: 1339814 - RNA, 18 nt, Human
gcagcggaacagcggugg

SEQ ID NO: 1339815 - RNA, 18 nt, Human
gcccuggaccccccuuuu

SEQ ID NO: 1339816 - RNA, 19 nt, Human
gccgggucuucagugucuu

SEQ ID NO: 1339817 - RNA, 21 nt, Human
gcggaacagcgguggaggccg

SEQ ID NO: 1339818 - RNA, 20 nt, Human
gcuaugggcuucagcaaggc

SEQ ID NO: 1339819 - RNA, 21 nt, Human
gcuccugcauuucucuuucuc

SEQ ID NO: 1339820 - RNA, 19 nt, Human
ggacuucccccucccugcu

SEQ ID NO: 1339821 - RNA, 24 nt, Human
ggcaagaggggauggaccccaggg

SEQ ID NO: 1339822 - RNA, 24 nt, Human
ggcaauggggugaccuaaaaggga

SEQ ID NO: 1339823 - RNA, 19 nt, Human
ggcacucagccccacccaa

SEQ ID NO: 1339824 - RNA, 22 nt, Human
ggcccaggggccugagacaccu

SEQ ID NO: 1339825 - RNA, 18 nt, Human
ggcucagcuuugggcgcu

SEQ ID NO: 1339826 - RNA, 18 nt, Human
gggacccugggcaagagg

SEQ ID NO: 1339827 - RNA, 22 nt, Human
gggccuguaccagacagagcag

SEQ ID NO: 1339828 - RNA, 18 nt, Human
ggggauggaccccagggg

SEQ ID NO: 1339829 - RNA, 18 nt, Human
ggguccucugaggcucag

SEQ ID NO: 1339830 - RNA, 23 nt, Human
gggugggcccugaggagcacggg

SEQ ID NO: 1339831 - RNA, 20 nt, Human
ggucauaggagcaggugaga

SEQ ID NO: 1339832 - RNA, 24 nt, Human
gguggguggggcagggcggggcug

SEQ ID NO: 1339833 - RNA, 26 nt, Human
guccacccucuacccucaacccccac

SEQ ID NO: 1339834 - RNA, 19 nt, Human
guggcacucagccccaccc

SEQ ID NO: 1339835 - RNA, 24 nt, Human
gugggcccugaggagcacgggagu

SEQ ID NO: 1339836 - RNA, 21 nt, Human
guggguggggcagggcggggc

SEQ ID NO: 1339837 - RNA, 22 nt, Human
guuugugcuggaccuuagacuc

SEQ ID NO: 1339838 - RNA, 21 nt, Human
uacagggugccaaagaugagc

SEQ ID NO: 1339839 - RNA, 23 nt, Human
uacagggugccaaagaugagcac

SEQ ID NO: 1339840 - RNA, 19 nt, Human
uacccucaacccccacagc

SEQ ID NO: 1339841 - RNA, 26 nt, Human
uacccucaacccccacagcugggccu

SEQ ID NO: 1339842 - RNA, 21 nt, Human
uacuggcacaguguggagcag

SEQ ID NO: 1339843 - RNA, 20 nt, Human
uagacccagaaagacacacu

SEQ ID NO: 1339844 - RNA, 18 nt, Human
ucaacccccacagcuggg

SEQ ID NO: 1339845 - RNA, 20 nt, Human
ucagagccuaggauggaggg

SEQ ID NO: 1339846 - RNA, 18 nt, Human
ucagcaggggccuguacc

SEQ ID NO: 1339847 - RNA, 22 nt, Human
ucagccccacccaaugaccagg

SEQ ID NO: 1339848 - RNA, 18 nt, Human
uccaagccccuuccagaa

SEQ ID NO: 1339849 - RNA, 24 nt, Human
uccacccucuacccucaaccccca

SEQ ID NO: 1339850 - RNA, 18 nt, Human
uccaucugggcuaggacu

SEQ ID NO: 1339851 - RNA, 19 nt, Human
ucccaaggaaccgggagcc

SEQ ID NO: 1339852 - RNA, 20 nt, Human
uccugcauuucucuuucucc

SEQ ID NO: 1339853 - RNA, 24 nt, Human
uccugcauuucucuuucuccuuca

SEQ ID NO: 1339854 - RNA, 26 nt, Human
uccuuggguggcucaguccucagccu

SEQ ID NO: 1339855 - RNA, 21 nt, Human
ucugccggguuugugcuggac

SEQ ID NO: 1339856 - RNA, 23 nt, Human
ucugcuugguacaggauggggac

SEQ ID NO: 1339857 - RNA, 23 nt, Human
ucugggcuaggacuucccccucc

SEQ ID NO: 1339858 - RNA, 23 nt, Human
ugacugaagccguggcagaagcu

SEQ ID NO: 1339859 - RNA, 20 nt, Human
ugagacaccuaggcuacugg

SEQ ID NO: 1339860 - RNA, 18 nt, Human
ugccaaagguccaauggg

SEQ ID NO: 1339861 - RNA, 24 nt, Human
ugccuucaggcccguccuuggucc

SEQ ID NO: 1339862 - RNA, 20 nt, Human
ugcuaugggcuucagcaagg

SEQ ID NO: 1339863 - RNA, 22 nt, Human
uggagggacaguccuugaccca

SEQ ID NO: 1339864 - RNA, 21 nt, Human
uggcagaagcuggggcgggug

SEQ ID NO: 1339865 - RNA, 21 nt, Human
uggccuggccauccuggucgc

SEQ ID NO: 1339866 - RNA, 22 nt, Human
uggcucagcuuugggcgcuuuu

SEQ ID NO: 1339867 - RNA, 24 nt, Human
uggcucaguccucagccucugguc

SEQ ID NO: 1339868 - RNA, 19 nt, Human
ugggaggaggcgacugcug

SEQ ID NO: 1339869 - RNA, 23 nt, Human
ugggaggaggcgacugcuggagg

SEQ ID NO: 1339870 - RNA, 18 nt, Human
uggguggggcagggcggg

SEQ ID NO: 1339871 - RNA, 24 nt, Human
uggguggguggggcagggcggggc

SEQ ID NO: 1339872 - RNA, 22 nt, Human
uguggagcaggggcugggucug

SEQ ID NO: 1339873 - RNA, 18 nt, Human
uguggggcucaggguggg

SEQ ID NO: 1339874 - RNA, 19 nt, Human
uucccccaugugccuucag

SEQ ID NO: 1339875 - RNA, 24 nt, Human
uugacccaaacuaccccgagcccu

SEQ ID NO: 1339876 - RNA, 28 nt, Human
uuuccaagccccuuccagaagaguggcc

SEQ ID NO: 1339877 - RNA, 25 nt, Human
aaaaaaaaaaaacugggcaagagaa

SEQ ID NO: 1339878 - RNA, 22 nt, Human
aaaaaaaaacugggcaagagaa

SEQ ID NO: 1339879 - RNA, 23 nt, Human
aaaaucugcauuuuguagauuuc

SEQ ID NO: 1339880 - RNA, 23 nt, Human
aaagcagaacaaauaucugcaaa

SEQ ID NO: 1339881 - RNA, 25 nt, Human
aaagcagaacaaauaucugcaaacc

SEQ ID NO: 1339882 - RNA, 28 nt, Human
aacaauaaaagccaaccccacuggagaa

SEQ ID NO: 1339883 - RNA, 25 nt, Human
aacugggcaagagaagaggaaauca

SEQ ID NO: 1339884 - RNA, 20 nt, Human
aagaaacaauaaaagccaac

SEQ ID NO: 1339885 - RNA, 24 nt, Human
aaguguuggugguucccagaaacc

SEQ ID NO: 1339886 - RNA, 20 nt, Human
acaaagcagaacaaauaucu

SEQ ID NO: 1339887 - RNA, 21 nt, Human
acacauuaacucacuuugccc

SEQ ID NO: 1339888 - RNA, 22 nt, Human
acccugaagugaugguggaaau

SEQ ID NO: 1339889 - RNA, 20 nt, Human
acggaacccaggacuuagcu

SEQ ID NO: 1339890 - RNA, 20 nt, Human
acuaccagcuccgcccaggu

SEQ ID NO: 1339891 - RNA, 24 nt, Human
agaaggcccccaaccccucggucc

SEQ ID NO: 1339892 - RNA, 20 nt, Human
agaguaaaaagagaggggga

SEQ ID NO: 1339893 - RNA, 21 nt, Human
agcagaacaaauaucugcaaa

SEQ ID NO: 1339894 - RNA, 20 nt, Human
agcagagggcccauaggcag

SEQ ID NO: 1339895 - RNA, 21 nt, Human
aggaaguuccuggaaccuaaa

SEQ ID NO: 1339896 - RNA, 23 nt, Human
aggaggcugcaggaggggagggg

SEQ ID NO: 1339897 - RNA, 26 nt, Human
aggcccccaaccccucgguccuccac

SEQ ID NO: 1339898 - RNA, 23 nt, Human
aggccuggcuucaagaaccagga

SEQ ID NO: 1339899 - RNA, 19 nt, Human
aggcuuuaaaaaaaaaaaa

SEQ ID NO: 1339900 - RNA, 21 nt, Human
agggaggaggcugccacagug

SEQ ID NO: 1339901 - RNA, 22 nt, Human
agggggaaaaaagaaaaucugg

SEQ ID NO: 1339902 - RNA, 23 nt, Human
agucaacccugggaaaaagcuaa

SEQ ID NO: 1339903 - RNA, 20 nt, Human
agugaagcagaaaagcuaca

SEQ ID NO: 1339904 - RNA, 21 nt, Human
auaaaagccaaccccacugga

SEQ ID NO: 1339905 - RNA, 26 nt, Human
aucccugcaaaacaaacuccagaaaa

SEQ ID NO: 1339906 - RNA, 23 nt, Human
caaaagaagggccccaaugucau

SEQ ID NO: 1339907 - RNA, 31 nt, Human
caaacccaaacaagaaacaauaaaagccaag

SEQ ID NO: 1339908 - RNA, 19 nt, Human
caaagcgacgggacugacc

SEQ ID NO: 1339909 - RNA, 23 nt, Human
caaccccucgguccuccacaccg

SEQ ID NO: 1339910 - RNA, 21 nt, Human
caagagaagaggaaaucagga

SEQ ID NO: 1339911 - RNA, 21 nt, Human
caauuuuuacaaagcagaaca

SEQ ID NO: 1339912 - RNA, 26 nt, Human
cacuaauggccaauuuuuacaaagcu

SEQ ID NO: 1339913 - RNA, 21 nt, Human
cacuuaugaccaagguugggu

SEQ ID NO: 1339914 - RNA, 19 nt, Human
cagcaaaagaagggcccca

SEQ ID NO: 1339915 - RNA, 22 nt, Human
cagccaggcacacuuaugacca

SEQ ID NO: 1339916 - RNA, 21 nt, Human
cagcuaucccugcaaaacaaa

SEQ ID NO: 1339917 - RNA, 18 nt, Human
caggaaguuccuggaacc

SEQ ID NO: 1339918 - RNA, 23 nt, Human
caguuucagcaaaagaagggccc

SEQ ID NO: 1339919 - RNA, 22 nt, Human
ccaaacaagaaacaauaaaagc

SEQ ID NO: 1339920 - RNA, 25 nt, Human
ccaaccccacuggagaggagaaaau

SEQ ID NO: 1339921 - RNA, 23 nt, Human
ccacacaccauggcuuuuuccac

SEQ ID NO: 1339922 - RNA, 28 nt, Human
ccaggcuuuaaaaaaaaaaaaaaaaaaa

SEQ ID NO: 1339923 - RNA, 26 nt, Human
ccauacucccagcuaucccugcaaaa

SEQ ID NO: 1339924 - RNA, 22 nt, Human
ccauaggcagcacccugcaaaa

SEQ ID NO: 1339925 - RNA, 23 nt, Human
cccauaggcagcacccugcaaaa

SEQ ID NO: 1339926 - RNA, 20 nt, Human
ccccaaccccucgguccucc

SEQ ID NO: 1339927 - RNA, 20 nt, Human
cccccaaccccucgguccuc

SEQ ID NO: 1339928 - RNA, 24 nt, Human
ccccggccagcccgccugagauga

SEQ ID NO: 1339929 - RNA, 19 nt, Human
ccccuucccaaguccuucc

SEQ ID NO: 1339930 - RNA, 21 nt, Human
cccugggaaaaagcuaaaccu

SEQ ID NO: 1339931 - RNA, 22 nt, Human
ccguccggaugcagcugauugc

SEQ ID NO: 1339932 - RNA, 21 nt, Human
ccuggcuucaagaaccaggaa

SEQ ID NO: 1339933 - RNA, 19 nt, Human
ccuguccaccaccaccucg

SEQ ID NO: 1339934 - RNA, 25 nt, Human
ccuguccaccaccaccucggauguc

SEQ ID NO: 1339935 - RNA, 19 nt, Human
ccuucccaaguccuuccug

SEQ ID NO: 1339936 - RNA, 20 nt, Human
cgagggccccggccagcccg

SEQ ID NO: 1339937 - RNA, 21 nt, Human
cgcaucguggagcaggguggc

SEQ ID NO: 1339938 - RNA, 23 nt, Human
cggauguccccgcacacagccuu

SEQ ID NO: 1339939 - RNA, 24 nt, Human
cggccagcccgccugagaugaugu

SEQ ID NO: 1339940 - RNA, 22 nt, Human
cgugugaggagagggcaagggg

SEQ ID NO: 1339941 - RNA, 19 nt, Human
cucaaccacauuuuaaucu

SEQ ID NO: 1339942 - RNA, 23 nt, Human
gaagcaaaauguacuaccagcuc

SEQ ID NO: 1339943 - RNA, 22 nt, Human
gaagcagaaaagcuacauucug

SEQ ID NO: 1339944 - RNA, 23 nt, Human
gaaggcccccaaccccucggucc

SEQ ID NO: 1339945 - RNA, 20 nt, Human
gaggagagaugcuuuuugag

SEQ ID NO: 1339946 - RNA, 21 nt, Human
gaggagagggcaaggggcugg

SEQ ID NO: 1339947 - RNA, 18 nt, Human
gagggccccggccagccc

SEQ ID NO: 1339948 - RNA, 27 nt, Human
gcaaaauguacuaccagcuccgccccc

SEQ ID NO: 1339949 - RNA, 22 nt, Human
gcaucguggagcaggguggcca

SEQ ID NO: 1339950 - RNA, 24 nt, Human
gcccccaaccccucgguccuccac

SEQ ID NO: 1339951 - RNA, 18 nt, Human
gccugagaugauguggga

SEQ ID NO: 1339952 - RNA, 21 nt, Human
ggaaaaagcuaaaccugcaag

SEQ ID NO: 1339953 - RNA, 26 nt, Human
ggacuggaaggggauguucaugguca

SEQ ID NO: 1339954 - RNA, 19 nt, Human
ggagcagagggcccauagg

SEQ ID NO: 1339955 - RNA, 23 nt, Human
ggcaagagaagaggaaaucagga

SEQ ID NO: 1339956 - RNA, 18 nt, Human
gggauguucauggucagc

SEQ ID NO: 1339957 - RNA, 20 nt, Human
gguagaaggcccccaacccc

SEQ ID NO: 1339958 - RNA, 23 nt, Human
guccgguggggguugaccugcuc

SEQ ID NO: 1339959 - RNA, 19 nt, Human
gugaagcagaaaagcuaca

SEQ ID NO: 1339960 - RNA, 19 nt, Human
gugggucaaaucuaugucu

SEQ ID NO: 1339961 - RNA, 19 nt, Human
uaaaacccugaagugaugg

SEQ ID NO: 1339962 - RNA, 18 nt, Human
uacaaagcagaacaaaua

SEQ ID NO: 1339963 - RNA, 25 nt, Human
uacaaagcagaacaaauaucugcaa

SEQ ID NO: 1339964 - RNA, 22 nt, Human
uacgugugaggagagggcaagg

SEQ ID NO: 1339965 - RNA, 18 nt, Human
uagaaggcccccaacccc

SEQ ID NO: 1339966 - RNA, 25 nt, Human
uagcuccgguagaaggcccccaacc

SEQ ID NO: 1339967 - RNA, 21 nt, Human
uagcuuucuaagaagcaaaau

SEQ ID NO: 1339968 - RNA, 21 nt, Human
ucagggcauagcucuuuagag

SEQ ID NO: 1339969 - RNA, 26 nt, Human
uccaaacccaaacaagaaacaauaaa

SEQ ID NO: 1339970 - RNA, 18 nt, Human
ucccugcaaaacaaacuc

SEQ ID NO: 1339971 - RNA, 22 nt, Human
uccucugggaucuaaggaucca

SEQ ID NO: 1339972 - RNA, 22 nt, Human
ucugcaagcgcugcuucaccac

SEQ ID NO: 1339973 - RNA, 19 nt, Human
ucuuguagucaacccuggg

SEQ ID NO: 1339974 - RNA, 22 nt, Human
ugaauuuugucaaaauaaaagu

SEQ ID NO: 1339975 - RNA, 22 nt, Human
ugagaagggggaaaaaagaaaa

SEQ ID NO: 1339976 - RNA, 22 nt, Human
ugagaugaugugggacugcggg

SEQ ID NO: 1339977 - RNA, 19 nt, Human
ugagcagaguaaaaagaga

SEQ ID NO: 1339978 - RNA, 25 nt, Human
ugagcagaguaaaaagagaggggga

SEQ ID NO: 1339979 - RNA, 23 nt, Human
ugaggagagggcaaggggcugga

SEQ ID NO: 1339980 - RNA, 18 nt, Human
uggaaggggauguucaug

SEQ ID NO: 1339981 - RNA, 19 nt, Human
ugggaaaaagcuaaaccug

SEQ ID NO: 1339982 - RNA, 22 nt, Human
ugggaaaaagcuaaaccugcaa

SEQ ID NO: 1339983 - RNA, 24 nt, Human
ugggaaaaagcuaaaccugcaagu

SEQ ID NO: 1339984 - RNA, 21 nt, Human
ugggaucuaaggauccaggga

SEQ ID NO: 1339985 - RNA, 22 nt, Human
ugggaucuaaggauccagggag

SEQ ID NO: 1339986 - RNA, 21 nt, Human
ugggucaaaucuaugucucca

SEQ ID NO: 1339987 - RNA, 20 nt, Human
uuaaaaaaaaaaaaaaaaaa

SEQ ID NO: 1339988 - RNA, 19 nt, Human
uuaaucuugcaaaaacaug

SEQ ID NO: 1339989 - RNA, 20 nt, Human
uuaaucuugcaaaaacaugg

SEQ ID NO: 1339990 - RNA, 21 nt, Human
uuccaaacccaaacaagaaac

SEQ ID NO: 1339991 - RNA, 18 nt, Human
uuccagggucagucugca

SEQ ID NO: 1339992 - RNA, 18 nt, Human
uucccagaaaccacacac

SEQ ID NO: 1339993 - RNA, 20 nt, Human
uugcaaaaacaugguuuucu

SEQ ID NO: 1339994 - RNA, 24 nt, Human
uuuucagucacugcaaauuuucuu

SEQ ID NO: 1339995 - RNA, 24 nt, Human
uuuuuuuuuuuuuuuuacuguuuu

SEQ ID NO: 1339996 - RNA, 19 nt, Human
aaaagccuguuaguccuac

SEQ ID NO: 1339997 - RNA, 21 nt, Human
aaaauaaaaagcacauaucuu

SEQ ID NO: 1339998 - RNA, 22 nt, Human
aaacacaauccaacaaaauucu

SEQ ID NO: 1339999 - RNA, 24 nt, Human
aaauaaaaagcacauaucuuuaau

SEQ ID NO: 1340000 - RNA, 18 nt, Human
aacacccuagccagaaga

SEQ ID NO: 1340001 - RNA, 22 nt, Human
aagauaauccaaagcucaacug

SEQ ID NO: 1340002 - RNA, 23 nt, Human
aagcaaaugaacucaucugcaaa

SEQ ID NO: 1340003 - RNA, 20 nt, Human
aauaucugggcaguaaccau

SEQ ID NO: 1340004 - RNA, 23 nt, Human
acaaaaccaaaaaugcauaaaua

SEQ ID NO: 1340005 - RNA, 29 nt, Human
accaaaaaugcauaaauauaucuaacacc

SEQ ID NO: 1340006 - RNA, 20 nt, Human
accaggcugcccaacagcaa

SEQ ID NO: 1340007 - RNA, 23 nt, Human
agagaagaaaaggaucuuaaaaa

SEQ ID NO: 1340008 - RNA, 18 nt, Human
agaggacacaggccggag

SEQ ID NO: 1340009 - RNA, 20 nt, Human
agcaacagaaaaacgucaag

SEQ ID NO: 1340010 - RNA, 23 nt, Human
agcggagcacagcgccaggugcg

SEQ ID NO: 1340011 - RNA, 23 nt, Human
aggauuccagucuccaaacuuuu

SEQ ID NO: 1340012 - RNA, 20 nt, Human
auaaacaaauauuucucaag

SEQ ID NO: 1340013 - RNA, 22 nt, Human
auacaaauuggaccaaaauaga

SEQ ID NO: 1340014 - RNA, 18 nt, Human
augguaaaaaaaaaaaaa

SEQ ID NO: 1340015 - RNA, 18 nt, Human
auucuugacucucuuucu

SEQ ID NO: 1340016 - RNA, 21 nt, Human
auuugaggcuuaauauugucc

SEQ ID NO: 1340017 - RNA, 22 nt, Human
caacaaaauucuugacucucuu

SEQ ID NO: 1340018 - RNA, 22 nt, Human
cacagcgccaggugcgcccccc

SEQ ID NO: 1340019 - RNA, 24 nt, Human
caccagcaaacgggcuccgcuccu

SEQ ID NO: 1340020 - RNA, 19 nt, Human
caccuugguaagacaggau

SEQ ID NO: 1340021 - RNA, 21 nt, Human
cagcaaacgggcuccgcuccu

SEQ ID NO: 1340022 - RNA, 18 nt, Human
cagcaauaacagacguaa

SEQ ID NO: 1340023 - RNA, 22 nt, Human
caggggcuagggccacagcgga

SEQ ID NO: 1340024 - RNA, 20 nt, Human
caguaaccauuaaaucaaau

SEQ ID NO: 1340025 - RNA, 21 nt, Human
cauagcaugauguuagagaaa

SEQ ID NO: 1340026 - RNA, 19 nt, Human
cauuauagcuacuugguua

SEQ ID NO: 1340027 - RNA, 24 nt, Human
ccacuagauacaaauuggaccaaa

SEQ ID NO: 1340028 - RNA, 18 nt, Human
ccagcaccagcaaacggg

SEQ ID NO: 1340029 - RNA, 18 nt, Human
ccaggugcgccccccucc

SEQ ID NO: 1340030 - RNA, 21 nt, Human
ccccccuccagcaccagcaaa

SEQ ID NO: 1340031 - RNA, 27 nt, Human
cucaaaagagccaaggaguacuauaaa

SEQ ID NO: 1340032 - RNA, 22 nt, Human
cuccagcaccagcaaacgggcu

SEQ ID NO: 1340033 - RNA, 21 nt, Human
cugauuuaaaaaguguuagaa

SEQ ID NO: 1340034 - RNA, 22 nt, Human
cugcuaagguaaauuauuauau

SEQ ID NO: 1340035 - RNA, 21 nt, Human
cugggccuuucauuuaauaag

SEQ ID NO: 1340036 - RNA, 21 nt, Human
gaaaagacaggagagaaugua

SEQ ID NO: 1340037 - RNA, 18 nt, Human
gaacagucaaaacggcac

SEQ ID NO: 1340038 - RNA, 18 nt, Human
gcaacagaaaaacgucaa

SEQ ID NO: 1340039 - RNA, 20 nt, Human
gcaacagaaaaacgucaaga

SEQ ID NO: 1340040 - RNA, 21 nt, Human
gcacagcgccaggugcgcccc

SEQ ID NO: 1340041 - RNA, 18 nt, Human
gcauuugaaaugcacaga

SEQ ID NO: 1340042 - RNA, 20 nt, Human
gcuaagucccauuauagcua

SEQ ID NO: 1340043 - RNA, 19 nt, Human
ggaagguaaugguaaucua

SEQ ID NO: 1340044 - RNA, 18 nt, Human
gggaaaauugaagaggaa

SEQ ID NO: 1340045 - RNA, 18 nt, Human
guaaaaaugcaaauaugc

SEQ ID NO: 1340046 - RNA, 21 nt, Human
uaaaaacaaaaccaaaaaugc

SEQ ID NO: 1340047 - RNA, 27 nt, Human
uaaaaagcacauaucuuuaauuucuaa

SEQ ID NO: 1340048 - RNA, 22 nt, Human
uaaaaaugcaaauaugccaccu

SEQ ID NO: 1340049 - RNA, 22 nt, Human
uaaauaaaucuacaucuaggua

SEQ ID NO: 1340050 - RNA, 24 nt, Human
uaaaucuguagaagcagagggaga

SEQ ID NO: 1340051 - RNA, 21 nt, Human
uaacagacguaaccgugaaaa

SEQ ID NO: 1340052 - RNA, 19 nt, Human
uaacuggaggcaaauaaac

SEQ ID NO: 1340053 - RNA, 24 nt, Human
uaauauuguccaaauuuacuguuu

SEQ ID NO: 1340054 - RNA, 27 nt, Human
uacaaaagcaaaugaacucaucugcaa

SEQ ID NO: 1340055 - RNA, 19 nt, Human
uaccauaugugaugaucuu

SEQ ID NO: 1340056 - RNA, 24 nt, Human
uagaagcagagggagacacucggg

SEQ ID NO: 1340057 - RNA, 21 nt, Human
uagagaaaaauauaaacaaau

SEQ ID NO: 1340058 - RNA, 23 nt, Human
uauaaacaaauauuucucaagua

SEQ ID NO: 1340059 - RNA, 24 nt, Human
uauaaacauucucaaauuguauuu

SEQ ID NO: 1340060 - RNA, 19 nt, Human
uauuuugcucauauuacuc

SEQ ID NO: 1340061 - RNA, 23 nt, Human
ucaaaugaucucucucuccuugg

SEQ ID NO: 1340062 - RNA, 24 nt, Human
ucaaaugaucucucucuccuuggu

SEQ ID NO: 1340063 - RNA, 22 nt, Human
ucauuguuucaauaagacaaaa

SEQ ID NO: 1340064 - RNA, 21 nt, Human
uccagcaccagcaaacgggcu

SEQ ID NO: 1340065 - RNA, 23 nt, Human
ucuacaaaagcaaaugaacucau

SEQ ID NO: 1340066 - RNA, 22 nt, Human
ucucuccuugguccaucuucuc

SEQ ID NO: 1340067 - RNA, 18 nt, Human
ucuguugucagauguuca

SEQ ID NO: 1340068 - RNA, 21 nt, Human
ugaaaacacaucuacaaaagc

SEQ ID NO: 1340069 - RNA, 22 nt, Human
ugaaaacacaucuacaaaagca

SEQ ID NO: 1340070 - RNA, 22 nt, Human
ugaaaagacaggagagaaugua

SEQ ID NO: 1340071 - RNA, 22 nt, Human
ugaaauuucuguugucagaugu

SEQ ID NO: 1340072 - RNA, 25 nt, Human
ugaauaaaaccacagcauaaucgga

SEQ ID NO: 1340073 - RNA, 18 nt, Human
ugagaagcccacaggggc

SEQ ID NO: 1340074 - RNA, 28 nt, Human
ugauuuaaaaaguguuagaaggagaaaa

SEQ ID NO: 1340075 - RNA, 20 nt, Human
uggagacucaaaagagccaa

SEQ ID NO: 1340076 - RNA, 26 nt, Human
ugguaaaaaaaaaaaaauguuuuaag

SEQ ID NO: 1340077 - RNA, 21 nt, Human
uggucagaacagucaaaacgg

SEQ ID NO: 1340078 - RNA, 24 nt, Human
uggucagaacagucaaaacggcac

SEQ ID NO: 1340079 - RNA, 21 nt, Human
uguaagccucaguguuccaau

SEQ ID NO: 1340080 - RNA, 22 nt, Human
ugugaauaaaaccacagcauaa

SEQ ID NO: 1340081 - RNA, 23 nt, Human
uuagaucuauagauuuuuuuuuu

SEQ ID NO: 1340082 - RNA, 22 nt, Human
uuaguucuagucaugaggaaaa

SEQ ID NO: 1340083 - RNA, 20 nt, Human
uucaggaaaugaaaagucac

SEQ ID NO: 1340084 - RNA, 21 nt, Human
uugaccagaacaaagaaaaug

SEQ ID NO: 1340085 - RNA, 22 nt, Human
uugcaaauaaaccagcauuucu

SEQ ID NO: 1340086 - RNA, 21 nt, Human
uuuaagcaguaaaaaugcaaa

SEQ ID NO: 1340087 - RNA, 21 nt, Human
uuucaggaaaugaaaagucac

SEQ ID NO: 1340088 - RNA, 22 nt, Human
aggaaggaacaggcccagagga

SEQ ID NO: 1340089 - RNA, 26 nt, Human
aggaaggaacaggcccagaggaucua

SEQ ID NO: 1340090 - RNA, 22 nt, Human
caaaacagguccuccucuaagc

SEQ ID NO: 1340091 - RNA, 22 nt, Human
cauuuuuauuguuauuaugcau

SEQ ID NO: 1340092 - RNA, 26 nt, Human
ccauucauuuuuguaucuugaguuuu

SEQ ID NO: 1340093 - RNA, 22 nt, Human
ggacguuuaaagaaaaggaagg

SEQ ID NO: 1340094 - RNA, 20 nt, Human
aaaccaagcucucaccuauu

SEQ ID NO: 1340095 - RNA, 22 nt, Human
aaauaaccucccaacagaaaau

SEQ ID NO: 1340096 - RNA, 18 nt, Human
aaauacccaacucaaaac

SEQ ID NO: 1340097 - RNA, 19 nt, Human
aacuacugucccccgcccc

SEQ ID NO: 1340098 - RNA, 30 nt, Human
aauaaccucccaacagaaaauauuuccacu

SEQ ID NO: 1340099 - RNA, 21 nt, Human
acacuauauguucaaaaaaug

SEQ ID NO: 1340100 - RNA, 18 nt, Human
acagagaaaaaccaauga

SEQ ID NO: 1340101 - RNA, 25 nt, Human
acagagaaaaaccaaugaacauaaa

SEQ ID NO: 1340102 - RNA, 19 nt, Human
acucaguuuuucagcauga

SEQ ID NO: 1340103 - RNA, 21 nt, Human
aggcaggggcgggcgucuaca

SEQ ID NO: 1340104 - RNA, 24 nt, Human
auuuuuucaauuuaacuuugggag

SEQ ID NO: 1340105 - RNA, 21 nt, Human
caaacccaaucaagaaacaga

SEQ ID NO: 1340106 - RNA, 19 nt, Human
caacuacugucccccgccc

SEQ ID NO: 1340107 - RNA, 21 nt, Human
caacuacugucccccgccccg

SEQ ID NO: 1340108 - RNA, 24 nt, Human
cacaauaacuggugagcuaaaaac

SEQ ID NO: 1340109 - RNA, 24 nt, Human
ccaacucaaaacuauaacaaaccc

SEQ ID NO: 1340110 - RNA, 19 nt, Human
cccccgccccgccaacgcc

SEQ ID NO: 1340111 - RNA, 18 nt, Human
cuacugucccccgccccg

SEQ ID NO: 1340112 - RNA, 19 nt, Human
gagaaaaaccaaugaacau

SEQ ID NO: 1340113 - RNA, 19 nt, Human
gcaggggcgggcgucuaca

SEQ ID NO: 1340114 - RNA, 19 nt, Human
ggagguggcggagaggcag

SEQ ID NO: 1340115 - RNA, 24 nt, Human
uaaaaaccacaauucagagaucaa

SEQ ID NO: 1340116 - RNA, 26 nt, Human
uaaaauacccaacucaaaacuauaag

SEQ ID NO: 1340117 - RNA, 24 nt, Human
uaaauaaccucccaacagaaaaua

SEQ ID NO: 1340118 - RNA, 22 nt, Human
uacacaauaacuggugagcuaa

SEQ ID NO: 1340119 - RNA, 20 nt, Human
uagaaacuuuauguaaccua

SEQ ID NO: 1340120 - RNA, 19 nt, Human
uagaaguuaaagaaccuau

SEQ ID NO: 1340121 - RNA, 23 nt, Human
ucaaaacuauaacaaacccaauc

SEQ ID NO: 1340122 - RNA, 18 nt, Human
ucacauaagaaaaguggu

SEQ ID NO: 1340123 - RNA, 26 nt, Human
uccaccaucaaagcaauuugaugaau

SEQ ID NO: 1340124 - RNA, 23 nt, Human
ucuacaacuacugucccccgccc

SEQ ID NO: 1340125 - RNA, 20 nt, Human
ucucauaaugcaaaauccuu

SEQ ID NO: 1340126 - RNA, 19 nt, Human
ucucugaggcaggggcggg

SEQ ID NO: 1340127 - RNA, 19 nt, Human
uggagguggcggagaggca

SEQ ID NO: 1340128 - RNA, 20 nt, Human
uggagguggcggagaggcag

SEQ ID NO: 1340129 - RNA, 18 nt, Human
uguaaacaaaguucaguc

SEQ ID NO: 1340130 - RNA, 23 nt, Human
uuagaucuaauaaaggagaaaaa

SEQ ID NO: 1340131 - RNA, 18 nt, Human
uucacagagaaaaaccaa

SEQ ID NO: 1340132 - RNA, 27 nt, Human
uuguccaauucuccacucucacucauc

SEQ ID NO: 1340133 - RNA, 23 nt, Human
uuuaaaauaaauaaccucccaac

SEQ ID NO: 1340134 - RNA, 20 nt, Human
uuuguuuacuaggccuuugu

SEQ ID NO: 1340135 - RNA, 24 nt, Human
aaaaauuugauuuuuuucaugcca

SEQ ID NO: 1340136 - RNA, 22 nt, Human
aaacaagguuccgagcaggaaa

SEQ ID NO: 1340137 - RNA, 20 nt, Human
aaagauggugaagaacucaa

SEQ ID NO: 1340138 - RNA, 22 nt, Human
aagaggugucugcugaauuuug

SEQ ID NO: 1340139 - RNA, 22 nt, Human
agccaggaaauucgaauucgau

SEQ ID NO: 1340140 - RNA, 21 nt, Human
augaaagcaaggagaaacuaa

SEQ ID NO: 1340141 - RNA, 18 nt, Human
ggccugggagagaaucuc

SEQ ID NO: 1340142 - RNA, 18 nt, Human
guaaaauauuucauuugg

SEQ ID NO: 1340143 - RNA, 20 nt, Human
gugcagggccuuaaaagcag

SEQ ID NO: 1340144 - RNA, 22 nt, Human
uagcuaaguucagggacaacau

SEQ ID NO: 1340145 - RNA, 21 nt, Human
ucagggacaacauucauuuau

SEQ ID NO: 1340146 - RNA, 22 nt, Human
ucaguugcaaaagauggugaag

SEQ ID NO: 1340147 - RNA, 22 nt, Human
ugcaaaagauggugaagaacuc

SEQ ID NO: 1340148 - RNA, 19 nt, Human
uggugaagaacucaagcug

SEQ ID NO: 1340149 - RNA, 23 nt, Human
uucagggacaacauucauuuaua

SEQ ID NO: 1340150 - RNA, 24 nt, Human
agcagcuucaagaaccagcuguag

SEQ ID NO: 1340151 - RNA, 24 nt, Human
cagcuucaagaaccagcuguaguc

SEQ ID NO: 1340152 - RNA, 20 nt, Human
cucacaccucccguugacgu

SEQ ID NO: 1340153 - RNA, 20 nt, Human
cuucaagaaccagcuguagg

SEQ ID NO: 1340154 - RNA, 22 nt, Human
gaucagggcgccgccggcgucc

SEQ ID NO: 1340155 - RNA, 21 nt, Human
gcuguagucuggcuuuggccu

SEQ ID NO: 1340156 - RNA, 22 nt, Human
ugcagcagcuucaagaaccagc

SEQ ID NO: 1340157 - RNA, 22 nt, Human
aaaccuguuuugucaaaacugg

SEQ ID NO: 1340158 - RNA, 27 nt, Human
aaauaaaucuuuccuugugauuggaaa

SEQ ID NO: 1340159 - RNA, 24 nt, Human
aacucuucaaguggaaauaaaaaa

SEQ ID NO: 1340160 - RNA, 18 nt, Human
aaggauacucccaaagcc

SEQ ID NO: 1340161 - RNA, 24 nt, Human
aauauggauugaacauaaaauguu

SEQ ID NO: 1340162 - RNA, 21 nt, Human
aauuacuaaaaaauaaaaaua

SEQ ID NO: 1340163 - RNA, 24 nt, Human
agaaaaacccacuaguauaauguu

SEQ ID NO: 1340164 - RNA, 18 nt, Human
agaaggauacucccaaag

SEQ ID NO: 1340165 - RNA, 24 nt, Human
auauaguauuuauguauauauaua

SEQ ID NO: 1340166 - RNA, 20 nt, Human
auuuugaucuauagucuaaa

SEQ ID NO: 1340167 - RNA, 21 nt, Human
caaugccagcacagauuuggg

SEQ ID NO: 1340168 - RNA, 22 nt, Human
cacuuuuucauaggcucacaca

SEQ ID NO: 1340169 - RNA, 24 nt, Human
cagccuuuuauaaguuuacuaaca

SEQ ID NO: 1340170 - RNA, 22 nt, Human
caguacacgcaccuaauauaug

SEQ ID NO: 1340171 - RNA, 23 nt, Human
cauauacauaacaaaagagugua

SEQ ID NO: 1340172 - RNA, 22 nt, Human
caugccuuuacgaguccauaua

SEQ ID NO: 1340173 - RNA, 23 nt, Human
cauuauaccgagaaaaaagcucu

SEQ ID NO: 1340174 - RNA, 25 nt, Human
ccccuaaauuacuaaaaaauaaaaa

SEQ ID NO: 1340175 - RNA, 18 nt, Human
cccuaaauuacuaaaaaa

SEQ ID NO: 1340176 - RNA, 21 nt, Human
ccuuucucccuccucccuccc

SEQ ID NO: 1340177 - RNA, 22 nt, Human
cucacacaaccuaugauuaucu

SEQ ID NO: 1340178 - RNA, 22 nt, Human
cucccaaagccacgagaauggg

SEQ ID NO: 1340179 - RNA, 23 nt, Human
cuugacacucugggcgagaugaa

SEQ ID NO: 1340180 - RNA, 23 nt, Human
gaaaacccagguggccauuucca

SEQ ID NO: 1340181 - RNA, 28 nt, Human
gccaaguacccuccauaaacucuuaaag

SEQ ID NO: 1340182 - RNA, 22 nt, Human
gccuuuuauaaguuuacuaaca

SEQ ID NO: 1340183 - RNA, 21 nt, Human
ggaaauaguuuugaaaugaag

SEQ ID NO: 1340184 - RNA, 19 nt, Human
guaaugccaaguacccucc

SEQ ID NO: 1340185 - RNA, 18 nt, Human
gugguuuuuagaaacagu

SEQ ID NO: 1340186 - RNA, 24 nt, Human
guuucaauacugaccauuuacuau

SEQ ID NO: 1340187 - RNA, 26 nt, Human
uaaaaaacaaaccuguuuugucaaaa

SEQ ID NO: 1340188 - RNA, 24 nt, Human
uaaguaacuuuuaauaucagaaaa

SEQ ID NO: 1340189 - RNA, 19 nt, Human
uaaucccuaugacuucccu

SEQ ID NO: 1340190 - RNA, 20 nt, Human
uacaaaauacaugcuuggug

SEQ ID NO: 1340191 - RNA, 24 nt, Human
uacauauacauaacaaaagagugu

SEQ ID NO: 1340192 - RNA, 21 nt, Human
uaggugcuaucccaaagcccu

SEQ ID NO: 1340193 - RNA, 20 nt, Human
uaguauuuauguauauauau

SEQ ID NO: 1340194 - RNA, 27 nt, Human
uagucuaaaaauuaacagcucgaucac

SEQ ID NO: 1340195 - RNA, 21 nt, Human
uauaauguuuuguccuuucaa

SEQ ID NO: 1340196 - RNA, 19 nt, Human
uaucagaaaaauaaaacuc

SEQ ID NO: 1340197 - RNA, 22 nt, Human
uaugggaaaacccagguggcca

SEQ ID NO: 1340198 - RNA, 20 nt, Human
uccacaggugaaauguacga

SEQ ID NO: 1340199 - RNA, 19 nt, Human
uccugauaugggaaaaccc

SEQ ID NO: 1340200 - RNA, 21 nt, Human
uccuuggcuuauuaguugcag

SEQ ID NO: 1340201 - RNA, 23 nt, Human
uccuuggcuuauuaguugcagga

SEQ ID NO: 1340202 - RNA, 24 nt, Human
ucuaaaaauuaacagcucgaucac

SEQ ID NO: 1340203 - RNA, 21 nt, Human
ugauaugggaaaacccaggug

SEQ ID NO: 1340204 - RNA, 21 nt, Human
ugauggaauguuugcauccuc

SEQ ID NO: 1340205 - RNA, 18 nt, Human
ugccaagggcaucauuau

SEQ ID NO: 1340206 - RNA, 24 nt, Human
ugccaaguacccuccauaaacucu

SEQ ID NO: 1340207 - RNA, 18 nt, Human
uggaauguuugcauccuc

SEQ ID NO: 1340208 - RNA, 19 nt, Human
ugggaaaacccagguggcc

SEQ ID NO: 1340209 - RNA, 21 nt, Human
uguaaagaaggcagcacugga

SEQ ID NO: 1340210 - RNA, 19 nt, Human
uguaaugccaaguacccuc

SEQ ID NO: 1340211 - RNA, 19 nt, Human
uguguugggaaaauaaugc

SEQ ID NO: 1340212 - RNA, 20 nt, Human
uguguugggaaaauaaugcu

SEQ ID NO: 1340213 - RNA, 20 nt, Human
uuacuugcaauccugcagaa

SEQ ID NO: 1340214 - RNA, 27 nt, Human
uucaaaccaaacuaauagacaagagac

SEQ ID NO: 1340215 - RNA, 23 nt, Human
uuccuugugauuggaaauaguuu

SEQ ID NO: 1340216 - RNA, 20 nt, Human
uucguucauaucuacaagac

SEQ ID NO: 1340217 - RNA, 24 nt, Human
uuuuuuuuuuuuuuuuuuuucaag

SEQ ID NO: 1340218 - RNA, 25 nt, Human
agcaucuacuuucucauacugugac

SEQ ID NO: 1340219 - RNA, 18 nt, Human
aggaaggaaggcucccau

SEQ ID NO: 1340220 - RNA, 21 nt, Human
auucuucacugauaauucugg

SEQ ID NO: 1340221 - RNA, 27 nt, Human
cacaagaucaguaguuuauuccaauga

SEQ ID NO: 1340222 - RNA, 21 nt, Human
cagcacccgcgaaccgcccug

SEQ ID NO: 1340223 - RNA, 20 nt, Human
ccuggcuaggggccccggcc

SEQ ID NO: 1340224 - RNA, 22 nt, Human
cuuacaaggacggacaugucug

SEQ ID NO: 1340225 - RNA, 18 nt, Human
ggaacaucuuguuacaga

SEQ ID NO: 1340226 - RNA, 24 nt, Human
guuugucuggagaggguaucuuuc

SEQ ID NO: 1340227 - RNA, 18 nt, Human
uaccguacuauuugcauc

SEQ ID NO: 1340228 - RNA, 20 nt, Human
uaggaaggaaggcucccaug

SEQ ID NO: 1340229 - RNA, 23 nt, Human
ucagggugggaggugauccaauc

SEQ ID NO: 1340230 - RNA, 19 nt, Human
ucuugauuaggaaggaagg

SEQ ID NO: 1340231 - RNA, 26 nt, Human
ugacagcacccgcgaaccgcccugac

SEQ ID NO: 1340232 - RNA, 23 nt, Human
uggaagcuuuuaacuuacaagga

SEQ ID NO: 1340233 - RNA, 21 nt, Human
ugucugggccuggcuaggggc

SEQ ID NO: 1340234 - RNA, 22 nt, Human
ugugacacaagcacuggauucu

SEQ ID NO: 1340235 - RNA, 24 nt, Human
ugugacacaagcacuggauucuuu

SEQ ID NO: 1340236 - RNA, 19 nt, Human
uuacucucaagcgauagaa

SEQ ID NO: 1340237 - RNA, 21 nt, Human
uuccccagcaucuacuuucuc

SEQ ID NO: 1340238 - RNA, 21 nt, Human
aaaagcuuaauucagggagac

SEQ ID NO: 1340239 - RNA, 19 nt, Human
agacaaaauagaaaggucu

SEQ ID NO: 1340240 - RNA, 21 nt, Human
agacaaaauagaaaggucuag

SEQ ID NO: 1340241 - RNA, 22 nt, Human
caacagagggcacugggccaaa

SEQ ID NO: 1340242 - RNA, 18 nt, Human
ggaguggaaagaaaaagc

SEQ ID NO: 1340243 - RNA, 21 nt, Human
uacaacaccgccgacuccgcg

SEQ ID NO: 1340244 - RNA, 24 nt, Human
uaggauguuucaacagagggcacu

SEQ ID NO: 1340245 - RNA, 20 nt, Human
uauguaaaguguccaaaagg

SEQ ID NO: 1340246 - RNA, 19 nt, Human
ucaacagagggcacugggc

SEQ ID NO: 1340247 - RNA, 23 nt, Human
uccauauguaaaguguccaaaag

SEQ ID NO: 1340248 - RNA, 24 nt, Human
ugaggugugaaggggccaaaucag

SEQ ID NO: 1340249 - RNA, 19 nt, Human
uguaauaggaguggaaaga

SEQ ID NO: 1340250 - RNA, 24 nt, Human
uguccaaaaggaaaagcuuaauuc

SEQ ID NO: 1340251 - RNA, 21 nt, Human
uucagggagacaaaauagaaa

SEQ ID NO: 1340252 - RNA, 22 nt, Human
uuguugauaaugauaagcuuuu

SEQ ID NO: 1340253 - RNA, 21 nt, Human
uuuagaauccauauguaaagu

SEQ ID NO: 1340254 - RNA, 18 nt, Human
uuuuuuuuuuuuuuuuug

SEQ ID NO: 1340255 - RNA, 25 nt, Human
aaagugcuggagauuacaggcauga

SEQ ID NO: 1340256 - RNA, 24 nt, Human
aaagugcugggauuacaggcguga

SEQ ID NO: 1340257 - RNA, 27 nt, Human
aagugcuggagauuacaggcaugagcu

SEQ ID NO: 1340258 - RNA, 19 nt, Human
aagugcugggauuacaggc

SEQ ID NO: 1340259 - RNA, 19 nt, Human
aagugcugggauuacaggc

SEQ ID NO: 1340260 - RNA, 18 nt, Human
aauguagugauguggggu

SEQ ID NO: 1340261 - RNA, 24 nt, Human
accauguuggccaggcugguaucg

SEQ ID NO: 1340262 - RNA, 24 nt, Human
acccaguuaauuuuuguauuuuua

SEQ ID NO: 1340263 - RNA, 18 nt, Human
accggguuucaccauguu

SEQ ID NO: 1340264 - RNA, 24 nt, Human
accggguuucaccauguuggccag

SEQ ID NO: 1340265 - RNA, 20 nt, Human
agacccggaggccggggcga

SEQ ID NO: 1340266 - RNA, 19 nt, Human
agauuacaggcaugagcug

SEQ ID NO: 1340267 - RNA, 20 nt, Human
agauuacaggcaugagcugc

SEQ ID NO: 1340268 - RNA, 20 nt, Human
aggaggagccuggguuagug

SEQ ID NO: 1340269 - RNA, 21 nt, Human
aggcaugagcugcuaggucca

SEQ ID NO: 1340270 - RNA, 19 nt, Human
aggccggggcgaggaggag

SEQ ID NO: 1340271 - RNA, 18 nt, Human
aggcgugagucacugugc

SEQ ID NO: 1340272 - RNA, 18 nt, Human
aguagcugggauuacagg

SEQ ID NO: 1340273 - RNA, 19 nt, Human
aguagcugggauuacaggc

SEQ ID NO: 1340274 - RNA, 24 nt, Human
agugcaauggcacuaucucgguuc

SEQ ID NO: 1340275 - RNA, 18 nt, Human
agugcugggauuacaggc

SEQ ID NO: 1340276 - RNA, 22 nt, Human
augccucagcccccucaguagc

SEQ ID NO: 1340277 - RNA, 25 nt, Human
caaagugcuggagauuacaggcaug

SEQ ID NO: 1340278 - RNA, 24 nt, Human
caaagugcugggauuacaggcgug

SEQ ID NO: 1340279 - RNA, 22 nt, Human
caagugauucucaugccucagc

SEQ ID NO: 1340280 - RNA, 28 nt, Human
caagugauucucaugccucagcccccuc

SEQ ID NO: 1340281 - RNA, 22 nt, Human
cacaaaccgaggugccgggaac

SEQ ID NO: 1340282 - RNA, 24 nt, Human
caccacacccaguuaauuuuugua

SEQ ID NO: 1340283 - RNA, 18 nt, Human
caccauguuggccaggcu

SEQ ID NO: 1340284 - RNA, 21 nt, Human
caccauguuggccaggcuggu

SEQ ID NO: 1340285 - RNA, 24 nt, Human
caccauguuggccaggcugguauc

SEQ ID NO: 1340286 - RNA, 31 nt, Human
caccauguuggccaggcugguaucgaacucc

SEQ ID NO: 1340287 - RNA, 20 nt, Human
caccugagccuggagaaccc

SEQ ID NO: 1340288 - RNA, 21 nt, Human
cacgggccgagggaauguagu

SEQ ID NO: 1340289 - RNA, 20 nt, Human
cacugugcgccgggcugggu

SEQ ID NO: 1340290 - RNA, 25 nt, Human
cacuuuguucuccaggcugaucuca

SEQ ID NO: 1340291 - RNA, 21 nt, Human
cagccgggccugccguccccu

SEQ ID NO: 1340292 - RNA, 18 nt, Human
cagcgcgccccuccgcag

SEQ ID NO: 1340293 - RNA, 21 nt, Human
cagcgcgccccuccgcagccc

SEQ ID NO: 1340294 - RNA, 26 nt, Human
caggcacggguggggugaggggacuc

SEQ ID NO: 1340295 - RNA, 21 nt, Human
caggcgcccgccaccacaccc

SEQ ID NO: 1340296 - RNA, 21 nt, Human
caggcugaucucaaacucuug

SEQ ID NO: 1340297 - RNA, 20 nt, Human
caguagcugggauuacaggc

SEQ ID NO: 1340298 - RNA, 25 nt, Human
caguagcugggauuacaggcgcccg

SEQ ID NO: 1340299 - RNA, 23 nt, Human
caguuccagggcagccgggccug

SEQ ID NO: 1340300 - RNA, 24 nt, Human
cauguuggccaggcugguaucgaa

SEQ ID NO: 1340301 - RNA, 25 nt, Human
ccaaagugcuggagauuacaggcau

SEQ ID NO: 1340302 - RNA, 22 nt, Human
ccaaagugcugggauuacaggc

SEQ ID NO: 1340303 - RNA, 22 nt, Human
ccaaagugcugggauuacaggc

SEQ ID NO: 1340304 - RNA, 24 nt, Human
ccaaagugcugggauuacaggcgu

SEQ ID NO: 1340305 - RNA, 25 nt, Human
ccaacacaaaccgaggugccgggaa

SEQ ID NO: 1340306 - RNA, 24 nt, Human
ccaacuuucuuccucucccaccca

SEQ ID NO: 1340307 - RNA, 24 nt, Human
ccaggccggagugcaauggcacua

SEQ ID NO: 1340308 - RNA, 26 nt, Human
cccaacuuucuuccucucccacccac

SEQ ID NO: 1340309 - RNA, 20 nt, Human
cccagguucaagugauucuc

SEQ ID NO: 1340310 - RNA, 23 nt, Human
cccagguucaagugauucucaug

SEQ ID NO: 1340311 - RNA, 20 nt, Human
ccccaacuuucuuccucucc

SEQ ID NO: 1340312 - RNA, 24 nt, Human
cccucaguagcugggauuacaggc

SEQ ID NO: 1340313 - RNA, 24 nt, Human
ccggguuucaccauguuggccagg

SEQ ID NO: 1340314 - RNA, 19 nt, Human
ccuaaccucaagugaucug

SEQ ID NO: 1340315 - RNA, 23 nt, Human
ccucaguagcugggauuacaggc

SEQ ID NO: 1340316 - RNA, 19 nt, Human
ccucccaaagugcuggaga

SEQ ID NO: 1340317 - RNA, 22 nt, Human
ccuccugccuccgccucccaaa

SEQ ID NO: 1340318 - RNA, 26 nt, Human
ccuccugccuccgccucccaaagugc

SEQ ID NO: 1340319 - RNA, 18 nt, Human
ccucuguugcccaggccg

SEQ ID NO: 1340320 - RNA, 27 nt, Human
ccucuguugcccaggccggagugcaau

SEQ ID NO: 1340321 - RNA, 22 nt, Human
ccugagccuggagaaccccaac

SEQ ID NO: 1340322 - RNA, 19 nt, Human
ccugucucccaguuccagg

SEQ ID NO: 1340323 - RNA, 18 nt, Human
cgcccgccaccacaccca

SEQ ID NO: 1340324 - RNA, 18 nt, Human
cgcgccccuccgcagccc

SEQ ID NO: 1340325 - RNA, 22 nt, Human
cggguuucaccauguuggccag

SEQ ID NO: 1340326 - RNA, 23 nt, Human
cggguuucaccauguuggccagg

SEQ ID NO: 1340327 - RNA, 23 nt, Human
cucagcccccucaguagcuggga

SEQ ID NO: 1340328 - RNA, 18 nt, Human
cucccacccaccucacuc

SEQ ID NO: 1340329 - RNA, 19 nt, Human
cucccagguucaagugauu

SEQ ID NO: 1340330 - RNA, 21 nt, Human
cuccugccuccgccucccaaa

SEQ ID NO: 1340331 - RNA, 24 nt, Human
cugccuccgccucccaaagugcug

SEQ ID NO: 1340332 - RNA, 20 nt, Human
gaagccccagcgcgccccuc

SEQ ID NO: 1340333 - RNA, 18 nt, Human
gagauuacaggcaugagc

SEQ ID NO: 1340334 - RNA, 19 nt, Human
gauuacaggcaugagcugc

SEQ ID NO: 1340335 - RNA, 18 nt, Human
gauuacaggcgcccgcca

SEQ ID NO: 1340336 - RNA, 18 nt, Human
gauuacaggcgugaguca

SEQ ID NO: 1340337 - RNA, 21 nt, Human
gauuacaggcgugagucacug

SEQ ID NO: 1340338 - RNA, 24 nt, Human
gauuacaggcgugagucacugugc

SEQ ID NO: 1340339 - RNA, 22 nt, Human
gcaaccucugucucccagguuc

SEQ ID NO: 1340340 - RNA, 20 nt, Human
gccggagugcaauggcacua

SEQ ID NO: 1340341 - RNA, 23 nt, Human
gcugguaucgaacuccuaaccuc

SEQ ID NO: 1340342 - RNA, 21 nt, Human
ggagcucugccgaaugcagug

SEQ ID NO: 1340343 - RNA, 19 nt, Human
ggcgaggaggagccugggu

SEQ ID NO: 1340344 - RNA, 18 nt, Human
gugcuggagauuacaggc

SEQ ID NO: 1340345 - RNA, 24 nt, Human
uaacaaagcaguuaaaaccuuuaa

SEQ ID NO: 1340346 - RNA, 18 nt, Human
uaaccucaagugaucugc

SEQ ID NO: 1340347 - RNA, 24 nt, Human
uaauuuuuguauuuuuaguagaga

SEQ ID NO: 1340348 - RNA, 24 nt, Human
uacaggcaugagcugcuaggucca

SEQ ID NO: 1340349 - RNA, 24 nt, Human
uacaggcgcccgccaccacaccca

SEQ ID NO: 1340350 - RNA, 22 nt, Human
uagagaccggguuucaccaugu

SEQ ID NO: 1340351 - RNA, 24 nt, Human
uagccucgcccucccaaagugcug

SEQ ID NO: 1340352 - RNA, 24 nt, Human
uaguagagaccggguuucaccaug

SEQ ID NO: 1340353 - RNA, 27 nt, Human
ucacucacaggcacggguggggugagg

SEQ ID NO: 1340354 - RNA, 18 nt, Human
ucagcccccucaguagcu

SEQ ID NO: 1340355 - RNA, 20 nt, Human
ucagcccccucaguagcugg

SEQ ID NO: 1340356 - RNA, 20 nt, Human
ucaguagcugggauuacagg

SEQ ID NO: 1340357 - RNA, 19 nt, Human
ucauugcaaccucugucuc

SEQ ID NO: 1340358 - RNA, 23 nt, Human
ucauugcaaccucugucucccag

SEQ ID NO: 1340359 - RNA, 24 nt, Human
ucauugcaaccucugucucccagg

SEQ ID NO: 1340360 - RNA, 21 nt, Human
uccagggcagccgggccugcc

SEQ ID NO: 1340361 - RNA, 25 nt, Human
ucccaaagugcuggagauuacaggc

SEQ ID NO: 1340362 - RNA, 24 nt, Human
ucccaaagugcugggauuacaggc

SEQ ID NO: 1340363 - RNA, 21 nt, Human
ucccacccaccucacucacag

SEQ ID NO: 1340364 - RNA, 21 nt, Human
ucccagguucaagugauucuc

SEQ ID NO: 1340365 - RNA, 24 nt, Human
ucccagguucaagugauucucaug

SEQ ID NO: 1340366 - RNA, 24 nt, Human
uccucuguugcccaggccggagug

SEQ ID NO: 1340367 - RNA, 19 nt, Human
ucucacuuuguucuccagg

SEQ ID NO: 1340368 - RNA, 20 nt, Human
ucucaugccucagcccccuc

SEQ ID NO: 1340369 - RNA, 22 nt, Human
ucucccacccaccucacucaca

SEQ ID NO: 1340370 - RNA, 22 nt, Human
ucucccagguucaagugauucu

SEQ ID NO: 1340371 - RNA, 18 nt, Human
ucuguugcccaggccgga

SEQ ID NO: 1340372 - RNA, 24 nt, Human
ucuguugcccaggccggagugcaa

SEQ ID NO: 1340373 - RNA, 24 nt, Human
ucuuccucuguugcccaggccgga

SEQ ID NO: 1340374 - RNA, 19 nt, Human
ucuugaguuucaccaccuc

SEQ ID NO: 1340375 - RNA, 21 nt, Human
ugacuucaagagauccuccug

SEQ ID NO: 1340376 - RNA, 24 nt, Human
ugacuucaagagauccuccugccu

SEQ ID NO: 1340377 - RNA, 18 nt, Human
ugagccuggagaacccca

SEQ ID NO: 1340378 - RNA, 24 nt, Human
ugcccaggccggagugcaauggca

SEQ ID NO: 1340379 - RNA, 24 nt, Human
ugccucagcccccucaguagcugg

SEQ ID NO: 1340380 - RNA, 24 nt, Human
ugccuccgccucccaaagugcugg

SEQ ID NO: 1340381 - RNA, 23 nt, Human
ugccuugcucacuggagcucugc

SEQ ID NO: 1340382 - RNA, 24 nt, Human
ugcugggauuacaggcgugaguca

SEQ ID NO: 1340383 - RNA, 24 nt, Human
uggccaggcugguaucgaacuccu

SEQ ID NO: 1340384 - RNA, 21 nt, Human
ugggauuacaggcgcccgcca

SEQ ID NO: 1340385 - RNA, 22 nt, Human
ugggauuacaggcgcccgccac

SEQ ID NO: 1340386 - RNA, 24 nt, Human
ugggauuacaggcgcccgccacca

SEQ ID NO: 1340387 - RNA, 18 nt, Human
ugggauuacaggcgugag

SEQ ID NO: 1340388 - RNA, 21 nt, Human
ugggauuacaggcgugaguca

SEQ ID NO: 1340389 - RNA, 22 nt, Human
ugggauuacaggcgugagucac

SEQ ID NO: 1340390 - RNA, 22 nt, Human
ugggauuacaggcgugagucac

SEQ ID NO: 1340391 - RNA, 22 nt, Human
ugggauuacaggcgugagucac

SEQ ID NO: 1340392 - RNA, 24 nt, Human
ugggauuacaggcgugagucacug

SEQ ID NO: 1340393 - RNA, 22 nt, Human
uguagugauguggggugggcac

SEQ ID NO: 1340394 - RNA, 23 nt, Human
ugugcgccgggcuggguaagcuu

SEQ ID NO: 1340395 - RNA, 20 nt, Human
uguugcccaggccggagugc

SEQ ID NO: 1340396 - RNA, 23 nt, Human
uuaauuuuuguauuuuuaguaga

SEQ ID NO: 1340397 - RNA, 24 nt, Human
uuaguagagaccggguuucaccau

SEQ ID NO: 1340398 - RNA, 24 nt, Human
uucaagagauccuccugccuccgc

SEQ ID NO: 1340399 - RNA, 23 nt, Human
uucaagugauucucaugccucag

SEQ ID NO: 1340400 - RNA, 26 nt, Human
uucauugcaaccucugucugguucuc

SEQ ID NO: 1340401 - RNA, 18 nt, Human
uuccagggaccccggcag

SEQ ID NO: 1340402 - RNA, 23 nt, Human
uugaggcagucuuccucuguugc

SEQ ID NO: 1340403 - RNA, 24 nt, Human
uugaggcagucuuccucuguugcc

SEQ ID NO: 1340404 - RNA, 23 nt, Human
uugcaaccucugucucccagguu

SEQ ID NO: 1340405 - RNA, 24 nt, Human
uugcaaccucugucucccagguuc

SEQ ID NO: 1340406 - RNA, 18 nt, Human
uugcccaggccggagugc

SEQ ID NO: 1340407 - RNA, 24 nt, Human
uugguuccuugacaacucacuugg

SEQ ID NO: 1340408 - RNA, 24 nt, Human
uuucaccauguuggccaggcuggu

SEQ ID NO: 1340409 - RNA, 24 nt, Human
uuuuuaguagagaccggguuucac

SEQ ID NO: 1340410 - RNA, 20 nt, Human
uuuuuguauuuuuaguagag

SEQ ID NO: 1340411 - RNA, 30 nt, Human
uuuuuuuuuuuuaauagaugggggucucaa

SEQ ID NO: 1340412 - RNA, 28 nt, Human
uuuuuuuuuuuuuuuuuuaauagauggg

SEQ ID NO: 1340413 - RNA, 20 nt, Human
aaaaacuagugacaaacauc

SEQ ID NO: 1340414 - RNA, 21 nt, Human
aaaaacuagugacaaacaucu

SEQ ID NO: 1340415 - RNA, 26 nt, Human
aacagagugggacuucaucuccuuaa

SEQ ID NO: 1340416 - RNA, 24 nt, Human
acucuagccugggcaacagagugg

SEQ ID NO: 1340417 - RNA, 22 nt, Human
agccugggcaacagagugggac

SEQ ID NO: 1340418 - RNA, 24 nt, Human
agccugggcaacagagugggacuu

SEQ ID NO: 1340419 - RNA, 23 nt, Human
agcucuuauaguaaaucaaaaua

SEQ ID NO: 1340420 - RNA, 25 nt, Human
auaaaauaguccuucaguauuaaaa

SEQ ID NO: 1340421 - RNA, 25 nt, Human
auaaugcauacccaggauauaagca

SEQ ID NO: 1340422 - RNA, 20 nt, Human
auaguccuucaguauuaaaa

SEQ ID NO: 1340423 - RNA, 26 nt, Human
caacagagugggacuucaucuccuua

SEQ ID NO: 1340424 - RNA, 24 nt, Human
caagcgaggcaggucaggacaggc

SEQ ID NO: 1340425 - RNA, 21 nt, Human
cacaucuugggcgcucccugg

SEQ ID NO: 1340426 - RNA, 18 nt, Human
cacucuagccugggcaac

SEQ ID NO: 1340427 - RNA, 22 nt, Human
cacucuagccugggcaacagag

SEQ ID NO: 1340428 - RNA, 24 nt, Human
cacucuagccugggcaacagagug

SEQ ID NO: 1340429 - RNA, 21 nt, Human
cagagugggacuucaucuccu

SEQ ID NO: 1340430 - RNA, 27 nt, Human
cccccacaucuugggcgcucccugggc

SEQ ID NO: 1340431 - RNA, 25 nt, Human
cccucggcuggacaggaccgggguc

SEQ ID NO: 1340432 - RNA, 21 nt, Human
ccuccacgaugaucuugaucu

SEQ ID NO: 1340433 - RNA, 21 nt, Human
ccugggcaacagagugggacu

SEQ ID NO: 1340434 - RNA, 19 nt, Human
cugcugcgugcccccgucc

SEQ ID NO: 1340435 - RNA, 24 nt, Human
gcacucuagccugggcaacagagu

SEQ ID NO: 1340436 - RNA, 24 nt, Human
ggacgaggagggguuccccuuggu

SEQ ID NO: 1340437 - RNA, 22 nt, Human
ggacuuggcugacauucuuugg

SEQ ID NO: 1340438 - RNA, 20 nt, Human
ggcaagcgaggcaggucagg

SEQ ID NO: 1340439 - RNA, 20 nt, Human
ggcgaguggcugcgcuccgc

SEQ ID NO: 1340440 - RNA, 22 nt, Human
uaccaggugauuuuuaugccac

SEQ ID NO: 1340441 - RNA, 26 nt, Human
uaggucaauugcaaaaacaaugcauc

SEQ ID NO: 1340442 - RNA, 25 nt, Human
uauuuuauuacauauauagcugagc

SEQ ID NO: 1340443 - RNA, 21 nt, Human
ucccuggcgcugcuacggccg

SEQ ID NO: 1340444 - RNA, 24 nt, Human
ucuagccugggcaacagaguggga

SEQ ID NO: 1340445 - RNA, 28 nt, Human
ucuuugggggcaagcgaggcaggucagg

SEQ ID NO: 1340446 - RNA, 22 nt, Human
ugacaaacaucuuuagaaaaaa

SEQ ID NO: 1340447 - RNA, 18 nt, Human
ugcacucuagccugggca

SEQ ID NO: 1340448 - RNA, 22 nt, Human
ugcacucuagccugggcaacag

SEQ ID NO: 1340449 - RNA, 19 nt, Human
uggcugcgcuccgcgcucg

SEQ ID NO: 1340450 - RNA, 19 nt, Human
uuaccaggugauuuuuaug

SEQ ID NO: 1340451 - RNA, 19 nt, Human
uucaccuugguuuuggagg

SEQ ID NO: 1340452 - RNA, 23 nt, Human
uucaccuugguuuuggaggcugc

SEQ ID NO: 1340453 - RNA, 21 nt, Human
uuccuuggccacguccuucag

SEQ ID NO: 1340454 - RNA, 22 nt, Human
uucuuugggggcaagcgaggca

SEQ ID NO: 1340455 - RNA, 21 nt, Human
uuggaggcugccggcgguccc

SEQ ID NO: 1340456 - RNA, 22 nt, Human
uuuuuuuuuuuuuuuuccacag

SEQ ID NO: 1340457 - RNA, 24 nt, Human
aaaaagacuugaaacuuucaccug

SEQ ID NO: 1340458 - RNA, 21 nt, Human
aaacaggaugcugacauucuc

SEQ ID NO: 1340459 - RNA, 20 nt, Human
aaauacucuauguuccacuu

SEQ ID NO: 1340460 - RNA, 22 nt, Human
aaauuacaggugugagccacca

SEQ ID NO: 1340461 - RNA, 19 nt, Human
aaauuuuauaaggauugua

SEQ ID NO: 1340462 - RNA, 19 nt, Human
aacaaagcaaaaugaaugu

SEQ ID NO: 1340463 - RNA, 19 nt, Human
aacagagugagacccuguc

SEQ ID NO: 1340464 - RNA, 21 nt, Human
aacagagugagacccugucuc

SEQ ID NO: 1340465 - RNA, 20 nt, Human
aaccuccaccucccagguuc

SEQ ID NO: 1340466 - RNA, 24 nt, Human
aaggugcugaaauuacagguguga

SEQ ID NO: 1340467 - RNA, 24 nt, Human
aagugauccgccugccucggccuc

SEQ ID NO: 1340468 - RNA, 24 nt, Human
aauccuucucaaagguuuuuccac

SEQ ID NO: 1340469 - RNA, 18 nt, Human
aauuacaggugugagcca

SEQ ID NO: 1340470 - RNA, 24 nt, Human
aauuacaggugugagccaccaugc

SEQ ID NO: 1340471 - RNA, 22 nt, Human
acaaagcaaaaugaauguacuu

SEQ ID NO: 1340472 - RNA, 18 nt, Human
acagacaccagccaccau

SEQ ID NO: 1340473 - RNA, 21 nt, Human
acagacaccagccaccaugcc

SEQ ID NO: 1340474 - RNA, 20 nt, Human
acagagugagacccugucuc

SEQ ID NO: 1340475 - RNA, 23 nt, Human
acaggaugcugacauucucucca

SEQ ID NO: 1340476 - RNA, 23 nt, Human
accaaaugauucauguucucuac

SEQ ID NO: 1340477 - RNA, 22 nt, Human
accaucuuggccaggcuggucu

SEQ ID NO: 1340478 - RNA, 20 nt, Human
acgcugucacccaggcugga

SEQ ID NO: 1340479 - RNA, 21 nt, Human
acgcugucacccaggcuggag

SEQ ID NO: 1340480 - RNA, 24 nt, Human
acgcugucacccaggcuggaguga

SEQ ID NO: 1340481 - RNA, 24 nt, Human
acuccagccuggguaacagaguga

SEQ ID NO: 1340482 - RNA, 24 nt, Human
agaaaguaggauggugguugccag

SEQ ID NO: 1340483 - RNA, 22 nt, Human
agaccaaaagaaguaacugaua

SEQ ID NO: 1340484 - RNA, 22 nt, Human
agaccaaaugauucauguucuc

SEQ ID NO: 1340485 - RNA, 22 nt, Human
agccuggguaacagagugagac

SEQ ID NO: 1340486 - RNA, 22 nt, Human
agcugggauuacagacaccagc

SEQ ID NO: 1340487 - RNA, 20 nt, Human
aggagaagacucuagaccaa

SEQ ID NO: 1340488 - RNA, 24 nt, Human
aggaggagaagacucuagaccaaa

SEQ ID NO: 1340489 - RNA, 24 nt, Human
aggaucacuugagcccagaaguuc

SEQ ID NO: 1340490 - RNA, 20 nt, Human
aggcaggguuccaccaucuu

SEQ ID NO: 1340491 - RNA, 18 nt, Human
aggugagaggaucacuug

SEQ ID NO: 1340492 - RNA, 26 nt, Human
aggugcugaaauuacaggugugagcc

SEQ ID NO: 1340493 - RNA, 21 nt, Human
agguucaagugauucuccugc

SEQ ID NO: 1340494 - RNA, 22 nt, Human
agguucaagugauucuccugcc

SEQ ID NO: 1340495 - RNA, 23 nt, Human
agguucaagugauucuccugccu

SEQ ID NO: 1340496 - RNA, 22 nt, Human
agucacaaaaaagggcaaauac

SEQ ID NO: 1340497 - RNA, 25 nt, Human
auaguaacaaagcaaaaugaaugua

SEQ ID NO: 1340498 - RNA, 24 nt, Human
aucaaauuuggaaauuaugucuuu

SEQ ID NO: 1340499 - RNA, 24 nt, Human
aucacuccauugcacuccagccug

SEQ ID NO: 1340500 - RNA, 21 nt, Human
auucauuugcucagagcugau

SEQ ID NO: 1340501 - RNA, 18 nt, Human
auugcacuccagccuggg

SEQ ID NO: 1340502 - RNA, 24 nt, Human
auugcacuccagccuggguaacag

SEQ ID NO: 1340503 - RNA, 27 nt, Human
caaaaaaaaauacaaaaauccuucuca

SEQ ID NO: 1340504 - RNA, 20 nt, Human
caaauuuggaaauuaugucu

SEQ ID NO: 1340505 - RNA, 24 nt, Human
caaggugcugaaauuacaggugug

SEQ ID NO: 1340506 - RNA, 22 nt, Human
caagugauccgccugccucggc

SEQ ID NO: 1340507 - RNA, 22 nt, Human
caagugauucuccugccucaac

SEQ ID NO: 1340508 - RNA, 28 nt, Human
caagugauucuccugccucaaccuccca

SEQ ID NO: 1340509 - RNA, 19 nt, Human
cacaaaaaagggcaaauac

SEQ ID NO: 1340510 - RNA, 21 nt, Human
caccaucuuggccaggcuggu

SEQ ID NO: 1340511 - RNA, 23 nt, Human
caccaucuuggccaggcuggucu

SEQ ID NO: 1340512 - RNA, 24 nt, Human
caccaucuuggccaggcuggucuu

SEQ ID NO: 1340513 - RNA, 21 nt, Human
cacccccuccuggcucuggcc

SEQ ID NO: 1340514 - RNA, 22 nt, Human
cacuccagccuggguaacagag

SEQ ID NO: 1340515 - RNA, 22 nt, Human
cacuccagccuggguaacagag

SEQ ID NO: 1340516 - RNA, 24 nt, Human
cacuccagccuggguaacagagug

SEQ ID NO: 1340517 - RNA, 21 nt, Human
cagaagaaaucagugucaucc

SEQ ID NO: 1340518 - RNA, 25 nt, Human
cagaagaaaucagugucauccaagu

SEQ ID NO: 1340519 - RNA, 19 nt, Human
cagaccaaaugauucaugu

SEQ ID NO: 1340520 - RNA, 28 nt, Human
cagagcugauuuuuaaaauaauuuauua

SEQ ID NO: 1340521 - RNA, 19 nt, Human
caggaugcugacauucucu

SEQ ID NO: 1340522 - RNA, 24 nt, Human
caggguuccaccaucuuggccagg

SEQ ID NO: 1340523 - RNA, 20 nt, Human
caucuguagucccaccuacu

SEQ ID NO: 1340524 - RNA, 24 nt, Human
caucuguagucccaccuacucagg

SEQ ID NO: 1340525 - RNA, 18 nt, Human
cauugcacuccagccugg

SEQ ID NO: 1340526 - RNA, 19 nt, Human
cauugcacuccagccuggg

SEQ ID NO: 1340527 - RNA, 21 nt, Human
cauugcacuccagccugggua

SEQ ID NO: 1340528 - RNA, 22 nt, Human
cauugcacuccagccuggguaa

SEQ ID NO: 1340529 - RNA, 24 nt, Human
cauugcacuccagccuggguaaca

SEQ ID NO: 1340530 - RNA, 21 nt, Human
ccaaggugcugaaauuacagg

SEQ ID NO: 1340531 - RNA, 24 nt, Human
ccaaggugcugaaauuacaggugu

SEQ ID NO: 1340532 - RNA, 27 nt, Human
ccacagcugggauuacagacaccagcc

SEQ ID NO: 1340533 - RNA, 19 nt, Human
ccaccaugccuggcuuaaa

SEQ ID NO: 1340534 - RNA, 24 nt, Human
ccaccucccagguucaagugauuc

SEQ ID NO: 1340535 - RNA, 18 nt, Human
ccauugcacuccagccug

SEQ ID NO: 1340536 - RNA, 20 nt, Human
ccauugcacuccagccuggg

SEQ ID NO: 1340537 - RNA, 21 nt, Human
ccauugcacuccagccugggu

SEQ ID NO: 1340538 - RNA, 23 nt, Human
ccauugcacuccagccuggguaa

SEQ ID NO: 1340539 - RNA, 24 nt, Human
ccauugcacuccagccuggguaac

SEQ ID NO: 1340540 - RNA, 23 nt, Human
cccagguucaagugauucuccuc

SEQ ID NO: 1340541 - RNA, 23 nt, Human
cccagguucaagugauucuccug

SEQ ID NO: 1340542 - RNA, 23 nt, Human
ccccuccuggcucuggccagcaa

SEQ ID NO: 1340543 - RNA, 24 nt, Human
ccucccagguucaagugauucucc

SEQ ID NO: 1340544 - RNA, 18 nt, Human
ccugaccucaagugaucc

SEQ ID NO: 1340545 - RNA, 21 nt, Human
ccugaccucaagugauccgcc

SEQ ID NO: 1340546 - RNA, 23 nt, Human
ccugaccucaagugauccgccug

SEQ ID NO: 1340547 - RNA, 21 nt, Human
ccugccucaaccucccacagc

SEQ ID NO: 1340548 - RNA, 24 nt, Human
ccugccucggccucccaaggugcu

SEQ ID NO: 1340549 - RNA, 19 nt, Human
cuagaccaaaagaaguaac

SEQ ID NO: 1340550 - RNA, 23 nt, Human
cucaagugauccgccugccucgg

SEQ ID NO: 1340551 - RNA, 22 nt, Human
cucacugaaaccuccaccuccc

SEQ ID NO: 1340552 - RNA, 23 nt, Human
cucacugaaaccuccaccuccca

SEQ ID NO: 1340553 - RNA, 24 nt, Human
cucacugaaaccuccaccucccag

SEQ ID NO: 1340554 - RNA, 18 nt, Human
cucaggaagcugagguga

SEQ ID NO: 1340555 - RNA, 24 nt, Human
cuccauugcacuccagccugggua

SEQ ID NO: 1340556 - RNA, 26 nt, Human
cuccauugcacuccagccuggguaac

SEQ ID NO: 1340557 - RNA, 21 nt, Human
cucccaaggugcugaaauuac

SEQ ID NO: 1340558 - RNA, 19 nt, Human
cucccagguucaagugauu

SEQ ID NO: 1340559 - RNA, 26 nt, Human
cuccugaccucaagugauccgccugc

SEQ ID NO: 1340560 - RNA, 22 nt, Human
cuccugccucaaccucccacag

SEQ ID NO: 1340561 - RNA, 24 nt, Human
cugaaaccuccaccucccagguuc

SEQ ID NO: 1340562 - RNA, 28 nt, Human
cugaggagagagggauauaaggacuuau

SEQ ID NO: 1340563 - RNA, 23 nt, Human
cuucaugauucaucaaugcugcc

SEQ ID NO: 1340564 - RNA, 20 nt, Human
cuuccacccacuacuuauca

SEQ ID NO: 1340565 - RNA, 28 nt, Human
gaaauuccuuuacacccccuccuggcuc

SEQ ID NO: 1340566 - RNA, 24 nt, Human
gacacaguaucuagcaaugaucaa

SEQ ID NO: 1340567 - RNA, 24 nt, Human
gaccucaagugauccgccugccuc

SEQ ID NO: 1340568 - RNA, 20 nt, Human
gagcccagaaguucaaaggg

SEQ ID NO: 1340569 - RNA, 21 nt, Human
gagcugauuuuuaaaauaauu

SEQ ID NO: 1340570 - RNA, 21 nt, Human
gaggaaacugauuugcccagc

SEQ ID NO: 1340571 - RNA, 24 nt, Human
gaucacuugagcccagaaguucaa

SEQ ID NO: 1340572 - RNA, 18 nt, Human
gauuacagacaccagcca

SEQ ID NO: 1340573 - RNA, 24 nt, Human
gauuacagacaccagccaccaugc

SEQ ID NO: 1340574 - RNA, 24 nt, Human
gcacuccagccuggguaacagagu

SEQ ID NO: 1340575 - RNA, 23 nt, Human
gcuggucuugaacuccugaccuc

SEQ ID NO: 1340576 - RNA, 20 nt, Human
ggagaagacucuagaccaaa

SEQ ID NO: 1340577 - RNA, 20 nt, Human
ggauuacagacaccagccac

SEQ ID NO: 1340578 - RNA, 24 nt, Human
ggcuggucuugaacuccugaccuc

SEQ ID NO: 1340579 - RNA, 19 nt, Human
gggcugaggagagagggau

SEQ ID NO: 1340580 - RNA, 19 nt, Human
ggucuugaacuccugaccu

SEQ ID NO: 1340581 - RNA, 24 nt, Human
gugauucuccugccucaaccuccc

SEQ ID NO: 1340582 - RNA, 21 nt, Human
gugcugaaauuacagguguga

SEQ ID NO: 1340583 - RNA, 23 nt, Human
guucaaaggggcagugaucacuc

SEQ ID NO: 1340584 - RNA, 18 nt, Human
uaaacaggaugcugacau

SEQ ID NO: 1340585 - RNA, 22 nt, Human
uaaacaggaugcugacauucuc

SEQ ID NO: 1340586 - RNA, 22 nt, Human
uaacagagugagacccugucuc

SEQ ID NO: 1340587 - RNA, 24 nt, Human
uaagugaaauaagccagucacaaa

SEQ ID NO: 1340588 - RNA, 24 nt, Human
uacagaagaaaucagugucaucca

SEQ ID NO: 1340589 - RNA, 23 nt, Human
uacagacaccagccaccaugccc

SEQ ID NO: 1340590 - RNA, 22 nt, Human
uacaggugugagccaccaugcc

SEQ ID NO: 1340591 - RNA, 22 nt, Human
uacaggugugagccaccaugcc

SEQ ID NO: 1340592 - RNA, 23 nt, Human
uacaggugugagccaccaugccu

SEQ ID NO: 1340593 - RNA, 21 nt, Human
uagaccaaaagaaguaacuga

SEQ ID NO: 1340594 - RNA, 26 nt, Human
uaguagaggcaggguuccaccaucuu

SEQ ID NO: 1340595 - RNA, 22 nt, Human
uagucaaaaaaaaauacaaaaa

SEQ ID NO: 1340596 - RNA, 25 nt, Human
uaugccaagucuuaagcugcaaucc

SEQ ID NO: 1340597 - RNA, 21 nt, Human
ucaagugauccgccugccucg

SEQ ID NO: 1340598 - RNA, 19 nt, Human
ucaagugauucuccugccu

SEQ ID NO: 1340599 - RNA, 21 nt, Human
ucacccaggcuggagugaggu

SEQ ID NO: 1340600 - RNA, 24 nt, Human
ucacugaaaccuccaccucccagg

SEQ ID NO: 1340601 - RNA, 19 nt, Human
ucacugauuucaacagaau

SEQ ID NO: 1340602 - RNA, 18 nt, Human
ucagaccaaaugauucau

SEQ ID NO: 1340603 - RNA, 23 nt, Human
ucagccuaaaaaaaguuaaagaa

SEQ ID NO: 1340604 - RNA, 25 nt, Human
uccacccacuacuuaucaccacuuc

SEQ ID NO: 1340605 - RNA, 23 nt, Human
uccagccuggguaacagagugag

SEQ ID NO: 1340606 - RNA, 24 nt, Human
uccagccuggguaacagagugaga

SEQ ID NO: 1340607 - RNA, 20 nt, Human
uccauugcacuccagccugg

SEQ ID NO: 1340608 - RNA, 23 nt, Human
ucccaaggugcugaaauuacagg

SEQ ID NO: 1340609 - RNA, 21 nt, Human
ucccagguucaagugauucuc

SEQ ID NO: 1340610 - RNA, 24 nt, Human
ucccagguucaagugauucuccug

SEQ ID NO: 1340611 - RNA, 18 nt, Human
ucggccucccaaggugcu

SEQ ID NO: 1340612 - RNA, 27 nt, Human
ucuacaauuacaaaaagaacaguuauu

SEQ ID NO: 1340613 - RNA, 22 nt, Human
ucuagcaaugaucaaaauguga

SEQ ID NO: 1340614 - RNA, 27 nt, Human
ucuauaguuacaaaaagaccggggucc

SEQ ID NO: 1340615 - RNA, 24 nt, Human
ucuccugccucaaccucccacagc

SEQ ID NO: 1340616 - RNA, 19 nt, Human
ucucuccauucaaaauuuu

SEQ ID NO: 1340617 - RNA, 22 nt, Human
ucuuacgcugucacccaggcug

SEQ ID NO: 1340618 - RNA, 24 nt, Human
ucuuacgcugucacccaggcugga

SEQ ID NO: 1340619 - RNA, 21 nt, Human
ucuugaacuccugaccucaag

SEQ ID NO: 1340620 - RNA, 22 nt, Human
ucuuggccaggcuggucuugaa

SEQ ID NO: 1340621 - RNA, 19 nt, Human
ugaaaccuccaccucccag

SEQ ID NO: 1340622 - RNA, 22 nt, Human
ugaaauuacaggugugagccac

SEQ ID NO: 1340623 - RNA, 24 nt, Human
ugaaauuacaggugugagccacca

SEQ ID NO: 1340624 - RNA, 24 nt, Human
ugaaauuacaggugugagccacca

SEQ ID NO: 1340625 - RNA, 18 nt, Human
ugaccucaagugauccgc

SEQ ID NO: 1340626 - RNA, 24 nt, Human
ugaccucaagugauccgccugccu

SEQ ID NO: 1340627 - RNA, 21 nt, Human
ugacgcaugcuaacauauaug

SEQ ID NO: 1340628 - RNA, 24 nt, Human
ugaggagagagggauauaaggacu

SEQ ID NO: 1340629 - RNA, 23 nt, Human
ugaggugaaaugaucuuggcuca

SEQ ID NO: 1340630 - RNA, 19 nt, Human
ugaggugagaggaucacuu

SEQ ID NO: 1340631 - RNA, 19 nt, Human
ugaggugagaggaucacuu

SEQ ID NO: 1340632 - RNA, 21 nt, Human
ugaggugagaggaucacuuga

SEQ ID NO: 1340633 - RNA, 24 nt, Human
ugaggugagaggaucacuugagcc

SEQ ID NO: 1340634 - RNA, 24 nt, Human
ugcacuccagccuggguaacagag

SEQ ID NO: 1340635 - RNA, 21 nt, Human
ugccucggccucccaaggugc

SEQ ID NO: 1340636 - RNA, 24 nt, Human
ugccucggccucccaaggugcuga

SEQ ID NO: 1340637 - RNA, 24 nt, Human
ugcugaaauuacaggugugagcca

SEQ ID NO: 1340638 - RNA, 24 nt, Human
uggccaggcuggucuugaacuccu

SEQ ID NO: 1340639 - RNA, 21 nt, Human
uggcucuggccagcaagaacu

SEQ ID NO: 1340640 - RNA, 21 nt, Human
ugggauuacagacaccagcca

SEQ ID NO: 1340641 - RNA, 22 nt, Human
ugggauuacagacaccagccac

SEQ ID NO: 1340642 - RNA, 24 nt, Human
ugggauuacagacaccagccacca

SEQ ID NO: 1340643 - RNA, 21 nt, Human
uggguaacagagugagacccu

SEQ ID NO: 1340644 - RNA, 23 nt, Human
ugguggcacacaucuguaguccc

SEQ ID NO: 1340645 - RNA, 19 nt, Human
uguguuuuuaguagaggca

SEQ ID NO: 1340646 - RNA, 22 nt, Human
uuacaaaaccauuaaaggaggu

SEQ ID NO: 1340647 - RNA, 22 nt, Human
uuacgcugucacccaggcugga

SEQ ID NO: 1340648 - RNA, 24 nt, Human
uuacgcugucacccaggcuggagu

SEQ ID NO: 1340649 - RNA, 23 nt, Human
uuagacacaguaucuagcaauga

SEQ ID NO: 1340650 - RNA, 24 nt, Human
uuaguagaggcaggguuccaccau

SEQ ID NO: 1340651 - RNA, 21 nt, Human
uucaagugauucuccugccuc

SEQ ID NO: 1340652 - RNA, 24 nt, Human
uucaagugauucuccugccucaac

SEQ ID NO: 1340653 - RNA, 24 nt, Human
uuguguguguguuuuuaguagagg

SEQ ID NO: 1340654 - RNA, 18 nt, Human
uuucaccugaaugcaucu

SEQ ID NO: 1340655 - RNA, 21 nt, Human
uuucuuagaggacaauuuggg

SEQ ID NO: 1340656 - RNA, 23 nt, Human
uuuuuuuuuuuuugagagagucu

SEQ ID NO: 1340657 - RNA, 18 nt, Human
uuuuuuuuuuuuuuuuug

SEQ ID NO: 1340658 - RNA, 21 nt, Human
aacccuuuaauguugggcuuu

SEQ ID NO: 1340659 - RNA, 22 nt, Human
aagaacagcagugagggcgggc

SEQ ID NO: 1340660 - RNA, 20 nt, Human
aagcagugaccccugcaccc

SEQ ID NO: 1340661 - RNA, 18 nt, Human
acagggcccugagcugac

SEQ ID NO: 1340662 - RNA, 22 nt, Human
acccccacucuauucccuccaa

SEQ ID NO: 1340663 - RNA, 19 nt, Human
acccuuuaauguugggcuu

SEQ ID NO: 1340664 - RNA, 20 nt, Human
agcaaaugccucccuuccau

SEQ ID NO: 1340665 - RNA, 19 nt, Human
aggagaggcucugcuagcg

SEQ ID NO: 1340666 - RNA, 21 nt, Human
aggagccccugugccaccuag

SEQ ID NO: 1340667 - RNA, 22 nt, Human
aggaggaggcaaggccgacugc

SEQ ID NO: 1340668 - RNA, 18 nt, Human
aggcaagaacagcaguga

SEQ ID NO: 1340669 - RNA, 24 nt, Human
aggcagcggcaaggaggcaguucu

SEQ ID NO: 1340670 - RNA, 22 nt, Human
aggcaggaggggguggccccag

SEQ ID NO: 1340671 - RNA, 19 nt, Human
aggcagggccggcccagca

SEQ ID NO: 1340672 - RNA, 18 nt, Human
aggccucaguuuccccag

SEQ ID NO: 1340673 - RNA, 18 nt, Human
aggggcagcucuaagggg

SEQ ID NO: 1340674 - RNA, 25 nt, Human
caaaugccucccuuccaucugccuc

SEQ ID NO: 1340675 - RNA, 22 nt, Human
caaggacaccccugcagagucc

SEQ ID NO: 1340676 - RNA, 24 nt, Human
cacccccucucugggagcugaggg

SEQ ID NO: 1340677 - RNA, 21 nt, Human
caccucagcggaagccagagg

SEQ ID NO: 1340678 - RNA, 19 nt, Human
caccugaaucaggcccagg

SEQ ID NO: 1340679 - RNA, 22 nt, Human
cagcagcugacaaggaacaugc

SEQ ID NO: 1340680 - RNA, 20 nt, Human
cagcccaagucacagagcau

SEQ ID NO: 1340681 - RNA, 27 nt, Human
cagccccaacuuugccuuggugacucu

SEQ ID NO: 1340682 - RNA, 20 nt, Human
cagcggcaaggaggcaguuc

SEQ ID NO: 1340683 - RNA, 23 nt, Human
cagcuagauggggcacccccuuc

SEQ ID NO: 1340684 - RNA, 25 nt, Human
caggagccccugugccaccuagucg

SEQ ID NO: 1340685 - RNA, 23 nt, Human
caggcaccauccuccccuaccua

SEQ ID NO: 1340686 - RNA, 20 nt, Human
caggccagagaggggcagcc

SEQ ID NO: 1340687 - RNA, 20 nt, Human
caggcccaggcccuggagaa

SEQ ID NO: 1340688 - RNA, 20 nt, Human
cagggcccugagcugacaag

SEQ ID NO: 1340689 - RNA, 22 nt, Human
cagugaccccugcacccagcua

SEQ ID NO: 1340690 - RNA, 22 nt, Human
caucugugggcagcccccaggc

SEQ ID NO: 1340691 - RNA, 19 nt, Human
ccagaggggcugccuggca

SEQ ID NO: 1340692 - RNA, 19 nt, Human
ccagcuagauggggcaccc

SEQ ID NO: 1340693 - RNA, 19 nt, Human
ccauuccaggccucaguuu

SEQ ID NO: 1340694 - RNA, 25 nt, Human
cccacccccacucuauucccuccaa

SEQ ID NO: 1340695 - RNA, 22 nt, Human
cccaggcccuggagagcccagg

SEQ ID NO: 1340696 - RNA, 23 nt, Human
cccccaggcccaggaugguggcc

SEQ ID NO: 1340697 - RNA, 19 nt, Human
ccccuaccuaggcccacau

SEQ ID NO: 1340698 - RNA, 22 nt, Human
ccccugcagagucccaccccca

SEQ ID NO: 1340699 - RNA, 18 nt, Human
ccccugugccaccuaguc

SEQ ID NO: 1340700 - RNA, 18 nt, Human
ccccugugccaccuaguc

SEQ ID NO: 1340701 - RNA, 23 nt, Human
cccucucagccacaaggcuaccc

SEQ ID NO: 1340702 - RNA, 25 nt, Human
cccugagcugacaagcagugacccc

SEQ ID NO: 1340703 - RNA, 20 nt, Human
cccugcacccagcuagaugg

SEQ ID NO: 1340704 - RNA, 24 nt, Human
ccggccaggccagagaggggcagc

SEQ ID NO: 1340705 - RNA, 20 nt, Human
ccggugccgguguccgcggc

SEQ ID NO: 1340706 - RNA, 18 nt, Human
ccucccguccagccugac

SEQ ID NO: 1340707 - RNA, 24 nt, Human
ccuguggugcuguaggcccagaaa

SEQ ID NO: 1340708 - RNA, 22 nt, Human
ccuugcagugguccgagccagg

SEQ ID NO: 1340709 - RNA, 18 nt, Human
cggcccuugcaguggucc

SEQ ID NO: 1340710 - RNA, 19 nt, Human
cggcgcugguuacggugcc

SEQ ID NO: 1340711 - RNA, 23 nt, Human
cucagccacaaggcuacccuccc

SEQ ID NO: 1340712 - RNA, 23 nt, Human
cucccguccagccugacuggagg

SEQ ID NO: 1340713 - RNA, 21 nt, Human
cucuagccccggccucugacc

SEQ ID NO: 1340714 - RNA, 25 nt, Human
cucugccccaggccugcaaccaccu

SEQ ID NO: 1340715 - RNA, 21 nt, Human
cucugggccauuccaggccuc

SEQ ID NO: 1340716 - RNA, 18 nt, Human
cugcagagucccaccccc

SEQ ID NO: 1340717 - RNA, 28 nt, Human
cugcagagucccacccccacucuauucc

SEQ ID NO: 1340718 - RNA, 19 nt, Human
cugccaggagaggcucugc

SEQ ID NO: 1340719 - RNA, 20 nt, Human
cuggucuggcccugccucgg

SEQ ID NO: 1340720 - RNA, 18 nt, Human
cuugacucuggcucaagg

SEQ ID NO: 1340721 - RNA, 19 nt, Human
cuugugggucccucugcuc

SEQ ID NO: 1340722 - RNA, 18 nt, Human
cuuugcccauccaucccc

SEQ ID NO: 1340723 - RNA, 21 nt, Human
gaacagcagugagggcgggcg

SEQ ID NO: 1340724 - RNA, 21 nt, Human
gaagccugcugucuuuccagg

SEQ ID NO: 1340725 - RNA, 21 nt, Human
gaccccucucagccacaagga

SEQ ID NO: 1340726 - RNA, 18 nt, Human
gacucugggccauuccag

SEQ ID NO: 1340727 - RNA, 20 nt, Human
gacugcaguggggagcccgg

SEQ ID NO: 1340728 - RNA, 18 nt, Human
gagcauggcccugguggg

SEQ ID NO: 1340729 - RNA, 20 nt, Human
gagcauggcccuggugggcg

SEQ ID NO: 1340730 - RNA, 21 nt, Human
gcacagagggguaucaauaac

SEQ ID NO: 1340731 - RNA, 20 nt, Human
gcccaggcccuggagagccc

SEQ ID NO: 1340732 - RNA, 19 nt, Human
gccggugccgguguccgcg

SEQ ID NO: 1340733 - RNA, 24 nt, Human
gccucaguuuccccagcuguaagg

SEQ ID NO: 1340734 - RNA, 23 nt, Human
gcgcgggguccugcggaguccgu

SEQ ID NO: 1340735 - RNA, 21 nt, Human
gcggcggcggcgggcgcgggg

SEQ ID NO: 1340736 - RNA, 22 nt, Human
gcgggcgcgggguccugcggag

SEQ ID NO: 1340737 - RNA, 18 nt, Human
ggaagccagaggggcugc

SEQ ID NO: 1340738 - RNA, 19 nt, Human
ggagccucaggcugggacc

SEQ ID NO: 1340739 - RNA, 25 nt, Human
ggcaaggccgacugcaguggggagc

SEQ ID NO: 1340740 - RNA, 19 nt, Human
ggcaggacucuccuuugcc

SEQ ID NO: 1340741 - RNA, 26 nt, Human
ggcccagaaaggguggggaucagccc

SEQ ID NO: 1340742 - RNA, 18 nt, Human
ggccucaguuuccccagc

SEQ ID NO: 1340743 - RNA, 18 nt, Human
gggcacagggcccugagc

SEQ ID NO: 1340744 - RNA, 18 nt, Human
gggcccaguggguggagc

SEQ ID NO: 1340745 - RNA, 18 nt, Human
gggcggcgaggggugcga

SEQ ID NO: 1340746 - RNA, 21 nt, Human
ggggggcccaguggguggagc

SEQ ID NO: 1340747 - RNA, 22 nt, Human
gggguccugcggaguccguggc

SEQ ID NO: 1340748 - RNA, 21 nt, Human
ggguggccccagccagugucc

SEQ ID NO: 1340749 - RNA, 19 nt, Human
gguagaggaggaggaggag

SEQ ID NO: 1340750 - RNA, 24 nt, Human
ggucaggaggcuacuccagcugga

SEQ ID NO: 1340751 - RNA, 23 nt, Human
guggccccagccaguguccuagu

SEQ ID NO: 1340752 - RNA, 22 nt, Human
uaaauaaaacagaaagguugca

SEQ ID NO: 1340753 - RNA, 19 nt, Human
uacuccagcuggaacagag

SEQ ID NO: 1340754 - RNA, 20 nt, Human
uaucaauaacugggggggcc

SEQ ID NO: 1340755 - RNA, 18 nt, Human
ucagcaaaugccucccuu

SEQ ID NO: 1340756 - RNA, 21 nt, Human
ucccacccccacucuauuccc

SEQ ID NO: 1340757 - RNA, 19 nt, Human
ucuggcccugccucggccc

SEQ ID NO: 1340758 - RNA, 21 nt, Human
ugaccacccaggcucugcccc

SEQ ID NO: 1340759 - RNA, 31 nt, Human
ugagcugacaagcagugaccccugcacccaa

SEQ ID NO: 1340760 - RNA, 19 nt, Human
ugagggcagagcuggguca

SEQ ID NO: 1340761 - RNA, 19 nt, Human
ugagggcgggcguguucua

SEQ ID NO: 1340762 - RNA, 21 nt, Human
ugcagcuuucccaugguggcu

SEQ ID NO: 1340763 - RNA, 19 nt, Human
ugcaggcacagauguaggg

SEQ ID NO: 1340764 - RNA, 22 nt, Human
ugccccguccucugucagcaaa

SEQ ID NO: 1340765 - RNA, 23 nt, Human
ugccucggcccuugcaguggucc

SEQ ID NO: 1340766 - RNA, 18 nt, Human
ugccucuagccccggccu

SEQ ID NO: 1340767 - RNA, 24 nt, Human
ugccuuggugacucugggccauuc

SEQ ID NO: 1340768 - RNA, 23 nt, Human
ugcugcagcccuugacucuggcu

SEQ ID NO: 1340769 - RNA, 18 nt, Human
uggagccucaggcuggga

SEQ ID NO: 1340770 - RNA, 19 nt, Human
uggaggcagcggcaaggag

SEQ ID NO: 1340771 - RNA, 18 nt, Human
uggccagggcagacggug

SEQ ID NO: 1340772 - RNA, 18 nt, Human
ugggccaggcuggucagg

SEQ ID NO: 1340773 - RNA, 20 nt, Human
ugggggggcccagugggugg

SEQ ID NO: 1340774 - RNA, 19 nt, Human
ugggucaggaugccaaugc

SEQ ID NO: 1340775 - RNA, 20 nt, Human
uggucuggcccugccucggc

SEQ ID NO: 1340776 - RNA, 29 nt, Human
ugugcaggcacagauguagggggaacgcc

SEQ ID NO: 1340777 - RNA, 19 nt, Human
uuuuuuuuuuuuuuuuugc

SEQ ID NO: 1340778 - RNA, 25 nt, Human
uuuuuuuuuuuuuuuuuugcaauga

SEQ ID NO: 1340779 - RNA, 20 nt, Human
uuuuuuuuuuuuuuuuuugg

SEQ ID NO: 1340780 - RNA, 18 nt, Human
aaaacuugaacaucaaaa

SEQ ID NO: 1340781 - RNA, 21 nt, Human
aaacuuucuacaccaaugaug

SEQ ID NO: 1340782 - RNA, 20 nt, Human
aacagcccuuccacauagga

SEQ ID NO: 1340783 - RNA, 24 nt, Human
aaccgaauggggauacaucugaga

SEQ ID NO: 1340784 - RNA, 28 nt, Human
aacucacuaucaccaccauuaaaaccuc

SEQ ID NO: 1340785 - RNA, 24 nt, Human
acaaauauaaauccaaaaauucca

SEQ ID NO: 1340786 - RNA, 25 nt, Human
acaaauauaaauccaaaaauuccau

SEQ ID NO: 1340787 - RNA, 23 nt, Human
acacuauuguauguggugccccu

SEQ ID NO: 1340788 - RNA, 20 nt, Human
acuacauaaaaaaacuauag

SEQ ID NO: 1340789 - RNA, 28 nt, Human
acuugaacaucaaaaccuguaccuugcc

SEQ ID NO: 1340790 - RNA, 22 nt, Human
agaagaaaaaaaaacacacaaa

SEQ ID NO: 1340791 - RNA, 28 nt, Human
agaagaaaaaaaaacacacaaacuuucu

SEQ ID NO: 1340792 - RNA, 19 nt, Human
aggaaaacccucauggaga

SEQ ID NO: 1340793 - RNA, 22 nt, Human
aguauuauacaaaaaugaaaac

SEQ ID NO: 1340794 - RNA, 22 nt, Human
auaaaaaacagcuggugccaca

SEQ ID NO: 1340795 - RNA, 21 nt, Human
auagaauacaaugacugcccc

SEQ ID NO: 1340796 - RNA, 21 nt, Human
auccaaaaauuccauccaccu

SEQ ID NO: 1340797 - RNA, 21 nt, Human
auccuuuuaaggucccuaucg

SEQ ID NO: 1340798 - RNA, 20 nt, Human
auggggauacaucugagaaa

SEQ ID NO: 1340799 - RNA, 24 nt, Human
caaauuagggagggaaaagaaggc

SEQ ID NO: 1340800 - RNA, 21 nt, Human
caacuagggagaagaaaaaaa

SEQ ID NO: 1340801 - RNA, 21 nt, Human
caauacuguuuaccaaaaauu

SEQ ID NO: 1340802 - RNA, 27 nt, Human
cacaaugauauauaaaaacacauacug

SEQ ID NO: 1340803 - RNA, 25 nt, Human
caccaaguguggcaaaaguuuuugu

SEQ ID NO: 1340804 - RNA, 24 nt, Human
cacuaucaccaccauuaaaaccuu

SEQ ID NO: 1340805 - RNA, 27 nt, Human
cacugcccugaagacucaaggaacaaa

SEQ ID NO: 1340806 - RNA, 18 nt, Human
cagguguaaacaucuggu

SEQ ID NO: 1340807 - RNA, 18 nt, Human
caugcacaaaacaugcau

SEQ ID NO: 1340808 - RNA, 23 nt, Human
cauucccguuuuuagacaccaga

SEQ ID NO: 1340809 - RNA, 23 nt, Human
ccaauaaaacuugaacaucaaaa

SEQ ID NO: 1340810 - RNA, 23 nt, Human
ccucauggagacacugcccugaa

SEQ ID NO: 1340811 - RNA, 23 nt, Human
cuaguaacaguucugagaauaaa

SEQ ID NO: 1340812 - RNA, 22 nt, Human
cucaaggaacaaauauaaaucc

SEQ ID NO: 1340813 - RNA, 27 nt, Human
cucacuaucaccaccauuaaaaccuuc

SEQ ID NO: 1340814 - RNA, 24 nt, Human
cucaugcacaaaacaugcauauag

SEQ ID NO: 1340815 - RNA, 26 nt, Human
cuuaucccaauaaaacuugaacaucu

SEQ ID NO: 1340816 - RNA, 27 nt, Human
gaacaaauauaaauccaaaaauuccau

SEQ ID NO: 1340817 - RNA, 19 nt, Human
gaagaaaaaaaaacacaca

SEQ ID NO: 1340818 - RNA, 22 nt, Human
gagaagaaaaaaaaacacacaa

SEQ ID NO: 1340819 - RNA, 22 nt, Human
ggaaaagaaggcaucuaaaugu

SEQ ID NO: 1340820 - RNA, 19 nt, Human
gguuauuaggaacagggcc

SEQ ID NO: 1340821 - RNA, 20 nt, Human
uaaaaaacagcccuuccaca

SEQ ID NO: 1340822 - RNA, 28 nt, Human
uaaaauaaaaaacagcuggugccacaaa

SEQ ID NO: 1340823 - RNA, 21 nt, Human
uaaauccuccaaggaaugaaa

SEQ ID NO: 1340824 - RNA, 18 nt, Human
uaacagcaguaaaacaaa

SEQ ID NO: 1340825 - RNA, 23 nt, Human
uaacagcaguaaaacaaaugguu

SEQ ID NO: 1340826 - RNA, 19 nt, Human
uacaaaaaugaaaacacca

SEQ ID NO: 1340827 - RNA, 18 nt, Human
uacaaugacugccccuca

SEQ ID NO: 1340828 - RNA, 19 nt, Human
uacuucuaacuagcaaaac

SEQ ID NO: 1340829 - RNA, 19 nt, Human
uagggagaagaaaaaaaaa

SEQ ID NO: 1340830 - RNA, 19 nt, Human
uagugaaugucucugugcc

SEQ ID NO: 1340831 - RNA, 22 nt, Human
uccaaggaaugaaagguuggac

SEQ ID NO: 1340832 - RNA, 19 nt, Human
uccacauaggaucaaaggu

SEQ ID NO: 1340833 - RNA, 23 nt, Human
ucgguggcauagcgcucagugag

SEQ ID NO: 1340834 - RNA, 25 nt, Human
ucuaguaacaguucugagaauaaaa

SEQ ID NO: 1340835 - RNA, 24 nt, Human
ugggcucugcacagccacagcaug

SEQ ID NO: 1340836 - RNA, 25 nt, Human
uuaaaaccucaauauguacuucuaa

SEQ ID NO: 1340837 - RNA, 20 nt, Human
uuagacaccagaucacacug

SEQ ID NO: 1340838 - RNA, 19 nt, Human
uuccacauaggaucaaagg

SEQ ID NO: 1340839 - RNA, 21 nt, Human
uugaacaucaaaaccuguacc

SEQ ID NO: 1340840 - RNA, 21 nt, Human
uuguauguggugccccucaac

SEQ ID NO: 1340841 - RNA, 19 nt, Human
uuuuuaaaaagcauuccau

SEQ ID NO: 1340842 - RNA, 21 nt, Human
uuuuuuuuuuuuuuuuacagg

SEQ ID NO: 1340843 - RNA, 22 nt, Human
uuuuuuuuuuuuuuuuuacagg

SEQ ID NO: 1340844 - RNA, 20 nt, Human
aaaaaaaggcagagaaaaaa

SEQ ID NO: 1340845 - RNA, 22 nt, Human
aaaaaagaaaaaaaacaaaaaa

SEQ ID NO: 1340846 - RNA, 18 nt, Human
aaaaaccaaccaaccaac

SEQ ID NO: 1340847 - RNA, 21 nt, Human
aaaaagaaaacacagaaauaa

SEQ ID NO: 1340848 - RNA, 22 nt, Human
aaaacaaaaaaaaaaggcagag

SEQ ID NO: 1340849 - RNA, 26 nt, Human
aaaacaaaacaaaacaaaaaaacuaa

SEQ ID NO: 1340850 - RNA, 19 nt, Human
aaaaccugaacaaauccug

SEQ ID NO: 1340851 - RNA, 21 nt, Human
aaaaggcuugcuguaagagaa

SEQ ID NO: 1340852 - RNA, 19 nt, Human
aaaagucauaagacuucag

SEQ ID NO: 1340853 - RNA, 18 nt, Human
aaacaaaaaccaaccaac

SEQ ID NO: 1340854 - RNA, 19 nt, Human
aaacaaaacaaaacaaaaa

SEQ ID NO: 1340855 - RNA, 25 nt, Human
aaacaaaacaaaacaaaaaaacuaa

SEQ ID NO: 1340856 - RNA, 20 nt, Human
aaacaaaaccaaacaaaaac

SEQ ID NO: 1340857 - RNA, 19 nt, Human
aaacaauaaaacaaaacaa

SEQ ID NO: 1340858 - RNA, 20 nt, Human
aaacagcccagacaccagaa

SEQ ID NO: 1340859 - RNA, 23 nt, Human
aaacagcugaaaaacuugauuuc

SEQ ID NO: 1340860 - RNA, 20 nt, Human
aaaccuggaagaguaugaua

SEQ ID NO: 1340861 - RNA, 19 nt, Human
aaagauguuaggaagauau

SEQ ID NO: 1340862 - RNA, 18 nt, Human
aaaugaccuuccccuuga

SEQ ID NO: 1340863 - RNA, 21 nt, Human
aaaugaccuuccccuugaaac

SEQ ID NO: 1340864 - RNA, 20 nt, Human
aacaaaaaccaaccaaccaa

SEQ ID NO: 1340865 - RNA, 26 nt, Human
aacaaaaaccaaccaaccaaccaaca

SEQ ID NO: 1340866 - RNA, 18 nt, Human
aacaugccuuuaauugca

SEQ ID NO: 1340867 - RNA, 21 nt, Human
aaccaaacaaaaaccaaccaa

SEQ ID NO: 1340868 - RNA, 21 nt, Human
aaccaaacaaaggcauaaaca

SEQ ID NO: 1340869 - RNA, 26 nt, Human
aaccaugaaagaaaaaauguaagcag

SEQ ID NO: 1340870 - RNA, 22 nt, Human
aaccgcaauaacugauuuaacc

SEQ ID NO: 1340871 - RNA, 20 nt, Human
aacugcauagucaugagagc

SEQ ID NO: 1340872 - RNA, 25 nt, Human
aacuuacacaaaauacaaguuaugu

SEQ ID NO: 1340873 - RNA, 21 nt, Human
aagaaaaaaggcgauauagaa

SEQ ID NO: 1340874 - RNA, 19 nt, Human
aagaaagagacagugaaca

SEQ ID NO: 1340875 - RNA, 19 nt, Human
aagcaaggccaaccuacaa

SEQ ID NO: 1340876 - RNA, 19 nt, Human
aagcagcaccuggaacaug

SEQ ID NO: 1340877 - RNA, 18 nt, Human
aagcagcuacaaaagaac

SEQ ID NO: 1340878 - RNA, 22 nt, Human
aagcuacaaugacaaucauuca

SEQ ID NO: 1340879 - RNA, 18 nt, Human
aaggucaugaacuugaaa

SEQ ID NO: 1340880 - RNA, 21 nt, Human
aaguaaagauaauaaaacaug

SEQ ID NO: 1340881 - RNA, 18 nt, Human
aaguuccagccuuagacc

SEQ ID NO: 1340882 - RNA, 18 nt, Human
aauuaugguauaaacuug

SEQ ID NO: 1340883 - RNA, 22 nt, Human
acaaaacaaaaaaacuaaccag

SEQ ID NO: 1340884 - RNA, 20 nt, Human
acaaaaccaaacaaaaacca

SEQ ID NO: 1340885 - RNA, 24 nt, Human
acaaaaccaaacaaaaaccaacca

SEQ ID NO: 1340886 - RNA, 22 nt, Human
acaaaugaccuuccccuugaaa

SEQ ID NO: 1340887 - RNA, 22 nt, Human
acauuccaaguucaaauaaaau

SEQ ID NO: 1340888 - RNA, 21 nt, Human
accaaacaaaaaccaaccaac

SEQ ID NO: 1340889 - RNA, 22 nt, Human
accucaagaacauguuaaggua

SEQ ID NO: 1340890 - RNA, 20 nt, Human
acuauaccagaggacaaggu

SEQ ID NO: 1340891 - RNA, 18 nt, Human
agcaagcaaggccaaccu

SEQ ID NO: 1340892 - RNA, 18 nt, Human
agcacgguaaaaccggcg

SEQ ID NO: 1340893 - RNA, 27 nt, Human
agcuacaaaagaacuacugauaaacaa

SEQ ID NO: 1340894 - RNA, 24 nt, Human
aggagggggggaaaaaccugaaca

SEQ ID NO: 1340895 - RNA, 28 nt, Human
aggcuacccccuccaaccccccaaaaaa

SEQ ID NO: 1340896 - RNA, 20 nt, Human
agugagugaugaagacgcaa

SEQ ID NO: 1340897 - RNA, 23 nt, Human
aguggauuuucugguuagcauga

SEQ ID NO: 1340898 - RNA, 24 nt, Human
auauaucuuacuaacuauuuuguu

SEQ ID NO: 1340899 - RNA, 19 nt, Human
augacuccauagggaggaa

SEQ ID NO: 1340900 - RNA, 18 nt, Human
augcaggccuuugcaaga

SEQ ID NO: 1340901 - RNA, 24 nt, Human
auuaaaaacaauaaaacaaaacaa

SEQ ID NO: 1340902 - RNA, 21 nt, Human
caaaaaccaaccaaccaacca

SEQ ID NO: 1340903 - RNA, 25 nt, Human
caaaaaccaaccaaccaaccaacaa

SEQ ID NO: 1340904 - RNA, 18 nt, Human
caaaacaaaaaaacuaac

SEQ ID NO: 1340905 - RNA, 21 nt, Human
caaacaaaaaccaaccaacca

SEQ ID NO: 1340906 - RNA, 25 nt, Human
caaacaaaaaccaaccaaccaacca

SEQ ID NO: 1340907 - RNA, 23 nt, Human
caaacaaaggcauaaacaaaguu

SEQ ID NO: 1340908 - RNA, 18 nt, Human
caaagcagcaccuggaac

SEQ ID NO: 1340909 - RNA, 24 nt, Human
caaccaaccaacaaaacagcugaa

SEQ ID NO: 1340910 - RNA, 24 nt, Human
caaccuacaacccugaaugcacca

SEQ ID NO: 1340911 - RNA, 19 nt, Human
caaggccaaccuacaaccc

SEQ ID NO: 1340912 - RNA, 19 nt, Human
caagguguacuauaauacc

SEQ ID NO: 1340913 - RNA, 27 nt, Human
cacaacacaggggaaaauuaacaaaaa

SEQ ID NO: 1340914 - RNA, 21 nt, Human
cacagaaauaacuacccaacu

SEQ ID NO: 1340915 - RNA, 20 nt, Human
cacuguguaaugauuccugc

SEQ ID NO: 1340916 - RNA, 23 nt, Human
cacuuaccaaauuuccuuuuaau

SEQ ID NO: 1340917 - RNA, 22 nt, Human
cagauaaaccacaauaagucca

SEQ ID NO: 1340918 - RNA, 26 nt, Human
cagccacauuauuuacuucuuguccc

SEQ ID NO: 1340919 - RNA, 21 nt, Human
cagcuacaaaagaacuacuga

SEQ ID NO: 1340920 - RNA, 25 nt, Human
cagcugaaaaacuugauuuccaaua

SEQ ID NO: 1340921 - RNA, 18 nt, Human
cauguaugcaggcaaggc

SEQ ID NO: 1340922 - RNA, 25 nt, Human
ccaaaaauagguggggaaaaauccu

SEQ ID NO: 1340923 - RNA, 19 nt, Human
ccaaacaauuuugacucau

SEQ ID NO: 1340924 - RNA, 21 nt, Human
ccaaccaaccaacaaaacagc

SEQ ID NO: 1340925 - RNA, 23 nt, Human
ccaaccccccaaaaaaguaaaga

SEQ ID NO: 1340926 - RNA, 24 nt, Human
ccagaaagacaauguucugugggg

SEQ ID NO: 1340927 - RNA, 22 nt, Human
ccaguuugauugcagauaaguc

SEQ ID NO: 1340928 - RNA, 25 nt, Human
ccccucgcccuuuuaaauaauuuca

SEQ ID NO: 1340929 - RNA, 22 nt, Human
cccuuuaaacaaaaccaaacaa

SEQ ID NO: 1340930 - RNA, 25 nt, Human
ccuacaacccugaaugcaccaaagg

SEQ ID NO: 1340931 - RNA, 23 nt, Human
ccugaacaaauccuggaacacac

SEQ ID NO: 1340932 - RNA, 19 nt, Human
ccuggaacacaccuaugua

SEQ ID NO: 1340933 - RNA, 21 nt, Human
ccuguacuaaauguagcccaa

SEQ ID NO: 1340934 - RNA, 21 nt, Human
cuaaccauccaucccacauua

SEQ ID NO: 1340935 - RNA, 22 nt, Human
cucaagaacauguuaagguaag

SEQ ID NO: 1340936 - RNA, 20 nt, Human
cucugaacaaaagcacugug

SEQ ID NO: 1340937 - RNA, 20 nt, Human
cugcacucaagccguuugag

SEQ ID NO: 1340938 - RNA, 20 nt, Human
cuguggggaaacacuguagg

SEQ ID NO: 1340939 - RNA, 25 nt, Human
gaaaucacugggaacauuccaaguu

SEQ ID NO: 1340940 - RNA, 19 nt, Human
gaaccaaacaaaggcauaa

SEQ ID NO: 1340941 - RNA, 23 nt, Human
gaccuuccccuugaaaacugagg

SEQ ID NO: 1340942 - RNA, 18 nt, Human
gauauagaauaaaaugca

SEQ ID NO: 1340943 - RNA, 18 nt, Human
gauuugaagaaaaaaggc

SEQ ID NO: 1340944 - RNA, 19 nt, Human
gcagagaaaaaaaugaaaa

SEQ ID NO: 1340945 - RNA, 25 nt, Human
gcagagaaaaaaaugaaaacauaag

SEQ ID NO: 1340946 - RNA, 24 nt, Human
gcagcaccuggaacauguccaugc

SEQ ID NO: 1340947 - RNA, 24 nt, Human
gccaacaaggcagaaaauacccug

SEQ ID NO: 1340948 - RNA, 18 nt, Human
gcuaggcuacccccucca

SEQ ID NO: 1340949 - RNA, 23 nt, Human
ggaaaaaaagaaaaaaaacaaaa

SEQ ID NO: 1340950 - RNA, 22 nt, Human
ggaacauguccaugcucugaac

SEQ ID NO: 1340951 - RNA, 21 nt, Human
ggaggaauaacuacuacucag

SEQ ID NO: 1340952 - RNA, 24 nt, Human
ggcauaaacaaaguucaggaauaa

SEQ ID NO: 1340953 - RNA, 24 nt, Human
guacaagaaauaagcuaaaaugag

SEQ ID NO: 1340954 - RNA, 24 nt, Human
guggaggccacuuaccaaauuucc

SEQ ID NO: 1340955 - RNA, 27 nt, Human
gugguuccuguacuaaauguagcccaa

SEQ ID NO: 1340956 - RNA, 28 nt, Human
uaaaaacaauaaaacaaaacaaaacaaa

SEQ ID NO: 1340957 - RNA, 20 nt, Human
uaaaaagcuuacacaaucua

SEQ ID NO: 1340958 - RNA, 23 nt, Human
uaaaacaaaacaaaacaaaaaaa

SEQ ID NO: 1340959 - RNA, 24 nt, Human
uaaaauaaaccccuuaaggacuga

SEQ ID NO: 1340960 - RNA, 19 nt, Human
uaaaaugagauauaaaccu

SEQ ID NO: 1340961 - RNA, 18 nt, Human
uaaacaaaaccaaacaaa

SEQ ID NO: 1340962 - RNA, 22 nt, Human
uaaagcuuauacaauauacaag

SEQ ID NO: 1340963 - RNA, 19 nt, Human
uacaagauuaggagggggg

SEQ ID NO: 1340964 - RNA, 19 nt, Human
uacaguauaauauuucaau

SEQ ID NO: 1340965 - RNA, 18 nt, Human
uacagugcuugaaaacaa

SEQ ID NO: 1340966 - RNA, 18 nt, Human
uacauacauugcauguau

SEQ ID NO: 1340967 - RNA, 22 nt, Human
uagaaccucucagauaaaccac

SEQ ID NO: 1340968 - RNA, 18 nt, Human
uagaauaguaucaccugg

SEQ ID NO: 1340969 - RNA, 21 nt, Human
uagacguuuguuaaaaaaaca

SEQ ID NO: 1340970 - RNA, 21 nt, Human
uaggaaguuacaguuuugcau

SEQ ID NO: 1340971 - RNA, 23 nt, Human
uaucaaacaaguucgcgccaaua

SEQ ID NO: 1340972 - RNA, 19 nt, Human
uauggaacugagcagauuc

SEQ ID NO: 1340973 - RNA, 21 nt, Human
uauggaacugagcagauucuu

SEQ ID NO: 1340974 - RNA, 24 nt, Human
uauuucaauuaucuucggaaagaa

SEQ ID NO: 1340975 - RNA, 18 nt, Human
ucaaaaaagaaaagaaaa

SEQ ID NO: 1340976 - RNA, 24 nt, Human
ucaaaaacagcccagacaccagaa

SEQ ID NO: 1340977 - RNA, 24 nt, Human
ucaaauaucaaacaaguucgcgcc

SEQ ID NO: 1340978 - RNA, 21 nt, Human
ucaacgcugaaaucacucaaa

SEQ ID NO: 1340979 - RNA, 22 nt, Human
ucaacuuguauuccagccacau

SEQ ID NO: 1340980 - RNA, 22 nt, Human
ucagaagaaccaaacaaaggca

SEQ ID NO: 1340981 - RNA, 22 nt, Human
ucagcugaaaaaaaaagaaaaa

SEQ ID NO: 1340982 - RNA, 28 nt, Human
ucagcugaaaaaaaaagaaaaaaguucc

SEQ ID NO: 1340983 - RNA, 26 nt, Human
ucaguacuggaaaaaaagaaaaaaaa

SEQ ID NO: 1340984 - RNA, 23 nt, Human
uccaugccaugguaccucaagaa

SEQ ID NO: 1340985 - RNA, 22 nt, Human
uccaugcucugaacaaaagcac

SEQ ID NO: 1340986 - RNA, 19 nt, Human
ucccaauaaaccacaaaag

SEQ ID NO: 1340987 - RNA, 20 nt, Human
uccccaguggauuuucuggu

SEQ ID NO: 1340988 - RNA, 21 nt, Human
ucggaaagaaacuaucaaaau

SEQ ID NO: 1340989 - RNA, 24 nt, Human
ucucagauaaaccacaauaagucc

SEQ ID NO: 1340990 - RNA, 23 nt, Human
ucugugguaugagaauggccaaa

SEQ ID NO: 1340991 - RNA, 22 nt, Human
ucuuggacuuuucaaaaaagaa

SEQ ID NO: 1340992 - RNA, 19 nt, Human
ugaaaacaaagucauaagu

SEQ ID NO: 1340993 - RNA, 23 nt, Human
ugaaagaaaagaaacauuuucug

SEQ ID NO: 1340994 - RNA, 20 nt, Human
ugaaagcacagaugguacca

SEQ ID NO: 1340995 - RNA, 20 nt, Human
ugaacaaauccuggaacaca

SEQ ID NO: 1340996 - RNA, 21 nt, Human
ugagaagagagacuaaguuac

SEQ ID NO: 1340997 - RNA, 25 nt, Human
ugagagcauagauacauucuaaaca

SEQ ID NO: 1340998 - RNA, 21 nt, Human
ugagucugcugcaauuucaga

SEQ ID NO: 1340999 - RNA, 23 nt, Human
ugauaaacaauaagcuacaauga

SEQ ID NO: 1341000 - RNA, 18 nt, Human
ugauuccugccaugacuc

SEQ ID NO: 1341001 - RNA, 19 nt, Human
ugccaacaaggcagaaaau

SEQ ID NO: 1341002 - RNA, 21 nt, Human
uggaacauuucaaugcaccuc

SEQ ID NO: 1341003 - RNA, 21 nt, Human
uggaugauuggagcagauuuu

SEQ ID NO: 1341004 - RNA, 18 nt, Human
uggcacagaaaauuacac

SEQ ID NO: 1341005 - RNA, 23 nt, Human
uggccguuaaagcaaagcagcac

SEQ ID NO: 1341006 - RNA, 27 nt, Human
ugggggugauuaaaaaggcuugcugua

SEQ ID NO: 1341007 - RNA, 24 nt, Human
ugguagcaaauacuucccauauuu

SEQ ID NO: 1341008 - RNA, 18 nt, Human
ugguaugagaauggccaa

SEQ ID NO: 1341009 - RNA, 23 nt, Human
uguguaaugauuccugccaugac

SEQ ID NO: 1341010 - RNA, 24 nt, Human
uuaaaaacaauaaaacaaaacaaa

SEQ ID NO: 1341011 - RNA, 22 nt, Human
uuaaacaaaaccaaacaaaaac

SEQ ID NO: 1341012 - RNA, 21 nt, Human
uucaaaggaaccuccucccca

SEQ ID NO: 1341013 - RNA, 26 nt, Human
uugaucacugaaacagauuuaggugu

SEQ ID NO: 1341014 - RNA, 22 nt, Human
uugaucaucuaauaaaagcauu

SEQ ID NO: 1341015 - RNA, 23 nt, Human
uugcugcacucaagccguuugag

SEQ ID NO: 1341016 - RNA, 19 nt, Human
uuggagcagauuugaagaa

SEQ ID NO: 1341017 - RNA, 24 nt, Human
uuuaaacaaaaccaaacaaaaacc

SEQ ID NO: 1341018 - RNA, 23 nt, Human
uuuccuuuuuugucaacuuuuug

SEQ ID NO: 1341019 - RNA, 22 nt, Human
uuuuauggacaguaaaaagcuu

SEQ ID NO: 1341020 - RNA, 22 nt, Human
uuuuugugaaagcacagauggu

SEQ ID NO: 1341021 - RNA, 21 nt, Human
uuuuuugugaaagcacagaug

SEQ ID NO: 1341022 - RNA, 24 nt, Human
aaccaagcgaaccaguccaucagg

SEQ ID NO: 1341023 - RNA, 23 nt, Human
auggagaacaaucggcagauaca

SEQ ID NO: 1341024 - RNA, 20 nt, Human
caagcgaaccaguccaucag

SEQ ID NO: 1341025 - RNA, 22 nt, Human
caagcgaaccaguccaucaggg

SEQ ID NO: 1341026 - RNA, 22 nt, Human
cacagguauagaugcacucuag

SEQ ID NO: 1341027 - RNA, 19 nt, Human
caucagggagcaaaaaagg

SEQ ID NO: 1341028 - RNA, 24 nt, Human
ccuggacucaaagccggcccugac

SEQ ID NO: 1341029 - RNA, 20 nt, Human
cuuucuggcagacauucuag

SEQ ID NO: 1341030 - RNA, 21 nt, Human
ggagaacaaucggcagauaca

SEQ ID NO: 1341031 - RNA, 23 nt, Human
uaccaaaugccaguuuaucuguu

SEQ ID NO: 1341032 - RNA, 22 nt, Human
uagcaaagacagaguugaucag

SEQ ID NO: 1341033 - RNA, 20 nt, Human
uccaucagggagcaaaaaag

SEQ ID NO: 1341034 - RNA, 21 nt, Human
ucugucuuaucaccauauccu

SEQ ID NO: 1341035 - RNA, 22 nt, Human
ugaugauaaaggaugcaccaug

SEQ ID NO: 1341036 - RNA, 18 nt, Human
ugcaaguaccaaaugccg

SEQ ID NO: 1341037 - RNA, 22 nt, Human
ugcagugccuggacucaaagcc

SEQ ID NO: 1341038 - RNA, 19 nt, Human
ugccucuaggccucugcag

SEQ ID NO: 1341039 - RNA, 24 nt, Human
ugccuggacucaaagccggcccug

SEQ ID NO: 1341040 - RNA, 20 nt, Human
ugcuuucgugaugauaaagg

SEQ ID NO: 1341041 - RNA, 25 nt, Human
uguaccagauguauuggcguaaaag

SEQ ID NO: 1341042 - RNA, 22 nt, Human
uuggaaccauggagaacaaucg

SEQ ID NO: 1341043 - RNA, 20 nt, Human
uuuuuuuuuuuuuuuuucgg

SEQ ID NO: 1341044 - RNA, 22 nt, Human
uuuuuuuuuuuuuuuuucguuu

SEQ ID NO: 1341045 - RNA, 24 nt, Human
aaaauaaagcaaaagcucauuuca

SEQ ID NO: 1341046 - RNA, 19 nt, Human
aaacuuggaaaauaaagca

SEQ ID NO: 1341047 - RNA, 21 nt, Human
aaagacaggagcagagaggcc

SEQ ID NO: 1341048 - RNA, 22 nt, Human
aaggugagagagaaacuuggaa

SEQ ID NO: 1341049 - RNA, 22 nt, Human
accuggaagucagaaggcguug

SEQ ID NO: 1341050 - RNA, 21 nt, Human
agacaggagcagagaggccug

SEQ ID NO: 1341051 - RNA, 18 nt, Human
agcaggaggcgaauucga

SEQ ID NO: 1341052 - RNA, 21 nt, Human
agucagaaggcguugaaguau

SEQ ID NO: 1341053 - RNA, 18 nt, Human
auccucaggcucugcccu

SEQ ID NO: 1341054 - RNA, 23 nt, Human
auuacaccggggaagccuucgcc

SEQ ID NO: 1341055 - RNA, 23 nt, Human
cacccccgaagaaugccccugaa

SEQ ID NO: 1341056 - RNA, 19 nt, Human
caccuggaagucagaaggc

SEQ ID NO: 1341057 - RNA, 21 nt, Human
cagcccaggaaauuacaccgg

SEQ ID NO: 1341058 - RNA, 18 nt, Human
cagucaucaccuggaagu

SEQ ID NO: 1341059 - RNA, 20 nt, Human
ccaaacaaaagacaggagca

SEQ ID NO: 1341060 - RNA, 19 nt, Human
ccaggaaauuacaccgggg

SEQ ID NO: 1341061 - RNA, 28 nt, Human
cccccgaagaaugccccugaaggugagg

SEQ ID NO: 1341062 - RNA, 21 nt, Human
ccccgaagaaugccccugaag

SEQ ID NO: 1341063 - RNA, 18 nt, Human
ccccugaaggugagagag

SEQ ID NO: 1341064 - RNA, 19 nt, Human
cccgaagaaugccccugaa

SEQ ID NO: 1341065 - RNA, 19 nt, Human
cccugaaggugagagagaa

SEQ ID NO: 1341066 - RNA, 21 nt, Human
gaugcacccccgaagaaugcc

SEQ ID NO: 1341067 - RNA, 23 nt, Human
gccugagagcaggaggcgaauuc

SEQ ID NO: 1341068 - RNA, 21 nt, Human
ucugcccucccucugaugcac

SEQ ID NO: 1341069 - RNA, 21 nt, Human
ucuucaugaugagcaggaacu

SEQ ID NO: 1341070 - RNA, 21 nt, Human
ugaaguaucgcggggaucuuc

SEQ ID NO: 1341071 - RNA, 18 nt, Human
ugagagagaaacuuggaa

SEQ ID NO: 1341072 - RNA, 24 nt, Human
ugcacccccgaagaaugccccuga

SEQ ID NO: 1341073 - RNA, 19 nt, Human
ugccccugaaggugagaga

SEQ ID NO: 1341074 - RNA, 21 nt, Human
uuuuuuggcagagagacccaa

SEQ ID NO: 1341075 - RNA, 24 nt, Human
aaucgcuugaacccgggaggugga

SEQ ID NO: 1341076 - RNA, 24 nt, Human
aggcaggagaaucgcuugaacccg

SEQ ID NO: 1341077 - RNA, 20 nt, Human
aggcugaggcaggagaaucg

SEQ ID NO: 1341078 - RNA, 24 nt, Human
aggcugaggcaggagaaucgcuug

SEQ ID NO: 1341079 - RNA, 24 nt, Human
agguggagguuucagugggccgag

SEQ ID NO: 1341080 - RNA, 24 nt, Human
cagcuacucgggaggcugaggcag

SEQ ID NO: 1341081 - RNA, 18 nt, Human
ccccgagcaaccggcagg

SEQ ID NO: 1341082 - RNA, 21 nt, Human
ccccgagcaaccggcaggccu

SEQ ID NO: 1341083 - RNA, 22 nt, Human
ccccgagcaaccggcaggccuu

SEQ ID NO: 1341084 - RNA, 21 nt, Human
ccuguaaucucagcuacucgg

SEQ ID NO: 1341085 - RNA, 18 nt, Human
cgaccccgagcaaccggc

SEQ ID NO: 1341086 - RNA, 23 nt, Human
cgccuguaaucucagcuacucgg

SEQ ID NO: 1341087 - RNA, 24 nt, Human
cgccuguaaucucagcuacucggg

SEQ ID NO: 1341088 - RNA, 24 nt, Human
cgggagguggagguuucagugggc

SEQ ID NO: 1341089 - RNA, 21 nt, Human
cugggcaacagagcgagauuc

SEQ ID NO: 1341090 - RNA, 18 nt, Human
gaccccgagcaaccggca

SEQ ID NO: 1341091 - RNA, 19 nt, Human
gaccccgagcaaccggcag

SEQ ID NO: 1341092 - RNA, 23 nt, Human
gagaaucgcuugaacccgggagg

SEQ ID NO: 1341093 - RNA, 21 nt, Human
gagcaaccggcaggccuugcg

SEQ ID NO: 1341094 - RNA, 23 nt, Human
gccuguaaucucagcuacucggg

SEQ ID NO: 1341095 - RNA, 18 nt, Human
ggagguuucagugggccg

SEQ ID NO: 1341096 - RNA, 22 nt, Human
ggagguuucagugggccgagau

SEQ ID NO: 1341097 - RNA, 24 nt, Human
ggagguuucagugggccgagaugg

SEQ ID NO: 1341098 - RNA, 18 nt, Human
ggcgugguggcgggcgcc

SEQ ID NO: 1341099 - RNA, 23 nt, Human
ggcgugguggcgggcgccuguaa

SEQ ID NO: 1341100 - RNA, 24 nt, Human
gguggcgggcgccuguaaucucag

SEQ ID NO: 1341101 - RNA, 25 nt, Human
gucauacgaccccgagcaaccggca

SEQ ID NO: 1341102 - RNA, 19 nt, Human
gucugcggcuuccggucgu

SEQ ID NO: 1341103 - RNA, 23 nt, Human
uacccacggccucgugagggcuc

SEQ ID NO: 1341104 - RNA, 23 nt, Human
uacgaccccgagcaaccggcagg

SEQ ID NO: 1341105 - RNA, 24 nt, Human
ucgcuugaacccgggagguggagg

SEQ ID NO: 1341106 - RNA, 24 nt, Human
ucgggaggcugaggcaggagaauc

SEQ ID NO: 1341107 - RNA, 20 nt, Human
ugaggcaggagaaucgcuug

SEQ ID NO: 1341108 - RNA, 24 nt, Human
ugaggcaggagaaucgcuugaacc

SEQ ID NO: 1341109 - RNA, 25 nt, Human
ugaggcaggagaaucgcuugaaccc

SEQ ID NO: 1341110 - RNA, 20 nt, Human
ugggccgagaugggcugggc

SEQ ID NO: 1341111 - RNA, 24 nt, Human
ugguggcgggcgccuguaaucuca

SEQ ID NO: 1341112 - RNA, 21 nt, Human
uuucagugggccgagaugggc

SEQ ID NO: 1341113 - RNA, 24 nt, Human
aaacagcccuugggcuccccuccc

SEQ ID NO: 1341114 - RNA, 21 nt, Human
acucugaggagagcaaguggc

SEQ ID NO: 1341115 - RNA, 20 nt, Human
agagcaaguggcagaaacag

SEQ ID NO: 1341116 - RNA, 18 nt, Human
cacauuuggcucguggcu

SEQ ID NO: 1341117 - RNA, 21 nt, Human
cagcagccaccgaccacuuuu

SEQ ID NO: 1341118 - RNA, 21 nt, Human
cagcccuugggcuccccuccc

SEQ ID NO: 1341119 - RNA, 20 nt, Human
cagugcugccagccgaccuu

SEQ ID NO: 1341120 - RNA, 23 nt, Human
ccccaucaccuuggccagugcug

SEQ ID NO: 1341121 - RNA, 19 nt, Human
ccuugggcuccccucccca

SEQ ID NO: 1341122 - RNA, 23 nt, Human
cuguguagcacaccccaucaccu

SEQ ID NO: 1341123 - RNA, 19 nt, Human
cuugggcuccccuccccag

SEQ ID NO: 1341124 - RNA, 20 nt, Human
gaccacuuuugcuuauugag

SEQ ID NO: 1341125 - RNA, 22 nt, Human
ggcucguggcuccuguacugga

SEQ ID NO: 1341126 - RNA, 20 nt, Human
gugcuguccaauacagcagc

SEQ ID NO: 1341127 - RNA, 22 nt, Human
guggcagaaacagcccuugggc

SEQ ID NO: 1341128 - RNA, 20 nt, Human
uagcacaccccaucaccuug

SEQ ID NO: 1341129 - RNA, 22 nt, Human
uagcacaccccaucaccuuggc

SEQ ID NO: 1341130 - RNA, 24 nt, Human
uagcacaccccaucaccuuggcca

SEQ ID NO: 1341131 - RNA, 20 nt, Human
uaggcccugaccugguccag

SEQ ID NO: 1341132 - RNA, 20 nt, Human
uccauccacuacacagugac

SEQ ID NO: 1341133 - RNA, 21 nt, Human
uccauccacuacacagugaca

SEQ ID NO: 1341134 - RNA, 22 nt, Human
uccauccacuacacagugacau

SEQ ID NO: 1341135 - RNA, 19 nt, Human
ucguggcuccuguacugga

SEQ ID NO: 1341136 - RNA, 24 nt, Human
ucuguggugauggaaaucuuuuuc

SEQ ID NO: 1341137 - RNA, 18 nt, Human
ugagcaccucaauauaga

SEQ ID NO: 1341138 - RNA, 18 nt, Human
uggacaacacagcuguag

SEQ ID NO: 1341139 - RNA, 19 nt, Human
ugggcuccccuccccagag

SEQ ID NO: 1341140 - RNA, 25 nt, Human
uuuuuauuccacaaacaguaaacuc

SEQ ID NO: 1341141 - RNA, 24 nt, Human
aaacggguacauagacauguucuu

SEQ ID NO: 1341142 - RNA, 21 nt, Human
aacuguauaaugccugagaac

SEQ ID NO: 1341143 - RNA, 20 nt, Human
auauacuccuccuuccuaga

SEQ ID NO: 1341144 - RNA, 20 nt, Human
caaaaaaguacccuacuaaa

SEQ ID NO: 1341145 - RNA, 18 nt, Human
cacaaaaaagagcaguaa

SEQ ID NO: 1341146 - RNA, 22 nt, Human
cacaaaaaagagcaguaaaaua

SEQ ID NO: 1341147 - RNA, 20 nt, Human
cccuacuaaaccuuucuaug

SEQ ID NO: 1341148 - RNA, 19 nt, Human
ccuccuuccuagaaacggg

SEQ ID NO: 1341149 - RNA, 21 nt, Human
cggguacauagacauguucuu

SEQ ID NO: 1341150 - RNA, 23 nt, Human
gaaagaagguggacauuuuuggu

SEQ ID NO: 1341151 - RNA, 18 nt, Human
gaagguggacauuuuugg

SEQ ID NO: 1341152 - RNA, 18 nt, Human
gacagaccaaaugcaucu

SEQ ID NO: 1341153 - RNA, 18 nt, Human
gcaucugugucagaaaua

SEQ ID NO: 1341154 - RNA, 22 nt, Human
gcuccacggcgucccgccccuc

SEQ ID NO: 1341155 - RNA, 20 nt, Human
ggguacauagacauguucuu

SEQ ID NO: 1341156 - RNA, 18 nt, Human
gucccgccccuccuccuc

SEQ ID NO: 1341157 - RNA, 24 nt, Human
uaaaaccucagcauuucaaaaaag

SEQ ID NO: 1341158 - RNA, 23 nt, Human
uaaaauaaauacucagaacuuuc

SEQ ID NO: 1341159 - RNA, 23 nt, Human
uaaauacucagaacuuucccagg

SEQ ID NO: 1341160 - RNA, 20 nt, Human
uaugcacaaaaaagagcagu

SEQ ID NO: 1341161 - RNA, 20 nt, Human
ucagaaauagacaaaaggca

SEQ ID NO: 1341162 - RNA, 18 nt, Human
uccucgguugucgccacc

SEQ ID NO: 1341163 - RNA, 19 nt, Human
uccucgguugucgccaccg

SEQ ID NO: 1341164 - RNA, 22 nt, Human
ugcaaaaaaguacccuacuaaa

SEQ ID NO: 1341165 - RNA, 23 nt, Human
ugcaguuuugacagaccaaaugc

SEQ ID NO: 1341166 - RNA, 18 nt, Human
ugucagaaauagacaaaa

SEQ ID NO: 1341167 - RNA, 18 nt, Human
uucuuccaugaauugccc

SEQ ID NO: 1341168 - RNA, 19 nt, Human
uuguauuauuccacuuagc

SEQ ID NO: 1341169 - RNA, 22 nt, Human
uuuuuuuuuuuuuuuuuccuuu

SEQ ID NO: 1341170 - RNA, 23 nt, Human
uuuuuuuuuuuuuuuuuuccuuu

SEQ ID NO: 1341171 - RNA, 26 nt, Human
uuuuuuuuuuuuuuuuuuuccuuuaa

SEQ ID NO: 1341172 - RNA, 18 nt, Human
aaaaauagagcgucuccc

SEQ ID NO: 1341173 - RNA, 23 nt, Human
aaacccaaaauguuaggucgaaa

SEQ ID NO: 1341174 - RNA, 19 nt, Human
aagaaucaaucaucaccca

SEQ ID NO: 1341175 - RNA, 20 nt, Human
aaugaccccguguucaaaaa

SEQ ID NO: 1341176 - RNA, 24 nt, Human
acacagcugcaaguacccguaggc

SEQ ID NO: 1341177 - RNA, 22 nt, Human
accccguguucaaaaacagccg

SEQ ID NO: 1341178 - RNA, 20 nt, Human
acugcagaaugaccccgugu

SEQ ID NO: 1341179 - RNA, 24 nt, Human
agacacgcgccggcagcuucccag

SEQ ID NO: 1341180 - RNA, 18 nt, Human
caccgccagccucagggc

SEQ ID NO: 1341181 - RNA, 19 nt, Human
cagagucccacgguauccc

SEQ ID NO: 1341182 - RNA, 18 nt, Human
cagcacagugagcagcag

SEQ ID NO: 1341183 - RNA, 22 nt, Human
cagcagcguggcgcucacagag

SEQ ID NO: 1341184 - RNA, 20 nt, Human
cagguccgagggccagcacc

SEQ ID NO: 1341185 - RNA, 20 nt, Human
caucacccaauacaaauaaa

SEQ ID NO: 1341186 - RNA, 19 nt, Human
cauuuggaguagcaucuga

SEQ ID NO: 1341187 - RNA, 26 nt, Human
ccagcaccugcuuuggugacggaagc

SEQ ID NO: 1341188 - RNA, 23 nt, Human
cccaaaauguuaggucgaaagaa

SEQ ID NO: 1341189 - RNA, 19 nt, Human
cccaugcacaacugcguau

SEQ ID NO: 1341190 - RNA, 21 nt, Human
cccccgaggacgggccuccug

SEQ ID NO: 1341191 - RNA, 20 nt, Human
ccgaaaggacccagaacaaa

SEQ ID NO: 1341192 - RNA, 21 nt, Human
ccgucccgccgcacgcguccc

SEQ ID NO: 1341193 - RNA, 23 nt, Human
ccguguucaaaaacagccgcucc

SEQ ID NO: 1341194 - RNA, 18 nt, Human
ccuccaccgagcgugagg

SEQ ID NO: 1341195 - RNA, 21 nt, Human
ccucccgaaaggacccagaac

SEQ ID NO: 1341196 - RNA, 23 nt, Human
ccucccgaaaggacccagaacaa

SEQ ID NO: 1341197 - RNA, 22 nt, Human
ccuccugugcugcccaucagcc

SEQ ID NO: 1341198 - RNA, 24 nt, Human
ccucugaaacgucccuccagccgu

SEQ ID NO: 1341199 - RNA, 20 nt, Human
cgcacgcgucccuccaccga

SEQ ID NO: 1341200 - RNA, 18 nt, Human
cggccagcaggggcgacg

SEQ ID NO: 1341201 - RNA, 20 nt, Human
cucacagagaccagcagggc

SEQ ID NO: 1341202 - RNA, 23 nt, Human
gagaccagcagggcgcagcucug

SEQ ID NO: 1341203 - RNA, 19 nt, Human
gcagggcgcagcucuggga

SEQ ID NO: 1341204 - RNA, 18 nt, Human
gcccuggcugggcucuca

SEQ ID NO: 1341205 - RNA, 20 nt, Human
gcgccucccggcuuccgucc

SEQ ID NO: 1341206 - RNA, 21 nt, Human
ggccggcgcuccgcgcagggc

SEQ ID NO: 1341207 - RNA, 18 nt, Human
guggugucuccacguggc

SEQ ID NO: 1341208 - RNA, 26 nt, Human
uaaaacccaaaauguuaggucgaaag

SEQ ID NO: 1341209 - RNA, 24 nt, Human
uaacugugaaaaaauagagcgucu

SEQ ID NO: 1341210 - RNA, 24 nt, Human
uauuuaugcgcaacgguucacaca

SEQ ID NO: 1341211 - RNA, 23 nt, Human
ucacacaagccuuccugaaauuc

SEQ ID NO: 1341212 - RNA, 21 nt, Human
ucagcccucccgaaaggaccc

SEQ ID NO: 1341213 - RNA, 21 nt, Human
ucccgaaaggacccagaacaa

SEQ ID NO: 1341214 - RNA, 21 nt, Human
ucugggaugccacaugggaca

SEQ ID NO: 1341215 - RNA, 21 nt, Human
ugcuuuggugaccgcagcugu

SEQ ID NO: 1341216 - RNA, 22 nt, Human
uggcgcagggcacgugcacucc

SEQ ID NO: 1341217 - RNA, 22 nt, Human
ugggagagggugacgccgcggu

SEQ ID NO: 1341218 - RNA, 23 nt, Human
ugggagagggugacgccgcggua

SEQ ID NO: 1341219 - RNA, 18 nt, Human
ugggucccagcagcacag

SEQ ID NO: 1341220 - RNA, 21 nt, Human
uucaaaaacagccgcucccau

SEQ ID NO: 1341221 - RNA, 20 nt, Human
aauuaccuaccacaacaccu

SEQ ID NO: 1341222 - RNA, 19 nt, Human
aauuuucgacucacaguuc

SEQ ID NO: 1341223 - RNA, 21 nt, Human
accuaccacaacaccugggaa

SEQ ID NO: 1341224 - RNA, 21 nt, Human
acuaccaccuuuccgcagaag

SEQ ID NO: 1341225 - RNA, 25 nt, Human
aggagaagagagaccgcugagagaa

SEQ ID NO: 1341226 - RNA, 24 nt, Human
caagagugagaaugagagccagua

SEQ ID NO: 1341227 - RNA, 24 nt, Human
cacaaacaugcaugcauccaggua

SEQ ID NO: 1341228 - RNA, 22 nt, Human
cacaacaccugggaauuaugag

SEQ ID NO: 1341229 - RNA, 21 nt, Human
cagaagcaacugcaaaagcgc

SEQ ID NO: 1341230 - RNA, 24 nt, Human
ccaaaagaccuguuuguuacacaa

SEQ ID NO: 1341231 - RNA, 19 nt, Human
ccgcugagagaaucguagg

SEQ ID NO: 1341232 - RNA, 21 nt, Human
cuagauaagccaaaagaccug

SEQ ID NO: 1341233 - RNA, 28 nt, Human
gagaauagcaugagggaaaccgguaccc

SEQ ID NO: 1341234 - RNA, 18 nt, Human
gcaaaagcgccggcuccg

SEQ ID NO: 1341235 - RNA, 20 nt, Human
guggaaggcaccucuucaca

SEQ ID NO: 1341236 - RNA, 18 nt, Human
uacacaaacaugcaugca

SEQ ID NO: 1341237 - RNA, 23 nt, Human
uauaaaaccaucagaucucauga

SEQ ID NO: 1341238 - RNA, 21 nt, Human
uaucaugagaauagcaugagg

SEQ ID NO: 1341239 - RNA, 18 nt, Human
ucagaucucaugaaagcu

SEQ ID NO: 1341240 - RNA, 19 nt, Human
uccacauggcugggaaggc

SEQ ID NO: 1341241 - RNA, 22 nt, Human
ugaaagcucacuaucaugagaa

SEQ ID NO: 1341242 - RNA, 20 nt, Human
ugagaaugagagccaguagg

SEQ ID NO: 1341243 - RNA, 22 nt, Human
ugagagccaguaggggaaaugc

SEQ ID NO: 1341244 - RNA, 32 nt, Human
uuaacaaucacgguggaaggcaccucuucuuu

SEQ ID NO: 1341245 - RNA, 25 nt, Human
uuaauuuucgacucacaguuccaca

SEQ ID NO: 1341246 - RNA, 23 nt, Human
uucaaacuugaggagaagagaga

SEQ ID NO: 1341247 - RNA, 23 nt, Human
aaaggcaaaggguauguggugag

SEQ ID NO: 1341248 - RNA, 19 nt, Human
aacaaugguugcugauuug

SEQ ID NO: 1341249 - RNA, 23 nt, Human
aagagaccagcagacaaacugag

SEQ ID NO: 1341250 - RNA, 21 nt, Human
aagccguaauugcugaaaaug

SEQ ID NO: 1341251 - RNA, 24 nt, Human
acguuuaagagucucucucccucc

SEQ ID NO: 1341252 - RNA, 24 nt, Human
agagacgugcagggccuggccccc

SEQ ID NO: 1341253 - RNA, 23 nt, Human
agagagagagauuccagugucac

SEQ ID NO: 1341254 - RNA, 20 nt, Human
caagagaccagcagacaaac

SEQ ID NO: 1341255 - RNA, 20 nt, Human
caccauuugaggccggguag

SEQ ID NO: 1341256 - RNA, 21 nt, Human
caggaagacugcagaucauaa

SEQ ID NO: 1341257 - RNA, 21 nt, Human
cagugucucauguaaaaccuc

SEQ ID NO: 1341258 - RNA, 22 nt, Human
cccaagagaccagcagacaaac

SEQ ID NO: 1341259 - RNA, 19 nt, Human
cccggccggggcugccuga

SEQ ID NO: 1341260 - RNA, 20 nt, Human
cccugggcacccaggauggc

SEQ ID NO: 1341261 - RNA, 19 nt, Human
ccgcugccggcucagccgc

SEQ ID NO: 1341262 - RNA, 21 nt, Human
ccucucugccagcuucucuug

SEQ ID NO: 1341263 - RNA, 22 nt, Human
ccugaggcggcccgcugccggc

SEQ ID NO: 1341264 - RNA, 26 nt, Human
cgagaaaugccaccacguggcacugc

SEQ ID NO: 1341265 - RNA, 24 nt, Human
cggguaggagagacgugcagggcc

SEQ ID NO: 1341266 - RNA, 22 nt, Human
cucucugccagcuucucuugga

SEQ ID NO: 1341267 - RNA, 22 nt, Human
cugcagaucauaacaacaaugg

SEQ ID NO: 1341268 - RNA, 20 nt, Human
cugcaggaggagacuggugg

SEQ ID NO: 1341269 - RNA, 23 nt, Human
cugccggcucagccgccaccaag

SEQ ID NO: 1341270 - RNA, 18 nt, Human
cugccggggacccgggcg

SEQ ID NO: 1341271 - RNA, 19 nt, Human
cuggccccccaagagacca

SEQ ID NO: 1341272 - RNA, 21 nt, Human
gagagauuccagugucaccag

SEQ ID NO: 1341273 - RNA, 24 nt, Human
gaggcccuggugugguaccaucau

SEQ ID NO: 1341274 - RNA, 19 nt, Human
gaggugcgaacaaagccug

SEQ ID NO: 1341275 - RNA, 20 nt, Human
gcagacaaacugaggcggca

SEQ ID NO: 1341276 - RNA, 22 nt, Human
gccaacagcccaaaguuuuaag

SEQ ID NO: 1341277 - RNA, 20 nt, Human
ggaggagacugguggaagcc

SEQ ID NO: 1341278 - RNA, 22 nt, Human
ggcccggccggggcugccugag

SEQ ID NO: 1341279 - RNA, 21 nt, Human
ggccuggccccccaagagacc

SEQ ID NO: 1341280 - RNA, 23 nt, Human
guugcugauuuggcaucaaagag

SEQ ID NO: 1341281 - RNA, 19 nt, Human
uaagggaagaccucucugc

SEQ ID NO: 1341282 - RNA, 18 nt, Human
uaauugcugaaaauggca

SEQ ID NO: 1341283 - RNA, 23 nt, Human
uagagguuucauaauuuugcucu

SEQ ID NO: 1341284 - RNA, 22 nt, Human
uauguggugaggggccaggcug

SEQ ID NO: 1341285 - RNA, 19 nt, Human
ucaaagccguaauugcuga

SEQ ID NO: 1341286 - RNA, 23 nt, Human
ucucauguaaaaccuccaaggca

SEQ ID NO: 1341287 - RNA, 18 nt, Human
ucucccuccuuguguucu

SEQ ID NO: 1341288 - RNA, 23 nt, Human
ugaaaauggcaccaacaugcugc

SEQ ID NO: 1341289 - RNA, 18 nt, Human
ugccggggacccgggcgg

SEQ ID NO: 1341290 - RNA, 21 nt, Human
ugcugaaaauggcaccaacau

SEQ ID NO: 1341291 - RNA, 22 nt, Human
uggagagagugggugaccaaca

SEQ ID NO: 1341292 - RNA, 20 nt, Human
uggcaucaaagagguggcac

SEQ ID NO: 1341293 - RNA, 18 nt, Human
ugggaggagcgggcggua

SEQ ID NO: 1341294 - RNA, 19 nt, Human
uguggugaggggccaggcu

SEQ ID NO: 1341295 - RNA, 19 nt, Human
uguggugaggggccaggcu

SEQ ID NO: 1341296 - RNA, 22 nt, Human
uuggcaucaaagagguggcacu

SEQ ID NO: 1341297 - RNA, 18 nt, Human
aaaauuaaaacaucagcc

SEQ ID NO: 1341298 - RNA, 20 nt, Human
aacauagugagaccccccca

SEQ ID NO: 1341299 - RNA, 23 nt, Human
aacauagugagacccccccaucu

SEQ ID NO: 1341300 - RNA, 23 nt, Human
aagaagaaaaaguagagagacac

SEQ ID NO: 1341301 - RNA, 21 nt, Human
aagaagaagaaaaaguagaga

SEQ ID NO: 1341302 - RNA, 22 nt, Human
aagccucccacggcccgcccag

SEQ ID NO: 1341303 - RNA, 25 nt, Human
agaaaaaguagagagacacgaggac

SEQ ID NO: 1341304 - RNA, 21 nt, Human
agaagaagaaaaaguagagag

SEQ ID NO: 1341305 - RNA, 22 nt, Human
agacccccccaucucugcaaaa

SEQ ID NO: 1341306 - RNA, 21 nt, Human
agacucaacaccaaaccagaa

SEQ ID NO: 1341307 - RNA, 23 nt, Human
agcaagaagaagaaaaaguagag

SEQ ID NO: 1341308 - RNA, 25 nt, Human
agcaagaagaagaaaaaguagagag

SEQ ID NO: 1341309 - RNA, 22 nt, Human
agccugggcaacauagugagac

SEQ ID NO: 1341310 - RNA, 23 nt, Human
agccugggcaacauagugagacc

SEQ ID NO: 1341311 - RNA, 24 nt, Human
agccugggcaacauagugagaccc

SEQ ID NO: 1341312 - RNA, 20 nt, Human
agcuucuugggaggcugagg

SEQ ID NO: 1341313 - RNA, 24 nt, Human
agcuucuugggaggcugagguggg

SEQ ID NO: 1341314 - RNA, 24 nt, Human
aggcugaggugggaggauugcuug

SEQ ID NO: 1341315 - RNA, 22 nt, Human
aggugggaggauugcuugagcu

SEQ ID NO: 1341316 - RNA, 23 nt, Human
agguugaggcugcagugagccau

SEQ ID NO: 1341317 - RNA, 24 nt, Human
agugagccauugcauuccagccug

SEQ ID NO: 1341318 - RNA, 18 nt, Human
auacuggacccucccaag

SEQ ID NO: 1341319 - RNA, 18 nt, Human
augucaaaagaaugaaau

SEQ ID NO: 1341320 - RNA, 18 nt, Human
auugcauuccagccuggg

SEQ ID NO: 1341321 - RNA, 24 nt, Human
auugcauuccagccugggucacgg

SEQ ID NO: 1341322 - RNA, 19 nt, Human
auugcuugagcucaggagg

SEQ ID NO: 1341323 - RNA, 20 nt, Human
caaaauuaaaacaucagccg

SEQ ID NO: 1341324 - RNA, 22 nt, Human
caaaauuaaaacaucagccgac

SEQ ID NO: 1341325 - RNA, 23 nt, Human
caucuucaucuugagagaggaag

SEQ ID NO: 1341326 - RNA, 18 nt, Human
cauuccagccugggucac

SEQ ID NO: 1341327 - RNA, 23 nt, Human
cauuccagccugggucacggagc

SEQ ID NO: 1341328 - RNA, 18 nt, Human
cauugcauuccagccugg

SEQ ID NO: 1341329 - RNA, 19 nt, Human
cauugcauuccagccuggg

SEQ ID NO: 1341330 - RNA, 20 nt, Human
cauugcauuccagccugggu

SEQ ID NO: 1341331 - RNA, 22 nt, Human
cauugcauuccagccuggguca

SEQ ID NO: 1341332 - RNA, 20 nt, Human
ccauugcauuccagccuggg

SEQ ID NO: 1341333 - RNA, 21 nt, Human
ccauugcauuccagccugggu

SEQ ID NO: 1341334 - RNA, 22 nt, Human
ccauugcauuccagccuggguc

SEQ ID NO: 1341335 - RNA, 24 nt, Human
ccauugcauuccagccugggucac

SEQ ID NO: 1341336 - RNA, 22 nt, Human
cccggcccccaccucaggaagc

SEQ ID NO: 1341337 - RNA, 22 nt, Human
ccucauacuggacccucccaag

SEQ ID NO: 1341338 - RNA, 24 nt, Human
cgagaccagccugggcaacauagu

SEQ ID NO: 1341339 - RNA, 18 nt, Human
cugcagugagccauugca

SEQ ID NO: 1341340 - RNA, 21 nt, Human
cuggaagcaaggcugaacauc

SEQ ID NO: 1341341 - RNA, 21 nt, Human
cuuagcacugaacucgucaca

SEQ ID NO: 1341342 - RNA, 20 nt, Human
gaacaucuucaucuugagag

SEQ ID NO: 1341343 - RNA, 24 nt, Human
gaccguguccccauccagcaagac

SEQ ID NO: 1341344 - RNA, 24 nt, Human
gaggugggaggauugcuugagcuc

SEQ ID NO: 1341345 - RNA, 24 nt, Human
gcaggagagagacucaacaccaaa

SEQ ID NO: 1341346 - RNA, 24 nt, Human
gcauuccagccugggucacggagc

SEQ ID NO: 1341347 - RNA, 19 nt, Human
gccauugcauuccagccug

SEQ ID NO: 1341348 - RNA, 24 nt, Human
gcucaggagguugaggcugcagug

SEQ ID NO: 1341349 - RNA, 24 nt, Human
gcuugagcucaggagguugaggcu

SEQ ID NO: 1341350 - RNA, 22 nt, Human
ggaagccucccacggcccgccc

SEQ ID NO: 1341351 - RNA, 22 nt, Human
ggaggauugcuugagcucagga

SEQ ID NO: 1341352 - RNA, 27 nt, Human
gucauccucucaccucauacuggaccc

SEQ ID NO: 1341353 - RNA, 25 nt, Human
uaaaaaccucagaucagcagaccga

SEQ ID NO: 1341354 - RNA, 20 nt, Human
uaaaauauucacauaauguc

SEQ ID NO: 1341355 - RNA, 24 nt, Human
uagagagacacgaggacacacaca

SEQ ID NO: 1341356 - RNA, 23 nt, Human
uagcuucuugggaggcugaggug

SEQ ID NO: 1341357 - RNA, 24 nt, Human
uagcuucuugggaggcugaggugg

SEQ ID NO: 1341358 - RNA, 22 nt, Human
uagugagacccccccaucucug

SEQ ID NO: 1341359 - RNA, 19 nt, Human
ucacggagcugguggccag

SEQ ID NO: 1341360 - RNA, 19 nt, Human
ucccaaggaggaugugacc

SEQ ID NO: 1341361 - RNA, 21 nt, Human
ucucagguuuccuacauggcu

SEQ ID NO: 1341362 - RNA, 23 nt, Human
ugaaaugauagcgauauagccaa

SEQ ID NO: 1341363 - RNA, 23 nt, Human
ugaaugcaguccgucauaugacc

SEQ ID NO: 1341364 - RNA, 19 nt, Human
ugagagaggaagaggccca

SEQ ID NO: 1341365 - RNA, 20 nt, Human
ugaggugggaggauugcuug

SEQ ID NO: 1341366 - RNA, 23 nt, Human
ugaggugggaggauugcuugagc

SEQ ID NO: 1341367 - RNA, 23 nt, Human
ugaggugggaggauugcuugagc

SEQ ID NO: 1341368 - RNA, 24 nt, Human
ugaggugggaggauugcuugagcu

SEQ ID NO: 1341369 - RNA, 19 nt, Human
uggacaucacagugcuaaa

SEQ ID NO: 1341370 - RNA, 26 nt, Human
uggcccggcccccaccucaggaagcc

SEQ ID NO: 1341371 - RNA, 22 nt, Human
ugggaggcugaggugggaggau

SEQ ID NO: 1341372 - RNA, 24 nt, Human
ugggaggcugaggugggaggauug

SEQ ID NO: 1341373 - RNA, 20 nt, Human
uggugguguguacauguggu

SEQ ID NO: 1341374 - RNA, 21 nt, Human
uguccccauccagcaagacca

SEQ ID NO: 1341375 - RNA, 20 nt, Human
ugugaccaaauguuugcaga

SEQ ID NO: 1341376 - RNA, 24 nt, Human
uugcuugagcucaggagguugagg

SEQ ID NO: 1341377 - RNA, 20 nt, Human
uugggaggcugaggugggag

SEQ ID NO: 1341378 - RNA, 19 nt, Human
uuuaacauaccccuuggcc

SEQ ID NO: 1341379 - RNA, 24 nt, Human
uuuauuagucuuauuuuccaguaa

SEQ ID NO: 1341380 - RNA, 22 nt, Human
uuucaguggaacucaguuuguu

SEQ ID NO: 1341381 - RNA, 25 nt, Human
uuucucuuuuuaaacauugccaguu

SEQ ID NO: 1341382 - RNA, 22 nt, Human
aaaagaagaaauaaauauacaa

SEQ ID NO: 1341383 - RNA, 18 nt, Human
aggcucggaguagugacc

SEQ ID NO: 1341384 - RNA, 25 nt, Human
cacgugguucuacaauaauuuuucc

SEQ ID NO: 1341385 - RNA, 22 nt, Human
cgucacaggcucggaguaguga

SEQ ID NO: 1341386 - RNA, 24 nt, Human
cgugguucuacaauaauuuuuccu

SEQ ID NO: 1341387 - RNA, 21 nt, Human
cugccgcaaacgucacaggcu

SEQ ID NO: 1341388 - RNA, 20 nt, Human
ggaaaagaagaaauaaauau

SEQ ID NO: 1341389 - RNA, 23 nt, Human
uucacauauugccacaauaguua

SEQ ID NO: 1341390 - RNA, 18 nt, Human
aaacaagcccccucccuc

SEQ ID NO: 1341391 - RNA, 18 nt, Human
aaacaagcccccucccuc

SEQ ID NO: 1341392 - RNA, 20 nt, Human
aaacaagcccccucccucag

SEQ ID NO: 1341393 - RNA, 21 nt, Human
aaacacgaagggggcagcugg

SEQ ID NO: 1341394 - RNA, 23 nt, Human
aacaagcccccucccucagugcu

SEQ ID NO: 1341395 - RNA, 21 nt, Human
aagugcugggccgcccagagg

SEQ ID NO: 1341396 - RNA, 20 nt, Human
acacgaagggggcagcugga

SEQ ID NO: 1341397 - RNA, 22 nt, Human
agcaggaagaaguugugucuga

SEQ ID NO: 1341398 - RNA, 20 nt, Human
aggaagaaguugugucugag

SEQ ID NO: 1341399 - RNA, 19 nt, Human
agggaagggaaacaagccc

SEQ ID NO: 1341400 - RNA, 23 nt, Human
caccaggcugagggcuucuuggu

SEQ ID NO: 1341401 - RNA, 20 nt, Human
cagagggacagcccugcccu

SEQ ID NO: 1341402 - RNA, 23 nt, Human
cagggccaggcgggcccauuacg

SEQ ID NO: 1341403 - RNA, 23 nt, Human
cccagcuacagcaaacacaggga

SEQ ID NO: 1341404 - RNA, 19 nt, Human
ccccacgacuggagcagca

SEQ ID NO: 1341405 - RNA, 20 nt, Human
ccgggagggaagggaaacaa

SEQ ID NO: 1341406 - RNA, 18 nt, Human
ccuccugcccucucccca

SEQ ID NO: 1341407 - RNA, 18 nt, Human
ccugcccucuccccaucc

SEQ ID NO: 1341408 - RNA, 24 nt, Human
cuacagcaaacacagggaaacacg

SEQ ID NO: 1341409 - RNA, 19 nt, Human
cugcccuggagcuugucgc

SEQ ID NO: 1341410 - RNA, 24 nt, Human
gaagauuuggucuugaacuugggg

SEQ ID NO: 1341411 - RNA, 26 nt, Human
gaagggaaacaagcccccucccucaa

SEQ ID NO: 1341412 - RNA, 30 nt, Human
gaggaaaaggcacuuggcugggucuccccc

SEQ ID NO: 1341413 - RNA, 23 nt, Human
gagggcuucuugguuccuggaga

SEQ ID NO: 1341414 - RNA, 23 nt, Human
gcacuuggcugggucuccuccug

SEQ ID NO: 1341415 - RNA, 19 nt, Human
gcuacagcaaacacaggga

SEQ ID NO: 1341416 - RNA, 22 nt, Human
ggagcagcaggaagaaguugug

SEQ ID NO: 1341417 - RNA, 21 nt, Human
uacagcaaacacagggaaaca

SEQ ID NO: 1341418 - RNA, 22 nt, Human
uacagcaaacacagggaaacac

SEQ ID NO: 1341419 - RNA, 20 nt, Human
ucaguccuggcucuaggcuc

SEQ ID NO: 1341420 - RNA, 19 nt, Human
uccgcgcgcucgcagcgca

SEQ ID NO: 1341421 - RNA, 18 nt, Human
ugcccagcuacagcaaac

SEQ ID NO: 1341422 - RNA, 22 nt, Human
ugcccuggagcuugucgccggg

SEQ ID NO: 1341423 - RNA, 23 nt, Human
ugcccuggagcuugucgccggga

SEQ ID NO: 1341424 - RNA, 19 nt, Human
ugcggcgcggcgcccaggg

SEQ ID NO: 1341425 - RNA, 21 nt, Human
ugucugaggaagugcugggcc

SEQ ID NO: 1341426 - RNA, 20 nt, Human
uuggucuugaacuugggggg

SEQ ID NO: 1341427 - RNA, 25 nt, Human
aaaaaaucccaaggcaaguaacaca

SEQ ID NO: 1341428 - RNA, 26 nt, Human
aaaauaaaacaagugcuuauuacgaa

SEQ ID NO: 1341429 - RNA, 19 nt, Human
aaaaugcccaaagcugcag

SEQ ID NO: 1341430 - RNA, 23 nt, Human
aacacaauuuguucacuagcacu

SEQ ID NO: 1341431 - RNA, 21 nt, Human
aacagaacagaaaaaucaaga

SEQ ID NO: 1341432 - RNA, 22 nt, Human
aacauccugaacauagcaauuc

SEQ ID NO: 1341433 - RNA, 25 nt, Human
aagcaaaaguauguaaugcaacagc

SEQ ID NO: 1341434 - RNA, 18 nt, Human
aagcugcagcuguuugga

SEQ ID NO: 1341435 - RNA, 18 nt, Human
acaaagucagaggaagaa

SEQ ID NO: 1341436 - RNA, 19 nt, Human
acagaauagaggaaaugcc

SEQ ID NO: 1341437 - RNA, 21 nt, Human
acauauacuguuuuuauuugg

SEQ ID NO: 1341438 - RNA, 20 nt, Human
acuguuuuuauuuggguuug

SEQ ID NO: 1341439 - RNA, 21 nt, Human
agaacauccugaacauagcaa

SEQ ID NO: 1341440 - RNA, 18 nt, Human
agagucccugcccccacc

SEQ ID NO: 1341441 - RNA, 21 nt, Human
agcaaggggcccacaugaaca

SEQ ID NO: 1341442 - RNA, 18 nt, Human
agccuuagaauggaagcu

SEQ ID NO: 1341443 - RNA, 18 nt, Human
agcugcagcuguuuggac

SEQ ID NO: 1341444 - RNA, 21 nt, Human
aggaagaauaauuaaaaagaa

SEQ ID NO: 1341445 - RNA, 18 nt, Human
auagaggaaaugcccaca

SEQ ID NO: 1341446 - RNA, 21 nt, Human
auagaggaaaugcccacagca

SEQ ID NO: 1341447 - RNA, 22 nt, Human
auccugaacauagcaauucaac

SEQ ID NO: 1341448 - RNA, 22 nt, Human
caacagaacagaaaaaucaaga

SEQ ID NO: 1341449 - RNA, 22 nt, Human
caaguuagauacuguacaucua

SEQ ID NO: 1341450 - RNA, 24 nt, Human
cacacacaaaauaaaacaagugcc

SEQ ID NO: 1341451 - RNA, 20 nt, Human
cacagcaaauaguucuagug

SEQ ID NO: 1341452 - RNA, 22 nt, Human
cacccccuagaacauccugaaa

SEQ ID NO: 1341453 - RNA, 20 nt, Human
caucaaggaaaacagguuca

SEQ ID NO: 1341454 - RNA, 23 nt, Human
ccacacacacaaaauaaaacaag

SEQ ID NO: 1341455 - RNA, 22 nt, Human
cccugcccccuuucucuuacaa

SEQ ID NO: 1341456 - RNA, 21 nt, Human
cgaaaagagucccugccccca

SEQ ID NO: 1341457 - RNA, 18 nt, Human
cuagcacucuuacuugaa

SEQ ID NO: 1341458 - RNA, 25 nt, Human
cucacugucacccugaaagguuuuc

SEQ ID NO: 1341459 - RNA, 19 nt, Human
cuccguaggaagcuuaagg

SEQ ID NO: 1341460 - RNA, 21 nt, Human
cuggaauauagucagcaaggg

SEQ ID NO: 1341461 - RNA, 23 nt, Human
ggaaaugcccacagcaaauaguu

SEQ ID NO: 1341462 - RNA, 21 nt, Human
ggaaucuuugcaaguacguau

SEQ ID NO: 1341463 - RNA, 18 nt, Human
ggugguggugauuguuuc

SEQ ID NO: 1341464 - RNA, 21 nt, Human
gguuuguugaaugagaauaaa

SEQ ID NO: 1341465 - RNA, 19 nt, Human
guucaaaaaaucccaaggc

SEQ ID NO: 1341466 - RNA, 24 nt, Human
uaacagaauagaggaaaugcccac

SEQ ID NO: 1341467 - RNA, 21 nt, Human
uagaacauccugaacauagca

SEQ ID NO: 1341468 - RNA, 26 nt, Human
uaggcaccauuaaacaaaaaacccca

SEQ ID NO: 1341469 - RNA, 23 nt, Human
ucaacagaacagaaaaaucaaga

SEQ ID NO: 1341470 - RNA, 21 nt, Human
uccacacacacaaaauaaaac

SEQ ID NO: 1341471 - RNA, 19 nt, Human
ucuggaucugcucacuguc

SEQ ID NO: 1341472 - RNA, 21 nt, Human
ugaacauagcaauucaacaga

SEQ ID NO: 1341473 - RNA, 22 nt, Human
ugaaguggcuggaauauaguca

SEQ ID NO: 1341474 - RNA, 18 nt, Human
uuaaauuucuccagcaca

SEQ ID NO: 1341475 - RNA, 24 nt, Human
uuaggcaucaucaaggaaaacagg

SEQ ID NO: 1341476 - RNA, 21 nt, Human
uugcuucccugcccccuuucu

SEQ ID NO: 1341477 - RNA, 24 nt, Human
uugcuucccugcccccuuucucuu

SEQ ID NO: 1341478 - RNA, 18 nt, Human
uuggacuaggaagacagc

SEQ ID NO: 1341479 - RNA, 20 nt, Human
cagcacacuguauuaaaaca

SEQ ID NO: 1341480 - RNA, 22 nt, Human
aaaaaaguuuuaaugaaaaaga

SEQ ID NO: 1341481 - RNA, 22 nt, Human
aaaaagaaaagacauuaaaaag

SEQ ID NO: 1341482 - RNA, 19 nt, Human
aaaaauguggaaagaggcc

SEQ ID NO: 1341483 - RNA, 25 nt, Human
aacaaaaaaguuuuaaugaaaaaga

SEQ ID NO: 1341484 - RNA, 18 nt, Human
aaggaaaaaauguggaaa

SEQ ID NO: 1341485 - RNA, 26 nt, Human
aauaauaaauacauugcaaggaaaaa

SEQ ID NO: 1341486 - RNA, 24 nt, Human
aauguuuuggaacuagacagaggc

SEQ ID NO: 1341487 - RNA, 18 nt, Human
acucuaaauagucaaggg

SEQ ID NO: 1341488 - RNA, 18 nt, Human
agcuguugaaacugcagc

SEQ ID NO: 1341489 - RNA, 21 nt, Human
agcuguugaaacugcagcccu

SEQ ID NO: 1341490 - RNA, 20 nt, Human
aggauaucuagcuguugaaa

SEQ ID NO: 1341491 - RNA, 18 nt, Human
agggacagggaggaggga

SEQ ID NO: 1341492 - RNA, 22 nt, Human
agggaggagggaggaaacgggg

SEQ ID NO: 1341493 - RNA, 24 nt, Human
caacacuguggauguucaguacca

SEQ ID NO: 1341494 - RNA, 21 nt, Human
cacuggugguugcuagggaca

SEQ ID NO: 1341495 - RNA, 22 nt, Human
cauuaaaaaguucugcaaacag

SEQ ID NO: 1341496 - RNA, 24 nt, Human
cauuaaaaaguucugcaaacagga

SEQ ID NO: 1341497 - RNA, 23 nt, Human
ccaggauaucuagcuguugaaac

SEQ ID NO: 1341498 - RNA, 22 nt, Human
ccugaaaauuccaucuucaacu

SEQ ID NO: 1341499 - RNA, 23 nt, Human
cugaaaauuccaucuucaacugg

SEQ ID NO: 1341500 - RNA, 22 nt, Human
cugaauuguucccuuuaaaaug

SEQ ID NO: 1341501 - RNA, 24 nt, Human
cugaauuguucccuuuaaaauggu

SEQ ID NO: 1341502 - RNA, 22 nt, Human
cugcagcccucccaaugacucu

SEQ ID NO: 1341503 - RNA, 22 nt, Human
gaaagaggcauaucgaacaaaa

SEQ ID NO: 1341504 - RNA, 18 nt, Human
gacagggaggagggagga

SEQ ID NO: 1341505 - RNA, 18 nt, Human
gauacauacucugguaca

SEQ ID NO: 1341506 - RNA, 20 nt, Human
gcauggagcuggcugauuuu

SEQ ID NO: 1341507 - RNA, 23 nt, Human
gccacugaauuguucccuuuaaa

SEQ ID NO: 1341508 - RNA, 23 nt, Human
ggaagguuugggcauggagcugg

SEQ ID NO: 1341509 - RNA, 23 nt, Human
ggaggagggaggaaacggggagc

SEQ ID NO: 1341510 - RNA, 24 nt, Human
uaccaaaugccacugaauuguucc

SEQ ID NO: 1341511 - RNA, 23 nt, Human
uauaaacaucuaacacgaagacu

SEQ ID NO: 1341512 - RNA, 24 nt, Human
uaugaaagauccagaauaggcaaa

SEQ ID NO: 1341513 - RNA, 23 nt, Human
ucaggauacauacucugguacag

SEQ ID NO: 1341514 - RNA, 22 nt, Human
ucauuuugggaugauaaaaaaa

SEQ ID NO: 1341515 - RNA, 24 nt, Human
uccaggauaucuagcuguugaaac

SEQ ID NO: 1341516 - RNA, 19 nt, Human
ucuagcuguugaaacugca

SEQ ID NO: 1341517 - RNA, 18 nt, Human
ugaaacugcagcccuccc

SEQ ID NO: 1341518 - RNA, 20 nt, Human
ugcaaacaauauccaggaua

SEQ ID NO: 1341519 - RNA, 20 nt, Human
ugccacugaauuguucccuu

SEQ ID NO: 1341520 - RNA, 22 nt, Human
uggaaagaggcauaucgaacag

SEQ ID NO: 1341521 - RNA, 18 nt, Human
uggaaaggucccaagaug

SEQ ID NO: 1341522 - RNA, 20 nt, Human
uuaauggcuacaggguuuca

SEQ ID NO: 1341523 - RNA, 21 nt, Human
uucaagagccauauuuaugaa

SEQ ID NO: 1341524 - RNA, 23 nt, Human
uucacaucaagcuguccaaaccu

SEQ ID NO: 1341525 - RNA, 21 nt, Human
uucaccuaaauacaaauaaau

SEQ ID NO: 1341526 - RNA, 19 nt, Human
uugaaacugcagcccuccc

SEQ ID NO: 1341527 - RNA, 21 nt, Human
uuuaaaaauccuaucccauuc

SEQ ID NO: 1341528 - RNA, 21 nt, Human
uuuccugaaaauuccaucuuc

SEQ ID NO: 1341529 - RNA, 18 nt, Human
aagauugcuguuuucaug

SEQ ID NO: 1341530 - RNA, 21 nt, Human
agacggcccgcaccagagucg

SEQ ID NO: 1341531 - RNA, 21 nt, Human
aucacaaauuagucuuugauu

SEQ ID NO: 1341532 - RNA, 22 nt, Human
cagcucggggggaagaagacgg

SEQ ID NO: 1341533 - RNA, 19 nt, Human
ccauuucucccuccagugg

SEQ ID NO: 1341534 - RNA, 18 nt, Human
ccgcgcacgcccagcucg

SEQ ID NO: 1341535 - RNA, 19 nt, Human
cggggggaagaagacggcc

SEQ ID NO: 1341536 - RNA, 24 nt, Human
gcaaagucauaucuauuaaaaagu

SEQ ID NO: 1341537 - RNA, 21 nt, Human
ggaagcaaagucauaucuauu

SEQ ID NO: 1341538 - RNA, 19 nt, Human
ggcuugaaaaguacaggug

SEQ ID NO: 1341539 - RNA, 22 nt, Human
uaaaaaguaaaaucacaaauua

SEQ ID NO: 1341540 - RNA, 18 nt, Human
uaaaaucacaaauuaguc

SEQ ID NO: 1341541 - RNA, 20 nt, Human
ucagaagcauaagaagauug

SEQ ID NO: 1341542 - RNA, 20 nt, Human
ucuuugauuauucagaagca

SEQ ID NO: 1341543 - RNA, 21 nt, Human
ugaaaaguacaggugcucuuu

SEQ ID NO: 1341544 - RNA, 21 nt, Human
agaagcugaaguccucaagug

SEQ ID NO: 1341545 - RNA, 18 nt, Human
cccccgagaaugugacau

SEQ ID NO: 1341546 - RNA, 25 nt, Human
ccgaaaugacggcggccuucgccaa

SEQ ID NO: 1341547 - RNA, 24 nt, Human
ccuaaacuuuauuaaagaaaaaag

SEQ ID NO: 1341548 - RNA, 21 nt, Human
cgcaggcaccggcgacgcggc

SEQ ID NO: 1341549 - RNA, 19 nt, Human
cgggagagaagaagcgagg

SEQ ID NO: 1341550 - RNA, 22 nt, Human
gcaggcaccggcgacgcggcga

SEQ ID NO: 1341551 - RNA, 26 nt, Human
uaaacuuuauuaaagaaaaaagcaau

SEQ ID NO: 1341552 - RNA, 22 nt, Human
uaaaucucuagaacauacccaa

SEQ ID NO: 1341553 - RNA, 22 nt, Human
uaagcaauggugguaaaucucu

SEQ ID NO: 1341554 - RNA, 21 nt, Human
ucuagaacauacccaauuuuc

SEQ ID NO: 1341555 - RNA, 21 nt, Human
ucucuagaacauacccaauuu

SEQ ID NO: 1341556 - RNA, 22 nt, Human
ucugggcuuccucccccgagaa

SEQ ID NO: 1341557 - RNA, 18 nt, Human
aaggaaaaaaagguggua

SEQ ID NO: 1341558 - RNA, 19 nt, Human
aauuaaaaaggaaaaaaag

SEQ ID NO: 1341559 - RNA, 24 nt, Human
agauacugaaauuccuccggagcu

SEQ ID NO: 1341560 - RNA, 20 nt, Human
auacugaaauuccuccggaa

SEQ ID NO: 1341561 - RNA, 21 nt, Human
ccuccggagcucgcucggcuu

SEQ ID NO: 1341562 - RNA, 21 nt, Human
cuacuaaauugccggccgcgu

SEQ ID NO: 1341563 - RNA, 20 nt, Human
gaaauuccuccggagcucgc

SEQ ID NO: 1341564 - RNA, 26 nt, Human
gcaggucauuuugaaccucaaauaag

SEQ ID NO: 1341565 - RNA, 21 nt, Human
gcugacguagcagcccccuuc

SEQ ID NO: 1341566 - RNA, 24 nt, Human
ggauuuaguccaaaugaaaaugua

SEQ ID NO: 1341567 - RNA, 19 nt, Human
gguaaaaccgagccugagg

SEQ ID NO: 1341568 - RNA, 22 nt, Human
uagaugcaggacaucaacaucc

SEQ ID NO: 1341569 - RNA, 19 nt, Human
uaucaaaguuucaagcagg

SEQ ID NO: 1341570 - RNA, 20 nt, Human
uaucaaaguuucaagcaggu

SEQ ID NO: 1341571 - RNA, 20 nt, Human
ucaagcaggucauuuugaac

SEQ ID NO: 1341572 - RNA, 23 nt, Human
ucacaauauuuaguauuaauuaa

SEQ ID NO: 1341573 - RNA, 19 nt, Human
uccaaaugaaaauguagaa

SEQ ID NO: 1341574 - RNA, 18 nt, Human
uuccaauauguaucaaag

SEQ ID NO: 1341575 - RNA, 24 nt, Human
uugccggccgcgucgacuuuuuuu

SEQ ID NO: 1341576 - RNA, 18 nt, Human
aacagcaccccuaccggu

SEQ ID NO: 1341577 - RNA, 24 nt, Human
cuaaccgcaaccgccuccucccca

SEQ ID NO: 1341578 - RNA, 20 nt, Human
aaccacaaacagaauggaga

SEQ ID NO: 1341579 - RNA, 23 nt, Human
aacuauucccaaagccucuucca

SEQ ID NO: 1341580 - RNA, 18 nt, Human
aagaaggaauggaagaaa

SEQ ID NO: 1341581 - RNA, 21 nt, Human
aagaaggaauggaagaaaaca

SEQ ID NO: 1341582 - RNA, 19 nt, Human
aagagccaggaacagugag

SEQ ID NO: 1341583 - RNA, 20 nt, Human
aagcaccucucucagcgacc

SEQ ID NO: 1341584 - RNA, 25 nt, Human
aaucccuacccauccccgcccccac

SEQ ID NO: 1341585 - RNA, 19 nt, Human
acaaaccaggcaacgaucc

SEQ ID NO: 1341586 - RNA, 21 nt, Human
acagccuagaggcccaaguca

SEQ ID NO: 1341587 - RNA, 18 nt, Human
accaggcaacgaucccac

SEQ ID NO: 1341588 - RNA, 25 nt, Human
acccugagagcaucgauuggggaac

SEQ ID NO: 1341589 - RNA, 20 nt, Human
agaauucucuuucucucucc

SEQ ID NO: 1341590 - RNA, 22 nt, Human
agagacagccuagaggcccaag

SEQ ID NO: 1341591 - RNA, 20 nt, Human
agcacauucuuucuccuacu

SEQ ID NO: 1341592 - RNA, 20 nt, Human
agcaugugagcauaauccag

SEQ ID NO: 1341593 - RNA, 24 nt, Human
agcgacugcagacccacggcagag

SEQ ID NO: 1341594 - RNA, 21 nt, Human
aggacagggcaguaagaagga

SEQ ID NO: 1341595 - RNA, 19 nt, Human
aggcagagagaggguaggu

SEQ ID NO: 1341596 - RNA, 27 nt, Human
aggcccaagucauaaguuccacuccuu

SEQ ID NO: 1341597 - RNA, 18 nt, Human
aggcugaggcagagagag

SEQ ID NO: 1341598 - RNA, 23 nt, Human
aguagaaacuuuucuucccaaga

SEQ ID NO: 1341599 - RNA, 23 nt, Human
aguucugggucaaggggaaagau

SEQ ID NO: 1341600 - RNA, 24 nt, Human
caaaccccaaagguuuuaugaaga

SEQ ID NO: 1341601 - RNA, 27 nt, Human
caaaccccaaagguuuuaugaagaaaa

SEQ ID NO: 1341602 - RNA, 22 nt, Human
cagacccacggcagagaguaaa

SEQ ID NO: 1341603 - RNA, 21 nt, Human
cagcacauucuuucuccuacu

SEQ ID NO: 1341604 - RNA, 23 nt, Human
ccacagguaguaaggguggacag

SEQ ID NO: 1341605 - RNA, 18 nt, Human
ccacugcaguuuugaagc

SEQ ID NO: 1341606 - RNA, 23 nt, Human
ccacugcaguuuugaagcuauau

SEQ ID NO: 1341607 - RNA, 19 nt, Human
ccaggacacagagaagaca

SEQ ID NO: 1341608 - RNA, 18 nt, Human
ccagguagaggcaaaggg

SEQ ID NO: 1341609 - RNA, 20 nt, Human
ccagguagaggcaaagggag

SEQ ID NO: 1341610 - RNA, 18 nt, Human
ccagucuagaaagaaaga

SEQ ID NO: 1341611 - RNA, 28 nt, Human
ccccuugcugggcuguugggaugagggc

SEQ ID NO: 1341612 - RNA, 25 nt, Human
cccgcagcuggugccgacguggagc

SEQ ID NO: 1341613 - RNA, 19 nt, Human
ccuucccuaugaacuauuc

SEQ ID NO: 1341614 - RNA, 22 nt, Human
cucucagcgaccuagagacagg

SEQ ID NO: 1341615 - RNA, 20 nt, Human
cucuuucucucuccccuugc

SEQ ID NO: 1341616 - RNA, 24 nt, Human
gaaacuuuucuucccaagacuaga

SEQ ID NO: 1341617 - RNA, 23 nt, Human
gagcaguuuaugaaggugguuuu

SEQ ID NO: 1341618 - RNA, 18 nt, Human
gaggcagagagaggguag

SEQ ID NO: 1341619 - RNA, 22 nt, Human
ggaaaacacucagcacauucuu

SEQ ID NO: 1341620 - RNA, 19 nt, Human
ggaggaaaacacucagcac

SEQ ID NO: 1341621 - RNA, 20 nt, Human
ggcaguuaguaaguggggca

SEQ ID NO: 1341622 - RNA, 23 nt, Human
ggccagguagaggcaaagggagg

SEQ ID NO: 1341623 - RNA, 19 nt, Human
gggacagagacagccuaga

SEQ ID NO: 1341624 - RNA, 23 nt, Human
ggucaaggggaaagauuagaccc

SEQ ID NO: 1341625 - RNA, 23 nt, Human
gguguaggggagguugagggggc

SEQ ID NO: 1341626 - RNA, 22 nt, Human
guguaggggagguugagggggc

SEQ ID NO: 1341627 - RNA, 23 nt, Human
guuuuuaaaggcauuuuuguggg

SEQ ID NO: 1341628 - RNA, 19 nt, Human
uaaguuccacuccuucccc

SEQ ID NO: 1341629 - RNA, 23 nt, Human
uacccauccccgcccccacucgu

SEQ ID NO: 1341630 - RNA, 19 nt, Human
uagagacagggagagcaca

SEQ ID NO: 1341631 - RNA, 26 nt, Human
uaggaacuggcuuugcuccaggaaag

SEQ ID NO: 1341632 - RNA, 20 nt, Human
uaggaaggguguaggggagg

SEQ ID NO: 1341633 - RNA, 21 nt, Human
uauucccaaagccucuuccaa

SEQ ID NO: 1341634 - RNA, 22 nt, Human
uccaaggcagaggacagggcag

SEQ ID NO: 1341635 - RNA, 22 nt, Human
ucccacagguaguaagggugga

SEQ ID NO: 1341636 - RNA, 22 nt, Human
ucccagaacugcaagaagaaug

SEQ ID NO: 1341637 - RNA, 20 nt, Human
uccccaguucugaguagaac

SEQ ID NO: 1341638 - RNA, 22 nt, Human
uccccgagaugacccugagagc

SEQ ID NO: 1341639 - RNA, 21 nt, Human
uccccugcccuauuaucuaaa

SEQ ID NO: 1341640 - RNA, 18 nt, Human
ucucuccccuugcugggc

SEQ ID NO: 1341641 - RNA, 25 nt, Human
ucugaaguguagcuacagcaaaggg

SEQ ID NO: 1341642 - RNA, 18 nt, Human
ugaaaaagaauaggaagg

SEQ ID NO: 1341643 - RNA, 18 nt, Human
ugaaggugguuuucuccu

SEQ ID NO: 1341644 - RNA, 19 nt, Human
ugaggcagagagaggguag

SEQ ID NO: 1341645 - RNA, 22 nt, Human
ugaggcagagagaggguagguu

SEQ ID NO: 1341646 - RNA, 18 nt, Human
ugcagcgacugcagaccc

SEQ ID NO: 1341647 - RNA, 20 nt, Human
ugcccccuuaaauaugcccc

SEQ ID NO: 1341648 - RNA, 18 nt, Human
ugccccguuaucugcccc

SEQ ID NO: 1341649 - RNA, 21 nt, Human
ugcccuguucaauacaauuua

SEQ ID NO: 1341650 - RNA, 22 nt, Human
ugcuuggguguaaggcugaggc

SEQ ID NO: 1341651 - RNA, 22 nt, Human
uggaagaaaacacugaggucac

SEQ ID NO: 1341652 - RNA, 24 nt, Human
uggacaguuaagguagcuaacuaa

SEQ ID NO: 1341653 - RNA, 21 nt, Human
uggggaggaaguucuggguca

SEQ ID NO: 1341654 - RNA, 19 nt, Human
uggggcagaaugcuuaagu

SEQ ID NO: 1341655 - RNA, 22 nt, Human
uuaaaucgcuguuucuuccaug

SEQ ID NO: 1341656 - RNA, 19 nt, Human
uuaguuuuaggaacuggcu

SEQ ID NO: 1341657 - RNA, 19 nt, Human
uugcugggcuguugggaug

SEQ ID NO: 1341658 - RNA, 24 nt, Human
uugcugggcuguugggaugagggc

SEQ ID NO: 1341659 - RNA, 24 nt, Human
uuuuuguggggaggaaguucuggg

SEQ ID NO: 1341660 - RNA, 25 nt, Human
aacaacgguaacagcccuggcagga

SEQ ID NO: 1341661 - RNA, 20 nt, Human
aaccaccaccgcugauccua

SEQ ID NO: 1341662 - RNA, 22 nt, Human
caggcugaggggucaaaggcca

SEQ ID NO: 1341663 - RNA, 21 nt, Human
gaaccaccaccgcugauccua

SEQ ID NO: 1341664 - RNA, 23 nt, Human
uaacuuuauuacaaaaagcaaaa

SEQ ID NO: 1341665 - RNA, 19 nt, Human
ugauucaagaaaacaacgg

SEQ ID NO: 1341666 - RNA, 24 nt, Human
auuuucaucucaagaacauuuaag

SEQ ID NO: 1341667 - RNA, 21 nt, Human
ccucacucgcgccuucccuuc

SEQ ID NO: 1341668 - RNA, 22 nt, Human
ccucacucgcgccuucccuucu

SEQ ID NO: 1341669 - RNA, 21 nt, Human
ccuccuuuccucacucgcgcc

SEQ ID NO: 1341670 - RNA, 18 nt, Human
ccugggugacaaaguucc

SEQ ID NO: 1341671 - RNA, 22 nt, Human
gcuuuuguuguuagaaucugac

SEQ ID NO: 1341672 - RNA, 22 nt, Human
uccggaucaagaaucacaaagc

SEQ ID NO: 1341673 - RNA, 22 nt, Human
ucucaagaacauuuaaguuggg

SEQ ID NO: 1341674 - RNA, 22 nt, Human
ugggugaagaaauucagcuuuu

SEQ ID NO: 1341675 - RNA, 23 nt, Human
uuccugggugacaaaguuccgga

SEQ ID NO: 1341676 - RNA, 19 nt, Human
aaaagggacaggaccagaa

SEQ ID NO: 1341677 - RNA, 22 nt, Human
aaaccaaauauuccauguucuc

SEQ ID NO: 1341678 - RNA, 22 nt, Human
aaacuuggaaaccaccaagaag

SEQ ID NO: 1341679 - RNA, 21 nt, Human
aaagaagccagucugaaaagg

SEQ ID NO: 1341680 - RNA, 24 nt, Human
aaagagacaaacagaaccuucucc

SEQ ID NO: 1341681 - RNA, 20 nt, Human
aaagcacugggauuauaggc

SEQ ID NO: 1341682 - RNA, 22 nt, Human
aaagcacugggauuauaggcau

SEQ ID NO: 1341683 - RNA, 23 nt, Human
aaagcacugggauuauaggcaug

SEQ ID NO: 1341684 - RNA, 24 nt, Human
aaagcacugggauuauaggcauga

SEQ ID NO: 1341685 - RNA, 23 nt, Human
aagaagccagucugaaaaggcua

SEQ ID NO: 1341686 - RNA, 24 nt, Human
aagcccauacaauguacaacacca

SEQ ID NO: 1341687 - RNA, 20 nt, Human
aagugcuucaugagcagaug

SEQ ID NO: 1341688 - RNA, 24 nt, Human
aaucuacaauggggccaagugcua

SEQ ID NO: 1341689 - RNA, 19 nt, Human
acaagacaaccagcucgaa

SEQ ID NO: 1341690 - RNA, 24 nt, Human
acaguaaaaagugguugccaaaag

SEQ ID NO: 1341691 - RNA, 21 nt, Human
acauaaaauggcagcucuuga

SEQ ID NO: 1341692 - RNA, 21 nt, Human
accgcacccagccaagauugc

SEQ ID NO: 1341693 - RNA, 20 nt, Human
accuauauuuucagaagugc

SEQ ID NO: 1341694 - RNA, 18 nt, Human
agacaggaucuugcuaug

SEQ ID NO: 1341695 - RNA, 21 nt, Human
agagacaggaucuugcuaugu

SEQ ID NO: 1341696 - RNA, 19 nt, Human
agccaugaaaugacaugga

SEQ ID NO: 1341697 - RNA, 22 nt, Human
agcuuccaaaucccauaugccu

SEQ ID NO: 1341698 - RNA, 21 nt, Human
aggcaugaaccaccgcaccca

SEQ ID NO: 1341699 - RNA, 22 nt, Human
agggaagaaagggaugaaccag

SEQ ID NO: 1341700 - RNA, 19 nt, Human
aggguggagggugggaaaa

SEQ ID NO: 1341701 - RNA, 21 nt, Human
agugaaagaagccagucugaa

SEQ ID NO: 1341702 - RNA, 20 nt, Human
auaagaacaaucccuuugcg

SEQ ID NO: 1341703 - RNA, 23 nt, Human
aucugggugcaacuugcaauggg

SEQ ID NO: 1341704 - RNA, 23 nt, Human
augcccauagaaaaaccugcaca

SEQ ID NO: 1341705 - RNA, 19 nt, Human
auguugcccaggcuggucu

SEQ ID NO: 1341706 - RNA, 19 nt, Human
auguugcccaggcuggucu

SEQ ID NO: 1341707 - RNA, 18 nt, Human
caaauauuccauguucuc

SEQ ID NO: 1341708 - RNA, 24 nt, Human
caacagcuuuauucauaauugcca

SEQ ID NO: 1341709 - RNA, 22 nt, Human
caagagagccuccugccucagc

SEQ ID NO: 1341710 - RNA, 23 nt, Human
caagagagccuccugccucagcc

SEQ ID NO: 1341711 - RNA, 19 nt, Human
caauguacaacaccagagu

SEQ ID NO: 1341712 - RNA, 19 nt, Human
cacacccagcaaaugaagc

SEQ ID NO: 1341713 - RNA, 24 nt, Human
caccccaggacauaaugcagccac

SEQ ID NO: 1341714 - RNA, 19 nt, Human
caccgcacccagccaagau

SEQ ID NO: 1341715 - RNA, 24 nt, Human
caccuugaaaguuuacugcacagg

SEQ ID NO: 1341716 - RNA, 23 nt, Human
cacucugaagaugaaaucaagag

SEQ ID NO: 1341717 - RNA, 22 nt, Human
cagagcagaagucacuucugcu

SEQ ID NO: 1341718 - RNA, 19 nt, Human
cagccgacaccuugaaagu

SEQ ID NO: 1341719 - RNA, 21 nt, Human
cagcucgaagcagggacaggc

SEQ ID NO: 1341720 - RNA, 21 nt, Human
caggacaagcagcacaauucc

SEQ ID NO: 1341721 - RNA, 19 nt, Human
caggacauaaugcagccac

SEQ ID NO: 1341722 - RNA, 21 nt, Human
caggaccagaaaaguaacuau

SEQ ID NO: 1341723 - RNA, 24 nt, Human
caggaucuugcuauguugcccagg

SEQ ID NO: 1341724 - RNA, 18 nt, Human
cauacaauguacaacacc

SEQ ID NO: 1341725 - RNA, 21 nt, Human
cauagaaaaaccugcacaaag

SEQ ID NO: 1341726 - RNA, 21 nt, Human
ccaaaacuuggaaaccaccaa

SEQ ID NO: 1341727 - RNA, 20 nt, Human
ccacacccagcaaaugaagc

SEQ ID NO: 1341728 - RNA, 18 nt, Human
ccacaugcacaccccagg

SEQ ID NO: 1341729 - RNA, 19 nt, Human
ccagccaacaggacaagca

SEQ ID NO: 1341730 - RNA, 21 nt, Human
ccagccaacaggacaagcagc

SEQ ID NO: 1341731 - RNA, 23 nt, Human
ccagccaacaggacaagcagcac

SEQ ID NO: 1341732 - RNA, 20 nt, Human
ccagcucgaagcagggacag

SEQ ID NO: 1341733 - RNA, 19 nt, Human
cccacgcacaagacaacca

SEQ ID NO: 1341734 - RNA, 23 nt, Human
cccaucucugauacuucccaaac

SEQ ID NO: 1341735 - RNA, 21 nt, Human
ccccacaauaagauauaucug

SEQ ID NO: 1341736 - RNA, 18 nt, Human
cccuccccacaauaagau

SEQ ID NO: 1341737 - RNA, 24 nt, Human
ccuccugccucagccuuguaaagc

SEQ ID NO: 1341738 - RNA, 19 nt, Human
cuaaauagacccacaugca

SEQ ID NO: 1341739 - RNA, 27 nt, Human
cuaagcccauacaauguacaacaccag

SEQ ID NO: 1341740 - RNA, 20 nt, Human
cucaucugggugcaacuugc

SEQ ID NO: 1341741 - RNA, 23 nt, Human
cugcugaaaugauuuauaaaugu

SEQ ID NO: 1341742 - RNA, 21 nt, Human
cuucccaaacugagcuguuuu

SEQ ID NO: 1341743 - RNA, 19 nt, Human
cuucugcugagcuuccaaa

SEQ ID NO: 1341744 - RNA, 20 nt, Human
cuuggaccagaggaucuggg

SEQ ID NO: 1341745 - RNA, 23 nt, Human
gaaaagggacaggaccagaaaag

SEQ ID NO: 1341746 - RNA, 19 nt, Human
gacacauaaaauggcagcu

SEQ ID NO: 1341747 - RNA, 24 nt, Human
gacaguggcugggcuuuuuucccc

SEQ ID NO: 1341748 - RNA, 21 nt, Human
gaguuuaccugcacauguacc

SEQ ID NO: 1341749 - RNA, 23 nt, Human
gauuauaggcaugaaccaccgca

SEQ ID NO: 1341750 - RNA, 21 nt, Human
gcacacccagcgggguaggca

SEQ ID NO: 1341751 - RNA, 18 nt, Human
gcacugaagcucuuggua

SEQ ID NO: 1341752 - RNA, 19 nt, Human
gcacugggauuauaggcau

SEQ ID NO: 1341753 - RNA, 22 nt, Human
gccaaaacuuggaaaccaccaa

SEQ ID NO: 1341754 - RNA, 22 nt, Human
ggagagacaggaucuugcuaug

SEQ ID NO: 1341755 - RNA, 21 nt, Human
ggcaaugagaggugaaagaga

SEQ ID NO: 1341756 - RNA, 22 nt, Human
ggcuggucuugaacuccuauuc

SEQ ID NO: 1341757 - RNA, 21 nt, Human
gggagguuuuaggccagugaa

SEQ ID NO: 1341758 - RNA, 21 nt, Human
gggccucuggacucaaaaaug

SEQ ID NO: 1341759 - RNA, 23 nt, Human
guaaacucucaacacauacaaag

SEQ ID NO: 1341760 - RNA, 24 nt, Human
guaaagcacugggauuauaggcau

SEQ ID NO: 1341761 - RNA, 20 nt, Human
guuaagccuuggggagguuu

SEQ ID NO: 1341762 - RNA, 19 nt, Human
uaaaauucauuuauauagu

SEQ ID NO: 1341763 - RNA, 22 nt, Human
uaaauagacccacaugcacacc

SEQ ID NO: 1341764 - RNA, 23 nt, Human
uaaaugcacuauuaagccaugaa

SEQ ID NO: 1341765 - RNA, 22 nt, Human
uaaucuguauaacaaacccccu

SEQ ID NO: 1341766 - RNA, 23 nt, Human
uacaauggggccaagugcuaaag

SEQ ID NO: 1341767 - RNA, 18 nt, Human
uacaauguacaacaccag

SEQ ID NO: 1341768 - RNA, 19 nt, Human
uaccugaggguggagggug

SEQ ID NO: 1341769 - RNA, 20 nt, Human
uaccugaggguggagggugg

SEQ ID NO: 1341770 - RNA, 19 nt, Human
uagaaaaggaagaacuaug

SEQ ID NO: 1341771 - RNA, 23 nt, Human
uagacccacaugcacaccccagg

SEQ ID NO: 1341772 - RNA, 20 nt, Human
uaggcaugaaccaccgcacc

SEQ ID NO: 1341773 - RNA, 20 nt, Human
uauaacaaacccccuuguca

SEQ ID NO: 1341774 - RNA, 21 nt, Human
uauaacaaacccccuugucac

SEQ ID NO: 1341775 - RNA, 21 nt, Human
uaugacauucuagaaaaggaa

SEQ ID NO: 1341776 - RNA, 19 nt, Human
uauguugcccaggcugguc

SEQ ID NO: 1341777 - RNA, 20 nt, Human
uauguugcccaggcuggucu

SEQ ID NO: 1341778 - RNA, 23 nt, Human
uauguugcccaggcuggucuuga

SEQ ID NO: 1341779 - RNA, 24 nt, Human
uauguugcccaggcuggucuugaa

SEQ ID NO: 1341780 - RNA, 21 nt, Human
ucccaaacugagcuguuuucc

SEQ ID NO: 1341781 - RNA, 25 nt, Human
uccuuugcaggaacauggauggggc

SEQ ID NO: 1341782 - RNA, 26 nt, Human
ucuacaauggggccaagugcuaaagc

SEQ ID NO: 1341783 - RNA, 20 nt, Human
ucuguauaacaaacccccuu

SEQ ID NO: 1341784 - RNA, 18 nt, Human
ucuugcuauguugcccag

SEQ ID NO: 1341785 - RNA, 19 nt, Human
ucuugcuauguugcccagg

SEQ ID NO: 1341786 - RNA, 23 nt, Human
ucuugcuauguugcccaggcugg

SEQ ID NO: 1341787 - RNA, 24 nt, Human
ucuugcuauguugcccaggcuggu

SEQ ID NO: 1341788 - RNA, 21 nt, Human
ugaaaagagacaaacagaacc

SEQ ID NO: 1341789 - RNA, 22 nt, Human
ugaaagaagccagucugaaaag

SEQ ID NO: 1341790 - RNA, 19 nt, Human
ugaauuaaaaacaugccca

SEQ ID NO: 1341791 - RNA, 23 nt, Human
ugacauucuagaaaaggaagaac

SEQ ID NO: 1341792 - RNA, 18 nt, Human
ugaugcaugaccacaccu

SEQ ID NO: 1341793 - RNA, 22 nt, Human
ugcacauguacccccugaaccu

SEQ ID NO: 1341794 - RNA, 24 nt, Human
ugcccaggcuggucuugaacuccu

SEQ ID NO: 1341795 - RNA, 27 nt, Human
ugcuauguugcccaggcuggucuugaa

SEQ ID NO: 1341796 - RNA, 25 nt, Human
uggaaaccaccaagaagucuuucaa

SEQ ID NO: 1341797 - RNA, 24 nt, Human
uggagagacaggaucuugcuaugu

SEQ ID NO: 1341798 - RNA, 20 nt, Human
uggauggggcuggaggccau

SEQ ID NO: 1341799 - RNA, 18 nt, Human
uggauuucuuuccccucc

SEQ ID NO: 1341800 - RNA, 23 nt, Human
ugggaaggaagggacagaagcuc

SEQ ID NO: 1341801 - RNA, 20 nt, Human
ugggagugaaauaacaugga

SEQ ID NO: 1341802 - RNA, 21 nt, Human
ugggauuauaggcaugaacca

SEQ ID NO: 1341803 - RNA, 23 nt, Human
ugggauuauaggcaugaaccacc

SEQ ID NO: 1341804 - RNA, 24 nt, Human
ugggauuauaggcaugaaccaccg

SEQ ID NO: 1341805 - RNA, 18 nt, Human
ugggcagagaaugaaaag

SEQ ID NO: 1341806 - RNA, 25 nt, Human
ugucaaagagcucuguaaacucuca

SEQ ID NO: 1341807 - RNA, 24 nt, Human
ugucugugaaagccggggagcagc

SEQ ID NO: 1341808 - RNA, 25 nt, Human
ugugagggcaggggauauaugagaa

SEQ ID NO: 1341809 - RNA, 20 nt, Human
uucauaauugccaaaacuug

SEQ ID NO: 1341810 - RNA, 18 nt, Human
uucauguaaacuauggac

SEQ ID NO: 1341811 - RNA, 23 nt, Human
uuggagagacaggaucuugcuau

SEQ ID NO: 1341812 - RNA, 20 nt, Human
uuuguaaagacuaagaucgc

SEQ ID NO: 1341813 - RNA, 21 nt, Human
uuuuuuggagagacaggaucu

SEQ ID NO: 1341814 - RNA, 28 nt, Human
uuuuuuuuuuuuuuuuuuuuuuuggggg

SEQ ID NO: 1341815 - RNA, 24 nt, Human
aaaaugcccccaggugaggcucuu

SEQ ID NO: 1341816 - RNA, 18 nt, Human
caaaaugcccccagguga

SEQ ID NO: 1341817 - RNA, 21 nt, Human
ccuccacccacaaaaugcccc

SEQ ID NO: 1341818 - RNA, 23 nt, Human
uucaggcagcaaaggccuucucc

SEQ ID NO: 1341819 - RNA, 22 nt, Human
aaacagauguggaauugaagaa

SEQ ID NO: 1341820 - RNA, 23 nt, Human
aaacagauguggaauugaagaau

SEQ ID NO: 1341821 - RNA, 23 nt, Human
aaaguggggggaaaaagggcugg

SEQ ID NO: 1341822 - RNA, 19 nt, Human
aaccacgaguaccucauca

SEQ ID NO: 1341823 - RNA, 25 nt, Human
aacuuguuucuccaacaacauccug

SEQ ID NO: 1341824 - RNA, 22 nt, Human
aaguggggggaaaaagggcugg

SEQ ID NO: 1341825 - RNA, 20 nt, Human
aagugugacggcuuccaugc

SEQ ID NO: 1341826 - RNA, 24 nt, Human
accggucagcauuguuggcugcac

SEQ ID NO: 1341827 - RNA, 18 nt, Human
agagccucacggucuccu

SEQ ID NO: 1341828 - RNA, 18 nt, Human
agagccucacggucuccu

SEQ ID NO: 1341829 - RNA, 20 nt, Human
agggcuuagaggauaagcac

SEQ ID NO: 1341830 - RNA, 22 nt, Human
caagaagggguaaaaagccgug

SEQ ID NO: 1341831 - RNA, 18 nt, Human
cacaucccccagcaagcc

SEQ ID NO: 1341832 - RNA, 25 nt, Human
caccggucagcauuguuggcugcac

SEQ ID NO: 1341833 - RNA, 24 nt, Human
cagcaagccgccugcaccaggccu

SEQ ID NO: 1341834 - RNA, 23 nt, Human
cagcccaagaaaucaggaucaag

SEQ ID NO: 1341835 - RNA, 23 nt, Human
ccagaaccacgaguaccucauca

SEQ ID NO: 1341836 - RNA, 18 nt, Human
ccccagcaagccgccugc

SEQ ID NO: 1341837 - RNA, 21 nt, Human
ccccagcaagccgccugcacc

SEQ ID NO: 1341838 - RNA, 22 nt, Human
cccccagcaagccgccugcacc

SEQ ID NO: 1341839 - RNA, 21 nt, Human
ccugcuguaucuacaccuacc

SEQ ID NO: 1341840 - RNA, 21 nt, Human
cguggaccacauggccacucc

SEQ ID NO: 1341841 - RNA, 20 nt, Human
cucaucacguccugagcgcu

SEQ ID NO: 1341842 - RNA, 25 nt, Human
gagcgcucacaucccccagcaagcc

SEQ ID NO: 1341843 - RNA, 22 nt, Human
gucccggaggagacgccgcggc

SEQ ID NO: 1341844 - RNA, 23 nt, Human
gucccgggaggagacgccgccgg

SEQ ID NO: 1341845 - RNA, 19 nt, Human
uaccucaucacauccugag

SEQ ID NO: 1341846 - RNA, 19 nt, Human
uaccucaucacguccugag

SEQ ID NO: 1341847 - RNA, 24 nt, Human
uauuucucaaaaguggggggaaaa

SEQ ID NO: 1341848 - RNA, 24 nt, Human
ucagaaguguuucuagagcuccag

SEQ ID NO: 1341849 - RNA, 19 nt, Human
ucuagaaacagauguggaa

SEQ ID NO: 1341850 - RNA, 20 nt, Human
ucucaaaaguggggggaaaa

SEQ ID NO: 1341851 - RNA, 24 nt, Human
ucuccaacaacauccugaauccau

SEQ ID NO: 1341852 - RNA, 19 nt, Human
ucuccucgggccccucagc

SEQ ID NO: 1341853 - RNA, 19 nt, Human
ucuccucgggccccucagc

SEQ ID NO: 1341854 - RNA, 19 nt, Human
uggaccacauggccacucc

SEQ ID NO: 1341855 - RNA, 22 nt, Human
uguggaauugaagaauguccca

SEQ ID NO: 1341856 - RNA, 19 nt, Human
uucuccaacaacauccuga

SEQ ID NO: 1341857 - RNA, 22 nt, Human
aaacuggaccacccacacuuug

SEQ ID NO: 1341858 - RNA, 25 nt, Human
aaagaaaacccacaaaaaaccugga

SEQ ID NO: 1341859 - RNA, 25 nt, Human
aacaaagaaaacccacaaaaaaccu

SEQ ID NO: 1341860 - RNA, 22 nt, Human
aacaacaacaacaacaaagaaa

SEQ ID NO: 1341861 - RNA, 24 nt, Human
aagaacagaaagagcugcauuagc

SEQ ID NO: 1341862 - RNA, 19 nt, Human
aagccugacacucaaucuu

SEQ ID NO: 1341863 - RNA, 20 nt, Human
aagcugggcagauggagcca

SEQ ID NO: 1341864 - RNA, 19 nt, Human
aaguaagaacagaaagagc

SEQ ID NO: 1341865 - RNA, 20 nt, Human
acaacaaagaaaacccacaa

SEQ ID NO: 1341866 - RNA, 19 nt, Human
acaacaacaacaaagaaaa

SEQ ID NO: 1341867 - RNA, 18 nt, Human
acaacaacaacaacaaag

SEQ ID NO: 1341868 - RNA, 19 nt, Human
acaacaacaacaacaaaga

SEQ ID NO: 1341869 - RNA, 21 nt, Human
accuuccccaggaccccuguu

SEQ ID NO: 1341870 - RNA, 20 nt, Human
acuggcgucccaggcugaag

SEQ ID NO: 1341871 - RNA, 20 nt, Human
agaccugggaggcagaugga

SEQ ID NO: 1341872 - RNA, 24 nt, Human
agagauggcagcgugggaagcagg

SEQ ID NO: 1341873 - RNA, 22 nt, Human
agcacagagucuaaaaauauua

SEQ ID NO: 1341874 - RNA, 23 nt, Human
agcgugggaagcaggaaggucag

SEQ ID NO: 1341875 - RNA, 24 nt, Human
aggaacucccacugggcacacauc

SEQ ID NO: 1341876 - RNA, 27 nt, Human
aggaagacuuaaaggacgauuugaggg

SEQ ID NO: 1341877 - RNA, 24 nt, Human
aggcugaagccauuugcugcgacc

SEQ ID NO: 1341878 - RNA, 21 nt, Human
agggcagugggugcaggaggc

SEQ ID NO: 1341879 - RNA, 18 nt, Human
auaaaacacuggcguccc

SEQ ID NO: 1341880 - RNA, 18 nt, Human
caaagaaaacccacaaaa

SEQ ID NO: 1341881 - RNA, 20 nt, Human
caacaacaaagaaaacccac

SEQ ID NO: 1341882 - RNA, 24 nt, Human
caacaacaaagaaaacccacaaaa

SEQ ID NO: 1341883 - RNA, 20 nt, Human
caacaacaacaaagaaaacc

SEQ ID NO: 1341884 - RNA, 27 nt, Human
caacaacaacaacaaagaaaacccaca

SEQ ID NO: 1341885 - RNA, 27 nt, Human
caacaacaacaacaaagaaaacccaca

SEQ ID NO: 1341886 - RNA, 24 nt, Human
caagaagauucccaucaguccaaa

SEQ ID NO: 1341887 - RNA, 22 nt, Human
cacacaucuacagaggagugcg

SEQ ID NO: 1341888 - RNA, 24 nt, Human
cacccaaagaggacuuguaauuca

SEQ ID NO: 1341889 - RNA, 20 nt, Human
cacccccuccuacacccaaa

SEQ ID NO: 1341890 - RNA, 23 nt, Human
cacucaauccacucggcaccugg

SEQ ID NO: 1341891 - RNA, 19 nt, Human
cagagugcccggaugcggc

SEQ ID NO: 1341892 - RNA, 21 nt, Human
cagcggccgccguuuguuuuc

SEQ ID NO: 1341893 - RNA, 23 nt, Human
caucaguccaaacuggaccaccc

SEQ ID NO: 1341894 - RNA, 22 nt, Human
caucgguaucauccguuuaaaa

SEQ ID NO: 1341895 - RNA, 20 nt, Human
cauuagccuuuucauaauga

SEQ ID NO: 1341896 - RNA, 24 nt, Human
ccacaaaaaaccuggagaaaauau

SEQ ID NO: 1341897 - RNA, 23 nt, Human
ccacgccacucccgccgcgacca

SEQ ID NO: 1341898 - RNA, 24 nt, Human
cccacccccuccuacacccaaaga

SEQ ID NO: 1341899 - RNA, 26 nt, Human
ccccaggaccccuguucuacaggacc

SEQ ID NO: 1341900 - RNA, 24 nt, Human
ccccgagaccaugcaugaaggccc

SEQ ID NO: 1341901 - RNA, 25 nt, Human
ccccugcccacccccuccuacaccc

SEQ ID NO: 1341902 - RNA, 20 nt, Human
ccccuguuccuuccuguuuc

SEQ ID NO: 1341903 - RNA, 20 nt, Human
cccgccgcgaccagcagagu

SEQ ID NO: 1341904 - RNA, 27 nt, Human
cccuccuggacuuguccccugcccacc

SEQ ID NO: 1341905 - RNA, 23 nt, Human
cccugcccuggacaccuucccca

SEQ ID NO: 1341906 - RNA, 19 nt, Human
cccugcgccacgccacucc

SEQ ID NO: 1341907 - RNA, 18 nt, Human
cccugggaccccuccugg

SEQ ID NO: 1341908 - RNA, 23 nt, Human
ccucugucacauggcuagaacaa

SEQ ID NO: 1341909 - RNA, 19 nt, Human
ccugacacucaaucuugaa

SEQ ID NO: 1341910 - RNA, 18 nt, Human
ccuggggcuggaaggaac

SEQ ID NO: 1341911 - RNA, 24 nt, Human
cgacacacagcgaacuacauacuu

SEQ ID NO: 1341912 - RNA, 19 nt, Human
cgccaggccagaggaagcu

SEQ ID NO: 1341913 - RNA, 21 nt, Human
cucccacugggcacacaucua

SEQ ID NO: 1341914 - RNA, 23 nt, Human
cugcauuagccuuuucauaauga

SEQ ID NO: 1341915 - RNA, 24 nt, Human
cuggaagggagggaaagucuugga

SEQ ID NO: 1341916 - RNA, 18 nt, Human
gaaaacccacaaaaaacc

SEQ ID NO: 1341917 - RNA, 21 nt, Human
gaccccuguuccuuccuguuu

SEQ ID NO: 1341918 - RNA, 23 nt, Human
gagugcguggcgcagugaggacg

SEQ ID NO: 1341919 - RNA, 20 nt, Human
gcaggaggcaggcaagcugg

SEQ ID NO: 1341920 - RNA, 22 nt, Human
gccacgccacucccgccgcgac

SEQ ID NO: 1341921 - RNA, 25 nt, Human
gcccuggacaccuuccccaggaccc

SEQ ID NO: 1341922 - RNA, 20 nt, Human
gcugcgguccuggggcugga

SEQ ID NO: 1341923 - RNA, 28 nt, Human
gcugcgguccuggggcuggcggcucgcc

SEQ ID NO: 1341924 - RNA, 22 nt, Human
gcugcugcgguccuggggcugg

SEQ ID NO: 1341925 - RNA, 22 nt, Human
ggaagcaggaaggucagggcag

SEQ ID NO: 1341926 - RNA, 23 nt, Human
ggaaggaagacuuaaaggacgau

SEQ ID NO: 1341927 - RNA, 20 nt, Human
ggaagggagggaaagucuug

SEQ ID NO: 1341928 - RNA, 23 nt, Human
ggcguauuuuacugaacuaagag

SEQ ID NO: 1341929 - RNA, 21 nt, Human
ggcuagaacaacaacaacaac

SEQ ID NO: 1341930 - RNA, 30 nt, Human
gggaccccuccuggacuuguccccugcccu

SEQ ID NO: 1341931 - RNA, 21 nt, Human
ggggaaaggguggcacaggaa

SEQ ID NO: 1341932 - RNA, 18 nt, Human
gguccuggggcuggaagg

SEQ ID NO: 1341933 - RNA, 18 nt, Human
gucagggcagugggugca

SEQ ID NO: 1341934 - RNA, 19 nt, Human
gucgggacacccuucccag

SEQ ID NO: 1341935 - RNA, 18 nt, Human
uaaaaagaaugacaagaa

SEQ ID NO: 1341936 - RNA, 21 nt, Human
uaaaacacuggcgucccaggc

SEQ ID NO: 1341937 - RNA, 23 nt, Human
uaaaccuuucccauucaaggcac

SEQ ID NO: 1341938 - RNA, 23 nt, Human
uacugaacuaagagcauaaaaca

SEQ ID NO: 1341939 - RNA, 22 nt, Human
uagaacaacaacaacaacaaag

SEQ ID NO: 1341940 - RNA, 23 nt, Human
uagaacaacaacaacaacaaaga

SEQ ID NO: 1341941 - RNA, 24 nt, Human
uagaacaacaacaacaacaaagaa

SEQ ID NO: 1341942 - RNA, 21 nt, Human
uaugacagcacagagucuaaa

SEQ ID NO: 1341943 - RNA, 22 nt, Human
uaugacagcacagagucuaaaa

SEQ ID NO: 1341944 - RNA, 24 nt, Human
ucaaucuugaauuucgggggcgua

SEQ ID NO: 1341945 - RNA, 19 nt, Human
ucccaucaguccaaacugg

SEQ ID NO: 1341946 - RNA, 22 nt, Human
ucccaucaguccaaacuggacc

SEQ ID NO: 1341947 - RNA, 25 nt, Human
uccccgagaccaugcaugaaggccc

SEQ ID NO: 1341948 - RNA, 20 nt, Human
ugaggggcggggaaagggug

SEQ ID NO: 1341949 - RNA, 22 nt, Human
ugcaugaaggcccugggacccc

SEQ ID NO: 1341950 - RNA, 22 nt, Human
ugcccuggacaccuuccccagg

SEQ ID NO: 1341951 - RNA, 26 nt, Human
ugcggcagcggccgccguuuguuuuc

SEQ ID NO: 1341952 - RNA, 19 nt, Human
ugcugcgguccuggggcug

SEQ ID NO: 1341953 - RNA, 21 nt, Human
uggcacccuggcagagauggc

SEQ ID NO: 1341954 - RNA, 21 nt, Human
uggcagagauggcagcguggg

SEQ ID NO: 1341955 - RNA, 21 nt, Human
uggcccccaaggccagcgccu

SEQ ID NO: 1341956 - RNA, 22 nt, Human
ugggaccccuccuggacuugac

SEQ ID NO: 1341957 - RNA, 20 nt, Human
ugggcagauggagccacagc

SEQ ID NO: 1341958 - RNA, 24 nt, Human
uucaauagaagauuucuguaauga

SEQ ID NO: 1341959 - RNA, 19 nt, Human
uucccaccuuuuauuucca

SEQ ID NO: 1341960 - RNA, 18 nt, Human
uugaaaaaguuggagcau

SEQ ID NO: 1341961 - RNA, 19 nt, Human
uugaaaaaguuggagcauu

SEQ ID NO: 1341962 - RNA, 19 nt, Human
aaaaaaucaugcaagagca

SEQ ID NO: 1341963 - RNA, 19 nt, Human
aggaaagauuugagacuac

SEQ ID NO: 1341964 - RNA, 19 nt, Human
ccguuagcucugggcgccg

SEQ ID NO: 1341965 - RNA, 24 nt, Human
uaaaaaaucaugcaagagcauuuu

SEQ ID NO: 1341966 - RNA, 20 nt, Human
ugcacagaugcaaaaugauc

SEQ ID NO: 1341967 - RNA, 21 nt, Human
uuuuuuuuuuuuuuuuuuugg

SEQ ID NO: 1341968 - RNA, 20 nt, Human
acuguccccagguggacaga

SEQ ID NO: 1341969 - RNA, 18 nt, Human
agaggaggaggaaggggc

SEQ ID NO: 1341970 - RNA, 19 nt, Human
agcagcuuaaauaugaggc

SEQ ID NO: 1341971 - RNA, 21 nt, Human
agcaggaagaggaggaggaag

SEQ ID NO: 1341972 - RNA, 24 nt, Human
aggaggaggaaggggccgcagagc

SEQ ID NO: 1341973 - RNA, 25 nt, Human
agguccagcagggaggggaccagga

SEQ ID NO: 1341974 - RNA, 20 nt, Human
cagcagggaggggaccagga

SEQ ID NO: 1341975 - RNA, 21 nt, Human
cagcccagugggacuaggcag

SEQ ID NO: 1341976 - RNA, 21 nt, Human
ccccuuagacccaggccugag

SEQ ID NO: 1341977 - RNA, 20 nt, Human
gaagaggaggaggaaggggc

SEQ ID NO: 1341978 - RNA, 19 nt, Human
gacuaggcaggaagcucug

SEQ ID NO: 1341979 - RNA, 20 nt, Human
gagcaggaagaggaggagga

SEQ ID NO: 1341980 - RNA, 24 nt, Human
gagcaggaagaggaggaggaaggg

SEQ ID NO: 1341981 - RNA, 21 nt, Human
ggaaggacagaacgacgcagg

SEQ ID NO: 1341982 - RNA, 24 nt, Human
ggaccaggaucucuugcuccacgg

SEQ ID NO: 1341983 - RNA, 18 nt, Human
gggaccaggaucucuugc

SEQ ID NO: 1341984 - RNA, 20 nt, Human
gguccagcagggaggggacc

SEQ ID NO: 1341985 - RNA, 20 nt, Human
uaugaggcaagcagucaggg

SEQ ID NO: 1341986 - RNA, 19 nt, Human
uccccagguggacagaagu

SEQ ID NO: 1341987 - RNA, 19 nt, Human
ucggaaggacagaacgacg

SEQ ID NO: 1341988 - RNA, 18 nt, Human
ugagccucuggcaggggc

SEQ ID NO: 1341989 - RNA, 20 nt, Human
ugccuggggcuggguugggg

SEQ ID NO: 1341990 - RNA, 21 nt, Human
ugccuggggcuggguuggggu

SEQ ID NO: 1341991 - RNA, 22 nt, Human
ugccuggggcuggguugggguc

SEQ ID NO: 1341992 - RNA, 21 nt, Human
ugggucagaggccuggugggc

SEQ ID NO: 1341993 - RNA, 21 nt, Human
uggguggcagguccagcaggg

SEQ ID NO: 1341994 - RNA, 24 nt, Human
uucggaaggacagaacgacgcagg

SEQ ID NO: 1341995 - RNA, 18 nt, Human
uuggagcaggaagaggag

SEQ ID NO: 1341996 - RNA, 20 nt, Human
uuggagcaggaagaggagga

SEQ ID NO: 1341997 - RNA, 19 nt, Human
uuggcagggcggucuuccc

SEQ ID NO: 1341998 - RNA, 24 nt, Human
aaaauucaaccuauacaaaaagga

SEQ ID NO: 1341999 - RNA, 21 nt, Human
agaaaacaaaaauucaaccua

SEQ ID NO: 1342000 - RNA, 21 nt, Human
aggcgguacugcggugggagc

SEQ ID NO: 1342001 - RNA, 25 nt, Human
ccugcaccccccgcgcccccggcca

SEQ ID NO: 1342002 - RNA, 24 nt, Human
gagcagcagccaaguccgcgggaa

SEQ ID NO: 1342003 - RNA, 23 nt, Human
uauacaaaaaggagaaaugcuuc

SEQ ID NO: 1342004 - RNA, 24 nt, Human
ugggagcagcagccaaguccgcgg

SEQ ID NO: 1342005 - RNA, 20 nt, Human
uucaaccuauacaaaaagga

SEQ ID NO: 1342006 - RNA, 23 nt, Human
aaaaaagaaaccaagcuaccaaa

SEQ ID NO: 1342007 - RNA, 24 nt, Human
aaaaagaaaccaagcuaccaaacu

SEQ ID NO: 1342008 - RNA, 19 nt, Human
aaaaccuuguuagcauuuu

SEQ ID NO: 1342009 - RNA, 21 nt, Human
aaaagaaaccaagcuaccaaa

SEQ ID NO: 1342010 - RNA, 22 nt, Human
aaacuaccaccaguggaaucgg

SEQ ID NO: 1342011 - RNA, 22 nt, Human
aaagguuuuuuuuuucaauaaa

SEQ ID NO: 1342012 - RNA, 23 nt, Human
aaggagucaaaauccagugacac

SEQ ID NO: 1342013 - RNA, 20 nt, Human
aaguaucaaaaaguacuacu

SEQ ID NO: 1342014 - RNA, 23 nt, Human
aauguguucauauuacuuucaua

SEQ ID NO: 1342015 - RNA, 21 nt, Human
agaagcacuagcaaacuacca

SEQ ID NO: 1342016 - RNA, 20 nt, Human
agcggugccgacagcaagca

SEQ ID NO: 1342017 - RNA, 18 nt, Human
auaaauacuaaaguauca

SEQ ID NO: 1342018 - RNA, 27 nt, Human
caauucuuaaaaauuaaaaauugaaga

SEQ ID NO: 1342019 - RNA, 21 nt, Human
cagaaugcccauuauauuuuc

SEQ ID NO: 1342020 - RNA, 23 nt, Human
cagcggugccgacagcaagcaga

SEQ ID NO: 1342021 - RNA, 23 nt, Human
cagggaaagaaaacacauauauc

SEQ ID NO: 1342022 - RNA, 26 nt, Human
caucagggaaagaaaacacauauauc

SEQ ID NO: 1342023 - RNA, 20 nt, Human
caucucugucaauucuacca

SEQ ID NO: 1342024 - RNA, 22 nt, Human
ccuaaacaucagggaaagaaaa

SEQ ID NO: 1342025 - RNA, 21 nt, Human
cggugccgacagcaagcagaa

SEQ ID NO: 1342026 - RNA, 21 nt, Human
cuaaacaucagggaaagaaaa

SEQ ID NO: 1342027 - RNA, 21 nt, Human
cucucagugcuagggagcaac

SEQ ID NO: 1342028 - RNA, 20 nt, Human
gauacaaacuuagaguuuau

SEQ ID NO: 1342029 - RNA, 18 nt, Human
uaacuccagcaaagauuu

SEQ ID NO: 1342030 - RNA, 22 nt, Human
uaauaaaaaaaagaaaccaagc

SEQ ID NO: 1342031 - RNA, 22 nt, Human
uacagauguccaaguauguagu

SEQ ID NO: 1342032 - RNA, 23 nt, Human
uagcaaacuaccaccaguggaau

SEQ ID NO: 1342033 - RNA, 21 nt, Human
uaggcaaaaaaaaaagguuuu

SEQ ID NO: 1342034 - RNA, 22 nt, Human
ugacacacucauaaaaacucca

SEQ ID NO: 1342035 - RNA, 18 nt, Human
ugccgacagcaagcagaa

SEQ ID NO: 1342036 - RNA, 20 nt, Human
ugggccaaucuaucaaaacc

SEQ ID NO: 1342037 - RNA, 18 nt, Human
uuagaaauucuccaauuc

SEQ ID NO: 1342038 - RNA, 19 nt, Human
uuagcauuuuugcuuuucu

SEQ ID NO: 1342039 - RNA, 23 nt, Human
uuuaacauuagaaauucuccaau

SEQ ID NO: 1342040 - RNA, 22 nt, Human
uuuuaccuacccacaccucuca

SEQ ID NO: 1342041 - RNA, 20 nt, Human
uuuuucaaauauacugucug

SEQ ID NO: 1342042 - RNA, 18 nt, Human
uuuuuuuuuuuuuuuucg

SEQ ID NO: 1342043 - RNA, 21 nt, Human
uuuuuuuuuuuuuuuuucgau

SEQ ID NO: 1342044 - RNA, 23 nt, Human
aaccagaacagaccgacggcccc

SEQ ID NO: 1342045 - RNA, 18 nt, Human
caaccagaacagaccgac

SEQ ID NO: 1342046 - RNA, 20 nt, Human
caaccagaacagaccgacgg

SEQ ID NO: 1342047 - RNA, 24 nt, Human
caaccagaacagaccgacggcccc

SEQ ID NO: 1342048 - RNA, 23 nt, Human
cacgugacccgccgcuggucacc

SEQ ID NO: 1342049 - RNA, 21 nt, Human
cagaccgacggccccaccaca

SEQ ID NO: 1342050 - RNA, 21 nt, Human
ccaggcaccgcgucacgugac

SEQ ID NO: 1342051 - RNA, 22 nt, Human
cugcccugaaagccccaggcgu

SEQ ID NO: 1342052 - RNA, 19 nt, Human
gaacagaccgacggcccca

SEQ ID NO: 1342053 - RNA, 20 nt, Human
gaccgacggccccaccacag

SEQ ID NO: 1342054 - RNA, 23 nt, Human
gcccugaaagccccaggcguccc

SEQ ID NO: 1342055 - RNA, 21 nt, Human
gugcgcgggcuccucugcgau

SEQ ID NO: 1342056 - RNA, 18 nt, Human
ucgugcgcgggcuccucu

SEQ ID NO: 1342057 - RNA, 24 nt, Human
ugcacagcugccugcccugaaagc

SEQ ID NO: 1342058 - RNA, 20 nt, Human
uuccucucacaagaccuuua

SEQ ID NO: 1342059 - RNA, 18 nt, Human
uuuuuuuuccucucacaa

SEQ ID NO: 1342060 - RNA, 21 nt, Human
uuuuuuuuuccucucacaaga

SEQ ID NO: 1342061 - RNA, 19 nt, Human
aaaaggcaacauggaacac

SEQ ID NO: 1342062 - RNA, 21 nt, Human
aaacagaaacccucuaaaacc

SEQ ID NO: 1342063 - RNA, 27 nt, Human
aaacauggccauaagcaauuuugagga

SEQ ID NO: 1342064 - RNA, 23 nt, Human
aaaccacacacaauuccacaacc

SEQ ID NO: 1342065 - RNA, 22 nt, Human
aacaagaacacuuucuccucac

SEQ ID NO: 1342066 - RNA, 22 nt, Human
aacaccgaccuagaugcagcaa

SEQ ID NO: 1342067 - RNA, 22 nt, Human
aacagaaacccucuaaaaccac

SEQ ID NO: 1342068 - RNA, 20 nt, Human
aacauggugaaacgcugucu

SEQ ID NO: 1342069 - RNA, 21 nt, Human
aacauggugaaacgcugucuc

SEQ ID NO: 1342070 - RNA, 21 nt, Human
aaccaaaucauccaaacugaa

SEQ ID NO: 1342071 - RNA, 21 nt, Human
aaccaaaugaguaacauaaaa

SEQ ID NO: 1342072 - RNA, 23 nt, Human
aaccugacaccaaaugacacuuc

SEQ ID NO: 1342073 - RNA, 22 nt, Human
aacuucuugaacaaaaccuaga

SEQ ID NO: 1342074 - RNA, 20 nt, Human
aacuuggccaggcgcaguga

SEQ ID NO: 1342075 - RNA, 19 nt, Human
aagacaucuugacaagaaa

SEQ ID NO: 1342076 - RNA, 23 nt, Human
aagagugagacuccaucucaaaa

SEQ ID NO: 1342077 - RNA, 24 nt, Human
aaucgcuugaauccaggaggcaga

SEQ ID NO: 1342078 - RNA, 19 nt, Human
aauucaccccauccucccc

SEQ ID NO: 1342079 - RNA, 24 nt, Human
acaaaacagaaaagcaaacuggag

SEQ ID NO: 1342080 - RNA, 23 nt, Human
acaaaaccuagaaguuaaagggc

SEQ ID NO: 1342081 - RNA, 24 nt, Human
acagaauccuuacuuuagcaucga

SEQ ID NO: 1342082 - RNA, 19 nt, Human
acagggcaagggcagcccc

SEQ ID NO: 1342083 - RNA, 24 nt, Human
accccauccuccccaccaucuuaa

SEQ ID NO: 1342084 - RNA, 24 nt, Human
acuacugcacuccagccuggguga

SEQ ID NO: 1342085 - RNA, 25 nt, Human
acuccagccugggugacaagaguga

SEQ ID NO: 1342086 - RNA, 18 nt, Human
acugcacuccagccuggg

SEQ ID NO: 1342087 - RNA, 18 nt, Human
acugcacuccagccuggg

SEQ ID NO: 1342088 - RNA, 19 nt, Human
acugcacuccagccugggu

SEQ ID NO: 1342089 - RNA, 21 nt, Human
acugcacuccagccuggguga

SEQ ID NO: 1342090 - RNA, 22 nt, Human
acugcacuccagccugggugac

SEQ ID NO: 1342091 - RNA, 23 nt, Human
acugcacuccagccugggugaca

SEQ ID NO: 1342092 - RNA, 24 nt, Human
acugcacuccagccugggugacaa

SEQ ID NO: 1342093 - RNA, 25 nt, Human
acugcacuccagccugggugacaag

SEQ ID NO: 1342094 - RNA, 21 nt, Human
agaaagcuaugcuuacaaucc

SEQ ID NO: 1342095 - RNA, 22 nt, Human
agaccauccuagcuaacauggu

SEQ ID NO: 1342096 - RNA, 22 nt, Human
agagguugcagugagcugagau

SEQ ID NO: 1342097 - RNA, 24 nt, Human
agagguugcagugagcugagaucg

SEQ ID NO: 1342098 - RNA, 24 nt, Human
agcacuuugggaggccgaggcagg

SEQ ID NO: 1342099 - RNA, 23 nt, Human
agccgggugugguggcacgugcc

SEQ ID NO: 1342100 - RNA, 25 nt, Human
agccugggugacaagagugagacuc

SEQ ID NO: 1342101 - RNA, 19 nt, Human
agcuaacauggugaaacgc

SEQ ID NO: 1342102 - RNA, 20 nt, Human
aggcagagguugcagugagc

SEQ ID NO: 1342103 - RNA, 24 nt, Human
aggcagagguugcagugagcugag

SEQ ID NO: 1342104 - RNA, 22 nt, Human
aggcagaucacaaggucaggag

SEQ ID NO: 1342105 - RNA, 24 nt, Human
aggcaggcagaucacaaggucagg

SEQ ID NO: 1342106 - RNA, 26 nt, Human
aggcaggcagaucacaaggucaggag

SEQ ID NO: 1342107 - RNA, 24 nt, Human
aggcgcagugacucacgccuguaa

SEQ ID NO: 1342108 - RNA, 24 nt, Human
aggcugggacaggagaaucgcuug

SEQ ID NO: 1342109 - RNA, 23 nt, Human
agguuucacuauaaaauuuuagg

SEQ ID NO: 1342110 - RNA, 24 nt, Human
agugacucacgccuguaaucccag

SEQ ID NO: 1342111 - RNA, 27 nt, Human
aguuucuggaauuuuauuauuuuuaau

SEQ ID NO: 1342112 - RNA, 22 nt, Human
auaaaauguucacaucaacccc

SEQ ID NO: 1342113 - RNA, 20 nt, Human
auaaaucaucacugcccaaa

SEQ ID NO: 1342114 - RNA, 26 nt, Human
auagugauagaaacagcacuugugcc

SEQ ID NO: 1342115 - RNA, 23 nt, Human
aucagaaaaacaaauuggaucuc

SEQ ID NO: 1342116 - RNA, 21 nt, Human
aucauccuuuuucaucaacag

SEQ ID NO: 1342117 - RNA, 24 nt, Human
auccaggaggcagagguugcagug

SEQ ID NO: 1342118 - RNA, 22 nt, Human
auccuccccaccaucuuaaagc

SEQ ID NO: 1342119 - RNA, 24 nt, Human
aucgcacuacugcacuccagccug

SEQ ID NO: 1342120 - RNA, 22 nt, Human
auggaacacagcauacacuaca

SEQ ID NO: 1342121 - RNA, 19 nt, Human
auuacaguaaaaccucauc

SEQ ID NO: 1342122 - RNA, 19 nt, Human
auucaccccauccucccca

SEQ ID NO: 1342123 - RNA, 24 nt, Human
caaaacaucaaauacuucauauag

SEQ ID NO: 1342124 - RNA, 22 nt, Human
caaaagauauucccagauaugc

SEQ ID NO: 1342125 - RNA, 23 nt, Human
caaaagauauucccagauaugcu

SEQ ID NO: 1342126 - RNA, 22 nt, Human
caaacaaaacaucaaauacuuc

SEQ ID NO: 1342127 - RNA, 26 nt, Human
caaaccaaaucauccaaacugaaaga

SEQ ID NO: 1342128 - RNA, 22 nt, Human
caaacugaaagaugaaugauau

SEQ ID NO: 1342129 - RNA, 19 nt, Human
caaauuggaucucuugggu

SEQ ID NO: 1342130 - RNA, 21 nt, Human
caacaauauaaagcagguuuc

SEQ ID NO: 1342131 - RNA, 24 nt, Human
caagaacacuuucuccucacuucc

SEQ ID NO: 1342132 - RNA, 24 nt, Human
caauuacaguaaaaccucauccua

SEQ ID NO: 1342133 - RNA, 19 nt, Human
caauuccaaucaaaguauu

SEQ ID NO: 1342134 - RNA, 19 nt, Human
cacacaauuccacaaccaa

SEQ ID NO: 1342135 - RNA, 19 nt, Human
caccaucuuaaagcugcau

SEQ ID NO: 1342136 - RNA, 23 nt, Human
cacccaacuccccaacuucaugg

SEQ ID NO: 1342137 - RNA, 21 nt, Human
caccccauccuccccaccauc

SEQ ID NO: 1342138 - RNA, 23 nt, Human
caccccauccuccccaccaucuu

SEQ ID NO: 1342139 - RNA, 27 nt, Human
caccccauccuccccaccaucuuaaag

SEQ ID NO: 1342140 - RNA, 24 nt, Human
cacgccuguaaucccagcacuuug

SEQ ID NO: 1342141 - RNA, 23 nt, Human
cacuccagccugggugacaagag

SEQ ID NO: 1342142 - RNA, 24 nt, Human
cacuccagccugggugacaagagu

SEQ ID NO: 1342143 - RNA, 25 nt, Human
cacuccagccugggugacaagagug

SEQ ID NO: 1342144 - RNA, 19 nt, Human
cacucgggaaucaagacag

SEQ ID NO: 1342145 - RNA, 21 nt, Human
cacuucaacagugcaaccugu

SEQ ID NO: 1342146 - RNA, 21 nt, Human
cacuuuuuucccuucccucuu

SEQ ID NO: 1342147 - RNA, 18 nt, Human
cagacuguguauuaagca

SEQ ID NO: 1342148 - RNA, 24 nt, Human
cagcacuuugggaggccgaggcag

SEQ ID NO: 1342149 - RNA, 25 nt, Human
cagcacuuugggaggccgaggcagg

SEQ ID NO: 1342150 - RNA, 22 nt, Human
cagcaucauaaauauuuuacua

SEQ ID NO: 1342151 - RNA, 24 nt, Human
cagcaucauaaauauuuuacuauu

SEQ ID NO: 1342152 - RNA, 24 nt, Human
cagcugcuaccaggacacaaaaca

SEQ ID NO: 1342153 - RNA, 23 nt, Human
caggacacaaaacagaaaagcug

SEQ ID NO: 1342154 - RNA, 22 nt, Human
caggcagaucacaaggucagga

SEQ ID NO: 1342155 - RNA, 24 nt, Human
caguuaaaaaaaaaaaaaaaaaaa

SEQ ID NO: 1342156 - RNA, 23 nt, Human
cauacacuacacugacggcaguu

SEQ ID NO: 1342157 - RNA, 24 nt, Human
cauacugcuaugcauuaaaaucau

SEQ ID NO: 1342158 - RNA, 21 nt, Human
cauauaugcacaucauacaau

SEQ ID NO: 1342159 - RNA, 25 nt, Human
cauccaaacugaaagaugaaugaua

SEQ ID NO: 1342160 - RNA, 20 nt, Human
cauccuccccaccaucuuaa

SEQ ID NO: 1342161 - RNA, 24 nt, Human
cauccuggccgccgcgcccucucc

SEQ ID NO: 1342162 - RNA, 21 nt, Human
caucuaaaaaggcaacaugga

SEQ ID NO: 1342163 - RNA, 22 nt, Human
ccaagaguaaacuuuacccaau

SEQ ID NO: 1342164 - RNA, 18 nt, Human
ccauccuccccaccaucu

SEQ ID NO: 1342165 - RNA, 21 nt, Human
cccgagccggagggaaaaggc

SEQ ID NO: 1342166 - RNA, 19 nt, Human
ccgccgcgcccucuccggc

SEQ ID NO: 1342167 - RNA, 20 nt, Human
ccgccgcgcccucuccggcu

SEQ ID NO: 1342168 - RNA, 20 nt, Human
ccuagcuaacauggugaaac

SEQ ID NO: 1342169 - RNA, 21 nt, Human
ccuagcuaacauggugaaacg

SEQ ID NO: 1342170 - RNA, 21 nt, Human
ccuauagucccagcuaccugg

SEQ ID NO: 1342171 - RNA, 22 nt, Human
ccuauagucccagcuaccuggg

SEQ ID NO: 1342172 - RNA, 23 nt, Human
ccucacuuccuucccaaccucca

SEQ ID NO: 1342173 - RNA, 23 nt, Human
ccugggugacaagagugagacuc

SEQ ID NO: 1342174 - RNA, 18 nt, Human
cgagccggagggaaaagg

SEQ ID NO: 1342175 - RNA, 26 nt, Human
cgaggcaggcagaucacaaggucagg

SEQ ID NO: 1342176 - RNA, 21 nt, Human
cgcacuacugcacuccagccu

SEQ ID NO: 1342177 - RNA, 18 nt, Human
cgccgcgcccucuccggc

SEQ ID NO: 1342178 - RNA, 23 nt, Human
cgccuguaaucccagcacuuugg

SEQ ID NO: 1342179 - RNA, 24 nt, Human
cgccuguaaucccagcacuuuggg

SEQ ID NO: 1342180 - RNA, 19 nt, Human
cgcuugaauccaggaggca

SEQ ID NO: 1342181 - RNA, 18 nt, Human
cgucagcgaaggcggauc

SEQ ID NO: 1342182 - RNA, 21 nt, Human
cuacugaaccaaaggcuguau

SEQ ID NO: 1342183 - RNA, 21 nt, Human
cuacugcacuccagccugggu

SEQ ID NO: 1342184 - RNA, 24 nt, Human
cuacugcacuccagccugggugac

SEQ ID NO: 1342185 - RNA, 22 nt, Human
cucacgccuguaaucccagcac

SEQ ID NO: 1342186 - RNA, 24 nt, Human
cucacgccuguaaucccagcacuu

SEQ ID NO: 1342187 - RNA, 23 nt, Human
cugaaacucacgugcaauauugc

SEQ ID NO: 1342188 - RNA, 19 nt, Human
cuucaaauguaacaagaga

SEQ ID NO: 1342189 - RNA, 22 nt, Human
gaaaaaaagaacugaaacucac

SEQ ID NO: 1342190 - RNA, 19 nt, Human
gaaaagaaaaaccacacag

SEQ ID NO: 1342191 - RNA, 22 nt, Human
gacaggagaaucgcuugaaucc

SEQ ID NO: 1342192 - RNA, 23 nt, Human
gagaaucgcuugaauccaggagg

SEQ ID NO: 1342193 - RNA, 23 nt, Human
gagaucgcacuacugcacuccag

SEQ ID NO: 1342194 - RNA, 21 nt, Human
gaggcagagguugcagugagc

SEQ ID NO: 1342195 - RNA, 18 nt, Human
gaggcugggacaggagaa

SEQ ID NO: 1342196 - RNA, 25 nt, Human
gauaugcuucaugcucuuaugcuuu

SEQ ID NO: 1342197 - RNA, 20 nt, Human
gcacuacugcacuccagccu

SEQ ID NO: 1342198 - RNA, 24 nt, Human
gcuaacauggugaaacgcugucuc

SEQ ID NO: 1342199 - RNA, 22 nt, Human
ggaaagaacggagggcgcgagc

SEQ ID NO: 1342200 - RNA, 23 nt, Human
ggacaggagaaucgcuugaaucc

SEQ ID NO: 1342201 - RNA, 21 nt, Human
ggcacgugccuauagucccag

SEQ ID NO: 1342202 - RNA, 21 nt, Human
ggccaggcgcagugacucacg

SEQ ID NO: 1342203 - RNA, 19 nt, Human
gggcccggggcgcaagcga

SEQ ID NO: 1342204 - RNA, 19 nt, Human
gggcgcaagcgagacgcuc

SEQ ID NO: 1342205 - RNA, 23 nt, Human
guaagagugaaccccaacccagc

SEQ ID NO: 1342206 - RNA, 18 nt, Human
guaagaguuuccuuccaa

SEQ ID NO: 1342207 - RNA, 19 nt, Human
gucucuacuaaaaauacaa

SEQ ID NO: 1342208 - RNA, 21 nt, Human
gucuuaaaggcaaaagauauu

SEQ ID NO: 1342209 - RNA, 22 nt, Human
guuauaggucaguuuaccuaaa

SEQ ID NO: 1342210 - RNA, 21 nt, Human
guugcagugagcugagaucgc

SEQ ID NO: 1342211 - RNA, 19 nt, Human
uaaaaaggcaacauggaac

SEQ ID NO: 1342212 - RNA, 22 nt, Human
uaaaagauauguaauaaaguaa

SEQ ID NO: 1342213 - RNA, 22 nt, Human
uaaaauagcuauuacuaaagca

SEQ ID NO: 1342214 - RNA, 24 nt, Human
uaaaauagcuauuacuaaagcaaa

SEQ ID NO: 1342215 - RNA, 21 nt, Human
uaaaauguucacaucaacccc

SEQ ID NO: 1342216 - RNA, 22 nt, Human
uaaauucaccccauccucccca

SEQ ID NO: 1342217 - RNA, 22 nt, Human
uaacaagagaaugaagagguga

SEQ ID NO: 1342218 - RNA, 25 nt, Human
uaacauaaaauguucacaucaaccc

SEQ ID NO: 1342219 - RNA, 22 nt, Human
uaacauggugaaacgcugucuc

SEQ ID NO: 1342220 - RNA, 24 nt, Human
uaacauggugaaacgcugucucua

SEQ ID NO: 1342221 - RNA, 22 nt, Human
uaauacauacauuucacaaaca

SEQ ID NO: 1342222 - RNA, 20 nt, Human
uacagcuuugugcauuaaag

SEQ ID NO: 1342223 - RNA, 25 nt, Human
uaccaggacacaaaacagaaaagca

SEQ ID NO: 1342224 - RNA, 23 nt, Human
uacugcacuccagccugggugac

SEQ ID NO: 1342225 - RNA, 24 nt, Human
uacugcacuccagccugggugaca

SEQ ID NO: 1342226 - RNA, 25 nt, Human
uacugcacuccagccugggugacaa

SEQ ID NO: 1342227 - RNA, 21 nt, Human
uagaaaguuaacauuuuagua

SEQ ID NO: 1342228 - RNA, 18 nt, Human
uagccgcacggcccgugc

SEQ ID NO: 1342229 - RNA, 22 nt, Human
uagccgggugugguggcacgug

SEQ ID NO: 1342230 - RNA, 19 nt, Human
uagugauagaaacagcacu

SEQ ID NO: 1342231 - RNA, 21 nt, Human
uauaaaccaaaugaguaacau

SEQ ID NO: 1342232 - RNA, 18 nt, Human
uaucaagcucuuaguuua

SEQ ID NO: 1342233 - RNA, 19 nt, Human
uauccuaacuacaacaaaa

SEQ ID NO: 1342234 - RNA, 21 nt, Human
uauuagugaauaacauugguu

SEQ ID NO: 1342235 - RNA, 24 nt, Human
uauuuuuaauacauacauuucaca

SEQ ID NO: 1342236 - RNA, 20 nt, Human
ucaaauacuucauauagaac

SEQ ID NO: 1342237 - RNA, 22 nt, Human
ucaacagugcaaccuguaauaa

SEQ ID NO: 1342238 - RNA, 18 nt, Human
ucacaaggucaggagauc

SEQ ID NO: 1342239 - RNA, 24 nt, Human
ucacaaggucaggagaucuagacc

SEQ ID NO: 1342240 - RNA, 18 nt, Human
ucacuuccuucccaaccu

SEQ ID NO: 1342241 - RNA, 20 nt, Human
ucacuugucacauauuuuuc

SEQ ID NO: 1342242 - RNA, 22 nt, Human
ucaucagaaaaacaaauuggau

SEQ ID NO: 1342243 - RNA, 21 nt, Human
uccaaaacauacuuuuaaaag

SEQ ID NO: 1342244 - RNA, 26 nt, Human
uccaaaacauacuuuuaaaagaaaua

SEQ ID NO: 1342245 - RNA, 24 nt, Human
uccagccugggugacaagagugag

SEQ ID NO: 1342246 - RNA, 25 nt, Human
uccagccugggugacaagagugaga

SEQ ID NO: 1342247 - RNA, 22 nt, Human
uccaucucaaaaaaaagaaaaa

SEQ ID NO: 1342248 - RNA, 23 nt, Human
uccaucucaaaaaaaagaaaaaa

SEQ ID NO: 1342249 - RNA, 21 nt, Human
ucccaaccuccaaugaaaguu

SEQ ID NO: 1342250 - RNA, 23 nt, Human
ucgcacuacugcacuccagccug

SEQ ID NO: 1342251 - RNA, 22 nt, Human
ucucuacuaaaaauacaaaaaa

SEQ ID NO: 1342252 - RNA, 18 nt, Human
ucuggguacaggagagaa

SEQ ID NO: 1342253 - RNA, 21 nt, Human
ucuguggcugaaagauuuacc

SEQ ID NO: 1342254 - RNA, 18 nt, Human
ugaaaagaaaaaccacac

SEQ ID NO: 1342255 - RNA, 21 nt, Human
ugaaaagaaaaaccacacagu

SEQ ID NO: 1342256 - RNA, 18 nt, Human
ugaacaaaaccuagaagu

SEQ ID NO: 1342257 - RNA, 20 nt, Human
ugaacaaaaccuagaaguua

SEQ ID NO: 1342258 - RNA, 23 nt, Human
ugaaugauauuagugaauaacau

SEQ ID NO: 1342259 - RNA, 23 nt, Human
ugacaagaaaucuuuacugacaa

SEQ ID NO: 1342260 - RNA, 21 nt, Human
ugacucacgccuguaauccca

SEQ ID NO: 1342261 - RNA, 22 nt, Human
ugacucacgccuguaaucccag

SEQ ID NO: 1342262 - RNA, 24 nt, Human
ugacucacgccuguaaucccagca

SEQ ID NO: 1342263 - RNA, 22 nt, Human
ugagcugagaucgcacuacugc

SEQ ID NO: 1342264 - RNA, 22 nt, Human
ugaguaaacugccugcccaugu

SEQ ID NO: 1342265 - RNA, 24 nt, Human
ugcagaacacuaggcugagauaga

SEQ ID NO: 1342266 - RNA, 19 nt, Human
ugcauucuuuuagcauaua

SEQ ID NO: 1342267 - RNA, 23 nt, Human
ugccuauagucccagcuaccugg

SEQ ID NO: 1342268 - RNA, 24 nt, Human
ugccuauagucccagcuaccuggg

SEQ ID NO: 1342269 - RNA, 22 nt, Human
ugccugcccaugugugcugcag

SEQ ID NO: 1342270 - RNA, 20 nt, Human
ugggaggccgaggcaggcag

SEQ ID NO: 1342271 - RNA, 24 nt, Human
ugggaggccgaggcaggcagauca

SEQ ID NO: 1342272 - RNA, 23 nt, Human
ugggaggcugggacaggagaauc

SEQ ID NO: 1342273 - RNA, 19 nt, Human
ugggauaauucacccaacu

SEQ ID NO: 1342274 - RNA, 20 nt, Human
uggguacaggagagaaucaa

SEQ ID NO: 1342275 - RNA, 19 nt, Human
uggugaaacgcugucucua

SEQ ID NO: 1342276 - RNA, 24 nt, Human
ugguggcacgugccuauaguccca

SEQ ID NO: 1342277 - RNA, 18 nt, Human
uuaaggucaguagauuuc

SEQ ID NO: 1342278 - RNA, 19 nt, Human
uuaauacauacauuucaca

SEQ ID NO: 1342279 - RNA, 20 nt, Human
uuagccgggugugguggcac

SEQ ID NO: 1342280 - RNA, 20 nt, Human
uuagccgggugugguggcac

SEQ ID NO: 1342281 - RNA, 24 nt, Human
uuagccgggugugguggcacgugc

SEQ ID NO: 1342282 - RNA, 26 nt, Human
uucacaaacagaaacccucuaaaacc

SEQ ID NO: 1342283 - RNA, 19 nt, Human
uucaggggguagaaagcca

SEQ ID NO: 1342284 - RNA, 19 nt, Human
uucaggggguagaaagcca

SEQ ID NO: 1342285 - RNA, 21 nt, Human
uucaggggguagaaagccauc

SEQ ID NO: 1342286 - RNA, 21 nt, Human
uucauauagaacugaaacuug

SEQ ID NO: 1342287 - RNA, 22 nt, Human
uucauaugucuuacaauuugga

SEQ ID NO: 1342288 - RNA, 19 nt, Human
uucuaaauucaggagcuug

SEQ ID NO: 1342289 - RNA, 18 nt, Human
uucugccuucuugcauua

SEQ ID NO: 1342290 - RNA, 18 nt, Human
uugcagugagcugagauc

SEQ ID NO: 1342291 - RNA, 19 nt, Human
uugcagugagcugagaucg

SEQ ID NO: 1342292 - RNA, 22 nt, Human
uugcagugagcugagaucgcac

SEQ ID NO: 1342293 - RNA, 25 nt, Human
uugggaggccgaggcaggcagauca

SEQ ID NO: 1342294 - RNA, 18 nt, Human
uugggguauuaaggucag

SEQ ID NO: 1342295 - RNA, 24 nt, Human
uuuagcauauaugcacaucauaca

SEQ ID NO: 1342296 - RNA, 18 nt, Human
uuuaugcauuucuuccca

SEQ ID NO: 1342297 - RNA, 21 nt, Human
uuucucuuuaaguaacaucca

SEQ ID NO: 1342298 - RNA, 21 nt, Human
aaaguugccucuccuccaccu

SEQ ID NO: 1342299 - RNA, 21 nt, Human
aagguacauggcaaggcacuu

SEQ ID NO: 1342300 - RNA, 21 nt, Human
acagggaaaguugccucuccu

SEQ ID NO: 1342301 - RNA, 24 nt, Human
acggagaaagauacugaaauggag

SEQ ID NO: 1342302 - RNA, 23 nt, Human
acucugaaacagaugaaaaggga

SEQ ID NO: 1342303 - RNA, 23 nt, Human
agccccuugagcccuuuuuguua

SEQ ID NO: 1342304 - RNA, 21 nt, Human
aggaggccccagcagccaguc

SEQ ID NO: 1342305 - RNA, 21 nt, Human
caacacgagcacagugacccc

SEQ ID NO: 1342306 - RNA, 23 nt, Human
cacacccaaaagaggagaaccag

SEQ ID NO: 1342307 - RNA, 18 nt, Human
cacagugaccccagugac

SEQ ID NO: 1342308 - RNA, 22 nt, Human
caggagcagggacgggucccua

SEQ ID NO: 1342309 - RNA, 21 nt, Human
caugcaaauuugcugagcaca

SEQ ID NO: 1342310 - RNA, 24 nt, Human
cauggcaaggcacuuuugaaaaca

SEQ ID NO: 1342311 - RNA, 25 nt, Human
cauggcaaggcacuuuugaaaacau

SEQ ID NO: 1342312 - RNA, 22 nt, Human
ccacacccaaaagaggagaacc

SEQ ID NO: 1342313 - RNA, 19 nt, Human
ccacggagaaagauacuga

SEQ ID NO: 1342314 - RNA, 18 nt, Human
cccagugacggugauggu

SEQ ID NO: 1342315 - RNA, 19 nt, Human
ccccagugacggugauggu

SEQ ID NO: 1342316 - RNA, 23 nt, Human
ccgcccugcuccucucccaacuc

SEQ ID NO: 1342317 - RNA, 18 nt, Human
cgcccugcuccucuccca

SEQ ID NO: 1342318 - RNA, 18 nt, Human
gaaauggagcucuugcca

SEQ ID NO: 1342319 - RNA, 25 nt, Human
gccccagcagccagucuccagcccc

SEQ ID NO: 1342320 - RNA, 18 nt, Human
gcccugcuccucucccaa

SEQ ID NO: 1342321 - RNA, 22 nt, Human
gcccugcuccucucccaacuca

SEQ ID NO: 1342322 - RNA, 20 nt, Human
ggagcagggacgggucccua

SEQ ID NO: 1342323 - RNA, 26 nt, Human
ucccuacaaggccgcccugcuccucu

SEQ ID NO: 1342324 - RNA, 18 nt, Human
uuaggcccacacccaaaa

SEQ ID NO: 1342325 - RNA, 18 nt, Human
uuuuuuuugcuuuguacu

SEQ ID NO: 1342326 - RNA, 19 nt, Human
aaaacaaaacauaaaaccc

SEQ ID NO: 1342327 - RNA, 20 nt, Human
aaaacaaaacauaaaacccc

SEQ ID NO: 1342328 - RNA, 21 nt, Human
aaaagcacaaccacuuuacaa

SEQ ID NO: 1342329 - RNA, 24 nt, Human
aaaagucuaguaacauuucuaaau

SEQ ID NO: 1342330 - RNA, 23 nt, Human
aaacaaaacauaaaaccccaaac

SEQ ID NO: 1342331 - RNA, 25 nt, Human
aaacaaaaguuuagucucuccuagu

SEQ ID NO: 1342332 - RNA, 28 nt, Human
aaagaaaaacaaaacauaaaaccccaaa

SEQ ID NO: 1342333 - RNA, 20 nt, Human
aaccacucacuccaccucag

SEQ ID NO: 1342334 - RNA, 24 nt, Human
aagaaagagcagaaaaacuucuaa

SEQ ID NO: 1342335 - RNA, 23 nt, Human
accacuuuacaagauuaaaaguc

SEQ ID NO: 1342336 - RNA, 26 nt, Human
agaaaaacaaaacauaaaaccccaaa

SEQ ID NO: 1342337 - RNA, 24 nt, Human
agaaaagaaaaacaaaacauaaaa

SEQ ID NO: 1342338 - RNA, 21 nt, Human
auuaaauauauauauauauau

SEQ ID NO: 1342339 - RNA, 23 nt, Human
auucaaaauaaaugcccuuugau

SEQ ID NO: 1342340 - RNA, 24 nt, Human
auugcaaaucccagacuccagugg

SEQ ID NO: 1342341 - RNA, 21 nt, Human
caaaauuucacagaccuaaaa

SEQ ID NO: 1342342 - RNA, 23 nt, Human
cacaaaauuucacagaccuaaaa

SEQ ID NO: 1342343 - RNA, 21 nt, Human
cacagaccuaaaaugugcaag

SEQ ID NO: 1342344 - RNA, 26 nt, Human
cacuucauuuuagaaaagaaaaacaa

SEQ ID NO: 1342345 - RNA, 27 nt, Human
caggaaaagucucacaaaauuucacag

SEQ ID NO: 1342346 - RNA, 22 nt, Human
cauaaaaccccaaacucccaaa

SEQ ID NO: 1342347 - RNA, 21 nt, Human
ccaccucaaaaaacauagagc

SEQ ID NO: 1342348 - RNA, 23 nt, Human
ccacucacuccaccucaaaaaac

SEQ ID NO: 1342349 - RNA, 21 nt, Human
ccauuuaaaaaugaagaaaaa

SEQ ID NO: 1342350 - RNA, 19 nt, Human
cccagacuccaguggaaag

SEQ ID NO: 1342351 - RNA, 27 nt, Human
ccccaggugcagccacgaucagcucac

SEQ ID NO: 1342352 - RNA, 23 nt, Human
cccuacccuccccccaggugcag

SEQ ID NO: 1342353 - RNA, 22 nt, Human
ccuccucccuacccucccccca

SEQ ID NO: 1342354 - RNA, 22 nt, Human
cuaaauauuauucauaucauac

SEQ ID NO: 1342355 - RNA, 20 nt, Human
cucacuccaccucaaaaaac

SEQ ID NO: 1342356 - RNA, 19 nt, Human
cuccucccuacccuccccc

SEQ ID NO: 1342357 - RNA, 26 nt, Human
cuguccuuuguguuugugugugugug

SEQ ID NO: 1342358 - RNA, 27 nt, Human
cuuuuguucugaggugagccauaacag

SEQ ID NO: 1342359 - RNA, 22 nt, Human
gaaaaaccacucacuccaccuc

SEQ ID NO: 1342360 - RNA, 18 nt, Human
uaaaaccccaaacuccca

SEQ ID NO: 1342361 - RNA, 19 nt, Human
uaaaaccccaaacucccaa

SEQ ID NO: 1342362 - RNA, 18 nt, Human
uaaaauuacaguacaagc

SEQ ID NO: 1342363 - RNA, 23 nt, Human
uaaccuccagaauugcaaauccc

SEQ ID NO: 1342364 - RNA, 27 nt, Human
uaagaaagagcagaaaaacuucuaaua

SEQ ID NO: 1342365 - RNA, 21 nt, Human
uacacacaugaaagaugcaug

SEQ ID NO: 1342366 - RNA, 21 nt, Human
uacccuccccccaggugcagc

SEQ ID NO: 1342367 - RNA, 23 nt, Human
uagaaaaccccaaaucuuuagga

SEQ ID NO: 1342368 - RNA, 19 nt, Human
uagacagcacacaucacca

SEQ ID NO: 1342369 - RNA, 24 nt, Human
uagguggcaugccccuccucccua

SEQ ID NO: 1342370 - RNA, 22 nt, Human
uaguuuuagaaaaccccaaauc

SEQ ID NO: 1342371 - RNA, 21 nt, Human
uauuauuuuuuuacuguccag

SEQ ID NO: 1342372 - RNA, 25 nt, Human
uauuuacacacaugaaagaugcaug

SEQ ID NO: 1342373 - RNA, 21 nt, Human
ucaaauaucaaaauguaugac

SEQ ID NO: 1342374 - RNA, 22 nt, Human
ucccuacccuccccccaggugc

SEQ ID NO: 1342375 - RNA, 23 nt, Human
ucugaggugagccauaacagcug

SEQ ID NO: 1342376 - RNA, 24 nt, Human
ucuugguguuuaauuuucggguga

SEQ ID NO: 1342377 - RNA, 24 nt, Human
ucuuuuguucugaggugagccaua

SEQ ID NO: 1342378 - RNA, 20 nt, Human
ugaaauuagcccagaaauga

SEQ ID NO: 1342379 - RNA, 18 nt, Human
ugaagaaaaaccacucac

SEQ ID NO: 1342380 - RNA, 22 nt, Human
ugccaaacggaaaaaaaaggga

SEQ ID NO: 1342381 - RNA, 23 nt, Human
ugccaaacggaaaaaaaagggaa

SEQ ID NO: 1342382 - RNA, 21 nt, Human
ugccccuccucccuacccucc

SEQ ID NO: 1342383 - RNA, 22 nt, Human
uggcaugccccuccucccuacc

SEQ ID NO: 1342384 - RNA, 23 nt, Human
uggccauuuaaaaaugaagaaaa

SEQ ID NO: 1342385 - RNA, 23 nt, Human
uggguugccaaacggaaaaaaaa

SEQ ID NO: 1342386 - RNA, 20 nt, Human
uguaagaaagagcagaaaaa

SEQ ID NO: 1342387 - RNA, 18 nt, Human
ugugugugugugugugug

SEQ ID NO: 1342388 - RNA, 18 nt, Human
ugugugugugugugugug

SEQ ID NO: 1342389 - RNA, 18 nt, Human
ugugugugugugugugug

SEQ ID NO: 1342390 - RNA, 18 nt, Human
ugugugugugugugugug

SEQ ID NO: 1342391 - RNA, 18 nt, Human
ugugugugugugugugug

SEQ ID NO: 1342392 - RNA, 18 nt, Human
ugugugugugugugugug

SEQ ID NO: 1342393 - RNA, 18 nt, Human
ugugugugugugugugug

SEQ ID NO: 1342394 - RNA, 21 nt, Human
ugugugugugugugugugugu

SEQ ID NO: 1342395 - RNA, 21 nt, Human
ugugugugugugugugugugu

SEQ ID NO: 1342396 - RNA, 21 nt, Human
ugugugugugugugugugugu

SEQ ID NO: 1342397 - RNA, 21 nt, Human
ugugugugugugugugugugu

SEQ ID NO: 1342398 - RNA, 21 nt, Human
ugugugugugugugugugugu

SEQ ID NO: 1342399 - RNA, 21 nt, Human
ugugugugugugugugugugu

SEQ ID NO: 1342400 - RNA, 21 nt, Human
ugugugugugugugugugugu

SEQ ID NO: 1342401 - RNA, 21 nt, Human
ugugugugugugugugugugu

SEQ ID NO: 1342402 - RNA, 21 nt, Human
ugugugugugugugugugugu

SEQ ID NO: 1342403 - RNA, 21 nt, Human
ugugugugugugugugugugu

SEQ ID NO: 1342404 - RNA, 21 nt, Human
ugugugugugugugugugugu

SEQ ID NO: 1342405 - RNA, 21 nt, Human
ugugugugugugugugugugu

SEQ ID NO: 1342406 - RNA, 22 nt, Human
ugugugugugugugugugugug

SEQ ID NO: 1342407 - RNA, 22 nt, Human
ugugugugugugugugugugug

SEQ ID NO: 1342408 - RNA, 22 nt, Human
ugugugugugugugugugugug

SEQ ID NO: 1342409 - RNA, 22 nt, Human
ugugugugugugugugugugug

SEQ ID NO: 1342410 - RNA, 22 nt, Human
ugugugugugugugugugugug

SEQ ID NO: 1342411 - RNA, 23 nt, Human
uuaguuuuagaaaaccccaaauc

SEQ ID NO: 1342412 - RNA, 22 nt, Human
uuccuagauucuuuaguuuuag

SEQ ID NO: 1342413 - RNA, 19 nt, Human
uugcguuggcucuugcgcc

SEQ ID NO: 1342414 - RNA, 24 nt, Human
uuugugugugugugugugugugug

SEQ ID NO: 1342415 - RNA, 28 nt, Human
uuuguguuugugugugugugugugugug

SEQ ID NO: 1342416 - RNA, 25 nt, Human
uuuguucugaggugagccauaacag

SEQ ID NO: 1342417 - RNA, 20 nt, Human
aacaauaaauacuaacagua

SEQ ID NO: 1342418 - RNA, 20 nt, Human
aagcaggaauaaaauacuua

SEQ ID NO: 1342419 - RNA, 22 nt, Human
aagucaugccuaucagcgagcc

SEQ ID NO: 1342420 - RNA, 20 nt, Human
aauuauugcaugucagcugg

SEQ ID NO: 1342421 - RNA, 22 nt, Human
acaaauucuccuccuaaaauuc

SEQ ID NO: 1342422 - RNA, 21 nt, Human
auagugguaaacaauaaauac

SEQ ID NO: 1342423 - RNA, 22 nt, Human
cagcgagcccaccuccugggcu

SEQ ID NO: 1342424 - RNA, 24 nt, Human
caggcagggacaauucccucccag

SEQ ID NO: 1342425 - RNA, 19 nt, Human
ccagaagcaggcagggaca

SEQ ID NO: 1342426 - RNA, 24 nt, Human
ccguagauggugucaauaucuucu

SEQ ID NO: 1342427 - RNA, 22 nt, Human
ccuaucagcgagcccaccuccu

SEQ ID NO: 1342428 - RNA, 21 nt, Human
ccucccagccuggcagggccu

SEQ ID NO: 1342429 - RNA, 24 nt, Human
ccuccuaaaauuccuuuuccuagg

SEQ ID NO: 1342430 - RNA, 19 nt, Human
cgaaagcaggaauaaaaua

SEQ ID NO: 1342431 - RNA, 20 nt, Human
cgaaagcaggaauaaaauac

SEQ ID NO: 1342432 - RNA, 23 nt, Human
cucccagccuggcagggccuuau

SEQ ID NO: 1342433 - RNA, 21 nt, Human
cugcucacaaauucuccuccu

SEQ ID NO: 1342434 - RNA, 18 nt, Human
gucagcuggacaucacuu

SEQ ID NO: 1342435 - RNA, 25 nt, Human
uaaaaguaacacgaaagcaggaaua

SEQ ID NO: 1342436 - RNA, 21 nt, Human
uaacacgaaagcaggaauaaa

SEQ ID NO: 1342437 - RNA, 19 nt, Human
uagaguauugaguacagua

SEQ ID NO: 1342438 - RNA, 20 nt, Human
uaggaaagucuucauggaua

SEQ ID NO: 1342439 - RNA, 20 nt, Human
uagugguaaacaauaaauac

SEQ ID NO: 1342440 - RNA, 20 nt, Human
uaucuucuuucuccagaagc

SEQ ID NO: 1342441 - RNA, 18 nt, Human
ucauggauaaaaauucuu

SEQ ID NO: 1342442 - RNA, 20 nt, Human
aacugcagcgaacagcacca

SEQ ID NO: 1342443 - RNA, 22 nt, Human
acugcuccaugggccucuccug

SEQ ID NO: 1342444 - RNA, 23 nt, Human
agacacaaagaaggugagaguaa

SEQ ID NO: 1342445 - RNA, 20 nt, Human
agacacacacagaaauauga

SEQ ID NO: 1342446 - RNA, 21 nt, Human
agccccauuuauuugcacagc

SEQ ID NO: 1342447 - RNA, 18 nt, Human
agcgaacagcaccaggga

SEQ ID NO: 1342448 - RNA, 18 nt, Human
aggaggccauccaaggag

SEQ ID NO: 1342449 - RNA, 20 nt, Human
aggaggccauccaaggagug

SEQ ID NO: 1342450 - RNA, 19 nt, Human
caagcguacaugcucccuu

SEQ ID NO: 1342451 - RNA, 19 nt, Human
cagcaccagggaagcugga

SEQ ID NO: 1342452 - RNA, 20 nt, Human
ccaaucuuggaccaagcgua

SEQ ID NO: 1342453 - RNA, 21 nt, Human
ccaugggccucuccuggaccu

SEQ ID NO: 1342454 - RNA, 27 nt, Human
ccucuggaaguaugcuaugcucaacuu

SEQ ID NO: 1342455 - RNA, 26 nt, Human
cuccuuucuugccaucuccauaagaa

SEQ ID NO: 1342456 - RNA, 25 nt, Human
cugaggaaaggaaucuaaggcuuau

SEQ ID NO: 1342457 - RNA, 22 nt, Human
cuguuucccucuagccugggca

SEQ ID NO: 1342458 - RNA, 21 nt, Human
gccaaucuuggaccaagcgua

SEQ ID NO: 1342459 - RNA, 23 nt, Human
gccacaaacagcaguuuucgauu

SEQ ID NO: 1342460 - RNA, 19 nt, Human
gccugggcaggggcugaga

SEQ ID NO: 1342461 - RNA, 24 nt, Human
gcuguuucccucuagccugggcag

SEQ ID NO: 1342462 - RNA, 25 nt, Human
ggguuccugccacaaacagcaguuu

SEQ ID NO: 1342463 - RNA, 21 nt, Human
guaacugaaaaaaccugaaac

SEQ ID NO: 1342464 - RNA, 20 nt, Human
uaacugaaaaaaccugaaac

SEQ ID NO: 1342465 - RNA, 22 nt, Human
uaaguaaaacccauugcacaga

SEQ ID NO: 1342466 - RNA, 20 nt, Human
uaucaaggaacuagccaauc

SEQ ID NO: 1342467 - RNA, 24 nt, Human
ucagccccauuuauuugcacagcc

SEQ ID NO: 1342468 - RNA, 22 nt, Human
uccauaagaccaccucuggaag

SEQ ID NO: 1342469 - RNA, 22 nt, Human
ucccucuagccugggcaggggc

SEQ ID NO: 1342470 - RNA, 23 nt, Human
ucccuuccuucuuacuccaugga

SEQ ID NO: 1342471 - RNA, 21 nt, Human
ucuuccauggcuacaggaauu

SEQ ID NO: 1342472 - RNA, 19 nt, Human
ugaaaaaaccugaaacucu

SEQ ID NO: 1342473 - RNA, 23 nt, Human
ugagagagacacacacagaaaua

SEQ ID NO: 1342474 - RNA, 30 nt, Human
ugagagagacacacacagaaauaugauagu

SEQ ID NO: 1342475 - RNA, 21 nt, Human
ugagaguaagaugcuaucaag

SEQ ID NO: 1342476 - RNA, 22 nt, Human
ugcucccuuccuucuuacucca

SEQ ID NO: 1342477 - RNA, 19 nt, Human
uggaagagacugcuccaug

SEQ ID NO: 1342478 - RNA, 24 nt, Human
uguaacugaaaaaaccugaaacuc

SEQ ID NO: 1342479 - RNA, 21 nt, Human
uuaucaguagcuguuucccuc

SEQ ID NO: 1342480 - RNA, 18 nt, Human
uuccuuucaucacagaca

SEQ ID NO: 1342481 - RNA, 20 nt, Human
uugcacagccagggguuccu

SEQ ID NO: 1342482 - RNA, 23 nt, Human
aaaaaaaaaccaacccagcaaaa

SEQ ID NO: 1342483 - RNA, 25 nt, Human
aaaaaaaaaccaacccagcaaaauc

SEQ ID NO: 1342484 - RNA, 25 nt, Human
aaaaaaaaccaacccagcaaaaucu

SEQ ID NO: 1342485 - RNA, 19 nt, Human
aauuaaaaaaaaaaccaac

SEQ ID NO: 1342486 - RNA, 18 nt, Human
acgcugugcccggcccgg

SEQ ID NO: 1342487 - RNA, 19 nt, Human
agacgggggcugggguggu

SEQ ID NO: 1342488 - RNA, 21 nt, Human
aguggcugcccgaggccgggc

SEQ ID NO: 1342489 - RNA, 23 nt, Human
cacagacgggggcugggguggug

SEQ ID NO: 1342490 - RNA, 22 nt, Human
ccaccgggccuucagucacaga

SEQ ID NO: 1342491 - RNA, 22 nt, Human
cccgccgcaggugggcgggggc

SEQ ID NO: 1342492 - RNA, 21 nt, Human
ccgggcuggucggggcgcggg

SEQ ID NO: 1342493 - RNA, 22 nt, Human
ccucuguagccacgcugugccc

SEQ ID NO: 1342494 - RNA, 24 nt, Human
cgaaccagguagcccaaaaaugcc

SEQ ID NO: 1342495 - RNA, 20 nt, Human
cucuguagccacgcugugcc

SEQ ID NO: 1342496 - RNA, 19 nt, Human
cugcccgaggccgggcugg

SEQ ID NO: 1342497 - RNA, 19 nt, Human
gcccgguucucugggucca

SEQ ID NO: 1342498 - RNA, 19 nt, Human
gggggcuggggugguggcg

SEQ ID NO: 1342499 - RNA, 21 nt, Human
gucaaggaggaucguggucuu

SEQ ID NO: 1342500 - RNA, 23 nt, Human
uaaaaaaaaaaccaacccagcaa

SEQ ID NO: 1342501 - RNA, 22 nt, Human
uaaaaaaugccgcagacaguac

SEQ ID NO: 1342502 - RNA, 25 nt, Human
uaaaaacgaaccagguagcccaaaa

SEQ ID NO: 1342503 - RNA, 19 nt, Human
ucacagacgggggcugggg

SEQ ID NO: 1342504 - RNA, 21 nt, Human
ucagucacagacgggggcugg

SEQ ID NO: 1342505 - RNA, 18 nt, Human
ugaguggcugcccgaggc

SEQ ID NO: 1342506 - RNA, 19 nt, Human
ugcccggcccgguucucug

SEQ ID NO: 1342507 - RNA, 20 nt, Human
ugggagggggccgcgcccgg

SEQ ID NO: 1342508 - RNA, 22 nt, Human
ugggagggggccgcgcccggcg

SEQ ID NO: 1342509 - RNA, 18 nt, Human
uggucggggcgcgggcgg

SEQ ID NO: 1342510 - RNA, 21 nt, Human
uguagccacgcugugcccggc

SEQ ID NO: 1342511 - RNA, 23 nt, Human
uuaauuaaaaaaaaaaccaaccc

SEQ ID NO: 1342512 - RNA, 22 nt, Human
uucagucacagacgggggcugg

SEQ ID NO: 1342513 - RNA, 20 nt, Human
uucucuggguccaauaaaua

SEQ ID NO: 1342514 - RNA, 26 nt, Human
uucucuggguccaauaaauaccaguc

SEQ ID NO: 1342515 - RNA, 19 nt, Human
uugggagggggccgcgccc

SEQ ID NO: 1342516 - RNA, 23 nt, Human
uugggagggggccgcgcccggcg

SEQ ID NO: 1342517 - RNA, 25 nt, Human
aagcaauccuucucauuuggucucc

SEQ ID NO: 1342518 - RNA, 25 nt, Human
acacaagacaccaucacugcccaac

SEQ ID NO: 1342519 - RNA, 19 nt, Human
acuagaaugcagagccaca

SEQ ID NO: 1342520 - RNA, 19 nt, Human
acugcucuugucauaggug

SEQ ID NO: 1342521 - RNA, 21 nt, Human
agcuggagucccagcucugcc

SEQ ID NO: 1342522 - RNA, 21 nt, Human
aggagaacauuagcuacaacc

SEQ ID NO: 1342523 - RNA, 22 nt, Human
agggauuacaggcaugagccac

SEQ ID NO: 1342524 - RNA, 23 nt, Human
agggauuacaggcaugagccacc

SEQ ID NO: 1342525 - RNA, 24 nt, Human
agggauuacaggcaugagccacca

SEQ ID NO: 1342526 - RNA, 22 nt, Human
aucccuuccaagcccugugucg

SEQ ID NO: 1342527 - RNA, 25 nt, Human
caaacuccugggcucaagcaauccu

SEQ ID NO: 1342528 - RNA, 19 nt, Human
caccacaccaggcuaaugc

SEQ ID NO: 1342529 - RNA, 18 nt, Human
caccaggcuaaugcuccu

SEQ ID NO: 1342530 - RNA, 18 nt, Human
caccugcugcccuuggca

SEQ ID NO: 1342531 - RNA, 21 nt, Human
cacuguacuggcugcuagggc

SEQ ID NO: 1342532 - RNA, 24 nt, Human
cacuuuguugcccuggcuggucuc

SEQ ID NO: 1342533 - RNA, 25 nt, Human
cacuuuguugcccuggcuggucuca

SEQ ID NO: 1342534 - RNA, 21 nt, Human
cagugggcgauccucagccua

SEQ ID NO: 1342535 - RNA, 23 nt, Human
caucggcucugucucugucucuc

SEQ ID NO: 1342536 - RNA, 24 nt, Human
ccaaauugcagggauuacaggcau

SEQ ID NO: 1342537 - RNA, 25 nt, Human
ccagccccaggacucaaugcuuucu

SEQ ID NO: 1342538 - RNA, 22 nt, Human
cccacaaguggguccacagaac

SEQ ID NO: 1342539 - RNA, 20 nt, Human
ccccaaacaagcuuucaaau

SEQ ID NO: 1342540 - RNA, 18 nt, Human
cccugagagacacaagac

SEQ ID NO: 1342541 - RNA, 21 nt, Human
cccuuuaaauuuggaugcuuu

SEQ ID NO: 1342542 - RNA, 20 nt, Human
ccugggcucaagcaauccuu

SEQ ID NO: 1342543 - RNA, 22 nt, Human
cuaaaaauucuuggcaucccca

SEQ ID NO: 1342544 - RNA, 21 nt, Human
cuaccgaaauccuccaugcca

SEQ ID NO: 1342545 - RNA, 18 nt, Human
cuccacacggacaucugg

SEQ ID NO: 1342546 - RNA, 21 nt, Human
cuccugggcucaagcaauccu

SEQ ID NO: 1342547 - RNA, 23 nt, Human
cuccugggcucaagcaauccuuc

SEQ ID NO: 1342548 - RNA, 26 nt, Human
cuccugggcucaagcaauccuucuca

SEQ ID NO: 1342549 - RNA, 24 nt, Human
cucugcccggaucaccugcugccc

SEQ ID NO: 1342550 - RNA, 26 nt, Human
cugccacagcacgcgcaugugcugcu

SEQ ID NO: 1342551 - RNA, 23 nt, Human
cuggacguuccuugcuccugaaa

SEQ ID NO: 1342552 - RNA, 25 nt, Human
cuggcuggucucaaacuccuggggg

SEQ ID NO: 1342553 - RNA, 22 nt, Human
cuuucaaccacucuccagauga

SEQ ID NO: 1342554 - RNA, 22 nt, Human
cuuuggcuuucaaccacucucc

SEQ ID NO: 1342555 - RNA, 20 nt, Human
gaaauccuccaugccacugg

SEQ ID NO: 1342556 - RNA, 23 nt, Human
gaaauccuccaugccacuggcuc

SEQ ID NO: 1342557 - RNA, 20 nt, Human
gacgucugcccauuucuugu

SEQ ID NO: 1342558 - RNA, 20 nt, Human
gacuuaagucuggucaaugg

SEQ ID NO: 1342559 - RNA, 22 nt, Human
gagugaauucuccaggaaccaa

SEQ ID NO: 1342560 - RNA, 18 nt, Human
gauuacaggcaugagcca

SEQ ID NO: 1342561 - RNA, 21 nt, Human
gauuacaggcaugagccacca

SEQ ID NO: 1342562 - RNA, 22 nt, Human
gauuacaggcaugagccaccac

SEQ ID NO: 1342563 - RNA, 19 nt, Human
gauuccuaucgaucaccuc

SEQ ID NO: 1342564 - RNA, 25 nt, Human
gcaaguaccucaccuucacugcucu

SEQ ID NO: 1342565 - RNA, 18 nt, Human
gccugcucuggccccauc

SEQ ID NO: 1342566 - RNA, 19 nt, Human
ggauuacaggcaugagcca

SEQ ID NO: 1342567 - RNA, 23 nt, Human
gggauuacaggcaugagccacca

SEQ ID NO: 1342568 - RNA, 22 nt, Human
guggccccucccaacguccccu

SEQ ID NO: 1342569 - RNA, 20 nt, Human
uacaaccaaccacaagagag

SEQ ID NO: 1342570 - RNA, 22 nt, Human
uacaggcaugagccaccacacc

SEQ ID NO: 1342571 - RNA, 22 nt, Human
uagagacaggguaucacuuugu

SEQ ID NO: 1342572 - RNA, 21 nt, Human
uagguggaguguggucacaga

SEQ ID NO: 1342573 - RNA, 24 nt, Human
uaucacuuuguugcccuggcuggu

SEQ ID NO: 1342574 - RNA, 18 nt, Human
ucaccugcugcccuuggc

SEQ ID NO: 1342575 - RNA, 23 nt, Human
ucacugcccaacauggcaccagg

SEQ ID NO: 1342576 - RNA, 23 nt, Human
ucacugcucuugucauaggugac

SEQ ID NO: 1342577 - RNA, 19 nt, Human
uccacagaacucagacccu

SEQ ID NO: 1342578 - RNA, 27 nt, Human
uccacagaacucagacccugagagaca

SEQ ID NO: 1342579 - RNA, 24 nt, Human
ucccaaauugcagggauuacaggc

SEQ ID NO: 1342580 - RNA, 18 nt, Human
ucccuggacguuccuugc

SEQ ID NO: 1342581 - RNA, 23 nt, Human
ucccugguaaccucguccagccc

SEQ ID NO: 1342582 - RNA, 22 nt, Human
uccgccuguucugccugcucug

SEQ ID NO: 1342583 - RNA, 22 nt, Human
uccuccaugccacuggcuccag

SEQ ID NO: 1342584 - RNA, 20 nt, Human
uccuccuauguaccggcccu

SEQ ID NO: 1342585 - RNA, 18 nt, Human
uccugggcucaagcaauc

SEQ ID NO: 1342586 - RNA, 23 nt, Human
uccuuuggcuuucaaccacucuc

SEQ ID NO: 1342587 - RNA, 22 nt, Human
ucuaccgaaauccuccaugcca

SEQ ID NO: 1342588 - RNA, 23 nt, Human
ucucaaacuccugggcucaagca

SEQ ID NO: 1342589 - RNA, 19 nt, Human
ucucccaaauugcagggau

SEQ ID NO: 1342590 - RNA, 18 nt, Human
ucugucucugucucuccc

SEQ ID NO: 1342591 - RNA, 20 nt, Human
ugacgucugcccauuucuug

SEQ ID NO: 1342592 - RNA, 22 nt, Human
ugagagacacaagacaccauca

SEQ ID NO: 1342593 - RNA, 21 nt, Human
ugagccaaaggaugacgucug

SEQ ID NO: 1342594 - RNA, 19 nt, Human
ugagcuggagucccagcuc

SEQ ID NO: 1342595 - RNA, 23 nt, Human
ugagcuggagucccagcucugcc

SEQ ID NO: 1342596 - RNA, 20 nt, Human
ugcagggauuacaggcauga

SEQ ID NO: 1342597 - RNA, 24 nt, Human
ugcagugucuauguccccuccaca

SEQ ID NO: 1342598 - RNA, 20 nt, Human
ugccacagcacgcgcaugug

SEQ ID NO: 1342599 - RNA, 22 nt, Human
ugccacagcacgcgcaugugcu

SEQ ID NO: 1342600 - RNA, 23 nt, Human
ugccacuggcuccagugggcgau

SEQ ID NO: 1342601 - RNA, 22 nt, Human
ugcccggaucaccugcugcccu

SEQ ID NO: 1342602 - RNA, 19 nt, Human
ugccugcucuggccccauc

SEQ ID NO: 1342603 - RNA, 19 nt, Human
ugcucuggccccaucggcu

SEQ ID NO: 1342604 - RNA, 19 nt, Human
uggcaccaggcccuggcac

SEQ ID NO: 1342605 - RNA, 25 nt, Human
uggcuccagugggcgauccucagcc

SEQ ID NO: 1342606 - RNA, 19 nt, Human
ugggacgcugaucaaggug

SEQ ID NO: 1342607 - RNA, 21 nt, Human
ugggacgcugaucaagguguc

SEQ ID NO: 1342608 - RNA, 19 nt, Human
uggucacagacagggcacu

SEQ ID NO: 1342609 - RNA, 22 nt, Human
ugucucucccucccgauuggga

SEQ ID NO: 1342610 - RNA, 21 nt, Human
ugucucugucucucccucccg

SEQ ID NO: 1342611 - RNA, 23 nt, Human
uuauagcaagaagcuuggggagg

SEQ ID NO: 1342612 - RNA, 27 nt, Human
uucuaaaaauucuuggcauccccauuu

SEQ ID NO: 1342613 - RNA, 21 nt, Human
uucuccaggaaccaacccugg

SEQ ID NO: 1342614 - RNA, 27 nt, Human
uugccaggguccugugcaggguggccc

SEQ ID NO: 1342615 - RNA, 24 nt, Human
uuuguagagacaggguaucacuuu

SEQ ID NO: 1342616 - RNA, 18 nt, Human
uuuuuuuguagagacagg

SEQ ID NO: 1342617 - RNA, 18 nt, Human
uuuuuuuuuuuuuuuuug

SEQ ID NO: 1342618 - RNA, 19 nt, Human
uuuuuuuuuuuuuuuuugu

SEQ ID NO: 1342619 - RNA, 30 nt, Human
uuuuuuuuuuuuuuuuuguagagacagggg

SEQ ID NO: 1342620 - RNA, 20 nt, Human
aaaaaacauaaaaaccagaa

SEQ ID NO: 1342621 - RNA, 20 nt, Human
aaaaaccagaaugcugggua

SEQ ID NO: 1342622 - RNA, 19 nt, Human
auaaaacagaauacacagu

SEQ ID NO: 1342623 - RNA, 23 nt, Human
auaaaacagaauacacaguuguc

SEQ ID NO: 1342624 - RNA, 19 nt, Human
auagaacauggcccacccc

SEQ ID NO: 1342625 - RNA, 18 nt, Human
caacaaugaacuagggac

SEQ ID NO: 1342626 - RNA, 19 nt, Human
cagaaugcuggguaggugc

SEQ ID NO: 1342627 - RNA, 23 nt, Human
cauaaaaaacauaaaaaccagaa

SEQ ID NO: 1342628 - RNA, 29 nt, Human
cguggcgcaggccgcucuguagaccuucu

SEQ ID NO: 1342629 - RNA, 24 nt, Human
cugguggugcugguggugaaaacu

SEQ ID NO: 1342630 - RNA, 20 nt, Human
gaacauggcccaccccuccu

SEQ ID NO: 1342631 - RNA, 19 nt, Human
ggguaggugcugguggugc

SEQ ID NO: 1342632 - RNA, 25 nt, Human
ggguaggugcugguggugcuggugg

SEQ ID NO: 1342633 - RNA, 21 nt, Human
gguggugcugguggugaaaac

SEQ ID NO: 1342634 - RNA, 21 nt, Human
guggugaaaacugcagggcua

SEQ ID NO: 1342635 - RNA, 18 nt, Human
ugcugguggugcuggugg

SEQ ID NO: 1342636 - RNA, 20 nt, Human
ugcugguggugcugguggug

SEQ ID NO: 1342637 - RNA, 24 nt, Human
ugggagcgcggggggagggggagg

SEQ ID NO: 1342638 - RNA, 20 nt, Human
uggguaggugcugguggugc

SEQ ID NO: 1342639 - RNA, 20 nt, Human
aaaaggaaacaagucaucaa

SEQ ID NO: 1342640 - RNA, 23 nt, Human
aaagaaaaaagaaaagaaaagaa

SEQ ID NO: 1342641 - RNA, 24 nt, Human
aaauuugaaagugcuuugugaacu

SEQ ID NO: 1342642 - RNA, 22 nt, Human
aagaaaagaaaagaaaaaagga

SEQ ID NO: 1342643 - RNA, 21 nt, Human
aagaaagaaaaaagaaaagaa

SEQ ID NO: 1342644 - RNA, 23 nt, Human
aagaaagaaaaaagaaaagaaaa

SEQ ID NO: 1342645 - RNA, 23 nt, Human
aagcaaauaggcaguuuacagaa

SEQ ID NO: 1342646 - RNA, 21 nt, Human
agaaaaaagaaaagaaaagaa

SEQ ID NO: 1342647 - RNA, 19 nt, Human
agaaaagaaaagaaaaaag

SEQ ID NO: 1342648 - RNA, 21 nt, Human
agaaaagaaaagaaaaaagga

SEQ ID NO: 1342649 - RNA, 19 nt, Human
agaaaagaaaagaaaagaa

SEQ ID NO: 1342650 - RNA, 19 nt, Human
aggcaguuuacagaaggga

SEQ ID NO: 1342651 - RNA, 22 nt, Human
aggcugagucagcaucugcuug

SEQ ID NO: 1342652 - RNA, 19 nt, Human
aucccauuucugccccuca

SEQ ID NO: 1342653 - RNA, 20 nt, Human
caaaaugagcccuggacuug

SEQ ID NO: 1342654 - RNA, 27 nt, Human
caaaaugagcccuggacuugaccguca

SEQ ID NO: 1342655 - RNA, 23 nt, Human
caagaagggugcaucgaguggca

SEQ ID NO: 1342656 - RNA, 21 nt, Human
cacucuguccuacuucaggaa

SEQ ID NO: 1342657 - RNA, 19 nt, Human
cacuuaagaaauugggccc

SEQ ID NO: 1342658 - RNA, 21 nt, Human
cagacugaaagcaugaccaga

SEQ ID NO: 1342659 - RNA, 26 nt, Human
cagacugaaagcaugaccagaaauau

SEQ ID NO: 1342660 - RNA, 23 nt, Human
cagagccuccagcuuuguucccu

SEQ ID NO: 1342661 - RNA, 21 nt, Human
cagugggccuugucuggacuu

SEQ ID NO: 1342662 - RNA, 25 nt, Human
cagugggccuugucuggacuuugcc

SEQ ID NO: 1342663 - RNA, 20 nt, Human
cauuuuugucagacugaaag

SEQ ID NO: 1342664 - RNA, 21 nt, Human
ccacacacucuguccuacuuc

SEQ ID NO: 1342665 - RNA, 18 nt, Human
ccagagccuccagcuuug

SEQ ID NO: 1342666 - RNA, 19 nt, Human
ccauguaaaagcacaggcc

SEQ ID NO: 1342667 - RNA, 18 nt, Human
cccaaugggguacccaag

SEQ ID NO: 1342668 - RNA, 22 nt, Human
cccaucuuccaaauggccucaa

SEQ ID NO: 1342669 - RNA, 20 nt, Human
ccccgauaagcaaauaggca

SEQ ID NO: 1342670 - RNA, 24 nt, Human
ccuccagcuuuguucccuucaccc

SEQ ID NO: 1342671 - RNA, 21 nt, Human
ccugucccauaaauuugaaag

SEQ ID NO: 1342672 - RNA, 27 nt, Human
cgagaagaaauccaagaagggugcauc

SEQ ID NO: 1342673 - RNA, 19 nt, Human
cgccccaauuucuucuugc

SEQ ID NO: 1342674 - RNA, 21 nt, Human
cucaaaaccacacacucuguc

SEQ ID NO: 1342675 - RNA, 19 nt, Human
gaacaggcugagucagcau

SEQ ID NO: 1342676 - RNA, 18 nt, Human
gacccagcuccagagccu

SEQ ID NO: 1342677 - RNA, 21 nt, Human
gcaguaucauccauuuuuguc

SEQ ID NO: 1342678 - RNA, 21 nt, Human
gccccucauguuuuggccugu

SEQ ID NO: 1342679 - RNA, 22 nt, Human
uacccaagugcugucuaggagc

SEQ ID NO: 1342680 - RNA, 22 nt, Human
uacccaagugcugucuaggagc

SEQ ID NO: 1342681 - RNA, 25 nt, Human
ucacaugucuuccucuccaagaccc

SEQ ID NO: 1342682 - RNA, 18 nt, Human
ucagaagaaaaaaaucuu

SEQ ID NO: 1342683 - RNA, 23 nt, Human
ucccauccugcauuuccuguccc

SEQ ID NO: 1342684 - RNA, 19 nt, Human
ucuggacuuugccaaaggu

SEQ ID NO: 1342685 - RNA, 18 nt, Human
ugaaagugcuuugugaac

SEQ ID NO: 1342686 - RNA, 23 nt, Human
ugacuggcgccauaggaacugca

SEQ ID NO: 1342687 - RNA, 24 nt, Human
ugcagugggccuugucuggacuuu

SEQ ID NO: 1342688 - RNA, 18 nt, Human
ugcauucuggcaugacgc

SEQ ID NO: 1342689 - RNA, 20 nt, Human
ugccgggagguggcuggguu

SEQ ID NO: 1342690 - RNA, 24 nt, Human
ugcucagccaggggcucuccuaug

SEQ ID NO: 1342691 - RNA, 19 nt, Human
ugcuguauguugccaagau

SEQ ID NO: 1342692 - RNA, 20 nt, Human
uggcacuaugguacaagaca

SEQ ID NO: 1342693 - RNA, 19 nt, Human
uggcaugacgcugagguug

SEQ ID NO: 1342694 - RNA, 18 nt, Human
ugucuggacuuugccaaa

SEQ ID NO: 1342695 - RNA, 22 nt, Human
ugugaacuaaaaagcccaugua

SEQ ID NO: 1342696 - RNA, 19 nt, Human
uuagcucuuaauggaacag

SEQ ID NO: 1342697 - RNA, 20 nt, Human
uucacaugucuuccucucca

SEQ ID NO: 1342698 - RNA, 24 nt, Human
uugacccuuaagucauuauuaaaa

SEQ ID NO: 1342699 - RNA, 18 nt, Human
uugaccgucaaaacagac

SEQ ID NO: 1342700 - RNA, 19 nt, Human
uugccgggagguggcuggg

SEQ ID NO: 1342701 - RNA, 19 nt, Human
uugggcccaucuuccaaau

SEQ ID NO: 1342702 - RNA, 20 nt, Human
uugggcccaucuuccaaaug

SEQ ID NO: 1342703 - RNA, 23 nt, Human
uugggcccaucuuccaaauggcc

SEQ ID NO: 1342704 - RNA, 23 nt, Human
uuguucccuucacccugcguucc

SEQ ID NO: 1342705 - RNA, 24 nt, Human
uuuagaaagaaagaaaaaagaaaa

SEQ ID NO: 1342706 - RNA, 23 nt, Human
uuucagauagcacaggguggccc

SEQ ID NO: 1342707 - RNA, 26 nt, Human
uuucuucuugcuucuuagcucuuaau

SEQ ID NO: 1342708 - RNA, 21 nt, Human
uuuucagaagaaaaaaaucuu

SEQ ID NO: 1342709 - RNA, 21 nt, Human
agaugagcgcuucuaaacuua

SEQ ID NO: 1342710 - RNA, 18 nt, Human
cagaagcaagcgaaaagc

SEQ ID NO: 1342711 - RNA, 20 nt, Human
cagaagcaagcgaaaagcca

SEQ ID NO: 1342712 - RNA, 19 nt, Human
aaagaugccugaggugcgg

SEQ ID NO: 1342713 - RNA, 23 nt, Human
aaccagcacagcgacguccagca

SEQ ID NO: 1342714 - RNA, 23 nt, Human
acagagaacagcaacagcagcaa

SEQ ID NO: 1342715 - RNA, 21 nt, Human
agaaaaccccaggcacagcug

SEQ ID NO: 1342716 - RNA, 18 nt, Human
agccaagaaccagucccc

SEQ ID NO: 1342717 - RNA, 21 nt, Human
aggacagagaacagcaacagc

SEQ ID NO: 1342718 - RNA, 24 nt, Human
aggcagauaccccacggcccccca

SEQ ID NO: 1342719 - RNA, 22 nt, Human
aggccuccagccccugggccaa

SEQ ID NO: 1342720 - RNA, 20 nt, Human
agguaaggggcugcugacgu

SEQ ID NO: 1342721 - RNA, 19 nt, Human
auguuuccacacgcacgua

SEQ ID NO: 1342722 - RNA, 18 nt, Human
cacacagcuggaagcgga

SEQ ID NO: 1342723 - RNA, 21 nt, Human
cacguagacccagugccccca

SEQ ID NO: 1342724 - RNA, 19 nt, Human
cagcaauagggcuggcggc

SEQ ID NO: 1342725 - RNA, 19 nt, Human
cagcuggcauccugaggca

SEQ ID NO: 1342726 - RNA, 18 nt, Human
cagugguccccaaaaguu

SEQ ID NO: 1342727 - RNA, 21 nt, Human
ccacagagcuugaguugugca

SEQ ID NO: 1342728 - RNA, 19 nt, Human
ccagcuggcauccugaggc

SEQ ID NO: 1342729 - RNA, 19 nt, Human
ccagggaccagggcucgga

SEQ ID NO: 1342730 - RNA, 20 nt, Human
ccagggaccagggcucggag

SEQ ID NO: 1342731 - RNA, 19 nt, Human
ccaggggggcagugccagc

SEQ ID NO: 1342732 - RNA, 24 nt, Human
ccccccacacacaccagcugugcu

SEQ ID NO: 1342733 - RNA, 23 nt, Human
ccccugggccaaggacagagaac

SEQ ID NO: 1342734 - RNA, 21 nt, Human
ccugggccaaggacagagaac

SEQ ID NO: 1342735 - RNA, 18 nt, Human
ccuguaagugaagcuggg

SEQ ID NO: 1342736 - RNA, 20 nt, Human
cggaaaggacucagcuugcg

SEQ ID NO: 1342737 - RNA, 19 nt, Human
cguccagcaaacgccggac

SEQ ID NO: 1342738 - RNA, 20 nt, Human
cucggugcuggcaaaggagc

SEQ ID NO: 1342739 - RNA, 20 nt, Human
cuguguccccugggaagugu

SEQ ID NO: 1342740 - RNA, 19 nt, Human
gaaaaggccuccagccccu

SEQ ID NO: 1342741 - RNA, 20 nt, Human
gagggccggccaggaaccag

SEQ ID NO: 1342742 - RNA, 19 nt, Human
gcaccuccacaggccacag

SEQ ID NO: 1342743 - RNA, 23 nt, Human
gcagauaccccacggccccccac

SEQ ID NO: 1342744 - RNA, 22 nt, Human
gcagggguggggcuuugggacg

SEQ ID NO: 1342745 - RNA, 23 nt, Human
gcagugguccccaaaaguucccc

SEQ ID NO: 1342746 - RNA, 18 nt, Human
gcuggcggcagcugaaac

SEQ ID NO: 1342747 - RNA, 19 nt, Human
ggcaguguccagcugaggg

SEQ ID NO: 1342748 - RNA, 20 nt, Human
ggccgugggccuggggaagg

SEQ ID NO: 1342749 - RNA, 18 nt, Human
gggcucggagcaggccgg

SEQ ID NO: 1342750 - RNA, 23 nt, Human
gucaggaaaaggccuccagcccc

SEQ ID NO: 1342751 - RNA, 22 nt, Human
gugacagggggcaggcagauac

SEQ ID NO: 1342752 - RNA, 23 nt, Human
uacagggcugagcgauugugugg

SEQ ID NO: 1342753 - RNA, 19 nt, Human
uaccagggccccgggauga

SEQ ID NO: 1342754 - RNA, 22 nt, Human
uccagggaccagggcucggagc

SEQ ID NO: 1342755 - RNA, 19 nt, Human
uccccagguaaggggcugc

SEQ ID NO: 1342756 - RNA, 18 nt, Human
ugacagggggcaggcaga

SEQ ID NO: 1342757 - RNA, 23 nt, Human
ugacagggggcaggcagauaccc

SEQ ID NO: 1342758 - RNA, 23 nt, Human
ugagaaaaccccaggcacagcug

SEQ ID NO: 1342759 - RNA, 21 nt, Human
ugagggccggccaggaaccag

SEQ ID NO: 1342760 - RNA, 24 nt, Human
ugagguuccaaacagccaggaaug

SEQ ID NO: 1342761 - RNA, 19 nt, Human
ugaguugugcagggguggg

SEQ ID NO: 1342762 - RNA, 19 nt, Human
ugcagggguggggcuuugg

SEQ ID NO: 1342763 - RNA, 19 nt, Human
ugcagggguggggcuuugg

SEQ ID NO: 1342764 - RNA, 22 nt, Human
ugccugaggugcgguugggcag

SEQ ID NO: 1342765 - RNA, 18 nt, Human
ugcucugagggccggcca

SEQ ID NO: 1342766 - RNA, 20 nt, Human
uggaagagcucggugcuggc

SEQ ID NO: 1342767 - RNA, 20 nt, Human
uggaagcggaugguccuacc

SEQ ID NO: 1342768 - RNA, 20 nt, Human
uggcaaaggagcggaaagga

SEQ ID NO: 1342769 - RNA, 22 nt, Human
uguaagugaagcugggcacaaa

SEQ ID NO: 1342770 - RNA, 19 nt, Human
uugcggggugagcaggugg

SEQ ID NO: 1342771 - RNA, 26 nt, Human
aaacaaguaauuuuguaaaagucaga

SEQ ID NO: 1342772 - RNA, 20 nt, Human
aaaggugcaaucucggcuca

SEQ ID NO: 1342773 - RNA, 21 nt, Human
aaagugcugggauuacaggca

SEQ ID NO: 1342774 - RNA, 24 nt, Human
aaagugcugggauuacaggcagga

SEQ ID NO: 1342775 - RNA, 25 nt, Human
aacaaguaauuuuguaaaagucaga

SEQ ID NO: 1342776 - RNA, 23 nt, Human
aaguaauuuuguaaaagucagaa

SEQ ID NO: 1342777 - RNA, 18 nt, Human
aagugcugggauuacagg

SEQ ID NO: 1342778 - RNA, 19 nt, Human
aagugcugggauuacaggc

SEQ ID NO: 1342779 - RNA, 26 nt, Human
aagugcugggauuacaggcaggagcc

SEQ ID NO: 1342780 - RNA, 19 nt, Human
aaugaaagcacaaucuaaa

SEQ ID NO: 1342781 - RNA, 22 nt, Human
accuccgccucuuggguucaag

SEQ ID NO: 1342782 - RNA, 24 nt, Human
acuggguuucuccauguuggucag

SEQ ID NO: 1342783 - RNA, 19 nt, Human
agaaggacuaacagggucu

SEQ ID NO: 1342784 - RNA, 21 nt, Human
agcagcugggauuacaggcau

SEQ ID NO: 1342785 - RNA, 23 nt, Human
agcagcugggauuacaggcaugu

SEQ ID NO: 1342786 - RNA, 24 nt, Human
aggugauccgcccaccucggccuc

SEQ ID NO: 1342787 - RNA, 24 nt, Human
aggugcaaucucggcucaccacaa

SEQ ID NO: 1342788 - RNA, 24 nt, Human
aguacaaaggugcaaucucggcuc

SEQ ID NO: 1342789 - RNA, 23 nt, Human
agucagaaaacaccaguauccuu

SEQ ID NO: 1342790 - RNA, 18 nt, Human
agugcugggauuacaggc

SEQ ID NO: 1342791 - RNA, 25 nt, Human
auagaguuugcccccaaauggaaaa

SEQ ID NO: 1342792 - RNA, 23 nt, Human
auccagcagguaaguagaaggac

SEQ ID NO: 1342793 - RNA, 27 nt, Human
caaagugcugggauuacaggcaggagc

SEQ ID NO: 1342794 - RNA, 20 nt, Human
caagaauagaguuugccccc

SEQ ID NO: 1342795 - RNA, 22 nt, Human
caagaauagaguuugcccccaa

SEQ ID NO: 1342796 - RNA, 22 nt, Human
caagcaauucuccugccucagc

SEQ ID NO: 1342797 - RNA, 24 nt, Human
cacaagaauagaguuugcccccaa

SEQ ID NO: 1342798 - RNA, 26 nt, Human
cacaagaauagaguuugcccccaaau

SEQ ID NO: 1342799 - RNA, 21 nt, Human
caccacaaccuccgccucuug

SEQ ID NO: 1342800 - RNA, 24 nt, Human
caccucggccucccaaagugcugg

SEQ ID NO: 1342801 - RNA, 23 nt, Human
cagccuccugagcagcugggauu

SEQ ID NO: 1342802 - RNA, 20 nt, Human
caggagccaccacgcccggc

SEQ ID NO: 1342803 - RNA, 24 nt, Human
caguagagacuggguuucuccaug

SEQ ID NO: 1342804 - RNA, 22 nt, Human
caguauccuucugaucucaucc

SEQ ID NO: 1342805 - RNA, 18 nt, Human
caucccacucugcacaac

SEQ ID NO: 1342806 - RNA, 19 nt, Human
ccaaagugcugggauuaca

SEQ ID NO: 1342807 - RNA, 23 nt, Human
ccaaagugcugggauuacaggca

SEQ ID NO: 1342808 - RNA, 24 nt, Human
ccacaaccuccgccucuuggguuc

SEQ ID NO: 1342809 - RNA, 19 nt, Human
ccauguuggucaggcuggu

SEQ ID NO: 1342810 - RNA, 24 nt, Human
cccaaagugcugggauuacaggca

SEQ ID NO: 1342811 - RNA, 20 nt, Human
cccaggcuggaguacaaagg

SEQ ID NO: 1342812 - RNA, 22 nt, Human
cccaggcuggaguacaaaggug

SEQ ID NO: 1342813 - RNA, 24 nt, Human
cccgaccucaggugauccgcccac

SEQ ID NO: 1342814 - RNA, 24 nt, Human
ccucuuggguucaagcaauucucc

SEQ ID NO: 1342815 - RNA, 19 nt, Human
ccugagcagcugggauuac

SEQ ID NO: 1342816 - RNA, 23 nt, Human
ccugagcagcugggauuacaggc

SEQ ID NO: 1342817 - RNA, 24 nt, Human
ccugagcagcugggauuacaggca

SEQ ID NO: 1342818 - RNA, 18 nt, Human
ccuggauuuuucugucag

SEQ ID NO: 1342819 - RNA, 18 nt, Human
cgaccucaggugauccgc

SEQ ID NO: 1342820 - RNA, 24 nt, Human
cuaaagaguauuaucacaccguga

SEQ ID NO: 1342821 - RNA, 26 nt, Human
cucacaagaauagaguuugcccccaa

SEQ ID NO: 1342822 - RNA, 24 nt, Human
cucaccacaaccuccgccucuugg

SEQ ID NO: 1342823 - RNA, 24 nt, Human
cuccauguuggucaggcuggucuc

SEQ ID NO: 1342824 - RNA, 18 nt, Human
cucguugcccaggcugga

SEQ ID NO: 1342825 - RNA, 19 nt, Human
cucguugcccaggcuggag

SEQ ID NO: 1342826 - RNA, 21 nt, Human
cugaccccaucccagacacgu

SEQ ID NO: 1342827 - RNA, 23 nt, Human
cugagcagcugggauuacaggca

SEQ ID NO: 1342828 - RNA, 24 nt, Human
cugagcagcugggauuacaggcau

SEQ ID NO: 1342829 - RNA, 23 nt, Human
cugccucagccuccugagcagcu

SEQ ID NO: 1342830 - RNA, 22 nt, Human
cuggauuuuucugucagcugga

SEQ ID NO: 1342831 - RNA, 24 nt, Human
cuggguuucuccauguuggucagg

SEQ ID NO: 1342832 - RNA, 21 nt, Human
cuuuuuuuuuuuuuuuuuuuu

SEQ ID NO: 1342833 - RNA, 24 nt, Human
gaccucaggugauccgcccaccuc

SEQ ID NO: 1342834 - RNA, 22 nt, Human
gagcagcugggauuacaggcau

SEQ ID NO: 1342835 - RNA, 25 nt, Human
gagcagcugggauuacaggcaugug

SEQ ID NO: 1342836 - RNA, 18 nt, Human
gauuacaggcaggagcca

SEQ ID NO: 1342837 - RNA, 18 nt, Human
gauuacaggcaugugcca

SEQ ID NO: 1342838 - RNA, 18 nt, Human
gcagcugggauuacaggc

SEQ ID NO: 1342839 - RNA, 20 nt, Human
gcagcugggauuacaggcau

SEQ ID NO: 1342840 - RNA, 19 nt, Human
gcucguugcccaggcugga

SEQ ID NO: 1342841 - RNA, 19 nt, Human
gcuggaguacaaaggugca

SEQ ID NO: 1342842 - RNA, 23 nt, Human
gcuggucucaaacucccgaccuc

SEQ ID NO: 1342843 - RNA, 19 nt, Human
ggauuacaggcaggagcca

SEQ ID NO: 1342844 - RNA, 19 nt, Human
ggauuacaggcaugugcca

SEQ ID NO: 1342845 - RNA, 23 nt, Human
gggagggauauagggagaggaag

SEQ ID NO: 1342846 - RNA, 20 nt, Human
ggguucaagcaauucuccug

SEQ ID NO: 1342847 - RNA, 21 nt, Human
ggguuucuccauguuggucag

SEQ ID NO: 1342848 - RNA, 24 nt, Human
gugauccgcccaccucggccuccc

SEQ ID NO: 1342849 - RNA, 20 nt, Human
uaaguagaaggacuaacagg

SEQ ID NO: 1342850 - RNA, 23 nt, Human
uacaggcaggagccaccacgccc

SEQ ID NO: 1342851 - RNA, 22 nt, Human
uacaggcaugugccaccacgcc

SEQ ID NO: 1342852 - RNA, 19 nt, Human
uagggagaggaaggcgaua

SEQ ID NO: 1342853 - RNA, 21 nt, Human
uauaauaaugaaagcacaauc

SEQ ID NO: 1342854 - RNA, 19 nt, Human
ucaagcaauucuccugccu

SEQ ID NO: 1342855 - RNA, 23 nt, Human
ucaccacaaccuccgccucuugg

SEQ ID NO: 1342856 - RNA, 24 nt, Human
ucaccacaaccuccgccucuuggg

SEQ ID NO: 1342857 - RNA, 25 nt, Human
ucaccacaaccuccgccucuugggu

SEQ ID NO: 1342858 - RNA, 24 nt, Human
ucaguagagacuggguuucuccau

SEQ ID NO: 1342859 - RNA, 24 nt, Human
ucccaaagugcugggauuacaggc

SEQ ID NO: 1342860 - RNA, 24 nt, Human
uccgccucuuggguucaagcaauu

SEQ ID NO: 1342861 - RNA, 24 nt, Human
uccugagcagcugggauuacaggc

SEQ ID NO: 1342862 - RNA, 18 nt, Human
ucggccucccaaagugcu

SEQ ID NO: 1342863 - RNA, 24 nt, Human
ucugucagcuggaggaugcauuuc

SEQ ID NO: 1342864 - RNA, 24 nt, Human
ucuuggguucaagcaauucuccug

SEQ ID NO: 1342865 - RNA, 18 nt, Human
ucuuuuuuuuuuuuuuuu

SEQ ID NO: 1342866 - RNA, 24 nt, Human
ugaaaacaaacaaguaauuuugua

SEQ ID NO: 1342867 - RNA, 20 nt, Human
ugaaagcagaagacaugaug

SEQ ID NO: 1342868 - RNA, 21 nt, Human
ugaaagcagaagacaugaugc

SEQ ID NO: 1342869 - RNA, 24 nt, Human
ugauccgcccaccucggccuccca

SEQ ID NO: 1342870 - RNA, 24 nt, Human
ugcccaggcuggaguacaaaggug

SEQ ID NO: 1342871 - RNA, 24 nt, Human
ugccucagccuccugagcagcugg

SEQ ID NO: 1342872 - RNA, 18 nt, Human
uggaagccauuuuucuuu

SEQ ID NO: 1342873 - RNA, 18 nt, Human
ugggauuacaggcaggag

SEQ ID NO: 1342874 - RNA, 21 nt, Human
ugggauuacaggcaggagcca

SEQ ID NO: 1342875 - RNA, 22 nt, Human
ugggauuacaggcaggagccac

SEQ ID NO: 1342876 - RNA, 24 nt, Human
ugggauuacaggcaggagccacca

SEQ ID NO: 1342877 - RNA, 18 nt, Human
ugggauuacaggcaugug

SEQ ID NO: 1342878 - RNA, 21 nt, Human
ugggauuacaggcaugugcca

SEQ ID NO: 1342879 - RNA, 22 nt, Human
ugggauuacaggcaugugccac

SEQ ID NO: 1342880 - RNA, 24 nt, Human
ugggauuacaggcaugugccacca

SEQ ID NO: 1342881 - RNA, 21 nt, Human
uggguucaagcaauucuccug

SEQ ID NO: 1342882 - RNA, 23 nt, Human
uggguucaagcaauucuccugcc

SEQ ID NO: 1342883 - RNA, 24 nt, Human
uggguucaagcaauucuccugccu

SEQ ID NO: 1342884 - RNA, 23 nt, Human
uggguuucuccauguuggucagg

SEQ ID NO: 1342885 - RNA, 21 nt, Human
uggucaggcuggucucaaacu

SEQ ID NO: 1342886 - RNA, 19 nt, Human
uggucucaaacucccgacc

SEQ ID NO: 1342887 - RNA, 21 nt, Human
uguaaaagucagaaaacacca

SEQ ID NO: 1342888 - RNA, 20 nt, Human
uguccuggaagccauuuuuc

SEQ ID NO: 1342889 - RNA, 21 nt, Human
uucaagcaauucuccugccuc

SEQ ID NO: 1342890 - RNA, 24 nt, Human
uucaagcaauucuccugccucagc

SEQ ID NO: 1342891 - RNA, 21 nt, Human
uucaugggagggauauaggga

SEQ ID NO: 1342892 - RNA, 20 nt, Human
uugcucguugcccaggcugg

SEQ ID NO: 1342893 - RNA, 21 nt, Human
uugcucguugcccaggcugga

SEQ ID NO: 1342894 - RNA, 21 nt, Human
uuucuccauguuggucaggcu

SEQ ID NO: 1342895 - RNA, 24 nt, Human
uuugcucguugcccaggcuggagu

SEQ ID NO: 1342896 - RNA, 21 nt, Human
uuuugcucguugcccaggcug

SEQ ID NO: 1342897 - RNA, 23 nt, Human
uuuugcucguugcccaggcugga

SEQ ID NO: 1342898 - RNA, 23 nt, Human
uuuuguaaaagucagaaaacacc

SEQ ID NO: 1342899 - RNA, 24 nt, Human
uuuuugcucguugcccaggcugga

SEQ ID NO: 1342900 - RNA, 24 nt, Human
uuuuuugcucguugcccaggcugg

SEQ ID NO: 1342901 - RNA, 20 nt, Human
uuuuuuuuuuugagacagag

SEQ ID NO: 1342902 - RNA, 27 nt, Human
uuuuuuuuuuuuuuuuuuuuuuugggg

SEQ ID NO: 1342903 - RNA, 23 nt, Human
aaacaaaugaaagcugccuuccc

SEQ ID NO: 1342904 - RNA, 20 nt, Human
aagcugccuucccugcagcc

SEQ ID NO: 1342905 - RNA, 23 nt, Human
aaugaaagcugccuucccugcag

SEQ ID NO: 1342906 - RNA, 26 nt, Human
aaaaagcccuuaaauaaaugcuacca

SEQ ID NO: 1342907 - RNA, 24 nt, Human
aaacgaguuagguccugcaugugg

SEQ ID NO: 1342908 - RNA, 21 nt, Human
aagcaggaaagggcccucuag

SEQ ID NO: 1342909 - RNA, 18 nt, Human
agaggcggggagggggcc

SEQ ID NO: 1342910 - RNA, 26 nt, Human
agaggcggggagggggccgcgggccg

SEQ ID NO: 1342911 - RNA, 18 nt, Human
aggaaaaaacgaguuagg

SEQ ID NO: 1342912 - RNA, 22 nt, Human
aggaggcgguggagagaggcgg

SEQ ID NO: 1342913 - RNA, 22 nt, Human
aggcggggagggggccgcgggc

SEQ ID NO: 1342914 - RNA, 20 nt, Human
aggcgguggagagaggcggg

SEQ ID NO: 1342915 - RNA, 21 nt, Human
agggaaaggcuaacacugaug

SEQ ID NO: 1342916 - RNA, 21 nt, Human
agucuguucuuuugcuaggcc

SEQ ID NO: 1342917 - RNA, 24 nt, Human
caacagguaauaaaacaaggaaaa

SEQ ID NO: 1342918 - RNA, 21 nt, Human
cacgacacaaaagugugcaaa

SEQ ID NO: 1342919 - RNA, 25 nt, Human
cagcagccgggaggugugauucuga

SEQ ID NO: 1342920 - RNA, 21 nt, Human
caggaaagggcccucuaggug

SEQ ID NO: 1342921 - RNA, 24 nt, Human
cauuucaguaaauuuuuuaaugac

SEQ ID NO: 1342922 - RNA, 19 nt, Human
cggggagggggccgcgggc

SEQ ID NO: 1342923 - RNA, 22 nt, Human
cugaaauagggaaaggcuaaca

SEQ ID NO: 1342924 - RNA, 20 nt, Human
cuucucgcuccggcccucug

SEQ ID NO: 1342925 - RNA, 20 nt, Human
gagaagcaggaaagggcccu

SEQ ID NO: 1342926 - RNA, 19 nt, Human
gaggcuggaauccacuugg

SEQ ID NO: 1342927 - RNA, 23 nt, Human
gugcugaaauagggaaaggcuaa

SEQ ID NO: 1342928 - RNA, 22 nt, Human
uaagauugugcugaaauaggga

SEQ ID NO: 1342929 - RNA, 22 nt, Human
uacccuuuaauuuuaguauauu

SEQ ID NO: 1342930 - RNA, 24 nt, Human
ucagagaagcaggaaagggcccuc

SEQ ID NO: 1342931 - RNA, 19 nt, Human
uccugcaugugucuccacu

SEQ ID NO: 1342932 - RNA, 19 nt, Human
ucuguucuuuugcuaggcc

SEQ ID NO: 1342933 - RNA, 19 nt, Human
ugaaccagaccaaauaccc

SEQ ID NO: 1342934 - RNA, 22 nt, Human
ugaaccagaccaaauacccuuu

SEQ ID NO: 1342935 - RNA, 21 nt, Human
ugaggcuggaauccacuuggc

SEQ ID NO: 1342936 - RNA, 23 nt, Human
ugaggcugggugaccugugcuuu

SEQ ID NO: 1342937 - RNA, 23 nt, Human
ugagucuaagauugugcugaaau

SEQ ID NO: 1342938 - RNA, 21 nt, Human
ugcugcagucucucagaaaga

SEQ ID NO: 1342939 - RNA, 22 nt, Human
ugcuguaaaugcucuuuuaaca

SEQ ID NO: 1342940 - RNA, 21 nt, Human
ugggugaccugugcuuucaga

SEQ ID NO: 1342941 - RNA, 20 nt, Human
uuaguauauuaaccucugcu

SEQ ID NO: 1342942 - RNA, 24 nt, Human
aaaccaacacauuccucaacccca

SEQ ID NO: 1342943 - RNA, 23 nt, Human
aaagaaaccaacacauuccucaa

SEQ ID NO: 1342944 - RNA, 22 nt, Human
aaagugcauuaagauagacuga

SEQ ID NO: 1342945 - RNA, 19 nt, Human
aacagggaaugaccgagaa

SEQ ID NO: 1342946 - RNA, 22 nt, Human
aacaugugaauccaacagcccu

SEQ ID NO: 1342947 - RNA, 19 nt, Human
aacccuguaguucaguagc

SEQ ID NO: 1342948 - RNA, 18 nt, Human
aaccucugcuccacugga

SEQ ID NO: 1342949 - RNA, 25 nt, Human
aagaaagaaaccaacacauuccuca

SEQ ID NO: 1342950 - RNA, 20 nt, Human
aagacaaacccugcugcaaa

SEQ ID NO: 1342951 - RNA, 22 nt, Human
aagguaguuagguaaaggugga

SEQ ID NO: 1342952 - RNA, 19 nt, Human
aaggugaacuuaucagagc

SEQ ID NO: 1342953 - RNA, 27 nt, Human
aaugguaccuucuccaccacccgaggg

SEQ ID NO: 1342954 - RNA, 23 nt, Human
acaaagacaaacccugcugcaaa

SEQ ID NO: 1342955 - RNA, 24 nt, Human
acaaagacaaacccugcugcaaau

SEQ ID NO: 1342956 - RNA, 21 nt, Human
acacacacacacaugcccgug

SEQ ID NO: 1342957 - RNA, 23 nt, Human
acaggaugcaaacggcccugaca

SEQ ID NO: 1342958 - RNA, 22 nt, Human
agaaagaaaccaacacauuccu

SEQ ID NO: 1342959 - RNA, 23 nt, Human
agaaggaagaagaaucagccugg

SEQ ID NO: 1342960 - RNA, 22 nt, Human
agagcaauaguuaggcucugag

SEQ ID NO: 1342961 - RNA, 22 nt, Human
agccgcugguggcugucuuccu

SEQ ID NO: 1342962 - RNA, 21 nt, Human
agccuggguuucccuucucug

SEQ ID NO: 1342963 - RNA, 18 nt, Human
aggaguaagguuaaugag

SEQ ID NO: 1342964 - RNA, 18 nt, Human
aggaugauaagccugaaa

SEQ ID NO: 1342965 - RNA, 25 nt, Human
agggguguuaaucuuggcccugaaa

SEQ ID NO: 1342966 - RNA, 23 nt, Human
aguuacugagcugagggggccag

SEQ ID NO: 1342967 - RNA, 19 nt, Human
augaccgagaaagaaagaa

SEQ ID NO: 1342968 - RNA, 19 nt, Human
caaauaauacuaacuggca

SEQ ID NO: 1342969 - RNA, 24 nt, Human
caaccugaaacucacauggcuaaa

SEQ ID NO: 1342970 - RNA, 26 nt, Human
cacacacacacaugcccgugucuggc

SEQ ID NO: 1342971 - RNA, 20 nt, Human
cacagaauguucuguuucag

SEQ ID NO: 1342972 - RNA, 23 nt, Human
cacugcuaagaaccucugcucca

SEQ ID NO: 1342973 - RNA, 20 nt, Human
cacuguaugccuucuuaggc

SEQ ID NO: 1342974 - RNA, 18 nt, Human
cagcaaauaauacuaacu

SEQ ID NO: 1342975 - RNA, 19 nt, Human
cagcaaauaauacuaacug

SEQ ID NO: 1342976 - RNA, 27 nt, Human
cagccgcugguggcugucuuccuccug

SEQ ID NO: 1342977 - RNA, 18 nt, Human
caggaugcaaacggcccu

SEQ ID NO: 1342978 - RNA, 22 nt, Human
caucugaauucacaaagacaaa

SEQ ID NO: 1342979 - RNA, 23 nt, Human
caucugaauucacaaagacaaac

SEQ ID NO: 1342980 - RNA, 22 nt, Human
cauggcucccuucuacuuucug

SEQ ID NO: 1342981 - RNA, 24 nt, Human
cauuuaucauuucucuacacuuga

SEQ ID NO: 1342982 - RNA, 21 nt, Human
ccccaaagcgcuucuaacuuc

SEQ ID NO: 1342983 - RNA, 20 nt, Human
cccccagcaaugcaaggauu

SEQ ID NO: 1342984 - RNA, 22 nt, Human
cccgggauaaaucuucccugga

SEQ ID NO: 1342985 - RNA, 20 nt, Human
cccuggauccuacacaaccc

SEQ ID NO: 1342986 - RNA, 24 nt, Human
ccgagaaagaaagaaaccaacaca

SEQ ID NO: 1342987 - RNA, 19 nt, Human
ccgcugguggcugucuucc

SEQ ID NO: 1342988 - RNA, 22 nt, Human
ccgcugguggcugucuuccucc

SEQ ID NO: 1342989 - RNA, 23 nt, Human
ccuccugcaggagggguguuaau

SEQ ID NO: 1342990 - RNA, 23 nt, Human
cuaaguacaaauuauucuguacu

SEQ ID NO: 1342991 - RNA, 21 nt, Human
cugaacccuguaguucaguag

SEQ ID NO: 1342992 - RNA, 23 nt, Human
cugccccaaagcgcuucuaacuu

SEQ ID NO: 1342993 - RNA, 18 nt, Human
cuuucugaacccuguagu

SEQ ID NO: 1342994 - RNA, 24 nt, Human
gaaacagggaaugaccgagaaaga

SEQ ID NO: 1342995 - RNA, 23 nt, Human
gaaccucugcuccacuggaaaca

SEQ ID NO: 1342996 - RNA, 20 nt, Human
gacauggcaaaucugauuua

SEQ ID NO: 1342997 - RNA, 19 nt, Human
gagggcagaaccacccugc

SEQ ID NO: 1342998 - RNA, 20 nt, Human
gcagcagcagauccaauugc

SEQ ID NO: 1342999 - RNA, 19 nt, Human
gcauggcucccuucuacuu

SEQ ID NO: 1343000 - RNA, 24 nt, Human
gccccaaagcgcuucuaacuucuu

SEQ ID NO: 1343001 - RNA, 19 nt, Human
gcccugcauuucacagaau

SEQ ID NO: 1343002 - RNA, 21 nt, Human
gccgcugguggcugucuuccu

SEQ ID NO: 1343003 - RNA, 18 nt, Human
gcugucuuccuccugcag

SEQ ID NO: 1343004 - RNA, 24 nt, Human
ggaaugaccgagaaagaaagaaac

SEQ ID NO: 1343005 - RNA, 20 nt, Human
ggaaugugauacagcaguuc

SEQ ID NO: 1343006 - RNA, 21 nt, Human
ggccugguaaggcagaggcug

SEQ ID NO: 1343007 - RNA, 24 nt, Human
gggaagaguuuccuaaagugcauu

SEQ ID NO: 1343008 - RNA, 23 nt, Human
guaaggcagaggcugguuccucc

SEQ ID NO: 1343009 - RNA, 19 nt, Human
uagaaggaagaagaaucag

SEQ ID NO: 1343010 - RNA, 23 nt, Human
uagaaggaagaagaaucagccug

SEQ ID NO: 1343011 - RNA, 19 nt, Human
uauacgcaaagcacgugca

SEQ ID NO: 1343012 - RNA, 22 nt, Human
ucaccuaagugugaccuagucc

SEQ ID NO: 1343013 - RNA, 18 nt, Human
ucaucaccuaagugugac

SEQ ID NO: 1343014 - RNA, 21 nt, Human
uccccguguugcgaaaccccc

SEQ ID NO: 1343015 - RNA, 27 nt, Human
uccccuggcuucagggauugauggccu

SEQ ID NO: 1343016 - RNA, 20 nt, Human
uccucaaccccaguaggcuc

SEQ ID NO: 1343017 - RNA, 20 nt, Human
ucuguacuggacauggcaaa

SEQ ID NO: 1343018 - RNA, 21 nt, Human
ucuuggcccugaaaugaaaca

SEQ ID NO: 1343019 - RNA, 22 nt, Human
ugaaacacacacacacaugccc

SEQ ID NO: 1343020 - RNA, 20 nt, Human
ugaaacacacacacacaugg

SEQ ID NO: 1343021 - RNA, 21 nt, Human
ugaacguguaccaaccugaaa

SEQ ID NO: 1343022 - RNA, 20 nt, Human
ugaauucacaaagacaaacc

SEQ ID NO: 1343023 - RNA, 22 nt, Human
ugacacaccuaguuuuugcuuu

SEQ ID NO: 1343024 - RNA, 21 nt, Human
ugaccuaguccuacaagguga

SEQ ID NO: 1343025 - RNA, 19 nt, Human
ugagaaaacauaacacagg

SEQ ID NO: 1343026 - RNA, 26 nt, Human
ugagaugaaacaauuuaacaugugaa

SEQ ID NO: 1343027 - RNA, 18 nt, Human
uggaaacagagggacuug

SEQ ID NO: 1343028 - RNA, 23 nt, Human
uggcacaaguuaucagacuacaa

SEQ ID NO: 1343029 - RNA, 21 nt, Human
ugguaaggcagaggcugguuc

SEQ ID NO: 1343030 - RNA, 21 nt, Human
uggucagugagcccaggcucu

SEQ ID NO: 1343031 - RNA, 19 nt, Human
ugucuuccuccugcaggag

SEQ ID NO: 1343032 - RNA, 24 nt, Human
uguuaaagaauucucaaaggagua

SEQ ID NO: 1343033 - RNA, 18 nt, Human
uucaacacuaaaacucac

SEQ ID NO: 1343034 - RNA, 22 nt, Human
uucacaaagacaaacccugcug

SEQ ID NO: 1343035 - RNA, 20 nt, Human
uucccuggauccuacacaac

SEQ ID NO: 1343036 - RNA, 24 nt, Human
uuuaacaugugaauccaacagccc

SEQ ID NO: 1343037 - RNA, 22 nt, Human
aaacacacccgaacuuuucaac

SEQ ID NO: 1343038 - RNA, 23 nt, Human
aaacacacccgaacuuuucaaca

SEQ ID NO: 1343039 - RNA, 19 nt, Human
aaacaggaaaagccuuaug

SEQ ID NO: 1343040 - RNA, 20 nt, Human
accccacaacucuuuuccug

SEQ ID NO: 1343041 - RNA, 21 nt, Human
acccgaacuuuucaacaagac

SEQ ID NO: 1343042 - RNA, 22 nt, Human
agaaaacaaacauuccagcaga

SEQ ID NO: 1343043 - RNA, 18 nt, Human
agagaggauagagaggca

SEQ ID NO: 1343044 - RNA, 19 nt, Human
aggaaaagccuuaugggca

SEQ ID NO: 1343045 - RNA, 23 nt, Human
auaaaguacuuuccaaaugcaag

SEQ ID NO: 1343046 - RNA, 23 nt, Human
auccuuuagccucucccagaucc

SEQ ID NO: 1343047 - RNA, 21 nt, Human
augccugcugggggaggagag

SEQ ID NO: 1343048 - RNA, 21 nt, Human
augggccccauaccccacaac

SEQ ID NO: 1343049 - RNA, 22 nt, Human
caccauguuagcguguuuaggc

SEQ ID NO: 1343050 - RNA, 21 nt, Human
caccuccuccuagcucagagc

SEQ ID NO: 1343051 - RNA, 22 nt, Human
caccuccuccuagcucagagcc

SEQ ID NO: 1343052 - RNA, 22 nt, Human
caccuccuccucucuccccaag

SEQ ID NO: 1343053 - RNA, 23 nt, Human
cagaaggaauaggagugaugaga

SEQ ID NO: 1343054 - RNA, 25 nt, Human
cagaaguggcugggccaccuccuuc

SEQ ID NO: 1343055 - RNA, 18 nt, Human
cagagcccacugcccucc

SEQ ID NO: 1343056 - RNA, 23 nt, Human
cagcacccacuacccuccugccc

SEQ ID NO: 1343057 - RNA, 19 nt, Human
caggaagagcaauguggac

SEQ ID NO: 1343058 - RNA, 21 nt, Human
cauccccucccccaaggagcc

SEQ ID NO: 1343059 - RNA, 23 nt, Human
ccaacacccuaacccacauagcc

SEQ ID NO: 1343060 - RNA, 26 nt, Human
ccaaggagccccucccuuucuggccc

SEQ ID NO: 1343061 - RNA, 18 nt, Human
ccaaugcaucuggcaucu

SEQ ID NO: 1343062 - RNA, 18 nt, Human
ccaaugcaucuggcaucu

SEQ ID NO: 1343063 - RNA, 21 nt, Human
ccacagugcucucccucuuaa

SEQ ID NO: 1343064 - RNA, 20 nt, Human
ccacuagcauccacucccaa

SEQ ID NO: 1343065 - RNA, 22 nt, Human
ccaugccccaucuaccaaacac

SEQ ID NO: 1343066 - RNA, 19 nt, Human
cccagugugccacaaggca

SEQ ID NO: 1343067 - RNA, 20 nt, Human
cccauccucuaccaagauug

SEQ ID NO: 1343068 - RNA, 24 nt, Human
cccaucuaccaaacacacccgaac

SEQ ID NO: 1343069 - RNA, 18 nt, Human
ccccaagacagccaaucu

SEQ ID NO: 1343070 - RNA, 18 nt, Human
ccccaaggagccccuccc

SEQ ID NO: 1343071 - RNA, 20 nt, Human
ccccaaggagccccucccuu

SEQ ID NO: 1343072 - RNA, 19 nt, Human
ccccacugcccucgugccg

SEQ ID NO: 1343073 - RNA, 18 nt, Human
ccccauaccccacaacuc

SEQ ID NO: 1343074 - RNA, 22 nt, Human
ccccaucuaccaaacacacccg

SEQ ID NO: 1343075 - RNA, 24 nt, Human
ccccucccuuucuggcccuuuucc

SEQ ID NO: 1343076 - RNA, 22 nt, Human
ccccugcccccuccagaccaga

SEQ ID NO: 1343077 - RNA, 22 nt, Human
cccgaacuuuucaacaagacaa

SEQ ID NO: 1343078 - RNA, 20 nt, Human
cccucugucagucuuucuuc

SEQ ID NO: 1343079 - RNA, 21 nt, Human
cccugcccccuccagaccaga

SEQ ID NO: 1343080 - RNA, 23 nt, Human
ccuccuccuagcucagagcccac

SEQ ID NO: 1343081 - RNA, 22 nt, Human
ccuccugcccugagugccucug

SEQ ID NO: 1343082 - RNA, 24 nt, Human
ccugcaaagcggccuugaccagca

SEQ ID NO: 1343083 - RNA, 20 nt, Human
ccugcugggggaggagagag

SEQ ID NO: 1343084 - RNA, 21 nt, Human
ccuucuccaccuuacucugga

SEQ ID NO: 1343085 - RNA, 22 nt, Human
ccuugaccagcacccacuaccc

SEQ ID NO: 1343086 - RNA, 23 nt, Human
cuaacccacauagccucuuccuu

SEQ ID NO: 1343087 - RNA, 21 nt, Human
cuaagccccaagaucucacuc

SEQ ID NO: 1343088 - RNA, 20 nt, Human
cucagagcccacugcccucc

SEQ ID NO: 1343089 - RNA, 24 nt, Human
cuccaacacccuaacccacauagc

SEQ ID NO: 1343090 - RNA, 23 nt, Human
cucccucugucagucuuucuucu

SEQ ID NO: 1343091 - RNA, 24 nt, Human
cucccuuucuggcccuuuuccacc

SEQ ID NO: 1343092 - RNA, 23 nt, Human
cucuuaaguucugagagccccac

SEQ ID NO: 1343093 - RNA, 24 nt, Human
cucuuccuuuguguauccuuuagc

SEQ ID NO: 1343094 - RNA, 19 nt, Human
cuggacccucuucuaagcu

SEQ ID NO: 1343095 - RNA, 22 nt, Human
cuggcccuuuuccaccucuucc

SEQ ID NO: 1343096 - RNA, 20 nt, Human
cugggguggugcaguagagc

SEQ ID NO: 1343097 - RNA, 21 nt, Human
cuguaccugaguucaguaaga

SEQ ID NO: 1343098 - RNA, 21 nt, Human
cuuaaguuccuuugggcugug

SEQ ID NO: 1343099 - RNA, 21 nt, Human
gaggagagaggauagagaggc

SEQ ID NO: 1343100 - RNA, 19 nt, Human
gccccaucuaccaaacaca

SEQ ID NO: 1343101 - RNA, 22 nt, Human
gcccucccuuuacccuuuacug

SEQ ID NO: 1343102 - RNA, 20 nt, Human
gcccuuuuccaccucuuccu

SEQ ID NO: 1343103 - RNA, 20 nt, Human
gcguugggggucuucaugcc

SEQ ID NO: 1343104 - RNA, 19 nt, Human
gcuggaaauccuggcugca

SEQ ID NO: 1343105 - RNA, 18 nt, Human
gcuguucguuccuuccag

SEQ ID NO: 1343106 - RNA, 21 nt, Human
ggcagcccacagcccagcaca

SEQ ID NO: 1343107 - RNA, 22 nt, Human
ggccaccuccuccuagcucaga

SEQ ID NO: 1343108 - RNA, 20 nt, Human
gggaagggcugggguggugc

SEQ ID NO: 1343109 - RNA, 23 nt, Human
gggcugggguggugcaguagagc

SEQ ID NO: 1343110 - RNA, 24 nt, Human
gggcuguggggaagggcuggggug

SEQ ID NO: 1343111 - RNA, 23 nt, Human
gugccuaaguuuccccuaggagc

SEQ ID NO: 1343112 - RNA, 19 nt, Human
guggcugggccaccuccuc

SEQ ID NO: 1343113 - RNA, 22 nt, Human
uaagcagucaccuccuccucuc

SEQ ID NO: 1343114 - RNA, 18 nt, Human
uacauuuguuuccacaca

SEQ ID NO: 1343115 - RNA, 22 nt, Human
uaccagaaguccaacauuuucc

SEQ ID NO: 1343116 - RNA, 18 nt, Human
uaccugaguucaguaaga

SEQ ID NO: 1343117 - RNA, 21 nt, Human
uagcauccacucccaaucccc

SEQ ID NO: 1343118 - RNA, 21 nt, Human
uagcauccacucccaaucccu

SEQ ID NO: 1343119 - RNA, 25 nt, Human
uagcgcaggacaaaugugaggaggc

SEQ ID NO: 1343120 - RNA, 22 nt, Human
uagcugaacuuuauucacagcc

SEQ ID NO: 1343121 - RNA, 21 nt, Human
uaggcucaguccucugaugcc

SEQ ID NO: 1343122 - RNA, 27 nt, Human
uaucuagcgcaggacaaaugugagggg

SEQ ID NO: 1343123 - RNA, 24 nt, Human
ucaccuccuccucucuccccaaga

SEQ ID NO: 1343124 - RNA, 22 nt, Human
ucaguggcccucuucuaauccc

SEQ ID NO: 1343125 - RNA, 25 nt, Human
ucaguggcccucuucuaaucccucc

SEQ ID NO: 1343126 - RNA, 18 nt, Human
ucauuaacucccugaaac

SEQ ID NO: 1343127 - RNA, 18 nt, Human
uccacacaugugccaaau

SEQ ID NO: 1343128 - RNA, 20 nt, Human
ucccugaaacaggaaaagcc

SEQ ID NO: 1343129 - RNA, 21 nt, Human
ucccuuuacccuuuacugcca

SEQ ID NO: 1343130 - RNA, 19 nt, Human
uccuaagcagucaccuccu

SEQ ID NO: 1343131 - RNA, 19 nt, Human
uccuccuagcucagagccc

SEQ ID NO: 1343132 - RNA, 22 nt, Human
uccuuuagccucucccagaucc

SEQ ID NO: 1343133 - RNA, 19 nt, Human
ucuguaacccccacugccc

SEQ ID NO: 1343134 - RNA, 19 nt, Human
ucugucagucuuucuucuu

SEQ ID NO: 1343135 - RNA, 20 nt, Human
ucugucagucuuucuucuuu

SEQ ID NO: 1343136 - RNA, 23 nt, Human
ucuuaaguuccuuugggcugugg

SEQ ID NO: 1343137 - RNA, 22 nt, Human
ucuuucuucuuugaauuccucc

SEQ ID NO: 1343138 - RNA, 21 nt, Human
ugaaacaggaaaagccuuaug

SEQ ID NO: 1343139 - RNA, 18 nt, Human
ugagagccccacuaaccc

SEQ ID NO: 1343140 - RNA, 26 nt, Human
ugaggaggcagcccacagcccagcac

SEQ ID NO: 1343141 - RNA, 21 nt, Human
ugaugccccucaucucuagau

SEQ ID NO: 1343142 - RNA, 21 nt, Human
ugccccaucuaccaaacacac

SEQ ID NO: 1343143 - RNA, 21 nt, Human
ugcccugagugccucuggugc

SEQ ID NO: 1343144 - RNA, 22 nt, Human
ugcccugagugccucuggugcu

SEQ ID NO: 1343145 - RNA, 24 nt, Human
ugcccugagugccucuggugcugu

SEQ ID NO: 1343146 - RNA, 19 nt, Human
ugccucuggugcugucugu

SEQ ID NO: 1343147 - RNA, 21 nt, Human
ugccugcugggggaggagaga

SEQ ID NO: 1343148 - RNA, 19 nt, Human
ugcuggaaauccuggcugc

SEQ ID NO: 1343149 - RNA, 23 nt, Human
ugcuggaaauccuggcugcaugc

SEQ ID NO: 1343150 - RNA, 18 nt, Human
uggacacuaccagaaguc

SEQ ID NO: 1343151 - RNA, 20 nt, Human
uggauguuuccuucucauag

SEQ ID NO: 1343152 - RNA, 21 nt, Human
uggcccucuucuaaucccucc

SEQ ID NO: 1343153 - RNA, 18 nt, Human
ugggcuguggggaagggc

SEQ ID NO: 1343154 - RNA, 20 nt, Human
ugggggaggagagaggauag

SEQ ID NO: 1343155 - RNA, 18 nt, Human
uguagucugcgcuagugc

SEQ ID NO: 1343156 - RNA, 21 nt, Human
uguguuccucucuacucaguu

SEQ ID NO: 1343157 - RNA, 23 nt, Human
uguuccuuccccugcccccucca

SEQ ID NO: 1343158 - RNA, 20 nt, Human
uguucguuccuuccaugccc

SEQ ID NO: 1343159 - RNA, 22 nt, Human
uguucguuccuuccaugcccca

SEQ ID NO: 1343160 - RNA, 25 nt, Human
uuccacacaugugccaaauuuuacc

SEQ ID NO: 1343161 - RNA, 22 nt, Human
uuccagcagaaggaauaggagu

SEQ ID NO: 1343162 - RNA, 20 nt, Human
uuccugggccuuccgaucuc

SEQ ID NO: 1343163 - RNA, 18 nt, Human
uucguuccuuccaugccc

SEQ ID NO: 1343164 - RNA, 18 nt, Human
uucuaaucccuccaacac

SEQ ID NO: 1343165 - RNA, 26 nt, Human
uucucauaggucauccccucccccaa

SEQ ID NO: 1343166 - RNA, 20 nt, Human
uugauccuucuccaccuuac

SEQ ID NO: 1343167 - RNA, 21 nt, Human
uuguauuuuuuagagcaaaac

SEQ ID NO: 1343168 - RNA, 22 nt, Human
uuguuuccacacaugugccaaa

SEQ ID NO: 1343169 - RNA, 24 nt, Human
uuuguugccccuucggcuuccugu

SEQ ID NO: 1343170 - RNA, 19 nt, Human
uuuuccaccucuuccuaag

SEQ ID NO: 1343171 - RNA, 23 nt, Human
uuuuuagagcaaaacaacaguua

SEQ ID NO: 1343172 - RNA, 25 nt, Human
aaaacaaaaugaaacagaucucucc

SEQ ID NO: 1343173 - RNA, 23 nt, Human
aaaacaaacaguuacaaggguua

SEQ ID NO: 1343174 - RNA, 24 nt, Human
aaaaucaucuaggaccaaaagcac

SEQ ID NO: 1343175 - RNA, 25 nt, Human
aaacauccuucucccuuaugaaggg

SEQ ID NO: 1343176 - RNA, 26 nt, Human
aaacuccaacgaguuauuacguuccu

SEQ ID NO: 1343177 - RNA, 19 nt, Human
aacaaaaugaaacagaucu

SEQ ID NO: 1343178 - RNA, 19 nt, Human
aacgaguuauuacguuccu

SEQ ID NO: 1343179 - RNA, 21 nt, Human
aaguagacauuugaugaaugu

SEQ ID NO: 1343180 - RNA, 22 nt, Human
acccucauuuuuaaacuccaac

SEQ ID NO: 1343181 - RNA, 22 nt, Human
acuuauuuuccucagcacuuug

SEQ ID NO: 1343182 - RNA, 23 nt, Human
agauuaacaacauauaacuauaa

SEQ ID NO: 1343183 - RNA, 20 nt, Human
aguugauacuuauuuuccuc

SEQ ID NO: 1343184 - RNA, 22 nt, Human
auacuuuucuacugucuucugg

SEQ ID NO: 1343185 - RNA, 23 nt, Human
auuuuuuuucagacaucaguguu

SEQ ID NO: 1343186 - RNA, 20 nt, Human
caaaacaguugccagucuga

SEQ ID NO: 1343187 - RNA, 23 nt, Human
caaaacuagaaagaggcccaagu

SEQ ID NO: 1343188 - RNA, 24 nt, Human
caacaacaaaacaaacaguuacaa

SEQ ID NO: 1343189 - RNA, 22 nt, Human
caaguaguaaggcuaccuaugg

SEQ ID NO: 1343190 - RNA, 18 nt, Human
caauuccuacaccaagac

SEQ ID NO: 1343191 - RNA, 20 nt, Human
cagaaaauacuuauguaaau

SEQ ID NO: 1343192 - RNA, 20 nt, Human
caggaaaagugaagcgaaaa

SEQ ID NO: 1343193 - RNA, 23 nt, Human
ccaccgaguaacagaccaacucu

SEQ ID NO: 1343194 - RNA, 18 nt, Human
ccuacaccaagacaacuc

SEQ ID NO: 1343195 - RNA, 20 nt, Human
ccucauuuuuaaacuccaac

SEQ ID NO: 1343196 - RNA, 22 nt, Human
cgcaccuucgucucugcacucu

SEQ ID NO: 1343197 - RNA, 20 nt, Human
cggcaaaacaaaaugaaaag

SEQ ID NO: 1343198 - RNA, 21 nt, Human
cggcaaaacaaaaugaaacag

SEQ ID NO: 1343199 - RNA, 20 nt, Human
cugcacucucacccgccagg

SEQ ID NO: 1343200 - RNA, 23 nt, Human
gcagauccucuuuuuuguccuug

SEQ ID NO: 1343201 - RNA, 22 nt, Human
gccaagacccucauuuuuaaac

SEQ ID NO: 1343202 - RNA, 26 nt, Human
gccauaccuucaccuugggcagaucc

SEQ ID NO: 1343203 - RNA, 18 nt, Human
guaugucuaaacaugucu

SEQ ID NO: 1343204 - RNA, 21 nt, Human
uaacuauaaccuugucuccaa

SEQ ID NO: 1343205 - RNA, 22 nt, Human
uaaguagacauuugaugaaugu

SEQ ID NO: 1343206 - RNA, 18 nt, Human
uacaaacauccuucuccc

SEQ ID NO: 1343207 - RNA, 24 nt, Human
uacccaaaaggcuuagaaauaauu

SEQ ID NO: 1343208 - RNA, 19 nt, Human
uaccugaacuuaacuaauc

SEQ ID NO: 1343209 - RNA, 22 nt, Human
uaccuucaccuugggcagaucc

SEQ ID NO: 1343210 - RNA, 21 nt, Human
uagaaagaggcccaaguagua

SEQ ID NO: 1343211 - RNA, 23 nt, Human
uaggaccaaaagcacuaucaagu

SEQ ID NO: 1343212 - RNA, 21 nt, Human
uaguccuuccuggcccaugcu

SEQ ID NO: 1343213 - RNA, 21 nt, Human
ucauagacagccaacuugcag

SEQ ID NO: 1343214 - RNA, 19 nt, Human
ucccacagaaaauacuuau

SEQ ID NO: 1343215 - RNA, 19 nt, Human
ucuacagccaggaaaagug

SEQ ID NO: 1343216 - RNA, 23 nt, Human
ucuacagccaggaaaagugaagc

SEQ ID NO: 1343217 - RNA, 18 nt, Human
ucucuguugaccauuguu

SEQ ID NO: 1343218 - RNA, 21 nt, Human
ucuuaugucauguauuuggcu

SEQ ID NO: 1343219 - RNA, 23 nt, Human
ucuucuaaaucucuaaaugcuca

SEQ ID NO: 1343220 - RNA, 20 nt, Human
ucuugcuacaaaacaguugc

SEQ ID NO: 1343221 - RNA, 19 nt, Human
ucuugcuuuccaauuccua

SEQ ID NO: 1343222 - RNA, 18 nt, Human
ugaagagaacagcugagg

SEQ ID NO: 1343223 - RNA, 22 nt, Human
ugaagcgaaaacggcuuccgua

SEQ ID NO: 1343224 - RNA, 21 nt, Human
ugucuagaaagaaugauagaa

SEQ ID NO: 1343225 - RNA, 19 nt, Human
uugaaaaaaaaacaacaac

SEQ ID NO: 1343226 - RNA, 27 nt, Human
uugaagauacuuuucuacugucuucug

SEQ ID NO: 1343227 - RNA, 19 nt, Human
uugccaagacccucauuuu

SEQ ID NO: 1343228 - RNA, 23 nt, Human
uugcuggcugccauuuucacucu

SEQ ID NO: 1343229 - RNA, 21 nt, Human
uuguaugucuaaacaugucuu

SEQ ID NO: 1343230 - RNA, 24 nt, Human
uuuaaguagacauuugaugaaugu

SEQ ID NO: 1343231 - RNA, 26 nt, Human
uuuccaauuccuacaccaagacaacu

SEQ ID NO: 1343232 - RNA, 25 nt, Human
aaacaacaacaacaaaaaacauacc

SEQ ID NO: 1343233 - RNA, 21 nt, Human
aaaguugacaaagucagauaa

SEQ ID NO: 1343234 - RNA, 22 nt, Human
aaauaaaguugacaaagucaga

SEQ ID NO: 1343235 - RNA, 22 nt, Human
aacaacaacaaaaaacauaccu

SEQ ID NO: 1343236 - RNA, 26 nt, Human
aacagagccaauccaaggcagaauga

SEQ ID NO: 1343237 - RNA, 22 nt, Human
aagcagacacggcggcccggac

SEQ ID NO: 1343238 - RNA, 23 nt, Human
acaaaaaacauaccuacauuucc

SEQ ID NO: 1343239 - RNA, 27 nt, Human
acaacaaaaaacauaccuacauuucca

SEQ ID NO: 1343240 - RNA, 24 nt, Human
acuguaucuucaucuuaauuuuua

SEQ ID NO: 1343241 - RNA, 18 nt, Human
agacugaaauuuaggccu

SEQ ID NO: 1343242 - RNA, 18 nt, Human
agagcucuucacauuccc

SEQ ID NO: 1343243 - RNA, 20 nt, Human
agccggcagcggcagcggca

SEQ ID NO: 1343244 - RNA, 21 nt, Human
aggaaggauuuggacucuugg

SEQ ID NO: 1343245 - RNA, 20 nt, Human
agggaacaaaaagauuucca

SEQ ID NO: 1343246 - RNA, 21 nt, Human
aucugaaagguuuaaacagag

SEQ ID NO: 1343247 - RNA, 18 nt, Human
aucuuucucuucuucagu

SEQ ID NO: 1343248 - RNA, 22 nt, Human
auuuuuuucuuccuuuuuuggc

SEQ ID NO: 1343249 - RNA, 19 nt, Human
caaaauagauuuauccaga

SEQ ID NO: 1343250 - RNA, 24 nt, Human
caaagaauuuauuguaaauguagu

SEQ ID NO: 1343251 - RNA, 23 nt, Human
caaauuccugacugaauccuuca

SEQ ID NO: 1343252 - RNA, 22 nt, Human
caacaacaaaaaacauaccuac

SEQ ID NO: 1343253 - RNA, 20 nt, Human
caacaacaacaaaaaacaua

SEQ ID NO: 1343254 - RNA, 22 nt, Human
caacaacaacaaaaaacauacc

SEQ ID NO: 1343255 - RNA, 23 nt, Human
caacaacaacaaaaaacauaccu

SEQ ID NO: 1343256 - RNA, 18 nt, Human
cacugcacagccgagagc

SEQ ID NO: 1343257 - RNA, 19 nt, Human
cagacaauaaaccugagau

SEQ ID NO: 1343258 - RNA, 19 nt, Human
cagccgagagcucuucaca

SEQ ID NO: 1343259 - RNA, 19 nt, Human
cagcggcagcggcagcggu

SEQ ID NO: 1343260 - RNA, 20 nt, Human
cagcggcagcggcagcggug

SEQ ID NO: 1343261 - RNA, 18 nt, Human
cauuccccggcuccgggg

SEQ ID NO: 1343262 - RNA, 19 nt, Human
ccccggcaauuccagccuc

SEQ ID NO: 1343263 - RNA, 21 nt, Human
cccggcaauuccagccucggc

SEQ ID NO: 1343264 - RNA, 21 nt, Human
ccgcggccgcuggagccuugu

SEQ ID NO: 1343265 - RNA, 19 nt, Human
ccuccccggcaauuccagc

SEQ ID NO: 1343266 - RNA, 19 nt, Human
ccuccucuucuaaacuuuu

SEQ ID NO: 1343267 - RNA, 19 nt, Human
ccugagccucuuuuuggcc

SEQ ID NO: 1343268 - RNA, 18 nt, Human
cgcggcccaggccccgac

SEQ ID NO: 1343269 - RNA, 19 nt, Human
cggcagcggcagcgguggc

SEQ ID NO: 1343270 - RNA, 18 nt, Human
cggcagcgguggccggcc

SEQ ID NO: 1343271 - RNA, 20 nt, Human
cggcccggaccaccgcggcc

SEQ ID NO: 1343272 - RNA, 26 nt, Human
cucauucuuuucuucuucauuuuguu

SEQ ID NO: 1343273 - RNA, 20 nt, Human
cucuucaaauuccugacuga

SEQ ID NO: 1343274 - RNA, 22 nt, Human
cuucauggcuggguuaaauacu

SEQ ID NO: 1343275 - RNA, 21 nt, Human
cuugcuuugggccuccccggc

SEQ ID NO: 1343276 - RNA, 18 nt, Human
cuuuucuucuucauuuug

SEQ ID NO: 1343277 - RNA, 18 nt, Human
gaaauacuuaaugugaug

SEQ ID NO: 1343278 - RNA, 20 nt, Human
gagccucuuuuuggccuugc

SEQ ID NO: 1343279 - RNA, 18 nt, Human
gauaaugauaaucuauca

SEQ ID NO: 1343280 - RNA, 22 nt, Human
gcagcggcagcgguggccggcc

SEQ ID NO: 1343281 - RNA, 26 nt, Human
ggccccgacgguaccacugcacagcc

SEQ ID NO: 1343282 - RNA, 18 nt, Human
ggccuccccggcaauucc

SEQ ID NO: 1343283 - RNA, 20 nt, Human
gugaugacccauuuucagau

SEQ ID NO: 1343284 - RNA, 21 nt, Human
uaaaaaaaacucagaauucca

SEQ ID NO: 1343285 - RNA, 23 nt, Human
uaaaaacaacaacaacaaaaaac

SEQ ID NO: 1343286 - RNA, 25 nt, Human
uaagaguguauuggucauggcaucu

SEQ ID NO: 1343287 - RNA, 28 nt, Human
uaaguaccuuucauuagggucaaauuuu

SEQ ID NO: 1343288 - RNA, 19 nt, Human
uagaauucucauucuuuuc

SEQ ID NO: 1343289 - RNA, 18 nt, Human
uagggucaaauuuuuccu

SEQ ID NO: 1343290 - RNA, 19 nt, Human
uaucagacaauaaaccuga

SEQ ID NO: 1343291 - RNA, 22 nt, Human
uauuuugcuuuuuaugcucauu

SEQ ID NO: 1343292 - RNA, 21 nt, Human
ucagauaaaaaaaacucagaa

SEQ ID NO: 1343293 - RNA, 21 nt, Human
ucauucuuuucuucuucauuu

SEQ ID NO: 1343294 - RNA, 18 nt, Human
uccagauuugcaggacca

SEQ ID NO: 1343295 - RNA, 22 nt, Human
uccugagccucuuuuuggccuu

SEQ ID NO: 1343296 - RNA, 21 nt, Human
ucgcggcccaggccccgacgg

SEQ ID NO: 1343297 - RNA, 18 nt, Human
ucuaucagacaauaaacc

SEQ ID NO: 1343298 - RNA, 21 nt, Human
ucuaucagacaauaaaccuga

SEQ ID NO: 1343299 - RNA, 20 nt, Human
ucuuguucuugccgcccaug

SEQ ID NO: 1343300 - RNA, 22 nt, Human
ucuuucuuuuuaucuuucucuu

SEQ ID NO: 1343301 - RNA, 21 nt, Human
ugacaaagucagauaaaaaaa

SEQ ID NO: 1343302 - RNA, 22 nt, Human
ugacaaagucagauaaaaaaaa

SEQ ID NO: 1343303 - RNA, 22 nt, Human
ugacugaauccuucaggaagug

SEQ ID NO: 1343304 - RNA, 22 nt, Human
uggaagcagacacggcggcccg

SEQ ID NO: 1343305 - RNA, 19 nt, Human
uggccggccuggacacugg

SEQ ID NO: 1343306 - RNA, 20 nt, Human
ugggaagauucuuccugacc

SEQ ID NO: 1343307 - RNA, 18 nt, Human
ugggagauuuuccagucc

SEQ ID NO: 1343308 - RNA, 20 nt, Human
uguagaauuaaaacuauaaa

SEQ ID NO: 1343309 - RNA, 22 nt, Human
uuaaaaacaacaacaacaaaaa

SEQ ID NO: 1343310 - RNA, 19 nt, Human
uuaaacucaaguuuguuaa

SEQ ID NO: 1343311 - RNA, 24 nt, Human
uuaaaguaugugcuuuuuucccac

SEQ ID NO: 1343312 - RNA, 22 nt, Human
uuagguugcugcucuucaaauu

SEQ ID NO: 1343313 - RNA, 18 nt, Human
uucaauguccuuugucuu

SEQ ID NO: 1343314 - RNA, 18 nt, Human
uuccugagccucuuuuug

SEQ ID NO: 1343315 - RNA, 22 nt, Human
uucuuucuuuuuaucuuucucu

SEQ ID NO: 1343316 - RNA, 21 nt, Human
uugggagauuuuccaguccaa

SEQ ID NO: 1343317 - RNA, 22 nt, Human
uuucaugacuguaucuucaucu

SEQ ID NO: 1343318 - RNA, 20 nt, Human
uuuccaguaucuaccuacug

SEQ ID NO: 1343319 - RNA, 23 nt, Human
uuuuuuggcaguaagucuuccag

SEQ ID NO: 1343320 - RNA, 23 nt, Human
aaauauuuacacagaacaggaca

SEQ ID NO: 1343321 - RNA, 20 nt, Human
aacaacacaagccaauccuu

SEQ ID NO: 1343322 - RNA, 22 nt, Human
acacuccagcuuuuggacuugu

SEQ ID NO: 1343323 - RNA, 19 nt, Human
agaauaugcauauuaccuc

SEQ ID NO: 1343324 - RNA, 20 nt, Human
agaguuccuguccaaguuuu

SEQ ID NO: 1343325 - RNA, 21 nt, Human
agcuacgaaagucuauaaaua

SEQ ID NO: 1343326 - RNA, 23 nt, Human
aucauaccucuuucacaccaugg

SEQ ID NO: 1343327 - RNA, 19 nt, Human
augcauuuuuaacuuauga

SEQ ID NO: 1343328 - RNA, 22 nt, Human
auuuuugcuaaugcauugagag

SEQ ID NO: 1343329 - RNA, 23 nt, Human
caagacagggaauuucccaauca

SEQ ID NO: 1343330 - RNA, 24 nt, Human
cacaauguaaaucgaggaccaucu

SEQ ID NO: 1343331 - RNA, 25 nt, Human
caccagcgguacaccagcucuggcc

SEQ ID NO: 1343332 - RNA, 22 nt, Human
cacccuagcaagaggcuucugg

SEQ ID NO: 1343333 - RNA, 21 nt, Human
cagaacaagagaauccuccaa

SEQ ID NO: 1343334 - RNA, 20 nt, Human
cagaauaugcauauuaccuc

SEQ ID NO: 1343335 - RNA, 22 nt, Human
cagccccauuucaagcugagga

SEQ ID NO: 1343336 - RNA, 24 nt, Human
caggacaaaggaugauuuuccuuu

SEQ ID NO: 1343337 - RNA, 23 nt, Human
caucaugauuacagauggucacc

SEQ ID NO: 1343338 - RNA, 22 nt, Human
ccaacagauaccuuuggacugg

SEQ ID NO: 1343339 - RNA, 21 nt, Human
ccaccacaucaugauuacaga

SEQ ID NO: 1343340 - RNA, 24 nt, Human
ccuggguuuccagccuccugccuc

SEQ ID NO: 1343341 - RNA, 19 nt, Human
cugaagagaaaaaaagacc

SEQ ID NO: 1343342 - RNA, 20 nt, Human
cuucagaauaugcauauuac

SEQ ID NO: 1343343 - RNA, 20 nt, Human
cuuguaagaccugauccacc

SEQ ID NO: 1343344 - RNA, 18 nt, Human
cuuguaagaccugauccc

SEQ ID NO: 1343345 - RNA, 21 nt, Human
cuuuggacuggaccuugcacc

SEQ ID NO: 1343346 - RNA, 20 nt, Human
gaauaugcauauuaccucca

SEQ ID NO: 1343347 - RNA, 18 nt, Human
gaccugauccaccagcgg

SEQ ID NO: 1343348 - RNA, 18 nt, Human
gagaaaaaaagaccgucc

SEQ ID NO: 1343349 - RNA, 21 nt, Human
gagaucgcggacccugacccu

SEQ ID NO: 1343350 - RNA, 18 nt, Human
gauuuuugcuaaugcauu

SEQ ID NO: 1343351 - RNA, 20 nt, Human
gcagccccauuucaagcuga

SEQ ID NO: 1343352 - RNA, 21 nt, Human
gcguccaagauuuaccaccac

SEQ ID NO: 1343353 - RNA, 18 nt, Human
ggacccugacccucgugc

SEQ ID NO: 1343354 - RNA, 21 nt, Human
ggcccagggcaagacagggaa

SEQ ID NO: 1343355 - RNA, 23 nt, Human
guagaauuuuucuaagcuacgaa

SEQ ID NO: 1343356 - RNA, 20 nt, Human
guaugguuucuguauccuga

SEQ ID NO: 1343357 - RNA, 20 nt, Human
gucaccaacuuauguuuuag

SEQ ID NO: 1343358 - RNA, 19 nt, Human
uaacaacacaagccaaucc

SEQ ID NO: 1343359 - RNA, 20 nt, Human
uaacucaacguuuuucaaga

SEQ ID NO: 1343360 - RNA, 25 nt, Human
uaagguagcguccaagauuuaccac

SEQ ID NO: 1343361 - RNA, 22 nt, Human
uagccacucucuccauuaggcc

SEQ ID NO: 1343362 - RNA, 21 nt, Human
uaggauuuuuugacuuuauga

SEQ ID NO: 1343363 - RNA, 21 nt, Human
ucauaccucuuucacaccaug

SEQ ID NO: 1343364 - RNA, 25 nt, Human
uccaaguuuugcucacacccuagca

SEQ ID NO: 1343365 - RNA, 19 nt, Human
ucccaaucacugaguaggc

SEQ ID NO: 1343366 - RNA, 23 nt, Human
ucugaagagaaaaaaagaccguc

SEQ ID NO: 1343367 - RNA, 25 nt, Human
ugacaaacacaaacaucuacugaga

SEQ ID NO: 1343368 - RNA, 21 nt, Human
ugacuucaccauggggaaggg

SEQ ID NO: 1343369 - RNA, 20 nt, Human
uggcccagggcaagacaggg

SEQ ID NO: 1343370 - RNA, 25 nt, Human
ugguaugguuucuguauccugacug

SEQ ID NO: 1343371 - RNA, 20 nt, Human
uguagccacucucuccauua

SEQ ID NO: 1343372 - RNA, 20 nt, Human
uucaucccucuuaaaaguua

SEQ ID NO: 1343373 - RNA, 21 nt, Human
uuccugggguacucucagucc

SEQ ID NO: 1343374 - RNA, 23 nt, Human
uuccuuugucuaguuauuguaag

SEQ ID NO: 1343375 - RNA, 21 nt, Human
uuguaagguagcguccaagau

SEQ ID NO: 1343376 - RNA, 25 nt, Human
uuuccagccuccugccucacacucc

SEQ ID NO: 1343377 - RNA, 20 nt, Human
uuugucuggagaaucuugac

SEQ ID NO: 1343378 - RNA, 22 nt, Human
aacagcacugacagaaugugua

SEQ ID NO: 1343379 - RNA, 21 nt, Human
aagcucaagugauccuccugc

SEQ ID NO: 1343380 - RNA, 25 nt, Human
aagugauccuccugccucagccucc

SEQ ID NO: 1343381 - RNA, 19 nt, Human
acgcagcgcgcagacgugu

SEQ ID NO: 1343382 - RNA, 19 nt, Human
aggucgcugccccggggag

SEQ ID NO: 1343383 - RNA, 24 nt, Human
caaaguuccgggacuacaggugug

SEQ ID NO: 1343384 - RNA, 22 nt, Human
caagugauccuccugccucagc

SEQ ID NO: 1343385 - RNA, 27 nt, Human
caagugauccuccugccucagccuccc

SEQ ID NO: 1343386 - RNA, 19 nt, Human
cacccgggcuccaggucgc

SEQ ID NO: 1343387 - RNA, 24 nt, Human
cacccgggcuccaggucgcugccc

SEQ ID NO: 1343388 - RNA, 23 nt, Human
cacgcagcgcgcagacguguggc

SEQ ID NO: 1343389 - RNA, 18 nt, Human
cagccuuugccacagccc

SEQ ID NO: 1343390 - RNA, 24 nt, Human
ccaaaguuccgggacuacaggugu

SEQ ID NO: 1343391 - RNA, 24 nt, Human
cccaaaguuccgggacuacaggug

SEQ ID NO: 1343392 - RNA, 18 nt, Human
ccgcgcgcgcccuucucu

SEQ ID NO: 1343393 - RNA, 23 nt, Human
ccuccugccucagccucccaaag

SEQ ID NO: 1343394 - RNA, 18 nt, Human
cgcugcggggcgcgggaa

SEQ ID NO: 1343395 - RNA, 20 nt, Human
cgggaaagcgacgcgcggug

SEQ ID NO: 1343396 - RNA, 22 nt, Human
cgggacuacaggugugagcuac

SEQ ID NO: 1343397 - RNA, 24 nt, Human
cgggacuacaggugugagcuacug

SEQ ID NO: 1343398 - RNA, 25 nt, Human
cgggacuacaggugugagcuacugc

SEQ ID NO: 1343399 - RNA, 25 nt, Human
cggugcagacugccgcacccgggcu

SEQ ID NO: 1343400 - RNA, 24 nt, Human
cucaagugauccuccugccucagc

SEQ ID NO: 1343401 - RNA, 22 nt, Human
cucugugccgcgcgcgcccuuc

SEQ ID NO: 1343402 - RNA, 20 nt, Human
cugccucagccucccaaagu

SEQ ID NO: 1343403 - RNA, 24 nt, Human
cugcuugcugguuuuaccuucgau

SEQ ID NO: 1343404 - RNA, 18 nt, Human
gacuacaggugugagcua

SEQ ID NO: 1343405 - RNA, 19 nt, Human
gacuacaggugugagcuac

SEQ ID NO: 1343406 - RNA, 23 nt, Human
gacuacaggugugagcuacugca

SEQ ID NO: 1343407 - RNA, 19 nt, Human
gccccggggaggaagugcu

SEQ ID NO: 1343408 - RNA, 18 nt, Human
gcuccaggucgcugcccc

SEQ ID NO: 1343409 - RNA, 21 nt, Human
gggacuacaggugugagcuac

SEQ ID NO: 1343410 - RNA, 23 nt, Human
gggacuacaggugugagcuacug

SEQ ID NO: 1343411 - RNA, 24 nt, Human
gugauccuccugccucagccuccc

SEQ ID NO: 1343412 - RNA, 22 nt, Human
uaaaagagcaguuacuggaaua

SEQ ID NO: 1343413 - RNA, 18 nt, Human
uagauggcugagcuggug

SEQ ID NO: 1343414 - RNA, 24 nt, Human
uaguagagacaagcucucgcuaua

SEQ ID NO: 1343415 - RNA, 24 nt, Human
uauauuguccagucuggucucaaa

SEQ ID NO: 1343416 - RNA, 18 nt, Human
ucaagugauccuccugcc

SEQ ID NO: 1343417 - RNA, 18 nt, Human
ucagccucccaaaguucc

SEQ ID NO: 1343418 - RNA, 20 nt, Human
ucagccucccaaaguuccgg

SEQ ID NO: 1343419 - RNA, 20 nt, Human
uccuccugccucagccuccc

SEQ ID NO: 1343420 - RNA, 19 nt, Human
ucugugccgcgcgcgcccu

SEQ ID NO: 1343421 - RNA, 24 nt, Human
ugaagcucaagugauccuccugcc

SEQ ID NO: 1343422 - RNA, 19 nt, Human
ugacuguccccaaguuugu

SEQ ID NO: 1343423 - RNA, 24 nt, Human
ugccgcgcgcgcccuucucucagg

SEQ ID NO: 1343424 - RNA, 24 nt, Human
ugccucagccucccaaaguuccgg

SEQ ID NO: 1343425 - RNA, 18 nt, Human
ugccuguuuuagguccug

SEQ ID NO: 1343426 - RNA, 19 nt, Human
ugcggggcgcgggaaggcg

SEQ ID NO: 1343427 - RNA, 20 nt, Human
uggcugagcuggugcagcug

SEQ ID NO: 1343428 - RNA, 23 nt, Human
uggcugagcuggugcagcugcau

SEQ ID NO: 1343429 - RNA, 18 nt, Human
ugggcuggguggugccug

SEQ ID NO: 1343430 - RNA, 18 nt, Human
uguccauugggcugggug

SEQ ID NO: 1343431 - RNA, 18 nt, Human
uguuucagcaugucucug

SEQ ID NO: 1343432 - RNA, 23 nt, Human
uucagcaugucucugggccucuu

SEQ ID NO: 1343433 - RNA, 24 nt, Human
uuuuuuaguagagacaagcucucg

SEQ ID NO: 1343434 - RNA, 20 nt, Human
acuagugacugaaugauguc

SEQ ID NO: 1343435 - RNA, 22 nt, Human
aguacaaguuccacucugcuac

SEQ ID NO: 1343436 - RNA, 24 nt, Human
gagcacacaucuuccaugcugucc

SEQ ID NO: 1343437 - RNA, 18 nt, Human
gcuguccgcugauugccu

SEQ ID NO: 1343438 - RNA, 21 nt, Human
uacaaguuccacucugcuaca

SEQ ID NO: 1343439 - RNA, 18 nt, Human
uauccgagccagagcaca

SEQ ID NO: 1343440 - RNA, 18 nt, Human
uuaaaaacauuuauucug

SEQ ID NO: 1343441 - RNA, 21 nt, Human
uuuuuuuuuuuuuuuuuuaca

SEQ ID NO: 1343442 - RNA, 19 nt, Human
aagaaggggcuggugggcu

SEQ ID NO: 1343443 - RNA, 20 nt, Human
acugcucugccuucucaggu

SEQ ID NO: 1343444 - RNA, 23 nt, Human
acugcucugccuucucagguggg

SEQ ID NO: 1343445 - RNA, 23 nt, Human
agaaaaaaacgggauuuccuuca

SEQ ID NO: 1343446 - RNA, 21 nt, Human
agcacagacacugcucugccu

SEQ ID NO: 1343447 - RNA, 23 nt, Human
aggagcagcuuaggguccuggga

SEQ ID NO: 1343448 - RNA, 18 nt, Human
aggaggcaggggugcugc

SEQ ID NO: 1343449 - RNA, 19 nt, Human
aggaggcaggggugcuggc

SEQ ID NO: 1343450 - RNA, 23 nt, Human
aggccaggaccaggaggcagggg

SEQ ID NO: 1343451 - RNA, 19 nt, Human
caagaagaaggggcuggug

SEQ ID NO: 1343452 - RNA, 18 nt, Human
caccgaagagggcagggu

SEQ ID NO: 1343453 - RNA, 21 nt, Human
cagcacagacacugcucugcc

SEQ ID NO: 1343454 - RNA, 20 nt, Human
caggguguggucaguguggg

SEQ ID NO: 1343455 - RNA, 18 nt, Human
cagugguggcuaccuggc

SEQ ID NO: 1343456 - RNA, 20 nt, Human
cauuuuuguccgcacggcgg

SEQ ID NO: 1343457 - RNA, 24 nt, Human
ccaggacauccucauagucaccca

SEQ ID NO: 1343458 - RNA, 22 nt, Human
ccaggguuuauuuggcgccugg

SEQ ID NO: 1343459 - RNA, 19 nt, Human
cccaugugguccacaaagu

SEQ ID NO: 1343460 - RNA, 23 nt, Human
ccccccuucccucucccccuccc

SEQ ID NO: 1343461 - RNA, 20 nt, Human
cccccuucaaccuugggcuu

SEQ ID NO: 1343462 - RNA, 23 nt, Human
ccugggaagcugagccccccuuc

SEQ ID NO: 1343463 - RNA, 21 nt, Human
cgcacggcggaaaaucugcag

SEQ ID NO: 1343464 - RNA, 23 nt, Human
cggagucagcccugggccaggga

SEQ ID NO: 1343465 - RNA, 22 nt, Human
cucauagucacccauguggucc

SEQ ID NO: 1343466 - RNA, 24 nt, Human
cucauagucacccaugugguccac

SEQ ID NO: 1343467 - RNA, 18 nt, Human
cucugccuucucaggugg

SEQ ID NO: 1343468 - RNA, 26 nt, Human
cuucacaagaagaaggggcugguggg

SEQ ID NO: 1343469 - RNA, 22 nt, Human
gagaggcggagucagcccuggg

SEQ ID NO: 1343470 - RNA, 19 nt, Human
gagcagcuuaggguccugg

SEQ ID NO: 1343471 - RNA, 21 nt, Human
gagcagcuuaggguccuggga

SEQ ID NO: 1343472 - RNA, 18 nt, Human
gagccccccuucccucuc

SEQ ID NO: 1343473 - RNA, 18 nt, Human
gcccccuucaaccuuggg

SEQ ID NO: 1343474 - RNA, 19 nt, Human
gggccagggagaggcaagc

SEQ ID NO: 1343475 - RNA, 18 nt, Human
gggcuccuccacgggccu

SEQ ID NO: 1343476 - RNA, 20 nt, Human
ggggcuggugggcuccucca

SEQ ID NO: 1343477 - RNA, 18 nt, Human
gggggaacugaugaggga

SEQ ID NO: 1343478 - RNA, 26 nt, Human
gucaccgaagagggcagggugugguc

SEQ ID NO: 1343479 - RNA, 18 nt, Human
guggccaugugaggggua

SEQ ID NO: 1343480 - RNA, 20 nt, Human
gugggcuccuccacgggccu

SEQ ID NO: 1343481 - RNA, 19 nt, Human
uagaagaaugucaccgaag

SEQ ID NO: 1343482 - RNA, 22 nt, Human
ucaaccuugggcuucaccagga

SEQ ID NO: 1343483 - RNA, 23 nt, Human
ucaccaggaccuggcagcacaga

SEQ ID NO: 1343484 - RNA, 20 nt, Human
ucagugugggucaugcgugg

SEQ ID NO: 1343485 - RNA, 18 nt, Human
uccaaggacagcuuccca

SEQ ID NO: 1343486 - RNA, 22 nt, Human
uccaaggacagcuucccaucau

SEQ ID NO: 1343487 - RNA, 18 nt, Human
uccacgggccucugggag

SEQ ID NO: 1343488 - RNA, 19 nt, Human
uccacgggccucugggagg

SEQ ID NO: 1343489 - RNA, 24 nt, Human
uccuccaaggacagcuucccauca

SEQ ID NO: 1343490 - RNA, 23 nt, Human
uccuccacgggccucugggaggc

SEQ ID NO: 1343491 - RNA, 22 nt, Human
ucucccaggagcagcuuagggu

SEQ ID NO: 1343492 - RNA, 26 nt, Human
ucugcaccaaagugucugucuagaaa

SEQ ID NO: 1343493 - RNA, 19 nt, Human
ugaaaagaagcuucugcac

SEQ ID NO: 1343494 - RNA, 21 nt, Human
ugaaaagaagcuucugcacca

SEQ ID NO: 1343495 - RNA, 22 nt, Human
ugcaaagaagagcuggaauucc

SEQ ID NO: 1343496 - RNA, 23 nt, Human
ugcucugccuucucagguggggg

SEQ ID NO: 1343497 - RNA, 25 nt, Human
ugggaagcugagccccccuucccuc

SEQ ID NO: 1343498 - RNA, 19 nt, Human
ugucuagaaaaaaacggga

SEQ ID NO: 1343499 - RNA, 23 nt, Human
ugucuagaaaaaaacgggauuuc

SEQ ID NO: 1343500 - RNA, 18 nt, Human
uuuguccgcacggcggaa

SEQ ID NO: 1343501 - RNA, 21 nt, Human
aagcaggaggacgcgagacga

SEQ ID NO: 1343502 - RNA, 19 nt, Human
accauuuguaucuugggcu

SEQ ID NO: 1343503 - RNA, 18 nt, Human
agcacuuaucaaagcuaa

SEQ ID NO: 1343504 - RNA, 24 nt, Human
agcaggaggacgcgagacgacugc

SEQ ID NO: 1343505 - RNA, 22 nt, Human
caaaacaucccuugcaucaagu

SEQ ID NO: 1343506 - RNA, 22 nt, Human
caccagaacaagcaacauuaaa

SEQ ID NO: 1343507 - RNA, 24 nt, Human
ccaccaggcugugcucucucucag

SEQ ID NO: 1343508 - RNA, 21 nt, Human
ccagaacccaccaggcugugc

SEQ ID NO: 1343509 - RNA, 19 nt, Human
ccauuuguaucuugggcuu

SEQ ID NO: 1343510 - RNA, 21 nt, Human
cccaccaggcugugcucucuc

SEQ ID NO: 1343511 - RNA, 19 nt, Human
ccccagaacccaccaggcu

SEQ ID NO: 1343512 - RNA, 24 nt, Human
cccggccccuaggccguagacccc

SEQ ID NO: 1343513 - RNA, 28 nt, Human
cccggccccuaggccguagaccccagaa

SEQ ID NO: 1343514 - RNA, 22 nt, Human
ccguagaccccagaacccacca

SEQ ID NO: 1343515 - RNA, 21 nt, Human
ccucggggcuggagcccggcu

SEQ ID NO: 1343516 - RNA, 22 nt, Human
ccucggggcuggagcccggcuc

SEQ ID NO: 1343517 - RNA, 26 nt, Human
ccuucucaaaaaacuuugcuuaaggg

SEQ ID NO: 1343518 - RNA, 22 nt, Human
cggccccuaggccguagacccc

SEQ ID NO: 1343519 - RNA, 21 nt, Human
cguagaccccagaacccacca

SEQ ID NO: 1343520 - RNA, 18 nt, Human
cuaauagcacuuaucaaa

SEQ ID NO: 1343521 - RNA, 23 nt, Human
cuguucaccagaacaagcaacau

SEQ ID NO: 1343522 - RNA, 20 nt, Human
gaccccagaacccaccaggc

SEQ ID NO: 1343523 - RNA, 19 nt, Human
gagcccggcucgggaucgc

SEQ ID NO: 1343524 - RNA, 19 nt, Human
gauaacauugguucccaug

SEQ ID NO: 1343525 - RNA, 20 nt, Human
gaucgcagcacuggucgcgg

SEQ ID NO: 1343526 - RNA, 19 nt, Human
ggaggggguacuaucuaca

SEQ ID NO: 1343527 - RNA, 20 nt, Human
guagaccccagaacccacca

SEQ ID NO: 1343528 - RNA, 20 nt, Human
uacaacaaauacuucauuca

SEQ ID NO: 1343529 - RNA, 24 nt, Human
uagaagcuuaaacacuuuuccaag

SEQ ID NO: 1343530 - RNA, 21 nt, Human
uagccauaaaccauuuguauc

SEQ ID NO: 1343531 - RNA, 19 nt, Human
ucauuucccuucucaaaaa

SEQ ID NO: 1343532 - RNA, 23 nt, Human
ucccauguuauauauucauuacu

SEQ ID NO: 1343533 - RNA, 25 nt, Human
ucccuucucaaaaaacuuugcuuaa

SEQ ID NO: 1343534 - RNA, 24 nt, Human
uccguaggcaggcccgcccgaccc

SEQ ID NO: 1343535 - RNA, 20 nt, Human
uccucggggcuggagcccgg

SEQ ID NO: 1343536 - RNA, 22 nt, Human
uccucggggcuggagcccggcu

SEQ ID NO: 1343537 - RNA, 24 nt, Human
ucuaaacagauuuauucuuuaaga

SEQ ID NO: 1343538 - RNA, 21 nt, Human
ugaaaauggaaccuuauccca

SEQ ID NO: 1343539 - RNA, 23 nt, Human
ugcugcuggcccgcgggguuccg

SEQ ID NO: 1343540 - RNA, 21 nt, Human
uggaaccuuaucccagugcua

SEQ ID NO: 1343541 - RNA, 18 nt, Human
uggcacguaacauggcua

SEQ ID NO: 1343542 - RNA, 23 nt, Human
uucaccagaacaagcaacauuaa

SEQ ID NO: 1343543 - RNA, 19 nt, Human
aaacccaggccugccucug

SEQ ID NO: 1343544 - RNA, 21 nt, Human
aagcaaacucgacugaaucca

SEQ ID NO: 1343545 - RNA, 19 nt, Human
aauaaacccaggccugccu

SEQ ID NO: 1343546 - RNA, 21 nt, Human
agacaagagccugacaagagc

SEQ ID NO: 1343547 - RNA, 22 nt, Human
agcuggucacuuagccgccugg

SEQ ID NO: 1343548 - RNA, 21 nt, Human
augcuaaccuccagcucuggu

SEQ ID NO: 1343549 - RNA, 23 nt, Human
cacaacuucaugggccacacagg

SEQ ID NO: 1343550 - RNA, 18 nt, Human
cagcaaggacagggccuc

SEQ ID NO: 1343551 - RNA, 18 nt, Human
cagcaaggacagggccuc

SEQ ID NO: 1343552 - RNA, 18 nt, Human
cccagguaaauucccagg

SEQ ID NO: 1343553 - RNA, 22 nt, Human
cccuuagacaacacaaucuccg

SEQ ID NO: 1343554 - RNA, 20 nt, Human
cccuuguccagagcugccuu

SEQ ID NO: 1343555 - RNA, 25 nt, Human
ccugaccccugggguugggucuggg

SEQ ID NO: 1343556 - RNA, 26 nt, Human
ccugaccccugggguugggucugggg

SEQ ID NO: 1343557 - RNA, 22 nt, Human
cgacugaauccaagugaucugu

SEQ ID NO: 1343558 - RNA, 23 nt, Human
cguggguggcagcagcacugguc

SEQ ID NO: 1343559 - RNA, 19 nt, Human
cucguggcugugggugugg

SEQ ID NO: 1343560 - RNA, 19 nt, Human
cucuggacugccugcuccc

SEQ ID NO: 1343561 - RNA, 23 nt, Human
cucuggugcaguucccacggagc

SEQ ID NO: 1343562 - RNA, 22 nt, Human
cuggcagcaaggacagggccuc

SEQ ID NO: 1343563 - RNA, 23 nt, Human
cuuagacaacacaaucuccgaaa

SEQ ID NO: 1343564 - RNA, 21 nt, Human
gaccccaucauccuguuccca

SEQ ID NO: 1343565 - RNA, 21 nt, Human
gaccccaucauccuguucccc

SEQ ID NO: 1343566 - RNA, 20 nt, Human
gcagcaaggacagggccucg

SEQ ID NO: 1343567 - RNA, 24 nt, Human
gcucuggugcaguucccacggagc

SEQ ID NO: 1343568 - RNA, 21 nt, Human
ggaaggagggcaggcaggagg

SEQ ID NO: 1343569 - RNA, 21 nt, Human
ggaaggagggcaggcaggagg

SEQ ID NO: 1343570 - RNA, 24 nt, Human
ggccccacaguccuagaagcacag

SEQ ID NO: 1343571 - RNA, 23 nt, Human
gggaaggagggcaggcaggaggg

SEQ ID NO: 1343572 - RNA, 19 nt, Human
gggcuggggaggccaguuc

SEQ ID NO: 1343573 - RNA, 26 nt, Human
gguguggguggguggguagguaggug

SEQ ID NO: 1343574 - RNA, 25 nt, Human
guccagagcugccuuggccuaaugg

SEQ ID NO: 1343575 - RNA, 20 nt, Human
guggguggguggguagguag

SEQ ID NO: 1343576 - RNA, 24 nt, Human
uaaccuccagcucuggugcaguuc

SEQ ID NO: 1343577 - RNA, 23 nt, Human
ucagguccaccugcaauaaaccc

SEQ ID NO: 1343578 - RNA, 27 nt, Human
ucaugggccacacaggggaggaacacc

SEQ ID NO: 1343579 - RNA, 19 nt, Human
uccaagugaucuguaucug

SEQ ID NO: 1343580 - RNA, 19 nt, Human
ucccuuguccagagcugcc

SEQ ID NO: 1343581 - RNA, 24 nt, Human
uccgaggcggcucagacaaacccu

SEQ ID NO: 1343582 - RNA, 24 nt, Human
uccuugcaagaugcuaaccuccag

SEQ ID NO: 1343583 - RNA, 21 nt, Human
ucuggcagcaaggacagggcc

SEQ ID NO: 1343584 - RNA, 21 nt, Human
ucuguaucugccaaaaaggag

SEQ ID NO: 1343585 - RNA, 18 nt, Human
ugagccaggucccuccug

SEQ ID NO: 1343586 - RNA, 20 nt, Human
ugaucuguaucugccaaaaa

SEQ ID NO: 1343587 - RNA, 25 nt, Human
uggcagcaaggacagggccucgugg

SEQ ID NO: 1343588 - RNA, 23 nt, Human
uggcagugggcuggggaggccag

SEQ ID NO: 1343589 - RNA, 23 nt, Human
uggcagugggcuggggaggccag

SEQ ID NO: 1343590 - RNA, 23 nt, Human
uggcuguucaccugaccccuggg

SEQ ID NO: 1343591 - RNA, 24 nt, Human
ugggaaggagggcaggcaggaggg

SEQ ID NO: 1343592 - RNA, 20 nt, Human
ugggccacacaggggcccca

SEQ ID NO: 1343593 - RNA, 21 nt, Human
ugggcuggggaggccaguucu

SEQ ID NO: 1343594 - RNA, 18 nt, Human
uggguggcagcagcacug

SEQ ID NO: 1343595 - RNA, 24 nt, Human
uggguggcagcagcacugguccuc

SEQ ID NO: 1343596 - RNA, 21 nt, Human
uggguggguagguagguggga

SEQ ID NO: 1343597 - RNA, 25 nt, Human
uguccagagcugccuugagccaggu

SEQ ID NO: 1343598 - RNA, 22 nt, Human
uuucacgacuggauauguuacu

SEQ ID NO: 1343599 - RNA, 23 nt, Human
uuucacgacuggauauguuacua

SEQ ID NO: 1343600 - RNA, 20 nt, Human
uuuuuuuuuuuuuaaagaua

SEQ ID NO: 1343601 - RNA, 19 nt, Human
uuuuuuuuuuuuuuuuuaa

SEQ ID NO: 1343602 - RNA, 21 nt, Human
aaaacaccccagagugaaacg

SEQ ID NO: 1343603 - RNA, 18 nt, Human
aaacaccccagagugaaa

SEQ ID NO: 1343604 - RNA, 22 nt, Human
aaaucccaucguggaggagggg

SEQ ID NO: 1343605 - RNA, 20 nt, Human
aacccaagacaaaaagcccg

SEQ ID NO: 1343606 - RNA, 21 nt, Human
aacugcucccaaugaaucaau

SEQ ID NO: 1343607 - RNA, 18 nt, Human
aagaauaccccauccacc

SEQ ID NO: 1343608 - RNA, 22 nt, Human
aagaauaccccauccaccaaag

SEQ ID NO: 1343609 - RNA, 24 nt, Human
accacaaaaauacgccuagggaau

SEQ ID NO: 1343610 - RNA, 21 nt, Human
accccauccaccaaagccaca

SEQ ID NO: 1343611 - RNA, 23 nt, Human
agaaaucaaugaaaguccauuuc

SEQ ID NO: 1343612 - RNA, 28 nt, Human
agaaaucaaugaaaguccauuucggcaa

SEQ ID NO: 1343613 - RNA, 18 nt, Human
agagaaaaggcaucugga

SEQ ID NO: 1343614 - RNA, 18 nt, Human
aggaggaggaagggaaag

SEQ ID NO: 1343615 - RNA, 22 nt, Human
aggcaucauuauugacuuuuua

SEQ ID NO: 1343616 - RNA, 26 nt, Human
aggcaucuggaggaggaggaagggaa

SEQ ID NO: 1343617 - RNA, 24 nt, Human
agggaaagggggcuggaacccaag

SEQ ID NO: 1343618 - RNA, 21 nt, Human
aucuggaggaggaggaaggga

SEQ ID NO: 1343619 - RNA, 19 nt, Human
aucuuaaauuccuggcuug

SEQ ID NO: 1343620 - RNA, 23 nt, Human
caaaaaacaccccagagugaaac

SEQ ID NO: 1343621 - RNA, 24 nt, Human
caaaaaacaccccagagugaaacg

SEQ ID NO: 1343622 - RNA, 20 nt, Human
caagaauaccccauccacca

SEQ ID NO: 1343623 - RNA, 23 nt, Human
caagaauaccccauccaccaaag

SEQ ID NO: 1343624 - RNA, 26 nt, Human
caagaauaccccauccaccaaagcca

SEQ ID NO: 1343625 - RNA, 18 nt, Human
caagugaccaaagggcug

SEQ ID NO: 1343626 - RNA, 20 nt, Human
cacaaaaauacgccuaggga

SEQ ID NO: 1343627 - RNA, 24 nt, Human
cacgagcagcagccugcgcuggaa

SEQ ID NO: 1343628 - RNA, 23 nt, Human
cagaguauguauuugaaaaaagg

SEQ ID NO: 1343629 - RNA, 24 nt, Human
cagcagccugcgcuggaaaugucu

SEQ ID NO: 1343630 - RNA, 23 nt, Human
caucaagguuggucccauuuccu

SEQ ID NO: 1343631 - RNA, 23 nt, Human
ccaaagccacauauucaucaagg

SEQ ID NO: 1343632 - RNA, 21 nt, Human
ccagaccagcgaaacugcucc

SEQ ID NO: 1343633 - RNA, 20 nt, Human
ccagagugaaacgagccgaa

SEQ ID NO: 1343634 - RNA, 21 nt, Human
cccgcggagccuccacugccc

SEQ ID NO: 1343635 - RNA, 25 nt, Human
ccucaaaaaacaccccagagugaaa

SEQ ID NO: 1343636 - RNA, 21 nt, Human
ccucuuaauuucccuccuccc

SEQ ID NO: 1343637 - RNA, 26 nt, Human
cgagcagcagccugcgcuggaaaugu

SEQ ID NO: 1343638 - RNA, 19 nt, Human
cggacaccacgagcagcag

SEQ ID NO: 1343639 - RNA, 22 nt, Human
cuccuggaggauccagaccagc

SEQ ID NO: 1343640 - RNA, 18 nt, Human
gaaacugcucccaaugaa

SEQ ID NO: 1343641 - RNA, 23 nt, Human
gaaucaaucccaacgggggcuaa

SEQ ID NO: 1343642 - RNA, 21 nt, Human
gacccgcggagccuccacugc

SEQ ID NO: 1343643 - RNA, 21 nt, Human
gaccucggcguuccgaccucu

SEQ ID NO: 1343644 - RNA, 24 nt, Human
gagcaugaccugguucaagaauac

SEQ ID NO: 1343645 - RNA, 21 nt, Human
gaggcgccaccagacucgacc

SEQ ID NO: 1343646 - RNA, 20 nt, Human
gcauggagccgcuuucgacc

SEQ ID NO: 1343647 - RNA, 19 nt, Human
gcgaaacugcucccaauga

SEQ ID NO: 1343648 - RNA, 21 nt, Human
ggacaccacgagcagcagccu

SEQ ID NO: 1343649 - RNA, 18 nt, Human
ggaggaagucucuggcuc

SEQ ID NO: 1343650 - RNA, 20 nt, Human
ggaggaggaagggaaagggg

SEQ ID NO: 1343651 - RNA, 19 nt, Human
ggaguaaaaauuucguucu

SEQ ID NO: 1343652 - RNA, 26 nt, Human
uaaacagagaccacguuaaucaacgg

SEQ ID NO: 1343653 - RNA, 19 nt, Human
uaaauuccuggcuugguug

SEQ ID NO: 1343654 - RNA, 19 nt, Human
uaaggauaccgaggcgcca

SEQ ID NO: 1343655 - RNA, 24 nt, Human
uacagaguauguauuugaaaaaag

SEQ ID NO: 1343656 - RNA, 18 nt, Human
uccuuaucccuuuuccca

SEQ ID NO: 1343657 - RNA, 21 nt, Human
ucggcaagggagaaaaauccc

SEQ ID NO: 1343658 - RNA, 18 nt, Human
ucuggaggaggaggaagg

SEQ ID NO: 1343659 - RNA, 27 nt, Human
ugaaaaaaggaacuaccacaaaaauac

SEQ ID NO: 1343660 - RNA, 22 nt, Human
uggaacccaagacaaaaagccc

SEQ ID NO: 1343661 - RNA, 21 nt, Human
uggaacccaagacaaaaagcu

SEQ ID NO: 1343662 - RNA, 27 nt, Human
uggaaguaaguagaaaucaaugaaagu

SEQ ID NO: 1343663 - RNA, 19 nt, Human
uggaggaagucucuggcuc

SEQ ID NO: 1343664 - RNA, 23 nt, Human
ugggcauggagccgcuuucgacc

SEQ ID NO: 1343665 - RNA, 23 nt, Human
ugguucaagaauaccccauccac

SEQ ID NO: 1343666 - RNA, 24 nt, Human
uugaaaaaaggaacuaccacaaaa

SEQ ID NO: 1343667 - RNA, 23 nt, Human
aaacaaaccccaucaacugucca

SEQ ID NO: 1343668 - RNA, 23 nt, Human
aacaaaccccaucaacuguccac

SEQ ID NO: 1343669 - RNA, 20 nt, Human
aacagaaaucaaccccaccu

SEQ ID NO: 1343670 - RNA, 19 nt, Human
accgccgccgccgccgccg

SEQ ID NO: 1343671 - RNA, 22 nt, Human
accgccgccgccgccgccgccc

SEQ ID NO: 1343672 - RNA, 23 nt, Human
accucaugccuagaggcaacauc

SEQ ID NO: 1343673 - RNA, 22 nt, Human
accuccccuuggcuagucacug

SEQ ID NO: 1343674 - RNA, 22 nt, Human
acugugaaaagcgugcguaagg

SEQ ID NO: 1343675 - RNA, 19 nt, Human
agaaaucaaccccaccucc

SEQ ID NO: 1343676 - RNA, 25 nt, Human
auaaauauacagaaacaaaccccau

SEQ ID NO: 1343677 - RNA, 25 nt, Human
caaaccccaucaacuguccacauca

SEQ ID NO: 1343678 - RNA, 18 nt, Human
caccuccccuuggcuagu

SEQ ID NO: 1343679 - RNA, 21 nt, Human
caccuccccuuggcuagucac

SEQ ID NO: 1343680 - RNA, 19 nt, Human
caucaacuguccacaucag

SEQ ID NO: 1343681 - RNA, 22 nt, Human
ccccaccuccccuuggcuaguc

SEQ ID NO: 1343682 - RNA, 20 nt, Human
ccgccgccgccgcccagccc

SEQ ID NO: 1343683 - RNA, 22 nt, Human
ccgccgccgccgccgcccagcc

SEQ ID NO: 1343684 - RNA, 18 nt, Human
ccgccgccgccgccgccg

SEQ ID NO: 1343685 - RNA, 21 nt, Human
ccgccgccgccgccgccgccc

SEQ ID NO: 1343686 - RNA, 23 nt, Human
ccgccgccgccgccgccgcccag

SEQ ID NO: 1343687 - RNA, 23 nt, Human
ccucacuggugggcucaccauug

SEQ ID NO: 1343688 - RNA, 25 nt, Human
cuagaggccuuuaccuaccaacuag

SEQ ID NO: 1343689 - RNA, 20 nt, Human
cucaaaagaacauuacuagg

SEQ ID NO: 1343690 - RNA, 23 nt, Human
cuuuugcugacuggagcccugac

SEQ ID NO: 1343691 - RNA, 21 nt, Human
gaaaucaaccccaccuccccu

SEQ ID NO: 1343692 - RNA, 24 nt, Human
gaacagaaaucaaccccaccuccc

SEQ ID NO: 1343693 - RNA, 22 nt, Human
guccuagcagcaaggauuucua

SEQ ID NO: 1343694 - RNA, 21 nt, Human
guguaguuaggaacagaaauc

SEQ ID NO: 1343695 - RNA, 19 nt, Human
uaaggcaauugaaucgagg

SEQ ID NO: 1343696 - RNA, 21 nt, Human
uauacagaaacaaaccccauc

SEQ ID NO: 1343697 - RNA, 20 nt, Human
ucaguaauccucacuggugg

SEQ ID NO: 1343698 - RNA, 25 nt, Human
uccaaguagaaugugaccaaugacc

SEQ ID NO: 1343699 - RNA, 18 nt, Human
ugccuagaggcaacaucu

SEQ ID NO: 1343700 - RNA, 24 nt, Human
uuuuacaaaguucuguacauaaaa

SEQ ID NO: 1343701 - RNA, 18 nt, Human
uuuuuuuuuuuuuuuuug

SEQ ID NO: 1343702 - RNA, 18 nt, Human
uuuuuuuuuuuuuuuuug

SEQ ID NO: 1343703 - RNA, 22 nt, Human
aaguuccugacacagcuaaucc

SEQ ID NO: 1343704 - RNA, 20 nt, Human
accccagaacucuccugcga

SEQ ID NO: 1343705 - RNA, 19 nt, Human
caaguuccugacacagcua

SEQ ID NO: 1343706 - RNA, 21 nt, Human
ccaaguuccugacacagcuaa

SEQ ID NO: 1343707 - RNA, 21 nt, Human
ccagaacucuccugcgacugu

SEQ ID NO: 1343708 - RNA, 19 nt, Human
ccugcgacugugagccgag

SEQ ID NO: 1343709 - RNA, 20 nt, Human
cucuucggcuucgccuccgg

SEQ ID NO: 1343710 - RNA, 22 nt, Human
cuggaaugggcgagcuucucuu

SEQ ID NO: 1343711 - RNA, 23 nt, Human
cuucgccuccgggccuucucaag

SEQ ID NO: 1343712 - RNA, 18 nt, Human
gcccguguaccccagaaa

SEQ ID NO: 1343713 - RNA, 18 nt, Human
uucccagucuggaauggg

SEQ ID NO: 1343714 - RNA, 21 nt, Human
uuuuuauuucaagaggugcca

SEQ ID NO: 1343715 - RNA, 19 nt, Human
uuuuuuuuuuuuuuuugca

SEQ ID NO: 1343716 - RNA, 18 nt, Human
uuuuuuuuuuuuuuuuug

SEQ ID NO: 1343717 - RNA, 19 nt, Human
uuuuuuuuuuuuuuuuugc

SEQ ID NO: 1343718 - RNA, 24 nt, Human
aaccagcccuuccagagacugccc

SEQ ID NO: 1343719 - RNA, 19 nt, Human
aacucccccccagacuucu

SEQ ID NO: 1343720 - RNA, 21 nt, Human
aacucccccccagacuucuau

SEQ ID NO: 1343721 - RNA, 20 nt, Human
aagccuugccccagcccacc

SEQ ID NO: 1343722 - RNA, 24 nt, Human
aagccuugccccagcccaccccuc

SEQ ID NO: 1343723 - RNA, 23 nt, Human
acaggaaagaaaacaauuuccaa

SEQ ID NO: 1343724 - RNA, 21 nt, Human
acugggcucccaaauacgugc

SEQ ID NO: 1343725 - RNA, 20 nt, Human
acuuggguggagggauaccg

SEQ ID NO: 1343726 - RNA, 25 nt, Human
aggaaagaaaacaauuuccaaagga

SEQ ID NO: 1343727 - RNA, 18 nt, Human
aggcagaugggguggggg

SEQ ID NO: 1343728 - RNA, 21 nt, Human
aggcagauggggugggggugc

SEQ ID NO: 1343729 - RNA, 23 nt, Human
agguggccauacuuggguggagg

SEQ ID NO: 1343730 - RNA, 18 nt, Human
augaagacaaacaggugg

SEQ ID NO: 1343731 - RNA, 23 nt, Human
caaacagguggccauacuugggu

SEQ ID NO: 1343732 - RNA, 18 nt, Human
cagccuugaaccagcccu

SEQ ID NO: 1343733 - RNA, 19 nt, Human
caugaccagaccagaagcc

SEQ ID NO: 1343734 - RNA, 18 nt, Human
ccagaccagaagccccug

SEQ ID NO: 1343735 - RNA, 18 nt, Human
ccccagcccaccccucuc

SEQ ID NO: 1343736 - RNA, 19 nt, Human
cccccaacucccccccaga

SEQ ID NO: 1343737 - RNA, 20 nt, Human
cccccaacucccccccagac

SEQ ID NO: 1343738 - RNA, 23 nt, Human
cccuauacccaaacagccuugaa

SEQ ID NO: 1343739 - RNA, 20 nt, Human
ccugaaggcagauggggugg

SEQ ID NO: 1343740 - RNA, 19 nt, Human
ccugaccccuauacccaaa

SEQ ID NO: 1343741 - RNA, 21 nt, Human
ccuugccccagcccaccccuc

SEQ ID NO: 1343742 - RNA, 22 nt, Human
cuaacaucugccgccauccccc

SEQ ID NO: 1343743 - RNA, 18 nt, Human
cuuauuuugcuacagugg

SEQ ID NO: 1343744 - RNA, 18 nt, Human
gcucccaaauacgugcuc

SEQ ID NO: 1343745 - RNA, 18 nt, Human
uaagccuugccccagccc

SEQ ID NO: 1343746 - RNA, 19 nt, Human
uacacaggaaagaaaacaa

SEQ ID NO: 1343747 - RNA, 22 nt, Human
uacaguagccagucugggaggc

SEQ ID NO: 1343748 - RNA, 21 nt, Human
uaccugaccccuauacccaaa

SEQ ID NO: 1343749 - RNA, 19 nt, Human
uacgugcucguguguucuc

SEQ ID NO: 1343750 - RNA, 22 nt, Human
uauauacaaaauaauguaugua

SEQ ID NO: 1343751 - RNA, 19 nt, Human
uaugaaguaauuacacagg

SEQ ID NO: 1343752 - RNA, 24 nt, Human
uccagagacugccccuaguggccc

SEQ ID NO: 1343753 - RNA, 18 nt, Human
ucccccaacuccccccca

SEQ ID NO: 1343754 - RNA, 19 nt, Human
ucccccaacucccccccag

SEQ ID NO: 1343755 - RNA, 19 nt, Human
ucccccaacucccccccag

SEQ ID NO: 1343756 - RNA, 21 nt, Human
ucccccaacucccccccagac

SEQ ID NO: 1343757 - RNA, 22 nt, Human
ucccccaacucccccccagacu

SEQ ID NO: 1343758 - RNA, 24 nt, Human
ucccccaacucccccccagacuuc

SEQ ID NO: 1343759 - RNA, 24 nt, Human
ucucuagggacaugaccagaccag

SEQ ID NO: 1343760 - RNA, 18 nt, Human
ugaagacaaacagguggc

SEQ ID NO: 1343761 - RNA, 31 nt, Human
ugaagacaaacagguggccauacuugggugg

SEQ ID NO: 1343762 - RNA, 20 nt, Human
ugacagaugacaaacggaac

SEQ ID NO: 1343763 - RNA, 21 nt, Human
ugaccagaccagaagccccug

SEQ ID NO: 1343764 - RNA, 23 nt, Human
ugaccccuauacccaaacagccu

SEQ ID NO: 1343765 - RNA, 23 nt, Human
ugcccaggauaagccuugcccca

SEQ ID NO: 1343766 - RNA, 24 nt, Human
ugccccagcccaccccucucuucu

SEQ ID NO: 1343767 - RNA, 24 nt, Human
ugccccagcccaccccucucuucu

SEQ ID NO: 1343768 - RNA, 26 nt, Human
ugccgccaucccccaacuccccccca

SEQ ID NO: 1343769 - RNA, 20 nt, Human
ugcuacaguggagaaggggc

SEQ ID NO: 1343770 - RNA, 19 nt, Human
uggaaggagaccaugacag

SEQ ID NO: 1343771 - RNA, 24 nt, Human
uggaaggagaccaugacagaugac

SEQ ID NO: 1343772 - RNA, 24 nt, Human
uggcccacugggcagugcaggcug

SEQ ID NO: 1343773 - RNA, 19 nt, Human
ugggcucccaaauacgugc

SEQ ID NO: 1343774 - RNA, 21 nt, Human
ugguggaaggagaccaugaca

SEQ ID NO: 1343775 - RNA, 19 nt, Human
uugccccagcccaccccuc

SEQ ID NO: 1343776 - RNA, 20 nt, Human
aaucccgcuccugccgcgag

SEQ ID NO: 1343777 - RNA, 20 nt, Human
ccacgguggugacuuccuuu

SEQ ID NO: 1343778 - RNA, 22 nt, Human
cuccgcucgugccgcucgugcc

SEQ ID NO: 1343779 - RNA, 22 nt, Human
cuccugccgcgaggcgcccucc

SEQ ID NO: 1343780 - RNA, 22 nt, Human
cuuuuacuaucccacgcucucc

SEQ ID NO: 1343781 - RNA, 22 nt, Human
guagccuuaaagaauuuuuuuu

SEQ ID NO: 1343782 - RNA, 20 nt, Human
guagguccucuccucuucuc

SEQ ID NO: 1343783 - RNA, 21 nt, Human
uaguaaauguuccaauuacgc

SEQ ID NO: 1343784 - RNA, 22 nt, Human
ucccguuccccugccgguuccc

SEQ ID NO: 1343785 - RNA, 20 nt, Human
uccuuuuccgcuccccuaca

SEQ ID NO: 1343786 - RNA, 27 nt, Human
ucgcaggccacgguggugacuuccuuu

SEQ ID NO: 1343787 - RNA, 20 nt, Human
uggaguacauccacacgaaa

SEQ ID NO: 1343788 - RNA, 28 nt, Human
uuaauaguagccuuaaagaauuuuuuuu

SEQ ID NO: 1343789 - RNA, 19 nt, Human
uuguagguccucuccucuu

SEQ ID NO: 1343790 - RNA, 19 nt, Human
uuuuuuuuuuuuuuuuuaa

SEQ ID NO: 1343791 - RNA, 21 nt, Human
aaaaaaaaggauauuauauau

SEQ ID NO: 1343792 - RNA, 18 nt, Human
caacacgccguaccgcag

SEQ ID NO: 1343793 - RNA, 20 nt, Human
caauccuuuugauaagaaau

SEQ ID NO: 1343794 - RNA, 23 nt, Human
ccgcugggaccaacacgccguac

SEQ ID NO: 1343795 - RNA, 19 nt, Human
ccuacagcacgucccuacc

SEQ ID NO: 1343796 - RNA, 21 nt, Human
ccucagcugaaccgcugggac

SEQ ID NO: 1343797 - RNA, 19 nt, Human
cugggaccaacacgccgua

SEQ ID NO: 1343798 - RNA, 18 nt, Human
cuguaaaacaaauaccau

SEQ ID NO: 1343799 - RNA, 22 nt, Human
gaaguucuaagaaaaaaugaca

SEQ ID NO: 1343800 - RNA, 21 nt, Human
gcugaaccgcugggaccaaca

SEQ ID NO: 1343801 - RNA, 25 nt, Human
uaaacuccaaagccaauuucaaaag

SEQ ID NO: 1343802 - RNA, 23 nt, Human
uaaauaaaugcuugaaauauacc

SEQ ID NO: 1343803 - RNA, 21 nt, Human
uauccaauccuuuugauaaga

SEQ ID NO: 1343804 - RNA, 23 nt, Human
ugaaauauacccaguagaaacuu

SEQ ID NO: 1343805 - RNA, 18 nt, Human
uuucaugucauaaaaugg

SEQ ID NO: 1343806 - RNA, 23 nt, Human
aaaaaaaaaaagacgggggaggg

SEQ ID NO: 1343807 - RNA, 25 nt, Human
aaaaagaagcauuguuugaaaaaaa

SEQ ID NO: 1343808 - RNA, 22 nt, Human
aaaacaaagaaaaagaaaaccc

SEQ ID NO: 1343809 - RNA, 20 nt, Human
aaaacaaauccacaccagca

SEQ ID NO: 1343810 - RNA, 21 nt, Human
aaaagcaaaacaaagccauug

SEQ ID NO: 1343811 - RNA, 22 nt, Human
aaacaaaagcaaaaccaguuaa

SEQ ID NO: 1343812 - RNA, 22 nt, Human
aaacaaagaaaaagaaaaccca

SEQ ID NO: 1343813 - RNA, 22 nt, Human
aaagagcacacaaaaaaaggau

SEQ ID NO: 1343814 - RNA, 20 nt, Human
aaagcaaaaccaguuaaacc

SEQ ID NO: 1343815 - RNA, 22 nt, Human
aaaguuauucuaaaaauggcac

SEQ ID NO: 1343816 - RNA, 25 nt, Human
aaccacuuuucacugaucucucccc

SEQ ID NO: 1343817 - RNA, 19 nt, Human
aaccauccugccuuccuau

SEQ ID NO: 1343818 - RNA, 20 nt, Human
aaccucacuacucaaauacc

SEQ ID NO: 1343819 - RNA, 24 nt, Human
aagaacacugauagacucuaacuc

SEQ ID NO: 1343820 - RNA, 19 nt, Human
aagaagcaaauggaacaca

SEQ ID NO: 1343821 - RNA, 20 nt, Human
aagagcacacaaaaaaagga

SEQ ID NO: 1343822 - RNA, 22 nt, Human
aagaugaaagugaaauuacaaa

SEQ ID NO: 1343823 - RNA, 19 nt, Human
aagcaaaaaaauccagcca

SEQ ID NO: 1343824 - RNA, 18 nt, Human
aagcaaauggaacacaaa

SEQ ID NO: 1343825 - RNA, 21 nt, Human
aagcacaguggcugcuuugua

SEQ ID NO: 1343826 - RNA, 23 nt, Human
aagcauuguuugaaaaaaaaaaa

SEQ ID NO: 1343827 - RNA, 20 nt, Human
acacaaaaaaaggauauuaa

SEQ ID NO: 1343828 - RNA, 18 nt, Human
agacaacaagcuaaauga

SEQ ID NO: 1343829 - RNA, 19 nt, Human
agauucacaugcauguuca

SEQ ID NO: 1343830 - RNA, 18 nt, Human
agcaaaagcaaagaagca

SEQ ID NO: 1343831 - RNA, 18 nt, Human
aggaagggagcuuucgcu

SEQ ID NO: 1343832 - RNA, 21 nt, Human
aggggguuauaacaagaacac

SEQ ID NO: 1343833 - RNA, 23 nt, Human
aguaaaacacaucaaacuuaaag

SEQ ID NO: 1343834 - RNA, 21 nt, Human
agugagccggcggagcccagg

SEQ ID NO: 1343835 - RNA, 24 nt, Human
auacagaaagcauaaauauacagu

SEQ ID NO: 1343836 - RNA, 20 nt, Human
aucaaaaguaaccucacuac

SEQ ID NO: 1343837 - RNA, 18 nt, Human
augaaacaaguguaaggc

SEQ ID NO: 1343838 - RNA, 18 nt, Human
auuuucaucuguaaugca

SEQ ID NO: 1343839 - RNA, 22 nt, Human
caaaagcaaaaccaguuaaacc

SEQ ID NO: 1343840 - RNA, 23 nt, Human
caagaaaaaaacaaagaaaaaga

SEQ ID NO: 1343841 - RNA, 22 nt, Human
caaugagagaguaaaacacauc

SEQ ID NO: 1343842 - RNA, 19 nt, Human
cacugaucucucccccaca

SEQ ID NO: 1343843 - RNA, 22 nt, Human
cagacaacaagcuaaaugacgu

SEQ ID NO: 1343844 - RNA, 18 nt, Human
ccauauaaccauccugcc

SEQ ID NO: 1343845 - RNA, 21 nt, Human
cccaggcagcgcuugucaaga

SEQ ID NO: 1343846 - RNA, 22 nt, Human
ccccaaauagcuacuuuugaau

SEQ ID NO: 1343847 - RNA, 19 nt, Human
ccuacagcugaaacacuau

SEQ ID NO: 1343848 - RNA, 19 nt, Human
cgcugcucagaaaucaaag

SEQ ID NO: 1343849 - RNA, 19 nt, Human
cggcggagcccaggcagcg

SEQ ID NO: 1343850 - RNA, 24 nt, Human
cuuaaaguguuuacuuuuugaaca

SEQ ID NO: 1343851 - RNA, 22 nt, Human
cuuuuaggcaacugcaguccga

SEQ ID NO: 1343852 - RNA, 23 nt, Human
gaaaaaaaaaaaaaaagacgggg

SEQ ID NO: 1343853 - RNA, 26 nt, Human
gaaaaggucacucaguuauuagugag

SEQ ID NO: 1343854 - RNA, 22 nt, Human
gaauagcaagcaaaaaaaucca

SEQ ID NO: 1343855 - RNA, 21 nt, Human
gagcaaaagcaaagaagcaag

SEQ ID NO: 1343856 - RNA, 21 nt, Human
gaugucacuaaaaugcucugu

SEQ ID NO: 1343857 - RNA, 23 nt, Human
gccgagcugaaggaagcuccggc

SEQ ID NO: 1343858 - RNA, 24 nt, Human
ggaaggacaaaauauauaugcaaa

SEQ ID NO: 1343859 - RNA, 22 nt, Human
ggagcaaaagcaaagaagcaag

SEQ ID NO: 1343860 - RNA, 24 nt, Human
ggggagggaaugucuauuuuuuuu

SEQ ID NO: 1343861 - RNA, 22 nt, Human
guaaaacacaucaaacuuaaag

SEQ ID NO: 1343862 - RNA, 20 nt, Human
gugaucaagaaaaaaacaaa

SEQ ID NO: 1343863 - RNA, 20 nt, Human
guggagcaaaaaagauaaaa

SEQ ID NO: 1343864 - RNA, 18 nt, Human
uaaaacaaauccacacca

SEQ ID NO: 1343865 - RNA, 21 nt, Human
uaaaagaucaucugaauaaga

SEQ ID NO: 1343866 - RNA, 26 nt, Human
uaaacaaaagcaaaaccaaucaacgg

SEQ ID NO: 1343867 - RNA, 21 nt, Human
uaaacaucucaugccaaguga

SEQ ID NO: 1343868 - RNA, 18 nt, Human
uaagaaaaccacuuuuca

SEQ ID NO: 1343869 - RNA, 23 nt, Human
uaagguaguacuauuucaccuua

SEQ ID NO: 1343870 - RNA, 25 nt, Human
uaauuuaucacuuaaaaaucaucuc

SEQ ID NO: 1343871 - RNA, 23 nt, Human
uacagggggaggccguucaguaa

SEQ ID NO: 1343872 - RNA, 25 nt, Human
uacuagaaaguuacagcucauuuaa

SEQ ID NO: 1343873 - RNA, 18 nt, Human
uagaagauucuaugagca

SEQ ID NO: 1343874 - RNA, 22 nt, Human
uagcaagcaaaaaaauccagcc

SEQ ID NO: 1343875 - RNA, 19 nt, Human
uauaaaaugaaagugcuuu

SEQ ID NO: 1343876 - RNA, 27 nt, Human
uauaacaagaacacugauagacucuaa

SEQ ID NO: 1343877 - RNA, 19 nt, Human
uauaaccauccugccuucc

SEQ ID NO: 1343878 - RNA, 23 nt, Human
uaugguuaacggugccgugcaaa

SEQ ID NO: 1343879 - RNA, 20 nt, Human
uauguaaaagaaaaagcagu

SEQ ID NO: 1343880 - RNA, 25 nt, Human
ucaaaaguaaccucacuacucaaau

SEQ ID NO: 1343881 - RNA, 18 nt, Human
ucacuacucaaauaccau

SEQ ID NO: 1343882 - RNA, 20 nt, Human
ucacuaguucucagcauuuu

SEQ ID NO: 1343883 - RNA, 21 nt, Human
ucacucaguuauuagugagcc

SEQ ID NO: 1343884 - RNA, 22 nt, Human
uccaaaauaaacaucucaugcc

SEQ ID NO: 1343885 - RNA, 25 nt, Human
uccgaucaaaaguaaccucacuacu

SEQ ID NO: 1343886 - RNA, 21 nt, Human
uccuugggaaaggucaaaaag

SEQ ID NO: 1343887 - RNA, 21 nt, Human
ugaaaaagcaaaacaaagcca

SEQ ID NO: 1343888 - RNA, 21 nt, Human
ugaaaaguaguucuauuacag

SEQ ID NO: 1343889 - RNA, 19 nt, Human
ugacacaaaaacgaauagc

SEQ ID NO: 1343890 - RNA, 19 nt, Human
ugacacaaaaacgaauagc

SEQ ID NO: 1343891 - RNA, 23 nt, Human
ugacauauagauaaacaaaagca

SEQ ID NO: 1343892 - RNA, 20 nt, Human
ugagagaguaaaacacauca

SEQ ID NO: 1343893 - RNA, 20 nt, Human
ugagagaguaaaacacauca

SEQ ID NO: 1343894 - RNA, 21 nt, Human
ugagccacagguguccuccuu

SEQ ID NO: 1343895 - RNA, 21 nt, Human
ugcuuuguagcgcuucuccuu

SEQ ID NO: 1343896 - RNA, 22 nt, Human
uggaaagacaaauuucagccua

SEQ ID NO: 1343897 - RNA, 22 nt, Human
ugggaaaggucaaaaagaagca

SEQ ID NO: 1343898 - RNA, 25 nt, Human
ugggaaaggucaaaaagaagcugga

SEQ ID NO: 1343899 - RNA, 22 nt, Human
uguacauguggagcaaaaaaga

SEQ ID NO: 1343900 - RNA, 18 nt, Human
uguagcgcuucuccuugg

SEQ ID NO: 1343901 - RNA, 19 nt, Human
uguaugcuaucacguaagg

SEQ ID NO: 1343902 - RNA, 19 nt, Human
uuaaaagaucaucugaauu

SEQ ID NO: 1343903 - RNA, 22 nt, Human
uuaaaguuauucuaaaaauggc

SEQ ID NO: 1343904 - RNA, 23 nt, Human
uucaaauauuacaauacauuaua

SEQ ID NO: 1343905 - RNA, 18 nt, Human
uucaagaagcugagagaa

SEQ ID NO: 1343906 - RNA, 18 nt, Human
uucaagaagcugagagaa

SEQ ID NO: 1343907 - RNA, 19 nt, Human
uucaaugugcauuauagug

SEQ ID NO: 1343908 - RNA, 23 nt, Human
uuggaaggacaaaauauauaugc

SEQ ID NO: 1343909 - RNA, 20 nt, Human
uuucacugaucucuccccca

SEQ ID NO: 1343910 - RNA, 22 nt, Human
aaaauaaaauguucgcacaaug

SEQ ID NO: 1343911 - RNA, 21 nt, Human
aagaaaacgcugccuuggaaa

SEQ ID NO: 1343912 - RNA, 26 nt, Human
accgggaggcggcggcggccccccuu

SEQ ID NO: 1343913 - RNA, 24 nt, Human
agaaaagcagcgccggccugcagg

SEQ ID NO: 1343914 - RNA, 23 nt, Human
agcuggccagggcugcccaaaac

SEQ ID NO: 1343915 - RNA, 18 nt, Human
caguggcugccggcaggg

SEQ ID NO: 1343916 - RNA, 20 nt, Human
ccaacagagcccaaacuccg

SEQ ID NO: 1343917 - RNA, 18 nt, Human
ccagggcugcccaaaacc

SEQ ID NO: 1343918 - RNA, 26 nt, Human
ccgggaggcggcggcggccccccuuc

SEQ ID NO: 1343919 - RNA, 22 nt, Human
ccucuccucucuuugaagcaaa

SEQ ID NO: 1343920 - RNA, 22 nt, Human
ccuuggaaauuguuugcacaag

SEQ ID NO: 1343921 - RNA, 21 nt, Human
cgccggccugcaggaaucccc

SEQ ID NO: 1343922 - RNA, 18 nt, Human
cgggaggcggcggcggcc

SEQ ID NO: 1343923 - RNA, 20 nt, Human
cgguuucugcugagggcugg

SEQ ID NO: 1343924 - RNA, 20 nt, Human
cugcugagggcuggugacac

SEQ ID NO: 1343925 - RNA, 21 nt, Human
cuggugacacacuggccucuu

SEQ ID NO: 1343926 - RNA, 21 nt, Human
cuucccgcuggccaggugggc

SEQ ID NO: 1343927 - RNA, 19 nt, Human
cuuucgguuucugcugagg

SEQ ID NO: 1343928 - RNA, 18 nt, Human
gaaaagcagcgccggccu

SEQ ID NO: 1343929 - RNA, 27 nt, Human
gagucaguuccaaagugaaggcgcuga

SEQ ID NO: 1343930 - RNA, 18 nt, Human
ggcagggaagaaaacgcu

SEQ ID NO: 1343931 - RNA, 18 nt, Human
ggccaggaacagaguaga

SEQ ID NO: 1343932 - RNA, 20 nt, Human
uacaccuuagccaacagagc

SEQ ID NO: 1343933 - RNA, 22 nt, Human
uagccaacagagcccaaacucc

SEQ ID NO: 1343934 - RNA, 23 nt, Human
uagccaacagagcccaaacuccg

SEQ ID NO: 1343935 - RNA, 19 nt, Human
uccaaggccacagggagcu

SEQ ID NO: 1343936 - RNA, 22 nt, Human
ucccccgcgccugguagccugg

SEQ ID NO: 1343937 - RNA, 19 nt, Human
ugccuuggaaauuguuugc

SEQ ID NO: 1343938 - RNA, 20 nt, Human
uggcaucaugggaacgccug

SEQ ID NO: 1343939 - RNA, 23 nt, Human
uggccaggugggcuucuuuaggu

SEQ ID NO: 1343940 - RNA, 19 nt, Human
uggccucuugucaguggcu

SEQ ID NO: 1343941 - RNA, 19 nt, Human
uggcugccggcagggccag

SEQ ID NO: 1343942 - RNA, 24 nt, Human
uguucgcacaaugggagaaaauug

SEQ ID NO: 1343943 - RNA, 18 nt, Human
uucuuuaggucucugagu

SEQ ID NO: 1343944 - RNA, 25 nt, Human
uugaagcaaaaccuccagguguacu

SEQ ID NO: 1343945 - RNA, 26 nt, Human
aaacacaugcauacacacacauccuc

SEQ ID NO: 1343946 - RNA, 18 nt, Human
acaaaaucccaggucuuu

SEQ ID NO: 1343947 - RNA, 22 nt, Human
acaugcauacacacacauccuc

SEQ ID NO: 1343948 - RNA, 19 nt, Human
acauuuuauuauccauugu

SEQ ID NO: 1343949 - RNA, 20 nt, Human
agaaauugaauaacaaagga

SEQ ID NO: 1343950 - RNA, 23 nt, Human
aggucuuuagucuccucaugucc

SEQ ID NO: 1343951 - RNA, 24 nt, Human
caaaaucccaggucuuuagucucc

SEQ ID NO: 1343952 - RNA, 25 nt, Human
caaacacaugcauacacacacaucc

SEQ ID NO: 1343953 - RNA, 26 nt, Human
cauacacacacauccuccucugugug

SEQ ID NO: 1343954 - RNA, 18 nt, Human
cuguguguuacuuccucc

SEQ ID NO: 1343955 - RNA, 18 nt, Human
cuuucgagacugacgggc

SEQ ID NO: 1343956 - RNA, 19 nt, Human
guccgggcgcguggcgagg

SEQ ID NO: 1343957 - RNA, 22 nt, Human
gucuuuagucuccucauguccu

SEQ ID NO: 1343958 - RNA, 19 nt, Human
uacaaaacgcgaguagcag

SEQ ID NO: 1343959 - RNA, 18 nt, Human
uagcagaccccagcugug

SEQ ID NO: 1343960 - RNA, 18 nt, Human
uagcagaccccagcugug

SEQ ID NO: 1343961 - RNA, 18 nt, Human
ucccaggucuuuagucuc

SEQ ID NO: 1343962 - RNA, 23 nt, Human
uccccaaaaacaccuuucgagac

SEQ ID NO: 1343963 - RNA, 25 nt, Human
ugauugacaaaaucccaggucuuua

SEQ ID NO: 1343964 - RNA, 28 nt, Human
ugcauacacacacauccuccucugugug

SEQ ID NO: 1343965 - RNA, 21 nt, Human
uguguaaagcucaggcugauu

SEQ ID NO: 1343966 - RNA, 24 nt, Human
uuagucuccucauguccuuucuca

SEQ ID NO: 1343967 - RNA, 21 nt, Human
acaccgguggucuccagccuc

SEQ ID NO: 1343968 - RNA, 23 nt, Human
accgguggucuccagccucuccc

SEQ ID NO: 1343969 - RNA, 21 nt, Human
agugaacaggcagcuccuccc

SEQ ID NO: 1343970 - RNA, 22 nt, Human
cacaggggccucacggggcgug

SEQ ID NO: 1343971 - RNA, 23 nt, Human
cagugaauuuacccgcgaggccu

SEQ ID NO: 1343972 - RNA, 22 nt, Human
caguggaucccacugcugcagc

SEQ ID NO: 1343973 - RNA, 23 nt, Human
cauccucugccuuuguccccgcc

SEQ ID NO: 1343974 - RNA, 23 nt, Human
ccaggcgcuccucagcuggacuu

SEQ ID NO: 1343975 - RNA, 23 nt, Human
ccagugaacaggcagcuccuccc

SEQ ID NO: 1343976 - RNA, 19 nt, Human
cccgcgaggccuucacacc

SEQ ID NO: 1343977 - RNA, 21 nt, Human
cccugcacaggggccucacgg

SEQ ID NO: 1343978 - RNA, 22 nt, Human
ccgcuguguggagucucuccug

SEQ ID NO: 1343979 - RNA, 21 nt, Human
ccgguggucuccagccucucc

SEQ ID NO: 1343980 - RNA, 19 nt, Human
ccucaguuccauccaggca

SEQ ID NO: 1343981 - RNA, 25 nt, Human
ccuccaccccuccccaauggggcua

SEQ ID NO: 1343982 - RNA, 19 nt, Human
ccugcgucugucucugcuc

SEQ ID NO: 1343983 - RNA, 20 nt, Human
ccuuccuccaccccucccca

SEQ ID NO: 1343984 - RNA, 22 nt, Human
cggccccuucugucucccagug

SEQ ID NO: 1343985 - RNA, 23 nt, Human
cggcgcccuggcugaucccagug

SEQ ID NO: 1343986 - RNA, 21 nt, Human
cgugcucacacccgauguaug

SEQ ID NO: 1343987 - RNA, 21 nt, Human
cucccugcacaggggccucac

SEQ ID NO: 1343988 - RNA, 18 nt, Human
cuggggaccggccccuuc

SEQ ID NO: 1343989 - RNA, 18 nt, Human
gccucacggggcguggaa

SEQ ID NO: 1343990 - RNA, 18 nt, Human
gccucuccccaguggauc

SEQ ID NO: 1343991 - RNA, 24 nt, Human
gcugugccaccaucucccgccucu

SEQ ID NO: 1343992 - RNA, 18 nt, Human
ggcccggcgcccuggcug

SEQ ID NO: 1343993 - RNA, 22 nt, Human
ggcccuuuuuuuuuuuuuuuuu

SEQ ID NO: 1343994 - RNA, 20 nt, Human
ggcgccuggggaccggcccc

SEQ ID NO: 1343995 - RNA, 21 nt, Human
guggccugugagggcccauag

SEQ ID NO: 1343996 - RNA, 22 nt, Human
guggucuccagccucuccccag

SEQ ID NO: 1343997 - RNA, 22 nt, Human
uccauccaggcagauucaggcu

SEQ ID NO: 1343998 - RNA, 24 nt, Human
uccucaguuccauccaggcagauu

SEQ ID NO: 1343999 - RNA, 26 nt, Human
ucuccagccucuccccaguggauccc

SEQ ID NO: 1344000 - RNA, 23 nt, Human
ucucccgccucugccgcugcacu

SEQ ID NO: 1344001 - RNA, 20 nt, Human
ucugucucugcucugugcuc

SEQ ID NO: 1344002 - RNA, 27 nt, Human
ucugugcucagaagugggaggcguaac

SEQ ID NO: 1344003 - RNA, 20 nt, Human
ucuguggaccagccgccgcc

SEQ ID NO: 1344004 - RNA, 21 nt, Human
ucuguggaccagccgccgccc

SEQ ID NO: 1344005 - RNA, 18 nt, Human
ugagaugccacgacucug

SEQ ID NO: 1344006 - RNA, 21 nt, Human
ugccaccaucucccgccucug

SEQ ID NO: 1344007 - RNA, 23 nt, Human
ugccuuuguccccgccugcgucu

SEQ ID NO: 1344008 - RNA, 19 nt, Human
uggaccagccgccgcccag

SEQ ID NO: 1344009 - RNA, 22 nt, Human
uggcccuuuuuuuuuuuuuuuu

SEQ ID NO: 1344010 - RNA, 24 nt, Human
uggccugugagggcccauaggauc

SEQ ID NO: 1344011 - RNA, 21 nt, Human
uggcucugcuugucagcguga

SEQ ID NO: 1344012 - RNA, 24 nt, Human
uggggaccggccccuucugucucc

SEQ ID NO: 1344013 - RNA, 19 nt, Human
uggggcuacauccucugcc

SEQ ID NO: 1344014 - RNA, 24 nt, Human
uuuacccgcgaggccuucacaccg

SEQ ID NO: 1344015 - RNA, 25 nt, Human
uuuuuuuuggcccuuuuuuuuuuuu

SEQ ID NO: 1344016 - RNA, 29 nt, Human
uuuuuuuuuuuuggcccuuuuuuuuuuuu

SEQ ID NO: 1344017 - RNA, 18 nt, Human
uuuuuuuuuuuuuuuuug

SEQ ID NO: 1344018 - RNA, 26 nt, Human
uuuuuuuuuuuuuuuuuggcccuuuu

SEQ ID NO: 1344019 - RNA, 22 nt, Human
uuuuuuuuuuuuuuuuuuuggc

SEQ ID NO: 1344020 - RNA, 27 nt, Human
uuuuuuuuuuuuuuuuuuuuuuugggg

SEQ ID NO: 1344021 - RNA, 21 nt, Human
aaagugagugcaugcaugcca

SEQ ID NO: 1344022 - RNA, 21 nt, Human
acacacacacacacgcacagc

SEQ ID NO: 1344023 - RNA, 23 nt, Human
acacacaugcacacacacacaca

SEQ ID NO: 1344024 - RNA, 19 nt, Human
acagaauguucaacggagg

SEQ ID NO: 1344025 - RNA, 21 nt, Human
accagcuagcccccaagacag

SEQ ID NO: 1344026 - RNA, 18 nt, Human
acugcgcuccgggccggc

SEQ ID NO: 1344027 - RNA, 23 nt, Human
acugucaccuccagccccaaagu

SEQ ID NO: 1344028 - RNA, 19 nt, Human
auaccgcccacccucccuc

SEQ ID NO: 1344029 - RNA, 18 nt, Human
auagacaggucuuuauuu

SEQ ID NO: 1344030 - RNA, 20 nt, Human
auagacaggucuuuauuugg

SEQ ID NO: 1344031 - RNA, 23 nt, Human
augcacacacacacacacacacg

SEQ ID NO: 1344032 - RNA, 24 nt, Human
caagacagccucucccaaccaccu

SEQ ID NO: 1344033 - RNA, 27 nt, Human
cacacacacacacacacacgcacagcu

SEQ ID NO: 1344034 - RNA, 19 nt, Human
cacacacaugcacacacac

SEQ ID NO: 1344035 - RNA, 20 nt, Human
cacacacaugcacacacaca

SEQ ID NO: 1344036 - RNA, 28 nt, Human
cacacacaugcacacacacacacacaca

SEQ ID NO: 1344037 - RNA, 19 nt, Human
cacccucccuccuccccag

SEQ ID NO: 1344038 - RNA, 22 nt, Human
cacccucccuccuccccagggg

SEQ ID NO: 1344039 - RNA, 22 nt, Human
caccuccagccccaaagugagu

SEQ ID NO: 1344040 - RNA, 22 nt, Human
cagacagacacacacaugcaca

SEQ ID NO: 1344041 - RNA, 21 nt, Human
cagcuagcccccaagacagcc

SEQ ID NO: 1344042 - RNA, 25 nt, Human
caugcacacacacacacacacacgc

SEQ ID NO: 1344043 - RNA, 24 nt, Human
ccaagacagccucucccaaccacu

SEQ ID NO: 1344044 - RNA, 20 nt, Human
ccagcuacucuuaccuccuc

SEQ ID NO: 1344045 - RNA, 20 nt, Human
cccacccucccuccucccca

SEQ ID NO: 1344046 - RNA, 18 nt, Human
ccccaagacagccucucc

SEQ ID NO: 1344047 - RNA, 21 nt, Human
ccccaagacagccucucccaa

SEQ ID NO: 1344048 - RNA, 22 nt, Human
ccccacuggaaacugcgcuccg

SEQ ID NO: 1344049 - RNA, 21 nt, Human
ccccaggggcccagcacuggg

SEQ ID NO: 1344050 - RNA, 22 nt, Human
cccccaagacagccucucccaa

SEQ ID NO: 1344051 - RNA, 22 nt, Human
ccgcccacccucccuccucccc

SEQ ID NO: 1344052 - RNA, 19 nt, Human
ccugaugcuccagggcucu

SEQ ID NO: 1344053 - RNA, 22 nt, Human
cucccuccuccccaggggccca

SEQ ID NO: 1344054 - RNA, 20 nt, Human
cucucccaaccaccuucccu

SEQ ID NO: 1344055 - RNA, 27 nt, Human
cucuggcuucuccccgcuuucuggucu

SEQ ID NO: 1344056 - RNA, 22 nt, Human
cucuuaccuccuccaccagcua

SEQ ID NO: 1344057 - RNA, 22 nt, Human
cugaugcuccagggcucuuuuc

SEQ ID NO: 1344058 - RNA, 18 nt, Human
cugggggaaaggaacuug

SEQ ID NO: 1344059 - RNA, 20 nt, Human
cuuaccuccuccaccagcua

SEQ ID NO: 1344060 - RNA, 25 nt, Human
cuuucaggcucagucaacuuucugu

SEQ ID NO: 1344061 - RNA, 31 nt, Human
gacagacacacacaugcacacacacacacag

SEQ ID NO: 1344062 - RNA, 19 nt, Human
gacagccucucccaaccac

SEQ ID NO: 1344063 - RNA, 21 nt, Human
gccaagaacucuggcuucucc

SEQ ID NO: 1344064 - RNA, 19 nt, Human
gcccacccucccuccuccc

SEQ ID NO: 1344065 - RNA, 22 nt, Human
ggcaguggagaugucagaggga

SEQ ID NO: 1344066 - RNA, 21 nt, Human
uaccuccuccaccagcuagcc

SEQ ID NO: 1344067 - RNA, 23 nt, Human
uagcccccaagacagccucuccc

SEQ ID NO: 1344068 - RNA, 22 nt, Human
uccaccagcuagcccccaagac

SEQ ID NO: 1344069 - RNA, 19 nt, Human
ucccaaccaccuucccuuc

SEQ ID NO: 1344070 - RNA, 21 nt, Human
uccccaggggcccagcacugg

SEQ ID NO: 1344071 - RNA, 24 nt, Human
uccuccaccagcuagcccccaaga

SEQ ID NO: 1344072 - RNA, 20 nt, Human
ugaucuccuccucugcccuc

SEQ ID NO: 1344073 - RNA, 20 nt, Human
ugcacacacacacacacaca

SEQ ID NO: 1344074 - RNA, 25 nt, Human
ugcacacacacacacacacacgcac

SEQ ID NO: 1344075 - RNA, 33 nt, Human
ugcaugcaugccagacagacacacacaugcagu

SEQ ID NO: 1344076 - RNA, 26 nt, Human
ugcccucaccuacugucaccuccagc

SEQ ID NO: 1344077 - RNA, 22 nt, Human
ugggaccuggcccuuucaggcu

SEQ ID NO: 1344078 - RNA, 23 nt, Human
uuucugggggaaaggaacuugga

SEQ ID NO: 1344079 - RNA, 19 nt, Human
aacauuuggaaguuuucuc

SEQ ID NO: 1344080 - RNA, 23 nt, Human
aagaagcaggggggcagguggag

SEQ ID NO: 1344081 - RNA, 28 nt, Human
aagcaggggggcagguggaaggucgacc

SEQ ID NO: 1344082 - RNA, 18 nt, Human
acuacacuccagccuggg

SEQ ID NO: 1344083 - RNA, 21 nt, Human
agaggcugaggugggaggaua

SEQ ID NO: 1344084 - RNA, 24 nt, Human
agcuauuugagaggcugagguggg

SEQ ID NO: 1344085 - RNA, 24 nt, Human
aggcugaggugggaggauagcuug

SEQ ID NO: 1344086 - RNA, 24 nt, Human
auugcgccacuacacuccagccug

SEQ ID NO: 1344087 - RNA, 23 nt, Human
cacuacacuccagccugggugac

SEQ ID NO: 1344088 - RNA, 18 nt, Human
cacuccagccugggugac

SEQ ID NO: 1344089 - RNA, 24 nt, Human
cagcuauuugagaggcugaggugg

SEQ ID NO: 1344090 - RNA, 20 nt, Human
ccacuacacuccagccuggg

SEQ ID NO: 1344091 - RNA, 21 nt, Human
ccacuacacuccagccugggu

SEQ ID NO: 1344092 - RNA, 22 nt, Human
ccacuacacuccagccugggug

SEQ ID NO: 1344093 - RNA, 24 nt, Human
ccacuacacuccagccugggugac

SEQ ID NO: 1344094 - RNA, 20 nt, Human
cccaggacgagggcugcacu

SEQ ID NO: 1344095 - RNA, 23 nt, Human
ccuccauggggcguagcaggaac

SEQ ID NO: 1344096 - RNA, 22 nt, Human
gagcugcccggugcagacccag

SEQ ID NO: 1344097 - RNA, 18 nt, Human
gaggagagugaggggaga

SEQ ID NO: 1344098 - RNA, 19 nt, Human
gccacuacacuccagccug

SEQ ID NO: 1344099 - RNA, 24 nt, Human
gccacuacacuccagccuggguga

SEQ ID NO: 1344100 - RNA, 19 nt, Human
gcguagcaggaaccgggcu

SEQ ID NO: 1344101 - RNA, 21 nt, Human
gcuuugcugccuguaguccca

SEQ ID NO: 1344102 - RNA, 20 nt, Human
ggaggagagugaggggagag

SEQ ID NO: 1344103 - RNA, 19 nt, Human
gguggaggagagugagggg

SEQ ID NO: 1344104 - RNA, 21 nt, Human
gguguggccguguccugagcc

SEQ ID NO: 1344105 - RNA, 23 nt, Human
uaagaagcaggggggcaggugga

SEQ ID NO: 1344106 - RNA, 23 nt, Human
uaagaagcaggggggcaggugga

SEQ ID NO: 1344107 - RNA, 20 nt, Human
uagcuugagcccaaggaggg

SEQ ID NO: 1344108 - RNA, 21 nt, Human
ucagugaggcugggcagaugg

SEQ ID NO: 1344109 - RNA, 21 nt, Human
ucuuuauaaacauuuggaagu

SEQ ID NO: 1344110 - RNA, 26 nt, Human
ugacagacuuucuuuauaaacauuug

SEQ ID NO: 1344111 - RNA, 22 nt, Human
ugagaaaagugaccacgugggg

SEQ ID NO: 1344112 - RNA, 19 nt, Human
ugagaggcugaggugggag

SEQ ID NO: 1344113 - RNA, 24 nt, Human
ugagauugcgccacuacacuccag

SEQ ID NO: 1344114 - RNA, 20 nt, Human
ugaggggagagcugcccggu

SEQ ID NO: 1344115 - RNA, 18 nt, Human
ugaggugggaggauagcu

SEQ ID NO: 1344116 - RNA, 20 nt, Human
ugaggugggaggauagcuug

SEQ ID NO: 1344117 - RNA, 24 nt, Human
ugaggugggaggauagcuugagcc

SEQ ID NO: 1344118 - RNA, 22 nt, Human
ugccuguagucccagcuauuug

SEQ ID NO: 1344119 - RNA, 22 nt, Human
ugcuuugcugccuguaguccca

SEQ ID NO: 1344120 - RNA, 23 nt, Human
uggucucggagccuccauggggc

SEQ ID NO: 1344121 - RNA, 22 nt, Human
ugguguggccguguccugagcc

SEQ ID NO: 1344122 - RNA, 25 nt, Human
uuggaaguuuucucccccaucuucu

SEQ ID NO: 1344123 - RNA, 23 nt, Human
uuuggaaguuuucucccccaucu

SEQ ID NO: 1344124 - RNA, 21 nt, Human
aaacuggucucauucauauca

SEQ ID NO: 1344125 - RNA, 24 nt, Human
aaauacaguaaagauugaaaccaa

SEQ ID NO: 1344126 - RNA, 22 nt, Human
acagaccccuccccaacuuaag

SEQ ID NO: 1344127 - RNA, 21 nt, Human
aggcagaaacuugucaaccca

SEQ ID NO: 1344128 - RNA, 22 nt, Human
agggucagggaagaggagaagg

SEQ ID NO: 1344129 - RNA, 23 nt, Human
aucuucuuuagacauaaugcuau

SEQ ID NO: 1344130 - RNA, 20 nt, Human
cagaccccuccccaacuuaa

SEQ ID NO: 1344131 - RNA, 19 nt, Human
caguaaagauugaaaccaa

SEQ ID NO: 1344132 - RNA, 21 nt, Human
cccaccgacgcacaacagacc

SEQ ID NO: 1344133 - RNA, 22 nt, Human
cccaccgacgcacaacagaccc

SEQ ID NO: 1344134 - RNA, 18 nt, Human
ccggcagccaggacagcu

SEQ ID NO: 1344135 - RNA, 23 nt, Human
cucccaucuccuggaagcucuac

SEQ ID NO: 1344136 - RNA, 20 nt, Human
cuccuggccguggguuggga

SEQ ID NO: 1344137 - RNA, 23 nt, Human
cucugagggucagggaagaggag

SEQ ID NO: 1344138 - RNA, 23 nt, Human
gaggagaagggacggggaggaga

SEQ ID NO: 1344139 - RNA, 20 nt, Human
gaugggggguggucuccaga

SEQ ID NO: 1344140 - RNA, 21 nt, Human
gcuugugucuuuggucccgga

SEQ ID NO: 1344141 - RNA, 21 nt, Human
ggccguggguugggaggggag

SEQ ID NO: 1344142 - RNA, 18 nt, Human
gggacggggaggagaagg

SEQ ID NO: 1344143 - RNA, 23 nt, Human
ggggaggagaaggaacaggggag

SEQ ID NO: 1344144 - RNA, 22 nt, Human
ggggaugggggguggucuccag

SEQ ID NO: 1344145 - RNA, 20 nt, Human
ggguugggaggggagggugg

SEQ ID NO: 1344146 - RNA, 20 nt, Human
uaagaugcaaacuuacguga

SEQ ID NO: 1344147 - RNA, 24 nt, Human
uaagcccggcagccaggacagcac

SEQ ID NO: 1344148 - RNA, 23 nt, Human
uaaggaaaaaauucauuuaaaaa

SEQ ID NO: 1344149 - RNA, 22 nt, Human
uauuuuaaauggcugagcuggu

SEQ ID NO: 1344150 - RNA, 19 nt, Human
uccaagaaguugugaggag

SEQ ID NO: 1344151 - RNA, 21 nt, Human
ugagggucagggaagaggaga

SEQ ID NO: 1344152 - RNA, 28 nt, Human
ugagggucagggaagaggagaagggacg

SEQ ID NO: 1344153 - RNA, 20 nt, Human
ugcagaaagccaguccugaa

SEQ ID NO: 1344154 - RNA, 20 nt, Human
uggcugagcuggucauuaga

SEQ ID NO: 1344155 - RNA, 21 nt, Human
uggguugggaggggagggugg

SEQ ID NO: 1344156 - RNA, 21 nt, Human
uggguugggaggggagggugg

SEQ ID NO: 1344157 - RNA, 25 nt, Human
uguagcuggucaggggauggggggu

SEQ ID NO: 1344158 - RNA, 20 nt, Human
ugugucuuuggucccggagg

SEQ ID NO: 1344159 - RNA, 18 nt, Human
uugcuuaagcaggcgaca

SEQ ID NO: 1344160 - RNA, 24 nt, Human
aaagugcugggauuacaggcguga

SEQ ID NO: 1344161 - RNA, 25 nt, Human
aagcaauucuccugccucagccucc

SEQ ID NO: 1344162 - RNA, 24 nt, Human
aaguaucugggauuacaggcaugu

SEQ ID NO: 1344163 - RNA, 19 nt, Human
aagugcugggauuacaggc

SEQ ID NO: 1344164 - RNA, 19 nt, Human
aagugcugggauuacaggc

SEQ ID NO: 1344165 - RNA, 26 nt, Human
aagugcugggauuacaggcgugagcc

SEQ ID NO: 1344166 - RNA, 24 nt, Human
aauuuuguauuuuuaguagagaug

SEQ ID NO: 1344167 - RNA, 23 nt, Human
acagcaggcccagcugaaacaag

SEQ ID NO: 1344168 - RNA, 24 nt, Human
accauguuagucagguuggucuug

SEQ ID NO: 1344169 - RNA, 18 nt, Human
accccaaccuccaaaauu

SEQ ID NO: 1344170 - RNA, 18 nt, Human
acuaaggugcccaguggu

SEQ ID NO: 1344171 - RNA, 24 nt, Human
aggcgauccgcccaccuuggccuc

SEQ ID NO: 1344172 - RNA, 18 nt, Human
agugcugggauuacaggc

SEQ ID NO: 1344173 - RNA, 19 nt, Human
augggguuucaccauguua

SEQ ID NO: 1344174 - RNA, 20 nt, Human
augggguuucaccauguuag

SEQ ID NO: 1344175 - RNA, 24 nt, Human
augggguuucaccauguuagucag

SEQ ID NO: 1344176 - RNA, 26 nt, Human
augggguuucaccauguuagucaggu

SEQ ID NO: 1344177 - RNA, 21 nt, Human
auucuccugccucagccuccc

SEQ ID NO: 1344178 - RNA, 21 nt, Human
auuucaucuccuaggccccaa

SEQ ID NO: 1344179 - RNA, 24 nt, Human
caaagugcugggauuacaggcgug

SEQ ID NO: 1344180 - RNA, 23 nt, Human
caaccuccaaaauuaaaaaaaaa

SEQ ID NO: 1344181 - RNA, 23 nt, Human
caaccuccaccuccuggguucaa

SEQ ID NO: 1344182 - RNA, 22 nt, Human
caagcaauucuccugccucagc

SEQ ID NO: 1344183 - RNA, 24 nt, Human
caccauguuagucagguuggucuu

SEQ ID NO: 1344184 - RNA, 21 nt, Human
caccccaaccuccaaaauuaa

SEQ ID NO: 1344185 - RNA, 21 nt, Human
cacugcaaccuccaccuccug

SEQ ID NO: 1344186 - RNA, 23 nt, Human
cacugcaaccuccaccuccuggg

SEQ ID NO: 1344187 - RNA, 23 nt, Human
cagcugaaacaaggaggucucuu

SEQ ID NO: 1344188 - RNA, 19 nt, Human
caugugccaucaugccugg

SEQ ID NO: 1344189 - RNA, 24 nt, Human
cauguuagucagguuggucuugaa

SEQ ID NO: 1344190 - RNA, 22 nt, Human
ccaaagugcugggauuacaggc

SEQ ID NO: 1344191 - RNA, 22 nt, Human
ccaaagugcugggauuacaggc

SEQ ID NO: 1344192 - RNA, 24 nt, Human
ccaaagugcugggauuacaggcgu

SEQ ID NO: 1344193 - RNA, 23 nt, Human
ccaaguaucugggauuacaggca

SEQ ID NO: 1344194 - RNA, 24 nt, Human
ccaaguaucugggauuacaggcau

SEQ ID NO: 1344195 - RNA, 27 nt, Human
ccaccuccuggguucaagcaauucuuu

SEQ ID NO: 1344196 - RNA, 19 nt, Human
cccaaguaucugggauuac

SEQ ID NO: 1344197 - RNA, 24 nt, Human
cccaaguaucugggauuacaggca

SEQ ID NO: 1344198 - RNA, 18 nt, Human
cccagcugaaacaaggag

SEQ ID NO: 1344199 - RNA, 18 nt, Human
cccaguggucagaugagc

SEQ ID NO: 1344200 - RNA, 19 nt, Human
ccuccaccuccuggguuca

SEQ ID NO: 1344201 - RNA, 24 nt, Human
ccuccuggguucaagcaauucucc

SEQ ID NO: 1344202 - RNA, 24 nt, Human
ccugaccucaggcgauccgcccac

SEQ ID NO: 1344203 - RNA, 23 nt, Human
ccuggguucaagcaauucuccug

SEQ ID NO: 1344204 - RNA, 24 nt, Human
cgauccgcccaccuuggccuccca

SEQ ID NO: 1344205 - RNA, 21 nt, Human
cgcccagcgcccgccgcgagc

SEQ ID NO: 1344206 - RNA, 24 nt, Human
cucacugcaaccuccaccuccugg

SEQ ID NO: 1344207 - RNA, 26 nt, Human
cucacugcaaccuccaccuccugggu

SEQ ID NO: 1344208 - RNA, 24 nt, Human
cucaggcgauccgcccaccuuggc

SEQ ID NO: 1344209 - RNA, 23 nt, Human
cuccaaaauuaaaaaaaaaaauc

SEQ ID NO: 1344210 - RNA, 21 nt, Human
cuccuggguucaagcaauucu

SEQ ID NO: 1344211 - RNA, 18 nt, Human
cugcaaccuccaccuccu

SEQ ID NO: 1344212 - RNA, 23 nt, Human
cugcaaccuccaccuccuggguu

SEQ ID NO: 1344213 - RNA, 22 nt, Human
gacagcaggcccagcugaaaca

SEQ ID NO: 1344214 - RNA, 23 nt, Human
gaccucaggcgauccgcccaccu

SEQ ID NO: 1344215 - RNA, 18 nt, Human
gagaugggguuucaccau

SEQ ID NO: 1344216 - RNA, 24 nt, Human
gagaugggguuucaccauguuagu

SEQ ID NO: 1344217 - RNA, 18 nt, Human
gagucggaucccgcccag

SEQ ID NO: 1344218 - RNA, 18 nt, Human
gauuacaggcaugugcca

SEQ ID NO: 1344219 - RNA, 22 nt, Human
gauuacaggcaugugccaucau

SEQ ID NO: 1344220 - RNA, 18 nt, Human
gauuacaggcgugagcca

SEQ ID NO: 1344221 - RNA, 22 nt, Human
gauuacaggcgugagccaccgc

SEQ ID NO: 1344222 - RNA, 22 nt, Human
gauuacaggcgugagccaccgc

SEQ ID NO: 1344223 - RNA, 19 nt, Human
gauugcaccccaaccucca

SEQ ID NO: 1344224 - RNA, 22 nt, Human
gcaaccuccaccuccuggguuc

SEQ ID NO: 1344225 - RNA, 24 nt, Human
ggauuacaggcaugugccaucaug

SEQ ID NO: 1344226 - RNA, 22 nt, Human
gggguuucaccauguuagucag

SEQ ID NO: 1344227 - RNA, 19 nt, Human
ggucuugaacuccugaccu

SEQ ID NO: 1344228 - RNA, 20 nt, Human
ggucuugaacuccugaccuc

SEQ ID NO: 1344229 - RNA, 23 nt, Human
guagagaugggguuucaccaugu

SEQ ID NO: 1344230 - RNA, 22 nt, Human
uaaagauugcaccccaaccucc

SEQ ID NO: 1344231 - RNA, 22 nt, Human
uacaggcaugugccaucaugcc

SEQ ID NO: 1344232 - RNA, 23 nt, Human
uacaggcgugagccaccgcgccc

SEQ ID NO: 1344233 - RNA, 22 nt, Human
uagagaugggguuucaccaugu

SEQ ID NO: 1344234 - RNA, 24 nt, Human
uaguagagaugggguuucaccaug

SEQ ID NO: 1344235 - RNA, 26 nt, Human
uaguagagaugggguuucaccauguu

SEQ ID NO: 1344236 - RNA, 24 nt, Human
uagucagguuggucuugaacuccu

SEQ ID NO: 1344237 - RNA, 19 nt, Human
ucaagcaauucuccugccu

SEQ ID NO: 1344238 - RNA, 23 nt, Human
ucacugcaaccuccaccuccugg

SEQ ID NO: 1344239 - RNA, 24 nt, Human
ucacugcaaccuccaccuccuggg

SEQ ID NO: 1344240 - RNA, 25 nt, Human
ucacugcaaccuccaccuccugggu

SEQ ID NO: 1344241 - RNA, 27 nt, Human
ucacugcaaccuccaccuccuggguuc

SEQ ID NO: 1344242 - RNA, 18 nt, Human
ucaucuccuaggccccaa

SEQ ID NO: 1344243 - RNA, 24 nt, Human
ucccaaagugcugggauuacaggc

SEQ ID NO: 1344244 - RNA, 24 nt, Human
ucccaaguaucugggauuacaggc

SEQ ID NO: 1344245 - RNA, 22 nt, Human
uccuaggccccaaucaaucauc

SEQ ID NO: 1344246 - RNA, 21 nt, Human
uccuggguucaagcaauucuc

SEQ ID NO: 1344247 - RNA, 24 nt, Human
uccuggguucaagcaauucuccug

SEQ ID NO: 1344248 - RNA, 19 nt, Human
ucuccugccucagccuccc

SEQ ID NO: 1344249 - RNA, 23 nt, Human
ucuugaacuccugaccucaggcg

SEQ ID NO: 1344250 - RNA, 22 nt, Human
ucuuugguucagguuggcacua

SEQ ID NO: 1344251 - RNA, 18 nt, Human
ugaaacaaggaggucucu

SEQ ID NO: 1344252 - RNA, 20 nt, Human
ugaaacaaggaggucucuuu

SEQ ID NO: 1344253 - RNA, 18 nt, Human
ugaccucaggcgauccgc

SEQ ID NO: 1344254 - RNA, 21 nt, Human
ugaccucaggcgauccgccca

SEQ ID NO: 1344255 - RNA, 24 nt, Human
ugcaccccaaccuccaaaauuaaa

SEQ ID NO: 1344256 - RNA, 24 nt, Human
ugccucagccucccaaguaucugg

SEQ ID NO: 1344257 - RNA, 24 nt, Human
ugcugggauuacaggcgugagcca

SEQ ID NO: 1344258 - RNA, 24 nt, Human
uggcacgaucucagcucacugcaa

SEQ ID NO: 1344259 - RNA, 18 nt, Human
ugggauuacaggcaugug

SEQ ID NO: 1344260 - RNA, 19 nt, Human
ugggauuacaggcaugugc

SEQ ID NO: 1344261 - RNA, 21 nt, Human
ugggauuacaggcaugugcca

SEQ ID NO: 1344262 - RNA, 21 nt, Human
ugggauuacaggcaugugcca

SEQ ID NO: 1344263 - RNA, 23 nt, Human
ugggauuacaggcaugugccauc

SEQ ID NO: 1344264 - RNA, 24 nt, Human
ugggauuacaggcaugugccauca

SEQ ID NO: 1344265 - RNA, 18 nt, Human
ugggauuacaggcgugag

SEQ ID NO: 1344266 - RNA, 19 nt, Human
ugggauuacaggcgugagc

SEQ ID NO: 1344267 - RNA, 21 nt, Human
ugggauuacaggcgugagcca

SEQ ID NO: 1344268 - RNA, 22 nt, Human
ugggauuacaggcgugagccac

SEQ ID NO: 1344269 - RNA, 23 nt, Human
ugggauuacaggcgugagccacc

SEQ ID NO: 1344270 - RNA, 24 nt, Human
ugggauuacaggcgugagccaccg

SEQ ID NO: 1344271 - RNA, 24 nt, Human
ugggguuucaccauguuagucagg

SEQ ID NO: 1344272 - RNA, 21 nt, Human
uggguucaagcaauucuccug

SEQ ID NO: 1344273 - RNA, 23 nt, Human
uggguucaagcaauucuccugcc

SEQ ID NO: 1344274 - RNA, 24 nt, Human
uggguucaagcaauucuccugccu

SEQ ID NO: 1344275 - RNA, 21 nt, Human
uguauuuuuaguagagauggg

SEQ ID NO: 1344276 - RNA, 20 nt, Human
uguucccacaacccacugca

SEQ ID NO: 1344277 - RNA, 26 nt, Human
uguucccacaacccacugcaccuggg

SEQ ID NO: 1344278 - RNA, 22 nt, Human
uuaaggcauauucuaaagauug

SEQ ID NO: 1344279 - RNA, 18 nt, Human
uuaguagagaugggguuu

SEQ ID NO: 1344280 - RNA, 22 nt, Human
uuaguagagaugggguuucacc

SEQ ID NO: 1344281 - RNA, 24 nt, Human
uuaguagagaugggguuucaccau

SEQ ID NO: 1344282 - RNA, 21 nt, Human
uucaagcaauucuccugccuc

SEQ ID NO: 1344283 - RNA, 24 nt, Human
uucaagcaauucuccugccucagc

SEQ ID NO: 1344284 - RNA, 18 nt, Human
uucccacaacccacugca

SEQ ID NO: 1344285 - RNA, 23 nt, Human
uuguauuuuuaguagagaugggg

SEQ ID NO: 1344286 - RNA, 19 nt, Human
uuucaccauguuagucagg

SEQ ID NO: 1344287 - RNA, 23 nt, Human
uuucagggguggggaacacuuua

SEQ ID NO: 1344288 - RNA, 19 nt, Human
uuuuguauuuuuaguagag

SEQ ID NO: 1344289 - RNA, 20 nt, Human
uuuuguauuuuuaguagaga

SEQ ID NO: 1344290 - RNA, 24 nt, Human
uuuuuaguagagaugggguuucac

SEQ ID NO: 1344291 - RNA, 23 nt, Human
uuuuucuuugguccuuuuauccu

SEQ ID NO: 1344292 - RNA, 23 nt, Human
uuuuuuuucagggguggggaaca

SEQ ID NO: 1344293 - RNA, 19 nt, Human
uuuuuuuuuuuucaggggu

SEQ ID NO: 1344294 - RNA, 20 nt, Human
uuuuuuuuuuuuuucagggg

SEQ ID NO: 1344295 - RNA, 24 nt, Human
uuuuuuuuuuuuuuucaggggugg

SEQ ID NO: 1344296 - RNA, 25 nt, Human
uuuuuuuuuuuuuuuuuuuucaggg

SEQ ID NO: 1344297 - RNA, 19 nt, Human
aaaaaccagaaacaacuuc

SEQ ID NO: 1344298 - RNA, 21 nt, Human
aaacaaaugucucaggucaaa

SEQ ID NO: 1344299 - RNA, 21 nt, Human
aaacaccaacaguacccacuu

SEQ ID NO: 1344300 - RNA, 22 nt, Human
aaacauucauagccccuucccc

SEQ ID NO: 1344301 - RNA, 23 nt, Human
aaacauucauagccccuuccccu

SEQ ID NO: 1344302 - RNA, 18 nt, Human
aaagcacugcugggcccu

SEQ ID NO: 1344303 - RNA, 22 nt, Human
aaaggagacaggaaaagcugcc

SEQ ID NO: 1344304 - RNA, 19 nt, Human
aacacagugaagcccuguc

SEQ ID NO: 1344305 - RNA, 20 nt, Human
aacacagugaagcccugucu

SEQ ID NO: 1344306 - RNA, 21 nt, Human
aacacagugaagcccugucuc

SEQ ID NO: 1344307 - RNA, 24 nt, Human
aaccugggugacagagcgagacuc

SEQ ID NO: 1344308 - RNA, 20 nt, Human
aagaggagcagagcaugaua

SEQ ID NO: 1344309 - RNA, 19 nt, Human
aagaggcagaaacaucugc

SEQ ID NO: 1344310 - RNA, 23 nt, Human
aagcugcugagugagugacagcu

SEQ ID NO: 1344311 - RNA, 22 nt, Human
aaggagacaggaaaagcugcca

SEQ ID NO: 1344312 - RNA, 18 nt, Human
aaucaguggaacugauaa

SEQ ID NO: 1344313 - RNA, 24 nt, Human
aauggcgugaacccaggaggcaga

SEQ ID NO: 1344314 - RNA, 23 nt, Human
acaaaacagcaagagcacagguc

SEQ ID NO: 1344315 - RNA, 20 nt, Human
acaagccccaaaaaaccagg

SEQ ID NO: 1344316 - RNA, 20 nt, Human
acacaagccccaaaaaacca

SEQ ID NO: 1344317 - RNA, 24 nt, Human
acagagcgagacuccgucucaaaa

SEQ ID NO: 1344318 - RNA, 23 nt, Human
acaggaaaagcugccacuggagg

SEQ ID NO: 1344319 - RNA, 24 nt, Human
acccaagagccuuccugggcucuc

SEQ ID NO: 1344320 - RNA, 23 nt, Human
accugggugacagagcgagacuc

SEQ ID NO: 1344321 - RNA, 22 nt, Human
acgccacugcacuccaaccugg

SEQ ID NO: 1344322 - RNA, 28 nt, Human
acuccgucucaaaaaaaaaaaaaaaaaa

SEQ ID NO: 1344323 - RNA, 18 nt, Human
acugcacuccaaccuggg

SEQ ID NO: 1344324 - RNA, 24 nt, Human
acugcacuccaaccugggugacag

SEQ ID NO: 1344325 - RNA, 23 nt, Human
acuucacaggggagaaaaccagc

SEQ ID NO: 1344326 - RNA, 23 nt, Human
agagcuugcagugagccgagauc

SEQ ID NO: 1344327 - RNA, 25 nt, Human
agaggagcagagcaugauaaagcua

SEQ ID NO: 1344328 - RNA, 20 nt, Human
agcaagacuguugcagaaga

SEQ ID NO: 1344329 - RNA, 24 nt, Human
agcacuuugggaggccgagguggg

SEQ ID NO: 1344330 - RNA, 18 nt, Human
agcugcugagugagugac

SEQ ID NO: 1344331 - RNA, 21 nt, Human
agcugcugagugagugacagc

SEQ ID NO: 1344332 - RNA, 21 nt, Human
agcuuggccaacccaagagcc

SEQ ID NO: 1344333 - RNA, 19 nt, Human
aggagggugauugcugggc

SEQ ID NO: 1344334 - RNA, 21 nt, Human
aggcagagcuugcagugagcc

SEQ ID NO: 1344335 - RNA, 24 nt, Human
aggcagagcuugcagugagccgag

SEQ ID NO: 1344336 - RNA, 21 nt, Human
aggcaggagaauggcgugaac

SEQ ID NO: 1344337 - RNA, 24 nt, Human
aggcaggagaauggcgugaaccca

SEQ ID NO: 1344338 - RNA, 27 nt, Human
aggcaggagaauggcgugaacccagga

SEQ ID NO: 1344339 - RNA, 19 nt, Human
aggcagguggccagaugag

SEQ ID NO: 1344340 - RNA, 25 nt, Human
aggcagguggccagaugaggucaga

SEQ ID NO: 1344341 - RNA, 21 nt, Human
aggccgaggugggcggaucac

SEQ ID NO: 1344342 - RNA, 22 nt, Human
aggccuugugcugggcaccgua

SEQ ID NO: 1344343 - RNA, 24 nt, Human
aggcgcaguggcucacaucuguaa

SEQ ID NO: 1344344 - RNA, 19 nt, Human
aggcugaggcaggagaaug

SEQ ID NO: 1344345 - RNA, 24 nt, Human
aggugggcggaucacgaggucagg

SEQ ID NO: 1344346 - RNA, 24 nt, Human
aggugugguggcgggcaccuguag

SEQ ID NO: 1344347 - RNA, 22 nt, Human
agugagugacagcugggcacaa

SEQ ID NO: 1344348 - RNA, 24 nt, Human
aguggcucacaucuguaaucccag

SEQ ID NO: 1344349 - RNA, 19 nt, Human
aucaaacaccaacaguacc

SEQ ID NO: 1344350 - RNA, 24 nt, Human
aucacgccacugcacuccaaccug

SEQ ID NO: 1344351 - RNA, 19 nt, Human
auccagcucuucucuuuca

SEQ ID NO: 1344352 - RNA, 19 nt, Human
caaaaaaccaggcccugca

SEQ ID NO: 1344353 - RNA, 23 nt, Human
caaaacagcaagagcacaggucc

SEQ ID NO: 1344354 - RNA, 21 nt, Human
caaaacuucuaaagaugcaaa

SEQ ID NO: 1344355 - RNA, 24 nt, Human
caaacacaagcaguauacauacca

SEQ ID NO: 1344356 - RNA, 22 nt, Human
caaagcagcucuuucuggagac

SEQ ID NO: 1344357 - RNA, 22 nt, Human
caacaguacccacuugugccag

SEQ ID NO: 1344358 - RNA, 20 nt, Human
caacccaaacacaagcagua

SEQ ID NO: 1344359 - RNA, 19 nt, Human
caagccccaaaaaaccagg

SEQ ID NO: 1344360 - RNA, 22 nt, Human
cacacaggggcaaggaaaaacc

SEQ ID NO: 1344361 - RNA, 24 nt, Human
cacaucuguaaucccagcacuuug

SEQ ID NO: 1344362 - RNA, 23 nt, Human
caccaacaguacccacuugugcc

SEQ ID NO: 1344363 - RNA, 22 nt, Human
caccacacaagccccaaaaaac

SEQ ID NO: 1344364 - RNA, 23 nt, Human
caccuguaguaccagcuacuugg

SEQ ID NO: 1344365 - RNA, 24 nt, Human
caccuguaguaccagcuacuuggg

SEQ ID NO: 1344366 - RNA, 23 nt, Human
cacuccaaccugggugacagagc

SEQ ID NO: 1344367 - RNA, 24 nt, Human
cacuccaaccugggugacagagcg

SEQ ID NO: 1344368 - RNA, 19 nt, Human
cacugcacuccaaccuggg

SEQ ID NO: 1344369 - RNA, 24 nt, Human
cacugcacuccaaccugggugaca

SEQ ID NO: 1344370 - RNA, 22 nt, Human
cacuugugccaggccuugugcu

SEQ ID NO: 1344371 - RNA, 18 nt, Human
cagaugaggucagagcuc

SEQ ID NO: 1344372 - RNA, 24 nt, Human
cagcacuuugggaggccgaggugg

SEQ ID NO: 1344373 - RNA, 22 nt, Human
cagcagccugaccucuacaucu

SEQ ID NO: 1344374 - RNA, 22 nt, Human
cagcaguagcccauguguuggc

SEQ ID NO: 1344375 - RNA, 20 nt, Human
cagcccaaaggagcagucaa

SEQ ID NO: 1344376 - RNA, 18 nt, Human
cagcccaagaggcugccc

SEQ ID NO: 1344377 - RNA, 20 nt, Human
cagcccaggcuucccagcag

SEQ ID NO: 1344378 - RNA, 24 nt, Human
cagcuacuugggaggcugaggcag

SEQ ID NO: 1344379 - RNA, 22 nt, Human
cagcugggcacaaagugucuug

SEQ ID NO: 1344380 - RNA, 18 nt, Human
caggccaucuggaggagc

SEQ ID NO: 1344381 - RNA, 21 nt, Human
caggcccugcagagccaugac

SEQ ID NO: 1344382 - RNA, 24 nt, Human
caggcuucccagcaguagcccaug

SEQ ID NO: 1344383 - RNA, 21 nt, Human
cauaagauuuuccgugcccug

SEQ ID NO: 1344384 - RNA, 23 nt, Human
caucuguaaucccagcacuuugg

SEQ ID NO: 1344385 - RNA, 24 nt, Human
caucuguaaucccagcacuuuggg

SEQ ID NO: 1344386 - RNA, 24 nt, Human
ccaacaguacccacuugugccagg

SEQ ID NO: 1344387 - RNA, 20 nt, Human
ccaccuucuggcuuuguagc

SEQ ID NO: 1344388 - RNA, 20 nt, Human
ccacugcacuccaaccuggg

SEQ ID NO: 1344389 - RNA, 20 nt, Human
ccacugcacuccaaccuggg

SEQ ID NO: 1344390 - RNA, 24 nt, Human
ccacugcacuccaaccugggugac

SEQ ID NO: 1344391 - RNA, 18 nt, Human
ccagcccaagaggcugcc

SEQ ID NO: 1344392 - RNA, 22 nt, Human
cccaaaggagcagucaagggcc

SEQ ID NO: 1344393 - RNA, 18 nt, Human
ccccaaaaaaccaggccc

SEQ ID NO: 1344394 - RNA, 19 nt, Human
cccccuccuccucucucuu

SEQ ID NO: 1344395 - RNA, 22 nt, Human
cccccuccuccucucucuuucc

SEQ ID NO: 1344396 - RNA, 23 nt, Human
ccccuccuccucucucuuuccua

SEQ ID NO: 1344397 - RNA, 23 nt, Human
cccugucucuacuaaaaauacaa

SEQ ID NO: 1344398 - RNA, 22 nt, Human
ccuggcuaacacagugaagccc

SEQ ID NO: 1344399 - RNA, 21 nt, Human
ccuguaguaccagcuacuugg

SEQ ID NO: 1344400 - RNA, 24 nt, Human
cgagaccauccuggcuaacacagu

SEQ ID NO: 1344401 - RNA, 19 nt, Human
cgagaucacgccacugcac

SEQ ID NO: 1344402 - RNA, 24 nt, Human
cgaggugggcggaucacgagguca

SEQ ID NO: 1344403 - RNA, 26 nt, Human
cgccacugcacuccaaccugggugac

SEQ ID NO: 1344404 - RNA, 24 nt, Human
cggccaggcgcaguggcucacauc

SEQ ID NO: 1344405 - RNA, 21 nt, Human
cgggcaccuguaguaccagcu

SEQ ID NO: 1344406 - RNA, 18 nt, Human
cucaaaaaaaaaaaaaaa

SEQ ID NO: 1344407 - RNA, 24 nt, Human
cucacaucuguaaucccagcacuu

SEQ ID NO: 1344408 - RNA, 19 nt, Human
cuccgucucaaaaaaaaaa

SEQ ID NO: 1344409 - RNA, 23 nt, Human
cucucuccaaguccuuccuuuaa

SEQ ID NO: 1344410 - RNA, 19 nt, Human
cuggagaccuccuguggag

SEQ ID NO: 1344411 - RNA, 18 nt, Human
cuggcuaacacagugaag

SEQ ID NO: 1344412 - RNA, 24 nt, Human
cuggcuaacacagugaagcccugu

SEQ ID NO: 1344413 - RNA, 19 nt, Human
cuugcagugagccgagauc

SEQ ID NO: 1344414 - RNA, 30 nt, Human
gaacauguauacaaacauucauagccccuu

SEQ ID NO: 1344415 - RNA, 19 nt, Human
gaagcccugucucuacuaa

SEQ ID NO: 1344416 - RNA, 21 nt, Human
gacagagcgagacuccgucuc

SEQ ID NO: 1344417 - RNA, 24 nt, Human
gacagagcgagacuccgucucaaa

SEQ ID NO: 1344418 - RNA, 26 nt, Human
gagaaaauaggagaacgaacaccagc

SEQ ID NO: 1344419 - RNA, 22 nt, Human
gagcuuggccaacccaagagcc

SEQ ID NO: 1344420 - RNA, 26 nt, Human
gaggguccccucuucuacccuuggga

SEQ ID NO: 1344421 - RNA, 22 nt, Human
gcaaggaaaaaccagaaacaac

SEQ ID NO: 1344422 - RNA, 21 nt, Human
gcagagcaugauaaagcuaca

SEQ ID NO: 1344423 - RNA, 22 nt, Human
gcaggagaauggcgugaaccca

SEQ ID NO: 1344424 - RNA, 24 nt, Human
gccacugcacuccaaccuggguga

SEQ ID NO: 1344425 - RNA, 19 nt, Human
gccaggugugguggcgggc

SEQ ID NO: 1344426 - RNA, 24 nt, Human
gccccaaaaaaccaggcccugcag

SEQ ID NO: 1344427 - RNA, 18 nt, Human
gcccugugaacauguaua

SEQ ID NO: 1344428 - RNA, 20 nt, Human
gccgagaucacgccacugca

SEQ ID NO: 1344429 - RNA, 24 nt, Human
gcuaacacagugaagcccugucuc

SEQ ID NO: 1344430 - RNA, 18 nt, Human
gcucagccaccuucuggc

SEQ ID NO: 1344431 - RNA, 22 nt, Human
gcugaggcaggagaauggcgug

SEQ ID NO: 1344432 - RNA, 22 nt, Human
gcugguucagcagccugaccuc

SEQ ID NO: 1344433 - RNA, 23 nt, Human
ggaaauauauaauccagcucuuc

SEQ ID NO: 1344434 - RNA, 21 nt, Human
ggagaaaaccagcccaagagg

SEQ ID NO: 1344435 - RNA, 21 nt, Human
ggccaggcgcaguggcucaca

SEQ ID NO: 1344436 - RNA, 21 nt, Human
ggcggaucacgaggucaggag

SEQ ID NO: 1344437 - RNA, 20 nt, Human
gggaggccgaggugggcgga

SEQ ID NO: 1344438 - RNA, 18 nt, Human
gggcaagucaugaggucc

SEQ ID NO: 1344439 - RNA, 21 nt, Human
gggcaucugagucaugcaugg

SEQ ID NO: 1344440 - RNA, 18 nt, Human
gucacuggggagcccugg

SEQ ID NO: 1344441 - RNA, 21 nt, Human
uaacacagugaagcccugucu

SEQ ID NO: 1344442 - RNA, 22 nt, Human
uaacacagugaagcccugucuc

SEQ ID NO: 1344443 - RNA, 24 nt, Human
uaacacagugaagcccugucucua

SEQ ID NO: 1344444 - RNA, 21 nt, Human
uaauggucaccacacaagccc

SEQ ID NO: 1344445 - RNA, 22 nt, Human
uacaaaaguagggggcaaguca

SEQ ID NO: 1344446 - RNA, 24 nt, Human
uacauacaaaccuuggcccagccc

SEQ ID NO: 1344447 - RNA, 19 nt, Human
uaccuuaagggucaaugag

SEQ ID NO: 1344448 - RNA, 18 nt, Human
uauacaaacauucauagc

SEQ ID NO: 1344449 - RNA, 25 nt, Human
uauacaaacauucauagccccuucc

SEQ ID NO: 1344450 - RNA, 22 nt, Human
ucaaaaaaaaaaaaaaaaaaaa

SEQ ID NO: 1344451 - RNA, 23 nt, Human
ucaaaaaaaaaaaaaaaaaaaaa

SEQ ID NO: 1344452 - RNA, 22 nt, Human
ucaaacaccaacaguacccacu

SEQ ID NO: 1344453 - RNA, 20 nt, Human
ucaacccaaacacaagcagu

SEQ ID NO: 1344454 - RNA, 24 nt, Human
ucacgaggucaggagagcgagacc

SEQ ID NO: 1344455 - RNA, 23 nt, Human
ucacgccacugcacuccaaccug

SEQ ID NO: 1344456 - RNA, 18 nt, Human
ucagcccugcucugcugc

SEQ ID NO: 1344457 - RNA, 24 nt, Human
ucauaucaggccaucuggaggagc

SEQ ID NO: 1344458 - RNA, 24 nt, Human
uccaaccugggugacagagcgaga

SEQ ID NO: 1344459 - RNA, 24 nt, Human
uccccucagcccugcucugcugca

SEQ ID NO: 1344460 - RNA, 23 nt, Human
uccgucucaaaaaaaaaaaaaaa

SEQ ID NO: 1344461 - RNA, 22 nt, Human
ucucuacuaaaaauacaaaaaa

SEQ ID NO: 1344462 - RNA, 20 nt, Human
ucugcggccaggcgcagugg

SEQ ID NO: 1344463 - RNA, 19 nt, Human
ucuugugagaccagcuaua

SEQ ID NO: 1344464 - RNA, 21 nt, Human
ugaaacaaaugucucagguca

SEQ ID NO: 1344465 - RNA, 24 nt, Human
ugaaacaaccccccacagugggga

SEQ ID NO: 1344466 - RNA, 20 nt, Human
ugaaggacauggaaagagga

SEQ ID NO: 1344467 - RNA, 21 nt, Human
ugaaggacauggaaagaggag

SEQ ID NO: 1344468 - RNA, 22 nt, Human
ugagccgagaucacgccacugc

SEQ ID NO: 1344469 - RNA, 24 nt, Human
ugagcuacagagaaaaagagccaa

SEQ ID NO: 1344470 - RNA, 19 nt, Human
ugaggagggugauugcugg

SEQ ID NO: 1344471 - RNA, 24 nt, Human
ugaggcaggagaauggcgugaacc

SEQ ID NO: 1344472 - RNA, 25 nt, Human
ugaggcaggagaauggcgugaaccc

SEQ ID NO: 1344473 - RNA, 21 nt, Human
uggaagaaagaugguuugcuc

SEQ ID NO: 1344474 - RNA, 19 nt, Human
uggaaggaguaagacacag

SEQ ID NO: 1344475 - RNA, 21 nt, Human
uggagaccuccuguggagggu

SEQ ID NO: 1344476 - RNA, 21 nt, Human
uggcucacaucuguaauccca

SEQ ID NO: 1344477 - RNA, 22 nt, Human
uggcucacaucuguaaucccag

SEQ ID NO: 1344478 - RNA, 24 nt, Human
uggcucacaucuguaaucccagca

SEQ ID NO: 1344479 - RNA, 19 nt, Human
ugggaggccgaggugggcg

SEQ ID NO: 1344480 - RNA, 24 nt, Human
ugggaggccgaggugggcggauca

SEQ ID NO: 1344481 - RNA, 18 nt, Human
ugggaggcugaggcagga

SEQ ID NO: 1344482 - RNA, 24 nt, Human
ugggaggcugaggcaggagaaugg

SEQ ID NO: 1344483 - RNA, 25 nt, Human
ugugcucguucauucacuuguucau

SEQ ID NO: 1344484 - RNA, 24 nt, Human
uguuaaaacaugacacagaugggu

SEQ ID NO: 1344485 - RNA, 18 nt, Human
uugcagugagccgagauc

SEQ ID NO: 1344486 - RNA, 20 nt, Human
uugcagugagccgagaucac

SEQ ID NO: 1344487 - RNA, 21 nt, Human
uugcagugagccgagaucacg

SEQ ID NO: 1344488 - RNA, 23 nt, Human
uugcgagggaguaggaaaugaag

SEQ ID NO: 1344489 - RNA, 21 nt, Human
uuggcccagcccaaaggagca

SEQ ID NO: 1344490 - RNA, 25 nt, Human
uugggaggccgaggugggcggauca

SEQ ID NO: 1344491 - RNA, 24 nt, Human
uuucccccuccuccucucucuuuc

SEQ ID NO: 1344492 - RNA, 18 nt, Human
aaacccagaagaaucaag

SEQ ID NO: 1344493 - RNA, 23 nt, Human
aaaucuauugccugcaccaaacc

SEQ ID NO: 1344494 - RNA, 21 nt, Human
aagcaaugucauaaagucaaa

SEQ ID NO: 1344495 - RNA, 19 nt, Human
aagccaccacaaaaaaaug

SEQ ID NO: 1344496 - RNA, 19 nt, Human
aauccaacaacucaagucu

SEQ ID NO: 1344497 - RNA, 18 nt, Human
acugcacugacuuaccaa

SEQ ID NO: 1344498 - RNA, 23 nt, Human
agauaggaaguggucuuuaggga

SEQ ID NO: 1344499 - RNA, 21 nt, Human
agccaaaagguccucacagaa

SEQ ID NO: 1344500 - RNA, 24 nt, Human
agcucagcaccaguggcggcuguc

SEQ ID NO: 1344501 - RNA, 24 nt, Human
aggaaaugucagaaaggcaaaaug

SEQ ID NO: 1344502 - RNA, 23 nt, Human
aguggcccaauuguuuccagugu

SEQ ID NO: 1344503 - RNA, 22 nt, Human
aucaagcuguuccuuuaaaagu

SEQ ID NO: 1344504 - RNA, 21 nt, Human
aucagccgccuucugcuucaa

SEQ ID NO: 1344505 - RNA, 21 nt, Human
auggucuuauugugggagggg

SEQ ID NO: 1344506 - RNA, 23 nt, Human
auuacuuaaguaacuaccacuca

SEQ ID NO: 1344507 - RNA, 23 nt, Human
auuuucuccuuugcaaucaagcu

SEQ ID NO: 1344508 - RNA, 19 nt, Human
caaaauggccagcauuauc

SEQ ID NO: 1344509 - RNA, 22 nt, Human
caaacauaaugagcacaaucuu

SEQ ID NO: 1344510 - RNA, 19 nt, Human
caagacggggagguaaagc

SEQ ID NO: 1344511 - RNA, 23 nt, Human
cacccugaaaucuuaugaguagc

SEQ ID NO: 1344512 - RNA, 18 nt, Human
caccuuuacuuggaaagu

SEQ ID NO: 1344513 - RNA, 23 nt, Human
cacuaguacuacaaggcuuaaca

SEQ ID NO: 1344514 - RNA, 21 nt, Human
cagaggaaaacaacagaaugu

SEQ ID NO: 1344515 - RNA, 21 nt, Human
cagaugucacucauaaguuuu

SEQ ID NO: 1344516 - RNA, 19 nt, Human
cagcacuccacaaacauaa

SEQ ID NO: 1344517 - RNA, 21 nt, Human
cagcauuauccauuugcuuuu

SEQ ID NO: 1344518 - RNA, 20 nt, Human
cagcucagcaccaguggcgg

SEQ ID NO: 1344519 - RNA, 19 nt, Human
caggggcuuccuagcagcu

SEQ ID NO: 1344520 - RNA, 22 nt, Human
cagguuuugcauacugagaaca

SEQ ID NO: 1344521 - RNA, 21 nt, Human
cauaagaauauggaaggauuc

SEQ ID NO: 1344522 - RNA, 18 nt, Human
ccagcauuauccauuugc

SEQ ID NO: 1344523 - RNA, 25 nt, Human
ccucuaauccaacaacucaagucug

SEQ ID NO: 1344524 - RNA, 28 nt, Human
ccugcaccaaaccaauucugacagcacc

SEQ ID NO: 1344525 - RNA, 19 nt, Human
cgccuucugcuucaacaac

SEQ ID NO: 1344526 - RNA, 19 nt, Human
cucacagaagcuuuaaccc

SEQ ID NO: 1344527 - RNA, 24 nt, Human
cuccaaccacccucuaauagcuag

SEQ ID NO: 1344528 - RNA, 23 nt, Human
cugggauuuugguccaaaguuuu

SEQ ID NO: 1344529 - RNA, 23 nt, Human
cuguguaaaggaccacgagaacc

SEQ ID NO: 1344530 - RNA, 24 nt, Human
cuuaugcaacugcacugacuuacc

SEQ ID NO: 1344531 - RNA, 23 nt, Human
gaaccuccugacuaccuccacuu

SEQ ID NO: 1344532 - RNA, 23 nt, Human
gauuucaguuagaaaacacccug

SEQ ID NO: 1344533 - RNA, 18 nt, Human
gcgggaaccucgccuccc

SEQ ID NO: 1344534 - RNA, 23 nt, Human
gcuuaucuauuuucuccuuugca

SEQ ID NO: 1344535 - RNA, 23 nt, Human
ggaaaauuacuuucuuuugccac

SEQ ID NO: 1344536 - RNA, 20 nt, Human
ggaugcuuuuuaagguaugg

SEQ ID NO: 1344537 - RNA, 28 nt, Human
ggugagucggaggggugacaguggguca

SEQ ID NO: 1344538 - RNA, 21 nt, Human
gucugugauuaguaguagucu

SEQ ID NO: 1344539 - RNA, 20 nt, Human
guggaaugcugauagauuca

SEQ ID NO: 1344540 - RNA, 24 nt, Human
uaaacaaaaugaaacccaaagcug

SEQ ID NO: 1344541 - RNA, 22 nt, Human
uaaacauguuuuacuuuuuucc

SEQ ID NO: 1344542 - RNA, 22 nt, Human
uaaaggaccacgagaaccuccu

SEQ ID NO: 1344543 - RNA, 22 nt, Human
uaacccaaguaaucauaagaau

SEQ ID NO: 1344544 - RNA, 19 nt, Human
uacaacaaaaaaaauuaga

SEQ ID NO: 1344545 - RNA, 22 nt, Human
uacugggugaauagcacuuucc

SEQ ID NO: 1344546 - RNA, 24 nt, Human
uacugggugaauagcacuuuccuu

SEQ ID NO: 1344547 - RNA, 23 nt, Human
uagcuaaacaaaaugaaacccaa

SEQ ID NO: 1344548 - RNA, 26 nt, Human
uagcuaaacaaaaugaaacccaaagc

SEQ ID NO: 1344549 - RNA, 19 nt, Human
uaggaaguuggagauaaau

SEQ ID NO: 1344550 - RNA, 18 nt, Human
uaggaggacugaaccgcg

SEQ ID NO: 1344551 - RNA, 22 nt, Human
uaggauaucuuaagagccaaaa

SEQ ID NO: 1344552 - RNA, 22 nt, Human
uaggcagaaugauucaucucuc

SEQ ID NO: 1344553 - RNA, 24 nt, Human
uauaaaacaauacagcaaaagaaa

SEQ ID NO: 1344554 - RNA, 23 nt, Human
ucaauacaaaacauuccaaaaag

SEQ ID NO: 1344555 - RNA, 21 nt, Human
ucagcaccaguggcggcuguc

SEQ ID NO: 1344556 - RNA, 24 nt, Human
ucaguuagaaaacacccugaaauc

SEQ ID NO: 1344557 - RNA, 18 nt, Human
ucaguuaggaggacugaa

SEQ ID NO: 1344558 - RNA, 21 nt, Human
uccaaaaagugaaaagugauc

SEQ ID NO: 1344559 - RNA, 21 nt, Human
uccugagauccacaggaaccc

SEQ ID NO: 1344560 - RNA, 27 nt, Human
uccuuugcaaucaagcuguuccuuuuc

SEQ ID NO: 1344561 - RNA, 20 nt, Human
ucuacaacuaaacuguuugu

SEQ ID NO: 1344562 - RNA, 22 nt, Human
ugaaagaguaagagcaagcacc

SEQ ID NO: 1344563 - RNA, 24 nt, Human
ugacuuaccaacaaucagccgccu

SEQ ID NO: 1344564 - RNA, 18 nt, Human
ugagaacagugagauuuc

SEQ ID NO: 1344565 - RNA, 18 nt, Human
ugaguagcauacuccaac

SEQ ID NO: 1344566 - RNA, 26 nt, Human
ugcaccaaaccaauucugacagcacu

SEQ ID NO: 1344567 - RNA, 21 nt, Human
ugcuucaacaacucuuagcau

SEQ ID NO: 1344568 - RNA, 20 nt, Human
uggaaaguuacaacacuagu

SEQ ID NO: 1344569 - RNA, 24 nt, Human
uggaaaguuacaacacuaguacua

SEQ ID NO: 1344570 - RNA, 24 nt, Human
uggaagaucuuagaauugcuugcc

SEQ ID NO: 1344571 - RNA, 22 nt, Human
uggaaggauucggcuaagacaa

SEQ ID NO: 1344572 - RNA, 18 nt, Human
uggaaugcugauagauuc

SEQ ID NO: 1344573 - RNA, 25 nt, Human
uggaaugcugauagauucacuuuuu

SEQ ID NO: 1344574 - RNA, 21 nt, Human
uggauaagccaccacaaaaaa

SEQ ID NO: 1344575 - RNA, 21 nt, Human
uggcagaggaaaacaacagaa

SEQ ID NO: 1344576 - RNA, 18 nt, Human
uggcuagauguuuugugg

SEQ ID NO: 1344577 - RNA, 24 nt, Human
uggcuagauguuuuguggaagauc

SEQ ID NO: 1344578 - RNA, 21 nt, Human
uggcucuagucuccaaagcaa

SEQ ID NO: 1344579 - RNA, 20 nt, Human
uggguaguuaugauagaaua

SEQ ID NO: 1344580 - RNA, 20 nt, Human
uggguuuacugggugaauag

SEQ ID NO: 1344581 - RNA, 21 nt, Human
ugucagaaaggcaaaauggcc

SEQ ID NO: 1344582 - RNA, 22 nt, Human
ugucagaaaggcaaaauggcca

SEQ ID NO: 1344583 - RNA, 26 nt, Human
uguggaaugcugauagauucacuuuu

SEQ ID NO: 1344584 - RNA, 22 nt, Human
uguuguacuuacuaucccuagg

SEQ ID NO: 1344585 - RNA, 22 nt, Human
uuaaaagugagacauuagaguu

SEQ ID NO: 1344586 - RNA, 18 nt, Human
uuagaaaacacccugaaa

SEQ ID NO: 1344587 - RNA, 23 nt, Human
uuagaaaacacccugaaaucuua

SEQ ID NO: 1344588 - RNA, 24 nt, Human
uuaguaguagucugccaaaugaga

SEQ ID NO: 1344589 - RNA, 24 nt, Human
uuaguuccucuaauccaacaacuc

SEQ ID NO: 1344590 - RNA, 26 nt, Human
uucaagcuccaacaagcucgccgacc

SEQ ID NO: 1344591 - RNA, 24 nt, Human
uuccuagcagcucagcaccagugg

SEQ ID NO: 1344592 - RNA, 22 nt, Human
uucuauguucaacuaccacuua

SEQ ID NO: 1344593 - RNA, 19 nt, Human
uugcaaucaagcuguuccu

SEQ ID NO: 1344594 - RNA, 25 nt, Human
uuggaaaguuacaacacuaguacua

SEQ ID NO: 1344595 - RNA, 21 nt, Human
uuuaggauaucuuaagagcca

SEQ ID NO: 1344596 - RNA, 19 nt, Human
uuucacaggcauuugaugc

SEQ ID NO: 1344597 - RNA, 20 nt, Human
uuucaguuagaaaacacccu

SEQ ID NO: 1344598 - RNA, 24 nt, Human
uuugcuuguugaaaagcaauguca

SEQ ID NO: 1344599 - RNA, 21 nt, Human
uuuggucauuacccuuguggu

SEQ ID NO: 1344600 - RNA, 24 nt, Human
uuuuguggaagaucuuagaauugc

SEQ ID NO: 1344601 - RNA, 24 nt, Human
uuuuuuuuuugccggugagucgga

SEQ ID NO: 1344602 - RNA, 19 nt, Human
uuuuuuuuuuuuuuugcca

SEQ ID NO: 1344603 - RNA, 22 nt, Human
aaacaaaccugaacucguccac

SEQ ID NO: 1344604 - RNA, 18 nt, Human
aacaaaauuagucacuuu

SEQ ID NO: 1344605 - RNA, 19 nt, Human
aacauggccaacuccuccu

SEQ ID NO: 1344606 - RNA, 18 nt, Human
aacugcauggacccuccc

SEQ ID NO: 1344607 - RNA, 25 nt, Human
aacugcauggacccucccagacccu

SEQ ID NO: 1344608 - RNA, 23 nt, Human
aagaaaccggcaaaaccgagaac

SEQ ID NO: 1344609 - RNA, 20 nt, Human
aagcagacaaccacguaugg

SEQ ID NO: 1344610 - RNA, 25 nt, Human
aagcagacaaccacguauggcuucg

SEQ ID NO: 1344611 - RNA, 19 nt, Human
aaggcaagcugcugguguu

SEQ ID NO: 1344612 - RNA, 23 nt, Human
aauguuaaaaaaaauuaugugcc

SEQ ID NO: 1344613 - RNA, 26 nt, Human
acaguaaagaacuaaaaggucuacac

SEQ ID NO: 1344614 - RNA, 21 nt, Human
acccucccagacccugcucug

SEQ ID NO: 1344615 - RNA, 21 nt, Human
acucguccacccucucagccc

SEQ ID NO: 1344616 - RNA, 20 nt, Human
agaaaccggcaaaaccgaga

SEQ ID NO: 1344617 - RNA, 23 nt, Human
agaacgacggaaucugcugcaaa

SEQ ID NO: 1344618 - RNA, 20 nt, Human
agacucaguaagaacgacgg

SEQ ID NO: 1344619 - RNA, 18 nt, Human
agcauccgugguccuggu

SEQ ID NO: 1344620 - RNA, 22 nt, Human
agcccguggcccaggaggcccc

SEQ ID NO: 1344621 - RNA, 20 nt, Human
aggucguuuuucuucauguu

SEQ ID NO: 1344622 - RNA, 20 nt, Human
aguaaagaacuaaagaaacc

SEQ ID NO: 1344623 - RNA, 22 nt, Human
auggcgccggaauccauuuucc

SEQ ID NO: 1344624 - RNA, 21 nt, Human
caaagcauccgugguccuggu

SEQ ID NO: 1344625 - RNA, 22 nt, Human
caacggagacggggacgccacg

SEQ ID NO: 1344626 - RNA, 23 nt, Human
caccagcgggaacugcauggacc

SEQ ID NO: 1344627 - RNA, 22 nt, Human
cacgggcacagaugaccacguu

SEQ ID NO: 1344628 - RNA, 21 nt, Human
cacugaguuaccuacggugcc

SEQ ID NO: 1344629 - RNA, 24 nt, Human
cagcaacauccacagagaauuagc

SEQ ID NO: 1344630 - RNA, 24 nt, Human
cauaaccuaguuaccaaauguuaa

SEQ ID NO: 1344631 - RNA, 19 nt, Human
cauggccaacuccuccuuc

SEQ ID NO: 1344632 - RNA, 25 nt, Human
ccaaaauguaaccaggagacccccc

SEQ ID NO: 1344633 - RNA, 21 nt, Human
ccaaguagcugacaauguaga

SEQ ID NO: 1344634 - RNA, 19 nt, Human
ccacaggcugggcucacac

SEQ ID NO: 1344635 - RNA, 21 nt, Human
ccacugaguuaccuacggugc

SEQ ID NO: 1344636 - RNA, 18 nt, Human
cccaggaggccccugggg

SEQ ID NO: 1344637 - RNA, 19 nt, Human
ccccccguccccgccccgc

SEQ ID NO: 1344638 - RNA, 21 nt, Human
cccccgcugcagacucaguaa

SEQ ID NO: 1344639 - RNA, 26 nt, Human
ccccguccccgccccgcacacgccug

SEQ ID NO: 1344640 - RNA, 23 nt, Human
cccgcugcagacucaguaagaac

SEQ ID NO: 1344641 - RNA, 18 nt, Human
cccguggcccaggaggcc

SEQ ID NO: 1344642 - RNA, 26 nt, Human
cccguggcccaggaggccccuggggc

SEQ ID NO: 1344643 - RNA, 23 nt, Human
ccgccgugcugggucgccgcucc

SEQ ID NO: 1344644 - RNA, 21 nt, Human
ccguccccgccccgcacacgc

SEQ ID NO: 1344645 - RNA, 22 nt, Human
ccgugcugggucgccgcuccuc

SEQ ID NO: 1344646 - RNA, 24 nt, Human
ccucccagacccugcucuggcaga

SEQ ID NO: 1344647 - RNA, 21 nt, Human
cgaauguucaaaguucgugca

SEQ ID NO: 1344648 - RNA, 22 nt, Human
cgccggaauccauuuuccaucc

SEQ ID NO: 1344649 - RNA, 22 nt, Human
cgggcacaggugacgucacggg

SEQ ID NO: 1344650 - RNA, 26 nt, Human
cguccacccucucagcccagucccca

SEQ ID NO: 1344651 - RNA, 25 nt, Human
cuaaagaaaccggcaaaaccgagaa

SEQ ID NO: 1344652 - RNA, 20 nt, Human
cucccagacccugcucuggc

SEQ ID NO: 1344653 - RNA, 21 nt, Human
cucggaauccauuuuccaucc

SEQ ID NO: 1344654 - RNA, 20 nt, Human
cugcacacuuguucacuccc

SEQ ID NO: 1344655 - RNA, 22 nt, Human
cugcucuggcagacgaccccga

SEQ ID NO: 1344656 - RNA, 18 nt, Human
cugcugcaaaaacaaacc

SEQ ID NO: 1344657 - RNA, 18 nt, Human
gaacuaaagaaaccggca

SEQ ID NO: 1344658 - RNA, 19 nt, Human
gacaauguagagcccauaa

SEQ ID NO: 1344659 - RNA, 19 nt, Human
gaccugggggcucggaggc

SEQ ID NO: 1344660 - RNA, 22 nt, Human
gaggguuacacggcaggagguu

SEQ ID NO: 1344661 - RNA, 22 nt, Human
gaggguuacacggcaggagguu

SEQ ID NO: 1344662 - RNA, 22 nt, Human
gcagguggugggugcuguggcg

SEQ ID NO: 1344663 - RNA, 23 nt, Human
gccccgagagucugaaggcggca

SEQ ID NO: 1344664 - RNA, 21 nt, Human
gccugaggugugacggcucgg

SEQ ID NO: 1344665 - RNA, 22 nt, Human
ggaaacagguuuaauccaaaau

SEQ ID NO: 1344666 - RNA, 18 nt, Human
ggaaagcagacaaccacg

SEQ ID NO: 1344667 - RNA, 21 nt, Human
ggacccucccagacccugcuc

SEQ ID NO: 1344668 - RNA, 21 nt, Human
ggaggccccuggggcacuggc

SEQ ID NO: 1344669 - RNA, 20 nt, Human
ggcggcagguggugggugcu

SEQ ID NO: 1344670 - RNA, 20 nt, Human
ggcgggaaaaggaauuccuu

SEQ ID NO: 1344671 - RNA, 22 nt, Human
gugacggcucggcuucuagagu

SEQ ID NO: 1344672 - RNA, 24 nt, Human
gugccucuccuucccaaaauguua

SEQ ID NO: 1344673 - RNA, 19 nt, Human
gugggugcuguggcgcccc

SEQ ID NO: 1344674 - RNA, 21 nt, Human
guuugcaaucugaaaucaaaa

SEQ ID NO: 1344675 - RNA, 26 nt, Human
uaaagaaaccggcaaaacuggagacc

SEQ ID NO: 1344676 - RNA, 22 nt, Human
uaaccaggagaccccccguccc

SEQ ID NO: 1344677 - RNA, 18 nt, Human
uacacaugaaaggaacau

SEQ ID NO: 1344678 - RNA, 21 nt, Human
uacaucugcacacuuguucac

SEQ ID NO: 1344679 - RNA, 19 nt, Human
uaggaaagcagacaaccac

SEQ ID NO: 1344680 - RNA, 20 nt, Human
uccacccucucagcccaguc

SEQ ID NO: 1344681 - RNA, 24 nt, Human
uccacccucucagcccagucccca

SEQ ID NO: 1344682 - RNA, 22 nt, Human
uccagcccguggcccaggaggc

SEQ ID NO: 1344683 - RNA, 25 nt, Human
uccccagguccguauggagcccccg

SEQ ID NO: 1344684 - RNA, 21 nt, Human
ucccuacacauaaccgggaaa

SEQ ID NO: 1344685 - RNA, 21 nt, Human
ucccuccacaccagcgggaac

SEQ ID NO: 1344686 - RNA, 19 nt, Human
ucccugggcagccccucca

SEQ ID NO: 1344687 - RNA, 23 nt, Human
ucccugggcagccccuccagccc

SEQ ID NO: 1344688 - RNA, 24 nt, Human
uccugguugaagccggcguagagc

SEQ ID NO: 1344689 - RNA, 24 nt, Human
uccugguugaagccggcguagagc

SEQ ID NO: 1344690 - RNA, 21 nt, Human
ucugaaggcggcagguggugg

SEQ ID NO: 1344691 - RNA, 18 nt, Human
ucuuguuucucuuuuucu

SEQ ID NO: 1344692 - RNA, 21 nt, Human
ugaagcuaacgucacagcuga

SEQ ID NO: 1344693 - RNA, 22 nt, Human
ugacaguaaagaacuaaagaaa

SEQ ID NO: 1344694 - RNA, 28 nt, Human
ugacagugacaguaaagaacuaaagaaa

SEQ ID NO: 1344695 - RNA, 19 nt, Human
ugaggggaggggagacggu

SEQ ID NO: 1344696 - RNA, 19 nt, Human
ugaggugugacggcucggc

SEQ ID NO: 1344697 - RNA, 20 nt, Human
ugcagacucaguaagaacga

SEQ ID NO: 1344698 - RNA, 23 nt, Human
ugccucauucuaauggccccaac

SEQ ID NO: 1344699 - RNA, 21 nt, Human
ugcuguggcgcccccagcugg

SEQ ID NO: 1344700 - RNA, 24 nt, Human
uggaccugggggcucggaggccag

SEQ ID NO: 1344701 - RNA, 18 nt, Human
uggccuggugucugccuc

SEQ ID NO: 1344702 - RNA, 19 nt, Human
uguagcuauucuuacaaau

SEQ ID NO: 1344703 - RNA, 23 nt, Human
uuuuucuuuuaguggaucagugu

SEQ ID NO: 1344704 - RNA, 19 nt, Human
aaaaauuucagaaugacau

SEQ ID NO: 1344705 - RNA, 22 nt, Human
caaacauaacuaguagagaaaa

SEQ ID NO: 1344706 - RNA, 26 nt, Human
cauaacuaguagagaaaaauuucaga

SEQ ID NO: 1344707 - RNA, 24 nt, Human
cuggagcccauauuuuuucugcac

SEQ ID NO: 1344708 - RNA, 23 nt, Human
gaagccuucucauauuuguacuu

SEQ ID NO: 1344709 - RNA, 25 nt, Human
uaaccagguugacucaaacuaggug

SEQ ID NO: 1344710 - RNA, 25 nt, Human
uaguagagaaaaauuucagaaugac

SEQ ID NO: 1344711 - RNA, 19 nt, Human
ugacaugguaaaaaccacu

SEQ ID NO: 1344712 - RNA, 23 nt, Human
ugagaagccuucucauauuugua

SEQ ID NO: 1344713 - RNA, 22 nt, Human
accagguacauuucagauauau

SEQ ID NO: 1344714 - RNA, 21 nt, Human
agcaggaaauggcuuccaagg

SEQ ID NO: 1344715 - RNA, 24 nt, Human
caggcaaagacuuuauuagagaaa

SEQ ID NO: 1344716 - RNA, 24 nt, Human
cguagccacaaucucuguuaauuc

SEQ ID NO: 1344717 - RNA, 20 nt, Human
cucacuuuuaucauaagacu

SEQ ID NO: 1344718 - RNA, 23 nt, Human
cugauagccugcauauaccauga

SEQ ID NO: 1344719 - RNA, 22 nt, Human
cugauccuucugcugauagccu

SEQ ID NO: 1344720 - RNA, 18 nt, Human
cuucuaacuucuuggcug

SEQ ID NO: 1344721 - RNA, 19 nt, Human
gcuuccaagggcagaacca

SEQ ID NO: 1344722 - RNA, 23 nt, Human
ggcuauaacauuugggcccugcg

SEQ ID NO: 1344723 - RNA, 19 nt, Human
uaugcucaguagcuugcau

SEQ ID NO: 1344724 - RNA, 24 nt, Human
uggaauaaucuugaaucugaacag

SEQ ID NO: 1344725 - RNA, 23 nt, Human
uuaguggcaugagcaggaaaugg

SEQ ID NO: 1344726 - RNA, 21 nt, Human
uucuuuggcuauaacauuugg

SEQ ID NO: 1344727 - RNA, 22 nt, Human
aaauaaauacggagggguggga

SEQ ID NO: 1344728 - RNA, 18 nt, Human
aaggagggacugucggcg

SEQ ID NO: 1344729 - RNA, 20 nt, Human
acccggggcuccggcucccc

SEQ ID NO: 1344730 - RNA, 22 nt, Human
agacaaggagggacugucggcg

SEQ ID NO: 1344731 - RNA, 21 nt, Human
agacacuguuuauugaguggc

SEQ ID NO: 1344732 - RNA, 20 nt, Human
agguggcaggucaugccagg

SEQ ID NO: 1344733 - RNA, 21 nt, Human
caccgcguccacgcuccagcc

SEQ ID NO: 1344734 - RNA, 23 nt, Human
caccgcguccacgcuccagccuc

SEQ ID NO: 1344735 - RNA, 18 nt, Human
caugccagggugcugugg

SEQ ID NO: 1344736 - RNA, 20 nt, Human
cccccgccccacccuccccc

SEQ ID NO: 1344737 - RNA, 19 nt, Human
ccccgccccacccuccccc

SEQ ID NO: 1344738 - RNA, 21 nt, Human
ccccgccccacccucccccac

SEQ ID NO: 1344739 - RNA, 22 nt, Human
ccccgccccacccucccccacc

SEQ ID NO: 1344740 - RNA, 20 nt, Human
ccucguaauucucgaaagcu

SEQ ID NO: 1344741 - RNA, 19 nt, Human
ccugaaucccggagacaga

SEQ ID NO: 1344742 - RNA, 22 nt, Human
cgccccacccucccccaccgcg

SEQ ID NO: 1344743 - RNA, 23 nt, Human
gcccccgccccacccucccccac

SEQ ID NO: 1344744 - RNA, 21 nt, Human
ggagagguagcuggcuccggu

SEQ ID NO: 1344745 - RNA, 26 nt, Human
ggaggcggacgccaggucccccaagg

SEQ ID NO: 1344746 - RNA, 23 nt, Human
ggggagggccucugccuccuguc

SEQ ID NO: 1344747 - RNA, 24 nt, Human
gguggcaggucaugccagggugcu

SEQ ID NO: 1344748 - RNA, 23 nt, Human
gugggaauugcagggugcagaga

SEQ ID NO: 1344749 - RNA, 19 nt, Human
ucaggucguggggacccgg

SEQ ID NO: 1344750 - RNA, 21 nt, Human
uccacgcuccagccucaaggg

SEQ ID NO: 1344751 - RNA, 23 nt, Human
uccuccaauaaugcggaugggga

SEQ ID NO: 1344752 - RNA, 22 nt, Human
uccucguaauucucgaaagcug

SEQ ID NO: 1344753 - RNA, 21 nt, Human
ugccagggugcugugggcauc

SEQ ID NO: 1344754 - RNA, 23 nt, Human
ugcccccgccccacccuccccca

SEQ ID NO: 1344755 - RNA, 19 nt, Human
ugcugugggcaucuggcag

SEQ ID NO: 1344756 - RNA, 18 nt, Human
uggaagcagagguggcag

SEQ ID NO: 1344757 - RNA, 18 nt, Human
uggaagcagagguggcag

SEQ ID NO: 1344758 - RNA, 18 nt, Human
aauauugaccucauacag

SEQ ID NO: 1344759 - RNA, 21 nt, Human
agacaaaagaugaaagcuggg

SEQ ID NO: 1344760 - RNA, 21 nt, Human
agacuuggaugccacccagug

SEQ ID NO: 1344761 - RNA, 22 nt, Human
agaugaaagcuggguuuucucg

SEQ ID NO: 1344762 - RNA, 22 nt, Human
caaaacaugugcuaaaaaguua

SEQ ID NO: 1344763 - RNA, 20 nt, Human
ccaaguacaaaacaugugcu

SEQ ID NO: 1344764 - RNA, 25 nt, Human
ccucauacagacaaaagaugaaagc

SEQ ID NO: 1344765 - RNA, 19 nt, Human
gcuucacacgguuuuccaa

SEQ ID NO: 1344766 - RNA, 20 nt, Human
uacagacaaaagaugaaagc

SEQ ID NO: 1344767 - RNA, 27 nt, Human
uaccaaguacaaaacaugugcuaaaaa

SEQ ID NO: 1344768 - RNA, 23 nt, Human
uauaggacacuguaauuaauuca

SEQ ID NO: 1344769 - RNA, 20 nt, Human
ucauacagacaaaagaugaa

SEQ ID NO: 1344770 - RNA, 23 nt, Human
ucauacagacaaaagaugaaagc

SEQ ID NO: 1344771 - RNA, 22 nt, Human
ugacaucaauauugaccucaua

SEQ ID NO: 1344772 - RNA, 18 nt, Human
ugugcuaaaaaguuaaca

SEQ ID NO: 1344773 - RNA, 24 nt, Human
uuuuuuuuuuuuuuuuucuggauu

SEQ ID NO: 1344774 - RNA, 28 nt, Human
uuuuuuuuuuuuuuuuuuuuucuggggg

SEQ ID NO: 1344775 - RNA, 20 nt, Human
aaugcugcaacucagagaug

SEQ ID NO: 1344776 - RNA, 19 nt, Human
acucaggugucagaaagaa

SEQ ID NO: 1344777 - RNA, 27 nt, Human
agaaagaaacucugucacaaccauaga

SEQ ID NO: 1344778 - RNA, 18 nt, Human
agauuccaagccccuccc

SEQ ID NO: 1344779 - RNA, 18 nt, Human
aggagaaagacucaggug

SEQ ID NO: 1344780 - RNA, 22 nt, Human
aggggaaggggugaggagggau

SEQ ID NO: 1344781 - RNA, 19 nt, Human
auguuugcaggucuguguc

SEQ ID NO: 1344782 - RNA, 19 nt, Human
caacucagagaugcccuuu

SEQ ID NO: 1344783 - RNA, 19 nt, Human
cagaaagaaacucugucac

SEQ ID NO: 1344784 - RNA, 20 nt, Human
cagauuccaagccccuccca

SEQ ID NO: 1344785 - RNA, 25 nt, Human
ccccucccagcaagcuuuccgugca

SEQ ID NO: 1344786 - RNA, 23 nt, Human
cccuuuggcuucaugccagauuc

SEQ ID NO: 1344787 - RNA, 21 nt, Human
cgugcagcaggagaaagacuc

SEQ ID NO: 1344788 - RNA, 25 nt, Human
cuucaugccagauuccaagccccuc

SEQ ID NO: 1344789 - RNA, 20 nt, Human
gcagcucuucggaauugugu

SEQ ID NO: 1344790 - RNA, 19 nt, Human
ggcucugggaaucccaugg

SEQ ID NO: 1344791 - RNA, 18 nt, Human
gggaaucccauggucagg

SEQ ID NO: 1344792 - RNA, 19 nt, Human
ggggaaggggugaggaggg

SEQ ID NO: 1344793 - RNA, 20 nt, Human
gugcagcaggagaaagacuc

SEQ ID NO: 1344794 - RNA, 18 nt, Human
uaaaugcugcaacucaga

SEQ ID NO: 1344795 - RNA, 22 nt, Human
uagauguuugcaggucuguguc

SEQ ID NO: 1344796 - RNA, 21 nt, Human
ucagguagaaagagggauucc

SEQ ID NO: 1344797 - RNA, 20 nt, Human
ugagugggaucauuuaaaug

SEQ ID NO: 1344798 - RNA, 18 nt, Human
ugccagauuccaagcccc

SEQ ID NO: 1344799 - RNA, 21 nt, Human
uggucagguagaaagagggau

SEQ ID NO: 1344800 - RNA, 19 nt, Human
ugucacaaccauagauguu

SEQ ID NO: 1344801 - RNA, 22 nt, Human
ugucacaaccauagauguuugc

SEQ ID NO: 1344802 - RNA, 23 nt, Human
ugucacaaccauagauguuugca

SEQ ID NO: 1344803 - RNA, 23 nt, Human
uuccucaacaaugaggagucuga

SEQ ID NO: 1344804 - RNA, 22 nt, Human
aacaggaaggagaugauuggug

SEQ ID NO: 1344805 - RNA, 24 nt, Human
aacaggaaggagaugauuggugag

SEQ ID NO: 1344806 - RNA, 18 nt, Human
agagauuacaaagagauu

SEQ ID NO: 1344807 - RNA, 24 nt, Human
agcgagcugauggcguucuccaga

SEQ ID NO: 1344808 - RNA, 18 nt, Human
aggaaggagaugauuggu

SEQ ID NO: 1344809 - RNA, 18 nt, Human
cagaacucgguuucgugc

SEQ ID NO: 1344810 - RNA, 22 nt, Human
gugaguuuucuucguaaccagg

SEQ ID NO: 1344811 - RNA, 22 nt, Human
guucacuguggauaggaagggc

SEQ ID NO: 1344812 - RNA, 18 nt, Human
uaacaggaaggagaugau

SEQ ID NO: 1344813 - RNA, 19 nt, Human
uaaccagguucacugugga

SEQ ID NO: 1344814 - RNA, 27 nt, Human
uggugaguuuucuucguaaccagguuc

SEQ ID NO: 1344815 - RNA, 20 nt, Human
ugguuuaauuuuaagcagcg

SEQ ID NO: 1344816 - RNA, 20 nt, Human
uuaugaguucaauauuuuua

SEQ ID NO: 1344817 - RNA, 22 nt, Human
uuccuucccaccauggagaucc

SEQ ID NO: 1344818 - RNA, 25 nt, Human
uucuuuacaaugauuucagaagaga

SEQ ID NO: 1344819 - RNA, 21 nt, Human
acauaguuugccaggcaggcu

SEQ ID NO: 1344820 - RNA, 21 nt, Human
agcgagagagcaaagucagaa

SEQ ID NO: 1344821 - RNA, 23 nt, Human
caaaaccaggcagcagaagaagg

SEQ ID NO: 1344822 - RNA, 21 nt, Human
caaaauuguuuugaaaaacau

SEQ ID NO: 1344823 - RNA, 19 nt, Human
cagcuugacagauuaaugu

SEQ ID NO: 1344824 - RNA, 21 nt, Human
ccccaaaaccaggcagcagaa

SEQ ID NO: 1344825 - RNA, 24 nt, Human
ccccaaaaccaggcagcagaagaa

SEQ ID NO: 1344826 - RNA, 20 nt, Human
cccccaaaaccaggcagcag

SEQ ID NO: 1344827 - RNA, 21 nt, Human
cccccaaaaccaggcagcaga

SEQ ID NO: 1344828 - RNA, 24 nt, Human
cccccaaaaccaggcagcagaaga

SEQ ID NO: 1344829 - RNA, 22 nt, Human
gcagaagaaggcauacucaagc

SEQ ID NO: 1344830 - RNA, 23 nt, Human
gucauacagcccccaaaaccagg

SEQ ID NO: 1344831 - RNA, 26 nt, Human
uacagcccccaaaaccaggcagcaga

SEQ ID NO: 1344832 - RNA, 23 nt, Human
ucagcgagagagcaaagucagaa

SEQ ID NO: 1344833 - RNA, 24 nt, Human
ucagcgagagagcaaagucagaag

SEQ ID NO: 1344834 - RNA, 23 nt, Human
ugguauacauuuuaaaauaugaa

SEQ ID NO: 1344835 - RNA, 25 nt, Human
uguuucauucuuugcuugucauuua

SEQ ID NO: 1344836 - RNA, 23 nt, Human
uugauccuagcuccacauuucuu

SEQ ID NO: 1344837 - RNA, 20 nt, Human
uuguaaaaauaaaauucaca

SEQ ID NO: 1344838 - RNA, 20 nt, Human
agcuguuuaaacaagaaguu

SEQ ID NO: 1344839 - RNA, 18 nt, Human
aggcaagauaaaaagucu

SEQ ID NO: 1344840 - RNA, 22 nt, Human
aggcaagauaaaaagucucuga

SEQ ID NO: 1344841 - RNA, 19 nt, Human
auccuaaaaccuguugagu

SEQ ID NO: 1344842 - RNA, 26 nt, Human
ccucugagaggauuacagacuaugca

SEQ ID NO: 1344843 - RNA, 18 nt, Human
ccucuuaaaucuuucuuu

SEQ ID NO: 1344844 - RNA, 19 nt, Human
ggcugagaauggaagaagg

SEQ ID NO: 1344845 - RNA, 21 nt, Human
uaaaaagucucugacuugaaa

SEQ ID NO: 1344846 - RNA, 19 nt, Human
uauaacaaucaauuuuuga

SEQ ID NO: 1344847 - RNA, 18 nt, Human
ucuggcugagaauggaag

SEQ ID NO: 1344848 - RNA, 18 nt, Human
ugagaauggaagaaggga

SEQ ID NO: 1344849 - RNA, 22 nt, Human
ugcuucuggcugagaauggaag

SEQ ID NO: 1344850 - RNA, 22 nt, Human
uuaaacaagaaguuucccucuc

SEQ ID NO: 1344851 - RNA, 21 nt, Human
uuacagacuaugcaaucugcu

SEQ ID NO: 1344852 - RNA, 20 nt, Human
uuguucagaugguuucuugu

SEQ ID NO: 1344853 - RNA, 27 nt, Human
aagaagacauaugaggugucgcggacc

SEQ ID NO: 1344854 - RNA, 18 nt, Human
aagcagacauaaaauuac

SEQ ID NO: 1344855 - RNA, 18 nt, Human
aagcagacauaaaauuac

SEQ ID NO: 1344856 - RNA, 26 nt, Human
agaaaaaaaaaggugaaaguagagaa

SEQ ID NO: 1344857 - RNA, 24 nt, Human
agaauagggauguuuguggguagg

SEQ ID NO: 1344858 - RNA, 19 nt, Human
agcggccucggcgaggcaa

SEQ ID NO: 1344859 - RNA, 21 nt, Human
aggagcguugcuucugaacua

SEQ ID NO: 1344860 - RNA, 21 nt, Human
augaaaacucuaucucuaaau

SEQ ID NO: 1344861 - RNA, 25 nt, Human
auuuuauuuuccuuaaagcagacau

SEQ ID NO: 1344862 - RNA, 21 nt, Human
caaauggacaaacuaauaaau

SEQ ID NO: 1344863 - RNA, 19 nt, Human
caccuguccacuccggcuc

SEQ ID NO: 1344864 - RNA, 19 nt, Human
cacgcuccucgcagcggcc

SEQ ID NO: 1344865 - RNA, 23 nt, Human
cacuguuacuguguuacugcucu

SEQ ID NO: 1344866 - RNA, 21 nt, Human
cagaguuauaguaugcuucuc

SEQ ID NO: 1344867 - RNA, 23 nt, Human
cagcggccucggcgaggcaaguc

SEQ ID NO: 1344868 - RNA, 24 nt, Human
caggacagaucuauacauguuaca

SEQ ID NO: 1344869 - RNA, 22 nt, Human
cgaggcaaguccuccccuccuc

SEQ ID NO: 1344870 - RNA, 22 nt, Human
cuaccaaaucauuuaguagugu

SEQ ID NO: 1344871 - RNA, 23 nt, Human
cucacaggacagaucuauacaug

SEQ ID NO: 1344872 - RNA, 24 nt, Human
cuuaaacaaauauucaaugcuuaa

SEQ ID NO: 1344873 - RNA, 23 nt, Human
gaaccauagauucaucagaaaug

SEQ ID NO: 1344874 - RNA, 19 nt, Human
gcgaggcaaguccuccccu

SEQ ID NO: 1344875 - RNA, 19 nt, Human
gcgcgggagccggguuccc

SEQ ID NO: 1344876 - RNA, 22 nt, Human
guaguacuuuuauuuuucauga

SEQ ID NO: 1344877 - RNA, 24 nt, Human
guuuguggguagguauuaucuuca

SEQ ID NO: 1344878 - RNA, 23 nt, Human
uaaaagaaaaaaaaaggugaaag

SEQ ID NO: 1344879 - RNA, 26 nt, Human
uaaacaaauauucaaugcuuaauuuu

SEQ ID NO: 1344880 - RNA, 21 nt, Human
uaaaccuucuaggauaaaaau

SEQ ID NO: 1344881 - RNA, 19 nt, Human
uaaccugauuucuaccaaa

SEQ ID NO: 1344882 - RNA, 18 nt, Human
ucaauggaagaucagagu

SEQ ID NO: 1344883 - RNA, 19 nt, Human
ucacuaccaaaucauuuag

SEQ ID NO: 1344884 - RNA, 23 nt, Human
ucagaaacuauuguaacaguuua

SEQ ID NO: 1344885 - RNA, 28 nt, Human
ucgcaguaagcacugaugcuguccggac

SEQ ID NO: 1344886 - RNA, 21 nt, Human
ucggcgaggcaaguccucccc

SEQ ID NO: 1344887 - RNA, 21 nt, Human
ugaaagauuuacaauagcaaa

SEQ ID NO: 1344888 - RNA, 20 nt, Human
uggaagaaaauaacuuugau

SEQ ID NO: 1344889 - RNA, 21 nt, Human
uggaagaaaauaacuuugaug

SEQ ID NO: 1344890 - RNA, 26 nt, Human
uggacaaacuaauaaauaaauaacau

SEQ ID NO: 1344891 - RNA, 21 nt, Human
uggcaagcaagcaaacuuuug

SEQ ID NO: 1344892 - RNA, 23 nt, Human
uuaaaagaaaaaaaaaggugaaa

SEQ ID NO: 1344893 - RNA, 27 nt, Human
uucccuggaccuucgcccuugggcacg

SEQ ID NO: 1344894 - RNA, 25 nt, Human
uuuuuuuuuuuuuuuucccuauuaa

SEQ ID NO: 1344895 - RNA, 21 nt, Human
aaaaaggacaucuuuuaagcu

SEQ ID NO: 1344896 - RNA, 19 nt, Human
aaacaauuccaucccucuc

SEQ ID NO: 1344897 - RNA, 21 nt, Human
aaauuccaauucuuauaacuc

SEQ ID NO: 1344898 - RNA, 19 nt, Human
aacaauuccaucccucuca

SEQ ID NO: 1344899 - RNA, 19 nt, Human
aacagcagcuugggaagug

SEQ ID NO: 1344900 - RNA, 19 nt, Human
aauggaaagaaccccagcc

SEQ ID NO: 1344901 - RNA, 19 nt, Human
acuuuacgaaugaaagaaa

SEQ ID NO: 1344902 - RNA, 18 nt, Human
auacuugcaaccucuucg

SEQ ID NO: 1344903 - RNA, 20 nt, Human
auggaaagaaccccagccua

SEQ ID NO: 1344904 - RNA, 19 nt, Human
caagcaaccagccuguugu

SEQ ID NO: 1344905 - RNA, 21 nt, Human
cacuccagucucaaagccagg

SEQ ID NO: 1344906 - RNA, 23 nt, Human
cacuuuaggauuccacgccaagc

SEQ ID NO: 1344907 - RNA, 24 nt, Human
cagaaauuccaauucuuauaacuc

SEQ ID NO: 1344908 - RNA, 22 nt, Human
cagcaggacaugcacugccccu

SEQ ID NO: 1344909 - RNA, 22 nt, Human
cagcucagccuugaaacagcag

SEQ ID NO: 1344910 - RNA, 22 nt, Human
ccagcucagccuugaaacagca

SEQ ID NO: 1344911 - RNA, 21 nt, Human
cuccugcgcguuaagccucac

SEQ ID NO: 1344912 - RNA, 23 nt, Human
gcaggaagaagaucaaggaguca

SEQ ID NO: 1344913 - RNA, 18 nt, Human
ggcuggggucucacucca

SEQ ID NO: 1344914 - RNA, 20 nt, Human
gggcaaggacaucaaguagc

SEQ ID NO: 1344915 - RNA, 24 nt, Human
gucucacuccagucucaaagccag

SEQ ID NO: 1344916 - RNA, 23 nt, Human
uaacuccccggggacagcaaucu

SEQ ID NO: 1344917 - RNA, 24 nt, Human
uaacuccccggggacagcaaucug

SEQ ID NO: 1344918 - RNA, 26 nt, Human
uaacuuuacgaaugaaagaaaacaau

SEQ ID NO: 1344919 - RNA, 23 nt, Human
uagcccuucugaauccgucuccu

SEQ ID NO: 1344920 - RNA, 26 nt, Human
ucagccuugaaacagcagcuugggaa

SEQ ID NO: 1344921 - RNA, 21 nt, Human
uccacgcaggaagaagaucaa

SEQ ID NO: 1344922 - RNA, 20 nt, Human
uccccggggacagcaaucug

SEQ ID NO: 1344923 - RNA, 31 nt, Human
ucuauaauggaaagaaccccagccuagggcc

SEQ ID NO: 1344924 - RNA, 21 nt, Human
ucucagcuggggcagaggggc

SEQ ID NO: 1344925 - RNA, 27 nt, Human
ucuguagcccuucugaauccgucuccu

SEQ ID NO: 1344926 - RNA, 18 nt, Human
ucuuauaacucaaauccc

SEQ ID NO: 1344927 - RNA, 19 nt, Human
ugaaagaaaacaauuccau

SEQ ID NO: 1344928 - RNA, 22 nt, Human
uggaaagaaccccagccuaggg

SEQ ID NO: 1344929 - RNA, 19 nt, Human
uggcagagagggcagcagg

SEQ ID NO: 1344930 - RNA, 21 nt, Human
uggcagagagggcagcaggaa

SEQ ID NO: 1344931 - RNA, 27 nt, Human
uguucugugcccucuggcagagagggc

SEQ ID NO: 1344932 - RNA, 23 nt, Human
uuuuuuuuuuuuuuuuuugauuu

SEQ ID NO: 1344933 - RNA, 20 nt, Human
uuuuuuuuuuuuuuuuuugg

SEQ ID NO: 1344934 - RNA, 18 nt, Human
aaaaacaccuccccuaca

SEQ ID NO: 1344935 - RNA, 24 nt, Human
aaauacaaaaacaacucgcauuua

SEQ ID NO: 1344936 - RNA, 21 nt, Human
aacacacaaauacaaaaacaa

SEQ ID NO: 1344937 - RNA, 19 nt, Human
aacaccuccccuacaugcc

SEQ ID NO: 1344938 - RNA, 25 nt, Human
aacccagccccuccauuagacccca

SEQ ID NO: 1344939 - RNA, 25 nt, Human
aagaaccacccaacccucuugccuc

SEQ ID NO: 1344940 - RNA, 19 nt, Human
aagaacccagccccuccau

SEQ ID NO: 1344941 - RNA, 27 nt, Human
aagaacccagccccuccauuagacccc

SEQ ID NO: 1344942 - RNA, 18 nt, Human
acaacaaugccccagaac

SEQ ID NO: 1344943 - RNA, 20 nt, Human
acacaaauacaaaaacaacu

SEQ ID NO: 1344944 - RNA, 21 nt, Human
acacugggucuuccagguggc

SEQ ID NO: 1344945 - RNA, 19 nt, Human
acagcccacucuucccgcc

SEQ ID NO: 1344946 - RNA, 18 nt, Human
accacaaggcccaucuca

SEQ ID NO: 1344947 - RNA, 21 nt, Human
accacaaggcccaucucaaca

SEQ ID NO: 1344948 - RNA, 19 nt, Human
accacccaacccucuugcc

SEQ ID NO: 1344949 - RNA, 22 nt, Human
accagagcucaggggcagucag

SEQ ID NO: 1344950 - RNA, 25 nt, Human
acccuggccuggggaagggaaguca

SEQ ID NO: 1344951 - RNA, 19 nt, Human
acccuuccccagcuccccc

SEQ ID NO: 1344952 - RNA, 21 nt, Human
accuguuccugccuggguccc

SEQ ID NO: 1344953 - RNA, 22 nt, Human
agacauccugaccccucugccc

SEQ ID NO: 1344954 - RNA, 18 nt, Human
agacgcacccacacaccc

SEQ ID NO: 1344955 - RNA, 18 nt, Human
agagggcagagcuggcug

SEQ ID NO: 1344956 - RNA, 19 nt, Human
agagggcagagcuggcugc

SEQ ID NO: 1344957 - RNA, 21 nt, Human
agagggugcuggcuccagcug

SEQ ID NO: 1344958 - RNA, 21 nt, Human
agaugcugggggcugcuagug

SEQ ID NO: 1344959 - RNA, 25 nt, Human
agaugcugggggcugcuagugggcc

SEQ ID NO: 1344960 - RNA, 20 nt, Human
agcagccagagggugcuggc

SEQ ID NO: 1344961 - RNA, 21 nt, Human
agccugacaauggggaggggg

SEQ ID NO: 1344962 - RNA, 24 nt, Human
agcugaccucccagcagacagcac

SEQ ID NO: 1344963 - RNA, 26 nt, Human
agcugaccucccagcagacagcaccg

SEQ ID NO: 1344964 - RNA, 21 nt, Human
agcugggugggugggagaugc

SEQ ID NO: 1344965 - RNA, 25 nt, Human
agcugggugggugggagaugcuggg

SEQ ID NO: 1344966 - RNA, 22 nt, Human
aggcaucccagcaacccuggcc

SEQ ID NO: 1344967 - RNA, 18 nt, Human
aguccuccuccuccccuc

SEQ ID NO: 1344968 - RNA, 19 nt, Human
auaaaacagagauuccaga

SEQ ID NO: 1344969 - RNA, 22 nt, Human
auccugaccccucugcccuagg

SEQ ID NO: 1344970 - RNA, 18 nt, Human
aucuuuuuuuccccuccu

SEQ ID NO: 1344971 - RNA, 19 nt, Human
aucuuuuuuuccccuccuu

SEQ ID NO: 1344972 - RNA, 21 nt, Human
auggcagaucccuuggggcug

SEQ ID NO: 1344973 - RNA, 24 nt, Human
caaaaacaccuccccuacaugccc

SEQ ID NO: 1344974 - RNA, 24 nt, Human
caagggacaacaaugccccagaac

SEQ ID NO: 1344975 - RNA, 18 nt, Human
caauacacagauacacag

SEQ ID NO: 1344976 - RNA, 18 nt, Human
cacauucccagccuccag

SEQ ID NO: 1344977 - RNA, 22 nt, Human
caccaagauaucacggcgcgac

SEQ ID NO: 1344978 - RNA, 23 nt, Human
caccaagauaucacggcgcgaca

SEQ ID NO: 1344979 - RNA, 18 nt, Human
cacccaacccucuugccu

SEQ ID NO: 1344980 - RNA, 26 nt, Human
cacccacucugagggucacucagaau

SEQ ID NO: 1344981 - RNA, 19 nt, Human
caccccagaucccuggggg

SEQ ID NO: 1344982 - RNA, 24 nt, Human
caccccagaucccugggggcucua

SEQ ID NO: 1344983 - RNA, 21 nt, Human
cacccugggaaagacagccca

SEQ ID NO: 1344984 - RNA, 23 nt, Human
cacccuuccccagcucccccacc

SEQ ID NO: 1344985 - RNA, 25 nt, Human
caccucuguguucccuccccaaguc

SEQ ID NO: 1344986 - RNA, 21 nt, Human
cacucucuccuccccucuuua

SEQ ID NO: 1344987 - RNA, 20 nt, Human
cagaacccaccccuccccgc

SEQ ID NO: 1344988 - RNA, 26 nt, Human
cagacacaagggacaacaaugccccc

SEQ ID NO: 1344989 - RNA, 24 nt, Human
cagaucccugggggcucuccccgg

SEQ ID NO: 1344990 - RNA, 22 nt, Human
cagcccauccugaccaccccuc

SEQ ID NO: 1344991 - RNA, 19 nt, Human
cagcccccauccuuuccuc

SEQ ID NO: 1344992 - RNA, 23 nt, Human
cagguggcuucugagcuaacuga

SEQ ID NO: 1344993 - RNA, 19 nt, Human
caguagcggugugggggca

SEQ ID NO: 1344994 - RNA, 18 nt, Human
caguggcagggagccacc

SEQ ID NO: 1344995 - RNA, 24 nt, Human
caguggcagggagccaccaagaua

SEQ ID NO: 1344996 - RNA, 25 nt, Human
caguggcagggagccaccaagauau

SEQ ID NO: 1344997 - RNA, 21 nt, Human
caucccuggcccugauucuga

SEQ ID NO: 1344998 - RNA, 27 nt, Human
caucucaacacacaaauacaaaaacaa

SEQ ID NO: 1344999 - RNA, 21 nt, Human
ccagccaguuuugugugucau

SEQ ID NO: 1345000 - RNA, 22 nt, Human
ccagcucccccacccuaucucu

SEQ ID NO: 1345001 - RNA, 18 nt, Human
ccagcugaccucccagca

SEQ ID NO: 1345002 - RNA, 25 nt, Human
ccauauccucucaaucuucugcauc

SEQ ID NO: 1345003 - RNA, 20 nt, Human
ccauccuuuccuccucuccu

SEQ ID NO: 1345004 - RNA, 21 nt, Human
cccacucuucccgccugcacc

SEQ ID NO: 1345005 - RNA, 23 nt, Human
cccaggcagaacgcguccuugcc

SEQ ID NO: 1345006 - RNA, 21 nt, Human
ccccagaacccaccccucccc

SEQ ID NO: 1345007 - RNA, 20 nt, Human
ccccagaucccugggggcuc

SEQ ID NO: 1345008 - RNA, 23 nt, Human
ccccagcccauccugaccacccc

SEQ ID NO: 1345009 - RNA, 23 nt, Human
cccccacccuaucucuaguccac

SEQ ID NO: 1345010 - RNA, 18 nt, Human
cccccgagaaucagcggg

SEQ ID NO: 1345011 - RNA, 24 nt, Human
cccccuaccgggauacccccuaga

SEQ ID NO: 1345012 - RNA, 25 nt, Human
cccccuaccgggauacccccuagac

SEQ ID NO: 1345013 - RNA, 19 nt, Human
ccccucccuucugcucuuc

SEQ ID NO: 1345014 - RNA, 24 nt, Human
ccccucugugcuccccagccugag

SEQ ID NO: 1345015 - RNA, 18 nt, Human
cccggaaauguguugcgg

SEQ ID NO: 1345016 - RNA, 18 nt, Human
cccuagacgcacccacac

SEQ ID NO: 1345017 - RNA, 19 nt, Human
cccucuugccucugggcac

SEQ ID NO: 1345018 - RNA, 18 nt, Human
ccuacaugcccaggcaga

SEQ ID NO: 1345019 - RNA, 23 nt, Human
ccuaccgggauacccccuagacg

SEQ ID NO: 1345020 - RNA, 22 nt, Human
ccucccuucugcucuucagccc

SEQ ID NO: 1345021 - RNA, 24 nt, Human
ccucuagauuaucuacaccucucc

SEQ ID NO: 1345022 - RNA, 21 nt, Human
ccucucaaucuucugcauccc

SEQ ID NO: 1345023 - RNA, 25 nt, Human
ccucucaaucuucugcauccccuuu

SEQ ID NO: 1345024 - RNA, 24 nt, Human
ccucuggcucccugcaggcccccu

SEQ ID NO: 1345025 - RNA, 18 nt, Human
ccugacaauggggagggg

SEQ ID NO: 1345026 - RNA, 22 nt, Human
ccugagcccugaccaccccaga

SEQ ID NO: 1345027 - RNA, 18 nt, Human
ccugcaggcccccuaccg

SEQ ID NO: 1345028 - RNA, 24 nt, Human
ccuuacccccgagaaucagcggga

SEQ ID NO: 1345029 - RNA, 18 nt, Human
ccuugaccagcugaccuc

SEQ ID NO: 1345030 - RNA, 22 nt, Human
ccuugaccagcugaccucccag

SEQ ID NO: 1345031 - RNA, 19 nt, Human
ccuuggggcugccagcagc

SEQ ID NO: 1345032 - RNA, 21 nt, Human
cuagcagucuaugccucuaga

SEQ ID NO: 1345033 - RNA, 22 nt, Human
cucacagagccuccacauuccc

SEQ ID NO: 1345034 - RNA, 19 nt, Human
cucccccacccuaucucua

SEQ ID NO: 1345035 - RNA, 23 nt, Human
cuccgugauucucagauggagaa

SEQ ID NO: 1345036 - RNA, 18 nt, Human
cuccuccccucuuuaauc

SEQ ID NO: 1345037 - RNA, 20 nt, Human
cuccuccccucuuuaauccc

SEQ ID NO: 1345038 - RNA, 18 nt, Human
cuccuuucuuugucuugg

SEQ ID NO: 1345039 - RNA, 25 nt, Human
cucuauccaucuccauauccucuca

SEQ ID NO: 1345040 - RNA, 22 nt, Human
cucuccuccccucuuuaauccc

SEQ ID NO: 1345041 - RNA, 23 nt, Human
cugaccccucugcccuagcuggg

SEQ ID NO: 1345042 - RNA, 22 nt, Human
cugcaggcccccuaccgggaua

SEQ ID NO: 1345043 - RNA, 23 nt, Human
cugcggcaugcuugcaucacccu

SEQ ID NO: 1345044 - RNA, 20 nt, Human
cuggccuggggaagggaagu

SEQ ID NO: 1345045 - RNA, 21 nt, Human
cugggaaagacagcccacucu

SEQ ID NO: 1345046 - RNA, 19 nt, Human
cuggguuugaguuucaaua

SEQ ID NO: 1345047 - RNA, 22 nt, Human
cugugcuccccagccuggugac

SEQ ID NO: 1345048 - RNA, 21 nt, Human
cuucaagaacccagccccucc

SEQ ID NO: 1345049 - RNA, 18 nt, Human
cuucccagaggacccugc

SEQ ID NO: 1345050 - RNA, 19 nt, Human
cuuccccagcucccccacc

SEQ ID NO: 1345051 - RNA, 19 nt, Human
cuucccgccugcacccuuc

SEQ ID NO: 1345052 - RNA, 27 nt, Human
cuuuuuuuccccuccuuucuuugucuu

SEQ ID NO: 1345053 - RNA, 23 nt, Human
gacaauaaaaauaacaauaguaa

SEQ ID NO: 1345054 - RNA, 24 nt, Human
gaccccucugcccuagcugggugg

SEQ ID NO: 1345055 - RNA, 23 nt, Human
gacuauuucaggucccaguucuc

SEQ ID NO: 1345056 - RNA, 18 nt, Human
gaggaucuugugcuccuc

SEQ ID NO: 1345057 - RNA, 22 nt, Human
gcagagacaccugucucuaaga

SEQ ID NO: 1345058 - RNA, 22 nt, Human
gcaguggcagggagccaccaag

SEQ ID NO: 1345059 - RNA, 22 nt, Human
gccccagaacccaccccucccc

SEQ ID NO: 1345060 - RNA, 25 nt, Human
gccccagaacccaccccuccccgcu

SEQ ID NO: 1345061 - RNA, 18 nt, Human
gcccugauucugagggcu

SEQ ID NO: 1345062 - RNA, 21 nt, Human
gcucuucagcccccauccuuu

SEQ ID NO: 1345063 - RNA, 24 nt, Human
gcugcagcucugauacccuuuccu

SEQ ID NO: 1345064 - RNA, 20 nt, Human
ggcagagcuggcugcagcuc

SEQ ID NO: 1345065 - RNA, 23 nt, Human
ggcgcgacaggaggggaggugca

SEQ ID NO: 1345066 - RNA, 19 nt, Human
ggcugccagcagccagagg

SEQ ID NO: 1345067 - RNA, 21 nt, Human
gggacaacaaugccccagaac

SEQ ID NO: 1345068 - RNA, 18 nt, Human
gggcagagcuggcugcag

SEQ ID NO: 1345069 - RNA, 21 nt, Human
gggcagagcuggcugcagcuc

SEQ ID NO: 1345070 - RNA, 23 nt, Human
gggucuaagagcacagagaaggg

SEQ ID NO: 1345071 - RNA, 22 nt, Human
ggugccagggguaagggaaaga

SEQ ID NO: 1345072 - RNA, 19 nt, Human
ggugugguuggcagaagcu

SEQ ID NO: 1345073 - RNA, 22 nt, Human
gugggugggagaugcugggggc

SEQ ID NO: 1345074 - RNA, 20 nt, Human
gugugggggcagagacaccu

SEQ ID NO: 1345075 - RNA, 21 nt, Human
uaaaacccaaggcagucuggg

SEQ ID NO: 1345076 - RNA, 20 nt, Human
uaacaauaguaauuacaaga

SEQ ID NO: 1345077 - RNA, 19 nt, Human
uaacuucccagaggacccu

SEQ ID NO: 1345078 - RNA, 24 nt, Human
uaagggaaagauaaaacccaaggc

SEQ ID NO: 1345079 - RNA, 21 nt, Human
uaauggagggaaucucaaacc

SEQ ID NO: 1345080 - RNA, 22 nt, Human
uacagagaaaccacaaggccca

SEQ ID NO: 1345081 - RNA, 19 nt, Human
uacaguaccauggguaggg

SEQ ID NO: 1345082 - RNA, 18 nt, Human
uacauggucaaaggggag

SEQ ID NO: 1345083 - RNA, 18 nt, Human
uacccccuagacgcaccc

SEQ ID NO: 1345084 - RNA, 23 nt, Human
uagaccccaguagcggugugggg

SEQ ID NO: 1345085 - RNA, 19 nt, Human
uagaguaacuucccagagg

SEQ ID NO: 1345086 - RNA, 21 nt, Human
uaggguagagggcagagcugg

SEQ ID NO: 1345087 - RNA, 22 nt, Human
ucaacacacaaauacaaaaaca

SEQ ID NO: 1345088 - RNA, 19 nt, Human
ucagguaggcucuucuuac

SEQ ID NO: 1345089 - RNA, 18 nt, Human
uccacagacacaagggac

SEQ ID NO: 1345090 - RNA, 23 nt, Human
uccacagacacaagggacaacaa

SEQ ID NO: 1345091 - RNA, 19 nt, Human
uccagagauggaaacacug

SEQ ID NO: 1345092 - RNA, 20 nt, Human
ucccaacaccucuguguucc

SEQ ID NO: 1345093 - RNA, 26 nt, Human
ucccaacaccucuguguucccucccc

SEQ ID NO: 1345094 - RNA, 19 nt, Human
ucccagcaacccuggccug

SEQ ID NO: 1345095 - RNA, 18 nt, Human
uccccagcucccccaccc

SEQ ID NO: 1345096 - RNA, 21 nt, Human
uccccagcucccccacccuau

SEQ ID NO: 1345097 - RNA, 24 nt, Human
uccccagcucccccacccuaucuc

SEQ ID NO: 1345098 - RNA, 24 nt, Human
ucccuggcccugauucuuccgaug

SEQ ID NO: 1345099 - RNA, 22 nt, Human
ucccugggggcucuagcagucu

SEQ ID NO: 1345100 - RNA, 19 nt, Human
uccucugccuugaccagcu

SEQ ID NO: 1345101 - RNA, 18 nt, Human
uccugaccaccccuccuc

SEQ ID NO: 1345102 - RNA, 22 nt, Human
uccuggagcucugcacucucuc

SEQ ID NO: 1345103 - RNA, 21 nt, Human
ucuaagaggcaaacagacauc

SEQ ID NO: 1345104 - RNA, 18 nt, Human
ucugagcuaacugaugcc

SEQ ID NO: 1345105 - RNA, 19 nt, Human
ucugcaucccuggcccuga

SEQ ID NO: 1345106 - RNA, 19 nt, Human
ucugucuccccucccuucu

SEQ ID NO: 1345107 - RNA, 20 nt, Human
ucuguguucccuccccaagu

SEQ ID NO: 1345108 - RNA, 23 nt, Human
ucuugguuguuuuaauggaggga

SEQ ID NO: 1345109 - RNA, 20 nt, Human
ucuuguggacaccuguuccu

SEQ ID NO: 1345110 - RNA, 24 nt, Human
ugaagccugagcccugaccacccc

SEQ ID NO: 1345111 - RNA, 19 nt, Human
ugaccaccccuccucugcc

SEQ ID NO: 1345112 - RNA, 19 nt, Human
ugaccagcugaccucccag

SEQ ID NO: 1345113 - RNA, 20 nt, Human
ugagaaacuggugauggcaa

SEQ ID NO: 1345114 - RNA, 21 nt, Human
ugagaacaaauggcagauccc

SEQ ID NO: 1345115 - RNA, 19 nt, Human
ugagcccugaccaccccag

SEQ ID NO: 1345116 - RNA, 18 nt, Human
ugccagcagccagagggu

SEQ ID NO: 1345117 - RNA, 24 nt, Human
ugccuugaccagcugaccucccag

SEQ ID NO: 1345118 - RNA, 20 nt, Human
uggaaggcuucucagggcgu

SEQ ID NO: 1345119 - RNA, 20 nt, Human
uggcucccugcaggcccccu

SEQ ID NO: 1345120 - RNA, 20 nt, Human
ugggugggugggagaugcug

SEQ ID NO: 1345121 - RNA, 23 nt, Human
uggugauggcaaaaacaccuccc

SEQ ID NO: 1345122 - RNA, 20 nt, Human
ugucuuucuggccucccuag

SEQ ID NO: 1345123 - RNA, 23 nt, Human
ugugucaugaauguguucaugug

SEQ ID NO: 1345124 - RNA, 18 nt, Human
uguuccugccuggguccc

SEQ ID NO: 1345125 - RNA, 24 nt, Human
uuccuggagcucugcacucucucc

SEQ ID NO: 1345126 - RNA, 18 nt, Human
uucguccuuuucucuacc

SEQ ID NO: 1345127 - RNA, 19 nt, Human
uucugagcuaacugaugcc

SEQ ID NO: 1345128 - RNA, 21 nt, Human
uugauagguuaaucucagugc

SEQ ID NO: 1345129 - RNA, 18 nt, Human
uugccucugggcacaccc

SEQ ID NO: 1345130 - RNA, 24 nt, Human
uuguuucccccuuaaaagaaaaac

SEQ ID NO: 1345131 - RNA, 23 nt, Human
uuuaauccccucugucuccccuc

SEQ ID NO: 1345132 - RNA, 25 nt, Human
uuuagcauaaaacagagauuccaga

SEQ ID NO: 1345133 - RNA, 23 nt, Human
uuuaucuuuuuuuccccuccuuu

SEQ ID NO: 1345134 - RNA, 18 nt, Human
accucgcccgcuuccucc

SEQ ID NO: 1345135 - RNA, 19 nt, Human
accucgcccgcuuccucca

SEQ ID NO: 1345136 - RNA, 21 nt, Human
accucgcccgcuuccuccagc

SEQ ID NO: 1345137 - RNA, 24 nt, Human
caccucgcccgcuuccuccagcau

SEQ ID NO: 1345138 - RNA, 22 nt, Human
cauaaaaugcaauaaaaugcuu

SEQ ID NO: 1345139 - RNA, 24 nt, Human
ccacaccagccugagccccagacg

SEQ ID NO: 1345140 - RNA, 21 nt, Human
ccgccccgccagccgcgcugc

SEQ ID NO: 1345141 - RNA, 22 nt, Human
ccgccccgccagccgcgcugcc

SEQ ID NO: 1345142 - RNA, 23 nt, Human
ccgccccgccagccgcgcugccu

SEQ ID NO: 1345143 - RNA, 18 nt, Human
ccugugggcaccgcggcg

SEQ ID NO: 1345144 - RNA, 24 nt, Human
cgacucgugcucggccccagggac

SEQ ID NO: 1345145 - RNA, 19 nt, Human
cgccgggguccugcgggcg

SEQ ID NO: 1345146 - RNA, 20 nt, Human
cgcggggcggcagcugggac

SEQ ID NO: 1345147 - RNA, 25 nt, Human
cggcggcggcggcggcucccgcgga

SEQ ID NO: 1345148 - RNA, 24 nt, Human
cggcggcggggccgcgcggggcgg

SEQ ID NO: 1345149 - RNA, 22 nt, Human
cuccagcaccucgcccgcuucc

SEQ ID NO: 1345150 - RNA, 23 nt, Human
gcauccaucaugacgacucgugc

SEQ ID NO: 1345151 - RNA, 21 nt, Human
gcccugagguccugugggcac

SEQ ID NO: 1345152 - RNA, 20 nt, Human
gccgccgggguccugcgggc

SEQ ID NO: 1345153 - RNA, 23 nt, Human
gcggggcagcccgcacucgcccu

SEQ ID NO: 1345154 - RNA, 20 nt, Human
gcugcaucccacaccagccu

SEQ ID NO: 1345155 - RNA, 21 nt, Human
gcugcaucccacaccagccug

SEQ ID NO: 1345156 - RNA, 19 nt, Human
ggcugcaucccacaccagc

SEQ ID NO: 1345157 - RNA, 18 nt, Human
gggacggcggcggcggcg

SEQ ID NO: 1345158 - RNA, 19 nt, Human
gggacggcggcggcggcgg

SEQ ID NO: 1345159 - RNA, 20 nt, Human
gggggcuccggcuguggggg

SEQ ID NO: 1345160 - RNA, 20 nt, Human
uaaaaugcaauaaaaugcuu

SEQ ID NO: 1345161 - RNA, 22 nt, Human
uagggugaggggcgaaaggugg

SEQ ID NO: 1345162 - RNA, 20 nt, Human
ucacauaaacuccaagucau

SEQ ID NO: 1345163 - RNA, 23 nt, Human
ucacauaaacuccaagucauaaa

SEQ ID NO: 1345164 - RNA, 21 nt, Human
ucccacaccagccugagcccc

SEQ ID NO: 1345165 - RNA, 19 nt, Human
ucccgcggacucaccucgg

SEQ ID NO: 1345166 - RNA, 20 nt, Human
ucccggaaggugcggcaggc

SEQ ID NO: 1345167 - RNA, 26 nt, Human
ugagccccagacggucaggacccguc

SEQ ID NO: 1345168 - RNA, 22 nt, Human
uggccggcggcggggccgcgcg

SEQ ID NO: 1345169 - RNA, 23 nt, Human
aaaacuccuccauaauuucacaa

SEQ ID NO: 1345170 - RNA, 24 nt, Human
aagaugagggaccucagggaggga

SEQ ID NO: 1345171 - RNA, 20 nt, Human
aaugaaagagaggaagagga

SEQ ID NO: 1345172 - RNA, 21 nt, Human
acccuuaugggcaagaaaggu

SEQ ID NO: 1345173 - RNA, 21 nt, Human
agagagaaaggcagccuggga

SEQ ID NO: 1345174 - RNA, 23 nt, Human
agaggaagaggagccuaugggag

SEQ ID NO: 1345175 - RNA, 18 nt, Human
agcccggccaacccaccg

SEQ ID NO: 1345176 - RNA, 18 nt, Human
aggaggccgagccccagg

SEQ ID NO: 1345177 - RNA, 18 nt, Human
aggaguguucaggaucug

SEQ ID NO: 1345178 - RNA, 19 nt, Human
aggaguguucaggaucugc

SEQ ID NO: 1345179 - RNA, 19 nt, Human
aggcagccugggagggcca

SEQ ID NO: 1345180 - RNA, 21 nt, Human
aggcagccugggagggccagc

SEQ ID NO: 1345181 - RNA, 18 nt, Human
aggccgcgaccagagaga

SEQ ID NO: 1345182 - RNA, 25 nt, Human
aggccgcgaccagagagaaaggcag

SEQ ID NO: 1345183 - RNA, 19 nt, Human
agggaccucagggagggac

SEQ ID NO: 1345184 - RNA, 19 nt, Human
agggcacaaggacuugaaa

SEQ ID NO: 1345185 - RNA, 23 nt, Human
agucaggggguugagaggacugg

SEQ ID NO: 1345186 - RNA, 23 nt, Human
caauccuguaacucguuacaaac

SEQ ID NO: 1345187 - RNA, 18 nt, Human
cagaaucagagcagggac

SEQ ID NO: 1345188 - RNA, 19 nt, Human
cagaaucagagcagggaca

SEQ ID NO: 1345189 - RNA, 24 nt, Human
cagacugguggcucccgggcgccc

SEQ ID NO: 1345190 - RNA, 21 nt, Human
caggcccucagcccucuuuuc

SEQ ID NO: 1345191 - RNA, 27 nt, Human
caggcccucagcccucuuuuccucaua

SEQ ID NO: 1345192 - RNA, 22 nt, Human
ccaccuccaggcccucagcccu

SEQ ID NO: 1345193 - RNA, 19 nt, Human
ccagcccggccaacccacc

SEQ ID NO: 1345194 - RNA, 19 nt, Human
ccaggaguggggcugcggg

SEQ ID NO: 1345195 - RNA, 18 nt, Human
cccccaagucugaacuca

SEQ ID NO: 1345196 - RNA, 22 nt, Human
cccccaagucugaacucauagg

SEQ ID NO: 1345197 - RNA, 23 nt, Human
cccccaagucugaacucauaggc

SEQ ID NO: 1345198 - RNA, 18 nt, Human
ccccugggacccccagcc

SEQ ID NO: 1345199 - RNA, 19 nt, Human
cccuggagaaucucaggca

SEQ ID NO: 1345200 - RNA, 19 nt, Human
cccugggacccccagccac

SEQ ID NO: 1345201 - RNA, 20 nt, Human
ccgcgaccagagagaaaggc

SEQ ID NO: 1345202 - RNA, 24 nt, Human
ccugggacccccagccacgauggg

SEQ ID NO: 1345203 - RNA, 19 nt, Human
cgggaaggaggaccggcuu

SEQ ID NO: 1345204 - RNA, 21 nt, Human
gagagcaaaacacagagauuu

SEQ ID NO: 1345205 - RNA, 22 nt, Human
gagcccacgcucgaggggcuga

SEQ ID NO: 1345206 - RNA, 21 nt, Human
gagggccagcccggccaaccc

SEQ ID NO: 1345207 - RNA, 21 nt, Human
gaugggcuggcuccgcgggag

SEQ ID NO: 1345208 - RNA, 18 nt, Human
gccuccagccccugggac

SEQ ID NO: 1345209 - RNA, 18 nt, Human
gcgguggaggccggggcg

SEQ ID NO: 1345210 - RNA, 22 nt, Human
ggaagaggagccuaugggagga

SEQ ID NO: 1345211 - RNA, 21 nt, Human
ggaggaggccgagccccaggg

SEQ ID NO: 1345212 - RNA, 19 nt, Human
ggcacaaggacuugaaagg

SEQ ID NO: 1345213 - RNA, 20 nt, Human
ggccgggaaggaggaccggc

SEQ ID NO: 1345214 - RNA, 19 nt, Human
ggcugcgggcgcggcacca

SEQ ID NO: 1345215 - RNA, 23 nt, Human
gguugagaggacuggaggcgccu

SEQ ID NO: 1345216 - RNA, 19 nt, Human
uaacaggaaacacguggca

SEQ ID NO: 1345217 - RNA, 18 nt, Human
uaccauuugcuuuccggc

SEQ ID NO: 1345218 - RNA, 20 nt, Human
uaguuccuagugagacacgu

SEQ ID NO: 1345219 - RNA, 18 nt, Human
ucauaggcuggggaggag

SEQ ID NO: 1345220 - RNA, 21 nt, Human
ucccgggcgcccugaggacuc

SEQ ID NO: 1345221 - RNA, 19 nt, Human
ugaaagagaggaagaggag

SEQ ID NO: 1345222 - RNA, 20 nt, Human
ugaaugaaagagaggaagag

SEQ ID NO: 1345223 - RNA, 18 nt, Human
ugagggaccucagggagg

SEQ ID NO: 1345224 - RNA, 22 nt, Human
uggcucccgggcgcccugagga

SEQ ID NO: 1345225 - RNA, 24 nt, Human
ugggaggaggccgagccccagggc

SEQ ID NO: 1345226 - RNA, 24 nt, Human
uggggaggaggagacaucuaggug

SEQ ID NO: 1345227 - RNA, 19 nt, Human
uggggcugcgggcgcggca

SEQ ID NO: 1345228 - RNA, 18 nt, Human
ugguggcucccgggcgcc

SEQ ID NO: 1345229 - RNA, 21 nt, Human
uuacaaacacgauucuccuua

SEQ ID NO: 1345230 - RNA, 22 nt, Human
uucccaucugacuuuauuucac

SEQ ID NO: 1345231 - RNA, 19 nt, Human
uucuuuguaaaaacccuua

SEQ ID NO: 1345232 - RNA, 18 nt, Human
uuuacauuuuuguucagg

SEQ ID NO: 1345233 - RNA, 22 nt, Human
cggcgccccucacauccgcucu

SEQ ID NO: 1345234 - RNA, 24 nt, Human
ucuccucgccccagggugccccug

SEQ ID NO: 1345235 - RNA, 22 nt, Human
aagcagcucugacaacuccagc

SEQ ID NO: 1345236 - RNA, 22 nt, Human
aaguagcagguauugaagcuag

SEQ ID NO: 1345237 - RNA, 24 nt, Human
agaaaaacagacugggggagcagg

SEQ ID NO: 1345238 - RNA, 19 nt, Human
agccacugucaucuccccu

SEQ ID NO: 1345239 - RNA, 18 nt, Human
aggagacacagaccuccc

SEQ ID NO: 1345240 - RNA, 22 nt, Human
aguggagggacuguggcccaaa

SEQ ID NO: 1345241 - RNA, 24 nt, Human
aguucaguggaucccgagugaguc

SEQ ID NO: 1345242 - RNA, 20 nt, Human
cauucaaggccaagacauuc

SEQ ID NO: 1345243 - RNA, 23 nt, Human
ccaaagguagugaugacucugcu

SEQ ID NO: 1345244 - RNA, 21 nt, Human
ccagauccaaaaucagcagcc

SEQ ID NO: 1345245 - RNA, 18 nt, Human
cugcugggaggagacaca

SEQ ID NO: 1345246 - RNA, 20 nt, Human
cuggaagcagcaggguccuu

SEQ ID NO: 1345247 - RNA, 20 nt, Human
cuuugaaggaugaauaggag

SEQ ID NO: 1345248 - RNA, 19 nt, Human
gacucugcugggaggagac

SEQ ID NO: 1345249 - RNA, 21 nt, Human
gagcuuucuccagauccaaaa

SEQ ID NO: 1345250 - RNA, 18 nt, Human
ggagaaaaacagacuggg

SEQ ID NO: 1345251 - RNA, 22 nt, Human
ggagcaggaagagucaguguga

SEQ ID NO: 1345252 - RNA, 23 nt, Human
gggacuguggcccaaacucaggg

SEQ ID NO: 1345253 - RNA, 23 nt, Human
gugagcuuucuccagauccaaaa

SEQ ID NO: 1345254 - RNA, 21 nt, Human
uacauggauggaguagcagga

SEQ ID NO: 1345255 - RNA, 21 nt, Human
uagcagguauugaagcuaggg

SEQ ID NO: 1345256 - RNA, 23 nt, Human
ucagcagccugucauucaaggcc

SEQ ID NO: 1345257 - RNA, 18 nt, Human
uccacaauaguuccccuu

SEQ ID NO: 1345258 - RNA, 24 nt, Human
uccacaauaguuccccuuggcccu

SEQ ID NO: 1345259 - RNA, 22 nt, Human
uccccuuggcccugucaagccu

SEQ ID NO: 1345260 - RNA, 21 nt, Human
uccuugaaggauaagcaaugg

SEQ ID NO: 1345261 - RNA, 18 nt, Human
ugaaggauaagcaauggc

SEQ ID NO: 1345262 - RNA, 22 nt, Human
uggaucccgagugagucagaag

SEQ ID NO: 1345263 - RNA, 19 nt, Human
uggcccaaacucagggaua

SEQ ID NO: 1345264 - RNA, 24 nt, Human
ugggugauccugcggccccaaagg

SEQ ID NO: 1345265 - RNA, 26 nt, Human
uugaaggauaagcaauggcugcauga

SEQ ID NO: 1345266 - RNA, 22 nt, Human
aacaacauuggcaccgacaaaa

SEQ ID NO: 1345267 - RNA, 20 nt, Human
aaccagccagacaucuuuuu

SEQ ID NO: 1345268 - RNA, 25 nt, Human
aacugcuucuugaaguaggucccac

SEQ ID NO: 1345269 - RNA, 23 nt, Human
aagcacuuugacaucucuacauu

SEQ ID NO: 1345270 - RNA, 20 nt, Human
aagcucuccuugaugcucuu

SEQ ID NO: 1345271 - RNA, 24 nt, Human
aaggcucagaagauugaaguauca

SEQ ID NO: 1345272 - RNA, 18 nt, Human
aaguaggucccacucccu

SEQ ID NO: 1345273 - RNA, 21 nt, Human
acacagcaccaccagggguaa

SEQ ID NO: 1345274 - RNA, 21 nt, Human
acuguguagauaagagaaaau

SEQ ID NO: 1345275 - RNA, 23 nt, Human
agagaaaauguggcuguaaggug

SEQ ID NO: 1345276 - RNA, 20 nt, Human
agcaccaccagggguaaggu

SEQ ID NO: 1345277 - RNA, 18 nt, Human
agcucuccuugaugcucu

SEQ ID NO: 1345278 - RNA, 22 nt, Human
aggagcagaggagaggggcuca

SEQ ID NO: 1345279 - RNA, 23 nt, Human
agucgucgguaaucaagcccaga

SEQ ID NO: 1345280 - RNA, 19 nt, Human
aucccuuucucuccuacaa

SEQ ID NO: 1345281 - RNA, 18 nt, Human
caacaacauuggcaccga

SEQ ID NO: 1345282 - RNA, 21 nt, Human
cacagcaccaccagggguaag

SEQ ID NO: 1345283 - RNA, 18 nt, Human
cacagugaaguugcugcu

SEQ ID NO: 1345284 - RNA, 18 nt, Human
caccacaguuccuucaug

SEQ ID NO: 1345285 - RNA, 19 nt, Human
cagaaaguguuucaaaggc

SEQ ID NO: 1345286 - RNA, 20 nt, Human
cauguaggcauaugcuuuau

SEQ ID NO: 1345287 - RNA, 21 nt, Human
cccccagccauccauggucua

SEQ ID NO: 1345288 - RNA, 18 nt, Human
ccucaaggacaggaacca

SEQ ID NO: 1345289 - RNA, 22 nt, Human
ccucugauuuuguacuuccauc

SEQ ID NO: 1345290 - RNA, 24 nt, Human
ccugugacacagcaccaccagggg

SEQ ID NO: 1345291 - RNA, 18 nt, Human
ccuucucucuuccucucc

SEQ ID NO: 1345292 - RNA, 22 nt, Human
ccuucucucuuccucuccccca

SEQ ID NO: 1345293 - RNA, 23 nt, Human
cgccugagaaaccagccagacau

SEQ ID NO: 1345294 - RNA, 23 nt, Human
cucacaucuccagcaggaaaugg

SEQ ID NO: 1345295 - RNA, 22 nt, Human
cucacuuccauucugcaaccca

SEQ ID NO: 1345296 - RNA, 20 nt, Human
cuccugugacacagcaccac

SEQ ID NO: 1345297 - RNA, 20 nt, Human
cuuuucugcacaaaaucugg

SEQ ID NO: 1345298 - RNA, 24 nt, Human
gcacaaaaucugggaaucuggaaa

SEQ ID NO: 1345299 - RNA, 23 nt, Human
uaagacaagacccuugggaccua

SEQ ID NO: 1345300 - RNA, 22 nt, Human
uacaaggcucagaagauugaag

SEQ ID NO: 1345301 - RNA, 19 nt, Human
uacaagguuuucacuguuu

SEQ ID NO: 1345302 - RNA, 19 nt, Human
uaggucccacucccuaaaa

SEQ ID NO: 1345303 - RNA, 18 nt, Human
ucaagcccagacgccaua

SEQ ID NO: 1345304 - RNA, 24 nt, Human
ucacaauggacuuuuacucgagga

SEQ ID NO: 1345305 - RNA, 21 nt, Human
ucauuggcuggauuccaagua

SEQ ID NO: 1345306 - RNA, 18 nt, Human
ucccaaaaagcucuccuu

SEQ ID NO: 1345307 - RNA, 23 nt, Human
ucccaaaaagcucuccuugaugc

SEQ ID NO: 1345308 - RNA, 24 nt, Human
ucccuaaaaggccuggcacagccc

SEQ ID NO: 1345309 - RNA, 21 nt, Human
uccuauaugcucugucccucc

SEQ ID NO: 1345310 - RNA, 21 nt, Human
ucuccagcaggaaauggaggc

SEQ ID NO: 1345311 - RNA, 21 nt, Human
ucuuccuucuuaggcaacuga

SEQ ID NO: 1345312 - RNA, 18 nt, Human
ugaagaucauuggcugga

SEQ ID NO: 1345313 - RNA, 22 nt, Human
ugaucacauauccuuuugauaa

SEQ ID NO: 1345314 - RNA, 20 nt, Human
ugauuuccuccacaguuccc

SEQ ID NO: 1345315 - RNA, 21 nt, Human
ugcaguagcgcgacaugguua

SEQ ID NO: 1345316 - RNA, 21 nt, Human
uggcaccgacaaaauugaggc

SEQ ID NO: 1345317 - RNA, 18 nt, Human
uggccuucucucuuccuc

SEQ ID NO: 1345318 - RNA, 22 nt, Human
uguucagcauacgauuccugac

SEQ ID NO: 1345319 - RNA, 18 nt, Human
uuccucaaggacaggaac

SEQ ID NO: 1345320 - RNA, 25 nt, Human
uuccucaaggacaggaaccaauugc

SEQ ID NO: 1345321 - RNA, 19 nt, Human
uugcauggccuuucggcca

SEQ ID NO: 1345322 - RNA, 20 nt, Human
uugccgugugucucugaccu

SEQ ID NO: 1345323 - RNA, 24 nt, Human
aaaaccuccuccaaucccccuuca

SEQ ID NO: 1345324 - RNA, 23 nt, Human
aaccgaugucuggcggugaaacg

SEQ ID NO: 1345325 - RNA, 18 nt, Human
aacgagggggaggaaaag

SEQ ID NO: 1345326 - RNA, 19 nt, Human
aacuuauuuauuuucuagg

SEQ ID NO: 1345327 - RNA, 19 nt, Human
aaggaaaaggugaacgagg

SEQ ID NO: 1345328 - RNA, 21 nt, Human
aaggggggcugggggcgggag

SEQ ID NO: 1345329 - RNA, 23 nt, Human
acagaggagggaggaagagaagc

SEQ ID NO: 1345330 - RNA, 19 nt, Human
agaaggaggggagggggaa

SEQ ID NO: 1345331 - RNA, 21 nt, Human
agaaggaggggagggggaaau

SEQ ID NO: 1345332 - RNA, 28 nt, Human
agagaagcccgccuuagcccagcuuggg

SEQ ID NO: 1345333 - RNA, 18 nt, Human
agaggaagggaagagcag

SEQ ID NO: 1345334 - RNA, 20 nt, Human
agaggaagggaagagcaggg

SEQ ID NO: 1345335 - RNA, 21 nt, Human
agcagcagaaggaagaggggg

SEQ ID NO: 1345336 - RNA, 21 nt, Human
agcagcgucaaggcuccccca

SEQ ID NO: 1345337 - RNA, 19 nt, Human
aggaaaaggugaacgaggg

SEQ ID NO: 1345338 - RNA, 18 nt, Human
aggaagaggggggcaaag

SEQ ID NO: 1345339 - RNA, 22 nt, Human
aggaggagguggagaggaaggg

SEQ ID NO: 1345340 - RNA, 23 nt, Human
aggaggagguggagaggagggac

SEQ ID NO: 1345341 - RNA, 21 nt, Human
aggcgacagaggagggaggaa

SEQ ID NO: 1345342 - RNA, 21 nt, Human
aggcucccccaccuccccucc

SEQ ID NO: 1345343 - RNA, 24 nt, Human
aggcucccccaccuccccuccgcc

SEQ ID NO: 1345344 - RNA, 23 nt, Human
agggaaggggggcugggggcggg

SEQ ID NO: 1345345 - RNA, 19 nt, Human
agggagggagccgcugccc

SEQ ID NO: 1345346 - RNA, 23 nt, Human
aggggaggggagagggagaagga

SEQ ID NO: 1345347 - RNA, 24 nt, Human
agggggaggguugggggcagcugg

SEQ ID NO: 1345348 - RNA, 24 nt, Human
agguggagaggaagggaagagcag

SEQ ID NO: 1345349 - RNA, 18 nt, Human
aucgggcuuccccucccc

SEQ ID NO: 1345350 - RNA, 26 nt, Human
augguaucugugccuggcgccugucc

SEQ ID NO: 1345351 - RNA, 22 nt, Human
caaaaggggugaaauugaccag

SEQ ID NO: 1345352 - RNA, 18 nt, Human
caaggaggaggaggaggu

SEQ ID NO: 1345353 - RNA, 21 nt, Human
caaggcucccccaccuccccu

SEQ ID NO: 1345354 - RNA, 22 nt, Human
caaggcucccccaccuccccuc

SEQ ID NO: 1345355 - RNA, 21 nt, Human
caccuccccuccgccgcgucc

SEQ ID NO: 1345356 - RNA, 18 nt, Human
cagcagagggggugggaa

SEQ ID NO: 1345357 - RNA, 22 nt, Human
cagccacccgcacaaagggaaa

SEQ ID NO: 1345358 - RNA, 19 nt, Human
cagccccgggccgcguccc

SEQ ID NO: 1345359 - RNA, 19 nt, Human
cagcccggacgccuggguu

SEQ ID NO: 1345360 - RNA, 21 nt, Human
ccaccagccccgggccgcguc

SEQ ID NO: 1345361 - RNA, 22 nt, Human
ccagccacccgcacaaagggaa

SEQ ID NO: 1345362 - RNA, 26 nt, Human
cccccaccuccccuccgccgcguccc

SEQ ID NO: 1345363 - RNA, 22 nt, Human
cccccgccccuccccucccccc

SEQ ID NO: 1345364 - RNA, 19 nt, Human
cccccugcgcuccccucgg

SEQ ID NO: 1345365 - RNA, 22 nt, Human
ccccgccccuccccucccccug

SEQ ID NO: 1345366 - RNA, 20 nt, Human
ccccucccccaagagggcuc

SEQ ID NO: 1345367 - RNA, 21 nt, Human
ccccuccgccgcgucccccgc

SEQ ID NO: 1345368 - RNA, 22 nt, Human
ccccuccgccgcgucccccgcc

SEQ ID NO: 1345369 - RNA, 22 nt, Human
cccgcgcgcugggggcuagggc

SEQ ID NO: 1345370 - RNA, 18 nt, Human
cccgcggcccccgccgcc

SEQ ID NO: 1345371 - RNA, 20 nt, Human
cccgcucccgccccagagga

SEQ ID NO: 1345372 - RNA, 18 nt, Human
cccgggaaaugggggacu

SEQ ID NO: 1345373 - RNA, 21 nt, Human
ccgccccagaggacuaauugc

SEQ ID NO: 1345374 - RNA, 23 nt, Human
ccgccgccuccaggaagcuccgg

SEQ ID NO: 1345375 - RNA, 23 nt, Human
ccgccgccucgauccggccccag

SEQ ID NO: 1345376 - RNA, 19 nt, Human
ccgccgcgucccccgcccc

SEQ ID NO: 1345377 - RNA, 19 nt, Human
ccgccgcgucccccgcccc

SEQ ID NO: 1345378 - RNA, 22 nt, Human
ccuccccucccccugcgcuccc

SEQ ID NO: 1345379 - RNA, 23 nt, Human
cgacagaggagggaggaagagaa

SEQ ID NO: 1345380 - RNA, 18 nt, Human
cgagggggaggaaaagga

SEQ ID NO: 1345381 - RNA, 22 nt, Human
cgagggggaggaaaaggaggcg

SEQ ID NO: 1345382 - RNA, 22 nt, Human
cgcacaaagggaaauaaaaacc

SEQ ID NO: 1345383 - RNA, 25 nt, Human
cgccccuccccucccccugcgcucc

SEQ ID NO: 1345384 - RNA, 22 nt, Human
cgcccgagacuggccgcagcga

SEQ ID NO: 1345385 - RNA, 20 nt, Human
cgccgcgucccccgccccuc

SEQ ID NO: 1345386 - RNA, 21 nt, Human
cgccgggaggugggacgcugg

SEQ ID NO: 1345387 - RNA, 24 nt, Human
cgcgggcagcgcgguucccuggag

SEQ ID NO: 1345388 - RNA, 24 nt, Human
cgcucccggccccucucccagccc

SEQ ID NO: 1345389 - RNA, 22 nt, Human
cgcugggggcuagggcgagggg

SEQ ID NO: 1345390 - RNA, 18 nt, Human
cggagacugugaccccgg

SEQ ID NO: 1345391 - RNA, 19 nt, Human
cgggccccuuuccccaagg

SEQ ID NO: 1345392 - RNA, 19 nt, Human
cgggggaaggggggaccuc

SEQ ID NO: 1345393 - RNA, 22 nt, Human
cgucaaggcucccccaccuccc

SEQ ID NO: 1345394 - RNA, 18 nt, Human
cuaggccaugggagggcu

SEQ ID NO: 1345395 - RNA, 24 nt, Human
cucccagcccggacgccuggguuc

SEQ ID NO: 1345396 - RNA, 24 nt, Human
cucccccaccuccccuccgccgcg

SEQ ID NO: 1345397 - RNA, 21 nt, Human
cucgauccggccccagccacc

SEQ ID NO: 1345398 - RNA, 18 nt, Human
cuggacacugaccgggac

SEQ ID NO: 1345399 - RNA, 20 nt, Human
cuggcuuggggaagggagau

SEQ ID NO: 1345400 - RNA, 20 nt, Human
gaacgagggggaggaaaagg

SEQ ID NO: 1345401 - RNA, 23 nt, Human
gaaggaagaggggggcaaaggaa

SEQ ID NO: 1345402 - RNA, 20 nt, Human
gagaccuucagcuguucugg

SEQ ID NO: 1345403 - RNA, 19 nt, Human
gagaggaagggaagagcag

SEQ ID NO: 1345404 - RNA, 24 nt, Human
gagagggagaaggaggggaggggg

SEQ ID NO: 1345405 - RNA, 19 nt, Human
gagcagcagaaggaagagg

SEQ ID NO: 1345406 - RNA, 21 nt, Human
gagcagcagaaggaagagggg

SEQ ID NO: 1345407 - RNA, 22 nt, Human
gagcagcagaaggaagaggggg

SEQ ID NO: 1345408 - RNA, 22 nt, Human
gagcagcagaaggaagaggggg

SEQ ID NO: 1345409 - RNA, 21 nt, Human
gaggaaaaggaggcgacagag

SEQ ID NO: 1345410 - RNA, 23 nt, Human
gaggacucaaaagggggccgagg

SEQ ID NO: 1345411 - RNA, 23 nt, Human
gagguggggagcagcugggagug

SEQ ID NO: 1345412 - RNA, 20 nt, Human
gaucccuuccuggggucggg

SEQ ID NO: 1345413 - RNA, 22 nt, Human
gaucgggcuuccccucccccaa

SEQ ID NO: 1345414 - RNA, 27 nt, Human
gaugguaucugugccuggcgccugucc

SEQ ID NO: 1345415 - RNA, 24 nt, Human
gccagcgccaccugcggacgcucc

SEQ ID NO: 1345416 - RNA, 19 nt, Human
gcccccgccgccucgaucc

SEQ ID NO: 1345417 - RNA, 24 nt, Human
gccccgaaccccgcgcgcuggggg

SEQ ID NO: 1345418 - RNA, 18 nt, Human
gccgcagcgagcgcggag

SEQ ID NO: 1345419 - RNA, 20 nt, Human
gccgcccgccgccuccagga

SEQ ID NO: 1345420 - RNA, 19 nt, Human
gccggggccgaggccgcgg

SEQ ID NO: 1345421 - RNA, 24 nt, Human
gccggggccgaggccgcggcagcu

SEQ ID NO: 1345422 - RNA, 18 nt, Human
gccucgauccggccccag

SEQ ID NO: 1345423 - RNA, 21 nt, Human
gcggaggcgcgcggaguuucc

SEQ ID NO: 1345424 - RNA, 19 nt, Human
gcggagggaaggggggcug

SEQ ID NO: 1345425 - RNA, 20 nt, Human
ggaccgggagaguggggaug

SEQ ID NO: 1345426 - RNA, 24 nt, Human
ggagagggagaaggaggggagggg

SEQ ID NO: 1345427 - RNA, 19 nt, Human
ggagaguggggaugugcaa

SEQ ID NO: 1345428 - RNA, 24 nt, Human
ggagcagcugggagugacacugcu

SEQ ID NO: 1345429 - RNA, 19 nt, Human
ggagcgcgggaggugggga

SEQ ID NO: 1345430 - RNA, 19 nt, Human
ggaggcgcgcggaguuucc

SEQ ID NO: 1345431 - RNA, 23 nt, Human
ggaggugggacgcuggggagggg

SEQ ID NO: 1345432 - RNA, 18 nt, Human
ggcagcuggcuuggggaa

SEQ ID NO: 1345433 - RNA, 20 nt, Human
ggcagggggaggguuggggg

SEQ ID NO: 1345434 - RNA, 20 nt, Human
ggcgacagaggagggaggaa

SEQ ID NO: 1345435 - RNA, 18 nt, Human
gggaaggggggcuggggg

SEQ ID NO: 1345436 - RNA, 18 nt, Human
gggcaaaggaaggguggg

SEQ ID NO: 1345437 - RNA, 19 nt, Human
gggcagggggaggguuggg

SEQ ID NO: 1345438 - RNA, 22 nt, Human
gggcagggggaggguugggggc

SEQ ID NO: 1345439 - RNA, 19 nt, Human
gggccgaggccgcggcagc

SEQ ID NO: 1345440 - RNA, 23 nt, Human
gggccgaggccgcggcagcugga

SEQ ID NO: 1345441 - RNA, 19 nt, Human
gggcuccccaggggcgcgg

SEQ ID NO: 1345442 - RNA, 18 nt, Human
gggcugggggcgggaguc

SEQ ID NO: 1345443 - RNA, 19 nt, Human
gggcugggggcgggagucg

SEQ ID NO: 1345444 - RNA, 18 nt, Human
ggggagagggagaaggag

SEQ ID NO: 1345445 - RNA, 25 nt, Human
ggggagagggagaaggaggggaggg

SEQ ID NO: 1345446 - RNA, 25 nt, Human
ggggaggggagagggagaaggaggg

SEQ ID NO: 1345447 - RNA, 19 nt, Human
ggggcaaaggaaggguggg

SEQ ID NO: 1345448 - RNA, 24 nt, Human
ggugaacgagggggaggaaaagga

SEQ ID NO: 1345449 - RNA, 21 nt, Human
gguggagaggaagggaagagc

SEQ ID NO: 1345450 - RNA, 19 nt, Human
ggugggugcggaucgggcu

SEQ ID NO: 1345451 - RNA, 18 nt, Human
gucccccgccccuccccu

SEQ ID NO: 1345452 - RNA, 23 nt, Human
guggagaggucacuggcugaaau

SEQ ID NO: 1345453 - RNA, 21 nt, Human
uaaaaaccuccuccaaucccc

SEQ ID NO: 1345454 - RNA, 19 nt, Human
uaauugcgggcagggggag

SEQ ID NO: 1345455 - RNA, 20 nt, Human
uccccaggggcgcgggcgcc

SEQ ID NO: 1345456 - RNA, 20 nt, Human
ucccccaccuccccuccgcc

SEQ ID NO: 1345457 - RNA, 18 nt, Human
ucccccgccccuccccuc

SEQ ID NO: 1345458 - RNA, 21 nt, Human
ucccccugcgcuccccucgga

SEQ ID NO: 1345459 - RNA, 24 nt, Human
ucccuggagcgacacggccgcccg

SEQ ID NO: 1345460 - RNA, 18 nt, Human
uccgccgcgucccccgcc

SEQ ID NO: 1345461 - RNA, 25 nt, Human
uccgcgggcagcgcgguucccugga

SEQ ID NO: 1345462 - RNA, 21 nt, Human
uccgggaucccuuccuggggu

SEQ ID NO: 1345463 - RNA, 19 nt, Human
ucggcucagcggggagccc

SEQ ID NO: 1345464 - RNA, 19 nt, Human
ucucccagcccggacgccu

SEQ ID NO: 1345465 - RNA, 19 nt, Human
ugaaacggaccgggagagu

SEQ ID NO: 1345466 - RNA, 21 nt, Human
ugacacugcuggggaggggag

SEQ ID NO: 1345467 - RNA, 20 nt, Human
ugcucugugccccgcucccg

SEQ ID NO: 1345468 - RNA, 20 nt, Human
uggggagggagggagccgcu

SEQ ID NO: 1345469 - RNA, 21 nt, Human
uggggaggggaggggagaggg

SEQ ID NO: 1345470 - RNA, 21 nt, Human
ugucgcgcuccucucggcuca

SEQ ID NO: 1345471 - RNA, 25 nt, Human
uguucccaccagccccgggccgcgu

SEQ ID NO: 1345472 - RNA, 20 nt, Human
uuccccucccccaagagggc

SEQ ID NO: 1345473 - RNA, 22 nt, Human
uucuccgggccccuuuccccaa

SEQ ID NO: 1345474 - RNA, 20 nt, Human
aaaauaaaucacgcugcgaa

SEQ ID NO: 1345475 - RNA, 24 nt, Human
aagaaaauaaaucacgcugcgaag

SEQ ID NO: 1345476 - RNA, 21 nt, Human
cagccucgcuccgccggcggg

SEQ ID NO: 1345477 - RNA, 18 nt, Human
ccucgcuccgccggcggg

SEQ ID NO: 1345478 - RNA, 23 nt, Human
cggcgggagcagcgagccgggag

SEQ ID NO: 1345479 - RNA, 21 nt, Human
cgggagcagcgagccgggagg

SEQ ID NO: 1345480 - RNA, 18 nt, Human
gccuguuaccacuagccu

SEQ ID NO: 1345481 - RNA, 22 nt, Human
ggaagaagaguucagaaaaaaa

SEQ ID NO: 1345482 - RNA, 19 nt, Human
ggagcagcgagccgggagg

SEQ ID NO: 1345483 - RNA, 23 nt, Human
gggaggcuccguccaccucggcc

SEQ ID NO: 1345484 - RNA, 21 nt, Human
ucacgcugcgaagaaagggca

SEQ ID NO: 1345485 - RNA, 24 nt, Human
ucccuggaagaagaguucagaaaa

SEQ ID NO: 1345486 - RNA, 20 nt, Human
ugcgaagaaagggcagccuc

SEQ ID NO: 1345487 - RNA, 23 nt, Human
uggaagaagaguucagaaaaaaa

SEQ ID NO: 1345488 - RNA, 18 nt, Human
uucagaaaaaaagaagaa

SEQ ID NO: 1345489 - RNA, 19 nt, Human
aagcguugaagaucucagc

SEQ ID NO: 1345490 - RNA, 19 nt, Human
agaggcuuagugguugaag

SEQ ID NO: 1345491 - RNA, 19 nt, Human
aggaagaaggaaauagaag

SEQ ID NO: 1345492 - RNA, 23 nt, Human
cacucccuaucuagguacuucuu

SEQ ID NO: 1345493 - RNA, 22 nt, Human
cagcuugcugcucccacugacu

SEQ ID NO: 1345494 - RNA, 23 nt, Human
ccccuugcuggcucugcagaggc

SEQ ID NO: 1345495 - RNA, 21 nt, Human
ccguacugaguggcucuuccu

SEQ ID NO: 1345496 - RNA, 20 nt, Human
ccuguggagcuguggcucug

SEQ ID NO: 1345497 - RNA, 20 nt, Human
cgagugcaggccuguggagc

SEQ ID NO: 1345498 - RNA, 19 nt, Human
cugcucccacugacugucc

SEQ ID NO: 1345499 - RNA, 20 nt, Human
cugcucccacugacuguccu

SEQ ID NO: 1345500 - RNA, 22 nt, Human
gauuauacuuuuccccuugcug

SEQ ID NO: 1345501 - RNA, 22 nt, Human
ggagcccaguccguagcagucc

SEQ ID NO: 1345502 - RNA, 25 nt, Human
uacugaguggcucuuccucccacuc

SEQ ID NO: 1345503 - RNA, 22 nt, Human
uagaagguggccguacugagug

SEQ ID NO: 1345504 - RNA, 20 nt, Human
ucucuuggccucaguguccu

SEQ ID NO: 1345505 - RNA, 21 nt, Human
ucugcagaggccccagacucc

SEQ ID NO: 1345506 - RNA, 23 nt, Human
ugacaagaggcuuagugguugaa

SEQ ID NO: 1345507 - RNA, 25 nt, Human
ugacaagaggcuuagugguugaagg

SEQ ID NO: 1345508 - RNA, 23 nt, Human
ugcucccacugacuguccuugau

SEQ ID NO: 1345509 - RNA, 18 nt, Human
uggcucugcagaggcccc

SEQ ID NO: 1345510 - RNA, 18 nt, Human
uggcucuuccucccacuc

SEQ ID NO: 1345511 - RNA, 20 nt, Human
uggcucuuccucccacuccc

SEQ ID NO: 1345512 - RNA, 18 nt, Human
ugggagcagcugccucgu

SEQ ID NO: 1345513 - RNA, 18 nt, Human
uuauacuuuuccccuugc

SEQ ID NO: 1345514 - RNA, 21 nt, Human
aaacagggugaagucaaaggg

SEQ ID NO: 1345515 - RNA, 21 nt, Human
aaacagggugaagucaaaggg

SEQ ID NO: 1345516 - RNA, 23 nt, Human
aaagauugggaaauauagaauaa

SEQ ID NO: 1345517 - RNA, 20 nt, Human
aaaucgcagccucaacacaa

SEQ ID NO: 1345518 - RNA, 22 nt, Human
aacacuuuuaugagggcagaug

SEQ ID NO: 1345519 - RNA, 22 nt, Human
aacacuuuuaugagggcagaug

SEQ ID NO: 1345520 - RNA, 18 nt, Human
aagcccugaucccuuuac

SEQ ID NO: 1345521 - RNA, 22 nt, Human
acaaacagggugaagucaaagg

SEQ ID NO: 1345522 - RNA, 22 nt, Human
acaaacagggugaagucaaagg

SEQ ID NO: 1345523 - RNA, 22 nt, Human
agagcagcugagauccagaaug

SEQ ID NO: 1345524 - RNA, 21 nt, Human
agaggaugggccaggggaucc

SEQ ID NO: 1345525 - RNA, 20 nt, Human
agaugccuuugccauaggcu

SEQ ID NO: 1345526 - RNA, 19 nt, Human
agcaccccuccauaccacu

SEQ ID NO: 1345527 - RNA, 24 nt, Human
aggaaauacuggagauggggcuca

SEQ ID NO: 1345528 - RNA, 20 nt, Human
aggagaccacaaagggagac

SEQ ID NO: 1345529 - RNA, 21 nt, Human
aggaggaacuggugugaggug

SEQ ID NO: 1345530 - RNA, 19 nt, Human
agggcacgaugucagggac

SEQ ID NO: 1345531 - RNA, 18 nt, Human
auagaauaacugaagccc

SEQ ID NO: 1345532 - RNA, 21 nt, Human
auagagcuucuuggcgguccg

SEQ ID NO: 1345533 - RNA, 19 nt, Human
aucaugcuuuguuaggucc

SEQ ID NO: 1345534 - RNA, 19 nt, Human
caaagggaaagucagggga

SEQ ID NO: 1345535 - RNA, 19 nt, Human
caaagggaaagucagggga

SEQ ID NO: 1345536 - RNA, 23 nt, Human
caauagguucuguccggaggacc

SEQ ID NO: 1345537 - RNA, 18 nt, Human
cacacccagauguuccca

SEQ ID NO: 1345538 - RNA, 18 nt, Human
cacacccagauguuccca

SEQ ID NO: 1345539 - RNA, 19 nt, Human
cacccuuugugagaggcuc

SEQ ID NO: 1345540 - RNA, 22 nt, Human
cacuagccgaaccaaggccaac

SEQ ID NO: 1345541 - RNA, 21 nt, Human
cacugcaggagaggaugggcc

SEQ ID NO: 1345542 - RNA, 22 nt, Human
cagcaggaggaacuggugugag

SEQ ID NO: 1345543 - RNA, 18 nt, Human
caggagggcugcucagca

SEQ ID NO: 1345544 - RNA, 24 nt, Human
cagggugaagucaaagggaaaguc

SEQ ID NO: 1345545 - RNA, 24 nt, Human
cagggugaagucaaagggaaaguc

SEQ ID NO: 1345546 - RNA, 19 nt, Human
cagugcuaggcagcacccc

SEQ ID NO: 1345547 - RNA, 22 nt, Human
cccauuccugaguauccaaagg

SEQ ID NO: 1345548 - RNA, 29 nt, Human
ccccugaacgccauagagaaauuccucug

SEQ ID NO: 1345549 - RNA, 23 nt, Human
cccuccauaccacuagccgaacc

SEQ ID NO: 1345550 - RNA, 24 nt, Human
ccuccauaccacuagccgaaccaa

SEQ ID NO: 1345551 - RNA, 23 nt, Human
ccugggguaacaggggugguacg

SEQ ID NO: 1345552 - RNA, 23 nt, Human
ccugggguaacaggggugguacg

SEQ ID NO: 1345553 - RNA, 24 nt, Human
ccuucaagagcagcugagauccag

SEQ ID NO: 1345554 - RNA, 20 nt, Human
cgaggaagcugauguugaug

SEQ ID NO: 1345555 - RNA, 18 nt, Human
cuagccgaaccaaggcca

SEQ ID NO: 1345556 - RNA, 20 nt, Human
cuagccgaaccaaggccaac

SEQ ID NO: 1345557 - RNA, 22 nt, Human
cuaggcagcaccccuccauacc

SEQ ID NO: 1345558 - RNA, 25 nt, Human
cugcacagcuccccugaacgccaua

SEQ ID NO: 1345559 - RNA, 22 nt, Human
cuguagaucuccuucacggcuu

SEQ ID NO: 1345560 - RNA, 19 nt, Human
cugugcuguccuuuuccca

SEQ ID NO: 1345561 - RNA, 20 nt, Human
cugugcuguccuuuucccau

SEQ ID NO: 1345562 - RNA, 21 nt, Human
cuucaagagcagcugagaucc

SEQ ID NO: 1345563 - RNA, 18 nt, Human
cuugugcagacauggucg

SEQ ID NO: 1345564 - RNA, 18 nt, Human
cuugugcagacauggucg

SEQ ID NO: 1345565 - RNA, 18 nt, Human
gcaggagaggaugggcca

SEQ ID NO: 1345566 - RNA, 19 nt, Human
ggaaaggcgugggaugaua

SEQ ID NO: 1345567 - RNA, 23 nt, Human
ggauccugggguaacaggggugg

SEQ ID NO: 1345568 - RNA, 23 nt, Human
ggauccugggguaacaggggugg

SEQ ID NO: 1345569 - RNA, 22 nt, Human
ggauggcaggcucugcuguugc

SEQ ID NO: 1345570 - RNA, 18 nt, Human
ggcagauggauccugggg

SEQ ID NO: 1345571 - RNA, 20 nt, Human
gggcagauggauccuggggu

SEQ ID NO: 1345572 - RNA, 24 nt, Human
guaacaagucacuguccuucaaga

SEQ ID NO: 1345573 - RNA, 19 nt, Human
guaauggccccuugauucc

SEQ ID NO: 1345574 - RNA, 24 nt, Human
gucugcaucaagcugugggugucg

SEQ ID NO: 1345575 - RNA, 19 nt, Human
guugcuagagaugauccac

SEQ ID NO: 1345576 - RNA, 18 nt, Human
uaauggccccuugauucc

SEQ ID NO: 1345577 - RNA, 18 nt, Human
uacaguuuagauuccgac

SEQ ID NO: 1345578 - RNA, 18 nt, Human
uacaguuuagauuccgac

SEQ ID NO: 1345579 - RNA, 21 nt, Human
uaccugaacacuuuuaugagg

SEQ ID NO: 1345580 - RNA, 21 nt, Human
uaccugaacacuuuuaugagg

SEQ ID NO: 1345581 - RNA, 19 nt, Human
uagauguaaucacuucaca

SEQ ID NO: 1345582 - RNA, 19 nt, Human
uagauguaaucacuucaca

SEQ ID NO: 1345583 - RNA, 20 nt, Human
uaggcugcuccaugcagcug

SEQ ID NO: 1345584 - RNA, 23 nt, Human
uaucuugggguccugaguauuaa

SEQ ID NO: 1345585 - RNA, 23 nt, Human
uaucuugggguccugaguauuaa

SEQ ID NO: 1345586 - RNA, 18 nt, Human
ucaagcucuaccaugaag

SEQ ID NO: 1345587 - RNA, 18 nt, Human
ucaagcucuaccaugaag

SEQ ID NO: 1345588 - RNA, 18 nt, Human
ucagucucuuccugauau

SEQ ID NO: 1345589 - RNA, 18 nt, Human
ucagucucuuccugauau

SEQ ID NO: 1345590 - RNA, 18 nt, Human
uccacugcaggagaggau

SEQ ID NO: 1345591 - RNA, 21 nt, Human
uccaggcuguagagacuuccu

SEQ ID NO: 1345592 - RNA, 21 nt, Human
uccauaccacuagccgaaccc

SEQ ID NO: 1345593 - RNA, 23 nt, Human
ucccuauuaucccauggaaaggc

SEQ ID NO: 1345594 - RNA, 19 nt, Human
uccugggguaacaggggug

SEQ ID NO: 1345595 - RNA, 19 nt, Human
uccugggguaacaggggug

SEQ ID NO: 1345596 - RNA, 23 nt, Human
ucgcagccucaacacaauagguu

SEQ ID NO: 1345597 - RNA, 23 nt, Human
ucucugauggauacagaguucuc

SEQ ID NO: 1345598 - RNA, 20 nt, Human
ugaccuguugcuagagauga

SEQ ID NO: 1345599 - RNA, 23 nt, Human
ugaccuguugcuagagaugaucc

SEQ ID NO: 1345600 - RNA, 21 nt, Human
ugagaaauaaggauaucaugc

SEQ ID NO: 1345601 - RNA, 21 nt, Human
ugagagguaguuugacaaugu

SEQ ID NO: 1345602 - RNA, 18 nt, Human
ugagccaaaacaacaugc

SEQ ID NO: 1345603 - RNA, 20 nt, Human
ugagccaaaacaacaugcag

SEQ ID NO: 1345604 - RNA, 26 nt, Human
ugagggcagauggauccuccccgagg

SEQ ID NO: 1345605 - RNA, 26 nt, Human
ugagggcagauggauccuccccgagg

SEQ ID NO: 1345606 - RNA, 19 nt, Human
ugagggcagauggauccug

SEQ ID NO: 1345607 - RNA, 19 nt, Human
ugagggcagauggauccug

SEQ ID NO: 1345608 - RNA, 20 nt, Human
ugauggauacagaguucuca

SEQ ID NO: 1345609 - RNA, 18 nt, Human
ugauucauuaucucccuc

SEQ ID NO: 1345610 - RNA, 20 nt, Human
ugcuccaugcagcugcaguu

SEQ ID NO: 1345611 - RNA, 22 nt, Human
uggaucgggucugggggauggu

SEQ ID NO: 1345612 - RNA, 22 nt, Human
uggaucgggucugggggauggu

SEQ ID NO: 1345613 - RNA, 22 nt, Human
uggcaggagggcugcucagcag

SEQ ID NO: 1345614 - RNA, 23 nt, Human
uggcaggcucugcuguugcggug

SEQ ID NO: 1345615 - RNA, 21 nt, Human
ugggaaauauagaauaacuga

SEQ ID NO: 1345616 - RNA, 18 nt, Human
ugggagagagaaaaucgc

SEQ ID NO: 1345617 - RNA, 18 nt, Human
ugggaugauauggugagg

SEQ ID NO: 1345618 - RNA, 21 nt, Human
ugggccaggggauccaacuug

SEQ ID NO: 1345619 - RNA, 21 nt, Human
uguaucuugggguccugagua

SEQ ID NO: 1345620 - RNA, 21 nt, Human
uguaucuugggguccugagua

SEQ ID NO: 1345621 - RNA, 23 nt, Human
uguccacgucaucgauaguucca

SEQ ID NO: 1345622 - RNA, 18 nt, Human
uuggagggcauccugugc

SEQ ID NO: 1345623 - RNA, 24 nt, Human
uuuuuuuuuuuuuuuuuccauuuu

SEQ ID NO: 1345624 - RNA, 26 nt, Human
aaacagaacgaaaacaucaccacccc

SEQ ID NO: 1345625 - RNA, 24 nt, Human
aauaaaacagaacgaaaacaucac

SEQ ID NO: 1345626 - RNA, 21 nt, Human
acaguggccuccucuuccucc

SEQ ID NO: 1345627 - RNA, 19 nt, Human
accuagcccuggaggcagg

SEQ ID NO: 1345628 - RNA, 20 nt, Human
aggcaccagugaagggaggc

SEQ ID NO: 1345629 - RNA, 22 nt, Human
aggcaccagugaagggaggcug

SEQ ID NO: 1345630 - RNA, 27 nt, Human
auccccuucaaaccuccccugggcucc

SEQ ID NO: 1345631 - RNA, 22 nt, Human
caaggcaccagugaagggggag

SEQ ID NO: 1345632 - RNA, 20 nt, Human
cacagaggaggccuggcccc

SEQ ID NO: 1345633 - RNA, 22 nt, Human
cacagguagaggaagccacaaa

SEQ ID NO: 1345634 - RNA, 20 nt, Human
caguggccuccucuuccucc

SEQ ID NO: 1345635 - RNA, 24 nt, Human
ccacgggccacaguggccuccucu

SEQ ID NO: 1345636 - RNA, 23 nt, Human
ccaggauccccuucaaaccuccc

SEQ ID NO: 1345637 - RNA, 25 nt, Human
ccccugggcuccacgucccaagggc

SEQ ID NO: 1345638 - RNA, 24 nt, Human
cccgcgagccggggggcuccgccu

SEQ ID NO: 1345639 - RNA, 19 nt, Human
ccuccccugcacggugggg

SEQ ID NO: 1345640 - RNA, 19 nt, Human
cgauccccgcgagccgggg

SEQ ID NO: 1345641 - RNA, 20 nt, Human
cuagcccuggaggcagggca

SEQ ID NO: 1345642 - RNA, 20 nt, Human
cuccucuuccuccuccucca

SEQ ID NO: 1345643 - RNA, 19 nt, Human
gagcacagguagaggaagc

SEQ ID NO: 1345644 - RNA, 21 nt, Human
gauaggccgccugccugggcc

SEQ ID NO: 1345645 - RNA, 24 nt, Human
gcggacucccuccccugcacggug

SEQ ID NO: 1345646 - RNA, 22 nt, Human
ggcaaggccacgggccacagug

SEQ ID NO: 1345647 - RNA, 21 nt, Human
ggccccuagcaucaaggcacc

SEQ ID NO: 1345648 - RNA, 23 nt, Human
ggucccucugccaaaggaggugg

SEQ ID NO: 1345649 - RNA, 28 nt, Human
gugcuggggucccucugccaaaggaggu

SEQ ID NO: 1345650 - RNA, 18 nt, Human
uagaaaaauaaaacagaa

SEQ ID NO: 1345651 - RNA, 21 nt, Human
uagaggaagccacaaaugggu

SEQ ID NO: 1345652 - RNA, 22 nt, Human
ucacagaggaggccuggccccu

SEQ ID NO: 1345653 - RNA, 19 nt, Human
uccccgcgagccggggggc

SEQ ID NO: 1345654 - RNA, 22 nt, Human
uccccgcgagccggggggcucc

SEQ ID NO: 1345655 - RNA, 21 nt, Human
uccuccaaggaucaggauagg

SEQ ID NO: 1345656 - RNA, 20 nt, Human
ucucuaccuagcccuggagg

SEQ ID NO: 1345657 - RNA, 22 nt, Human
ugacccgcaggacgcagcgcuc

SEQ ID NO: 1345658 - RNA, 23 nt, Human
ugcuggggucccucugccaaagg

SEQ ID NO: 1345659 - RNA, 19 nt, Human
ugggcuccacgucccaagg

SEQ ID NO: 1345660 - RNA, 31 nt, Human
aacaaauaaccacuuaaauagaacagugucc

SEQ ID NO: 1345661 - RNA, 22 nt, Human
aagaacugaugcaggcucaaag

SEQ ID NO: 1345662 - RNA, 22 nt, Human
aauaaaguacaauugaaccugg

SEQ ID NO: 1345663 - RNA, 21 nt, Human
agaacugaugcaggcucaaag

SEQ ID NO: 1345664 - RNA, 22 nt, Human
agccgcacgcaagcccaacgca

SEQ ID NO: 1345665 - RNA, 19 nt, Human
aguccauacaucacacugg

SEQ ID NO: 1345666 - RNA, 22 nt, Human
auacacaacuauaauaaaguac

SEQ ID NO: 1345667 - RNA, 21 nt, Human
cacgcaagcccaacgcagccg

SEQ ID NO: 1345668 - RNA, 23 nt, Human
caguguucuagagaccuagaggg

SEQ ID NO: 1345669 - RNA, 23 nt, Human
cgagccgcacgcaagcccaacgc

SEQ ID NO: 1345670 - RNA, 21 nt, Human
cggaacccgaaacaagacugg

SEQ ID NO: 1345671 - RNA, 21 nt, Human
cugaugcaggcucaaaggaag

SEQ ID NO: 1345672 - RNA, 20 nt, Human
gauuuguauuuuauuuccuu

SEQ ID NO: 1345673 - RNA, 19 nt, Human
ggaacccgaaacaagacug

SEQ ID NO: 1345674 - RNA, 25 nt, Human
ggguuucaagaaaucaaauccuaau

SEQ ID NO: 1345675 - RNA, 23 nt, Human
guagauaggcaaaaccaagaacu

SEQ ID NO: 1345676 - RNA, 22 nt, Human
uaggcaaaaccaagaacugaug

SEQ ID NO: 1345677 - RNA, 24 nt, Human
uagggcauuuuaaugugcaaaaaa

SEQ ID NO: 1345678 - RNA, 23 nt, Human
uauaauaaaguacaauugaaccu

SEQ ID NO: 1345679 - RNA, 23 nt, Human
ucuuuacacaugcagacaaacca

SEQ ID NO: 1345680 - RNA, 22 nt, Human
ugguagauaggcaaaaccaaga

SEQ ID NO: 1345681 - RNA, 22 nt, Human
uuuugcguuuaauguuuuugau

SEQ ID NO: 1345682 - RNA, 23 nt, Human
uuuuugauugaguccauacauca

SEQ ID NO: 1345683 - RNA, 24 nt, Human
aaacccaucccauucugaaaccag

SEQ ID NO: 1345684 - RNA, 22 nt, Human
aaccuggacucuucuaaagugg

SEQ ID NO: 1345685 - RNA, 25 nt, Human
aagaaacccaucccauucugaaacc

SEQ ID NO: 1345686 - RNA, 19 nt, Human
aaggacagauaucaaugaa

SEQ ID NO: 1345687 - RNA, 20 nt, Human
acaccacugugccccccagc

SEQ ID NO: 1345688 - RNA, 24 nt, Human
acagaguguuaaugcucaacgaug

SEQ ID NO: 1345689 - RNA, 23 nt, Human
acagucaaaugugguuggggaug

SEQ ID NO: 1345690 - RNA, 21 nt, Human
agauaucaaugaaaacuuuua

SEQ ID NO: 1345691 - RNA, 18 nt, Human
aggcaggggucugcagcu

SEQ ID NO: 1345692 - RNA, 19 nt, Human
aggcaggggucugcagcuc

SEQ ID NO: 1345693 - RNA, 25 nt, Human
auccacacaaucucuccaaauauuu

SEQ ID NO: 1345694 - RNA, 21 nt, Human
caaaugcacauccccucucuu

SEQ ID NO: 1345695 - RNA, 22 nt, Human
cacuaaguuccuccaauggucc

SEQ ID NO: 1345696 - RNA, 22 nt, Human
cacuacacaccacugugccccc

SEQ ID NO: 1345697 - RNA, 24 nt, Human
cacucugucugcuaagcacccacu

SEQ ID NO: 1345698 - RNA, 18 nt, Human
cagaaucucaagauaugu

SEQ ID NO: 1345699 - RNA, 21 nt, Human
cagaguucugcccugcuuccc

SEQ ID NO: 1345700 - RNA, 19 nt, Human
ccaaacugagcguggaugg

SEQ ID NO: 1345701 - RNA, 21 nt, Human
ccacugugccccccagccagc

SEQ ID NO: 1345702 - RNA, 22 nt, Human
ccccagccagcuucacucuguc

SEQ ID NO: 1345703 - RNA, 21 nt, Human
ccucuaaaugcucaccaaccu

SEQ ID NO: 1345704 - RNA, 21 nt, Human
ccugggcucaagagcguucuc

SEQ ID NO: 1345705 - RNA, 19 nt, Human
cuacacaccacugugcccc

SEQ ID NO: 1345706 - RNA, 21 nt, Human
cuacacaccacugugcccccc

SEQ ID NO: 1345707 - RNA, 21 nt, Human
cuauccaacaucacacacaaa

SEQ ID NO: 1345708 - RNA, 24 nt, Human
cucagagugaacaaauccagagga

SEQ ID NO: 1345709 - RNA, 21 nt, Human
cugcagcucugucacagagug

SEQ ID NO: 1345710 - RNA, 18 nt, Human
cugcuaagcacccacucu

SEQ ID NO: 1345711 - RNA, 22 nt, Human
cugugccccccagccagcuuca

SEQ ID NO: 1345712 - RNA, 21 nt, Human
cuuaaauccacacaaucucuc

SEQ ID NO: 1345713 - RNA, 18 nt, Human
gagccacuugacucgugu

SEQ ID NO: 1345714 - RNA, 20 nt, Human
gauggaagggggcagaggga

SEQ ID NO: 1345715 - RNA, 18 nt, Human
ggacaggaguuggcugga

SEQ ID NO: 1345716 - RNA, 19 nt, Human
ggcagacaagcccuauucu

SEQ ID NO: 1345717 - RNA, 23 nt, Human
gugccccccagccagcuucacuc

SEQ ID NO: 1345718 - RNA, 18 nt, Human
guuggggauggaaggggg

SEQ ID NO: 1345719 - RNA, 19 nt, Human
uaaagugggcagacaagcc

SEQ ID NO: 1345720 - RNA, 21 nt, Human
uaacaagaacaaaggggucuc

SEQ ID NO: 1345721 - RNA, 22 nt, Human
uaacaugaggugaagaaaccca

SEQ ID NO: 1345722 - RNA, 24 nt, Human
uaacaugaggugaagaaacccauc

SEQ ID NO: 1345723 - RNA, 23 nt, Human
uaagcacccacucugcaaacaga

SEQ ID NO: 1345724 - RNA, 20 nt, Human
uaccuuggucuuuugauaca

SEQ ID NO: 1345725 - RNA, 18 nt, Human
ucaagagcguucugguca

SEQ ID NO: 1345726 - RNA, 25 nt, Human
ucuaaaugcucaccaaccuggacuc

SEQ ID NO: 1345727 - RNA, 21 nt, Human
ucugcuaagcacccacucugc

SEQ ID NO: 1345728 - RNA, 20 nt, Human
ugaaagacaagaggguggcc

SEQ ID NO: 1345729 - RNA, 24 nt, Human
ugacaacaggacacagaugcaaug

SEQ ID NO: 1345730 - RNA, 22 nt, Human
ugacucgugucacaaagaaugg

SEQ ID NO: 1345731 - RNA, 20 nt, Human
ugagacucaaggcagggguc

SEQ ID NO: 1345732 - RNA, 21 nt, Human
ugagaugagacucaaggcagg

SEQ ID NO: 1345733 - RNA, 19 nt, Human
ugagccacuugacucgugu

SEQ ID NO: 1345734 - RNA, 22 nt, Human
ugaggugaagaaacccauccca

SEQ ID NO: 1345735 - RNA, 22 nt, Human
ugauacacagcagcacuacaca

SEQ ID NO: 1345736 - RNA, 18 nt, Human
ugcccugaggagguugug

SEQ ID NO: 1345737 - RNA, 18 nt, Human
ugcccugcuucccucuaa

SEQ ID NO: 1345738 - RNA, 22 nt, Human
ugcccugcuucccucuaaaugc

SEQ ID NO: 1345739 - RNA, 20 nt, Human
uggaggagcagauggguccc

SEQ ID NO: 1345740 - RNA, 21 nt, Human
uggcuggaggagcagaugggu

SEQ ID NO: 1345741 - RNA, 20 nt, Human
ugggaggagccaccauggug

SEQ ID NO: 1345742 - RNA, 18 nt, Human
uggggauggaagggggca

SEQ ID NO: 1345743 - RNA, 23 nt, Human
uggggauggaagggggcagaggg

SEQ ID NO: 1345744 - RNA, 23 nt, Human
uggucuuuugauacacagcagca

SEQ ID NO: 1345745 - RNA, 19 nt, Human
ugugagggacaggaguugg

SEQ ID NO: 1345746 - RNA, 18 nt, Human
ugugguuggggauggaag

SEQ ID NO: 1345747 - RNA, 22 nt, Human
uuggcuggaggagcagaugggu

SEQ ID NO: 1345748 - RNA, 22 nt, Human
aaacaacaacaauaaacaaccc

SEQ ID NO: 1345749 - RNA, 23 nt, Human
aaaccaauuuccaaaaagacuag

SEQ ID NO: 1345750 - RNA, 23 nt, Human
aaagaaacaaucuuauucuucag

SEQ ID NO: 1345751 - RNA, 25 nt, Human
aacaacaauaaacaacccagaaaaa

SEQ ID NO: 1345752 - RNA, 21 nt, Human
aacaacauuaguaacuauuuu

SEQ ID NO: 1345753 - RNA, 19 nt, Human
aacaaugagaacacuugga

SEQ ID NO: 1345754 - RNA, 21 nt, Human
aacccaaauguccaucaaugg

SEQ ID NO: 1345755 - RNA, 21 nt, Human
aacccagaaaaauggagaucu

SEQ ID NO: 1345756 - RNA, 23 nt, Human
aagaaagaaaaaucuaaacauau

SEQ ID NO: 1345757 - RNA, 18 nt, Human
aagcagggaaaaggcaga

SEQ ID NO: 1345758 - RNA, 21 nt, Human
aauuguauggccucaagcagg

SEQ ID NO: 1345759 - RNA, 21 nt, Human
acaacaacaaacaacaacaaa

SEQ ID NO: 1345760 - RNA, 20 nt, Human
acaccgccuguucucacuca

SEQ ID NO: 1345761 - RNA, 18 nt, Human
accugcacauugugcaca

SEQ ID NO: 1345762 - RNA, 21 nt, Human
acucuggguaauucacuuuug

SEQ ID NO: 1345763 - RNA, 18 nt, Human
acuggaaaaccucaaccu

SEQ ID NO: 1345764 - RNA, 24 nt, Human
acuuauuggauagauauacuuuuu

SEQ ID NO: 1345765 - RNA, 23 nt, Human
agaaaaaucuaaacauauuuuua

SEQ ID NO: 1345766 - RNA, 21 nt, Human
agagagcaaacaguaaugaga

SEQ ID NO: 1345767 - RNA, 22 nt, Human
agaggcucgcuggcucccacgg

SEQ ID NO: 1345768 - RNA, 18 nt, Human
agggacauagaugaagcu

SEQ ID NO: 1345769 - RNA, 22 nt, Human
agggugaguuggugaacgugug

SEQ ID NO: 1345770 - RNA, 25 nt, Human
aguaagauuuucuuuaauuuuucuu

SEQ ID NO: 1345771 - RNA, 23 nt, Human
aguaaugagauccuauaaagaga

SEQ ID NO: 1345772 - RNA, 21 nt, Human
caaagacagaaaaccaaacac

SEQ ID NO: 1345773 - RNA, 22 nt, Human
caaauguccaucaaugguagac

SEQ ID NO: 1345774 - RNA, 23 nt, Human
caacaacaauaaacaacccagaa

SEQ ID NO: 1345775 - RNA, 22 nt, Human
caauagcaaagacuuggaacca

SEQ ID NO: 1345776 - RNA, 20 nt, Human
cacaaaccauuggcaaccug

SEQ ID NO: 1345777 - RNA, 24 nt, Human
cacaccaacauggcacauguauac

SEQ ID NO: 1345778 - RNA, 18 nt, Human
cacauguauacauaugua

SEQ ID NO: 1345779 - RNA, 18 nt, Human
cagaaaaccaaacaccgc

SEQ ID NO: 1345780 - RNA, 25 nt, Human
cauauacaccauggaauacuaugca

SEQ ID NO: 1345781 - RNA, 22 nt, Human
ccaaacaccgccuguucucacu

SEQ ID NO: 1345782 - RNA, 20 nt, Human
cccaacauuucagacaaguu

SEQ ID NO: 1345783 - RNA, 24 nt, Human
cccccaacauuucagacaaguugu

SEQ ID NO: 1345784 - RNA, 24 nt, Human
ccugucaugggguugggggaggug

SEQ ID NO: 1345785 - RNA, 22 nt, Human
ccuucccauagacagcugaagc

SEQ ID NO: 1345786 - RNA, 19 nt, Human
cgcaaagacagaaaaccaa

SEQ ID NO: 1345787 - RNA, 18 nt, Human
cucauguguccagcuucc

SEQ ID NO: 1345788 - RNA, 30 nt, Human
gacaacaacaaacaacaacaauaaacaacu

SEQ ID NO: 1345789 - RNA, 23 nt, Human
gagaggcucgcuggcucccacgg

SEQ ID NO: 1345790 - RNA, 22 nt, Human
gcaaacuaucgcaaagacagaa

SEQ ID NO: 1345791 - RNA, 19 nt, Human
gcaaagacagaaaaccaaa

SEQ ID NO: 1345792 - RNA, 18 nt, Human
gcagaaaaugacaacaac

SEQ ID NO: 1345793 - RNA, 19 nt, Human
gcccccaacauuucagaca

SEQ ID NO: 1345794 - RNA, 20 nt, Human
gggguugggggaggugggag

SEQ ID NO: 1345795 - RNA, 23 nt, Human
gggguugggggaggugggaggga

SEQ ID NO: 1345796 - RNA, 22 nt, Human
ggucacugccaugccagaaaca

SEQ ID NO: 1345797 - RNA, 22 nt, Human
guccuuuguagggacauagaug

SEQ ID NO: 1345798 - RNA, 19 nt, Human
gugcagcacaccaacaugg

SEQ ID NO: 1345799 - RNA, 22 nt, Human
uaaaaugaauccuaaggaguug

SEQ ID NO: 1345800 - RNA, 18 nt, Human
uaaaugacuugcucaaga

SEQ ID NO: 1345801 - RNA, 23 nt, Human
uacaugcuguauuguguccaagu

SEQ ID NO: 1345802 - RNA, 19 nt, Human
uagaauuacuggaaaaccu

SEQ ID NO: 1345803 - RNA, 18 nt, Human
uaguaacaccucaacaac

SEQ ID NO: 1345804 - RNA, 18 nt, Human
uaguucugaaaaugccug

SEQ ID NO: 1345805 - RNA, 22 nt, Human
uaucacuggccaaugacucagc

SEQ ID NO: 1345806 - RNA, 22 nt, Human
ucacagucacaaaccauuggca

SEQ ID NO: 1345807 - RNA, 19 nt, Human
ucaccauugucuuuccuuc

SEQ ID NO: 1345808 - RNA, 25 nt, Human
ucacugccaugccagaaacagauug

SEQ ID NO: 1345809 - RNA, 21 nt, Human
ucagaaagaaacaaucuuauu

SEQ ID NO: 1345810 - RNA, 19 nt, Human
ucagcccccaacauuucag

SEQ ID NO: 1345811 - RNA, 22 nt, Human
ucauguguccagcuuccaucug

SEQ ID NO: 1345812 - RNA, 20 nt, Human
ucccucaauauauaggacaa

SEQ ID NO: 1345813 - RNA, 22 nt, Human
ucccuugagcacguaagaucag

SEQ ID NO: 1345814 - RNA, 21 nt, Human
ucgcaaagacagaaaaccaaa

SEQ ID NO: 1345815 - RNA, 21 nt, Human
ucucagaugacugcuagaagu

SEQ ID NO: 1345816 - RNA, 19 nt, Human
ugaaagaguaaaguauuuu

SEQ ID NO: 1345817 - RNA, 21 nt, Human
ugaaagaguaaaguauuuuga

SEQ ID NO: 1345818 - RNA, 18 nt, Human
ugacaacaacaaacaaca

SEQ ID NO: 1345819 - RNA, 19 nt, Human
ugacaacaacaaacaacaa

SEQ ID NO: 1345820 - RNA, 20 nt, Human
ugacaacaacaaacaacaac

SEQ ID NO: 1345821 - RNA, 23 nt, Human
ugacaacaacaaacaacaacaau

SEQ ID NO: 1345822 - RNA, 21 nt, Human
ugacuuccauugcaagacucc

SEQ ID NO: 1345823 - RNA, 23 nt, Human
ugacuuggucacugccaugccag

SEQ ID NO: 1345824 - RNA, 31 nt, Human
ugagaaacaaaccagcaguuguuugaaaacc

SEQ ID NO: 1345825 - RNA, 19 nt, Human
ugagcgaggaacuguaugg

SEQ ID NO: 1345826 - RNA, 24 nt, Human
ugaggcaagcaaacuuagagaggu

SEQ ID NO: 1345827 - RNA, 19 nt, Human
ugaugaguuaaugggugca

SEQ ID NO: 1345828 - RNA, 21 nt, Human
uggaaaaccucaaccuagaug

SEQ ID NO: 1345829 - RNA, 20 nt, Human
uggaagauugcaaccuuggc

SEQ ID NO: 1345830 - RNA, 23 nt, Human
uggaagauugcaaccuuggcuca

SEQ ID NO: 1345831 - RNA, 20 nt, Human
uggaauacuaugcagccaua

SEQ ID NO: 1345832 - RNA, 22 nt, Human
uggauuuuuuuuuauagcacac

SEQ ID NO: 1345833 - RNA, 19 nt, Human
uggcacauguauacauaug

SEQ ID NO: 1345834 - RNA, 18 nt, Human
uggcucagaaagaaacaa

SEQ ID NO: 1345835 - RNA, 21 nt, Human
uguccaaugugaauuaugcua

SEQ ID NO: 1345836 - RNA, 21 nt, Human
uguccaucaaugguagacugg

SEQ ID NO: 1345837 - RNA, 18 nt, Human
uguguagauuuucccaug

SEQ ID NO: 1345838 - RNA, 23 nt, Human
uuaaacuggucuuccuaggcuuu

SEQ ID NO: 1345839 - RNA, 23 nt, Human
uuacuggaaaaccucaaccuaga

SEQ ID NO: 1345840 - RNA, 24 nt, Human
uucaccauugucuuuccuucuaaa

SEQ ID NO: 1345841 - RNA, 23 nt, Human
uucuagugcaagaaagaaaaauc

SEQ ID NO: 1345842 - RNA, 22 nt, Human
uucucacagucacaaaccauug

SEQ ID NO: 1345843 - RNA, 21 nt, Human
uugaacacaaaaagagaaguc

SEQ ID NO: 1345844 - RNA, 21 nt, Human
uuggucacugccaugccagaa

SEQ ID NO: 1345845 - RNA, 24 nt, Human
uugguuuuugaaugaauugucuua

SEQ ID NO: 1345846 - RNA, 22 nt, Human
uuucucaagcucugaaagcuuu

SEQ ID NO: 1345847 - RNA, 24 nt, Human
uuucuuggucucaaagcuucucuu

SEQ ID NO: 1345848 - RNA, 22 nt, Human
uuucuuuucuuuucucacaguc

SEQ ID NO: 1345849 - RNA, 21 nt, Human
uuugauauuaacaacuguuuc

SEQ ID NO: 1345850 - RNA, 19 nt, Human
uuuuaaguguaagauaaua

SEQ ID NO: 1345851 - RNA, 21 nt, Human
ccgcugguggugcugagcgcg

SEQ ID NO: 1345852 - RNA, 18 nt, Human
cgagcugcggagacgccc

SEQ ID NO: 1345853 - RNA, 21 nt, Human
ugguggugcugagcgcgcggg

SEQ ID NO: 1345854 - RNA, 29 nt, Human
aaacagaaugauagagcaagagggacccc

SEQ ID NO: 1345855 - RNA, 24 nt, Human
aaaugucuuuauugaaacagaaug

SEQ ID NO: 1345856 - RNA, 19 nt, Human
aagcagcagggaggaggca

SEQ ID NO: 1345857 - RNA, 21 nt, Human
aagcagcagggaggaggcagg

SEQ ID NO: 1345858 - RNA, 22 nt, Human
aagcagcagggaggaggcaggg

SEQ ID NO: 1345859 - RNA, 19 nt, Human
agcagggaggaggcagggu

SEQ ID NO: 1345860 - RNA, 23 nt, Human
agcagggaggaggcagggugggg

SEQ ID NO: 1345861 - RNA, 19 nt, Human
agcccugccuucccuacuc

SEQ ID NO: 1345862 - RNA, 20 nt, Human
aggaggcaggguggggacgg

SEQ ID NO: 1345863 - RNA, 19 nt, Human
agggaggaggcaggguggg

SEQ ID NO: 1345864 - RNA, 20 nt, Human
aggugccucugagacuucug

SEQ ID NO: 1345865 - RNA, 23 nt, Human
aggugccucugagacuucugggc

SEQ ID NO: 1345866 - RNA, 20 nt, Human
caaagcagcagggaggaggc

SEQ ID NO: 1345867 - RNA, 19 nt, Human
cagcagaggccgagcugca

SEQ ID NO: 1345868 - RNA, 18 nt, Human
caggauggagcccagacc

SEQ ID NO: 1345869 - RNA, 19 nt, Human
ccccugacucuggccaagg

SEQ ID NO: 1345870 - RNA, 20 nt, Human
ccucugagacuucugggcag

SEQ ID NO: 1345871 - RNA, 21 nt, Human
ccuguccccugacucuggcca

SEQ ID NO: 1345872 - RNA, 21 nt, Human
cgugaggugccucugagacuu

SEQ ID NO: 1345873 - RNA, 20 nt, Human
cugagacuucugggcagccc

SEQ ID NO: 1345874 - RNA, 26 nt, Human
gaagagcaccggcaggcagcagaggc

SEQ ID NO: 1345875 - RNA, 18 nt, Human
gagcaccggcaggcagca

SEQ ID NO: 1345876 - RNA, 19 nt, Human
gagccacgaagagcaccgg

SEQ ID NO: 1345877 - RNA, 25 nt, Human
gauagagcaagaaauaaugaggucu

SEQ ID NO: 1345878 - RNA, 19 nt, Human
gccgagcugcagcugcugg

SEQ ID NO: 1345879 - RNA, 23 nt, Human
uccgcgauggcuggcgugaggug

SEQ ID NO: 1345880 - RNA, 19 nt, Human
ucucccuguccccugacuc

SEQ ID NO: 1345881 - RNA, 18 nt, Human
ucuuugggcgcaggaugg

SEQ ID NO: 1345882 - RNA, 21 nt, Human
ugacucuggccaaggaaguga

SEQ ID NO: 1345883 - RNA, 21 nt, Human
ugagacuucugggcagcccug

SEQ ID NO: 1345884 - RNA, 21 nt, Human
ugaggucuggguggaugucuu

SEQ ID NO: 1345885 - RNA, 19 nt, Human
uuuuuuuuuuuuuuuugcu

SEQ ID NO: 1345886 - RNA, 18 nt, Human
uuuuuuuuuuuuuuuuug

SEQ ID NO: 1345887 - RNA, 24 nt, Human
uuuuuuuuuuuuuuuuugcucguu

SEQ ID NO: 1345888 - RNA, 19 nt, Human
aaaaagaaacagacacaaa

SEQ ID NO: 1345889 - RNA, 20 nt, Human
aaaaagaaacagacacaaaa

SEQ ID NO: 1345890 - RNA, 21 nt, Human
aaaagaaacagacacaaaaag

SEQ ID NO: 1345891 - RNA, 21 nt, Human
aaaaguaggauccaaugugcu

SEQ ID NO: 1345892 - RNA, 19 nt, Human
aaagaaacagacacaaaaa

SEQ ID NO: 1345893 - RNA, 20 nt, Human
aacaacugaaaauacacuga

SEQ ID NO: 1345894 - RNA, 23 nt, Human
aagaauuuagaaagccugauggg

SEQ ID NO: 1345895 - RNA, 21 nt, Human
aagaggacaggggagcuggag

SEQ ID NO: 1345896 - RNA, 24 nt, Human
acugcagcaaggucaacuaaccug

SEQ ID NO: 1345897 - RNA, 19 nt, Human
acuuuugcuauuugcccuc

SEQ ID NO: 1345898 - RNA, 23 nt, Human
agaaacuuuugguuuucuuguga

SEQ ID NO: 1345899 - RNA, 18 nt, Human
agaaugccauaucaccuc

SEQ ID NO: 1345900 - RNA, 19 nt, Human
agacucaacaacugaaaau

SEQ ID NO: 1345901 - RNA, 21 nt, Human
agagaucugguucaauaucug

SEQ ID NO: 1345902 - RNA, 22 nt, Human
agauggacacaaggauacaaga

SEQ ID NO: 1345903 - RNA, 21 nt, Human
agccuuguuucaauggacaga

SEQ ID NO: 1345904 - RNA, 23 nt, Human
auacccuggcaagagagaaacag

SEQ ID NO: 1345905 - RNA, 20 nt, Human
aucaccuccacccuuuacug

SEQ ID NO: 1345906 - RNA, 23 nt, Human
caacaaauguaaagugccuggca

SEQ ID NO: 1345907 - RNA, 21 nt, Human
caaccaaucuuccuggaaguu

SEQ ID NO: 1345908 - RNA, 20 nt, Human
caagaacaggucucaucuaa

SEQ ID NO: 1345909 - RNA, 19 nt, Human
caccuccacccuuuacugu

SEQ ID NO: 1345910 - RNA, 19 nt, Human
cagacuuucaaccaaucuu

SEQ ID NO: 1345911 - RNA, 21 nt, Human
cagauccuccuccuacuuuuc

SEQ ID NO: 1345912 - RNA, 22 nt, Human
caguagaaauaggguugccuuc

SEQ ID NO: 1345913 - RNA, 23 nt, Human
caguguguuagaaccucucuccc

SEQ ID NO: 1345914 - RNA, 19 nt, Human
cccagucugauauuucagc

SEQ ID NO: 1345915 - RNA, 18 nt, Human
ccuagggcaaugccccag

SEQ ID NO: 1345916 - RNA, 19 nt, Human
ccuccuacuuuuccugucc

SEQ ID NO: 1345917 - RNA, 19 nt, Human
ccuccuacuuuuccugucc

SEQ ID NO: 1345918 - RNA, 18 nt, Human
cuaauacccuggcaagag

SEQ ID NO: 1345919 - RNA, 22 nt, Human
cucaacccuaauccucagaggc

SEQ ID NO: 1345920 - RNA, 23 nt, Human
cucaacccuaauccucagaggca

SEQ ID NO: 1345921 - RNA, 19 nt, Human
cucucuagguuuuaaugaa

SEQ ID NO: 1345922 - RNA, 22 nt, Human
cuguacuaugagucaacaacuc

SEQ ID NO: 1345923 - RNA, 19 nt, Human
cuuucagaaugccauauca

SEQ ID NO: 1345924 - RNA, 21 nt, Human
gaaacagacacaaaaaguuac

SEQ ID NO: 1345925 - RNA, 22 nt, Human
gaaauucuuccuuccccuacuu

SEQ ID NO: 1345926 - RNA, 20 nt, Human
gaauaaaauuuuugaaguag

SEQ ID NO: 1345927 - RNA, 20 nt, Human
gaaucuuaggaugugcuucu

SEQ ID NO: 1345928 - RNA, 19 nt, Human
gaauuuagaaagccugaug

SEQ ID NO: 1345929 - RNA, 19 nt, Human
gacacaaggauacaagaac

SEQ ID NO: 1345930 - RNA, 25 nt, Human
gacuuagucccucccuacuuucaga

SEQ ID NO: 1345931 - RNA, 22 nt, Human
gagaagcuggggaaguuguggg

SEQ ID NO: 1345932 - RNA, 22 nt, Human
gaggacaggggagcuggagaag

SEQ ID NO: 1345933 - RNA, 26 nt, Human
gccccagauccuccuccuacuuuucc

SEQ ID NO: 1345934 - RNA, 21 nt, Human
guguaaacuuaaacaagcuuc

SEQ ID NO: 1345935 - RNA, 22 nt, Human
uaaagugccuggcauaaucugc

SEQ ID NO: 1345936 - RNA, 19 nt, Human
uacaaagucauuuggagac

SEQ ID NO: 1345937 - RNA, 20 nt, Human
uagcuguguaaacuuaaaca

SEQ ID NO: 1345938 - RNA, 19 nt, Human
uaucugaagaaaaguagga

SEQ ID NO: 1345939 - RNA, 20 nt, Human
ucacaguuagucuuucccug

SEQ ID NO: 1345940 - RNA, 20 nt, Human
uccucagaggcaccucuuuu

SEQ ID NO: 1345941 - RNA, 26 nt, Human
uccucagaggcaccucuuuuauuuuu

SEQ ID NO: 1345942 - RNA, 18 nt, Human
uccuugaugaucccccuc

SEQ ID NO: 1345943 - RNA, 21 nt, Human
ugaagaggacaggggagcugg

SEQ ID NO: 1345944 - RNA, 22 nt, Human
ugaagaggacaggggagcugga

SEQ ID NO: 1345945 - RNA, 23 nt, Human
ugaagaggacaggggagcuggag

SEQ ID NO: 1345946 - RNA, 20 nt, Human
ugaagauggacacaaggaua

SEQ ID NO: 1345947 - RNA, 23 nt, Human
ugaggagggggaggaaauuggag

SEQ ID NO: 1345948 - RNA, 23 nt, Human
ugaugaucccccuuccauucuau

SEQ ID NO: 1345949 - RNA, 21 nt, Human
ugccaguucucuuuugcucca

SEQ ID NO: 1345950 - RNA, 22 nt, Human
ugccaguucucuuuugcuccaa

SEQ ID NO: 1345951 - RNA, 26 nt, Human
ugcucaacccuaauccucagaggcac

SEQ ID NO: 1345952 - RNA, 21 nt, Human
ugcucuggggcuuccaguagc

SEQ ID NO: 1345953 - RNA, 27 nt, Human
uggaacucagagcuuuggugugaaugu

SEQ ID NO: 1345954 - RNA, 21 nt, Human
uggcauaaucugcccugcagg

SEQ ID NO: 1345955 - RNA, 20 nt, Human
ugggaaggagaacugcagca

SEQ ID NO: 1345956 - RNA, 22 nt, Human
uggucauggugauaguaguugg

SEQ ID NO: 1345957 - RNA, 23 nt, Human
uguccuugaugaucccccuucca

SEQ ID NO: 1345958 - RNA, 22 nt, Human
ugugagagugaggagggggagg

SEQ ID NO: 1345959 - RNA, 21 nt, Human
uguguuagaaccucucuccca

SEQ ID NO: 1345960 - RNA, 19 nt, Human
uuaaugggaaggagaacug

SEQ ID NO: 1345961 - RNA, 20 nt, Human
uuagaaccucucucccaaug

SEQ ID NO: 1345962 - RNA, 21 nt, Human
uucaauggacagaaaggaacc

SEQ ID NO: 1345963 - RNA, 24 nt, Human
uucaauuucuucagcuguaaaaug

SEQ ID NO: 1345964 - RNA, 23 nt, Human
uucccugaaucuuaggaugugcu

SEQ ID NO: 1345965 - RNA, 22 nt, Human
uucucucacuguccuuacuugg

SEQ ID NO: 1345966 - RNA, 20 nt, Human
uucuucagcuguaaaaugga

SEQ ID NO: 1345967 - RNA, 20 nt, Human
uugccuucaguguguuagaa

SEQ ID NO: 1345968 - RNA, 18 nt, Human
uugguuuucuugugagag

SEQ ID NO: 1345969 - RNA, 21 nt, Human
uuguuucaauggacagaaagg

SEQ ID NO: 1345970 - RNA, 23 nt, Human
uuuuccuguccuuccuaauaccc

SEQ ID NO: 1345971 - RNA, 20 nt, Human
uuuugguuuucuugugagag

SEQ ID NO: 1345972 - RNA, 19 nt, Human
aaacacaacagacuucaca

SEQ ID NO: 1345973 - RNA, 19 nt, Human
accucgagaggcccccgag

SEQ ID NO: 1345974 - RNA, 21 nt, Human
accuucccagagaggggccag

SEQ ID NO: 1345975 - RNA, 26 nt, Human
acucugagaagcucaaacacaacaga

SEQ ID NO: 1345976 - RNA, 21 nt, Human
agagaggggccaggccuggca

SEQ ID NO: 1345977 - RNA, 18 nt, Human
agccuggggcacggacag

SEQ ID NO: 1345978 - RNA, 19 nt, Human
aggaaggaaaaggagucau

SEQ ID NO: 1345979 - RNA, 22 nt, Human
aggccucuguuucugggcccag

SEQ ID NO: 1345980 - RNA, 23 nt, Human
aggggccaggccuggcagcccug

SEQ ID NO: 1345981 - RNA, 22 nt, Human
caacccccaggccccggccccc

SEQ ID NO: 1345982 - RNA, 20 nt, Human
caaccuucccagagaggggc

SEQ ID NO: 1345983 - RNA, 18 nt, Human
cacccggggagguuucuc

SEQ ID NO: 1345984 - RNA, 19 nt, Human
cagaagggagcuggcgucg

SEQ ID NO: 1345985 - RNA, 19 nt, Human
cagacaggagcugagguag

SEQ ID NO: 1345986 - RNA, 21 nt, Human
caggccccggccccccagaag

SEQ ID NO: 1345987 - RNA, 20 nt, Human
caguaggcgaucaucaggug

SEQ ID NO: 1345988 - RNA, 22 nt, Human
cccagggugguugaggacucac

SEQ ID NO: 1345989 - RNA, 20 nt, Human
ccccagauagcucucccagc

SEQ ID NO: 1345990 - RNA, 23 nt, Human
cccgcagacaguaggcgaucauc

SEQ ID NO: 1345991 - RNA, 22 nt, Human
cccuccccagauagcucuccca

SEQ ID NO: 1345992 - RNA, 18 nt, Human
cgccccucccuccucccc

SEQ ID NO: 1345993 - RNA, 22 nt, Human
cgccuccuaagcagucaaccuu

SEQ ID NO: 1345994 - RNA, 19 nt, Human
cggccuccucucccccucc

SEQ ID NO: 1345995 - RNA, 20 nt, Human
cuccccucggcaggccucug

SEQ ID NO: 1345996 - RNA, 18 nt, Human
cucggccuccucuccccc

SEQ ID NO: 1345997 - RNA, 25 nt, Human
cucggccuccucucccccuccccag

SEQ ID NO: 1345998 - RNA, 27 nt, Human
cucugggguguauucugcucggccucc

SEQ ID NO: 1345999 - RNA, 26 nt, Human
cugagguagggguuggagaggcugac

SEQ ID NO: 1346000 - RNA, 18 nt, Human
gacagggcugcccgucuc

SEQ ID NO: 1346001 - RNA, 21 nt, Human
gcaggccucuguuucugggcc

SEQ ID NO: 1346002 - RNA, 21 nt, Human
gcccagggugguugaggacuc

SEQ ID NO: 1346003 - RNA, 22 nt, Human
gcgccuccuaagcagucaaccu

SEQ ID NO: 1346004 - RNA, 19 nt, Human
ggaaaaggagucauuccac

SEQ ID NO: 1346005 - RNA, 19 nt, Human
ggagcugagguagggguug

SEQ ID NO: 1346006 - RNA, 24 nt, Human
ggccaggaaggaaaaggagucauu

SEQ ID NO: 1346007 - RNA, 25 nt, Human
ggcgccccucccuccuccccugccc

SEQ ID NO: 1346008 - RNA, 26 nt, Human
gggagcgggucuggaagggggucgcg

SEQ ID NO: 1346009 - RNA, 23 nt, Human
ggguggacagaggccaggcuccu

SEQ ID NO: 1346010 - RNA, 20 nt, Human
ggucuggaagggggucgcgg

SEQ ID NO: 1346011 - RNA, 23 nt, Human
uaacaaacgguguaaaaaaccag

SEQ ID NO: 1346012 - RNA, 23 nt, Human
ucaaccuucccagagaggggcca

SEQ ID NO: 1346013 - RNA, 18 nt, Human
ucacugagggagagcagg

SEQ ID NO: 1346014 - RNA, 18 nt, Human
ucagcucucaaccuuccc

SEQ ID NO: 1346015 - RNA, 22 nt, Human
uccacucugagaagcucaaaca

SEQ ID NO: 1346016 - RNA, 23 nt, Human
uccccagauagcucucccagccu

SEQ ID NO: 1346017 - RNA, 21 nt, Human
uccucucccccuccccagaua

SEQ ID NO: 1346018 - RNA, 27 nt, Human
ugagaagcucaaacacaacagacuuca

SEQ ID NO: 1346019 - RNA, 21 nt, Human
ugagguagggguuggagaggc

SEQ ID NO: 1346020 - RNA, 21 nt, Human
ugcaccggucgccuuuggucc

SEQ ID NO: 1346021 - RNA, 22 nt, Human
ugcagacaggagcugagguagg

SEQ ID NO: 1346022 - RNA, 20 nt, Human
ugcccuggcugucagucugu

SEQ ID NO: 1346023 - RNA, 18 nt, Human
ugcucggccuccucuccc

SEQ ID NO: 1346024 - RNA, 18 nt, Human
uggaggaagggacagggc

SEQ ID NO: 1346025 - RNA, 20 nt, Human
uggaggaagggacagggcug

SEQ ID NO: 1346026 - RNA, 20 nt, Human
ugggguguauucugcucggc

SEQ ID NO: 1346027 - RNA, 21 nt, Human
uuggagaggcugaccucgaga

SEQ ID NO: 1346028 - RNA, 21 nt, Human
aaaaaucaucuccuaugaacc

SEQ ID NO: 1346029 - RNA, 21 nt, Human
aaaaccacaggccaccgcccu

SEQ ID NO: 1346030 - RNA, 26 nt, Human
aaaagaaagcagaacucauuuagcaa

SEQ ID NO: 1346031 - RNA, 19 nt, Human
aaaccaggggcagaggagg

SEQ ID NO: 1346032 - RNA, 24 nt, Human
aacaaauaaaacauauuuuucuca

SEQ ID NO: 1346033 - RNA, 22 nt, Human
aacaagagcaaaacuacaucua

SEQ ID NO: 1346034 - RNA, 18 nt, Human
aacacucucaccaaugaa

SEQ ID NO: 1346035 - RNA, 19 nt, Human
aacauagugaaaccccauc

SEQ ID NO: 1346036 - RNA, 20 nt, Human
aacauagugaaaccccaucu

SEQ ID NO: 1346037 - RNA, 20 nt, Human
aacauagugaaaccccaucu

SEQ ID NO: 1346038 - RNA, 21 nt, Human
aacauagugaaaccccaucuc

SEQ ID NO: 1346039 - RNA, 25 nt, Human
aacugcaccauugcacuccagccug

SEQ ID NO: 1346040 - RNA, 26 nt, Human
aagaaaaaaaaaauuugguucuuuga

SEQ ID NO: 1346041 - RNA, 25 nt, Human
aagcauuucaaacagaacaguguuc

SEQ ID NO: 1346042 - RNA, 24 nt, Human
aaucacuugaacccaggaggcgga

SEQ ID NO: 1346043 - RNA, 21 nt, Human
acauccaaccagcacaccuaa

SEQ ID NO: 1346044 - RNA, 20 nt, Human
acauuauaaaaaccauaaag

SEQ ID NO: 1346045 - RNA, 22 nt, Human
accauugcacuccagccugggc

SEQ ID NO: 1346046 - RNA, 25 nt, Human
accauugcacuccagccugggcaac

SEQ ID NO: 1346047 - RNA, 24 nt, Human
acccaggaggcggagguugcagug

SEQ ID NO: 1346048 - RNA, 24 nt, Human
accccaucucuacuaaaaauacaa

SEQ ID NO: 1346049 - RNA, 28 nt, Human
acugcaccauugcacuccagccugggca

SEQ ID NO: 1346050 - RNA, 19 nt, Human
agaaagcauuucaaacaga

SEQ ID NO: 1346051 - RNA, 23 nt, Human
agaaggaagugacuugugcaagg

SEQ ID NO: 1346052 - RNA, 22 nt, Human
agaaucacuugaacccaggagg

SEQ ID NO: 1346053 - RNA, 20 nt, Human
agagcaaaacuacaucuaaa

SEQ ID NO: 1346054 - RNA, 24 nt, Human
agcacuuugggaggccgaggcagg

SEQ ID NO: 1346055 - RNA, 23 nt, Human
agccaggcgugguggcaggugcc

SEQ ID NO: 1346056 - RNA, 23 nt, Human
aggaguucgagacuagccugacc

SEQ ID NO: 1346057 - RNA, 18 nt, Human
aggcaggagaaucacuug

SEQ ID NO: 1346058 - RNA, 23 nt, Human
aggcaggagaaucacuugaaccc

SEQ ID NO: 1346059 - RNA, 24 nt, Human
aggcaggagaaucacuugaaccca

SEQ ID NO: 1346060 - RNA, 18 nt, Human
aggcaggcggaucaccug

SEQ ID NO: 1346061 - RNA, 22 nt, Human
aggcaggcggaucaccugaggu

SEQ ID NO: 1346062 - RNA, 26 nt, Human
aggcaggcggaucaccugaggucagg

SEQ ID NO: 1346063 - RNA, 24 nt, Human
aggccaggugcaguggcucaagcc

SEQ ID NO: 1346064 - RNA, 21 nt, Human
aggccgaggcaggcggaucac

SEQ ID NO: 1346065 - RNA, 19 nt, Human
aggcggagguugcagugag

SEQ ID NO: 1346066 - RNA, 23 nt, Human
aggcggagguugcagugagucaa

SEQ ID NO: 1346067 - RNA, 24 nt, Human
aggcgugguggcaggugccuguaa

SEQ ID NO: 1346068 - RNA, 24 nt, Human
aggcugaggcaggagaaucacuug

SEQ ID NO: 1346069 - RNA, 18 nt, Human
aggucaggaguucgagac

SEQ ID NO: 1346070 - RNA, 24 nt, Human
aggugcaguggcucaagccucuaa

SEQ ID NO: 1346071 - RNA, 22 nt, Human
agguuaaaagaacacucucacc

SEQ ID NO: 1346072 - RNA, 24 nt, Human
aguggcucaagccucuaaucccag

SEQ ID NO: 1346073 - RNA, 25 nt, Human
aguguccgauugcaggccugugaga

SEQ ID NO: 1346074 - RNA, 21 nt, Human
auacugcauuauaaauccaga

SEQ ID NO: 1346075 - RNA, 23 nt, Human
auacugcauuauaaauccagaga

SEQ ID NO: 1346076 - RNA, 25 nt, Human
aucuuguuuaaucucuuuuuuuuuu

SEQ ID NO: 1346077 - RNA, 25 nt, Human
auguugggcccugauaaaaaugguu

SEQ ID NO: 1346078 - RNA, 24 nt, Human
auugcacuccagccugggcaacaa

SEQ ID NO: 1346079 - RNA, 25 nt, Human
auugcacuccagccugggcaacaag

SEQ ID NO: 1346080 - RNA, 21 nt, Human
caaaugaauacauuucacuug

SEQ ID NO: 1346081 - RNA, 21 nt, Human
caacaagagcaaaacuacauc

SEQ ID NO: 1346082 - RNA, 27 nt, Human
caacaagagcaaaacuacaucuaaaaa

SEQ ID NO: 1346083 - RNA, 20 nt, Human
caaccagcacaccuaacgca

SEQ ID NO: 1346084 - RNA, 23 nt, Human
caagccaacaaauaaaacauauu

SEQ ID NO: 1346085 - RNA, 19 nt, Human
caagccucuaaucccagca

SEQ ID NO: 1346086 - RNA, 24 nt, Human
caagccucuaaucccagcacuuug

SEQ ID NO: 1346087 - RNA, 23 nt, Human
caccugaggucaggaguucgaga

SEQ ID NO: 1346088 - RNA, 24 nt, Human
cacuccagccugggcaacaagagc

SEQ ID NO: 1346089 - RNA, 21 nt, Human
cacuugaaaaaaagcuccuuu

SEQ ID NO: 1346090 - RNA, 24 nt, Human
cagcacuuugggaggccgaggcag

SEQ ID NO: 1346091 - RNA, 26 nt, Human
cagcacuuugggaggccgaggcaggc

SEQ ID NO: 1346092 - RNA, 24 nt, Human
cagcccaggcugggcaaacaacag

SEQ ID NO: 1346093 - RNA, 24 nt, Human
cagcuacucgggaggcugaggcag

SEQ ID NO: 1346094 - RNA, 24 nt, Human
caggcggaucaccugaggucagga

SEQ ID NO: 1346095 - RNA, 21 nt, Human
caguguccgauugcaggccug

SEQ ID NO: 1346096 - RNA, 24 nt, Human
cauuauaaauccagagacaugagg

SEQ ID NO: 1346097 - RNA, 19 nt, Human
cauugcacuccagccuggg

SEQ ID NO: 1346098 - RNA, 21 nt, Human
cauugcacuccagccugggca

SEQ ID NO: 1346099 - RNA, 22 nt, Human
ccaaaaagaaagcagaacucau

SEQ ID NO: 1346100 - RNA, 25 nt, Human
ccacacagagacaguguccgauugc

SEQ ID NO: 1346101 - RNA, 24 nt, Human
ccacccgggguagaaaccacagcc

SEQ ID NO: 1346102 - RNA, 26 nt, Human
ccagcacaccuaacgcaaaguaugac

SEQ ID NO: 1346103 - RNA, 20 nt, Human
ccauugcacuccagccuggg

SEQ ID NO: 1346104 - RNA, 20 nt, Human
ccauugcacuccagccuggg

SEQ ID NO: 1346105 - RNA, 21 nt, Human
ccauugcacuccagccugggc

SEQ ID NO: 1346106 - RNA, 23 nt, Human
ccauugcacuccagccugggcaa

SEQ ID NO: 1346107 - RNA, 24 nt, Human
ccauugcacuccagccugggcaac

SEQ ID NO: 1346108 - RNA, 25 nt, Human
ccauugcacuccagccugggcaaca

SEQ ID NO: 1346109 - RNA, 24 nt, Human
ccugaccaacauagugaaacccca

SEQ ID NO: 1346110 - RNA, 22 nt, Human
ccugaggucaggaguucgagac

SEQ ID NO: 1346111 - RNA, 19 nt, Human
ccuguaauuccagcuacuc

SEQ ID NO: 1346112 - RNA, 21 nt, Human
ccuguaauuccagcuacucgg

SEQ ID NO: 1346113 - RNA, 23 nt, Human
cgaacuagguaauaaaaucuguu

SEQ ID NO: 1346114 - RNA, 24 nt, Human
cgagacuagccugaccaacauagu

SEQ ID NO: 1346115 - RNA, 26 nt, Human
cgaggcaggcggaucaccugagguca

SEQ ID NO: 1346116 - RNA, 24 nt, Human
cggaucaccugaggucaggaguuc

SEQ ID NO: 1346117 - RNA, 27 nt, Human
cggaucaccugaggucaggaguucgag

SEQ ID NO: 1346118 - RNA, 24 nt, Human
cgggaggcugaggcaggagaauca

SEQ ID NO: 1346119 - RNA, 22 nt, Human
cgggguagaaaccacagccacu

SEQ ID NO: 1346120 - RNA, 21 nt, Human
cgugacaagugaaaacugcuu

SEQ ID NO: 1346121 - RNA, 24 nt, Human
cucaagccucuaaucccagcacuu

SEQ ID NO: 1346122 - RNA, 31 nt, Human
cugcaccauugcacuccagccugggcaacaa

SEQ ID NO: 1346123 - RNA, 21 nt, Human
cugcugcuuucuagcagccca

SEQ ID NO: 1346124 - RNA, 26 nt, Human
cuucaggaaagaaaaacagacuauuc

SEQ ID NO: 1346125 - RNA, 20 nt, Human
cuuuucggcaauuucuccaa

SEQ ID NO: 1346126 - RNA, 20 nt, Human
gaaagcauuucaaacagaag

SEQ ID NO: 1346127 - RNA, 23 nt, Human
gaaguuccugcacauccaaccag

SEQ ID NO: 1346128 - RNA, 19 nt, Human
gaauacauuucacuugaaa

SEQ ID NO: 1346129 - RNA, 19 nt, Human
gagaaaauugaggcucaga

SEQ ID NO: 1346130 - RNA, 18 nt, Human
gaggaggaacuuacagua

SEQ ID NO: 1346131 - RNA, 19 nt, Human
gaggcaggcggaucaccug

SEQ ID NO: 1346132 - RNA, 18 nt, Human
gagguugcagugagucaa

SEQ ID NO: 1346133 - RNA, 24 nt, Human
gaucaccugaggucaggaguucga

SEQ ID NO: 1346134 - RNA, 22 nt, Human
gcaggagaaucacuugaaccca

SEQ ID NO: 1346135 - RNA, 21 nt, Human
gcccaggcugggcaaacaaca

SEQ ID NO: 1346136 - RNA, 22 nt, Human
gcccuaggauccugccuggugc

SEQ ID NO: 1346137 - RNA, 19 nt, Human
gcgacugcagccucaagug

SEQ ID NO: 1346138 - RNA, 21 nt, Human
ggaggcggagguugcagugag

SEQ ID NO: 1346139 - RNA, 18 nt, Human
ggagguugcagugaguca

SEQ ID NO: 1346140 - RNA, 24 nt, Human
ggagguugcagugagucaaaacug

SEQ ID NO: 1346141 - RNA, 22 nt, Human
ggaucaccugaggucaggaguu

SEQ ID NO: 1346142 - RNA, 23 nt, Human
ggaucaccugaggucaggaguuc

SEQ ID NO: 1346143 - RNA, 23 nt, Human
guggcaggugccuguaauuccag

SEQ ID NO: 1346144 - RNA, 20 nt, Human
guucaagaccaaaauuugac

SEQ ID NO: 1346145 - RNA, 20 nt, Human
uaaaaauacaaaauuagcca

SEQ ID NO: 1346146 - RNA, 22 nt, Human
uaaaaauacaaaauuagccagg

SEQ ID NO: 1346147 - RNA, 23 nt, Human
uaaaaauacaaaauuagccaggc

SEQ ID NO: 1346148 - RNA, 23 nt, Human
uaaaaccuagucugaucuaaagc

SEQ ID NO: 1346149 - RNA, 18 nt, Human
uaaaagaacacucucacc

SEQ ID NO: 1346150 - RNA, 23 nt, Human
uaacgcagaauaagaggcgcccu

SEQ ID NO: 1346151 - RNA, 20 nt, Human
uaacuaaaaggaagcggcaa

SEQ ID NO: 1346152 - RNA, 22 nt, Human
uaagcuaaaucuauaggccuca

SEQ ID NO: 1346153 - RNA, 18 nt, Human
uagcagcccaggcugggc

SEQ ID NO: 1346154 - RNA, 20 nt, Human
uagcaguuccaaaaagaaag

SEQ ID NO: 1346155 - RNA, 18 nt, Human
uauaacuuuugggggagg

SEQ ID NO: 1346156 - RNA, 21 nt, Human
uauaauacaauacauuaaccu

SEQ ID NO: 1346157 - RNA, 20 nt, Human
uauccagaagugccgcggga

SEQ ID NO: 1346158 - RNA, 20 nt, Human
ucaaacagaacaguguucuc

SEQ ID NO: 1346159 - RNA, 20 nt, Human
ucaccugaggucaggaguuc

SEQ ID NO: 1346160 - RNA, 19 nt, Human
uccuuaaagaaaaaaaaaa

SEQ ID NO: 1346161 - RNA, 25 nt, Human
ucgggaggcugaggcaggagaauca

SEQ ID NO: 1346162 - RNA, 23 nt, Human
ucuaaagcaucuuauccaugguu

SEQ ID NO: 1346163 - RNA, 18 nt, Human
ucuagcagcccaggcugg

SEQ ID NO: 1346164 - RNA, 19 nt, Human
ucuccauuaugacaaauug

SEQ ID NO: 1346165 - RNA, 20 nt, Human
ucucuacuaaaaauacaaaa

SEQ ID NO: 1346166 - RNA, 20 nt, Human
ucuguaauuggaugucugug

SEQ ID NO: 1346167 - RNA, 24 nt, Human
ucuuaagcuaaaucuauaggccuc

SEQ ID NO: 1346168 - RNA, 23 nt, Human
ucuuucuguaauuggaugucugu

SEQ ID NO: 1346169 - RNA, 23 nt, Human
ucuuuuuuuuuuucacacuugau

SEQ ID NO: 1346170 - RNA, 19 nt, Human
ugaaaccccaucucuacua

SEQ ID NO: 1346171 - RNA, 30 nt, Human
ugaauacauuucacuugaaaaaaagcuccu

SEQ ID NO: 1346172 - RNA, 20 nt, Human
ugaggcaggagaaucacuug

SEQ ID NO: 1346173 - RNA, 24 nt, Human
ugaggcaggagaaucacuugaacc

SEQ ID NO: 1346174 - RNA, 25 nt, Human
ugaggcaggagaaucacuugaaccc

SEQ ID NO: 1346175 - RNA, 20 nt, Human
ugagucuggaagggucuggg

SEQ ID NO: 1346176 - RNA, 19 nt, Human
ugauaaaaggaaggaaaaa

SEQ ID NO: 1346177 - RNA, 21 nt, Human
ugcaccauugcacuccagccu

SEQ ID NO: 1346178 - RNA, 19 nt, Human
ugcacuccagccugggcaa

SEQ ID NO: 1346179 - RNA, 22 nt, Human
ugccuggugcccugcagugccc

SEQ ID NO: 1346180 - RNA, 24 nt, Human
ugccuguaauuccagcuacucggg

SEQ ID NO: 1346181 - RNA, 24 nt, Human
ugcuuucuagcagcccaggcuggg

SEQ ID NO: 1346182 - RNA, 21 nt, Human
uggaagggucugggaccuggg

SEQ ID NO: 1346183 - RNA, 22 nt, Human
uggcaggugccuguaauuccag

SEQ ID NO: 1346184 - RNA, 22 nt, Human
uggcucaagccucuaaucccag

SEQ ID NO: 1346185 - RNA, 24 nt, Human
uggcucaagccucuaaucccagca

SEQ ID NO: 1346186 - RNA, 20 nt, Human
uggcucgguccaaucaauaa

SEQ ID NO: 1346187 - RNA, 19 nt, Human
ugggaccuggggguaucca

SEQ ID NO: 1346188 - RNA, 20 nt, Human
ugggaggccgaggcaggcgg

SEQ ID NO: 1346189 - RNA, 24 nt, Human
ugggaggccgaggcaggcggauca

SEQ ID NO: 1346190 - RNA, 19 nt, Human
ugggcccugauaaaaaugg

SEQ ID NO: 1346191 - RNA, 24 nt, Human
ugguggcaggugccuguaauucca

SEQ ID NO: 1346192 - RNA, 22 nt, Human
ugguucaagaccaaaauuugac

SEQ ID NO: 1346193 - RNA, 19 nt, Human
uguaaacucagccuucuug

SEQ ID NO: 1346194 - RNA, 21 nt, Human
uuaaugauuaaaaccuagucu

SEQ ID NO: 1346195 - RNA, 23 nt, Human
uuccaaaaagaaagcagaacuca

SEQ ID NO: 1346196 - RNA, 19 nt, Human
uucuguuucugaaacucgu

SEQ ID NO: 1346197 - RNA, 24 nt, Human
uugaacccaggaggcggagguugc

SEQ ID NO: 1346198 - RNA, 22 nt, Human
uugcagugagucaaaacugcac

SEQ ID NO: 1346199 - RNA, 25 nt, Human
uugggaggccgaggcaggcggauca

SEQ ID NO: 1346200 - RNA, 18 nt, Human
uuuccuguccauuugcug

SEQ ID NO: 1346201 - RNA, 23 nt, Human
uuuccuguccauuugcugagguc

SEQ ID NO: 1346202 - RNA, 20 nt, Human
uuucuagcagcccaggcugg

SEQ ID NO: 1346203 - RNA, 22 nt, Human
aaacacacauggacaguaagac

SEQ ID NO: 1346204 - RNA, 24 nt, Human
aaacacacccaccgcagggacccc

SEQ ID NO: 1346205 - RNA, 22 nt, Human
aagcgccugcccaggccagucc

SEQ ID NO: 1346206 - RNA, 20 nt, Human
acaaagucaagaggaaggag

SEQ ID NO: 1346207 - RNA, 23 nt, Human
accagguuucagaccacaaaguc

SEQ ID NO: 1346208 - RNA, 20 nt, Human
agacaccuggucuggguccc

SEQ ID NO: 1346209 - RNA, 19 nt, Human
agaggaaggugcugagcac

SEQ ID NO: 1346210 - RNA, 19 nt, Human
agcugacugcagacaccug

SEQ ID NO: 1346211 - RNA, 19 nt, Human
aggaauaaccgcagucacc

SEQ ID NO: 1346212 - RNA, 21 nt, Human
aggaauaaccgcagucaccgu

SEQ ID NO: 1346213 - RNA, 19 nt, Human
aggcgugcccauggccguc

SEQ ID NO: 1346214 - RNA, 23 nt, Human
agggggucagcagucgguaaagc

SEQ ID NO: 1346215 - RNA, 22 nt, Human
agucaagaggaaggaggaccuu

SEQ ID NO: 1346216 - RNA, 21 nt, Human
augcucaaaguucaaacggcc

SEQ ID NO: 1346217 - RNA, 21 nt, Human
augugaucugucccugugacu

SEQ ID NO: 1346218 - RNA, 18 nt, Human
caaaggaggaaaaugugg

SEQ ID NO: 1346219 - RNA, 19 nt, Human
cacacauggacaguaagac

SEQ ID NO: 1346220 - RNA, 23 nt, Human
caccagaguugccacucugggga

SEQ ID NO: 1346221 - RNA, 21 nt, Human
cacccaccgcagggaccccgg

SEQ ID NO: 1346222 - RNA, 25 nt, Human
cacccgagaccccggccuccccggg

SEQ ID NO: 1346223 - RNA, 19 nt, Human
cagcaccguauggacuggc

SEQ ID NO: 1346224 - RNA, 22 nt, Human
cagcacgcacgcuccagucccc

SEQ ID NO: 1346225 - RNA, 19 nt, Human
caggagcugacugcagaca

SEQ ID NO: 1346226 - RNA, 24 nt, Human
cagguuucagaccacaaagucaag

SEQ ID NO: 1346227 - RNA, 21 nt, Human
caguaagaccagguuucagac

SEQ ID NO: 1346228 - RNA, 18 nt, Human
cauccucgugcuaugggg

SEQ ID NO: 1346229 - RNA, 22 nt, Human
ccaaacacacauggacaguaag

SEQ ID NO: 1346230 - RNA, 19 nt, Human
ccacccugaccauccgggc

SEQ ID NO: 1346231 - RNA, 21 nt, Human
ccaguccgaaacacacccacc

SEQ ID NO: 1346232 - RNA, 21 nt, Human
cccacaggccccaaccucacc

SEQ ID NO: 1346233 - RNA, 23 nt, Human
cccacccugaccauccgggccca

SEQ ID NO: 1346234 - RNA, 19 nt, Human
ccccggccuccccgggccc

SEQ ID NO: 1346235 - RNA, 19 nt, Human
cccgcacgcguugcgcaua

SEQ ID NO: 1346236 - RNA, 23 nt, Human
cccgcacgcguugcgcauaccuc

SEQ ID NO: 1346237 - RNA, 19 nt, Human
ccgcagggaccccguccag

SEQ ID NO: 1346238 - RNA, 19 nt, Human
ccuccaggaauaaccgcag

SEQ ID NO: 1346239 - RNA, 24 nt, Human
ccugggccggcggccacccgagac

SEQ ID NO: 1346240 - RNA, 22 nt, Human
cgaaacacacccaccgcaggga

SEQ ID NO: 1346241 - RNA, 20 nt, Human
cggcagcagcagcagggcag

SEQ ID NO: 1346242 - RNA, 20 nt, Human
cggcccacaggccccaaccu

SEQ ID NO: 1346243 - RNA, 21 nt, Human
cggcccacaggccccaaccuc

SEQ ID NO: 1346244 - RNA, 23 nt, Human
cgugcccauggccgucccugcuc

SEQ ID NO: 1346245 - RNA, 23 nt, Human
cguggccaggcgugcccauggcc

SEQ ID NO: 1346246 - RNA, 25 nt, Human
cguugcgcauaccucagcacgcacg

SEQ ID NO: 1346247 - RNA, 23 nt, Human
cuccaggaauaaccgcagucacc

SEQ ID NO: 1346248 - RNA, 30 nt, Human
cuccucgagaggaaggugcugagcaccucu

SEQ ID NO: 1346249 - RNA, 21 nt, Human
cugaccauccgggcccaaaca

SEQ ID NO: 1346250 - RNA, 23 nt, Human
cugcuccccacccugaccauccg

SEQ ID NO: 1346251 - RNA, 18 nt, Human
gaaacacacccaccgcag

SEQ ID NO: 1346252 - RNA, 25 nt, Human
gaaacacacccaccgcagggacccc

SEQ ID NO: 1346253 - RNA, 18 nt, Human
gcagcagcagcagggcag

SEQ ID NO: 1346254 - RNA, 21 nt, Human
gcagcagcagcagggcaggac

SEQ ID NO: 1346255 - RNA, 22 nt, Human
gcaugucugccgaccuccagga

SEQ ID NO: 1346256 - RNA, 18 nt, Human
gccacgccccucugccau

SEQ ID NO: 1346257 - RNA, 20 nt, Human
gccagcugugucucaggagc

SEQ ID NO: 1346258 - RNA, 18 nt, Human
gcccaggcaacacauccu

SEQ ID NO: 1346259 - RNA, 20 nt, Human
ggaaaccccugauguaacac

SEQ ID NO: 1346260 - RNA, 21 nt, Human
ggccacaggaaaccccugaug

SEQ ID NO: 1346261 - RNA, 28 nt, Human
uaagaccagguuucagaccacaaaguca

SEQ ID NO: 1346262 - RNA, 18 nt, Human
uagcaccacgccacgccc

SEQ ID NO: 1346263 - RNA, 25 nt, Human
ucccugcuccccacccugaccaucc

SEQ ID NO: 1346264 - RNA, 24 nt, Human
ucccugugacuggucacauugccu

SEQ ID NO: 1346265 - RNA, 21 nt, Human
uccgggcccaaacacacaugg

SEQ ID NO: 1346266 - RNA, 22 nt, Human
uccucggugugucugccccuuu

SEQ ID NO: 1346267 - RNA, 24 nt, Human
ucggugugucugccccuuuucugu

SEQ ID NO: 1346268 - RNA, 18 nt, Human
ucugggucccucaagccc

SEQ ID NO: 1346269 - RNA, 22 nt, Human
ugacagcaccguauggacuggc

SEQ ID NO: 1346270 - RNA, 19 nt, Human
ugaccauccgggcccaaac

SEQ ID NO: 1346271 - RNA, 19 nt, Human
ugacugcagacaccugguc

SEQ ID NO: 1346272 - RNA, 19 nt, Human
ugccacuggcuguuccugg

SEQ ID NO: 1346273 - RNA, 18 nt, Human
ugcucaaaguucaaacgg

SEQ ID NO: 1346274 - RNA, 22 nt, Human
uggcagcacaagcgccugccca

SEQ ID NO: 1346275 - RNA, 19 nt, Human
uggcccagggggucagcag

SEQ ID NO: 1346276 - RNA, 25 nt, Human
ugucugccccuuuucuguccagcug

SEQ ID NO: 1346277 - RNA, 23 nt, Human
uuuucuguccagcugucaggugg

SEQ ID NO: 1346278 - RNA, 22 nt, Human
aaccugaaaaaggaggcacagg

SEQ ID NO: 1346279 - RNA, 20 nt, Human
aagaaccagcccauugucuc

SEQ ID NO: 1346280 - RNA, 19 nt, Human
accaggggaaggcucacca

SEQ ID NO: 1346281 - RNA, 19 nt, Human
agagagagagaaaugaaac

SEQ ID NO: 1346282 - RNA, 19 nt, Human
agcaaggaagguuggucac

SEQ ID NO: 1346283 - RNA, 18 nt, Human
aggacaggagagaccuga

SEQ ID NO: 1346284 - RNA, 24 nt, Human
aggcacaggacuguguggcagggg

SEQ ID NO: 1346285 - RNA, 25 nt, Human
aggggugauaggugggugguggggg

SEQ ID NO: 1346286 - RNA, 19 nt, Human
agguggguggugggggcug

SEQ ID NO: 1346287 - RNA, 21 nt, Human
auaaaacacaguuccuccccu

SEQ ID NO: 1346288 - RNA, 24 nt, Human
caaccaaguagcaaggauagacau

SEQ ID NO: 1346289 - RNA, 19 nt, Human
cacguggucccaggacacc

SEQ ID NO: 1346290 - RNA, 27 nt, Human
cacugcugagaaacagaggacauagag

SEQ ID NO: 1346291 - RNA, 24 nt, Human
caucccaaccugaaaaaggaggca

SEQ ID NO: 1346292 - RNA, 21 nt, Human
ccaaccugaaaaaggaggcac

SEQ ID NO: 1346293 - RNA, 18 nt, Human
cccauugucucaccuggc

SEQ ID NO: 1346294 - RNA, 20 nt, Human
ccugaaaaaggaggcacagg

SEQ ID NO: 1346295 - RNA, 19 nt, Human
cugaaaaaggaggcacagg

SEQ ID NO: 1346296 - RNA, 20 nt, Human
cugacaggggagggaaagca

SEQ ID NO: 1346297 - RNA, 21 nt, Human
cugucccagcccagcagguca

SEQ ID NO: 1346298 - RNA, 18 nt, Human
gaagaaaucuggacucag

SEQ ID NO: 1346299 - RNA, 18 nt, Human
gacuguguggcaggggag

SEQ ID NO: 1346300 - RNA, 19 nt, Human
gacuguguggcaggggagg

SEQ ID NO: 1346301 - RNA, 18 nt, Human
gauagguggguggugggg

SEQ ID NO: 1346302 - RNA, 18 nt, Human
gaucaucccaaccugaaa

SEQ ID NO: 1346303 - RNA, 22 nt, Human
gauggcagcagauaucuguggg

SEQ ID NO: 1346304 - RNA, 18 nt, Human
gccaggcagacaccaggg

SEQ ID NO: 1346305 - RNA, 19 nt, Human
gcugagaaacagaggacau

SEQ ID NO: 1346306 - RNA, 18 nt, Human
ggagagaagaaaucugga

SEQ ID NO: 1346307 - RNA, 18 nt, Human
ggaggagggcaaaaggug

SEQ ID NO: 1346308 - RNA, 21 nt, Human
ggcaaaagguguugagccaag

SEQ ID NO: 1346309 - RNA, 23 nt, Human
gggaaggcucaccaggcagaggg

SEQ ID NO: 1346310 - RNA, 19 nt, Human
gggaauggagagagagaga

SEQ ID NO: 1346311 - RNA, 25 nt, Human
ggugaggggugauagguggguggug

SEQ ID NO: 1346312 - RNA, 23 nt, Human
ggugauagguggguggugggggc

SEQ ID NO: 1346313 - RNA, 19 nt, Human
gguggugggggcugccagg

SEQ ID NO: 1346314 - RNA, 18 nt, Human
gucacguugaccugaguu

SEQ ID NO: 1346315 - RNA, 19 nt, Human
guggcaggggaggagggca

SEQ ID NO: 1346316 - RNA, 21 nt, Human
guuuauguguaagcaaggaag

SEQ ID NO: 1346317 - RNA, 19 nt, Human
uauauacaaguuuaugugu

SEQ ID NO: 1346318 - RNA, 23 nt, Human
ucaguagaacccauuaaauuuca

SEQ ID NO: 1346319 - RNA, 22 nt, Human
uccaagggagaggaaguaagga

SEQ ID NO: 1346320 - RNA, 20 nt, Human
ucccaaccugaaaaaggagg

SEQ ID NO: 1346321 - RNA, 24 nt, Human
ucuucauucauuuauucauccauu

SEQ ID NO: 1346322 - RNA, 20 nt, Human
ugaaacaagaaccagcccau

SEQ ID NO: 1346323 - RNA, 21 nt, Human
ugaaacaagaaccagcccauu

SEQ ID NO: 1346324 - RNA, 24 nt, Human
ugacaggggagggaaagcagucuc

SEQ ID NO: 1346325 - RNA, 22 nt, Human
ugagaaacagaggacauagaga

SEQ ID NO: 1346326 - RNA, 19 nt, Human
ugagccaagcuggaugguu

SEQ ID NO: 1346327 - RNA, 21 nt, Human
ugaguuuggaggcccuuggag

SEQ ID NO: 1346328 - RNA, 19 nt, Human
ugccaggcagacaccaggg

SEQ ID NO: 1346329 - RNA, 24 nt, Human
uggaggcccuuggaggauguuggc

SEQ ID NO: 1346330 - RNA, 21 nt, Human
uggcaggggaggagggcaaaa

SEQ ID NO: 1346331 - RNA, 18 nt, Human
ugggggcugccaggcaga

SEQ ID NO: 1346332 - RNA, 28 nt, Human
uggguggugggggcugccaggcagacac

SEQ ID NO: 1346333 - RNA, 18 nt, Human
uguccagcuaugaguuug

SEQ ID NO: 1346334 - RNA, 19 nt, Human
uguggcaggggaggagggc

SEQ ID NO: 1346335 - RNA, 24 nt, Human
uucauucauuuauucauccauuuc

SEQ ID NO: 1346336 - RNA, 22 nt, Human
uuuuuggaucucuucauucauu

SEQ ID NO: 1346337 - RNA, 19 nt, Human
uuuuuuuuuuuuggaucuc

SEQ ID NO: 1346338 - RNA, 18 nt, Human
uuuuuuuuuuuuuuuuug

SEQ ID NO: 1346339 - RNA, 18 nt, Human
uuuuuuuuuuuuuuuuug

SEQ ID NO: 1346340 - RNA, 19 nt, Human
acaucagggaaaauggggu

SEQ ID NO: 1346341 - RNA, 18 nt, Human
acauguauauauucauga

SEQ ID NO: 1346342 - RNA, 21 nt, Human
auggagccugcggcagucacc

SEQ ID NO: 1346343 - RNA, 19 nt, Human
cacccgggacucuccgagc

SEQ ID NO: 1346344 - RNA, 20 nt, Human
cacccgggacucuccgagcc

SEQ ID NO: 1346345 - RNA, 23 nt, Human
ccagcguccucccuauaaaucuc

SEQ ID NO: 1346346 - RNA, 21 nt, Human
ccugcggcagucacccgggac

SEQ ID NO: 1346347 - RNA, 20 nt, Human
cugcggcagucacccgggac

SEQ ID NO: 1346348 - RNA, 22 nt, Human
gagcccacgcguccgcccacgc

SEQ ID NO: 1346349 - RNA, 21 nt, Human
gagccugcggcagucacccgg

SEQ ID NO: 1346350 - RNA, 19 nt, Human
ggccacagggcgauggagc

SEQ ID NO: 1346351 - RNA, 24 nt, Human
ucuacaauuaaauuauuauugacu

SEQ ID NO: 1346352 - RNA, 20 nt, Human
uguguacauguauauauuca

SEQ ID NO: 1346353 - RNA, 22 nt, Human
uguguacauguauauauucaug

SEQ ID NO: 1346354 - RNA, 20 nt, Human
uguguguacauguauauaau

SEQ ID NO: 1346355 - RNA, 23 nt, Human
uuuuuuuuuuucuuuuucuuuuu

SEQ ID NO: 1346356 - RNA, 25 nt, Human
uuuuuuuuuuuuuuuuuuucuuuuu

SEQ ID NO: 1346357 - RNA, 23 nt, Human
aaagaucaguuauacuuccucca

SEQ ID NO: 1346358 - RNA, 21 nt, Human
acuuggcaauucucucauccu

SEQ ID NO: 1346359 - RNA, 24 nt, Human
caaagaucaguuauacuuccucca

SEQ ID NO: 1346360 - RNA, 21 nt, Human
cagaaucaccauucucagcuu

SEQ ID NO: 1346361 - RNA, 23 nt, Human
cucaccguuccgccccgcccugc

SEQ ID NO: 1346362 - RNA, 19 nt, Human
uaauaagccuuucaucuuu

SEQ ID NO: 1346363 - RNA, 19 nt, Human
uaugauacaaaaaccuacu

SEQ ID NO: 1346364 - RNA, 21 nt, Human
ucucucauccuucucugguca

SEQ ID NO: 1346365 - RNA, 22 nt, Human
ucucucauccuucucuggucaa

SEQ ID NO: 1346366 - RNA, 23 nt, Human
uuggcguucaguacaacuuggca

SEQ ID NO: 1346367 - RNA, 20 nt, Human
uuuuuuuuuuuuuuuuuugg

SEQ ID NO: 1346368 - RNA, 25 nt, Human
aaacaguccuccugccucagccucc

SEQ ID NO: 1346369 - RNA, 24 nt, Human
aaacuccugaacucaaacaguccu

SEQ ID NO: 1346370 - RNA, 24 nt, Human
aaaguguugggauuacaggcguga

SEQ ID NO: 1346371 - RNA, 19 nt, Human
aagcgccuggcaaacagga

SEQ ID NO: 1346372 - RNA, 21 nt, Human
aaguguugggauuacaggcgu

SEQ ID NO: 1346373 - RNA, 26 nt, Human
aaguguugggauuacaggcgugagcc

SEQ ID NO: 1346374 - RNA, 25 nt, Human
aaucugucacccaggcuggagugca

SEQ ID NO: 1346375 - RNA, 23 nt, Human
acaggugcucgccaccacacccg

SEQ ID NO: 1346376 - RNA, 23 nt, Human
accauguuggucaggcuggucuu

SEQ ID NO: 1346377 - RNA, 23 nt, Human
acccaggcuggagugcaguggug

SEQ ID NO: 1346378 - RNA, 21 nt, Human
agcggccgggggcgcgcuggg

SEQ ID NO: 1346379 - RNA, 25 nt, Human
aggcuggagugcaguggugugaucu

SEQ ID NO: 1346380 - RNA, 21 nt, Human
aggugcucggcagaugccggc

SEQ ID NO: 1346381 - RNA, 22 nt, Human
aguagagaugggguuucaccau

SEQ ID NO: 1346382 - RNA, 22 nt, Human
aguccuccugccucagccuccc

SEQ ID NO: 1346383 - RNA, 19 nt, Human
agugcaguggugugaucuc

SEQ ID NO: 1346384 - RNA, 23 nt, Human
agugcaguggugugaucucagcu

SEQ ID NO: 1346385 - RNA, 24 nt, Human
agugcaguggugugaucucagcug

SEQ ID NO: 1346386 - RNA, 24 nt, Human
aguggugugaucucagcugauugc

SEQ ID NO: 1346387 - RNA, 21 nt, Human
auagaaagcgccuggcaaaca

SEQ ID NO: 1346388 - RNA, 24 nt, Human
augggguuucaccauguuggucag

SEQ ID NO: 1346389 - RNA, 18 nt, Human
auucuccugccucagccu

SEQ ID NO: 1346390 - RNA, 27 nt, Human
caaacaguccuccugccucagccuccc

SEQ ID NO: 1346391 - RNA, 27 nt, Human
caaacaguccuccugccucagccuccc

SEQ ID NO: 1346392 - RNA, 24 nt, Human
caaaguguugggauuacaggcgug

SEQ ID NO: 1346393 - RNA, 22 nt, Human
caagugauucuccugccucagc

SEQ ID NO: 1346394 - RNA, 27 nt, Human
caagugauucuccugccucagccuccc

SEQ ID NO: 1346395 - RNA, 24 nt, Human
caaucugucacccaggcuggagug

SEQ ID NO: 1346396 - RNA, 21 nt, Human
caccauguuggucaggcuggu

SEQ ID NO: 1346397 - RNA, 24 nt, Human
caccauguuggucaggcuggucuu

SEQ ID NO: 1346398 - RNA, 21 nt, Human
cacccaggcuggagugcagug

SEQ ID NO: 1346399 - RNA, 25 nt, Human
cacugcacccagcccagugauuaca

SEQ ID NO: 1346400 - RNA, 22 nt, Human
cauuacaggugcucgccaccac

SEQ ID NO: 1346401 - RNA, 22 nt, Human
ccaaaguguugggauuacaggc

SEQ ID NO: 1346402 - RNA, 22 nt, Human
ccaaaguguugggauuacaggc

SEQ ID NO: 1346403 - RNA, 24 nt, Human
ccaaaguguugggauuacaggcgu

SEQ ID NO: 1346404 - RNA, 18 nt, Human
ccacugcacccagcccag

SEQ ID NO: 1346405 - RNA, 18 nt, Human
ccacugcacccagcccag

SEQ ID NO: 1346406 - RNA, 21 nt, Human
ccacugcacccagcccaguga

SEQ ID NO: 1346407 - RNA, 22 nt, Human
cccaaguagcugacauuacagg

SEQ ID NO: 1346408 - RNA, 20 nt, Human
cccaggcuggagugcagugg

SEQ ID NO: 1346409 - RNA, 18 nt, Human
cccuccucuccaccccag

SEQ ID NO: 1346410 - RNA, 22 nt, Human
ccuccgcuuccuggguucaagu

SEQ ID NO: 1346411 - RNA, 18 nt, Human
ccuccucuccaccccagg

SEQ ID NO: 1346412 - RNA, 23 nt, Human
ccuccugccucagccucccaaag

SEQ ID NO: 1346413 - RNA, 23 nt, Human
ccugccucagccucccaaguagc

SEQ ID NO: 1346414 - RNA, 23 nt, Human
ccuggguucaagugauucuccuc

SEQ ID NO: 1346415 - RNA, 23 nt, Human
ccuggguucaagugauucuccug

SEQ ID NO: 1346416 - RNA, 18 nt, Human
cgagcgcggcgcggagga

SEQ ID NO: 1346417 - RNA, 24 nt, Human
cgggggcgcggcgcgggcgcagag

SEQ ID NO: 1346418 - RNA, 18 nt, Human
cucccuccucuccacccc

SEQ ID NO: 1346419 - RNA, 18 nt, Human
cugccucagccucccaaa

SEQ ID NO: 1346420 - RNA, 23 nt, Human
cugccucagccucccaaguagcu

SEQ ID NO: 1346421 - RNA, 24 nt, Human
cuggagugcaguggugugaucuca

SEQ ID NO: 1346422 - RNA, 21 nt, Human
cuuaaaacuccugaacucaaa

SEQ ID NO: 1346423 - RNA, 24 nt, Human
gagaugggguuucaccauguuggu

SEQ ID NO: 1346424 - RNA, 18 nt, Human
gauuacaggcgugagcca

SEQ ID NO: 1346425 - RNA, 22 nt, Human
gauuacaggcgugagccacugc

SEQ ID NO: 1346426 - RNA, 23 nt, Human
gauuacaggcgugagccacugca

SEQ ID NO: 1346427 - RNA, 21 nt, Human
gauucuccugccucagccucc

SEQ ID NO: 1346428 - RNA, 21 nt, Human
gcacccagcccagugauuaca

SEQ ID NO: 1346429 - RNA, 18 nt, Human
gccgggggcgcgcugggg

SEQ ID NO: 1346430 - RNA, 19 nt, Human
gccucagccucccaaagug

SEQ ID NO: 1346431 - RNA, 19 nt, Human
gcgcggcgcgggcgcagag

SEQ ID NO: 1346432 - RNA, 21 nt, Human
gcgcuggggagggggcgccgg

SEQ ID NO: 1346433 - RNA, 23 nt, Human
ggcgcgcuggggagggggcgccg

SEQ ID NO: 1346434 - RNA, 22 nt, Human
ggcuggagugcaguggugugau

SEQ ID NO: 1346435 - RNA, 19 nt, Human
ggggagggggcgccggggg

SEQ ID NO: 1346436 - RNA, 22 nt, Human
gggguuucaccauguuggucag

SEQ ID NO: 1346437 - RNA, 22 nt, Human
ggguuucaccauguuggucagg

SEQ ID NO: 1346438 - RNA, 22 nt, Human
ggugcucgccaccacacccggc

SEQ ID NO: 1346439 - RNA, 23 nt, Human
guagagaugggguuucaccaugu

SEQ ID NO: 1346440 - RNA, 22 nt, Human
gugagccacugcacccagccca

SEQ ID NO: 1346441 - RNA, 24 nt, Human
gugauucuccugccucagccuccc

SEQ ID NO: 1346442 - RNA, 23 nt, Human
uaauuuuuauauuuuaguagaga

SEQ ID NO: 1346443 - RNA, 25 nt, Human
uaauuuuuauauuuuaguagagaug

SEQ ID NO: 1346444 - RNA, 19 nt, Human
uacaggcgugagccacugc

SEQ ID NO: 1346445 - RNA, 24 nt, Human
uacaggcgugagccacugcaccca

SEQ ID NO: 1346446 - RNA, 23 nt, Human
uacaggugcucgccaccacaccc

SEQ ID NO: 1346447 - RNA, 22 nt, Human
uagagaugggguuucaccaugu

SEQ ID NO: 1346448 - RNA, 23 nt, Human
uagcugacauuacaggugcucgc

SEQ ID NO: 1346449 - RNA, 24 nt, Human
uaguagagaugggguuucaccaug

SEQ ID NO: 1346450 - RNA, 26 nt, Human
uaguagagaugggguuucaccauguu

SEQ ID NO: 1346451 - RNA, 19 nt, Human
ucaagugauucuccugccu

SEQ ID NO: 1346452 - RNA, 24 nt, Human
ucaaucugucacccaggcuggagu

SEQ ID NO: 1346453 - RNA, 24 nt, Human
ucacccaggcuggagugcaguggu

SEQ ID NO: 1346454 - RNA, 20 nt, Human
ucagccucccaaguagcugg

SEQ ID NO: 1346455 - RNA, 24 nt, Human
ucccaaaguguugggauuacaggc

SEQ ID NO: 1346456 - RNA, 24 nt, Human
ucccaaguagcugacauuacaggu

SEQ ID NO: 1346457 - RNA, 20 nt, Human
uccuccugccucagccuccc

SEQ ID NO: 1346458 - RNA, 19 nt, Human
uccuggguucaagugauuc

SEQ ID NO: 1346459 - RNA, 20 nt, Human
uccuggguucaagugauucu

SEQ ID NO: 1346460 - RNA, 21 nt, Human
uccuggguucaagugauucuc

SEQ ID NO: 1346461 - RNA, 22 nt, Human
uccuggguucaagugauucucc

SEQ ID NO: 1346462 - RNA, 24 nt, Human
uccuggguucaagugauucuccug

SEQ ID NO: 1346463 - RNA, 22 nt, Human
ucggcagaugccggcucccucc

SEQ ID NO: 1346464 - RNA, 22 nt, Human
ucucaaucugucacccaggcug

SEQ ID NO: 1346465 - RNA, 24 nt, Human
ucucaaucugucacccaggcugga

SEQ ID NO: 1346466 - RNA, 20 nt, Human
ucuccaccccaggcucgucu

SEQ ID NO: 1346467 - RNA, 26 nt, Human
ucuccugccucagccucccaaguagc

SEQ ID NO: 1346468 - RNA, 24 nt, Human
ucugucacccaggcuggagugcag

SEQ ID NO: 1346469 - RNA, 24 nt, Human
ugaacucaaacaguccuccugccu

SEQ ID NO: 1346470 - RNA, 21 nt, Human
ugacauuacaggugcucgcca

SEQ ID NO: 1346471 - RNA, 24 nt, Human
ugacauuacaggugcucgccacca

SEQ ID NO: 1346472 - RNA, 22 nt, Human
ugagagggagucucaaucuguc

SEQ ID NO: 1346473 - RNA, 24 nt, Human
ugauugcaaccuccgcuuccuggg

SEQ ID NO: 1346474 - RNA, 20 nt, Human
ugcaaccuccgcuuccuggg

SEQ ID NO: 1346475 - RNA, 20 nt, Human
ugccggcucccuccucucca

SEQ ID NO: 1346476 - RNA, 24 nt, Human
ugccucagccucccaaaguguugg

SEQ ID NO: 1346477 - RNA, 24 nt, Human
ugccucagccucccaaguagcuga

SEQ ID NO: 1346478 - RNA, 19 nt, Human
uggagugcaguggugugau

SEQ ID NO: 1346479 - RNA, 24 nt, Human
uggagugcaguggugugaucucag

SEQ ID NO: 1346480 - RNA, 18 nt, Human
ugggauuacaggcgugag

SEQ ID NO: 1346481 - RNA, 19 nt, Human
ugggauuacaggcgugagc

SEQ ID NO: 1346482 - RNA, 21 nt, Human
ugggauuacaggcgugagcca

SEQ ID NO: 1346483 - RNA, 22 nt, Human
ugggauuacaggcgugagccac

SEQ ID NO: 1346484 - RNA, 22 nt, Human
ugggauuacaggcgugagccac

SEQ ID NO: 1346485 - RNA, 24 nt, Human
ugggauuacaggcgugagccacug

SEQ ID NO: 1346486 - RNA, 26 nt, Human
ugggauuacaggcgugagccacugca

SEQ ID NO: 1346487 - RNA, 24 nt, Human
ugggguuucaccauguuggucagg

SEQ ID NO: 1346488 - RNA, 23 nt, Human
uggguucaagugauucuccugcc

SEQ ID NO: 1346489 - RNA, 24 nt, Human
uggguucaagugauucuccugccu

SEQ ID NO: 1346490 - RNA, 25 nt, Human
uggucaggcuggucuuaaaacuccu

SEQ ID NO: 1346491 - RNA, 18 nt, Human
uuaguagagaugggguuu

SEQ ID NO: 1346492 - RNA, 22 nt, Human
uuaguagagaugggguuucacc

SEQ ID NO: 1346493 - RNA, 24 nt, Human
uuaguagagaugggguuucaccau

SEQ ID NO: 1346494 - RNA, 21 nt, Human
uucaagugauucuccugccuc

SEQ ID NO: 1346495 - RNA, 23 nt, Human
uucaagugauucuccugccucag

SEQ ID NO: 1346496 - RNA, 24 nt, Human
uucaagugauucuccugccucagc

SEQ ID NO: 1346497 - RNA, 23 nt, Human
uugcaaccuccgcuuccuggguu

SEQ ID NO: 1346498 - RNA, 24 nt, Human
uugcaaccuccgcuuccuggguuc

SEQ ID NO: 1346499 - RNA, 24 nt, Human
uuucaccauguuggucaggcuggu

SEQ ID NO: 1346500 - RNA, 23 nt, Human
uuuuaguagagaugggguuucac

SEQ ID NO: 1346501 - RNA, 19 nt, Human
uuuuuauauuuuaguagag

SEQ ID NO: 1346502 - RNA, 23 nt, Human
aaaaaaaaaaaaaaaagaaagaa

SEQ ID NO: 1346503 - RNA, 19 nt, Human
aaaaaaaacuagccgggca

SEQ ID NO: 1346504 - RNA, 25 nt, Human
aaaaaaagaaagaaauuacuuaaag

SEQ ID NO: 1346505 - RNA, 26 nt, Human
aaaaauacaaaaaaaaacuagccggg

SEQ ID NO: 1346506 - RNA, 25 nt, Human
aaaagcaaauaccacagaagggcuu

SEQ ID NO: 1346507 - RNA, 21 nt, Human
aaaauacucuuggccacaaag

SEQ ID NO: 1346508 - RNA, 22 nt, Human
aaaccccaucuguacuaaaaaa

SEQ ID NO: 1346509 - RNA, 22 nt, Human
aaagcaaauaccacagaagggc

SEQ ID NO: 1346510 - RNA, 21 nt, Human
aacacaaucccuaaauuggcu

SEQ ID NO: 1346511 - RNA, 19 nt, Human
aacauggugaaaccccauc

SEQ ID NO: 1346512 - RNA, 20 nt, Human
aacauggugaaaccccaucu

SEQ ID NO: 1346513 - RNA, 23 nt, Human
aacauggugaaaccccaucugua

SEQ ID NO: 1346514 - RNA, 21 nt, Human
aaccaacacaagaacaacaca

SEQ ID NO: 1346515 - RNA, 22 nt, Human
aagaaagaaauuacuuaaagga

SEQ ID NO: 1346516 - RNA, 23 nt, Human
aagaaagaaauuacuuaaaggac

SEQ ID NO: 1346517 - RNA, 23 nt, Human
aagcgagaggacacagccaagga

SEQ ID NO: 1346518 - RNA, 25 nt, Human
aaggcagguggagcaccugagguca

SEQ ID NO: 1346519 - RNA, 22 nt, Human
accaacauggugaaaccccauc

SEQ ID NO: 1346520 - RNA, 22 nt, Human
accguugcacuccagccugggc

SEQ ID NO: 1346521 - RNA, 25 nt, Human
accguugcacuccagccugggcaac

SEQ ID NO: 1346522 - RNA, 24 nt, Human
accugaggucaggaguuugagacu

SEQ ID NO: 1346523 - RNA, 23 nt, Human
agccgggcacgguggcgggugcc

SEQ ID NO: 1346524 - RNA, 24 nt, Human
agccugaccaacauggugaaaccc

SEQ ID NO: 1346525 - RNA, 22 nt, Human
agcgagaggacacagccaagga

SEQ ID NO: 1346526 - RNA, 22 nt, Human
aggcacgagacucacuugaacc

SEQ ID NO: 1346527 - RNA, 24 nt, Human
aggcacgagacucacuugaaccug

SEQ ID NO: 1346528 - RNA, 20 nt, Human
aggcagguggagcaccugag

SEQ ID NO: 1346529 - RNA, 26 nt, Human
aggcagguggagcaccugaggucagg

SEQ ID NO: 1346530 - RNA, 24 nt, Human
aggcugaggcacgagacucacuug

SEQ ID NO: 1346531 - RNA, 23 nt, Human
agugaaaaaauuaacagcugccc

SEQ ID NO: 1346532 - RNA, 24 nt, Human
aguggcucacgccuguaaucccag

SEQ ID NO: 1346533 - RNA, 24 nt, Human
aguuggagguugcagugagccgag

SEQ ID NO: 1346534 - RNA, 22 nt, Human
aucccagcacuuugggaggcca

SEQ ID NO: 1346535 - RNA, 20 nt, Human
caaaaaaaaacuagccgggc

SEQ ID NO: 1346536 - RNA, 23 nt, Human
caaaaaaaaacuagccgggcacg

SEQ ID NO: 1346537 - RNA, 24 nt, Human
caacaguaccaagugcaaauaugu

SEQ ID NO: 1346538 - RNA, 21 nt, Human
caacauggugaaaccccaucu

SEQ ID NO: 1346539 - RNA, 24 nt, Human
caaggcagguggagcaccugaggu

SEQ ID NO: 1346540 - RNA, 26 nt, Human
cacaaaaaaaaaaaaaaaaaaaagaa

SEQ ID NO: 1346541 - RNA, 25 nt, Human
cacaagaacaacacaaucccuaaau

SEQ ID NO: 1346542 - RNA, 18 nt, Human
caccguugcacuccagcc

SEQ ID NO: 1346543 - RNA, 18 nt, Human
caccguugcacuccagcc

SEQ ID NO: 1346544 - RNA, 23 nt, Human
caccugaggucaggaguuugaga

SEQ ID NO: 1346545 - RNA, 24 nt, Human
cacgccuguaaucccagcacuuug

SEQ ID NO: 1346546 - RNA, 24 nt, Human
cagcacuuugggaggccaaggcag

SEQ ID NO: 1346547 - RNA, 25 nt, Human
cagcacuuugggaggccaaggcagg

SEQ ID NO: 1346548 - RNA, 19 nt, Human
cagcaguacuugaaaagaa

SEQ ID NO: 1346549 - RNA, 20 nt, Human
caggaccccgccaaggucaa

SEQ ID NO: 1346550 - RNA, 24 nt, Human
cagguggagcaccugaggucagga

SEQ ID NO: 1346551 - RNA, 22 nt, Human
caguaccaagugcaaauaugua

SEQ ID NO: 1346552 - RNA, 23 nt, Human
caguggaaacuacaccuuuagac

SEQ ID NO: 1346553 - RNA, 27 nt, Human
cauuuuuauuuuaagaaauggcuuagg

SEQ ID NO: 1346554 - RNA, 19 nt, Human
ccggccucugagcagucac

SEQ ID NO: 1346555 - RNA, 20 nt, Human
ccguugcacuccagccuggg

SEQ ID NO: 1346556 - RNA, 20 nt, Human
ccguugcacuccagccuggg

SEQ ID NO: 1346557 - RNA, 21 nt, Human
ccguugcacuccagccugggc

SEQ ID NO: 1346558 - RNA, 23 nt, Human
ccguugcacuccagccugggcaa

SEQ ID NO: 1346559 - RNA, 24 nt, Human
ccguugcacuccagccugggcaac

SEQ ID NO: 1346560 - RNA, 25 nt, Human
ccguugcacuccagccugggcaaca

SEQ ID NO: 1346561 - RNA, 24 nt, Human
ccugaccaacauggugaaacccca

SEQ ID NO: 1346562 - RNA, 22 nt, Human
ccugaggucaggaguuugagac

SEQ ID NO: 1346563 - RNA, 21 nt, Human
ccugggaguuggagguugcag

SEQ ID NO: 1346564 - RNA, 22 nt, Human
ccuguaaucccagcacuuuggg

SEQ ID NO: 1346565 - RNA, 21 nt, Human
ccuguaaucccagcuacuugg

SEQ ID NO: 1346566 - RNA, 23 nt, Human
cgccuguaaucccagcacuuugg

SEQ ID NO: 1346567 - RNA, 21 nt, Human
cguugcacuccagccugggca

SEQ ID NO: 1346568 - RNA, 20 nt, Human
cguugcacuccagccugggg

SEQ ID NO: 1346569 - RNA, 24 nt, Human
cuauaaacaaucacuguugcuccc

SEQ ID NO: 1346570 - RNA, 22 nt, Human
cucacgccuguaaucccagcac

SEQ ID NO: 1346571 - RNA, 24 nt, Human
cucacgccuguaaucccagcacuu

SEQ ID NO: 1346572 - RNA, 24 nt, Human
cuccgucacaaaaaaaaaaaaaaa

SEQ ID NO: 1346573 - RNA, 27 nt, Human
cuccgucacaaaaaaaaaaaaaaaaaa

SEQ ID NO: 1346574 - RNA, 20 nt, Human
cucuagaagcccaggacccc

SEQ ID NO: 1346575 - RNA, 21 nt, Human
cugaggcuuuggggucaacgg

SEQ ID NO: 1346576 - RNA, 25 nt, Human
gacugcaccguugcacuccagccug

SEQ ID NO: 1346577 - RNA, 23 nt, Human
gagacuagccugaccaacauggu

SEQ ID NO: 1346578 - RNA, 23 nt, Human
gagacugcaccguugcacuccag

SEQ ID NO: 1346579 - RNA, 21 nt, Human
gagcaccugaggucaggaguu

SEQ ID NO: 1346580 - RNA, 24 nt, Human
gagcaccugaggucaggaguuuga

SEQ ID NO: 1346581 - RNA, 20 nt, Human
gagggaaacuccgucacaaa

SEQ ID NO: 1346582 - RNA, 23 nt, Human
gagguugcagugagccgagacug

SEQ ID NO: 1346583 - RNA, 25 nt, Human
gcaccguugcacuccagccugggca

SEQ ID NO: 1346584 - RNA, 28 nt, Human
gcaccguugcacuccagccugggcaaca

SEQ ID NO: 1346585 - RNA, 23 nt, Human
gcaccugaggucaggaguuugag

SEQ ID NO: 1346586 - RNA, 21 nt, Human
gcccugaggcuuugggguccc

SEQ ID NO: 1346587 - RNA, 23 nt, Human
gccgggcacgguggcgggugccu

SEQ ID NO: 1346588 - RNA, 20 nt, Human
gcgggugccuguaaucccag

SEQ ID NO: 1346589 - RNA, 22 nt, Human
gcgggugccuguaaucccagcu

SEQ ID NO: 1346590 - RNA, 21 nt, Human
gcugcugcgggauccuacaag

SEQ ID NO: 1346591 - RNA, 23 nt, Human
gcuuaggcugggcacaguggcuc

SEQ ID NO: 1346592 - RNA, 18 nt, Human
ggagguugcagugagccg

SEQ ID NO: 1346593 - RNA, 20 nt, Human
ggagguugcagugagccgag

SEQ ID NO: 1346594 - RNA, 22 nt, Human
ggagguugcagugagccgagac

SEQ ID NO: 1346595 - RNA, 23 nt, Human
ggcacgguggcgggugccuguaa

SEQ ID NO: 1346596 - RNA, 23 nt, Human
ggcuuaggcugggcacaguggcu

SEQ ID NO: 1346597 - RNA, 18 nt, Human
gggcacaguggcucacgc

SEQ ID NO: 1346598 - RNA, 24 nt, Human
gggcacaguggcucacgccuguaa

SEQ ID NO: 1346599 - RNA, 24 nt, Human
ggugccuguaaucccagcuacuug

SEQ ID NO: 1346600 - RNA, 23 nt, Human
gguggcgggugccuguaauccca

SEQ ID NO: 1346601 - RNA, 23 nt, Human
guggcgggugccuguaaucccag

SEQ ID NO: 1346602 - RNA, 25 nt, Human
guugcacuccagccugggcaacaag

SEQ ID NO: 1346603 - RNA, 19 nt, Human
guugcagugagccgagacu

SEQ ID NO: 1346604 - RNA, 22 nt, Human
uaaacaaucacuguugcuccca

SEQ ID NO: 1346605 - RNA, 24 nt, Human
uaccaagugcaaauauguaaaaga

SEQ ID NO: 1346606 - RNA, 21 nt, Human
uacccagcccccuucuucuaa

SEQ ID NO: 1346607 - RNA, 20 nt, Human
uacuaaaaaaaauacaaaaa

SEQ ID NO: 1346608 - RNA, 21 nt, Human
uagccgggcacgguggcgggu

SEQ ID NO: 1346609 - RNA, 18 nt, Human
ucacuugaaccugggagu

SEQ ID NO: 1346610 - RNA, 21 nt, Human
ucaugucgcucugucucuugc

SEQ ID NO: 1346611 - RNA, 23 nt, Human
uccgucacaaaaaaaaaaaaaaa

SEQ ID NO: 1346612 - RNA, 26 nt, Human
ucgcucugucucuugcugcuccugac

SEQ ID NO: 1346613 - RNA, 22 nt, Human
ucuagaagcccaggaccccgcc

SEQ ID NO: 1346614 - RNA, 21 nt, Human
ugaaaacaaaaaacuauaaac

SEQ ID NO: 1346615 - RNA, 21 nt, Human
ugaaaagaagcccggccucug

SEQ ID NO: 1346616 - RNA, 22 nt, Human
ugaaaagaagcccggccucuga

SEQ ID NO: 1346617 - RNA, 19 nt, Human
ugaaaauacucuuggccac

SEQ ID NO: 1346618 - RNA, 23 nt, Human
ugaaaauacucuuggccacuguc

SEQ ID NO: 1346619 - RNA, 19 nt, Human
ugaaaccccaucuguacua

SEQ ID NO: 1346620 - RNA, 24 nt, Human
ugaaccugggaguuggagguugca

SEQ ID NO: 1346621 - RNA, 25 nt, Human
ugaagcucacuucaaucucuuuagg

SEQ ID NO: 1346622 - RNA, 24 nt, Human
ugaccaacauggugaaaccccauc

SEQ ID NO: 1346623 - RNA, 23 nt, Human
ugagacuagccugaccaacaugg

SEQ ID NO: 1346624 - RNA, 24 nt, Human
ugaggcacgagacucacuugaacc

SEQ ID NO: 1346625 - RNA, 23 nt, Human
ugaggcuuuggggucaacgggcu

SEQ ID NO: 1346626 - RNA, 18 nt, Human
ugaggucaggaguuugag

SEQ ID NO: 1346627 - RNA, 21 nt, Human
ugcaccguugcacuccagccu

SEQ ID NO: 1346628 - RNA, 19 nt, Human
ugcacuccagccugggcaa

SEQ ID NO: 1346629 - RNA, 23 nt, Human
ugccuguaaucccagcuacuugg

SEQ ID NO: 1346630 - RNA, 24 nt, Human
ugccuguaaucccagcuacuuggg

SEQ ID NO: 1346631 - RNA, 18 nt, Human
uggacauaagcccugagg

SEQ ID NO: 1346632 - RNA, 24 nt, Human
uggagcaccugaggucaggaguuu

SEQ ID NO: 1346633 - RNA, 22 nt, Human
uggcgggugccuguaaucccag

SEQ ID NO: 1346634 - RNA, 24 nt, Human
uggcgggugccuguaaucccagcu

SEQ ID NO: 1346635 - RNA, 22 nt, Human
uggcucacgccuguaaucccag

SEQ ID NO: 1346636 - RNA, 24 nt, Human
uggcucacgccuguaaucccagca

SEQ ID NO: 1346637 - RNA, 19 nt, Human
ugggaaccaacacaagaac

SEQ ID NO: 1346638 - RNA, 22 nt, Human
ugggaggccaaggcagguggag

SEQ ID NO: 1346639 - RNA, 24 nt, Human
ugggaggcugaggcacgagacuca

SEQ ID NO: 1346640 - RNA, 24 nt, Human
ugggaguuggagguugcagugagc

SEQ ID NO: 1346641 - RNA, 24 nt, Human
uguucuguuuuggauuuuuuuuuu

SEQ ID NO: 1346642 - RNA, 24 nt, Human
uuaggcugggcacaguggcucacg

SEQ ID NO: 1346643 - RNA, 21 nt, Human
uugaaaagaagcccggccucu

SEQ ID NO: 1346644 - RNA, 23 nt, Human
uugaaaauacucuuggccacaaa

SEQ ID NO: 1346645 - RNA, 24 nt, Human
uugaaccugggaguuggagguugc

SEQ ID NO: 1346646 - RNA, 23 nt, Human
uugcacuccagccugggcaacaa

SEQ ID NO: 1346647 - RNA, 18 nt, Human
uugcagugagccgagacu

SEQ ID NO: 1346648 - RNA, 19 nt, Human
uugcagugagccgagacug

SEQ ID NO: 1346649 - RNA, 20 nt, Human
uugcagugagccgagacugc

SEQ ID NO: 1346650 - RNA, 22 nt, Human
uugcagugagccgagacugcac

SEQ ID NO: 1346651 - RNA, 18 nt, Human
uuuuuuuuuuuuuuuuug

SEQ ID NO: 1346652 - RNA, 23 nt, Human
aagaaccauuuacucagauaguc

SEQ ID NO: 1346653 - RNA, 18 nt, Human
aaggcggcgggggaggag

SEQ ID NO: 1346654 - RNA, 24 nt, Human
agccugcuuuugagguauugauuu

SEQ ID NO: 1346655 - RNA, 22 nt, Human
agucaaaugcacaaaggcucuu

SEQ ID NO: 1346656 - RNA, 22 nt, Human
agucaggaacugccuaggucca

SEQ ID NO: 1346657 - RNA, 24 nt, Human
auaagcugccuaaggaaaccucag

SEQ ID NO: 1346658 - RNA, 24 nt, Human
auagagcuuacucuuauguuaaag

SEQ ID NO: 1346659 - RNA, 19 nt, Human
caaaugcacaaaggcucuu

SEQ ID NO: 1346660 - RNA, 25 nt, Human
cacaaaauuaagcuaaccagcuuga

SEQ ID NO: 1346661 - RNA, 20 nt, Human
cacucuuccucaaagccaag

SEQ ID NO: 1346662 - RNA, 19 nt, Human
caguaaauucgaccucucc

SEQ ID NO: 1346663 - RNA, 23 nt, Human
ccacaaagaaccauuuacucaga

SEQ ID NO: 1346664 - RNA, 21 nt, Human
ccacuuugggguuuucuuguc

SEQ ID NO: 1346665 - RNA, 21 nt, Human
cugccacucuuccucaaagcc

SEQ ID NO: 1346666 - RNA, 21 nt, Human
gaauccuuuuuccuaaaguuu

SEQ ID NO: 1346667 - RNA, 24 nt, Human
ggaugggaaaagcaggccacuuug

SEQ ID NO: 1346668 - RNA, 18 nt, Human
ggcggcgggggaggaggc

SEQ ID NO: 1346669 - RNA, 19 nt, Human
ggggaggaggccgaggguc

SEQ ID NO: 1346670 - RNA, 20 nt, Human
gggggaggaggccgaggguc

SEQ ID NO: 1346671 - RNA, 24 nt, Human
guccacaaagaaccauuuacucag

SEQ ID NO: 1346672 - RNA, 24 nt, Human
guggaacagucaggaacugccuag

SEQ ID NO: 1346673 - RNA, 18 nt, Human
uaaaguuuaacucacauc

SEQ ID NO: 1346674 - RNA, 23 nt, Human
uacugugagccucaccacccagg

SEQ ID NO: 1346675 - RNA, 18 nt, Human
uagcuaaaauuuuuuaaa

SEQ ID NO: 1346676 - RNA, 19 nt, Human
uugagguauugauuuuuuu

SEQ ID NO: 1346677 - RNA, 20 nt, Human
aaaagacaacaaaaaagcac

SEQ ID NO: 1346678 - RNA, 28 nt, Human
aaaagacaacaaaaaagcacacaccaag

SEQ ID NO: 1346679 - RNA, 21 nt, Human
aacaaaaaagcacacaccaaa

SEQ ID NO: 1346680 - RNA, 19 nt, Human
aacagcucuuacauccuuc

SEQ ID NO: 1346681 - RNA, 21 nt, Human
aaccauggucaauccaaugau

SEQ ID NO: 1346682 - RNA, 21 nt, Human
aacucuagggauaucuaaguu

SEQ ID NO: 1346683 - RNA, 21 nt, Human
aagaagaaaugacacugaugu

SEQ ID NO: 1346684 - RNA, 20 nt, Human
aagaaguguuuugccaucug

SEQ ID NO: 1346685 - RNA, 19 nt, Human
aagcacacaccaaaaaacc

SEQ ID NO: 1346686 - RNA, 23 nt, Human
acaacaaaaaagcacacaccaaa

SEQ ID NO: 1346687 - RNA, 22 nt, Human
accugagcacaaguccaaaagc

SEQ ID NO: 1346688 - RNA, 18 nt, Human
acucuagggauaucuaag

SEQ ID NO: 1346689 - RNA, 24 nt, Human
agacaacaaaaaagcacacaccaa

SEQ ID NO: 1346690 - RNA, 25 nt, Human
agacaacaaaaaagcacacaccaaa

SEQ ID NO: 1346691 - RNA, 19 nt, Human
agagggagggagggaagag

SEQ ID NO: 1346692 - RNA, 22 nt, Human
agccuaagaauauucugagagu

SEQ ID NO: 1346693 - RNA, 20 nt, Human
agggagggaagagauuugag

SEQ ID NO: 1346694 - RNA, 24 nt, Human
agggagggagggaagagauuugag

SEQ ID NO: 1346695 - RNA, 28 nt, Human
agggggccccacgccggcaccugagcgu

SEQ ID NO: 1346696 - RNA, 18 nt, Human
augacacugauguacaaa

SEQ ID NO: 1346697 - RNA, 23 nt, Human
auuugcagaaauaaacuuuccuc

SEQ ID NO: 1346698 - RNA, 21 nt, Human
caaaagauucacagccuccga

SEQ ID NO: 1346699 - RNA, 24 nt, Human
caaaugacucaccaagggacucuc

SEQ ID NO: 1346700 - RNA, 23 nt, Human
caacaaaaaagcacacaccaaaa

SEQ ID NO: 1346701 - RNA, 24 nt, Human
caacaaaaaagcacacaccaaaaa

SEQ ID NO: 1346702 - RNA, 24 nt, Human
caacugaugaaaagcuucaaauac

SEQ ID NO: 1346703 - RNA, 18 nt, Human
caauccaaugaugcacuu

SEQ ID NO: 1346704 - RNA, 19 nt, Human
cacaguaacuuccagugac

SEQ ID NO: 1346705 - RNA, 18 nt, Human
cacgccggcaccugagcg

SEQ ID NO: 1346706 - RNA, 25 nt, Human
caucucccauuuacauucggggguc

SEQ ID NO: 1346707 - RNA, 19 nt, Human
ccaaaagcacugacagcug

SEQ ID NO: 1346708 - RNA, 26 nt, Human
ccccacgccggcaccugagcgucccc

SEQ ID NO: 1346709 - RNA, 21 nt, Human
cgccggcaccugagcgucccc

SEQ ID NO: 1346710 - RNA, 23 nt, Human
cucaggaagaaagaugcugagaa

SEQ ID NO: 1346711 - RNA, 24 nt, Human
cucaggaagaaagaugcugagaaa

SEQ ID NO: 1346712 - RNA, 19 nt, Human
cuuagcuucuacuugcugc

SEQ ID NO: 1346713 - RNA, 22 nt, Human
cuugaaaaaaaaaaaagccuaa

SEQ ID NO: 1346714 - RNA, 26 nt, Human
cuugaaaaaaaaaaaagccuaagaau

SEQ ID NO: 1346715 - RNA, 22 nt, Human
gaaaaaaaaaaaagccuaagaa

SEQ ID NO: 1346716 - RNA, 18 nt, Human
gaaaagcuucaaauacua

SEQ ID NO: 1346717 - RNA, 23 nt, Human
gaaaugacacugauguacaaaug

SEQ ID NO: 1346718 - RNA, 25 nt, Human
gaggucuugucugugucgucuccuu

SEQ ID NO: 1346719 - RNA, 18 nt, Human
gagguuuauucuugagua

SEQ ID NO: 1346720 - RNA, 19 nt, Human
gcauguguggugaauggaa

SEQ ID NO: 1346721 - RNA, 19 nt, Human
ggauguaagguccaugacc

SEQ ID NO: 1346722 - RNA, 20 nt, Human
gggagagggagggagggaag

SEQ ID NO: 1346723 - RNA, 23 nt, Human
uaacuugaaaaaaaaaaaagccu

SEQ ID NO: 1346724 - RNA, 21 nt, Human
uaagaagaaaugacacugaug

SEQ ID NO: 1346725 - RNA, 23 nt, Human
uaaggggccucuuccuuugaucu

SEQ ID NO: 1346726 - RNA, 21 nt, Human
uaguagccacaguaacuucca

SEQ ID NO: 1346727 - RNA, 18 nt, Human
ucagauccuauaagugca

SEQ ID NO: 1346728 - RNA, 22 nt, Human
uccaaaagauucacagccuccg

SEQ ID NO: 1346729 - RNA, 23 nt, Human
uccaaaagauucacagccuccga

SEQ ID NO: 1346730 - RNA, 23 nt, Human
uccaaaagcacugacagcuggga

SEQ ID NO: 1346731 - RNA, 22 nt, Human
ucuacuugcugcggguagaagc

SEQ ID NO: 1346732 - RNA, 23 nt, Human
ucuauaacuugaaaaaaaaaaaa

SEQ ID NO: 1346733 - RNA, 24 nt, Human
ucuauaacuugaaaaaaaaaaaag

SEQ ID NO: 1346734 - RNA, 25 nt, Human
ugaaaaaccauggucaauccaauga

SEQ ID NO: 1346735 - RNA, 18 nt, Human
ugaaaagcuucaaauacu

SEQ ID NO: 1346736 - RNA, 20 nt, Human
ugagccaacugaugaaaagc

SEQ ID NO: 1346737 - RNA, 18 nt, Human
ugccccuaaucaagaagu

SEQ ID NO: 1346738 - RNA, 18 nt, Human
ugcugagaaacucuaggg

SEQ ID NO: 1346739 - RNA, 24 nt, Human
ugcugcggguagaagcuggcaagc

SEQ ID NO: 1346740 - RNA, 21 nt, Human
ugcuuugucuuuauuucugau

SEQ ID NO: 1346741 - RNA, 19 nt, Human
uggaauaaaucccuucuau

SEQ ID NO: 1346742 - RNA, 25 nt, Human
uggaauucccaugaacagcucuuac

SEQ ID NO: 1346743 - RNA, 19 nt, Human
uggcauguguggugaaugg

SEQ ID NO: 1346744 - RNA, 18 nt, Human
uggguacucucaucuccc

SEQ ID NO: 1346745 - RNA, 23 nt, Human
ugucugugucgucuccuuugcug

SEQ ID NO: 1346746 - RNA, 18 nt, Human
uucaauaacuaguuggcu

SEQ ID NO: 1346747 - RNA, 19 nt, Human
uugaaaaaaaaaaaagccu

SEQ ID NO: 1346748 - RNA, 27 nt, Human
uuuaagaagacauuugaauuuuugccc

SEQ ID NO: 1346749 - RNA, 21 nt, Human
aaccuggcuguuuccaaucuc

SEQ ID NO: 1346750 - RNA, 23 nt, Human
agaaaaccauuuauuccuggggc

SEQ ID NO: 1346751 - RNA, 20 nt, Human
agacaggaaccaggggacug

SEQ ID NO: 1346752 - RNA, 26 nt, Human
agacaggaaccaggggacugggucca

SEQ ID NO: 1346753 - RNA, 20 nt, Human
agagccuggggaaucuggag

SEQ ID NO: 1346754 - RNA, 18 nt, Human
aggaagaagaaaugaaga

SEQ ID NO: 1346755 - RNA, 19 nt, Human
aggaggugcagcugagggc

SEQ ID NO: 1346756 - RNA, 21 nt, Human
agggcagccagguuuccuuac

SEQ ID NO: 1346757 - RNA, 21 nt, Human
cacucacugcuccaaccuggc

SEQ ID NO: 1346758 - RNA, 23 nt, Human
ccuuacucacucacugcuccaac

SEQ ID NO: 1346759 - RNA, 23 nt, Human
cucacugcuccaaccuggcuguu

SEQ ID NO: 1346760 - RNA, 24 nt, Human
cucacugcuccaaccuggcuguuu

SEQ ID NO: 1346761 - RNA, 19 nt, Human
cuccaaccuggcuguuucc

SEQ ID NO: 1346762 - RNA, 21 nt, Human
cucugagagccuggggaaucu

SEQ ID NO: 1346763 - RNA, 22 nt, Human
cuucucugagagccuggggaau

SEQ ID NO: 1346764 - RNA, 26 nt, Human
cuuucugcugaucuucucugagagcc

SEQ ID NO: 1346765 - RNA, 24 nt, Human
gaaccaggggacuggguccagaug

SEQ ID NO: 1346766 - RNA, 18 nt, Human
gaggaagccaagaaaacc

SEQ ID NO: 1346767 - RNA, 18 nt, Human
gaggugcagcugagggcu

SEQ ID NO: 1346768 - RNA, 24 nt, Human
gcuccaaccuggcuguuuccaauc

SEQ ID NO: 1346769 - RNA, 21 nt, Human
ggucuugcagacuuucugcug

SEQ ID NO: 1346770 - RNA, 23 nt, Human
uaaagauuucuuuauuguggucc

SEQ ID NO: 1346771 - RNA, 21 nt, Human
ucccugagugaggacaggagu

SEQ ID NO: 1346772 - RNA, 18 nt, Human
ucuugcagacuuucugcu

SEQ ID NO: 1346773 - RNA, 23 nt, Human
ugaaguggaggcaguaggaagaa

SEQ ID NO: 1346774 - RNA, 24 nt, Human
ugaaguggaggcaguaggaagaag

SEQ ID NO: 1346775 - RNA, 19 nt, Human
uggaggggaggaggugcag

SEQ ID NO: 1346776 - RNA, 24 nt, Human
uuacaaauaacagacaggaaccag

SEQ ID NO: 1346777 - RNA, 23 nt, Human
aaaagaagaucaagaucacgacc

SEQ ID NO: 1346778 - RNA, 22 nt, Human
aagacaacggugauaacaacug

SEQ ID NO: 1346779 - RNA, 18 nt, Human
aagaggcagaucagcacc

SEQ ID NO: 1346780 - RNA, 20 nt, Human
aagaggcagaucagcacccc

SEQ ID NO: 1346781 - RNA, 22 nt, Human
aaggaguagucaggaggcuggu

SEQ ID NO: 1346782 - RNA, 20 nt, Human
aagggcucagauuagggggu

SEQ ID NO: 1346783 - RNA, 21 nt, Human
acagaguagagcagccaauga

SEQ ID NO: 1346784 - RNA, 19 nt, Human
accuggcuggagcuuggau

SEQ ID NO: 1346785 - RNA, 25 nt, Human
acguaagcaugagguuguuggggaa

SEQ ID NO: 1346786 - RNA, 24 nt, Human
agagaaaacuuucccauaauaagc

SEQ ID NO: 1346787 - RNA, 18 nt, Human
agagcaggguaaggaaga

SEQ ID NO: 1346788 - RNA, 19 nt, Human
agcgcgcugcgcugggggc

SEQ ID NO: 1346789 - RNA, 20 nt, Human
agcucuaguaagagggccug

SEQ ID NO: 1346790 - RNA, 18 nt, Human
aggguaaggaagacaacg

SEQ ID NO: 1346791 - RNA, 21 nt, Human
caaccugugaaaaaagaugac

SEQ ID NO: 1346792 - RNA, 22 nt, Human
caaccugugaaaaaagaugacu

SEQ ID NO: 1346793 - RNA, 20 nt, Human
cacauacucagauguccccu

SEQ ID NO: 1346794 - RNA, 21 nt, Human
cacgaccgagagcaggguaag

SEQ ID NO: 1346795 - RNA, 22 nt, Human
cacuaggugaccagguagggga

SEQ ID NO: 1346796 - RNA, 18 nt, Human
cagagaaaacuuucccau

SEQ ID NO: 1346797 - RNA, 21 nt, Human
cagccaaugaccuuaacucaa

SEQ ID NO: 1346798 - RNA, 27 nt, Human
cagcggagcgcugagcuucccgaaucg

SEQ ID NO: 1346799 - RNA, 21 nt, Human
caugucccuggucccuggagu

SEQ ID NO: 1346800 - RNA, 23 nt, Human
ccacaucaaucaaugcuucuccc

SEQ ID NO: 1346801 - RNA, 26 nt, Human
cccucugccccagcggagcgcugagc

SEQ ID NO: 1346802 - RNA, 22 nt, Human
ccgccgcgacccucugccccag

SEQ ID NO: 1346803 - RNA, 21 nt, Human
cuccauagucuccuaccccuc

SEQ ID NO: 1346804 - RNA, 26 nt, Human
cuuuucucucccuucaaccugugaaa

SEQ ID NO: 1346805 - RNA, 19 nt, Human
gagguuguuggggaacacg

SEQ ID NO: 1346806 - RNA, 25 nt, Human
gcgcugagcuucggccgcuccgggu

SEQ ID NO: 1346807 - RNA, 21 nt, Human
gcggagcgcgcugcgcugggg

SEQ ID NO: 1346808 - RNA, 21 nt, Human
gcuccaucuucuggggacagg

SEQ ID NO: 1346809 - RNA, 21 nt, Human
gggaacacggaaaggaagggc

SEQ ID NO: 1346810 - RNA, 22 nt, Human
gggcuaucacuaggugaccagg

SEQ ID NO: 1346811 - RNA, 22 nt, Human
ggggacagggccucagugggcu

SEQ ID NO: 1346812 - RNA, 18 nt, Human
ggugcgucggggagcggc

SEQ ID NO: 1346813 - RNA, 18 nt, Human
guagagcagccaaugacc

SEQ ID NO: 1346814 - RNA, 18 nt, Human
gucauugucacuaguggu

SEQ ID NO: 1346815 - RNA, 31 nt, Human
uaaaaaucacguaagcaugagguuguugggg

SEQ ID NO: 1346816 - RNA, 18 nt, Human
uaagaucuccauagucuc

SEQ ID NO: 1346817 - RNA, 18 nt, Human
uagagcagccaaugaccu

SEQ ID NO: 1346818 - RNA, 22 nt, Human
uagagcagccaaugaccuuaac

SEQ ID NO: 1346819 - RNA, 18 nt, Human
uagccacaucuuguuggc

SEQ ID NO: 1346820 - RNA, 18 nt, Human
uaucaggagguaagaucu

SEQ ID NO: 1346821 - RNA, 23 nt, Human
uaucaggagguaagaucuccaua

SEQ ID NO: 1346822 - RNA, 22 nt, Human
ucaaucaaugcuucucccuggc

SEQ ID NO: 1346823 - RNA, 21 nt, Human
ucagcaccccgcggagcgcgc

SEQ ID NO: 1346824 - RNA, 18 nt, Human
uccauagucuccuacccc

SEQ ID NO: 1346825 - RNA, 21 nt, Human
uccauagucuccuaccccucc

SEQ ID NO: 1346826 - RNA, 24 nt, Human
uccauagucuccuaccccuccugg

SEQ ID NO: 1346827 - RNA, 24 nt, Human
ucccuggagucagugaugucggca

SEQ ID NO: 1346828 - RNA, 26 nt, Human
ucccuggagucagugaugucggcauu

SEQ ID NO: 1346829 - RNA, 19 nt, Human
ucucuuggagaaggaguag

SEQ ID NO: 1346830 - RNA, 20 nt, Human
ugaaaaaagaugacugggca

SEQ ID NO: 1346831 - RNA, 19 nt, Human
ugcgcugggggcggccggu

SEQ ID NO: 1346832 - RNA, 19 nt, Human
ugggaagaccuuguaugga

SEQ ID NO: 1346833 - RNA, 23 nt, Human
ugggggcggccggugcgucgggg

SEQ ID NO: 1346834 - RNA, 18 nt, Human
ugggguggucaucaguuc

SEQ ID NO: 1346835 - RNA, 19 nt, Human
ugguugaguuucuuggaga

SEQ ID NO: 1346836 - RNA, 23 nt, Human
ugugcuggcuccaucuucugggg

SEQ ID NO: 1346837 - RNA, 19 nt, Human
uuggccagucacaaacacc

SEQ ID NO: 1346838 - RNA, 24 nt, Human
uugggguggucaucaguucuucuc

SEQ ID NO: 1346839 - RNA, 21 nt, Human
uuguacagguaaaagaagauc

SEQ ID NO: 1346840 - RNA, 23 nt, Human
uuucuuggagaagaggcagauca

SEQ ID NO: 1346841 - RNA, 19 nt, Human
uuuuuuuuuuuuuuuuugu

SEQ ID NO: 1346842 - RNA, 21 nt, Human
uuuuuuuuuuuuuuuuuuugg

SEQ ID NO: 1346843 - RNA, 20 nt, Human
aagggucccugggucugggc

SEQ ID NO: 1346844 - RNA, 19 nt, Human
agcccaggggcaggaggau

SEQ ID NO: 1346845 - RNA, 20 nt, Human
aggcaggagagggcuggggc

SEQ ID NO: 1346846 - RNA, 25 nt, Human
aggcaggagagggcuggggccaggg

SEQ ID NO: 1346847 - RNA, 18 nt, Human
agggcuggggccagggga

SEQ ID NO: 1346848 - RNA, 22 nt, Human
agggcuggggccaggggaguuu

SEQ ID NO: 1346849 - RNA, 24 nt, Human
auuuggagcuggagggguuggggc

SEQ ID NO: 1346850 - RNA, 24 nt, Human
cauugugcgggccucugaggcugu

SEQ ID NO: 1346851 - RNA, 18 nt, Human
ccacagcggccccuccuc

SEQ ID NO: 1346852 - RNA, 22 nt, Human
ccagaccacagcggccccuccu

SEQ ID NO: 1346853 - RNA, 19 nt, Human
ccucugaggcuguggcagg

SEQ ID NO: 1346854 - RNA, 26 nt, Human
ccucugaggcuguggcagggguaccc

SEQ ID NO: 1346855 - RNA, 18 nt, Human
ccuggcagagaggaggug

SEQ ID NO: 1346856 - RNA, 23 nt, Human
cgacccagggggucccugagagc

SEQ ID NO: 1346857 - RNA, 20 nt, Human
cgcuggcuuuuauugccucc

SEQ ID NO: 1346858 - RNA, 21 nt, Human
cuaugacagccccucccuggg

SEQ ID NO: 1346859 - RNA, 23 nt, Human
cugggacuaugacagccccuccc

SEQ ID NO: 1346860 - RNA, 23 nt, Human
gccagaccacagcggccccuccu

SEQ ID NO: 1346861 - RNA, 19 nt, Human
gccuggacagggagggggc

SEQ ID NO: 1346862 - RNA, 18 nt, Human
ggagcuggagggguuggg

SEQ ID NO: 1346863 - RNA, 19 nt, Human
ggagcuggagggguugggg

SEQ ID NO: 1346864 - RNA, 19 nt, Human
ggguugggggugugacagg

SEQ ID NO: 1346865 - RNA, 24 nt, Human
ucagucagaaauagguauugcuua

SEQ ID NO: 1346866 - RNA, 21 nt, Human
ucccugagagcccaggggcag

SEQ ID NO: 1346867 - RNA, 22 nt, Human
ucccugagagcccaggggcagg

SEQ ID NO: 1346868 - RNA, 19 nt, Human
uccuggcagagaggaggug

SEQ ID NO: 1346869 - RNA, 19 nt, Human
ugagcuuggggccaagggu

SEQ ID NO: 1346870 - RNA, 23 nt, Human
uggaggcucagauuuggagcugg

SEQ ID NO: 1346871 - RNA, 21 nt, Human
ugugguggaggcucagauuug

SEQ ID NO: 1346872 - RNA, 23 nt, Human
aacccuguugguuucaccuguug

SEQ ID NO: 1346873 - RNA, 20 nt, Human
acuucaguacuucaaguguu

SEQ ID NO: 1346874 - RNA, 23 nt, Human
ccuacuauuggaguagaugaaac

SEQ ID NO: 1346875 - RNA, 20 nt, Human
ccuuaacuuuuagaaagagg

SEQ ID NO: 1346876 - RNA, 21 nt, Human
cucuucagauuuuacugugca

SEQ ID NO: 1346877 - RNA, 25 nt, Human
uaacagcaugaaaucugacuucagu

SEQ ID NO: 1346878 - RNA, 22 nt, Human
uauuggaguagaugaaacccug

SEQ ID NO: 1346879 - RNA, 23 nt, Human
aaaauaucuugagucuccaacua

SEQ ID NO: 1346880 - RNA, 26 nt, Human
aaucacauuacucuucacagaauuca

SEQ ID NO: 1346881 - RNA, 24 nt, Human
acccauguacccugcugcuccgga

SEQ ID NO: 1346882 - RNA, 19 nt, Human
accgcauuuggggcaggau

SEQ ID NO: 1346883 - RNA, 19 nt, Human
acugcccaugcaagggaau

SEQ ID NO: 1346884 - RNA, 19 nt, Human
caaccgccugggucccgcc

SEQ ID NO: 1346885 - RNA, 24 nt, Human
caaucacauuacucuucacagaau

SEQ ID NO: 1346886 - RNA, 22 nt, Human
cacagaauucacagaauucauu

SEQ ID NO: 1346887 - RNA, 20 nt, Human
cagccaaugggcugcaguca

SEQ ID NO: 1346888 - RNA, 23 nt, Human
cagccucaaccgccugggucccg

SEQ ID NO: 1346889 - RNA, 18 nt, Human
caugcaagggaauacacc

SEQ ID NO: 1346890 - RNA, 25 nt, Human
ccauguacccugcugcuccggacgc

SEQ ID NO: 1346891 - RNA, 19 nt, Human
cccauguacccugcugcuc

SEQ ID NO: 1346892 - RNA, 20 nt, Human
ccccaaagcucuggggaacc

SEQ ID NO: 1346893 - RNA, 23 nt, Human
ccgggcccggaccccggcccucg

SEQ ID NO: 1346894 - RNA, 18 nt, Human
cuagccccgggcugggac

SEQ ID NO: 1346895 - RNA, 21 nt, Human
cuccugaccagccucaaccgc

SEQ ID NO: 1346896 - RNA, 18 nt, Human
cugaaugaaccucccacc

SEQ ID NO: 1346897 - RNA, 20 nt, Human
cugaaugaaccucccaccca

SEQ ID NO: 1346898 - RNA, 24 nt, Human
cuggggaaccguggauaccaggga

SEQ ID NO: 1346899 - RNA, 20 nt, Human
cugugugcagaaugcaggcu

SEQ ID NO: 1346900 - RNA, 21 nt, Human
gaacuugaagacuucauggua

SEQ ID NO: 1346901 - RNA, 20 nt, Human
gccugggucccgccgccggg

SEQ ID NO: 1346902 - RNA, 23 nt, Human
gccugggucccgccgccgggccc

SEQ ID NO: 1346903 - RNA, 22 nt, Human
gcuccggacgcucugagggcua

SEQ ID NO: 1346904 - RNA, 21 nt, Human
ggcuggcugacuccugaccag

SEQ ID NO: 1346905 - RNA, 19 nt, Human
ggggaugggagcagaugcu

SEQ ID NO: 1346906 - RNA, 19 nt, Human
uaaggaaugucucaaagaa

SEQ ID NO: 1346907 - RNA, 21 nt, Human
uacagcuugccacuuuccucc

SEQ ID NO: 1346908 - RNA, 24 nt, Human
uacaugggucucuauguaaaacuu

SEQ ID NO: 1346909 - RNA, 19 nt, Human
uagacuuauuuucaaucac

SEQ ID NO: 1346910 - RNA, 22 nt, Human
uagcacauugaaauagaaaaga

SEQ ID NO: 1346911 - RNA, 19 nt, Human
uagccccgggcugggaccu

SEQ ID NO: 1346912 - RNA, 19 nt, Human
ucauacaugggucucuaug

SEQ ID NO: 1346913 - RNA, 22 nt, Human
uccccaaagcucuggggaaccg

SEQ ID NO: 1346914 - RNA, 18 nt, Human
ucccugagagugguggcu

SEQ ID NO: 1346915 - RNA, 24 nt, Human
uccgaccgcauuuggggcaggauc

SEQ ID NO: 1346916 - RNA, 18 nt, Human
uccggacgcucugagggc

SEQ ID NO: 1346917 - RNA, 24 nt, Human
ucgcgugguccccaaagcucuggg

SEQ ID NO: 1346918 - RNA, 19 nt, Human
ucuacagcuugccacuuuc

SEQ ID NO: 1346919 - RNA, 18 nt, Human
ugacuccugaccagccuc

SEQ ID NO: 1346920 - RNA, 23 nt, Human
ugagucuccaacuauaaggaaug

SEQ ID NO: 1346921 - RNA, 19 nt, Human
ugaugcaacaaaaauaucu

SEQ ID NO: 1346922 - RNA, 22 nt, Human
ugcccaugcaagggaauacacc

SEQ ID NO: 1346923 - RNA, 24 nt, Human
ugcgacugcuguggguucacucag

SEQ ID NO: 1346924 - RNA, 18 nt, Human
ugcuuugcacaagcuucu

SEQ ID NO: 1346925 - RNA, 24 nt, Human
ugggggaugggagcagaugcugug

SEQ ID NO: 1346926 - RNA, 18 nt, Human
uggugggugcugaaugaa

SEQ ID NO: 1346927 - RNA, 18 nt, Human
uggugggugcugaaugaa

SEQ ID NO: 1346928 - RNA, 22 nt, Human
ugucucaaagaaaauguccuug

SEQ ID NO: 1346929 - RNA, 19 nt, Human
uugaagacuucaugguaga

SEQ ID NO: 1346930 - RNA, 24 nt, Human
uugccacuuuccucccuggucuug

SEQ ID NO: 1346931 - RNA, 25 nt, Human
uuggagguuuucgcgugguccccaa

SEQ ID NO: 1346932 - RNA, 24 nt, Human
uuugcacaagcuucucagugacau

SEQ ID NO: 1346933 - RNA, 21 nt, Human
uuuggggcaggaucccugaga

SEQ ID NO: 1346934 - RNA, 21 nt, Human
uuuuacagcuguuuagacuua

SEQ ID NO: 1346935 - RNA, 20 nt, Human
uuuuuuuuuuuuuuuuugcu

SEQ ID NO: 1346936 - RNA, 23 nt, Human
uuuuuuuuuuuuuuuuuugcuga

SEQ ID NO: 1346937 - RNA, 20 nt, Human
uuuuuuuuuuuuuuuuuugg

SEQ ID NO: 1346938 - RNA, 22 nt, Human
aaagcaccaaucaacuuuacag

SEQ ID NO: 1346939 - RNA, 21 nt, Human
aaaggagcucugaagggacca

SEQ ID NO: 1346940 - RNA, 21 nt, Human
aaaguaagaaccaaugucagg

SEQ ID NO: 1346941 - RNA, 21 nt, Human
aaauucucuugcuccccgcuu

SEQ ID NO: 1346942 - RNA, 18 nt, Human
aaggagcucugaagggac

SEQ ID NO: 1346943 - RNA, 22 nt, Human
aagugacuccacagaggggaag

SEQ ID NO: 1346944 - RNA, 23 nt, Human
aagugacuccacagaggggaagg

SEQ ID NO: 1346945 - RNA, 24 nt, Human
aauacaaaagugacuccacagaag

SEQ ID NO: 1346946 - RNA, 20 nt, Human
agaggaggcagcauacaaaa

SEQ ID NO: 1346947 - RNA, 19 nt, Human
agcuccgaccccucccauu

SEQ ID NO: 1346948 - RNA, 19 nt, Human
aggaggccgcugccugccc

SEQ ID NO: 1346949 - RNA, 24 nt, Human
aucagcugcuccccaaaccuucaa

SEQ ID NO: 1346950 - RNA, 18 nt, Human
auccccuccuugcccagu

SEQ ID NO: 1346951 - RNA, 20 nt, Human
augucaggauucacaaaaca

SEQ ID NO: 1346952 - RNA, 22 nt, Human
caaaaguaagaaccaaugucag

SEQ ID NO: 1346953 - RNA, 26 nt, Human
caacaacauuuuaagaaaucugguua

SEQ ID NO: 1346954 - RNA, 22 nt, Human
cagauaaauguuuacuuagaug

SEQ ID NO: 1346955 - RNA, 25 nt, Human
cagcauacaaaaguaagaaccaaug

SEQ ID NO: 1346956 - RNA, 23 nt, Human
cagcugguucuuuuucuuaaucu

SEQ ID NO: 1346957 - RNA, 22 nt, Human
caguggcagcuuuccaaaguuu

SEQ ID NO: 1346958 - RNA, 22 nt, Human
ccaaucaacuuuacagaucuga

SEQ ID NO: 1346959 - RNA, 25 nt, Human
ccacaaugggaacugggaacaaucc

SEQ ID NO: 1346960 - RNA, 21 nt, Human
ccaccgccaccgccgccaacg

SEQ ID NO: 1346961 - RNA, 25 nt, Human
ccaccgccaccgccgccaacguuag

SEQ ID NO: 1346962 - RNA, 27 nt, Human
ccaccgccgccaacguuagaccacuug

SEQ ID NO: 1346963 - RNA, 23 nt, Human
ccaucuacuggaugcugaaaguc

SEQ ID NO: 1346964 - RNA, 21 nt, Human
ccccagauucauggauccccu

SEQ ID NO: 1346965 - RNA, 21 nt, Human
cccgcuccgugcugcuccucc

SEQ ID NO: 1346966 - RNA, 18 nt, Human
ccgccgccaccgccaccg

SEQ ID NO: 1346967 - RNA, 21 nt, Human
ccgccgccaccgccaccgccg

SEQ ID NO: 1346968 - RNA, 25 nt, Human
ccgccgccaccgccaccgccgccaa

SEQ ID NO: 1346969 - RNA, 23 nt, Human
ccgccgccgccaccgccaccgcc

SEQ ID NO: 1346970 - RNA, 18 nt, Human
ccgccgccgccgccaccg

SEQ ID NO: 1346971 - RNA, 26 nt, Human
ccgcugagcagccaggaucccggucu

SEQ ID NO: 1346972 - RNA, 19 nt, Human
ccgcugccugcccuuggcg

SEQ ID NO: 1346973 - RNA, 20 nt, Human
ccgcugccugcccuuggcgc

SEQ ID NO: 1346974 - RNA, 20 nt, Human
ccucccauuguuguccccuc

SEQ ID NO: 1346975 - RNA, 19 nt, Human
ccuugcaagagcccuccuu

SEQ ID NO: 1346976 - RNA, 19 nt, Human
cgccacgcucucccgcucc

SEQ ID NO: 1346977 - RNA, 22 nt, Human
cggaugucucuuuucaaauucu

SEQ ID NO: 1346978 - RNA, 20 nt, Human
cucccauuguuguccccucu

SEQ ID NO: 1346979 - RNA, 20 nt, Human
cucugaagggaccacaaugg

SEQ ID NO: 1346980 - RNA, 20 nt, Human
cucuuccuuggcuccuuucu

SEQ ID NO: 1346981 - RNA, 22 nt, Human
cugaggcugcuuaguuguagcc

SEQ ID NO: 1346982 - RNA, 20 nt, Human
cugcuccccaaaccuucaac

SEQ ID NO: 1346983 - RNA, 23 nt, Human
cugcugccuucccgcugagcagc

SEQ ID NO: 1346984 - RNA, 24 nt, Human
cugggagggcacagaggaggcagc

SEQ ID NO: 1346985 - RNA, 28 nt, Human
cugugccagugugugugugugugugugg

SEQ ID NO: 1346986 - RNA, 19 nt, Human
gaccacuugccugcugccu

SEQ ID NO: 1346987 - RNA, 19 nt, Human
gacugggaggagacuccua

SEQ ID NO: 1346988 - RNA, 20 nt, Human
gaugcuguuggaaaggagcu

SEQ ID NO: 1346989 - RNA, 20 nt, Human
gauucauggauccccuccuu

SEQ ID NO: 1346990 - RNA, 18 nt, Human
gcuccgugcugcuccucc

SEQ ID NO: 1346991 - RNA, 21 nt, Human
gcuccgugcugcuccuccagg

SEQ ID NO: 1346992 - RNA, 22 nt, Human
guggggggaggaggcagcagag

SEQ ID NO: 1346993 - RNA, 25 nt, Human
guguguguguguaugcgugcgcgca

SEQ ID NO: 1346994 - RNA, 22 nt, Human
guguguguguguguguguguaa

SEQ ID NO: 1346995 - RNA, 19 nt, Human
uacuucuuguguuucccag

SEQ ID NO: 1346996 - RNA, 19 nt, Human
ucaugguucagcugguucu

SEQ ID NO: 1346997 - RNA, 20 nt, Human
uccuguugguuguacuucuu

SEQ ID NO: 1346998 - RNA, 24 nt, Human
uccuugcaagagcccuccuugcug

SEQ ID NO: 1346999 - RNA, 23 nt, Human
ucgccacgcucucccgcuccgug

SEQ ID NO: 1347000 - RNA, 24 nt, Human
ucggugccgccgccgccgccaccg

SEQ ID NO: 1347001 - RNA, 24 nt, Human
ucuccaguggcagcuuuucccaag

SEQ ID NO: 1347002 - RNA, 19 nt, Human
ucucccgcuccgugcugcu

SEQ ID NO: 1347003 - RNA, 24 nt, Human
ucucccgcuccgugcugcuccucc

SEQ ID NO: 1347004 - RNA, 27 nt, Human
ugaaacuugguggggggaggaggcagc

SEQ ID NO: 1347005 - RNA, 23 nt, Human
ugaaagucucgugggagcacacc

SEQ ID NO: 1347006 - RNA, 27 nt, Human
ugacuccacagaggggaaggaagagcu

SEQ ID NO: 1347007 - RNA, 21 nt, Human
ugaggcugcuuaguuguagcc

SEQ ID NO: 1347008 - RNA, 19 nt, Human
ugcgcgcacgcacgcagua

SEQ ID NO: 1347009 - RNA, 21 nt, Human
ugcgcgcacgcacgcaguagc

SEQ ID NO: 1347010 - RNA, 18 nt, Human
uggaaaggagcucugaag

SEQ ID NO: 1347011 - RNA, 18 nt, Human
uggagcagauuaacaagg

SEQ ID NO: 1347012 - RNA, 19 nt, Human
uggcgcugguuccuguugg

SEQ ID NO: 1347013 - RNA, 23 nt, Human
ugggagggcacagaggaggcagc

SEQ ID NO: 1347014 - RNA, 19 nt, Human
ugguggggggaggaggcag

SEQ ID NO: 1347015 - RNA, 22 nt, Human
ugguggggggaggaggcagcag

SEQ ID NO: 1347016 - RNA, 18 nt, Human
ugguucuuucucauuugg

SEQ ID NO: 1347017 - RNA, 21 nt, Human
ugguucuuuuucuuaaucucu

SEQ ID NO: 1347018 - RNA, 24 nt, Human
uguguguaugcgugcgcgcacgca

SEQ ID NO: 1347019 - RNA, 19 nt, Human
uguguguguguaugcgugc

SEQ ID NO: 1347020 - RNA, 21 nt, Human
uguguguguguguguaugcgu

SEQ ID NO: 1347021 - RNA, 21 nt, Human
uguguguguguguguguaugc

SEQ ID NO: 1347022 - RNA, 24 nt, Human
uguguguguguguguguaugcgug

SEQ ID NO: 1347023 - RNA, 18 nt, Human
ugugugugugugugugug

SEQ ID NO: 1347024 - RNA, 19 nt, Human
ugugugugugugugugugu

SEQ ID NO: 1347025 - RNA, 25 nt, Human
uucaugauuucuugugguucuuucu

SEQ ID NO: 1347026 - RNA, 18 nt, Human
uuggagcagauuaacaag

SEQ ID NO: 1347027 - RNA, 23 nt, Human
uuggagcagauuaacaaggaaaa

SEQ ID NO: 1347028 - RNA, 19 nt, Human
uuguuucaugguucagcug

SEQ ID NO: 1347029 - RNA, 24 nt, Human
uuuaagaaaucugguuaaaaagaa

SEQ ID NO: 1347030 - RNA, 19 nt, Human
cacggcccuagaacggggc

SEQ ID NO: 1347031 - RNA, 22 nt, Human
ccccuagggcgggucccggcuc

SEQ ID NO: 1347032 - RNA, 20 nt, Human
ccgcgccuccccgugccggg

SEQ ID NO: 1347033 - RNA, 21 nt, Human
cugcuacagucucggcaaagg

SEQ ID NO: 1347034 - RNA, 22 nt, Human
cugcuacagucucggcaaaggc

SEQ ID NO: 1347035 - RNA, 18 nt, Human
gcgggcuggcgggcgagc

SEQ ID NO: 1347036 - RNA, 20 nt, Human
gggcgagcggcgagcgcgcg

SEQ ID NO: 1347037 - RNA, 25 nt, Human
gggcgagcggcgagcgcgcggcgau

SEQ ID NO: 1347038 - RNA, 23 nt, Human
gugcgccccgcgccuccccgugc

SEQ ID NO: 1347039 - RNA, 23 nt, Human
guggagcgcgccgccacggaccc

SEQ ID NO: 1347040 - RNA, 22 nt, Human
uagaacggggcgccgccuccga

SEQ ID NO: 1347041 - RNA, 19 nt, Human
ucucugcuacagucucggc

SEQ ID NO: 1347042 - RNA, 24 nt, Human
ucucugcuacagucucggcaaagg

SEQ ID NO: 1347043 - RNA, 18 nt, Human
aaaaacaagccaaaaaaa

SEQ ID NO: 1347044 - RNA, 22 nt, Human
aaagucaaacugaaaccacgga

SEQ ID NO: 1347045 - RNA, 20 nt, Human
aagaggacaggagaaaguca

SEQ ID NO: 1347046 - RNA, 21 nt, Human
aagguugagggcaaaaugaca

SEQ ID NO: 1347047 - RNA, 23 nt, Human
acacauccaucccacauagcaca

SEQ ID NO: 1347048 - RNA, 21 nt, Human
acaggagaaagucagcacaag

SEQ ID NO: 1347049 - RNA, 19 nt, Human
acaggagccacgggaaaga

SEQ ID NO: 1347050 - RNA, 21 nt, Human
acccuucccccagaagccugu

SEQ ID NO: 1347051 - RNA, 21 nt, Human
acuggaacgcaguguucuacu

SEQ ID NO: 1347052 - RNA, 21 nt, Human
agaaggcugggccagagccaa

SEQ ID NO: 1347053 - RNA, 23 nt, Human
agagauccuuuccuuuggccucc

SEQ ID NO: 1347054 - RNA, 23 nt, Human
agcacaagacuaaaagggcccca

SEQ ID NO: 1347055 - RNA, 22 nt, Human
agccaaaaaaaaaaaaaaaaaa

SEQ ID NO: 1347056 - RNA, 23 nt, Human
agccaccccugcccuggcuccca

SEQ ID NO: 1347057 - RNA, 24 nt, Human
agggggcugcuuagccccagccag

SEQ ID NO: 1347058 - RNA, 19 nt, Human
aggugcugguuucuucugg

SEQ ID NO: 1347059 - RNA, 18 nt, Human
auggguaacaggggagaa

SEQ ID NO: 1347060 - RNA, 18 nt, Human
caagaccggggugacugg

SEQ ID NO: 1347061 - RNA, 22 nt, Human
cacaagacuaaaagggccccag

SEQ ID NO: 1347062 - RNA, 22 nt, Human
cacaaucccauggagggacagg

SEQ ID NO: 1347063 - RNA, 22 nt, Human
caccaucaccucaaaagagauc

SEQ ID NO: 1347064 - RNA, 25 nt, Human
caccccugcccuggcucccaggucu

SEQ ID NO: 1347065 - RNA, 23 nt, Human
cagcacaagacuaaaagggcccc

SEQ ID NO: 1347066 - RNA, 19 nt, Human
cagcaccaucaccucaaaa

SEQ ID NO: 1347067 - RNA, 21 nt, Human
cagccaccccugcccuggcuc

SEQ ID NO: 1347068 - RNA, 22 nt, Human
caggcuccaugucuugcucuuc

SEQ ID NO: 1347069 - RNA, 21 nt, Human
cauucccgugauggccaaggg

SEQ ID NO: 1347070 - RNA, 24 nt, Human
ccaaaaaaaaaaaaaaaaaacccc

SEQ ID NO: 1347071 - RNA, 19 nt, Human
ccaacacugagcucuuucu

SEQ ID NO: 1347072 - RNA, 22 nt, Human
ccaacacugagcucuuucuagc

SEQ ID NO: 1347073 - RNA, 23 nt, Human
ccaauaccacauucugaacacag

SEQ ID NO: 1347074 - RNA, 18 nt, Human
ccacgggaaagaggugcu

SEQ ID NO: 1347075 - RNA, 23 nt, Human
cccccagccugauggccugccgu

SEQ ID NO: 1347076 - RNA, 22 nt, Human
ccccugcccuggcucccagguc

SEQ ID NO: 1347077 - RNA, 23 nt, Human
ccgcugcccucacaggauggcag

SEQ ID NO: 1347078 - RNA, 19 nt, Human
ccuugucccacacucgaaa

SEQ ID NO: 1347079 - RNA, 22 nt, Human
cggaggagggggcugcuuagcc

SEQ ID NO: 1347080 - RNA, 18 nt, Human
cuaaacuggaagaggaca

SEQ ID NO: 1347081 - RNA, 21 nt, Human
cucacaggauggcaguuccgu

SEQ ID NO: 1347082 - RNA, 28 nt, Human
cuccagaaacagcucggccagcaccauc

SEQ ID NO: 1347083 - RNA, 27 nt, Human
cuccccugucuuauucuaaacuggaag

SEQ ID NO: 1347084 - RNA, 22 nt, Human
cucgaaaagccuuuuucucccc

SEQ ID NO: 1347085 - RNA, 19 nt, Human
cugggccagagccaauacc

SEQ ID NO: 1347086 - RNA, 18 nt, Human
cuugcucuucaauuccgu

SEQ ID NO: 1347087 - RNA, 19 nt, Human
gagcaucuccagaaacagc

SEQ ID NO: 1347088 - RNA, 18 nt, Human
gccaaaaaaaaaaaaaaa

SEQ ID NO: 1347089 - RNA, 20 nt, Human
gccaaaaaaaaaaaaaaaaa

SEQ ID NO: 1347090 - RNA, 21 nt, Human
gccccaggagaaauaccaagg

SEQ ID NO: 1347091 - RNA, 19 nt, Human
gcccccagccugauggccu

SEQ ID NO: 1347092 - RNA, 19 nt, Human
gcucuuucuagcauggacu

SEQ ID NO: 1347093 - RNA, 23 nt, Human
gcugguuucuucuggcaagaccg

SEQ ID NO: 1347094 - RNA, 22 nt, Human
ggaaagaggugcugguuucuuc

SEQ ID NO: 1347095 - RNA, 19 nt, Human
ggccuccgauccuccacaa

SEQ ID NO: 1347096 - RNA, 21 nt, Human
ggggagaaggcugggccagag

SEQ ID NO: 1347097 - RNA, 26 nt, Human
uaaaaaacaagccaaaaaaaaaaaaa

SEQ ID NO: 1347098 - RNA, 19 nt, Human
uaaaagggccccaggagaa

SEQ ID NO: 1347099 - RNA, 20 nt, Human
uaaacucuauagccaaaauc

SEQ ID NO: 1347100 - RNA, 20 nt, Human
uaaacuggaagaggacagga

SEQ ID NO: 1347101 - RNA, 20 nt, Human
uagcacagcccccagccuga

SEQ ID NO: 1347102 - RNA, 18 nt, Human
uagcagagccugugccau

SEQ ID NO: 1347103 - RNA, 24 nt, Human
uagccaaaaucccucuggagcauc

SEQ ID NO: 1347104 - RNA, 20 nt, Human
ucaauuccguucacugacau

SEQ ID NO: 1347105 - RNA, 24 nt, Human
ucacugacaucagaccuuguccca

SEQ ID NO: 1347106 - RNA, 20 nt, Human
ucagcacaagacuaaaaggg

SEQ ID NO: 1347107 - RNA, 30 nt, Human
ucccucuggagcaucuccagaaacagcucu

SEQ ID NO: 1347108 - RNA, 20 nt, Human
uccuccacaaucccauggag

SEQ ID NO: 1347109 - RNA, 24 nt, Human
uccuccacaaucccauggagggac

SEQ ID NO: 1347110 - RNA, 25 nt, Human
ucuauagccaaaaucccucuggagc

SEQ ID NO: 1347111 - RNA, 24 nt, Human
ucuccagaaacagcucggccagca

SEQ ID NO: 1347112 - RNA, 24 nt, Human
ucuuucuagcauggacuccauucc

SEQ ID NO: 1347113 - RNA, 23 nt, Human
ugacuggaacgcaguguucuacu

SEQ ID NO: 1347114 - RNA, 21 nt, Human
ugagcauggggucagccaccc

SEQ ID NO: 1347115 - RNA, 23 nt, Human
ugcccuggcucccaggucucgcu

SEQ ID NO: 1347116 - RNA, 21 nt, Human
uggaaagaggcaagaauuaug

SEQ ID NO: 1347117 - RNA, 18 nt, Human
uggaagaggacaggagaa

SEQ ID NO: 1347118 - RNA, 24 nt, Human
ugucuugcucuucaauuccguuca

SEQ ID NO: 1347119 - RNA, 27 nt, Human
uuuuuuuuuuuuuuuuuuuuuuugggg

SEQ ID NO: 1347120 - RNA, 31 nt, Human; identical to SEQ ID NO: 314735

SEQ ID NO: 1347121 - RNA, 25 nt, Human
aaggagaccccggcaccugccuccu

SEQ ID NO: 1347122 - RNA, 20 nt, Human
accaaaguacacagacccua

SEQ ID NO: 1347123 - RNA, 23 nt, Human
caaaggagaccccggcaccugcc

SEQ ID NO: 1347124 - RNA, 19 nt, Human
caccugccuccgcggcagc

SEQ ID NO: 1347125 - RNA, 19 nt, Human
gcagccaggaccacacugc

SEQ ID NO: 1347126 - RNA, 23 nt, Human
gcagcugcccacugaaauauuua

SEQ ID NO: 1347127 - RNA, 20 nt, Human
uagaauacaaccaaaguaca

SEQ ID NO: 1347128 - RNA, 25 nt, Human
uccuccucuuucuaagcucuucaca

SEQ ID NO: 1347129 - RNA, 19 nt, Human
ugaaggaaauaugcugugu

SEQ ID NO: 1347130 - RNA, 20 nt, Human
ugaggcaaaggagaccccgg

SEQ ID NO: 1347131 - RNA, 18 nt, Human
ugggaucacagagauggc

SEQ ID NO: 1347132 - RNA, 19 nt, Human
ugggaucacagagauggcc

SEQ ID NO: 1347133 - RNA, 19 nt, Human
uuagaauacaaccaaagua

SEQ ID NO: 1347134 - RNA, 20 nt, Human
uucacauugaggcaaaggag

SEQ ID NO: 1347135 - RNA, 22 nt, Human
uucacugucaauaaaagauaaa

SEQ ID NO: 1347136 - RNA, 19 nt, Human
cagcucccuugucacagaa

SEQ ID NO: 1347137 - RNA, 21 nt, Human
cccuugucacagaagaucuug

SEQ ID NO: 1347138 - RNA, 20 nt, Human
cgcucagugcccaagccaca

SEQ ID NO: 1347139 - RNA, 20 nt, Human
ucugcagguucagggggaca

SEQ ID NO: 1347140 - RNA, 26 nt, Human
uuaaugguuacgaaaucuguuucuuc

SEQ ID NO: 1347141 - RNA, 21 nt, Human
uuccucucagcucccuuguca

SEQ ID NO: 1347142 - RNA, 24 nt, Human
aaaaaaaaaaaaaaaaaaacaaaa

SEQ ID NO: 1347143 - RNA, 27 nt, Human
aaaaaaaaaaaaaaaaacaaaacacau

SEQ ID NO: 1347144 - RNA, 23 nt, Human
aaaaacccaacaauaaaauacug

SEQ ID NO: 1347145 - RNA, 20 nt, Human
aaaacacaucacaaacugca

SEQ ID NO: 1347146 - RNA, 26 nt, Human
aaacacaucacaaacugcacuugaag

SEQ ID NO: 1347147 - RNA, 21 nt, Human
aaagcacauuugcaaaaauaa

SEQ ID NO: 1347148 - RNA, 25 nt, Human
aaaugcaacacgauuuaaaaaaagg

SEQ ID NO: 1347149 - RNA, 21 nt, Human
aacaaaacacaucacaaacug

SEQ ID NO: 1347150 - RNA, 23 nt, Human
aagaaaacuuuaacaaauauugc

SEQ ID NO: 1347151 - RNA, 25 nt, Human
aagaaaagggauauuccauccauac

SEQ ID NO: 1347152 - RNA, 28 nt, Human
aagaacuuagaaagcuauaaaaggacug

SEQ ID NO: 1347153 - RNA, 23 nt, Human
aagacauauauugcauuuaauau

SEQ ID NO: 1347154 - RNA, 20 nt, Human
aaggcucaauuuuuucucca

SEQ ID NO: 1347155 - RNA, 24 nt, Human
aaucuauugaggaagcuaaaauaa

SEQ ID NO: 1347156 - RNA, 25 nt, Human
aaugacaagaaugaaaucuauugga

SEQ ID NO: 1347157 - RNA, 19 nt, Human
aauguagauaccacuuuau

SEQ ID NO: 1347158 - RNA, 21 nt, Human
acaaagucucaaaguauuaac

SEQ ID NO: 1347159 - RNA, 27 nt, Human
acacugccacacguaaaccgggugucc

SEQ ID NO: 1347160 - RNA, 23 nt, Human
acagaugucuauuuuauuaaaaa

SEQ ID NO: 1347161 - RNA, 23 nt, Human
acaugcaaucuauugaggaagcu

SEQ ID NO: 1347162 - RNA, 24 nt, Human
agaaacaagaacacaaucuacagg

SEQ ID NO: 1347163 - RNA, 21 nt, Human
agaaagcuauaaaaggacuga

SEQ ID NO: 1347164 - RNA, 21 nt, Human
agaacuuuggugcaguaggug

SEQ ID NO: 1347165 - RNA, 21 nt, Human
agaguucacuuugagggaauu

SEQ ID NO: 1347166 - RNA, 27 nt, Human
aggaaagaaacauuauaaaaaaaucaa

SEQ ID NO: 1347167 - RNA, 19 nt, Human
aggucauaacuaaauuuag

SEQ ID NO: 1347168 - RNA, 22 nt, Human
aggucauaacuaaauuuagaac

SEQ ID NO: 1347169 - RNA, 24 nt, Human
auaaaaaaaucaaaaucucuagaa

SEQ ID NO: 1347170 - RNA, 19 nt, Human
auaaagacaagacauauau

SEQ ID NO: 1347171 - RNA, 18 nt, Human
auguagauaccacuuuau

SEQ ID NO: 1347172 - RNA, 24 nt, Human
caaaacacaucacaaacugcacuu

SEQ ID NO: 1347173 - RNA, 25 nt, Human
caaaaugacaagaaugaaaucuauu

SEQ ID NO: 1347174 - RNA, 20 nt, Human
caacaauaaaauacugucaa

SEQ ID NO: 1347175 - RNA, 22 nt, Human
caagaacacaaucuacaggaaa

SEQ ID NO: 1347176 - RNA, 21 nt, Human
caaggcucaguucugcaaccc

SEQ ID NO: 1347177 - RNA, 18 nt, Human
cacugccacacguaaaca

SEQ ID NO: 1347178 - RNA, 20 nt, Human
ccacuuuauuugaacaucac

SEQ ID NO: 1347179 - RNA, 18 nt, Human
ccauaauaaagacaagac

SEQ ID NO: 1347180 - RNA, 18 nt, Human
ccaugaucacuuaaccua

SEQ ID NO: 1347181 - RNA, 18 nt, Human
cgauuuaaaaaaaggaaa

SEQ ID NO: 1347182 - RNA, 20 nt, Human
cuaaaaucaaauaaaaaccc

SEQ ID NO: 1347183 - RNA, 20 nt, Human
cuaauaacaaugauccauga

SEQ ID NO: 1347184 - RNA, 19 nt, Human
cuccaaagcagcaucugug

SEQ ID NO: 1347185 - RNA, 18 nt, Human
cuguaauagagacagguu

SEQ ID NO: 1347186 - RNA, 20 nt, Human
gacuuggcgcuauucucccu

SEQ ID NO: 1347187 - RNA, 19 nt, Human
gaugccauaauaaagacaa

SEQ ID NO: 1347188 - RNA, 23 nt, Human
gcaaaaauaaaaaauagcccaga

SEQ ID NO: 1347189 - RNA, 23 nt, Human
gcaaaugaaaagcacacaacuaa

SEQ ID NO: 1347190 - RNA, 20 nt, Human
gcugacccauaaaucacauu

SEQ ID NO: 1347191 - RNA, 20 nt, Human
gcugcaguuacuaacuucug

SEQ ID NO: 1347192 - RNA, 23 nt, Human
ggugcaguaggugagcugcaguu

SEQ ID NO: 1347193 - RNA, 20 nt, Human
guaaacgugcuaagcauucc

SEQ ID NO: 1347194 - RNA, 24 nt, Human
gugaaaaccuaauggaacugaaug

SEQ ID NO: 1347195 - RNA, 24 nt, Human
guuugguauuaaagugcaaacuua

SEQ ID NO: 1347196 - RNA, 22 nt, Human
uaaaaaauagcccagagacuug

SEQ ID NO: 1347197 - RNA, 18 nt, Human
uaaaauguucaaguauuc

SEQ ID NO: 1347198 - RNA, 21 nt, Human
uaaauacaagucgagaaacug

SEQ ID NO: 1347199 - RNA, 21 nt, Human
uaaauagauguauggcaacau

SEQ ID NO: 1347200 - RNA, 23 nt, Human
uaaaugagauuaacacaugugaa

SEQ ID NO: 1347201 - RNA, 25 nt, Human
uaaggucgauggaucuugaaggcca

SEQ ID NO: 1347202 - RNA, 22 nt, Human
uaaguuuccuuucugauucuac

SEQ ID NO: 1347203 - RNA, 22 nt, Human
uaauggucaugcugacccauaa

SEQ ID NO: 1347204 - RNA, 18 nt, Human
uacaaaaaaaaaaaaaaa

SEQ ID NO: 1347205 - RNA, 18 nt, Human
uacaaauaggaugaagca

SEQ ID NO: 1347206 - RNA, 19 nt, Human
uaccaaggcucaguucugc

SEQ ID NO: 1347207 - RNA, 19 nt, Human
uagaauuucacaaagccac

SEQ ID NO: 1347208 - RNA, 20 nt, Human
uauauugcauuuaauauuaa

SEQ ID NO: 1347209 - RNA, 18 nt, Human
ucaaauaucaauuguaac

SEQ ID NO: 1347210 - RNA, 20 nt, Human
ucagaacauguuaauuacaa

SEQ ID NO: 1347211 - RNA, 22 nt, Human
ucgagaacuuuggugcaguagg

SEQ ID NO: 1347212 - RNA, 20 nt, Human
ugaagcacugguacgaggua

SEQ ID NO: 1347213 - RNA, 19 nt, Human
ugacccauaaaucacauga

SEQ ID NO: 1347214 - RNA, 18 nt, Human
ugagaaauaacuaaaaag

SEQ ID NO: 1347215 - RNA, 21 nt, Human
ugagaaauaacuaaaaagcaa

SEQ ID NO: 1347216 - RNA, 19 nt, Human
ugcaaaugaaaagcacaca

SEQ ID NO: 1347217 - RNA, 18 nt, Human
ugcaguaggugagcugca

SEQ ID NO: 1347218 - RNA, 21 nt, Human
ugccucuaucuuuacaaucuc

SEQ ID NO: 1347219 - RNA, 23 nt, Human
uggagaaaccaccuuuaaaauca

SEQ ID NO: 1347220 - RNA, 21 nt, Human
ugugaaaaccuaauggaacug

SEQ ID NO: 1347221 - RNA, 21 nt, Human
uuaaaaaaguuacaaacaggu

SEQ ID NO: 1347222 - RNA, 21 nt, Human
uuacaaacagguggacugcag

SEQ ID NO: 1347223 - RNA, 24 nt, Human
uuagaagcauguucaaaugacuaa

SEQ ID NO: 1347224 - RNA, 21 nt, Human
uuagagcuuuccuugacaaag

SEQ ID NO: 1347225 - RNA, 28 nt, Human
uugcuuuaaacuauuauucagaaagaca

SEQ ID NO: 1347226 - RNA, 18 nt, Human
uuuaaaaucacuuucccc

SEQ ID NO: 1347227 - RNA, 24 nt, Human
uuuaaacuauuauucagaaagaca

SEQ ID NO: 1347228 - RNA, 24 nt, Human
uuuagaauuucacaaagccacaaa

SEQ ID NO: 1347229 - RNA, 24 nt, Human
uuucugauucuacaccugcguuac

SEQ ID NO: 1347230 - RNA, 20 nt, Human
uuugcagagcccuacugcag

SEQ ID NO: 1347231 - RNA, 19 nt, Human
aacaaggcaucuugaaaac

SEQ ID NO: 1347232 - RNA, 23 nt, Human
aucaauguaaccuuccaguuccg

SEQ ID NO: 1347233 - RNA, 24 nt, Human
caaaagcagagucuugugccuucc

SEQ ID NO: 1347234 - RNA, 22 nt, Human
caacaaggcaucuugaaaacuc

SEQ ID NO: 1347235 - RNA, 24 nt, Human
cagaaugaagaacuucagccaaca

SEQ ID NO: 1347236 - RNA, 20 nt, Human
cagagccaaugauaccuucc

SEQ ID NO: 1347237 - RNA, 21 nt, Human
cagauagaguugcucuuccag

SEQ ID NO: 1347238 - RNA, 23 nt, Human
cagauagaguugcucuuccagga

SEQ ID NO: 1347239 - RNA, 18 nt, Human
caguggcagagagucucu

SEQ ID NO: 1347240 - RNA, 18 nt, Human
caguggcagagagucucu

SEQ ID NO: 1347241 - RNA, 19 nt, Human
cauucugguucuguugugg

SEQ ID NO: 1347242 - RNA, 27 nt, Human
cccacagucauugcuucauuccuuguc

SEQ ID NO: 1347243 - RNA, 20 nt, Human
ccuuccaguuccgggaagcc

SEQ ID NO: 1347244 - RNA, 22 nt, Human
gaagcucuccuacauccaucuu

SEQ ID NO: 1347245 - RNA, 21 nt, Human
gcagagucuugugccuucaaa

SEQ ID NO: 1347246 - RNA, 24 nt, Human
gcagagucuugugccuucaaagga

SEQ ID NO: 1347247 - RNA, 23 nt, Human
gggaugaaaacucuucaaaggaa

SEQ ID NO: 1347248 - RNA, 18 nt, Human
guucauauuccucuagga

SEQ ID NO: 1347249 - RNA, 20 nt, Human
uaaggcauccuguucccagu

SEQ ID NO: 1347250 - RNA, 23 nt, Human
uacauccaucuucuauaccagga

SEQ ID NO: 1347251 - RNA, 23 nt, Human
ucaaaggaaaaccuccccucaac

SEQ ID NO: 1347252 - RNA, 18 nt, Human
ucagguugcuaaagggag

SEQ ID NO: 1347253 - RNA, 20 nt, Human
ucauucugguucuguugugg

SEQ ID NO: 1347254 - RNA, 18 nt, Human
ucuaggaaauacuaugcu

SEQ ID NO: 1347255 - RNA, 21 nt, Human
ugaaaagacagcugagucugg

SEQ ID NO: 1347256 - RNA, 24 nt, Human
ugcagugggaagagagguagguac

SEQ ID NO: 1347257 - RNA, 23 nt, Human
ugcuucauuccuugucugaucaa

SEQ ID NO: 1347258 - RNA, 18 nt, Human
uggcagagagucucuuac

SEQ ID NO: 1347259 - RNA, 22 nt, Human
uggcagagagucucuuacucag

SEQ ID NO: 1347260 - RNA, 23 nt, Human
uggcagagagucucuuacucagg

SEQ ID NO: 1347261 - RNA, 23 nt, Human
ugggaugaaaacucuucaaagga

SEQ ID NO: 1347262 - RNA, 22 nt, Human
uggucuaucccagaaauuugca

SEQ ID NO: 1347263 - RNA, 20 nt, Human
uguagcuauucaggggacaa

SEQ ID NO: 1347264 - RNA, 20 nt, Human
uguagcuauucaggggacaa

SEQ ID NO: 1347265 - RNA, 21 nt, Human
uuacucagguugcuaaaggga

SEQ ID NO: 1347266 - RNA, 26 nt, Human
uucaaagcaacaaggcaucuugaaaa

SEQ ID NO: 1347267 - RNA, 20 nt, Human
uugcagcccaguggcagaga

SEQ ID NO: 1347268 - RNA, 23 nt, Human
uugcagcccaguggcagagaguc

SEQ ID NO: 1347269 - RNA, 19 nt, Human
uugugggcuaaggcauccu

SEQ ID NO: 1347270 - RNA, 26 nt, Human
uuuuuuuuuuuucaaggggagauuca

SEQ ID NO: 1347271 - RNA, 24 nt, Human
uuuuuuuuuuuuuuuuuuucaagg

SEQ ID NO: 1347272 - RNA, 19 nt, Human
aaaaacaaaacagagagga

SEQ ID NO: 1347273 - RNA, 25 nt, Human
aaaagaauaaaauuaagggaugggg

SEQ ID NO: 1347274 - RNA, 24 nt, Human
aaacagagaggaaagaaggauucg

SEQ ID NO: 1347275 - RNA, 18 nt, Human
aaggauucggggacaggg

SEQ ID NO: 1347276 - RNA, 19 nt, Human
acaaaacagagaggaaaga

SEQ ID NO: 1347277 - RNA, 21 nt, Human
caaaagccuucaccgaggccu

SEQ ID NO: 1347278 - RNA, 24 nt, Human
caaagagaugauauacagcaacac

SEQ ID NO: 1347279 - RNA, 23 nt, Human
cacauaaaaauaaaagcugaaau

SEQ ID NO: 1347280 - RNA, 20 nt, Human
caccgaggccugaacagggu

SEQ ID NO: 1347281 - RNA, 19 nt, Human
cagcucagggauaucgccu

SEQ ID NO: 1347282 - RNA, 19 nt, Human
ccagucgucguggacugga

SEQ ID NO: 1347283 - RNA, 19 nt, Human
cgaggccugaacaggguca

SEQ ID NO: 1347284 - RNA, 18 nt, Human
cuucaccgaggccugaac

SEQ ID NO: 1347285 - RNA, 18 nt, Human
cuugaaaugcacucuuca

SEQ ID NO: 1347286 - RNA, 22 nt, Human
cuuucuguaaucccucucucca

SEQ ID NO: 1347287 - RNA, 24 nt, Human
cuuucuguaaucccucucuccacc

SEQ ID NO: 1347288 - RNA, 18 nt, Human
gaaaaacaaaacagagag

SEQ ID NO: 1347289 - RNA, 19 nt, Human
ggaggggagagagggaggg

SEQ ID NO: 1347290 - RNA, 24 nt, Human
ggaggggagagagggaggggaaug

SEQ ID NO: 1347291 - RNA, 19 nt, Human
ggagggggaggggagagag

SEQ ID NO: 1347292 - RNA, 21 nt, Human
ggagggggaggggagagaggg

SEQ ID NO: 1347293 - RNA, 21 nt, Human
gggugggaaggggaguaacca

SEQ ID NO: 1347294 - RNA, 21 nt, Human
uaaccaaaagccuucaccgag

SEQ ID NO: 1347295 - RNA, 19 nt, Human
uaagggauggggugggaag

SEQ ID NO: 1347296 - RNA, 20 nt, Human
ucaguuaauuuguaaaugcu

SEQ ID NO: 1347297 - RNA, 21 nt, Human
ugaaaaacaaaacagagagga

SEQ ID NO: 1347298 - RNA, 22 nt, Human
ugaaauaagguguucuccuuuc

SEQ ID NO: 1347299 - RNA, 22 nt, Human
ugaaaugcacucuucaaaagaa

SEQ ID NO: 1347300 - RNA, 24 nt, Human
ugccuauucaucaaugcgcagaug

SEQ ID NO: 1347301 - RNA, 23 nt, Human
uucuguaaucccucucuccaccu

SEQ ID NO: 1347302 - RNA, 21 nt, Human
uuucuguaaucccucucucca

SEQ ID NO: 1347303 - RNA, 18 nt, Human
uuuuauuuucaucuuaca

SEQ ID NO: 1347304 - RNA, 22 nt, Human
aaaaccaaagaacccccaaauc

SEQ ID NO: 1347305 - RNA, 23 nt, Human
aaacagaugcgaggcuacuuuau

SEQ ID NO: 1347306 - RNA, 18 nt, Human
aaaccaaagaacccccaa

SEQ ID NO: 1347307 - RNA, 24 nt, Human
aaccaaagaacccccaaauccaaa

SEQ ID NO: 1347308 - RNA, 22 nt, Human
aaccaacacaaguaguauagca

SEQ ID NO: 1347309 - RNA, 20 nt, Human
aacccccaaauccaaacccc

SEQ ID NO: 1347310 - RNA, 24 nt, Human
aacccccaaauccaaaccccuaac

SEQ ID NO: 1347311 - RNA, 20 nt, Human
aagccuuuacagcuacccag

SEQ ID NO: 1347312 - RNA, 21 nt, Human
acacuagcuuuccaguuacac

SEQ ID NO: 1347313 - RNA, 19 nt, Human
accaaagaacccccaaauc

SEQ ID NO: 1347314 - RNA, 20 nt, Human
accaccucuagauacaaaag

SEQ ID NO: 1347315 - RNA, 19 nt, Human
agccugacaaaagaaauca

SEQ ID NO: 1347316 - RNA, 24 nt, Human
agcugcaugugaaauaccgagaac

SEQ ID NO: 1347317 - RNA, 27 nt, Human
aggaauaaaaacauauuaacaaaaugu

SEQ ID NO: 1347318 - RNA, 22 nt, Human
aggacggacgcgcggcgaggga

SEQ ID NO: 1347319 - RNA, 25 nt, Human
auuccugcaagguaaugaagcuggg

SEQ ID NO: 1347320 - RNA, 20 nt, Human
caaaccccuaaccaacacaa

SEQ ID NO: 1347321 - RNA, 22 nt, Human
caaagaacccccaaauccaaag

SEQ ID NO: 1347322 - RNA, 21 nt, Human
caacacaaguaguauagcaau

SEQ ID NO: 1347323 - RNA, 23 nt, Human
caaccacugugccgcauccaagc

SEQ ID NO: 1347324 - RNA, 18 nt, Human
cacaaugugauugcaaau

SEQ ID NO: 1347325 - RNA, 25 nt, Human
caccacacuagcuuuccaguuacac

SEQ ID NO: 1347326 - RNA, 21 nt, Human
cacuagaaaauugucccuaca

SEQ ID NO: 1347327 - RNA, 23 nt, Human
cauccaagcaacaguacacaaac

SEQ ID NO: 1347328 - RNA, 22 nt, Human
ccaaauaauuccuaaacuaaaa

SEQ ID NO: 1347329 - RNA, 21 nt, Human
ccaaauccaaaccccuaacca

SEQ ID NO: 1347330 - RNA, 23 nt, Human
ccacacuagcuuuccaguuacac

SEQ ID NO: 1347331 - RNA, 22 nt, Human
cccccaaauccaaaccccuaac

SEQ ID NO: 1347332 - RNA, 22 nt, Human
ccccuaaccaacacaaguagua

SEQ ID NO: 1347333 - RNA, 18 nt, Human
cccuaaagguugggcacu

SEQ ID NO: 1347334 - RNA, 18 nt, Human
ccggcuggcuggcuggcu

SEQ ID NO: 1347335 - RNA, 22 nt, Human
cgccggcccggcuggcuggcug

SEQ ID NO: 1347336 - RNA, 22 nt, Human
cugugccgcauccaagcaacag

SEQ ID NO: 1347337 - RNA, 23 nt, Human
cuguucaguuuaacguguugugu

SEQ ID NO: 1347338 - RNA, 19 nt, Human
cuuccagugucaaaaccca

SEQ ID NO: 1347339 - RNA, 22 nt, Human
gaacacccuaaagguugggcac

SEQ ID NO: 1347340 - RNA, 22 nt, Human
gaacccccaaauccaaaccccu

SEQ ID NO: 1347341 - RNA, 18 nt, Human
gagcuggcaggcgagcgc

SEQ ID NO: 1347342 - RNA, 18 nt, Human
gaggacuuuacagaagga

SEQ ID NO: 1347343 - RNA, 19 nt, Human
gcaaaacagaggacucuuc

SEQ ID NO: 1347344 - RNA, 19 nt, Human
gcagaaagagagcugcaug

SEQ ID NO: 1347345 - RNA, 24 nt, Human
gcagaaccaccucuagauacaaaa

SEQ ID NO: 1347346 - RNA, 23 nt, Human
gcuggcuggcuggcccgggagga

SEQ ID NO: 1347347 - RNA, 20 nt, Human
gcuggcuggcuggcuggcug

SEQ ID NO: 1347348 - RNA, 22 nt, Human
ggaggacggacgcgcggcgagg

SEQ ID NO: 1347349 - RNA, 18 nt, Human
ggcccgggaggacggagg

SEQ ID NO: 1347350 - RNA, 19 nt, Human
gggaggacggaggacggac

SEQ ID NO: 1347351 - RNA, 23 nt, Human
uaaauuuacacuuaaaaaaaccc

SEQ ID NO: 1347352 - RNA, 22 nt, Human
uaauaaaggaauuuucaccaca

SEQ ID NO: 1347353 - RNA, 21 nt, Human
uaauagcaaaacauaggaaua

SEQ ID NO: 1347354 - RNA, 21 nt, Human
uacaaacaaggaaucugcagu

SEQ ID NO: 1347355 - RNA, 26 nt, Human
uacacuaucacagcuucacaaaugga

SEQ ID NO: 1347356 - RNA, 18 nt, Human
uacuuuaaaaaagccuac

SEQ ID NO: 1347357 - RNA, 21 nt, Human
uacuuuauacagcacuagaaa

SEQ ID NO: 1347358 - RNA, 20 nt, Human
uagcaaaacauaggaauaaa

SEQ ID NO: 1347359 - RNA, 22 nt, Human
uagcagaaccaccucuagauac

SEQ ID NO: 1347360 - RNA, 20 nt, Human
uauagcaauguuaagcaucu

SEQ ID NO: 1347361 - RNA, 24 nt, Human
uaucuaccauuaagaaucuaugca

SEQ ID NO: 1347362 - RNA, 22 nt, Human
ucauuguuguagccugacaaaa

SEQ ID NO: 1347363 - RNA, 20 nt, Human
uccaagcaacaguacacaaa

SEQ ID NO: 1347364 - RNA, 20 nt, Human
uccaguaaauuacccuucag

SEQ ID NO: 1347365 - RNA, 18 nt, Human
uccaugcauccuuuauuc

SEQ ID NO: 1347366 - RNA, 23 nt, Human
ucccuacauucagcucucauucc

SEQ ID NO: 1347367 - RNA, 24 nt, Human
ucuagauacaaaagacugagauuu

SEQ ID NO: 1347368 - RNA, 23 nt, Human
ucuaugcacaaugugauugcaaa

SEQ ID NO: 1347369 - RNA, 21 nt, Human
ucuguucacaguaaaugaggu

SEQ ID NO: 1347370 - RNA, 19 nt, Human
ucuuugauuagaacacccu

SEQ ID NO: 1347371 - RNA, 24 nt, Human
ugaacccauguauccaguggcaga

SEQ ID NO: 1347372 - RNA, 18 nt, Human
ugagaaacagaugcgagg

SEQ ID NO: 1347373 - RNA, 21 nt, Human
ugagaaacagaugcgaggcua

SEQ ID NO: 1347374 - RNA, 19 nt, Human
ugccgcauccaagcaacag

SEQ ID NO: 1347375 - RNA, 18 nt, Human
uggaaaaaaaaauuaaaa

SEQ ID NO: 1347376 - RNA, 21 nt, Human
uggcagaaagagagcugcaug

SEQ ID NO: 1347377 - RNA, 23 nt, Human
uggcccgggaggacggaggacgg

SEQ ID NO: 1347378 - RNA, 24 nt, Human
uggcuaguaauaaauuuacacuua

SEQ ID NO: 1347379 - RNA, 23 nt, Human
uguuaacaaaaaauaauaaagga

SEQ ID NO: 1347380 - RNA, 20 nt, Human
uuaaaaaagccuacaaggag

SEQ ID NO: 1347381 - RNA, 19 nt, Human
uuaaaaccaaagaaccccc

SEQ ID NO: 1347382 - RNA, 25 nt, Human
uuaaaaccaaagaacccccaaaucc

SEQ ID NO: 1347383 - RNA, 22 nt, Human
uucacaaauggauugaacccau

SEQ ID NO: 1347384 - RNA, 23 nt, Human
uuggaaauguuauaaaauuuuua

SEQ ID NO: 1347385 - RNA, 21 nt, Human
uuuacauuacaaacaaggaau

SEQ ID NO: 1347386 - RNA, 19 nt, Human
acaaaacaggauauuuauu

SEQ ID NO: 1347387 - RNA, 23 nt, Human
acaaaauaagugcuauaccaggu

SEQ ID NO: 1347388 - RNA, 18 nt, Human
acgacaggacaccugagc

SEQ ID NO: 1347389 - RNA, 20 nt, Human
agcacgacaggacaccugag

SEQ ID NO: 1347390 - RNA, 19 nt, Human
uaagugcuauaccagguuu

SEQ ID NO: 1347391 - RNA, 21 nt, Human
uacaaaauaagugcuauacca

SEQ ID NO: 1347392 - RNA, 24 nt, Human
uacucugaauuuuuagguacaaaa

SEQ ID NO: 1347393 - RNA, 19 nt, Human
ucccagguccacuguauuc

SEQ ID NO: 1347394 - RNA, 18 nt, Human
ucccgcccgcuccugggc

SEQ ID NO: 1347395 - RNA, 20 nt, Human
uuagguacaaaauaagugcu

SEQ ID NO: 1347396 - RNA, 19 nt, Human
cccccguggccugcccugc

SEQ ID NO: 1347397 - RNA, 22 nt, Human
ggugcccccccguggccugccc

SEQ ID NO: 1347398 - RNA, 19 nt, Human
ugcaacagaguuuauugag

SEQ ID NO: 1347399 - RNA, 23 nt, Human
ugcaacagaguuuauugaggugc

SEQ ID NO: 1347400 - RNA, 24 nt, Human
accguccccuucugacccucacca

SEQ ID NO: 1347401 - RNA, 24 nt, Human
agcacauuuaauaaagaaagcuga

SEQ ID NO: 1347402 - RNA, 21 nt, Human
caaaaguccccacagucccca

SEQ ID NO: 1347403 - RNA, 22 nt, Human
cagcagacgugguacagaagug

SEQ ID NO: 1347404 - RNA, 22 nt, Human
cccaaaaguccccacagucccc

SEQ ID NO: 1347405 - RNA, 18 nt, Human
ccccacaguccccacaga

SEQ ID NO: 1347406 - RNA, 21 nt, Human
cccgguggcugccuggauccu

SEQ ID NO: 1347407 - RNA, 25 nt, Human
cuccauacaaggcuggagaccagca

SEQ ID NO: 1347408 - RNA, 23 nt, Human
gcuaagcgcugcucuugguaccg

SEQ ID NO: 1347409 - RNA, 20 nt, Human
uacaaggcuggagaccagca

SEQ ID NO: 1347410 - RNA, 24 nt, Human
uccagagcgccuggcugcuccaga

SEQ ID NO: 1347411 - RNA, 22 nt, Human
ucuaacuccauacaaggcugga

SEQ ID NO: 1347412 - RNA, 19 nt, Human
ugccuggauccugggcgcc

SEQ ID NO: 1347413 - RNA, 18 nt, Human
uguggggucccaaaaguc

SEQ ID NO: 1347414 - RNA, 22 nt, Human
uucccgguggcugccuggaucc

SEQ ID NO: 1347415 - RNA, 25 nt, Human
uuuuuuuuuuuuuuuugcuuuguga

SEQ ID NO: 1347416 - RNA, 23 nt, Human
uuuuuuuuuuuuuuuuuugcuuu

SEQ ID NO: 1347417 - RNA, 27 nt, Human
uuuuuuuuuuuuuuuuuuuuuuugggg

SEQ ID NO: 1347418 - RNA, 18 nt, Human
accgccucgcccucgccc

SEQ ID NO: 1347419 - RNA, 19 nt, Human
caccgccucgcccucgccc

SEQ ID NO: 1347420 - RNA, 18 nt, Human
ccagcacgugcgcgucca

SEQ ID NO: 1347421 - RNA, 21 nt, Human
ccccgucgccgucgcccucug

SEQ ID NO: 1347422 - RNA, 19 nt, Human
cgcccucgcccucaccguc

SEQ ID NO: 1347423 - RNA, 25 nt, Human
cgccucgcccucgcccucgcccuca

SEQ ID NO: 1347424 - RNA, 23 nt, Human
cgcguccaguggcagcucgugcg

SEQ ID NO: 1347425 - RNA, 21 nt, Human
cguccaggcucugcuggauca

SEQ ID NO: 1347426 - RNA, 25 nt, Human
cguccccgucgccgucgcccucugu

SEQ ID NO: 1347427 - RNA, 21 nt, Human
cgugcgccgugagcagccgcg

SEQ ID NO: 1347428 - RNA, 22 nt, Human
cucaccguccccgucgccgucg

SEQ ID NO: 1347429 - RNA, 19 nt, Human
cuccugcuugaggaugggg

SEQ ID NO: 1347430 - RNA, 19 nt, Human
cucgugcgccgugagcagc

SEQ ID NO: 1347431 - RNA, 23 nt, Human
cucgugcgccgugagcagccgcg

SEQ ID NO: 1347432 - RNA, 21 nt, Human
cugcggcugggggacuggggc

SEQ ID NO: 1347433 - RNA, 21 nt, Human
cugcuggaucagguccuccuc

SEQ ID NO: 1347434 - RNA, 19 nt, Human
gagcagccgcgggcuguac

SEQ ID NO: 1347435 - RNA, 21 nt, Human
gccuccgcggggccgcccucc

SEQ ID NO: 1347436 - RNA, 22 nt, Human
ggcugcggcugggggacugggg

SEQ ID NO: 1347437 - RNA, 21 nt, Human
gggcggggugggcgccgcguc

SEQ ID NO: 1347438 - RNA, 21 nt, Human
gucgccgucgcccucugucgg

SEQ ID NO: 1347439 - RNA, 24 nt, Human
ucaggcuccaggcugcggcugggg

SEQ ID NO: 1347440 - RNA, 23 nt, Human
ucagguccuccuccaugagcacc

SEQ ID NO: 1347441 - RNA, 19 nt, Human
uccaugagcaccgccucgc

SEQ ID NO: 1347442 - RNA, 27 nt, Human
uccucaggcuccaggcugcggcugggg

SEQ ID NO: 1347443 - RNA, 18 nt, Human
ucgcccucgcccucgccc

SEQ ID NO: 1347444 - RNA, 23 nt, Human
ucgcucuccacgcccugcuccug

SEQ ID NO: 1347445 - RNA, 19 nt, Human
ucugucggggucgcgccgu

SEQ ID NO: 1347446 - RNA, 19 nt, Human
ugagcaccgccucgcccuc

SEQ ID NO: 1347447 - RNA, 20 nt, Human
ugagcaccgccucgcccucg

SEQ ID NO: 1347448 - RNA, 22 nt, Human
ugaggauggggaacagcggcuc

SEQ ID NO: 1347449 - RNA, 20 nt, Human
ugcuugaggauggggaacag

SEQ ID NO: 1347450 - RNA, 21 nt, Human
ugggggacuggggcuccugcu

SEQ ID NO: 1347451 - RNA, 18 nt, Human
uuccagcacgugcgcguc

SEQ ID NO: 1347452 - RNA, 23 nt, Human
aaaaagccacgaagcuugauccc

SEQ ID NO: 1347453 - RNA, 21 nt, Human
acgcuggguguacaguacggg

SEQ ID NO: 1347454 - RNA, 26 nt, Human
agccacgaagcuugauccccacgaag

SEQ ID NO: 1347455 - RNA, 20 nt, Human
aggagguggggacaaagcgu

SEQ ID NO: 1347456 - RNA, 23 nt, Human
aggggaugugggaacagccacag

SEQ ID NO: 1347457 - RNA, 23 nt, Human
cagccccgcggggugggggaggg

SEQ ID NO: 1347458 - RNA, 18 nt, Human
cagcccgucggcggagcu

SEQ ID NO: 1347459 - RNA, 26 nt, Human
caucuccccuccccagccgcugggaa

SEQ ID NO: 1347460 - RNA, 22 nt, Human
ccaucuccccuccccagccgcu

SEQ ID NO: 1347461 - RNA, 27 nt, Human
ccccugggaggguggggcgggcuccua

SEQ ID NO: 1347462 - RNA, 18 nt, Human
cccgggccgggcugggcg

SEQ ID NO: 1347463 - RNA, 18 nt, Human
cccugcccagcccgggcg

SEQ ID NO: 1347464 - RNA, 18 nt, Human
cccugggcccagugggca

SEQ ID NO: 1347465 - RNA, 19 nt, Human
ccgcugggaaaggggagag

SEQ ID NO: 1347466 - RNA, 22 nt, Human
ccgggcggggcccucggccgcc

SEQ ID NO: 1347467 - RNA, 23 nt, Human
ccugggaggguggggcgggcucc

SEQ ID NO: 1347468 - RNA, 21 nt, Human
ccugggauauucaaggggaug

SEQ ID NO: 1347469 - RNA, 25 nt, Human
ccugguccuggguugguccagccac

SEQ ID NO: 1347470 - RNA, 19 nt, Human
cggggcccucggccgccgu

SEQ ID NO: 1347471 - RNA, 21 nt, Human
cguccagcccgucggcggagc

SEQ ID NO: 1347472 - RNA, 19 nt, Human
gaggggcgcagggcggaga

SEQ ID NO: 1347473 - RNA, 18 nt, Human
gaugugggaacagccaca

SEQ ID NO: 1347474 - RNA, 22 nt, Human
gcagagauggugcccaugggga

SEQ ID NO: 1347475 - RNA, 19 nt, Human
gccacuguggucccugggc

SEQ ID NO: 1347476 - RNA, 24 nt, Human
gccgugaagcucucgugcgcggag

SEQ ID NO: 1347477 - RNA, 23 nt, Human
gcgggcccgggccgggcugggcg

SEQ ID NO: 1347478 - RNA, 19 nt, Human
gcuccuaggcaggguucgg

SEQ ID NO: 1347479 - RNA, 22 nt, Human
gcugggaaaggggagaggccca

SEQ ID NO: 1347480 - RNA, 23 nt, Human
ggaagguaaaaaacccacgagag

SEQ ID NO: 1347481 - RNA, 18 nt, Human
ggaccaggugggcagggg

SEQ ID NO: 1347482 - RNA, 18 nt, Human
ggagcugcagcgccgggc

SEQ ID NO: 1347483 - RNA, 20 nt, Human
ggaggagguggggacaaagc

SEQ ID NO: 1347484 - RNA, 18 nt, Human
ggcagagggcugaggaug

SEQ ID NO: 1347485 - RNA, 18 nt, Human
ggcccgggggccggggcg

SEQ ID NO: 1347486 - RNA, 20 nt, Human
ggcggggcccucggccgccg

SEQ ID NO: 1347487 - RNA, 20 nt, Human
ggcugaggauggagccccug

SEQ ID NO: 1347488 - RNA, 28 nt, Human
gggaggagguggggacaaaggggacccc

SEQ ID NO: 1347489 - RNA, 23 nt, Human
gggcgggcgcacggggcggcccg

SEQ ID NO: 1347490 - RNA, 19 nt, Human
gggcggggcccucggccgc

SEQ ID NO: 1347491 - RNA, 24 nt, Human
gggggacgcagagcccagaugagg

SEQ ID NO: 1347492 - RNA, 23 nt, Human
gggugggggagggggggacgcag

SEQ ID NO: 1347493 - RNA, 22 nt, Human
ggguugguccagccacuguggu

SEQ ID NO: 1347494 - RNA, 20 nt, Human
gguggagaaccgcgggcccg

SEQ ID NO: 1347495 - RNA, 19 nt, Human
gugggcaggggauccaggu

SEQ ID NO: 1347496 - RNA, 21 nt, Human
gugggcaggggauccagguga

SEQ ID NO: 1347497 - RNA, 20 nt, Human
guggucccugggcccagugg

SEQ ID NO: 1347498 - RNA, 24 nt, Human
guggucccugggcccagugggcag

SEQ ID NO: 1347499 - RNA, 18 nt, Human
ucacagugaccucgacgc

SEQ ID NO: 1347500 - RNA, 19 nt, Human
ucgcgugggaucaggaagg

SEQ ID NO: 1347501 - RNA, 22 nt, Human
ugagggacccggcccggccugg

SEQ ID NO: 1347502 - RNA, 21 nt, Human
ugauccccacgaagcccagcc

SEQ ID NO: 1347503 - RNA, 22 nt, Human
uggcagagauggugcccauggg

SEQ ID NO: 1347504 - RNA, 24 nt, Human
uggcagagauggugcccaugggga

SEQ ID NO: 1347505 - RNA, 24 nt, Human
ugggcagagggcugaggauggagc

SEQ ID NO: 1347506 - RNA, 27 nt, Human
ugggcaggggauccaggucgaacguuu

SEQ ID NO: 1347507 - RNA, 23 nt, Human
ugggcccagugggcagagggcug

SEQ ID NO: 1347508 - RNA, 20 nt, Human
ugugacgggcccgggggccg

SEQ ID NO: 1347509 - RNA, 22 nt, Human
aaacauuugcagagcgagaaaa

SEQ ID NO: 1347510 - RNA, 19 nt, Human
aaagaaagaggaagaggga

SEQ ID NO: 1347511 - RNA, 26 nt, Human
aaagagccaacagcugggaacuuggg

SEQ ID NO: 1347512 - RNA, 23 nt, Human
aaccccacccuccagggccccag

SEQ ID NO: 1347513 - RNA, 22 nt, Human
aaccccacuggcccccacccaa

SEQ ID NO: 1347514 - RNA, 22 nt, Human
aagaaucccuccaguaucaucc

SEQ ID NO: 1347515 - RNA, 21 nt, Human
aagcaggcaccgcagaccucg

SEQ ID NO: 1347516 - RNA, 19 nt, Human
accccccaaccccacccuc

SEQ ID NO: 1347517 - RNA, 18 nt, Human
accuccuucagugagcug

SEQ ID NO: 1347518 - RNA, 23 nt, Human
acgaggugcguguuguguguguu

SEQ ID NO: 1347519 - RNA, 18 nt, Human
acggugccguuccgcaga

SEQ ID NO: 1347520 - RNA, 22 nt, Human
acucaccacagaacucgcagcg

SEQ ID NO: 1347521 - RNA, 20 nt, Human
agaaaaacacacgcuggccg

SEQ ID NO: 1347522 - RNA, 20 nt, Human
agaaagcaacagugaaaagg

SEQ ID NO: 1347523 - RNA, 21 nt, Human
agaaucccuccaguaucaucc

SEQ ID NO: 1347524 - RNA, 20 nt, Human
agagcccaaguccauggcca

SEQ ID NO: 1347525 - RNA, 20 nt, Human
agaggagacagagguggccg

SEQ ID NO: 1347526 - RNA, 20 nt, Human
agagggacaaggacacagag

SEQ ID NO: 1347527 - RNA, 25 nt, Human
agagucccaccccccaaccccaccc

SEQ ID NO: 1347528 - RNA, 21 nt, Human
agcaggggcauccaagggcuu

SEQ ID NO: 1347529 - RNA, 19 nt, Human
agcguggcuuccccugagc

SEQ ID NO: 1347530 - RNA, 24 nt, Human
agcuggacuucuuagccaggccug

SEQ ID NO: 1347531 - RNA, 19 nt, Human
agcuggcucccggcgcccu

SEQ ID NO: 1347532 - RNA, 22 nt, Human
agcugggggcucuuguccucag

SEQ ID NO: 1347533 - RNA, 19 nt, Human
aggaggccccgaucccagc

SEQ ID NO: 1347534 - RNA, 22 nt, Human
aggccccagcaggccccacaga

SEQ ID NO: 1347535 - RNA, 20 nt, Human
agggacaaggacacagagga

SEQ ID NO: 1347536 - RNA, 20 nt, Human
agggagagcccaaguccaug

SEQ ID NO: 1347537 - RNA, 22 nt, Human
agggagagggagcaggaguggg

SEQ ID NO: 1347538 - RNA, 18 nt, Human
aggggcugcgggcuucca

SEQ ID NO: 1347539 - RNA, 18 nt, Human
agguccaccaggccgaga

SEQ ID NO: 1347540 - RNA, 19 nt, Human
agguggucaggcucugggc

SEQ ID NO: 1347541 - RNA, 19 nt, Human
aguggagagcugggcgggu

SEQ ID NO: 1347542 - RNA, 23 nt, Human
aucccuccaguaucauccuguua

SEQ ID NO: 1347543 - RNA, 19 nt, Human
caaagcaggcaccgcagac

SEQ ID NO: 1347544 - RNA, 22 nt, Human
caaccccacccuccagggcccc

SEQ ID NO: 1347545 - RNA, 23 nt, Human
caaggugggcgucaggcagaccc

SEQ ID NO: 1347546 - RNA, 18 nt, Human
caccccccaaccccaccc

SEQ ID NO: 1347547 - RNA, 18 nt, Human
caccccccaaccccaccc

SEQ ID NO: 1347548 - RNA, 27 nt, Human
caccccccaaccccacccuccagggcc

SEQ ID NO: 1347549 - RNA, 21 nt, Human
cacccuccagggccccagagc

SEQ ID NO: 1347550 - RNA, 19 nt, Human
cacccuguggccccagagu

SEQ ID NO: 1347551 - RNA, 21 nt, Human
cacccuguggccccagagucc

SEQ ID NO: 1347552 - RNA, 19 nt, Human
caccguggcaugauguggu

SEQ ID NO: 1347553 - RNA, 19 nt, Human
caccguggcaugauguggu

SEQ ID NO: 1347554 - RNA, 22 nt, Human
cacuggagccgcuuugccagcc

SEQ ID NO: 1347555 - RNA, 20 nt, Human
cagaacccugguucaucugc

SEQ ID NO: 1347556 - RNA, 21 nt, Human
cagcaggggcauccaagggcu

SEQ ID NO: 1347557 - RNA, 18 nt, Human
cagcucugagcucuuccc

SEQ ID NO: 1347558 - RNA, 21 nt, Human
caggcaccgcagaccucgcag

SEQ ID NO: 1347559 - RNA, 23 nt, Human
caggcucugggccuugagguccu

SEQ ID NO: 1347560 - RNA, 22 nt, Human
caggcucuucuuagggagcgag

SEQ ID NO: 1347561 - RNA, 20 nt, Human
cagguggucaggcucugggc

SEQ ID NO: 1347562 - RNA, 20 nt, Human
caguggcuccucuuuucccc

SEQ ID NO: 1347563 - RNA, 22 nt, Human
cauccuguuauccaaccguccc

SEQ ID NO: 1347564 - RNA, 23 nt, Human
caucgcccugccuggcugcuaga

SEQ ID NO: 1347565 - RNA, 26 nt, Human
ccacccaaaugcucccaacggguccc

SEQ ID NO: 1347566 - RNA, 22 nt, Human
ccagccagagacccccucccag

SEQ ID NO: 1347567 - RNA, 26 nt, Human
ccagccagagacccccucccagccau

SEQ ID NO: 1347568 - RNA, 27 nt, Human
ccagccagccagagacccccucccagc

SEQ ID NO: 1347569 - RNA, 18 nt, Human
ccagggccccagggacag

SEQ ID NO: 1347570 - RNA, 19 nt, Human
ccaucagagaccuggcugc

SEQ ID NO: 1347571 - RNA, 21 nt, Human
cccaaccccacccuccagggc

SEQ ID NO: 1347572 - RNA, 21 nt, Human
cccacccaaaugcucccaacg

SEQ ID NO: 1347573 - RNA, 19 nt, Human
cccagagccccugaggcuc

SEQ ID NO: 1347574 - RNA, 24 nt, Human
cccaucaucuuggccagggcuuuu

SEQ ID NO: 1347575 - RNA, 23 nt, Human
ccccaaccccacccuccagggcc

SEQ ID NO: 1347576 - RNA, 18 nt, Human
ccccacccaaaugcuccc

SEQ ID NO: 1347577 - RNA, 22 nt, Human
ccccacccuccagggccccaga

SEQ ID NO: 1347578 - RNA, 20 nt, Human
ccccacuggcccccacccag

SEQ ID NO: 1347579 - RNA, 20 nt, Human
ccccagagccccugaggcuc

SEQ ID NO: 1347580 - RNA, 21 nt, Human
ccccagaguccucgggcuggg

SEQ ID NO: 1347581 - RNA, 20 nt, Human
cccccacccaaaugcuccca

SEQ ID NO: 1347582 - RNA, 22 nt, Human
ccccccaaccccacccuccagg

SEQ ID NO: 1347583 - RNA, 20 nt, Human
ccccucccagccauggccua

SEQ ID NO: 1347584 - RNA, 21 nt, Human
ccccugagcaagcaccguggc

SEQ ID NO: 1347585 - RNA, 19 nt, Human
ccccugaggcucuuugggg

SEQ ID NO: 1347586 - RNA, 25 nt, Human
cccgaucccagccccggcugccagc

SEQ ID NO: 1347587 - RNA, 20 nt, Human
cccugagcaagcaccguggc

SEQ ID NO: 1347588 - RNA, 23 nt, Human
ccgacucugccacucccagcugc

SEQ ID NO: 1347589 - RNA, 22 nt, Human
ccucagaacccaggccugaucu

SEQ ID NO: 1347590 - RNA, 23 nt, Human
ccuccaguaucauccuguuaucc

SEQ ID NO: 1347591 - RNA, 23 nt, Human
ccucugcagccacuuugcugcuc

SEQ ID NO: 1347592 - RNA, 18 nt, Human
ccugcagcuccuguuugc

SEQ ID NO: 1347593 - RNA, 20 nt, Human
ccugccccaggguguuucca

SEQ ID NO: 1347594 - RNA, 23 nt, Human
ccuggcuucuagcuggcccagga

SEQ ID NO: 1347595 - RNA, 21 nt, Human
ccuugggucaggggugcaugu

SEQ ID NO: 1347596 - RNA, 23 nt, Human
cgagaaaauaaauaacaucgcaa

SEQ ID NO: 1347597 - RNA, 23 nt, Human
cgagggagagcccaaguccaugg

SEQ ID NO: 1347598 - RNA, 21 nt, Human
cggcugccaucagagaccugg

SEQ ID NO: 1347599 - RNA, 19 nt, Human
cggcuuggcggccaacugg

SEQ ID NO: 1347600 - RNA, 21 nt, Human
cgggccggggggccccggcga

SEQ ID NO: 1347601 - RNA, 25 nt, Human
cguaggaggaggagaggcaguuggu

SEQ ID NO: 1347602 - RNA, 26 nt, Human
cguuccgcagaccuagggaaccccac

SEQ ID NO: 1347603 - RNA, 23 nt, Human
cucaccacagaacucgcagcgga

SEQ ID NO: 1347604 - RNA, 23 nt, Human
cucccaacgggucccugacaccc

SEQ ID NO: 1347605 - RNA, 21 nt, Human
cuccucuagccucaacugcuu

SEQ ID NO: 1347606 - RNA, 19 nt, Human
cugccaggaccugcgccgc

SEQ ID NO: 1347607 - RNA, 21 nt, Human
cugccuggcugcuagacgggg

SEQ ID NO: 1347608 - RNA, 23 nt, Human
cuggaccaggugggcaugggcug

SEQ ID NO: 1347609 - RNA, 20 nt, Human
cuguagugugcccggccccu

SEQ ID NO: 1347610 - RNA, 20 nt, Human
cuucccagcugggaaggccc

SEQ ID NO: 1347611 - RNA, 21 nt, Human
cuugacagaaaaacacacgcu

SEQ ID NO: 1347612 - RNA, 23 nt, Human
cuuggccagggcuuuugggcuug

SEQ ID NO: 1347613 - RNA, 19 nt, Human
gaagaagaggagacagagg

SEQ ID NO: 1347614 - RNA, 20 nt, Human
gaagacacccuguggccccu

SEQ ID NO: 1347615 - RNA, 18 nt, Human
gacuggccaccugcucca

SEQ ID NO: 1347616 - RNA, 18 nt, Human
gagaggggaucuggaaug

SEQ ID NO: 1347617 - RNA, 22 nt, Human
gagccaacagcugggaacuugg

SEQ ID NO: 1347618 - RNA, 23 nt, Human
gagcgcgcguggcucgagaggcc

SEQ ID NO: 1347619 - RNA, 23 nt, Human
gagcgcgcguggcuggacaggcc

SEQ ID NO: 1347620 - RNA, 20 nt, Human
gagcugccaggaccugcgcc

SEQ ID NO: 1347621 - RNA, 21 nt, Human
gaggaagaagaggagacagag

SEQ ID NO: 1347622 - RNA, 21 nt, Human
gaggaagaagaggagacagag

SEQ ID NO: 1347623 - RNA, 22 nt, Human
gaggcagcugucagcucugagc

SEQ ID NO: 1347624 - RNA, 22 nt, Human
gcaacagugaaaagggagaggg

SEQ ID NO: 1347625 - RNA, 18 nt, Human
gcagccaacaaggauuuc

SEQ ID NO: 1347626 - RNA, 25 nt, Human
gccccagagccccugaggcucuuuu

SEQ ID NO: 1347627 - RNA, 24 nt, Human
gccccgaucccagccccggcugcc

SEQ ID NO: 1347628 - RNA, 19 nt, Human
gccuuuggggaggccggcc

SEQ ID NO: 1347629 - RNA, 20 nt, Human
gcguuuuuaaaaaagugaaa

SEQ ID NO: 1347630 - RNA, 22 nt, Human
gcuccagggccccagggacagg

SEQ ID NO: 1347631 - RNA, 19 nt, Human
gcucccaacgggucccuga

SEQ ID NO: 1347632 - RNA, 20 nt, Human
gcucuuguccucaggauucu

SEQ ID NO: 1347633 - RNA, 21 nt, Human
ggaaacggaaagaaagaggaa

SEQ ID NO: 1347634 - RNA, 20 nt, Human
ggaaccccacaaggccggca

SEQ ID NO: 1347635 - RNA, 19 nt, Human
ggacuucuuagccaggccu

SEQ ID NO: 1347636 - RNA, 22 nt, Human
ggaggaagaagaggagacagag

SEQ ID NO: 1347637 - RNA, 23 nt, Human
ggccaggcugagcaagccgggcc

SEQ ID NO: 1347638 - RNA, 21 nt, Human
ggccagggcuuuugggcuugg

SEQ ID NO: 1347639 - RNA, 18 nt, Human
ggcggguggcccaggccc

SEQ ID NO: 1347640 - RNA, 22 nt, Human
ggcucccaggccccagcaggcc

SEQ ID NO: 1347641 - RNA, 23 nt, Human
gggacaaggacacagaggaggaa

SEQ ID NO: 1347642 - RNA, 21 nt, Human
gggagagagggaaccagaaca

SEQ ID NO: 1347643 - RNA, 24 nt, Human
gggaggccggccgggggcucaggg

SEQ ID NO: 1347644 - RNA, 19 nt, Human
gggccccucauccucagac

SEQ ID NO: 1347645 - RNA, 19 nt, Human
gggcggguggcccaggccc

SEQ ID NO: 1347646 - RNA, 25 nt, Human
gggcucccaggccccagcaggcccc

SEQ ID NO: 1347647 - RNA, 19 nt, Human
gggcuuggccaggcugagc

SEQ ID NO: 1347648 - RNA, 21 nt, Human
ggggaggagagucccaccccc

SEQ ID NO: 1347649 - RNA, 18 nt, Human
ggggaggccggccggggg

SEQ ID NO: 1347650 - RNA, 19 nt, Human
gggggaggagagucccacc

SEQ ID NO: 1347651 - RNA, 22 nt, Human
gggggcucagggacagcugggg

SEQ ID NO: 1347652 - RNA, 21 nt, Human
gggugcgccgcugcuuuccga

SEQ ID NO: 1347653 - RNA, 26 nt, Human
ggugguggcaacuucuuggccaaggg

SEQ ID NO: 1347654 - RNA, 21 nt, Human
gucagcucugagcucuuccca

SEQ ID NO: 1347655 - RNA, 21 nt, Human
gugagguucaagggccccuca

SEQ ID NO: 1347656 - RNA, 19 nt, Human
gugaguggcccagggggcu

SEQ ID NO: 1347657 - RNA, 18 nt, Human
guggcccagggggcugcc

SEQ ID NO: 1347658 - RNA, 24 nt, Human
guuccgcagaccuagggaacccca

SEQ ID NO: 1347659 - RNA, 21 nt, Human
uaaagagccaacagcugggaa

SEQ ID NO: 1347660 - RNA, 18 nt, Human
uaacaucgcaaaggagcc

SEQ ID NO: 1347661 - RNA, 19 nt, Human
uacaaccccacuggccccc

SEQ ID NO: 1347662 - RNA, 19 nt, Human
uagcuggcucccggcgccc

SEQ ID NO: 1347663 - RNA, 21 nt, Human
ucagggacagcugggggcucu

SEQ ID NO: 1347664 - RNA, 21 nt, Human
uccacuugacagaaaaacaca

SEQ ID NO: 1347665 - RNA, 21 nt, Human
ucccaccccccaaccccaccc

SEQ ID NO: 1347666 - RNA, 19 nt, Human
ucccagacaggcugcccag

SEQ ID NO: 1347667 - RNA, 22 nt, Human
ucccagccauggccuaaagagc

SEQ ID NO: 1347668 - RNA, 18 nt, Human
ucccaggccccagcaggc

SEQ ID NO: 1347669 - RNA, 20 nt, Human
ucccaggccccagcaggccc

SEQ ID NO: 1347670 - RNA, 20 nt, Human
uccccugugaccagaccggc

SEQ ID NO: 1347671 - RNA, 18 nt, Human
uccgcagaccuagggaac

SEQ ID NO: 1347672 - RNA, 21 nt, Human
ucgcagguggucaggcucugg

SEQ ID NO: 1347673 - RNA, 21 nt, Human
ucgcccugccuggcugcuaga

SEQ ID NO: 1347674 - RNA, 18 nt, Human
ucgggcugggggaagggc

SEQ ID NO: 1347675 - RNA, 24 nt, Human
ucuacaaccccacuggcccccacc

SEQ ID NO: 1347676 - RNA, 26 nt, Human
ucuacaaccccacuggcccccaccca

SEQ ID NO: 1347677 - RNA, 19 nt, Human
ucuagccucaacugcuucu

SEQ ID NO: 1347678 - RNA, 19 nt, Human
ucucaaagcaggcaccgca

SEQ ID NO: 1347679 - RNA, 23 nt, Human
ucucuacaaccccacuggccccc

SEQ ID NO: 1347680 - RNA, 21 nt, Human
ucuuggccagggcuuuugggc

SEQ ID NO: 1347681 - RNA, 19 nt, Human
ugaaggaagacacccugug

SEQ ID NO: 1347682 - RNA, 23 nt, Human
ugacagaaaaacacacgcuggcc

SEQ ID NO: 1347683 - RNA, 19 nt, Human
ugagaggauauucaugggg

SEQ ID NO: 1347684 - RNA, 22 nt, Human
ugagaugugaagguccgagggg

SEQ ID NO: 1347685 - RNA, 20 nt, Human
ugagguccugcagcuccugu

SEQ ID NO: 1347686 - RNA, 22 nt, Human
ugagguccugcagcuccuguuu

SEQ ID NO: 1347687 - RNA, 20 nt, Human
ugaggugagguucaagggcc

SEQ ID NO: 1347688 - RNA, 19 nt, Human
ugccuuuggggaggccggc

SEQ ID NO: 1347689 - RNA, 21 nt, Human
ugccuuuggggaggccggccg

SEQ ID NO: 1347690 - RNA, 18 nt, Human
uggaaacggaaagaaaga

SEQ ID NO: 1347691 - RNA, 20 nt, Human
uggcaacuucuuggccaagg

SEQ ID NO: 1347692 - RNA, 18 nt, Human
uggcacgagaggggaucu

SEQ ID NO: 1347693 - RNA, 23 nt, Human
uggccaggcugagcaagccgggc

SEQ ID NO: 1347694 - RNA, 26 nt, Human
uggcccaggcccuuggccgagaagcc

SEQ ID NO: 1347695 - RNA, 20 nt, Human
uggcccagggggcugcccgg

SEQ ID NO: 1347696 - RNA, 25 nt, Human
uggccccagaguccucgggcugggg

SEQ ID NO: 1347697 - RNA, 22 nt, Human
uggcccugguggguugggaggu

SEQ ID NO: 1347698 - RNA, 21 nt, Human
uggcuguagugugcccggccc

SEQ ID NO: 1347699 - RNA, 22 nt, Human
uggcuuccccugagcaagcacc

SEQ ID NO: 1347700 - RNA, 22 nt, Human
uggcuugcuccuuuggaaacgg

SEQ ID NO: 1347701 - RNA, 25 nt, Human
ugggaaggccccucucgggggcagc

SEQ ID NO: 1347702 - RNA, 22 nt, Human
ugggccuugagguccugcagcu

SEQ ID NO: 1347703 - RNA, 21 nt, Human
ugggcggguggcccaggcccu

SEQ ID NO: 1347704 - RNA, 24 nt, Human
ugggcucaguggggggcucccagg

SEQ ID NO: 1347705 - RNA, 23 nt, Human
ugggggagagagggaaccagaac

SEQ ID NO: 1347706 - RNA, 20 nt, Human
uggggggccuugacauggca

SEQ ID NO: 1347707 - RNA, 21 nt, Human
uggguccgucucuucaggauc

SEQ ID NO: 1347708 - RNA, 19 nt, Human
ugugaagguccgaggggcu

SEQ ID NO: 1347709 - RNA, 20 nt, Human
ugugaagguccgaggggcug

SEQ ID NO: 1347710 - RNA, 23 nt, Human
uguggccccagaguccucgggcu

SEQ ID NO: 1347711 - RNA, 22 nt, Human
uguucgcauguacaugugugug

SEQ ID NO: 1347712 - RNA, 18 nt, Human
uguuguguguguucgcau

SEQ ID NO: 1347713 - RNA, 20 nt, Human
uucaucugcucacuggagcc

SEQ ID NO: 1347714 - RNA, 18 nt, Human
uucaugggggagagaggg

SEQ ID NO: 1347715 - RNA, 23 nt, Human
uuguguguguucgcauguacaug

SEQ ID NO: 1347716 - RNA, 24 nt, Human
uuuugaggaguggagagcugggcg

SEQ ID NO: 1347717 - RNA, 23 nt, Human
acccagcgaggacaaaggggccu

SEQ ID NO: 1347718 - RNA, 20 nt, Human
acccuacuuagacccucgca

SEQ ID NO: 1347719 - RNA, 24 nt, Human
acgccaccgcucccgcugccgucu

SEQ ID NO: 1347720 - RNA, 23 nt, Human
agcaacugcccaccauugucccu

SEQ ID NO: 1347721 - RNA, 20 nt, Human
agccccuggcccaccccucu

SEQ ID NO: 1347722 - RNA, 19 nt, Human
aggcgcaggugggcgcgcu

SEQ ID NO: 1347723 - RNA, 20 nt, Human
caacugcccaccauuguccc

SEQ ID NO: 1347724 - RNA, 19 nt, Human
caagacaggucccagaccu

SEQ ID NO: 1347725 - RNA, 21 nt, Human
caccccucuccuucccacuuc

SEQ ID NO: 1347726 - RNA, 21 nt, Human
cagcgaggacaaaggggccuc

SEQ ID NO: 1347727 - RNA, 19 nt, Human
caguggacuccgcgcugcg

SEQ ID NO: 1347728 - RNA, 18 nt, Human
ccagggagcugggccgcg

SEQ ID NO: 1347729 - RNA, 26 nt, Human
cccacaguccaagacaggucccagac

SEQ ID NO: 1347730 - RNA, 23 nt, Human
cccacccagcgaggacaaagggg

SEQ ID NO: 1347731 - RNA, 19 nt, Human
ccccucuccuucccacuuc

SEQ ID NO: 1347732 - RNA, 21 nt, Human
cccgauggcccggcucuacca

SEQ ID NO: 1347733 - RNA, 21 nt, Human
cccggcucuaccaguucugga

SEQ ID NO: 1347734 - RNA, 19 nt, Human
cccucuccuucccacuucu

SEQ ID NO: 1347735 - RNA, 23 nt, Human
cccuggcccaccccucuccuucc

SEQ ID NO: 1347736 - RNA, 22 nt, Human
ccuccuucgcuccgagggcaaa

SEQ ID NO: 1347737 - RNA, 23 nt, Human
ccugcgggcugggggcuggagga

SEQ ID NO: 1347738 - RNA, 21 nt, Human
ccuggcccaccccucuccuuc

SEQ ID NO: 1347739 - RNA, 20 nt, Human
cgccaccgcucccgcugccg

SEQ ID NO: 1347740 - RNA, 18 nt, Human
cgcgcggagaggcgcagg

SEQ ID NO: 1347741 - RNA, 24 nt, Human
cgcucccgcugccgucuacccgac

SEQ ID NO: 1347742 - RNA, 23 nt, Human
cuggcccagcagugaggcaggcu

SEQ ID NO: 1347743 - RNA, 20 nt, Human
cugggcgcccaggcccggga

SEQ ID NO: 1347744 - RNA, 20 nt, Human
gagggaaggcggggagacgc

SEQ ID NO: 1347745 - RNA, 20 nt, Human
gcccaccccucuccuuccca

SEQ ID NO: 1347746 - RNA, 18 nt, Human
gccgacaggggcgcggag

SEQ ID NO: 1347747 - RNA, 25 nt, Human
gccgcgcggagaggcgcaggugggc

SEQ ID NO: 1347748 - RNA, 20 nt, Human
gcgccgacaggggcgcggag

SEQ ID NO: 1347749 - RNA, 20 nt, Human
ggaggaggagcgcuccggcc

SEQ ID NO: 1347750 - RNA, 18 nt, Human
ggagggagggaaggcggg

SEQ ID NO: 1347751 - RNA, 20 nt, Human
ggcccagcagugaggcaggc

SEQ ID NO: 1347752 - RNA, 23 nt, Human
gggcugggggcuggaggaggagc

SEQ ID NO: 1347753 - RNA, 22 nt, Human
gugaggcaggcugagggcaugg

SEQ ID NO: 1347754 - RNA, 23 nt, Human
guugaucaaaggcaguggccacc

SEQ ID NO: 1347755 - RNA, 23 nt, Human
uccaagacaggucccagaccuuu

SEQ ID NO: 1347756 - RNA, 23 nt, Human
uccgcgcugcgggcgccgcgggg

SEQ ID NO: 1347757 - RNA, 21 nt, Human
uccugcaggggagaggccugg

SEQ ID NO: 1347758 - RNA, 19 nt, Human
ugagggugagucucccaca

SEQ ID NO: 1347759 - RNA, 18 nt, Human
ugaugcgaggcuccaggg

SEQ ID NO: 1347760 - RNA, 20 nt, Human
ugcaaugccaguccugcagg

SEQ ID NO: 1347761 - RNA, 18 nt, Human
uggcaaggugagggugag

SEQ ID NO: 1347762 - RNA, 19 nt, Human
uggcccagcagugaggcag

SEQ ID NO: 1347763 - RNA, 19 nt, Human
uguccggcugggcgcccag

SEQ ID NO: 1347764 - RNA, 23 nt, Human
acccaaauuuaaggaccagaagc

SEQ ID NO: 1347765 - RNA, 22 nt, Human
caaaaauaacccaaauuuaagg

SEQ ID NO: 1347766 - RNA, 20 nt, Human
caaccccaucaagacugucc

SEQ ID NO: 1347767 - RNA, 21 nt, Human
ccagaagguucucaaccccau

SEQ ID NO: 1347768 - RNA, 20 nt, Human
ccaguucuucucagagagua

SEQ ID NO: 1347769 - RNA, 18 nt, Human
ccccagaagguucucaac

SEQ ID NO: 1347770 - RNA, 21 nt, Human
cucaaccccaucaagacuguc

SEQ ID NO: 1347771 - RNA, 24 nt, Human
cuccccagaagguucucaaccccc

SEQ ID NO: 1347772 - RNA, 22 nt, Human
gugcaaagagagggucaucugg

SEQ ID NO: 1347773 - RNA, 20 nt, Human
uaaccaaaaauaacccaaau

SEQ ID NO: 1347774 - RNA, 19 nt, Human
uacaucucuagcuccaguu

SEQ ID NO: 1347775 - RNA, 21 nt, Human
ucauggguacugauuaagggc

SEQ ID NO: 1347776 - RNA, 22 nt, Human
uccccagaagguucucaacccc

SEQ ID NO: 1347777 - RNA, 18 nt, Human
ucuggcuccccagaaggu

SEQ ID NO: 1347778 - RNA, 22 nt, Human
ugcaaagagagggucaucuggc

SEQ ID NO: 1347779 - RNA, 20 nt, Human
ugcagacucuucagauccag

SEQ ID NO: 1347780 - RNA, 24 nt, Human
uucucaaccccaucaagacugucc

SEQ ID NO: 1347781 - RNA, 18 nt, Human
uugugcaaagagaggguc

SEQ ID NO: 1347782 - RNA, 21 nt, Human
aggcuagguguuggagaaaga

SEQ ID NO: 1347783 - RNA, 25 nt, Human
agguguuggagaaagaggaccagcu

SEQ ID NO: 1347784 - RNA, 24 nt, Human
augucaggggcuggccgggauggc

SEQ ID NO: 1347785 - RNA, 20 nt, Human
cccucccuuuuuucuugccc

SEQ ID NO: 1347786 - RNA, 22 nt, Human
cuacguucaaaacuccaacccc

SEQ ID NO: 1347787 - RNA, 24 nt, Human
cucaggcuagguguuggagaaaga

SEQ ID NO: 1347788 - RNA, 20 nt, Human
cuccaacccccucccuuuuu

SEQ ID NO: 1347789 - RNA, 22 nt, Human
gacacaacacuuaccaagcuag

SEQ ID NO: 1347790 - RNA, 22 nt, Human
ggcuagguguuggagaaagagg

SEQ ID NO: 1347791 - RNA, 24 nt, Human
uacuacguucaaaacuccaacccc

SEQ ID NO: 1347792 - RNA, 21 nt, Human
ucaaaacuccaacccccuccc

SEQ ID NO: 1347793 - RNA, 22 nt, Human
ucagucuuggugcaagaucgau

SEQ ID NO: 1347794 - RNA, 20 nt, Human
uccaacccccucccuuuuuu

SEQ ID NO: 1347795 - RNA, 21 nt, Human
uucaaaacuccaacccccucc

SEQ ID NO: 1347796 - RNA, 20 nt, Human
aaacaaagccacaucacaug

SEQ ID NO: 1347797 - RNA, 18 nt, Human
accaguggcuaacugaau

SEQ ID NO: 1347798 - RNA, 21 nt, Human
acuuaaucuuuucugcugugu

SEQ ID NO: 1347799 - RNA, 23 nt, Human
agcuagcaacucauagcuaaugc

SEQ ID NO: 1347800 - RNA, 23 nt, Human
auuauucauuaaaaaaguauauc

SEQ ID NO: 1347801 - RNA, 26 nt, Human
cuaacugaauuaaaacaaagccacau

SEQ ID NO: 1347802 - RNA, 29 nt, Human
uacagcuuaauuuuacaaugaagggaccu

SEQ ID NO: 1347803 - RNA, 22 nt, Human
uagaauauaacccacacauuaa

SEQ ID NO: 1347804 - RNA, 26 nt, Human
uagaauauaacccacacauuaaaaac

SEQ ID NO: 1347805 - RNA, 22 nt, Human
uagacaaguuaugaacaccugu

SEQ ID NO: 1347806 - RNA, 22 nt, Human
uaugggagauuugagcuuagac

SEQ ID NO: 1347807 - RNA, 23 nt, Human
ugaauuaaaacaaagccacauca

SEQ ID NO: 1347808 - RNA, 23 nt, Human
ugccacagaauuuugcuuuggga

SEQ ID NO: 1347809 - RNA, 21 nt, Human
ugcuguguuuuuauucucaaa

SEQ ID NO: 1347810 - RNA, 21 nt, Human
uuaaucuuuucugcuguguuu

SEQ ID NO: 1347811 - RNA, 25 nt, Human
uuacuuaaucuuuucugcuguguuu

SEQ ID NO: 1347812 - RNA, 20 nt, Human
uuagacaaguuaugaacacc

SEQ ID NO: 1347813 - RNA, 19 nt, Human
uuuuuuuuuuuuuacuuaa

SEQ ID NO: 1347814 - RNA, 20 nt, Human
aaaaauagcaguaaggcggc

SEQ ID NO: 1347815 - RNA, 24 nt, Human
aaacccaaugggaaaggaggugac

SEQ ID NO: 1347816 - RNA, 21 nt, Human
aaauagcaguaaggcggcagc

SEQ ID NO: 1347817 - RNA, 19 nt, Human
aagcugccacagcuggugg

SEQ ID NO: 1347818 - RNA, 21 nt, Human
accacuacccaccccgcccca

SEQ ID NO: 1347819 - RNA, 24 nt, Human
acccucauaaagacgggcaaaaau

SEQ ID NO: 1347820 - RNA, 21 nt, Human
agagggagucugaggccuggu

SEQ ID NO: 1347821 - RNA, 21 nt, Human
agucuuugggaggaaccaauu

SEQ ID NO: 1347822 - RNA, 19 nt, Human
agugcagggcggggaaaag

SEQ ID NO: 1347823 - RNA, 23 nt, Human
auaaagacgggcaaaaaugcagg

SEQ ID NO: 1347824 - RNA, 22 nt, Human
caaaaaugcaggugagagggaa

SEQ ID NO: 1347825 - RNA, 19 nt, Human
caacuggugaagugcuggg

SEQ ID NO: 1347826 - RNA, 24 nt, Human
caagacagucaaauuauucaaagu

SEQ ID NO: 1347827 - RNA, 20 nt, Human
cacucccacaaaacccaggg

SEQ ID NO: 1347828 - RNA, 21 nt, Human
cagcuuuggucuccagcaugc

SEQ ID NO: 1347829 - RNA, 18 nt, Human
cagggcggggaaaagagg

SEQ ID NO: 1347830 - RNA, 19 nt, Human
cagggcggggaaaagaggg

SEQ ID NO: 1347831 - RNA, 18 nt, Human
ccacuacccaccccgccc

SEQ ID NO: 1347832 - RNA, 21 nt, Human
cccacaaaacccagggcucca

SEQ ID NO: 1347833 - RNA, 21 nt, Human
ccccuuuuauccccuuuauuc

SEQ ID NO: 1347834 - RNA, 19 nt, Human
cccugggucaucagaacuc

SEQ ID NO: 1347835 - RNA, 22 nt, Human
ccuaaccccugggucaucagaa

SEQ ID NO: 1347836 - RNA, 22 nt, Human
cgccccaagcugccacagcugg

SEQ ID NO: 1347837 - RNA, 18 nt, Human
cucagcccuaaccccugg

SEQ ID NO: 1347838 - RNA, 19 nt, Human
cuccucugugcuucuuucc

SEQ ID NO: 1347839 - RNA, 23 nt, Human
cuggugggcaugaaugggaguug

SEQ ID NO: 1347840 - RNA, 19 nt, Human
gcacucccacaaaacccag

SEQ ID NO: 1347841 - RNA, 25 nt, Human
gcccuaauccaguauauauguugcu

SEQ ID NO: 1347842 - RNA, 22 nt, Human
ggaguugcagaagagucuuugg

SEQ ID NO: 1347843 - RNA, 19 nt, Human
ggcggggaaaagagggagu

SEQ ID NO: 1347844 - RNA, 21 nt, Human
gggaaaggaggugacaaacgu

SEQ ID NO: 1347845 - RNA, 20 nt, Human
gggaguugcagaagagucuu

SEQ ID NO: 1347846 - RNA, 23 nt, Human
gucuccagcaugcuggauacaag

SEQ ID NO: 1347847 - RNA, 26 nt, Human
gugcagggcggggaaaagagggaguc

SEQ ID NO: 1347848 - RNA, 19 nt, Human
gugggcaugaaugggaguu

SEQ ID NO: 1347849 - RNA, 21 nt, Human
uaacaccagaaauuaaaaggg

SEQ ID NO: 1347850 - RNA, 25 nt, Human
uaaccccugggucaucagaacuccu

SEQ ID NO: 1347851 - RNA, 21 nt, Human
uauauauguugcugaagauaa

SEQ ID NO: 1347852 - RNA, 21 nt, Human
ucagaacuccuccucugugcu

SEQ ID NO: 1347853 - RNA, 19 nt, Human
ucugugcuucuuuccagag

SEQ ID NO: 1347854 - RNA, 22 nt, Human
ugaccacuacccaccccgcccc

SEQ ID NO: 1347855 - RNA, 19 nt, Human
ugagagggaaggaaccucc

SEQ ID NO: 1347856 - RNA, 20 nt, Human
ugagagggaaggaaccucca

SEQ ID NO: 1347857 - RNA, 21 nt, Human
ugagcacucccacaaaaccca

SEQ ID NO: 1347858 - RNA, 23 nt, Human
ugcauuagcagaacuuuaaauac

SEQ ID NO: 1347859 - RNA, 21 nt, Human
ugugcaacuacuauuuugauu

SEQ ID NO: 1347860 - RNA, 23 nt, Human
uucaaaguugaaaugagugagaa

SEQ ID NO: 1347861 - RNA, 22 nt, Human
uuccuaaaaacccaaugggaaa

SEQ ID NO: 1347862 - RNA, 23 nt, Human
uuuuccuaaaaacccaaugggaa

SEQ ID NO: 1347863 - RNA, 20 nt, Human
aaaacaaugugcaggguggc

SEQ ID NO: 1347864 - RNA, 18 nt, Human
aagaguccagacuucaag

SEQ ID NO: 1347865 - RNA, 23 nt, Human
aaguagagaugagaccccaaacg

SEQ ID NO: 1347866 - RNA, 26 nt, Human
aauacaguuuauugucgcccugcguc

SEQ ID NO: 1347867 - RNA, 24 nt, Human
acccaggaaaucagcaaaaaccca

SEQ ID NO: 1347868 - RNA, 19 nt, Human
accugagccaccuccuccu

SEQ ID NO: 1347869 - RNA, 22 nt, Human
accugguguggggucugugguc

SEQ ID NO: 1347870 - RNA, 21 nt, Human
agaaaaagcugagcugggaga

SEQ ID NO: 1347871 - RNA, 20 nt, Human
agaaccccggcgugccucuc

SEQ ID NO: 1347872 - RNA, 19 nt, Human
agacuucaagggucccuca

SEQ ID NO: 1347873 - RNA, 18 nt, Human
agcaaaaacccauuuaag

SEQ ID NO: 1347874 - RNA, 19 nt, Human
aggaagccugggagaccug

SEQ ID NO: 1347875 - RNA, 23 nt, Human
aggaagccugggagaccuggugc

SEQ ID NO: 1347876 - RNA, 23 nt, Human
aguggccccagggggacgaaggc

SEQ ID NO: 1347877 - RNA, 21 nt, Human
aucaagccccaucauccuagc

SEQ ID NO: 1347878 - RNA, 19 nt, Human
aucauaauagaaauaaagu

SEQ ID NO: 1347879 - RNA, 23 nt, Human
aucauaauagaaauaaagugcac

SEQ ID NO: 1347880 - RNA, 23 nt, Human
auuuacagccacuccccauugcu

SEQ ID NO: 1347881 - RNA, 23 nt, Human
caaaguguuucauuccccuagaa

SEQ ID NO: 1347882 - RNA, 23 nt, Human
caaccaccuuucaccccauccug

SEQ ID NO: 1347883 - RNA, 18 nt, Human
caaccccagggcgcuccc

SEQ ID NO: 1347884 - RNA, 27 nt, Human
caacgggcuguuucagcuccgagauuu

SEQ ID NO: 1347885 - RNA, 20 nt, Human
caagcccaaggcacaaacgg

SEQ ID NO: 1347886 - RNA, 19 nt, Human
caccuccuccuucgcgggc

SEQ ID NO: 1347887 - RNA, 22 nt, Human
caccuccuccuucgcgggcccc

SEQ ID NO: 1347888 - RNA, 21 nt, Human
cacucguuuccccuuauucug

SEQ ID NO: 1347889 - RNA, 23 nt, Human
cagacuucaagggucccucacag

SEQ ID NO: 1347890 - RNA, 20 nt, Human
cagcacaaggugagcggcag

SEQ ID NO: 1347891 - RNA, 23 nt, Human
caggaaaucagcaaaaacccauu

SEQ ID NO: 1347892 - RNA, 22 nt, Human
caucccaaaaccauccccuguc

SEQ ID NO: 1347893 - RNA, 20 nt, Human
cauuuaagaguccagacuuc

SEQ ID NO: 1347894 - RNA, 23 nt, Human
cauuuaagaguccagacuucaag

SEQ ID NO: 1347895 - RNA, 23 nt, Human
ccaaaaccauccccugucaccca

SEQ ID NO: 1347896 - RNA, 25 nt, Human
ccaccuuucaccccauccugaaucc

SEQ ID NO: 1347897 - RNA, 25 nt, Human
ccagaaccccggcgugccucuccuc

SEQ ID NO: 1347898 - RNA, 21 nt, Human
ccaggccccgcguuuccacgc

SEQ ID NO: 1347899 - RNA, 19 nt, Human
cccauccguggaaaaacug

SEQ ID NO: 1347900 - RNA, 24 nt, Human
ccccaucauccuagcaugcaccca

SEQ ID NO: 1347901 - RNA, 18 nt, Human
cccccggggccgguuccc

SEQ ID NO: 1347902 - RNA, 24 nt, Human
ccccgcguuuccacgccucccccg

SEQ ID NO: 1347903 - RNA, 19 nt, Human
ccccgggcgcucccaaccc

SEQ ID NO: 1347904 - RNA, 21 nt, Human
cccggacccacgcguucucuc

SEQ ID NO: 1347905 - RNA, 23 nt, Human
cccuagaaguagagaugagaccc

SEQ ID NO: 1347906 - RNA, 23 nt, Human
ccggacccacgcguucucuccuc

SEQ ID NO: 1347907 - RNA, 21 nt, Human
ccucccacccgcgacccgggc

SEQ ID NO: 1347908 - RNA, 24 nt, Human
ccuccuccuucgcgggccccgggc

SEQ ID NO: 1347909 - RNA, 18 nt, Human
ccuggagcugaugguggu

SEQ ID NO: 1347910 - RNA, 18 nt, Human
ccuuuaagcaaccaccuu

SEQ ID NO: 1347911 - RNA, 18 nt, Human
cgagcugaagcuucaucu

SEQ ID NO: 1347912 - RNA, 23 nt, Human
cgagcuggaggcggaagggccgg

SEQ ID NO: 1347913 - RNA, 22 nt, Human
cggcgugccucuccucccaccc

SEQ ID NO: 1347914 - RNA, 18 nt, Human
cgggccccgggcgcuccc

SEQ ID NO: 1347915 - RNA, 25 nt, Human
cuccagaaccccggcgugccucucc

SEQ ID NO: 1347916 - RNA, 18 nt, Human
cucuccucccacccgcga

SEQ ID NO: 1347917 - RNA, 18 nt, Human
cucuccucccgccggaga

SEQ ID NO: 1347918 - RNA, 22 nt, Human
cucugagaccaaaugagauaga

SEQ ID NO: 1347919 - RNA, 24 nt, Human
cugcugagcuagacuuuaguacac

SEQ ID NO: 1347920 - RNA, 21 nt, Human
cuuucaccccauccugaaucc

SEQ ID NO: 1347921 - RNA, 21 nt, Human
cuuugaguuggguuuucagug

SEQ ID NO: 1347922 - RNA, 23 nt, Human
gaaaucagcaaaaacccauuuaa

SEQ ID NO: 1347923 - RNA, 23 nt, Human
gagaauaacuggagccugaugac

SEQ ID NO: 1347924 - RNA, 18 nt, Human
gagaccccaaacggguca

SEQ ID NO: 1347925 - RNA, 18 nt, Human
gagcaagcccaaggcaca

SEQ ID NO: 1347926 - RNA, 18 nt, Human
gaguuggguuuucaguga

SEQ ID NO: 1347927 - RNA, 19 nt, Human
ggaaaacaaugugcagggu

SEQ ID NO: 1347928 - RNA, 21 nt, Human
ggaaaacaaugugcagggugg

SEQ ID NO: 1347929 - RNA, 22 nt, Human
ggccccgggcgcucccaacccc

SEQ ID NO: 1347930 - RNA, 23 nt, Human
gggagaggcuggucgagucccag

SEQ ID NO: 1347931 - RNA, 25 nt, Human
gggagaggcuggucgagucccaggc

SEQ ID NO: 1347932 - RNA, 19 nt, Human
gggccccgggcgcucccaa

SEQ ID NO: 1347933 - RNA, 19 nt, Human
uaagaguccagacuucaag

SEQ ID NO: 1347934 - RNA, 21 nt, Human
uaagcaaccaccuuucacccc

SEQ ID NO: 1347935 - RNA, 20 nt, Human
uaauagaaauaaagugcaca

SEQ ID NO: 1347936 - RNA, 21 nt, Human
uacaguuuauugucgcccugc

SEQ ID NO: 1347937 - RNA, 26 nt, Human
uaggaaagagccuuccugaaaaucag

SEQ ID NO: 1347938 - RNA, 19 nt, Human
ucacccauccguggaaaaa

SEQ ID NO: 1347939 - RNA, 21 nt, Human
ucccaaccccagggcgcuccc

SEQ ID NO: 1347940 - RNA, 24 nt, Human
uccccauugcuugcauuaccgccu

SEQ ID NO: 1347941 - RNA, 21 nt, Human
uccccuagaaguagagaugag

SEQ ID NO: 1347942 - RNA, 18 nt, Human
ucccugaugccaaaaagg

SEQ ID NO: 1347943 - RNA, 19 nt, Human
ucgcgggccccgggcgcuc

SEQ ID NO: 1347944 - RNA, 24 nt, Human
ucuacauuauggugaguuguauaa

SEQ ID NO: 1347945 - RNA, 20 nt, Human
ugacaccugagccaccuccu

SEQ ID NO: 1347946 - RNA, 24 nt, Human
ugaggaagccugggagaccuggug

SEQ ID NO: 1347947 - RNA, 23 nt, Human
ugcccuuggauccagcugugccu

SEQ ID NO: 1347948 - RNA, 21 nt, Human
ugcuugcauuaccgccugagc

SEQ ID NO: 1347949 - RNA, 20 nt, Human
uggaaaaacugucccugaug

SEQ ID NO: 1347950 - RNA, 23 nt, Human
uggaaaacaaugugcaggguggc

SEQ ID NO: 1347951 - RNA, 18 nt, Human
uggagccugaugacauca

SEQ ID NO: 1347952 - RNA, 22 nt, Human
uggggacugcugagcuagacuu

SEQ ID NO: 1347953 - RNA, 23 nt, Human
ugguguggggucuguggucuguu

SEQ ID NO: 1347954 - RNA, 21 nt, Human
uguuucauuccccuagaagua

SEQ ID NO: 1347955 - RNA, 22 nt, Human
uuggcccuaaauagaguuagaa

SEQ ID NO: 1347956 - RNA, 18 nt, Human
uuguauuucauuuuccuu

SEQ ID NO: 1347957 - RNA, 21 nt, Human
uuuuuuuuuuuuuuuugaagg

SEQ ID NO: 1347958 - RNA, 18 nt, Human
uuuuuuuuuuuuuuuuug

SEQ ID NO: 1347959 - RNA, 22 nt, Human
aaaaauacaggcaucacacaaa

SEQ ID NO: 1347960 - RNA, 19 nt, Human
aaagugcugggauuacagg

SEQ ID NO: 1347961 - RNA, 22 nt, Human
aaagugcugggauuacaggcgg

SEQ ID NO: 1347962 - RNA, 23 nt, Human
aaagugcugggauuacaggcgga

SEQ ID NO: 1347963 - RNA, 23 nt, Human
aaaucaacuuuaaauugaagaga

SEQ ID NO: 1347964 - RNA, 23 nt, Human
aacuacuuaaaacaaaaaacccc

SEQ ID NO: 1347965 - RNA, 18 nt, Human
aagaaaagcucagaagug

SEQ ID NO: 1347966 - RNA, 19 nt, Human
aagagaaagaggguaacga

SEQ ID NO: 1347967 - RNA, 25 nt, Human
aagcaauucucaugccucagccucc

SEQ ID NO: 1347968 - RNA, 21 nt, Human
aaguagccaggauuacaggca

SEQ ID NO: 1347969 - RNA, 24 nt, Human
aaguagccaggauuacaggcaugu

SEQ ID NO: 1347970 - RNA, 26 nt, Human
aaguagccaggauuacaggcauguau

SEQ ID NO: 1347971 - RNA, 18 nt, Human
aagugcugggauuacagg

SEQ ID NO: 1347972 - RNA, 19 nt, Human
aagugcugggauuacaggc

SEQ ID NO: 1347973 - RNA, 25 nt, Human
aagugcugggauuacaggcggaacc

SEQ ID NO: 1347974 - RNA, 18 nt, Human
aauguuaccaaagcugca

SEQ ID NO: 1347975 - RNA, 22 nt, Human
acacaauuacauacauucacac

SEQ ID NO: 1347976 - RNA, 22 nt, Human
accacguuggccaggcuggucu

SEQ ID NO: 1347977 - RNA, 19 nt, Human
acccaggcuggagugcagu

SEQ ID NO: 1347978 - RNA, 22 nt, Human
acccauuuugaaccugaggugc

SEQ ID NO: 1347979 - RNA, 19 nt, Human
accuggacuguggcugacu

SEQ ID NO: 1347980 - RNA, 19 nt, Human
acuggaaugcauggacaug

SEQ ID NO: 1347981 - RNA, 24 nt, Human
agcccugaugucuggaucuuuagu

SEQ ID NO: 1347982 - RNA, 18 nt, Human
aggugcaugugggccgca

SEQ ID NO: 1347983 - RNA, 23 nt, Human
auauauuaaugcacacacagaga

SEQ ID NO: 1347984 - RNA, 21 nt, Human
auauuaaugcacacacagaga

SEQ ID NO: 1347985 - RNA, 22 nt, Human
augaauuuuugcauaggcagag

SEQ ID NO: 1347986 - RNA, 22 nt, Human
augccucagccucccaaguagc

SEQ ID NO: 1347987 - RNA, 20 nt, Human
auucauuuucccagacuucu

SEQ ID NO: 1347988 - RNA, 22 nt, Human
auuuuuguauuuuuaguagaga

SEQ ID NO: 1347989 - RNA, 24 nt, Human
auuuuuguauuuuuaguagagaca

SEQ ID NO: 1347990 - RNA, 26 nt, Human
caaagugcugggauuacaggcggaac

SEQ ID NO: 1347991 - RNA, 20 nt, Human
caaccuccaccucccagguu

SEQ ID NO: 1347992 - RNA, 23 nt, Human
caaccuccaccucccagguucaa

SEQ ID NO: 1347993 - RNA, 19 nt, Human
caagaaaagcucagaagug

SEQ ID NO: 1347994 - RNA, 23 nt, Human
caagaaucuaaacacuuuccagg

SEQ ID NO: 1347995 - RNA, 22 nt, Human
caagagauccaccugccuggac

SEQ ID NO: 1347996 - RNA, 21 nt, Human
cacacagcugcuaugcuccca

SEQ ID NO: 1347997 - RNA, 22 nt, Human
cacacagcugcuaugcucccaa

SEQ ID NO: 1347998 - RNA, 20 nt, Human
caccacguuggccaggcugg

SEQ ID NO: 1347999 - RNA, 21 nt, Human
caccacguuggccaggcuggu

SEQ ID NO: 1348000 - RNA, 22 nt, Human
caccacguuggccaggcugguc

SEQ ID NO: 1348001 - RNA, 24 nt, Human
caccacguuggccaggcuggucuu

SEQ ID NO: 1348002 - RNA, 24 nt, Human
caccgaaagaugaauuuuugcaua

SEQ ID NO: 1348003 - RNA, 23 nt, Human
caccugccuggaccucccaaagu

SEQ ID NO: 1348004 - RNA, 23 nt, Human
cacguuggccaggcuggucuuga

SEQ ID NO: 1348005 - RNA, 21 nt, Human
cacugcaaccuccaccuccca

SEQ ID NO: 1348006 - RNA, 21 nt, Human
cagaaagcacacgugcagggc

SEQ ID NO: 1348007 - RNA, 21 nt, Human
caggacaccagugccccugag

SEQ ID NO: 1348008 - RNA, 23 nt, Human
caggacaccagugccccugaggg

SEQ ID NO: 1348009 - RNA, 21 nt, Human
caggauuacaggcauguauca

SEQ ID NO: 1348010 - RNA, 24 nt, Human
caguguuucaccacguuggccagg

SEQ ID NO: 1348011 - RNA, 19 nt, Human
caucacacccagcucauuu

SEQ ID NO: 1348012 - RNA, 19 nt, Human
ccaaagugcugggauuaca

SEQ ID NO: 1348013 - RNA, 22 nt, Human
ccaaagugcugggauuacaggc

SEQ ID NO: 1348014 - RNA, 23 nt, Human
ccaaagugcugggauuacaggcg

SEQ ID NO: 1348015 - RNA, 24 nt, Human
ccaaguagccaggauuacaggcau

SEQ ID NO: 1348016 - RNA, 27 nt, Human
ccaccucccagguucaagcaauucuuu

SEQ ID NO: 1348017 - RNA, 24 nt, Human
cccaaguagccaggauuacaggca

SEQ ID NO: 1348018 - RNA, 20 nt, Human
cccacacacaauuacauaca

SEQ ID NO: 1348019 - RNA, 23 nt, Human
cccagguucaagcaauucucaug

SEQ ID NO: 1348020 - RNA, 22 nt, Human
ccccugagggcucauauggcuc

SEQ ID NO: 1348021 - RNA, 20 nt, Human
ccgcugugcccagcccugau

SEQ ID NO: 1348022 - RNA, 23 nt, Human
ccgcugugcccagcccugauguc

SEQ ID NO: 1348023 - RNA, 22 nt, Human
ccucccagguucaagcaauucu

SEQ ID NO: 1348024 - RNA, 24 nt, Human
ccuccuggucucaagagauccacc

SEQ ID NO: 1348025 - RNA, 21 nt, Human
ccugcagggccgcgucgccag

SEQ ID NO: 1348026 - RNA, 21 nt, Human
ccuggucucaagagauccacc

SEQ ID NO: 1348027 - RNA, 21 nt, Human
cuaaacacuuuccagguccca

SEQ ID NO: 1348028 - RNA, 24 nt, Human
cucacugcaaccuccaccucccag

SEQ ID NO: 1348029 - RNA, 25 nt, Human
cucaugccucagccucccaaguagc

SEQ ID NO: 1348030 - RNA, 24 nt, Human
cugcaaccuccaccucccagguuc

SEQ ID NO: 1348031 - RNA, 21 nt, Human
cugccagaagacacccauuuu

SEQ ID NO: 1348032 - RNA, 21 nt, Human
cuggaccucccaaagugcugg

SEQ ID NO: 1348033 - RNA, 21 nt, Human
cuggucuugaccuccuggucu

SEQ ID NO: 1348034 - RNA, 21 nt, Human
cuugcucagucacccaggcug

SEQ ID NO: 1348035 - RNA, 22 nt, Human
gauccaccugccuggaccuccc

SEQ ID NO: 1348036 - RNA, 20 nt, Human
gauuacaggcggaaccgcug

SEQ ID NO: 1348037 - RNA, 19 nt, Human
gcaggaucuagaauaggua

SEQ ID NO: 1348038 - RNA, 21 nt, Human
gccuggaccucccaaagugcu

SEQ ID NO: 1348039 - RNA, 24 nt, Human
uacaggcauguaucaucacaccca

SEQ ID NO: 1348040 - RNA, 23 nt, Human
uacauacauucacacagcugcua

SEQ ID NO: 1348041 - RNA, 18 nt, Human
uagcuaaaaauacaggca

SEQ ID NO: 1348042 - RNA, 24 nt, Human
uaguagagacaguguuucaccacg

SEQ ID NO: 1348043 - RNA, 21 nt, Human
uaucaagaaucuaaacacuuu

SEQ ID NO: 1348044 - RNA, 21 nt, Human
ucacccaggcuggagugcagu

SEQ ID NO: 1348045 - RNA, 24 nt, Human
ucacugcaaccuccaccucccagg

SEQ ID NO: 1348046 - RNA, 25 nt, Human
ucacugcaaccuccaccucccaggu

SEQ ID NO: 1348047 - RNA, 27 nt, Human
ucacugcaaccuccaccucccagguuc

SEQ ID NO: 1348048 - RNA, 20 nt, Human
ucagccucccaaguagccag

SEQ ID NO: 1348049 - RNA, 21 nt, Human
ucagccucccaaguagccagg

SEQ ID NO: 1348050 - RNA, 25 nt, Human
ucagcucacugcaaccuccaccucc

SEQ ID NO: 1348051 - RNA, 24 nt, Human
ucagucacccaggcuggagugcag

SEQ ID NO: 1348052 - RNA, 19 nt, Human
ucauuuuuuucuuuucuuu

SEQ ID NO: 1348053 - RNA, 24 nt, Human
ucccaaagugcugggauuacaggc

SEQ ID NO: 1348054 - RNA, 24 nt, Human
ucccaaguagccaggauuacaggc

SEQ ID NO: 1348055 - RNA, 21 nt, Human
ucccagguucaagcaauucuc

SEQ ID NO: 1348056 - RNA, 24 nt, Human
ucccagguucaagcaauucucaug

SEQ ID NO: 1348057 - RNA, 24 nt, Human
ucgcaugagcucagcucacugcaa

SEQ ID NO: 1348058 - RNA, 21 nt, Human
ucuaaacacuuuccagguccc

SEQ ID NO: 1348059 - RNA, 23 nt, Human
ucuugcucagucacccaggcugg

SEQ ID NO: 1348060 - RNA, 24 nt, Human
ucuugcucagucacccaggcugga

SEQ ID NO: 1348061 - RNA, 24 nt, Human
ugaggugcaugugggccgcaguga

SEQ ID NO: 1348062 - RNA, 22 nt, Human
ugcaggacaccagugccccuga

SEQ ID NO: 1348063 - RNA, 23 nt, Human
ugccucagccucccaaguagcca

SEQ ID NO: 1348064 - RNA, 24 nt, Human
ugccucagccucccaaguagccag

SEQ ID NO: 1348065 - RNA, 24 nt, Human
ugcucagucacccaggcuggagug

SEQ ID NO: 1348066 - RNA, 19 nt, Human
ugcugggauuacaggcgga

SEQ ID NO: 1348067 - RNA, 19 nt, Human
uggacuguggcugacuagu

SEQ ID NO: 1348068 - RNA, 19 nt, Human
uggagugcagucgcaugag

SEQ ID NO: 1348069 - RNA, 24 nt, Human
uggcaagaaaagcucagaaguguu

SEQ ID NO: 1348070 - RNA, 24 nt, Human
uggccaggcuggucuugaccuccu

SEQ ID NO: 1348071 - RNA, 18 nt, Human
ugggauuacaggcggaac

SEQ ID NO: 1348072 - RNA, 20 nt, Human
ugggauuacaggcggaaccg

SEQ ID NO: 1348073 - RNA, 20 nt, Human
ugggauuacaggcggaaccg

SEQ ID NO: 1348074 - RNA, 21 nt, Human
ugggauuacaggcggaaccgc

SEQ ID NO: 1348075 - RNA, 23 nt, Human
ugggauuacaggcggaaccgcug

SEQ ID NO: 1348076 - RNA, 20 nt, Human
ugguagguagcuaguguugc

SEQ ID NO: 1348077 - RNA, 24 nt, Human
uucaaaaauucauuuucccagacu

SEQ ID NO: 1348078 - RNA, 19 nt, Human
uuccaggucccaggcaacc

SEQ ID NO: 1348079 - RNA, 18 nt, Human
uugaucucagcaaaagua

SEQ ID NO: 1348080 - RNA, 23 nt, Human
uugaucucagcaaaaguauagaa

SEQ ID NO: 1348081 - RNA, 24 nt, Human
uugcucagucacccaggcuggagu

SEQ ID NO: 1348082 - RNA, 18 nt, Human
uugcuggaaccuggacug

SEQ ID NO: 1348083 - RNA, 24 nt, Human
uuggccaggcuggucuugaccucc

SEQ ID NO: 1348084 - RNA, 21 nt, Human
uuucaccacguuggccaggcu

SEQ ID NO: 1348085 - RNA, 24 nt, Human
uuuuuaguagagacaguguuucac

SEQ ID NO: 1348086 - RNA, 20 nt, Human
uuuuuguauuuuuaguagag

SEQ ID NO: 1348087 - RNA, 19 nt, Human
aaguaauucuggagagcug

SEQ ID NO: 1348088 - RNA, 19 nt, Human
agaagcugaauuuauaugg

SEQ ID NO: 1348089 - RNA, 19 nt, Human
agguggaguugcaagugag

SEQ ID NO: 1348090 - RNA, 22 nt, Human
augaagagaggaauuaccuaca

SEQ ID NO: 1348091 - RNA, 23 nt, Human
cagagccugagggagcccagggg

SEQ ID NO: 1348092 - RNA, 22 nt, Human
cagaugccagaggagaagcuga

SEQ ID NO: 1348093 - RNA, 22 nt, Human
ccagagccugagggagcccagg

SEQ ID NO: 1348094 - RNA, 18 nt, Human
ccaggggacuccugugcu

SEQ ID NO: 1348095 - RNA, 25 nt, Human
ccugugcugcgauuuguuacauaga

SEQ ID NO: 1348096 - RNA, 24 nt, Human
uaagcauuugagcucaaaccuccu

SEQ ID NO: 1348097 - RNA, 21 nt, Human
uacucuuuccuugcuuugaga

SEQ ID NO: 1348098 - RNA, 19 nt, Human
uauguugccagcaguuuaa

SEQ ID NO: 1348099 - RNA, 20 nt, Human
uauguugccagcaguuuaag

SEQ ID NO: 1348100 - RNA, 27 nt, Human
ugccucauaggcagaaauucauugaau

SEQ ID NO: 1348101 - RNA, 21 nt, Human
uguugccagcaguuuaagcau

SEQ ID NO: 1348102 - RNA, 19 nt, Human
acgcccggccgggcauggg

SEQ ID NO: 1348103 - RNA, 19 nt, Human
agaggacaaagggggacag

SEQ ID NO: 1348104 - RNA, 19 nt, Human
aggacaaagggggacagag

SEQ ID NO: 1348105 - RNA, 20 nt, Human
aggcggagugggccccccgg

SEQ ID NO: 1348106 - RNA, 19 nt, Human
aguggcagcguagccgagg

SEQ ID NO: 1348107 - RNA, 19 nt, Human
auaaagccccaaaccacgc

SEQ ID NO: 1348108 - RNA, 20 nt, Human
caccagggcaccagccggcg

SEQ ID NO: 1348109 - RNA, 18 nt, Human
ccacuucuuaggaaaaac

SEQ ID NO: 1348110 - RNA, 18 nt, Human
ccccggauccggguuugc

SEQ ID NO: 1348111 - RNA, 18 nt, Human
cccggccuccuggagagc

SEQ ID NO: 1348112 - RNA, 26 nt, Human
cuccucccggauauaaagccccaaaa

SEQ ID NO: 1348113 - RNA, 19 nt, Human
cugcguggcaguagcccuc

SEQ ID NO: 1348114 - RNA, 18 nt, Human
gaaagaacagcagcucgc

SEQ ID NO: 1348115 - RNA, 18 nt, Human
gcccggccgggcaugggg

SEQ ID NO: 1348116 - RNA, 24 nt, Human
ggagagccugagauaaagaggaca

SEQ ID NO: 1348117 - RNA, 21 nt, Human
ggagugggccccccggccucc

SEQ ID NO: 1348118 - RNA, 19 nt, Human
ggauauaaagccccaaacc

SEQ ID NO: 1348119 - RNA, 25 nt, Human
ggcgccuucgaaagaacagcagcuc

SEQ ID NO: 1348120 - RNA, 23 nt, Human
uauaaagccccaaaccacgccac

SEQ ID NO: 1348121 - RNA, 19 nt, Human
uccggguuugcaaacgccc

SEQ ID NO: 1348122 - RNA, 21 nt, Human
uccuugcccaagggcgggagc

SEQ ID NO: 1348123 - RNA, 22 nt, Human
ucgaaagaacagcagcucgcga

SEQ ID NO: 1348124 - RNA, 22 nt, Human
ugcguggcaguagcccucaaac

SEQ ID NO: 1348125 - RNA, 24 nt, Human
uggccugggcuuccccuugagggc

SEQ ID NO: 1348126 - RNA, 22 nt, Human
ugggcuuccccuugagggcccg

SEQ ID NO: 1348127 - RNA, 23 nt, Human
uuugcaaacgccccaggauuugc

SEQ ID NO: 1348128 - RNA, 23 nt, Human
aaacauuucugacaucuuccucc

SEQ ID NO: 1348129 - RNA, 18 nt, Human
agccccaguagcaaagcu

SEQ ID NO: 1348130 - RNA, 24 nt, Human
aucuuccuccagcucagucugcca

SEQ ID NO: 1348131 - RNA, 18 nt, Human
auuucugacaucuuccuc

SEQ ID NO: 1348132 - RNA, 19 nt, Human
ccauccaaguugaugccaa

SEQ ID NO: 1348133 - RNA, 21 nt, Human
cccaccuuccuccauacagaa

SEQ ID NO: 1348134 - RNA, 25 nt, Human
cccaccuuccuccauacagaauuga

SEQ ID NO: 1348135 - RNA, 18 nt, Human
cccccuuaacagugaccc

SEQ ID NO: 1348136 - RNA, 22 nt, Human
ccuccagcucagucugccaugc

SEQ ID NO: 1348137 - RNA, 22 nt, Human
cggaauccucagccccaguagc

SEQ ID NO: 1348138 - RNA, 20 nt, Human
gcccccuuaacagugacccg

SEQ ID NO: 1348139 - RNA, 23 nt, Human
gcuuugggagauuauacaggucc

SEQ ID NO: 1348140 - RNA, 18 nt, Human
ggaaauguccacuccuuu

SEQ ID NO: 1348141 - RNA, 18 nt, Human
uacauuauuaccaaaccu

SEQ ID NO: 1348142 - RNA, 24 nt, Human
uaccugcauuuuuaaagacagcuu

SEQ ID NO: 1348143 - RNA, 24 nt, Human
ucacaugcuuaccugcauuuuuaa

SEQ ID NO: 1348144 - RNA, 19 nt, Human
uccuccagcucagucugcc

SEQ ID NO: 1348145 - RNA, 25 nt, Human
uccuuugggggugauuuuucuccuc

SEQ ID NO: 1348146 - RNA, 21 nt, Human
uuaccccaccuuccuccauac

SEQ ID NO: 1348147 - RNA, 18 nt, Human
uuuuuuuuuuuuuuuuug

SEQ ID NO: 1348148 - RNA, 20 nt, Human
uuuuuuuuuuuuuuuuugcc

SEQ ID NO: 1348149 - RNA, 19 nt, Human
aaacagcaacagaucccca

SEQ ID NO: 1348150 - RNA, 21 nt, Human
aaacagcaacagauccccaga

SEQ ID NO: 1348151 - RNA, 21 nt, Human
acagcaacagauccccagaac

SEQ ID NO: 1348152 - RNA, 22 nt, Human
acagcaacagauccccagaaca

SEQ ID NO: 1348153 - RNA, 20 nt, Human
accccgccgcuccagacaag

SEQ ID NO: 1348154 - RNA, 18 nt, Human
agaccccgccgcuccaga

SEQ ID NO: 1348155 - RNA, 25 nt, Human
agauccccagaacagaugacagccc

SEQ ID NO: 1348156 - RNA, 19 nt, Human
agcacucuccuccaggugu

SEQ ID NO: 1348157 - RNA, 20 nt, Human
cagcaacagauccccagaac

SEQ ID NO: 1348158 - RNA, 23 nt, Human
caggagccaaaugggccuuccag

SEQ ID NO: 1348159 - RNA, 24 nt, Human
caggugcuuccuauugggcugggc

SEQ ID NO: 1348160 - RNA, 24 nt, Human
ccagaacagaugacagcccuaaag

SEQ ID NO: 1348161 - RNA, 25 nt, Human
ccagaacagaugacagcccuaaaga

SEQ ID NO: 1348162 - RNA, 20 nt, Human
cccaagaaacagcaacagau

SEQ ID NO: 1348163 - RNA, 22 nt, Human
cccaagaaacagcaacagaucc

SEQ ID NO: 1348164 - RNA, 23 nt, Human
cccaagaaacagcaacagauccc

SEQ ID NO: 1348165 - RNA, 23 nt, Human
cccgagguguggaguguauucug

SEQ ID NO: 1348166 - RNA, 22 nt, Human
ccuccaggugugcaccagcucu

SEQ ID NO: 1348167 - RNA, 22 nt, Human
cguccgggcgccuccgcgguga

SEQ ID NO: 1348168 - RNA, 22 nt, Human
cuccgcggugagucgcgccgcc

SEQ ID NO: 1348169 - RNA, 25 nt, Human
cuccuccaggugugcaccagcuccc

SEQ ID NO: 1348170 - RNA, 21 nt, Human
cugggccucggcccgggcggc

SEQ ID NO: 1348171 - RNA, 20 nt, Human
cuugggcucagaccccgccg

SEQ ID NO: 1348172 - RNA, 22 nt, Human
gcccgaagccucaggagguccu

SEQ ID NO: 1348173 - RNA, 21 nt, Human
gcggcggcggcggcuuccgac

SEQ ID NO: 1348174 - RNA, 23 nt, Human
gcuggcggcggcggcggcuuccg

SEQ ID NO: 1348175 - RNA, 27 nt, Human
gcuggcggcggcggcggcuuccgacuu

SEQ ID NO: 1348176 - RNA, 21 nt, Human
ggagguccuccugcauaagag

SEQ ID NO: 1348177 - RNA, 22 nt, Human
gggacgcuggcggcggcggcgg

SEQ ID NO: 1348178 - RNA, 21 nt, Human
uagaaagaguguggaucaggu

SEQ ID NO: 1348179 - RNA, 21 nt, Human
uauuauggagucccgaggugu

SEQ ID NO: 1348180 - RNA, 25 nt, Human
uauuauggagucccgagguguggag

SEQ ID NO: 1348181 - RNA, 22 nt, Human
ucagaccccgccgcuccagaca

SEQ ID NO: 1348182 - RNA, 23 nt, Human
uccccagacgggagacagacccu

SEQ ID NO: 1348183 - RNA, 21 nt, Human
ucccuggggcuagaaagagug

SEQ ID NO: 1348184 - RNA, 24 nt, Human
ucccuggggcuagaaagagugugg

SEQ ID NO: 1348185 - RNA, 21 nt, Human
ucgcggcuggucccggggcgg

SEQ ID NO: 1348186 - RNA, 19 nt, Human
ucuccgucccgagaagaag

SEQ ID NO: 1348187 - RNA, 18 nt, Human
ugagcaucccuggggcua

SEQ ID NO: 1348188 - RNA, 21 nt, Human
uggcggcggcggcggcuuccg

SEQ ID NO: 1348189 - RNA, 24 nt, Human
uggcggcggcggcggcuuccgacu

SEQ ID NO: 1348190 - RNA, 22 nt, Human
ugggcccaagaaacagcaacag

SEQ ID NO: 1348191 - RNA, 21 nt, Human
ugggcugggccucggcccggg

SEQ ID NO: 1348192 - RNA, 18 nt, Human
ugggucccugccuggugc

SEQ ID NO: 1348193 - RNA, 21 nt, Human
uucagcuccccagacgggaga

SEQ ID NO: 1348194 - RNA, 24 nt, Human
aaagugcugggauuacaggcguga

SEQ ID NO: 1348195 - RNA, 19 nt, Human
aagugcugggauuacaggc

SEQ ID NO: 1348196 - RNA, 19 nt, Human
aagugcugggauuacaggc

SEQ ID NO: 1348197 - RNA, 26 nt, Human
aagugcugggauuacaggcgugagcc

SEQ ID NO: 1348198 - RNA, 20 nt, Human
aaugcaguggcgcaaucucg

SEQ ID NO: 1348199 - RNA, 24 nt, Human
aaugcaguggcgcaaucucggcuc

SEQ ID NO: 1348200 - RNA, 21 nt, Human
acaggcaccugccaccaugcc

SEQ ID NO: 1348201 - RNA, 25 nt, Human
accucccggguuuaugccauuuucc

SEQ ID NO: 1348202 - RNA, 19 nt, Human
accucgugauccgcccuuc

SEQ ID NO: 1348203 - RNA, 18 nt, Human
acggggucucaccguguu

SEQ ID NO: 1348204 - RNA, 20 nt, Human
acggggucucaccguguuag

SEQ ID NO: 1348205 - RNA, 18 nt, Human
aguagcugggacuacagg

SEQ ID NO: 1348206 - RNA, 19 nt, Human
aguagcugggacuacaggc

SEQ ID NO: 1348207 - RNA, 23 nt, Human
aguagcugggacuacaggcaccu

SEQ ID NO: 1348208 - RNA, 24 nt, Human
caaagugcugggauuacaggcgug

SEQ ID NO: 1348209 - RNA, 18 nt, Human
caccguguuagccaggau

SEQ ID NO: 1348210 - RNA, 24 nt, Human
caccguguuagccaggauggucuc

SEQ ID NO: 1348211 - RNA, 22 nt, Human
caggauggucuccaucuccuga

SEQ ID NO: 1348212 - RNA, 22 nt, Human
ccaaagugcugggauuacaggc

SEQ ID NO: 1348213 - RNA, 22 nt, Human
ccaaagugcugggauuacaggc

SEQ ID NO: 1348214 - RNA, 24 nt, Human
ccaaagugcugggauuacaggcgu

SEQ ID NO: 1348215 - RNA, 23 nt, Human
cccggguuuaugccauuuuccug

SEQ ID NO: 1348216 - RNA, 18 nt, Human
ccgcccuucucagccucc

SEQ ID NO: 1348217 - RNA, 21 nt, Human
ccgcgcccagccuacuuuuuc

SEQ ID NO: 1348218 - RNA, 21 nt, Human
ccucgugauccgcccuucuca

SEQ ID NO: 1348219 - RNA, 24 nt, Human
cgugauccgcccuucucagccucc

SEQ ID NO: 1348220 - RNA, 25 nt, Human
cuagaagacaaguuaauauccaggc

SEQ ID NO: 1348221 - RNA, 24 nt, Human
cucacugcaagcuccaccucccgg

SEQ ID NO: 1348222 - RNA, 22 nt, Human
cuccugaccucgugauccgccc

SEQ ID NO: 1348223 - RNA, 23 nt, Human
cucgugauccgcccuucucagcc

SEQ ID NO: 1348224 - RNA, 24 nt, Human
cugcaagcuccaccucccggguuu

SEQ ID NO: 1348225 - RNA, 21 nt, Human
cugcacuggcuccaguuaugu

SEQ ID NO: 1348226 - RNA, 22 nt, Human
gaccucgugauccgcccuucuc

SEQ ID NO: 1348227 - RNA, 24 nt, Human
gaccucgugauccgcccuucucag

SEQ ID NO: 1348228 - RNA, 22 nt, Human
gacuacaggcaccugccaccau

SEQ ID NO: 1348229 - RNA, 18 nt, Human
gauuacaggcgugagcca

SEQ ID NO: 1348230 - RNA, 22 nt, Human
gauuacaggcgugagccaccgc

SEQ ID NO: 1348231 - RNA, 22 nt, Human
gauuacaggcgugagccaccgc

SEQ ID NO: 1348232 - RNA, 23 nt, Human
gcccggcuaauuuuuuguauuuu

SEQ ID NO: 1348233 - RNA, 19 nt, Human
gcccuucucagccucccaa

SEQ ID NO: 1348234 - RNA, 24 nt, Human
gccgaguagcugggacuacaggca

SEQ ID NO: 1348235 - RNA, 19 nt, Human
gcuggaaugcaguggcgca

SEQ ID NO: 1348236 - RNA, 22 nt, Human
gggucucaccguguuagccagg

SEQ ID NO: 1348237 - RNA, 20 nt, Human
ggucuccaucuccugaccuc

SEQ ID NO: 1348238 - RNA, 24 nt, Human
gugauccgcccuucucagccuccc

SEQ ID NO: 1348239 - RNA, 24 nt, Human
uaauuuuuuguauuuuuagcggag

SEQ ID NO: 1348240 - RNA, 25 nt, Human
uaauuuuuuguauuuuuagcggaga

SEQ ID NO: 1348241 - RNA, 23 nt, Human
uacaggcaccugccaccaugccc

SEQ ID NO: 1348242 - RNA, 24 nt, Human
uacaggcgugagccaccgcgccca

SEQ ID NO: 1348243 - RNA, 22 nt, Human
uagaagacaaguuaauauccag

SEQ ID NO: 1348244 - RNA, 24 nt, Human
uagccaggauggucuccaucuccu

SEQ ID NO: 1348245 - RNA, 24 nt, Human
uagcggagacggggucucaccgug

SEQ ID NO: 1348246 - RNA, 26 nt, Human
uagcggagacggggucucaccguguu

SEQ ID NO: 1348247 - RNA, 19 nt, Human
ucacccaggcuggaaugca

SEQ ID NO: 1348248 - RNA, 24 nt, Human
ucaccguguuagccaggauggucu

SEQ ID NO: 1348249 - RNA, 24 nt, Human
ucacugcaagcuccaccucccggg

SEQ ID NO: 1348250 - RNA, 24 nt, Human
ucccaaagugcugggauuacaggc

SEQ ID NO: 1348251 - RNA, 24 nt, Human
ucccggguuuaugccauuuuccug

SEQ ID NO: 1348252 - RNA, 24 nt, Human
ucucgcucagucacccaggcugga

SEQ ID NO: 1348253 - RNA, 18 nt, Human
ucuuuuuuuuuuuuuuuu

SEQ ID NO: 1348254 - RNA, 18 nt, Human
ugagacagagucucgcuc

SEQ ID NO: 1348255 - RNA, 22 nt, Human
ugauccgcccuucucagccucc

SEQ ID NO: 1348256 - RNA, 22 nt, Human
ugcaguggcgcaaucucggcuc

SEQ ID NO: 1348257 - RNA, 23 nt, Human
ugcaguggcgcaaucucggcuca

SEQ ID NO: 1348258 - RNA, 25 nt, Human
ugcccggcuaauuuuuuguauuuuu

SEQ ID NO: 1348259 - RNA, 24 nt, Human
ugccgaguagcugggacuacaggc

SEQ ID NO: 1348260 - RNA, 24 nt, Human
ugcugggauuacaggcgugagcca

SEQ ID NO: 1348261 - RNA, 19 nt, Human
uggaaugcaguggcgcaau

SEQ ID NO: 1348262 - RNA, 24 nt, Human
uggaaugcaguggcgcaaucucgg

SEQ ID NO: 1348263 - RNA, 21 nt, Human
ugggacuacaggcaccugcca

SEQ ID NO: 1348264 - RNA, 22 nt, Human
ugggacuacaggcaccugccac

SEQ ID NO: 1348265 - RNA, 24 nt, Human
ugggacuacaggcaccugccacca

SEQ ID NO: 1348266 - RNA, 25 nt, Human
ugggacuacaggcaccugccaccau

SEQ ID NO: 1348267 - RNA, 18 nt, Human
ugggauuacaggcgugag

SEQ ID NO: 1348268 - RNA, 19 nt, Human
ugggauuacaggcgugagc

SEQ ID NO: 1348269 - RNA, 21 nt, Human
ugggauuacaggcgugagcca

SEQ ID NO: 1348270 - RNA, 22 nt, Human
ugggauuacaggcgugagccac

SEQ ID NO: 1348271 - RNA, 23 nt, Human
ugggauuacaggcgugagccacc

SEQ ID NO: 1348272 - RNA, 24 nt, Human
ugggauuacaggcgugagccaccg

SEQ ID NO: 1348273 - RNA, 24 nt, Human
uuagcggagacggggucucaccgu

SEQ ID NO: 1348274 - RNA, 21 nt, Human
uucucagccucccaaagugcu

SEQ ID NO: 1348275 - RNA, 23 nt, Human
uuguauuuuuagcggagacgggg

SEQ ID NO: 1348276 - RNA, 21 nt, Human
uuuuuguauuuuuagcggaga

SEQ ID NO: 1348277 - RNA, 24 nt, Human
uuuuuuguauuuuuagcggagacg

SEQ ID NO: 1348278 - RNA, 20 nt, Human
uuuuuuuuuuugagacagag

SEQ ID NO: 1348279 - RNA, 25 nt, Human
uuuuuuuuuuuugagacagagucuc

SEQ ID NO: 1348280 - RNA, 18 nt, Human
uuuuuuuuuuuuuuuuug

SEQ ID NO: 1348281 - RNA, 24 nt, Human
uuuuuuuuuuuuuuuuuucuuuuu

SEQ ID NO: 1348282 - RNA, 21 nt, Human
aacuuuguggggugucugugg

SEQ ID NO: 1348283 - RNA, 24 nt, Human
agaacucagugagaccaagaaccc

SEQ ID NO: 1348284 - RNA, 19 nt, Human
agugagaccaagaacccac

SEQ ID NO: 1348285 - RNA, 21 nt, Human
cagugagaccaagaacccacc

SEQ ID NO: 1348286 - RNA, 19 nt, Human
cucagugagaccaagaacc

SEQ ID NO: 1348287 - RNA, 19 nt, Human
ggccgggcaggcaggcagg

SEQ ID NO: 1348288 - RNA, 22 nt, Human
gggugucuguggcuugcuacag

SEQ ID NO: 1348289 - RNA, 21 nt, Human
ggugucuguggcuugcuacag

SEQ ID NO: 1348290 - RNA, 21 nt, Human
guggcuugcuacagugacauc

SEQ ID NO: 1348291 - RNA, 18 nt, Human
ugagaccaagaacccacc

SEQ ID NO: 1348292 - RNA, 19 nt, Human
ugagaccaagaacccacca

SEQ ID NO: 1348293 - RNA, 24 nt, Human
aggagagggggcuuugugaggcuu

SEQ ID NO: 1348294 - RNA, 19 nt, Human
ugaacuaggagagggggcu

SEQ ID NO: 1348295 - RNA, 18 nt, Human
ugaggcuuugccacagug

SEQ ID NO: 1348296 - RNA, 24 nt, Human
uuuauucucagcauaugcuuguga

SEQ ID NO: 1348297 - RNA, 20 nt, Human
uuuuuuuuuuuuuuuuccau

SEQ ID NO: 1348298 - RNA, 23 nt, Human
uuuuuuuuuuuuuuuuuuuccau

SEQ ID NO: 1348299 - RNA, 24 nt, Human
uuuuuuuuuuuuuuuuuuuccaug

SEQ ID NO: 1348300 - RNA, 19 nt, Human
aaaagacaagcgacaaaaa

SEQ ID NO: 1348301 - RNA, 22 nt, Human
aagucuuagaaauagugaagcu

SEQ ID NO: 1348302 - RNA, 18 nt, Human
aauguggaauggaugacc

SEQ ID NO: 1348303 - RNA, 18 nt, Human
acuuagcccgguaucugg

SEQ ID NO: 1348304 - RNA, 21 nt, Human
agacaagcgacaaaaagagca

SEQ ID NO: 1348305 - RNA, 26 nt, Human
agacaagcgacaaaaagaggggaccc

SEQ ID NO: 1348306 - RNA, 22 nt, Human
agcaccccaugcucuucuauca

SEQ ID NO: 1348307 - RNA, 21 nt, Human
agcgacaaaaagagcaccgaa

SEQ ID NO: 1348308 - RNA, 19 nt, Human
augacccuccaauauuucc

SEQ ID NO: 1348309 - RNA, 20 nt, Human
caaaaagagcaccgaaggca

SEQ ID NO: 1348310 - RNA, 21 nt, Human
caaaaagagcaccgaaggcac

SEQ ID NO: 1348311 - RNA, 19 nt, Human
caacccugaaaagaauguc

SEQ ID NO: 1348312 - RNA, 22 nt, Human
caacuugcucuuuuaaugugga

SEQ ID NO: 1348313 - RNA, 28 nt, Human
caagcgacaaaaagagcaccgaaggcac

SEQ ID NO: 1348314 - RNA, 24 nt, Human
caccccaugcucuucuaucaggga

SEQ ID NO: 1348315 - RNA, 18 nt, Human
cacugccucauucccaga

SEQ ID NO: 1348316 - RNA, 20 nt, Human
cagagcaccccaugcucuuc

SEQ ID NO: 1348317 - RNA, 22 nt, Human
cagcugcccuucauccucuguc

SEQ ID NO: 1348318 - RNA, 27 nt, Human
cagcugcccuucauccucugucgucuc

SEQ ID NO: 1348319 - RNA, 22 nt, Human
cagcugcuguaugccuugagaa

SEQ ID NO: 1348320 - RNA, 20 nt, Human
cagggcgcauccucugggcc

SEQ ID NO: 1348321 - RNA, 25 nt, Human
ccacgccguuucuuccuuucuaucc

SEQ ID NO: 1348322 - RNA, 21 nt, Human
cccgucaguucccugggccuc

SEQ ID NO: 1348323 - RNA, 19 nt, Human
ccuacugucaguccuugaa

SEQ ID NO: 1348324 - RNA, 26 nt, Human
ccuagcuacgguuccugcuuguuuuc

SEQ ID NO: 1348325 - RNA, 24 nt, Human
ccuccgcggcugccucugccaccu

SEQ ID NO: 1348326 - RNA, 18 nt, Human
ccuuucuauccgcuccaa

SEQ ID NO: 1348327 - RNA, 22 nt, Human
cggcugccucugccaccugcuc

SEQ ID NO: 1348328 - RNA, 23 nt, Human
cuccaauauuuccccagagcacc

SEQ ID NO: 1348329 - RNA, 20 nt, Human
cuccccauucucucuccacc

SEQ ID NO: 1348330 - RNA, 23 nt, Human
cuccuccgcggcugccucugcca

SEQ ID NO: 1348331 - RNA, 18 nt, Human
cugccucugccaccugcu

SEQ ID NO: 1348332 - RNA, 20 nt, Human
cugccucugccaccugcucc

SEQ ID NO: 1348333 - RNA, 19 nt, Human
cuuagcccgguaucuggca

SEQ ID NO: 1348334 - RNA, 23 nt, Human
cuuagcccgguaucuggcaugug

SEQ ID NO: 1348335 - RNA, 21 nt, Human
cuuccgggacugccagggcgc

SEQ ID NO: 1348336 - RNA, 23 nt, Human
cuugagaaugggcaaaagacaag

SEQ ID NO: 1348337 - RNA, 19 nt, Human
gcauguggcaugcccagua

SEQ ID NO: 1348338 - RNA, 18 nt, Human
gcuuugguccuucucccg

SEQ ID NO: 1348339 - RNA, 20 nt, Human
gggcaaaagacaagcgacaa

SEQ ID NO: 1348340 - RNA, 20 nt, Human
uaagugaauccaugucucuu

SEQ ID NO: 1348341 - RNA, 18 nt, Human
uaccacugaaaauucaac

SEQ ID NO: 1348342 - RNA, 19 nt, Human
ucaacccugaaaagaaugu

SEQ ID NO: 1348343 - RNA, 19 nt, Human
uccgcccagauugcuuugg

SEQ ID NO: 1348344 - RNA, 18 nt, Human
uccucugucgucucccca

SEQ ID NO: 1348345 - RNA, 19 nt, Human
ucuauccgcuccaauguca

SEQ ID NO: 1348346 - RNA, 26 nt, Human
ucucuugcuugccgcuauuugcccac

SEQ ID NO: 1348347 - RNA, 18 nt, Human
ucugccaccugcuccgcc

SEQ ID NO: 1348348 - RNA, 24 nt, Human
ugaaaagaaugucuucgguugugg

SEQ ID NO: 1348349 - RNA, 21 nt, Human
ugaaaauucaacccugaaaag

SEQ ID NO: 1348350 - RNA, 22 nt, Human
ugagaaugggcaaaagacaagc

SEQ ID NO: 1348351 - RNA, 24 nt, Human
ugccagauacuuagcccgguaucu

SEQ ID NO: 1348352 - RNA, 20 nt, Human
ugccucugccaccugcuccu

SEQ ID NO: 1348353 - RNA, 20 nt, Human
uggaauggaugacccuccaa

SEQ ID NO: 1348354 - RNA, 21 nt, Human
uggaauggaugacccuccaau

SEQ ID NO: 1348355 - RNA, 23 nt, Human
ugggcaaaagacaagcgacaaaa

SEQ ID NO: 1348356 - RNA, 19 nt, Human
uggugacaagauuuagguc

SEQ ID NO: 1348357 - RNA, 22 nt, Human
uguggaauggaugacccuccaa

SEQ ID NO: 1348358 - RNA, 20 nt, Human
uuagaaauagugaagcuccu

SEQ ID NO: 1348359 - RNA, 23 nt, Human
uucauaauggauaccacugaaaa

SEQ ID NO: 1348360 - RNA, 21 nt, Human
uuccuuucuauccgcuccaau

SEQ ID NO: 1348361 - RNA, 24 nt, Human
uuggugacaagauuuaggucuuuu

SEQ ID NO: 1348362 - RNA, 18 nt, Human
uugugggcccauaaaguc

SEQ ID NO: 1348363 - RNA, 22 nt, Human
aaaacuaaacaaaaacaaaaau

SEQ ID NO: 1348364 - RNA, 25 nt, Human
aaacaaaaacaaaaauacccagaag

SEQ ID NO: 1348365 - RNA, 24 nt, Human
aaacaaaaacaaaaauacccagag

SEQ ID NO: 1348366 - RNA, 19 nt, Human
aaacaaaaauacccagagc

SEQ ID NO: 1348367 - RNA, 20 nt, Human
aaacaaaaauacccagagca

SEQ ID NO: 1348368 - RNA, 19 nt, Human
aaaccauaagaaaaacaca

SEQ ID NO: 1348369 - RNA, 19 nt, Human
aaagaggaugggggucagg

SEQ ID NO: 1348370 - RNA, 23 nt, Human
aaagcugucccggcccucugccu

SEQ ID NO: 1348371 - RNA, 19 nt, Human
aaaggggagagcgagggcu

SEQ ID NO: 1348372 - RNA, 22 nt, Human
aacaaaaacaaaaauacccaga

SEQ ID NO: 1348373 - RNA, 24 nt, Human
aacacacacucauacacacacaca

SEQ ID NO: 1348374 - RNA, 20 nt, Human
aagagaauggcagccauaca

SEQ ID NO: 1348375 - RNA, 19 nt, Human
aagcaacagagaggucuuc

SEQ ID NO: 1348376 - RNA, 23 nt, Human
aagcagcaaguccugaagcccca

SEQ ID NO: 1348377 - RNA, 23 nt, Human
aagccccagauccagaaagcaac

SEQ ID NO: 1348378 - RNA, 18 nt, Human
aagugccuucugccaaca

SEQ ID NO: 1348379 - RNA, 23 nt, Human
acaaaaacaaaaauacccagagc

SEQ ID NO: 1348380 - RNA, 19 nt, Human
acaagcaguacacguuaag

SEQ ID NO: 1348381 - RNA, 27 nt, Human
acacacacacacacucacgcacacaca

SEQ ID NO: 1348382 - RNA, 27 nt, Human
acacacacacacucacgcacacacaca

SEQ ID NO: 1348383 - RNA, 19 nt, Human
acaugaaaucuuuuaagca

SEQ ID NO: 1348384 - RNA, 24 nt, Human
acucacgcacacacacaagcagua

SEQ ID NO: 1348385 - RNA, 21 nt, Human
agaagggaagggagaaaggga

SEQ ID NO: 1348386 - RNA, 18 nt, Human
agaccccugccucagucc

SEQ ID NO: 1348387 - RNA, 20 nt, Human
agagcagauggggagagggu

SEQ ID NO: 1348388 - RNA, 18 nt, Human
agaggaugggggucaggg

SEQ ID NO: 1348389 - RNA, 21 nt, Human
agagguaggaaaagaggaugg

SEQ ID NO: 1348390 - RNA, 26 nt, Human
agauccuacugaaggcaggggggagg

SEQ ID NO: 1348391 - RNA, 21 nt, Human
agccaggaacugugguuccca

SEQ ID NO: 1348392 - RNA, 22 nt, Human
agccccagauccagaaagcaac

SEQ ID NO: 1348393 - RNA, 19 nt, Human
aggcagccaggaacugugg

SEQ ID NO: 1348394 - RNA, 18 nt, Human
aggcaggggggaggcggg

SEQ ID NO: 1348395 - RNA, 18 nt, Human
aggcaggggggaggcggg

SEQ ID NO: 1348396 - RNA, 24 nt, Human
aggggggaggcgggaagggaugug

SEQ ID NO: 1348397 - RNA, 22 nt, Human
agguaggaaaagaggauggggg

SEQ ID NO: 1348398 - RNA, 24 nt, Human
caaaaacaaaaauacccagagcag

SEQ ID NO: 1348399 - RNA, 23 nt, Human
caaaggcggaccacgagccuccu

SEQ ID NO: 1348400 - RNA, 23 nt, Human
caaaggugugcacacuucuccca

SEQ ID NO: 1348401 - RNA, 18 nt, Human
caacucagggcgaagaga

SEQ ID NO: 1348402 - RNA, 24 nt, Human
cacacacacucacgcacacacaca

SEQ ID NO: 1348403 - RNA, 22 nt, Human
cacacacucauacacacacaca

SEQ ID NO: 1348404 - RNA, 29 nt, Human
cacacucacgcacacacacaagcaguaca

SEQ ID NO: 1348405 - RNA, 21 nt, Human
cagcagaccgggagaagggaa

SEQ ID NO: 1348406 - RNA, 21 nt, Human
cagccccucggcgcggcgccc

SEQ ID NO: 1348407 - RNA, 23 nt, Human
cagccccucggcgcggcgccccu

SEQ ID NO: 1348408 - RNA, 21 nt, Human
ccacuccgcagccccucggcg

SEQ ID NO: 1348409 - RNA, 24 nt, Human
ccagagaccccugccucaguccgg

SEQ ID NO: 1348410 - RNA, 18 nt, Human
ccagagacccucagccca

SEQ ID NO: 1348411 - RNA, 18 nt, Human
ccagagcagauggggaga

SEQ ID NO: 1348412 - RNA, 24 nt, Human
ccaggcaaaggcggaccacgagcc

SEQ ID NO: 1348413 - RNA, 20 nt, Human
ccagggugccggcgggggca

SEQ ID NO: 1348414 - RNA, 23 nt, Human
cccacacaugaaaucuuuuaagc

SEQ ID NO: 1348415 - RNA, 23 nt, Human
ccccaaaugacuuauugagcaau

SEQ ID NO: 1348416 - RNA, 19 nt, Human
ccccacuccgcagccccuc

SEQ ID NO: 1348417 - RNA, 21 nt, Human
ccccagagaccccugccucag

SEQ ID NO: 1348418 - RNA, 21 nt, Human
ccccagagaccccugccucag

SEQ ID NO: 1348419 - RNA, 22 nt, Human
ccccagauccagaaagcaacuc

SEQ ID NO: 1348420 - RNA, 24 nt, Human
cccccacuccgcagccccucggcg

SEQ ID NO: 1348421 - RNA, 25 nt, Human
cccccagagaccccugccucagucc

SEQ ID NO: 1348422 - RNA, 21 nt, Human
ccccugccucaguccgggguu

SEQ ID NO: 1348423 - RNA, 21 nt, Human
ccuccucgcccccagagaccc

SEQ ID NO: 1348424 - RNA, 26 nt, Human
ccucuggccggccugucugcuggccu

SEQ ID NO: 1348425 - RNA, 25 nt, Human
cuaaaacuaaacaaaaacaaaaaua

SEQ ID NO: 1348426 - RNA, 27 nt, Human
cucacgcacacacacaagcaguacacg

SEQ ID NO: 1348427 - RNA, 20 nt, Human
cuccugagcggggagagccc

SEQ ID NO: 1348428 - RNA, 25 nt, Human
cugaagccccagauccagaaagcaa

SEQ ID NO: 1348429 - RNA, 23 nt, Human
cugauaaauuaauuccucucugu

SEQ ID NO: 1348430 - RNA, 22 nt, Human
gaaagggaguuaucaaugacau

SEQ ID NO: 1348431 - RNA, 18 nt, Human
gaaggcaggggggaggcg

SEQ ID NO: 1348432 - RNA, 22 nt, Human
gagaagggaagggagaaaggga

SEQ ID NO: 1348433 - RNA, 18 nt, Human
gaggaugggggucagggg

SEQ ID NO: 1348434 - RNA, 19 nt, Human
gauuucaguacuugcuuca

SEQ ID NO: 1348435 - RNA, 22 nt, Human
gcaauuucuaaaccaaacagag

SEQ ID NO: 1348436 - RNA, 21 nt, Human
gcccuccucgcccccagagac

SEQ ID NO: 1348437 - RNA, 19 nt, Human
gcugaagagaauggcagcc

SEQ ID NO: 1348438 - RNA, 19 nt, Human
ggaaagcugucccggcccu

SEQ ID NO: 1348439 - RNA, 20 nt, Human
ggaccucuaagcuuuccccu

SEQ ID NO: 1348440 - RNA, 20 nt, Human
ggacucccggucccccgccc

SEQ ID NO: 1348441 - RNA, 24 nt, Human
ggcuguggaaaggggagagcgagg

SEQ ID NO: 1348442 - RNA, 22 nt, Human
gggaacgguggggaaacagagc

SEQ ID NO: 1348443 - RNA, 24 nt, Human
uaaacaaaaacaaaaauacccaga

SEQ ID NO: 1348444 - RNA, 18 nt, Human
uaaaggcugacugaagca

SEQ ID NO: 1348445 - RNA, 18 nt, Human
uaaaucaugagaacauga

SEQ ID NO: 1348446 - RNA, 24 nt, Human
uaagaaaaacacaacaguuuuagg

SEQ ID NO: 1348447 - RNA, 20 nt, Human
uaagcaaaguuuucuugucu

SEQ ID NO: 1348448 - RNA, 25 nt, Human
uacaacacccacagacccuucugag

SEQ ID NO: 1348449 - RNA, 21 nt, Human
uacaacauaaagcaacagaga

SEQ ID NO: 1348450 - RNA, 31 nt, Human
uacacacacacacacucacgcacacacacag

SEQ ID NO: 1348451 - RNA, 18 nt, Human
uacacaggagaaaggcag

SEQ ID NO: 1348452 - RNA, 20 nt, Human
uacacaggagaaaggcagcc

SEQ ID NO: 1348453 - RNA, 18 nt, Human
ucagcccaggcaaaggcg

SEQ ID NO: 1348454 - RNA, 24 nt, Human
uccggccccgccggacgccccuuc

SEQ ID NO: 1348455 - RNA, 19 nt, Human
ucuaaaccaaacagagagg

SEQ ID NO: 1348456 - RNA, 21 nt, Human
ucuaaaccaaacagagaggua

SEQ ID NO: 1348457 - RNA, 24 nt, Human
ucugccaacaacuucuaaggugcu

SEQ ID NO: 1348458 - RNA, 21 nt, Human
ucugcuggccuugcgucccgc

SEQ ID NO: 1348459 - RNA, 24 nt, Human
ucuggccggccugucugcuggccu

SEQ ID NO: 1348460 - RNA, 25 nt, Human
ucuucauguuugggaaguggcuggg

SEQ ID NO: 1348461 - RNA, 23 nt, Human
ugaagagaauggcagccauacag

SEQ ID NO: 1348462 - RNA, 18 nt, Human
ugaaggcaggggggaggc

SEQ ID NO: 1348463 - RNA, 18 nt, Human
ugagaggaaagcuguccc

SEQ ID NO: 1348464 - RNA, 18 nt, Human
ugccaaaccccaaaugac

SEQ ID NO: 1348465 - RNA, 18 nt, Human
ugcucauccucauaggag

SEQ ID NO: 1348466 - RNA, 24 nt, Human
uggaaaggggagagcgagggcuga

SEQ ID NO: 1348467 - RNA, 18 nt, Human
uggauacacaggcaugaa

SEQ ID NO: 1348468 - RNA, 23 nt, Human
ugggaaguggcugggcaggaugc

SEQ ID NO: 1348469 - RNA, 22 nt, Human
ugggauggcuauggggcauguc

SEQ ID NO: 1348470 - RNA, 21 nt, Human
ugggcaggaugccaaacccca

SEQ ID NO: 1348471 - RNA, 22 nt, Human
uguacaacauaaagcaacagag

SEQ ID NO: 1348472 - RNA, 20 nt, Human
ugugcacacuucucccacag

SEQ ID NO: 1348473 - RNA, 24 nt, Human
uuaauuccucucuguuguaaaccu

SEQ ID NO: 1348474 - RNA, 23 nt, Human
uugcuucauucccauaaaucaug

SEQ ID NO: 1348475 - RNA, 18 nt, Human
uuuucaaguggggugaac

SEQ ID NO: 1348476 - RNA, 19 nt, Human
aguucugggaccucucagg

SEQ ID NO: 1348477 - RNA, 19 nt, Human
cagaguucugggaccucuc

SEQ ID NO: 1348478 - RNA, 20 nt, Human
cccacauaguagauuuuagu

SEQ ID NO: 1348479 - RNA, 20 nt, Human
cucagcgcuggacucacuuc

SEQ ID NO: 1348480 - RNA, 25 nt, Human
ugccuggaagagaacuuuggauuuc

SEQ ID NO: 1348481 - RNA, 21 nt, Human
uggauuucucuaccccacugg

SEQ ID NO: 1348482 - RNA, 19 nt, Human
aguucugggaccucucagg

SEQ ID NO: 1348483 - RNA, 19 nt, Human
cagaguucugggaccucuc

SEQ ID NO: 1348484 - RNA, 25 nt, Human
ugccuggaagagaacuuuggauuuc

SEQ ID NO: 1348485 - RNA, 21 nt, Human
uggaauuauuaaaaaaugaaa

SEQ ID NO: 1348486 - RNA, 21 nt, Human
uggaucugcaagaaaaaucuc

SEQ ID NO: 1348487 - RNA, 22 nt, Human
uuggauuucucuaccccacugg

SEQ ID NO: 1348488 - RNA, 24 nt, Human
aaacaucuuagucacauccuccca

SEQ ID NO: 1348489 - RNA, 19 nt, Human
aacaucuuagucacauccu

SEQ ID NO: 1348490 - RNA, 22 nt, Human
aaguauuuacucucagcagccc

SEQ ID NO: 1348491 - RNA, 25 nt, Human
acgcaacuucacccaggugcuggcc

SEQ ID NO: 1348492 - RNA, 23 nt, Human
acuccuacuccucaauguccucu

SEQ ID NO: 1348493 - RNA, 22 nt, Human
agcccccucuccccgcugggcc

SEQ ID NO: 1348494 - RNA, 20 nt, Human
aggaggcuucccaauuguac

SEQ ID NO: 1348495 - RNA, 20 nt, Human
auggauuuuugagggaucag

SEQ ID NO: 1348496 - RNA, 21 nt, Human
auggauuuuugagggaucagg

SEQ ID NO: 1348497 - RNA, 24 nt, Human
caaaauccgagaucuggacuugug

SEQ ID NO: 1348498 - RNA, 24 nt, Human
caacuugagcuccaucugucuccu

SEQ ID NO: 1348499 - RNA, 18 nt, Human
cacagggccacccgcucc

SEQ ID NO: 1348500 - RNA, 23 nt, Human
cacauccucccacagggccaccc

SEQ ID NO: 1348501 - RNA, 21 nt, Human
caggagcugcugcagcaugac

SEQ ID NO: 1348502 - RNA, 21 nt, Human
cagggugaucaggagcugcug

SEQ ID NO: 1348503 - RNA, 23 nt, Human
caguaucaaaauccgagaucugg

SEQ ID NO: 1348504 - RNA, 24 nt, Human
caugacggcguccgcacuccuuuc

SEQ ID NO: 1348505 - RNA, 18 nt, Human
ccagcugcccccacuccu

SEQ ID NO: 1348506 - RNA, 19 nt, Human
cccgcuccguggccgccuu

SEQ ID NO: 1348507 - RNA, 22 nt, Human
ccucugucuuagcccauagggc

SEQ ID NO: 1348508 - RNA, 19 nt, Human
ccuuuggaugacgcaacuu

SEQ ID NO: 1348509 - RNA, 20 nt, Human
cgaucuccuuaaucgccgac

SEQ ID NO: 1348510 - RNA, 22 nt, Human
cucccaacuugagcuccaucug

SEQ ID NO: 1348511 - RNA, 25 nt, Human
cuccccgcugggccggcacgccccc

SEQ ID NO: 1348512 - RNA, 20 nt, Human
cuccucaauguccucucuca

SEQ ID NO: 1348513 - RNA, 25 nt, Human
cugacaggaggcuucccaauuguac

SEQ ID NO: 1348514 - RNA, 22 nt, Human
cuucccaccgcugcagccgggu

SEQ ID NO: 1348515 - RNA, 18 nt, Human
cuuguccaccucugauga

SEQ ID NO: 1348516 - RNA, 23 nt, Human
gacuccuacuccucaauguccuc

SEQ ID NO: 1348517 - RNA, 21 nt, Human
gagcugcugcagcaugacggc

SEQ ID NO: 1348518 - RNA, 21 nt, Human
gccagcugcccccacuccucc

SEQ ID NO: 1348519 - RNA, 23 nt, Human
gcccccgccuucccaccgcugca

SEQ ID NO: 1348520 - RNA, 22 nt, Human
ggaggcuucccaauuguaccga

SEQ ID NO: 1348521 - RNA, 19 nt, Human
ggugaucaggagcugcugc

SEQ ID NO: 1348522 - RNA, 25 nt, Human
uaaucgccgacuccuacuccucaau

SEQ ID NO: 1348523 - RNA, 19 nt, Human
uacaguaucaaaauccgag

SEQ ID NO: 1348524 - RNA, 24 nt, Human
uacguccuugaagguuaacaguuc

SEQ ID NO: 1348525 - RNA, 21 nt, Human
ucacccaggugcuggccucgg

SEQ ID NO: 1348526 - RNA, 19 nt, Human
ucagcagcccccucucccc

SEQ ID NO: 1348527 - RNA, 19 nt, Human
uccaacauagauucuuuga

SEQ ID NO: 1348528 - RNA, 20 nt, Human
ugacgcaacuucacccaggu

SEQ ID NO: 1348529 - RNA, 18 nt, Human
ugaugaggaaauugcugg

SEQ ID NO: 1348530 - RNA, 19 nt, Human
uggccgccuuuggaugacg

SEQ ID NO: 1348531 - RNA, 22 nt, Human
uugaagguuaacaguuccuucu

SEQ ID NO: 1348532 - RNA, 24 nt, Human
aaaguuaccaaccuuauuaaaaua

SEQ ID NO: 1348533 - RNA, 22 nt, Human
acccugcacugcuagaaagaag

SEQ ID NO: 1348534 - RNA, 19 nt, Human
caacacagaagcuaagcag

SEQ ID NO: 1348535 - RNA, 24 nt, Human
caaccuuauuaaaauaaauaugau

SEQ ID NO: 1348536 - RNA, 21 nt, Human
cccacagaucuuguccucauc

SEQ ID NO: 1348537 - RNA, 24 nt, Human
cccacaguccgcaguccccgaggc

SEQ ID NO: 1348538 - RNA, 23 nt, Human
ccccacaguccgcaguccccgag

SEQ ID NO: 1348539 - RNA, 20 nt, Human
cccguccuucccucucucuc

SEQ ID NO: 1348540 - RNA, 18 nt, Human
ccgcaguccccgaggccu

SEQ ID NO: 1348541 - RNA, 20 nt, Human
ccggccagccuccccacagu

SEQ ID NO: 1348542 - RNA, 20 nt, Human
ccguccuucccucucucucc

SEQ ID NO: 1348543 - RNA, 21 nt, Human
cgacaguucucagcaccgcca

SEQ ID NO: 1348544 - RNA, 18 nt, Human
cuagaaagaagcaacaac

SEQ ID NO: 1348545 - RNA, 24 nt, Human
cucccgacaguucucagcaccgcc

SEQ ID NO: 1348546 - RNA, 26 nt, Human
cuccggccagccuccccacaguccgc

SEQ ID NO: 1348547 - RNA, 19 nt, Human
cugcaaucuacuagcuagu

SEQ ID NO: 1348548 - RNA, 20 nt, Human
cugcuagaaagaagcaacaa

SEQ ID NO: 1348549 - RNA, 19 nt, Human
gccaggccccguccuuccc

SEQ ID NO: 1348550 - RNA, 22 nt, Human
guccugggacuuaaauggacuc

SEQ ID NO: 1348551 - RNA, 22 nt, Human
guccuucccucucucuccggcc

SEQ ID NO: 1348552 - RNA, 25 nt, Human
uaaaauuacuggugucuacaaacug

SEQ ID NO: 1348553 - RNA, 24 nt, Human
ucaagguaaaaguuaccaaccuua

SEQ ID NO: 1348554 - RNA, 18 nt, Human
uccccgaggccuggagcc

SEQ ID NO: 1348555 - RNA, 18 nt, Human
ucccgggggccaggcccc

SEQ ID NO: 1348556 - RNA, 19 nt, Human
uccgcaguccccgaggccu

SEQ ID NO: 1348557 - RNA, 23 nt, Human
uccucggucucaagaagcucccg

SEQ ID NO: 1348558 - RNA, 18 nt, Human
ucucuccggccagccucc

SEQ ID NO: 1348559 - RNA, 20 nt, Human
ugcuagaaagaagcaacaac

SEQ ID NO: 1348560 - RNA, 23 nt, Human
uuccccgucggcgucagcuccaa

SEQ ID NO: 1348561 - RNA, 18 nt, Human
uuuuuuuuuuuuuuuuug

SEQ ID NO: 1348562 - RNA, 19 nt, Human
aaaaagcagaaaaacauug

SEQ ID NO: 1348563 - RNA, 28 nt, Human
aaaaauagcaauggaaugaccgguaccc

SEQ ID NO: 1348564 - RNA, 22 nt, Human
aaaacguagaaaucugugaaac

SEQ ID NO: 1348565 - RNA, 29 nt, Human
aaacaagaacuggaucuaggagggacccc

SEQ ID NO: 1348566 - RNA, 22 nt, Human
aaagcagaaaaacauugcagga

SEQ ID NO: 1348567 - RNA, 18 nt, Human
aacauggugaaaccccau

SEQ ID NO: 1348568 - RNA, 19 nt, Human
aacauggugaaaccccauu

SEQ ID NO: 1348569 - RNA, 20 nt, Human
aacauggugaaaccccauuu

SEQ ID NO: 1348570 - RNA, 21 nt, Human
aacauggugaaaccccauuuc

SEQ ID NO: 1348571 - RNA, 21 nt, Human
aacauggugaaaccccauuuc

SEQ ID NO: 1348572 - RNA, 18 nt, Human
aagaaguacauucaucua

SEQ ID NO: 1348573 - RNA, 26 nt, Human
aaggcaaaaagcagaaaaagggaccc

SEQ ID NO: 1348574 - RNA, 20 nt, Human
aaggcaggcggaucacaagg

SEQ ID NO: 1348575 - RNA, 21 nt, Human
aauauaaaaaaaagaccuauu

SEQ ID NO: 1348576 - RNA, 24 nt, Human
aauggcgugaacccgggaggugga

SEQ ID NO: 1348577 - RNA, 24 nt, Human
acaaagcaagacuccaucucaaaa

SEQ ID NO: 1348578 - RNA, 21 nt, Human
acgccacugcacuccagccug

SEQ ID NO: 1348579 - RNA, 24 nt, Human
acgccacugcacuccagccugggc

SEQ ID NO: 1348580 - RNA, 18 nt, Human
acugcacuccagccuggg

SEQ ID NO: 1348581 - RNA, 23 nt, Human
acugcacuccagccugggcgaca

SEQ ID NO: 1348582 - RNA, 18 nt, Human
agaugucuacaaugacuc

SEQ ID NO: 1348583 - RNA, 23 nt, Human
agccaggcgugguggcaggugcc

SEQ ID NO: 1348584 - RNA, 24 nt, Human
agccugggcgacaaagcaagacuc

SEQ ID NO: 1348585 - RNA, 19 nt, Human
aggcaaaaagcagaaaaac

SEQ ID NO: 1348586 - RNA, 28 nt, Human
aggcaaaaagcagaaaaacauugcagga

SEQ ID NO: 1348587 - RNA, 21 nt, Human
aggcaggagaauggcgugaac

SEQ ID NO: 1348588 - RNA, 24 nt, Human
aggcaggagaauggcgugaacccg

SEQ ID NO: 1348589 - RNA, 18 nt, Human
aggcaggcggaucacaag

SEQ ID NO: 1348590 - RNA, 24 nt, Human
aggcaggcggaucacaaggucagg

SEQ ID NO: 1348591 - RNA, 26 nt, Human
aggcaggcggaucacaaggucaggag

SEQ ID NO: 1348592 - RNA, 24 nt, Human
aggcgcaguggcucacgccuguaa

SEQ ID NO: 1348593 - RNA, 25 nt, Human
aggcggaucacaaggucaggagauu

SEQ ID NO: 1348594 - RNA, 18 nt, Human
aggcugaggcaggagaau

SEQ ID NO: 1348595 - RNA, 21 nt, Human
aggugaucuauuuagcaucug

SEQ ID NO: 1348596 - RNA, 24 nt, Human
agguggagguugcagugagcugag

SEQ ID NO: 1348597 - RNA, 21 nt, Human
aguacauaggcgguauuuaaa

SEQ ID NO: 1348598 - RNA, 24 nt, Human
aguggcucacgccuguaaucccag

SEQ ID NO: 1348599 - RNA, 20 nt, Human
aucacaaggucaggagauuc

SEQ ID NO: 1348600 - RNA, 24 nt, Human
aucacgccacugcacuccagccug

SEQ ID NO: 1348601 - RNA, 22 nt, Human
aucccagcacuuugggaggcca

SEQ ID NO: 1348602 - RNA, 23 nt, Human
caaaaagcagaaaaacauugcag

SEQ ID NO: 1348603 - RNA, 22 nt, Human
caacaaauagaugguagugcaa

SEQ ID NO: 1348604 - RNA, 22 nt, Human
caaggcaggcggaucacaaggu

SEQ ID NO: 1348605 - RNA, 26 nt, Human
caaggcaggcggaucacaaggucagg

SEQ ID NO: 1348606 - RNA, 24 nt, Human
caccaaauaucaacugcaguucac

SEQ ID NO: 1348607 - RNA, 20 nt, Human
caccacggcgcccagggccc

SEQ ID NO: 1348608 - RNA, 24 nt, Human
cacgccuguaaucccagcacuuug

SEQ ID NO: 1348609 - RNA, 19 nt, Human
cacugcacuccagccuggg

SEQ ID NO: 1348610 - RNA, 20 nt, Human
cacugcacuccagccugggc

SEQ ID NO: 1348611 - RNA, 22 nt, Human
cacugcacuccagccugggcga

SEQ ID NO: 1348612 - RNA, 23 nt, Human
cacugcacuccagccugggcgac

SEQ ID NO: 1348613 - RNA, 24 nt, Human
cacugcacuccagccugggcgaca

SEQ ID NO: 1348614 - RNA, 27 nt, Human
cacugcacuccagccugggcgacaaag

SEQ ID NO: 1348615 - RNA, 19 nt, Human
cagaaaaacauugcaggag

SEQ ID NO: 1348616 - RNA, 24 nt, Human
cagcacuuugggaggccaaggcag

SEQ ID NO: 1348617 - RNA, 25 nt, Human
cagcacuuugggaggccaaggcagg

SEQ ID NO: 1348618 - RNA, 24 nt, Human
cagcuacucaggaggcugaggcag

SEQ ID NO: 1348619 - RNA, 20 nt, Human
caggcggaucacaaggucau

SEQ ID NO: 1348620 - RNA, 21 nt, Human
caucucaaaaaauaaauaaau

SEQ ID NO: 1348621 - RNA, 20 nt, Human
ccacugcacuccagccuggg

SEQ ID NO: 1348622 - RNA, 21 nt, Human
ccacugcacuccagccugggc

SEQ ID NO: 1348623 - RNA, 21 nt, Human
ccacugcacuccagccugggc

SEQ ID NO: 1348624 - RNA, 23 nt, Human
ccacugcacuccagccugggcga

SEQ ID NO: 1348625 - RNA, 24 nt, Human
ccacugcacuccagccugggcgac

SEQ ID NO: 1348626 - RNA, 18 nt, Human
ccaggcaaguaagcucac

SEQ ID NO: 1348627 - RNA, 21 nt, Human
cccgggagguggagguugcag

SEQ ID NO: 1348628 - RNA, 20 nt, Human
cccuugugagcgcaacccca

SEQ ID NO: 1348629 - RNA, 21 nt, Human
ccguggcgacggucgccccuu

SEQ ID NO: 1348630 - RNA, 22 nt, Human
ccuggcuaacauggugaaaccc

SEQ ID NO: 1348631 - RNA, 23 nt, Human
ccuggcuaacauggugaaacccc

SEQ ID NO: 1348632 - RNA, 24 nt, Human
ccuggcuaacauggugaaacccca

SEQ ID NO: 1348633 - RNA, 21 nt, Human
ccuguagucccagcuacucag

SEQ ID NO: 1348634 - RNA, 22 nt, Human
ccuguagucccagcuacucagg

SEQ ID NO: 1348635 - RNA, 26 nt, Human
cgccacugcacuccagccugggcgac

SEQ ID NO: 1348636 - RNA, 22 nt, Human
cgcccagggccgcggagguggg

SEQ ID NO: 1348637 - RNA, 24 nt, Human
cgccuguaaucccagcacuuuggg

SEQ ID NO: 1348638 - RNA, 29 nt, Human
cgggagguggagguugcagugacaacggu

SEQ ID NO: 1348639 - RNA, 24 nt, Human
cgggagguggagguugcagugagc

SEQ ID NO: 1348640 - RNA, 25 nt, Human
cucaaaauauaaaaaaaaguuagcc

SEQ ID NO: 1348641 - RNA, 22 nt, Human
cucacgccuguaaucccagcac

SEQ ID NO: 1348642 - RNA, 24 nt, Human
cucacgccuguaaucccagcacuu

SEQ ID NO: 1348643 - RNA, 22 nt, Human
cucagauuuuauaaauuuaaaa

SEQ ID NO: 1348644 - RNA, 18 nt, Human
cugaauuaaaacuaaagc

SEQ ID NO: 1348645 - RNA, 19 nt, Human
cuggauccuagaagcucag

SEQ ID NO: 1348646 - RNA, 23 nt, Human
cuggcuaacauggugaaacccca

SEQ ID NO: 1348647 - RNA, 23 nt, Human
gagaucacgccacugcacuccag

SEQ ID NO: 1348648 - RNA, 21 nt, Human
gagcuuguugcugccuugggc

SEQ ID NO: 1348649 - RNA, 22 nt, Human
gagguugcagugagcugagauc

SEQ ID NO: 1348650 - RNA, 19 nt, Human
gcaggagacuuagcaguuc

SEQ ID NO: 1348651 - RNA, 24 nt, Human
gccaaaaaacaagaacuggaucua

SEQ ID NO: 1348652 - RNA, 22 nt, Human
gccacugcacuccagccugggc

SEQ ID NO: 1348653 - RNA, 24 nt, Human
gccacugcacuccagccugggcga

SEQ ID NO: 1348654 - RNA, 20 nt, Human
gcgcaguggcucacgccugu

SEQ ID NO: 1348655 - RNA, 24 nt, Human
gcuaacauggugaaaccccauuuc

SEQ ID NO: 1348656 - RNA, 20 nt, Human
gcugagaucacgccacugca

SEQ ID NO: 1348657 - RNA, 22 nt, Human
gcugaggcaggagaauggcgug

SEQ ID NO: 1348658 - RNA, 22 nt, Human
ggagguugcagugagcugagau

SEQ ID NO: 1348659 - RNA, 23 nt, Human
ggagguugcagugagcugagauc

SEQ ID NO: 1348660 - RNA, 24 nt, Human
ggagguugcagugagcugagauca

SEQ ID NO: 1348661 - RNA, 23 nt, Human
ggaguacauaggcgguauuuaaa

SEQ ID NO: 1348662 - RNA, 23 nt, Human
ggcaaguaagcucacaaaaagaa

SEQ ID NO: 1348663 - RNA, 22 nt, Human
ggucaacaccuuauucaguaaa

SEQ ID NO: 1348664 - RNA, 19 nt, Human
gguggagguugcagugagc

SEQ ID NO: 1348665 - RNA, 18 nt, Human
gugaaacucuauccuucg

SEQ ID NO: 1348666 - RNA, 24 nt, Human
gugaacccgggagguggagguugc

SEQ ID NO: 1348667 - RNA, 20 nt, Human
guggagguugcagugagcug

SEQ ID NO: 1348668 - RNA, 24 nt, Human
guggauguuuacgauaaauaaaaa

SEQ ID NO: 1348669 - RNA, 19 nt, Human
guugcagugagcugagauc

SEQ ID NO: 1348670 - RNA, 19 nt, Human
uaacauggugaaaccccau

SEQ ID NO: 1348671 - RNA, 21 nt, Human
uaacauggugaaaccccauuu

SEQ ID NO: 1348672 - RNA, 24 nt, Human
uaacauggugaaaccccauuucua

SEQ ID NO: 1348673 - RNA, 21 nt, Human
uaacuuauaaagcauucaucu

SEQ ID NO: 1348674 - RNA, 20 nt, Human
uacaauuagguacuuaccau

SEQ ID NO: 1348675 - RNA, 18 nt, Human
uaccuugucaacaaacau

SEQ ID NO: 1348676 - RNA, 18 nt, Human
uauacuggaauuguccuc

SEQ ID NO: 1348677 - RNA, 26 nt, Human
uauauauggggaaggcaaaaagcaga

SEQ ID NO: 1348678 - RNA, 23 nt, Human
uaucugaaaacugaaguauaaag

SEQ ID NO: 1348679 - RNA, 22 nt, Human
uaugccaaaaaacaagaacugg

SEQ ID NO: 1348680 - RNA, 23 nt, Human
uaugccaaaaaacaagaacugga

SEQ ID NO: 1348681 - RNA, 24 nt, Human
ucacaaggucaggagauugagacc

SEQ ID NO: 1348682 - RNA, 23 nt, Human
ucacgccacugcacuccagccug

SEQ ID NO: 1348683 - RNA, 22 nt, Human
uccaaaauauaaaaaaaagacc

SEQ ID NO: 1348684 - RNA, 24 nt, Human
uccagccugggcgacaaagcaaga

SEQ ID NO: 1348685 - RNA, 20 nt, Human
uccauauaucugaaaacuga

SEQ ID NO: 1348686 - RNA, 21 nt, Human
ucgacaccacggcgcccaggg

SEQ ID NO: 1348687 - RNA, 21 nt, Human
ucucuggggaaaaaaaauagc

SEQ ID NO: 1348688 - RNA, 24 nt, Human
ucuggccaggcgcaguggcucacg

SEQ ID NO: 1348689 - RNA, 21 nt, Human
ugagaaaccaaugaagauuaa

SEQ ID NO: 1348690 - RNA, 24 nt, Human
ugagaccauccuggcuaacauggu

SEQ ID NO: 1348691 - RNA, 22 nt, Human
ugagcugagaucacgccacugc

SEQ ID NO: 1348692 - RNA, 24 nt, Human
ugaggcaggagaauggcgugaacc

SEQ ID NO: 1348693 - RNA, 25 nt, Human
ugaggcaggagaauggcgugaaccc

SEQ ID NO: 1348694 - RNA, 24 nt, Human
ugccuguagucccagcuacucagg

SEQ ID NO: 1348695 - RNA, 24 nt, Human
uggaaugacaauagaugucagaua

SEQ ID NO: 1348696 - RNA, 18 nt, Human
uggagguugcagugagcu

SEQ ID NO: 1348697 - RNA, 24 nt, Human
uggccaggcgcaguggcucacgcc

SEQ ID NO: 1348698 - RNA, 23 nt, Human
uggccgccaccguggcgacgguc

SEQ ID NO: 1348699 - RNA, 24 nt, Human
uggcgugaacccgggagguggagg

SEQ ID NO: 1348700 - RNA, 22 nt, Human
uggcucacgccuguaaucccag

SEQ ID NO: 1348701 - RNA, 24 nt, Human
uggcucacgccuguaaucccagca

SEQ ID NO: 1348702 - RNA, 24 nt, Human
ugggaggccaaggcaggcggauca

SEQ ID NO: 1348703 - RNA, 21 nt, Human
ugggcgacaaagcaagacucc

SEQ ID NO: 1348704 - RNA, 22 nt, Human
ugguauugcacaaagguuaauu

SEQ ID NO: 1348705 - RNA, 24 nt, Human
ugguggcaggugccuguaguccca

SEQ ID NO: 1348706 - RNA, 20 nt, Human
uuaugccaaaaaacaagaac

SEQ ID NO: 1348707 - RNA, 26 nt, Human
uuaugccaaaaaacaagaacuggauc

SEQ ID NO: 1348708 - RNA, 24 nt, Human
uugauggcagccauuucaggcaga

SEQ ID NO: 1348709 - RNA, 18 nt, Human
uugcagugagcugagauc

SEQ ID NO: 1348710 - RNA, 20 nt, Human
uugcagugagcugagaucac

SEQ ID NO: 1348711 - RNA, 21 nt, Human
uugcagugagcugagaucacg

SEQ ID NO: 1348712 - RNA, 22 nt, Human
uuucuacucaaaauauaaaaaa

SEQ ID NO: 1348713 - RNA, 23 nt, Human
uuugagaaaccaaugaagauuaa

SEQ ID NO: 1348714 - RNA, 30 nt, Human
aaaaaaaaaaaaaaggguuucagaaagagg

SEQ ID NO: 1348715 - RNA, 24 nt, Human
aaaaaaaaaaaggguuucagaaag

SEQ ID NO: 1348716 - RNA, 22 nt, Human
aagggagcagggagaaaagaga

SEQ ID NO: 1348717 - RNA, 20 nt, Human
aauaagggagcagggagaaa

SEQ ID NO: 1348718 - RNA, 24 nt, Human
agaccugaagagaauuguuggugg

SEQ ID NO: 1348719 - RNA, 20 nt, Human
aggacggaagaguuugaaga

SEQ ID NO: 1348720 - RNA, 20 nt, Human
aggcauaaccaggugcugca

SEQ ID NO: 1348721 - RNA, 20 nt, Human
aggggacccagcuagagucc

SEQ ID NO: 1348722 - RNA, 27 nt, Human
aggugcugcaaguuggcucuguaaacu

SEQ ID NO: 1348723 - RNA, 19 nt, Human
cagguuucucucagauucu

SEQ ID NO: 1348724 - RNA, 20 nt, Human
cauugugacacaggcaagau

SEQ ID NO: 1348725 - RNA, 25 nt, Human
ccauugugggggcaauagccaugga

SEQ ID NO: 1348726 - RNA, 19 nt, Human
gaacauagaccacauaacc

SEQ ID NO: 1348727 - RNA, 24 nt, Human
uagaccacauaaccauuuaccugg

SEQ ID NO: 1348728 - RNA, 26 nt, Human
ucuaugcugaaacucaucaccagggg

SEQ ID NO: 1348729 - RNA, 18 nt, Human
ugaaaggaggcauaacca

SEQ ID NO: 1348730 - RNA, 23 nt, Human
ugagaugaaaggaggcauaacca

SEQ ID NO: 1348731 - RNA, 24 nt, Human
ugugacacaggcaagaucaugugg

SEQ ID NO: 1348732 - RNA, 19 nt, Human
uguggcugaggaguagucg

SEQ ID NO: 1348733 - RNA, 19 nt, Human
ugugguagagauuuaaacu

SEQ ID NO: 1348734 - RNA, 18 nt, Human
ugugguuuguuuggaaca

SEQ ID NO: 1348735 - RNA, 20 nt, Human
uuaccuggcagcucuuuggc

SEQ ID NO: 1348736 - RNA, 22 nt, Human
uugugacacaggcaagaucaug

SEQ ID NO: 1348737 - RNA, 20 nt, Human
uuuaauaagggagcagggag

SEQ ID NO: 1348738 - RNA, 23 nt, Human
uuucguuuucuuuuccuugaaca

SEQ ID NO: 1348739 - RNA, 25 nt, Human
uuucguuuucuuuuccuugaacauu

SEQ ID NO: 1348740 - RNA, 20 nt, Human
aaacaggcaguaaaucaauu

SEQ ID NO: 1348741 - RNA, 23 nt, Human
aaauagcucagcucaccuaaaac

SEQ ID NO: 1348742 - RNA, 19 nt, Human
aacauucuaaauggauacu

SEQ ID NO: 1348743 - RNA, 18 nt, Human
acagaacuuaaaaaaaaa

SEQ ID NO: 1348744 - RNA, 21 nt, Human
acagaacuuaaaaaaaaaucc

SEQ ID NO: 1348745 - RNA, 26 nt, Human
acauaccuguauguaguucaaauaca

SEQ ID NO: 1348746 - RNA, 19 nt, Human
auacaaaacucuccaaaca

SEQ ID NO: 1348747 - RNA, 18 nt, Human
aucacaguacacauagca

SEQ ID NO: 1348748 - RNA, 20 nt, Human
aucacaguacacauagcauu

SEQ ID NO: 1348749 - RNA, 20 nt, Human
auuuuauauauaauauauau

SEQ ID NO: 1348750 - RNA, 21 nt, Human
caacaucauggauaacaugaa

SEQ ID NO: 1348751 - RNA, 22 nt, Human
cagcucaccuaaaacaguaucu

SEQ ID NO: 1348752 - RNA, 23 nt, Human
cagcucaccuaaaacaguaucug

SEQ ID NO: 1348753 - RNA, 22 nt, Human
ccaaacauuacaugaacauucu

SEQ ID NO: 1348754 - RNA, 18 nt, Human
cccccgggaaggcgggcc

SEQ ID NO: 1348755 - RNA, 22 nt, Human
cuaaaacaguaucuggaugugc

SEQ ID NO: 1348756 - RNA, 22 nt, Human
gcaacggaaaggcacaauuagc

SEQ ID NO: 1348757 - RNA, 19 nt, Human
uaaaaaaaaauccaaaaac

SEQ ID NO: 1348758 - RNA, 23 nt, Human
uaaaaaaaaauccaaaaacuaau

SEQ ID NO: 1348759 - RNA, 23 nt, Human
uaccugaauuauuaaacugacau

SEQ ID NO: 1348760 - RNA, 24 nt, Human
uauacagaacuuaaaaaaaaaucc

SEQ ID NO: 1348761 - RNA, 24 nt, Human
uauuauuuuauauauaauauauau

SEQ ID NO: 1348762 - RNA, 18 nt, Human
ucagauauauaauugcau

SEQ ID NO: 1348763 - RNA, 18 nt, Human
ucaguaacugauacccuc

SEQ ID NO: 1348764 - RNA, 19 nt, Human
uccaaaaacuaauuuuucu

SEQ ID NO: 1348765 - RNA, 23 nt, Human
uccauaauacaaaacucuccaaa

SEQ ID NO: 1348766 - RNA, 22 nt, Human
uguaaaaacaggcaguaaauca

SEQ ID NO: 1348767 - RNA, 21 nt, Human
uuaagauaaaguuaaugucuu

SEQ ID NO: 1348768 - RNA, 21 nt, Human
uuauauauauuauauauaagu

SEQ ID NO: 1348769 - RNA, 21 nt, Human
aaaaaacaaccucuaaacaca

SEQ ID NO: 1348770 - RNA, 18 nt, Human
aaaagaggacccagggcu

SEQ ID NO: 1348771 - RNA, 24 nt, Human
aaacagcugcaaaaauagugucuu

SEQ ID NO: 1348772 - RNA, 24 nt, Human
aacaccaagaucugcaaaaaacaa

SEQ ID NO: 1348773 - RNA, 27 nt, Human
aagaaaacucgaacauuaacauucuuc

SEQ ID NO: 1348774 - RNA, 21 nt, Human
aaucuguggcgucuucucucc

SEQ ID NO: 1348775 - RNA, 24 nt, Human
acaaacuucaaacagcugcaaaaa

SEQ ID NO: 1348776 - RNA, 22 nt, Human
acaagauaagaaaacucgaaca

SEQ ID NO: 1348777 - RNA, 20 nt, Human
agcucuccuccccacuaccc

SEQ ID NO: 1348778 - RNA, 20 nt, Human
agggaaggaaaucuguggcg

SEQ ID NO: 1348779 - RNA, 23 nt, Human
agggccccuccauaccccaucuc

SEQ ID NO: 1348780 - RNA, 18 nt, Human
auagagucgccauuugcc

SEQ ID NO: 1348781 - RNA, 18 nt, Human
caaccucuaaacacaaga

SEQ ID NO: 1348782 - RNA, 20 nt, Human
caaccucuaaacacaagaua

SEQ ID NO: 1348783 - RNA, 19 nt, Human
caagauaagaaaacucgaa

SEQ ID NO: 1348784 - RNA, 21 nt, Human
caagauaagaaaacucgaaca

SEQ ID NO: 1348785 - RNA, 23 nt, Human
caagaucugcaaaaaacaaccuc

SEQ ID NO: 1348786 - RNA, 26 nt, Human
caccuggggcugggcgggcugggcug

SEQ ID NO: 1348787 - RNA, 18 nt, Human
caguaagugaaagaaagu

SEQ ID NO: 1348788 - RNA, 23 nt, Human
caguacggaaaauauacaaacuu

SEQ ID NO: 1348789 - RNA, 19 nt, Human
ccaccuggggcugggcggg

SEQ ID NO: 1348790 - RNA, 22 nt, Human
ccauccagcccuggggcgggcg

SEQ ID NO: 1348791 - RNA, 19 nt, Human
cccuccauaccccaucuca

SEQ ID NO: 1348792 - RNA, 20 nt, Human
cccuccauaccccaucucag

SEQ ID NO: 1348793 - RNA, 25 nt, Human
ccggugcccaucaaaaagaggaccc

SEQ ID NO: 1348794 - RNA, 18 nt, Human
ccucccucugccagcagc

SEQ ID NO: 1348795 - RNA, 22 nt, Human
ccucccucugccagcagcugaa

SEQ ID NO: 1348796 - RNA, 19 nt, Human
ccucuaaacacaagauaag

SEQ ID NO: 1348797 - RNA, 18 nt, Human
ccuggaggagagggaagg

SEQ ID NO: 1348798 - RNA, 22 nt, Human
ccuucguucauggccagcuugc

SEQ ID NO: 1348799 - RNA, 18 nt, Human
cggugcccaucaaaaaga

SEQ ID NO: 1348800 - RNA, 19 nt, Human
cggugcccaucaaaaagag

SEQ ID NO: 1348801 - RNA, 22 nt, Human
cuccaaugagagggaggcaugg

SEQ ID NO: 1348802 - RNA, 22 nt, Human
cuccuggaggagagggaaggaa

SEQ ID NO: 1348803 - RNA, 20 nt, Human
cucgaaggccgagagggaag

SEQ ID NO: 1348804 - RNA, 24 nt, Human
cugcaaaaauagugucuuugggag

SEQ ID NO: 1348805 - RNA, 20 nt, Human
cuggguguuuuccaccaagu

SEQ ID NO: 1348806 - RNA, 24 nt, Human
gagaaaauagagucucuacaucga

SEQ ID NO: 1348807 - RNA, 23 nt, Human
gcaaaaaacaaccucuaaacaca

SEQ ID NO: 1348808 - RNA, 22 nt, Human
gccgagagggaagggccccucc

SEQ ID NO: 1348809 - RNA, 22 nt, Human
gcucuccuccccacuacccacu

SEQ ID NO: 1348810 - RNA, 18 nt, Human
gcuuugacacaguaagug

SEQ ID NO: 1348811 - RNA, 23 nt, Human
ggaaaacacuuguuuccucccuc

SEQ ID NO: 1348812 - RNA, 21 nt, Human
gggcugggcgggcugggcugc

SEQ ID NO: 1348813 - RNA, 18 nt, Human
ggggaucuaucuuauggu

SEQ ID NO: 1348814 - RNA, 21 nt, Human
gugcccaucaaaaagaggacc

SEQ ID NO: 1348815 - RNA, 20 nt, Human
uaagaaaacucgaacauuag

SEQ ID NO: 1348816 - RNA, 23 nt, Human
ucagggugaaagcgagaugaaaa

SEQ ID NO: 1348817 - RNA, 22 nt, Human
ucgaacauuaacauucuucaau

SEQ ID NO: 1348818 - RNA, 24 nt, Human
ucuaugguaaaguggggccggggc

SEQ ID NO: 1348819 - RNA, 24 nt, Human
ucucaggggaccuggggagggacc

SEQ ID NO: 1348820 - RNA, 26 nt, Human
ucucuaugguaaaguggggcaggggu

SEQ ID NO: 1348821 - RNA, 28 nt, Human
ucugugacaaaaauaagggccggggucc

SEQ ID NO: 1348822 - RNA, 20 nt, Human
ucuucaauuuuguguaagcu

SEQ ID NO: 1348823 - RNA, 19 nt, Human
ucuuuagucagggugaaag

SEQ ID NO: 1348824 - RNA, 25 nt, Human
ucuuuagucagggugaaagcgagau

SEQ ID NO: 1348825 - RNA, 19 nt, Human
ugaaagcgagaugaaaaug

SEQ ID NO: 1348826 - RNA, 21 nt, Human
ugagagggaggcaugggaaua

SEQ ID NO: 1348827 - RNA, 18 nt, Human
ugccagcucuccucccca

SEQ ID NO: 1348828 - RNA, 19 nt, Human
ugcuuuggucagcuccucc

SEQ ID NO: 1348829 - RNA, 18 nt, Human
uggggcugggcgggcugg

SEQ ID NO: 1348830 - RNA, 19 nt, Human
uggggcugggcgggcuggg

SEQ ID NO: 1348831 - RNA, 20 nt, Human
uggggcugggcgggcugggc

SEQ ID NO: 1348832 - RNA, 18 nt, Human
ugguaaaguggggcaggg

SEQ ID NO: 1348833 - RNA, 18 nt, Human
uguuuccucccucugcca

SEQ ID NO: 1348834 - RNA, 25 nt, Human
uuguuuccucccucugccagcagcu

SEQ ID NO: 1348835 - RNA, 21 nt, Human
aaaaaauacccucaugccccu

SEQ ID NO: 1348836 - RNA, 23 nt, Human
aaaacaagauccaaccacgggug

SEQ ID NO: 1348837 - RNA, 18 nt, Human
aaaauacccucaugcccc

SEQ ID NO: 1348838 - RNA, 21 nt, Human
aaaauacccucaugccccuag

SEQ ID NO: 1348839 - RNA, 23 nt, Human
aaaauacccucaugccccuagaa

SEQ ID NO: 1348840 - RNA, 18 nt, Human
aaacaagauccaaccacg

SEQ ID NO: 1348841 - RNA, 19 nt, Human
aaaccuuagaaccuaaaaa

SEQ ID NO: 1348842 - RNA, 20 nt, Human
aaccaagaagaaugagacaa

SEQ ID NO: 1348843 - RNA, 19 nt, Human
acaagauaaaaccuuagaa

SEQ ID NO: 1348844 - RNA, 22 nt, Human
accucauucuacccccacccag

SEQ ID NO: 1348845 - RNA, 19 nt, Human
accugcagcaaugccuccc

SEQ ID NO: 1348846 - RNA, 19 nt, Human
agaaaugucaacugucccc

SEQ ID NO: 1348847 - RNA, 22 nt, Human
agauaaaaccuuagaaccuaaa

SEQ ID NO: 1348848 - RNA, 19 nt, Human
aggcagaggugggugggac

SEQ ID NO: 1348849 - RNA, 24 nt, Human
aggcagaggugggugggaccagaa

SEQ ID NO: 1348850 - RNA, 18 nt, Human
aggggaaaugccaaugaa

SEQ ID NO: 1348851 - RNA, 19 nt, Human
caaaagcugcucucagaaa

SEQ ID NO: 1348852 - RNA, 19 nt, Human
caaagccagcucaccccac

SEQ ID NO: 1348853 - RNA, 21 nt, Human
caaagccagcucaccccaccc

SEQ ID NO: 1348854 - RNA, 23 nt, Human
caacaagauaaaaccuuagaacc

SEQ ID NO: 1348855 - RNA, 19 nt, Human
caacugucccccauccccu

SEQ ID NO: 1348856 - RNA, 21 nt, Human
caagaggcacccacugcaaaa

SEQ ID NO: 1348857 - RNA, 23 nt, Human
caccccaccucauucuaccccca

SEQ ID NO: 1348858 - RNA, 18 nt, Human
cagcaaugccucccuggc

SEQ ID NO: 1348859 - RNA, 20 nt, Human
cagcucaccccaccccaccu

SEQ ID NO: 1348860 - RNA, 22 nt, Human
cagcucaccccaccccaccuca

SEQ ID NO: 1348861 - RNA, 21 nt, Human
caggcucaccugcagcaaugc

SEQ ID NO: 1348862 - RNA, 19 nt, Human
caguuaaaaccuacucaac

SEQ ID NO: 1348863 - RNA, 18 nt, Human
ccacccuggaaaaacugu

SEQ ID NO: 1348864 - RNA, 21 nt, Human
ccacggguggcaagggcaucc

SEQ ID NO: 1348865 - RNA, 22 nt, Human
cccaaugauaggccacccugga

SEQ ID NO: 1348866 - RNA, 18 nt, Human
cccaccccaccucauucu

SEQ ID NO: 1348867 - RNA, 19 nt, Human
cccaccucauucuaccccc

SEQ ID NO: 1348868 - RNA, 21 nt, Human
cccacugcaaaacaacuugaa

SEQ ID NO: 1348869 - RNA, 26 nt, Human
cccccacccagaacauuuugcuaaaa

SEQ ID NO: 1348870 - RNA, 21 nt, Human
ccccuagaauuccaaagccag

SEQ ID NO: 1348871 - RNA, 24 nt, Human
ccccuagucaaaaauaauugggac

SEQ ID NO: 1348872 - RNA, 22 nt, Human
ccugcagcaaugccucccuggc

SEQ ID NO: 1348873 - RNA, 21 nt, Human
cgagagcggcugcacguggug

SEQ ID NO: 1348874 - RNA, 19 nt, Human
cucaccccaccccaccuca

SEQ ID NO: 1348875 - RNA, 20 nt, Human
cucaccccaccccaccucau

SEQ ID NO: 1348876 - RNA, 18 nt, Human
cucauucuacccccaccc

SEQ ID NO: 1348877 - RNA, 24 nt, Human
cugcccuguaagaugccacaaaag

SEQ ID NO: 1348878 - RNA, 21 nt, Human
cuuagaaccuaaaaaauaccc

SEQ ID NO: 1348879 - RNA, 21 nt, Human
cuucccccuuggguagguccc

SEQ ID NO: 1348880 - RNA, 18 nt, Human
gaaaaacuguccccugca

SEQ ID NO: 1348881 - RNA, 20 nt, Human
gagcugccgaacucagcugc

SEQ ID NO: 1348882 - RNA, 19 nt, Human
gcacacugcaaacgccugc

SEQ ID NO: 1348883 - RNA, 21 nt, Human
gccagcucaccccaccccacc

SEQ ID NO: 1348884 - RNA, 25 nt, Human
gcccuguaagaugccacaaaagcug

SEQ ID NO: 1348885 - RNA, 18 nt, Human
gcugccgaacucagcugc

SEQ ID NO: 1348886 - RNA, 21 nt, Human
ggaaaaacuguccccugcagg

SEQ ID NO: 1348887 - RNA, 20 nt, Human
uacucaaccaagaagaauga

SEQ ID NO: 1348888 - RNA, 21 nt, Human
uagaauuccaaagccagcuca

SEQ ID NO: 1348889 - RNA, 22 nt, Human
uagaauuccaaagccagcucac

SEQ ID NO: 1348890 - RNA, 21 nt, Human
ucacaagaggcacccacugca

SEQ ID NO: 1348891 - RNA, 24 nt, Human
uccaaagccagcucaccccacccc

SEQ ID NO: 1348892 - RNA, 19 nt, Human
ucccccauccccuagucaa

SEQ ID NO: 1348893 - RNA, 26 nt, Human
uccccugcaggguuuccaaggauugg

SEQ ID NO: 1348894 - RNA, 19 nt, Human
ucccuggccagaaagggcc

SEQ ID NO: 1348895 - RNA, 20 nt, Human
ucccuggccagaaagggccu

SEQ ID NO: 1348896 - RNA, 25 nt, Human
ucuacccccacccagaacauuuugc

SEQ ID NO: 1348897 - RNA, 27 nt, Human
ucuugucuucccccuuggguagguccc

SEQ ID NO: 1348898 - RNA, 21 nt, Human
ugcccaucuaacaggagccca

SEQ ID NO: 1348899 - RNA, 24 nt, Human
ugucuucccccuuggguagguccc

SEQ ID NO: 1348900 - RNA, 22 nt, Human
uuagaaccuaaaaaauacccuc

SEQ ID NO: 1348901 - RNA, 21 nt, Human
uuccaaggaugacaucuuguc

SEQ ID NO: 1348902 - RNA, 24 nt, Human
uugcuaaaauuaauccgcccgugc

SEQ ID NO: 1348903 - RNA, 21 nt, Human
aaaaccacuccccacgccccc

SEQ ID NO: 1348904 - RNA, 19 nt, Human
aaccacuccccacgccccc

SEQ ID NO: 1348905 - RNA, 19 nt, Human
acaacgggcgucugccugg

SEQ ID NO: 1348906 - RNA, 19 nt, Human
accacuccccacgcccccu

SEQ ID NO: 1348907 - RNA, 23 nt, Human
agagaagacgggcggggagcaga

SEQ ID NO: 1348908 - RNA, 27 nt, Human
agccacagcugccaacaacaaccgccc

SEQ ID NO: 1348909 - RNA, 18 nt, Human
aggaaggugcugccgagc

SEQ ID NO: 1348910 - RNA, 21 nt, Human
aggcauuuauugaaaacuuau

SEQ ID NO: 1348911 - RNA, 24 nt, Human
augccauauaaacaaacuaaacuc

SEQ ID NO: 1348912 - RNA, 23 nt, Human
cauucuuugccauugccuacaag

SEQ ID NO: 1348913 - RNA, 20 nt, Human
ccacagcugccaacaacaac

SEQ ID NO: 1348914 - RNA, 20 nt, Human
ccacauucuuugccauugcc

SEQ ID NO: 1348915 - RNA, 21 nt, Human
ccgccuaaaaccacuccccac

SEQ ID NO: 1348916 - RNA, 19 nt, Human
ggaaacgcagaagagaaga

SEQ ID NO: 1348917 - RNA, 21 nt, Human
ggaaacgcagaagagaagacg

SEQ ID NO: 1348918 - RNA, 22 nt, Human
ggcgucugccuggcaaagaagg

SEQ ID NO: 1348919 - RNA, 19 nt, Human
gggcggggagcagagguuc

SEQ ID NO: 1348920 - RNA, 24 nt, Human
uaaacucuuuuagcugcuauacca

SEQ ID NO: 1348921 - RNA, 22 nt, Human
uaagaaauggcacauggaaaca

SEQ ID NO: 1348922 - RNA, 21 nt, Human
uacaacgggcgucugccuggc

SEQ ID NO: 1348923 - RNA, 19 nt, Human
uaggcauuuauugaaaacu

SEQ ID NO: 1348924 - RNA, 25 nt, Human
ugccaacaacaaccgccccucagcc

SEQ ID NO: 1348925 - RNA, 18 nt, Human
uggcaaagaaggaaggug

SEQ ID NO: 1348926 - RNA, 22 nt, Human
uggcacauggaaacauggcagg

SEQ ID NO: 1348927 - RNA, 19 nt, Human
uuuaugcuugaacuuuagg

SEQ ID NO: 1348928 - RNA, 21 nt, Human
accucagcccaccuccacgcu

SEQ ID NO: 1348929 - RNA, 22 nt, Human
acuauucaagaacagaugucca

SEQ ID NO: 1348930 - RNA, 21 nt, Human
aggcagagcguucaaaucgug

SEQ ID NO: 1348931 - RNA, 19 nt, Human
agucccaaagggcuggaga

SEQ ID NO: 1348932 - RNA, 22 nt, Human
aucaaugccuauaugguccagu

SEQ ID NO: 1348933 - RNA, 20 nt, Human
auggugaggguagggcuuug

SEQ ID NO: 1348934 - RNA, 22 nt, Human
auuuccauaguuaucacaugua

SEQ ID NO: 1348935 - RNA, 24 nt, Human
caagaacagauguccaauacucag

SEQ ID NO: 1348936 - RNA, 22 nt, Human
caccuucuaaccucagcccacc

SEQ ID NO: 1348937 - RNA, 18 nt, Human
cagcccaccuccacgcug

SEQ ID NO: 1348938 - RNA, 23 nt, Human
ccacgcucugcaccuucuaaccu

SEQ ID NO: 1348939 - RNA, 21 nt, Human
cccuuugcuugcguugacuuc

SEQ ID NO: 1348940 - RNA, 21 nt, Human
ccucacgcugcuucggcugcu

SEQ ID NO: 1348941 - RNA, 20 nt, Human
cgcacuccccuuugcuugcg

SEQ ID NO: 1348942 - RNA, 21 nt, Human
cggauaagaacuguaacccug

SEQ ID NO: 1348943 - RNA, 23 nt, Human
cucacaaucuucuuccacgcucu

SEQ ID NO: 1348944 - RNA, 22 nt, Human
cucacgcugcuucggcugcuuc

SEQ ID NO: 1348945 - RNA, 18 nt, Human
cuccacgcugcucuuccc

SEQ ID NO: 1348946 - RNA, 18 nt, Human
cuccccgacccgcacucc

SEQ ID NO: 1348947 - RNA, 24 nt, Human
cugcucuucccacaggaccuggug

SEQ ID NO: 1348948 - RNA, 18 nt, Human
gcccucacgcugcuucgg

SEQ ID NO: 1348949 - RNA, 19 nt, Human
gcggauaagaacuguaacc

SEQ ID NO: 1348950 - RNA, 19 nt, Human
gcucugcaccuucuaaccu

SEQ ID NO: 1348951 - RNA, 19 nt, Human
gcugcuucuaagaucccau

SEQ ID NO: 1348952 - RNA, 22 nt, Human
gucccaaagggcuggagagccc

SEQ ID NO: 1348953 - RNA, 19 nt, Human
uaaggagaucuucauguga

SEQ ID NO: 1348954 - RNA, 25 nt, Human
uagaugggucucuuccuuuauguuu

SEQ ID NO: 1348955 - RNA, 24 nt, Human
uaucaaagguaauauucauaaaga

SEQ ID NO: 1348956 - RNA, 25 nt, Human
uaucaaagguaauauucauaaagaa

SEQ ID NO: 1348957 - RNA, 22 nt, Human
uauucaagaacagauguccaau

SEQ ID NO: 1348958 - RNA, 21 nt, Human
ucaaugccuauaugguccaag

SEQ ID NO: 1348959 - RNA, 18 nt, Human
ucacgcugcuucggcugc

SEQ ID NO: 1348960 - RNA, 28 nt, Human
ucagcccaccuccacgcugcucuuccca

SEQ ID NO: 1348961 - RNA, 24 nt, Human
ucagcucacaaucuucuuccacgc

SEQ ID NO: 1348962 - RNA, 23 nt, Human
ucccaaagggcuggagagcccca

SEQ ID NO: 1348963 - RNA, 22 nt, Human
ucccaaagggcuggagagccuc

SEQ ID NO: 1348964 - RNA, 19 nt, Human
uccccgacccgcacucccc

SEQ ID NO: 1348965 - RNA, 21 nt, Human
uccccgacccgcacuccccuu

SEQ ID NO: 1348966 - RNA, 18 nt, Human
uccuuuauguuuuucagu

SEQ ID NO: 1348967 - RNA, 23 nt, Human
ucggcugcuucuaagaucccauu

SEQ ID NO: 1348968 - RNA, 22 nt, Human
ucuaagaucccauuggaagucc

SEQ ID NO: 1348969 - RNA, 23 nt, Human
ucugcaccuucuaaccucagccc

SEQ ID NO: 1348970 - RNA, 19 nt, Human
ugaggguagggcuuugggc

SEQ ID NO: 1348971 - RNA, 20 nt, Human
uggcccugggcugccgcccu

SEQ ID NO: 1348972 - RNA, 22 nt, Human
uggugaggguagggcuuugggc

SEQ ID NO: 1348973 - RNA, 20 nt, Human
uuauguuuuucagucacaua

SEQ ID NO: 1348974 - RNA, 22 nt, Human
uuccauaguuaucacauguacu

SEQ ID NO: 1348975 - RNA, 18 nt, Human
uucuaaccucagcccacc

SEQ ID NO: 1348976 - RNA, 21 nt, Human
uuuccuauggcaggcccaggg

SEQ ID NO: 1348977 - RNA, 18 nt, Human
uuuuuuuuuuuuuuuuug

SEQ ID NO: 1348978 - RNA, 19 nt, Human
uuuuuuuuuuuuuuuuugu

SEQ ID NO: 1348979 - RNA, 18 nt, Human
aaccuggaagaaauggca

SEQ ID NO: 1348980 - RNA, 19 nt, Human
aaucaugacuauguaauua

SEQ ID NO: 1348981 - RNA, 21 nt, Human
aaucaugacuauguaauuaac

SEQ ID NO: 1348982 - RNA, 24 nt, Human
acaagggaccgcagacggagagcc

SEQ ID NO: 1348983 - RNA, 18 nt, Human
agaccugcaguuggggug

SEQ ID NO: 1348984 - RNA, 23 nt, Human
agccaaaccggacggccggccuc

SEQ ID NO: 1348985 - RNA, 23 nt, Human
auuacauuuauuuuuaaggccau

SEQ ID NO: 1348986 - RNA, 22 nt, Human
caaccuggaagaaauggcaggc

SEQ ID NO: 1348987 - RNA, 26 nt, Human
caauacauuuuucauagaaacaaaua

SEQ ID NO: 1348988 - RNA, 20 nt, Human
cagcagaaaaaaaauuacca

SEQ ID NO: 1348989 - RNA, 22 nt, Human
cagcagaaaaaaaauuaccaaa

SEQ ID NO: 1348990 - RNA, 23 nt, Human
caggcaaagcguccaaaauuaga

SEQ ID NO: 1348991 - RNA, 26 nt, Human
caggcucuuccacuccuuuuggcucu

SEQ ID NO: 1348992 - RNA, 18 nt, Human
cccaggaaaaucuccaag

SEQ ID NO: 1348993 - RNA, 23 nt, Human
ccgcccagagccuucacaaggga

SEQ ID NO: 1348994 - RNA, 21 nt, Human
ccuaaauuaacagaaaaaaac

SEQ ID NO: 1348995 - RNA, 22 nt, Human
ccugggagaggugagccaaacc

SEQ ID NO: 1348996 - RNA, 22 nt, Human
cgagcguccgggggcgacgugg

SEQ ID NO: 1348997 - RNA, 20 nt, Human
cgccucugcggcucccucaa

SEQ ID NO: 1348998 - RNA, 22 nt, Human
cgcucgcgaagggccugagcac

SEQ ID NO: 1348999 - RNA, 23 nt, Human
cuccaagacaggcucuuccacuc

SEQ ID NO: 1349000 - RNA, 23 nt, Human
cucuggcuguccaugcuuaaccc

SEQ ID NO: 1349001 - RNA, 18 nt, Human
cugagcaguagcugcagg

SEQ ID NO: 1349002 - RNA, 18 nt, Human
cugcggcucccucaaccu

SEQ ID NO: 1349003 - RNA, 21 nt, Human
cuuuuggcucuccagugugaa

SEQ ID NO: 1349004 - RNA, 18 nt, Human
gagccaaaccggacggcc

SEQ ID NO: 1349005 - RNA, 19 nt, Human
gcccagagccuucacaagg

SEQ ID NO: 1349006 - RNA, 24 nt, Human
gcccagagccuucacaagggaccc

SEQ ID NO: 1349007 - RNA, 21 nt, Human
ggagagccccgcucgcgaagg

SEQ ID NO: 1349008 - RNA, 18 nt, Human
ggagaggugagccaaacc

SEQ ID NO: 1349009 - RNA, 23 nt, Human
ggcaccuuuuugggcugaaaaua

SEQ ID NO: 1349010 - RNA, 19 nt, Human
ggccucugcagccgcccag

SEQ ID NO: 1349011 - RNA, 24 nt, Human
gggcgccccagcguuucugagcag

SEQ ID NO: 1349012 - RNA, 18 nt, Human
uaaaaaaaaaucaguggc

SEQ ID NO: 1349013 - RNA, 22 nt, Human
uauuuuauauaaaauaagaagu

SEQ ID NO: 1349014 - RNA, 25 nt, Human
uccaccagcagaaaaaaaauuacca

SEQ ID NO: 1349015 - RNA, 22 nt, Human
uccaccagcagaaaaaauuuaa

SEQ ID NO: 1349016 - RNA, 18 nt, Human
uccaugcuuaacccuaca

SEQ ID NO: 1349017 - RNA, 21 nt, Human
ucccaaggaaucaaacauuuu

SEQ ID NO: 1349018 - RNA, 18 nt, Human
uccccaggaaaaucucca

SEQ ID NO: 1349019 - RNA, 20 nt, Human
ucugccagggugggcgcccc

SEQ ID NO: 1349020 - RNA, 23 nt, Human
ugaaacaugauuaauuuuaaugu

SEQ ID NO: 1349021 - RNA, 19 nt, Human
ugagauuauuuggaguugg

SEQ ID NO: 1349022 - RNA, 21 nt, Human
ugcaguuggggugggaaggga

SEQ ID NO: 1349023 - RNA, 18 nt, Human
ugccagggugggcgcccc

SEQ ID NO: 1349024 - RNA, 23 nt, Human
ugcuaagaaaauauagcaauauu

SEQ ID NO: 1349025 - RNA, 22 nt, Human
uggcaauauuuauauacaaggu

SEQ ID NO: 1349026 - RNA, 23 nt, Human
uggcauagcauugaacuggggaa

SEQ ID NO: 1349027 - RNA, 19 nt, Human
ugggcugaaaauaguugau

SEQ ID NO: 1349028 - RNA, 18 nt, Human
ugugauaagguuucuuuc

SEQ ID NO: 1349029 - RNA, 21 nt, Human
uuaacccuacauuuacuacau

SEQ ID NO: 1349030 - RNA, 19 nt, Human
uuagaccugcaguuggggu

SEQ ID NO: 1349031 - RNA, 24 nt, Human
uucaucuuuguucaacuuuuugcu

SEQ ID NO: 1349032 - RNA, 19 nt, Human
uuccuggccugcaggagua

SEQ ID NO: 1349033 - RNA, 20 nt, Human
uuccuggccugcaggaguau

SEQ ID NO: 1349034 - RNA, 24 nt, Human
uuccugggagaggugagccaaacc

SEQ ID NO: 1349035 - RNA, 23 nt, Human
uuggggugggaagggagcugcuu

SEQ ID NO: 1349036 - RNA, 24 nt, Human
uuucauagaaacaaauauaucacc

SEQ ID NO: 1349037 - RNA, 18 nt, Human
uuuuacagauuuuuagua

SEQ ID NO: 1349038 - RNA, 26 nt, Human
aaaaacguaggaaaaccagauauaac

SEQ ID NO: 1349039 - RNA, 20 nt, Human
aaaacuucucaaguggccau

SEQ ID NO: 1349040 - RNA, 24 nt, Human
aaaccagauauaacaagcucuaaa

SEQ ID NO: 1349041 - RNA, 24 nt, Human
aaaccggucccgccagacccgcgc

SEQ ID NO: 1349042 - RNA, 22 nt, Human
aaaggcaccacacacacgcaca

SEQ ID NO: 1349043 - RNA, 19 nt, Human
aacaagcucuaaagggcua

SEQ ID NO: 1349044 - RNA, 21 nt, Human
aagaguccauguuaagucacc

SEQ ID NO: 1349045 - RNA, 20 nt, Human
aaugcuacuggaauggaaua

SEQ ID NO: 1349046 - RNA, 20 nt, Human
aauuucaguuauaaaauggg

SEQ ID NO: 1349047 - RNA, 21 nt, Human
agaaaucacuauuuauccaca

SEQ ID NO: 1349048 - RNA, 20 nt, Human
agaccugacaaaucauauua

SEQ ID NO: 1349049 - RNA, 21 nt, Human
agauagucaaacagcuagagc

SEQ ID NO: 1349050 - RNA, 19 nt, Human
agcaaugaaacacaggaga

SEQ ID NO: 1349051 - RNA, 21 nt, Human
agccucaggcauuauugaucc

SEQ ID NO: 1349052 - RNA, 23 nt, Human
agguagaaacugucaacagcagc

SEQ ID NO: 1349053 - RNA, 19 nt, Human
augaaacacaggagauaaa

SEQ ID NO: 1349054 - RNA, 18 nt, Human
caaaagaugacugcaggu

SEQ ID NO: 1349055 - RNA, 27 nt, Human
cacacacacgcacacacacgguucucu

SEQ ID NO: 1349056 - RNA, 20 nt, Human
cacacacgcacacacacggu

SEQ ID NO: 1349057 - RNA, 20 nt, Human
cacauuuaaaaaccagcaca

SEQ ID NO: 1349058 - RNA, 21 nt, Human
caccacacacacgcacacaca

SEQ ID NO: 1349059 - RNA, 21 nt, Human
cagcacaacuccucuagugaa

SEQ ID NO: 1349060 - RNA, 25 nt, Human
cagcagccauggcaaccuucucucu

SEQ ID NO: 1349061 - RNA, 23 nt, Human
cauuauugauccugugccaucca

SEQ ID NO: 1349062 - RNA, 19 nt, Human
ccaaaccggucccgccaga

SEQ ID NO: 1349063 - RNA, 27 nt, Human
ccacacacacgcacacacacgguucuc

SEQ ID NO: 1349064 - RNA, 21 nt, Human
cccgcgcggccgccgcccccg

SEQ ID NO: 1349065 - RNA, 20 nt, Human
ccgucucggccgccggagcu

SEQ ID NO: 1349066 - RNA, 18 nt, Human
cgucucggccgccggagc

SEQ ID NO: 1349067 - RNA, 31 nt, Human
cugucaacagcagccauggcaaccuucucuu

SEQ ID NO: 1349068 - RNA, 19 nt, Human
gggaaaaagcacugaaaug

SEQ ID NO: 1349069 - RNA, 18 nt, Human
gucagaggcugagaaauc

SEQ ID NO: 1349070 - RNA, 18 nt, Human
guggcucuagaacaacag

SEQ ID NO: 1349071 - RNA, 27 nt, Human
guucugggccgucagcagucgacuuuc

SEQ ID NO: 1349072 - RNA, 22 nt, Human
uaacaagcucuaaagggcuaaa

SEQ ID NO: 1349073 - RNA, 22 nt, Human
uaagaccugacaaaucauauua

SEQ ID NO: 1349074 - RNA, 23 nt, Human
uaagcuucuaacuuauauugaca

SEQ ID NO: 1349075 - RNA, 23 nt, Human
uacaagagguagaaacugucaac

SEQ ID NO: 1349076 - RNA, 20 nt, Human
uauuccauaaauacuuacua

SEQ ID NO: 1349077 - RNA, 23 nt, Human
ucaaacagcuagagcuauacaau

SEQ ID NO: 1349078 - RNA, 27 nt, Human
ucagcaguauguggcuccguccuucuc

SEQ ID NO: 1349079 - RNA, 23 nt, Human
ucaggcauuauugauccugugcc

SEQ ID NO: 1349080 - RNA, 18 nt, Human
ucauuccauagcagauuu

SEQ ID NO: 1349081 - RNA, 22 nt, Human
uccauaaauacuuacuauuucu

SEQ ID NO: 1349082 - RNA, 22 nt, Human
ucccuguacaagagguagaaac

SEQ ID NO: 1349083 - RNA, 22 nt, Human
ugaaauaccaguugaagugcag

SEQ ID NO: 1349084 - RNA, 21 nt, Human
ugaaauuauaagaccugacaa

SEQ ID NO: 1349085 - RNA, 24 nt, Human
ugaauaaucagcaaugaaacacag

SEQ ID NO: 1349086 - RNA, 23 nt, Human
ugaugcacauuuaaaaaccagca

SEQ ID NO: 1349087 - RNA, 19 nt, Human
ugcaaaugacgaaucaaca

SEQ ID NO: 1349088 - RNA, 27 nt, Human
ugccaguucugggccguuaccaagugg

SEQ ID NO: 1349089 - RNA, 23 nt, Human
uggaauaauauuacauagaaaaa

SEQ ID NO: 1349090 - RNA, 22 nt, Human
ugucaacagcagccauggcaac

SEQ ID NO: 1349091 - RNA, 20 nt, Human
uguggcuccguccuucucuu

SEQ ID NO: 1349092 - RNA, 18 nt, Human
uuagggaaaaagcacuga

SEQ ID NO: 1349093 - RNA, 22 nt, Human
uucacagcacucugacgguauu

SEQ ID NO: 1349094 - RNA, 26 nt, Human
uuccaaaccggucccgccagacccgc

SEQ ID NO: 1349095 - RNA, 18 nt, Human
uuccauagcagauuugaa

SEQ ID NO: 1349096 - RNA, 22 nt, Human
uugaaaaaacacaaauauaaug

SEQ ID NO: 1349097 - RNA, 33 nt, Human
uugaaaaaacacaaauauaauguaggaaguaau

SEQ ID NO: 1349098 - RNA, 18 nt, Human
uuggcaaaacuucucaag

SEQ ID NO: 1349099 - RNA, 24 nt, Human
uuuuuuuuuuuaagcuucuaacuu

SEQ ID NO: 1349100 - RNA, 19 nt, Human
uuuuuuuuuuuuuuuuuaa

SEQ ID NO: 1349101 - RNA, 23 nt, Human
accacugagaagggacccgggcc

SEQ ID NO: 1349102 - RNA, 22 nt, Human
acccccaccuccuccccugagc

SEQ ID NO: 1349103 - RNA, 19 nt, Human
agcaccgagcccuuggggc

SEQ ID NO: 1349104 - RNA, 19 nt, Human
agggguuaggcccaggccc

SEQ ID NO: 1349105 - RNA, 21 nt, Human
caggccaagggguuaggccca

SEQ ID NO: 1349106 - RNA, 18 nt, Human
ccaccugcgaggggagga

SEQ ID NO: 1349107 - RNA, 21 nt, Human
ccccaccuccuccccugagcu

SEQ ID NO: 1349108 - RNA, 23 nt, Human
cccccaccuccuccccugagcua

SEQ ID NO: 1349109 - RNA, 21 nt, Human
ccccucacccgggguaggagc

SEQ ID NO: 1349110 - RNA, 18 nt, Human
cccuccuggacccccacc

SEQ ID NO: 1349111 - RNA, 18 nt, Human
cccugucacgccuccccg

SEQ ID NO: 1349112 - RNA, 22 nt, Human
ccgcgcuccggucccaccgacg

SEQ ID NO: 1349113 - RNA, 19 nt, Human
ccucuggaagcugggccag

SEQ ID NO: 1349114 - RNA, 24 nt, Human
cgcccgcccgcgcuccggucccac

SEQ ID NO: 1349115 - RNA, 20 nt, Human
cggggggccgcgcccgcccg

SEQ ID NO: 1349116 - RNA, 21 nt, Human
cugaagagggcacgaucccac

SEQ ID NO: 1349117 - RNA, 20 nt, Human
cuggacccccaccuccuccc

SEQ ID NO: 1349118 - RNA, 21 nt, Human
gagcuugcccugaagcacaga

SEQ ID NO: 1349119 - RNA, 22 nt, Human
gagcuugcccugaagcacagag

SEQ ID NO: 1349120 - RNA, 22 nt, Human
gaucccccuccuggacccccac

SEQ ID NO: 1349121 - RNA, 20 nt, Human
gcccagggucccucuggaag

SEQ ID NO: 1349122 - RNA, 21 nt, Human
gcccagggucccucuggaagc

SEQ ID NO: 1349123 - RNA, 24 nt, Human
ggccaccccucacccgggguagga

SEQ ID NO: 1349124 - RNA, 21 nt, Human
gggaucccccuccuggacccc

SEQ ID NO: 1349125 - RNA, 19 nt, Human
uacacgugaugucggggac

SEQ ID NO: 1349126 - RNA, 19 nt, Human
uagcaccgagcccuugggg

SEQ ID NO: 1349127 - RNA, 18 nt, Human
ucccaccugcgaggggag

SEQ ID NO: 1349128 - RNA, 18 nt, Human
ucccccuccuggaccccc

SEQ ID NO: 1349129 - RNA, 24 nt, Human
ucccucuggaagcugggccaggcc

SEQ ID NO: 1349130 - RNA, 18 nt, Human
ugaagcacagagcaccac

SEQ ID NO: 1349131 - RNA, 22 nt, Human
ugaagcacagagcaccacugag

SEQ ID NO: 1349132 - RNA, 18 nt, Human
ugcagguaggugagcggg

SEQ ID NO: 1349133 - RNA, 20 nt, Human
ugcccugaagcacagagcac

SEQ ID NO: 1349134 - RNA, 22 nt, Human
ugcgaggggaggaggcuggaga

SEQ ID NO: 1349135 - RNA, 28 nt, Human
ugcgaggggaggaggcuggagaaaggag

SEQ ID NO: 1349136 - RNA, 21 nt, Human
uggaagcugggccaggccaag

SEQ ID NO: 1349137 - RNA, 25 nt, Human
uggcacaaauuuuauuccguuacaa

SEQ ID NO: 1349138 - RNA, 20 nt, Human
uggggcugccccuguggaga

SEQ ID NO: 1349139 - RNA, 19 nt, Human
aaaaggacggggaagacag

SEQ ID NO: 1349140 - RNA, 19 nt, Human
aggacggggaagacaggga

SEQ ID NO: 1349141 - RNA, 26 nt, Human
aggccagaggcgagacugguggaaaa

SEQ ID NO: 1349142 - RNA, 20 nt, Human
cccccacuucuccuccugcc

SEQ ID NO: 1349143 - RNA, 23 nt, Human
ccuccugccucagcucccaggac

SEQ ID NO: 1349144 - RNA, 20 nt, Human
cucccaggaguggccagagg

SEQ ID NO: 1349145 - RNA, 18 nt, Human
cuggcagcgggacagggg

SEQ ID NO: 1349146 - RNA, 19 nt, Human
guggugaggcagucccucc

SEQ ID NO: 1349147 - RNA, 22 nt, Human
ugccucagcucccaggacccag

SEQ ID NO: 1349148 - RNA, 19 nt, Human
uuuuuuuuuuuuuuuuugg

SEQ ID NO: 1349149 - RNA, 23 nt, Human
uuuuuuuuuuuuuuuuugguuuu

SEQ ID NO: 1349150 - RNA, 25 nt, Human
aaacaaaugucuaacaauaggaaac

SEQ ID NO: 1349151 - RNA, 18 nt, Human
aaacuggaaacaaauguc

SEQ ID NO: 1349152 - RNA, 18 nt, Human
aacccgagagagugacaa

SEQ ID NO: 1349153 - RNA, 21 nt, Human
aacccggacgcgacgagacgg

SEQ ID NO: 1349154 - RNA, 20 nt, Human
aaugucuuccgagcaguucu

SEQ ID NO: 1349155 - RNA, 18 nt, Human
acaacccggacgcgacga

SEQ ID NO: 1349156 - RNA, 21 nt, Human
agaaacuggaaacaaaugucu

SEQ ID NO: 1349157 - RNA, 25 nt, Human
agaaaugguauaguaagagauauug

SEQ ID NO: 1349158 - RNA, 26 nt, Human
agaaaugguauaguaagagauauugu

SEQ ID NO: 1349159 - RNA, 21 nt, Human
agaagagguuucuacaauuua

SEQ ID NO: 1349160 - RNA, 24 nt, Human
auaaagagaacuaacucuguuuuu

SEQ ID NO: 1349161 - RNA, 25 nt, Human
aucccagcucucugucccauccauu

SEQ ID NO: 1349162 - RNA, 23 nt, Human
caaugucuuccgagcaguucucu

SEQ ID NO: 1349163 - RNA, 21 nt, Human
ccagucuugaacagucuugaa

SEQ ID NO: 1349164 - RNA, 24 nt, Human
ccauauaugcuccucuccuauucc

SEQ ID NO: 1349165 - RNA, 20 nt, Human
ccuuucgcgagccgggaagc

SEQ ID NO: 1349166 - RNA, 21 nt, Human
cuaccaaugucuuccgagcag

SEQ ID NO: 1349167 - RNA, 20 nt, Human
cucugccauauaugcuccuc

SEQ ID NO: 1349168 - RNA, 22 nt, Human
cugcacaucaccccagucacac

SEQ ID NO: 1349169 - RNA, 22 nt, Human
cuuguaaacuacuccaaaucac

SEQ ID NO: 1349170 - RNA, 30 nt, Human
gagggcacucugaaugaggaaucuuguaaa

SEQ ID NO: 1349171 - RNA, 23 nt, Human
gggaagcuacagaguaacaaccc

SEQ ID NO: 1349172 - RNA, 23 nt, Human
uaacaacccgagagagugacaac

SEQ ID NO: 1349173 - RNA, 23 nt, Human
uaagcccuaaaaugaaauuguga

SEQ ID NO: 1349174 - RNA, 24 nt, Human
uaagcccuaaaaugaaauugugaa

SEQ ID NO: 1349175 - RNA, 20 nt, Human
uaaggaaauccaaucaauca

SEQ ID NO: 1349176 - RNA, 23 nt, Human
uaaggaaauccaaucaaucagaa

SEQ ID NO: 1349177 - RNA, 23 nt, Human
uacauugcuaccuuuuuaugucu

SEQ ID NO: 1349178 - RNA, 19 nt, Human
uacuccaaaucaccagucu

SEQ ID NO: 1349179 - RNA, 24 nt, Human
uaggaaacugguuuaaaaaaauca

SEQ ID NO: 1349180 - RNA, 20 nt, Human
ucacuuguacauuagauccc

SEQ ID NO: 1349181 - RNA, 25 nt, Human
uccucuaccucuuuacucacccuca

SEQ ID NO: 1349182 - RNA, 21 nt, Human
ucuacaauuuacuaucacauu

SEQ ID NO: 1349183 - RNA, 27 nt, Human
ucuacaauuuacuaucacauuuaccca

SEQ ID NO: 1349184 - RNA, 18 nt, Human
ucuuguaaacuacuccaa

SEQ ID NO: 1349185 - RNA, 21 nt, Human
ugucauaaagagaacuaacuc

SEQ ID NO: 1349186 - RNA, 18 nt, Human
uuagaucccagcucucug

SEQ ID NO: 1349187 - RNA, 23 nt, Human
uucacuuguacauuagaucccag

SEQ ID NO: 1349188 - RNA, 21 nt, Human
aaaacaaauguacauacccuu

SEQ ID NO: 1349189 - RNA, 20 nt, Human
aaacaaauguacauacccuu

SEQ ID NO: 1349190 - RNA, 22 nt, Human
acaaaacaaauguacauacccu

SEQ ID NO: 1349191 - RNA, 23 nt, Human
augcaaaauaugaaucuggcuca

SEQ ID NO: 1349192 - RNA, 23 nt, Human
caaaacaaauguacauacccuuc

SEQ ID NO: 1349193 - RNA, 21 nt, Human
caccacgcucuccuaggcagu

SEQ ID NO: 1349194 - RNA, 23 nt, Human
cuuagagaccuccucucuugcuu

SEQ ID NO: 1349195 - RNA, 22 nt, Human
cuucccgcuauuugcugugggu

SEQ ID NO: 1349196 - RNA, 23 nt, Human
gagcuggggccaccacgcucucc

SEQ ID NO: 1349197 - RNA, 25 nt, Human
gcaaaaaguggcacagaggcuaucc

SEQ ID NO: 1349198 - RNA, 24 nt, Human
gcaaaauaugaaucuggcucaaag

SEQ ID NO: 1349199 - RNA, 18 nt, Human
ggcaaaaaguggcacaga

SEQ ID NO: 1349200 - RNA, 21 nt, Human
ucuggcaaaaaguggcacaga

SEQ ID NO: 1349201 - RNA, 25 nt, Human
ugacacacaaaacaaauguacauac

SEQ ID NO: 1349202 - RNA, 22 nt, Human
uggcucaaagacacucuggcaa

SEQ ID NO: 1349203 - RNA, 26 nt, Human
uuagagaccuccucucuugcuuuucu

SEQ ID NO: 1349204 - RNA, 20 nt, Human
aaaaaaauacuugaacagaa

SEQ ID NO: 1349205 - RNA, 19 nt, Human
aaaaaaggacugugcugug

SEQ ID NO: 1349206 - RNA, 27 nt, Human
aaaacaccacccucuucuccuggcuga

SEQ ID NO: 1349207 - RNA, 23 nt, Human
aaacaucaugccuacuccaaagc

SEQ ID NO: 1349208 - RNA, 22 nt, Human
aacacguggugcaucagagaca

SEQ ID NO: 1349209 - RNA, 19 nt, Human
aaccccauguaggccggcg

SEQ ID NO: 1349210 - RNA, 25 nt, Human
aagcagccaucucccagugggucug

SEQ ID NO: 1349211 - RNA, 23 nt, Human
aagcuagccacuauucugagaac

SEQ ID NO: 1349212 - RNA, 24 nt, Human
aagcuagccacuauucugagaacg

SEQ ID NO: 1349213 - RNA, 24 nt, Human
aagcucuuuuuuuacccucuuuuc

SEQ ID NO: 1349214 - RNA, 20 nt, Human
aaguggcaaugucccaugaa

SEQ ID NO: 1349215 - RNA, 23 nt, Human
aaguggcaaugucccaugaaggc

SEQ ID NO: 1349216 - RNA, 19 nt, Human
acauaguuacaguuccuac

SEQ ID NO: 1349217 - RNA, 20 nt, Human
accuggagccccucccagac

SEQ ID NO: 1349218 - RNA, 23 nt, Human
acugcugucagcaugcccaaaga

SEQ ID NO: 1349219 - RNA, 19 nt, Human
aggaacagaaaaaaggacc

SEQ ID NO: 1349220 - RNA, 19 nt, Human
aggcaggaggauguuaaac

SEQ ID NO: 1349221 - RNA, 21 nt, Human
aggcaggaggauguuaaacuu

SEQ ID NO: 1349222 - RNA, 24 nt, Human
aggcaggaggauguuaaacuuggu

SEQ ID NO: 1349223 - RNA, 18 nt, Human
caccugccacuuccgcgu

SEQ ID NO: 1349224 - RNA, 20 nt, Human
cagaauaugcuguacagaac

SEQ ID NO: 1349225 - RNA, 20 nt, Human
cagacgguaaucccaccccu

SEQ ID NO: 1349226 - RNA, 25 nt, Human
cagcaacauucucuaguguuccggc

SEQ ID NO: 1349227 - RNA, 18 nt, Human
cagcaugcccaaagagaa

SEQ ID NO: 1349228 - RNA, 19 nt, Human
cagccugcgccuuacagcg

SEQ ID NO: 1349229 - RNA, 22 nt, Human
cagcuuaaggagagcaaaaaua

SEQ ID NO: 1349230 - RNA, 18 nt, Human
ccacgaccugggagugcu

SEQ ID NO: 1349231 - RNA, 22 nt, Human
ccacgggcguccacuucugcag

SEQ ID NO: 1349232 - RNA, 22 nt, Human
cccaccccuguucucacacucu

SEQ ID NO: 1349233 - RNA, 19 nt, Human
cccacgggggggggggggg

SEQ ID NO: 1349234 - RNA, 24 nt, Human
cccacggggggggggggggagugu

SEQ ID NO: 1349235 - RNA, 22 nt, Human
ccccaaagagaacagggcuugc

SEQ ID NO: 1349236 - RNA, 20 nt, Human
ccccacgggggggggggggg

SEQ ID NO: 1349237 - RNA, 24 nt, Human
ccccauguaggccggcgagcaguu

SEQ ID NO: 1349238 - RNA, 18 nt, Human
cccccgucaccugccacu

SEQ ID NO: 1349239 - RNA, 21 nt, Human
ccccgcugccgucgccgucgc

SEQ ID NO: 1349240 - RNA, 23 nt, Human
ccccgcugccgucgccgucgccg

SEQ ID NO: 1349241 - RNA, 20 nt, Human
ccccucccagacagacgguu

SEQ ID NO: 1349242 - RNA, 23 nt, Human
cccgcaccccgugcugcacagcc

SEQ ID NO: 1349243 - RNA, 22 nt, Human
cccuguucucacacucuuccug

SEQ ID NO: 1349244 - RNA, 18 nt, Human
ccgcauaugaagaugcua

SEQ ID NO: 1349245 - RNA, 18 nt, Human
ccgcguccacgcugcugc

SEQ ID NO: 1349246 - RNA, 23 nt, Human
ccggcuucaagcagcgcuuguca

SEQ ID NO: 1349247 - RNA, 24 nt, Human
ccgucgccgucgccgccgccgccg

SEQ ID NO: 1349248 - RNA, 24 nt, Human
ccgucgccgucgccgucgccgccg

SEQ ID NO: 1349249 - RNA, 18 nt, Human
ccuacugacugccccagc

SEQ ID NO: 1349250 - RNA, 22 nt, Human
ccuguucucacacucuuccugg

SEQ ID NO: 1349251 - RNA, 20 nt, Human
cgagggggcagaggaaggcg

SEQ ID NO: 1349252 - RNA, 19 nt, Human
cgccagcgccagccgcguc

SEQ ID NO: 1349253 - RNA, 21 nt, Human
cguccccgcugccgucgccgu

SEQ ID NO: 1349254 - RNA, 20 nt, Human
cucucagcaacauucucuag

SEQ ID NO: 1349255 - RNA, 18 nt, Human
cugagaacgucagaaaag

SEQ ID NO: 1349256 - RNA, 19 nt, Human
gaaaaacugcugucagcau

SEQ ID NO: 1349257 - RNA, 20 nt, Human
gacccagcuccaguacuggg

SEQ ID NO: 1349258 - RNA, 20 nt, Human
gagacccagcuccaguacug

SEQ ID NO: 1349259 - RNA, 18 nt, Human
gcacgcacacgugaaaac

SEQ ID NO: 1349260 - RNA, 20 nt, Human
gcagaaggcaugugccuaca

SEQ ID NO: 1349261 - RNA, 19 nt, Human
gcccgcgugaaaacaccac

SEQ ID NO: 1349262 - RNA, 20 nt, Human
gcccgcgugaaaacaccacc

SEQ ID NO: 1349263 - RNA, 21 nt, Human
gcuggcaggagggaagcuuga

SEQ ID NO: 1349264 - RNA, 20 nt, Human
gcuugguguugccguugugg

SEQ ID NO: 1349265 - RNA, 20 nt, Human
ggaccugggagugcucagcg

SEQ ID NO: 1349266 - RNA, 24 nt, Human
ggcauccgcaucugcuggcacaca

SEQ ID NO: 1349267 - RNA, 21 nt, Human
ggucugcggggugaacgaggg

SEQ ID NO: 1349268 - RNA, 21 nt, Human
guuugaagcuagccacuauuc

SEQ ID NO: 1349269 - RNA, 21 nt, Human
uacaguuccuacugacugccc

SEQ ID NO: 1349270 - RNA, 21 nt, Human
uaccuggagccccucccagac

SEQ ID NO: 1349271 - RNA, 20 nt, Human
uacuugaacagaauaugcug

SEQ ID NO: 1349272 - RNA, 19 nt, Human
uagaaagggcucauccgug

SEQ ID NO: 1349273 - RNA, 20 nt, Human
uaugcuguacagaacuaggg

SEQ ID NO: 1349274 - RNA, 22 nt, Human
ucacacucuuccuggcauccgc

SEQ ID NO: 1349275 - RNA, 22 nt, Human
ucaccugccacuuccgcguccc

SEQ ID NO: 1349276 - RNA, 21 nt, Human
ucagcccuguggagaaauaca

SEQ ID NO: 1349277 - RNA, 21 nt, Human
ucaggcaggaggauguuaaac

SEQ ID NO: 1349278 - RNA, 26 nt, Human
uccacaguaggaacagaaaaaaggac

SEQ ID NO: 1349279 - RNA, 23 nt, Human
ucccaccccuguucucacacucu

SEQ ID NO: 1349280 - RNA, 24 nt, Human
ucccgcuacugcugccguccccgc

SEQ ID NO: 1349281 - RNA, 19 nt, Human
uccuccucccccgcacccc

SEQ ID NO: 1349282 - RNA, 22 nt, Human
uccuggcugagaagaucaaagc

SEQ ID NO: 1349283 - RNA, 24 nt, Human
ucgccgucgccgccgccgccgccg

SEQ ID NO: 1349284 - RNA, 24 nt, Human
ucgccgucgccgucgccgccgccg

SEQ ID NO: 1349285 - RNA, 20 nt, Human
ucgugacccgcguggccguu

SEQ ID NO: 1349286 - RNA, 18 nt, Human
ucuaaacaauacuuuuga

SEQ ID NO: 1349287 - RNA, 19 nt, Human
ucuccuggcugagaagauc

SEQ ID NO: 1349288 - RNA, 19 nt, Human
ucuguauacaagcauggag

SEQ ID NO: 1349289 - RNA, 18 nt, Human
ucuguccccggaaguggc

SEQ ID NO: 1349290 - RNA, 22 nt, Human
ugaaaacaccacccucuucucc

SEQ ID NO: 1349291 - RNA, 22 nt, Human
ugaacagaauaugcuguacaga

SEQ ID NO: 1349292 - RNA, 21 nt, Human
ugacacacgguggaaccugca

SEQ ID NO: 1349293 - RNA, 20 nt, Human
ugacugccccagccacgacc

SEQ ID NO: 1349294 - RNA, 24 nt, Human
ugagauggacguaccuggagaccc

SEQ ID NO: 1349295 - RNA, 19 nt, Human
ugagcaggaaagucuaaac

SEQ ID NO: 1349296 - RNA, 18 nt, Human
ugaggaccugggagugcu

SEQ ID NO: 1349297 - RNA, 21 nt, Human
ugaggcuaugaaaaacugcug

SEQ ID NO: 1349298 - RNA, 19 nt, Human
ugcaaacaaggcaugagau

SEQ ID NO: 1349299 - RNA, 21 nt, Human
ugcaggaggucagcccugugg

SEQ ID NO: 1349300 - RNA, 21 nt, Human
ugccuacuccaaagccuucuu

SEQ ID NO: 1349301 - RNA, 21 nt, Human
ugcucccgcuacugcugccgu

SEQ ID NO: 1349302 - RNA, 26 nt, Human
ugcugcacagccugcgccuuacagcg

SEQ ID NO: 1349303 - RNA, 22 nt, Human
ugcuggcacacacccccgucac

SEQ ID NO: 1349304 - RNA, 25 nt, Human
uggcaaugucccaugaaggcguggc

SEQ ID NO: 1349305 - RNA, 24 nt, Human
ugggagugcugaggaccugggagu

SEQ ID NO: 1349306 - RNA, 19 nt, Human
uucagcaccguauagacag

SEQ ID NO: 1349307 - RNA, 24 nt, Human
uugcuggaggccagugccaagggc

SEQ ID NO: 1349308 - RNA, 25 nt, Human
aaaaaaaaaaaaaauaucaaagccu

SEQ ID NO: 1349309 - RNA, 18 nt, Human
aaaagaaauucaugccau

SEQ ID NO: 1349310 - RNA, 22 nt, Human
aacuugacacagucccagaagc

SEQ ID NO: 1349311 - RNA, 23 nt, Human
aagaaaaaaagauauuuuuacac

SEQ ID NO: 1349312 - RNA, 22 nt, Human
aagaaaucuagaggcugacuuu

SEQ ID NO: 1349313 - RNA, 18 nt, Human
aagagcgcccugcuacag

SEQ ID NO: 1349314 - RNA, 22 nt, Human
aaguacagucacaauauugugc

SEQ ID NO: 1349315 - RNA, 18 nt, Human
aagugucauccauucuuu

SEQ ID NO: 1349316 - RNA, 20 nt, Human
aaguuucucgggcacaagcu

SEQ ID NO: 1349317 - RNA, 22 nt, Human
aauuaaaaaaaaaaaaaauauc

SEQ ID NO: 1349318 - RNA, 25 nt, Human
acaagaaaaaauugaacuccuucca

SEQ ID NO: 1349319 - RNA, 20 nt, Human
acacagucccagaagccaag

SEQ ID NO: 1349320 - RNA, 22 nt, Human
acagucccagaagccaagcuca

SEQ ID NO: 1349321 - RNA, 18 nt, Human
acuuuguaagugaaagcu

SEQ ID NO: 1349322 - RNA, 21 nt, Human
agcauuuaaaauuuagaaaua

SEQ ID NO: 1349323 - RNA, 20 nt, Human
agcauuucagauguuuccag

SEQ ID NO: 1349324 - RNA, 19 nt, Human
agccuguuugguuucaugu

SEQ ID NO: 1349325 - RNA, 18 nt, Human
agcuguuacuucaacaca

SEQ ID NO: 1349326 - RNA, 18 nt, Human
aggcagacugaaacuugg

SEQ ID NO: 1349327 - RNA, 21 nt, Human
aggcaggaggaucagcacaug

SEQ ID NO: 1349328 - RNA, 21 nt, Human
augagcccucuagccucaaaa

SEQ ID NO: 1349329 - RNA, 21 nt, Human
auggaggguuuuagaucucca

SEQ ID NO: 1349330 - RNA, 23 nt, Human
auggcaauaaaguuaaaggauuc

SEQ ID NO: 1349331 - RNA, 25 nt, Human
auuaacacaguuuuuaaaguagcac

SEQ ID NO: 1349332 - RNA, 22 nt, Human
caacugaauuugccuuggcugg

SEQ ID NO: 1349333 - RNA, 24 nt, Human
caacuugacacagucccagaagcc

SEQ ID NO: 1349334 - RNA, 18 nt, Human
caagaggaaaggauuuuc

SEQ ID NO: 1349335 - RNA, 18 nt, Human
caagcccuagauccaacu

SEQ ID NO: 1349336 - RNA, 23 nt, Human
cacaaaagagcaaaaacuggagg

SEQ ID NO: 1349337 - RNA, 22 nt, Human
cacucuaacuuccaggccuaag

SEQ ID NO: 1349338 - RNA, 18 nt, Human
caggaggccacagacugc

SEQ ID NO: 1349339 - RNA, 21 nt, Human
caguacaacacaaaagagcaa

SEQ ID NO: 1349340 - RNA, 24 nt, Human
caguuuauucaaacuauuucaucu

SEQ ID NO: 1349341 - RNA, 20 nt, Human
ccaagcuucuggaaggaaga

SEQ ID NO: 1349342 - RNA, 23 nt, Human
cccuucucagcccaugaaggagc

SEQ ID NO: 1349343 - RNA, 19 nt, Human
cccuugguuggggagaucc

SEQ ID NO: 1349344 - RNA, 18 nt, Human
ccuaaaaauauguagaga

SEQ ID NO: 1349345 - RNA, 19 nt, Human
ccuacaauggaacuuaaga

SEQ ID NO: 1349346 - RNA, 21 nt, Human
ccuagauccaacugaauuugc

SEQ ID NO: 1349347 - RNA, 18 nt, Human
ccuuacaccugagucugu

SEQ ID NO: 1349348 - RNA, 21 nt, Human
ccuuccuucuuuccuuuuacc

SEQ ID NO: 1349349 - RNA, 22 nt, Human
cucaaggacggguaaagguaag

SEQ ID NO: 1349350 - RNA, 25 nt, Human
cuccuggaccgcuguucucaaggac

SEQ ID NO: 1349351 - RNA, 22 nt, Human
cugaaggcccucuugaaacuga

SEQ ID NO: 1349352 - RNA, 18 nt, Human
cuuccugauuccagaagu

SEQ ID NO: 1349353 - RNA, 23 nt, Human
cuuuccuuuuaccuccauaagaa

SEQ ID NO: 1349354 - RNA, 24 nt, Human
gaaaaaaaaauucauauccuaaaa

SEQ ID NO: 1349355 - RNA, 25 nt, Human
gaaaaaaagauauuuuuacacgaaa

SEQ ID NO: 1349356 - RNA, 24 nt, Human
gaaaaaaaggacaccaaguaaugu

SEQ ID NO: 1349357 - RNA, 27 nt, Human
gaaggaagagagcaguguggcagaggg

SEQ ID NO: 1349358 - RNA, 22 nt, Human
gagcaguguggcagagggugug

SEQ ID NO: 1349359 - RNA, 19 nt, Human
gagcccucuagccucaaaa

SEQ ID NO: 1349360 - RNA, 24 nt, Human
gcauuucagauguuuccaguuuuu

SEQ ID NO: 1349361 - RNA, 20 nt, Human
gccacagcauauaauagcug

SEQ ID NO: 1349362 - RNA, 19 nt, Human
ggguaagaaaucuagaggc

SEQ ID NO: 1349363 - RNA, 21 nt, Human
gggucuccuggccaaaauucc

SEQ ID NO: 1349364 - RNA, 25 nt, Human
gggugugucuguguguauaggcagu

SEQ ID NO: 1349365 - RNA, 18 nt, Human
gucaucucaucccagauu

SEQ ID NO: 1349366 - RNA, 23 nt, Human
uaaaaaaaaaaaaaauaucaaag

SEQ ID NO: 1349367 - RNA, 25 nt, Human
uaacauaaauagagcauuucagaug

SEQ ID NO: 1349368 - RNA, 19 nt, Human
uaacuuccaggccuaagau

SEQ ID NO: 1349369 - RNA, 20 nt, Human
uaagucacuggacaaucuac

SEQ ID NO: 1349370 - RNA, 24 nt, Human
uaauaaacuacugccucauuucuu

SEQ ID NO: 1349371 - RNA, 20 nt, Human
uaauuuaggaaaugauagcc

SEQ ID NO: 1349372 - RNA, 20 nt, Human
uacaacacaaaagagcaaaa

SEQ ID NO: 1349373 - RNA, 25 nt, Human
uacauccgucaucucaucccagauu

SEQ ID NO: 1349374 - RNA, 24 nt, Human
uaccaaggaagaagaaucaagcaa

SEQ ID NO: 1349375 - RNA, 20 nt, Human
uaccuauucugcuuagugac

SEQ ID NO: 1349376 - RNA, 19 nt, Human
uagaacuaaaggcaggagg

SEQ ID NO: 1349377 - RNA, 21 nt, Human
uaggaaaugauagcuuuccac

SEQ ID NO: 1349378 - RNA, 24 nt, Human
uaucagaaaagugcagcagguuuc

SEQ ID NO: 1349379 - RNA, 21 nt, Human
uaugaacauagcuuuucuucc

SEQ ID NO: 1349380 - RNA, 18 nt, Human
ucacaauauugugcaguc

SEQ ID NO: 1349381 - RNA, 22 nt, Human
ucacuggacaaucuacccagcu

SEQ ID NO: 1349382 - RNA, 20 nt, Human
uccaauuuuaauauccagau

SEQ ID NO: 1349383 - RNA, 20 nt, Human
uccacaaaaguuaacuucuc

SEQ ID NO: 1349384 - RNA, 24 nt, Human
ucccaagaggaaaggauuuucuuc

SEQ ID NO: 1349385 - RNA, 18 nt, Human
ucccagauucaagaacuc

SEQ ID NO: 1349386 - RNA, 23 nt, Human
uccuggccaaaauuccccaaagc

SEQ ID NO: 1349387 - RNA, 20 nt, Human
uccugguuuccccuucucag

SEQ ID NO: 1349388 - RNA, 20 nt, Human
ucuccuggccaaaauucccc

SEQ ID NO: 1349389 - RNA, 20 nt, Human
ucugaaggcgcacccuacaa

SEQ ID NO: 1349390 - RNA, 22 nt, Human
ucuugggcaguuuucaagcccu

SEQ ID NO: 1349391 - RNA, 18 nt, Human
ugaagacagaaaaguggu

SEQ ID NO: 1349392 - RNA, 21 nt, Human
ugaaggcccucuugaaacuga

SEQ ID NO: 1349393 - RNA, 21 nt, Human
ugaauuguuauuuuaccaguu

SEQ ID NO: 1349394 - RNA, 22 nt, Human
ugacuuugguucuguuuuuagg

SEQ ID NO: 1349395 - RNA, 19 nt, Human
uggaaggaagagagcagug

SEQ ID NO: 1349396 - RNA, 20 nt, Human
uggccaaaauuccccaaagc

SEQ ID NO: 1349397 - RNA, 24 nt, Human
uguuugguuucauguuucaggguc

SEQ ID NO: 1349398 - RNA, 20 nt, Human
uucugaauuaaaaaaaaaag

SEQ ID NO: 1349399 - RNA, 20 nt, Human
uucuuccugauuccagaagu

SEQ ID NO: 1349400 - RNA, 18 nt, Human
uugaaaaauaaaaguaua

SEQ ID NO: 1349401 - RNA, 18 nt, Human
uugguuggggagauccug

SEQ ID NO: 1349402 - RNA, 24 nt, Human
uuguguucaguacaacacaaaaga

SEQ ID NO: 1349403 - RNA, 21 nt, Human
uuuaaaguguacaguucagug

SEQ ID NO: 1349404 - RNA, 26 nt, Human
uuuaagauaaaaaaaaaaaaaaaaaa

SEQ ID NO: 1349405 - RNA, 21 nt, Human
uuuaaguucuguucuagucuu

SEQ ID NO: 1349406 - RNA, 26 nt, Human
uuuagaguaugaacauagcuuuucuu

SEQ ID NO: 1349407 - RNA, 21 nt, Human
uuuccuuccuucuuuccuuuu

SEQ ID NO: 1349408 - RNA, 27 nt, Human
aggaauauugggaggaaaccgguaccc

SEQ ID NO: 1349409 - RNA, 22 nt, Human
gggcguugcugcaaagcauccu

SEQ ID NO: 1349410 - RNA, 21 nt, Human
ugagaaggaauauugggagga

SEQ ID NO: 1349411 - RNA, 19 nt, Human
uugcugcaaagcauccugg

SEQ ID NO: 1349412 - RNA, 23 nt, Human
aaacgaaauaaacccaaggaacc

SEQ ID NO: 1349413 - RNA, 21 nt, Human
aaagcaagacgaaacccaccc

SEQ ID NO: 1349414 - RNA, 21 nt, Human
aacaguggccgcucagggucc

SEQ ID NO: 1349415 - RNA, 23 nt, Human
aacccacccagacagcucuuccg

SEQ ID NO: 1349416 - RNA, 22 nt, Human
aagcaagacgaaacccacccag

SEQ ID NO: 1349417 - RNA, 20 nt, Human
aagcacccuccguccgggga

SEQ ID NO: 1349418 - RNA, 20 nt, Human
aagguggagaagagagagga

SEQ ID NO: 1349419 - RNA, 26 nt, Human
aauaucuggugauaauaauuuuuucu

SEQ ID NO: 1349420 - RNA, 20 nt, Human
agacgaaacccacccagaca

SEQ ID NO: 1349421 - RNA, 22 nt, Human
agacgaaacccacccagacagc

SEQ ID NO: 1349422 - RNA, 18 nt, Human
agaggaaaacgaaauaaa

SEQ ID NO: 1349423 - RNA, 18 nt, Human
agcgcagcgcgaaagggg

SEQ ID NO: 1349424 - RNA, 18 nt, Human
agggccccaacaguggcc

SEQ ID NO: 1349425 - RNA, 22 nt, Human
aguauguuuuuggagcacagga

SEQ ID NO: 1349426 - RNA, 24 nt, Human
auccccgcuuucuucucuccuccc

SEQ ID NO: 1349427 - RNA, 19 nt, Human
auguuuuuggagcacagga

SEQ ID NO: 1349428 - RNA, 23 nt, Human
caaauaauccccugccuugcuca

SEQ ID NO: 1349429 - RNA, 24 nt, Human
caaggcaaaaaggcugugagagca

SEQ ID NO: 1349430 - RNA, 18 nt, Human
cacccuccguccggggac

SEQ ID NO: 1349431 - RNA, 26 nt, Human
ccacccagacagcucuuccgacuccc

SEQ ID NO: 1349432 - RNA, 25 nt, Human
ccacccucuacaccucaaauaaucc

SEQ ID NO: 1349433 - RNA, 25 nt, Human
ccagacagcucuuccgacucccaga

SEQ ID NO: 1349434 - RNA, 24 nt, Human
ccccaacaguggccgcucaggguc

SEQ ID NO: 1349435 - RNA, 19 nt, Human
ccucccagcuggaagugaa

SEQ ID NO: 1349436 - RNA, 20 nt, Human
cgaaauaaacccaaggaacc

SEQ ID NO: 1349437 - RNA, 19 nt, Human
cggccgaggcgccacgcgg

SEQ ID NO: 1349438 - RNA, 25 nt, Human
gaaccaaugcuacucgcgaagccga

SEQ ID NO: 1349439 - RNA, 18 nt, Human
gacuggguggcggugggg

SEQ ID NO: 1349440 - RNA, 20 nt, Human
gagaggaaaacgaaauaaac

SEQ ID NO: 1349441 - RNA, 21 nt, Human
gagcacgcuacagcgcagcgc

SEQ ID NO: 1349442 - RNA, 22 nt, Human
gaggcgccacgcggggccgcgg

SEQ ID NO: 1349443 - RNA, 22 nt, Human
ggcgacuaagguggagaagaga

SEQ ID NO: 1349444 - RNA, 20 nt, Human
ggggccgcggcucgcccugg

SEQ ID NO: 1349445 - RNA, 22 nt, Human
gguggagaagagagaggaaaac

SEQ ID NO: 1349446 - RNA, 21 nt, Human
gucucggcuucgcuucccacc

SEQ ID NO: 1349447 - RNA, 19 nt, Human
uacucgcgaagccgaaguc

SEQ ID NO: 1349448 - RNA, 21 nt, Human
ucagcguccagacccgcaggc

SEQ ID NO: 1349449 - RNA, 21 nt, Human
ucccacccucuacaccucaaa

SEQ ID NO: 1349450 - RNA, 21 nt, Human
ucgcuucccacccucuacacc

SEQ ID NO: 1349451 - RNA, 19 nt, Human
ucuaugccaggcagugccc

SEQ ID NO: 1349452 - RNA, 21 nt, Human
ucuggcaguacagccuucuuc

SEQ ID NO: 1349453 - RNA, 22 nt, Human
ucuggugauaauaauuuuuucu

SEQ ID NO: 1349454 - RNA, 20 nt, Human
ugaaaagcacccuccguccg

SEQ ID NO: 1349455 - RNA, 23 nt, Human
uggaagugaaaagcacccuccuc

SEQ ID NO: 1349456 - RNA, 20 nt, Human
ugucaggugguugaaaaacu

SEQ ID NO: 1349457 - RNA, 22 nt, Human
uucaaggcaaaaaggcugugag

SEQ ID NO: 1349458 - RNA, 23 nt, Human
uucaaggcaaaaaggcugugaga

SEQ ID NO: 1349459 - RNA, 19 nt, Human
uucccacccucuacaccuc

SEQ ID NO: 1349460 - RNA, 28 nt, Human
uuccucucugaagaccugauuccuuaaa

SEQ ID NO: 1349461 - RNA, 20 nt, Human
uuuggagcacaggauggaga

SEQ ID NO: 1349462 - RNA, 22 nt, Human
aagcgcccggagcacugagcag

SEQ ID NO: 1349463 - RNA, 20 nt, Human
aggcagaagaaagagcaugg

SEQ ID NO: 1349464 - RNA, 20 nt, Human
agugauggagguaucaggga

SEQ ID NO: 1349465 - RNA, 24 nt, Human
cagaagaaagagcauguuucccau

SEQ ID NO: 1349466 - RNA, 18 nt, Human
cagcaggacccaagccag

SEQ ID NO: 1349467 - RNA, 23 nt, Human
cagucugugccugccuuuguggu

SEQ ID NO: 1349468 - RNA, 18 nt, Human
cccuugggguuggagcag

SEQ ID NO: 1349469 - RNA, 22 nt, Human
ccugaagcgcccggagcacuga

SEQ ID NO: 1349470 - RNA, 19 nt, Human
cgcccggagcacugagcag

SEQ ID NO: 1349471 - RNA, 22 nt, Human
gagguaucagggagcgcuccag

SEQ ID NO: 1349472 - RNA, 20 nt, Human
gcaggguugcagucugugcc

SEQ ID NO: 1349473 - RNA, 18 nt, Human
uaacagaggcagaagaaa

SEQ ID NO: 1349474 - RNA, 23 nt, Human
uauaagagugguggaaacugcag

SEQ ID NO: 1349475 - RNA, 23 nt, Human
ugagcaggguugcagucugugcc

SEQ ID NO: 1349476 - RNA, 21 nt, Human
uuuuuuuuuuuuaacagaggc

SEQ ID NO: 1349477 - RNA, 23 nt, Human
uuuuuuuuuuuuuuuuuuaacag

SEQ ID NO: 1349478 - RNA, 20 nt, Human
auggggucuggaaacucuac

SEQ ID NO: 1349479 - RNA, 23 nt, Human
caccacgagcaguagagcagcag

SEQ ID NO: 1349480 - RNA, 22 nt, Human
cagcagagugggacaguccacg

SEQ ID NO: 1349481 - RNA, 20 nt, Human
ccacgagcaguagagcagca

SEQ ID NO: 1349482 - RNA, 18 nt, Human
ccuagaauaagugagaaa

SEQ ID NO: 1349483 - RNA, 22 nt, Human
ccugcaagucacaguccccgga

SEQ ID NO: 1349484 - RNA, 19 nt, Human
gagaaagugggggaaaggg

SEQ ID NO: 1349485 - RNA, 21 nt, Human
ggacccugcaagucacagucc

SEQ ID NO: 1349486 - RNA, 23 nt, Human
ggacccugcaagucacagucccc

SEQ ID NO: 1349487 - RNA, 24 nt, Human
ucccaaguaccuagaauaagugag

SEQ ID NO: 1349488 - RNA, 18 nt, Human
uccguggucuccagcugg

SEQ ID NO: 1349489 - RNA, 19 nt, Human
aucacugucauuaccccgg

SEQ ID NO: 1349490 - RNA, 21 nt, Human
cacacugcauaauuuuuugca

SEQ ID NO: 1349491 - RNA, 20 nt, Human
caccucugaaguucaguagc

SEQ ID NO: 1349492 - RNA, 25 nt, Human
cagcccagagcgcagcguugcgcag

SEQ ID NO: 1349493 - RNA, 20 nt, Human
caucacugucauuaccccgg

SEQ ID NO: 1349494 - RNA, 23 nt, Human
ccaauagcuggugugcuuuuucu

SEQ ID NO: 1349495 - RNA, 21 nt, Human
cccacugcccacgcugugcca

SEQ ID NO: 1349496 - RNA, 21 nt, Human
ccccacugcccacgcugugcc

SEQ ID NO: 1349497 - RNA, 18 nt, Human
ccccggaaguccucgauc

SEQ ID NO: 1349498 - RNA, 18 nt, Human
ccuguaggccccacugcc

SEQ ID NO: 1349499 - RNA, 20 nt, Human
ccuguaggccccacugccca

SEQ ID NO: 1349500 - RNA, 19 nt, Human
ccugucagcccagagcgca

SEQ ID NO: 1349501 - RNA, 19 nt, Human
cggaaguccucgaucacca

SEQ ID NO: 1349502 - RNA, 23 nt, Human
cguuuuauccgccugucagccca

SEQ ID NO: 1349503 - RNA, 19 nt, Human
gagcgcagcguugcgcagu

SEQ ID NO: 1349504 - RNA, 21 nt, Human
gcuggugugcuuuuucucagu

SEQ ID NO: 1349505 - RNA, 22 nt, Human
uaccccggaaguccucgaucac

SEQ ID NO: 1349506 - RNA, 21 nt, Human
uacgccgggaucucuguagac

SEQ ID NO: 1349507 - RNA, 21 nt, Human
ucaccuucugucaucuuaaga

SEQ ID NO: 1349508 - RNA, 18 nt, Human
ucacugucauuaccccgg

SEQ ID NO: 1349509 - RNA, 23 nt, Human
ucagucuugaugggaccguuuua

SEQ ID NO: 1349510 - RNA, 24 nt, Human
uuauccgccugucagcccagagcg

SEQ ID NO: 1349511 - RNA, 22 nt, Human
uuauuagucuuuuuauucuucu

SEQ ID NO: 1349512 - RNA, 19 nt, Human
aaaccgcacuuugugcuuc

SEQ ID NO: 1349513 - RNA, 18 nt, Human
aacacagaaaagcuagca

SEQ ID NO: 1349514 - RNA, 21 nt, Human
aacacccuaaccuuggguaac

SEQ ID NO: 1349515 - RNA, 20 nt, Human
aagcacagauauacucuggg

SEQ ID NO: 1349516 - RNA, 18 nt, Human
acagugcugugggcugag

SEQ ID NO: 1349517 - RNA, 19 nt, Human
agauggacaaaggcuuggg

SEQ ID NO: 1349518 - RNA, 20 nt, Human
agccagcgcgugcaggcugg

SEQ ID NO: 1349519 - RNA, 21 nt, Human
agccaggcgcccauuucugcc

SEQ ID NO: 1349520 - RNA, 18 nt, Human
agccguugagaccugaag

SEQ ID NO: 1349521 - RNA, 21 nt, Human
agcugguggggaaaguugggg

SEQ ID NO: 1349522 - RNA, 21 nt, Human
agcugugcagcuacgcaccuc

SEQ ID NO: 1349523 - RNA, 21 nt, Human
aggagaagaagauucuggcaa

SEQ ID NO: 1349524 - RNA, 18 nt, Human
aggcccuccaccccaaug

SEQ ID NO: 1349525 - RNA, 19 nt, Human
aggccuccagucaggcagc

SEQ ID NO: 1349526 - RNA, 19 nt, Human
aggggaccugguucuugug

SEQ ID NO: 1349527 - RNA, 22 nt, Human
aguagaauuuccaagguccugg

SEQ ID NO: 1349528 - RNA, 23 nt, Human
auggggcuaacaggagcggggag

SEQ ID NO: 1349529 - RNA, 21 nt, Human
caaacggcacuuaaacccccc

SEQ ID NO: 1349530 - RNA, 20 nt, Human
caacacagaaaagcuagcaa

SEQ ID NO: 1349531 - RNA, 20 nt, Human
caacagaaggaccaacaggc

SEQ ID NO: 1349532 - RNA, 28 nt, Human
caagguccuggguuaggcauuuuggggg

SEQ ID NO: 1349533 - RNA, 23 nt, Human
cagcaacagaaacuggcggccag

SEQ ID NO: 1349534 - RNA, 24 nt, Human
cagcagcacaggguggcagcagag

SEQ ID NO: 1349535 - RNA, 18 nt, Human
cagcuacgcaccucagca

SEQ ID NO: 1349536 - RNA, 25 nt, Human
cagcuacgcaccucagcagcacagg

SEQ ID NO: 1349537 - RNA, 18 nt, Human
caguagcuccaaacaggg

SEQ ID NO: 1349538 - RNA, 21 nt, Human
cauuaaacgaagcugcagguu

SEQ ID NO: 1349539 - RNA, 20 nt, Human
ccaaauauuagacaccaaca

SEQ ID NO: 1349540 - RNA, 19 nt, Human
ccaagguccuggguuaggc

SEQ ID NO: 1349541 - RNA, 21 nt, Human
ccagaagcugcggccucuccu

SEQ ID NO: 1349542 - RNA, 21 nt, Human
cccacccuacccaaauauuag

SEQ ID NO: 1349543 - RNA, 26 nt, Human
cccccagcugugcagcuacgcaccuc

SEQ ID NO: 1349544 - RNA, 20 nt, Human
ccccugagagauaagaccuc

SEQ ID NO: 1349545 - RNA, 24 nt, Human
cccuccaccccaaugugcuggaag

SEQ ID NO: 1349546 - RNA, 24 nt, Human
ccuuccuucaacacccuaaccuug

SEQ ID NO: 1349547 - RNA, 26 nt, Human
ccuuuaauuuugucaccauaaacauu

SEQ ID NO: 1349548 - RNA, 19 nt, Human
cggccagcccggcagcccc

SEQ ID NO: 1349549 - RNA, 24 nt, Human
cgguccagcuucucagcccaugcu

SEQ ID NO: 1349550 - RNA, 25 nt, Human
cuaccuuccuucaacacccuaaccu

SEQ ID NO: 1349551 - RNA, 22 nt, Human
cucaggacucuuccccuacaaa

SEQ ID NO: 1349552 - RNA, 21 nt, Human
cuccuccuugcugccgccaac

SEQ ID NO: 1349553 - RNA, 20 nt, Human
cugggccaagagaagagggg

SEQ ID NO: 1349554 - RNA, 23 nt, Human
cuggguuaggcauuuuggggggc

SEQ ID NO: 1349555 - RNA, 18 nt, Human
cugugcagcuacgcaccu

SEQ ID NO: 1349556 - RNA, 18 nt, Human
cuuggaaggccuccaguc

SEQ ID NO: 1349557 - RNA, 19 nt, Human
cuuggaaggccuccaguca

SEQ ID NO: 1349558 - RNA, 18 nt, Human
gaagccccacccucuacc

SEQ ID NO: 1349559 - RNA, 20 nt, Human
gaaguggggggaaccaggcu

SEQ ID NO: 1349560 - RNA, 21 nt, Human
gagaagaagauucuggcaaug

SEQ ID NO: 1349561 - RNA, 20 nt, Human
gagcugguggggaaaguugg

SEQ ID NO: 1349562 - RNA, 19 nt, Human
gaguggaaguggggggaac

SEQ ID NO: 1349563 - RNA, 21 nt, Human
gcaacagaaggaccaacaggc

SEQ ID NO: 1349564 - RNA, 19 nt, Human
gcagcagagagccacauua

SEQ ID NO: 1349565 - RNA, 19 nt, Human
gccccucaggacucuuccc

SEQ ID NO: 1349566 - RNA, 18 nt, Human
gccgguccagcuucucag

SEQ ID NO: 1349567 - RNA, 18 nt, Human
gcggcugucacccggagc

SEQ ID NO: 1349568 - RNA, 19 nt, Human
gcugugggcugaggggacc

SEQ ID NO: 1349569 - RNA, 23 nt, Human
gcuugggaaaccgcacuuugugc

SEQ ID NO: 1349570 - RNA, 24 nt, Human
ggaaggccuccagucaggcagccc

SEQ ID NO: 1349571 - RNA, 19 nt, Human
ggaaguggggggaaccagg

SEQ ID NO: 1349572 - RNA, 22 nt, Human
ggagagggacgccccagccccc

SEQ ID NO: 1349573 - RNA, 22 nt, Human
ggagcugguggggaaaguugga

SEQ ID NO: 1349574 - RNA, 18 nt, Human
ggaugaguagaauuucca

SEQ ID NO: 1349575 - RNA, 19 nt, Human
ggggaguggaagugggggg

SEQ ID NO: 1349576 - RNA, 20 nt, Human
ggggcuuagagaugggaaac

SEQ ID NO: 1349577 - RNA, 19 nt, Human
gggguaggggaaaguuggg

SEQ ID NO: 1349578 - RNA, 20 nt, Human
ggguagggcucagggggccg

SEQ ID NO: 1349579 - RNA, 19 nt, Human
gugggcugaggggaccugg

SEQ ID NO: 1349580 - RNA, 18 nt, Human
uaaaagguaagagggggg

SEQ ID NO: 1349581 - RNA, 19 nt, Human
uaagaccucccuuagcuca

SEQ ID NO: 1349582 - RNA, 24 nt, Human
uacccaaauauuagacaccaacac

SEQ ID NO: 1349583 - RNA, 24 nt, Human
uagacaccaacacagaaaagcuag

SEQ ID NO: 1349584 - RNA, 20 nt, Human
uaucucaggggaccugauug

SEQ ID NO: 1349585 - RNA, 23 nt, Human
ucaacaccugcugcuguggggca

SEQ ID NO: 1349586 - RNA, 23 nt, Human
ucagccaggcgcccauuucugcc

SEQ ID NO: 1349587 - RNA, 18 nt, Human
ucccccacccuacccaaa

SEQ ID NO: 1349588 - RNA, 18 nt, Human
ucccccacccuacccaaa

SEQ ID NO: 1349589 - RNA, 18 nt, Human
ucccuguauaaguccaga

SEQ ID NO: 1349590 - RNA, 23 nt, Human
uccugauaaaagguaagaggggg

SEQ ID NO: 1349591 - RNA, 19 nt, Human
uccuugcugccgccaacug

SEQ ID NO: 1349592 - RNA, 22 nt, Human
ucggcucugcuccagaagcugc

SEQ ID NO: 1349593 - RNA, 18 nt, Human
ucuaggugugucucaacu

SEQ ID NO: 1349594 - RNA, 22 nt, Human
ucuuguguguugccccucagga

SEQ ID NO: 1349595 - RNA, 18 nt, Human
ugccuaggaaucagccag

SEQ ID NO: 1349596 - RNA, 20 nt, Human
ugccuaggaaucagccaggc

SEQ ID NO: 1349597 - RNA, 23 nt, Human
ugcuguggggcaccucagugggg

SEQ ID NO: 1349598 - RNA, 19 nt, Human
ugcuucgucucggcucugc

SEQ ID NO: 1349599 - RNA, 19 nt, Human
uggcagcagagagccacau

SEQ ID NO: 1349600 - RNA, 19 nt, Human
ugggacccagugaggcagg

SEQ ID NO: 1349601 - RNA, 23 nt, Human
ugggaugaguagaauuuccaagg

SEQ ID NO: 1349602 - RNA, 23 nt, Human
uguggagcugguggggaaaguug

SEQ ID NO: 1349603 - RNA, 20 nt, Human
uugcugccgccaacugccua

SEQ ID NO: 1349604 - RNA, 21 nt, Human
uugggaugaguagaauuucca

SEQ ID NO: 1349605 - RNA, 18 nt, Human
uuggugccgguccagcuu

SEQ ID NO: 1349606 - RNA, 22 nt, Human
uuuccaagguccuggguuaggc

SEQ ID NO: 1349607 - RNA, 19 nt, Human
cacuaugagaaaacaggau

SEQ ID NO: 1349608 - RNA, 22 nt, Human
caucaaaugugaguuuacacua

SEQ ID NO: 1349609 - RNA, 19 nt, Human
ggaaauguucggggccuga

SEQ ID NO: 1349610 - RNA, 22 nt, Human
ggaaauguucggggccugaacc

SEQ ID NO: 1349611 - RNA, 20 nt, Human
ggccugaacauguuuguuuc

SEQ ID NO: 1349612 - RNA, 21 nt, Human
ugagaaaacaggauuugacaa

SEQ ID NO: 1349613 - RNA, 26 nt, Human
ugguuacuuuccuucauaaaaacaca

SEQ ID NO: 1349614 - RNA, 22 nt, Human
acacugcugaccucaggugaac

SEQ ID NO: 1349615 - RNA, 23 nt, Human
cuguucuaggugucuugccaagg

SEQ ID NO: 1349616 - RNA, 18 nt, Human
cuucacacugcugaccuc

SEQ ID NO: 1349617 - RNA, 20 nt, Human
ggggugggcuggaguagggg

SEQ ID NO: 1349618 - RNA, 24 nt, Human
guccagggucuguucuaggugucu

SEQ ID NO: 1349619 - RNA, 25 nt, Human
ucuguucuaggugucuugccaaggg

SEQ ID NO: 1349620 - RNA, 20 nt, Human
uggaguagggguaugguagu

SEQ ID NO: 1349621 - RNA, 19 nt, Human
aaagugcugggauuacagg

SEQ ID NO: 1349622 - RNA, 22 nt, Human
aaagugcugggauuacaggcga

SEQ ID NO: 1349623 - RNA, 21 nt, Human
aagcaaacagcugcuccuuuc

SEQ ID NO: 1349624 - RNA, 21 nt, Human
aagcaggucaauagagucagg

SEQ ID NO: 1349625 - RNA, 20 nt, Human
aagcucauccaguuaguuuu

SEQ ID NO: 1349626 - RNA, 21 nt, Human
aaguccuguucugagcuuagc

SEQ ID NO: 1349627 - RNA, 18 nt, Human
aagugcugggauuacagg

SEQ ID NO: 1349628 - RNA, 19 nt, Human
aagugcugggauuacaggc

SEQ ID NO: 1349629 - RNA, 26 nt, Human
aagugcugggauuacaggcgagagcc

SEQ ID NO: 1349630 - RNA, 23 nt, Human
aauaacaaucuacuuuucagagu

SEQ ID NO: 1349631 - RNA, 22 nt, Human
aauuucuauucucugucaucuc

SEQ ID NO: 1349632 - RNA, 19 nt, Human
aauuuuuuucuuugucugu

SEQ ID NO: 1349633 - RNA, 20 nt, Human
acugcaagcuccgccuccca

SEQ ID NO: 1349634 - RNA, 27 nt, Human
agacacuggcaaguccuguucugagcu

SEQ ID NO: 1349635 - RNA, 19 nt, Human
agccaccgcacccggccua

SEQ ID NO: 1349636 - RNA, 18 nt, Human
aggcgccugccacuaagc

SEQ ID NO: 1349637 - RNA, 22 nt, Human
aggcgccugccacuaagcccgg

SEQ ID NO: 1349638 - RNA, 25 nt, Human
aggcuggagugcaguggcgcgaucu

SEQ ID NO: 1349639 - RNA, 18 nt, Human
aguagcugggacuauagg

SEQ ID NO: 1349640 - RNA, 20 nt, Human
agugcaguggcgcgaucucg

SEQ ID NO: 1349641 - RNA, 23 nt, Human
agugcaguggcgcgaucucggcu

SEQ ID NO: 1349642 - RNA, 24 nt, Human
agugcaguggcgcgaucucggcuc

SEQ ID NO: 1349643 - RNA, 18 nt, Human
agugcugggauuacaggc

SEQ ID NO: 1349644 - RNA, 20 nt, Human
auaacaaucuacuuuucaga

SEQ ID NO: 1349645 - RNA, 25 nt, Human
aucuccacuguacuauuaagcucau

SEQ ID NO: 1349646 - RNA, 20 nt, Human
augggcuuucacuguguuag

SEQ ID NO: 1349647 - RNA, 19 nt, Human
auucuauugaucuguccuc

SEQ ID NO: 1349648 - RNA, 22 nt, Human
auuucuucacugagaauuucca

SEQ ID NO: 1349649 - RNA, 24 nt, Human
auuuuuguauuuuuaguagagaug

SEQ ID NO: 1349650 - RNA, 27 nt, Human
caaagugcugggauuacaggcgagagc

SEQ ID NO: 1349651 - RNA, 22 nt, Human
cacgcccuucuccugccucagc

SEQ ID NO: 1349652 - RNA, 24 nt, Human
cacuaagcccggcuaauuuuugua

SEQ ID NO: 1349653 - RNA, 18 nt, Human
cacuguguuagccaggau

SEQ ID NO: 1349654 - RNA, 19 nt, Human
cacuguguuagccaggaug

SEQ ID NO: 1349655 - RNA, 24 nt, Human
cacuguguuagccaggauggucuc

SEQ ID NO: 1349656 - RNA, 20 nt, Human
cauuguuucucccuggcugc

SEQ ID NO: 1349657 - RNA, 19 nt, Human
cauuuguuacuuugccagc

SEQ ID NO: 1349658 - RNA, 19 nt, Human
ccaaagugcugggauuaca

SEQ ID NO: 1349659 - RNA, 22 nt, Human
ccaaagugcugggauuacaggc

SEQ ID NO: 1349660 - RNA, 23 nt, Human
ccaaagugcugggauuacaggcg

SEQ ID NO: 1349661 - RNA, 19 nt, Human
ccagcgauccguacuuguc

SEQ ID NO: 1349662 - RNA, 21 nt, Human
ccaugcaggguuaagcagguc

SEQ ID NO: 1349663 - RNA, 19 nt, Human
ccaugcauuguuucucccu

SEQ ID NO: 1349664 - RNA, 22 nt, Human
ccaugcauuguuucucccuggc

SEQ ID NO: 1349665 - RNA, 22 nt, Human
cccacacgcuccccuacgacca

SEQ ID NO: 1349666 - RNA, 19 nt, Human
cccgaguagcugggacuau

SEQ ID NO: 1349667 - RNA, 24 nt, Human
cccgaguagcugggacuauaggcg

SEQ ID NO: 1349668 - RNA, 19 nt, Human
ccgcuucugaggcucccaa

SEQ ID NO: 1349669 - RNA, 22 nt, Human
ccuacgaccaucuggagacaag

SEQ ID NO: 1349670 - RNA, 19 nt, Human
ccucaauuucuauucucug

SEQ ID NO: 1349671 - RNA, 24 nt, Human
ccucccagguucacgcccuucucc

SEQ ID NO: 1349672 - RNA, 28 nt, Human
ccugaccucgugauccgccagccucggc

SEQ ID NO: 1349673 - RNA, 23 nt, Human
ccugccucagccucccgaguagc

SEQ ID NO: 1349674 - RNA, 24 nt, Human
cgcccaggcuggagugcaguggcg

SEQ ID NO: 1349675 - RNA, 21 nt, Human
cgccucccagguucacgcccu

SEQ ID NO: 1349676 - RNA, 18 nt, Human
cguagagucccagcgauc

SEQ ID NO: 1349677 - RNA, 24 nt, Human
cgugauccgccagccucggccucc

SEQ ID NO: 1349678 - RNA, 24 nt, Human
cucagccucccgaguagcugggac

SEQ ID NO: 1349679 - RNA, 24 nt, Human
cuccugaccucgugauccgccagc

SEQ ID NO: 1349680 - RNA, 24 nt, Human
cuccuuguugguaguagcugagga

SEQ ID NO: 1349681 - RNA, 23 nt, Human
cucugucgcccaggcuggagugc

SEQ ID NO: 1349682 - RNA, 19 nt, Human
cugaggagccaggugccuu

SEQ ID NO: 1349683 - RNA, 24 nt, Human
cugcaagcuccgccucccagguuc

SEQ ID NO: 1349684 - RNA, 23 nt, Human
cugccucagccucccgaguagcu

SEQ ID NO: 1349685 - RNA, 19 nt, Human
cuguggacucucugagggc

SEQ ID NO: 1349686 - RNA, 22 nt, Human
cuuuaugccccacacgcucccc

SEQ ID NO: 1349687 - RNA, 22 nt, Human
gaccucgugauccgccagccuc

SEQ ID NO: 1349688 - RNA, 22 nt, Human
gaccucgugauccgccagccuc

SEQ ID NO: 1349689 - RNA, 24 nt, Human
gaccucgugauccgccagccucgg

SEQ ID NO: 1349690 - RNA, 18 nt, Human
gauuacaggcgagagcca

SEQ ID NO: 1349691 - RNA, 22 nt, Human
gcaagcuccgccucccagguuc

SEQ ID NO: 1349692 - RNA, 19 nt, Human
gcccaggcuggagugcagu

SEQ ID NO: 1349693 - RNA, 20 nt, Human
gcccaggcuggagugcagug

SEQ ID NO: 1349694 - RNA, 22 nt, Human
gcccggcuaauuuuuguauuuu

SEQ ID NO: 1349695 - RNA, 24 nt, Human
gcuccuuuccauccuuccccccca

SEQ ID NO: 1349696 - RNA, 20 nt, Human
gcugaggagccaggugccuu

SEQ ID NO: 1349697 - RNA, 19 nt, Human
gcuggagugcaguggcgcg

SEQ ID NO: 1349698 - RNA, 18 nt, Human
ggaguucucucagccucu

SEQ ID NO: 1349699 - RNA, 24 nt, Human
ggauggucucaaucuccugaccuc

SEQ ID NO: 1349700 - RNA, 24 nt, Human
gugauccgccagccucggccuccc

SEQ ID NO: 1349701 - RNA, 22 nt, Human
guuagguauguuacaugccauu

SEQ ID NO: 1349702 - RNA, 20 nt, Human
guucuuuuuuguuaauuccu

SEQ ID NO: 1349703 - RNA, 21 nt, Human
guuucuauuuuuugccaaaug

SEQ ID NO: 1349704 - RNA, 23 nt, Human
uaagaagagaucugcuagugaca

SEQ ID NO: 1349705 - RNA, 24 nt, Human
uaauuuuuguauuuuuaguagaga

SEQ ID NO: 1349706 - RNA, 23 nt, Human
uacaggcgagagccaccgcaccc

SEQ ID NO: 1349707 - RNA, 21 nt, Human
uaccugaacuggaggcauggc

SEQ ID NO: 1349708 - RNA, 21 nt, Human
uacgaccaucuggagacaaga

SEQ ID NO: 1349709 - RNA, 19 nt, Human
uagagucagguuacuuuuc

SEQ ID NO: 1349710 - RNA, 20 nt, Human
uagcaggcagcccccuuuag

SEQ ID NO: 1349711 - RNA, 20 nt, Human
uaggaugucaaugcuauaaa

SEQ ID NO: 1349712 - RNA, 19 nt, Human
uaggcgccugccacuaagc

SEQ ID NO: 1349713 - RNA, 23 nt, Human
uaggcgccugccacuaagcccgg

SEQ ID NO: 1349714 - RNA, 20 nt, Human
uaguagagaugggcuuucac

SEQ ID NO: 1349715 - RNA, 24 nt, Human
uaguagagaugggcuuucacugug

SEQ ID NO: 1349716 - RNA, 24 nt, Human
uauagagcuucuccuguuguugac

SEQ ID NO: 1349717 - RNA, 19 nt, Human
uaucuggauauuuugguua

SEQ ID NO: 1349718 - RNA, 20 nt, Human
uaugcugccauucaaauggg

SEQ ID NO: 1349719 - RNA, 19 nt, Human
uauuuauuuauuuuuugag

SEQ ID NO: 1349720 - RNA, 22 nt, Human
uauuuauuuuuugagacagucu

SEQ ID NO: 1349721 - RNA, 20 nt, Human
ucacagcacuuuaugcccca

SEQ ID NO: 1349722 - RNA, 20 nt, Human
ucacgcccuucuccugccuc

SEQ ID NO: 1349723 - RNA, 18 nt, Human
ucacugcaagcuccgccu

SEQ ID NO: 1349724 - RNA, 19 nt, Human
ucacugcaagcuccgccuc

SEQ ID NO: 1349725 - RNA, 19 nt, Human
ucacugcaagcuccgccuc

SEQ ID NO: 1349726 - RNA, 24 nt, Human
ucacugcaagcuccgccucccagg

SEQ ID NO: 1349727 - RNA, 24 nt, Human
ucacuguguuagccaggauggucu

SEQ ID NO: 1349728 - RNA, 23 nt, Human
ucagccucccgaguagcugggac

SEQ ID NO: 1349729 - RNA, 24 nt, Human
ucccaaagugcugggauuacaggc

SEQ ID NO: 1349730 - RNA, 21 nt, Human
ucccagguucacgcccuucuc

SEQ ID NO: 1349731 - RNA, 24 nt, Human
ucccagguucacgcccuucuccug

SEQ ID NO: 1349732 - RNA, 21 nt, Human
uccccuacgaccaucuggaga

SEQ ID NO: 1349733 - RNA, 24 nt, Human
ucccgaguagcugggacuauaggc

SEQ ID NO: 1349734 - RNA, 23 nt, Human
uccgccucccagguucacgcccu

SEQ ID NO: 1349735 - RNA, 19 nt, Human
uccgcugucuuugguuagg

SEQ ID NO: 1349736 - RNA, 24 nt, Human
ucgcccaggcuggagugcaguggc

SEQ ID NO: 1349737 - RNA, 18 nt, Human
ucggccucccaaagugcu

SEQ ID NO: 1349738 - RNA, 18 nt, Human
ucuauuuuuugccaaaug

SEQ ID NO: 1349739 - RNA, 19 nt, Human
ucuccaaacugcucggcca

SEQ ID NO: 1349740 - RNA, 24 nt, Human
ucuccugccucagccucccgagua

SEQ ID NO: 1349741 - RNA, 23 nt, Human
ucugcuuucucccuuguucuuuc

SEQ ID NO: 1349742 - RNA, 24 nt, Human
ucugucgcccaggcuggagugcag

SEQ ID NO: 1349743 - RNA, 23 nt, Human
ucuugcucugucgcccaggcugg

SEQ ID NO: 1349744 - RNA, 24 nt, Human
ucuugcucugucgcccaggcugga

SEQ ID NO: 1349745 - RNA, 29 nt, Human
ugaaaaguucacagcacuuuaugcccccu

SEQ ID NO: 1349746 - RNA, 24 nt, Human
ugaaauauaguuucaccagauaca

SEQ ID NO: 1349747 - RNA, 28 nt, Human
ugacagaguccgcugucuuugguuaggu

SEQ ID NO: 1349748 - RNA, 22 nt, Human
ugcaguggcgcgaucucggcuc

SEQ ID NO: 1349749 - RNA, 24 nt, Human
ugccucagccucccgaguagcugg

SEQ ID NO: 1349750 - RNA, 19 nt, Human
ugcuauaaauguuggaucu

SEQ ID NO: 1349751 - RNA, 24 nt, Human
ugcucugucgcccaggcuggagug

SEQ ID NO: 1349752 - RNA, 24 nt, Human
ugcugggauuacaggcgagagcca

SEQ ID NO: 1349753 - RNA, 23 nt, Human
uggagugcaguggcgcgaucucg

SEQ ID NO: 1349754 - RNA, 24 nt, Human
uggagugcaguggcgcgaucucgg

SEQ ID NO: 1349755 - RNA, 21 nt, Human
ugggacuauaggcgccugcca

SEQ ID NO: 1349756 - RNA, 22 nt, Human
ugggacuauaggcgccugccac

SEQ ID NO: 1349757 - RNA, 22 nt, Human
ugggacuauaggcgccugccac

SEQ ID NO: 1349758 - RNA, 24 nt, Human
ugggacuauaggcgccugccacua

SEQ ID NO: 1349759 - RNA, 19 nt, Human
ugggauuacaggcgagagc

SEQ ID NO: 1349760 - RNA, 21 nt, Human
ugggauuacaggcgagagcca

SEQ ID NO: 1349761 - RNA, 22 nt, Human
ugggauuacaggcgagagccac

SEQ ID NO: 1349762 - RNA, 23 nt, Human
ugggauuacaggcgagagccacc

SEQ ID NO: 1349763 - RNA, 24 nt, Human
ugggauuacaggcgagagccaccg

SEQ ID NO: 1349764 - RNA, 24 nt, Human
ugggcuuucacuguguuagccagg

SEQ ID NO: 1349765 - RNA, 24 nt, Human
ugguuacuuuaaaaugcuuuucag

SEQ ID NO: 1349766 - RNA, 24 nt, Human
uguccucaauuucuauucucuguc

SEQ ID NO: 1349767 - RNA, 21 nt, Human
ugucuggaugguguuucaggg

SEQ ID NO: 1349768 - RNA, 19 nt, Human
ugucuguaguuuucagaaa

SEQ ID NO: 1349769 - RNA, 24 nt, Human
uguuugguuugucucccgcuucug

SEQ ID NO: 1349770 - RNA, 18 nt, Human
uuaguagagaugggcuuu

SEQ ID NO: 1349771 - RNA, 21 nt, Human
uuaguagagaugggcuuucac

SEQ ID NO: 1349772 - RNA, 23 nt, Human
uuaguagagaugggcuuucacug

SEQ ID NO: 1349773 - RNA, 24 nt, Human
uuaguagagaugggcuuucacugu

SEQ ID NO: 1349774 - RNA, 20 nt, Human
uuauuuauuuauuuauuuuu

SEQ ID NO: 1349775 - RNA, 21 nt, Human
uucacuguguuagccaggaug

SEQ ID NO: 1349776 - RNA, 23 nt, Human
uucauuugaugcucccuuaugca

SEQ ID NO: 1349777 - RNA, 18 nt, Human
uuccauuuuuuuuuacuu

SEQ ID NO: 1349778 - RNA, 24 nt, Human
uuccuuucuuucgaagaacuuccu

SEQ ID NO: 1349779 - RNA, 18 nt, Human
uucugaggcucccaacac

SEQ ID NO: 1349780 - RNA, 20 nt, Human
uucugcuuucucccuuguuc

SEQ ID NO: 1349781 - RNA, 21 nt, Human
uucuuugucuguaguuuucag

SEQ ID NO: 1349782 - RNA, 23 nt, Human
uugagacagucuugcucugucgc

SEQ ID NO: 1349783 - RNA, 24 nt, Human
uugcucugucgcccaggcuggagu

SEQ ID NO: 1349784 - RNA, 18 nt, Human
uuguuucacucuucuccu

SEQ ID NO: 1349785 - RNA, 19 nt, Human
uuuaaacuucucaguagca

SEQ ID NO: 1349786 - RNA, 19 nt, Human
uuucacuguguuagccagg

SEQ ID NO: 1349787 - RNA, 19 nt, Human
uuucagggccaauuuucca

SEQ ID NO: 1349788 - RNA, 24 nt, Human
uuucugcuuucucccuuguucuuu

SEQ ID NO: 1349789 - RNA, 18 nt, Human
uuucuuggcauugauugc

SEQ ID NO: 1349790 - RNA, 24 nt, Human
uuuucuguugacaguucuucucuu

SEQ ID NO: 1349791 - RNA, 19 nt, Human
uuuugguucuauaguuucc

SEQ ID NO: 1349792 - RNA, 24 nt, Human
uuuuuaguagagaugggcuuucac

SEQ ID NO: 1349793 - RNA, 23 nt, Human
uuuuugguucuauaguuuccauu

SEQ ID NO: 1349794 - RNA, 20 nt, Human
uuuuuguauuuuuaguagag

SEQ ID NO: 1349795 - RNA, 18 nt, Human
uuuuuuuuuuuuuuuuug

SEQ ID NO: 1349796 - RNA, 22 nt, Human
aagaauauggaggaguaaguac

SEQ ID NO: 1349797 - RNA, 24 nt, Human
acaagaaacauuuuauucucucca

SEQ ID NO: 1349798 - RNA, 18 nt, Human
acacaauuccuuuaaaug

SEQ ID NO: 1349799 - RNA, 25 nt, Human
accccagaaucucccaacuaguccu

SEQ ID NO: 1349800 - RNA, 18 nt, Human
agacacagacucucagac

SEQ ID NO: 1349801 - RNA, 23 nt, Human
agagggagcaggaggagcuggag

SEQ ID NO: 1349802 - RNA, 20 nt, Human
agcaggaggagcuggagaag

SEQ ID NO: 1349803 - RNA, 24 nt, Human
cagagggagcaggaggagcuggag

SEQ ID NO: 1349804 - RNA, 26 nt, Human
cauuuuauucucuccauucugcucca

SEQ ID NO: 1349805 - RNA, 19 nt, Human
ccaacuaguccucgaauua

SEQ ID NO: 1349806 - RNA, 25 nt, Human
cuggcagcucuccgcagcucucucu

SEQ ID NO: 1349807 - RNA, 25 nt, Human
gcggaacacgcccggugcagcuggc

SEQ ID NO: 1349808 - RNA, 19 nt, Human
gcuccaaacugccucuccu

SEQ ID NO: 1349809 - RNA, 26 nt, Human
uaaaaccuaagaaacuccagaaauuu

SEQ ID NO: 1349810 - RNA, 20 nt, Human
uaacuucaggaucuuagucu

SEQ ID NO: 1349811 - RNA, 19 nt, Human
uaccccagaaucucccaac

SEQ ID NO: 1349812 - RNA, 24 nt, Human
uaccccagaaucucccaacuaguc

SEQ ID NO: 1349813 - RNA, 22 nt, Human
uaggguaccuagaaaagguuuc

SEQ ID NO: 1349814 - RNA, 18 nt, Human
ucaggaucuuagucucag

SEQ ID NO: 1349815 - RNA, 18 nt, Human
uccaaacugccucuccuc

SEQ ID NO: 1349816 - RNA, 21 nt, Human
uccaaacugccucuccucacu

SEQ ID NO: 1349817 - RNA, 18 nt, Human
ucucccaacuaguccucg

SEQ ID NO: 1349818 - RNA, 19 nt, Human
ucugcuccaaacugccucu

SEQ ID NO: 1349819 - RNA, 18 nt, Human
ugaaagaauauggaggag

SEQ ID NO: 1349820 - RNA, 20 nt, Human
ugaaagaauauggaggagua

SEQ ID NO: 1349821 - RNA, 26 nt, Human
ugaaucaauaaaaccuaagaaacucc

SEQ ID NO: 1349822 - RNA, 21 nt, Human
ugccuacagcugcggaacacg

SEQ ID NO: 1349823 - RNA, 24 nt, Human
uggcagcucuccgcagcucucucu

SEQ ID NO: 1349824 - RNA, 19 nt, Human
uuaccccagaaucucccaa

SEQ ID NO: 1349825 - RNA, 18 nt, Human
uugaaagaauauggagga

SEQ ID NO: 1349826 - RNA, 19 nt, Human
ugcaacaggccaggaaacc

SEQ ID NO: 1349827 - RNA, 24 nt, Human
cagggaagagggcgccgagccucg

SEQ ID NO: 1349828 - RNA, 21 nt, Human
ccucgccgccgccgccgcuac

SEQ ID NO: 1349829 - RNA, 24 nt, Human
cgccgagccucgccgccgccgccg

SEQ ID NO: 1349830 - RNA, 24 nt, Human
cggcgcucgcucgcucucucgcuc

SEQ ID NO: 1349831 - RNA, 18 nt, Human
cuccucgcucccggcccc

SEQ ID NO: 1349832 - RNA, 21 nt, Human
ucgccgccgccgccgcuaccg

SEQ ID NO: 1349833 - RNA, 27 nt, Human
ucgccgccgccgccgcuaccgcuccgg

SEQ ID NO: 1349834 - RNA, 18 nt, Human
aauccauaaguucuccuu

SEQ ID NO: 1349835 - RNA, 26 nt, Human
acagcaaugagaagacuaucuguguc

SEQ ID NO: 1349836 - RNA, 22 nt, Human
acaguuuucuucuuggaacugu

SEQ ID NO: 1349837 - RNA, 18 nt, Human
accaaugucugcuacauu

SEQ ID NO: 1349838 - RNA, 18 nt, Human
agucuugggugggucuag

SEQ ID NO: 1349839 - RNA, 18 nt, Human
agugaucugguguguaac

SEQ ID NO: 1349840 - RNA, 18 nt, Human
aguucagaaucuucuuuc

SEQ ID NO: 1349841 - RNA, 23 nt, Human
auaacuuuauagauuugccuccu

SEQ ID NO: 1349842 - RNA, 18 nt, Human
auaagucuuggguggguc

SEQ ID NO: 1349843 - RNA, 18 nt, Human
auaaguucuccuucucga

SEQ ID NO: 1349844 - RNA, 24 nt, Human
augaaacaucuuucacacaacccu

SEQ ID NO: 1349845 - RNA, 19 nt, Human
auguuacaaucaaaaccaa

SEQ ID NO: 1349846 - RNA, 20 nt, Human
caccaucuguuccuuccacu

SEQ ID NO: 1349847 - RNA, 20 nt, Human
cauaaauccaccaauaccuu

SEQ ID NO: 1349848 - RNA, 18 nt, Human
ccacgcuauucugauuua

SEQ ID NO: 1349849 - RNA, 25 nt, Human
ccugcagauguugcuccacaguguc

SEQ ID NO: 1349850 - RNA, 21 nt, Human
cucagaaacagagccugagga

SEQ ID NO: 1349851 - RNA, 24 nt, Human
cugauaaugaaaaugaugacucuu

SEQ ID NO: 1349852 - RNA, 22 nt, Human
cugcuacauuuuccacuucuuc

SEQ ID NO: 1349853 - RNA, 20 nt, Human
cuggacaggaagauaagcuc

SEQ ID NO: 1349854 - RNA, 24 nt, Human
cuuaguuucaucauucacagcuuc

SEQ ID NO: 1349855 - RNA, 23 nt, Human
gccgcaccauaaauccaccaaua

SEQ ID NO: 1349856 - RNA, 23 nt, Human
ggaagauaagcuugcacaaggag

SEQ ID NO: 1349857 - RNA, 22 nt, Human
ucagaaucuucuuucuguuccu

SEQ ID NO: 1349858 - RNA, 19 nt, Human
ucauguggggacacuaagg

SEQ ID NO: 1349859 - RNA, 22 nt, Human
uccacagugucugcaccaaaca

SEQ ID NO: 1349860 - RNA, 19 nt, Human
uccaccaauaccuggucug

SEQ ID NO: 1349861 - RNA, 21 nt, Human
ucuacauugcagaauaagauc

SEQ ID NO: 1349862 - RNA, 18 nt, Human
ucugcaccaaacacacca

SEQ ID NO: 1349863 - RNA, 24 nt, Human
ucuguaacugagucaucccugauu

SEQ ID NO: 1349864 - RNA, 18 nt, Human
ucuguuccuuccacuccc

SEQ ID NO: 1349865 - RNA, 22 nt, Human
ucuuagaccugcagauguugcu

SEQ ID NO: 1349866 - RNA, 23 nt, Human
ucuuuggauaccacuguuuuagg

SEQ ID NO: 1349867 - RNA, 18 nt, Human
ugagaagacuaucugugu

SEQ ID NO: 1349868 - RNA, 24 nt, Human
ugccgcaccauaaauccaccaaua

SEQ ID NO: 1349869 - RNA, 23 nt, Human
uggaagagugacagauucaauga

SEQ ID NO: 1349870 - RNA, 22 nt, Human
uguaacgacuucaauguuuucu

SEQ ID NO: 1349871 - RNA, 21 nt, Human
uguaggagucauuucagaguc

SEQ ID NO: 1349872 - RNA, 24 nt, Human
uguaugguuuccuuuuucucuuuu

SEQ ID NO: 1349873 - RNA, 20 nt, Human
uuauaaucuucaauuucagu

SEQ ID NO: 1349874 - RNA, 19 nt, Human
uucuuggaacuguaacugu

SEQ ID NO: 1349875 - RNA, 21 nt, Human
uuggaggccuugauucuucuu

SEQ ID NO: 1349876 - RNA, 18 nt, Human
uugggugggucuagcuuu

SEQ ID NO: 1349877 - RNA, 19 nt, Human
uugugcuacaagugaagau

SEQ ID NO: 1349878 - RNA, 22 nt, Human
uuugccgcaccauaaauccacc

SEQ ID NO: 1349879 - RNA, 22 nt, Human
aaagcagagccaacagcagaaa

SEQ ID NO: 1349880 - RNA, 23 nt, Human
aacagcagaaacaacacgaggag

SEQ ID NO: 1349881 - RNA, 22 nt, Human
accaagucuuuacacugauccu

SEQ ID NO: 1349882 - RNA, 23 nt, Human
agcagaaacaacacgaggaggaa

SEQ ID NO: 1349883 - RNA, 18 nt, Human
agguagaaagaugggagg

SEQ ID NO: 1349884 - RNA, 22 nt, Human
caaaccuaggcccacccugccc

SEQ ID NO: 1349885 - RNA, 22 nt, Human
caaagcagagccaacagcagaa

SEQ ID NO: 1349886 - RNA, 24 nt, Human
caaagcagagccaacagcagaaac

SEQ ID NO: 1349887 - RNA, 18 nt, Human
caccaagucuuuacacug

SEQ ID NO: 1349888 - RNA, 19 nt, Human
cagauucauuggaaagggc

SEQ ID NO: 1349889 - RNA, 19 nt, Human
cagcacccacaccuucugg

SEQ ID NO: 1349890 - RNA, 20 nt, Human
cagcacugaguuccacucag

SEQ ID NO: 1349891 - RNA, 18 nt, Human
cccagggcucucaaaccu

SEQ ID NO: 1349892 - RNA, 23 nt, Human
cuacaaauucuacccagccgugu

SEQ ID NO: 1349893 - RNA, 22 nt, Human
cuagcggcaacaccaagucuuu

SEQ ID NO: 1349894 - RNA, 20 nt, Human
cucaaagcagagccaacagc

SEQ ID NO: 1349895 - RNA, 18 nt, Human
cuccagcgugaagguaaa

SEQ ID NO: 1349896 - RNA, 19 nt, Human
cugaaagauugguuccuuu

SEQ ID NO: 1349897 - RNA, 23 nt, Human
cuguggaucuuuucuacaaauuc

SEQ ID NO: 1349898 - RNA, 23 nt, Human
cuuggagccccagggcucucaaa

SEQ ID NO: 1349899 - RNA, 22 nt, Human
gagccaacagcagaaacaacac

SEQ ID NO: 1349900 - RNA, 22 nt, Human
gagcucaaagcagagccaacag

SEQ ID NO: 1349901 - RNA, 20 nt, Human
gcccacccugcccguccccc

SEQ ID NO: 1349902 - RNA, 20 nt, Human
gucuuuacacugauccuaaa

SEQ ID NO: 1349903 - RNA, 18 nt, Human
uaaaaucagcugccacug

SEQ ID NO: 1349904 - RNA, 19 nt, Human
uagaaagaugggagggaag

SEQ ID NO: 1349905 - RNA, 24 nt, Human
uagaaagaugggagggaagcaccu

SEQ ID NO: 1349906 - RNA, 21 nt, Human
uccccgcagcgaucuuggcuc

SEQ ID NO: 1349907 - RNA, 18 nt, Human
ugccacugaaagauuggu

SEQ ID NO: 1349908 - RNA, 23 nt, Human
ugguguuuccccuuccaaggucu

SEQ ID NO: 1349909 - RNA, 22 nt, Human
ugucauuuaggggaguuaaaau

SEQ ID NO: 1349910 - RNA, 23 nt, Human
uguuuccccuuccaaggucuuag

SEQ ID NO: 1349911 - RNA, 20 nt, Human
uuuaggggaguuaaaauccg

SEQ ID NO: 1349912 - RNA, 23 nt, Human
uuuuuuuuuuuuuuuuuuccuuu

SEQ ID NO: 1349913 - RNA, 24 nt, Human
uuuuuuuuuuuuuuuuuuccuuuu

SEQ ID NO: 1349914 - RNA, 25 nt, Human
uuuuuuuuuuuuuuuuuuuuccuuu

SEQ ID NO: 1349915 - RNA, 25 nt, Human
uuuuuuuuuuuuuuuuuuuuuccuu

SEQ ID NO: 1349916 - RNA, 30 nt, Human; identical to SEQ ID NO: 345631

SEQ ID NO: 1349917 - RNA, 23 nt, Human
aagacagcagaacucaaaguuca

SEQ ID NO: 1349918 - RNA, 24 nt, Human
cagaacucaaaguucaaggaauuu

SEQ ID NO: 1349919 - RNA, 21 nt, Human
cagacaccuucuuccauccua

SEQ ID NO: 1349920 - RNA, 26 nt, Human
ccuuuuguucuugcugcucuugguca

SEQ ID NO: 1349921 - RNA, 23 nt, Human
cuuaucaagaaugguugaacaga

SEQ ID NO: 1349922 - RNA, 22 nt, Human
guaauuuacggucagacaccuu

SEQ ID NO: 1349923 - RNA, 24 nt, Human
uaacuuaucaagaaugguugaaca

SEQ ID NO: 1349924 - RNA, 20 nt, Human
uaccaugaagacagcagaac

SEQ ID NO: 1349925 - RNA, 23 nt, Human
uaccaugaagacagcagaacuca

SEQ ID NO: 1349926 - RNA, 18 nt, Human
uacuaggaaacauuugau

SEQ ID NO: 1349927 - RNA, 19 nt, Human
uaucaagaaugguugaaca

SEQ ID NO: 1349928 - RNA, 18 nt, Human
ucaaaugugaaccauccu

SEQ ID NO: 1349929 - RNA, 19 nt, Human
ucagacaccuucuuccauc

SEQ ID NO: 1349930 - RNA, 19 nt, Human
uccccugucuuuacucaaa

SEQ ID NO: 1349931 - RNA, 20 nt, Human
ugaaaacaaacuccccuguc

SEQ ID NO: 1349932 - RNA, 18 nt, Human
ugaaccauccucucaaga

SEQ ID NO: 1349933 - RNA, 21 nt, Human
ugaagacagcagaacucaaag

SEQ ID NO: 1349934 - RNA, 22 nt, Human
ugaagacagcagaacucaaagu

SEQ ID NO: 1349935 - RNA, 18 nt, Human
ugagcacucugacuuuuc

SEQ ID NO: 1349936 - RNA, 21 nt, Human
uguaccagaaccucaucccca

SEQ ID NO: 1349937 - RNA, 22 nt, Human
ugucauucugaaaacaaacucc

SEQ ID NO: 1349938 - RNA, 22 nt, Human
uuccauccuagaguccugaguu

SEQ ID NO: 1349939 - RNA, 21 nt, Human
uugcacugcagguguaauuua

SEQ ID NO: 1349940 - RNA, 18 nt, Human
uuuguucuugcugcucuu

SEQ ID NO: 1349941 - RNA, 22 nt, Human
aacucccuucuucaauggacua

SEQ ID NO: 1349942 - RNA, 24 nt, Human
aagaucuacaaucuagaaauggaa

SEQ ID NO: 1349943 - RNA, 21 nt, Human
acaacaacuuucaaacucccu

SEQ ID NO: 1349944 - RNA, 22 nt, Human
acuaccaaaaaucagaaagcca

SEQ ID NO: 1349945 - RNA, 24 nt, Human
agaaagccacuauaaaacccaaug

SEQ ID NO: 1349946 - RNA, 22 nt, Human
gaaauggaaccacuacucuuuu

SEQ ID NO: 1349947 - RNA, 21 nt, Human
gcaguggcgacaguggcggga

SEQ ID NO: 1349948 - RNA, 21 nt, Human
ggcaucacuggaaaguccaga

SEQ ID NO: 1349949 - RNA, 21 nt, Human
guggcaguggcgacaguggcg

SEQ ID NO: 1349950 - RNA, 22 nt, Human
uaccaaaaaucagaaagccacu

SEQ ID NO: 1349951 - RNA, 24 nt, Human
uaccaaaaaucagaaagccacuau

SEQ ID NO: 1349952 - RNA, 21 nt, Human
ucuacaaucuagaaauggaac

SEQ ID NO: 1349953 - RNA, 19 nt, Human
ucuacaaucuagaaauggg

SEQ ID NO: 1349954 - RNA, 20 nt, Human
ugaaaauggcagaauuuauc

SEQ ID NO: 1349955 - RNA, 21 nt, Human
ugaaaauggcagaauuuaucu

SEQ ID NO: 1349956 - RNA, 23 nt, Human
uggaaccacuacucuuuugacag

SEQ ID NO: 1349957 - RNA, 18 nt, Human
uggcaucacuggaaaguc

SEQ ID NO: 1349958 - RNA, 18 nt, Human
uggcgacaguggcgggag

SEQ ID NO: 1349959 - RNA, 20 nt, Human
uuaucugaagaucuacaauc

SEQ ID NO: 1349960 - RNA, 24 nt, Human
aaguggcuccuacauaauguccca

SEQ ID NO: 1349961 - RNA, 18 nt, Human
agaagaacacgaggacgc

SEQ ID NO: 1349962 - RNA, 21 nt, Human
agggcagcugugauccuugcc

SEQ ID NO: 1349963 - RNA, 21 nt, Human
augagagaagaacacgaggac

SEQ ID NO: 1349964 - RNA, 18 nt, Human
cgguaucagaaucccugg

SEQ ID NO: 1349965 - RNA, 19 nt, Human
cguggccaaaucuguccuc

SEQ ID NO: 1349966 - RNA, 23 nt, Human
gagaagaacacgaggacgcaaug

SEQ ID NO: 1349967 - RNA, 23 nt, Human
gcuguguggcauggcagaaggcu

SEQ ID NO: 1349968 - RNA, 22 nt, Human
ggaugagagaagaacacgagga

SEQ ID NO: 1349969 - RNA, 18 nt, Human
ggcaguggcagagcagag

SEQ ID NO: 1349970 - RNA, 24 nt, Human
guggcuccuacauaaugucccagc

SEQ ID NO: 1349971 - RNA, 20 nt, Human
uaugaaguggcuccuacaua

SEQ ID NO: 1349972 - RNA, 18 nt, Human
ucccuggggcaguggcag

SEQ ID NO: 1349973 - RNA, 21 nt, Human
ucccugguuuaaggcaaggau

SEQ ID NO: 1349974 - RNA, 23 nt, Human
ucccugguuuaaggcaaggauug

SEQ ID NO: 1349975 - RNA, 20 nt, Human
uggcuccuacauaauguccc

SEQ ID NO: 1349976 - RNA, 23 nt, Human
uucaagggcagcugugauccuug

SEQ ID NO: 1349977 - RNA, 25 nt, Human
uucaagggcagcugugauccuugcc

SEQ ID NO: 1349978 - RNA, 26 nt, Human
aaagcaaaagccuguuuuuuuucuug

SEQ ID NO: 1349979 - RNA, 23 nt, Human
accucuaccuccucgcccuccau

SEQ ID NO: 1349980 - RNA, 18 nt, Human
acugcagaaguaguaucc

SEQ ID NO: 1349981 - RNA, 22 nt, Human
agcagccccacgaccucuggau

SEQ ID NO: 1349982 - RNA, 20 nt, Human
auagagcccacaaaaagccu

SEQ ID NO: 1349983 - RNA, 23 nt, Human
aucucacucaccaaaaugaauga

SEQ ID NO: 1349984 - RNA, 18 nt, Human
caagaaagcaaaagccug

SEQ ID NO: 1349985 - RNA, 20 nt, Human
caccccuucucuagcuccaa

SEQ ID NO: 1349986 - RNA, 21 nt, Human
cacucauuccaguuucccaac

SEQ ID NO: 1349987 - RNA, 23 nt, Human
cacuuuuguucugaacacgagag

SEQ ID NO: 1349988 - RNA, 19 nt, Human
cauaaccaccucuaccucc

SEQ ID NO: 1349989 - RNA, 18 nt, Human
ccaccccuucucuagcuc

SEQ ID NO: 1349990 - RNA, 23 nt, Human
ccagcaucaagcaaugucugaaa

SEQ ID NO: 1349991 - RNA, 21 nt, Human
ccaguuucccaaacugacuaa

SEQ ID NO: 1349992 - RNA, 21 nt, Human
ccccuucucuagcuccaacuu

SEQ ID NO: 1349993 - RNA, 18 nt, Human
ccccuugcuccucuacca

SEQ ID NO: 1349994 - RNA, 23 nt, Human
cccuccaagucuuuaccauucau

SEQ ID NO: 1349995 - RNA, 21 nt, Human
cccuccaucucuuguuggagg

SEQ ID NO: 1349996 - RNA, 23 nt, Human
ccuccaagucuuuaccauucauu

SEQ ID NO: 1349997 - RNA, 20 nt, Human
ccucuaccuccucgcccucc

SEQ ID NO: 1349998 - RNA, 22 nt, Human
cuaaaugccuuuucuaaaaucu

SEQ ID NO: 1349999 - RNA, 24 nt, Human
cucucugugaauaaccggcucuac

SEQ ID NO: 1350000 - RNA, 19 nt, Human
cuuuccuuuucugauuugg

SEQ ID NO: 1350001 - RNA, 23 nt, Human
gaacugccaaugcaccgucuuca

SEQ ID NO: 1350002 - RNA, 18 nt, Human
gagcagcaccccuugcuc

SEQ ID NO: 1350003 - RNA, 19 nt, Human
gggaagagcagccccacga

SEQ ID NO: 1350004 - RNA, 18 nt, Human
guugggcaccuccucucg

SEQ ID NO: 1350005 - RNA, 22 nt, Human
uaauaguaguaaucgucauaca

SEQ ID NO: 1350006 - RNA, 23 nt, Human
uaccacggggaagagcagcccca

SEQ ID NO: 1350007 - RNA, 22 nt, Human
uauuuucucccuccaagucuuu

SEQ ID NO: 1350008 - RNA, 23 nt, Human
ucacucauuccaguuucccaaac

SEQ ID NO: 1350009 - RNA, 20 nt, Human
ucagcaacuuucugugauaa

SEQ ID NO: 1350010 - RNA, 24 nt, Human
ucauaaccauaguauggaucuuca

SEQ ID NO: 1350011 - RNA, 21 nt, Human
ucauauccauaauaaucugga

SEQ ID NO: 1350012 - RNA, 23 nt, Human
uccauagccuugacagcaccauc

SEQ ID NO: 1350013 - RNA, 22 nt, Human
ucccaaacugacuaaaugccuu

SEQ ID NO: 1350014 - RNA, 19 nt, Human
ucccuccaagucuuuacca

SEQ ID NO: 1350015 - RNA, 25 nt, Human
ucccuccaagucuuuaccauucauu

SEQ ID NO: 1350016 - RNA, 18 nt, Human
uccuugguuuuaacucuu

SEQ ID NO: 1350017 - RNA, 19 nt, Human
ucuguaagacccucuguua

SEQ ID NO: 1350018 - RNA, 18 nt, Human
ucugugaauaaccggcuc

SEQ ID NO: 1350019 - RNA, 18 nt, Human
ucuucaguaucauuucca

SEQ ID NO: 1350020 - RNA, 24 nt, Human
ucuucauauccaccacgauaguua

SEQ ID NO: 1350021 - RNA, 21 nt, Human
ucuuguuggagggggcauaua

SEQ ID NO: 1350022 - RNA, 19 nt, Human
ugaauggauaacugcagaa

SEQ ID NO: 1350023 - RNA, 23 nt, Human
ugaucuucauauucaagaaagca

SEQ ID NO: 1350024 - RNA, 18 nt, Human
uggaggauauccauaacc

SEQ ID NO: 1350025 - RNA, 20 nt, Human
uugaaaaucuucauaaccau

SEQ ID NO: 1350026 - RNA, 22 nt, Human
uugcuccucuaccaccccuucu

SEQ ID NO: 1350027 - RNA, 23 nt, Human
aaaauauacaucugaaguacaag

SEQ ID NO: 1350028 - RNA, 24 nt, Human
aaaaucuguaaucccagcacuuug

SEQ ID NO: 1350029 - RNA, 27 nt, Human
aaacuccauuaucuaauagagagugac

SEQ ID NO: 1350030 - RNA, 21 nt, Human
aaauuccaaauggucaaacuc

SEQ ID NO: 1350031 - RNA, 19 nt, Human
aacauagugagaccccauc

SEQ ID NO: 1350032 - RNA, 20 nt, Human
aacauagugagaccccaucu

SEQ ID NO: 1350033 - RNA, 21 nt, Human
aacauagugagaccccaucuc

SEQ ID NO: 1350034 - RNA, 19 nt, Human
aagagugaaacuccauguc

SEQ ID NO: 1350035 - RNA, 19 nt, Human
aagguugcggugagccaag

SEQ ID NO: 1350036 - RNA, 18 nt, Human
aaucgcuugaaccuggga

SEQ ID NO: 1350037 - RNA, 21 nt, Human
acaauaaagaaaaugaagcca

SEQ ID NO: 1350038 - RNA, 23 nt, Human
acacauagucccugacacguuca

SEQ ID NO: 1350039 - RNA, 20 nt, Human
acaccauugcacuccagccu

SEQ ID NO: 1350040 - RNA, 23 nt, Human
acaguuccaaauaaccaaaaaca

SEQ ID NO: 1350041 - RNA, 22 nt, Human
accauugcacuccagccugggc

SEQ ID NO: 1350042 - RNA, 25 nt, Human
acuccagccugggcaacaagaguga

SEQ ID NO: 1350043 - RNA, 24 nt, Human
agaggaagguugcggugagccaag

SEQ ID NO: 1350044 - RNA, 22 nt, Human
agcacuuugggaggcugaggug

SEQ ID NO: 1350045 - RNA, 22 nt, Human
agccugggcaacauagugagac

SEQ ID NO: 1350046 - RNA, 23 nt, Human
agccugggcaacauagugagacc

SEQ ID NO: 1350047 - RNA, 24 nt, Human
agccugggcaacauagugagaccc

SEQ ID NO: 1350048 - RNA, 23 nt, Human
agcuacucgggaggcugaggcag

SEQ ID NO: 1350049 - RNA, 22 nt, Human
aggaagguugcggugagccaag

SEQ ID NO: 1350050 - RNA, 23 nt, Human
aggaguucaagaccagccugggc

SEQ ID NO: 1350051 - RNA, 24 nt, Human
aggauugcuugaguccaggaguuc

SEQ ID NO: 1350052 - RNA, 22 nt, Human
aggcaggagaaucgcuugaacc

SEQ ID NO: 1350053 - RNA, 24 nt, Human
aggcaggagaaucgcuugaaccug

SEQ ID NO: 1350054 - RNA, 20 nt, Human
aggcugaggcaggagaaucg

SEQ ID NO: 1350055 - RNA, 24 nt, Human
aggcugaggcaggagaaucgcuug

SEQ ID NO: 1350056 - RNA, 24 nt, Human
aggcugaggugagaggauugcuug

SEQ ID NO: 1350057 - RNA, 21 nt, Human
aguauuacacaauaaagaaaa

SEQ ID NO: 1350058 - RNA, 27 nt, Human
aguccaggaguucaagaccagccuggg

SEQ ID NO: 1350059 - RNA, 21 nt, Human
agucccugacacguucaguuc

SEQ ID NO: 1350060 - RNA, 24 nt, Human
aucacaccauugcacuccagccug

SEQ ID NO: 1350061 - RNA, 28 nt, Human
aucacaccauugcacuccagccugggca

SEQ ID NO: 1350062 - RNA, 24 nt, Human
auugcacuccagccugggcaacaa

SEQ ID NO: 1350063 - RNA, 25 nt, Human
auugcacuccagccugggcaacaag

SEQ ID NO: 1350064 - RNA, 24 nt, Human
auugcuugaguccaggaguucaag

SEQ ID NO: 1350065 - RNA, 24 nt, Human
caacauagugagaccccaucucuc

SEQ ID NO: 1350066 - RNA, 20 nt, Human
cacaauaaagaaaaugaagc

SEQ ID NO: 1350067 - RNA, 21 nt, Human
cacaccauugcacuccagccu

SEQ ID NO: 1350068 - RNA, 18 nt, Human
caccagaguuuucuuccc

SEQ ID NO: 1350069 - RNA, 19 nt, Human
cacuauucaaaagcagccc

SEQ ID NO: 1350070 - RNA, 23 nt, Human
cacuccagccugggcaacaagag

SEQ ID NO: 1350071 - RNA, 24 nt, Human
cacuccagccugggcaacaagagu

SEQ ID NO: 1350072 - RNA, 25 nt, Human
cacuccagccugggcaacaagagug

SEQ ID NO: 1350073 - RNA, 22 nt, Human
cacuguaauccuagcuacucgg

SEQ ID NO: 1350074 - RNA, 23 nt, Human
cacuguaauccuagcuacucggg

SEQ ID NO: 1350075 - RNA, 23 nt, Human
cacuguuuugcuaccaagauuca

SEQ ID NO: 1350076 - RNA, 23 nt, Human
cagcacuuugggaggcugaggug

SEQ ID NO: 1350077 - RNA, 19 nt, Human
cauacagugccacacauag

SEQ ID NO: 1350078 - RNA, 19 nt, Human
cauagugagaccccaucuc

SEQ ID NO: 1350079 - RNA, 19 nt, Human
cauugcacuccagccuggg

SEQ ID NO: 1350080 - RNA, 21 nt, Human
cauugcacuccagccugggca

SEQ ID NO: 1350081 - RNA, 25 nt, Human
cauugcacuccagccugggcaacaa

SEQ ID NO: 1350082 - RNA, 21 nt, Human
ccaaaaacauccuugaauaac

SEQ ID NO: 1350083 - RNA, 22 nt, Human
ccaagauucaagcugcaccaga

SEQ ID NO: 1350084 - RNA, 20 nt, Human
ccauugcacuccagccuggg

SEQ ID NO: 1350085 - RNA, 21 nt, Human
ccauugcacuccagccugggc

SEQ ID NO: 1350086 - RNA, 23 nt, Human
ccauugcacuccagccugggcaa

SEQ ID NO: 1350087 - RNA, 24 nt, Human
ccauugcacuccagccugggcaac

SEQ ID NO: 1350088 - RNA, 25 nt, Human
ccauugcacuccagccugggcaaca

SEQ ID NO: 1350089 - RNA, 21 nt, Human
ccugacacguucaguuccuac

SEQ ID NO: 1350090 - RNA, 24 nt, Human
ccugggcaacauagugagacccca

SEQ ID NO: 1350091 - RNA, 19 nt, Human
cggagagguuguguccaca

SEQ ID NO: 1350092 - RNA, 21 nt, Human
cuaccaagauucaagcugcac

SEQ ID NO: 1350093 - RNA, 20 nt, Human
cuccaugguugaaaaagcag

SEQ ID NO: 1350094 - RNA, 19 nt, Human
cugaaguacaaggaaugga

SEQ ID NO: 1350095 - RNA, 21 nt, Human
cuguaaucccagcacuuuggg

SEQ ID NO: 1350096 - RNA, 21 nt, Human
cuguaauccuagcuacucggg

SEQ ID NO: 1350097 - RNA, 20 nt, Human
gaagguugcggugagccaag

SEQ ID NO: 1350098 - RNA, 24 nt, Human
gaagguugcggugagccaagauca

SEQ ID NO: 1350099 - RNA, 24 nt, Human
gacaguuccaaauaaccaaaaaca

SEQ ID NO: 1350100 - RNA, 18 nt, Human
gaccccaucucucucagc

SEQ ID NO: 1350101 - RNA, 23 nt, Human
gagaaucgcuugaaccugggaga

SEQ ID NO: 1350102 - RNA, 21 nt, Human
gagaggaagguugcggugagc

SEQ ID NO: 1350103 - RNA, 24 nt, Human
gaggugagaggauugcuugagucc

SEQ ID NO: 1350104 - RNA, 24 nt, Human
gauugcuugaguccaggaguucaa

SEQ ID NO: 1350105 - RNA, 22 nt, Human
gcaccagaguuuucuuccccca

SEQ ID NO: 1350106 - RNA, 22 nt, Human
gcuugaguccaggaguucaaga

SEQ ID NO: 1350107 - RNA, 23 nt, Human
ggaggcugaggugagaggauugc

SEQ ID NO: 1350108 - RNA, 23 nt, Human
ggauugcuugaguccaggaguuc

SEQ ID NO: 1350109 - RNA, 24 nt, Human
guuaaaauauacaucugaaguaca

SEQ ID NO: 1350110 - RNA, 19 nt, Human
guucuuuauaaauggcaga

SEQ ID NO: 1350111 - RNA, 26 nt, Human
uaaaaucuguaaucccagcacuuugg

SEQ ID NO: 1350112 - RNA, 24 nt, Human
uaaccaaaaacauccuugaauaac

SEQ ID NO: 1350113 - RNA, 22 nt, Human
uaauacagucccugagaaucaa

SEQ ID NO: 1350114 - RNA, 19 nt, Human
uaccaagauucaagcugca

SEQ ID NO: 1350115 - RNA, 22 nt, Human
uacuccauucaaaaaugagggu

SEQ ID NO: 1350116 - RNA, 21 nt, Human
uaggaaaaacuuucacggaga

SEQ ID NO: 1350117 - RNA, 19 nt, Human
uauaaauggcagagacuca

SEQ ID NO: 1350118 - RNA, 23 nt, Human
ucacaccauugcacuccagccug

SEQ ID NO: 1350119 - RNA, 20 nt, Human
uccaugguugaaaaagcagc

SEQ ID NO: 1350120 - RNA, 22 nt, Human
ucccugacacguucaguuccua

SEQ ID NO: 1350121 - RNA, 20 nt, Human
ucgcuugaaccugggagagg

SEQ ID NO: 1350122 - RNA, 25 nt, Human
ucgcuugaaccugggagaggaaggu

SEQ ID NO: 1350123 - RNA, 24 nt, Human
ucgggaggcugaggcaggagaauc

SEQ ID NO: 1350124 - RNA, 21 nt, Human
ucugaaguacaaggaauggau

SEQ ID NO: 1350125 - RNA, 21 nt, Human
ucuuuauaaauggcagagacu

SEQ ID NO: 1350126 - RNA, 22 nt, Human
ugaaauaggaauaauacagucc

SEQ ID NO: 1350127 - RNA, 23 nt, Human
ugaaccugggagaggaagguugc

SEQ ID NO: 1350128 - RNA, 19 nt, Human
ugagaccccaucucucuca

SEQ ID NO: 1350129 - RNA, 20 nt, Human
ugaggcaggagaaucgcuug

SEQ ID NO: 1350130 - RNA, 24 nt, Human
ugaggcaggagaaucgcuugaacc

SEQ ID NO: 1350131 - RNA, 25 nt, Human
ugaggcaggagaaucgcuugaaccu

SEQ ID NO: 1350132 - RNA, 21 nt, Human
ugaggugagaggauugcuuga

SEQ ID NO: 1350133 - RNA, 22 nt, Human
ugaggugagaggauugcuugag

SEQ ID NO: 1350134 - RNA, 22 nt, Human
ugaggugagaggauugcuugag

SEQ ID NO: 1350135 - RNA, 19 nt, Human
ugcacuccagccugggcaa

SEQ ID NO: 1350136 - RNA, 24 nt, Human
ugcuucccagucuuggagacuugc

SEQ ID NO: 1350137 - RNA, 20 nt, Human
uggaccuugcuguucagcag

SEQ ID NO: 1350138 - RNA, 23 nt, Human
uggauaggaaaaacuuucacgga

SEQ ID NO: 1350139 - RNA, 21 nt, Human
ugggagaggaagguugcggug

SEQ ID NO: 1350140 - RNA, 22 nt, Human
ugggaggcugaggugagaggau

SEQ ID NO: 1350141 - RNA, 24 nt, Human
ugggaggcugaggugagaggauug

SEQ ID NO: 1350142 - RNA, 25 nt, Human
ugggaggcugaggugagaggauugg

SEQ ID NO: 1350143 - RNA, 22 nt, Human
ugggcaacauagugagacccca

SEQ ID NO: 1350144 - RNA, 23 nt, Human
ugucaaguauuuaaguaugacag

SEQ ID NO: 1350145 - RNA, 27 nt, Human
uucaaaaagaucaacaauauuuauaaa

SEQ ID NO: 1350146 - RNA, 24 nt, Human
uugaaccugggagaggaagguugc

SEQ ID NO: 1350147 - RNA, 22 nt, Human
uugaguccaggaguucaagacc

SEQ ID NO: 1350148 - RNA, 20 nt, Human
uugcggugagccaagaucac

SEQ ID NO: 1350149 - RNA, 21 nt, Human
uuggagacuugccauacagug

SEQ ID NO: 1350150 - RNA, 19 nt, Human
uugggaggcugaggugaga

SEQ ID NO: 1350151 - RNA, 22 nt, Human
uugggaggcugaggugagagga

SEQ ID NO: 1350152 - RNA, 23 nt, Human
aaaacaaaaguaaaacuucccaa

SEQ ID NO: 1350153 - RNA, 19 nt, Human
aaacaaaaguaaaacuucc

SEQ ID NO: 1350154 - RNA, 23 nt, Human
aaacauaaacauacuaaauaauc

SEQ ID NO: 1350155 - RNA, 19 nt, Human
aaagugcuaggauuacagg

SEQ ID NO: 1350156 - RNA, 24 nt, Human
aaagugcuaggauuacaggcguga

SEQ ID NO: 1350157 - RNA, 18 nt, Human
aaauacuggacccuuagc

SEQ ID NO: 1350158 - RNA, 23 nt, Human
aacaaaaaggauauuuaagauau

SEQ ID NO: 1350159 - RNA, 20 nt, Human
aacaaacccuguugauccug

SEQ ID NO: 1350160 - RNA, 23 nt, Human
aagaaaaagauaugcuuucaaaa

SEQ ID NO: 1350161 - RNA, 26 nt, Human
aagugcuaggauuacaggcgugagcc

SEQ ID NO: 1350162 - RNA, 18 nt, Human
acagaauguaaaauguau

SEQ ID NO: 1350163 - RNA, 22 nt, Human
accauguuggccaggcuggucu

SEQ ID NO: 1350164 - RNA, 18 nt, Human
acgggguuucaccauguu

SEQ ID NO: 1350165 - RNA, 23 nt, Human
acgggguuucaccauguuggcca

SEQ ID NO: 1350166 - RNA, 24 nt, Human
acgggguuucaccauguuggccag

SEQ ID NO: 1350167 - RNA, 24 nt, Human
acucccggguuucagcaauucucc

SEQ ID NO: 1350168 - RNA, 18 nt, Human
acucugucauccaggcug

SEQ ID NO: 1350169 - RNA, 24 nt, Human
acucugucauccaggcuggagugc

SEQ ID NO: 1350170 - RNA, 23 nt, Human
acugaccucaggugauccaccug

SEQ ID NO: 1350171 - RNA, 24 nt, Human
acuggacccuuagcacagaaaauu

SEQ ID NO: 1350172 - RNA, 18 nt, Human
agacagcagcacgagccc

SEQ ID NO: 1350173 - RNA, 19 nt, Human
agacagcagcacgagccca

SEQ ID NO: 1350174 - RNA, 22 nt, Human
agauagcagcgucuccgaagag

SEQ ID NO: 1350175 - RNA, 20 nt, Human
agcaauucuccugccucagc

SEQ ID NO: 1350176 - RNA, 22 nt, Human
agcagcgucuccgaagagacag

SEQ ID NO: 1350177 - RNA, 25 nt, Human
aggcuggagugcaguggcccagucu

SEQ ID NO: 1350178 - RNA, 24 nt, Human
aggugauccaccugccucggccuc

SEQ ID NO: 1350179 - RNA, 22 nt, Human
aguagagacgggguuucaccau

SEQ ID NO: 1350180 - RNA, 20 nt, Human
agugcaguggcccagucucg

SEQ ID NO: 1350181 - RNA, 24 nt, Human
agugcaguggcccagucucggcuc

SEQ ID NO: 1350182 - RNA, 23 nt, Human
aucaacuuuuccucuccuuuagg

SEQ ID NO: 1350183 - RNA, 24 nt, Human
auuuuuguauuuuuaguagagacg

SEQ ID NO: 1350184 - RNA, 20 nt, Human
caaaaguaaaacuucccaaa

SEQ ID NO: 1350185 - RNA, 24 nt, Human
caaagugcuaggauuacaggcgug

SEQ ID NO: 1350186 - RNA, 24 nt, Human
caccacgcccagcuaauuuuugua

SEQ ID NO: 1350187 - RNA, 21 nt, Human
caccauguuggccaggcuggu

SEQ ID NO: 1350188 - RNA, 22 nt, Human
caccauguuggccaggcugguc

SEQ ID NO: 1350189 - RNA, 23 nt, Human
caccauguuggccaggcuggucu

SEQ ID NO: 1350190 - RNA, 24 nt, Human
caccauguuggccaggcuggucuu

SEQ ID NO: 1350191 - RNA, 23 nt, Human
caccugccucggccucccaaagu

SEQ ID NO: 1350192 - RNA, 23 nt, Human
cacucugucauccaggcuggagu

SEQ ID NO: 1350193 - RNA, 24 nt, Human
cacucugucauccaggcuggagug

SEQ ID NO: 1350194 - RNA, 18 nt, Human
cagcacgagcccauuuac

SEQ ID NO: 1350195 - RNA, 20 nt, Human
cagccuccuggguagcuggg

SEQ ID NO: 1350196 - RNA, 22 nt, Human
caggugauccaccugccucggc

SEQ ID NO: 1350197 - RNA, 24 nt, Human
caugccaccacgcccagcuaauuu

SEQ ID NO: 1350198 - RNA, 24 nt, Human
cauguuggccaggcuggucuugaa

SEQ ID NO: 1350199 - RNA, 22 nt, Human
ccaaagugcuaggauuacaggc

SEQ ID NO: 1350200 - RNA, 24 nt, Human
ccaaagugcuaggauuacaggcgu

SEQ ID NO: 1350201 - RNA, 23 nt, Human
cccggguuucagcaauucuccug

SEQ ID NO: 1350202 - RNA, 18 nt, Human
ccgcgcccagccugcauu

SEQ ID NO: 1350203 - RNA, 23 nt, Human
ccuggguagcugggauuacaggc

SEQ ID NO: 1350204 - RNA, 24 nt, Human
ccuggguagcugggauuacaggcg

SEQ ID NO: 1350205 - RNA, 23 nt, Human
cgaagagacagcagcacgagccc

SEQ ID NO: 1350206 - RNA, 21 nt, Human
cgcaugccaccacgcccagcu

SEQ ID NO: 1350207 - RNA, 22 nt, Human
cuaucuagcaauuccuaaucau

SEQ ID NO: 1350208 - RNA, 24 nt, Human
cucacucugucauccaggcuggag

SEQ ID NO: 1350209 - RNA, 24 nt, Human
cucagccuccuggguagcugggau

SEQ ID NO: 1350210 - RNA, 21 nt, Human
cucccggguuucagcaauucu

SEQ ID NO: 1350211 - RNA, 21 nt, Human
cucucugcagccucugacucc

SEQ ID NO: 1350212 - RNA, 20 nt, Human
cugaccucaggugauccacc

SEQ ID NO: 1350213 - RNA, 21 nt, Human
cugcagccucugacucccggg

SEQ ID NO: 1350214 - RNA, 23 nt, Human
cugcagccucugacucccggguu

SEQ ID NO: 1350215 - RNA, 23 nt, Human
cugccucagccuccuggguagcu

SEQ ID NO: 1350216 - RNA, 23 nt, Human
cugccucggccucccaaagugcu

SEQ ID NO: 1350217 - RNA, 20 nt, Human
cuggguagcugggauuacag

SEQ ID NO: 1350218 - RNA, 19 nt, Human
cugucauccaggcuggagu

SEQ ID NO: 1350219 - RNA, 19 nt, Human
gacaguggcugacucaccc

SEQ ID NO: 1350220 - RNA, 24 nt, Human
gaccucaggugauccaccugccuc

SEQ ID NO: 1350221 - RNA, 22 nt, Human
gacucccggguuucagcaauuc

SEQ ID NO: 1350222 - RNA, 24 nt, Human
gagacgggguuucaccauguuggc

SEQ ID NO: 1350223 - RNA, 24 nt, Human
gagccaccgcgcccagccugcauu

SEQ ID NO: 1350224 - RNA, 18 nt, Human
gauuacaggcgcaugcca

SEQ ID NO: 1350225 - RNA, 18 nt, Human
gauuacaggcgugagcca

SEQ ID NO: 1350226 - RNA, 20 nt, Human
gauuacaggcgugagccacc

SEQ ID NO: 1350227 - RNA, 22 nt, Human
gauuacaggcgugagccaccgc

SEQ ID NO: 1350228 - RNA, 18 nt, Human
gcaugccaccacgcccag

SEQ ID NO: 1350229 - RNA, 22 nt, Human
gcccagcuaauuuuuguauuuu

SEQ ID NO: 1350230 - RNA, 21 nt, Human
gccucccguuaucguuuagac

SEQ ID NO: 1350231 - RNA, 25 nt, Human
gcuggagugcaguggcccagucucg

SEQ ID NO: 1350232 - RNA, 22 nt, Human
ggauuacaggcgugagccaccg

SEQ ID NO: 1350233 - RNA, 23 nt, Human
ggcugacucacccucucucacuc

SEQ ID NO: 1350234 - RNA, 23 nt, Human
gggguuucaccauguuggccagg

SEQ ID NO: 1350235 - RNA, 22 nt, Human
ggguuucaccauguuggccagg

SEQ ID NO: 1350236 - RNA, 23 nt, Human
guagagacgggguuucaccaugu

SEQ ID NO: 1350237 - RNA, 18 nt, Human
guagcugggauuacaggc

SEQ ID NO: 1350238 - RNA, 18 nt, Human
guagcugggauuacaggc

SEQ ID NO: 1350239 - RNA, 18 nt, Human
guagcugggauuacaggc

SEQ ID NO: 1350240 - RNA, 24 nt, Human
gugauccaccugccucggccuccc

SEQ ID NO: 1350241 - RNA, 19 nt, Human
guggcugacucacccucuc

SEQ ID NO: 1350242 - RNA, 18 nt, Human
uaagauagcagcgucucc

SEQ ID NO: 1350243 - RNA, 24 nt, Human
uaauuuuuguauuuuuaguagaga

SEQ ID NO: 1350244 - RNA, 24 nt, Human
uacaggcgcaugccaccacgccca

SEQ ID NO: 1350245 - RNA, 24 nt, Human
uacaggcgugagccaccgcgccca

SEQ ID NO: 1350246 - RNA, 21 nt, Human
uacauuguucugaagaaaaag

SEQ ID NO: 1350247 - RNA, 22 nt, Human
uagagacgggguuucaccaugu

SEQ ID NO: 1350248 - RNA, 18 nt, Human
uaggauuacaggcgugag

SEQ ID NO: 1350249 - RNA, 19 nt, Human
uaggauuacaggcgugagc

SEQ ID NO: 1350250 - RNA, 21 nt, Human
uaggauuacaggcgugagcca

SEQ ID NO: 1350251 - RNA, 22 nt, Human
uaggauuacaggcgugagccac

SEQ ID NO: 1350252 - RNA, 23 nt, Human
uaggauuacaggcgugagccacc

SEQ ID NO: 1350253 - RNA, 24 nt, Human
uaggauuacaggcgugagccaccg

SEQ ID NO: 1350254 - RNA, 24 nt, Human
uaguagagacgggguuucaccaug

SEQ ID NO: 1350255 - RNA, 26 nt, Human
uaguagagacgggguuucaccauguu

SEQ ID NO: 1350256 - RNA, 22 nt, Human
ucaaauaaauacuggacccuua

SEQ ID NO: 1350257 - RNA, 19 nt, Human
ucaacccuaccccgcagaa

SEQ ID NO: 1350258 - RNA, 27 nt, Human
ucagcaauucuccugccucagccuccu

SEQ ID NO: 1350259 - RNA, 20 nt, Human
ucagccuccuggguagcugg

SEQ ID NO: 1350260 - RNA, 21 nt, Human
ucaggugauccaccugccucg

SEQ ID NO: 1350261 - RNA, 24 nt, Human
ucauccaggcuggagugcaguggc

SEQ ID NO: 1350262 - RNA, 24 nt, Human
ucccaaagugcuaggauuacaggc

SEQ ID NO: 1350263 - RNA, 21 nt, Human
ucccggguuucagcaauucuc

SEQ ID NO: 1350264 - RNA, 24 nt, Human
ucccggguuucagcaauucuccug

SEQ ID NO: 1350265 - RNA, 23 nt, Human
uccuccucaaccuucccucgcug

SEQ ID NO: 1350266 - RNA, 24 nt, Human
uccuggguagcugggauuacaggc

SEQ ID NO: 1350267 - RNA, 18 nt, Human
ucggccucccaaagugcu

SEQ ID NO: 1350268 - RNA, 18 nt, Human
ucuaaaccaaaccagaag

SEQ ID NO: 1350269 - RNA, 23 nt, Human
ucucacucugucauccaggcugg

SEQ ID NO: 1350270 - RNA, 24 nt, Human
ucucacucugucauccaggcugga

SEQ ID NO: 1350271 - RNA, 24 nt, Human
ucuccugccucagccuccugggua

SEQ ID NO: 1350272 - RNA, 18 nt, Human
ucucucacucccgcgucc

SEQ ID NO: 1350273 - RNA, 24 nt, Human
ucucugcagccucugacucccggg

SEQ ID NO: 1350274 - RNA, 21 nt, Human
ucugcagccucugacucccgg

SEQ ID NO: 1350275 - RNA, 22 nt, Human
ucuggcuccuccucaaccuucc

SEQ ID NO: 1350276 - RNA, 24 nt, Human
ucugucauccaggcuggagugcag

SEQ ID NO: 1350277 - RNA, 24 nt, Human
ugaccucaggugauccaccugccu

SEQ ID NO: 1350278 - RNA, 28 nt, Human
ugacucccggguuucagcaauucuccuu

SEQ ID NO: 1350279 - RNA, 18 nt, Human
ugcaggacccggcucugg

SEQ ID NO: 1350280 - RNA, 22 nt, Human
ugcaguggcccagucucggcuc

SEQ ID NO: 1350281 - RNA, 21 nt, Human
ugccucagccuccuggguagc

SEQ ID NO: 1350282 - RNA, 24 nt, Human
ugccucagccuccuggguagcugg

SEQ ID NO: 1350283 - RNA, 21 nt, Human
ugccucggccucccaaagugc

SEQ ID NO: 1350284 - RNA, 23 nt, Human
ugccucggccucccaaagugcua

SEQ ID NO: 1350285 - RNA, 24 nt, Human
ugccucggccucccaaagugcuag

SEQ ID NO: 1350286 - RNA, 24 nt, Human
ugcuaggauuacaggcgugagcca

SEQ ID NO: 1350287 - RNA, 23 nt, Human
uggagugcaguggcccagucucg

SEQ ID NO: 1350288 - RNA, 24 nt, Human
uggagugcaguggcccagucucgg

SEQ ID NO: 1350289 - RNA, 26 nt, Human
uggccaggcuggucuugaacugaccu

SEQ ID NO: 1350290 - RNA, 21 nt, Human
ugggauuacaggcgcaugcca

SEQ ID NO: 1350291 - RNA, 22 nt, Human
ugggauuacaggcgcaugccac

SEQ ID NO: 1350292 - RNA, 24 nt, Human
ugggauuacaggcgcaugccacca

SEQ ID NO: 1350293 - RNA, 21 nt, Human
uggucuugaacugaccucagg

SEQ ID NO: 1350294 - RNA, 19 nt, Human
uguggcaguaaacagaaug

SEQ ID NO: 1350295 - RNA, 19 nt, Human
uuaagauauuuuccaaaac

SEQ ID NO: 1350296 - RNA, 24 nt, Human
uuacugaauucaacccuaccccgc

SEQ ID NO: 1350297 - RNA, 18 nt, Human
uuaguagagacgggguuu

SEQ ID NO: 1350298 - RNA, 22 nt, Human
uuaguagagacgggguuucacc

SEQ ID NO: 1350299 - RNA, 24 nt, Human
uuaguagagacgggguuucaccau

SEQ ID NO: 1350300 - RNA, 24 nt, Human
uuggccaggcuggucuugaacuga

SEQ ID NO: 1350301 - RNA, 23 nt, Human
uuguauuuuuaguagagacgggg

SEQ ID NO: 1350302 - RNA, 24 nt, Human
uuucaccauguuggccaggcuggu

SEQ ID NO: 1350303 - RNA, 24 nt, Human
uuuuuaguagagacgggguuucac

SEQ ID NO: 1350304 - RNA, 20 nt, Human
uuuuuguauuuuuaguagag

SEQ ID NO: 1350305 - RNA, 24 nt, Human
aaccugggagagaaaacaaguccc

SEQ ID NO: 1350306 - RNA, 22 nt, Human
aagaaccuguaaucccgacacu

SEQ ID NO: 1350307 - RNA, 25 nt, Human
aaugacuacuaacaauggcacuaua

SEQ ID NO: 1350308 - RNA, 18 nt, Human
accuguaaucccgacacu

SEQ ID NO: 1350309 - RNA, 24 nt, Human
acgaucacuugaggccaggaguuu

SEQ ID NO: 1350310 - RNA, 21 nt, Human
acuuuaaggaucacuagugaa

SEQ ID NO: 1350311 - RNA, 24 nt, Human
agaaaaaagaaaccugggagagaa

SEQ ID NO: 1350312 - RNA, 20 nt, Human
aucacuugaggccaggaguu

SEQ ID NO: 1350313 - RNA, 19 nt, Human
cacuguauugcaggaagaa

SEQ ID NO: 1350314 - RNA, 20 nt, Human
cacuguauugcaggaagaac

SEQ ID NO: 1350315 - RNA, 25 nt, Human
cagccgauccuuccuagucagguuc

SEQ ID NO: 1350316 - RNA, 26 nt, Human
cagcugggcuccuccuauacugaauc

SEQ ID NO: 1350317 - RNA, 27 nt, Human
cagcugggcuccuccuauacugaaucc

SEQ ID NO: 1350318 - RNA, 25 nt, Human
caggaagaaacgaugguaggccuug

SEQ ID NO: 1350319 - RNA, 21 nt, Human
caggaagaaccuguaaucccg

SEQ ID NO: 1350320 - RNA, 23 nt, Human
ccaaaggcaggaagaaacgaugg

SEQ ID NO: 1350321 - RNA, 18 nt, Human
cccagcugggcuccuccu

SEQ ID NO: 1350322 - RNA, 18 nt, Human
cgaggguuggagcggguc

SEQ ID NO: 1350323 - RNA, 25 nt, Human
cuaacaauggcacuauauuuccuuu

SEQ ID NO: 1350324 - RNA, 21 nt, Human
cugagguaagacgaucacuug

SEQ ID NO: 1350325 - RNA, 27 nt, Human
cuuccuagucagguucugaauccugag

SEQ ID NO: 1350326 - RNA, 18 nt, Human
gaauagagacuuuaagga

SEQ ID NO: 1350327 - RNA, 19 nt, Human
gaauugcuauagcgucccc

SEQ ID NO: 1350328 - RNA, 19 nt, Human
gagagaaaacaagucccaa

SEQ ID NO: 1350329 - RNA, 18 nt, Human
gaucacuugaggccagga

SEQ ID NO: 1350330 - RNA, 24 nt, Human
gaucacuugaggccaggaguuuaa

SEQ ID NO: 1350331 - RNA, 28 nt, Human
gggaauaacuggagagauaccgguaccc

SEQ ID NO: 1350332 - RNA, 22 nt, Human
gucccagcuacccuugagcagc

SEQ ID NO: 1350333 - RNA, 22 nt, Human
guggcuccaccccuaucccagc

SEQ ID NO: 1350334 - RNA, 22 nt, Human
uagaaugacuacuaacaauggc

SEQ ID NO: 1350335 - RNA, 20 nt, Human
uagcguagaauaacuccagu

SEQ ID NO: 1350336 - RNA, 24 nt, Human
uagcguagaauaacuccaguuccu

SEQ ID NO: 1350337 - RNA, 23 nt, Human
uagggcauaguuagaaaagauuu

SEQ ID NO: 1350338 - RNA, 19 nt, Human
ucaagguaacacgagucua

SEQ ID NO: 1350339 - RNA, 23 nt, Human
ucacuugaggccaggaguuuaag

SEQ ID NO: 1350340 - RNA, 30 nt, Human
uccaccccuaucccagcugggcuccuccua

SEQ ID NO: 1350341 - RNA, 23 nt, Human
uccugcucuguaccgaggguugg

SEQ ID NO: 1350342 - RNA, 24 nt, Human
uccugcucuguaccgaggguugga

SEQ ID NO: 1350343 - RNA, 20 nt, Human
ucugggaauaacuggagaga

SEQ ID NO: 1350344 - RNA, 21 nt, Human
ugaacagguggcuccaccccu

SEQ ID NO: 1350345 - RNA, 24 nt, Human
ugagaggcugagguaagacgauca

SEQ ID NO: 1350346 - RNA, 21 nt, Human
ugagauggaaagugucuuccc

SEQ ID NO: 1350347 - RNA, 22 nt, Human
ugcaggaagaaccuguaauccc

SEQ ID NO: 1350348 - RNA, 18 nt, Human
ugccugacggcccaaagg

SEQ ID NO: 1350349 - RNA, 24 nt, Human
uggagcgggucccaaccaacugcc

SEQ ID NO: 1350350 - RNA, 21 nt, Human
ugggagagaaaacaaguccca

SEQ ID NO: 1350351 - RNA, 23 nt, Human
uuagacaaauccaauauccauca

SEQ ID NO: 1350352 - RNA, 25 nt, Human
uugagaggcugagguaagacgauca

SEQ ID NO: 1350353 - RNA, 18 nt, Human
uuggagcgggucccaacc

SEQ ID NO: 1350354 - RNA, 27 nt, Human
uuuaagaaaaaagaaaccugggagaga

SEQ ID NO: 1350355 - RNA, 24 nt, Human
aaaauagaggccucacaauaauau

SEQ ID NO: 1350356 - RNA, 22 nt, Human
aaacucuauagccccuccccag

SEQ ID NO: 1350357 - RNA, 26 nt, Human
aaauacuggaaaauuaaagcugagcu

SEQ ID NO: 1350358 - RNA, 18 nt, Human
aacacaccccucacaguu

SEQ ID NO: 1350359 - RNA, 24 nt, Human
aacacagugagaaggcaaucaucu

SEQ ID NO: 1350360 - RNA, 20 nt, Human
aacaguggguuccaucuccc

SEQ ID NO: 1350361 - RNA, 19 nt, Human
aacauggugaaaccccguc

SEQ ID NO: 1350362 - RNA, 20 nt, Human
aacauggugaaaccccgucu

SEQ ID NO: 1350363 - RNA, 21 nt, Human
aacauggugaaaccccgucuc

SEQ ID NO: 1350364 - RNA, 19 nt, Human
aagcaaaagaaucccugaa

SEQ ID NO: 1350365 - RNA, 22 nt, Human
aagcagaaauggaaccugccca

SEQ ID NO: 1350366 - RNA, 23 nt, Human
aagcagaaauggaaccugcccaa

SEQ ID NO: 1350367 - RNA, 25 nt, Human
aagcagaaauggaaccugcccaagg

SEQ ID NO: 1350368 - RNA, 24 nt, Human
aagcaggaagagagccuuccccag

SEQ ID NO: 1350369 - RNA, 26 nt, Human
aagcaggaagagagccuuccccagga

SEQ ID NO: 1350370 - RNA, 22 nt, Human
aagcuccucaagcuugaaguua

SEQ ID NO: 1350371 - RNA, 20 nt, Human
acaaaggcugugaaaacacu

SEQ ID NO: 1350372 - RNA, 20 nt, Human
acacagguugugcacacugg

SEQ ID NO: 1350373 - RNA, 22 nt, Human
acacagugagaaggcaaucauc

SEQ ID NO: 1350374 - RNA, 20 nt, Human
acacugaguaaauauuuaau

SEQ ID NO: 1350375 - RNA, 22 nt, Human
accccaguagcucccauggcua

SEQ ID NO: 1350376 - RNA, 24 nt, Human
accccgucucuaauaaaaauacaa

SEQ ID NO: 1350377 - RNA, 22 nt, Human
accuagcggcuuaaugaaacac

SEQ ID NO: 1350378 - RNA, 23 nt, Human
acuccaccauccaaugguaaugg

SEQ ID NO: 1350379 - RNA, 21 nt, Human
acugcucugagcuccuggagg

SEQ ID NO: 1350380 - RNA, 22 nt, Human
acugcucugagcuccuggaggc

SEQ ID NO: 1350381 - RNA, 22 nt, Human
agaaagcaggggucauggcacc

SEQ ID NO: 1350382 - RNA, 21 nt, Human
agagaaacacugugcuaugca

SEQ ID NO: 1350383 - RNA, 19 nt, Human
agagagccuuccccaggag

SEQ ID NO: 1350384 - RNA, 19 nt, Human
agagagccuuccccaggag

SEQ ID NO: 1350385 - RNA, 18 nt, Human
agagcccuuccuaccgcc

SEQ ID NO: 1350386 - RNA, 22 nt, Human
agagguggacugaucuauugua

SEQ ID NO: 1350387 - RNA, 18 nt, Human
agcaaaagaaucccugaa

SEQ ID NO: 1350388 - RNA, 24 nt, Human
agcacuuugggaggccgaggcagg

SEQ ID NO: 1350389 - RNA, 27 nt, Human
agccugagcuaagaugauacuggaggc

SEQ ID NO: 1350390 - RNA, 20 nt, Human
agcggcuuaaugaaacacaa

SEQ ID NO: 1350391 - RNA, 23 nt, Human
agcuauuuugggcccaaggugau

SEQ ID NO: 1350392 - RNA, 24 nt, Human
agcuugaaguuaggugaacuucca

SEQ ID NO: 1350393 - RNA, 23 nt, Human
aggaaagaggcacccuuuuucca

SEQ ID NO: 1350394 - RNA, 19 nt, Human
aggagacacuuugaaugau

SEQ ID NO: 1350395 - RNA, 23 nt, Human
aggcagaagugcagguguggugu

SEQ ID NO: 1350396 - RNA, 26 nt, Human
aggcagguggaucaugagguccggag

SEQ ID NO: 1350397 - RNA, 25 nt, Human
aggccaggcccacccacucaaggga

SEQ ID NO: 1350398 - RNA, 20 nt, Human
aggccgaggcagguggauca

SEQ ID NO: 1350399 - RNA, 24 nt, Human
agggaaaaucuuuuaccuucccca

SEQ ID NO: 1350400 - RNA, 19 nt, Human
agggauggggauuacacag

SEQ ID NO: 1350401 - RNA, 19 nt, Human
agguccggagaucgagacu

SEQ ID NO: 1350402 - RNA, 18 nt, Human
aguaacucaaugccaaau

SEQ ID NO: 1350403 - RNA, 23 nt, Human
agucaggcauacuggacacccuu

SEQ ID NO: 1350404 - RNA, 19 nt, Human
agugagaaggcaaucaucu

SEQ ID NO: 1350405 - RNA, 23 nt, Human
auacauucccuuuacuggauucu

SEQ ID NO: 1350406 - RNA, 26 nt, Human
auuagaaaagagaacaaaaggggccg

SEQ ID NO: 1350407 - RNA, 25 nt, Human
caaagaguguuuaacucauuguugg

SEQ ID NO: 1350408 - RNA, 26 nt, Human
caaagcagggacccaaaauguguaau

SEQ ID NO: 1350409 - RNA, 23 nt, Human
caacaauaguaacucaaugccaa

SEQ ID NO: 1350410 - RNA, 19 nt, Human
caagaaaaaucccucucau

SEQ ID NO: 1350411 - RNA, 20 nt, Human
caauaguaacucaaugccaa

SEQ ID NO: 1350412 - RNA, 24 nt, Human
caauguucaauuagaaacaagaga

SEQ ID NO: 1350413 - RNA, 22 nt, Human
cacacacauagaugaacgugca

SEQ ID NO: 1350414 - RNA, 22 nt, Human
cacacagacccccacccacagc

SEQ ID NO: 1350415 - RNA, 27 nt, Human
cacacagacccccacccacagcaggcc

SEQ ID NO: 1350416 - RNA, 25 nt, Human
caccccaguagcucccauggcuacu

SEQ ID NO: 1350417 - RNA, 20 nt, Human
caccugagccaaaccuuagu

SEQ ID NO: 1350418 - RNA, 22 nt, Human
caccuguaaugccagcacuuug

SEQ ID NO: 1350419 - RNA, 23 nt, Human
caccuguaaugccagcacuuugg

SEQ ID NO: 1350420 - RNA, 24 nt, Human
caccuguaaugccagcacuuuggg

SEQ ID NO: 1350421 - RNA, 21 nt, Human
cacuaugucagccaagaaacc

SEQ ID NO: 1350422 - RNA, 22 nt, Human
cacucaguccucgugaccucgu

SEQ ID NO: 1350423 - RNA, 20 nt, Human
cagaaauggaaccugcccaa

SEQ ID NO: 1350424 - RNA, 20 nt, Human
cagacaccugagccaaaccu

SEQ ID NO: 1350425 - RNA, 22 nt, Human
cagcaagaaagugaggcagaaa

SEQ ID NO: 1350426 - RNA, 24 nt, Human
cagcacuuugggaggccgaggcag

SEQ ID NO: 1350427 - RNA, 26 nt, Human
cagcacuuugggaggccgaggcaggu

SEQ ID NO: 1350428 - RNA, 28 nt, Human
cagcaggccaggccccccacgugaaguc

SEQ ID NO: 1350429 - RNA, 19 nt, Human
cagccuccagaaccaccag

SEQ ID NO: 1350430 - RNA, 26 nt, Human
cagccuccagaaccaccagagagaaa

SEQ ID NO: 1350431 - RNA, 20 nt, Human
caggacacgaguagagacgg

SEQ ID NO: 1350432 - RNA, 20 nt, Human
caggcauacuggacacccuu

SEQ ID NO: 1350433 - RNA, 23 nt, Human
caggugugguguggcugcguucu

SEQ ID NO: 1350434 - RNA, 19 nt, Human
caguaggggaaaaaagaag

SEQ ID NO: 1350435 - RNA, 18 nt, Human
caguggguuccaucuccc

SEQ ID NO: 1350436 - RNA, 21 nt, Human
caucucccuggccacugcacu

SEQ ID NO: 1350437 - RNA, 24 nt, Human
cauuuugcucuguuaaaugccaaa

SEQ ID NO: 1350438 - RNA, 18 nt, Human
ccaaugguaauggcaccc

SEQ ID NO: 1350439 - RNA, 23 nt, Human
ccacccacucaagggauggggau

SEQ ID NO: 1350440 - RNA, 19 nt, Human
ccagacaccugagccaaac

SEQ ID NO: 1350441 - RNA, 20 nt, Human
ccagacaccugagccaaacc

SEQ ID NO: 1350442 - RNA, 18 nt, Human
ccagcaagaaagugaggc

SEQ ID NO: 1350443 - RNA, 19 nt, Human
ccagcaagaaagugaggca

SEQ ID NO: 1350444 - RNA, 18 nt, Human
ccaguuagaacacacccc

SEQ ID NO: 1350445 - RNA, 21 nt, Human
ccaguuagaacacaccccuca

SEQ ID NO: 1350446 - RNA, 23 nt, Human
cccaaaggaaacaguaggggaaa

SEQ ID NO: 1350447 - RNA, 21 nt, Human
cccacagcaggccaggccccc

SEQ ID NO: 1350448 - RNA, 19 nt, Human
ccccaggaguugaaucugc

SEQ ID NO: 1350449 - RNA, 19 nt, Human
ccccaguagcucccauggc

SEQ ID NO: 1350450 - RNA, 18 nt, Human
ccccauggucucuccggg

SEQ ID NO: 1350451 - RNA, 23 nt, Human
ccccuccccaguaucuagaaccu

SEQ ID NO: 1350452 - RNA, 20 nt, Human
ccccugaaagaugcucuggg

SEQ ID NO: 1350453 - RNA, 24 nt, Human
ccccugaaagaugcucuggggaga

SEQ ID NO: 1350454 - RNA, 19 nt, Human
ccgggcgcgguagcuccca

SEQ ID NO: 1350455 - RNA, 20 nt, Human
ccgggcuucaagccuuccca

SEQ ID NO: 1350456 - RNA, 24 nt, Human
ccuaacauggugaaaccccgucuc

SEQ ID NO: 1350457 - RNA, 28 nt, Human
ccuaacauggugaaaccccgucucuaau

SEQ ID NO: 1350458 - RNA, 22 nt, Human
ccuauuuucucauccuguagcc

SEQ ID NO: 1350459 - RNA, 18 nt, Human
ccucuggggacccagccu

SEQ ID NO: 1350460 - RNA, 26 nt, Human
ccuguagcccucuuauaauguagcua

SEQ ID NO: 1350461 - RNA, 22 nt, Human
cuaagcagaaauggaaccugcc

SEQ ID NO: 1350462 - RNA, 22 nt, Human
cuauccuaacauggugaaaccc

SEQ ID NO: 1350463 - RNA, 23 nt, Human
cuauccuaacauggugaaacccc

SEQ ID NO: 1350464 - RNA, 23 nt, Human
cuauuguagaaaggagauaagcu

SEQ ID NO: 1350465 - RNA, 23 nt, Human
cucacaauaauaugagcccugga

SEQ ID NO: 1350466 - RNA, 21 nt, Human
cuccccaguaucuagaaccuu

SEQ ID NO: 1350467 - RNA, 20 nt, Human
cucccuggccacugcacuga

SEQ ID NO: 1350468 - RNA, 21 nt, Human
cucgugaccucgucuuccugc

SEQ ID NO: 1350469 - RNA, 22 nt, Human
cugaaacucuauagccccuccc

SEQ ID NO: 1350470 - RNA, 21 nt, Human
cugcuccccauggucucuccg

SEQ ID NO: 1350471 - RNA, 24 nt, Human
cuggcuguuacuggggacugcucu

SEQ ID NO: 1350472 - RNA, 20 nt, Human
cugugcuggccaaacagugg

SEQ ID NO: 1350473 - RNA, 24 nt, Human
cuuauaagaaaaggaacagagacc

SEQ ID NO: 1350474 - RNA, 18 nt, Human
cuugaucuuggacuuccc

SEQ ID NO: 1350475 - RNA, 23 nt, Human
cuuggcucaguaccuuacacuga

SEQ ID NO: 1350476 - RNA, 22 nt, Human
gaaaaauguaaucaacaaccac

SEQ ID NO: 1350477 - RNA, 21 nt, Human
gaaauuagaaggcccgaggca

SEQ ID NO: 1350478 - RNA, 21 nt, Human
gaacagagaccacauacucuu

SEQ ID NO: 1350479 - RNA, 23 nt, Human
gaacgugcaggaugcuggggugg

SEQ ID NO: 1350480 - RNA, 23 nt, Human
gacccagccuuuccccacacuca

SEQ ID NO: 1350481 - RNA, 18 nt, Human
gaccucgucuuccugcuc

SEQ ID NO: 1350482 - RNA, 18 nt, Human
gagaagaaaugaguguua

SEQ ID NO: 1350483 - RNA, 19 nt, Human
gaggaacacagugagaagg

SEQ ID NO: 1350484 - RNA, 19 nt, Human
gaguagagacggaauaacc

SEQ ID NO: 1350485 - RNA, 24 nt, Human
gaguagagacggaauaaccccacg

SEQ ID NO: 1350486 - RNA, 19 nt, Human
gcaggaugcugggguggcu

SEQ ID NO: 1350487 - RNA, 21 nt, Human
gcuggggagaagccucugcuc

SEQ ID NO: 1350488 - RNA, 22 nt, Human
ggaacacagugagaaggcaauc

SEQ ID NO: 1350489 - RNA, 21 nt, Human
ggaauaaccccacgagugaca

SEQ ID NO: 1350490 - RNA, 25 nt, Human
ggacugaucuauuguagaaaggaga

SEQ ID NO: 1350491 - RNA, 21 nt, Human
ggagaagaaaugaguguuagc

SEQ ID NO: 1350492 - RNA, 20 nt, Human
ggagagaagacaguccacuc

SEQ ID NO: 1350493 - RNA, 23 nt, Human
ggccagagauuuggguuaggggu

SEQ ID NO: 1350494 - RNA, 23 nt, Human
ggccaggccccccacgugaaguc

SEQ ID NO: 1350495 - RNA, 19 nt, Human
gggauggggauuacacagg

SEQ ID NO: 1350496 - RNA, 18 nt, Human
gggcacagaaauucccac

SEQ ID NO: 1350497 - RNA, 18 nt, Human
gggcauuguguggggagu

SEQ ID NO: 1350498 - RNA, 24 nt, Human
gggcauuguguggggagugggugc

SEQ ID NO: 1350499 - RNA, 24 nt, Human
gggcgcgguagcucccaccuguaa

SEQ ID NO: 1350500 - RNA, 21 nt, Human
guaaagcaggaagagagccuu

SEQ ID NO: 1350501 - RNA, 22 nt, Human
guacacacacacauagaugaac

SEQ ID NO: 1350502 - RNA, 20 nt, Human
gucaaaaaauucuuacuuaa

SEQ ID NO: 1350503 - RNA, 18 nt, Human
guccccaguaacagccag

SEQ ID NO: 1350504 - RNA, 21 nt, Human
gugaagucuucauacagcccu

SEQ ID NO: 1350505 - RNA, 23 nt, Human
gugcuggccaaacaguggguucc

SEQ ID NO: 1350506 - RNA, 23 nt, Human
uaaagucaggcauacuggacacc

SEQ ID NO: 1350507 - RNA, 22 nt, Human
uaacauggugaaaccccgucuc

SEQ ID NO: 1350508 - RNA, 24 nt, Human
uaacauggugaaaccccgucucua

SEQ ID NO: 1350509 - RNA, 20 nt, Human
uaaccccacgagugacagcu

SEQ ID NO: 1350510 - RNA, 27 nt, Human
uaacuccccaguuagaacacaccccuu

SEQ ID NO: 1350511 - RNA, 22 nt, Human
uaagcaucaugaaucaaauaga

SEQ ID NO: 1350512 - RNA, 23 nt, Human
uaaguacaacuuugcuacauaaa

SEQ ID NO: 1350513 - RNA, 21 nt, Human
uacacugaguaaauauuuaau

SEQ ID NO: 1350514 - RNA, 21 nt, Human
uacuacagaaucaucagcuau

SEQ ID NO: 1350515 - RNA, 19 nt, Human
uacuggggacugcucugag

SEQ ID NO: 1350516 - RNA, 21 nt, Human
uacuuuccccacauguuccca

SEQ ID NO: 1350517 - RNA, 20 nt, Human
uagaaauagacacacaugcc

SEQ ID NO: 1350518 - RNA, 25 nt, Human
uagaacacaccccucacaguuacuu

SEQ ID NO: 1350519 - RNA, 19 nt, Human
uagaaggcccgaggcagag

SEQ ID NO: 1350520 - RNA, 22 nt, Human
uagcacacccaacugcuaagag

SEQ ID NO: 1350521 - RNA, 26 nt, Human
uaguagauucuaaauugcuauguaaa

SEQ ID NO: 1350522 - RNA, 19 nt, Human
uauuacagcgaucaaacuu

SEQ ID NO: 1350523 - RNA, 21 nt, Human
ucacaugauacauucccuuua

SEQ ID NO: 1350524 - RNA, 24 nt, Human
ucaugagguccggagaucgagacu

SEQ ID NO: 1350525 - RNA, 18 nt, Human
uccaauaagcugucuucc

SEQ ID NO: 1350526 - RNA, 20 nt, Human
uccacucucagaggaacaca

SEQ ID NO: 1350527 - RNA, 21 nt, Human
uccagaaagcaggggucaugg

SEQ ID NO: 1350528 - RNA, 18 nt, Human
uccagagauguuuagacu

SEQ ID NO: 1350529 - RNA, 22 nt, Human
ucccaaagaaacagauuuagcu

SEQ ID NO: 1350530 - RNA, 19 nt, Human
uccccacauguucccaccc

SEQ ID NO: 1350531 - RNA, 22 nt, Human
uccuaccgccucaauccagaaa

SEQ ID NO: 1350532 - RNA, 21 nt, Human
uccugcuguguggcagaucca

SEQ ID NO: 1350533 - RNA, 18 nt, Human
ucucuccggcuaagcaga

SEQ ID NO: 1350534 - RNA, 18 nt, Human
ucuuucucucucuuucuc

SEQ ID NO: 1350535 - RNA, 23 nt, Human
ugaagcaaaagaaucccugaaac

SEQ ID NO: 1350536 - RNA, 19 nt, Human
ugaagggcauugugugggg

SEQ ID NO: 1350537 - RNA, 30 nt, Human
ugaaucaaauagauaaccccacuaggauag

SEQ ID NO: 1350538 - RNA, 20 nt, Human
ugacuauagcagacccuguc

SEQ ID NO: 1350539 - RNA, 26 nt, Human
ugagcuacagaaaugucuccagcuaa

SEQ ID NO: 1350540 - RNA, 22 nt, Human
ugagggaaucuugggggucacu

SEQ ID NO: 1350541 - RNA, 24 nt, Human
ugaugggauuagugucuuauaaga

SEQ ID NO: 1350542 - RNA, 18 nt, Human
ugauuggcccaaggguga

SEQ ID NO: 1350543 - RNA, 25 nt, Human
ugcaggugugguguggcugcguucu

SEQ ID NO: 1350544 - RNA, 22 nt, Human
ugccuugccucaccccaauuca

SEQ ID NO: 1350545 - RNA, 20 nt, Human
ugcuacgcacuugcuucauc

SEQ ID NO: 1350546 - RNA, 19 nt, Human
ugcugggguggcucagugg

SEQ ID NO: 1350547 - RNA, 20 nt, Human
ugcugggguggcucaguggg

SEQ ID NO: 1350548 - RNA, 18 nt, Human
uggaagcacagagcuggg

SEQ ID NO: 1350549 - RNA, 24 nt, Human
ugggaggccgaggcagguggauca

SEQ ID NO: 1350550 - RNA, 20 nt, Human
uggggacccagccuuucccc

SEQ ID NO: 1350551 - RNA, 19 nt, Human
uggggagugggugccugag

SEQ ID NO: 1350552 - RNA, 19 nt, Human
uggggugaggccagagauu

SEQ ID NO: 1350553 - RNA, 19 nt, Human
uggguuccaucucccuggc

SEQ ID NO: 1350554 - RNA, 18 nt, Human
ugguguggcugcguucuc

SEQ ID NO: 1350555 - RNA, 22 nt, Human
uguaauuuuaaugcacuacauu

SEQ ID NO: 1350556 - RNA, 26 nt, Human
ugucuuauaagaaaaggaacagagac

SEQ ID NO: 1350557 - RNA, 24 nt, Human
ugugaccaaagcucaaauggucag

SEQ ID NO: 1350558 - RNA, 22 nt, Human
uguggggagugggugccugaga

SEQ ID NO: 1350559 - RNA, 22 nt, Human
ugugguguggcugcguucucug

SEQ ID NO: 1350560 - RNA, 22 nt, Human
uguucccaccccaguagcuccc

SEQ ID NO: 1350561 - RNA, 20 nt, Human
uuaaagaguucacuugauua

SEQ ID NO: 1350562 - RNA, 22 nt, Human
uuacacagguugugcacacugg

SEQ ID NO: 1350563 - RNA, 19 nt, Human
uuacuggggacugcucuga

SEQ ID NO: 1350564 - RNA, 24 nt, Human
uuacuggggacugcucugagcucc

SEQ ID NO: 1350565 - RNA, 18 nt, Human
uuagaaaagagaacaaaa

SEQ ID NO: 1350566 - RNA, 24 nt, Human
uuagucauuuuuuucccacugggu

SEQ ID NO: 1350567 - RNA, 19 nt, Human
uucaugucagaguuguaga

SEQ ID NO: 1350568 - RNA, 20 nt, Human
uuccucuggggacccagccu

SEQ ID NO: 1350569 - RNA, 23 nt, Human
uuccugcugcacacagaccccca

SEQ ID NO: 1350570 - RNA, 22 nt, Human
uuccugggauuuggagcuucug

SEQ ID NO: 1350571 - RNA, 24 nt, Human
uucuacgcuauguaacaaauuacu

SEQ ID NO: 1350572 - RNA, 19 nt, Human
uucucugcguagggucuca

SEQ ID NO: 1350573 - RNA, 21 nt, Human
uuggcacuuuacuuuugcaua

SEQ ID NO: 1350574 - RNA, 25 nt, Human
uugggaggccgaggcagguggauca

SEQ ID NO: 1350575 - RNA, 18 nt, Human
uugugccaaagcagggac

SEQ ID NO: 1350576 - RNA, 18 nt, Human
uuuacuggauucucugca

SEQ ID NO: 1350577 - RNA, 20 nt, Human
uuuccagagauguuuagacu

SEQ ID NO: 1350578 - RNA, 20 nt, Human
uuugcuuauccccuuauuca

SEQ ID NO: 1350579 - RNA, 22 nt, Human
aaaaaacaaacaaacaaaugca

SEQ ID NO: 1350580 - RNA, 20 nt, Human
aaaaagaccucugccccagc

SEQ ID NO: 1350581 - RNA, 23 nt, Human
aaaaagaccucugccccagccca

SEQ ID NO: 1350582 - RNA, 21 nt, Human
aaaaaugcauugauggcuggg

SEQ ID NO: 1350583 - RNA, 21 nt, Human
aaagaccucugccccagccca

SEQ ID NO: 1350584 - RNA, 20 nt, Human
aaaguuauuggcauugccau

SEQ ID NO: 1350585 - RNA, 20 nt, Human
aacauggagaaaccccgucu

SEQ ID NO: 1350586 - RNA, 21 nt, Human
aacauggagaaaccccgucuc

SEQ ID NO: 1350587 - RNA, 19 nt, Human
aacauggugaaaccccauc

SEQ ID NO: 1350588 - RNA, 20 nt, Human
aacauggugaaaccccaucu

SEQ ID NO: 1350589 - RNA, 21 nt, Human
aacauggugaaaccccaucuc

SEQ ID NO: 1350590 - RNA, 22 nt, Human
aacauggugaaaccccaucuca

SEQ ID NO: 1350591 - RNA, 20 nt, Human
aaccugcccccggcuccccc

SEQ ID NO: 1350592 - RNA, 23 nt, Human
aagagugaaacucugucucaaaa

SEQ ID NO: 1350593 - RNA, 18 nt, Human
aauuagccaggcauggug

SEQ ID NO: 1350594 - RNA, 20 nt, Human
acaagagugaaacucugucu

SEQ ID NO: 1350595 - RNA, 21 nt, Human
acaagagugaaacucugucuc

SEQ ID NO: 1350596 - RNA, 21 nt, Human
acacaggagaaucaagaaccc

SEQ ID NO: 1350597 - RNA, 20 nt, Human
acaggagaaucaagaaccca

SEQ ID NO: 1350598 - RNA, 19 nt, Human
acagugcuaacugcagcug

SEQ ID NO: 1350599 - RNA, 22 nt, Human
accauuguacuccagccugggc

SEQ ID NO: 1350600 - RNA, 23 nt, Human
accauuguacuccagccugggca

SEQ ID NO: 1350601 - RNA, 24 nt, Human
accauuguacuccagccugggcaa

SEQ ID NO: 1350602 - RNA, 24 nt, Human
acccaggagacggagguugcagug

SEQ ID NO: 1350603 - RNA, 24 nt, Human
accccgucucuacuaaaaauacaa

SEQ ID NO: 1350604 - RNA, 20 nt, Human
accugaggucgggaguucaa

SEQ ID NO: 1350605 - RNA, 22 nt, Human
accugaggucgggaguucaaga

SEQ ID NO: 1350606 - RNA, 24 nt, Human
accugaggucgggaguucaagacc

SEQ ID NO: 1350607 - RNA, 23 nt, Human
accuguaaucccagcuacucagg

SEQ ID NO: 1350608 - RNA, 23 nt, Human
agaaggcugacacaggagaauca

SEQ ID NO: 1350609 - RNA, 24 nt, Human
agacggagguugcagugagcugag

SEQ ID NO: 1350610 - RNA, 20 nt, Human
agagagaagcugguaacugg

SEQ ID NO: 1350611 - RNA, 19 nt, Human
agaucccuggcagcugcuc

SEQ ID NO: 1350612 - RNA, 24 nt, Human
agcacuuugggaggcugaggcggg

SEQ ID NO: 1350613 - RNA, 21 nt, Human
agcauuuugggaggccgaggc

SEQ ID NO: 1350614 - RNA, 24 nt, Human
agcauuuugggaggccgaggcggg

SEQ ID NO: 1350615 - RNA, 25 nt, Human
agccucaagucucugaagccccagc

SEQ ID NO: 1350616 - RNA, 22 nt, Human
agccuggccaacauggugaaac

SEQ ID NO: 1350617 - RNA, 24 nt, Human
agccuggccaacauggugaaaccc

SEQ ID NO: 1350618 - RNA, 20 nt, Human
agcugcacccuccauccucu

SEQ ID NO: 1350619 - RNA, 23 nt, Human
aggagacggagguugcagugagc

SEQ ID NO: 1350620 - RNA, 21 nt, Human
aggaggcugaggcuggagaag

SEQ ID NO: 1350621 - RNA, 22 nt, Human
aggcacuuuuggggcuagaggg

SEQ ID NO: 1350622 - RNA, 24 nt, Human
aggcagagccccagaagcccaugg

SEQ ID NO: 1350623 - RNA, 21 nt, Human
aggcagccugggauuccgggg

SEQ ID NO: 1350624 - RNA, 24 nt, Human
aggcagccugggauuccggggcag

SEQ ID NO: 1350625 - RNA, 24 nt, Human
aggcaugguggcacauaccuguaa

SEQ ID NO: 1350626 - RNA, 21 nt, Human
aggccgaggcgggcggauuac

SEQ ID NO: 1350627 - RNA, 21 nt, Human
aggcgggcagaucaucugagg

SEQ ID NO: 1350628 - RNA, 22 nt, Human
aggcgggcagaucaucugaggu

SEQ ID NO: 1350629 - RNA, 26 nt, Human
aggcgggcagaucaucugaggucaga

SEQ ID NO: 1350630 - RNA, 22 nt, Human
aggcgggcggauuaccugaggu

SEQ ID NO: 1350631 - RNA, 20 nt, Human
aggcuaaacacugggugggu

SEQ ID NO: 1350632 - RNA, 21 nt, Human
aggcugaggcgggcagaucau

SEQ ID NO: 1350633 - RNA, 24 nt, Human
aggcugaggcuggagaagcgcuug

SEQ ID NO: 1350634 - RNA, 21 nt, Human
aggcugcagggcaugggugug

SEQ ID NO: 1350635 - RNA, 19 nt, Human
agggauggggagggagggc

SEQ ID NO: 1350636 - RNA, 23 nt, Human
agggauggggagggagggccggg

SEQ ID NO: 1350637 - RNA, 25 nt, Human
agggguggggagaggucgggaggga

SEQ ID NO: 1350638 - RNA, 19 nt, Human
aggugcccgcguccucugc

SEQ ID NO: 1350639 - RNA, 24 nt, Human
agguggagguugcagugagccaag

SEQ ID NO: 1350640 - RNA, 24 nt, Human
aguggcucacaccucuaaucccag

SEQ ID NO: 1350641 - RNA, 20 nt, Human
auaaagcaugucuacacccc

SEQ ID NO: 1350642 - RNA, 24 nt, Human
aucgcaccauuguacuccagccug

SEQ ID NO: 1350643 - RNA, 24 nt, Human
aucgcgccauugcccuccagccug

SEQ ID NO: 1350644 - RNA, 21 nt, Human
aucuauuccauuuugccaaca

SEQ ID NO: 1350645 - RNA, 19 nt, Human
augccuguaaucccagcac

SEQ ID NO: 1350646 - RNA, 24 nt, Human
augggcacugggcagcaggcaccg

SEQ ID NO: 1350647 - RNA, 22 nt, Human
auguggaacacaacgcuuuuaa

SEQ ID NO: 1350648 - RNA, 21 nt, Human
auguuggccucaggagggcuu

SEQ ID NO: 1350649 - RNA, 24 nt, Human
auuaccugaggucgggaguucaag

SEQ ID NO: 1350650 - RNA, 18 nt, Human
auugcccuccagccuggg

SEQ ID NO: 1350651 - RNA, 22 nt, Human
auuguacuccagccugggcaag

SEQ ID NO: 1350652 - RNA, 27 nt, Human
caaaaaaguggccuuuauuuuccaguc

SEQ ID NO: 1350653 - RNA, 23 nt, Human
caacaagagugaaacucugucuc

SEQ ID NO: 1350654 - RNA, 24 nt, Human
caacauggagaaaccccgucucua

SEQ ID NO: 1350655 - RNA, 18 nt, Human
caacauggugaaacccca

SEQ ID NO: 1350656 - RNA, 22 nt, Human
caaccugcccccggcuccccca

SEQ ID NO: 1350657 - RNA, 23 nt, Human
caaccugcccccggcucccccaa

SEQ ID NO: 1350658 - RNA, 19 nt, Human
caagggguggggagagguc

SEQ ID NO: 1350659 - RNA, 24 nt, Human
cacaccucuaaucccagcauuuug

SEQ ID NO: 1350660 - RNA, 23 nt, Human
caccaacugccccagggcugccu

SEQ ID NO: 1350661 - RNA, 20 nt, Human
caccgcacgggguaggcugc

SEQ ID NO: 1350662 - RNA, 23 nt, Human
caccucuaaucccagcauuuugg

SEQ ID NO: 1350663 - RNA, 24 nt, Human
caccucuaaucccagcauuuuggg

SEQ ID NO: 1350664 - RNA, 26 nt, Human
caccucuaaucccagcauuuugggag

SEQ ID NO: 1350665 - RNA, 22 nt, Human
caccuggggaaggugggccuca

SEQ ID NO: 1350666 - RNA, 19 nt, Human
cacgcucgacccaugugga

SEQ ID NO: 1350667 - RNA, 21 nt, Human
cacucuugcuccgaggcaaag

SEQ ID NO: 1350668 - RNA, 25 nt, Human
cagaagcccauggauucaggaaucu

SEQ ID NO: 1350669 - RNA, 23 nt, Human
cagaagccccaggcuggggacga

SEQ ID NO: 1350670 - RNA, 24 nt, Human
cagaucaucugaggucagaaguuc

SEQ ID NO: 1350671 - RNA, 21 nt, Human
cagauugcucuucuugaaaac

SEQ ID NO: 1350672 - RNA, 22 nt, Human
cagcacuuugggaggcugaggc

SEQ ID NO: 1350673 - RNA, 24 nt, Human
cagcacuuugggaggcugaggcgg

SEQ ID NO: 1350674 - RNA, 24 nt, Human
cagcauuuugggaggccgaggcgg

SEQ ID NO: 1350675 - RNA, 24 nt, Human
cagccugugguuaugucagagaug

SEQ ID NO: 1350676 - RNA, 22 nt, Human
caggaccagaaccacccuaagc

SEQ ID NO: 1350677 - RNA, 24 nt, Human
caggaccagaaccacccuaagcag

SEQ ID NO: 1350678 - RNA, 29 nt, Human
caggagguggagguugcagugacaacggu

SEQ ID NO: 1350679 - RNA, 21 nt, Human
cagggccagggcucccugggc

SEQ ID NO: 1350680 - RNA, 24 nt, Human
caggggcccuggacccaagcuccu

SEQ ID NO: 1350681 - RNA, 24 nt, Human
cagucugaccaacauggagaaacc

SEQ ID NO: 1350682 - RNA, 19 nt, Human
cauaccuguaaucccagcu

SEQ ID NO: 1350683 - RNA, 20 nt, Human
cauccucucagccuccgacu

SEQ ID NO: 1350684 - RNA, 20 nt, Human
caucuccacccaguccaggg

SEQ ID NO: 1350685 - RNA, 19 nt, Human
caucuguaauccuagcuac

SEQ ID NO: 1350686 - RNA, 24 nt, Human
caucuguaauccuagcuacucaga

SEQ ID NO: 1350687 - RNA, 22 nt, Human
caugacagacagcuuggggccc

SEQ ID NO: 1350688 - RNA, 22 nt, Human
caugagcgccaggaccagaacc

SEQ ID NO: 1350689 - RNA, 20 nt, Human
caugccuguaaucccagcac

SEQ ID NO: 1350690 - RNA, 24 nt, Human
caugccuguaaucccagcacuuug

SEQ ID NO: 1350691 - RNA, 18 nt, Human
cauuacacaucucccugc

SEQ ID NO: 1350692 - RNA, 18 nt, Human
cauugcccuccagccugg

SEQ ID NO: 1350693 - RNA, 19 nt, Human
cauugcccuccagccuggg

SEQ ID NO: 1350694 - RNA, 23 nt, Human
cauugcccuccagccugggcaac

SEQ ID NO: 1350695 - RNA, 24 nt, Human
cauugcccuccagccugggcaaca

SEQ ID NO: 1350696 - RNA, 18 nt, Human
cauuguacuccagccugg

SEQ ID NO: 1350697 - RNA, 19 nt, Human
cauuguacuccagccuggg

SEQ ID NO: 1350698 - RNA, 20 nt, Human
cauuguacuccagccugggc

SEQ ID NO: 1350699 - RNA, 21 nt, Human
cauuguacuccagccugggca

SEQ ID NO: 1350700 - RNA, 22 nt, Human
cauuguacuccagccugggcaa

SEQ ID NO: 1350701 - RNA, 23 nt, Human
cauuguacuccagccugggcaag

SEQ ID NO: 1350702 - RNA, 23 nt, Human
cauuguacuccagccugggcaag

SEQ ID NO: 1350703 - RNA, 18 nt, Human
ccacagcagccuucaccc

SEQ ID NO: 1350704 - RNA, 19 nt, Human
ccacccaguccaggggccc

SEQ ID NO: 1350705 - RNA, 20 nt, Human
ccacccaguccaggggcccu

SEQ ID NO: 1350706 - RNA, 28 nt, Human
ccagaacccacaccugugagguauacag

SEQ ID NO: 1350707 - RNA, 22 nt, Human
ccagaagauaacucccuuugcc

SEQ ID NO: 1350708 - RNA, 24 nt, Human
ccagagagaggaagccaagagucc

SEQ ID NO: 1350709 - RNA, 22 nt, Human
ccaggagguggagguugcagug

SEQ ID NO: 1350710 - RNA, 20 nt, Human
ccaggggcccuggacccaag

SEQ ID NO: 1350711 - RNA, 24 nt, Human
ccaguccaggggcccuggacccaa

SEQ ID NO: 1350712 - RNA, 22 nt, Human
ccauccucucagccuccgacuc

SEQ ID NO: 1350713 - RNA, 21 nt, Human
ccauugcccuccagccugggc

SEQ ID NO: 1350714 - RNA, 22 nt, Human
ccauugcccuccagccugggca

SEQ ID NO: 1350715 - RNA, 23 nt, Human
ccauugcccuccagccugggcaa

SEQ ID NO: 1350716 - RNA, 24 nt, Human
ccauugcccuccagccugggcaac

SEQ ID NO: 1350717 - RNA, 21 nt, Human
ccauuguacuccagccugggc

SEQ ID NO: 1350718 - RNA, 22 nt, Human
ccauuguacuccagccugggca

SEQ ID NO: 1350719 - RNA, 24 nt, Human
ccauuguacuccagccugggcaag

SEQ ID NO: 1350720 - RNA, 18 nt, Human
cccaagcaucacugccuc

SEQ ID NO: 1350721 - RNA, 18 nt, Human
cccacaacccuuccccau

SEQ ID NO: 1350722 - RNA, 24 nt, Human
cccacaacccuuccccauugcuau

SEQ ID NO: 1350723 - RNA, 21 nt, Human
cccacagagcuagagccucug

SEQ ID NO: 1350724 - RNA, 21 nt, Human
cccaggagguggagguugcag

SEQ ID NO: 1350725 - RNA, 22 nt, Human
cccaggcuggggacgacggggc

SEQ ID NO: 1350726 - RNA, 20 nt, Human
cccaguacuaaagcugcacc

SEQ ID NO: 1350727 - RNA, 24 nt, Human
cccaguacuaaagcugcacccucc

SEQ ID NO: 1350728 - RNA, 22 nt, Human
ccccacuuauaaagcaugucua

SEQ ID NO: 1350729 - RNA, 20 nt, Human
ccccauggccauucuccaaa

SEQ ID NO: 1350730 - RNA, 24 nt, Human
cccccaagcaucacugccucaacc

SEQ ID NO: 1350731 - RNA, 19 nt, Human
cccgucuuuccugugucca

SEQ ID NO: 1350732 - RNA, 23 nt, Human
cccgucuuuccuguguccaggaa

SEQ ID NO: 1350733 - RNA, 18 nt, Human
cccuaugggaggcagagc

SEQ ID NO: 1350734 - RNA, 24 nt, Human
cccuccagccugggcaacaagagu

SEQ ID NO: 1350735 - RNA, 22 nt, Human
cccuggacccaagcuccugccc

SEQ ID NO: 1350736 - RNA, 25 nt, Human
cccugggccggcucccuuggaccuu

SEQ ID NO: 1350737 - RNA, 20 nt, Human
ccgugugggugcuccuuccu

SEQ ID NO: 1350738 - RNA, 21 nt, Human
ccuaacccccucaccugggga

SEQ ID NO: 1350739 - RNA, 19 nt, Human
ccucaccuggggaaggugg

SEQ ID NO: 1350740 - RNA, 23 nt, Human
ccuccagccugggcaacaagagu

SEQ ID NO: 1350741 - RNA, 22 nt, Human
ccugacagcuagcuuuaaaaca

SEQ ID NO: 1350742 - RNA, 23 nt, Human
ccuggccaacauggugaaacccc

SEQ ID NO: 1350743 - RNA, 24 nt, Human
ccuggccaacauggugaaacccca

SEQ ID NO: 1350744 - RNA, 22 nt, Human
ccuggcccaggcuguuggucuu

SEQ ID NO: 1350745 - RNA, 21 nt, Human
ccuguaaucccagcuacucag

SEQ ID NO: 1350746 - RNA, 21 nt, Human
ccuucccaaauccuucauuaa

SEQ ID NO: 1350747 - RNA, 24 nt, Human
cgagaccagccuggccaacauggu

SEQ ID NO: 1350748 - RNA, 18 nt, Human
cgaggcaaaguuauuggc

SEQ ID NO: 1350749 - RNA, 24 nt, Human
cgaggcgggcggauuaccugaggu

SEQ ID NO: 1350750 - RNA, 21 nt, Human
cgcaccauuguacuccagccu

SEQ ID NO: 1350751 - RNA, 19 nt, Human
cgcgccauugcccuccagc

SEQ ID NO: 1350752 - RNA, 21 nt, Human
cgcggccccuguccugugcug

SEQ ID NO: 1350753 - RNA, 24 nt, Human
cggauuaccugaggucgggaguuc

SEQ ID NO: 1350754 - RNA, 22 nt, Human
cggcacacaccagguucaugug

SEQ ID NO: 1350755 - RNA, 24 nt, Human
cgggcagaucaucugaggucagaa

SEQ ID NO: 1350756 - RNA, 18 nt, Human
cgggcggauuaccugagg

SEQ ID NO: 1350757 - RNA, 19 nt, Human
cucaaaaaacaaacaaaca

SEQ ID NO: 1350758 - RNA, 21 nt, Human
cucacaccucuaaucccagca

SEQ ID NO: 1350759 - RNA, 21 nt, Human
cucacaccucuaaucccagca

SEQ ID NO: 1350760 - RNA, 19 nt, Human
cucagaaggcugacacagg

SEQ ID NO: 1350761 - RNA, 24 nt, Human
cucaugccuguaaucccagcacuu

SEQ ID NO: 1350762 - RNA, 24 nt, Human
cucccccaagcaucacugccucaa

SEQ ID NO: 1350763 - RNA, 21 nt, Human
cucccuuggaccuuuggccuu

SEQ ID NO: 1350764 - RNA, 22 nt, Human
cucugcaccgcggccccugucc

SEQ ID NO: 1350765 - RNA, 19 nt, Human
cucugucucaaaaaaaaaa

SEQ ID NO: 1350766 - RNA, 22 nt, Human
cucugucucaaaaaacaaacaa

SEQ ID NO: 1350767 - RNA, 22 nt, Human
cugaccaacauggagaaacccc

SEQ ID NO: 1350768 - RNA, 21 nt, Human
cugaggcuuggagaaguuggg

SEQ ID NO: 1350769 - RNA, 19 nt, Human
cugccacagcuguaggugc

SEQ ID NO: 1350770 - RNA, 22 nt, Human
cugcugccgccaccauccgugu

SEQ ID NO: 1350771 - RNA, 23 nt, Human
cuggccaacauggugaaacccca

SEQ ID NO: 1350772 - RNA, 20 nt, Human
cuggccaucuuucugccagg

SEQ ID NO: 1350773 - RNA, 19 nt, Human
cuggcccugggauccagga

SEQ ID NO: 1350774 - RNA, 22 nt, Human
cugucagaggagaugggcuggc

SEQ ID NO: 1350775 - RNA, 19 nt, Human
cuguccugugcuggcuggg

SEQ ID NO: 1350776 - RNA, 19 nt, Human
cuuccuuucucccuagccc

SEQ ID NO: 1350777 - RNA, 21 nt, Human
cuugaacccaggagguggagg

SEQ ID NO: 1350778 - RNA, 18 nt, Human
cuuggagaaguuggguga

SEQ ID NO: 1350779 - RNA, 19 nt, Human
gaaaccccaucucaacuaa

SEQ ID NO: 1350780 - RNA, 18 nt, Human
gaaugaguagagaagacu

SEQ ID NO: 1350781 - RNA, 21 nt, Human
gaccugcccccggcuggugcc

SEQ ID NO: 1350782 - RNA, 22 nt, Human
gacgacggggcccauggagaga

SEQ ID NO: 1350783 - RNA, 21 nt, Human
gagaaaccccgucucuacuaa

SEQ ID NO: 1350784 - RNA, 21 nt, Human
gagaaguugggugacuugcca

SEQ ID NO: 1350785 - RNA, 19 nt, Human
gagagccgcaccaacugcc

SEQ ID NO: 1350786 - RNA, 21 nt, Human
gagguggagguugcagugagc

SEQ ID NO: 1350787 - RNA, 18 nt, Human
gagguugcagugagccaa

SEQ ID NO: 1350788 - RNA, 23 nt, Human
gagguugcagugagccaagaucg

SEQ ID NO: 1350789 - RNA, 23 nt, Human
gagguugcagugagcugagaucg

SEQ ID NO: 1350790 - RNA, 18 nt, Human
gauaacagugcuaacugc

SEQ ID NO: 1350791 - RNA, 24 nt, Human
gaucaucugaggucagaaguucga

SEQ ID NO: 1350792 - RNA, 23 nt, Human
gauuaccugaggucgggaguuca

SEQ ID NO: 1350793 - RNA, 24 nt, Human
gauuaccugaggucgggaguucaa

SEQ ID NO: 1350794 - RNA, 20 nt, Human
gcaccauuguacuccagccu

SEQ ID NO: 1350795 - RNA, 19 nt, Human
gcacuuuuggggcuagagg

SEQ ID NO: 1350796 - RNA, 23 nt, Human
gcagagccccagaagcccaugga

SEQ ID NO: 1350797 - RNA, 20 nt, Human
gcagccgccauaccagaagc

SEQ ID NO: 1350798 - RNA, 27 nt, Human
gcauugauggcugggcgugguggcuca

SEQ ID NO: 1350799 - RNA, 24 nt, Human
gccaacauggugaaaccccaucuc

SEQ ID NO: 1350800 - RNA, 22 nt, Human
gccauugcccuccagccugggc

SEQ ID NO: 1350801 - RNA, 19 nt, Human
gccccaggcuggggacgac

SEQ ID NO: 1350802 - RNA, 20 nt, Human
gccccagggcugccugcacc

SEQ ID NO: 1350803 - RNA, 20 nt, Human
gcccuggacccaagcuccug

SEQ ID NO: 1350804 - RNA, 19 nt, Human
gcugggcacaguggcucac

SEQ ID NO: 1350805 - RNA, 20 nt, Human
gcugggcacaguggcucaca

SEQ ID NO: 1350806 - RNA, 21 nt, Human
gcugggcgugguggcucaugc

SEQ ID NO: 1350807 - RNA, 18 nt, Human
ggaaagggacuuggaagc

SEQ ID NO: 1350808 - RNA, 18 nt, Human
ggaagcucauagaaucca

SEQ ID NO: 1350809 - RNA, 18 nt, Human
ggagaaacagaaguuagg

SEQ ID NO: 1350810 - RNA, 19 nt, Human
ggagaaccccggagccacc

SEQ ID NO: 1350811 - RNA, 21 nt, Human
ggagaagcgcuugaacccagg

SEQ ID NO: 1350812 - RNA, 18 nt, Human
ggagaaucaagaacccag

SEQ ID NO: 1350813 - RNA, 20 nt, Human
ggagaggucgggagggacgg

SEQ ID NO: 1350814 - RNA, 18 nt, Human
ggaggucagggccagggc

SEQ ID NO: 1350815 - RNA, 20 nt, Human
ggagguugcagugagccaag

SEQ ID NO: 1350816 - RNA, 23 nt, Human
ggagguugcagugagccaagauc

SEQ ID NO: 1350817 - RNA, 24 nt, Human
ggagguugcagugagccaagaucg

SEQ ID NO: 1350818 - RNA, 22 nt, Human
ggagguugcagugagcugagau

SEQ ID NO: 1350819 - RNA, 24 nt, Human
ggagguugcagugagcugagaucg

SEQ ID NO: 1350820 - RNA, 23 nt, Human
ggauuaccugaggucgggaguuc

SEQ ID NO: 1350821 - RNA, 23 nt, Human
ggcacaguggcucacaccucuaa

SEQ ID NO: 1350822 - RNA, 19 nt, Human
ggccccuguccugugcugg

SEQ ID NO: 1350823 - RNA, 19 nt, Human
ggcuaaacacugggugggu

SEQ ID NO: 1350824 - RNA, 21 nt, Human
ggcucaugccuguaaucccag

SEQ ID NO: 1350825 - RNA, 21 nt, Human
ggcugggcgugguggcucaug

SEQ ID NO: 1350826 - RNA, 20 nt, Human
gggauggggagggagggccg

SEQ ID NO: 1350827 - RNA, 22 nt, Human
gggauggggagggagggccggc

SEQ ID NO: 1350828 - RNA, 18 nt, Human
gggccuccccuggcccag

SEQ ID NO: 1350829 - RNA, 24 nt, Human
gggcgugguggcucaugccuguaa

SEQ ID NO: 1350830 - RNA, 24 nt, Human
gggcugccugcaccaacgagggcu

SEQ ID NO: 1350831 - RNA, 24 nt, Human
gggguggggagaggucgggaggga

SEQ ID NO: 1350832 - RNA, 19 nt, Human
gggguuuagcuccaacugg

SEQ ID NO: 1350833 - RNA, 21 nt, Human
ggguggcgcuggugauccggc

SEQ ID NO: 1350834 - RNA, 19 nt, Human
ggugcccgcguccucugcc

SEQ ID NO: 1350835 - RNA, 24 nt, Human
gguggcacauaccuguaaucccag

SEQ ID NO: 1350836 - RNA, 20 nt, Human
gguggcgcuggugauccggc

SEQ ID NO: 1350837 - RNA, 23 nt, Human
gguggcgcuggugauccggcauc

SEQ ID NO: 1350838 - RNA, 24 nt, Human
gguggcucaugccuguaaucccag

SEQ ID NO: 1350839 - RNA, 22 nt, Human
gguggggagaggucgggaggga

SEQ ID NO: 1350840 - RNA, 18 nt, Human
gucacugaggugcccagu

SEQ ID NO: 1350841 - RNA, 25 nt, Human
gucugcgcaagagccaugggcacca

SEQ ID NO: 1350842 - RNA, 20 nt, Human
gugauaggcaucuguaaucc

SEQ ID NO: 1350843 - RNA, 21 nt, Human
gugcgaaacucugucucaaaa

SEQ ID NO: 1350844 - RNA, 19 nt, Human
guugcagugagcugagauc

SEQ ID NO: 1350845 - RNA, 20 nt, Human
uaaaaauacaaaauuagcca

SEQ ID NO: 1350846 - RNA, 22 nt, Human
uaaaaauacaaaauuagccagg

SEQ ID NO: 1350847 - RNA, 23 nt, Human
uaaaaauacaaaauuagccaggc

SEQ ID NO: 1350848 - RNA, 23 nt, Human
uaaaugaaaaaagaccucugccc

SEQ ID NO: 1350849 - RNA, 23 nt, Human
uaauaugauccagucccaggagu

SEQ ID NO: 1350850 - RNA, 19 nt, Human
uacacaucucccugcccag

SEQ ID NO: 1350851 - RNA, 23 nt, Human
uacagagagaagcugguaacugg

SEQ ID NO: 1350852 - RNA, 23 nt, Human
uacccaggcauggugauaggcau

SEQ ID NO: 1350853 - RNA, 24 nt, Human
uaccuguaaucccagcuacucagg

SEQ ID NO: 1350854 - RNA, 18 nt, Human
uagaaaacaaacaggugu

SEQ ID NO: 1350855 - RNA, 19 nt, Human
uagagaagacugagaagua

SEQ ID NO: 1350856 - RNA, 21 nt, Human
uagcagcaacaagguaggugc

SEQ ID NO: 1350857 - RNA, 25 nt, Human
uagcagcaacaagguaggugcaaag

SEQ ID NO: 1350858 - RNA, 19 nt, Human
uaugucagagaugcaaaca

SEQ ID NO: 1350859 - RNA, 22 nt, Human
ucacugccucaaccuguucuug

SEQ ID NO: 1350860 - RNA, 21 nt, Human
ucagggccagggcucccuggg

SEQ ID NO: 1350861 - RNA, 22 nt, Human
ucaugccuguaaucccagcacu

SEQ ID NO: 1350862 - RNA, 25 nt, Human
uccaaacagauugcucuucuugaaa

SEQ ID NO: 1350863 - RNA, 19 nt, Human
uccacugugcagaccugcc

SEQ ID NO: 1350864 - RNA, 20 nt, Human
uccagccagacaggccccgg

SEQ ID NO: 1350865 - RNA, 18 nt, Human
uccagccugggcaagaag

SEQ ID NO: 1350866 - RNA, 18 nt, Human
uccauccucucagccucc

SEQ ID NO: 1350867 - RNA, 22 nt, Human
uccaugacagacagcuuggggc

SEQ ID NO: 1350868 - RNA, 23 nt, Human
uccccaaccugcccccggcuccc

SEQ ID NO: 1350869 - RNA, 19 nt, Human
ucccccaagcaucacugcc

SEQ ID NO: 1350870 - RNA, 20 nt, Human
ucccuguaaugcccgucuuu

SEQ ID NO: 1350871 - RNA, 24 nt, Human
ucccuguaaugcccgucuuuccug

SEQ ID NO: 1350872 - RNA, 23 nt, Human
ucgcaccauuguacuccagccug

SEQ ID NO: 1350873 - RNA, 23 nt, Human
ucgcgccauugcccuccagccug

SEQ ID NO: 1350874 - RNA, 23 nt, Human
ucucaaaaaacaaacaaacaaau

SEQ ID NO: 1350875 - RNA, 20 nt, Human
ucucuacuaaaaauacaaaa

SEQ ID NO: 1350876 - RNA, 18 nt, Human
ucucugaagccccagcuu

SEQ ID NO: 1350877 - RNA, 24 nt, Human
ucugaccaacauggagaaaccccg

SEQ ID NO: 1350878 - RNA, 22 nt, Human
ucugaggucagaaguucgagac

SEQ ID NO: 1350879 - RNA, 23 nt, Human
ucugaggucagaaguucgagacc

SEQ ID NO: 1350880 - RNA, 19 nt, Human
ugaaaccccaucucaacua

SEQ ID NO: 1350881 - RNA, 22 nt, Human
ugacacaggagaaucaagaacc

SEQ ID NO: 1350882 - RNA, 23 nt, Human
ugacacaggagaaucaagaaccc

SEQ ID NO: 1350883 - RNA, 21 nt, Human
ugaccuggcccugggauccag

SEQ ID NO: 1350884 - RNA, 20 nt, Human
ugagagagacuagagcaaug

SEQ ID NO: 1350885 - RNA, 19 nt, Human
ugagagaugaagaauguug

SEQ ID NO: 1350886 - RNA, 22 nt, Human
ugagcugagaucgcgccauugc

SEQ ID NO: 1350887 - RNA, 24 nt, Human
ugaggcgggcagaucaucugaggu

SEQ ID NO: 1350888 - RNA, 26 nt, Human
ugaggcgggcagaucaucugagguca

SEQ ID NO: 1350889 - RNA, 24 nt, Human
ugaggcuggagaagcgcuugaacc

SEQ ID NO: 1350890 - RNA, 21 nt, Human
ugaggcuuggagaaguugggu

SEQ ID NO: 1350891 - RNA, 21 nt, Human
ugauccggcaucuccacccag

SEQ ID NO: 1350892 - RNA, 18 nt, Human
ugccaagcuaauccugga

SEQ ID NO: 1350893 - RNA, 22 nt, Human
ugccacagcagccuucacccac

SEQ ID NO: 1350894 - RNA, 26 nt, Human
ugccacagcagccuucacccacagag

SEQ ID NO: 1350895 - RNA, 18 nt, Human
ugccacagcuguaggugc

SEQ ID NO: 1350896 - RNA, 18 nt, Human
ugccaggcagccugggau

SEQ ID NO: 1350897 - RNA, 20 nt, Human
ugccauggcagccgccauac

SEQ ID NO: 1350898 - RNA, 20 nt, Human
ugccccagggcugccugcac

SEQ ID NO: 1350899 - RNA, 19 nt, Human
ugcccuccagccugggcaa

SEQ ID NO: 1350900 - RNA, 19 nt, Human
ugccucaaccuguucuugu

SEQ ID NO: 1350901 - RNA, 24 nt, Human
ugccugcaccaacgagggcuccac

SEQ ID NO: 1350902 - RNA, 23 nt, Human
ugccuguaaucccagcacuuugg

SEQ ID NO: 1350903 - RNA, 24 nt, Human
ugccuguaaucccagcacuuuggg

SEQ ID NO: 1350904 - RNA, 21 nt, Human
ugcgaaguuggaucuucuggg

SEQ ID NO: 1350905 - RNA, 20 nt, Human
ugcucuucuugaaaacagca

SEQ ID NO: 1350906 - RNA, 23 nt, Human
ugcuuccaccagagucuguccac

SEQ ID NO: 1350907 - RNA, 21 nt, Human
uggacuggggcuggaacuagc

SEQ ID NO: 1350908 - RNA, 21 nt, Human
uggcagcaaacauuuugcuuc

SEQ ID NO: 1350909 - RNA, 22 nt, Human
uggcauugccauggcagccccg

SEQ ID NO: 1350910 - RNA, 24 nt, Human
uggccaacauggugaaaccccauc

SEQ ID NO: 1350911 - RNA, 21 nt, Human
uggccuuuauuuuccaauuuc

SEQ ID NO: 1350912 - RNA, 24 nt, Human
uggcucacaccucuaaucccagca

SEQ ID NO: 1350913 - RNA, 22 nt, Human
uggcucaugccuguaaucccag

SEQ ID NO: 1350914 - RNA, 24 nt, Human
uggcucaugccuguaaucccagca

SEQ ID NO: 1350915 - RNA, 23 nt, Human
uggcugggcgugguggcucaugc

SEQ ID NO: 1350916 - RNA, 24 nt, Human
uggcugggcgugguggcucaugcc

SEQ ID NO: 1350917 - RNA, 19 nt, Human
ugggaggccgaggcgggcg

SEQ ID NO: 1350918 - RNA, 22 nt, Human
ugggaggccgaggcgggcggau

SEQ ID NO: 1350919 - RNA, 20 nt, Human
ugggaggcugaggcgggcag

SEQ ID NO: 1350920 - RNA, 24 nt, Human
ugggaggcugaggcgggcagauca

SEQ ID NO: 1350921 - RNA, 22 nt, Human
uggggagggagggccggcugac

SEQ ID NO: 1350922 - RNA, 22 nt, Human
uggggcuagagggucccuaugg

SEQ ID NO: 1350923 - RNA, 22 nt, Human
ugggugacuugccaaaggucac

SEQ ID NO: 1350924 - RNA, 22 nt, Human
uggugauaggcaucuguaaucc

SEQ ID NO: 1350925 - RNA, 23 nt, Human
ugguggcacauaccuguaauccc

SEQ ID NO: 1350926 - RNA, 24 nt, Human
ugguggcacauaccuguaauccca

SEQ ID NO: 1350927 - RNA, 25 nt, Human
ugguggcucaugccuguaaucccaa

SEQ ID NO: 1350928 - RNA, 24 nt, Human
ugguuugucccuuuuccagccagu

SEQ ID NO: 1350929 - RNA, 20 nt, Human
uguacuccagccugggcaag

SEQ ID NO: 1350930 - RNA, 19 nt, Human
ugucuuccaacucaaacca

SEQ ID NO: 1350931 - RNA, 19 nt, Human
ugugccugucagaggagau

SEQ ID NO: 1350932 - RNA, 20 nt, Human
ugugcuggcuggguuccugc

SEQ ID NO: 1350933 - RNA, 22 nt, Human
uuagagcugacugaugcacugc

SEQ ID NO: 1350934 - RNA, 23 nt, Human
uuccaugacagacagcuuggggc

SEQ ID NO: 1350935 - RNA, 24 nt, Human
uugaacccaggagguggagguugc

SEQ ID NO: 1350936 - RNA, 18 nt, Human
uugaaugaguagagaaga

SEQ ID NO: 1350937 - RNA, 26 nt, Human
uugaaugaguagagaagacugagaag

SEQ ID NO: 1350938 - RNA, 22 nt, Human
uugcagugagccaagaucgcac

SEQ ID NO: 1350939 - RNA, 18 nt, Human
uugcagugagcugagauc

SEQ ID NO: 1350940 - RNA, 19 nt, Human
uugcagugagcugagaucg

SEQ ID NO: 1350941 - RNA, 20 nt, Human
uugcagugagcugagaucgc

SEQ ID NO: 1350942 - RNA, 22 nt, Human
uugcagugagcugagaucgcgc

SEQ ID NO: 1350943 - RNA, 25 nt, Human
uugggaggcugaggcgggcagauca

SEQ ID NO: 1350944 - RNA, 18 nt, Human
uuucagagcuuugguccc

SEQ ID NO: 1350945 - RNA, 19 nt, Human
uuucagagcuuuggucccu

SEQ ID NO: 1350946 - RNA, 23 nt, Human
uuuguuuuuaaccuucccaaauc

SEQ ID NO: 1350947 - RNA, 20 nt, Human
uuuuggggcuagaggguccc

SEQ ID NO: 1350948 - RNA, 20 nt, Human
aaaaagucccggcgcaaagg

SEQ ID NO: 1350949 - RNA, 23 nt, Human
aaacuugaggggggaccccccaa

SEQ ID NO: 1350950 - RNA, 21 nt, Human
acaccugugcuccccggcccc

SEQ ID NO: 1350951 - RNA, 23 nt, Human
accaggaaagggggguagagccc

SEQ ID NO: 1350952 - RNA, 21 nt, Human
acccggaacccggccccgacc

SEQ ID NO: 1350953 - RNA, 21 nt, Human
agcucccacaccugugcuccc

SEQ ID NO: 1350954 - RNA, 18 nt, Human
agcuccugcucagccacc

SEQ ID NO: 1350955 - RNA, 25 nt, Human
agcugugcugccccugcagagcccc

SEQ ID NO: 1350956 - RNA, 22 nt, Human
aggaacccaaccuccgguccuc

SEQ ID NO: 1350957 - RNA, 20 nt, Human
aguggcagccuggccugcac

SEQ ID NO: 1350958 - RNA, 24 nt, Human
caaagcucugccuuccagcccucc

SEQ ID NO: 1350959 - RNA, 24 nt, Human
caccccagcugugcugccccugcc

SEQ ID NO: 1350960 - RNA, 24 nt, Human
caccccagcugugcugccccugcu

SEQ ID NO: 1350961 - RNA, 19 nt, Human
caccugccacggcccaccc

SEQ ID NO: 1350962 - RNA, 25 nt, Human
cagccaccugccacggcccacccug

SEQ ID NO: 1350963 - RNA, 20 nt, Human
cagcgaggcacacccagguc

SEQ ID NO: 1350964 - RNA, 20 nt, Human
cagcucccacaccugugcuc

SEQ ID NO: 1350965 - RNA, 21 nt, Human
caggagccagggcagugcaug

SEQ ID NO: 1350966 - RNA, 23 nt, Human
ccacacacaugaugcccaggggu

SEQ ID NO: 1350967 - RNA, 21 nt, Human
ccagcagcgaggcacacccag

SEQ ID NO: 1350968 - RNA, 22 nt, Human
ccagcucccacaccugugcucc

SEQ ID NO: 1350969 - RNA, 19 nt, Human
cccacacacaugaugccca

SEQ ID NO: 1350970 - RNA, 19 nt, Human
cccaggucaggggaggggg

SEQ ID NO: 1350971 - RNA, 24 nt, Human
ccccacacacaugaugcccagggg

SEQ ID NO: 1350972 - RNA, 23 nt, Human
ccccgaccugguccucaagccuu

SEQ ID NO: 1350973 - RNA, 24 nt, Human
cccgacccggaacccggccccgac

SEQ ID NO: 1350974 - RNA, 18 nt, Human
cccuccucauacccacug

SEQ ID NO: 1350975 - RNA, 19 nt, Human
ccuggccugcaccccagcu

SEQ ID NO: 1350976 - RNA, 23 nt, Human
ccuggccugcaccccagcugugc

SEQ ID NO: 1350977 - RNA, 22 nt, Human
cuggccugcaccccagcugugc

SEQ ID NO: 1350978 - RNA, 20 nt, Human
cuggggucaccagcucccac

SEQ ID NO: 1350979 - RNA, 18 nt, Human
gaaagggggguagagccc

SEQ ID NO: 1350980 - RNA, 20 nt, Human
gaguggcagccuggccugca

SEQ ID NO: 1350981 - RNA, 18 nt, Human
gcaccccagcugugcugc

SEQ ID NO: 1350982 - RNA, 19 nt, Human
gcccugagaauucuggguc

SEQ ID NO: 1350983 - RNA, 20 nt, Human
ggagcuccugcucagccacc

SEQ ID NO: 1350984 - RNA, 26 nt, Human
ggcccaaagcucugccuuccagcccu

SEQ ID NO: 1350985 - RNA, 22 nt, Human
ggucaggggagggggcuugggu

SEQ ID NO: 1350986 - RNA, 19 nt, Human
ggucuggggucaccagcuc

SEQ ID NO: 1350987 - RNA, 23 nt, Human
uagaaaacacacagugaaguuua

SEQ ID NO: 1350988 - RNA, 22 nt, Human
uccccgacccggaacccggccc

SEQ ID NO: 1350989 - RNA, 20 nt, Human
ucccggaguggcagccuggc

SEQ ID NO: 1350990 - RNA, 22 nt, Human
ucccggaguggcagccuggccu

SEQ ID NO: 1350991 - RNA, 21 nt, Human
uccgagauagaaaacacacag

SEQ ID NO: 1350992 - RNA, 21 nt, Human
uccgguccucugcuacaacca

SEQ ID NO: 1350993 - RNA, 23 nt, Human
uccgguccucugcuacaaccacg

SEQ ID NO: 1350994 - RNA, 23 nt, Human
ugccacggcccacccuggggguc

SEQ ID NO: 1350995 - RNA, 19 nt, Human
ugccccugcagagccccag

SEQ ID NO: 1350996 - RNA, 18 nt, Human
uggcagccuggccugcac

SEQ ID NO: 1350997 - RNA, 23 nt, Human
ugugcugccccugcagagcccca

SEQ ID NO: 1350998 - RNA, 24 nt, Human
uucugggucuggggucaccagcuc

SEQ ID NO: 1350999 - RNA, 24 nt, Human
uuuuuuuuuuuuuuuuuuuuuagg

SEQ ID NO: 1351000 - RNA, 25 nt, Human
acaaagccaggcccagagccauccu

SEQ ID NO: 1351001 - RNA, 19 nt, Human
agaacaaagucagcucagg

SEQ ID NO: 1351002 - RNA, 19 nt, Human
aggcggcagucucccacug

SEQ ID NO: 1351003 - RNA, 23 nt, Human
caaagagcacgccugaguccagc

SEQ ID NO: 1351004 - RNA, 27 nt, Human
caaagccaggcccagagccaucccacc

SEQ ID NO: 1351005 - RNA, 19 nt, Human
caccccuuccccacccucu

SEQ ID NO: 1351006 - RNA, 19 nt, Human
cagagccaucccaccuuuc

SEQ ID NO: 1351007 - RNA, 22 nt, Human
cagagccaucccaccuuucccc

SEQ ID NO: 1351008 - RNA, 18 nt, Human
cagcacuuuuucugaggg

SEQ ID NO: 1351009 - RNA, 19 nt, Human
cagcccagccugucacccu

SEQ ID NO: 1351010 - RNA, 21 nt, Human
cagcccgacagccucggcaca

SEQ ID NO: 1351011 - RNA, 18 nt, Human
caggacagugagcccaag

SEQ ID NO: 1351012 - RNA, 18 nt, Human
caucccaccuuucccugc

SEQ ID NO: 1351013 - RNA, 23 nt, Human
ccaggacucacauguccuccuca

SEQ ID NO: 1351014 - RNA, 18 nt, Human
ccaggcccagagccaucc

SEQ ID NO: 1351015 - RNA, 22 nt, Human
ccaggcccagagccaucccacc

SEQ ID NO: 1351016 - RNA, 21 nt, Human
ccugcaggcuuaggguuuuga

SEQ ID NO: 1351017 - RNA, 18 nt, Human
cucacaugugagcugggc

SEQ ID NO: 1351018 - RNA, 18 nt, Human
cucacaugugagcugggc

SEQ ID NO: 1351019 - RNA, 22 nt, Human
cucacgccgaguuccuuccaga

SEQ ID NO: 1351020 - RNA, 19 nt, Human
gaagacgcagggugaggau

SEQ ID NO: 1351021 - RNA, 18 nt, Human
gacucacauguccuccuc

SEQ ID NO: 1351022 - RNA, 20 nt, Human
gcaccagcaggagggggugc

SEQ ID NO: 1351023 - RNA, 19 nt, Human
gcagucucccacuggcacc

SEQ ID NO: 1351024 - RNA, 18 nt, Human
gcgugggggguggggggc

SEQ ID NO: 1351025 - RNA, 20 nt, Human
ggaagaacaaagucagcuca

SEQ ID NO: 1351026 - RNA, 24 nt, Human
ggcacaagagcagggcuguaggaa

SEQ ID NO: 1351027 - RNA, 19 nt, Human
ggcuguaggaaagccauca

SEQ ID NO: 1351028 - RNA, 22 nt, Human
gggaagcagcgagugggaaggg

SEQ ID NO: 1351029 - RNA, 23 nt, Human
gggggcgggggccacugagcugg

SEQ ID NO: 1351030 - RNA, 24 nt, Human
ggggggcgggggccacugagcugg

SEQ ID NO: 1351031 - RNA, 24 nt, Human
uacugcaacucaggacagugagcc

SEQ ID NO: 1351032 - RNA, 22 nt, Human
uccagaaucccaaagaaggcuc

SEQ ID NO: 1351033 - RNA, 19 nt, Human
ucccacuggcaccagcagg

SEQ ID NO: 1351034 - RNA, 22 nt, Human
ucuccagcccagccugucaccc

SEQ ID NO: 1351035 - RNA, 21 nt, Human
ugaacaccagagacaccugcu

SEQ ID NO: 1351036 - RNA, 18 nt, Human
ugaaggaagaacaaaguc

SEQ ID NO: 1351037 - RNA, 23 nt, Human
ugagacaccccuuccccacccuc

SEQ ID NO: 1351038 - RNA, 22 nt, Human
ugagggauguggccaagccucc

SEQ ID NO: 1351039 - RNA, 23 nt, Human
ugcucccacccuagagacagccc

SEQ ID NO: 1351040 - RNA, 18 nt, Human
ugcuguucgggcgugggg

SEQ ID NO: 1351041 - RNA, 19 nt, Human
uggcaccagcaggaggggg

SEQ ID NO: 1351042 - RNA, 21 nt, Human
uggcaccagcaggagggggug

SEQ ID NO: 1351043 - RNA, 19 nt, Human
ugggaagcagcgaguggga

SEQ ID NO: 1351044 - RNA, 19 nt, Human
ugggaagggaaaggggaag

SEQ ID NO: 1351045 - RNA, 19 nt, Human
uggggcagcagccaccagg

SEQ ID NO: 1351046 - RNA, 19 nt, Human
ugggggguggggggcgggg

SEQ ID NO: 1351047 - RNA, 23 nt, Human
ugggggguggggggcgggggcca

SEQ ID NO: 1351048 - RNA, 19 nt, Human
uguuucuccagcccagccu

SEQ ID NO: 1351049 - RNA, 21 nt, Human
uuggacacacuucgaaggagg

SEQ ID NO: 1351050 - RNA, 19 nt, Human
uuugcagugaggggugggg

SEQ ID NO: 1351051 - RNA, 21 nt, Human
aaaaaggagucacugagucuc

SEQ ID NO: 1351052 - RNA, 20 nt, Human
aaggacuucuuaugccuccu

SEQ ID NO: 1351053 - RNA, 21 nt, Human
aauucaagcaaaauauuuguu

SEQ ID NO: 1351054 - RNA, 18 nt, Human
cugcaaucugccggugug

SEQ ID NO: 1351055 - RNA, 18 nt, Human
cuuaugccuccuuccuca

SEQ ID NO: 1351056 - RNA, 22 nt, Human
gagaaucauuaggaucacugga

SEQ ID NO: 1351057 - RNA, 20 nt, Human
gagucucagagaauugagaa

SEQ ID NO: 1351058 - RNA, 18 nt, Human
ggagucacugagucucag

SEQ ID NO: 1351059 - RNA, 23 nt, Human
uaaaaaggagucacugagucuca

SEQ ID NO: 1351060 - RNA, 24 nt, Human
uagaaaucauauguggauuuaccu

SEQ ID NO: 1351061 - RNA, 21 nt, Human
uccucagcacccuuagugagu

SEQ ID NO: 1351062 - RNA, 21 nt, Human
uggccugggggaccuugcccg

SEQ ID NO: 1351063 - RNA, 18 nt, Human
uguagaaaucauaugugg

SEQ ID NO: 1351064 - RNA, 23 nt, Human
uuccucagcacccuuagugagug

SEQ ID NO: 1351065 - RNA, 20 nt, Human
uucuuaugccuccuuccuca

SEQ ID NO: 1351066 - RNA, 18 nt, Human
uuuuuuuuuuuuuucuug

SEQ ID NO: 1351067 - RNA, 26 nt, Human
uuuuuuuuuuuuuuuuucuuguuuuu

SEQ ID NO: 1351068 - RNA, 19 nt, Human
aacuugaucaacacaaaau

SEQ ID NO: 1351069 - RNA, 19 nt, Human
aagugcugggauuccaggc

SEQ ID NO: 1351070 - RNA, 19 nt, Human
aagugcugggauuccaggc

SEQ ID NO: 1351071 - RNA, 23 nt, Human
aagugcugggauuccaggcguga

SEQ ID NO: 1351072 - RNA, 24 nt, Human
acugcguugcccaggcuggucucg

SEQ ID NO: 1351073 - RNA, 25 nt, Human
acugcguugcccaggcuggucucga

SEQ ID NO: 1351074 - RNA, 18 nt, Human
agguagggucugcaugug

SEQ ID NO: 1351075 - RNA, 22 nt, Human
agguagggucugcaugugccuc

SEQ ID NO: 1351076 - RNA, 21 nt, Human
aggugccagccugucucacau

SEQ ID NO: 1351077 - RNA, 21 nt, Human
auccugaggccugucgugguc

SEQ ID NO: 1351078 - RNA, 18 nt, Human
auguuccuuuuccuugga

SEQ ID NO: 1351079 - RNA, 20 nt, Human
caagugcugggauuccaggc

SEQ ID NO: 1351080 - RNA, 23 nt, Human
caagugcugggauuccaggcgug

SEQ ID NO: 1351081 - RNA, 18 nt, Human
caccuagacccugccagc

SEQ ID NO: 1351082 - RNA, 18 nt, Human
cacggaacaccaaggcug

SEQ ID NO: 1351083 - RNA, 24 nt, Human
cacugcguugcccaggcuggucuc

SEQ ID NO: 1351084 - RNA, 20 nt, Human
caggcgugagccaccacgcc

SEQ ID NO: 1351085 - RNA, 23 nt, Human
cagugugcacgcauguguaugua

SEQ ID NO: 1351086 - RNA, 26 nt, Human
cauguguauguaccugcacacggugu

SEQ ID NO: 1351087 - RNA, 22 nt, Human
cauuuccgcuucagcugcgggg

SEQ ID NO: 1351088 - RNA, 20 nt, Human
ccagccaccuagacccugcc

SEQ ID NO: 1351089 - RNA, 21 nt, Human
ccagggccacacaguagccug

SEQ ID NO: 1351090 - RNA, 18 nt, Human
ccugcacacgcuacuggc

SEQ ID NO: 1351091 - RNA, 24 nt, Human
ccugcacacgcuacuggcaccucg

SEQ ID NO: 1351092 - RNA, 25 nt, Human
ccugcacacgcuacuggcaccucgc

SEQ ID NO: 1351093 - RNA, 22 nt, Human
cgagauguuccuuuuccuugga

SEQ ID NO: 1351094 - RNA, 19 nt, Human
cggaacaccaaggcugaaa

SEQ ID NO: 1351095 - RNA, 24 nt, Human
cggauagagcccagggacgcugcu

SEQ ID NO: 1351096 - RNA, 22 nt, Human
cguugcccaggcuggucucgaa

SEQ ID NO: 1351097 - RNA, 24 nt, Human
cucaagugcugggauuccaggcgu

SEQ ID NO: 1351098 - RNA, 21 nt, Human
cugggacagauucucaaccgg

SEQ ID NO: 1351099 - RNA, 24 nt, Human
gacguccugagacauuucugggug

SEQ ID NO: 1351100 - RNA, 18 nt, Human
gauuccaggcgugagcca

SEQ ID NO: 1351101 - RNA, 21 nt, Human
gauuccaggcgugagccacca

SEQ ID NO: 1351102 - RNA, 21 nt, Human
gccagccaccuagacccugcc

SEQ ID NO: 1351103 - RNA, 23 nt, Human
gcuggucucgaacuccuggccuc

SEQ ID NO: 1351104 - RNA, 18 nt, Human
ggaacaccaaggcugaaa

SEQ ID NO: 1351105 - RNA, 24 nt, Human
ggcuggucucgaacuccuggccuc

SEQ ID NO: 1351106 - RNA, 18 nt, Human
uagagcccagggacgcug

SEQ ID NO: 1351107 - RNA, 23 nt, Human
uagggcgggcuccagguaggguc

SEQ ID NO: 1351108 - RNA, 25 nt, Human
uauguaccugcacacgcuacuggca

SEQ ID NO: 1351109 - RNA, 23 nt, Human
ucaagugcugggauuccaggcgu

SEQ ID NO: 1351110 - RNA, 18 nt, Human
uccaggcgugagccacca

SEQ ID NO: 1351111 - RNA, 25 nt, Human
ucccuagggcgggcuccagguaggg

SEQ ID NO: 1351112 - RNA, 19 nt, Human
ucucacugcguugcccagg

SEQ ID NO: 1351113 - RNA, 23 nt, Human
ucucacugcguugcccaggcugg

SEQ ID NO: 1351114 - RNA, 26 nt, Human
ucucacugcguugcccaggcuggucu

SEQ ID NO: 1351115 - RNA, 27 nt, Human
ucucacugcguugcccaggcuggucuc

SEQ ID NO: 1351116 - RNA, 21 nt, Human
ucucgaacuccuggccucaag

SEQ ID NO: 1351117 - RNA, 18 nt, Human
ucucucacugcguugccc

SEQ ID NO: 1351118 - RNA, 20 nt, Human
ugaccugcccagcgucccua

SEQ ID NO: 1351119 - RNA, 23 nt, Human
ugcccagcgucccuagggcgggc

SEQ ID NO: 1351120 - RNA, 24 nt, Human
ugcccaggcuggucucgaacuccu

SEQ ID NO: 1351121 - RNA, 24 nt, Human
ugcguugcccaggcuggucucgaa

SEQ ID NO: 1351122 - RNA, 18 nt, Human
ugggauuccaggcgugag

SEQ ID NO: 1351123 - RNA, 19 nt, Human
ugggauuccaggcgugagc

SEQ ID NO: 1351124 - RNA, 24 nt, Human
ugggauuccaggcgugagccacca

SEQ ID NO: 1351125 - RNA, 22 nt, Human
ugggggucucucacugcguugc

SEQ ID NO: 1351126 - RNA, 20 nt, Human
ugugcacgcauguguaugua

SEQ ID NO: 1351127 - RNA, 19 nt, Human
uucugggugucauaacagu

SEQ ID NO: 1351128 - RNA, 23 nt, Human
aagcagcucaggcuaagacaggc

SEQ ID NO: 1351129 - RNA, 22 nt, Human
aaggcaccccccuccuccucca

SEQ ID NO: 1351130 - RNA, 21 nt, Human
acaaaagcaaaagaaaucaga

SEQ ID NO: 1351131 - RNA, 24 nt, Human
acagcaaaguaacacgagaccaag

SEQ ID NO: 1351132 - RNA, 22 nt, Human
accaaggcaccccccuccuccu

SEQ ID NO: 1351133 - RNA, 18 nt, Human
acgagaccaaggcacccc

SEQ ID NO: 1351134 - RNA, 22 nt, Human
acgagaccaaggcaccccccuc

SEQ ID NO: 1351135 - RNA, 24 nt, Human
agaaaucagacugcacuggcuuuu

SEQ ID NO: 1351136 - RNA, 23 nt, Human
agacaggcugauguacuucaugc

SEQ ID NO: 1351137 - RNA, 26 nt, Human
agcuacuggguaauccaugcccaucg

SEQ ID NO: 1351138 - RNA, 24 nt, Human
aggcaccccccuccuccuccagag

SEQ ID NO: 1351139 - RNA, 22 nt, Human
aguagcuacuggguaauccaug

SEQ ID NO: 1351140 - RNA, 21 nt, Human
auaaaacaauugcuccacccc

SEQ ID NO: 1351141 - RNA, 18 nt, Human
auugcuccacccccaaau

SEQ ID NO: 1351142 - RNA, 21 nt, Human
caaagcagcucaggcuaagac

SEQ ID NO: 1351143 - RNA, 24 nt, Human
caaagcagcucaggcuaagacagg

SEQ ID NO: 1351144 - RNA, 22 nt, Human
caaaguaacacgagaccaaggc

SEQ ID NO: 1351145 - RNA, 24 nt, Human
caaauggcaguggugcccaucucc

SEQ ID NO: 1351146 - RNA, 22 nt, Human
caaccagaugcucgggcacaug

SEQ ID NO: 1351147 - RNA, 18 nt, Human
caaccccaaaauucuaag

SEQ ID NO: 1351148 - RNA, 23 nt, Human
caacgcacugaaacuggggaaua

SEQ ID NO: 1351149 - RNA, 19 nt, Human
cacccccaaauaagccaag

SEQ ID NO: 1351150 - RNA, 25 nt, Human
caccccccuccuccuccagagguuc

SEQ ID NO: 1351151 - RNA, 23 nt, Human
caccucugucacagcuccaaagg

SEQ ID NO: 1351152 - RNA, 30 nt, Human
cagcaaacccuaagcacagaagauucuaaa

SEQ ID NO: 1351153 - RNA, 21 nt, Human
cagcaaaguaacacgagacca

SEQ ID NO: 1351154 - RNA, 24 nt, Human
cagcaaaguaacacgagaccaagg

SEQ ID NO: 1351155 - RNA, 18 nt, Human
cagcacaggcacagcaaa

SEQ ID NO: 1351156 - RNA, 19 nt, Human
cagcagcaaacccuaagca

SEQ ID NO: 1351157 - RNA, 18 nt, Human
cagcagcagcaaacccua

SEQ ID NO: 1351158 - RNA, 22 nt, Human
cauggaagcaacuuacuuucaa

SEQ ID NO: 1351159 - RNA, 23 nt, Human
ccaaaauucuaagcucaccagca

SEQ ID NO: 1351160 - RNA, 24 nt, Human
ccaaaauucuaagcucaccagcag

SEQ ID NO: 1351161 - RNA, 19 nt, Human
ccaaaccaggaugguauua

SEQ ID NO: 1351162 - RNA, 23 nt, Human
ccaaaggacacaccauguuugaa

SEQ ID NO: 1351163 - RNA, 20 nt, Human
ccccaaaauucuaagcucac

SEQ ID NO: 1351164 - RNA, 25 nt, Human
ccccaaaauucuaagcucaccagca

SEQ ID NO: 1351165 - RNA, 22 nt, Human
ccccaaaauucuaagcucaccu

SEQ ID NO: 1351166 - RNA, 18 nt, Human
ccuagaucagacauagag

SEQ ID NO: 1351167 - RNA, 27 nt, Human
cgagaccaaggcaccccccuccuccuc

SEQ ID NO: 1351168 - RNA, 22 nt, Human
cucccagaaguuguaaaccuag

SEQ ID NO: 1351169 - RNA, 22 nt, Human
cuggccccagcugaccuuucca

SEQ ID NO: 1351170 - RNA, 22 nt, Human
cuuauagguuuguacauuuuaa

SEQ ID NO: 1351171 - RNA, 23 nt, Human
gaauaaaacaauugcuccacccc

SEQ ID NO: 1351172 - RNA, 19 nt, Human
gagcaaauggcaguggugc

SEQ ID NO: 1351173 - RNA, 20 nt, Human
gcaccccccuccuccuccag

SEQ ID NO: 1351174 - RNA, 24 nt, Human
gcacugaaacuggggaauaaaaca

SEQ ID NO: 1351175 - RNA, 20 nt, Human
gcuccaaaggacacaccaug

SEQ ID NO: 1351176 - RNA, 22 nt, Human
ggaggcucuucccccagccucc

SEQ ID NO: 1351177 - RNA, 18 nt, Human
ggcaguggugcccaucuc

SEQ ID NO: 1351178 - RNA, 23 nt, Human
gggaagugaaauuccuguacuuu

SEQ ID NO: 1351179 - RNA, 20 nt, Human
gguggccaguugugugggcc

SEQ ID NO: 1351180 - RNA, 24 nt, Human
uaacacgagaccaaggcacccccc

SEQ ID NO: 1351181 - RNA, 18 nt, Human
uaagcucaccagcagcag

SEQ ID NO: 1351182 - RNA, 24 nt, Human
uaagcucaccagcagcagcaaacc

SEQ ID NO: 1351183 - RNA, 24 nt, Human
uaugugcucaaguccuggugggaa

SEQ ID NO: 1351184 - RNA, 24 nt, Human
ucccaaccccaaaauucuaagcuc

SEQ ID NO: 1351185 - RNA, 20 nt, Human
ucccagaaguuguaaaccuu

SEQ ID NO: 1351186 - RNA, 21 nt, Human
ucccccagccuccuagaucag

SEQ ID NO: 1351187 - RNA, 18 nt, Human
ucuaacuccuucaagcuu

SEQ ID NO: 1351188 - RNA, 24 nt, Human
ucuaagucagaacaggccgggguc

SEQ ID NO: 1351189 - RNA, 20 nt, Human
ugacaaaagcaaaagaaauc

SEQ ID NO: 1351190 - RNA, 23 nt, Human
ugacaaaagcaaaagaaaucaga

SEQ ID NO: 1351191 - RNA, 24 nt, Human
ugacaaaagcaaaagaaaucagac

SEQ ID NO: 1351192 - RNA, 20 nt, Human
ugaggcaccacuggccccag

SEQ ID NO: 1351193 - RNA, 21 nt, Human
ugccugaggcaccacuggccc

SEQ ID NO: 1351194 - RNA, 24 nt, Human
ugccuuccacuuuuucccaacccc

SEQ ID NO: 1351195 - RNA, 18 nt, Human
ugcuuaugccuuccacuu

SEQ ID NO: 1351196 - RNA, 21 nt, Human
uggaagaauucagcccacaga

SEQ ID NO: 1351197 - RNA, 23 nt, Human
uguacuuuuaggugcugggcuca

SEQ ID NO: 1351198 - RNA, 25 nt, Human
uucaaagcagcucaggcuaagacag

SEQ ID NO: 1351199 - RNA, 22 nt, Human
uucacauauccuaaaauauccu

SEQ ID NO: 1351200 - RNA, 22 nt, Human
uucacucaaguuuucuaaagga

SEQ ID NO: 1351201 - RNA, 24 nt, Human
uucccaaccccaaaauucuaagcu

SEQ ID NO: 1351202 - RNA, 23 nt, Human
uuuucccaaccccaaaauucuaa

SEQ ID NO: 1351203 - RNA, 19 nt, Human
aagccucaggcccccucug

SEQ ID NO: 1351204 - RNA, 18 nt, Human
aagggccccagcuucuuc

SEQ ID NO: 1351205 - RNA, 18 nt, Human
agagagcagccuuuuugg

SEQ ID NO: 1351206 - RNA, 26 nt, Human
aggcccucaacacacccuugccaucu

SEQ ID NO: 1351207 - RNA, 20 nt, Human
agggaauagguggguggagg

SEQ ID NO: 1351208 - RNA, 20 nt, Human
aggugggcagacagguaagc

SEQ ID NO: 1351209 - RNA, 21 nt, Human
augagaacagcuccucacuga

SEQ ID NO: 1351210 - RNA, 18 nt, Human
caaaagcaggcgaagggc

SEQ ID NO: 1351211 - RNA, 19 nt, Human
cagggcaggcgagggagcc

SEQ ID NO: 1351212 - RNA, 21 nt, Human
caggugggcagacagguaagc

SEQ ID NO: 1351213 - RNA, 18 nt, Human
caucacaaccccuuacuc

SEQ ID NO: 1351214 - RNA, 19 nt, Human
ccacuggcgguguccucuc

SEQ ID NO: 1351215 - RNA, 18 nt, Human
cccacagggucugggcca

SEQ ID NO: 1351216 - RNA, 19 nt, Human
cccagaacuuccagagagu

SEQ ID NO: 1351217 - RNA, 19 nt, Human
cccuaccugggcccuuccc

SEQ ID NO: 1351218 - RNA, 19 nt, Human
ccucaggcccccucugguc

SEQ ID NO: 1351219 - RNA, 20 nt, Human
ccuggaccaugaaggugacc

SEQ ID NO: 1351220 - RNA, 21 nt, Human
ccuggaucaucugaauuuccc

SEQ ID NO: 1351221 - RNA, 23 nt, Human
ccuggcccuuguuccagacaggu

SEQ ID NO: 1351222 - RNA, 18 nt, Human
ccugggcccuucccggga

SEQ ID NO: 1351223 - RNA, 23 nt, Human
ccuucgccaucuaauugaagccc

SEQ ID NO: 1351224 - RNA, 20 nt, Human
cuggaccaugaaggugaccg

SEQ ID NO: 1351225 - RNA, 25 nt, Human
cuucugcuguaaacugggauaguga

SEQ ID NO: 1351226 - RNA, 22 nt, Human
gacucccagcuguaugaucuua

SEQ ID NO: 1351227 - RNA, 19 nt, Human
gagaacagcuccucacuga

SEQ ID NO: 1351228 - RNA, 20 nt, Human
gagcugggugagggagcggg

SEQ ID NO: 1351229 - RNA, 22 nt, Human
gaucaucugaauuucccuuuga

SEQ ID NO: 1351230 - RNA, 18 nt, Human
gcccaggguuccugcagc

SEQ ID NO: 1351231 - RNA, 20 nt, Human
gcuguaaacugggauaguga

SEQ ID NO: 1351232 - RNA, 25 nt, Human
ggccgcugcagugaagccucaggcc

SEQ ID NO: 1351233 - RNA, 20 nt, Human
gggaaagggggugagcagcu

SEQ ID NO: 1351234 - RNA, 21 nt, Human
gggcagacagguaagcagagc

SEQ ID NO: 1351235 - RNA, 18 nt, Human
gguguccucuccuucgcc

SEQ ID NO: 1351236 - RNA, 22 nt, Human
uaacacucacucccuggcccuc

SEQ ID NO: 1351237 - RNA, 24 nt, Human
uacccugccugccugggccccagc

SEQ ID NO: 1351238 - RNA, 19 nt, Human
ucaacacacccuugccauc

SEQ ID NO: 1351239 - RNA, 19 nt, Human
ucacuggccucccugccuc

SEQ ID NO: 1351240 - RNA, 22 nt, Human
ucacuggccucccugccucucu

SEQ ID NO: 1351241 - RNA, 24 nt, Human
ucccagcuguaugaucuuaugcaa

SEQ ID NO: 1351242 - RNA, 23 nt, Human
ucuucugcuguaaacugggauag

SEQ ID NO: 1351243 - RNA, 20 nt, Human
ucuuggggagacccagaacu

SEQ ID NO: 1351244 - RNA, 20 nt, Human
ugaaggugaccaggaaaggg

SEQ ID NO: 1351245 - RNA, 21 nt, Human
ugagaacagcuccucacugag

SEQ ID NO: 1351246 - RNA, 20 nt, Human
ugaggagcugggugagggaa

SEQ ID NO: 1351247 - RNA, 23 nt, Human
ugauaaccccuugugggugaugu

SEQ ID NO: 1351248 - RNA, 21 nt, Human
ugcaaguuacucaaucucucu

SEQ ID NO: 1351249 - RNA, 23 nt, Human
uggaagagagcagccuuuuugga

SEQ ID NO: 1351250 - RNA, 18 nt, Human
uggcagccgccauggccc

SEQ ID NO: 1351251 - RNA, 21 nt, Human
uggcagccgccauggcccagg

SEQ ID NO: 1351252 - RNA, 22 nt, Human
uggcccaggguuccugcagcag

SEQ ID NO: 1351253 - RNA, 25 nt, Human
ugggccccagccaugagaacagcuc

SEQ ID NO: 1351254 - RNA, 22 nt, Human
ugggugaugucugaggagcugg

SEQ ID NO: 1351255 - RNA, 21 nt, Human
uggguggaggccgcugcagug

SEQ ID NO: 1351256 - RNA, 18 nt, Human
ugucugaggagcugggug

SEQ ID NO: 1351257 - RNA, 20 nt, Human
ugucugaggagcugggugag

SEQ ID NO: 1351258 - RNA, 18 nt, Human
uucauaauuuaauacccu

SEQ ID NO: 1351259 - RNA, 20 nt, Human
aaaggugcauuccuggcagg

SEQ ID NO: 1351260 - RNA, 22 nt, Human
aagcagcaggucucgucaaaca

SEQ ID NO: 1351261 - RNA, 19 nt, Human
aagcagcuguugaggccag

SEQ ID NO: 1351262 - RNA, 21 nt, Human
aagcggcccaggaggcugggu

SEQ ID NO: 1351263 - RNA, 22 nt, Human
aagcuccagcuuagcugcccag

SEQ ID NO: 1351264 - RNA, 20 nt, Human
aagcugcaccugcagggugg

SEQ ID NO: 1351265 - RNA, 18 nt, Human
aaggagacagacagaaag

SEQ ID NO: 1351266 - RNA, 21 nt, Human
aaggagacagacagaaaggga

SEQ ID NO: 1351267 - RNA, 19 nt, Human
aagggccccugcccuguca

SEQ ID NO: 1351268 - RNA, 23 nt, Human
acacacacacacacacacacaca

SEQ ID NO: 1351269 - RNA, 23 nt, Human
acacacacacacacacacacaca

SEQ ID NO: 1351270 - RNA, 23 nt, Human
acacacacacacacacacacaca

SEQ ID NO: 1351271 - RNA, 23 nt, Human
acacacacacacacacacacaca

SEQ ID NO: 1351272 - RNA, 23 nt, Human
acacacacacacacacacacaca

SEQ ID NO: 1351273 - RNA, 23 nt, Human
acacacacacacacacacacaca

SEQ ID NO: 1351274 - RNA, 23 nt, Human
acacacacacacacacacacaca

SEQ ID NO: 1351275 - RNA, 23 nt, Human
acacacacacacacacacacaca

SEQ ID NO: 1351276 - RNA, 23 nt, Human
acacacacacacacacacacaca

SEQ ID NO: 1351277 - RNA, 23 nt, Human
acacacacacacacacacacaca

SEQ ID NO: 1351278 - RNA, 23 nt, Human
acacacacacacacacacacaca

SEQ ID NO: 1351279 - RNA, 23 nt, Human
acacacacacacacacacacaca

SEQ ID NO: 1351280 - RNA, 22 nt, Human
acacacacacacacacacacag

SEQ ID NO: 1351281 - RNA, 26 nt, Human
acacacacacgcacgcgcacacagca

SEQ ID NO: 1351282 - RNA, 21 nt, Human
acacacacgcacgcgcacaca

SEQ ID NO: 1351283 - RNA, 26 nt, Human
acccaacaggcacaaaucgucggcuu

SEQ ID NO: 1351284 - RNA, 24 nt, Human
acccagcugcccaggcccacccag

SEQ ID NO: 1351285 - RNA, 24 nt, Human
acccagcugcccaggcccacccag

SEQ ID NO: 1351286 - RNA, 24 nt, Human
acccucaccucugcagccccccag

SEQ ID NO: 1351287 - RNA, 22 nt, Human
acguggcaucugggguaccccc

SEQ ID NO: 1351288 - RNA, 31 nt, Human
acuccagacacacacacacacacacacacag

SEQ ID NO: 1351289 - RNA, 22 nt, Human
agagagaagcacagcuccccga

SEQ ID NO: 1351290 - RNA, 23 nt, Human
agagcccugggcucccgggcagc

SEQ ID NO: 1351291 - RNA, 24 nt, Human
agcaaggagacagacagaaaggga

SEQ ID NO: 1351292 - RNA, 18 nt, Human
agcaggaagcugaaggga

SEQ ID NO: 1351293 - RNA, 18 nt, Human
agcagguaccagugcucc

SEQ ID NO: 1351294 - RNA, 19 nt, Human
agcagguaccagugcucca

SEQ ID NO: 1351295 - RNA, 21 nt, Human
agccccuguugcauggccucc

SEQ ID NO: 1351296 - RNA, 21 nt, Human
agccggccugagcugggcacg

SEQ ID NO: 1351297 - RNA, 19 nt, Human
agccucccagccaccuccc

SEQ ID NO: 1351298 - RNA, 23 nt, Human
agcucagcucuucccugacucca

SEQ ID NO: 1351299 - RNA, 19 nt, Human
aggaagcugaagggaggga

SEQ ID NO: 1351300 - RNA, 23 nt, Human
aggacgcaccacagcuggggccc

SEQ ID NO: 1351301 - RNA, 21 nt, Human
aggcagcacgggguggccagg

SEQ ID NO: 1351302 - RNA, 26 nt, Human
aggcagcacgggguggccaggggcga

SEQ ID NO: 1351303 - RNA, 18 nt, Human
aggcagcggcgugagcca

SEQ ID NO: 1351304 - RNA, 19 nt, Human
aggcagggccugggcagcc

SEQ ID NO: 1351305 - RNA, 20 nt, Human
aggcccacccagcugcccag

SEQ ID NO: 1351306 - RNA, 20 nt, Human
aggcccacccagcugcccag

SEQ ID NO: 1351307 - RNA, 22 nt, Human
aggcgaaggcggggcugcaggg

SEQ ID NO: 1351308 - RNA, 19 nt, Human
agguaccagugcuccagaa

SEQ ID NO: 1351309 - RNA, 21 nt, Human
augaaggugaggugguggcag

SEQ ID NO: 1351310 - RNA, 23 nt, Human
caaagcuccagcuuagcugccca

SEQ ID NO: 1351311 - RNA, 20 nt, Human
cacacacacacacacacaca

SEQ ID NO: 1351312 - RNA, 20 nt, Human
cacacacacacacacacaca

SEQ ID NO: 1351313 - RNA, 20 nt, Human
cacacacacacacacacaca

SEQ ID NO: 1351314 - RNA, 20 nt, Human
cacacacacacacacacaca

SEQ ID NO: 1351315 - RNA, 20 nt, Human
cacacacacacacacacaca

SEQ ID NO: 1351316 - RNA, 20 nt, Human
cacacacacacacacacaca

SEQ ID NO: 1351317 - RNA, 20 nt, Human
cacacacacacacacacaca

SEQ ID NO: 1351318 - RNA, 20 nt, Human
cacacacacacacacacaca

SEQ ID NO: 1351319 - RNA, 20 nt, Human
cacacacacacacacacaca

SEQ ID NO: 1351320 - RNA, 20 nt, Human
cacacacacacacacacaca

SEQ ID NO: 1351321 - RNA, 20 nt, Human
cacacacacacacacacaca

SEQ ID NO: 1351322 - RNA, 20 nt, Human
cacacacacacacacacaca

SEQ ID NO: 1351323 - RNA, 20 nt, Human
cacacacacacacacacaca

SEQ ID NO: 1351324 - RNA, 20 nt, Human
cacacacacacacacacaca

SEQ ID NO: 1351325 - RNA, 20 nt, Human
cacacacacacacacacaca

SEQ ID NO: 1351326 - RNA, 22 nt, Human
cacacacacacacacacacaca

SEQ ID NO: 1351327 - RNA, 22 nt, Human
cacacacacacacacacacaca

SEQ ID NO: 1351328 - RNA, 22 nt, Human
cacacacacacacacacacaca

SEQ ID NO: 1351329 - RNA, 22 nt, Human
cacacacacacacacacacaca

SEQ ID NO: 1351330 - RNA, 26 nt, Human
cacacacacacacacacacacacaca

SEQ ID NO: 1351331 - RNA, 26 nt, Human
cacacacacacacacacacacacaca

SEQ ID NO: 1351332 - RNA, 26 nt, Human
cacacacacacacacacacacacaca

SEQ ID NO: 1351333 - RNA, 26 nt, Human
cacacacacacacacacacacacaca

SEQ ID NO: 1351334 - RNA, 26 nt, Human
cacacacacacacacacacacacaca

SEQ ID NO: 1351335 - RNA, 26 nt, Human
cacacacacacacacacacacacaca

SEQ ID NO: 1351336 - RNA, 26 nt, Human
cacacacacacacacacacacacaca

SEQ ID NO: 1351337 - RNA, 26 nt, Human
cacacacacacacacacacacacaca

SEQ ID NO: 1351338 - RNA, 26 nt, Human
cacacacacacacacacacacacacg

SEQ ID NO: 1351339 - RNA, 26 nt, Human
cacacacacacacacacacacacgca

SEQ ID NO: 1351340 - RNA, 26 nt, Human
cacacacacacacacacacacgcacg

SEQ ID NO: 1351341 - RNA, 26 nt, Human
cacacacacacacacacacgcacgcg

SEQ ID NO: 1351342 - RNA, 26 nt, Human
cacacacacacacacacgcacgcgca

SEQ ID NO: 1351343 - RNA, 25 nt, Human
cacacacacacacacgcacgcgcac

SEQ ID NO: 1351344 - RNA, 23 nt, Human
cacacacacacacgcacgcgcac

SEQ ID NO: 1351345 - RNA, 20 nt, Human
cacagcuccccgaccugcuc

SEQ ID NO: 1351346 - RNA, 21 nt, Human
caccaggaaggugaaggccuc

SEQ ID NO: 1351347 - RNA, 19 nt, Human
cacccagcugcccaggccc

SEQ ID NO: 1351348 - RNA, 19 nt, Human
cacccagcugcccaggccc

SEQ ID NO: 1351349 - RNA, 21 nt, Human
cacccuuuccggaaacucgca

SEQ ID NO: 1351350 - RNA, 19 nt, Human
caccggaccucagagcacc

SEQ ID NO: 1351351 - RNA, 19 nt, Human
caccuccuggcuuccaaag

SEQ ID NO: 1351352 - RNA, 23 nt, Human
cacgcgcacacagcaucaaugcc

SEQ ID NO: 1351353 - RNA, 21 nt, Human
cagaacaugcugcagauccac

SEQ ID NO: 1351354 - RNA, 23 nt, Human
cagagcgugccucggugcacuuu

SEQ ID NO: 1351355 - RNA, 25 nt, Human
cagauacccucaccucugcagcccc

SEQ ID NO: 1351356 - RNA, 19 nt, Human
cagauccacggugcccagu

SEQ ID NO: 1351357 - RNA, 19 nt, Human
cagcaugcgguccaccucc

SEQ ID NO: 1351358 - RNA, 19 nt, Human
cagcaugucugcccagugc

SEQ ID NO: 1351359 - RNA, 22 nt, Human
cagccagcaccagguccacauu

SEQ ID NO: 1351360 - RNA, 19 nt, Human
cagcccaggcccauccagc

SEQ ID NO: 1351361 - RNA, 24 nt, Human
cagcccaggcccauccagccgucc

SEQ ID NO: 1351362 - RNA, 19 nt, Human
cagccguccaggcccaccc

SEQ ID NO: 1351363 - RNA, 21 nt, Human
cagcggggcccuucaccuccu

SEQ ID NO: 1351364 - RNA, 19 nt, Human
cagcugcccaggcccaccc

SEQ ID NO: 1351365 - RNA, 21 nt, Human
cagcugggaggguggccccuc

SEQ ID NO: 1351366 - RNA, 20 nt, Human
caggaacuuggaagcccaga

SEQ ID NO: 1351367 - RNA, 21 nt, Human
caggagacucuguuccuccac

SEQ ID NO: 1351368 - RNA, 18 nt, Human
caggcacaaaucgucggc

SEQ ID NO: 1351369 - RNA, 21 nt, Human
caggcccagccucccagccac

SEQ ID NO: 1351370 - RNA, 23 nt, Human
cagggggugccacugggcaaugg

SEQ ID NO: 1351371 - RNA, 22 nt, Human
cagggucccugccagcucugcc

SEQ ID NO: 1351372 - RNA, 20 nt, Human
caucacuuccuugccucuac

SEQ ID NO: 1351373 - RNA, 21 nt, Human
caugacuccagacacacacac

SEQ ID NO: 1351374 - RNA, 19 nt, Human
cauggggccuacggugacc

SEQ ID NO: 1351375 - RNA, 23 nt, Human
cauuccacacacacugacucagc

SEQ ID NO: 1351376 - RNA, 20 nt, Human
ccaaacccacccaaaacgug

SEQ ID NO: 1351377 - RNA, 23 nt, Human
ccacaagagccugggaccccucu

SEQ ID NO: 1351378 - RNA, 18 nt, Human
ccacauucuggaccuggc

SEQ ID NO: 1351379 - RNA, 23 nt, Human
ccaccaugguuugccagccaugc

SEQ ID NO: 1351380 - RNA, 23 nt, Human
ccaccucccagcagcccccagcc

SEQ ID NO: 1351381 - RNA, 19 nt, Human
ccagaacaugcugcagauc

SEQ ID NO: 1351382 - RNA, 23 nt, Human
ccagaacauuccacacacacuga

SEQ ID NO: 1351383 - RNA, 22 nt, Human
ccagacagccagcaccaggucc

SEQ ID NO: 1351384 - RNA, 19 nt, Human
ccaggcccugcugcccuag

SEQ ID NO: 1351385 - RNA, 23 nt, Human
ccaucucaucccugggggucuca

SEQ ID NO: 1351386 - RNA, 21 nt, Human
ccaugacuccagacacacaca

SEQ ID NO: 1351387 - RNA, 26 nt, Human
ccaugguuugccagccaugcaggugg

SEQ ID NO: 1351388 - RNA, 19 nt, Human
cccaccacccagggcaugg

SEQ ID NO: 1351389 - RNA, 21 nt, Human
cccagcccaggcccauccagc

SEQ ID NO: 1351390 - RNA, 19 nt, Human
cccagcugcccaggcccac

SEQ ID NO: 1351391 - RNA, 19 nt, Human
cccagcugcccaggcccac

SEQ ID NO: 1351392 - RNA, 28 nt, Human
cccagcugcccaggcccacccagcugcc

SEQ ID NO: 1351393 - RNA, 21 nt, Human
cccaggccaucccaucgggaa

SEQ ID NO: 1351394 - RNA, 19 nt, Human
cccaggcccagccucccag

SEQ ID NO: 1351395 - RNA, 20 nt, Human
cccauagggcagggucccug

SEQ ID NO: 1351396 - RNA, 21 nt, Human
ccccagccaagcaggcagggc

SEQ ID NO: 1351397 - RNA, 22 nt, Human
ccccaggaacuuggaagcccag

SEQ ID NO: 1351398 - RNA, 18 nt, Human
ccccaggcccagggugac

SEQ ID NO: 1351399 - RNA, 20 nt, Human
ccccaggcccagggugacuc

SEQ ID NO: 1351400 - RNA, 23 nt, Human
cccccagccccagccaagcaggc

SEQ ID NO: 1351401 - RNA, 23 nt, Human
cccccaggaacuuggaagcccag

SEQ ID NO: 1351402 - RNA, 20 nt, Human
cccccaggccucaggucggc

SEQ ID NO: 1351403 - RNA, 27 nt, Human
cccccauugcugagcaucccccgggcu

SEQ ID NO: 1351404 - RNA, 21 nt, Human
ccccccgccuccaggccaggc

SEQ ID NO: 1351405 - RNA, 22 nt, Human
cccccugccuuccucaagaacc

SEQ ID NO: 1351406 - RNA, 25 nt, Human
cccccugccuuccucaagaacccgc

SEQ ID NO: 1351407 - RNA, 19 nt, Human
ccccgagaagcgcuugaag

SEQ ID NO: 1351408 - RNA, 19 nt, Human
ccccgaggcccgggcaccc

SEQ ID NO: 1351409 - RNA, 22 nt, Human
ccccugcccgcuaccccaucug

SEQ ID NO: 1351410 - RNA, 24 nt, Human
cccuccggccccugcccgcuaccc

SEQ ID NO: 1351411 - RNA, 21 nt, Human
cccugccaugacuccagacac

SEQ ID NO: 1351412 - RNA, 20 nt, Human
cccugcccugucagcucccc

SEQ ID NO: 1351413 - RNA, 21 nt, Human
cccuggacccugggcccugcc

SEQ ID NO: 1351414 - RNA, 25 nt, Human
cccuggacccugggcccugccuggg

SEQ ID NO: 1351415 - RNA, 18 nt, Human
cccugggcccugccuggg

SEQ ID NO: 1351416 - RNA, 20 nt, Human
ccgcagcgccugaggaugaa

SEQ ID NO: 1351417 - RNA, 20 nt, Human
ccgccugcgggaucugaggc

SEQ ID NO: 1351418 - RNA, 25 nt, Human
ccucaagaacccgcuguggcucccu

SEQ ID NO: 1351419 - RNA, 19 nt, Human
ccucauugaaguagggggc

SEQ ID NO: 1351420 - RNA, 21 nt, Human
ccuccaggccaggccacccaa

SEQ ID NO: 1351421 - RNA, 21 nt, Human
ccucccagcagcccccagccc

SEQ ID NO: 1351422 - RNA, 21 nt, Human
ccucccagccaccucccagca

SEQ ID NO: 1351423 - RNA, 21 nt, Human
ccucccuggcuggccgcaggg

SEQ ID NO: 1351424 - RNA, 21 nt, Human
ccucccuggcuggccgcaggg

SEQ ID NO: 1351425 - RNA, 20 nt, Human
ccucgagccuccagcaccac

SEQ ID NO: 1351426 - RNA, 24 nt, Human
ccugcgcagcggggcccuucaccu

SEQ ID NO: 1351427 - RNA, 25 nt, Human
ccuggacccugggcccugccugggg

SEQ ID NO: 1351428 - RNA, 19 nt, Human
ccugggaccccucuugcca

SEQ ID NO: 1351429 - RNA, 22 nt, Human
ccuguacccgccugccuagggc

SEQ ID NO: 1351430 - RNA, 24 nt, Human
ccuguagugaguugggaccggggc

SEQ ID NO: 1351431 - RNA, 19 nt, Human
cgagccuccagcaccacca

SEQ ID NO: 1351432 - RNA, 24 nt, Human
cgccggggugggccagcaugucug

SEQ ID NO: 1351433 - RNA, 19 nt, Human
cgccugaggaugaagguga

SEQ ID NO: 1351434 - RNA, 20 nt, Human
cgccugaggaugaaggugag

SEQ ID NO: 1351435 - RNA, 19 nt, Human
cgcgcacacagcaucaaug

SEQ ID NO: 1351436 - RNA, 26 nt, Human
cggagcucacccaggggcucaugccc

SEQ ID NO: 1351437 - RNA, 18 nt, Human
cgggaggagcagggcugg

SEQ ID NO: 1351438 - RNA, 18 nt, Human
cgggaggagcagggcugg

SEQ ID NO: 1351439 - RNA, 18 nt, Human
cggggcugcagggccagc

SEQ ID NO: 1351440 - RNA, 22 nt, Human
cgggguggccaggggcgagggu

SEQ ID NO: 1351441 - RNA, 23 nt, Human
cuccagcaccaccacggucagcc

SEQ ID NO: 1351442 - RNA, 19 nt, Human
cuccugggcccuggacccu

SEQ ID NO: 1351443 - RNA, 23 nt, Human
cuccuucucaccucuguucaccc

SEQ ID NO: 1351444 - RNA, 23 nt, Human
cucuaccccaggacgcaccacag

SEQ ID NO: 1351445 - RNA, 22 nt, Human
cucuggacccuggccaaagcuc

SEQ ID NO: 1351446 - RNA, 18 nt, Human
cucuucuuccacuuccuc

SEQ ID NO: 1351447 - RNA, 18 nt, Human
cugcagggcggccugggc

SEQ ID NO: 1351448 - RNA, 21 nt, Human
cugcagggcggccugggcaag

SEQ ID NO: 1351449 - RNA, 20 nt, Human
cugcagggucauggcgggag

SEQ ID NO: 1351450 - RNA, 24 nt, Human
cugcccaggcccacccagcccagg

SEQ ID NO: 1351451 - RNA, 23 nt, Human
cugggcaagugccugggcucagc

SEQ ID NO: 1351452 - RNA, 19 nt, Human
cugggucagcugggagggu

SEQ ID NO: 1351453 - RNA, 18 nt, Human
cugguccugcgcagcggg

SEQ ID NO: 1351454 - RNA, 20 nt, Human
cuguggcucccucgggccca

SEQ ID NO: 1351455 - RNA, 18 nt, Human
cuguguccggccugggug

SEQ ID NO: 1351456 - RNA, 24 nt, Human
cuucaccggaccucagagcacccu

SEQ ID NO: 1351457 - RNA, 23 nt, Human
cuucucaccucuguucacccacu

SEQ ID NO: 1351458 - RNA, 24 nt, Human
gaaaaugcugcccaucaggccugu

SEQ ID NO: 1351459 - RNA, 18 nt, Human
gaacuuggaagcccagag

SEQ ID NO: 1351460 - RNA, 19 nt, Human
gaaggaagguggggcgggc

SEQ ID NO: 1351461 - RNA, 20 nt, Human
gacucacguggaagcagcag

SEQ ID NO: 1351462 - RNA, 23 nt, Human
gaggugguggcagguaggggcag

SEQ ID NO: 1351463 - RNA, 23 nt, Human
gcaaugggccgccggggugggcc

SEQ ID NO: 1351464 - RNA, 20 nt, Human
gcagccggcgggcccagcag

SEQ ID NO: 1351465 - RNA, 21 nt, Human
gcagguaggggcagggugcag

SEQ ID NO: 1351466 - RNA, 25 nt, Human
gccaagggccccugcccugucagcu

SEQ ID NO: 1351467 - RNA, 18 nt, Human
gcccaccaugguuugcca

SEQ ID NO: 1351468 - RNA, 22 nt, Human
gcccagcagguaccagugcucc

SEQ ID NO: 1351469 - RNA, 21 nt, Human
gccccugcccugucagcuccc

SEQ ID NO: 1351470 - RNA, 18 nt, Human
gcccuggacccugggccc

SEQ ID NO: 1351471 - RNA, 20 nt, Human
gcgcagcugcuggccccugu

SEQ ID NO: 1351472 - RNA, 22 nt, Human
gcgggaggagcagggcuggcug

SEQ ID NO: 1351473 - RNA, 23 nt, Human
gcugcaggcgcccccauugcuga

SEQ ID NO: 1351474 - RNA, 23 nt, Human
ggaagaagcggcccaggaggcug

SEQ ID NO: 1351475 - RNA, 23 nt, Human
ggaagcucucucccucccugcuu

SEQ ID NO: 1351476 - RNA, 21 nt, Human
ggacaaggggcagguggugcu

SEQ ID NO: 1351477 - RNA, 21 nt, Human
ggagccagcggggugggcuca

SEQ ID NO: 1351478 - RNA, 24 nt, Human
ggagcucacugagcaggccugggc

SEQ ID NO: 1351479 - RNA, 19 nt, Human
ggcagcacgggguggccag

SEQ ID NO: 1351480 - RNA, 21 nt, Human
ggcagcacgggguggccaggg

SEQ ID NO: 1351481 - RNA, 23 nt, Human
ggcaucugggguacccccugccu

SEQ ID NO: 1351482 - RNA, 19 nt, Human
ggcgggaggagcagggcug

SEQ ID NO: 1351483 - RNA, 20 nt, Human
ggcgggcgcagcugcuggcc

SEQ ID NO: 1351484 - RNA, 20 nt, Human
ggcucaguucggagcggcag

SEQ ID NO: 1351485 - RNA, 20 nt, Human
ggcuggccgcagggggugcc

SEQ ID NO: 1351486 - RNA, 19 nt, Human
ggcuucagcccgggagggu

SEQ ID NO: 1351487 - RNA, 23 nt, Human
gggcaaggaggcagcacggggug

SEQ ID NO: 1351488 - RNA, 24 nt, Human
gggcaaugggccgccggggugggc

SEQ ID NO: 1351489 - RNA, 20 nt, Human
gggcagccuagucccugccu

SEQ ID NO: 1351490 - RNA, 23 nt, Human
ggggcccuucaccuccuggcuuc

SEQ ID NO: 1351491 - RNA, 21 nt, Human
ggguggccccuggcagcuccg

SEQ ID NO: 1351492 - RNA, 24 nt, Human
ggucccugccagcucugccuuggg

SEQ ID NO: 1351493 - RNA, 19 nt, Human
ggugaccccaggcccaggg

SEQ ID NO: 1351494 - RNA, 23 nt, Human
ggugaccccaggcccagggugac

SEQ ID NO: 1351495 - RNA, 20 nt, Human
ggugggcucagccaagggcc

SEQ ID NO: 1351496 - RNA, 23 nt, Human
gucauggcgggaggagcagggcu

SEQ ID NO: 1351497 - RNA, 24 nt, Human
guccacggugcccccaggccucag

SEQ ID NO: 1351498 - RNA, 22 nt, Human
guggccccuggcagcuccgccu

SEQ ID NO: 1351499 - RNA, 18 nt, Human
gugguggcagguaggggc

SEQ ID NO: 1351500 - RNA, 20 nt, Human
uaccccaggacgcaccacag

SEQ ID NO: 1351501 - RNA, 25 nt, Human
uaccccaucugacuagcagcagcca

SEQ ID NO: 1351502 - RNA, 20 nt, Human
uacccucaccucugcagccc

SEQ ID NO: 1351503 - RNA, 21 nt, Human
ucacccaggggcucaugcccc

SEQ ID NO: 1351504 - RNA, 26 nt, Human
ucaccuacaggcaggggaaccagggu

SEQ ID NO: 1351505 - RNA, 22 nt, Human
ucacugagcaggccugggcuaa

SEQ ID NO: 1351506 - RNA, 23 nt, Human
ucacugagcaggccugggcuaaa

SEQ ID NO: 1351507 - RNA, 19 nt, Human
ucagccaagggccccugcc

SEQ ID NO: 1351508 - RNA, 23 nt, Human
ucagccgcugccuggacucgucc

SEQ ID NO: 1351509 - RNA, 19 nt, Human
ucagcggggagacagaggc

SEQ ID NO: 1351510 - RNA, 20 nt, Human
ucaggaguggggcaagggca

SEQ ID NO: 1351511 - RNA, 22 nt, Human
ucagggccgcagcgccugagga

SEQ ID NO: 1351512 - RNA, 22 nt, Human
uccacacacacugacucagccg

SEQ ID NO: 1351513 - RNA, 19 nt, Human
uccacauucuggaccuggc

SEQ ID NO: 1351514 - RNA, 21 nt, Human
uccacggugcccccaggccuc

SEQ ID NO: 1351515 - RNA, 20 nt, Human
uccagacacacacacacaca

SEQ ID NO: 1351516 - RNA, 31 nt, Human
uccagacacacacacacacacacacacacag

SEQ ID NO: 1351517 - RNA, 20 nt, Human
uccagagagcagcagccagc

SEQ ID NO: 1351518 - RNA, 19 nt, Human
uccagccguccaggcccac

SEQ ID NO: 1351519 - RNA, 20 nt, Human
ucccagacagccagcaccag

SEQ ID NO: 1351520 - RNA, 22 nt, Human
ucccagacagccagcaccaggu

SEQ ID NO: 1351521 - RNA, 23 nt, Human
ucccagcagcccccagccccagc

SEQ ID NO: 1351522 - RNA, 18 nt, Human
ucccccgggcuggacucc

SEQ ID NO: 1351523 - RNA, 22 nt, Human
uccccugcuuugcccacaagag

SEQ ID NO: 1351524 - RNA, 22 nt, Human
ucccucgggcccauggggcagc

SEQ ID NO: 1351525 - RNA, 23 nt, Human
ucccucgggcccauggggcagcc

SEQ ID NO: 1351526 - RNA, 22 nt, Human
ucccugcuucucucuccugggc

SEQ ID NO: 1351527 - RNA, 22 nt, Human
ucccugggggucucaucucugc

SEQ ID NO: 1351528 - RNA, 24 nt, Human
uccuggacgcaggccucgagccuc

SEQ ID NO: 1351529 - RNA, 24 nt, Human
uccugggcccuggacccugggccc

SEQ ID NO: 1351530 - RNA, 25 nt, Human
uccugggcccuggacccugggcccu

SEQ ID NO: 1351531 - RNA, 21 nt, Human
ucuacccugcugguuuggaag

SEQ ID NO: 1351532 - RNA, 22 nt, Human
ucuccugggcccuggacccugg

SEQ ID NO: 1351533 - RNA, 20 nt, Human
ucucugcggucccaucacuu

SEQ ID NO: 1351534 - RNA, 21 nt, Human
ucugcagggucauggcgggag

SEQ ID NO: 1351535 - RNA, 21 nt, Human
ucugcggucccaucacuuccu

SEQ ID NO: 1351536 - RNA, 24 nt, Human
ucuugccauguccaagucagccug

SEQ ID NO: 1351537 - RNA, 23 nt, Human
ucuuucucuucuuccacuuccuc

SEQ ID NO: 1351538 - RNA, 24 nt, Human
ucuuucucuucuuccacuuccucu

SEQ ID NO: 1351539 - RNA, 20 nt, Human
ugaaaagcugcaccugcagg

SEQ ID NO: 1351540 - RNA, 25 nt, Human
ugaaggccucauugaaguagggggc

SEQ ID NO: 1351541 - RNA, 20 nt, Human
ugacuccccagcucagcucu

SEQ ID NO: 1351542 - RNA, 23 nt, Human
ugacuccccagcucagcucuucc

SEQ ID NO: 1351543 - RNA, 19 nt, Human
ugaggccagauacccucac

SEQ ID NO: 1351544 - RNA, 18 nt, Human
ugaucugggagccagcgg

SEQ ID NO: 1351545 - RNA, 21 nt, Human
ugcaggguggccccuggcagc

SEQ ID NO: 1351546 - RNA, 18 nt, Human
ugccaugacuccagacac

SEQ ID NO: 1351547 - RNA, 20 nt, Human
ugccaugacuccagacacac

SEQ ID NO: 1351548 - RNA, 25 nt, Human
ugccaugacuccagacacacacaca

SEQ ID NO: 1351549 - RNA, 18 nt, Human
ugcccaggcccacccagc

SEQ ID NO: 1351550 - RNA, 18 nt, Human
ugcccaggcccacccagc

SEQ ID NO: 1351551 - RNA, 18 nt, Human
ugccccgaggcccgggca

SEQ ID NO: 1351552 - RNA, 19 nt, Human
ugccugggcucagcgggga

SEQ ID NO: 1351553 - RNA, 21 nt, Human
uggaagaagcggcccaggagg

SEQ ID NO: 1351554 - RNA, 20 nt, Human
uggaagcccagaggggucug

SEQ ID NO: 1351555 - RNA, 22 nt, Human
uggacccuggccaaagcuccag

SEQ ID NO: 1351556 - RNA, 19 nt, Human
uggacccugggcccugccu

SEQ ID NO: 1351557 - RNA, 19 nt, Human
uggcaggagaaggcguuua

SEQ ID NO: 1351558 - RNA, 18 nt, Human
uggcagguaggggcaggg

SEQ ID NO: 1351559 - RNA, 21 nt, Human
uggccccuccggccccugccc

SEQ ID NO: 1351560 - RNA, 23 nt, Human
uggccccuccggccccugcccgc

SEQ ID NO: 1351561 - RNA, 22 nt, Human
uggccccuggcagcuccgccug

SEQ ID NO: 1351562 - RNA, 20 nt, Human
uggccgaguugggguucaga

SEQ ID NO: 1351563 - RNA, 21 nt, Human
uggcuuccaaagucgaacucc

SEQ ID NO: 1351564 - RNA, 22 nt, Human
ugggcaagugccugggcucagc

SEQ ID NO: 1351565 - RNA, 19 nt, Human
ugggcucagccaagggccc

SEQ ID NO: 1351566 - RNA, 23 nt, Human
uggggcaagggcaggcgcaggcg

SEQ ID NO: 1351567 - RNA, 22 nt, Human
ugggggucccaucucaucccug

SEQ ID NO: 1351568 - RNA, 18 nt, Human
uggugcugacaucaugcc

SEQ ID NO: 1351569 - RNA, 21 nt, Human
uguggccuggugaccagcacc

SEQ ID NO: 1351570 - RNA, 23 nt, Human
uguggcucccucgggcccauggg

SEQ ID NO: 1351571 - RNA, 22 nt, Human
uucacccacuuucccugccagg

SEQ ID NO: 1351572 - RNA, 19 nt, Human
uuggaagaagcggcccagg

SEQ ID NO: 1351573 - RNA, 23 nt, Human
uuuggcaggagaaggcguuuauu

SEQ ID NO: 1351574 - RNA, 27 nt, Human
uuuuuuuuuuuggcaggagaaggcguu

SEQ ID NO: 1351575 - RNA, 27 nt, Human
uuuuuuuuuuuuuuuggcaggagaagg

SEQ ID NO: 1351576 - RNA, 18 nt, Human
uuuuuuuuuuuuuuuuug

SEQ ID NO: 1351577 - RNA, 23 nt, Human
uuuuuuuuuuuuuuuuuggcagg

SEQ ID NO: 1351578 - RNA, 22 nt, Human
uuuuuuuuuuuuuuuuuuuggc

SEQ ID NO: 1351579 - RNA, 26 nt, Human
aaaagcuccaaccacguugccagucc

SEQ ID NO: 1351580 - RNA, 27 nt, Human
ccccaaaagcuccaaccacguugccag

SEQ ID NO: 1351581 - RNA, 21 nt, Human
ccguagaggcggcaggcccgc

SEQ ID NO: 1351582 - RNA, 23 nt, Human
ccuccuggccgcgacgccuugcc

SEQ ID NO: 1351583 - RNA, 19 nt, Human
ccugagcagggacuggucc

SEQ ID NO: 1351584 - RNA, 22 nt, Human
ccugccagcaaaagugacaccu

SEQ ID NO: 1351585 - RNA, 20 nt, Human
cuccuccgcuaguccgcucc

SEQ ID NO: 1351586 - RNA, 18 nt, Human
gccagcaaaagugacacc

SEQ ID NO: 1351587 - RNA, 23 nt, Human
gcuaguccgcucccgcguuccac

SEQ ID NO: 1351588 - RNA, 22 nt, Human
gggugugugugugcgggguccg

SEQ ID NO: 1351589 - RNA, 20 nt, Human
uccacagcgccccgccgcuc

SEQ ID NO: 1351590 - RNA, 23 nt, Human
ugcaguuggucggggagaggggc

SEQ ID NO: 1351591 - RNA, 20 nt, Human
ugguagagcccuucuccucc

SEQ ID NO: 1351592 - RNA, 23 nt, Human
ugguagagcccuucuccuccugg

SEQ ID NO: 1351593 - RNA, 25 nt, Human
uuaacccagccgacaaggcacgcuu

SEQ ID NO: 1351594 - RNA, 19 nt, Human
uuccccccaaaagcuccaa

SEQ ID NO: 1351595 - RNA, 24 nt, Human
aaaagaaccaacauggaugcaugg

SEQ ID NO: 1351596 - RNA, 19 nt, Human
aaaauaucacauguacccu

SEQ ID NO: 1351597 - RNA, 21 nt, Human
aaaaugaaacaagcuuagccc

SEQ ID NO: 1351598 - RNA, 21 nt, Human
aaacaggcacucacacuuuca

SEQ ID NO: 1351599 - RNA, 19 nt, Human
aaauacaaaaagcaagccc

SEQ ID NO: 1351600 - RNA, 18 nt, Human
aaaugaagcuaacaaaua

SEQ ID NO: 1351601 - RNA, 21 nt, Human
aaaugggaauaauaagaauau

SEQ ID NO: 1351602 - RNA, 19 nt, Human
aaccugcaaagguacccuc

SEQ ID NO: 1351603 - RNA, 20 nt, Human
aacugcccacauuuuugcca

SEQ ID NO: 1351604 - RNA, 19 nt, Human
aacuuccucuucuucucug

SEQ ID NO: 1351605 - RNA, 20 nt, Human
aagaacccuccuggggaaga

SEQ ID NO: 1351606 - RNA, 18 nt, Human
aagcacaggcuucucuug

SEQ ID NO: 1351607 - RNA, 20 nt, Human
aagccuuccuuacaaacacc

SEQ ID NO: 1351608 - RNA, 20 nt, Human
aaggccacaaaaaaucagaa

SEQ ID NO: 1351609 - RNA, 24 nt, Human
aaggccacaaaaaaucagaacgua

SEQ ID NO: 1351610 - RNA, 25 nt, Human
aaguaccuucuaacuacugaucuac

SEQ ID NO: 1351611 - RNA, 24 nt, Human
aagugaucugcccaccuuggccuc

SEQ ID NO: 1351612 - RNA, 24 nt, Human
aagugauucuccugccucacccuc

SEQ ID NO: 1351613 - RNA, 24 nt, Human
aagugcaguggcaugaucacagcu

SEQ ID NO: 1351614 - RNA, 24 nt, Human
aauaauaaucauaaucaugaaaau

SEQ ID NO: 1351615 - RNA, 21 nt, Human
aauagaaggauucugccugga

SEQ ID NO: 1351616 - RNA, 19 nt, Human
aauaucuacuuaaucucaa

SEQ ID NO: 1351617 - RNA, 19 nt, Human
aaugcugggauuacaggug

SEQ ID NO: 1351618 - RNA, 27 nt, Human
acaaaaagcaagcccauggaugucaac

SEQ ID NO: 1351619 - RNA, 21 nt, Human
acacuugcagguuaacagccu

SEQ ID NO: 1351620 - RNA, 18 nt, Human
acagccucaggggaagac

SEQ ID NO: 1351621 - RNA, 18 nt, Human
acagcucauugcagccuc

SEQ ID NO: 1351622 - RNA, 23 nt, Human
acaggguuucaccauguuggcca

SEQ ID NO: 1351623 - RNA, 24 nt, Human
acaggguuucaccauguuggccag

SEQ ID NO: 1351624 - RNA, 25 nt, Human
acaggguuucaccauguuggccagg

SEQ ID NO: 1351625 - RNA, 18 nt, Human
accacuguccuggccugu

SEQ ID NO: 1351626 - RNA, 28 nt, Human
accacuguccuggccuguuuccugucag

SEQ ID NO: 1351627 - RNA, 23 nt, Human
accauguuggccagguuggucuc

SEQ ID NO: 1351628 - RNA, 22 nt, Human
acccacucuuuugcccuuccca

SEQ ID NO: 1351629 - RNA, 25 nt, Human
acccaggcuggaagugcaguggcau

SEQ ID NO: 1351630 - RNA, 24 nt, Human
accuggcuaauuuuuuuguauuuu

SEQ ID NO: 1351631 - RNA, 18 nt, Human
acuacacauuguaugcau

SEQ ID NO: 1351632 - RNA, 28 nt, Human
acuaucuuauauucacacauguguuggu

SEQ ID NO: 1351633 - RNA, 25 nt, Human
acucuguugcccaggcuggaguuca

SEQ ID NO: 1351634 - RNA, 21 nt, Human
acugcaaccuuccucuccugg

SEQ ID NO: 1351635 - RNA, 22 nt, Human
acugcaaccuuccucuccuggg

SEQ ID NO: 1351636 - RNA, 26 nt, Human
acugugucacccaggcuggaagugca

SEQ ID NO: 1351637 - RNA, 20 nt, Human
agagaccuaccaccaggaua

SEQ ID NO: 1351638 - RNA, 19 nt, Human
agagagggugaagcucuga

SEQ ID NO: 1351639 - RNA, 23 nt, Human
agcacaaauacagcccagaaaca

SEQ ID NO: 1351640 - RNA, 23 nt, Human
agccccuucccaucuugucuuug

SEQ ID NO: 1351641 - RNA, 19 nt, Human
agcuggguaaugagagacc

SEQ ID NO: 1351642 - RNA, 19 nt, Human
aggaaugugguaguaaagg

SEQ ID NO: 1351643 - RNA, 24 nt, Human
aggcaaucugcccaccuuggucuc

SEQ ID NO: 1351644 - RNA, 23 nt, Human
aggcaggaguaucacuucaaccc

SEQ ID NO: 1351645 - RNA, 18 nt, Human
aggcuaaacuuuuuucuu

SEQ ID NO: 1351646 - RNA, 22 nt, Human
aggcucaggugauccuccuacc

SEQ ID NO: 1351647 - RNA, 18 nt, Human
aggcugagauagcuccca

SEQ ID NO: 1351648 - RNA, 19 nt, Human
aggcugaggcaggaguauc

SEQ ID NO: 1351649 - RNA, 24 nt, Human
agggacuacaggcaugagccacca

SEQ ID NO: 1351650 - RNA, 22 nt, Human
aggggacuugggacucacacag

SEQ ID NO: 1351651 - RNA, 19 nt, Human
aguaccuucuaacuacuga

SEQ ID NO: 1351652 - RNA, 23 nt, Human
aguagcuggaauuauagacgugu

SEQ ID NO: 1351653 - RNA, 18 nt, Human
aguagcugggauuacagg

SEQ ID NO: 1351654 - RNA, 22 nt, Human
aguaggcacaggguuucaccau

SEQ ID NO: 1351655 - RNA, 21 nt, Human
agugcaguggcaugaucacag

SEQ ID NO: 1351656 - RNA, 24 nt, Human
agugcaguggcaugaucacagcuc

SEQ ID NO: 1351657 - RNA, 24 nt, Human
aguggcaugaucucagcuuacugc

SEQ ID NO: 1351658 - RNA, 25 nt, Human
auacuuuuuuuuggaaauaggguga

SEQ ID NO: 1351659 - RNA, 23 nt, Human
aucauucaauaauaaucauaauc

SEQ ID NO: 1351660 - RNA, 20 nt, Human
aucucacucuguugcccagg

SEQ ID NO: 1351661 - RNA, 18 nt, Human
aucucacucuuuccuuag

SEQ ID NO: 1351662 - RNA, 22 nt, Human
aucuuccuauguuguccaggcu

SEQ ID NO: 1351663 - RNA, 23 nt, Human
aucuuccuauguuguccaggcug

SEQ ID NO: 1351664 - RNA, 19 nt, Human
augcaauacuuuuuuuugg

SEQ ID NO: 1351665 - RNA, 22 nt, Human
auguacccuacaaauauguaua

SEQ ID NO: 1351666 - RNA, 20 nt, Human
augucuccugccucauaagu

SEQ ID NO: 1351667 - RNA, 19 nt, Human
auguggggauaaaagaacc

SEQ ID NO: 1351668 - RNA, 20 nt, Human
auucagggcagggguccucu

SEQ ID NO: 1351669 - RNA, 24 nt, Human
caaauugcugggaugacuggcaug

SEQ ID NO: 1351670 - RNA, 18 nt, Human
caacuccauagaaauuca

SEQ ID NO: 1351671 - RNA, 21 nt, Human
caacuccauagaaauucagcu

SEQ ID NO: 1351672 - RNA, 22 nt, Human
caagggauccuccugccucagc

SEQ ID NO: 1351673 - RNA, 20 nt, Human
caagugauucuccugccuca

SEQ ID NO: 1351674 - RNA, 20 nt, Human
caauggcaguuaaugcuuau

SEQ ID NO: 1351675 - RNA, 19 nt, Human
cacacaaguguuccagaag

SEQ ID NO: 1351676 - RNA, 24 nt, Human
cacacaauacacccauguaauaaa

SEQ ID NO: 1351677 - RNA, 20 nt, Human
cacaguuugcacuuugaaau

SEQ ID NO: 1351678 - RNA, 24 nt, Human
caccacaccuggcuaauuuuugua

SEQ ID NO: 1351679 - RNA, 21 nt, Human
caccauguuggccagguuggu

SEQ ID NO: 1351680 - RNA, 22 nt, Human
caccauguuggccagguugguc

SEQ ID NO: 1351681 - RNA, 24 nt, Human
caccauguuggccagguuggucuc

SEQ ID NO: 1351682 - RNA, 23 nt, Human
cacccacucuuuugcccuuccca

SEQ ID NO: 1351683 - RNA, 24 nt, Human
cacccuguaaaagccuuccuuaca

SEQ ID NO: 1351684 - RNA, 22 nt, Human
caccuucucaagugcaggauuc

SEQ ID NO: 1351685 - RNA, 20 nt, Human
caccuuucauucagucucag

SEQ ID NO: 1351686 - RNA, 22 nt, Human
cacucuguugcccaggcuggag

SEQ ID NO: 1351687 - RNA, 21 nt, Human
cacuuaaaaaaugcacugaga

SEQ ID NO: 1351688 - RNA, 20 nt, Human
cacuuacccugauacagaaa

SEQ ID NO: 1351689 - RNA, 19 nt, Human
cacuuugaaauggacccag

SEQ ID NO: 1351690 - RNA, 23 nt, Human
cagaagauugccuacagaggcaa

SEQ ID NO: 1351691 - RNA, 21 nt, Human
cagaaguugguuaauggacac

SEQ ID NO: 1351692 - RNA, 24 nt, Human
cagaaucucacucuguugcccagg

SEQ ID NO: 1351693 - RNA, 22 nt, Human
cagcaaacucaagauacacuuu

SEQ ID NO: 1351694 - RNA, 19 nt, Human
cagcaucacacaauacacc

SEQ ID NO: 1351695 - RNA, 21 nt, Human
cagcaucacacaauacaccca

SEQ ID NO: 1351696 - RNA, 18 nt, Human
cagccaccacgcacagcc

SEQ ID NO: 1351697 - RNA, 19 nt, Human
cagccuccugaguagcugg

SEQ ID NO: 1351698 - RNA, 24 nt, Human
cagcuacucaggaggcugaggcag

SEQ ID NO: 1351699 - RNA, 23 nt, Human
cagcucauugcagccucuacauc

SEQ ID NO: 1351700 - RNA, 24 nt, Human
caggaggcugaggcaggaguauca

SEQ ID NO: 1351701 - RNA, 18 nt, Human
cagggccugguccaugga

SEQ ID NO: 1351702 - RNA, 24 nt, Human
cagggucucacugugucacccagg

SEQ ID NO: 1351703 - RNA, 24 nt, Human
caggguuucaccauguuggccagg

SEQ ID NO: 1351704 - RNA, 21 nt, Human
cauaacaagcugcaaacaaga

SEQ ID NO: 1351705 - RNA, 22 nt, Human
cauaaugcugggauuacaggug

SEQ ID NO: 1351706 - RNA, 24 nt, Human
caugcaccacuguccuggccuguu

SEQ ID NO: 1351707 - RNA, 20 nt, Human
caugggcagggccuggucca

SEQ ID NO: 1351708 - RNA, 21 nt, Human
cauuuuaaacuaacacugagu

SEQ ID NO: 1351709 - RNA, 23 nt, Human
cauuuuagaccacugagcacuuu

SEQ ID NO: 1351710 - RNA, 23 nt, Human
ccaaauacaaaaagcaagcccau

SEQ ID NO: 1351711 - RNA, 18 nt, Human
ccacaaagccauccaagc

SEQ ID NO: 1351712 - RNA, 22 nt, Human
ccacaaggucaaaguugagugu

SEQ ID NO: 1351713 - RNA, 21 nt, Human
ccagagaggcaccuucucaag

SEQ ID NO: 1351714 - RNA, 19 nt, Human
ccagaguagcugggauuac

SEQ ID NO: 1351715 - RNA, 22 nt, Human
ccagaguagcugggauuacagg

SEQ ID NO: 1351716 - RNA, 22 nt, Human
ccagaguagcugggauuacagg

SEQ ID NO: 1351717 - RNA, 24 nt, Human
ccagaguagcugggauuacaggug

SEQ ID NO: 1351718 - RNA, 23 nt, Human
ccagccaccacgcacagccacaa

SEQ ID NO: 1351719 - RNA, 20 nt, Human
ccaggguacagucaguggag

SEQ ID NO: 1351720 - RNA, 21 nt, Human
ccauaaugcugggauuacagg

SEQ ID NO: 1351721 - RNA, 24 nt, Human
cccaaguagcagggacuacaggca

SEQ ID NO: 1351722 - RNA, 19 nt, Human
cccacauuugcauuauguc

SEQ ID NO: 1351723 - RNA, 22 nt, Human
cccacauuugcauuaugucuaa

SEQ ID NO: 1351724 - RNA, 20 nt, Human
cccagccaaucugauugcaa

SEQ ID NO: 1351725 - RNA, 21 nt, Human
cccaucauuuguuugcuguug

SEQ ID NO: 1351726 - RNA, 21 nt, Human
cccaugguccaccuuuuuauu

SEQ ID NO: 1351727 - RNA, 24 nt, Human
ccccccguucagccagcacugagc

SEQ ID NO: 1351728 - RNA, 21 nt, Human
cccuaggccccaugcaagcuc

SEQ ID NO: 1351729 - RNA, 23 nt, Human
cccuccgaaaucuaaaaugaaag

SEQ ID NO: 1351730 - RNA, 23 nt, Human
cccugagugcccagcaugugccc

SEQ ID NO: 1351731 - RNA, 18 nt, Human
cccugauacagaaagaag

SEQ ID NO: 1351732 - RNA, 25 nt, Human
cccuucagaaagcagauccuugggc

SEQ ID NO: 1351733 - RNA, 20 nt, Human
cccuuuucauccacccacuc

SEQ ID NO: 1351734 - RNA, 23 nt, Human
ccuaccucagccucccaaguagc

SEQ ID NO: 1351735 - RNA, 22 nt, Human
ccuauguuguccaggcuggucu

SEQ ID NO: 1351736 - RNA, 22 nt, Human
ccucacuugagaagcuuugcaa

SEQ ID NO: 1351737 - RNA, 26 nt, Human
ccuccaaauacaaaaagcaagcccau

SEQ ID NO: 1351738 - RNA, 19 nt, Human
ccugaguagcuggaauuau

SEQ ID NO: 1351739 - RNA, 19 nt, Human
ccugauccaugaaucucug

SEQ ID NO: 1351740 - RNA, 23 nt, Human
ccuggguucaagugauucuccuc

SEQ ID NO: 1351741 - RNA, 23 nt, Human
ccuggguucaagugauucuccug

SEQ ID NO: 1351742 - RNA, 21 nt, Human
ccuggugcucuccuacccccc

SEQ ID NO: 1351743 - RNA, 18 nt, Human
ccuguaaaagccuuccuu

SEQ ID NO: 1351744 - RNA, 21 nt, Human
ccuguaaucccagcuacucag

SEQ ID NO: 1351745 - RNA, 20 nt, Human
ccuucugcuuuuagucauuu

SEQ ID NO: 1351746 - RNA, 19 nt, Human
cgaaaagaaugacauugag

SEQ ID NO: 1351747 - RNA, 23 nt, Human
cuaacaguuagaaguggagaaaa

SEQ ID NO: 1351748 - RNA, 24 nt, Human
cucaagugaucugcccaccuuggc

SEQ ID NO: 1351749 - RNA, 24 nt, Human
cucacucuguugcccaggcuggag

SEQ ID NO: 1351750 - RNA, 24 nt, Human
cucaggugauccuccuaccucagc

SEQ ID NO: 1351751 - RNA, 23 nt, Human
cucccauggccaggguuccugca

SEQ ID NO: 1351752 - RNA, 20 nt, Human
cuccuggguucaagugauuc

SEQ ID NO: 1351753 - RNA, 21 nt, Human
cuccuggguucaagugauucu

SEQ ID NO: 1351754 - RNA, 18 nt, Human
cugagcacuuuugccucu

SEQ ID NO: 1351755 - RNA, 23 nt, Human
cugcaaccuuccucuccuggguu

SEQ ID NO: 1351756 - RNA, 23 nt, Human
cugccucagccuccugaguagcu

SEQ ID NO: 1351757 - RNA, 19 nt, Human
cuggaagugcaguggcaug

SEQ ID NO: 1351758 - RNA, 21 nt, Human
cuggacaaguucccuuuuaug

SEQ ID NO: 1351759 - RNA, 24 nt, Human
cuggaguucaguggcaugaucuca

SEQ ID NO: 1351760 - RNA, 24 nt, Human
cuuacaaacaccuccaguagaucc

SEQ ID NO: 1351761 - RNA, 23 nt, Human
cuuagcucaaggccacaaaaaau

SEQ ID NO: 1351762 - RNA, 22 nt, Human
cuucccaaaagaaucagacacu

SEQ ID NO: 1351763 - RNA, 19 nt, Human
cuuuugccucuggacuaca

SEQ ID NO: 1351764 - RNA, 24 nt, Human
gaaaauauauguaaagaccuuuga

SEQ ID NO: 1351765 - RNA, 18 nt, Human
gaacguaaauuccagccc

SEQ ID NO: 1351766 - RNA, 22 nt, Human
gaagaggccaugcaggcucagg

SEQ ID NO: 1351767 - RNA, 23 nt, Human
gaagccccuucccaucuugucuu

SEQ ID NO: 1351768 - RNA, 18 nt, Human
gaaguagcaacuccauag

SEQ ID NO: 1351769 - RNA, 18 nt, Human
gaagugcaguggcaugau

SEQ ID NO: 1351770 - RNA, 23 nt, Human
gaaguggagaacaaagauaagug

SEQ ID NO: 1351771 - RNA, 24 nt, Human
gaccuaccaccaggauaguucaaa

SEQ ID NO: 1351772 - RNA, 21 nt, Human
gacuacaggcaugagccacca

SEQ ID NO: 1351773 - RNA, 20 nt, Human
gagacagaaucucacucugu

SEQ ID NO: 1351774 - RNA, 19 nt, Human
gagagaccuaccaccagga

SEQ ID NO: 1351775 - RNA, 19 nt, Human
gagagggugaagcucugag

SEQ ID NO: 1351776 - RNA, 22 nt, Human
gagagugaaaguuaccugaggu

SEQ ID NO: 1351777 - RNA, 20 nt, Human
gagcacuuuugccucuggaa

SEQ ID NO: 1351778 - RNA, 24 nt, Human
gagcucaggcaaucugcccaccuu

SEQ ID NO: 1351779 - RNA, 26 nt, Human
gaguagcugggauuacaggugcacac

SEQ ID NO: 1351780 - RNA, 24 nt, Human
gagugugguggcacaugccuguaa

SEQ ID NO: 1351781 - RNA, 19 nt, Human
gaugggguuuugauauguu

SEQ ID NO: 1351782 - RNA, 18 nt, Human
gauuacaggugccagcca

SEQ ID NO: 1351783 - RNA, 23 nt, Human
gcagaugcuacugcaguuuguau

SEQ ID NO: 1351784 - RNA, 19 nt, Human
gcaggauucagggcagggg

SEQ ID NO: 1351785 - RNA, 24 nt, Human
gcccaggcuggaguucaguggcau

SEQ ID NO: 1351786 - RNA, 20 nt, Human
gccucagccuccugaguagc

SEQ ID NO: 1351787 - RNA, 19 nt, Human
gcucuaauaaugcaguuga

SEQ ID NO: 1351788 - RNA, 21 nt, Human
ggaaagauguggaauguucuc

SEQ ID NO: 1351789 - RNA, 20 nt, Human
ggacagguggacaaaugcuc

SEQ ID NO: 1351790 - RNA, 19 nt, Human
ggacuacaggcaugagcca

SEQ ID NO: 1351791 - RNA, 24 nt, Human
ggacucaagugaucugcccaccuu

SEQ ID NO: 1351792 - RNA, 22 nt, Human
ggauccuccugccucagccucc

SEQ ID NO: 1351793 - RNA, 22 nt, Human
ggaucuuccuauguuguccagg

SEQ ID NO: 1351794 - RNA, 18 nt, Human
ggcagggccugguccaug

SEQ ID NO: 1351795 - RNA, 18 nt, Human
ggcagggguccucuugcc

SEQ ID NO: 1351796 - RNA, 21 nt, Human
ggcaugaucacagcucauugc

SEQ ID NO: 1351797 - RNA, 23 nt, Human
ggcucaggugauccuccuaccuc

SEQ ID NO: 1351798 - RNA, 20 nt, Human
ggcuggaagugcaguggcau

SEQ ID NO: 1351799 - RNA, 23 nt, Human
gggacuacaggcaugagccacca

SEQ ID NO: 1351800 - RNA, 24 nt, Human
gggauccuccugccucagccuccu

SEQ ID NO: 1351801 - RNA, 23 nt, Human
gggguuuugauauguugcucagg

SEQ ID NO: 1351802 - RNA, 22 nt, Human
ggguuucaccauguuggccagg

SEQ ID NO: 1351803 - RNA, 19 nt, Human
gguaagaacccuccugggg

SEQ ID NO: 1351804 - RNA, 24 nt, Human
gguggcacaugccuguaaucccag

SEQ ID NO: 1351805 - RNA, 18 nt, Human
guagcugggauuacaggu

SEQ ID NO: 1351806 - RNA, 19 nt, Human
guauuuuuuguagagaugg

SEQ ID NO: 1351807 - RNA, 24 nt, Human
gugauccuccuaccucagccuccc

SEQ ID NO: 1351808 - RNA, 19 nt, Human
gugauucuccugccucacc

SEQ ID NO: 1351809 - RNA, 22 nt, Human
gugccuccacacccagcuuaca

SEQ ID NO: 1351810 - RNA, 20 nt, Human
guggcaugaggagcuguggg

SEQ ID NO: 1351811 - RNA, 20 nt, Human
guggccugcugaguauuagc

SEQ ID NO: 1351812 - RNA, 19 nt, Human
guguccuaauacauaugua

SEQ ID NO: 1351813 - RNA, 23 nt, Human
guucaguggcaugaucucagcuu

SEQ ID NO: 1351814 - RNA, 19 nt, Human
guuguuccuggugcucucc

SEQ ID NO: 1351815 - RNA, 22 nt, Human
uaaaagaaccaacauggaugca

SEQ ID NO: 1351816 - RNA, 26 nt, Human
uaaaagccuuccuuacaaacaccucc

SEQ ID NO: 1351817 - RNA, 18 nt, Human
uaaacaagguacagagaa

SEQ ID NO: 1351818 - RNA, 24 nt, Human
uaaaccugcaaagguacccuccga

SEQ ID NO: 1351819 - RNA, 25 nt, Human
uaaacuccugaacucaagggauccu

SEQ ID NO: 1351820 - RNA, 19 nt, Human
uaaagggagagcugaucau

SEQ ID NO: 1351821 - RNA, 25 nt, Human
uaaauacuuucacuuaaaaaaugca

SEQ ID NO: 1351822 - RNA, 22 nt, Human
uaacaauaacuuauauauuuca

SEQ ID NO: 1351823 - RNA, 21 nt, Human
uaauuaucaaguaaaaucuca

SEQ ID NO: 1351824 - RNA, 22 nt, Human
uaauuuuuguauuuuuuguaga

SEQ ID NO: 1351825 - RNA, 24 nt, Human
uaauuuuuguauuuuuuguagaga

SEQ ID NO: 1351826 - RNA, 21 nt, Human
uacaaaaagcaagcccaugga

SEQ ID NO: 1351827 - RNA, 22 nt, Human
uacaaacaccuccaguagaucc

SEQ ID NO: 1351828 - RNA, 23 nt, Human
uacagcccagaaacacuugcagg

SEQ ID NO: 1351829 - RNA, 22 nt, Human
uacaggcaugagccaccacacc

SEQ ID NO: 1351830 - RNA, 21 nt, Human
uaccccaaaucucagcaucac

SEQ ID NO: 1351831 - RNA, 23 nt, Human
uaccccaaaucucagcaucacac

SEQ ID NO: 1351832 - RNA, 23 nt, Human
uaccucagccucccaaguagcag

SEQ ID NO: 1351833 - RNA, 23 nt, Human
uacugcaaccuuccucuccuggg

SEQ ID NO: 1351834 - RNA, 20 nt, Human
uagaauucucugauuucuug

SEQ ID NO: 1351835 - RNA, 24 nt, Human
uagacgugugccuccacacccagc

SEQ ID NO: 1351836 - RNA, 20 nt, Human
uagauccuccaaccacuuuc

SEQ ID NO: 1351837 - RNA, 22 nt, Human
uagauccuccaaccacuuucag

SEQ ID NO: 1351838 - RNA, 26 nt, Human
uagcucccauggccaggguuccuucc

SEQ ID NO: 1351839 - RNA, 18 nt, Human
uagcugcucucugccucc

SEQ ID NO: 1351840 - RNA, 22 nt, Human
uaggcacaggguuucaccaugu

SEQ ID NO: 1351841 - RNA, 24 nt, Human
uaguaggcacaggguuucaccaug

SEQ ID NO: 1351842 - RNA, 21 nt, Human
uauauaauauauaacuauaua

SEQ ID NO: 1351843 - RNA, 19 nt, Human
uaucaugucuccugccuca

SEQ ID NO: 1351844 - RNA, 24 nt, Human
uaucccucaucuacaaaaugggaa

SEQ ID NO: 1351845 - RNA, 24 nt, Human
uauguucccugcaccacuggugcc

SEQ ID NO: 1351846 - RNA, 24 nt, Human
uauguugcucaggcuugucucaaa

SEQ ID NO: 1351847 - RNA, 24 nt, Human
uauguuguccaggcuggucuuaaa

SEQ ID NO: 1351848 - RNA, 18 nt, Human
uauuaggaaugccuuguu

SEQ ID NO: 1351849 - RNA, 24 nt, Human
uauuuggagacagaaucucacucu

SEQ ID NO: 1351850 - RNA, 25 nt, Human
uauuuggagacagaaucucacucug

SEQ ID NO: 1351851 - RNA, 25 nt, Human
uauuuggagacagaaucucacucug

SEQ ID NO: 1351852 - RNA, 23 nt, Human
ucaaaacccauuugcaaauagau

SEQ ID NO: 1351853 - RNA, 26 nt, Human
ucaaaacccauuugcaaauagaugua

SEQ ID NO: 1351854 - RNA, 23 nt, Human
ucaaaauacauaugaguacaauc

SEQ ID NO: 1351855 - RNA, 19 nt, Human
ucaagugauucuccugccu

SEQ ID NO: 1351856 - RNA, 21 nt, Human
ucaccauguuggccagguugg

SEQ ID NO: 1351857 - RNA, 23 nt, Human
ucaccccuucagaaagcagaucc

SEQ ID NO: 1351858 - RNA, 24 nt, Human
ucacucuguugcccaggcuggagu

SEQ ID NO: 1351859 - RNA, 27 nt, Human
ucagaaagcagauccuugggcaccauu

SEQ ID NO: 1351860 - RNA, 22 nt, Human
ucagccuccugaguagcuggaa

SEQ ID NO: 1351861 - RNA, 23 nt, Human
ucagcucaccuuucauucagucu

SEQ ID NO: 1351862 - RNA, 22 nt, Human
ucagucucagacaccgugagaa

SEQ ID NO: 1351863 - RNA, 19 nt, Human
ucauauccagcuucccaaa

SEQ ID NO: 1351864 - RNA, 19 nt, Human
uccacaaagccauccaagc

SEQ ID NO: 1351865 - RNA, 21 nt, Human
uccacaauucucaccccuuca

SEQ ID NO: 1351866 - RNA, 19 nt, Human
uccacuguacaaauaaaau

SEQ ID NO: 1351867 - RNA, 24 nt, Human
uccagaguagcugggauuacaggu

SEQ ID NO: 1351868 - RNA, 25 nt, Human
uccaguagauccuccaaccacuuuc

SEQ ID NO: 1351869 - RNA, 24 nt, Human
ucccaaauugcugggaugacuggc

SEQ ID NO: 1351870 - RNA, 24 nt, Human
ucccaaguagcagggacuacaggc

SEQ ID NO: 1351871 - RNA, 18 nt, Human
ucccagccaaucugauug

SEQ ID NO: 1351872 - RNA, 23 nt, Human
ucccauaaugcugggauuacagg

SEQ ID NO: 1351873 - RNA, 25 nt, Human
ucccugcaccacuggugccuauuuc

SEQ ID NO: 1351874 - RNA, 27 nt, Human
uccuccuaccucagccucccaaguagc

SEQ ID NO: 1351875 - RNA, 26 nt, Human
uccuccugccucagccuccugaguag

SEQ ID NO: 1351876 - RNA, 19 nt, Human
uccuggguucaagugauuc

SEQ ID NO: 1351877 - RNA, 21 nt, Human
uccuggguucaagugauucuc

SEQ ID NO: 1351878 - RNA, 24 nt, Human
uccuggguucaagugauucuccug

SEQ ID NO: 1351879 - RNA, 19 nt, Human
uccuugaagaagcuucauu

SEQ ID NO: 1351880 - RNA, 23 nt, Human
ucucaaacuccugagcucaggca

SEQ ID NO: 1351881 - RNA, 24 nt, Human
ucucaccccuucagaaagcagauc

SEQ ID NO: 1351882 - RNA, 23 nt, Human
ucucacucuguugcccaggcugg

SEQ ID NO: 1351883 - RNA, 24 nt, Human
ucucacucuguugcccaggcugga

SEQ ID NO: 1351884 - RNA, 26 nt, Human
ucucacucuguugcccaggcuggagu

SEQ ID NO: 1351885 - RNA, 24 nt, Human
ucucacugugucacccaggcugga

SEQ ID NO: 1351886 - RNA, 22 nt, Human
ucuccaggcucaggugauccuc

SEQ ID NO: 1351887 - RNA, 25 nt, Human
ucuccaggcucaggugauccuccua

SEQ ID NO: 1351888 - RNA, 24 nt, Human
ucuccuggguucaagugauucucc

SEQ ID NO: 1351889 - RNA, 18 nt, Human
ucucugauuucuuggugc

SEQ ID NO: 1351890 - RNA, 19 nt, Human
ucucuugugcugccagcaa

SEQ ID NO: 1351891 - RNA, 21 nt, Human
ucugcagucccuacucuaagc

SEQ ID NO: 1351892 - RNA, 21 nt, Human
ucugcccaccuuggucuccca

SEQ ID NO: 1351893 - RNA, 19 nt, Human
ucugugaagaccuguaccc

SEQ ID NO: 1351894 - RNA, 18 nt, Human
ucuguugcccaggcugga

SEQ ID NO: 1351895 - RNA, 19 nt, Human
ucuuccuauguuguccagg

SEQ ID NO: 1351896 - RNA, 23 nt, Human
ucuuccuauguuguccaggcugg

SEQ ID NO: 1351897 - RNA, 24 nt, Human
ucuuccuauguuguccaggcuggu

SEQ ID NO: 1351898 - RNA, 23 nt, Human
ucuucuucucugagauuucuaga

SEQ ID NO: 1351899 - RNA, 20 nt, Human
ugaaauggacccagggaaga

SEQ ID NO: 1351900 - RNA, 24 nt, Human
ugaacucaagggauccuccugccu

SEQ ID NO: 1351901 - RNA, 20 nt, Human
ugaagaccuguacccucagu

SEQ ID NO: 1351902 - RNA, 23 nt, Human
ugaagauuauagcaauauuuuug

SEQ ID NO: 1351903 - RNA, 19 nt, Human
ugacuucauauccagcuuc

SEQ ID NO: 1351904 - RNA, 23 nt, Human
ugagagugaaaguuaccugaggu

SEQ ID NO: 1351905 - RNA, 19 nt, Human
ugagaucaaccuuccacca

SEQ ID NO: 1351906 - RNA, 24 nt, Human
ugagcacaaauacagcccagaaac

SEQ ID NO: 1351907 - RNA, 24 nt, Human
ugagccagcaggaaggaucucaca

SEQ ID NO: 1351908 - RNA, 24 nt, Human
ugaggcaggaguaucacuucaacc

SEQ ID NO: 1351909 - RNA, 25 nt, Human
ugaggcaggaguaucacuucaaccc

SEQ ID NO: 1351910 - RNA, 18 nt, Human
ugaggucagacacugugc

SEQ ID NO: 1351911 - RNA, 19 nt, Human
ugagugggccaggguacag

SEQ ID NO: 1351912 - RNA, 24 nt, Human
ugaucugcccaccuuggccuccca

SEQ ID NO: 1351913 - RNA, 21 nt, Human
ugauuugaucacuacacauug

SEQ ID NO: 1351914 - RNA, 19 nt, Human
ugcaaaaagagauuggaaa

SEQ ID NO: 1351915 - RNA, 21 nt, Human
ugcauagacaaaaugaaacaa

SEQ ID NO: 1351916 - RNA, 21 nt, Human
ugcauguaucaaaauaucaca

SEQ ID NO: 1351917 - RNA, 18 nt, Human
ugccagcaguucucuucc

SEQ ID NO: 1351918 - RNA, 19 nt, Human
ugccauucaauuucugcag

SEQ ID NO: 1351919 - RNA, 19 nt, Human
ugccauucaauuucugcag

SEQ ID NO: 1351920 - RNA, 21 nt, Human
ugcccaggcuggaguucagug

SEQ ID NO: 1351921 - RNA, 24 nt, Human
ugcccaggcuggaguucaguggca

SEQ ID NO: 1351922 - RNA, 24 nt, Human
ugccucagccuccugaguagcugg

SEQ ID NO: 1351923 - RNA, 24 nt, Human
ugccucauaaguaccacuggacaa

SEQ ID NO: 1351924 - RNA, 19 nt, Human
ugccugagcacaaauacag

SEQ ID NO: 1351925 - RNA, 28 nt, Human
ugccugagcacaaauacagcccagaaac

SEQ ID NO: 1351926 - RNA, 18 nt, Human
ugccuggauuugcaugug

SEQ ID NO: 1351927 - RNA, 24 nt, Human
ugccuguaaucccagcuacucagg

SEQ ID NO: 1351928 - RNA, 21 nt, Human
ugcucuccuaccccccguuca

SEQ ID NO: 1351929 - RNA, 20 nt, Human
ugcugagggaaacagggugg

SEQ ID NO: 1351930 - RNA, 18 nt, Human
ugcugggaugacuggcau

SEQ ID NO: 1351931 - RNA, 20 nt, Human
ugcugggauuacaggugcca

SEQ ID NO: 1351932 - RNA, 23 nt, Human
ugcugugagauauccacagaacu

SEQ ID NO: 1351933 - RNA, 21 nt, Human
uggaaggaacagaaaaauuuc

SEQ ID NO: 1351934 - RNA, 24 nt, Human
uggaauuauagacgugugccucca

SEQ ID NO: 1351935 - RNA, 24 nt, Human
uggacacaaaaauacaguuagaug

SEQ ID NO: 1351936 - RNA, 18 nt, Human
uggacucaagugaucugc

SEQ ID NO: 1351937 - RNA, 22 nt, Human
uggacucaagugaucugcccac

SEQ ID NO: 1351938 - RNA, 19 nt, Human
uggaguucaguggcaugau

SEQ ID NO: 1351939 - RNA, 19 nt, Human
uggaguucaguggcaugau

SEQ ID NO: 1351940 - RNA, 21 nt, Human
uggcacaugccuguaauccca

SEQ ID NO: 1351941 - RNA, 24 nt, Human
uggcaugaucucagcuuacugcaa

SEQ ID NO: 1351942 - RNA, 24 nt, Human
uggccagguuggucucaaacuccu

SEQ ID NO: 1351943 - RNA, 19 nt, Human
ugggacagggucucacugu

SEQ ID NO: 1351944 - RNA, 21 nt, Human
ugggagagcauuaggcugaga

SEQ ID NO: 1351945 - RNA, 18 nt, Human
ugggaucuuccuauguug

SEQ ID NO: 1351946 - RNA, 24 nt, Human
ugggaucuuccuauguuguccagg

SEQ ID NO: 1351947 - RNA, 21 nt, Human
ugggauuacaggugcacacca

SEQ ID NO: 1351948 - RNA, 19 nt, Human
ugggauuacaggugcacca

SEQ ID NO: 1351949 - RNA, 22 nt, Human
ugggauuacaggugccagccac

SEQ ID NO: 1351950 - RNA, 24 nt, Human
ugggauuacaggugccagccacca

SEQ ID NO: 1351951 - RNA, 21 nt, Human
uggggauaaaagaaccaacau

SEQ ID NO: 1351952 - RNA, 24 nt, Human
ugggguuuugauauguugcucagg

SEQ ID NO: 1351953 - RNA, 23 nt, Human
uggguucaagugauucuccugcc

SEQ ID NO: 1351954 - RNA, 24 nt, Human
uggguucaagugauucuccugccu

SEQ ID NO: 1351955 - RNA, 19 nt, Human
ugguaagaacccuccuggg

SEQ ID NO: 1351956 - RNA, 24 nt, Human
ugguggcacaugccuguaauccca

SEQ ID NO: 1351957 - RNA, 23 nt, Human
ugguguccuaauacauauguaug

SEQ ID NO: 1351958 - RNA, 25 nt, Human
uguaaaagccuuccuuacaaacacc

SEQ ID NO: 1351959 - RNA, 18 nt, Human
uguaauaaaccugcaaag

SEQ ID NO: 1351960 - RNA, 24 nt, Human
uguagagaugggguuuugauaugu

SEQ ID NO: 1351961 - RNA, 20 nt, Human
uguauucauaacaagcugca

SEQ ID NO: 1351962 - RNA, 24 nt, Human
uguccaggcuggucuuaaacuccu

SEQ ID NO: 1351963 - RNA, 23 nt, Human
ugucucaaacucuuggacucaac

SEQ ID NO: 1351964 - RNA, 25 nt, Human
ugugucacccaggcuggaagugcag

SEQ ID NO: 1351965 - RNA, 24 nt, Human
uguguguuguuccuggugcucucc

SEQ ID NO: 1351966 - RNA, 25 nt, Human
uguuaugacaccuccaaauacaaaa

SEQ ID NO: 1351967 - RNA, 23 nt, Human
uuaaaguagcuucaaaacccauu

SEQ ID NO: 1351968 - RNA, 24 nt, Human
uuacugcaaccuuccucuccuggg

SEQ ID NO: 1351969 - RNA, 18 nt, Human
uuagcccacccacaggug

SEQ ID NO: 1351970 - RNA, 22 nt, Human
uuaggcugagauagcucccaug

SEQ ID NO: 1351971 - RNA, 24 nt, Human
uuaguaggcacaggguuucaccau

SEQ ID NO: 1351972 - RNA, 21 nt, Human
uucaagugauucuccugccuc

SEQ ID NO: 1351973 - RNA, 23 nt, Human
uucaagugauucuccugccucac

SEQ ID NO: 1351974 - RNA, 18 nt, Human
uucaaguuaguuuacccu

SEQ ID NO: 1351975 - RNA, 24 nt, Human
uucacccuguaaaagccuuccuua

SEQ ID NO: 1351976 - RNA, 27 nt, Human
uucauucauaccccaaaucucagcauc

SEQ ID NO: 1351977 - RNA, 24 nt, Human
uuccuugggucccuuuuccuuagc

SEQ ID NO: 1351978 - RNA, 23 nt, Human
uucgccaggucccugagugccca

SEQ ID NO: 1351979 - RNA, 19 nt, Human
uugcagccucuacaucucc

SEQ ID NO: 1351980 - RNA, 21 nt, Human
uugcugggaugacuggcaugc

SEQ ID NO: 1351981 - RNA, 22 nt, Human
uuguagagaugggguuuugaua

SEQ ID NO: 1351982 - RNA, 24 nt, Human
uuguagagaugggguuuugauaug

SEQ ID NO: 1351983 - RNA, 19 nt, Human
uuucaccauguuggccagg

SEQ ID NO: 1351984 - RNA, 20 nt, Human
uuucaccauguuggccaggu

SEQ ID NO: 1351985 - RNA, 24 nt, Human
uuuguagagaugggguuuugauau

SEQ ID NO: 1351986 - RNA, 18 nt, Human
uuuucacauugcuaaguu

SEQ ID NO: 1351987 - RNA, 19 nt, Human
uuuugauauguugcucagg

SEQ ID NO: 1351988 - RNA, 24 nt, Human
uuuuuaguaggcacaggguuucac

SEQ ID NO: 1351989 - RNA, 20 nt, Human
uuuuuguauuuuuuguagag

SEQ ID NO: 1351990 - RNA, 23 nt, Human
uuuuuguauuuuuuguagagaug

SEQ ID NO: 1351991 - RNA, 22 nt, Human
uuuuuuguagagaugggguuuu

SEQ ID NO: 1351992 - RNA, 19 nt, Human
aaagguacaugccaaaucu

SEQ ID NO: 1351993 - RNA, 23 nt, Human
aagauuucuugaaguaagccacu

SEQ ID NO: 1351994 - RNA, 18 nt, Human
aaugacaucuuggggacc

SEQ ID NO: 1351995 - RNA, 21 nt, Human
aaugagguuaaaaaugggugu

SEQ ID NO: 1351996 - RNA, 23 nt, Human
acagggcuucuaaaagggcagga

SEQ ID NO: 1351997 - RNA, 24 nt, Human
agaaauagcccuuuggcccacagg

SEQ ID NO: 1351998 - RNA, 21 nt, Human
agauguugaaagguacaugcc

SEQ ID NO: 1351999 - RNA, 18 nt, Human
aggauauacuguuugaaa

SEQ ID NO: 1352000 - RNA, 18 nt, Human
augaaagaggagcaaaua

SEQ ID NO: 1352001 - RNA, 22 nt, Human
augccucuuuaagaaauagccc

SEQ ID NO: 1352002 - RNA, 20 nt, Human
auuucuugaaguaagccacu

SEQ ID NO: 1352003 - RNA, 19 nt, Human
cacauaguucaaaaucagg

SEQ ID NO: 1352004 - RNA, 21 nt, Human
ccccgccgcgcugcagucaga

SEQ ID NO: 1352005 - RNA, 22 nt, Human
ccccgccgcgcugcagucagaa

SEQ ID NO: 1352006 - RNA, 21 nt, Human
cggagauguaacagggcuucu

SEQ ID NO: 1352007 - RNA, 22 nt, Human
gaaaaaaacauuagauaaauaa

SEQ ID NO: 1352008 - RNA, 25 nt, Human
gaaaauaauaugaaagaggagccgg

SEQ ID NO: 1352009 - RNA, 20 nt, Human
guaaaccaugcuauuaaccc

SEQ ID NO: 1352010 - RNA, 23 nt, Human
uaaaaguggcagguuucuuaaaa

SEQ ID NO: 1352011 - RNA, 19 nt, Human
uaagaugucaguuuugaag

SEQ ID NO: 1352012 - RNA, 22 nt, Human
uacuguuugaaaauggaaaguu

SEQ ID NO: 1352013 - RNA, 18 nt, Human
uauacuguuugaaaaugg

SEQ ID NO: 1352014 - RNA, 25 nt, Human
uccaaaagguguuuaauuuuaugga

SEQ ID NO: 1352015 - RNA, 18 nt, Human
ugaagccauuuuuuuuua

SEQ ID NO: 1352016 - RNA, 19 nt, Human
ugaaguaagccacuugaac

SEQ ID NO: 1352017 - RNA, 20 nt, Human
ugaaugagguuaaaaauggg

SEQ ID NO: 1352018 - RNA, 19 nt, Human
ugcaaacuuuaccaugcua

SEQ ID NO: 1352019 - RNA, 19 nt, Human
ugcuauuaacccaacaucu

SEQ ID NO: 1352020 - RNA, 21 nt, Human
uggcuucucaggccugggggg

SEQ ID NO: 1352021 - RNA, 19 nt, Human
uguacugucaaguauaaga

SEQ ID NO: 1352022 - RNA, 20 nt, Human
uucuuguugaacagcagcuu

SEQ ID NO: 1352023 - RNA, 19 nt, Human
uugguauuuuggcuaaggu

SEQ ID NO: 1352024 - RNA, 23 nt, Human
uuucuuguugaacagcagcuuca

SEQ ID NO: 1352025 - RNA, 23 nt, Human
aacguggcccggcagguucccca

SEQ ID NO: 1352026 - RNA, 20 nt, Human
aagaagaacaagaacaacaa

SEQ ID NO: 1352027 - RNA, 23 nt, Human
aagaagaacaagaacaacaacug

SEQ ID NO: 1352028 - RNA, 22 nt, Human
aagggucacugccugaggagcc

SEQ ID NO: 1352029 - RNA, 25 nt, Human
accucgccccucccccaggccccag

SEQ ID NO: 1352030 - RNA, 26 nt, Human
accucgccccucccccaggccccagc

SEQ ID NO: 1352031 - RNA, 20 nt, Human
acugcacgaggcuuuccaug

SEQ ID NO: 1352032 - RNA, 20 nt, Human
agaagaacaagaacaacaac

SEQ ID NO: 1352033 - RNA, 25 nt, Human
agaagaacaagaacaacaacugaga

SEQ ID NO: 1352034 - RNA, 19 nt, Human
agaggugggggcugaggcc

SEQ ID NO: 1352035 - RNA, 21 nt, Human
caaagaacaagaagaacaaga

SEQ ID NO: 1352036 - RNA, 20 nt, Human
caaccagguccagccuccca

SEQ ID NO: 1352037 - RNA, 18 nt, Human
caagaacaacaacugaga

SEQ ID NO: 1352038 - RNA, 20 nt, Human
caauccugcccuccacuccc

SEQ ID NO: 1352039 - RNA, 22 nt, Human
cacacaaacggaagaggccacc

SEQ ID NO: 1352040 - RNA, 18 nt, Human
cacuccugcaggccagag

SEQ ID NO: 1352041 - RNA, 24 nt, Human
cacugccugaggagcccugcccca

SEQ ID NO: 1352042 - RNA, 24 nt, Human
cagcgggacaagcugcugggcccu

SEQ ID NO: 1352043 - RNA, 21 nt, Human
caggccccaccaacguggccc

SEQ ID NO: 1352044 - RNA, 25 nt, Human
ccaauccugcccuccacucccaugc

SEQ ID NO: 1352045 - RNA, 21 nt, Human
ccacacuguggcccagccacc

SEQ ID NO: 1352046 - RNA, 18 nt, Human
ccagccucccagcuucca

SEQ ID NO: 1352047 - RNA, 19 nt, Human
ccccacacccgccacccag

SEQ ID NO: 1352048 - RNA, 20 nt, Human
ccccaggccccagccugccc

SEQ ID NO: 1352049 - RNA, 21 nt, Human
ccccaggccccagccugcccc

SEQ ID NO: 1352050 - RNA, 20 nt, Human
cccccacacccgccacccag

SEQ ID NO: 1352051 - RNA, 18 nt, Human
cccccaggccccagccug

SEQ ID NO: 1352052 - RNA, 18 nt, Human
ccccucccccaggcccca

SEQ ID NO: 1352053 - RNA, 22 nt, Human
cccugccccaauccugcccucc

SEQ ID NO: 1352054 - RNA, 24 nt, Human
ccuccacucccaugcgcacacaaa

SEQ ID NO: 1352055 - RNA, 21 nt, Human
ccucccccaggccccagccug

SEQ ID NO: 1352056 - RNA, 23 nt, Human
ccugcaggccagaggugggggcu

SEQ ID NO: 1352057 - RNA, 19 nt, Human
ccugcccccacacccgcca

SEQ ID NO: 1352058 - RNA, 21 nt, Human
ccuggccugccuggggagggg

SEQ ID NO: 1352059 - RNA, 24 nt, Human
cgcacacaaacggaagaggccaca

SEQ ID NO: 1352060 - RNA, 25 nt, Human
cgccccucccccaggccccagccug

SEQ ID NO: 1352061 - RNA, 19 nt, Human
cggaagaggccacacugug

SEQ ID NO: 1352062 - RNA, 24 nt, Human
cggcagguuccccacugcagaccu

SEQ ID NO: 1352063 - RNA, 24 nt, Human
cuccugcaggccagaggugggggc

SEQ ID NO: 1352064 - RNA, 21 nt, Human
cugcagcaauuucaugccucc

SEQ ID NO: 1352065 - RNA, 19 nt, Human
cugggcccuggccugccug

SEQ ID NO: 1352066 - RNA, 19 nt, Human
gcagaccugggacaggccc

SEQ ID NO: 1352067 - RNA, 19 nt, Human
gccccucccccaggcccca

SEQ ID NO: 1352068 - RNA, 21 nt, Human
gccccucccccaggccccagc

SEQ ID NO: 1352069 - RNA, 22 nt, Human
gccugcccccacacccgccacc

SEQ ID NO: 1352070 - RNA, 20 nt, Human
gcugaagggucacugccuga

SEQ ID NO: 1352071 - RNA, 31 nt, Human
ggagcccugccccaauccugcccuccacucu

SEQ ID NO: 1352072 - RNA, 20 nt, Human
ggccagagccaccgggccuc

SEQ ID NO: 1352073 - RNA, 26 nt, Human
ggcucugcugguggccggcagcucca

SEQ ID NO: 1352074 - RNA, 22 nt, Human
gggccagagccaccgggccucc

SEQ ID NO: 1352075 - RNA, 19 nt, Human
guggcccagccaccuccuc

SEQ ID NO: 1352076 - RNA, 28 nt, Human
uacaaagaacaagaagaacaagaacaac

SEQ ID NO: 1352077 - RNA, 20 nt, Human
ucaauauuuacaaagaacaa

SEQ ID NO: 1352078 - RNA, 22 nt, Human
uccaugaagaggguaggcucug

SEQ ID NO: 1352079 - RNA, 23 nt, Human
uccccacugcagaccugggacag

SEQ ID NO: 1352080 - RNA, 22 nt, Human
uccugcaggccagagguggggg

SEQ ID NO: 1352081 - RNA, 22 nt, Human
ucgccccucccccaggccccag

SEQ ID NO: 1352082 - RNA, 20 nt, Human
ucgggccagagccaccgggc

SEQ ID NO: 1352083 - RNA, 19 nt, Human
ucugcagcaauuucaugcc

SEQ ID NO: 1352084 - RNA, 23 nt, Human
ucuuuauucuuuuaacuuucuca

SEQ ID NO: 1352085 - RNA, 19 nt, Human
ugcaaggcaaggaagggca

SEQ ID NO: 1352086 - RNA, 18 nt, Human
ugcaaggcugaaggguca

SEQ ID NO: 1352087 - RNA, 23 nt, Human
ugccuggggaggggccaaccagg

SEQ ID NO: 1352088 - RNA, 25 nt, Human
uggccggcagcuccaaggaagggca

SEQ ID NO: 1352089 - RNA, 23 nt, Human
uuuaacuuucucaauauuuacaa

SEQ ID NO: 1352090 - RNA, 23 nt, Human
uuuacaaagaacaagaagaacaa

SEQ ID NO: 1352091 - RNA, 18 nt, Human
uuuauggaaacuccaaaa

SEQ ID NO: 1352092 - RNA, 20 nt, Human
aacacuuugggaggccaagg

SEQ ID NO: 1352093 - RNA, 24 nt, Human
aacacuuugggaggccaagguggg

SEQ ID NO: 1352094 - RNA, 23 nt, Human
aacuccugggcucaagcgauccu

SEQ ID NO: 1352095 - RNA, 24 nt, Human
aagcgugugccaccaugccuagcu

SEQ ID NO: 1352096 - RNA, 25 nt, Human
aaguagcuaagauuacaagcgugug

SEQ ID NO: 1352097 - RNA, 25 nt, Human
aagugauccucccauuucagccucc

SEQ ID NO: 1352098 - RNA, 24 nt, Human
acauggucuugaacuccugaucuc

SEQ ID NO: 1352099 - RNA, 24 nt, Human
acuauguugcucaggcuggucuug

SEQ ID NO: 1352100 - RNA, 19 nt, Human
acugcagccucaaacuccu

SEQ ID NO: 1352101 - RNA, 25 nt, Human
agacagggagaagcugcugagguug

SEQ ID NO: 1352102 - RNA, 23 nt, Human
agacagggucucacuauguugcu

SEQ ID NO: 1352103 - RNA, 22 nt, Human
agagaaaaaggaggaauaugau

SEQ ID NO: 1352104 - RNA, 18 nt, Human
agagagggugaagcuuaa

SEQ ID NO: 1352105 - RNA, 24 nt, Human
agagagggugaagcuuaaagagag

SEQ ID NO: 1352106 - RNA, 22 nt, Human
agauuacaagcgugugccacca

SEQ ID NO: 1352107 - RNA, 18 nt, Human
agccuccagaguagcugg

SEQ ID NO: 1352108 - RNA, 24 nt, Human
agcuaagauuacaagcgugugcca

SEQ ID NO: 1352109 - RNA, 19 nt, Human
aggaagacagggagaagcu

SEQ ID NO: 1352110 - RNA, 21 nt, Human
aggcacgguggcucauuucug

SEQ ID NO: 1352111 - RNA, 19 nt, Human
aggcaugagccaccaugcc

SEQ ID NO: 1352112 - RNA, 21 nt, Human
aggccaaggugggcggaucac

SEQ ID NO: 1352113 - RNA, 24 nt, Human
aggcgcgguggcucacgccuguaa

SEQ ID NO: 1352114 - RNA, 25 nt, Human
aggcuggagugcaguggcaugaucu

SEQ ID NO: 1352115 - RNA, 25 nt, Human
aggcuggagugcagugguacgaucu

SEQ ID NO: 1352116 - RNA, 23 nt, Human
aggugggcggaucacuugagguc

SEQ ID NO: 1352117 - RNA, 23 nt, Human
aggugugagccacugugccuggc

SEQ ID NO: 1352118 - RNA, 19 nt, Human
agguugucagguuccuacu

SEQ ID NO: 1352119 - RNA, 20 nt, Human
aguagagaggggauuuuagc

SEQ ID NO: 1352120 - RNA, 18 nt, Human
aguagcugggacuacagg

SEQ ID NO: 1352121 - RNA, 20 nt, Human
agugauaggaggagccccga

SEQ ID NO: 1352122 - RNA, 22 nt, Human
agugaucugcccgccucggccu

SEQ ID NO: 1352123 - RNA, 24 nt, Human
agugauucuugugccucagccucc

SEQ ID NO: 1352124 - RNA, 20 nt, Human
agugcaguggcaugaucucg

SEQ ID NO: 1352125 - RNA, 23 nt, Human
agugcaguggcaugaucucggcu

SEQ ID NO: 1352126 - RNA, 24 nt, Human
agugcaguggcaugaucucggcuc

SEQ ID NO: 1352127 - RNA, 20 nt, Human
agugcagugguacgaucuug

SEQ ID NO: 1352128 - RNA, 23 nt, Human
agugguacgaucuugacucacua

SEQ ID NO: 1352129 - RNA, 18 nt, Human
auagcucacugcagccuc

SEQ ID NO: 1352130 - RNA, 22 nt, Human
auccuaacacuuugggaggcca

SEQ ID NO: 1352131 - RNA, 25 nt, Human
caaacuccugggcucaagugauccu

SEQ ID NO: 1352132 - RNA, 20 nt, Human
caaacugcuggaauuagcag

SEQ ID NO: 1352133 - RNA, 24 nt, Human
caaaguggugggauugcaggugug

SEQ ID NO: 1352134 - RNA, 25 nt, Human
caacagagagagaaacagagaaaaa

SEQ ID NO: 1352135 - RNA, 22 nt, Human
caagagauucuccugucucagc

SEQ ID NO: 1352136 - RNA, 23 nt, Human
caagagauucuccugucucagca

SEQ ID NO: 1352137 - RNA, 22 nt, Human
caagcgauccuccugccucagc

SEQ ID NO: 1352138 - RNA, 27 nt, Human
caagcgauccuccugccucagccuccc

SEQ ID NO: 1352139 - RNA, 27 nt, Human
caagcgauccuccugccucagccuccc

SEQ ID NO: 1352140 - RNA, 21 nt, Human
caaggugggcggaucacuuga

SEQ ID NO: 1352141 - RNA, 24 nt, Human
caaggugggcggaucacuugaggu

SEQ ID NO: 1352142 - RNA, 22 nt, Human
caagugauucuugugccucagc

SEQ ID NO: 1352143 - RNA, 27 nt, Human
caagugauucuugugccucagccuccc

SEQ ID NO: 1352144 - RNA, 24 nt, Human
caccaugccuagcuaauuuuugua

SEQ ID NO: 1352145 - RNA, 24 nt, Human
cacgccuguaauccuaacacuuug

SEQ ID NO: 1352146 - RNA, 24 nt, Human
cacgguggcucauuucugcaacuu

SEQ ID NO: 1352147 - RNA, 24 nt, Human
cacuauguugcucaggcuggucuu

SEQ ID NO: 1352148 - RNA, 18 nt, Human
cacucgccucuagcugca

SEQ ID NO: 1352149 - RNA, 24 nt, Human
cagagaaaaaggaggaauaugaua

SEQ ID NO: 1352150 - RNA, 20 nt, Human
cagcagaccacaugguacca

SEQ ID NO: 1352151 - RNA, 24 nt, Human
cagccucaaacuccugggcucaag

SEQ ID NO: 1352152 - RNA, 18 nt, Human
caggaguggggugugaaa

SEQ ID NO: 1352153 - RNA, 24 nt, Human
caggcgauccacccaccucggccc

SEQ ID NO: 1352154 - RNA, 22 nt, Human
caggcgcgguggcucacgccug

SEQ ID NO: 1352155 - RNA, 24 nt, Human
cagggucucacuauguugcucagg

SEQ ID NO: 1352156 - RNA, 20 nt, Human
caggugugagccacugugcc

SEQ ID NO: 1352157 - RNA, 19 nt, Human
cagguucaagagauucucc

SEQ ID NO: 1352158 - RNA, 24 nt, Human
caugccucccaaaggcaugagcca

SEQ ID NO: 1352159 - RNA, 23 nt, Human
cauucaaauaaugcucacuaaca

SEQ ID NO: 1352160 - RNA, 18 nt, Human
ccaaaagagcuuggacca

SEQ ID NO: 1352161 - RNA, 21 nt, Human
ccaaacugcuggaauuagcac

SEQ ID NO: 1352162 - RNA, 18 nt, Human
ccaaaggcaugagccacc

SEQ ID NO: 1352163 - RNA, 21 nt, Human
ccaaaguggugggauugcagg

SEQ ID NO: 1352164 - RNA, 21 nt, Human
ccaaaguggugggauugcagg

SEQ ID NO: 1352165 - RNA, 24 nt, Human
ccaaaguggugggauugcaggugu

SEQ ID NO: 1352166 - RNA, 24 nt, Human
ccacaugguaccacucccagccau

SEQ ID NO: 1352167 - RNA, 22 nt, Human
ccagaguagcugggacuacagg

SEQ ID NO: 1352168 - RNA, 24 nt, Human
ccagaguagcugggacuacaggug

SEQ ID NO: 1352169 - RNA, 21 nt, Human
ccagccuggccaacauggucu

SEQ ID NO: 1352170 - RNA, 19 nt, Human
ccagguucaagagauucuc

SEQ ID NO: 1352171 - RNA, 22 nt, Human
ccagguucaagagauucuccug

SEQ ID NO: 1352172 - RNA, 19 nt, Human
cccaaaggcaugagccacc

SEQ ID NO: 1352173 - RNA, 18 nt, Human
cccagccauagacuggac

SEQ ID NO: 1352174 - RNA, 19 nt, Human
cccaggcuggagugcagug

SEQ ID NO: 1352175 - RNA, 23 nt, Human
cccaggcuggagugcaguggcau

SEQ ID NO: 1352176 - RNA, 19 nt, Human
ccccaggcuggagugcagu

SEQ ID NO: 1352177 - RNA, 24 nt, Human
cccuccagguucaagagauucucc

SEQ ID NO: 1352178 - RNA, 22 nt, Human
ccuccagguucaagagauucuc

SEQ ID NO: 1352179 - RNA, 24 nt, Human
ccucccauuucagccuccagagua

SEQ ID NO: 1352180 - RNA, 24 nt, Human
ccugaucucaggcgauccacccac

SEQ ID NO: 1352181 - RNA, 19 nt, Human
ccuggccaacauggucuug

SEQ ID NO: 1352182 - RNA, 20 nt, Human
ccugggcucaagcgauccuc

SEQ ID NO: 1352183 - RNA, 23 nt, Human
ccugggcucaagcgauccuccug

SEQ ID NO: 1352184 - RNA, 22 nt, Human
ccugggcucaagugauccuccc

SEQ ID NO: 1352185 - RNA, 24 nt, Human
cgagaccagccuggccaacauggu

SEQ ID NO: 1352186 - RNA, 25 nt, Human
cgauccacccaccucggcccauauc

SEQ ID NO: 1352187 - RNA, 23 nt, Human
cgccuguaauccuaacacuuugg

SEQ ID NO: 1352188 - RNA, 24 nt, Human
cgccuguaauccuaacacuuuggg

SEQ ID NO: 1352189 - RNA, 24 nt, Human
cggaucacuugaggucgggaguuc

SEQ ID NO: 1352190 - RNA, 24 nt, Human
cuacaacuuccacccuccagguuc

SEQ ID NO: 1352191 - RNA, 24 nt, Human
cucaagcgauccuccugccucagc

SEQ ID NO: 1352192 - RNA, 24 nt, Human
cucaagugauccucccauuucagc

SEQ ID NO: 1352193 - RNA, 20 nt, Human
cucacgccuguaauccuaac

SEQ ID NO: 1352194 - RNA, 24 nt, Human
cucacgccuguaauccuaacacuu

SEQ ID NO: 1352195 - RNA, 19 nt, Human
cucacggauucaagugauu

SEQ ID NO: 1352196 - RNA, 24 nt, Human
cucacuacaaccuccaccucacgg

SEQ ID NO: 1352197 - RNA, 21 nt, Human
cucacugcagccucaaacucc

SEQ ID NO: 1352198 - RNA, 24 nt, Human
cucacugcagccucaaacuccugg

SEQ ID NO: 1352199 - RNA, 21 nt, Human
cucccaaguagcuaagauuac

SEQ ID NO: 1352200 - RNA, 22 nt, Human
cucccacuguggccaaucucaa

SEQ ID NO: 1352201 - RNA, 26 nt, Human
cuccugaccucuagugaucugcccgc

SEQ ID NO: 1352202 - RNA, 23 nt, Human
cuccugccucagccucccaaacu

SEQ ID NO: 1352203 - RNA, 23 nt, Human
cuccugggcucaagcgauccucc

SEQ ID NO: 1352204 - RNA, 23 nt, Human
cugcagccucaaacuccugggcu

SEQ ID NO: 1352205 - RNA, 18 nt, Human
cuggaccaagggguacac

SEQ ID NO: 1352206 - RNA, 24 nt, Human
cuggagugcaguggcaugaucucg

SEQ ID NO: 1352207 - RNA, 25 nt, Human
cuggccaacauggucuugaacuccu

SEQ ID NO: 1352208 - RNA, 21 nt, Human
cuugcucuguuccccaggcug

SEQ ID NO: 1352209 - RNA, 25 nt, Human
cuugugccucagccucccaaguagc

SEQ ID NO: 1352210 - RNA, 24 nt, Human
cuuguucugucacccaggcuggag

SEQ ID NO: 1352211 - RNA, 26 nt, Human
gaacuggaagauguuguugagccucu

SEQ ID NO: 1352212 - RNA, 19 nt, Human
gaagacagggagaagcugc

SEQ ID NO: 1352213 - RNA, 23 nt, Human
gaccagccuggccaacauggucu

SEQ ID NO: 1352214 - RNA, 19 nt, Human
gagagaaacagagaaaaag

SEQ ID NO: 1352215 - RNA, 26 nt, Human
gagaggaagacagggagaagcugccg

SEQ ID NO: 1352216 - RNA, 24 nt, Human
gaguagcugggacuacaggugugc

SEQ ID NO: 1352217 - RNA, 24 nt, Human
gaucacuugaggucgggaguucga

SEQ ID NO: 1352218 - RNA, 24 nt, Human
gaucucaggcgauccacccaccuc

SEQ ID NO: 1352219 - RNA, 24 nt, Human
gauuacaagcgugugccaccaugc

SEQ ID NO: 1352220 - RNA, 18 nt, Human
gauugcaggugugagcca

SEQ ID NO: 1352221 - RNA, 19 nt, Human
gauugcaggugugagccac

SEQ ID NO: 1352222 - RNA, 21 nt, Human
gauugcaggugugagccacug

SEQ ID NO: 1352223 - RNA, 25 nt, Human
gcaacagagagagaaacagagaaaa

SEQ ID NO: 1352224 - RNA, 22 nt, Human
gccuagcuaauuuuuguauuuu

SEQ ID NO: 1352225 - RNA, 24 nt, Human
gcgauccuccugccucagccuccc

SEQ ID NO: 1352226 - RNA, 18 nt, Human
gcucaagugauccuccca

SEQ ID NO: 1352227 - RNA, 21 nt, Human
gcuggaauuagcaccuuuggg

SEQ ID NO: 1352228 - RNA, 19 nt, Human
gcuggagugcaguggcaug

SEQ ID NO: 1352229 - RNA, 27 nt, Human
gcuuuuuuuuuucuuuuuuuuuucuuu

SEQ ID NO: 1352230 - RNA, 18 nt, Human
ggacagcccacccagucc

SEQ ID NO: 1352231 - RNA, 23 nt, Human
ggaucacuugaggucgggaguuc

SEQ ID NO: 1352232 - RNA, 21 nt, Human
ggccaggcgcgguggcucacg

SEQ ID NO: 1352233 - RNA, 19 nt, Human
ggccccaauucacuuuuua

SEQ ID NO: 1352234 - RNA, 18 nt, Human
ggcucaaacuccugaccu

SEQ ID NO: 1352235 - RNA, 18 nt, Human
ggcucacgccuguaaucc

SEQ ID NO: 1352236 - RNA, 18 nt, Human
ggcuggucuugaacuccu

SEQ ID NO: 1352237 - RNA, 23 nt, Human
gggauuuuagcauguuggucagg

SEQ ID NO: 1352238 - RNA, 22 nt, Human
gggcucaagcgauccuccugcc

SEQ ID NO: 1352239 - RNA, 20 nt, Human
gggcucaagugauccuccca

SEQ ID NO: 1352240 - RNA, 21 nt, Human
gguggcucacgccuguaaucc

SEQ ID NO: 1352241 - RNA, 23 nt, Human
gguggcucacgccuguaauccua

SEQ ID NO: 1352242 - RNA, 24 nt, Human
gugaucugcccgccucggccuucc

SEQ ID NO: 1352243 - RNA, 24 nt, Human
gugauucuugugccucagccuccc

SEQ ID NO: 1352244 - RNA, 22 nt, Human
gugccucagccucccaaguagc

SEQ ID NO: 1352245 - RNA, 23 nt, Human
gugccucagccucccaaguagcu

SEQ ID NO: 1352246 - RNA, 19 nt, Human
gugggcggaucacuugagg

SEQ ID NO: 1352247 - RNA, 24 nt, Human
uaacacuuugggaggccaaggugg

SEQ ID NO: 1352248 - RNA, 21 nt, Human
uaagauuacaagcgugugcca

SEQ ID NO: 1352249 - RNA, 24 nt, Human
uaagauuacaagcgugugccacca

SEQ ID NO: 1352250 - RNA, 24 nt, Human
uaauuuuuguauuuuuaguagaga

SEQ ID NO: 1352251 - RNA, 25 nt, Human
uaccaauaaacagaaauaaugauca

SEQ ID NO: 1352252 - RNA, 18 nt, Human
uagacuggaccaaggggu

SEQ ID NO: 1352253 - RNA, 19 nt, Human
uagcauguuggucaggcuc

SEQ ID NO: 1352254 - RNA, 24 nt, Human
uagcucacugcagccucaaacucc

SEQ ID NO: 1352255 - RNA, 24 nt, Human
uaggaggagccccgauuuguagug

SEQ ID NO: 1352256 - RNA, 24 nt, Human
uaguagagaggggauuuuagcaug

SEQ ID NO: 1352257 - RNA, 22 nt, Human
uagugaucugcccgccucggcc

SEQ ID NO: 1352258 - RNA, 24 nt, Human
uagugcaauaauagcucacugcag

SEQ ID NO: 1352259 - RNA, 24 nt, Human
uaguuucuaauuuuuuacuauuac

SEQ ID NO: 1352260 - RNA, 20 nt, Human
uauaaaacaugccauccuuc

SEQ ID NO: 1352261 - RNA, 24 nt, Human
uaugucacccaggcuggaaugcag

SEQ ID NO: 1352262 - RNA, 19 nt, Human
uauguugcucaggcugguc

SEQ ID NO: 1352263 - RNA, 20 nt, Human
uauguugcucaggcuggucu

SEQ ID NO: 1352264 - RNA, 24 nt, Human
uauguugcucaggcuggucuugaa

SEQ ID NO: 1352265 - RNA, 22 nt, Human
uauuaccaauaaacagaaauaa

SEQ ID NO: 1352266 - RNA, 19 nt, Human
ucacccaggcuggaaugca

SEQ ID NO: 1352267 - RNA, 24 nt, Human
ucacccaggcuggagugcaguggc

SEQ ID NO: 1352268 - RNA, 18 nt, Human
ucacuacaaccuccaccu

SEQ ID NO: 1352269 - RNA, 23 nt, Human
ucacuacaaccuccaccucacgg

SEQ ID NO: 1352270 - RNA, 26 nt, Human
ucacuacaaccuccaccucacggauu

SEQ ID NO: 1352271 - RNA, 18 nt, Human
ucacuacaacuuccaccc

SEQ ID NO: 1352272 - RNA, 24 nt, Human
ucacuacaacuuccacccuccagg

SEQ ID NO: 1352273 - RNA, 24 nt, Human
ucacugcagccucaaacuccuggg

SEQ ID NO: 1352274 - RNA, 23 nt, Human
ucagccuccagaguagcugggac

SEQ ID NO: 1352275 - RNA, 18 nt, Human
ucagccucccaaguagcu

SEQ ID NO: 1352276 - RNA, 21 nt, Human
ucagccucccaaguagcuaag

SEQ ID NO: 1352277 - RNA, 20 nt, Human
ucaggcgauccacccaccuc

SEQ ID NO: 1352278 - RNA, 24 nt, Human
ucaggcuggucuugaacuccuggg

SEQ ID NO: 1352279 - RNA, 20 nt, Human
uccacacacagcccuucuca

SEQ ID NO: 1352280 - RNA, 24 nt, Human
uccagaguagcugggacuacaggu

SEQ ID NO: 1352281 - RNA, 25 nt, Human
ucccaaaggcaugagccaccaugcc

SEQ ID NO: 1352282 - RNA, 22 nt, Human
ucccagccauagacuggaccaa

SEQ ID NO: 1352283 - RNA, 23 nt, Human
ucccagccauagacuggaccaag

SEQ ID NO: 1352284 - RNA, 21 nt, Human
uccccaggcuggagugcagug

SEQ ID NO: 1352285 - RNA, 20 nt, Human
ucccuuucugcaaaguuaac

SEQ ID NO: 1352286 - RNA, 24 nt, Human
uccuccugccucagccucccaaac

SEQ ID NO: 1352287 - RNA, 21 nt, Human
uccugggcucaagcgauccuc

SEQ ID NO: 1352288 - RNA, 22 nt, Human
uccugggcucaagcgauccucc

SEQ ID NO: 1352289 - RNA, 24 nt, Human
uccugggcucaagcgauccuccug

SEQ ID NO: 1352290 - RNA, 21 nt, Human
uccugggcucaagugauccuc

SEQ ID NO: 1352291 - RNA, 22 nt, Human
uccugggcucaagugauccucc

SEQ ID NO: 1352292 - RNA, 24 nt, Human
uccugggcucaagugauccuccca

SEQ ID NO: 1352293 - RNA, 23 nt, Human
ucucacuauguugcucaggcugg

SEQ ID NO: 1352294 - RNA, 24 nt, Human
ucucacuauguugcucaggcuggu

SEQ ID NO: 1352295 - RNA, 22 nt, Human
ucucaugucucugugccccaca

SEQ ID NO: 1352296 - RNA, 21 nt, Human
ucugaacuuaaaaaccaaaag

SEQ ID NO: 1352297 - RNA, 24 nt, Human
ucugucacccaggcuggagugcag

SEQ ID NO: 1352298 - RNA, 19 nt, Human
ucuguuccccaggcuggag

SEQ ID NO: 1352299 - RNA, 23 nt, Human
ucuugaacuccugaucucaggcg

SEQ ID NO: 1352300 - RNA, 19 nt, Human
ucuugaacuccugggcuca

SEQ ID NO: 1352301 - RNA, 23 nt, Human
ucuugaacuccugggcucaagcg

SEQ ID NO: 1352302 - RNA, 24 nt, Human
ucuugauaugucacccaggcugga

SEQ ID NO: 1352303 - RNA, 19 nt, Human
ucuugcucuguuccccagg

SEQ ID NO: 1352304 - RNA, 23 nt, Human
ucuugcucuguuccccaggcugg

SEQ ID NO: 1352305 - RNA, 24 nt, Human
ucuugcucuguuccccaggcugga

SEQ ID NO: 1352306 - RNA, 22 nt, Human
ucuuguucugucacccaggcug

SEQ ID NO: 1352307 - RNA, 23 nt, Human
ucuuguucugucacccaggcugg

SEQ ID NO: 1352308 - RNA, 24 nt, Human
ucuuguucugucacccaggcugga

SEQ ID NO: 1352309 - RNA, 25 nt, Human
ucuuuuuuagugucucuguaccauu

SEQ ID NO: 1352310 - RNA, 20 nt, Human
ugaccucuagugaucugccc

SEQ ID NO: 1352311 - RNA, 18 nt, Human
ugagacagagucuuguuc

SEQ ID NO: 1352312 - RNA, 22 nt, Human
ugagacagagucuuguucuguc

SEQ ID NO: 1352313 - RNA, 22 nt, Human
ugagacagggucucacuauguu

SEQ ID NO: 1352314 - RNA, 20 nt, Human
ugauucuugugccucagccu

SEQ ID NO: 1352315 - RNA, 23 nt, Human
ugcaggugugagccacugugccu

SEQ ID NO: 1352316 - RNA, 23 nt, Human
ugcaguagggacaaacuagaaac

SEQ ID NO: 1352317 - RNA, 22 nt, Human
ugcaguggcaugaucucggcuc

SEQ ID NO: 1352318 - RNA, 24 nt, Human
ugccucagccucccaaacugcugg

SEQ ID NO: 1352319 - RNA, 24 nt, Human
ugccucagccucccaaguagcuaa

SEQ ID NO: 1352320 - RNA, 21 nt, Human
ugccuggcugaucgccuucuu

SEQ ID NO: 1352321 - RNA, 24 nt, Human
ugcucaggcuggucuugaacuccu

SEQ ID NO: 1352322 - RNA, 24 nt, Human
ugcucuguuccccaggcuggagug

SEQ ID NO: 1352323 - RNA, 20 nt, Human
uggaauugggagacagggau

SEQ ID NO: 1352324 - RNA, 25 nt, Human
uggaauugggagacagggauuugug

SEQ ID NO: 1352325 - RNA, 18 nt, Human
uggagaagugguaugccc

SEQ ID NO: 1352326 - RNA, 19 nt, Human
uggagugcaguggcaugau

SEQ ID NO: 1352327 - RNA, 24 nt, Human
uggagugcaguggcaugaucucgg

SEQ ID NO: 1352328 - RNA, 21 nt, Human
uggagugcagugguacgaucu

SEQ ID NO: 1352329 - RNA, 23 nt, Human
uggagugcagugguacgaucuug

SEQ ID NO: 1352330 - RNA, 24 nt, Human
uggcaugaucucggcucacuacaa

SEQ ID NO: 1352331 - RNA, 24 nt, Human
uggccaggcgcgguggcucacgcc

SEQ ID NO: 1352332 - RNA, 24 nt, Human
uggcucacgccuguaauccuaaca

SEQ ID NO: 1352333 - RNA, 21 nt, Human
ugggacuacaggugugcacca

SEQ ID NO: 1352334 - RNA, 24 nt, Human
ugggacuacaggugugcaccacca

SEQ ID NO: 1352335 - RNA, 19 nt, Human
ugggaggccaaggugggcg

SEQ ID NO: 1352336 - RNA, 24 nt, Human
ugggaggccaaggugggcggauca

SEQ ID NO: 1352337 - RNA, 18 nt, Human
ugggauugcaggugugag

SEQ ID NO: 1352338 - RNA, 21 nt, Human
ugggauugcaggugugagcca

SEQ ID NO: 1352339 - RNA, 22 nt, Human
ugggauugcaggugugagccac

SEQ ID NO: 1352340 - RNA, 24 nt, Human
ugggauugcaggugugagccacug

SEQ ID NO: 1352341 - RNA, 24 nt, Human
ugggcucaagcgauccuccugccu

SEQ ID NO: 1352342 - RNA, 24 nt, Human
ugggcucaagugauccucccauuu

SEQ ID NO: 1352343 - RNA, 19 nt, Human
ugguacgaucuugacucac

SEQ ID NO: 1352344 - RNA, 24 nt, Human
ugguacgaucuugacucacuacaa

SEQ ID NO: 1352345 - RNA, 18 nt, Human
uguaaagucagagcuggg

SEQ ID NO: 1352346 - RNA, 21 nt, Human
uguuccccaggcuggagugca

SEQ ID NO: 1352347 - RNA, 24 nt, Human
uguucugucacccaggcuggagug

SEQ ID NO: 1352348 - RNA, 18 nt, Human
uuaguagagaggggauuu

SEQ ID NO: 1352349 - RNA, 18 nt, Human
uuaguagagaggggauuu

SEQ ID NO: 1352350 - RNA, 24 nt, Human
uuaguagagaggggauuuuagcau

SEQ ID NO: 1352351 - RNA, 23 nt, Human
uucaagugauucuugugccucag

SEQ ID NO: 1352352 - RNA, 23 nt, Human
uucuugagacagagucuuguucu

SEQ ID NO: 1352353 - RNA, 20 nt, Human
uucuuuuuuuuuucuugaga

SEQ ID NO: 1352354 - RNA, 20 nt, Human
uucuuuuuuuuuuuuuucuu

SEQ ID NO: 1352355 - RNA, 22 nt, Human
uugagacagggucucacuaugu

SEQ ID NO: 1352356 - RNA, 22 nt, Human
uugcaccaagauguucaccaca

SEQ ID NO: 1352357 - RNA, 24 nt, Human
uugcucuguuccccaggcuggagu

SEQ ID NO: 1352358 - RNA, 24 nt, Human
uuguucugucacccaggcuggagu

SEQ ID NO: 1352359 - RNA, 18 nt, Human
uuucuuuuuuuuuucuug

SEQ ID NO: 1352360 - RNA, 20 nt, Human
uuuuuguauuuuuaguagag

SEQ ID NO: 1352361 - RNA, 20 nt, Human
uuuuuuuucuugagacagag

SEQ ID NO: 1352362 - RNA, 24 nt, Human
uuuuuuuuucuugagacagagucu

SEQ ID NO: 1352363 - RNA, 24 nt, Human
aaagcuuucccacauuccccgcac

SEQ ID NO: 1352364 - RNA, 22 nt, Human
aacaagauaugaggcacgacug

SEQ ID NO: 1352365 - RNA, 24 nt, Human
agccaguacuaaaggccuugccac

SEQ ID NO: 1352366 - RNA, 23 nt, Human
auaggguuucucaccaacaugca

SEQ ID NO: 1352367 - RNA, 27 nt, Human
augaggcacgacugaagguucucccgc

SEQ ID NO: 1352368 - RNA, 19 nt, Human
caaaagguuucucaccagu

SEQ ID NO: 1352369 - RNA, 19 nt, Human
caaaggguuuuucaccagu

SEQ ID NO: 1352370 - RNA, 23 nt, Human
cacacacgaagcacuucccacac

SEQ ID NO: 1352371 - RNA, 22 nt, Human
cacgaagcacuucccacacucc

SEQ ID NO: 1352372 - RNA, 23 nt, Human
caguacuaaaggccuugccacac

SEQ ID NO: 1352373 - RNA, 19 nt, Human
caguaugaauucucugaug

SEQ ID NO: 1352374 - RNA, 24 nt, Human
caguaugaauuuuccgaugcugug

SEQ ID NO: 1352375 - RNA, 22 nt, Human
caugcaaucucugauguauggu

SEQ ID NO: 1352376 - RNA, 20 nt, Human
ccacacuccucacacccaaa

SEQ ID NO: 1352377 - RNA, 22 nt, Human
cuaaaggccuuuccacauuccu

SEQ ID NO: 1352378 - RNA, 22 nt, Human
cuaauagucuuuccacauugcu

SEQ ID NO: 1352379 - RNA, 25 nt, Human
gcugauggcgacuaauaaaggcuuu

SEQ ID NO: 1352380 - RNA, 22 nt, Human
ggcgacuaauaaaggcuuugcc

SEQ ID NO: 1352381 - RNA, 26 nt, Human
guacugaaggccuucccaaccggagg

SEQ ID NO: 1352382 - RNA, 24 nt, Human
guacugaaggccuucccacacucc

SEQ ID NO: 1352383 - RNA, 23 nt, Human
uaacaaaggcugagccacugaua

SEQ ID NO: 1352384 - RNA, 19 nt, Human
uaagaugagaauagaccug

SEQ ID NO: 1352385 - RNA, 21 nt, Human
uaagaugagaauagaccugcc

SEQ ID NO: 1352386 - RNA, 19 nt, Human
uaaguugauagcuaccacu

SEQ ID NO: 1352387 - RNA, 21 nt, Human
uacuagaaaagcuuucccaca

SEQ ID NO: 1352388 - RNA, 22 nt, Human
uagaaaagcuuucccacauucc

SEQ ID NO: 1352389 - RNA, 24 nt, Human
ucccacacuccucacacccaaagg

SEQ ID NO: 1352390 - RNA, 23 nt, Human
uccuugcauccguagggcuuuau

SEQ ID NO: 1352391 - RNA, 25 nt, Human
ucgccagugugaagucuuccauguu

SEQ ID NO: 1352392 - RNA, 21 nt, Human
ucucccaugcuuaacaaaggc

SEQ ID NO: 1352393 - RNA, 25 nt, Human
ucucugaugcuuagcaaggggugag

SEQ ID NO: 1352394 - RNA, 23 nt, Human
ugaaaagguacugaaggccuucc

SEQ ID NO: 1352395 - RNA, 20 nt, Human
ugaacaagguaugagccagu

SEQ ID NO: 1352396 - RNA, 22 nt, Human
ugagccaguacuaaaggccuug

SEQ ID NO: 1352397 - RNA, 25 nt, Human
ugaugugcaugaaggaaggaacuaa

SEQ ID NO: 1352398 - RNA, 19 nt, Human
uguugaacaagauaugagg

SEQ ID NO: 1352399 - RNA, 19 nt, Human
uguugaaccagguaugaaa

SEQ ID NO: 1352400 - RNA, 22 nt, Human
uucgcugauguugaaccaggua

SEQ ID NO: 1352401 - RNA, 23 nt, Human
uugaaaguuuccuaccagcauaa

SEQ ID NO: 1352402 - RNA, 24 nt, Human
aaagugcugggauuacagguguga

SEQ ID NO: 1352403 - RNA, 25 nt, Human
aacccagccuuucugaaccauccac

SEQ ID NO: 1352404 - RNA, 23 nt, Human
aagcaaaaggcuggucuccagga

SEQ ID NO: 1352405 - RNA, 22 nt, Human
aagcagagaagggaacccagcg

SEQ ID NO: 1352406 - RNA, 21 nt, Human
aagcagagaguucccucgagg

SEQ ID NO: 1352407 - RNA, 21 nt, Human
aagcagugucugccauccugg

SEQ ID NO: 1352408 - RNA, 18 nt, Human
aagugcugggauuacagg

SEQ ID NO: 1352409 - RNA, 18 nt, Human
aagugcugggauuacagg

SEQ ID NO: 1352410 - RNA, 19 nt, Human
aagugcugggauuacaggu

SEQ ID NO: 1352411 - RNA, 19 nt, Human
aagugcugggauuacaggu

SEQ ID NO: 1352412 - RNA, 22 nt, Human
aagugcugggauuacaggugug

SEQ ID NO: 1352413 - RNA, 23 nt, Human
aagugcugggauuacagguguga

SEQ ID NO: 1352414 - RNA, 26 nt, Human
aagugcugggauuacaggugugagcc

SEQ ID NO: 1352415 - RNA, 26 nt, Human
aagugcugggauuacaggugugagcu

SEQ ID NO: 1352416 - RNA, 24 nt, Human
aauuuauuguauuuuuaguagaga

SEQ ID NO: 1352417 - RNA, 20 nt, Human
acaagccccaggccugugac

SEQ ID NO: 1352418 - RNA, 19 nt, Human
acaagucaacucccucaug

SEQ ID NO: 1352419 - RNA, 21 nt, Human
acaggcacccaccaccaugcc

SEQ ID NO: 1352420 - RNA, 24 nt, Human
acagguuuuugccauguuggccag

SEQ ID NO: 1352421 - RNA, 18 nt, Human
acauggcacgaagcagag

SEQ ID NO: 1352422 - RNA, 25 nt, Human
accagcuccagagaagggggaacgc

SEQ ID NO: 1352423 - RNA, 18 nt, Human
acccagcgcccgugucuc

SEQ ID NO: 1352424 - RNA, 23 nt, Human
accucagccucccaaagugcugg

SEQ ID NO: 1352425 - RNA, 24 nt, Human
accuugugauucgcccaccucagc

SEQ ID NO: 1352426 - RNA, 21 nt, Human
acgaagcagagaagggaaccc

SEQ ID NO: 1352427 - RNA, 19 nt, Human
acgguggggccuggucucu

SEQ ID NO: 1352428 - RNA, 23 nt, Human
acuacaacagaguaacuuugacu

SEQ ID NO: 1352429 - RNA, 25 nt, Human
acugcaaucuccgcucccaggguuc

SEQ ID NO: 1352430 - RNA, 18 nt, Human
acuugucuggguagcaug

SEQ ID NO: 1352431 - RNA, 23 nt, Human
agacgaugccuucccaugucccc

SEQ ID NO: 1352432 - RNA, 19 nt, Human
agagaugggguuucauuau

SEQ ID NO: 1352433 - RNA, 24 nt, Human
agagaugggguuucauuauguugg

SEQ ID NO: 1352434 - RNA, 19 nt, Human
agcaugagguucugucuca

SEQ ID NO: 1352435 - RNA, 21 nt, Human
agccacacaagccccaggccu

SEQ ID NO: 1352436 - RNA, 23 nt, Human
agccaucuuccugccuuggccuc

SEQ ID NO: 1352437 - RNA, 24 nt, Human
agcgauucuucugccucagucucc

SEQ ID NO: 1352438 - RNA, 23 nt, Human
aggcauaggagggggcguguggg

SEQ ID NO: 1352439 - RNA, 22 nt, Human
aggccacaucuggcugggggcu

SEQ ID NO: 1352440 - RNA, 21 nt, Human
aggcuggauggccccgcccaa

SEQ ID NO: 1352441 - RNA, 20 nt, Human
agggcacagaugcagccugc

SEQ ID NO: 1352442 - RNA, 21 nt, Human
aggggucgguggucuuggagc

SEQ ID NO: 1352443 - RNA, 24 nt, Human
aggugauccaccuaccuugaccuc

SEQ ID NO: 1352444 - RNA, 20 nt, Human
aggugcccaccaccacgccc

SEQ ID NO: 1352445 - RNA, 21 nt, Human
aggugcccaccaccacgcccg

SEQ ID NO: 1352446 - RNA, 19 nt, Human
agguuuuugccauguuggc

SEQ ID NO: 1352447 - RNA, 23 nt, Human
agguuuuugccauguuggccagg

SEQ ID NO: 1352448 - RNA, 22 nt, Human
aguagagacagguuuuugccau

SEQ ID NO: 1352449 - RNA, 18 nt, Human
aguagagaugggguuuca

SEQ ID NO: 1352450 - RNA, 18 nt, Human
aguagcugggauaauagg

SEQ ID NO: 1352451 - RNA, 18 nt, Human
aguagcugggauuacagg

SEQ ID NO: 1352452 - RNA, 18 nt, Human
augcugcugggugccgag

SEQ ID NO: 1352453 - RNA, 23 nt, Human
augggguuucauuauguuggcca

SEQ ID NO: 1352454 - RNA, 24 nt, Human
augggguuucauuauguuggccag

SEQ ID NO: 1352455 - RNA, 20 nt, Human
auguuggccaggcuggucuc

SEQ ID NO: 1352456 - RNA, 21 nt, Human
auguuggccaggcuggucucg

SEQ ID NO: 1352457 - RNA, 24 nt, Human
auuuuuguauuuuuaguagagaca

SEQ ID NO: 1352458 - RNA, 24 nt, Human
caaagugcugggauuacaggugug

SEQ ID NO: 1352459 - RNA, 19 nt, Human
caacagaguaacuuugacu

SEQ ID NO: 1352460 - RNA, 22 nt, Human
caagcagagaguucccucgagg

SEQ ID NO: 1352461 - RNA, 22 nt, Human
caagccaucuuccugccuuggc

SEQ ID NO: 1352462 - RNA, 20 nt, Human
caagcgauucuucugccuca

SEQ ID NO: 1352463 - RNA, 21 nt, Human
caagcgauucuucugccucag

SEQ ID NO: 1352464 - RNA, 20 nt, Human
caaggcccuggugagcgugg

SEQ ID NO: 1352465 - RNA, 18 nt, Human
cacaagccccaggccugu

SEQ ID NO: 1352466 - RNA, 22 nt, Human
cacacaagccccaggccuguga

SEQ ID NO: 1352467 - RNA, 19 nt, Human
cacaccagcgccgcccucu

SEQ ID NO: 1352468 - RNA, 24 nt, Human
caccacgcccggcuaauuuuugua

SEQ ID NO: 1352469 - RNA, 20 nt, Human
caccccccuggccuccaccc

SEQ ID NO: 1352470 - RNA, 20 nt, Human
caccccuccccccacaccuu

SEQ ID NO: 1352471 - RNA, 21 nt, Human
caccccuccccccacaccuug

SEQ ID NO: 1352472 - RNA, 21 nt, Human
caccugugacaccuguggacc

SEQ ID NO: 1352473 - RNA, 23 nt, Human
cacugcaacuuccgccuucuggg

SEQ ID NO: 1352474 - RNA, 21 nt, Human
cacuggagugaggguuucagc

SEQ ID NO: 1352475 - RNA, 25 nt, Human
cagcagcgccaggcaaaacaguuuc

SEQ ID NO: 1352476 - RNA, 20 nt, Human
cagcccacaccagcgccgcc

SEQ ID NO: 1352477 - RNA, 21 nt, Human
caggcacccaccaccaugccc

SEQ ID NO: 1352478 - RNA, 18 nt, Human
cagggcacagaugcagcc

SEQ ID NO: 1352479 - RNA, 24 nt, Human
cagguuuuugccauguuggccagg

SEQ ID NO: 1352480 - RNA, 19 nt, Human
cauggcacgaagcagagaa

SEQ ID NO: 1352481 - RNA, 23 nt, Human
cauguuggccaggcuggucuuca

SEQ ID NO: 1352482 - RNA, 19 nt, Human
cauuauguuggccaggcug

SEQ ID NO: 1352483 - RNA, 24 nt, Human
cauuauguuggccaggcuggucuc

SEQ ID NO: 1352484 - RNA, 20 nt, Human
ccaaagugcugggauuacag

SEQ ID NO: 1352485 - RNA, 21 nt, Human
ccaaagugcugggauuacagg

SEQ ID NO: 1352486 - RNA, 21 nt, Human
ccaaagugcugggauuacagg

SEQ ID NO: 1352487 - RNA, 24 nt, Human
ccaaagugcugggauuacaggugu

SEQ ID NO: 1352488 - RNA, 22 nt, Human
ccacccacuggaugccauacca

SEQ ID NO: 1352489 - RNA, 22 nt, Human
ccagcuccagagaaggugggga

SEQ ID NO: 1352490 - RNA, 23 nt, Human
ccagcuccagagaagguggggag

SEQ ID NO: 1352491 - RNA, 22 nt, Human
ccaggaagggaggacgggggca

SEQ ID NO: 1352492 - RNA, 19 nt, Human
ccauguuggccaggcuggu

SEQ ID NO: 1352493 - RNA, 21 nt, Human
ccauguuggccaggcuggucu

SEQ ID NO: 1352494 - RNA, 27 nt, Human
cccaccaccaugcccagcuaauuuauu

SEQ ID NO: 1352495 - RNA, 18 nt, Human
cccacuggaugccauacc

SEQ ID NO: 1352496 - RNA, 24 nt, Human
cccaggguucaagccaucuuccug

SEQ ID NO: 1352497 - RNA, 18 nt, Human
ccccaaaggcccccucuc

SEQ ID NO: 1352498 - RNA, 19 nt, Human
ccccaaaggcccccucucc

SEQ ID NO: 1352499 - RNA, 20 nt, Human
ccccacaccuugugcgcucu

SEQ ID NO: 1352500 - RNA, 20 nt, Human
cccccaaaggcccccucucc

SEQ ID NO: 1352501 - RNA, 19 nt, Human
cccccaccccccuggccuc

SEQ ID NO: 1352502 - RNA, 20 nt, Human
cccccaccccccuggccucc

SEQ ID NO: 1352503 - RNA, 23 nt, Human
ccccccaccccccuggccuccac

SEQ ID NO: 1352504 - RNA, 25 nt, Human
cccccccaccccccuggccuccacc

SEQ ID NO: 1352505 - RNA, 21 nt, Human
ccccccuggccuccacccacu

SEQ ID NO: 1352506 - RNA, 18 nt, Human
cccccucuccuaacacca

SEQ ID NO: 1352507 - RNA, 20 nt, Human
cccccuggccuccacccacu

SEQ ID NO: 1352508 - RNA, 19 nt, Human
ccccgcgccagggccuccc

SEQ ID NO: 1352509 - RNA, 20 nt, Human
ccccugagggugcugguccu

SEQ ID NO: 1352510 - RNA, 24 nt, Human
cccgaagugcugggauuacaggug

SEQ ID NO: 1352511 - RNA, 19 nt, Human
cccgaguagcugggauaau

SEQ ID NO: 1352512 - RNA, 23 nt, Human
cccgaguagcugggauuacaggc

SEQ ID NO: 1352513 - RNA, 24 nt, Human
cccgaguagcugggauuacaggca

SEQ ID NO: 1352514 - RNA, 24 nt, Human
cccguccuauuugcauuuuaagaa

SEQ ID NO: 1352515 - RNA, 18 nt, Human
cccuccugacccagucac

SEQ ID NO: 1352516 - RNA, 19 nt, Human
cccugagccacacaagccc

SEQ ID NO: 1352517 - RNA, 23 nt, Human
ccgaagugcugggauuacaggug

SEQ ID NO: 1352518 - RNA, 24 nt, Human
ccgaagugcugggauuacaggugu

SEQ ID NO: 1352519 - RNA, 23 nt, Human
ccgaguagcugggauuacaggca

SEQ ID NO: 1352520 - RNA, 24 nt, Human
ccgccuucuggguucaagcgauuc

SEQ ID NO: 1352521 - RNA, 19 nt, Human
ccuaccuugaccucccgaa

SEQ ID NO: 1352522 - RNA, 24 nt, Human
ccugaccuuaggugauccaccuac

SEQ ID NO: 1352523 - RNA, 22 nt, Human
ccugugacaccuguggaccaga

SEQ ID NO: 1352524 - RNA, 24 nt, Human
ccugugacugaggccacaucuggc

SEQ ID NO: 1352525 - RNA, 24 nt, Human
ccuucuggguucaagcgauucuuc

SEQ ID NO: 1352526 - RNA, 18 nt, Human
cgaagcagagaagggaac

SEQ ID NO: 1352527 - RNA, 21 nt, Human
cguccgagccgcagggaugga

SEQ ID NO: 1352528 - RNA, 21 nt, Human
cgugacuggccuuacaccaug

SEQ ID NO: 1352529 - RNA, 21 nt, Human
cuaaaaugugaauggcuaaca

SEQ ID NO: 1352530 - RNA, 19 nt, Human
cucacugcaacuuccgccu

SEQ ID NO: 1352531 - RNA, 25 nt, Human
cucacugcaaucuccgcucccaggg

SEQ ID NO: 1352532 - RNA, 24 nt, Human
cucagucucccgaguagcugggau

SEQ ID NO: 1352533 - RNA, 21 nt, Human
cuccccagccgucacagcuga

SEQ ID NO: 1352534 - RNA, 22 nt, Human
cuccccggcagcccugagccac

SEQ ID NO: 1352535 - RNA, 23 nt, Human
cuccggagccaccguagcucccc

SEQ ID NO: 1352536 - RNA, 22 nt, Human
cuccugaccuugugauucgccc

SEQ ID NO: 1352537 - RNA, 21 nt, Human
cucuugucgccaggcuggagu

SEQ ID NO: 1352538 - RNA, 23 nt, Human
cugccucagucucccgaguagcu

SEQ ID NO: 1352539 - RNA, 23 nt, Human
cugccuuggccucccgaguagcu

SEQ ID NO: 1352540 - RNA, 21 nt, Human
cugcugggugccgaggguggc

SEQ ID NO: 1352541 - RNA, 19 nt, Human
cuguaggugggaugccagg

SEQ ID NO: 1352542 - RNA, 23 nt, Human
cugugagggccggcuuccuggcu

SEQ ID NO: 1352543 - RNA, 22 nt, Human
cugugcagccucuggugugcag

SEQ ID NO: 1352544 - RNA, 23 nt, Human
cuugcaccgucgcccuggcugug

SEQ ID NO: 1352545 - RNA, 24 nt, Human
cuuggccucccgaguagcugggau

SEQ ID NO: 1352546 - RNA, 21 nt, Human
cuuggugcccccccacccccc

SEQ ID NO: 1352547 - RNA, 26 nt, Human
cuuugacuuggugccuuaaacaacag

SEQ ID NO: 1352548 - RNA, 21 nt, Human
gaagggaggacgggggcagag

SEQ ID NO: 1352549 - RNA, 23 nt, Human
gaagguggggaggggaccccgcg

SEQ ID NO: 1352550 - RNA, 24 nt, Human
gaagugcugggauuacagguguga

SEQ ID NO: 1352551 - RNA, 20 nt, Human
gaccccgcgccagggccucc

SEQ ID NO: 1352552 - RNA, 24 nt, Human
gaccuuaggugauccaccuaccuu

SEQ ID NO: 1352553 - RNA, 22 nt, Human
gaccuugugauucgcccaccuc

SEQ ID NO: 1352554 - RNA, 24 nt, Human
gaccuugugauucgcccaccucag

SEQ ID NO: 1352555 - RNA, 25 nt, Human
gacggagucucgcucuugucgccag

SEQ ID NO: 1352556 - RNA, 18 nt, Human
gacuggcauuggggcugg

SEQ ID NO: 1352557 - RNA, 23 nt, Human
gagaugggguuucauuauguugg

SEQ ID NO: 1352558 - RNA, 24 nt, Human
gagaugggguuucauuauguuggc

SEQ ID NO: 1352559 - RNA, 25 nt, Human
gaguagcugggauuacaggcaccca

SEQ ID NO: 1352560 - RNA, 21 nt, Human
gaugccuucccauguccccac

SEQ ID NO: 1352561 - RNA, 18 nt, Human
gaugugggguggggaggg

SEQ ID NO: 1352562 - RNA, 24 nt, Human
gauuacaggcacccaccaccaugc

SEQ ID NO: 1352563 - RNA, 18 nt, Human
gauuacaggugugagcca

SEQ ID NO: 1352564 - RNA, 21 nt, Human
gauuacaggugugagccaccg

SEQ ID NO: 1352565 - RNA, 22 nt, Human
gauuacaggugugagccaccgu

SEQ ID NO: 1352566 - RNA, 19 nt, Human
gauuacaggugugagcuac

SEQ ID NO: 1352567 - RNA, 23 nt, Human
gauuacaggugugagcuaccuca

SEQ ID NO: 1352568 - RNA, 18 nt, Human
gcaccgucgcccuggcug

SEQ ID NO: 1352569 - RNA, 19 nt, Human
gcagccucuggugugcagc

SEQ ID NO: 1352570 - RNA, 20 nt, Human
gcagccucuggugugcagcu

SEQ ID NO: 1352571 - RNA, 19 nt, Human
gcagggccaggucucagga

SEQ ID NO: 1352572 - RNA, 23 nt, Human
gccaccguagcuccccagccguc

SEQ ID NO: 1352573 - RNA, 20 nt, Human
gccaucuuccugccuuggcc

SEQ ID NO: 1352574 - RNA, 20 nt, Human
gccauguuggccaggcuggu

SEQ ID NO: 1352575 - RNA, 21 nt, Human
gcccaccccuccccccacacc

SEQ ID NO: 1352576 - RNA, 22 nt, Human
gcccggcuaauuuuuguauuuu

SEQ ID NO: 1352577 - RNA, 21 nt, Human
gcccugagccacacaagcccc

SEQ ID NO: 1352578 - RNA, 24 nt, Human
gccucagucucccgaguagcuggg

SEQ ID NO: 1352579 - RNA, 20 nt, Human
gccuuggccucccgaguagc

SEQ ID NO: 1352580 - RNA, 20 nt, Human
gccuugggacucgccggacu

SEQ ID NO: 1352581 - RNA, 24 nt, Human
gcggcugccugcgggccauacucu

SEQ ID NO: 1352582 - RNA, 18 nt, Human
gcuaguccugagcuccag

SEQ ID NO: 1352583 - RNA, 19 nt, Human
gcuggagugcaauggcacg

SEQ ID NO: 1352584 - RNA, 18 nt, Human
ggagaacccagccuuucu

SEQ ID NO: 1352585 - RNA, 20 nt, Human
ggaggacgggggcagagggg

SEQ ID NO: 1352586 - RNA, 21 nt, Human
ggaggccaccugugacaccug

SEQ ID NO: 1352587 - RNA, 18 nt, Human
ggaggguguggggcagcg

SEQ ID NO: 1352588 - RNA, 19 nt, Human
ggaggguguggggcagcgg

SEQ ID NO: 1352589 - RNA, 24 nt, Human
ggcagacucgguucugugagggcc

SEQ ID NO: 1352590 - RNA, 20 nt, Human
ggcagccagggcacagaugc

SEQ ID NO: 1352591 - RNA, 21 nt, Human
ggcugccugcgggccauacuc

SEQ ID NO: 1352592 - RNA, 23 nt, Human
ggcuggucucgaacuccugaccu

SEQ ID NO: 1352593 - RNA, 23 nt, Human
ggcuggucuucaacuccugaccu

SEQ ID NO: 1352594 - RNA, 24 nt, Human
ggcugugcaguggcgcgaucucgg

SEQ ID NO: 1352595 - RNA, 22 nt, Human
gggcuccacccuccugacccag

SEQ ID NO: 1352596 - RNA, 22 nt, Human
gggguuucauuauguuggccag

SEQ ID NO: 1352597 - RNA, 23 nt, Human
ggguagcaugagguucugucuca

SEQ ID NO: 1352598 - RNA, 20 nt, Human
ggguucaagcgauucuucug

SEQ ID NO: 1352599 - RNA, 20 nt, Human
ggucucgaacuccugaccuu

SEQ ID NO: 1352600 - RNA, 23 nt, Human
guagagacagguuuuugccaugu

SEQ ID NO: 1352601 - RNA, 18 nt, Human
guagcugggauuacaggc

SEQ ID NO: 1352602 - RNA, 23 nt, Human
gucuuggagcguguggcagggcc

SEQ ID NO: 1352603 - RNA, 24 nt, Human
gugauccaccuaccuugaccuccc

SEQ ID NO: 1352604 - RNA, 24 nt, Human
gugauucgcccaccucagccuccc

SEQ ID NO: 1352605 - RNA, 23 nt, Human
gugcaguggcgcgaucucggcuc

SEQ ID NO: 1352606 - RNA, 21 nt, Human
guggggcagcagcgccaggca

SEQ ID NO: 1352607 - RNA, 19 nt, Human
guggggugggggcugacuc

SEQ ID NO: 1352608 - RNA, 24 nt, Human
uaauuuauuguauuuuuaguagag

SEQ ID NO: 1352609 - RNA, 24 nt, Human
uaauuuuuguauuuuuaguagaga

SEQ ID NO: 1352610 - RNA, 22 nt, Human
uacagguggauuucugcccuuu

SEQ ID NO: 1352611 - RNA, 23 nt, Human
uacaggugugagccaccgugacu

SEQ ID NO: 1352612 - RNA, 21 nt, Human
uaccucacccguccuauuugc

SEQ ID NO: 1352613 - RNA, 22 nt, Human
uagagacagguuuuugccaugu

SEQ ID NO: 1352614 - RNA, 19 nt, Human
uaggugcccaccaccacgc

SEQ ID NO: 1352615 - RNA, 21 nt, Human
uaggugcccaccaccacgccc

SEQ ID NO: 1352616 - RNA, 24 nt, Human
uaguagagacagguuuuugccaug

SEQ ID NO: 1352617 - RNA, 24 nt, Human
uaguagagaugggguuucauuaug

SEQ ID NO: 1352618 - RNA, 22 nt, Human
uaguccugagcuccagcugccc

SEQ ID NO: 1352619 - RNA, 24 nt, Human
uauguuggccaggcuggucucgaa

SEQ ID NO: 1352620 - RNA, 25 nt, Human
ucaacuccugaccuuaggugaucca

SEQ ID NO: 1352621 - RNA, 19 nt, Human
ucaagcgauucuucugccu

SEQ ID NO: 1352622 - RNA, 24 nt, Human
ucacugcaacuuccgccuucuggg

SEQ ID NO: 1352623 - RNA, 23 nt, Human
ucacugcaaucuccgcucccagg

SEQ ID NO: 1352624 - RNA, 23 nt, Human
ucacugcaaucuccgcucccagg

SEQ ID NO: 1352625 - RNA, 24 nt, Human
ucacugcaaucuccgcucccaggg

SEQ ID NO: 1352626 - RNA, 18 nt, Human
ucagccucccaaagugcu

SEQ ID NO: 1352627 - RNA, 20 nt, Human
ucagggaugucgggguggcc

SEQ ID NO: 1352628 - RNA, 23 nt, Human
ucagucucccgaguagcugggau

SEQ ID NO: 1352629 - RNA, 22 nt, Human
ucauuauguuggccaggcuggu

SEQ ID NO: 1352630 - RNA, 22 nt, Human
uccacgcaggccugaguggccg

SEQ ID NO: 1352631 - RNA, 25 nt, Human
uccacuugucuggguagcaugaggu

SEQ ID NO: 1352632 - RNA, 23 nt, Human
ucccaaagugcugggauuacagg

SEQ ID NO: 1352633 - RNA, 18 nt, Human
ucccaggguucaagccau

SEQ ID NO: 1352634 - RNA, 22 nt, Human
ucccaggguucaagccaucuuc

SEQ ID NO: 1352635 - RNA, 19 nt, Human
ucccgaagugcugggauua

SEQ ID NO: 1352636 - RNA, 23 nt, Human
ucccgaagugcugggauuacagg

SEQ ID NO: 1352637 - RNA, 24 nt, Human
ucccgaagugcugggauuacaggu

SEQ ID NO: 1352638 - RNA, 23 nt, Human
ucccgaguagcugggauaauagg

SEQ ID NO: 1352639 - RNA, 24 nt, Human
ucccgaguagcugggauuacaggc

SEQ ID NO: 1352640 - RNA, 18 nt, Human
ucccugagaagaagcagu

SEQ ID NO: 1352641 - RNA, 19 nt, Human
ucccuugggaacaaaaccc

SEQ ID NO: 1352642 - RNA, 22 nt, Human
ucccuugggaacaaaaccccug

SEQ ID NO: 1352643 - RNA, 23 nt, Human
ucccuugggaacaaaaccccugg

SEQ ID NO: 1352644 - RNA, 25 nt, Human
ucccuugggaacaaaaccccugggu

SEQ ID NO: 1352645 - RNA, 19 nt, Human
uccucuuccgagggcucca

SEQ ID NO: 1352646 - RNA, 19 nt, Human
uccugagcuccagcugccc

SEQ ID NO: 1352647 - RNA, 20 nt, Human
ucgaggugccagggagucuc

SEQ ID NO: 1352648 - RNA, 22 nt, Human
ucgcccuggcugugcaguggcg

SEQ ID NO: 1352649 - RNA, 23 nt, Human
ucgggguggccgugugcccagga

SEQ ID NO: 1352650 - RNA, 25 nt, Human
ucuccaggauggggccagcucgucc

SEQ ID NO: 1352651 - RNA, 22 nt, Human
ucuccaggauggggccagcucu

SEQ ID NO: 1352652 - RNA, 23 nt, Human
ucucgcucuugucgccaggcugg

SEQ ID NO: 1352653 - RNA, 24 nt, Human
ucucgcucuugucgccaggcugga

SEQ ID NO: 1352654 - RNA, 22 nt, Human
ucugcugaaagccacucagcuc

SEQ ID NO: 1352655 - RNA, 24 nt, Human
ucuugucgccaggcuggagugcaa

SEQ ID NO: 1352656 - RNA, 24 nt, Human
ucuuuuuuuuuugagacggagucu

SEQ ID NO: 1352657 - RNA, 23 nt, Human
ugacagguugacaugcaccuucc

SEQ ID NO: 1352658 - RNA, 18 nt, Human
ugacaugcaccuuccuug

SEQ ID NO: 1352659 - RNA, 21 nt, Human
ugacaugcaccuuccuugggc

SEQ ID NO: 1352660 - RNA, 19 nt, Human
ugaccuuaggugauccacc

SEQ ID NO: 1352661 - RNA, 20 nt, Human
ugacuggccuuacaccaugu

SEQ ID NO: 1352662 - RNA, 23 nt, Human
ugacuuggugccuuaaacaacag

SEQ ID NO: 1352663 - RNA, 22 nt, Human
ugagacggagucuugcaccguc

SEQ ID NO: 1352664 - RNA, 19 nt, Human
ugagagcaauugaccuaaa

SEQ ID NO: 1352665 - RNA, 18 nt, Human
ugagcguggcgccugcgu

SEQ ID NO: 1352666 - RNA, 19 nt, Human
ugaggcagaugcugcuggg

SEQ ID NO: 1352667 - RNA, 19 nt, Human
ugagggccggcuuccuggc

SEQ ID NO: 1352668 - RNA, 19 nt, Human
ugaggguuucagcaugugg

SEQ ID NO: 1352669 - RNA, 24 nt, Human
ugauucgcccaccucagccuccca

SEQ ID NO: 1352670 - RNA, 21 nt, Human
ugcagcuuggagaacccagcc

SEQ ID NO: 1352671 - RNA, 22 nt, Human
ugcaguggcgcgaucucggcuc

SEQ ID NO: 1352672 - RNA, 21 nt, Human
ugccaggaagugugauuaagc

SEQ ID NO: 1352673 - RNA, 27 nt, Human
ugccauguuggccaggcuggucuucaa

SEQ ID NO: 1352674 - RNA, 18 nt, Human
ugcccaccccucccccca

SEQ ID NO: 1352675 - RNA, 25 nt, Human
ugcccccccaccccccuggccucca

SEQ ID NO: 1352676 - RNA, 23 nt, Human
ugccucagucucccgaguagcug

SEQ ID NO: 1352677 - RNA, 24 nt, Human
ugccucagucucccgaguagcugg

SEQ ID NO: 1352678 - RNA, 23 nt, Human
ugccugaaggcauaggagggggc

SEQ ID NO: 1352679 - RNA, 20 nt, Human
ugccuuggccucccgaguaa

SEQ ID NO: 1352680 - RNA, 22 nt, Human
ugcgcucugugcaguggggcag

SEQ ID NO: 1352681 - RNA, 20 nt, Human
ugcugggauuacagguguga

SEQ ID NO: 1352682 - RNA, 24 nt, Human
ugcugggauuacaggugugagcca

SEQ ID NO: 1352683 - RNA, 23 nt, Human
uggagcguguggcagggccaggu

SEQ ID NO: 1352684 - RNA, 23 nt, Human
uggagugcaauggcacgaucuca

SEQ ID NO: 1352685 - RNA, 24 nt, Human
uggagugcaauggcacgaucucag

SEQ ID NO: 1352686 - RNA, 24 nt, Human
uggcacgaucucagcucacugcaa

SEQ ID NO: 1352687 - RNA, 23 nt, Human
uggcauuggggcuggaugacgcu

SEQ ID NO: 1352688 - RNA, 24 nt, Human
uggccaggcuggucucgaacuccu

SEQ ID NO: 1352689 - RNA, 24 nt, Human
uggccaggcuggucuucaacuccu

SEQ ID NO: 1352690 - RNA, 24 nt, Human
uggcuaacauaccagaacuauuug

SEQ ID NO: 1352691 - RNA, 20 nt, Human
uggcugggggcuccagcgac

SEQ ID NO: 1352692 - RNA, 21 nt, Human
ugggauaauaggugcccacca

SEQ ID NO: 1352693 - RNA, 19 nt, Human
ugggauuacaggcacccac

SEQ ID NO: 1352694 - RNA, 21 nt, Human
ugggauuacaggcacccacca

SEQ ID NO: 1352695 - RNA, 22 nt, Human
ugggauuacaggcacccaccac

SEQ ID NO: 1352696 - RNA, 24 nt, Human
ugggauuacaggcacccaccacca

SEQ ID NO: 1352697 - RNA, 18 nt, Human
ugggauuacaggugugag

SEQ ID NO: 1352698 - RNA, 18 nt, Human
ugggauuacaggugugag

SEQ ID NO: 1352699 - RNA, 19 nt, Human
ugggauuacaggugugagc

SEQ ID NO: 1352700 - RNA, 21 nt, Human
ugggauuacaggugugagcca

SEQ ID NO: 1352701 - RNA, 22 nt, Human
ugggauuacaggugugagccac

SEQ ID NO: 1352702 - RNA, 23 nt, Human
ugggauuacaggugugagccacc

SEQ ID NO: 1352703 - RNA, 23 nt, Human
ugggauuacaggugugagccacc

SEQ ID NO: 1352704 - RNA, 24 nt, Human
ugggauuacaggugugagccaccg

SEQ ID NO: 1352705 - RNA, 21 nt, Human
ugggauuacaggugugagcua

SEQ ID NO: 1352706 - RNA, 24 nt, Human
ugggauuacaggugugagcuaacc

SEQ ID NO: 1352707 - RNA, 22 nt, Human
ugggauuacaggugugagcuac

SEQ ID NO: 1352708 - RNA, 23 nt, Human
ugggauuacaggugugagcuacc

SEQ ID NO: 1352709 - RNA, 23 nt, Human
ugggauuacaggugugagcuacc

SEQ ID NO: 1352710 - RNA, 25 nt, Human
ugggauuacaggugugagcuaccuc

SEQ ID NO: 1352711 - RNA, 23 nt, Human
uggggcagcagcgccaggcaaaa

SEQ ID NO: 1352712 - RNA, 21 nt, Human
uggggccagcucguccgagcc

SEQ ID NO: 1352713 - RNA, 24 nt, Human
uggggcugugagugucugugccca

SEQ ID NO: 1352714 - RNA, 21 nt, Human
uggggucuccccggcagcccu

SEQ ID NO: 1352715 - RNA, 22 nt, Human
ugggguggggagggcugugaca

SEQ ID NO: 1352716 - RNA, 24 nt, Human
ugggguuucauuauguuggccagg

SEQ ID NO: 1352717 - RNA, 19 nt, Human
ugggguuuggggaugccac

SEQ ID NO: 1352718 - RNA, 20 nt, Human
uggguucaagcgauucuucu

SEQ ID NO: 1352719 - RNA, 23 nt, Human
uggguucaagcgauucuucugcc

SEQ ID NO: 1352720 - RNA, 24 nt, Human
uggguucaagcgauucuucugccu

SEQ ID NO: 1352721 - RNA, 21 nt, Human
uguauuuuuaguagagauggg

SEQ ID NO: 1352722 - RNA, 18 nt, Human
ugucuggguagcaugagg

SEQ ID NO: 1352723 - RNA, 21 nt, Human
ugucugugcccaccccucccc

SEQ ID NO: 1352724 - RNA, 25 nt, Human
ugucugugcccaccccuccccccac

SEQ ID NO: 1352725 - RNA, 24 nt, Human
ugugauucgcccaccucagccucc

SEQ ID NO: 1352726 - RNA, 20 nt, Human
ugugcagccucuggugugca

SEQ ID NO: 1352727 - RNA, 20 nt, Human
ugugcaguggcgcgaucucg

SEQ ID NO: 1352728 - RNA, 20 nt, Human
ugugcaguggcgcgaucucg

SEQ ID NO: 1352729 - RNA, 23 nt, Human
ugugcaguggcgcgaucucggcu

SEQ ID NO: 1352730 - RNA, 20 nt, Human
ugugggguggggagggcugu

SEQ ID NO: 1352731 - RNA, 19 nt, Human
uguuuucuuuuuuuuuuga

SEQ ID NO: 1352732 - RNA, 24 nt, Human
uuaguagagacagguuuuugccau

SEQ ID NO: 1352733 - RNA, 20 nt, Human
uuaguagagaugggguuuca

SEQ ID NO: 1352734 - RNA, 20 nt, Human
uuaguagagaugggguuuca

SEQ ID NO: 1352735 - RNA, 24 nt, Human
uuaguagagaugggguuucauuau

SEQ ID NO: 1352736 - RNA, 27 nt, Human
uuauugguggcugggaaguacaaguca

SEQ ID NO: 1352737 - RNA, 20 nt, Human
uucaagccaucuuccugccu

SEQ ID NO: 1352738 - RNA, 23 nt, Human
uucaagcgauucuucugccucag

SEQ ID NO: 1352739 - RNA, 25 nt, Human
uucaagcgauucuucugccucaguc

SEQ ID NO: 1352740 - RNA, 21 nt, Human
uucgcccaccucagccuccca

SEQ ID NO: 1352741 - RNA, 24 nt, Human
uucuggguucaagcgauucuucug

SEQ ID NO: 1352742 - RNA, 21 nt, Human
uugcaccgucgcccuggcugu

SEQ ID NO: 1352743 - RNA, 24 nt, Human
uugccauguuggccaggcuggucu

SEQ ID NO: 1352744 - RNA, 27 nt, Human
uugccggaggguguggggccgggcccc

SEQ ID NO: 1352745 - RNA, 23 nt, Human
uuguauuuuuaguagagaugggg

SEQ ID NO: 1352746 - RNA, 24 nt, Human
uuuauuguauuuuuaguagagaug

SEQ ID NO: 1352747 - RNA, 23 nt, Human
uuucauuauguuggccaggcugu

SEQ ID NO: 1352748 - RNA, 25 nt, Human
uuuuauuuuuuugagacggagucuc

SEQ ID NO: 1352749 - RNA, 23 nt, Human
uuuugccauguuggccaggcugg

SEQ ID NO: 1352750 - RNA, 24 nt, Human
uuuuuaguagagaugggguuucau

SEQ ID NO: 1352751 - RNA, 23 nt, Human
uuuuugccauguuggccaggcug

SEQ ID NO: 1352752 - RNA, 20 nt, Human
uuuuuguauuuuuaguagag

SEQ ID NO: 1352753 - RNA, 23 nt, Human
aaaaacuaauguaaacccaggaa

SEQ ID NO: 1352754 - RNA, 23 nt, Human
aaaaggaaaagaaaaaaaaagag

SEQ ID NO: 1352755 - RNA, 29 nt, Human
aaaaggaaaagaaaaaaaaagaguagaag

SEQ ID NO: 1352756 - RNA, 23 nt, Human
aaacaggaauggagaaaagggac

SEQ ID NO: 1352757 - RNA, 18 nt, Human
aagaaggccgcucuccuc

SEQ ID NO: 1352758 - RNA, 22 nt, Human
aagcaagcagcagcucucacac

SEQ ID NO: 1352759 - RNA, 23 nt, Human
aaugacuucaaggccugagaagg

SEQ ID NO: 1352760 - RNA, 25 nt, Human
acaagcaagcagcagcucucacaca

SEQ ID NO: 1352761 - RNA, 21 nt, Human
acaccuguaaucccagcacuu

SEQ ID NO: 1352762 - RNA, 19 nt, Human
acacugcagcacuccaggg

SEQ ID NO: 1352763 - RNA, 23 nt, Human
acaucauaaaacaaaauuagaac

SEQ ID NO: 1352764 - RNA, 18 nt, Human
acuccguugcccaggcug

SEQ ID NO: 1352765 - RNA, 19 nt, Human
acuccguugcccaggcugg

SEQ ID NO: 1352766 - RNA, 26 nt, Human
acuccguugcccaggcuggagaauca

SEQ ID NO: 1352767 - RNA, 19 nt, Human
acuuuauauauuuauauau

SEQ ID NO: 1352768 - RNA, 23 nt, Human
agaaacaauaauaguuacauaac

SEQ ID NO: 1352769 - RNA, 24 nt, Human
aggaaaaugaaaagucuucacagc

SEQ ID NO: 1352770 - RNA, 26 nt, Human
aggcagguggaccacuugaggucaga

SEQ ID NO: 1352771 - RNA, 19 nt, Human
aggugcgguggcuuacacc

SEQ ID NO: 1352772 - RNA, 24 nt, Human
aggugcgguggcuuacaccuguaa

SEQ ID NO: 1352773 - RNA, 18 nt, Human
auagaaacuggccaggug

SEQ ID NO: 1352774 - RNA, 22 nt, Human
aucccagcacuuugggaggcca

SEQ ID NO: 1352775 - RNA, 23 nt, Human
caacccaauuuuauuccuaaacu

SEQ ID NO: 1352776 - RNA, 20 nt, Human
caagagccacaccaugguga

SEQ ID NO: 1352777 - RNA, 24 nt, Human
caaggcagguggaccacuugaggu

SEQ ID NO: 1352778 - RNA, 26 nt, Human
caaggcagguggaccacuugagguca

SEQ ID NO: 1352779 - RNA, 23 nt, Human
caaguuaagauuuucuaagaccu

SEQ ID NO: 1352780 - RNA, 22 nt, Human
cacacugcagcacuccagggua

SEQ ID NO: 1352781 - RNA, 20 nt, Human
caccauggugagaaaggaca

SEQ ID NO: 1352782 - RNA, 19 nt, Human
caccuguaaucccagcacu

SEQ ID NO: 1352783 - RNA, 24 nt, Human
caccuguaaucccagcacuuuggg

SEQ ID NO: 1352784 - RNA, 22 nt, Human
cacuccguugcccaggcuggag

SEQ ID NO: 1352785 - RNA, 24 nt, Human
cagcacuuugggaggccaaggcag

SEQ ID NO: 1352786 - RNA, 25 nt, Human
cagcacuuugggaggccaaggcagg

SEQ ID NO: 1352787 - RNA, 24 nt, Human
cagcucucuguaucuuccaaucuu

SEQ ID NO: 1352788 - RNA, 24 nt, Human
caggaaaaaacuaauguaaaccca

SEQ ID NO: 1352789 - RNA, 24 nt, Human
caggccuaguggagaaacaagcaa

SEQ ID NO: 1352790 - RNA, 18 nt, Human
cagguggaccacuugagg

SEQ ID NO: 1352791 - RNA, 24 nt, Human
cagguggaccacuugaggucagaa

SEQ ID NO: 1352792 - RNA, 23 nt, Human
ccacaccauggugagaaaggaca

SEQ ID NO: 1352793 - RNA, 19 nt, Human
ccacaggggaaaaaaguaa

SEQ ID NO: 1352794 - RNA, 19 nt, Human
ccaggcuggagaaucaaaa

SEQ ID NO: 1352795 - RNA, 18 nt, Human
ccccauccucaagcgcca

SEQ ID NO: 1352796 - RNA, 20 nt, Human
ccccccauccucaagcgcca

SEQ ID NO: 1352797 - RNA, 25 nt, Human
cccccuccccccauccucaagcgcc

SEQ ID NO: 1352798 - RNA, 23 nt, Human
cccguaggcaacugugucggcuc

SEQ ID NO: 1352799 - RNA, 27 nt, Human
cccguaggcaacugugucggcuccaga

SEQ ID NO: 1352800 - RNA, 20 nt, Human
ccucaagcgccaaaaguacu

SEQ ID NO: 1352801 - RNA, 24 nt, Human
ccucuuacagucaaccuuuggagu

SEQ ID NO: 1352802 - RNA, 19 nt, Human
ccuggugcuaagucacccc

SEQ ID NO: 1352803 - RNA, 18 nt, Human
cuagugccauaaaaaagg

SEQ ID NO: 1352804 - RNA, 19 nt, Human
cucacacacugcagcacuc

SEQ ID NO: 1352805 - RNA, 20 nt, Human
cucuccucuuacagucaacc

SEQ ID NO: 1352806 - RNA, 26 nt, Human
cugcagcacuccaggguaggcccuaa

SEQ ID NO: 1352807 - RNA, 22 nt, Human
cuuacaccuguaaucccagcac

SEQ ID NO: 1352808 - RNA, 18 nt, Human
cuuacagucaaccuuugg

SEQ ID NO: 1352809 - RNA, 23 nt, Human
gaaaaaacuaauguaaacccagg

SEQ ID NO: 1352810 - RNA, 22 nt, Human
gaaaaacaaaauuaagaaaugc

SEQ ID NO: 1352811 - RNA, 22 nt, Human
gaaagaaaauuauuuguccaca

SEQ ID NO: 1352812 - RNA, 19 nt, Human
gacauggguagcuucugag

SEQ ID NO: 1352813 - RNA, 24 nt, Human
gaccacuugaggucagaaguucga

SEQ ID NO: 1352814 - RNA, 21 nt, Human
gagaaacaagcaagcagcagc

SEQ ID NO: 1352815 - RNA, 18 nt, Human
gaggaggggagugagaag

SEQ ID NO: 1352816 - RNA, 20 nt, Human
ggaauccucuacugccaccu

SEQ ID NO: 1352817 - RNA, 18 nt, Human
ggagagcuaauggaaccu

SEQ ID NO: 1352818 - RNA, 21 nt, Human
ggcuuacaccuguaaucccag

SEQ ID NO: 1352819 - RNA, 23 nt, Human
ggugaggaggggagugagaagaa

SEQ ID NO: 1352820 - RNA, 23 nt, Human
gguggcuuacaccuguaauccca

SEQ ID NO: 1352821 - RNA, 24 nt, Human
gguggcuuacaccuguaaucccag

SEQ ID NO: 1352822 - RNA, 23 nt, Human
guggcuuacaccuguaaucccag

SEQ ID NO: 1352823 - RNA, 20 nt, Human
guguaauuuggaaguagggu

SEQ ID NO: 1352824 - RNA, 23 nt, Human
uaaaacaaaauuagaacauacaa

SEQ ID NO: 1352825 - RNA, 19 nt, Human
uaaagcaaaaggaauccuc

SEQ ID NO: 1352826 - RNA, 21 nt, Human
uaaauaaucccccucccccca

SEQ ID NO: 1352827 - RNA, 20 nt, Human
uaaucccccuccccccaucc

SEQ ID NO: 1352828 - RNA, 22 nt, Human
uaaucccccuccccccauccuc

SEQ ID NO: 1352829 - RNA, 24 nt, Human
uacaccuguaaucccagcacuuug

SEQ ID NO: 1352830 - RNA, 20 nt, Human
uauucuuaagggcaggaaaa

SEQ ID NO: 1352831 - RNA, 20 nt, Human
ucagggcuccaagagccacc

SEQ ID NO: 1352832 - RNA, 19 nt, Human
uccucuacugccaccucgg

SEQ ID NO: 1352833 - RNA, 23 nt, Human
ucucacuccguugcccaggcugg

SEQ ID NO: 1352834 - RNA, 24 nt, Human
ucucacuccguugcccaggcugga

SEQ ID NO: 1352835 - RNA, 24 nt, Human
ucucacuccguugcccaggcugga

SEQ ID NO: 1352836 - RNA, 25 nt, Human
ucucacuccguugcccaggcuggag

SEQ ID NO: 1352837 - RNA, 19 nt, Human
ucuuuucuuuucucuuuuu

SEQ ID NO: 1352838 - RNA, 20 nt, Human
ugacuucaaggccugagaag

SEQ ID NO: 1352839 - RNA, 18 nt, Human
ugagaaaggacaugggua

SEQ ID NO: 1352840 - RNA, 22 nt, Human
ugagaagaaaucaaaagcucau

SEQ ID NO: 1352841 - RNA, 18 nt, Human
ugagauaauggcaagaga

SEQ ID NO: 1352842 - RNA, 22 nt, Human
ugagauggagucucacuccguu

SEQ ID NO: 1352843 - RNA, 25 nt, Human
ugauagaaacuggccaggugcggug

SEQ ID NO: 1352844 - RNA, 22 nt, Human
ugccauaaaaaaggaaaagaaa

SEQ ID NO: 1352845 - RNA, 24 nt, Human
uggaccacuugaggucagaaguuc

SEQ ID NO: 1352846 - RNA, 20 nt, Human
uggagaaaaacaaaauuaag

SEQ ID NO: 1352847 - RNA, 22 nt, Human
uggagaaacaagcaagcagcag

SEQ ID NO: 1352848 - RNA, 24 nt, Human
uggagucucacuccguugcccagg

SEQ ID NO: 1352849 - RNA, 24 nt, Human
uggccaggugcgguggcuuacacc

SEQ ID NO: 1352850 - RNA, 21 nt, Human
uggcuuacaccuguaauccca

SEQ ID NO: 1352851 - RNA, 24 nt, Human
uggcuuacaccuguaaucccagca

SEQ ID NO: 1352852 - RNA, 19 nt, Human
ugugugagcagcaaugagg

SEQ ID NO: 1352853 - RNA, 21 nt, Human
uuaaauaaucccccucccccc

SEQ ID NO: 1352854 - RNA, 19 nt, Human
uuaagauuuucuaagaccu

SEQ ID NO: 1352855 - RNA, 21 nt, Human
uuaagggcaggaaaaaacuaa

SEQ ID NO: 1352856 - RNA, 18 nt, Human
uucaggcuaagguaagaa

SEQ ID NO: 1352857 - RNA, 19 nt, Human
uuccuaaacuaccugggcu

SEQ ID NO: 1352858 - RNA, 19 nt, Human
uucucuuuuuugugagaug

SEQ ID NO: 1352859 - RNA, 23 nt, Human
uuggagagcuaauggaaccuggu

SEQ ID NO: 1352860 - RNA, 23 nt, Human
uuggagcaggccuaguggagaaa

SEQ ID NO: 1352861 - RNA, 22 nt, Human
uuuaaauaaucccccucccccc

SEQ ID NO: 1352862 - RNA, 21 nt, Human
uuucucuuuuuugugagaugg

SEQ ID NO: 1352863 - RNA, 21 nt, Human
uuuggaaguagggugaggagg

SEQ ID NO: 1352864 - RNA, 27 nt, Human
uuuuaaauaaucccccuccccccaucc

SEQ ID NO: 1352865 - RNA, 22 nt, Human
uuuucuuuucuuuucucuuuuu

SEQ ID NO: 1352866 - RNA, 21 nt, Human
aacccagauugauagcuucaa

SEQ ID NO: 1352867 - RNA, 18 nt, Human
acagguaggcagggcgca

SEQ ID NO: 1352868 - RNA, 19 nt, Human
accccucugcccuccccgc

SEQ ID NO: 1352869 - RNA, 22 nt, Human
accccucugcccuccccgcccu

SEQ ID NO: 1352870 - RNA, 21 nt, Human
accgccaucuccaggccccac

SEQ ID NO: 1352871 - RNA, 21 nt, Human
agagccagccccucuugguuc

SEQ ID NO: 1352872 - RNA, 25 nt, Human
agccagccccucuugggguccucga

SEQ ID NO: 1352873 - RNA, 18 nt, Human
agggcagcccccaccccu

SEQ ID NO: 1352874 - RNA, 25 nt, Human
caaaugccccucuuccucaccgcuc

SEQ ID NO: 1352875 - RNA, 26 nt, Human
caaaugccccucuuccucaccgcucc

SEQ ID NO: 1352876 - RNA, 18 nt, Human
caccgcuccugccccugc

SEQ ID NO: 1352877 - RNA, 23 nt, Human
cagcccugaccccucugcccucc

SEQ ID NO: 1352878 - RNA, 18 nt, Human
caggcaccccaccugccc

SEQ ID NO: 1352879 - RNA, 21 nt, Human
caggcaccccaccugcccccu

SEQ ID NO: 1352880 - RNA, 18 nt, Human
caggcucaggagggugga

SEQ ID NO: 1352881 - RNA, 19 nt, Human
ccagccccucuugguucug

SEQ ID NO: 1352882 - RNA, 20 nt, Human
ccaggcaccccaccugcccc

SEQ ID NO: 1352883 - RNA, 20 nt, Human
ccaggccccaccagcaccca

SEQ ID NO: 1352884 - RNA, 24 nt, Human
cccaccagcacccauccucugacc

SEQ ID NO: 1352885 - RNA, 22 nt, Human
ccccgcccugccuccugccccu

SEQ ID NO: 1352886 - RNA, 24 nt, Human
ccccugcuucuccuccucagcccc

SEQ ID NO: 1352887 - RNA, 23 nt, Human
cccugaccccucugcccuccccg

SEQ ID NO: 1352888 - RNA, 21 nt, Human
ccuaccaccguguccuuaccu

SEQ ID NO: 1352889 - RNA, 20 nt, Human
ccuccaggcucaggagggug

SEQ ID NO: 1352890 - RNA, 24 nt, Human
ccuccccgcccugccuccugcccc

SEQ ID NO: 1352891 - RNA, 24 nt, Human
ccugacccaaccucgaccaaaugc

SEQ ID NO: 1352892 - RNA, 19 nt, Human
ccugaccccucugcccucc

SEQ ID NO: 1352893 - RNA, 22 nt, Human
cgugcugcugacacgauggugg

SEQ ID NO: 1352894 - RNA, 21 nt, Human
cuccaggccccaccagcaccc

SEQ ID NO: 1352895 - RNA, 24 nt, Human
cuccaggccccaccagcacccauc

SEQ ID NO: 1352896 - RNA, 22 nt, Human
cucccaggcaccccaccugccc

SEQ ID NO: 1352897 - RNA, 18 nt, Human
cuccugccccugcuucuc

SEQ ID NO: 1352898 - RNA, 22 nt, Human
cucugaccacggaccucccagg

SEQ ID NO: 1352899 - RNA, 28 nt, Human
cugacacgaugguggcuguggauuuuuc

SEQ ID NO: 1352900 - RNA, 19 nt, Human
cugcccuccccgcccugcc

SEQ ID NO: 1352901 - RNA, 19 nt, Human
cugcccuccccgcccugcc

SEQ ID NO: 1352902 - RNA, 20 nt, Human
cugcccuccccgcccugccu

SEQ ID NO: 1352903 - RNA, 19 nt, Human
cuugguucugagaagcaaa

SEQ ID NO: 1352904 - RNA, 20 nt, Human
gagccagccccucuugguuc

SEQ ID NO: 1352905 - RNA, 24 nt, Human
gcaagaaugcccguccccaugucg

SEQ ID NO: 1352906 - RNA, 20 nt, Human
gccccugcuucuccuccuca

SEQ ID NO: 1352907 - RNA, 21 nt, Human
gccuuugccuaccaccguguc

SEQ ID NO: 1352908 - RNA, 21 nt, Human
ggccuccaggcucaggagggu

SEQ ID NO: 1352909 - RNA, 21 nt, Human
gggcagcccccaccccuggag

SEQ ID NO: 1352910 - RNA, 18 nt, Human
guggcuguggauuuuucg

SEQ ID NO: 1352911 - RNA, 22 nt, Human
uaccugacccaaccucgaccaa

SEQ ID NO: 1352912 - RNA, 21 nt, Human
uagcuucaaagggcagccccc

SEQ ID NO: 1352913 - RNA, 19 nt, Human
uccccgcccugccuccugc

SEQ ID NO: 1352914 - RNA, 20 nt, Human
uccucugaccacggaccucc

SEQ ID NO: 1352915 - RNA, 22 nt, Human
ucugcccuccccgcccugccuc

SEQ ID NO: 1352916 - RNA, 23 nt, Human
ugaauccacacuuaaaacccaga

SEQ ID NO: 1352917 - RNA, 22 nt, Human
ugaccacggaccucccaggcac

SEQ ID NO: 1352918 - RNA, 24 nt, Human
ugacccaaccucgaccaaaugccc

SEQ ID NO: 1352919 - RNA, 19 nt, Human
ugaggaagcggcaagaaug

SEQ ID NO: 1352920 - RNA, 23 nt, Human
ugucaauaaugaauccacacuua

SEQ ID NO: 1352921 - RNA, 20 nt, Human
uucaaagggcagcccccacc

SEQ ID NO: 1352922 - RNA, 23 nt, Human
uuccucaccgcuccugccccugc

SEQ ID NO: 1352923 - RNA, 18 nt, Human
aaagauucucugcagcaa

SEQ ID NO: 1352924 - RNA, 26 nt, Human
aacucccugcagcguugacaccgcac

SEQ ID NO: 1352925 - RNA, 22 nt, Human
aagcagcuuuguggcagugugg

SEQ ID NO: 1352926 - RNA, 23 nt, Human
aagcugccgauaaauuagagagc

SEQ ID NO: 1352927 - RNA, 22 nt, Human
aaggggcugugcagccaggagg

SEQ ID NO: 1352928 - RNA, 22 nt, Human
aaggugccacaacucccugcag

SEQ ID NO: 1352929 - RNA, 22 nt, Human
aagucccuggcagcuguggucc

SEQ ID NO: 1352930 - RNA, 22 nt, Human
acacccuguguccugcucuagg

SEQ ID NO: 1352931 - RNA, 20 nt, Human
acccuggggggaggcgucgg

SEQ ID NO: 1352932 - RNA, 19 nt, Human
acgaagaccaugaagcacc

SEQ ID NO: 1352933 - RNA, 26 nt, Human
acucugaguaauacguuaacaaaaaa

SEQ ID NO: 1352934 - RNA, 19 nt, Human
agaggcuugggugacucug

SEQ ID NO: 1352935 - RNA, 21 nt, Human
agcagcagcagcagcaccgac

SEQ ID NO: 1352936 - RNA, 22 nt, Human
agccccuggcucccaggguucc

SEQ ID NO: 1352937 - RNA, 19 nt, Human
agccgcacuucccuucccc

SEQ ID NO: 1352938 - RNA, 21 nt, Human
aggaagccagccuaggggugg

SEQ ID NO: 1352939 - RNA, 21 nt, Human
aggcagguggugugcgggccg

SEQ ID NO: 1352940 - RNA, 18 nt, Human
aggccucaggcggcccag

SEQ ID NO: 1352941 - RNA, 21 nt, Human
aggcggccaggugcucagagg

SEQ ID NO: 1352942 - RNA, 23 nt, Human
aggggagccuuccgugucccguu

SEQ ID NO: 1352943 - RNA, 21 nt, Human
aggggcugugcagccaggagg

SEQ ID NO: 1352944 - RNA, 27 nt, Human
aguggcggcggcgguguccaggcgacg

SEQ ID NO: 1352945 - RNA, 20 nt, Human
auggagagaacacagccaca

SEQ ID NO: 1352946 - RNA, 21 nt, Human
caaaaaguuucucuuccagug

SEQ ID NO: 1352947 - RNA, 18 nt, Human
cacaacucccugcagcgu

SEQ ID NO: 1352948 - RNA, 19 nt, Human
cacauguccacgaagacca

SEQ ID NO: 1352949 - RNA, 21 nt, Human
caccaccagcccccucccgcc

SEQ ID NO: 1352950 - RNA, 22 nt, Human
cacccauggagagaacacagcc

SEQ ID NO: 1352951 - RNA, 21 nt, Human
cacccgcgccgaccgagccgc

SEQ ID NO: 1352952 - RNA, 21 nt, Human
caccgacagcuugcgcuggaa

SEQ ID NO: 1352953 - RNA, 23 nt, Human
caccggcaggugggcgcugcccc

SEQ ID NO: 1352954 - RNA, 22 nt, Human
caccuucacccucagccaagag

SEQ ID NO: 1352955 - RNA, 19 nt, Human
cacgcagaaggggcugugc

SEQ ID NO: 1352956 - RNA, 23 nt, Human
cacgucgaaguuguuguacuugg

SEQ ID NO: 1352957 - RNA, 19 nt, Human
cacugguccgccugacagg

SEQ ID NO: 1352958 - RNA, 26 nt, Human
cagcagcagcagcagcaccgacagcu

SEQ ID NO: 1352959 - RNA, 20 nt, Human
cagccaggagggccccccuc

SEQ ID NO: 1352960 - RNA, 23 nt, Human
cagcccaggcccccgaccagcag

SEQ ID NO: 1352961 - RNA, 24 nt, Human
cagcccaggcccccgaccagcagc

SEQ ID NO: 1352962 - RNA, 20 nt, Human
cagccccuggcucccagggu

SEQ ID NO: 1352963 - RNA, 18 nt, Human
caggagccaccggcaggu

SEQ ID NO: 1352964 - RNA, 22 nt, Human
caggccagccccugagcuggga

SEQ ID NO: 1352965 - RNA, 21 nt, Human
caggccgggacgauacaucaa

SEQ ID NO: 1352966 - RNA, 23 nt, Human
caggguagggucacaagucccac

SEQ ID NO: 1352967 - RNA, 21 nt, Human
cagggugaugucuaaaguccc

SEQ ID NO: 1352968 - RNA, 23 nt, Human
caugcaggcagguggugugcggg

SEQ ID NO: 1352969 - RNA, 23 nt, Human
ccaccagcccccucccgccuccc

SEQ ID NO: 1352970 - RNA, 24 nt, Human
ccacccauggagagaacacagcca

SEQ ID NO: 1352971 - RNA, 22 nt, Human
ccagccccugagcugggagccu

SEQ ID NO: 1352972 - RNA, 20 nt, Human
cccacacagccccucaggau

SEQ ID NO: 1352973 - RNA, 21 nt, Human
cccacccauggagagaacaca

SEQ ID NO: 1352974 - RNA, 24 nt, Human
cccaccccgcaguacgacccgaag

SEQ ID NO: 1352975 - RNA, 25 nt, Human
cccaggccagccccugagcugggag

SEQ ID NO: 1352976 - RNA, 20 nt, Human
cccagggcguggacgcagcc

SEQ ID NO: 1352977 - RNA, 20 nt, Human
cccaugcccagagugugggg

SEQ ID NO: 1352978 - RNA, 20 nt, Human
cccucaggaugacacacaca

SEQ ID NO: 1352979 - RNA, 20 nt, Human
cccuccggaauugcuccugg

SEQ ID NO: 1352980 - RNA, 19 nt, Human
cccugcuccgggcccgcgc

SEQ ID NO: 1352981 - RNA, 22 nt, Human
cccugcuccgggcccgcgcugg

SEQ ID NO: 1352982 - RNA, 23 nt, Human
ccgcacgagcggcaccaccagcc

SEQ ID NO: 1352983 - RNA, 18 nt, Human
ccgcgcccccaucacaga

SEQ ID NO: 1352984 - RNA, 19 nt, Human
ccgcgccgaccgagccgca

SEQ ID NO: 1352985 - RNA, 28 nt, Human
ccucauggcuccugggccacugguccgc

SEQ ID NO: 1352986 - RNA, 25 nt, Human
ccucccaccugagcccuucuccggc

SEQ ID NO: 1352987 - RNA, 19 nt, Human
ccucccgucccaccuucac

SEQ ID NO: 1352988 - RNA, 20 nt, Human
ccucccgucccaccuucacc

SEQ ID NO: 1352989 - RNA, 24 nt, Human
ccugagcugggagccugcugaggc

SEQ ID NO: 1352990 - RNA, 18 nt, Human
ccugcgggugccccuguc

SEQ ID NO: 1352991 - RNA, 18 nt, Human
ccugcugaggccccuccc

SEQ ID NO: 1352992 - RNA, 18 nt, Human
ccugcugaggccccuccc

SEQ ID NO: 1352993 - RNA, 23 nt, Human
cgacccgaagacaugugagcagg

SEQ ID NO: 1352994 - RNA, 23 nt, Human
cgcaugcaggcagguggugugcg

SEQ ID NO: 1352995 - RNA, 20 nt, Human
cgcccccuccacccgcgccg

SEQ ID NO: 1352996 - RNA, 20 nt, Human
cgccggcggcccagcagcag

SEQ ID NO: 1352997 - RNA, 23 nt, Human
cgccugacaggguagggucacaa

SEQ ID NO: 1352998 - RNA, 22 nt, Human
cggcccagggcagaguaagcag

SEQ ID NO: 1352999 - RNA, 23 nt, Human
cguugacaccgcacgagcggcac

SEQ ID NO: 1353000 - RNA, 23 nt, Human
cucacgcccccuccacccgcgcc

SEQ ID NO: 1353001 - RNA, 25 nt, Human
cucaggacccacacagccccucagg

SEQ ID NO: 1353002 - RNA, 20 nt, Human
cucauggcuccugggccacu

SEQ ID NO: 1353003 - RNA, 19 nt, Human
cucccagaacaggcagaca

SEQ ID NO: 1353004 - RNA, 22 nt, Human
cucccaggguuccccccaggcc

SEQ ID NO: 1353005 - RNA, 22 nt, Human
cucuguguccaggggccuccca

SEQ ID NO: 1353006 - RNA, 19 nt, Human
cugaaggcuggcuggggac

SEQ ID NO: 1353007 - RNA, 18 nt, Human
cugcugaggccccuccca

SEQ ID NO: 1353008 - RNA, 19 nt, Human
cuguccucauggcuccugg

SEQ ID NO: 1353009 - RNA, 23 nt, Human
cuuggugcgggccaggugggagg

SEQ ID NO: 1353010 - RNA, 20 nt, Human
cuuuguggcaguguggugug

SEQ ID NO: 1353011 - RNA, 21 nt, Human
gaagcucccgccuaccugccc

SEQ ID NO: 1353012 - RNA, 19 nt, Human
gaccagcagcauggugacg

SEQ ID NO: 1353013 - RNA, 22 nt, Human
gaccggcauugggccccggcgg

SEQ ID NO: 1353014 - RNA, 20 nt, Human
gagagugcauacggggaggg

SEQ ID NO: 1353015 - RNA, 22 nt, Human
gagugcauacggggaggguggg

SEQ ID NO: 1353016 - RNA, 23 nt, Human
gcagugaacaggcugcagcuaaa

SEQ ID NO: 1353017 - RNA, 18 nt, Human
gcauacggggaggguggg

SEQ ID NO: 1353018 - RNA, 19 nt, Human
gccgaccccacccauggag

SEQ ID NO: 1353019 - RNA, 21 nt, Human
gccgcaugcaggcagguggug

SEQ ID NO: 1353020 - RNA, 18 nt, Human
gccuaggccugggagccc

SEQ ID NO: 1353021 - RNA, 21 nt, Human
gcggaacggagggcccacccc

SEQ ID NO: 1353022 - RNA, 23 nt, Human
gcggaacggagggcccaccccgc

SEQ ID NO: 1353023 - RNA, 24 nt, Human
gcggccaggugcucagagggcacc

SEQ ID NO: 1353024 - RNA, 20 nt, Human
gcggccgcauggugcugggg

SEQ ID NO: 1353025 - RNA, 19 nt, Human
gcgggugccccugucccuc

SEQ ID NO: 1353026 - RNA, 24 nt, Human
ggaaggcgcuggccgaccccaccc

SEQ ID NO: 1353027 - RNA, 18 nt, Human
ggacccacacagccccuc

SEQ ID NO: 1353028 - RNA, 19 nt, Human
ggacucaggacccacacag

SEQ ID NO: 1353029 - RNA, 21 nt, Human
ggagggcccaccccgcaguac

SEQ ID NO: 1353030 - RNA, 25 nt, Human
ggcaccaccagcccccucccgccuc

SEQ ID NO: 1353031 - RNA, 19 nt, Human
ggcaggugggcgcugcccc

SEQ ID NO: 1353032 - RNA, 19 nt, Human
ggccccggcggcggcggcg

SEQ ID NO: 1353033 - RNA, 22 nt, Human
ggcggccagcgcaccccagagc

SEQ ID NO: 1353034 - RNA, 25 nt, Human
ggcggccaggugcucagagggcacc

SEQ ID NO: 1353035 - RNA, 22 nt, Human
ggcggccgcauggugcuggggc

SEQ ID NO: 1353036 - RNA, 23 nt, Human
ggcggcggcgguguccaggcggc

SEQ ID NO: 1353037 - RNA, 21 nt, Human
gggaggguggguccaggaagc

SEQ ID NO: 1353038 - RNA, 23 nt, Human
gggccagggcacgcagaaggggc

SEQ ID NO: 1353039 - RNA, 19 nt, Human
gggccccggcggcggcggc

SEQ ID NO: 1353040 - RNA, 21 nt, Human
gggcugugcagccaggagggc

SEQ ID NO: 1353041 - RNA, 18 nt, Human
ggggaugggcgaagggaa

SEQ ID NO: 1353042 - RNA, 18 nt, Human
gggggaugggcgaaggga

SEQ ID NO: 1353043 - RNA, 21 nt, Human
ggguugucaguaccacacccu

SEQ ID NO: 1353044 - RNA, 21 nt, Human
gucgcaguggcggcggcggug

SEQ ID NO: 1353045 - RNA, 19 nt, Human
guuguacuuggugcgggcc

SEQ ID NO: 1353046 - RNA, 25 nt, Human
uaaaaaaauagguuuaaugcaggug

SEQ ID NO: 1353047 - RNA, 25 nt, Human
uacgacccgaagacaugugagcagg

SEQ ID NO: 1353048 - RNA, 18 nt, Human
ucagccaagaggcuuggg

SEQ ID NO: 1353049 - RNA, 24 nt, Human
ucagccccuggcucccaggguucc

SEQ ID NO: 1353050 - RNA, 21 nt, Human
uccaguggcacacaacugucc

SEQ ID NO: 1353051 - RNA, 18 nt, Human
uccccccaggccagcccc

SEQ ID NO: 1353052 - RNA, 19 nt, Human
ucccccugcuccgggcccg

SEQ ID NO: 1353053 - RNA, 22 nt, Human
ucccgccucccgucccaccuuc

SEQ ID NO: 1353054 - RNA, 19 nt, Human
ucccgucccaccuucaccc

SEQ ID NO: 1353055 - RNA, 19 nt, Human
uccgugcgcagggcggccg

SEQ ID NO: 1353056 - RNA, 21 nt, Human
uccgugcgcagggcggccgca

SEQ ID NO: 1353057 - RNA, 21 nt, Human
ucuaggguagccucugccugu

SEQ ID NO: 1353058 - RNA, 24 nt, Human
ucuccgcggcggcgccggcguccc

SEQ ID NO: 1353059 - RNA, 22 nt, Human
ucucuaccugauuuaggguuuu

SEQ ID NO: 1353060 - RNA, 19 nt, Human
ucugcagcaagaaaugagg

SEQ ID NO: 1353061 - RNA, 19 nt, Human
ucugccuguuguccuugca

SEQ ID NO: 1353062 - RNA, 18 nt, Human
ugaaggggcucucgggcg

SEQ ID NO: 1353063 - RNA, 24 nt, Human
ugagcaggagccaccggcaggugg

SEQ ID NO: 1353064 - RNA, 21 nt, Human
ugagcccuucuccggcccccc

SEQ ID NO: 1353065 - RNA, 23 nt, Human
ugaggugacacuagggucggaac

SEQ ID NO: 1353066 - RNA, 19 nt, Human
ugcaggcagguggugugcg

SEQ ID NO: 1353067 - RNA, 22 nt, Human
ugccaggccucaggcggcccag

SEQ ID NO: 1353068 - RNA, 21 nt, Human
ugcuggggcgcgcggcugggg

SEQ ID NO: 1353069 - RNA, 24 nt, Human
uggaagcgcagcaggacgcgaacg

SEQ ID NO: 1353070 - RNA, 18 nt, Human
uggagagaggcccacaga

SEQ ID NO: 1353071 - RNA, 19 nt, Human
uggagucagccccuggcuc

SEQ ID NO: 1353072 - RNA, 24 nt, Human
uggagucagccccuggcucccagg

SEQ ID NO: 1353073 - RNA, 21 nt, Human
uggcuccugggccacuggucc

SEQ ID NO: 1353074 - RNA, 20 nt, Human
ugggagcccgcagcugaccc

SEQ ID NO: 1353075 - RNA, 18 nt, Human
ugggcgaagggaaggcgc

SEQ ID NO: 1353076 - RNA, 19 nt, Human
ugggcgaagggaaggcgcu

SEQ ID NO: 1353077 - RNA, 22 nt, Human
ugggggaugggcgaagggaagg

SEQ ID NO: 1353078 - RNA, 19 nt, Human
uguaggcagaagagggcgg

SEQ ID NO: 1353079 - RNA, 22 nt, Human
uucaaaaaguuucucuuccagu

SEQ ID NO: 1353080 - RNA, 22 nt, Human
uuggcuggggcuggggccaggg

SEQ ID NO: 1353081 - RNA, 23 nt, Human
aaacaacuaugguucuugacuuc

SEQ ID NO: 1353082 - RNA, 22 nt, Human
aaggagcugaagccugugccag

SEQ ID NO: 1353083 - RNA, 19 nt, Human
aagggggguccccagacag

SEQ ID NO: 1353084 - RNA, 19 nt, Human
acacagcagccucccuccu

SEQ ID NO: 1353085 - RNA, 19 nt, Human
accugaaggagcugaagcc

SEQ ID NO: 1353086 - RNA, 18 nt, Human
acucauguucugcauccc

SEQ ID NO: 1353087 - RNA, 23 nt, Human
acugcagcucccggaucuccacu

SEQ ID NO: 1353088 - RNA, 20 nt, Human
agccaaugggcgagccgggc

SEQ ID NO: 1353089 - RNA, 18 nt, Human
agccgcugguggucuucg

SEQ ID NO: 1353090 - RNA, 24 nt, Human
aggaagucagaggacucagacacc

SEQ ID NO: 1353091 - RNA, 20 nt, Human
aggagcugccacaguuguuc

SEQ ID NO: 1353092 - RNA, 18 nt, Human
aggcagcaggcuaaacca

SEQ ID NO: 1353093 - RNA, 22 nt, Human
aggcaggaguggaggcagcagg

SEQ ID NO: 1353094 - RNA, 23 nt, Human
aggccaccccagaagcugcacag

SEQ ID NO: 1353095 - RNA, 21 nt, Human
aggcugccucccccucucagc

SEQ ID NO: 1353096 - RNA, 19 nt, Human
aucuuggagaucugagucu

SEQ ID NO: 1353097 - RNA, 18 nt, Human
auggacaugguggaggca

SEQ ID NO: 1353098 - RNA, 19 nt, Human
caccugaaggagcugaagc

SEQ ID NO: 1353099 - RNA, 23 nt, Human
cagcagccucccuccuggagucu

SEQ ID NO: 1353100 - RNA, 22 nt, Human
cagcccgggaacgcagcugcga

SEQ ID NO: 1353101 - RNA, 20 nt, Human
cagcucccggaucuccacuu

SEQ ID NO: 1353102 - RNA, 25 nt, Human
cagcuuucuguagguggcgaccucc

SEQ ID NO: 1353103 - RNA, 25 nt, Human
cagucggcccuuccaggugagacuc

SEQ ID NO: 1353104 - RNA, 19 nt, Human
cauuuuuucugguuuuccu

SEQ ID NO: 1353105 - RNA, 22 nt, Human
ccaccauagccuccgcccaggc

SEQ ID NO: 1353106 - RNA, 21 nt, Human
ccagaagcugcacagugaagc

SEQ ID NO: 1353107 - RNA, 21 nt, Human
ccagacccggcccuggacggc

SEQ ID NO: 1353108 - RNA, 23 nt, Human
ccagacuccagcuggcucuccua

SEQ ID NO: 1353109 - RNA, 25 nt, Human
cccacacagcagccucccuccugga

SEQ ID NO: 1353110 - RNA, 23 nt, Human
cccacaguugucuuugccggagc

SEQ ID NO: 1353111 - RNA, 28 nt, Human
ccccagaagcugcacagugaagcucccc

SEQ ID NO: 1353112 - RNA, 25 nt, Human
cccccuggccuuggaggcccucaau

SEQ ID NO: 1353113 - RNA, 21 nt, Human
cccuggacggcacggagcccc

SEQ ID NO: 1353114 - RNA, 23 nt, Human
cccugguggagcuggugcaccug

SEQ ID NO: 1353115 - RNA, 21 nt, Human
ccgcagcgccggggcccucag

SEQ ID NO: 1353116 - RNA, 22 nt, Human
ccgcccaggccaccccagaagc

SEQ ID NO: 1353117 - RNA, 20 nt, Human
ccgucgccuugccgccgccc

SEQ ID NO: 1353118 - RNA, 22 nt, Human
ccgucgccuugccgccgcccgg

SEQ ID NO: 1353119 - RNA, 23 nt, Human
ccuagccagcgucugcagcucca

SEQ ID NO: 1353120 - RNA, 23 nt, Human
ccuccagggaagcccccuggccu

SEQ ID NO: 1353121 - RNA, 19 nt, Human
ccuccgcccaggccacccc

SEQ ID NO: 1353122 - RNA, 23 nt, Human
ccuggccuuggaggcccucaauc

SEQ ID NO: 1353123 - RNA, 25 nt, Human
ccugugccagagccaaagcuggagc

SEQ ID NO: 1353124 - RNA, 22 nt, Human
cgcccaggccaccccagaagcu

SEQ ID NO: 1353125 - RNA, 20 nt, Human
cgccggggcccucagaucga

SEQ ID NO: 1353126 - RNA, 23 nt, Human
cggcacggagccccagcccggga

SEQ ID NO: 1353127 - RNA, 23 nt, Human
cucaaucucagccuggagcuggc

SEQ ID NO: 1353128 - RNA, 19 nt, Human
cucagcccggcugcaguug

SEQ ID NO: 1353129 - RNA, 27 nt, Human
cucagccucagcccggcugcaguuggc

SEQ ID NO: 1353130 - RNA, 20 nt, Human
cuccgcccaggccaccccag

SEQ ID NO: 1353131 - RNA, 21 nt, Human
cugaaggagcugaagccugug

SEQ ID NO: 1353132 - RNA, 21 nt, Human
cuggaggcgaugggcguggcc

SEQ ID NO: 1353133 - RNA, 22 nt, Human
cuggugcaggcacugggcccac

SEQ ID NO: 1353134 - RNA, 21 nt, Human
cuuggaggcccucaaucucag

SEQ ID NO: 1353135 - RNA, 19 nt, Human
cuuuccgcugagccuccuc

SEQ ID NO: 1353136 - RNA, 20 nt, Human
gaagccugugccagagccaa

SEQ ID NO: 1353137 - RNA, 19 nt, Human
gaaggagcagagaagcugc

SEQ ID NO: 1353138 - RNA, 20 nt, Human
gacaccagcuucccaucgcg

SEQ ID NO: 1353139 - RNA, 23 nt, Human
gacagcaccacagacauguugga

SEQ ID NO: 1353140 - RNA, 23 nt, Human
gagcugccacaguuguucacuug

SEQ ID NO: 1353141 - RNA, 20 nt, Human
gaggcaggaguggaggcagc

SEQ ID NO: 1353142 - RNA, 23 nt, Human
gauguuccgguucaucuuggaga

SEQ ID NO: 1353143 - RNA, 21 nt, Human
gcaccacagacauguuggaga

SEQ ID NO: 1353144 - RNA, 20 nt, Human
gcccaggccaccccagaagc

SEQ ID NO: 1353145 - RNA, 26 nt, Human
gcccccagacccggcccuggacggca

SEQ ID NO: 1353146 - RNA, 19 nt, Human
gcccugguggagcuggugc

SEQ ID NO: 1353147 - RNA, 18 nt, Human
gccuggagcuggcugaug

SEQ ID NO: 1353148 - RNA, 18 nt, Human
gcugcaguuggcaaccuc

SEQ ID NO: 1353149 - RNA, 22 nt, Human
gcugcaguuggcaaccuccuug

SEQ ID NO: 1353150 - RNA, 20 nt, Human
gcuuccccacacagcagccu

SEQ ID NO: 1353151 - RNA, 18 nt, Human
ggagacagcgaagcucag

SEQ ID NO: 1353152 - RNA, 21 nt, Human
ggagccugguuagccaauggg

SEQ ID NO: 1353153 - RNA, 20 nt, Human
ggcccacauaggccgagcuc

SEQ ID NO: 1353154 - RNA, 20 nt, Human
ggcccugguggagcuggugc

SEQ ID NO: 1353155 - RNA, 20 nt, Human
ggggggucuccuguugucug

SEQ ID NO: 1353156 - RNA, 22 nt, Human
ggguccccagacaguaaacucc

SEQ ID NO: 1353157 - RNA, 22 nt, Human
ggguggguugagccucaggugg

SEQ ID NO: 1353158 - RNA, 21 nt, Human
gguggguugagccucaggugg

SEQ ID NO: 1353159 - RNA, 19 nt, Human
guggagcuagcugagguuu

SEQ ID NO: 1353160 - RNA, 18 nt, Human
uaaguggaggccuguggc

SEQ ID NO: 1353161 - RNA, 20 nt, Human
uacaguagugaacaaaacaa

SEQ ID NO: 1353162 - RNA, 21 nt, Human
uacaguagugaacaaaacaac

SEQ ID NO: 1353163 - RNA, 26 nt, Human
uagcuugcuuuucaauuuaaguggag

SEQ ID NO: 1353164 - RNA, 19 nt, Human
uagguggcgaccuccauuu

SEQ ID NO: 1353165 - RNA, 21 nt, Human
uauacaguagugaacaaaaag

SEQ ID NO: 1353166 - RNA, 24 nt, Human
ucacaaccacggcccugguggagc

SEQ ID NO: 1353167 - RNA, 18 nt, Human
ucacuugggcaggaaguc

SEQ ID NO: 1353168 - RNA, 22 nt, Human
ucauacagucggcccuuccagg

SEQ ID NO: 1353169 - RNA, 24 nt, Human
uccaggaguggcugcuguccaugg

SEQ ID NO: 1353170 - RNA, 18 nt, Human
uccauguccaggaguggc

SEQ ID NO: 1353171 - RNA, 20 nt, Human
ucccugugcuuccuagccag

SEQ ID NO: 1353172 - RNA, 21 nt, Human
uccgcugagccuccucaacuc

SEQ ID NO: 1353173 - RNA, 20 nt, Human
ucgccuugccgccgcccggc

SEQ ID NO: 1353174 - RNA, 24 nt, Human
ucugcagcuccacauacuugaucu

SEQ ID NO: 1353175 - RNA, 19 nt, Human
ucugcaucccagacuccag

SEQ ID NO: 1353176 - RNA, 23 nt, Human
ucuguagguggcgaccuccauuu

SEQ ID NO: 1353177 - RNA, 18 nt, Human
ucuuggagaucugagucu

SEQ ID NO: 1353178 - RNA, 19 nt, Human
ugcagaguggccuccagcu

SEQ ID NO: 1353179 - RNA, 20 nt, Human
ugccacaguuguucacuugg

SEQ ID NO: 1353180 - RNA, 24 nt, Human
ugccacaguuguucacuugggcag

SEQ ID NO: 1353181 - RNA, 19 nt, Human
ugccagagccaaagcugga

SEQ ID NO: 1353182 - RNA, 21 nt, Human
ugccagagccaaagcuggagc

SEQ ID NO: 1353183 - RNA, 18 nt, Human
uggagcuggcugauguuc

SEQ ID NO: 1353184 - RNA, 19 nt, Human
uggaggcaggaguggaggc

SEQ ID NO: 1353185 - RNA, 23 nt, Human
uggcagccacgggaggggcagac

SEQ ID NO: 1353186 - RNA, 22 nt, Human
uggcauccuuaacggccagcuc

SEQ ID NO: 1353187 - RNA, 21 nt, Human
uggcgaccuccauuuccaggc

SEQ ID NO: 1353188 - RNA, 22 nt, Human
ugggcaggaagucagaggacuc

SEQ ID NO: 1353189 - RNA, 19 nt, Human
ugggcguggccgcagcgcc

SEQ ID NO: 1353190 - RNA, 21 nt, Human
ugggggccaaagguggacacc

SEQ ID NO: 1353191 - RNA, 24 nt, Human
ugggggccaaagguggacaccuug

SEQ ID NO: 1353192 - RNA, 19 nt, Human
uggguugagccucaggugg

SEQ ID NO: 1353193 - RNA, 19 nt, Human
ugguggagcuagcugaggu

SEQ ID NO: 1353194 - RNA, 22 nt, Human
ugguggagcuagcugagguuuu

SEQ ID NO: 1353195 - RNA, 23 nt, Human
uguagggguggcugcugaaagcc

SEQ ID NO: 1353196 - RNA, 21 nt, Human
uguggcagccacgggaggggc

SEQ ID NO: 1353197 - RNA, 23 nt, Human
uguucauguaaguuucauccaca

SEQ ID NO: 1353198 - RNA, 21 nt, Human
uguuggagaucugggacugca

SEQ ID NO: 1353199 - RNA, 22 nt, Human
uuccgucgccuugccgccgccc

SEQ ID NO: 1353200 - RNA, 26 nt, Human
uucguauggauacucauguucugcau

SEQ ID NO: 1353201 - RNA, 19 nt, Human
uucugcuuuaggggcauau

SEQ ID NO: 1353202 - RNA, 25 nt, Human
uuggaggcccucaaucucagccugg

SEQ ID NO: 1353203 - RNA, 24 nt, Human
uuguacugccucuuuaccucagug

SEQ ID NO: 1353204 - RNA, 20 nt, Human
uuucaucagcuccugguacu

SEQ ID NO: 1353205 - RNA, 26 nt, Human
aaagagggcgcugggccugguguucc

SEQ ID NO: 1353206 - RNA, 19 nt, Human
aaccucagauccccagcac

SEQ ID NO: 1353207 - RNA, 22 nt, Human
aaccucagauccccagcacagc

SEQ ID NO: 1353208 - RNA, 22 nt, Human
aagacugagcucagagaccugg

SEQ ID NO: 1353209 - RNA, 24 nt, Human
aagccugaggggaggcuggaagcu

SEQ ID NO: 1353210 - RNA, 20 nt, Human
aagccuggagggaauacuaa

SEQ ID NO: 1353211 - RNA, 19 nt, Human
aagcugaugcuaaagucag

SEQ ID NO: 1353212 - RNA, 20 nt, Human
aaugugugaccucaacacuc

SEQ ID NO: 1353213 - RNA, 23 nt, Human
acagagccacagaaaaacagaaa

SEQ ID NO: 1353214 - RNA, 22 nt, Human
accugaaucuuugcagcaggca

SEQ ID NO: 1353215 - RNA, 20 nt, Human
acuaagaaaugugcggacag

SEQ ID NO: 1353216 - RNA, 23 nt, Human
acuucucugagauuugcuuuugc

SEQ ID NO: 1353217 - RNA, 22 nt, Human
agaagagggcucaggggaguca

SEQ ID NO: 1353218 - RNA, 23 nt, Human
agaccaaaccucagauccccagc

SEQ ID NO: 1353219 - RNA, 18 nt, Human
agacgcacaggccaggga

SEQ ID NO: 1353220 - RNA, 27 nt, Human
agagagcagacaucacacuccagucgg

SEQ ID NO: 1353221 - RNA, 21 nt, Human
agaggggagagaagagagcag

SEQ ID NO: 1353222 - RNA, 23 nt, Human
agcacagccuccagcagccaccc

SEQ ID NO: 1353223 - RNA, 22 nt, Human
agccacagaaaaacagaaaccu

SEQ ID NO: 1353224 - RNA, 21 nt, Human
agccagcguugagauguuugc

SEQ ID NO: 1353225 - RNA, 18 nt, Human
agccuggagagaagaggg

SEQ ID NO: 1353226 - RNA, 19 nt, Human
aggcaguuccuggcugacu

SEQ ID NO: 1353227 - RNA, 18 nt, Human
aggccaggggugcaugug

SEQ ID NO: 1353228 - RNA, 22 nt, Human
agggaaggggguggcauguggg

SEQ ID NO: 1353229 - RNA, 18 nt, Human
agggacagaggggagaga

SEQ ID NO: 1353230 - RNA, 22 nt, Human
agggcucaggggagucaaugug

SEQ ID NO: 1353231 - RNA, 26 nt, Human
agguaugcaagaggguggagaagucu

SEQ ID NO: 1353232 - RNA, 24 nt, Human
aggugcuggggucucuggagaacc

SEQ ID NO: 1353233 - RNA, 20 nt, Human
agugaggagagagggcccag

SEQ ID NO: 1353234 - RNA, 19 nt, Human
aguucuggguguggagagg

SEQ ID NO: 1353235 - RNA, 21 nt, Human
auggaaugguguuuucuuagc

SEQ ID NO: 1353236 - RNA, 18 nt, Human
caaaccucagauccccag

SEQ ID NO: 1353237 - RNA, 20 nt, Human
caaacuuacggugccuggca

SEQ ID NO: 1353238 - RNA, 23 nt, Human
caagaggggcagcccccaggccc

SEQ ID NO: 1353239 - RNA, 21 nt, Human
cacagccuccagcagccaccc

SEQ ID NO: 1353240 - RNA, 18 nt, Human
cacugagcccagaccaaa

SEQ ID NO: 1353241 - RNA, 21 nt, Human
cagauccccagcacagccucc

SEQ ID NO: 1353242 - RNA, 21 nt, Human
cagccaccccugaucuaucag

SEQ ID NO: 1353243 - RNA, 22 nt, Human
cagcccccaggccccaggcugg

SEQ ID NO: 1353244 - RNA, 21 nt, Human
cagccuccagcagccaccccu

SEQ ID NO: 1353245 - RNA, 18 nt, Human
cagcggggaggggcacgg

SEQ ID NO: 1353246 - RNA, 25 nt, Human
cagcugaaucuccgugcagccccug

SEQ ID NO: 1353247 - RNA, 18 nt, Human
caggaggagauuagagga

SEQ ID NO: 1353248 - RNA, 19 nt, Human
caguccaaaggcaggaggc

SEQ ID NO: 1353249 - RNA, 24 nt, Human
caucuugcaauccaguugccaaca

SEQ ID NO: 1353250 - RNA, 18 nt, Human
cauggacagagccacaga

SEQ ID NO: 1353251 - RNA, 20 nt, Human
ccagaccaaaccucagaucc

SEQ ID NO: 1353252 - RNA, 24 nt, Human
ccagggucuggcuggaccaaagag

SEQ ID NO: 1353253 - RNA, 25 nt, Human
ccauauuuuuguccucauuuuguuu

SEQ ID NO: 1353254 - RNA, 22 nt, Human
ccccagcacagccuccagcagc

SEQ ID NO: 1353255 - RNA, 21 nt, Human
ccccaggccccaggcugggcc

SEQ ID NO: 1353256 - RNA, 19 nt, Human
ccccugggcuuugaugacu

SEQ ID NO: 1353257 - RNA, 19 nt, Human
ccccugggucucaggagcu

SEQ ID NO: 1353258 - RNA, 25 nt, Human
ccccugggucucaggagcuuagcuu

SEQ ID NO: 1353259 - RNA, 22 nt, Human
ccucagaccagccauuugccuc

SEQ ID NO: 1353260 - RNA, 23 nt, Human
ccuccagcagccaccccugaucu

SEQ ID NO: 1353261 - RNA, 19 nt, Human
ccugaucuaucaggguagg

SEQ ID NO: 1353262 - RNA, 18 nt, Human
ccuggagacgacucagcu

SEQ ID NO: 1353263 - RNA, 19 nt, Human
ccuggagagaagagggcuc

SEQ ID NO: 1353264 - RNA, 20 nt, Human
ccuggcugacuugcccucuc

SEQ ID NO: 1353265 - RNA, 21 nt, Human
ccugugcugcgugucugugga

SEQ ID NO: 1353266 - RNA, 19 nt, Human
cgccugugcugcgugucug

SEQ ID NO: 1353267 - RNA, 21 nt, Human
cgccugugcugcgugucugug

SEQ ID NO: 1353268 - RNA, 23 nt, Human
cgcgguaccaguggcaggucccc

SEQ ID NO: 1353269 - RNA, 22 nt, Human
cggugccuggcagacaucacuc

SEQ ID NO: 1353270 - RNA, 18 nt, Human
cucacucuuggccccggc

SEQ ID NO: 1353271 - RNA, 19 nt, Human
cucccacugagcccagacc

SEQ ID NO: 1353272 - RNA, 22 nt, Human
cucccacugagcccagaccaaa

SEQ ID NO: 1353273 - RNA, 18 nt, Human
cuccuuccaucccugccc

SEQ ID NO: 1353274 - RNA, 22 nt, Human
cugagauuugcuuuugccuccu

SEQ ID NO: 1353275 - RNA, 18 nt, Human
cugagcccagaccaaacc

SEQ ID NO: 1353276 - RNA, 22 nt, Human
cugaugcuaaagucagagcagu

SEQ ID NO: 1353277 - RNA, 20 nt, Human
cugcauccugggccaggugc

SEQ ID NO: 1353278 - RNA, 21 nt, Human
cugcuccuuccaucccugccc

SEQ ID NO: 1353279 - RNA, 21 nt, Human
cuggcccuucuccuggccauc

SEQ ID NO: 1353280 - RNA, 21 nt, Human
cuugcccucucuugucugggg

SEQ ID NO: 1353281 - RNA, 22 nt, Human
cuuggcaaggauguugaagaag

SEQ ID NO: 1353282 - RNA, 18 nt, Human
gaaagcaaggauccuacc

SEQ ID NO: 1353283 - RNA, 23 nt, Human
gaaggacagggaaggggguggcc

SEQ ID NO: 1353284 - RNA, 19 nt, Human
gaaggggguggcauguggg

SEQ ID NO: 1353285 - RNA, 18 nt, Human
gacagaguccuggaugca

SEQ ID NO: 1353286 - RNA, 21 nt, Human
gacagggaaggggguggcaug

SEQ ID NO: 1353287 - RNA, 23 nt, Human
gacauugggugcugggcaguggu

SEQ ID NO: 1353288 - RNA, 19 nt, Human
gaccaaaccucagaucccc

SEQ ID NO: 1353289 - RNA, 24 nt, Human
gagagaagagggcucaggggaguc

SEQ ID NO: 1353290 - RNA, 21 nt, Human
gagcccagaccaaaccucaga

SEQ ID NO: 1353291 - RNA, 21 nt, Human
gagggcccagggucuggcugg

SEQ ID NO: 1353292 - RNA, 21 nt, Human
gaggggaggcuggaagcugau

SEQ ID NO: 1353293 - RNA, 18 nt, Human
gaguuggggaaggacagg

SEQ ID NO: 1353294 - RNA, 24 nt, Human
gauguugaagaagauauccaagcc

SEQ ID NO: 1353295 - RNA, 21 nt, Human
gauuugcuuuugccuccuugu

SEQ ID NO: 1353296 - RNA, 23 nt, Human
gcaguccaaaggcaggaggcugc

SEQ ID NO: 1353297 - RNA, 19 nt, Human
gccacagaaaaacagaaac

SEQ ID NO: 1353298 - RNA, 25 nt, Human
gccucaucuucuccccuggggccaa

SEQ ID NO: 1353299 - RNA, 18 nt, Human
ggacagggaagggggugg

SEQ ID NO: 1353300 - RNA, 18 nt, Human
ggagagccagcguugaga

SEQ ID NO: 1353301 - RNA, 23 nt, Human
ggaugcagugacagcagccugga

SEQ ID NO: 1353302 - RNA, 21 nt, Human
ggaugcugaggccaggggugc

SEQ ID NO: 1353303 - RNA, 20 nt, Human
ggcagcccccaggccccagg

SEQ ID NO: 1353304 - RNA, 21 nt, Human
ggcagcccccaggccccaggc

SEQ ID NO: 1353305 - RNA, 21 nt, Human
ggcccagggucuggcuggacc

SEQ ID NO: 1353306 - RNA, 22 nt, Human
ggccgcgguaccaguggcaggu

SEQ ID NO: 1353307 - RNA, 18 nt, Human
gggaggacauugggugcu

SEQ ID NO: 1353308 - RNA, 20 nt, Human
gggauugcgcuguggguucc

SEQ ID NO: 1353309 - RNA, 27 nt, Human
gggcagcagagcugacagaguccugga

SEQ ID NO: 1353310 - RNA, 22 nt, Human
gggcagcccccaggccccaggc

SEQ ID NO: 1353311 - RNA, 22 nt, Human
gggccgcgguaccaguggcagg

SEQ ID NO: 1353312 - RNA, 20 nt, Human
ggggaaggacagggaagggg

SEQ ID NO: 1353313 - RNA, 19 nt, Human
ggguggcaugugggagagg

SEQ ID NO: 1353314 - RNA, 22 nt, Human
ggguguggagagggagacccag

SEQ ID NO: 1353315 - RNA, 21 nt, Human
ggugcugggcaguggugggug

SEQ ID NO: 1353316 - RNA, 19 nt, Human
gucauggaaugguguuuuc

SEQ ID NO: 1353317 - RNA, 22 nt, Human
gugcugggcagugguggguggg

SEQ ID NO: 1353318 - RNA, 24 nt, Human
gugcugggcagugguggguggggc

SEQ ID NO: 1353319 - RNA, 22 nt, Human
gugggcagcagagcugacagag

SEQ ID NO: 1353320 - RNA, 21 nt, Human
uaaaaaaauagcucuauuccc

SEQ ID NO: 1353321 - RNA, 23 nt, Human
uaaagucagagcaguccaaaggc

SEQ ID NO: 1353322 - RNA, 22 nt, Human
uaagacugagcucagagaccug

SEQ ID NO: 1353323 - RNA, 19 nt, Human
uaagcucucugucccugga

SEQ ID NO: 1353324 - RNA, 25 nt, Human
uaccagcugggccauucuuggauua

SEQ ID NO: 1353325 - RNA, 19 nt, Human
uagagcagggaggaggcag

SEQ ID NO: 1353326 - RNA, 20 nt, Human
uagcucuauuccccuggccc

SEQ ID NO: 1353327 - RNA, 21 nt, Human
uaggagcaucuugcaauccag

SEQ ID NO: 1353328 - RNA, 22 nt, Human
uaggagcaucuugcaauccagu

SEQ ID NO: 1353329 - RNA, 22 nt, Human
ucagaacugucacgccugugcu

SEQ ID NO: 1353330 - RNA, 23 nt, Human
ucagagcaguccaaaggcaggag

SEQ ID NO: 1353331 - RNA, 24 nt, Human
ucagguccuggugcagugaggaga

SEQ ID NO: 1353332 - RNA, 21 nt, Human
ucauggaaugguguuuucuua

SEQ ID NO: 1353333 - RNA, 18 nt, Human
uccagcagccaccccuga

SEQ ID NO: 1353334 - RNA, 20 nt, Human
uccccuggcccuucuccuga

SEQ ID NO: 1353335 - RNA, 20 nt, Human
uccccuggcccuucuccugg

SEQ ID NO: 1353336 - RNA, 24 nt, Human
uccccuggcccuucuccuggccau

SEQ ID NO: 1353337 - RNA, 23 nt, Human
uccuggaugcagugacagcagcc

SEQ ID NO: 1353338 - RNA, 22 nt, Human
ucuaggcuguggcuccgagugu

SEQ ID NO: 1353339 - RNA, 23 nt, Human
ucucccacugagcccagaccaaa

SEQ ID NO: 1353340 - RNA, 18 nt, Human
ucuccuggccaucucuga

SEQ ID NO: 1353341 - RNA, 18 nt, Human
ucugcgagucucccugcc

SEQ ID NO: 1353342 - RNA, 19 nt, Human
ucugucccuggagguaugc

SEQ ID NO: 1353343 - RNA, 21 nt, Human
ugacagcagccuggagacgac

SEQ ID NO: 1353344 - RNA, 25 nt, Human
ugcacugccaucucccacugagccc

SEQ ID NO: 1353345 - RNA, 23 nt, Human
ugccaucucccacugagcccaga

SEQ ID NO: 1353346 - RNA, 22 nt, Human
ugccauggacagagccacagaa

SEQ ID NO: 1353347 - RNA, 23 nt, Human
ugccguguuagcagcucacucuu

SEQ ID NO: 1353348 - RNA, 26 nt, Human
ugccuaaauccucacuuucuuggcau

SEQ ID NO: 1353349 - RNA, 22 nt, Human
ugccuggcagacaucacucauu

SEQ ID NO: 1353350 - RNA, 20 nt, Human
ugccuucgggauucuuuagc

SEQ ID NO: 1353351 - RNA, 22 nt, Human
uggaaagccugaggggaggcug

SEQ ID NO: 1353352 - RNA, 19 nt, Human
uggaccaaagagggcgcug

SEQ ID NO: 1353353 - RNA, 20 nt, Human
uggagagaagagggcucagg

SEQ ID NO: 1353354 - RNA, 20 nt, Human
uggagagaagagggcucagg

SEQ ID NO: 1353355 - RNA, 20 nt, Human
uggagguaugcaagagggug

SEQ ID NO: 1353356 - RNA, 22 nt, Human
uggcagacaucacuaaucaaac

SEQ ID NO: 1353357 - RNA, 21 nt, Human
uggcagacaucacucauuagg

SEQ ID NO: 1353358 - RNA, 20 nt, Human
uggcugacuugcccucucuu

SEQ ID NO: 1353359 - RNA, 18 nt, Human
uggcuugugagacagaau

SEQ ID NO: 1353360 - RNA, 19 nt, Human
ugggagguaguaagcucuc

SEQ ID NO: 1353361 - RNA, 26 nt, Human
ugggaugccauggacagagccacagg

SEQ ID NO: 1353362 - RNA, 19 nt, Human
uggggagguaggagcgagg

SEQ ID NO: 1353363 - RNA, 20 nt, Human
uggggaguuggggaaggaca

SEQ ID NO: 1353364 - RNA, 22 nt, Human
uggugacuggaaagccugaggg

SEQ ID NO: 1353365 - RNA, 21 nt, Human
uggugggagggcaaggacugg

SEQ ID NO: 1353366 - RNA, 21 nt, Human
ugguggguggggcgagucuuc

SEQ ID NO: 1353367 - RNA, 21 nt, Human
uguagagcagggaggaggcag

SEQ ID NO: 1353368 - RNA, 21 nt, Human
ugugaugugcaccucugugug

SEQ ID NO: 1353369 - RNA, 19 nt, Human
ugugggugguucaagaggg

SEQ ID NO: 1353370 - RNA, 21 nt, Human
uugccuaaauccucacuuucu

SEQ ID NO: 1353371 - RNA, 23 nt, Human
uuggggaaggacagggaaggggg

SEQ ID NO: 1353372 - RNA, 25 nt, Human
uuggggaaggacagggaagggggug

SEQ ID NO: 1353373 - RNA, 24 nt, Human
uuggucucuagagcagccugcauc

SEQ ID NO: 1353374 - RNA, 21 nt, Human
uuucuuggcaucagguccugg

SEQ ID NO: 1353375 - RNA, 18 nt, Human
uuuguccucauuuuguuu

SEQ ID NO: 1353376 - RNA, 24 nt, Human
aaagugcugggauuguaggcauga

SEQ ID NO: 1353377 - RNA, 19 nt, Human
aacaugucucuugccccca

SEQ ID NO: 1353378 - RNA, 22 nt, Human
aacccaaccagcuaccaccgcu

SEQ ID NO: 1353379 - RNA, 23 nt, Human
aaccccugggcucaaaugauccu

SEQ ID NO: 1353380 - RNA, 19 nt, Human
aacuggcaccauuggcaga

SEQ ID NO: 1353381 - RNA, 23 nt, Human
aagaagagugaggaggaggagga

SEQ ID NO: 1353382 - RNA, 18 nt, Human
aagagugaggaggaggag

SEQ ID NO: 1353383 - RNA, 19 nt, Human
aaggaaacuggcaccauug

SEQ ID NO: 1353384 - RNA, 23 nt, Human
aaggagacccccggcagcaacca

SEQ ID NO: 1353385 - RNA, 19 nt, Human
aaguagcugggacuacagg

SEQ ID NO: 1353386 - RNA, 20 nt, Human
aaguagcugggacuacaggu

SEQ ID NO: 1353387 - RNA, 26 nt, Human
aaguagcugggacuacagguacacac

SEQ ID NO: 1353388 - RNA, 24 nt, Human
aagugauccuccugcuuuggccuc

SEQ ID NO: 1353389 - RNA, 19 nt, Human
aagugcugggauuguaggc

SEQ ID NO: 1353390 - RNA, 21 nt, Human
aagugcugggauuguaggcau

SEQ ID NO: 1353391 - RNA, 24 nt, Human
aaucacuugaucccaggaggcgga

SEQ ID NO: 1353392 - RNA, 24 nt, Human
acaaagugagacucugucucaaaa

SEQ ID NO: 1353393 - RNA, 20 nt, Human
acaacaaccgagccccagca

SEQ ID NO: 1353394 - RNA, 18 nt, Human
acagaaggagacccccgg

SEQ ID NO: 1353395 - RNA, 19 nt, Human
acagacagugcccugggac

SEQ ID NO: 1353396 - RNA, 23 nt, Human
acaggcaaggcauggggaacgug

SEQ ID NO: 1353397 - RNA, 20 nt, Human
acaucauuaguagagucgag

SEQ ID NO: 1353398 - RNA, 23 nt, Human
accagcuaccaccgcuuucccag

SEQ ID NO: 1353399 - RNA, 22 nt, Human
accagugccaucccuagcccca

SEQ ID NO: 1353400 - RNA, 18 nt, Human
acuacaacaaccgagccc

SEQ ID NO: 1353401 - RNA, 21 nt, Human
acuccagcuuaggugacaaag

SEQ ID NO: 1353402 - RNA, 26 nt, Human
acuguacuccagcuuaggacaacggg

SEQ ID NO: 1353403 - RNA, 20 nt, Human
acuguacuccagcuuaggug

SEQ ID NO: 1353404 - RNA, 24 nt, Human
agcaggacaggcaaggcaugggga

SEQ ID NO: 1353405 - RNA, 18 nt, Human
agcccgagagggcuugcu

SEQ ID NO: 1353406 - RNA, 24 nt, Human
agcuuaggugacaaagugagacuc

SEQ ID NO: 1353407 - RNA, 19 nt, Human
aggacgugacugcuagaaa

SEQ ID NO: 1353408 - RNA, 23 nt, Human
aggaggcuaaggcaggagaauca

SEQ ID NO: 1353409 - RNA, 21 nt, Human
aggcaaggcauggggaacgug

SEQ ID NO: 1353410 - RNA, 18 nt, Human
aggcaggagaaucacuug

SEQ ID NO: 1353411 - RNA, 21 nt, Human
aggcggaaguugcagugagcc

SEQ ID NO: 1353412 - RNA, 24 nt, Human
aggcggaaguugcagugagccgag

SEQ ID NO: 1353413 - RNA, 24 nt, Human
aggcuaaggcaggagaaucacuug

SEQ ID NO: 1353414 - RNA, 19 nt, Human
aggcucaagugauccuccu

SEQ ID NO: 1353415 - RNA, 23 nt, Human
auagcaguuacuggagcccagca

SEQ ID NO: 1353416 - RNA, 22 nt, Human
auauguguguguauguauacau

SEQ ID NO: 1353417 - RNA, 20 nt, Human
auccaggcuggagugcgaca

SEQ ID NO: 1353418 - RNA, 22 nt, Human
aucgcgcacuguacuccagcuu

SEQ ID NO: 1353419 - RNA, 19 nt, Human
auggagcagagggcagcug

SEQ ID NO: 1353420 - RNA, 22 nt, Human
auggcggccugacucagggcug

SEQ ID NO: 1353421 - RNA, 24 nt, Human
caaagugcugggauuguaggcaug

SEQ ID NO: 1353422 - RNA, 27 nt, Human
caaaugauccuuccaccucagccuccc

SEQ ID NO: 1353423 - RNA, 27 nt, Human
caaaugauccuuccaccucagccuccc

SEQ ID NO: 1353424 - RNA, 23 nt, Human
caacaaccgagccccagcaaccc

SEQ ID NO: 1353425 - RNA, 31 nt, Human
caacccaaccagcuaccaccgcuuucccagg

SEQ ID NO: 1353426 - RNA, 22 nt, Human
caagugauccuccugcuuuggc

SEQ ID NO: 1353427 - RNA, 27 nt, Human
caagugauccuccugcuuuggccuccc

SEQ ID NO: 1353428 - RNA, 18 nt, Human
cacaccacuaaauccaga

SEQ ID NO: 1353429 - RNA, 22 nt, Human
cacauggcuaagugucugggug

SEQ ID NO: 1353430 - RNA, 24 nt, Human
caccucagccucccaaguagcugg

SEQ ID NO: 1353431 - RNA, 20 nt, Human
cacuaaaugcugagugucca

SEQ ID NO: 1353432 - RNA, 19 nt, Human
cacuguacuccagcuuagg

SEQ ID NO: 1353433 - RNA, 19 nt, Human
cacuguacuccagcuuagg

SEQ ID NO: 1353434 - RNA, 19 nt, Human
cacuguacuccagcuuagg

SEQ ID NO: 1353435 - RNA, 23 nt, Human
cacuguacuccagcuuaggugac

SEQ ID NO: 1353436 - RNA, 25 nt, Human
cacuguacuccagcuuaggugacaa

SEQ ID NO: 1353437 - RNA, 19 nt, Human
cagcuaccaccgcuuuccc

SEQ ID NO: 1353438 - RNA, 19 nt, Human
cagcuaccaccgcuuuccc

SEQ ID NO: 1353439 - RNA, 19 nt, Human
caggacaggcaaggcaugg

SEQ ID NO: 1353440 - RNA, 19 nt, Human
caggacaggcaaggcaugg

SEQ ID NO: 1353441 - RNA, 20 nt, Human
caugagccuaucuuagagaa

SEQ ID NO: 1353442 - RNA, 24 nt, Human
ccaaagugcugggauuguaggcau

SEQ ID NO: 1353443 - RNA, 23 nt, Human
ccacagugagacucccaagcccc

SEQ ID NO: 1353444 - RNA, 23 nt, Human
ccagcaacccaaccagcuaccac

SEQ ID NO: 1353445 - RNA, 18 nt, Human
ccagccuggcuggcagcc

SEQ ID NO: 1353446 - RNA, 20 nt, Human
ccaguauuuuggaauuaccu

SEQ ID NO: 1353447 - RNA, 23 nt, Human
cccaaguagcugggacuacaggu

SEQ ID NO: 1353448 - RNA, 24 nt, Human
cccaaguagcugggacuacaggua

SEQ ID NO: 1353449 - RNA, 24 nt, Human
ccccagcaacccaaccagcuacca

SEQ ID NO: 1353450 - RNA, 19 nt, Human
ccccaguacccucaucacc

SEQ ID NO: 1353451 - RNA, 22 nt, Human
ccccaguacccucaucacccug

SEQ ID NO: 1353452 - RNA, 21 nt, Human
cccccaguacccucaucaccc

SEQ ID NO: 1353453 - RNA, 24 nt, Human
cccccaguacccucaucacccugu

SEQ ID NO: 1353454 - RNA, 25 nt, Human
ccccugggcucaaaugauccuucca

SEQ ID NO: 1353455 - RNA, 24 nt, Human
ccuagccccagcucuagcaauggc

SEQ ID NO: 1353456 - RNA, 21 nt, Human
ccuaggcucaagugauccucc

SEQ ID NO: 1353457 - RNA, 22 nt, Human
ccuaggcucaagugauccuccu

SEQ ID NO: 1353458 - RNA, 24 nt, Human
ccugcuuuggccucccaaagugcu

SEQ ID NO: 1353459 - RNA, 22 nt, Human
ccugggcucaaaugauccuucc

SEQ ID NO: 1353460 - RNA, 26 nt, Human
ccuuccaccucagccucccaaguagc

SEQ ID NO: 1353461 - RNA, 21 nt, Human
cgacuacaacaaccgagcccc

SEQ ID NO: 1353462 - RNA, 23 nt, Human
cguacacuuauaaauaagaguac

SEQ ID NO: 1353463 - RNA, 24 nt, Human
cuacaacaaccgagccccagcaac

SEQ ID NO: 1353464 - RNA, 24 nt, Human
cucaaaugauccuuccaccucagc

SEQ ID NO: 1353465 - RNA, 18 nt, Human
cucaagugauccuccugc

SEQ ID NO: 1353466 - RNA, 24 nt, Human
cucaagugauccuccugcuuuggc

SEQ ID NO: 1353467 - RNA, 24 nt, Human
cucagccucccaaguagcugggac

SEQ ID NO: 1353468 - RNA, 19 nt, Human
cugaagcuucaaaccccug

SEQ ID NO: 1353469 - RNA, 22 nt, Human
cugcaaacaugucucuugcccc

SEQ ID NO: 1353470 - RNA, 18 nt, Human
cuggccacacagaaggag

SEQ ID NO: 1353471 - RNA, 21 nt, Human
cuuaagccuaugcuucccaag

SEQ ID NO: 1353472 - RNA, 18 nt, Human
cuugcacagacagugccc

SEQ ID NO: 1353473 - RNA, 24 nt, Human
gacaaagugagacucugucucaaa

SEQ ID NO: 1353474 - RNA, 23 nt, Human
gagaaucacuugaucccaggagg

SEQ ID NO: 1353475 - RNA, 21 nt, Human
gagacagggucuugcucuauc

SEQ ID NO: 1353476 - RNA, 20 nt, Human
gagaggguagggggcaagaa

SEQ ID NO: 1353477 - RNA, 23 nt, Human
gagaggguagggggcaagaagag

SEQ ID NO: 1353478 - RNA, 20 nt, Human
gagcagagggcagcugagcc

SEQ ID NO: 1353479 - RNA, 18 nt, Human
gagcagcucaaggcuugc

SEQ ID NO: 1353480 - RNA, 21 nt, Human
gaggaggaggaggaccaccag

SEQ ID NO: 1353481 - RNA, 18 nt, Human
gauucugagaugcaaguc

SEQ ID NO: 1353482 - RNA, 20 nt, Human
gauuguaggcaugagccuau

SEQ ID NO: 1353483 - RNA, 19 nt, Human
gcacuguacuccagcuuag

SEQ ID NO: 1353484 - RNA, 21 nt, Human
gcacuguacuccagcuuaggu

SEQ ID NO: 1353485 - RNA, 22 nt, Human
gcaggagaaucacuugauccca

SEQ ID NO: 1353486 - RNA, 22 nt, Human
gcaguguggagaggguaggggg

SEQ ID NO: 1353487 - RNA, 19 nt, Human
gcucaagugauccuccugc

SEQ ID NO: 1353488 - RNA, 22 nt, Human
gcuuuggccucccaaagugcug

SEQ ID NO: 1353489 - RNA, 24 nt, Human
ggaaguugcagugagccgagaucg

SEQ ID NO: 1353490 - RNA, 20 nt, Human
ggcaagaagagugaggagga

SEQ ID NO: 1353491 - RNA, 20 nt, Human
gggcagcugagcagcucaag

SEQ ID NO: 1353492 - RNA, 19 nt, Human
ggguguggcgguacacacc

SEQ ID NO: 1353493 - RNA, 24 nt, Human
ggguguggcgguacacaccuguaa

SEQ ID NO: 1353494 - RNA, 22 nt, Human
gguacacaccuguaaacccaga

SEQ ID NO: 1353495 - RNA, 18 nt, Human
ggugcaggacgugacugc

SEQ ID NO: 1353496 - RNA, 23 nt, Human
guaacccauauauguguguguau

SEQ ID NO: 1353497 - RNA, 20 nt, Human
guagagucgagucugcugac

SEQ ID NO: 1353498 - RNA, 24 nt, Human
gucuugcucuaucauccaggcugg

SEQ ID NO: 1353499 - RNA, 24 nt, Human
gugacaaagugagacucugucuca

SEQ ID NO: 1353500 - RNA, 19 nt, Human
guguauguauacauaugca

SEQ ID NO: 1353501 - RNA, 25 nt, Human
guguauguauacauaugcaccuacu

SEQ ID NO: 1353502 - RNA, 19 nt, Human
guugcagugagccgagauc

SEQ ID NO: 1353503 - RNA, 21 nt, Human
guugcagugagccgagaucgc

SEQ ID NO: 1353504 - RNA, 22 nt, Human
uaaacccagauacucaggaggc

SEQ ID NO: 1353505 - RNA, 25 nt, Human
uaaacccagauacucaggaggcuaa

SEQ ID NO: 1353506 - RNA, 20 nt, Human
uaagaguacugauaccagua

SEQ ID NO: 1353507 - RNA, 20 nt, Human
uaaggcaggagaaucacuug

SEQ ID NO: 1353508 - RNA, 24 nt, Human
uaaggcaggagaaucacuugaucc

SEQ ID NO: 1353509 - RNA, 25 nt, Human
uaaggcaggagaaucacuugauccc

SEQ ID NO: 1353510 - RNA, 22 nt, Human
uacuccagcuuaggugacaaag

SEQ ID NO: 1353511 - RNA, 24 nt, Human
uacuccagcuuaggugacaaagug

SEQ ID NO: 1353512 - RNA, 18 nt, Human
uagagacagggucuugcu

SEQ ID NO: 1353513 - RNA, 18 nt, Human
uagcaguuacuggagccc

SEQ ID NO: 1353514 - RNA, 21 nt, Human
uagccccagcucuagcaaugg

SEQ ID NO: 1353515 - RNA, 26 nt, Human
uagccccagcucuagcaauggcggcc

SEQ ID NO: 1353516 - RNA, 24 nt, Human
uaggcucaagugauccuccugcuu

SEQ ID NO: 1353517 - RNA, 18 nt, Human
uauauguguguguaugua

SEQ ID NO: 1353518 - RNA, 26 nt, Human
uaugauaaugacgcuuaauguuucca

SEQ ID NO: 1353519 - RNA, 18 nt, Human
uauggagcagagggcagc

SEQ ID NO: 1353520 - RNA, 19 nt, Human
uauguugcccaggcuaguc

SEQ ID NO: 1353521 - RNA, 24 nt, Human
uauguugcccaggcuagucuccaa

SEQ ID NO: 1353522 - RNA, 27 nt, Human
uauguugcccaggcuagucuccaauuc

SEQ ID NO: 1353523 - RNA, 19 nt, Human
uauuaauuuuuugguaggg

SEQ ID NO: 1353524 - RNA, 22 nt, Human
ucaaaaaaaacccgcaaacguu

SEQ ID NO: 1353525 - RNA, 21 nt, Human
ucaaggcuugcuucuccacag

SEQ ID NO: 1353526 - RNA, 22 nt, Human
ucacugaagcuucaaaccccug

SEQ ID NO: 1353527 - RNA, 24 nt, Human
ucacugaagcuucaaaccccuggg

SEQ ID NO: 1353528 - RNA, 18 nt, Human
ucagccucccaaguagcu

SEQ ID NO: 1353529 - RNA, 20 nt, Human
ucagccucccaaguagcugg

SEQ ID NO: 1353530 - RNA, 18 nt, Human
ucauccaggcuggagugc

SEQ ID NO: 1353531 - RNA, 24 nt, Human
uccagcuuaggugacaaagugaga

SEQ ID NO: 1353532 - RNA, 24 nt, Human
ucccaaagugcugggauuguaggc

SEQ ID NO: 1353533 - RNA, 24 nt, Human
ucccaaguagcugggacuacaggu

SEQ ID NO: 1353534 - RNA, 20 nt, Human
uccccagaguuaccaaaagu

SEQ ID NO: 1353535 - RNA, 21 nt, Human
uccuaggcucaagugauccuc

SEQ ID NO: 1353536 - RNA, 24 nt, Human
uccuaggcucaagugauccuccug

SEQ ID NO: 1353537 - RNA, 21 nt, Human
ucuaucaucagcauccaaaaa

SEQ ID NO: 1353538 - RNA, 24 nt, Human
ucuaucauccaggcuggagugcga

SEQ ID NO: 1353539 - RNA, 21 nt, Human
ucucaaaaaaaacccgcaaac

SEQ ID NO: 1353540 - RNA, 19 nt, Human
ucuugcucuaucauccagg

SEQ ID NO: 1353541 - RNA, 23 nt, Human
ucuugcucuaucauccaggcugg

SEQ ID NO: 1353542 - RNA, 24 nt, Human
ucuugcucuaucauccaggcugga

SEQ ID NO: 1353543 - RNA, 19 nt, Human
ugacaaagugagacucugu

SEQ ID NO: 1353544 - RNA, 21 nt, Human
ugagccgagaucgcgcacugu

SEQ ID NO: 1353545 - RNA, 23 nt, Human
ugaggaggaggaggaccaccagu

SEQ ID NO: 1353546 - RNA, 23 nt, Human
ugaggaggaggaggaccaccagu

SEQ ID NO: 1353547 - RNA, 18 nt, Human
ugaguagagcaccguggc

SEQ ID NO: 1353548 - RNA, 24 nt, Human
ugaguagagcaccguggccugcaa

SEQ ID NO: 1353549 - RNA, 22 nt, Human
ugaguguccagcauugcuguuc

SEQ ID NO: 1353550 - RNA, 23 nt, Human
ugcaguguggagaggguaggggg

SEQ ID NO: 1353551 - RNA, 24 nt, Human
ugcucuaucauccaggcuggagug

SEQ ID NO: 1353552 - RNA, 24 nt, Human
uggaacauaguaaguauucuguau

SEQ ID NO: 1353553 - RNA, 22 nt, Human
uggcagccuaccgcggccacgc

SEQ ID NO: 1353554 - RNA, 21 nt, Human
ugggacuacagguacacacca

SEQ ID NO: 1353555 - RNA, 22 nt, Human
ugggacuacagguacacaccac

SEQ ID NO: 1353556 - RNA, 24 nt, Human
ugggacuacagguacacaccacua

SEQ ID NO: 1353557 - RNA, 18 nt, Human
ugggauuguaggcaugag

SEQ ID NO: 1353558 - RNA, 19 nt, Human
ugggauuguaggcaugagc

SEQ ID NO: 1353559 - RNA, 19 nt, Human
ugggauuguaggcaugagc

SEQ ID NO: 1353560 - RNA, 20 nt, Human
ugggauuguaggcaugagcc

SEQ ID NO: 1353561 - RNA, 22 nt, Human
ugggauuguaggcaugagccua

SEQ ID NO: 1353562 - RNA, 24 nt, Human
uggggucucgguauguugcccagg

SEQ ID NO: 1353563 - RNA, 20 nt, Human
ugguagggauggggucucgg

SEQ ID NO: 1353564 - RNA, 24 nt, Human
ugguagggauggggucucgguaug

SEQ ID NO: 1353565 - RNA, 25 nt, Human
uguauacauaugcaccuacuaugua

SEQ ID NO: 1353566 - RNA, 18 nt, Human
uguauguauacauaugca

SEQ ID NO: 1353567 - RNA, 18 nt, Human
uguguauguauacauaug

SEQ ID NO: 1353568 - RNA, 20 nt, Human
uguguguauguauacauaug

SEQ ID NO: 1353569 - RNA, 18 nt, Human
uguguguguauguauaca

SEQ ID NO: 1353570 - RNA, 20 nt, Human
uguguguguauguauacaua

SEQ ID NO: 1353571 - RNA, 23 nt, Human
uguugagcaaaugaaggaaacug

SEQ ID NO: 1353572 - RNA, 19 nt, Human
uuaagccuaugcuucccaa

SEQ ID NO: 1353573 - RNA, 19 nt, Human
uucuuugucuugcacagac

SEQ ID NO: 1353574 - RNA, 22 nt, Human
uugcagugagccgagaucgcgc

SEQ ID NO: 1353575 - RNA, 24 nt, Human
uugcucuaucauccaggcuggagu

SEQ ID NO: 1353576 - RNA, 24 nt, Human
uugguagggauggggucucgguau

SEQ ID NO: 1353577 - RNA, 25 nt, Human
uuuaaauuuuaacacuuaaaaagug

SEQ ID NO: 1353578 - RNA, 19 nt, Human
uuuggccucccaaagugcu

SEQ ID NO: 1353579 - RNA, 20 nt, Human
uuugucuugcacagacagug

SEQ ID NO: 1353580 - RNA, 19 nt, Human
uuuuugguagggauggggu

SEQ ID NO: 1353581 - RNA, 24 nt, Human
uuuuuugguagggauggggucucg

SEQ ID NO: 1353582 - RNA, 22 nt, Human
aaaagaaagaaauucuggccaa

SEQ ID NO: 1353583 - RNA, 26 nt, Human
aaacaaaaaaaagaaagaaauucugg

SEQ ID NO: 1353584 - RNA, 22 nt, Human
aaacaaaaacaaaaaaaagaaa

SEQ ID NO: 1353585 - RNA, 22 nt, Human
aacacaaggaauacuuuuauac

SEQ ID NO: 1353586 - RNA, 23 nt, Human
aagcaacacacaacagcauggga

SEQ ID NO: 1353587 - RNA, 25 nt, Human
aaguagccaggacaguguccagaug

SEQ ID NO: 1353588 - RNA, 19 nt, Human
aauaacacaaggaauacuu

SEQ ID NO: 1353589 - RNA, 22 nt, Human
acauugcguuuaaauccuuagu

SEQ ID NO: 1353590 - RNA, 20 nt, Human
accuuuuuuuuuacccacuu

SEQ ID NO: 1353591 - RNA, 28 nt, Human
agaaauaacacaaggaauaccgguaccc

SEQ ID NO: 1353592 - RNA, 18 nt, Human
agaacuacauacaaagca

SEQ ID NO: 1353593 - RNA, 18 nt, Human
agcaagaauaagugacac

SEQ ID NO: 1353594 - RNA, 19 nt, Human
agcaugggaacaagagccc

SEQ ID NO: 1353595 - RNA, 21 nt, Human
aggaggcccaugauagcauuu

SEQ ID NO: 1353596 - RNA, 22 nt, Human
aggcuuucuuuugaucccuguu

SEQ ID NO: 1353597 - RNA, 24 nt, Human
agggccccagugagacccugcccc

SEQ ID NO: 1353598 - RNA, 24 nt, Human
aguacugggaagaccugaaccacc

SEQ ID NO: 1353599 - RNA, 20 nt, Human
auauccuuauuuccccaaaa

SEQ ID NO: 1353600 - RNA, 18 nt, Human
auccauugauguuucagc

SEQ ID NO: 1353601 - RNA, 18 nt, Human
aucuggaauggcaugaga

SEQ ID NO: 1353602 - RNA, 21 nt, Human
caacacacaacagcaugggaa

SEQ ID NO: 1353603 - RNA, 19 nt, Human
caacauggggcagaggggc

SEQ ID NO: 1353604 - RNA, 21 nt, Human
caacauggggcagaggggccc

SEQ ID NO: 1353605 - RNA, 21 nt, Human
cacuagaaagucagaaaacag

SEQ ID NO: 1353606 - RNA, 24 nt, Human
cagauuggaaacagagaccauuua

SEQ ID NO: 1353607 - RNA, 18 nt, Human
cauacagagaaguuuuag

SEQ ID NO: 1353608 - RNA, 19 nt, Human
cauccccgcuuccacuccc

SEQ ID NO: 1353609 - RNA, 24 nt, Human
cauucagcaaacacuggugagcac

SEQ ID NO: 1353610 - RNA, 25 nt, Human
ccuaauauccuuauuuccccaaaaa

SEQ ID NO: 1353611 - RNA, 21 nt, Human
ccuggacuaggacuuaaggac

SEQ ID NO: 1353612 - RNA, 22 nt, Human
ccuggacuaggacuuaaggacc

SEQ ID NO: 1353613 - RNA, 26 nt, Human
cgaaugccugucaucccaggagcucc

SEQ ID NO: 1353614 - RNA, 18 nt, Human
cuagaaagucagaaaaca

SEQ ID NO: 1353615 - RNA, 24 nt, Human
cucacacacauauaaacacuguau

SEQ ID NO: 1353616 - RNA, 18 nt, Human
cucagcaagaauaaguga

SEQ ID NO: 1353617 - RNA, 25 nt, Human
cugaccuaauauccuuauuucccca

SEQ ID NO: 1353618 - RNA, 21 nt, Human
cuggaauggugucccugaagu

SEQ ID NO: 1353619 - RNA, 19 nt, Human
gcaacacacaacagcaugg

SEQ ID NO: 1353620 - RNA, 22 nt, Human
gccaagaacuacauacaaagca

SEQ ID NO: 1353621 - RNA, 19 nt, Human
gccccagugagacccugcc

SEQ ID NO: 1353622 - RNA, 18 nt, Human
gcccugcaaagagugggc

SEQ ID NO: 1353623 - RNA, 22 nt, Human
gcugacacaguaccugaucuua

SEQ ID NO: 1353624 - RNA, 22 nt, Human
ggaaggcauccccgcuuccacu

SEQ ID NO: 1353625 - RNA, 18 nt, Human
ggagacagauuggaaaca

SEQ ID NO: 1353626 - RNA, 23 nt, Human
ggagacagauuggaaacagagac

SEQ ID NO: 1353627 - RNA, 20 nt, Human
ggauggccagaaaucuggaa

SEQ ID NO: 1353628 - RNA, 19 nt, Human
gggaagaccugaaccacca

SEQ ID NO: 1353629 - RNA, 27 nt, Human
gggccaggcccagggugcuucagaaga

SEQ ID NO: 1353630 - RNA, 18 nt, Human
ggggcagaggggcccugc

SEQ ID NO: 1353631 - RNA, 22 nt, Human
uaaaauagggcccaggauugcu

SEQ ID NO: 1353632 - RNA, 24 nt, Human
uaaauugcugaccuaauauccuua

SEQ ID NO: 1353633 - RNA, 18 nt, Human
uaaccaaaaaacaaaaac

SEQ ID NO: 1353634 - RNA, 20 nt, Human
uaaccaaaaaacaaaaacaa

SEQ ID NO: 1353635 - RNA, 23 nt, Human
uaaccaaaaaacaaaaacaaaaa

SEQ ID NO: 1353636 - RNA, 26 nt, Human
uaaccaaaaaacaaaaacaaaaaaaa

SEQ ID NO: 1353637 - RNA, 19 nt, Human
uaaccaaaaaacaaaaacc

SEQ ID NO: 1353638 - RNA, 22 nt, Human
uaaggugguaucugccagguuu

SEQ ID NO: 1353639 - RNA, 21 nt, Human
uaagugacacugucuccuuuu

SEQ ID NO: 1353640 - RNA, 25 nt, Human
uacagcauauaagcucaucuguaaa

SEQ ID NO: 1353641 - RNA, 26 nt, Human
uacuuugaucaccugguuaagguggg

SEQ ID NO: 1353642 - RNA, 18 nt, Human
uagcauuuguuacauauu

SEQ ID NO: 1353643 - RNA, 19 nt, Human
uaggacuuaaggacaggga

SEQ ID NO: 1353644 - RNA, 20 nt, Human
uauccuuauuuccccaaaaa

SEQ ID NO: 1353645 - RNA, 27 nt, Human
uauuacuuuuuucuggaaacauuugag

SEQ ID NO: 1353646 - RNA, 23 nt, Human
ucagaagaggccuguggaaggca

SEQ ID NO: 1353647 - RNA, 21 nt, Human
uccauaugccauauuugaggg

SEQ ID NO: 1353648 - RNA, 22 nt, Human
ucccagaguacugggaagaccc

SEQ ID NO: 1353649 - RNA, 18 nt, Human
uccccaccucuucucaug

SEQ ID NO: 1353650 - RNA, 18 nt, Human
ucccccagcauauuccca

SEQ ID NO: 1353651 - RNA, 19 nt, Human
ucccccagcauauucccag

SEQ ID NO: 1353652 - RNA, 18 nt, Human
uccccgcuuccacucccc

SEQ ID NO: 1353653 - RNA, 23 nt, Human
ucuucuacuuugccccugccuac

SEQ ID NO: 1353654 - RNA, 19 nt, Human
ugcuuuaucauacucucuc

SEQ ID NO: 1353655 - RNA, 26 nt, Human
uggaaacagagaccauuuacuucuga

SEQ ID NO: 1353656 - RNA, 25 nt, Human
uggccagaaaucuggaauggcauga

SEQ ID NO: 1353657 - RNA, 19 nt, Human
ugggaagaccugaaccacc

SEQ ID NO: 1353658 - RNA, 22 nt, Human
uguaaauauuguuucucauacc

SEQ ID NO: 1353659 - RNA, 27 nt, Human
uguaaccaaaaaacaaaaacaaaaaaa

SEQ ID NO: 1353660 - RNA, 23 nt, Human
ugucuugucucuuuaaaugagca

SEQ ID NO: 1353661 - RNA, 22 nt, Human
ugucuuguuuccuuaugauuaa

SEQ ID NO: 1353662 - RNA, 25 nt, Human
uguuuuaucauccauugauguuuca

SEQ ID NO: 1353663 - RNA, 21 nt, Human
uucagaguuagggcaacaugg

SEQ ID NO: 1353664 - RNA, 20 nt, Human
uugaggcuauguaaauauug

SEQ ID NO: 1353665 - RNA, 21 nt, Human
aaaaccuucccuauuccacag

SEQ ID NO: 1353666 - RNA, 24 nt, Human
aaagugcugggauuacaggcauga

SEQ ID NO: 1353667 - RNA, 21 nt, Human
aaauaacaaaaacauaaaaag

SEQ ID NO: 1353668 - RNA, 23 nt, Human
aacucaauuuuucuugcuagcau

SEQ ID NO: 1353669 - RNA, 19 nt, Human
aaggacauguuugcuuccc

SEQ ID NO: 1353670 - RNA, 21 nt, Human
aagguucaccauguuggccag

SEQ ID NO: 1353671 - RNA, 19 nt, Human
aaguagcugggauuacagg

SEQ ID NO: 1353672 - RNA, 19 nt, Human
aagugcugggauuacaggc

SEQ ID NO: 1353673 - RNA, 21 nt, Human
aagugcugggauuacaggcau

SEQ ID NO: 1353674 - RNA, 25 nt, Human
aauaacaaaaacauaaaaagaggga

SEQ ID NO: 1353675 - RNA, 22 nt, Human
aaugaagccuuagaaaaaaccu

SEQ ID NO: 1353676 - RNA, 24 nt, Human
aauguacaaucauguagccucuuu

SEQ ID NO: 1353677 - RNA, 21 nt, Human
aauuagccgggcaugggaagc

SEQ ID NO: 1353678 - RNA, 25 nt, Human
acaaaacacaaauaacaaaaacaua

SEQ ID NO: 1353679 - RNA, 18 nt, Human
acaauaaugaagccuuag

SEQ ID NO: 1353680 - RNA, 21 nt, Human
acaccacugcacucuagccug

SEQ ID NO: 1353681 - RNA, 23 nt, Human
acaggcgcccaccaccacacucg

SEQ ID NO: 1353682 - RNA, 18 nt, Human
accaccacacucggcuca

SEQ ID NO: 1353683 - RNA, 24 nt, Human
accauguuggccaggcuggucucg

SEQ ID NO: 1353684 - RNA, 24 nt, Human
acucuagccugggacauagaguga

SEQ ID NO: 1353685 - RNA, 24 nt, Human
acucuuguugcccaggcuggagug

SEQ ID NO: 1353686 - RNA, 25 nt, Human
acugaaauauuuauuuucuucaaaa

SEQ ID NO: 1353687 - RNA, 18 nt, Human
acugcacucuagccuggg

SEQ ID NO: 1353688 - RNA, 22 nt, Human
acugcacucuagccugggacau

SEQ ID NO: 1353689 - RNA, 24 nt, Human
acugcacucuagccugggacauag

SEQ ID NO: 1353690 - RNA, 24 nt, Human
acuuuaaaugggugaacugaaggg

SEQ ID NO: 1353691 - RNA, 20 nt, Human
agaaaaaccacucuagcugg

SEQ ID NO: 1353692 - RNA, 26 nt, Human
agaaaaggcaacucuauauaaggaua

SEQ ID NO: 1353693 - RNA, 21 nt, Human
agaagaugaggggauggaaga

SEQ ID NO: 1353694 - RNA, 22 nt, Human
agagugagaccuuaucucaaaa

SEQ ID NO: 1353695 - RNA, 24 nt, Human
agccugggacauagagugagaccu

SEQ ID NO: 1353696 - RNA, 21 nt, Human
agccugggcaagauccugucu

SEQ ID NO: 1353697 - RNA, 21 nt, Human
agcuaugccuuaguacagagc

SEQ ID NO: 1353698 - RNA, 21 nt, Human
aguagagacaagguucaccau

SEQ ID NO: 1353699 - RNA, 23 nt, Human
aguagcugggauuacaggcgccc

SEQ ID NO: 1353700 - RNA, 18 nt, Human
agugcugggauuacaggc

SEQ ID NO: 1353701 - RNA, 25 nt, Human
auaaaacaaaacacaaauaacaaaa

SEQ ID NO: 1353702 - RNA, 20 nt, Human
augaagccuuagaaaaaacc

SEQ ID NO: 1353703 - RNA, 21 nt, Human
auuuuuuuauuuuuaguagag

SEQ ID NO: 1353704 - RNA, 22 nt, Human
auuuuuuuauuuuuaguagaga

SEQ ID NO: 1353705 - RNA, 24 nt, Human
auuuuuuuauuuuuaguagagaca

SEQ ID NO: 1353706 - RNA, 20 nt, Human
caaaacacaaauaacaaaaa

SEQ ID NO: 1353707 - RNA, 24 nt, Human
caaagugcugggauuacaggcaug

SEQ ID NO: 1353708 - RNA, 22 nt, Human
caagaaaauguacuaaaacuca

SEQ ID NO: 1353709 - RNA, 22 nt, Human
caagcgauucuccugucuuagc

SEQ ID NO: 1353710 - RNA, 23 nt, Human
caagguucaccauguuggccagg

SEQ ID NO: 1353711 - RNA, 22 nt, Human
caauaaugaagccuuagaaaaa

SEQ ID NO: 1353712 - RNA, 21 nt, Human
cacaguuuucuccugcccccc

SEQ ID NO: 1353713 - RNA, 21 nt, Human
caccauguuggccaggcuggu

SEQ ID NO: 1353714 - RNA, 24 nt, Human
caccauguuggccaggcuggucuc

SEQ ID NO: 1353715 - RNA, 27 nt, Human
caccauguuggccaggcuggucucgaa

SEQ ID NO: 1353716 - RNA, 21 nt, Human
cacccaaaacucaucaugcau

SEQ ID NO: 1353717 - RNA, 24 nt, Human
cacucuuguugcccaggcuggagu

SEQ ID NO: 1353718 - RNA, 21 nt, Human
cacugcaaccuccgccucccg

SEQ ID NO: 1353719 - RNA, 23 nt, Human
cacugcaaccuccgccucccggg

SEQ ID NO: 1353720 - RNA, 18 nt, Human
cacugcacucuagccugg

SEQ ID NO: 1353721 - RNA, 19 nt, Human
cacugcacucuagccuggg

SEQ ID NO: 1353722 - RNA, 19 nt, Human
cacugcacucuagccuggg

SEQ ID NO: 1353723 - RNA, 22 nt, Human
cacugcacucuagccugggaca

SEQ ID NO: 1353724 - RNA, 21 nt, Human
cacuguacuccaagccugggc

SEQ ID NO: 1353725 - RNA, 24 nt, Human
cacuguacuccaagccugggcaag

SEQ ID NO: 1353726 - RNA, 25 nt, Human
cagaacuauaagucaauuaaaccuc

SEQ ID NO: 1353727 - RNA, 21 nt, Human
caggcgcccaccaccacacuc

SEQ ID NO: 1353728 - RNA, 24 nt, Human
caguaugcagcaaaugaagaaacg

SEQ ID NO: 1353729 - RNA, 23 nt, Human
cauaauagugaguucucacgaga

SEQ ID NO: 1353730 - RNA, 24 nt, Human
cauagagugagaccuuaucucaaa

SEQ ID NO: 1353731 - RNA, 24 nt, Human
cauguuggccaggcuggucucgaa

SEQ ID NO: 1353732 - RNA, 23 nt, Human
cauguuugcuuccccuucugcca

SEQ ID NO: 1353733 - RNA, 23 nt, Human
ccaaagugcugggauuacaggca

SEQ ID NO: 1353734 - RNA, 24 nt, Human
ccaaagugcugggauuacaggcau

SEQ ID NO: 1353735 - RNA, 25 nt, Human
ccaagaacacaggccucccucuccc

SEQ ID NO: 1353736 - RNA, 22 nt, Human
ccaaggguacaggguucuuuau

SEQ ID NO: 1353737 - RNA, 22 nt, Human
ccaaguagcugggauuacaggc

SEQ ID NO: 1353738 - RNA, 19 nt, Human
ccacugcacucuagccugg

SEQ ID NO: 1353739 - RNA, 20 nt, Human
ccacugcacucuagccuggg

SEQ ID NO: 1353740 - RNA, 20 nt, Human
ccacugcacucuagccuggg

SEQ ID NO: 1353741 - RNA, 21 nt, Human
ccacugcacucuagccuggga

SEQ ID NO: 1353742 - RNA, 22 nt, Human
ccacugcacucuagccugggac

SEQ ID NO: 1353743 - RNA, 24 nt, Human
cccaaagugcugggauuacaggca

SEQ ID NO: 1353744 - RNA, 23 nt, Human
cccaaguagcugggauuacaggc

SEQ ID NO: 1353745 - RNA, 23 nt, Human
cccaaguagcugggauuacaggc

SEQ ID NO: 1353746 - RNA, 23 nt, Human
cccggguucaagcgauucuccug

SEQ ID NO: 1353747 - RNA, 24 nt, Human
ccgccucccggguucaagcgauuc

SEQ ID NO: 1353748 - RNA, 21 nt, Human
ccuagcggggugaggggcagg

SEQ ID NO: 1353749 - RNA, 24 nt, Human
ccucccggguucaagcgauucucc

SEQ ID NO: 1353750 - RNA, 22 nt, Human
ccuccugcugcuaaguuagaag

SEQ ID NO: 1353751 - RNA, 19 nt, Human
ccugaccucaagugauccg

SEQ ID NO: 1353752 - RNA, 24 nt, Human
ccugaccucaagugauccgcccac

SEQ ID NO: 1353753 - RNA, 20 nt, Human
ccugaggccuccccagcccu

SEQ ID NO: 1353754 - RNA, 21 nt, Human
ccugcccccccauuuuagcua

SEQ ID NO: 1353755 - RNA, 20 nt, Human
cuacagccaagaacacaggc

SEQ ID NO: 1353756 - RNA, 24 nt, Human
cucaagugauccgcccaccugggc

SEQ ID NO: 1353757 - RNA, 24 nt, Human
cucacugcaaccuccgccucccgg

SEQ ID NO: 1353758 - RNA, 20 nt, Human
cuccugaggccuccccagcc

SEQ ID NO: 1353759 - RNA, 25 nt, Human
cuccugucuuagccucccaaguagc

SEQ ID NO: 1353760 - RNA, 18 nt, Human
cucuuguugcccaggcug

SEQ ID NO: 1353761 - RNA, 23 nt, Human
cugcaaccuccgccucccggguu

SEQ ID NO: 1353762 - RNA, 24 nt, Human
cugcaaccuccgccucccggguuc

SEQ ID NO: 1353763 - RNA, 21 nt, Human
cugggccucccaaagugcugg

SEQ ID NO: 1353764 - RNA, 23 nt, Human
cugucuuagccucccaaguagcu

SEQ ID NO: 1353765 - RNA, 23 nt, Human
cuuagccucccaaguagcuggga

SEQ ID NO: 1353766 - RNA, 24 nt, Human
cuuguugcccaggcuggagugcaa

SEQ ID NO: 1353767 - RNA, 21 nt, Human
gaaaaagccaauuuaaaaaga

SEQ ID NO: 1353768 - RNA, 18 nt, Human
gaagaaggacauguuugc

SEQ ID NO: 1353769 - RNA, 24 nt, Human
gacaagguucaccauguuggccag

SEQ ID NO: 1353770 - RNA, 22 nt, Human
gaccucaagugauccgcccacc

SEQ ID NO: 1353771 - RNA, 22 nt, Human
gauuacaggcaugagcaaaugu

SEQ ID NO: 1353772 - RNA, 19 nt, Human
gcccaggcuggagugcaau

SEQ ID NO: 1353773 - RNA, 20 nt, Human
gccgcuuagugcuagagaag

SEQ ID NO: 1353774 - RNA, 24 nt, Human
gcgauucuccugucuuagccuccc

SEQ ID NO: 1353775 - RNA, 21 nt, Human
gcucaaugagaaagaaaaacc

SEQ ID NO: 1353776 - RNA, 19 nt, Human
gcuggagugcaauggcaca

SEQ ID NO: 1353777 - RNA, 23 nt, Human
gcuggucucgaacuccugaccuc

SEQ ID NO: 1353778 - RNA, 20 nt, Human
ggaagaucccugcagaucag

SEQ ID NO: 1353779 - RNA, 22 nt, Human
ggauuacaggcaugagcaaaug

SEQ ID NO: 1353780 - RNA, 19 nt, Human
ggcgcccaccaccacacuc

SEQ ID NO: 1353781 - RNA, 24 nt, Human
ggcuggucucgaacuccugaccuc

SEQ ID NO: 1353782 - RNA, 20 nt, Human
gggaagcugcaguuagucau

SEQ ID NO: 1353783 - RNA, 19 nt, Human
ggucucgaacuccugaccu

SEQ ID NO: 1353784 - RNA, 18 nt, Human
guagcugggauuacaggc

SEQ ID NO: 1353785 - RNA, 22 nt, Human
gugaaucaagaugcugcuccuu

SEQ ID NO: 1353786 - RNA, 20 nt, Human
gugguccuaacaguaugcag

SEQ ID NO: 1353787 - RNA, 24 nt, Human
uaaaaagagggagacuaugugaua

SEQ ID NO: 1353788 - RNA, 20 nt, Human
uaaaaauggguuauauggua

SEQ ID NO: 1353789 - RNA, 19 nt, Human
uaaaacaaaacacaaauaa

SEQ ID NO: 1353790 - RNA, 24 nt, Human
uaaaacaaaacacaaauaacaaaa

SEQ ID NO: 1353791 - RNA, 26 nt, Human
uaaaacaaaacacaaauaacaaaaac

SEQ ID NO: 1353792 - RNA, 20 nt, Human
uaaaagaacacaacuaucua

SEQ ID NO: 1353793 - RNA, 21 nt, Human
uaaacauaaaacaaaacacaa

SEQ ID NO: 1353794 - RNA, 21 nt, Human
uaaagaaauauaagaaauuag

SEQ ID NO: 1353795 - RNA, 26 nt, Human
uaaaggguacaggguuuguuuguuuu

SEQ ID NO: 1353796 - RNA, 24 nt, Human
uaagaaaagcaagagucuguggua

SEQ ID NO: 1353797 - RNA, 21 nt, Human
uacaaaauauuccacuguaag

SEQ ID NO: 1353798 - RNA, 22 nt, Human
uacaggcaugagcaaaugugcc

SEQ ID NO: 1353799 - RNA, 18 nt, Human
uaccacagcaaccuccug

SEQ ID NO: 1353800 - RNA, 21 nt, Human
uagagacaagguucaccaugu

SEQ ID NO: 1353801 - RNA, 22 nt, Human
uagcagugugacaaugaacuaa

SEQ ID NO: 1353802 - RNA, 19 nt, Human
uagccauaaaaaauuagaa

SEQ ID NO: 1353803 - RNA, 20 nt, Human
uaggggagaaguacaugaua

SEQ ID NO: 1353804 - RNA, 23 nt, Human
uaguagagacaagguucaccaug

SEQ ID NO: 1353805 - RNA, 20 nt, Human
uagugcuagagaagaugagg

SEQ ID NO: 1353806 - RNA, 18 nt, Human
uaucaagauagaugguuu

SEQ ID NO: 1353807 - RNA, 20 nt, Human
uaucuaaaaucucuggaagu

SEQ ID NO: 1353808 - RNA, 19 nt, Human
uaugucuuauaggggagaa

SEQ ID NO: 1353809 - RNA, 24 nt, Human
ucaauccccucuucuagccagccc

SEQ ID NO: 1353810 - RNA, 22 nt, Human
ucacucuuguugcccaggcugg

SEQ ID NO: 1353811 - RNA, 23 nt, Human
ucacucuuguugcccaggcugga

SEQ ID NO: 1353812 - RNA, 23 nt, Human
ucacugcaaccuccgccucccgg

SEQ ID NO: 1353813 - RNA, 24 nt, Human
ucacugcaaccuccgccucccggg

SEQ ID NO: 1353814 - RNA, 25 nt, Human
ucacugcaaccuccgccucccgggu

SEQ ID NO: 1353815 - RNA, 26 nt, Human
ucacugcaaccuccgccucccggguu

SEQ ID NO: 1353816 - RNA, 24 nt, Human
ucagcucaaugagaaagaaaaacc

SEQ ID NO: 1353817 - RNA, 20 nt, Human
ucaugggaggaacccagugg

SEQ ID NO: 1353818 - RNA, 24 nt, Human
ucauuuuuuuauuuuuaguagaga

SEQ ID NO: 1353819 - RNA, 24 nt, Human
ucccaaagugcugggauuacaggc

SEQ ID NO: 1353820 - RNA, 24 nt, Human
ucccaaguagcugggauuacaggc

SEQ ID NO: 1353821 - RNA, 21 nt, Human
ucccggguucaagcgauucuc

SEQ ID NO: 1353822 - RNA, 24 nt, Human
ucccggguucaagcgauucuccug

SEQ ID NO: 1353823 - RNA, 21 nt, Human
ucccugcagaucagaucccca

SEQ ID NO: 1353824 - RNA, 26 nt, Human
uccuugcugcugccaugucgucgucg

SEQ ID NO: 1353825 - RNA, 24 nt, Human
ucuagccugggacauagagugaga

SEQ ID NO: 1353826 - RNA, 22 nt, Human
ucuccacccaaaacucaucaug

SEQ ID NO: 1353827 - RNA, 20 nt, Human
ucuccugcccccccauuuua

SEQ ID NO: 1353828 - RNA, 21 nt, Human
ucucgaacuccugaccucaag

SEQ ID NO: 1353829 - RNA, 19 nt, Human
ucugcuggaauggaaucca

SEQ ID NO: 1353830 - RNA, 23 nt, Human
ucugugguaugugaaucaagaug

SEQ ID NO: 1353831 - RNA, 22 nt, Human
ucuuguugcccaggcuggagug

SEQ ID NO: 1353832 - RNA, 18 nt, Human
ugaccucaagugauccgc

SEQ ID NO: 1353833 - RNA, 18 nt, Human
ugagaaagaaaaaccacu

SEQ ID NO: 1353834 - RNA, 23 nt, Human
ugagaaagaaaaaccacucuagc

SEQ ID NO: 1353835 - RNA, 23 nt, Human
ugagacagaguuucacucuuguu

SEQ ID NO: 1353836 - RNA, 18 nt, Human
ugaggggauggaagauga

SEQ ID NO: 1353837 - RNA, 24 nt, Human
ugauccgcccaccugggccuccca

SEQ ID NO: 1353838 - RNA, 20 nt, Human
ugccaugugaagaaggacau

SEQ ID NO: 1353839 - RNA, 18 nt, Human
ugcccaggcuggagugca

SEQ ID NO: 1353840 - RNA, 21 nt, Human
ugcccaggcuggagugcaaug

SEQ ID NO: 1353841 - RNA, 24 nt, Human
ugcccaggcuggagugcaauggca

SEQ ID NO: 1353842 - RNA, 21 nt, Human
ugccuggccaaggguacaggg

SEQ ID NO: 1353843 - RNA, 23 nt, Human
ugcugggauuacaggcaugagca

SEQ ID NO: 1353844 - RNA, 21 nt, Human
uggaaaaagccaauuuaaaaa

SEQ ID NO: 1353845 - RNA, 23 nt, Human
uggaaaaagccaauuuaaaaaga

SEQ ID NO: 1353846 - RNA, 25 nt, Human
uggaaaaagccaauuuaaaaagacc

SEQ ID NO: 1353847 - RNA, 23 nt, Human
uggagugcaauggcacagucuca

SEQ ID NO: 1353848 - RNA, 19 nt, Human
uggcacaauaaugaagccu

SEQ ID NO: 1353849 - RNA, 22 nt, Human
uggcacaauaaugaagccuuag

SEQ ID NO: 1353850 - RNA, 24 nt, Human
uggcacagucucagcucacugcaa

SEQ ID NO: 1353851 - RNA, 24 nt, Human
uggccaggcuggucucgaacuccu

SEQ ID NO: 1353852 - RNA, 19 nt, Human
ugggacauagagugagacc

SEQ ID NO: 1353853 - RNA, 18 nt, Human
ugggaggaacccaguggg

SEQ ID NO: 1353854 - RNA, 20 nt, Human
ugggagguaacugaaucaug

SEQ ID NO: 1353855 - RNA, 18 nt, Human
ugggauuacaggcaugag

SEQ ID NO: 1353856 - RNA, 19 nt, Human
ugggauuacaggcaugagc

SEQ ID NO: 1353857 - RNA, 19 nt, Human
ugggauuacaggcaugagc

SEQ ID NO: 1353858 - RNA, 19 nt, Human
ugggauuacaggcaugagc

SEQ ID NO: 1353859 - RNA, 20 nt, Human
ugggauuacaggcaugagca

SEQ ID NO: 1353860 - RNA, 22 nt, Human
ugggauuacaggcaugagcaaa

SEQ ID NO: 1353861 - RNA, 24 nt, Human
ugggauuacaggcaugagcaaaug

SEQ ID NO: 1353862 - RNA, 21 nt, Human
ugggauuacaggcgcccacca

SEQ ID NO: 1353863 - RNA, 24 nt, Human
ugggauuacaggcgcccaccacca

SEQ ID NO: 1353864 - RNA, 25 nt, Human
uggguaaacauaaaacaaaacacaa

SEQ ID NO: 1353865 - RNA, 23 nt, Human
ugugacaaugaacuaauauguau

SEQ ID NO: 1353866 - RNA, 20 nt, Human
uguugcccaggcuggagugc

SEQ ID NO: 1353867 - RNA, 19 nt, Human
uguuuguuuuuuguuuuuu

SEQ ID NO: 1353868 - RNA, 23 nt, Human
uuaaaccucuuuccuuuauaauu

SEQ ID NO: 1353869 - RNA, 24 nt, Human
uuaauuacuaaaugcccauuaugu

SEQ ID NO: 1353870 - RNA, 22 nt, Human
uuagauaccaccuuaaagcuuu

SEQ ID NO: 1353871 - RNA, 24 nt, Human
uuaguagagacaagguucaccaug

SEQ ID NO: 1353872 - RNA, 23 nt, Human
uucaaauauaggaaaacauaaga

SEQ ID NO: 1353873 - RNA, 23 nt, Human
uucaagaacuugauggauacaaa

SEQ ID NO: 1353874 - RNA, 23 nt, Human
uucaagcgauucuccugucuuag

SEQ ID NO: 1353875 - RNA, 20 nt, Human
uucaccauguuggccaggcu

SEQ ID NO: 1353876 - RNA, 24 nt, Human
uucacucuuguugcccaggcugga

SEQ ID NO: 1353877 - RNA, 18 nt, Human
uucuagccagcccccacc

SEQ ID NO: 1353878 - RNA, 25 nt, Human
uucucacgagauaugaugguuuuau

SEQ ID NO: 1353879 - RNA, 18 nt, Human
uuggcugugucuccaccc

SEQ ID NO: 1353880 - RNA, 23 nt, Human
uuguaguucucauaacccccaug

SEQ ID NO: 1353881 - RNA, 24 nt, Human
uuuaguagagacaagguucaccau

SEQ ID NO: 1353882 - RNA, 24 nt, Human
uuucacucuuguugcccaggcugg

SEQ ID NO: 1353883 - RNA, 20 nt, Human
uuucuccugcccccccauuu

SEQ ID NO: 1353884 - RNA, 24 nt, Human
uuuggcugugucuccacccaaaac

SEQ ID NO: 1353885 - RNA, 25 nt, Human
uuuuuuguuuuuugagacagaguuu

SEQ ID NO: 1353886 - RNA, 18 nt, Human
agcagcagcuuguuggau

SEQ ID NO: 1353887 - RNA, 22 nt, Human
aggucuuuggcauagcuguaca

SEQ ID NO: 1353888 - RNA, 26 nt, Human
auucuggcucuggcccugacccuggc

SEQ ID NO: 1353889 - RNA, 20 nt, Human
caacuccauauccagaaaaa

SEQ ID NO: 1353890 - RNA, 18 nt, Human
caccaaagcuagcagcag

SEQ ID NO: 1353891 - RNA, 22 nt, Human
cauauuuaguccaaccccaaaa

SEQ ID NO: 1353892 - RNA, 20 nt, Human
ccaaccccaaaaagacaauu

SEQ ID NO: 1353893 - RNA, 20 nt, Human
cccaaugaaggaagcaggau

SEQ ID NO: 1353894 - RNA, 23 nt, Human
ccuacacacaguauaacacugaa

SEQ ID NO: 1353895 - RNA, 24 nt, Human
ccuacacacaguauaacacugaau

SEQ ID NO: 1353896 - RNA, 18 nt, Human
ccugacccuggcucugga

SEQ ID NO: 1353897 - RNA, 22 nt, Human
ccugacccuggcucuggaaaug

SEQ ID NO: 1353898 - RNA, 18 nt, Human
ccuggcucuggaaauggg

SEQ ID NO: 1353899 - RNA, 23 nt, Human
ccuucuggcucaaacucugaguc

SEQ ID NO: 1353900 - RNA, 18 nt, Human
ccuugccugaguucugcu

SEQ ID NO: 1353901 - RNA, 21 nt, Human
cgccauuucucuacacugccu

SEQ ID NO: 1353902 - RNA, 19 nt, Human
cugacccuggcucuggaaa

SEQ ID NO: 1353903 - RNA, 21 nt, Human
cugauaccucugcaaaaaaag

SEQ ID NO: 1353904 - RNA, 19 nt, Human
cuggcccugacccuggcuc

SEQ ID NO: 1353905 - RNA, 18 nt, Human
cuggccuccugaugcucu

SEQ ID NO: 1353906 - RNA, 21 nt, Human
gacccuggcucuggaaauggg

SEQ ID NO: 1353907 - RNA, 21 nt, Human
gaccuuguuucuuugcuuuuc

SEQ ID NO: 1353908 - RNA, 26 nt, Human
gcccugacccuggcucuggaaauggg

SEQ ID NO: 1353909 - RNA, 24 nt, Human
gcuguacaacuccauauccagaaa

SEQ ID NO: 1353910 - RNA, 23 nt, Human
uauugggucuuccgcugaaacuc

SEQ ID NO: 1353911 - RNA, 25 nt, Human
ucagguucugauuggcauucugccg

SEQ ID NO: 1353912 - RNA, 22 nt, Human
uccagaaaauucagucccucaa

SEQ ID NO: 1353913 - RNA, 18 nt, Human
uccauauccagaaaauuc

SEQ ID NO: 1353914 - RNA, 23 nt, Human
ucuccuucuggcucaaacucuga

SEQ ID NO: 1353915 - RNA, 23 nt, Human
ucucuacacugccuauguagucg

SEQ ID NO: 1353916 - RNA, 24 nt, Human
ucugauucggauucuggcucuggc

SEQ ID NO: 1353917 - RNA, 18 nt, Human
ugaaaggcaacuguaaag

SEQ ID NO: 1353918 - RNA, 21 nt, Human
ugaaaggcaacuguaaaggca

SEQ ID NO: 1353919 - RNA, 23 nt, Human
ugaaggaagcaggauguguuugg

SEQ ID NO: 1353920 - RNA, 20 nt, Human
ugaauugaaaggcaacugua

SEQ ID NO: 1353921 - RNA, 21 nt, Human
ugacccuggcucuggaaaugg

SEQ ID NO: 1353922 - RNA, 25 nt, Human
ugacccuggcucuggaaaugggucu

SEQ ID NO: 1353923 - RNA, 19 nt, Human
ugcaaaaaaaggucuuugg

SEQ ID NO: 1353924 - RNA, 21 nt, Human
uggcauagcuguacaacucca

SEQ ID NO: 1353925 - RNA, 21 nt, Human
uggcauucggauuuggguucu

SEQ ID NO: 1353926 - RNA, 21 nt, Human
uggcgaaauaaaguucauguu

SEQ ID NO: 1353927 - RNA, 19 nt, Human
uggcucuggaaaugggucu

SEQ ID NO: 1353928 - RNA, 24 nt, Human
uggcucuggcccugacccuggcuc

SEQ ID NO: 1353929 - RNA, 19 nt, Human
uguaaaggcaacaucuaaa

SEQ ID NO: 1353930 - RNA, 18 nt, Human
uguuuuaccuacacacag

SEQ ID NO: 1353931 - RNA, 24 nt, Human
uuaguccaaccccaaaaagacaau

SEQ ID NO: 1353932 - RNA, 18 nt, Human
uucaguggcgcuuuggga

SEQ ID NO: 1353933 - RNA, 18 nt, Human
uuuggacacuuucaucuu

SEQ ID NO: 1353934 - RNA, 21 nt, Human
uuuuaaaacuuccccaaugaa

SEQ ID NO: 1353935 - RNA, 19 nt, Human
aaaaaauaaauucuggcag

SEQ ID NO: 1353936 - RNA, 18 nt, Human
aaacagaaauaagaaaga

SEQ ID NO: 1353937 - RNA, 23 nt, Human
aaacucaaggaaugaggcaacag

SEQ ID NO: 1353938 - RNA, 19 nt, Human
aaaugccauuagacgcuaa

SEQ ID NO: 1353939 - RNA, 19 nt, Human
aacauucauuuccuggccu

SEQ ID NO: 1353940 - RNA, 23 nt, Human
aaccaagaaaaugguuucuacaa

SEQ ID NO: 1353941 - RNA, 22 nt, Human
aaucucuugagaaagaaacaga

SEQ ID NO: 1353942 - RNA, 22 nt, Human
aauggaagagugaaacucaagg

SEQ ID NO: 1353943 - RNA, 21 nt, Human
agaaacagaaauaagaaagaa

SEQ ID NO: 1353944 - RNA, 18 nt, Human
agaaauaagaaagaagcc

SEQ ID NO: 1353945 - RNA, 18 nt, Human
agaaauguccauagguuc

SEQ ID NO: 1353946 - RNA, 20 nt, Human
agaaauuggggagaaucucu

SEQ ID NO: 1353947 - RNA, 24 nt, Human
agaaauuggggagaaucucuugag

SEQ ID NO: 1353948 - RNA, 19 nt, Human
agggcauguucuaaagucc

SEQ ID NO: 1353949 - RNA, 23 nt, Human
aguaaaaagauaccugcaaagaa

SEQ ID NO: 1353950 - RNA, 18 nt, Human
aucuaugccaccaccucc

SEQ ID NO: 1353951 - RNA, 22 nt, Human
cagauccaagaugauucaagaa

SEQ ID NO: 1353952 - RNA, 21 nt, Human
caucacacuuuauuacaauaa

SEQ ID NO: 1353953 - RNA, 23 nt, Human
cauggaacuggcucagaaauguc

SEQ ID NO: 1353954 - RNA, 22 nt, Human
ccacagugcuggugaggagagg

SEQ ID NO: 1353955 - RNA, 19 nt, Human
cccacacaaauaguaaaga

SEQ ID NO: 1353956 - RNA, 20 nt, Human
ccuccuuccugaggcuguag

SEQ ID NO: 1353957 - RNA, 24 nt, Human
ccuugccacagugcuggugaggag

SEQ ID NO: 1353958 - RNA, 26 nt, Human
cucuagaaauugauuuaauucaugaa

SEQ ID NO: 1353959 - RNA, 24 nt, Human
cuuccuagagccaaauccuucuuu

SEQ ID NO: 1353960 - RNA, 25 nt, Human
gaaagaaacagaaauaagaaagaag

SEQ ID NO: 1353961 - RNA, 18 nt, Human
gaagccuuccuagagcca

SEQ ID NO: 1353962 - RNA, 21 nt, Human
gagggcauguucuaaaguccc

SEQ ID NO: 1353963 - RNA, 21 nt, Human
gaucuaugccaccaccuccuu

SEQ ID NO: 1353964 - RNA, 20 nt, Human
gcaguggagaugacaaauac

SEQ ID NO: 1353965 - RNA, 24 nt, Human
gccacagugcuggugaggagaggg

SEQ ID NO: 1353966 - RNA, 22 nt, Human
ggaaugaggcaacagcuggauc

SEQ ID NO: 1353967 - RNA, 21 nt, Human
ggcucagaaauguccauaggu

SEQ ID NO: 1353968 - RNA, 22 nt, Human
uaaauucuggcaggaaauauua

SEQ ID NO: 1353969 - RNA, 26 nt, Human
uaagaaagaagcauuuuccuucuccc

SEQ ID NO: 1353970 - RNA, 18 nt, Human
uaagagcacaaagaucaa

SEQ ID NO: 1353971 - RNA, 18 nt, Human
uaagagcacaaagaucaa

SEQ ID NO: 1353972 - RNA, 25 nt, Human
uaagagcacaaagaucaacacaguc

SEQ ID NO: 1353973 - RNA, 25 nt, Human
uaaggcaggcauccaaaaugagauu

SEQ ID NO: 1353974 - RNA, 18 nt, Human
uauuuuuuaauuaccugg

SEQ ID NO: 1353975 - RNA, 18 nt, Human
uccaagaugauucaagaa

SEQ ID NO: 1353976 - RNA, 20 nt, Human
ucccagauccaagaugauuc

SEQ ID NO: 1353977 - RNA, 25 nt, Human
uccuagauuaauucuaaaccuguau

SEQ ID NO: 1353978 - RNA, 23 nt, Human
ucucuugagaaagaaacagaaau

SEQ ID NO: 1353979 - RNA, 19 nt, Human
ucugccuaagucgguaaca

SEQ ID NO: 1353980 - RNA, 19 nt, Human
ugacaaaaaauaaauucug

SEQ ID NO: 1353981 - RNA, 22 nt, Human
ugagaaagaaacagaaauaaga

SEQ ID NO: 1353982 - RNA, 19 nt, Human
ugaggagagggcauguucu

SEQ ID NO: 1353983 - RNA, 24 nt, Human
ugcaagaagcuaugacaaaaaaua

SEQ ID NO: 1353984 - RNA, 22 nt, Human
ugcauacaugcaagaagcuaug

SEQ ID NO: 1353985 - RNA, 19 nt, Human
ugccaacccauacugucac

SEQ ID NO: 1353986 - RNA, 21 nt, Human
ugccuugccacagugcuggug

SEQ ID NO: 1353987 - RNA, 19 nt, Human
uggaagagugaaacucaag

SEQ ID NO: 1353988 - RNA, 21 nt, Human
uggaagccuuccuagagccaa

SEQ ID NO: 1353989 - RNA, 25 nt, Human
uguaguaaccaagaaaaugguuucu

SEQ ID NO: 1353990 - RNA, 22 nt, Human
uucaagaaaggaauggugcccc

SEQ ID NO: 1353991 - RNA, 23 nt, Human
uuccugaggcuguaggagggcca

SEQ ID NO: 1353992 - RNA, 23 nt, Human
uucuucagcauugaagagccuga

SEQ ID NO: 1353993 - RNA, 23 nt, Human
aaaaagcagaugaauucaucccg

SEQ ID NO: 1353994 - RNA, 23 nt, Human
aaaauaucuccauaacacggagu

SEQ ID NO: 1353995 - RNA, 23 nt, Human
aaaccccaagcauguuaaaaaca

SEQ ID NO: 1353996 - RNA, 21 nt, Human
aaagaaaugccagugucccug

SEQ ID NO: 1353997 - RNA, 21 nt, Human
aacaacacagccaaacgcuau

SEQ ID NO: 1353998 - RNA, 21 nt, Human
aacacagccaaacgcuauccu

SEQ ID NO: 1353999 - RNA, 24 nt, Human
aaggaaaagacccaacugaaaaag

SEQ ID NO: 1354000 - RNA, 21 nt, Human
aaguacccagucccuuccauu

SEQ ID NO: 1354001 - RNA, 23 nt, Human
aauaaaugacagaagaucuguca

SEQ ID NO: 1354002 - RNA, 22 nt, Human
aaugccagugucccuguugccc

SEQ ID NO: 1354003 - RNA, 24 nt, Human
acaggcaagagcccuguuucugug

SEQ ID NO: 1354004 - RNA, 21 nt, Human
acaugccaaaagccaggaacu

SEQ ID NO: 1354005 - RNA, 20 nt, Human
acccuugagccguugacuuc

SEQ ID NO: 1354006 - RNA, 19 nt, Human
accucaguuuuuuucaucu

SEQ ID NO: 1354007 - RNA, 23 nt, Human
agacaucuuugggugugucuuca

SEQ ID NO: 1354008 - RNA, 24 nt, Human
agauggucagugaguccaaaaagc

SEQ ID NO: 1354009 - RNA, 21 nt, Human
agccguugacuucacugagcc

SEQ ID NO: 1354010 - RNA, 21 nt, Human
agcucuggccuccaccugcaa

SEQ ID NO: 1354011 - RNA, 19 nt, Human
aggaaaucccaaaaggcaa

SEQ ID NO: 1354012 - RNA, 26 nt, Human
aggaacugaaaacuacacacggugcc

SEQ ID NO: 1354013 - RNA, 22 nt, Human
aggcacagggacgagaggaggg

SEQ ID NO: 1354014 - RNA, 23 nt, Human
aucccauuuaacccucaccacca

SEQ ID NO: 1354015 - RNA, 28 nt, Human
caaaccccaagcauguuaaaaacagucu

SEQ ID NO: 1354016 - RNA, 25 nt, Human
caaagcagagccaauaauaccugcu

SEQ ID NO: 1354017 - RNA, 24 nt, Human
caacacagccaaacgcuauccccu

SEQ ID NO: 1354018 - RNA, 19 nt, Human
caacaugccaaaagccagg

SEQ ID NO: 1354019 - RNA, 21 nt, Human
caacaugccaaaagccaggaa

SEQ ID NO: 1354020 - RNA, 22 nt, Human
caagaacacggcagguucagac

SEQ ID NO: 1354021 - RNA, 23 nt, Human
caaggcacacagcuuggcaagga

SEQ ID NO: 1354022 - RNA, 21 nt, Human
cacagccaaacgcuauccccu

SEQ ID NO: 1354023 - RNA, 24 nt, Human
caccaaaaaauccagcaaguaccc

SEQ ID NO: 1354024 - RNA, 26 nt, Human
caccaaaaaauccagcaaguacccag

SEQ ID NO: 1354025 - RNA, 23 nt, Human
cacgaaaagccaagaacacggca

SEQ ID NO: 1354026 - RNA, 18 nt, Human
cacugagccucaguuccc

SEQ ID NO: 1354027 - RNA, 23 nt, Human
cacugagccucaguucccucauc

SEQ ID NO: 1354028 - RNA, 18 nt, Human
cagcaggccuggaugggu

SEQ ID NO: 1354029 - RNA, 19 nt, Human
cagugucccuguugcccgg

SEQ ID NO: 1354030 - RNA, 23 nt, Human
caucccauuuaacccucaccacc

SEQ ID NO: 1354031 - RNA, 20 nt, Human
caugccaaaagccaggaacu

SEQ ID NO: 1354032 - RNA, 26 nt, Human
cauguuaaaaacagucugagaugguc

SEQ ID NO: 1354033 - RNA, 22 nt, Human
cauuacaggaaaucccaaaagg

SEQ ID NO: 1354034 - RNA, 19 nt, Human
ccacguagcucuggccucc

SEQ ID NO: 1354035 - RNA, 19 nt, Human
ccacuuagagcugcgugag

SEQ ID NO: 1354036 - RNA, 18 nt, Human
cccucaccaccaccucgg

SEQ ID NO: 1354037 - RNA, 20 nt, Human
ccucccacgaaaagccaaga

SEQ ID NO: 1354038 - RNA, 24 nt, Human
ccugccacugagaaagaugagaau

SEQ ID NO: 1354039 - RNA, 21 nt, Human
cucagcccuucugcugguucu

SEQ ID NO: 1354040 - RNA, 24 nt, Human
cucaugacuauguggucuccuggg

SEQ ID NO: 1354041 - RNA, 22 nt, Human
cuccagggccacuucgaacccc

SEQ ID NO: 1354042 - RNA, 21 nt, Human
cugcauuacaggaaaucccaa

SEQ ID NO: 1354043 - RNA, 23 nt, Human
cugccugccagcucuaccacuua

SEQ ID NO: 1354044 - RNA, 24 nt, Human
cuggucuuugcagccaccguuguu

SEQ ID NO: 1354045 - RNA, 19 nt, Human
cuguguccucccagccaug

SEQ ID NO: 1354046 - RNA, 21 nt, Human
cuuagcccaccucaaccucag

SEQ ID NO: 1354047 - RNA, 22 nt, Human
cuugggaaaaauaaaugacaga

SEQ ID NO: 1354048 - RNA, 23 nt, Human
cuugggcuccucuuagcugacca

SEQ ID NO: 1354049 - RNA, 18 nt, Human
gaaaaauaaaugacagaa

SEQ ID NO: 1354050 - RNA, 22 nt, Human
gaacagcaggccuggaugggua

SEQ ID NO: 1354051 - RNA, 22 nt, Human
gcagccucccacgaaaagccaa

SEQ ID NO: 1354052 - RNA, 18 nt, Human
gccaacgcuuuuacagaa

SEQ ID NO: 1354053 - RNA, 22 nt, Human
gcccuguuucuguguccuccca

SEQ ID NO: 1354054 - RNA, 22 nt, Human
gccugggucugccugccagcuc

SEQ ID NO: 1354055 - RNA, 21 nt, Human
gggcaggguucccagcacaug

SEQ ID NO: 1354056 - RNA, 25 nt, Human
gggucauguuuucuguccggccuuc

SEQ ID NO: 1354057 - RNA, 18 nt, Human
gguauuaguuucucacuc

SEQ ID NO: 1354058 - RNA, 18 nt, Human
guagcucuggccuccacc

SEQ ID NO: 1354059 - RNA, 21 nt, Human
guccaggauuggggcacggag

SEQ ID NO: 1354060 - RNA, 19 nt, Human
uacuagcaaguagcaaagc

SEQ ID NO: 1354061 - RNA, 21 nt, Human
uagcaaagcaggacugccaga

SEQ ID NO: 1354062 - RNA, 18 nt, Human
uaggaugaguccaucccc

SEQ ID NO: 1354063 - RNA, 19 nt, Human
uauuaguuucucacuccau

SEQ ID NO: 1354064 - RNA, 20 nt, Human
ucacacaucaagaucugaga

SEQ ID NO: 1354065 - RNA, 20 nt, Human
uccaaaaagcagaugaauuc

SEQ ID NO: 1354066 - RNA, 23 nt, Human
uccaagagacugaauaacuuacu

SEQ ID NO: 1354067 - RNA, 27 nt, Human
uccaagagacugaauaacuuacuagca

SEQ ID NO: 1354068 - RNA, 21 nt, Human
uccagggccacuucgaacccc

SEQ ID NO: 1354069 - RNA, 19 nt, Human
uccagugaugugccaggca

SEQ ID NO: 1354070 - RNA, 19 nt, Human
uccaguuuuaucaaacccc

SEQ ID NO: 1354071 - RNA, 20 nt, Human
uccccugggcucgccgaaga

SEQ ID NO: 1354072 - RNA, 18 nt, Human
uccucccagccaugcacc

SEQ ID NO: 1354073 - RNA, 21 nt, Human
uccugggcaugcuccagccuc

SEQ ID NO: 1354074 - RNA, 23 nt, Human
ucgccgaagaugaaaagaaucgc

SEQ ID NO: 1354075 - RNA, 23 nt, Human
ucgguguuauuagcucauuuaag

SEQ ID NO: 1354076 - RNA, 18 nt, Human
ucguaaccagcuuccugu

SEQ ID NO: 1354077 - RNA, 23 nt, Human
ucuccaaagacaucuuugggugu

SEQ ID NO: 1354078 - RNA, 21 nt, Human
ucugcaaaccaucuccacugc

SEQ ID NO: 1354079 - RNA, 22 nt, Human
ucuucaugggcgugucaggggu

SEQ ID NO: 1354080 - RNA, 20 nt, Human
ugaaucacugcuauucuaag

SEQ ID NO: 1354081 - RNA, 20 nt, Human
ugagaaagaugagaauggug

SEQ ID NO: 1354082 - RNA, 18 nt, Human
ugagcaaacaacacagcc

SEQ ID NO: 1354083 - RNA, 24 nt, Human
ugagcaaacaacacagccaaacgc

SEQ ID NO: 1354084 - RNA, 20 nt, Human
ugcaaaccaucuccacugca

SEQ ID NO: 1354085 - RNA, 19 nt, Human
ugcaggaguuuguacgugu

SEQ ID NO: 1354086 - RNA, 18 nt, Human
ugccacgguuggacacuc

SEQ ID NO: 1354087 - RNA, 20 nt, Human
ugccagauagggcuggcucc

SEQ ID NO: 1354088 - RNA, 21 nt, Human
ugcccggggaucuccaaagac

SEQ ID NO: 1354089 - RNA, 20 nt, Human
ugccugggucugccugccag

SEQ ID NO: 1354090 - RNA, 24 nt, Human
ugcuugcuguuuuuccagugaugu

SEQ ID NO: 1354091 - RNA, 22 nt, Human
uggcaaggaggagugaaguuuu

SEQ ID NO: 1354092 - RNA, 19 nt, Human
uggcagcagccuucuaacu

SEQ ID NO: 1354093 - RNA, 19 nt, Human
uggcccagaugccccaccu

SEQ ID NO: 1354094 - RNA, 18 nt, Human
ugggaaaaauaaaugaca

SEQ ID NO: 1354095 - RNA, 18 nt, Human
ugggcaugcuccagccuc

SEQ ID NO: 1354096 - RNA, 21 nt, Human
ugggcgugucaggggucuggc

SEQ ID NO: 1354097 - RNA, 19 nt, Human
uggggccacauugaugggu

SEQ ID NO: 1354098 - RNA, 19 nt, Human
ugucaccaagguuggggcc

SEQ ID NO: 1354099 - RNA, 18 nt, Human
ugucaggggucuggcggu

SEQ ID NO: 1354100 - RNA, 21 nt, Human
ugucugugaaggugcgggugg

SEQ ID NO: 1354101 - RNA, 18 nt, Human
uguggaugguaccccugg

SEQ ID NO: 1354102 - RNA, 19 nt, Human
uguggaugguaccccuggg

SEQ ID NO: 1354103 - RNA, 22 nt, Human
uguggaugguaccccugggguu

SEQ ID NO: 1354104 - RNA, 24 nt, Human
uguggaugguaccccugggguugu

SEQ ID NO: 1354105 - RNA, 18 nt, Human
ugugucuucaugggcgug

SEQ ID NO: 1354106 - RNA, 21 nt, Human
uucaucugcaaagcagagcca

SEQ ID NO: 1354107 - RNA, 19 nt, Human
uuccagugaugugccaggg

SEQ ID NO: 1354108 - RNA, 18 nt, Human
uucccagcacauguuaau

SEQ ID NO: 1354109 - RNA, 18 nt, Human
uucccgccagaggcuugc

SEQ ID NO: 1354110 - RNA, 22 nt, Human
uucucagagcagugagcaaaca

SEQ ID NO: 1354111 - RNA, 21 nt, Human
uugcuacaucaagaucacaaa

SEQ ID NO: 1354112 - RNA, 20 nt, Human
uugggcaaacuacuccaccu

SEQ ID NO: 1354113 - RNA, 19 nt, Human
uuuaacccucaccaccacc

SEQ ID NO: 1354114 - RNA, 24 nt, Human
aaacaagaaaaugguacaaaauag

SEQ ID NO: 1354115 - RNA, 21 nt, Human
aaagccaggagucuccagaug

SEQ ID NO: 1354116 - RNA, 19 nt, Human
aagguccccugcccgcccg

SEQ ID NO: 1354117 - RNA, 18 nt, Human
aauaaacccaaacaaaga

SEQ ID NO: 1354118 - RNA, 22 nt, Human
agcaggcaauaaaacugaugag

SEQ ID NO: 1354119 - RNA, 21 nt, Human
agccgccggaguuuccaaacu

SEQ ID NO: 1354120 - RNA, 21 nt, Human
aguucagaaagccaggagucu

SEQ ID NO: 1354121 - RNA, 25 nt, Human
caaacaaaaauaccguaaucaacgg

SEQ ID NO: 1354122 - RNA, 18 nt, Human
caaacaaagacccucagc

SEQ ID NO: 1354123 - RNA, 18 nt, Human
caaagcagcugucccggc

SEQ ID NO: 1354124 - RNA, 21 nt, Human
caagccuacagcugggacuga

SEQ ID NO: 1354125 - RNA, 23 nt, Human
caaggcgggggccaggaccggcc

SEQ ID NO: 1354126 - RNA, 20 nt, Human
cacccgcccgucgcccgcgg

SEQ ID NO: 1354127 - RNA, 21 nt, Human
cagcaaagcagcugucccggc

SEQ ID NO: 1354128 - RNA, 24 nt, Human
caugcuaaaguuaaacaagaaaau

SEQ ID NO: 1354129 - RNA, 18 nt, Human
ccccgcacgcagccgccg

SEQ ID NO: 1354130 - RNA, 24 nt, Human
ccccugcccgcccgcgcacccgcc

SEQ ID NO: 1354131 - RNA, 26 nt, Human
cccgcacgcagccgccggaguuucca

SEQ ID NO: 1354132 - RNA, 22 nt, Human
cccgcgcacccgcccgucgccc

SEQ ID NO: 1354133 - RNA, 23 nt, Human
cccgcgcacccgcccgucgcccg

SEQ ID NO: 1354134 - RNA, 25 nt, Human
cccgcgcacccgcccgucgcccgcg

SEQ ID NO: 1354135 - RNA, 27 nt, Human
ccgggacgccagagucccucuccuuuc

SEQ ID NO: 1354136 - RNA, 19 nt, Human
ccuacagcugggacugaaa

SEQ ID NO: 1354137 - RNA, 18 nt, Human
ccucguugcucucuuccu

SEQ ID NO: 1354138 - RNA, 18 nt, Human
ccucucgucucucucucc

SEQ ID NO: 1354139 - RNA, 22 nt, Human
ccuuuccucguugcucucuucc

SEQ ID NO: 1354140 - RNA, 24 nt, Human
cgccagagucccucuccuuuccuc

SEQ ID NO: 1354141 - RNA, 24 nt, Human
cuccuuuccucguugcucucuucc

SEQ ID NO: 1354142 - RNA, 18 nt, Human
cugaaaccccgcacgcag

SEQ ID NO: 1354143 - RNA, 20 nt, Human
cuguccuuccuucuuucgcu

SEQ ID NO: 1354144 - RNA, 19 nt, Human
gccaagguccccugcccgc

SEQ ID NO: 1354145 - RNA, 22 nt, Human
gcgcccuuccucccucucgcuc

SEQ ID NO: 1354146 - RNA, 26 nt, Human
gcuaaaguuaaacaagaaaaugguac

SEQ ID NO: 1354147 - RNA, 23 nt, Human
gggaccucccacccucucgucuc

SEQ ID NO: 1354148 - RNA, 19 nt, Human
gggccaggaccggccacga

SEQ ID NO: 1354149 - RNA, 18 nt, Human
guccgucuguccuuccuu

SEQ ID NO: 1354150 - RNA, 23 nt, Human
guccuuccuucuuucgcucagcc

SEQ ID NO: 1354151 - RNA, 18 nt, Human
uaaacaagaaaaugguac

SEQ ID NO: 1354152 - RNA, 19 nt, Human
uaaacccaaacaaagaccc

SEQ ID NO: 1354153 - RNA, 23 nt, Human
uaaacccaaacaaagacccucag

SEQ ID NO: 1354154 - RNA, 21 nt, Human
uaccguaauaauaaacccaaa

SEQ ID NO: 1354155 - RNA, 22 nt, Human
uaugauccaugaucaacaacau

SEQ ID NO: 1354156 - RNA, 23 nt, Human
ucucacccaaagaaacaagggga

SEQ ID NO: 1354157 - RNA, 20 nt, Human
ucuccagauggccuugguga

SEQ ID NO: 1354158 - RNA, 23 nt, Human
ugacagacagguccgucuguccu

SEQ ID NO: 1354159 - RNA, 20 nt, Human
ugauccaugaucaacaacau

SEQ ID NO: 1354160 - RNA, 18 nt, Human
ugaugagauuugggcgcc

SEQ ID NO: 1354161 - RNA, 19 nt, Human
ugccucgccgcccuucagc

SEQ ID NO: 1354162 - RNA, 20 nt, Human
uuacaaacaaaaauaccgua

SEQ ID NO: 1354163 - RNA, 22 nt, Human
aaacaacaacaacaacaacaac

SEQ ID NO: 1354164 - RNA, 20 nt, Human
aaaucccaacuuugcuccuc

SEQ ID NO: 1354165 - RNA, 22 nt, Human
aacaacaacaacaacaacggag

SEQ ID NO: 1354166 - RNA, 23 nt, Human
aacaacaacaacaacaacggaga

SEQ ID NO: 1354167 - RNA, 20 nt, Human
aacaacggagauuccgucuc

SEQ ID NO: 1354168 - RNA, 23 nt, Human
aacaacggagauuccgucucagg

SEQ ID NO: 1354169 - RNA, 23 nt, Human
aagaaaagagagcccauugguaa

SEQ ID NO: 1354170 - RNA, 21 nt, Human
aagaggaagugacaaaggcaa

SEQ ID NO: 1354171 - RNA, 18 nt, Human
aaguagagggggaagggg

SEQ ID NO: 1354172 - RNA, 19 nt, Human
acaacaacaacaacaacaa

SEQ ID NO: 1354173 - RNA, 23 nt, Human
acaacaacaacaacaacaacgga

SEQ ID NO: 1354174 - RNA, 24 nt, Human
acaacaacaacaacaacaacggag

SEQ ID NO: 1354175 - RNA, 19 nt, Human
acaggauauaaacacagag

SEQ ID NO: 1354176 - RNA, 19 nt, Human
acggcauagagauggcacc

SEQ ID NO: 1354177 - RNA, 18 nt, Human
agaaaacaacaacaacaa

SEQ ID NO: 1354178 - RNA, 19 nt, Human
agagaaguccuuggacugu

SEQ ID NO: 1354179 - RNA, 19 nt, Human
agcaggugguguuggaaca

SEQ ID NO: 1354180 - RNA, 19 nt, Human
aggaggggacucgguagca

SEQ ID NO: 1354181 - RNA, 30 nt, Human
agggaggcauggccaauugcucugugggcc

SEQ ID NO: 1354182 - RNA, 20 nt, Human
aggugguuuugaaauuggga

SEQ ID NO: 1354183 - RNA, 21 nt, Human
agugacaaaggcaacaggaua

SEQ ID NO: 1354184 - RNA, 24 nt, Human
agugaugagguauaaaugaacuuc

SEQ ID NO: 1354185 - RNA, 20 nt, Human
aguggaggaggggacucggu

SEQ ID NO: 1354186 - RNA, 21 nt, Human
auaggaagggaaggaauagua

SEQ ID NO: 1354187 - RNA, 19 nt, Human
aucaagucuucccucuuuc

SEQ ID NO: 1354188 - RNA, 19 nt, Human
augcaccccaugccaaguc

SEQ ID NO: 1354189 - RNA, 19 nt, Human
augguucuucuccaacccc

SEQ ID NO: 1354190 - RNA, 24 nt, Human
caaaccuuggaguuccaaggccag

SEQ ID NO: 1354191 - RNA, 18 nt, Human
caacaacaacaacaacaa

SEQ ID NO: 1354192 - RNA, 18 nt, Human
caacacaaaaguuagccc

SEQ ID NO: 1354193 - RNA, 24 nt, Human
caacagcuagaaugcaccccaugc

SEQ ID NO: 1354194 - RNA, 26 nt, Human
cacaggauauaaacacagagugcagg

SEQ ID NO: 1354195 - RNA, 25 nt, Human
caccagagucaacacaaaaguuagc

SEQ ID NO: 1354196 - RNA, 22 nt, Human
cagcccacuaauuucccuuucu

SEQ ID NO: 1354197 - RNA, 20 nt, Human
cagcuguccaagccuuuaag

SEQ ID NO: 1354198 - RNA, 23 nt, Human
cagguggccgcgacuuguccccc

SEQ ID NO: 1354199 - RNA, 24 nt, Human
caggugguuuugaaauugggaggg

SEQ ID NO: 1354200 - RNA, 20 nt, Human
cauucaucaaaaacugggga

SEQ ID NO: 1354201 - RNA, 19 nt, Human
ccaucggacucauccucuc

SEQ ID NO: 1354202 - RNA, 23 nt, Human
cccauagcaggugguguuggaac

SEQ ID NO: 1354203 - RNA, 23 nt, Human
ccccaugccaagucugcaccucc

SEQ ID NO: 1354204 - RNA, 25 nt, Human
ccucauccucuucccaccuccccag

SEQ ID NO: 1354205 - RNA, 22 nt, Human
ccugcaccaaccucggggcuga

SEQ ID NO: 1354206 - RNA, 22 nt, Human
ccugcaggcacugauguaaacu

SEQ ID NO: 1354207 - RNA, 18 nt, Human
cgcccgggcuccccagcu

SEQ ID NO: 1354208 - RNA, 23 nt, Human
cuaaugguucuucuccaaccccc

SEQ ID NO: 1354209 - RNA, 19 nt, Human
cuccggagcagguggccgc

SEQ ID NO: 1354210 - RNA, 24 nt, Human
cugcaccaaccucggggcugagga

SEQ ID NO: 1354211 - RNA, 18 nt, Human
cugccaccauugcuauuu

SEQ ID NO: 1354212 - RNA, 19 nt, Human
cugccaggcuggagugcuc

SEQ ID NO: 1354213 - RNA, 18 nt, Human
gacuccuuaggauguaag

SEQ ID NO: 1354214 - RNA, 25 nt, Human
gaggggacucgguagcaaucugguc

SEQ ID NO: 1354215 - RNA, 22 nt, Human
gauggugggauggacugggugg

SEQ ID NO: 1354216 - RNA, 22 nt, Human
gcagcucaucaguggaggaggg

SEQ ID NO: 1354217 - RNA, 20 nt, Human
gccgaggugcugacugccag

SEQ ID NO: 1354218 - RNA, 22 nt, Human
gccuucugccaaaucccaacuu

SEQ ID NO: 1354219 - RNA, 20 nt, Human
ggacggcgcccgggcucccc

SEQ ID NO: 1354220 - RNA, 28 nt, Human
ggaggcauggccaauugcucugugggcc

SEQ ID NO: 1354221 - RNA, 18 nt, Human
ggcagcucaucaguggag

SEQ ID NO: 1354222 - RNA, 23 nt, Human
ggcagcucaucaguggaggaggg

SEQ ID NO: 1354223 - RNA, 23 nt, Human
ggcuagaaaacaacaacaacaac

SEQ ID NO: 1354224 - RNA, 18 nt, Human
gggaggcccugcaccaac

SEQ ID NO: 1354225 - RNA, 20 nt, Human
gggcugaggaucaagucuuc

SEQ ID NO: 1354226 - RNA, 20 nt, Human
ggggaaggggugaugguggg

SEQ ID NO: 1354227 - RNA, 18 nt, Human
uaagacaaaaugcaacac

SEQ ID NO: 1354228 - RNA, 20 nt, Human
uaaguagagggggaaggggu

SEQ ID NO: 1354229 - RNA, 22 nt, Human
uagaaaggagauaggaagggaa

SEQ ID NO: 1354230 - RNA, 24 nt, Human
uagccccuaguauccagagagccu

SEQ ID NO: 1354231 - RNA, 21 nt, Human
ucagaguaagacaaaaugcaa

SEQ ID NO: 1354232 - RNA, 22 nt, Human
uccaaggccagcaggaauuuac

SEQ ID NO: 1354233 - RNA, 21 nt, Human
uccaggaaguucugccaccau

SEQ ID NO: 1354234 - RNA, 24 nt, Human
ucccagaugagcaccagagucaac

SEQ ID NO: 1354235 - RNA, 18 nt, Human
ucccucuccagcugcucu

SEQ ID NO: 1354236 - RNA, 20 nt, Human
ucccucuccagcugcucugg

SEQ ID NO: 1354237 - RNA, 20 nt, Human
ucccugagacaucaaguggc

SEQ ID NO: 1354238 - RNA, 20 nt, Human
uccucauccucuucccaccu

SEQ ID NO: 1354239 - RNA, 18 nt, Human
uccuugaggaauaguaaa

SEQ ID NO: 1354240 - RNA, 21 nt, Human
ucucaagaaaagagagcccau

SEQ ID NO: 1354241 - RNA, 20 nt, Human
ucuguaaucuuuauucuuga

SEQ ID NO: 1354242 - RNA, 24 nt, Human
ugaagagucagggagccagucugc

SEQ ID NO: 1354243 - RNA, 18 nt, Human
ugagcucguuucuccuaa

SEQ ID NO: 1354244 - RNA, 24 nt, Human
ugaggaucaagucuucccucuuuc

SEQ ID NO: 1354245 - RNA, 22 nt, Human
ugccaaaucccaacuuugcucc

SEQ ID NO: 1354246 - RNA, 19 nt, Human
ugccaggcuggagugcucg

SEQ ID NO: 1354247 - RNA, 24 nt, Human
ugccuucugccaaaucccaacuuu

SEQ ID NO: 1354248 - RNA, 20 nt, Human
uggaggaggggacucgguag

SEQ ID NO: 1354249 - RNA, 22 nt, Human
uggcaccgaaagaaugaaugag

SEQ ID NO: 1354250 - RNA, 24 nt, Human
uggggauuugaggcugaagaguca

SEQ ID NO: 1354251 - RNA, 24 nt, Human
uggucaacagcuagaaugcacccc

SEQ ID NO: 1354252 - RNA, 21 nt, Human
uggugggauggacugggugga

SEQ ID NO: 1354253 - RNA, 21 nt, Human
uuaaggcugcaacccagaaau

SEQ ID NO: 1354254 - RNA, 23 nt, Human
uuaccccugagcucguuucuccu

SEQ ID NO: 1354255 - RNA, 21 nt, Human
uucagugggucagacuccauc

SEQ ID NO: 1354256 - RNA, 23 nt, Human
uuccagauacaccagcccaccgu

SEQ ID NO: 1354257 - RNA, 23 nt, Human
uucccugagacaucaaguggcuu

SEQ ID NO: 1354258 - RNA, 26 nt, Human
uucccugagacaucaaguggcuuuca

SEQ ID NO: 1354259 - RNA, 19 nt, Human
uugcuccucauccucuucc

SEQ ID NO: 1354260 - RNA, 24 nt, Human
uuuccaguucugcgauuacugccu

SEQ ID NO: 1354261 - RNA, 18 nt, Human
uuucuccuaaguucccag

SEQ ID NO: 1354262 - RNA, 21 nt, Human
uuucuccuaaguucccagaug

SEQ ID NO: 1354263 - RNA, 24 nt, Human
uuuggccaccagaguuuggcugug

SEQ ID NO: 1354264 - RNA, 21 nt, Human
aaaaauaaucaugguagacac

SEQ ID NO: 1354265 - RNA, 23 nt, Human
agaaaaauaaucaugguagacac

SEQ ID NO: 1354266 - RNA, 19 nt, Human
acaaagcuaggggucaucg

SEQ ID NO: 1354267 - RNA, 23 nt, Human
acugagcuuuaucccugcagccu

SEQ ID NO: 1354268 - RNA, 23 nt, Human
aggcagagguuuuguccccucug

SEQ ID NO: 1354269 - RNA, 20 nt, Human
aggcucccccacaacacgcc

SEQ ID NO: 1354270 - RNA, 23 nt, Human
auccccccauucaauuucugcug

SEQ ID NO: 1354271 - RNA, 26 nt, Human
cacaguucaggccacaaagcuagggg

SEQ ID NO: 1354272 - RNA, 21 nt, Human
caccuggggugggaucucagg

SEQ ID NO: 1354273 - RNA, 21 nt, Human
cagccacccacaguucaggcc

SEQ ID NO: 1354274 - RNA, 22 nt, Human
ccaucugucucuuuccagcugc

SEQ ID NO: 1354275 - RNA, 22 nt, Human
cccacaguucaggccacaaagc

SEQ ID NO: 1354276 - RNA, 19 nt, Human
cccauucaauuucugcugu

SEQ ID NO: 1354277 - RNA, 18 nt, Human
cccccacaacacgccucu

SEQ ID NO: 1354278 - RNA, 24 nt, Human
ccucugaggcucccccacaacacc

SEQ ID NO: 1354279 - RNA, 19 nt, Human
cgccagcgcuaucaauccc

SEQ ID NO: 1354280 - RNA, 19 nt, Human
cucacaagccucagucugc

SEQ ID NO: 1354281 - RNA, 22 nt, Human
cuggggugggaucucaggcaga

SEQ ID NO: 1354282 - RNA, 22 nt, Human
gaggcucccccacaacacgccu

SEQ ID NO: 1354283 - RNA, 26 nt, Human
guccuauucaccucugggcugucuca

SEQ ID NO: 1354284 - RNA, 20 nt, Human
ucaugucaagaaccagacuc

SEQ ID NO: 1354285 - RNA, 24 nt, Human
ucugucucuuuccagcugcuuccc

SEQ ID NO: 1354286 - RNA, 20 nt, Human
ugaagagaugucugaagggc

SEQ ID NO: 1354287 - RNA, 24 nt, Human
ugaagagaugucugaagggcaucu

SEQ ID NO: 1354288 - RNA, 20 nt, Human
ugccaucugucucuuuccag

SEQ ID NO: 1354289 - RNA, 25 nt, Human
uggggugggaucucaggcagagguu

SEQ ID NO: 1354290 - RNA, 19 nt, Human
ugucaagaaccagacucug

SEQ ID NO: 1354291 - RNA, 21 nt, Human
ugucugaagggcaucucaugu

SEQ ID NO: 1354292 - RNA, 22 nt, Human
aagaugugagaaguguugacag

SEQ ID NO: 1354293 - RNA, 20 nt, Human
aagcugcagcuuagauggga

SEQ ID NO: 1354294 - RNA, 20 nt, Human
agagaccccaggggacagga

SEQ ID NO: 1354295 - RNA, 23 nt, Human
aggaagcugcagcuuagauggga

SEQ ID NO: 1354296 - RNA, 26 nt, Human
aggaagucaccaucaaaccacuuucu

SEQ ID NO: 1354297 - RNA, 21 nt, Human
aucacaacuccauggcaacaa

SEQ ID NO: 1354298 - RNA, 19 nt, Human
augcagcagagaccccagg

SEQ ID NO: 1354299 - RNA, 22 nt, Human
caacaagaugacacaaaugcag

SEQ ID NO: 1354300 - RNA, 23 nt, Human
caacuccauggcaacaagaugac

SEQ ID NO: 1354301 - RNA, 21 nt, Human
caagaugacacaaaugcagca

SEQ ID NO: 1354302 - RNA, 18 nt, Human
cucugucucuccccucug

SEQ ID NO: 1354303 - RNA, 18 nt, Human
cugcuuguccucccuggc

SEQ ID NO: 1354304 - RNA, 22 nt, Human
cuugcugcucugucucuccccu

SEQ ID NO: 1354305 - RNA, 23 nt, Human
gcuugcugcucugucucuccccu

SEQ ID NO: 1354306 - RNA, 19 nt, Human
uaaaauuuaaugcaugggg

SEQ ID NO: 1354307 - RNA, 18 nt, Human
uccccucucuuggccuac

SEQ ID NO: 1354308 - RNA, 21 nt, Human
ucucugguuccccucucuugg

SEQ ID NO: 1354309 - RNA, 23 nt, Human
ucucuuggccuacgucugucccu

SEQ ID NO: 1354310 - RNA, 18 nt, Human
ugacacaaaugcagcaga

SEQ ID NO: 1354311 - RNA, 19 nt, Human
ugcugaaguuuauucacuu

SEQ ID NO: 1354312 - RNA, 22 nt, Human
uggcaacaagaugacacaaaug

SEQ ID NO: 1354313 - RNA, 19 nt, Human
ugggaugaucacaacucca

SEQ ID NO: 1354314 - RNA, 21 nt, Human
uucaaaccacuuucaguaaca

SEQ ID NO: 1354315 - RNA, 19 nt, Human
uugcugcucugucucuccc

SEQ ID NO: 1354316 - RNA, 25 nt, Human
uugcugcucugucucuccccucugg

SEQ ID NO: 1354317 - RNA, 22 nt, Human
aaacuucauuaagaaagaacac

SEQ ID NO: 1354318 - RNA, 19 nt, Human
acaacccgcacccuccuac

SEQ ID NO: 1354319 - RNA, 23 nt, Human
acagccacccuggggggccccgg

SEQ ID NO: 1354320 - RNA, 20 nt, Human
acaggcagcagcacagccac

SEQ ID NO: 1354321 - RNA, 24 nt, Human
acccgcacccuccuacaggcagca

SEQ ID NO: 1354322 - RNA, 23 nt, Human
accuccccugaagccccaaagua

SEQ ID NO: 1354323 - RNA, 26 nt, Human
agaagaaagggggaaaguggaaggag

SEQ ID NO: 1354324 - RNA, 22 nt, Human
agcacaacccgcacccuccuac

SEQ ID NO: 1354325 - RNA, 26 nt, Human
caaaaccugacaaucaucaaucacua

SEQ ID NO: 1354326 - RNA, 20 nt, Human
caaaagguccacuggccccu

SEQ ID NO: 1354327 - RNA, 21 nt, Human
caaaguacaaaaccacagaug

SEQ ID NO: 1354328 - RNA, 24 nt, Human
caccaucuacaggggaugcaaaag

SEQ ID NO: 1354329 - RNA, 21 nt, Human
caccccggcccccgccgcaac

SEQ ID NO: 1354330 - RNA, 22 nt, Human
caccccugcuuccuccuucuuc

SEQ ID NO: 1354331 - RNA, 20 nt, Human
cacccuggggggccccggcc

SEQ ID NO: 1354332 - RNA, 21 nt, Human
caccggcccggccgcccgcgc

SEQ ID NO: 1354333 - RNA, 18 nt, Human
cacucaccaucuacaggg

SEQ ID NO: 1354334 - RNA, 22 nt, Human
cagcacaacccgcacccuccua

SEQ ID NO: 1354335 - RNA, 18 nt, Human
ccacuggccccuucccuc

SEQ ID NO: 1354336 - RNA, 20 nt, Human
ccagcccaccggcccggccg

SEQ ID NO: 1354337 - RNA, 21 nt, Human
cccccgccgcaaccgccgcag

SEQ ID NO: 1354338 - RNA, 20 nt, Human
ccccugcuuccuccuucuuc

SEQ ID NO: 1354339 - RNA, 20 nt, Human
ccccugcuuccuccuucuuc

SEQ ID NO: 1354340 - RNA, 27 nt, Human
cccgcgccucacugcccggcccggacc

SEQ ID NO: 1354341 - RNA, 20 nt, Human
cccggcccccgccgcaaccg

SEQ ID NO: 1354342 - RNA, 18 nt, Human
cccugcuuccuccuucuu

SEQ ID NO: 1354343 - RNA, 20 nt, Human
cccugcuuccuccuucuucu

SEQ ID NO: 1354344 - RNA, 21 nt, Human
ccgaacgccgagauggacauc

SEQ ID NO: 1354345 - RNA, 21 nt, Human
ccgccgcaaccgccgcagcag

SEQ ID NO: 1354346 - RNA, 21 nt, Human
ccgccgcagcagccgccaccc

SEQ ID NO: 1354347 - RNA, 23 nt, Human
ccgccgggcccgccgcccagccc

SEQ ID NO: 1354348 - RNA, 20 nt, Human
ccgggcccgccgcccagccc

SEQ ID NO: 1354349 - RNA, 20 nt, Human
ccuccgaacgccgagaugga

SEQ ID NO: 1354350 - RNA, 20 nt, Human
ccuccuacaggcagcagcac

SEQ ID NO: 1354351 - RNA, 23 nt, Human
ccuccuacaggcagcagcacagc

SEQ ID NO: 1354352 - RNA, 19 nt, Human
ccugaagccccaaaguaca

SEQ ID NO: 1354353 - RNA, 19 nt, Human
ccugcuuccuccuucuucu

SEQ ID NO: 1354354 - RNA, 22 nt, Human
ccuggcagcgggacuuucagug

SEQ ID NO: 1354355 - RNA, 20 nt, Human
cgagauggacaucaccgcca

SEQ ID NO: 1354356 - RNA, 20 nt, Human
cgccgggcccgccgcccagc

SEQ ID NO: 1354357 - RNA, 21 nt, Human
cggccgccgggcccgccgccc

SEQ ID NO: 1354358 - RNA, 24 nt, Human
cuccccugaagccccaaaguacaa

SEQ ID NO: 1354359 - RNA, 18 nt, Human
cuccuaaaaaagggcgug

SEQ ID NO: 1354360 - RNA, 23 nt, Human
gcacaacccgcacccuccuacag

SEQ ID NO: 1354361 - RNA, 21 nt, Human
gcacccuccuacaggcagcag

SEQ ID NO: 1354362 - RNA, 18 nt, Human
gcccaccggcccggccgc

SEQ ID NO: 1354363 - RNA, 20 nt, Human
gcgugcaaacccgaggauga

SEQ ID NO: 1354364 - RNA, 19 nt, Human
ggaaaguggaaggagugag

SEQ ID NO: 1354365 - RNA, 18 nt, Human
gggcgggugcuuccaaag

SEQ ID NO: 1354366 - RNA, 20 nt, Human
gucaccgguuucccccaaca

SEQ ID NO: 1354367 - RNA, 23 nt, Human
uaagaaagaacacguuaaauuag

SEQ ID NO: 1354368 - RNA, 24 nt, Human
uacaaaaccacagauguccacagg

SEQ ID NO: 1354369 - RNA, 21 nt, Human
uauuuauuuaaaaacagaaca

SEQ ID NO: 1354370 - RNA, 25 nt, Human
ucaacaaaaauaaauuaaaacuuca

SEQ ID NO: 1354371 - RNA, 23 nt, Human
ucaccgccaacacucaccaucua

SEQ ID NO: 1354372 - RNA, 24 nt, Human
uccuaaaaaagggcgugcaaaccc

SEQ ID NO: 1354373 - RNA, 21 nt, Human
ucucgguggccuccagccguc

SEQ ID NO: 1354374 - RNA, 20 nt, Human
ugcaaaugguggcugaaagc

SEQ ID NO: 1354375 - RNA, 19 nt, Human
ugcccggcccggaccgcgg

SEQ ID NO: 1354376 - RNA, 19 nt, Human
ugcgagggcggccgccggg

SEQ ID NO: 1354377 - RNA, 20 nt, Human
uggaaggagugaguuccauu

SEQ ID NO: 1354378 - RNA, 18 nt, Human
uggccccuucccucccca

SEQ ID NO: 1354379 - RNA, 22 nt, Human
uuaaacaccuccccugaagccc

SEQ ID NO: 1354380 - RNA, 21 nt, Human
uucauuuuauugaguggaaag

SEQ ID NO: 1354381 - RNA, 20 nt, Human
uucucgguggccuccagccg

SEQ ID NO: 1354382 - RNA, 23 nt, Human
aaaauuuguagaugaacuuuuag

SEQ ID NO: 1354383 - RNA, 23 nt, Human
aaagaaauagcacauucccuuca

SEQ ID NO: 1354384 - RNA, 20 nt, Human
aaaguguuaggauuacacca

SEQ ID NO: 1354385 - RNA, 18 nt, Human
aacuuaugaagaauaccc

SEQ ID NO: 1354386 - RNA, 23 nt, Human
aagcacuggggauugucacaacu

SEQ ID NO: 1354387 - RNA, 19 nt, Human
aaguggcugggacuauagg

SEQ ID NO: 1354388 - RNA, 20 nt, Human
aaguggcugggacuauaggc

SEQ ID NO: 1354389 - RNA, 25 nt, Human
aaguguuaggauuacaccaugcccg

SEQ ID NO: 1354390 - RNA, 19 nt, Human
acaacugaacaaaauucac

SEQ ID NO: 1354391 - RNA, 18 nt, Human
acagaaaguuugagaucu

SEQ ID NO: 1354392 - RNA, 19 nt, Human
acagaacaaagagcugucu

SEQ ID NO: 1354393 - RNA, 24 nt, Human
accauguugcccaggcuggucuug

SEQ ID NO: 1354394 - RNA, 25 nt, Human
accauguugcccaggcuggucuuga

SEQ ID NO: 1354395 - RNA, 19 nt, Human
acuauaggcgcaugcugcc

SEQ ID NO: 1354396 - RNA, 22 nt, Human
acugaacaaaauucacguucac

SEQ ID NO: 1354397 - RNA, 18 nt, Human
agagcuucccacauaccu

SEQ ID NO: 1354398 - RNA, 22 nt, Human
aggcaauccgcccgccuuggcc

SEQ ID NO: 1354399 - RNA, 24 nt, Human
aggcaauccgcccgccuuggccuc

SEQ ID NO: 1354400 - RNA, 22 nt, Human
agucugacaacaaauggcacca

SEQ ID NO: 1354401 - RNA, 21 nt, Human
agugcaguggugcaaucucag

SEQ ID NO: 1354402 - RNA, 24 nt, Human
agugcaguggugcaaucucagcuc

SEQ ID NO: 1354403 - RNA, 22 nt, Human
auagaacacccaagauuaaagg

SEQ ID NO: 1354404 - RNA, 22 nt, Human
aucuauucaccccuucaugcug

SEQ ID NO: 1354405 - RNA, 18 nt, Human
augggauuucaccauguu

SEQ ID NO: 1354406 - RNA, 21 nt, Human
auuacaaugaaccuccucaga

SEQ ID NO: 1354407 - RNA, 19 nt, Human
auuuuaguagacaugggau

SEQ ID NO: 1354408 - RNA, 23 nt, Human
caaaguguuaggauuacaccaug

SEQ ID NO: 1354409 - RNA, 22 nt, Human
caagcgauucuccugccucagc

SEQ ID NO: 1354410 - RNA, 27 nt, Human
caagcgauucuccugccucagccuccc

SEQ ID NO: 1354411 - RNA, 21 nt, Human
cacaauacaggaacacaaagc

SEQ ID NO: 1354412 - RNA, 23 nt, Human
caccauguugcccaggcuggucu

SEQ ID NO: 1354413 - RNA, 24 nt, Human
caccauguugcccaggcuggucuu

SEQ ID NO: 1354414 - RNA, 27 nt, Human
caccauguugcccaggcuggucuugaa

SEQ ID NO: 1354415 - RNA, 23 nt, Human
cacccaagauuaaaggugcguaa

SEQ ID NO: 1354416 - RNA, 22 nt, Human
cacucuguugccugggcuggag

SEQ ID NO: 1354417 - RNA, 23 nt, Human
cacugcaacuuccgccuucuggg

SEQ ID NO: 1354418 - RNA, 20 nt, Human
cagaacaaagagcugucuuc

SEQ ID NO: 1354419 - RNA, 26 nt, Human
cagcgauaguaaacagaagauccuga

SEQ ID NO: 1354420 - RNA, 21 nt, Human
cagugcuaggaauuaugugga

SEQ ID NO: 1354421 - RNA, 22 nt, Human
cagugcuauuauacugaauaaa

SEQ ID NO: 1354422 - RNA, 23 nt, Human
cauguugcccaggcuggucuuga

SEQ ID NO: 1354423 - RNA, 24 nt, Human
cauguugcccaggcuggucuugaa

SEQ ID NO: 1354424 - RNA, 19 nt, Human
ccaaaguguuaggauuaca

SEQ ID NO: 1354425 - RNA, 23 nt, Human
ccaaaguguuaggauuacaccau

SEQ ID NO: 1354426 - RNA, 18 nt, Human
ccacaauacaggaacaca

SEQ ID NO: 1354427 - RNA, 23 nt, Human
ccaggccacaauacaggaacaca

SEQ ID NO: 1354428 - RNA, 19 nt, Human
cccaaguggcugggacuau

SEQ ID NO: 1354429 - RNA, 24 nt, Human
cccaaguggcugggacuauaggcg

SEQ ID NO: 1354430 - RNA, 20 nt, Human
cccacuuucgcgacuucucu

SEQ ID NO: 1354431 - RNA, 21 nt, Human
cccauuuaccuggaguuucug

SEQ ID NO: 1354432 - RNA, 21 nt, Human
ccccucaccagugcuaggaau

SEQ ID NO: 1354433 - RNA, 22 nt, Human
cccgccuuggccucccaaagug

SEQ ID NO: 1354434 - RNA, 27 nt, Human
cccuaucccgggccuggcgcagcuccu

SEQ ID NO: 1354435 - RNA, 24 nt, Human
ccgccuucuggguucaagcgauuc

SEQ ID NO: 1354436 - RNA, 27 nt, Human
ccuccacaccuauagucugacaacaaa

SEQ ID NO: 1354437 - RNA, 23 nt, Human
ccugccucagccucccaaguggc

SEQ ID NO: 1354438 - RNA, 19 nt, Human
ccugggcuggagugcagug

SEQ ID NO: 1354439 - RNA, 24 nt, Human
ccuucuggguucaagcgauucucc

SEQ ID NO: 1354440 - RNA, 21 nt, Human
ccuuugcaggaccugggcaac

SEQ ID NO: 1354441 - RNA, 22 nt, Human
cgaacacaacagucccuauccc

SEQ ID NO: 1354442 - RNA, 20 nt, Human
cgaccggggcgggcauucga

SEQ ID NO: 1354443 - RNA, 23 nt, Human
cggggagcggcggccgaccaggu

SEQ ID NO: 1354444 - RNA, 24 nt, Human
cucacucuguugccugggcuggag

SEQ ID NO: 1354445 - RNA, 19 nt, Human
cucacugcaacuuccgccu

SEQ ID NO: 1354446 - RNA, 24 nt, Human
cucagccucccaaguggcugggac

SEQ ID NO: 1354447 - RNA, 23 nt, Human
cuccguggacuaggcggggagcg

SEQ ID NO: 1354448 - RNA, 18 nt, Human
cugacaaaaauggcacca

SEQ ID NO: 1354449 - RNA, 23 nt, Human
cugccucagccucccaaguggcu

SEQ ID NO: 1354450 - RNA, 21 nt, Human
cugucccgucccucagucgcg

SEQ ID NO: 1354451 - RNA, 20 nt, Human
cuugaacuccugagcucagg

SEQ ID NO: 1354452 - RNA, 21 nt, Human
cuuugcaggaccugggcaaca

SEQ ID NO: 1354453 - RNA, 22 nt, Human
gaacaaagagcugucuucugcc

SEQ ID NO: 1354454 - RNA, 24 nt, Human
gagcucaggcaauccgcccgccuu

SEQ ID NO: 1354455 - RNA, 21 nt, Human
gauucuccugccucagccucc

SEQ ID NO: 1354456 - RNA, 19 nt, Human
gcaggaccugggcaacaga

SEQ ID NO: 1354457 - RNA, 19 nt, Human
gccacaauacaggaacaca

SEQ ID NO: 1354458 - RNA, 24 nt, Human
gccucagccucccaaguggcuggg

SEQ ID NO: 1354459 - RNA, 23 nt, Human
gccuggcuaauuuuuuguauuuu

SEQ ID NO: 1354460 - RNA, 24 nt, Human
gcgauucuccugccucagccuccc

SEQ ID NO: 1354461 - RNA, 20 nt, Human
gcuccuuugcaggaccuggg

SEQ ID NO: 1354462 - RNA, 22 nt, Human
gcuccuuugcaggaccugggaa

SEQ ID NO: 1354463 - RNA, 24 nt, Human
ggcuggagugcaguggugcaaucu

SEQ ID NO: 1354464 - RNA, 24 nt, Human
ggcuggucuugaacuccugagcuc

SEQ ID NO: 1354465 - RNA, 22 nt, Human
gggauuucaccauguugcccag

SEQ ID NO: 1354466 - RNA, 22 nt, Human
gggcauucgaacacaacagucc

SEQ ID NO: 1354467 - RNA, 20 nt, Human
ggguucaagcgauucuccug

SEQ ID NO: 1354468 - RNA, 19 nt, Human
gguucaagcgauucuccug

SEQ ID NO: 1354469 - RNA, 21 nt, Human
gugaccucugaccugacaaaa

SEQ ID NO: 1354470 - RNA, 20 nt, Human
uaaagcaaugugcaccaagc

SEQ ID NO: 1354471 - RNA, 21 nt, Human
uaaauuaaagcaaugugcacc

SEQ ID NO: 1354472 - RNA, 19 nt, Human
uaauccuuagaaagcugac

SEQ ID NO: 1354473 - RNA, 22 nt, Human
uaauuuuuuguauuuuaguaga

SEQ ID NO: 1354474 - RNA, 23 nt, Human
uagaaagcugacagcacaacuca

SEQ ID NO: 1354475 - RNA, 22 nt, Human
uagacaugggauuucaccaugu

SEQ ID NO: 1354476 - RNA, 20 nt, Human
uagagcaauacagaacaaag

SEQ ID NO: 1354477 - RNA, 24 nt, Human
uaguagacaugggauuucaccaug

SEQ ID NO: 1354478 - RNA, 21 nt, Human
uagucugacaacaaauggcac

SEQ ID NO: 1354479 - RNA, 21 nt, Human
uagucugacaacaaauggcac

SEQ ID NO: 1354480 - RNA, 21 nt, Human
uauucacuggaaaauuuguag

SEQ ID NO: 1354481 - RNA, 19 nt, Human
ucaagcgauucuccugccu

SEQ ID NO: 1354482 - RNA, 21 nt, Human
ucacauugucccuucugagua

SEQ ID NO: 1354483 - RNA, 24 nt, Human
ucacucuguugccugggcuggagu

SEQ ID NO: 1354484 - RNA, 18 nt, Human
ucacugcaacuuccgccu

SEQ ID NO: 1354485 - RNA, 24 nt, Human
ucacugcaacuuccgccuucuggg

SEQ ID NO: 1354486 - RNA, 19 nt, Human
uccacaaaaucuauucacc

SEQ ID NO: 1354487 - RNA, 20 nt, Human
uccacaaaaucuauucaccc

SEQ ID NO: 1354488 - RNA, 21 nt, Human
uccacaaaaucuauucacccc

SEQ ID NO: 1354489 - RNA, 20 nt, Human
uccaucuaauuuacugcagu

SEQ ID NO: 1354490 - RNA, 18 nt, Human
ucccaaaguguuaggauu

SEQ ID NO: 1354491 - RNA, 24 nt, Human
ucccaaaguguuaggauuacaccu

SEQ ID NO: 1354492 - RNA, 24 nt, Human
ucccaaguggcugggacuauaggc

SEQ ID NO: 1354493 - RNA, 21 nt, Human
ucccaauuacuguugaaccug

SEQ ID NO: 1354494 - RNA, 20 nt, Human
ucuaaagucagagaaaagac

SEQ ID NO: 1354495 - RNA, 23 nt, Human
ucucacucuguugccugggcugg

SEQ ID NO: 1354496 - RNA, 24 nt, Human
ucucacucuguugccugggcugga

SEQ ID NO: 1354497 - RNA, 19 nt, Human
ucuccacaaaaucuauuca

SEQ ID NO: 1354498 - RNA, 26 nt, Human
ucuccugccucagccucccaaguggc

SEQ ID NO: 1354499 - RNA, 25 nt, Human
ucuccuguggacaacugaacaaaau

SEQ ID NO: 1354500 - RNA, 23 nt, Human
ucucugucccgucccucagucgc

SEQ ID NO: 1354501 - RNA, 22 nt, Human
ucuguugccugggcuggagugc

SEQ ID NO: 1354502 - RNA, 24 nt, Human
ucuguugccugggcuggagugcag

SEQ ID NO: 1354503 - RNA, 23 nt, Human
ucuugaacuccugagcucaggca

SEQ ID NO: 1354504 - RNA, 24 nt, Human
ugaacuccugagcucaggcaaucc

SEQ ID NO: 1354505 - RNA, 19 nt, Human
ugaauaaagaaauagcaca

SEQ ID NO: 1354506 - RNA, 23 nt, Human
ugaauagaacacccaagauuaaa

SEQ ID NO: 1354507 - RNA, 20 nt, Human
ugaaucagaauguggaaaaa

SEQ ID NO: 1354508 - RNA, 19 nt, Human
ugaccugacaaaaauggca

SEQ ID NO: 1354509 - RNA, 18 nt, Human
ugagaccgacaauguucc

SEQ ID NO: 1354510 - RNA, 18 nt, Human
ugaggccuugggcagcag

SEQ ID NO: 1354511 - RNA, 24 nt, Human
ugcccaggcuggucuugaacuccu

SEQ ID NO: 1354512 - RNA, 28 nt, Human
ugcccaggcuggucuugaacuccugagc

SEQ ID NO: 1354513 - RNA, 24 nt, Human
ugccucagccucccaaguggcugg

SEQ ID NO: 1354514 - RNA, 18 nt, Human
ugccugggcuggagugca

SEQ ID NO: 1354515 - RNA, 19 nt, Human
ugccugggcuggagugcag

SEQ ID NO: 1354516 - RNA, 20 nt, Human
ugccugggcuggagugcagu

SEQ ID NO: 1354517 - RNA, 24 nt, Human
ugccugggcuggagugcaguggug

SEQ ID NO: 1354518 - RNA, 18 nt, Human
uggagugcaguggugcaa

SEQ ID NO: 1354519 - RNA, 23 nt, Human
uggagugcaguggugcaaucuca

SEQ ID NO: 1354520 - RNA, 24 nt, Human
uggagugcaguggugcaaucucag

SEQ ID NO: 1354521 - RNA, 19 nt, Human
ugggacuauaggcgcaugc

SEQ ID NO: 1354522 - RNA, 21 nt, Human
ugggacuauaggcgcaugcug

SEQ ID NO: 1354523 - RNA, 22 nt, Human
ugggacuauaggcgcaugcugc

SEQ ID NO: 1354524 - RNA, 24 nt, Human
ugggacuauaggcgcaugcugcca

SEQ ID NO: 1354525 - RNA, 24 nt, Human
ugggauuucaccauguugcccagg

SEQ ID NO: 1354526 - RNA, 23 nt, Human
uggguucaagcgauucuccugcc

SEQ ID NO: 1354527 - RNA, 24 nt, Human
uggguucaagcgauucuccugccu

SEQ ID NO: 1354528 - RNA, 24 nt, Human
uggucuugaacuccugagcucagg

SEQ ID NO: 1354529 - RNA, 24 nt, Human
uggugcaaucucagcucacugcaa

SEQ ID NO: 1354530 - RNA, 27 nt, Human
ugucccgucccucagucgcgaccucca

SEQ ID NO: 1354531 - RNA, 18 nt, Human
uuaguagacaugggauuu

SEQ ID NO: 1354532 - RNA, 24 nt, Human
uuaguagacaugggauuucaccau

SEQ ID NO: 1354533 - RNA, 21 nt, Human
uucaagcgauucuccugccuc

SEQ ID NO: 1354534 - RNA, 23 nt, Human
uucaagcgauucuccugccucag

SEQ ID NO: 1354535 - RNA, 24 nt, Human
uucaagcgauucuccugccucagc

SEQ ID NO: 1354536 - RNA, 19 nt, Human
uucacagaagcacugggga

SEQ ID NO: 1354537 - RNA, 24 nt, Human
uucaccccuucaugcugacaucac

SEQ ID NO: 1354538 - RNA, 18 nt, Human
uucacuggaaaauuugua

SEQ ID NO: 1354539 - RNA, 24 nt, Human
uugccugggcuggagugcaguggu

SEQ ID NO: 1354540 - RNA, 21 nt, Human
uuggccucccaaaguguuagg

SEQ ID NO: 1354541 - RNA, 22 nt, Human
uuucaccauguugcccaggcug

SEQ ID NO: 1354542 - RNA, 23 nt, Human
uuucaccauguugcccaggcugg

SEQ ID NO: 1354543 - RNA, 24 nt, Human
uuucaccauguugcccaggcuggu

SEQ ID NO: 1354544 - RNA, 21 nt, Human
uuugcaggaccugggcaacag

SEQ ID NO: 1354545 - RNA, 18 nt, Human
uuuuuguauuuuaguaga

SEQ ID NO: 1354546 - RNA, 21 nt, Human
uuuuuuguauuuuaguagaca

SEQ ID NO: 1354547 - RNA, 27 nt, Human
uuuuuuuuuuuuggagacggagucuca

SEQ ID NO: 1354548 - RNA, 23 nt, Human
uuuuuuuuuuuuuuggagacgga

SEQ ID NO: 1354549 - RNA, 20 nt, Human
uuuuuuuuuuuuuuuuuugg

SEQ ID NO: 1354550 - RNA, 23 nt, Human
aaacaaggacauucucuuacaua

SEQ ID NO: 1354551 - RNA, 18 nt, Human
aagagccagagcaugggu

SEQ ID NO: 1354552 - RNA, 24 nt, Human
acacacgcauauuucuccugaacc

SEQ ID NO: 1354553 - RNA, 21 nt, Human
acauggcacuuuuccuucccu

SEQ ID NO: 1354554 - RNA, 19 nt, Human
agacaagagccagagcaug

SEQ ID NO: 1354555 - RNA, 18 nt, Human
agagagacaagagccaga

SEQ ID NO: 1354556 - RNA, 20 nt, Human
agauacccaggaguuguaau

SEQ ID NO: 1354557 - RNA, 20 nt, Human
agccacggcggcagaguccc

SEQ ID NO: 1354558 - RNA, 22 nt, Human
aggcaaaaucgagguguuggca

SEQ ID NO: 1354559 - RNA, 24 nt, Human
agggccauauaauauuccauugua

SEQ ID NO: 1354560 - RNA, 18 nt, Human
agggguuggagcugcugc

SEQ ID NO: 1354561 - RNA, 20 nt, Human
agggguuggagcugcugcca

SEQ ID NO: 1354562 - RNA, 20 nt, Human
agguguuggcaggcugggcu

SEQ ID NO: 1354563 - RNA, 19 nt, Human
agugccaccaacugagcag

SEQ ID NO: 1354564 - RNA, 19 nt, Human
auccuccuuucccuuacug

SEQ ID NO: 1354565 - RNA, 25 nt, Human
aucucccuuucccccaugcugucuc

SEQ ID NO: 1354566 - RNA, 22 nt, Human
auggaaaguucucugcuuuuaa

SEQ ID NO: 1354567 - RNA, 21 nt, Human
auuauuauaaauaaugcugcu

SEQ ID NO: 1354568 - RNA, 20 nt, Human
caacugacgagcagccuuaa

SEQ ID NO: 1354569 - RNA, 30 nt, Human
cacaauccauaucuaaacgucaauuguccu

SEQ ID NO: 1354570 - RNA, 19 nt, Human
cacaguuucugugcacuga

SEQ ID NO: 1354571 - RNA, 19 nt, Human
caccagccauggaaaguuc

SEQ ID NO: 1354572 - RNA, 19 nt, Human
cacuuuuccuucccucucu

SEQ ID NO: 1354573 - RNA, 25 nt, Human
cagaagcuucuggaagaagaccuca

SEQ ID NO: 1354574 - RNA, 20 nt, Human
cagcuccuggagccggaccu

SEQ ID NO: 1354575 - RNA, 18 nt, Human
cagcuucaagcaacaucc

SEQ ID NO: 1354576 - RNA, 22 nt, Human
caucaucacaucuaaguuuaga

SEQ ID NO: 1354577 - RNA, 24 nt, Human
cauccuccuuucccuuacuggggg

SEQ ID NO: 1354578 - RNA, 20 nt, Human
ccauccuuccuucccaagcu

SEQ ID NO: 1354579 - RNA, 21 nt, Human
ccauucaauuccauucaaugc

SEQ ID NO: 1354580 - RNA, 22 nt, Human
ccauuuaagaugaaccauucaa

SEQ ID NO: 1354581 - RNA, 18 nt, Human
cccacaauccauaucuaa

SEQ ID NO: 1354582 - RNA, 23 nt, Human
ccccgauuaaggccaccugagac

SEQ ID NO: 1354583 - RNA, 19 nt, Human
cccgccagccugcagcaac

SEQ ID NO: 1354584 - RNA, 19 nt, Human
cccuuucccccaugcuguc

SEQ ID NO: 1354585 - RNA, 22 nt, Human
ccuagacuguaacacggucacu

SEQ ID NO: 1354586 - RNA, 21 nt, Human
ccugagacaguccacccugga

SEQ ID NO: 1354587 - RNA, 19 nt, Human
ccuggggucuccauuucuu

SEQ ID NO: 1354588 - RNA, 18 nt, Human
cuaagugggacuaagacc

SEQ ID NO: 1354589 - RNA, 24 nt, Human
cucacauucuucccacuggacuug

SEQ ID NO: 1354590 - RNA, 22 nt, Human
cuuaucagagcuaggacaauuu

SEQ ID NO: 1354591 - RNA, 22 nt, Human
cuucaagcaacauccauuuagc

SEQ ID NO: 1354592 - RNA, 20 nt, Human
cuugcagccacggcggcaga

SEQ ID NO: 1354593 - RNA, 24 nt, Human
cuuggccacaaaagggugcagggg

SEQ ID NO: 1354594 - RNA, 18 nt, Human
cuuuggguguggggugcu

SEQ ID NO: 1354595 - RNA, 25 nt, Human
gaagcuucuggaagaagaccucaca

SEQ ID NO: 1354596 - RNA, 21 nt, Human
gauuaaggccaccugagacag

SEQ ID NO: 1354597 - RNA, 18 nt, Human
gcaaauuuuucuggggac

SEQ ID NO: 1354598 - RNA, 23 nt, Human
gcagccacuuuccauuccucccu

SEQ ID NO: 1354599 - RNA, 21 nt, Human
gcugcaggcuaggggucuccc

SEQ ID NO: 1354600 - RNA, 20 nt, Human
gcugcuguaacaaagugcca

SEQ ID NO: 1354601 - RNA, 20 nt, Human
gcuguggcagggagagaagc

SEQ ID NO: 1354602 - RNA, 18 nt, Human
ggccaccugagacagucc

SEQ ID NO: 1354603 - RNA, 23 nt, Human
gggugccccacguguggggacag

SEQ ID NO: 1354604 - RNA, 18 nt, Human
ggguuggagcugcugcca

SEQ ID NO: 1354605 - RNA, 24 nt, Human
ggucuccauuucuuugcuacgugg

SEQ ID NO: 1354606 - RNA, 20 nt, Human
gguugggagugaggggggcc

SEQ ID NO: 1354607 - RNA, 19 nt, Human
gugcagggguuggagcugc

SEQ ID NO: 1354608 - RNA, 20 nt, Human
gugcuggagggagaggcugg

SEQ ID NO: 1354609 - RNA, 22 nt, Human
uaacacggucacugggguccag

SEQ ID NO: 1354610 - RNA, 22 nt, Human
uaaugcugcuaugaacauugug

SEQ ID NO: 1354611 - RNA, 26 nt, Human
uaccucugccaccagccauggaaagu

SEQ ID NO: 1354612 - RNA, 21 nt, Human
uagaacacuuucauugccccc

SEQ ID NO: 1354613 - RNA, 18 nt, Human
uauagucacaugaaugcc

SEQ ID NO: 1354614 - RNA, 24 nt, Human
uauguacggagacacacgcauagu

SEQ ID NO: 1354615 - RNA, 18 nt, Human
uauuuuguuuaucuauuc

SEQ ID NO: 1354616 - RNA, 20 nt, Human
ucaagcaacauccauuuagc

SEQ ID NO: 1354617 - RNA, 18 nt, Human
ucacgcacuauaaaauuc

SEQ ID NO: 1354618 - RNA, 24 nt, Human
ucaguauuuuucuagcagggcuuu

SEQ ID NO: 1354619 - RNA, 22 nt, Human
ucauuaggguugugagcagaau

SEQ ID NO: 1354620 - RNA, 22 nt, Human
ucauugcccccagaauaaaccg

SEQ ID NO: 1354621 - RNA, 20 nt, Human
uccuccuuucccuuacuggg

SEQ ID NO: 1354622 - RNA, 21 nt, Human
uccuggguccugugguagcuc

SEQ ID NO: 1354623 - RNA, 18 nt, Human
uccuucccaagcuuuaaa

SEQ ID NO: 1354624 - RNA, 23 nt, Human
ucgcuuaugauugcaggccuggg

SEQ ID NO: 1354625 - RNA, 19 nt, Human
ugaaaacaugaccuuuggg

SEQ ID NO: 1354626 - RNA, 19 nt, Human
ugacauggcacuuuuccuu

SEQ ID NO: 1354627 - RNA, 24 nt, Human
ugagaaucugcagaagcuucugga

SEQ ID NO: 1354628 - RNA, 20 nt, Human
ugauccaagacacucucccu

SEQ ID NO: 1354629 - RNA, 20 nt, Human
ugaucgaaccccacaaucca

SEQ ID NO: 1354630 - RNA, 19 nt, Human
ugcagccacggcggcagag

SEQ ID NO: 1354631 - RNA, 18 nt, Human
ugccaccagccauggaaa

SEQ ID NO: 1354632 - RNA, 21 nt, Human
ugccucaacuguauuuucugc

SEQ ID NO: 1354633 - RNA, 24 nt, Human
ugcuggagggagaggcuggaggcu

SEQ ID NO: 1354634 - RNA, 27 nt, Human
uggagggagaggcuggaggcuguuuuu

SEQ ID NO: 1354635 - RNA, 19 nt, Human
uggcaggcugggcucuuuc

SEQ ID NO: 1354636 - RNA, 22 nt, Human
uggcaggcugggcucuuucccg

SEQ ID NO: 1354637 - RNA, 21 nt, Human
uggcagggagagaagccugcg

SEQ ID NO: 1354638 - RNA, 27 nt, Human
ugggguccagcuccuggagccggaccu

SEQ ID NO: 1354639 - RNA, 18 nt, Human
uggggugcuaagugggac

SEQ ID NO: 1354640 - RNA, 20 nt, Human
ugucucuuuccaauguccuu

SEQ ID NO: 1354641 - RNA, 20 nt, Human
ugugaaaacaugaccuuugg

SEQ ID NO: 1354642 - RNA, 21 nt, Human
uguggcagggagagaagccug

SEQ ID NO: 1354643 - RNA, 24 nt, Human
uuagcagccacuuuccauuccucc

SEQ ID NO: 1354644 - RNA, 22 nt, Human
uucacgcacuauaaaauucacc

SEQ ID NO: 1354645 - RNA, 20 nt, Human
uucauuuuccauugcugcug

SEQ ID NO: 1354646 - RNA, 24 nt, Human
uuccaauguccuuucuaccucugc

SEQ ID NO: 1354647 - RNA, 22 nt, Human
uuccauccuuccuucccaagcu

SEQ ID NO: 1354648 - RNA, 25 nt, Human
uuccauccuuccuucccaagcuuua

SEQ ID NO: 1354649 - RNA, 22 nt, Human
uucccacuggacuuggccacaa

SEQ ID NO: 1354650 - RNA, 21 nt, Human
uucccggaggugcucauuagg

SEQ ID NO: 1354651 - RNA, 21 nt, Human
uuccugaccccagaggccagg

SEQ ID NO: 1354652 - RNA, 22 nt, Human
uuuaagaugaaccauucaauuc

SEQ ID NO: 1354653 - RNA, 24 nt, Human
uuucccggaggugcucauuagggu

SEQ ID NO: 1354654 - RNA, 21 nt, Human
uuucugcuuaggggcuuacaa

SEQ ID NO: 1354655 - RNA, 24 nt, Human
uuugcuacguggccugaggcuucc

SEQ ID NO: 1354656 - RNA, 27 nt, Human
uuugcuacguggccugaggcuuccuuu

SEQ ID NO: 1354657 - RNA, 24 nt, Human
uuuuaugucuggcuucuucauuac

SEQ ID NO: 1354658 - RNA, 23 nt, Human
acccagcaggcacagaaauguuu

SEQ ID NO: 1354659 - RNA, 21 nt, Human
acuuggggcugggcccauccu

SEQ ID NO: 1354660 - RNA, 18 nt, Human
agacaaagucaggacacg

SEQ ID NO: 1354661 - RNA, 18 nt, Human
agacgugccccuacccag

SEQ ID NO: 1354662 - RNA, 19 nt, Human
agcagccucagguguacag

SEQ ID NO: 1354663 - RNA, 22 nt, Human
agccacaucugaguccagcccc

SEQ ID NO: 1354664 - RNA, 18 nt, Human
agcuggaacuuggggcug

SEQ ID NO: 1354665 - RNA, 21 nt, Human
agcuggaacuuggggcugggc

SEQ ID NO: 1354666 - RNA, 24 nt, Human
aggagccguggggugucccugggu

SEQ ID NO: 1354667 - RNA, 20 nt, Human
aggaugaggacaagcagcag

SEQ ID NO: 1354668 - RNA, 20 nt, Human
aggcagacggccacggcgau

SEQ ID NO: 1354669 - RNA, 22 nt, Human
aggcugggggaggggcaggggc

SEQ ID NO: 1354670 - RNA, 24 nt, Human
aggugguggugguggugcugaggu

SEQ ID NO: 1354671 - RNA, 22 nt, Human
aucacacgcacauacacacaca

SEQ ID NO: 1354672 - RNA, 25 nt, Human
cacauacacacacacagaugggcug

SEQ ID NO: 1354673 - RNA, 22 nt, Human
cacucaccacuguacagccugg

SEQ ID NO: 1354674 - RNA, 18 nt, Human
cacuguacagccugggac

SEQ ID NO: 1354675 - RNA, 23 nt, Human
cacuguacagccugggacuccca

SEQ ID NO: 1354676 - RNA, 23 nt, Human
cagacgugccccuacccagcagg

SEQ ID NO: 1354677 - RNA, 19 nt, Human
cagcagcaggaccaggcag

SEQ ID NO: 1354678 - RNA, 19 nt, Human
cagcaggaccaggcagacg

SEQ ID NO: 1354679 - RNA, 26 nt, Human
cagcaugagaugugugugguuggggg

SEQ ID NO: 1354680 - RNA, 20 nt, Human
cagggaggagccguggggug

SEQ ID NO: 1354681 - RNA, 18 nt, Human
caugacaggccccgcgug

SEQ ID NO: 1354682 - RNA, 18 nt, Human
ccacaucugaguccagcc

SEQ ID NO: 1354683 - RNA, 20 nt, Human
ccacccagggggcugagcag

SEQ ID NO: 1354684 - RNA, 21 nt, Human
ccccgguguggggaagggccc

SEQ ID NO: 1354685 - RNA, 18 nt, Human
ccccucagacgugccccu

SEQ ID NO: 1354686 - RNA, 22 nt, Human
cccuaugugccccggcggccgg

SEQ ID NO: 1354687 - RNA, 18 nt, Human
ccggcuucugccuguccu

SEQ ID NO: 1354688 - RNA, 21 nt, Human
ccucaaggcugggggaggggc

SEQ ID NO: 1354689 - RNA, 19 nt, Human
ccucggccucagagguggg

SEQ ID NO: 1354690 - RNA, 19 nt, Human
ccugggcccuggggccgag

SEQ ID NO: 1354691 - RNA, 22 nt, Human
cgcacauacacacacacagaug

SEQ ID NO: 1354692 - RNA, 21 nt, Human
cgccacgccacacacacacuc

SEQ ID NO: 1354693 - RNA, 25 nt, Human
cugguaggugguggugguggugcuu

SEQ ID NO: 1354694 - RNA, 18 nt, Human
gagcagauggggguuguc

SEQ ID NO: 1354695 - RNA, 19 nt, Human
gagccguggggugucccug

SEQ ID NO: 1354696 - RNA, 26 nt, Human
gaggcaugcguggcacgugcucgugu

SEQ ID NO: 1354697 - RNA, 21 nt, Human
gaguguaggugucgggccugg

SEQ ID NO: 1354698 - RNA, 20 nt, Human
gcacugucccuccugggccc

SEQ ID NO: 1354699 - RNA, 23 nt, Human
gcagcucuccccgguguggggaa

SEQ ID NO: 1354700 - RNA, 19 nt, Human
gccacgccacacacacacu

SEQ ID NO: 1354701 - RNA, 18 nt, Human
gcccugguaggugguggu

SEQ ID NO: 1354702 - RNA, 19 nt, Human
gccugggacucccauugca

SEQ ID NO: 1354703 - RNA, 20 nt, Human
gcuggaacuuggggcugggc

SEQ ID NO: 1354704 - RNA, 18 nt, Human
gcugggcuugaugcugac

SEQ ID NO: 1354705 - RNA, 21 nt, Human
ggagcagggccccucagacgu

SEQ ID NO: 1354706 - RNA, 25 nt, Human
ggcaccucaaggcugggggaggggc

SEQ ID NO: 1354707 - RNA, 21 nt, Human
ggcagggaggagccguggggu

SEQ ID NO: 1354708 - RNA, 18 nt, Human
ggccacggcgaugaggcc

SEQ ID NO: 1354709 - RNA, 20 nt, Human
ggccgccacccagggggcug

SEQ ID NO: 1354710 - RNA, 23 nt, Human
ggccuggcccaggcuccaggcac

SEQ ID NO: 1354711 - RNA, 21 nt, Human
gggcagggucugaaggaccag

SEQ ID NO: 1354712 - RNA, 20 nt, Human
gggcccuggcccaggcccag

SEQ ID NO: 1354713 - RNA, 19 nt, Human
ggggaagggccccuguccg

SEQ ID NO: 1354714 - RNA, 22 nt, Human
ggggugucugcgugacccggga

SEQ ID NO: 1354715 - RNA, 24 nt, Human
gguagcaucacacgcacauacaca

SEQ ID NO: 1354716 - RNA, 23 nt, Human
gguggguggagagggcagcaugu

SEQ ID NO: 1354717 - RNA, 23 nt, Human
gugcauggccguguguaugcggg

SEQ ID NO: 1354718 - RNA, 23 nt, Human
gugcauggccguguguaugcggg

SEQ ID NO: 1354719 - RNA, 18 nt, Human
guggugcugagguccggc

SEQ ID NO: 1354720 - RNA, 23 nt, Human
gugguggugcugagguccggcug

SEQ ID NO: 1354721 - RNA, 23 nt, Human
guguguggcggccgccacccagg

SEQ ID NO: 1354722 - RNA, 23 nt, Human
uaagacaaagucaggacacgagc

SEQ ID NO: 1354723 - RNA, 24 nt, Human
uaagacaaagucaggacacgagcu

SEQ ID NO: 1354724 - RNA, 22 nt, Human
uaagggacagcuucggccggga

SEQ ID NO: 1354725 - RNA, 19 nt, Human
ucacgcccgauaaaacccc

SEQ ID NO: 1354726 - RNA, 19 nt, Human
ucacgcccgauaaaacccc

SEQ ID NO: 1354727 - RNA, 19 nt, Human
uccagccccuccuucuucc

SEQ ID NO: 1354728 - RNA, 22 nt, Human
ucuuccggcaauaaacgaggau

SEQ ID NO: 1354729 - RNA, 18 nt, Human
ugacaggccccgcguggg

SEQ ID NO: 1354730 - RNA, 19 nt, Human
ugacccgggaggggggugu

SEQ ID NO: 1354731 - RNA, 24 nt, Human
ugagaugugugugguuggggggug

SEQ ID NO: 1354732 - RNA, 21 nt, Human
ugagcacacgaggcaugcgug

SEQ ID NO: 1354733 - RNA, 21 nt, Human
ugagcuggaacuuggggcugg

SEQ ID NO: 1354734 - RNA, 19 nt, Human
ugcauaagguccagcucag

SEQ ID NO: 1354735 - RNA, 18 nt, Human
ugcccugguagguggugg

SEQ ID NO: 1354736 - RNA, 20 nt, Human
ugccucggggcagggagcgg

SEQ ID NO: 1354737 - RNA, 21 nt, Human
ugcgugcauggccguguguau

SEQ ID NO: 1354738 - RNA, 22 nt, Human
ugcucgugugguggucgugugc

SEQ ID NO: 1354739 - RNA, 18 nt, Human
uggaacuuggggcugggc

SEQ ID NO: 1354740 - RNA, 21 nt, Human
uggagaggugggaguucgggc

SEQ ID NO: 1354741 - RNA, 18 nt, Human
uggcacgugcucgugugg

SEQ ID NO: 1354742 - RNA, 18 nt, Human
uggcccaggcuccaggca

SEQ ID NO: 1354743 - RNA, 18 nt, Human
uggcggccgccacccagg

SEQ ID NO: 1354744 - RNA, 20 nt, Human
uggcggccgccacccagggg

SEQ ID NO: 1354745 - RNA, 21 nt, Human
ugggagagcuguggugcagug

SEQ ID NO: 1354746 - RNA, 18 nt, Human
ugggaguucgggcagggu

SEQ ID NO: 1354747 - RNA, 26 nt, Human
uggggccgagugugaguggcagugcc

SEQ ID NO: 1354748 - RNA, 19 nt, Human
ugguagguggugguggugg

SEQ ID NO: 1354749 - RNA, 25 nt, Human
uggugagcuggaacuuggggcuggg

SEQ ID NO: 1354750 - RNA, 20 nt, Human
uggugguggugcugaggucc

SEQ ID NO: 1354751 - RNA, 18 nt, Human
ugguggugguggugcuga

SEQ ID NO: 1354752 - RNA, 21 nt, Human
ugguggugguggugcugaggu

SEQ ID NO: 1354753 - RNA, 22 nt, Human
uguacagcaugagaugugugug

SEQ ID NO: 1354754 - RNA, 22 nt, Human
uguccuuggugggugccaaagc

SEQ ID NO: 1354755 - RNA, 25 nt, Human
uguccuuggugggugccaaagcugg

SEQ ID NO: 1354756 - RNA, 21 nt, Human
ugugagaggcaaaugugcacc

SEQ ID NO: 1354757 - RNA, 19 nt, Human
ugugcgugcauggccgugu

SEQ ID NO: 1354758 - RNA, 26 nt, Human
ugugcgugcauggccguguguaugcg

SEQ ID NO: 1354759 - RNA, 26 nt, Human
ugugugcgugcauggccguguguaug

SEQ ID NO: 1354760 - RNA, 21 nt, Human
aaaccugcagcccaagcccag

SEQ ID NO: 1354761 - RNA, 19 nt, Human
aaagaacauauuccucucc

SEQ ID NO: 1354762 - RNA, 21 nt, Human
aaagaacauauuccucuccaa

SEQ ID NO: 1354763 - RNA, 19 nt, Human
aaagcagacuguauaggaa

SEQ ID NO: 1354764 - RNA, 24 nt, Human
aaagccucuccaacauauucacac

SEQ ID NO: 1354765 - RNA, 24 nt, Human
aaaggcaaguagugucuguccaca

SEQ ID NO: 1354766 - RNA, 18 nt, Human
aaauagccuuaauuaaga

SEQ ID NO: 1354767 - RNA, 24 nt, Human
aagcagguggauacaaacuguuug

SEQ ID NO: 1354768 - RNA, 19 nt, Human
accaccuccacaaacguug

SEQ ID NO: 1354769 - RNA, 20 nt, Human
acccagguccagcuaagccc

SEQ ID NO: 1354770 - RNA, 24 nt, Human
agauuaccagagguugucaugacu

SEQ ID NO: 1354771 - RNA, 23 nt, Human
agauuguucuuagagacccccaa

SEQ ID NO: 1354772 - RNA, 23 nt, Human
agcaagaaguucuagguucccuc

SEQ ID NO: 1354773 - RNA, 21 nt, Human
aggaaaacccagguccagcua

SEQ ID NO: 1354774 - RNA, 23 nt, Human
aggagaagguaagauuaccagag

SEQ ID NO: 1354775 - RNA, 21 nt, Human
aggggaaaaaaaaauacugua

SEQ ID NO: 1354776 - RNA, 24 nt, Human
aggguucuucucagagauuguucu

SEQ ID NO: 1354777 - RNA, 18 nt, Human
agugaagaacacaaagcc

SEQ ID NO: 1354778 - RNA, 22 nt, Human
auagaugaggggaaagacuugg

SEQ ID NO: 1354779 - RNA, 22 nt, Human
auccuguccaacuuggcuccca

SEQ ID NO: 1354780 - RNA, 20 nt, Human
caaaaaugccuugaaauaac

SEQ ID NO: 1354781 - RNA, 22 nt, Human
caaaccugcagcccaagcccag

SEQ ID NO: 1354782 - RNA, 24 nt, Human
caauucuuaaucuguugcaaaaca

SEQ ID NO: 1354783 - RNA, 20 nt, Human
cacagugaagaacacaaagc

SEQ ID NO: 1354784 - RNA, 20 nt, Human
caccaccccagucaccaccc

SEQ ID NO: 1354785 - RNA, 25 nt, Human
cacucccuccuacgcuccuccaguc

SEQ ID NO: 1354786 - RNA, 21 nt, Human
cagcacgguacauguccucuc

SEQ ID NO: 1354787 - RNA, 20 nt, Human
cagcccaagcccaggagcca

SEQ ID NO: 1354788 - RNA, 18 nt, Human
cagccggcuccgaacgau

SEQ ID NO: 1354789 - RNA, 18 nt, Human
caggaaggcugccucccu

SEQ ID NO: 1354790 - RNA, 22 nt, Human
cauagaugaggggaaagacuug

SEQ ID NO: 1354791 - RNA, 24 nt, Human
cauaggaaaacccagguccagcua

SEQ ID NO: 1354792 - RNA, 22 nt, Human
cauguccucucacugcucggcc

SEQ ID NO: 1354793 - RNA, 23 nt, Human
ccaccuccacaaacguugagcca

SEQ ID NO: 1354794 - RNA, 24 nt, Human
ccagcuaagcccuaccucaaagua

SEQ ID NO: 1354795 - RNA, 20 nt, Human
ccagguccagcuaagcccua

SEQ ID NO: 1354796 - RNA, 20 nt, Human
ccccaaaccugcagcccaag

SEQ ID NO: 1354797 - RNA, 22 nt, Human
cccccaaaccugcagcccaagc

SEQ ID NO: 1354798 - RNA, 26 nt, Human
cccccaaaccugcagcccaagcccag

SEQ ID NO: 1354799 - RNA, 24 nt, Human
ccccuucaccaccccagucaccac

SEQ ID NO: 1354800 - RNA, 23 nt, Human
cccgcgccguggccgccgccucc

SEQ ID NO: 1354801 - RNA, 21 nt, Human
ccgccgccucccgcgccggcg

SEQ ID NO: 1354802 - RNA, 24 nt, Human
ccgccgccucccgcgccggcgucu

SEQ ID NO: 1354803 - RNA, 20 nt, Human
ccgccgccuucccgccgucc

SEQ ID NO: 1354804 - RNA, 19 nt, Human
ccgcgccguggccgccgcc

SEQ ID NO: 1354805 - RNA, 18 nt, Human
ccguggccgccgccuccc

SEQ ID NO: 1354806 - RNA, 21 nt, Human
ccuacgcuccuccagucuuca

SEQ ID NO: 1354807 - RNA, 19 nt, Human
ccucccucaggcuucccaa

SEQ ID NO: 1354808 - RNA, 24 nt, Human
ccugaguuaaagcagaccgggguc

SEQ ID NO: 1354809 - RNA, 22 nt, Human
ccugcaccaagccccagacucc

SEQ ID NO: 1354810 - RNA, 22 nt, Human
ccugcagcccaagcccaggagc

SEQ ID NO: 1354811 - RNA, 23 nt, Human
ccugcagcccaagcccaggagcc

SEQ ID NO: 1354812 - RNA, 20 nt, Human
cgccacgucgccaggcuguc

SEQ ID NO: 1354813 - RNA, 21 nt, Human
cucuccauucuuuuuugcagu

SEQ ID NO: 1354814 - RNA, 18 nt, Human
cugcagcacgguacaugu

SEQ ID NO: 1354815 - RNA, 19 nt, Human
cugcccgcuggccgccgcc

SEQ ID NO: 1354816 - RNA, 24 nt, Human
cuguagaauaauuaaagcuuccaa

SEQ ID NO: 1354817 - RNA, 24 nt, Human
cugucauagucacaaggagcaaga

SEQ ID NO: 1354818 - RNA, 24 nt, Human
gaaaagagcauaggaaaacccagg

SEQ ID NO: 1354819 - RNA, 18 nt, Human
gagccaauucaggggcug

SEQ ID NO: 1354820 - RNA, 20 nt, Human
gaguuuccucugauacaaaa

SEQ ID NO: 1354821 - RNA, 21 nt, Human
gauccggagccccucccgucg

SEQ ID NO: 1354822 - RNA, 21 nt, Human
gcagcucgcgccuggccacgc

SEQ ID NO: 1354823 - RNA, 21 nt, Human
gcauagucccccgacucaugc

SEQ ID NO: 1354824 - RNA, 24 nt, Human
gccaguuuaccauuagagagaguu

SEQ ID NO: 1354825 - RNA, 20 nt, Human
gcccaagcccaggagccacc

SEQ ID NO: 1354826 - RNA, 25 nt, Human
gccccagacuccagugcgcuggggg

SEQ ID NO: 1354827 - RNA, 18 nt, Human
gccgccuucccgccgucc

SEQ ID NO: 1354828 - RNA, 21 nt, Human
gcuuccaacacuaaaccacaa

SEQ ID NO: 1354829 - RNA, 23 nt, Human
ggagccccucccgucggggugcc

SEQ ID NO: 1354830 - RNA, 20 nt, Human
ggcaccaccugcaccaagcc

SEQ ID NO: 1354831 - RNA, 19 nt, Human
ggccgccgccucccgcgcc

SEQ ID NO: 1354832 - RNA, 19 nt, Human
guauuuccucuccauucuu

SEQ ID NO: 1354833 - RNA, 20 nt, Human
gugucuguccacacugaugg

SEQ ID NO: 1354834 - RNA, 20 nt, Human
guucugaugccccucuuuca

SEQ ID NO: 1354835 - RNA, 28 nt, Human
uaaagaacauauuccucuccaaaacuga

SEQ ID NO: 1354836 - RNA, 20 nt, Human
uaaagcagacuguuagaagc

SEQ ID NO: 1354837 - RNA, 22 nt, Human
uaaagcagacuguuagaagccc

SEQ ID NO: 1354838 - RNA, 22 nt, Human
uaagauguaaguccaaaccauu

SEQ ID NO: 1354839 - RNA, 20 nt, Human
uacaaacuguuuggcuauaa

SEQ ID NO: 1354840 - RNA, 25 nt, Human
uagaauccuaaagagugaugucucc

SEQ ID NO: 1354841 - RNA, 24 nt, Human
uagagacccccaaaccugcagccc

SEQ ID NO: 1354842 - RNA, 21 nt, Human
uagccaggaaggcugccuccc

SEQ ID NO: 1354843 - RNA, 24 nt, Human
uaggaagaucuauagaaacccguu

SEQ ID NO: 1354844 - RNA, 21 nt, Human
ucacucauccccugacccaga

SEQ ID NO: 1354845 - RNA, 22 nt, Human
ucagacaucugucauagucacu

SEQ ID NO: 1354846 - RNA, 20 nt, Human
ucaggacauccuguccaacu

SEQ ID NO: 1354847 - RNA, 21 nt, Human
ucaggacauccuguccaacuu

SEQ ID NO: 1354848 - RNA, 22 nt, Human
ucaggacauccuguccaacuug

SEQ ID NO: 1354849 - RNA, 23 nt, Human
ucaggacauccuguccaacuugg

SEQ ID NO: 1354850 - RNA, 19 nt, Human
uccaaaccauugcucuucc

SEQ ID NO: 1354851 - RNA, 25 nt, Human
ucccaggggcccaaggguucuucuc

SEQ ID NO: 1354852 - RNA, 24 nt, Human
uccccugacccagacggguuacac

SEQ ID NO: 1354853 - RNA, 22 nt, Human
ucccgcgccguggccgccgccu

SEQ ID NO: 1354854 - RNA, 23 nt, Human
uccugaguuaaagcagacuguau

SEQ ID NO: 1354855 - RNA, 23 nt, Human
ucgccaggcugucaggagcaugc

SEQ ID NO: 1354856 - RNA, 25 nt, Human
ucuauagaaacccguuacuacuaaa

SEQ ID NO: 1354857 - RNA, 23 nt, Human
ucucgggccgcggcugcccgcug

SEQ ID NO: 1354858 - RNA, 28 nt, Human
ucuucaaaaaugccuugaaauaacccac

SEQ ID NO: 1354859 - RNA, 18 nt, Human
ugaaagcagguggauaca

SEQ ID NO: 1354860 - RNA, 27 nt, Human
ugacuaugccaguaacagaucuauccc

SEQ ID NO: 1354861 - RNA, 19 nt, Human
ugaguuaaagcagacugua

SEQ ID NO: 1354862 - RNA, 18 nt, Human
ugcaucauagaugagggg

SEQ ID NO: 1354863 - RNA, 23 nt, Human
ugccaguagaauccuaaagagug

SEQ ID NO: 1354864 - RNA, 19 nt, Human
ugccucaaaaaaaauagcu

SEQ ID NO: 1354865 - RNA, 18 nt, Human
ugcgcugggggcaucaga

SEQ ID NO: 1354866 - RNA, 22 nt, Human
ugcucuucccuucauaaaaagg

SEQ ID NO: 1354867 - RNA, 18 nt, Human
uggauacaaacuguuugg

SEQ ID NO: 1354868 - RNA, 21 nt, Human
uggcaguggacacacccuccu

SEQ ID NO: 1354869 - RNA, 21 nt, Human
uggcucccaggggcccaaggg

SEQ ID NO: 1354870 - RNA, 21 nt, Human
ugggagaaagcuaaaguaaca

SEQ ID NO: 1354871 - RNA, 22 nt, Human
ugggagaaagcuaaaguaacag

SEQ ID NO: 1354872 - RNA, 24 nt, Human
uggggcaccaccugcaccaagccc

SEQ ID NO: 1354873 - RNA, 19 nt, Human
uguaaguccaaaccauugc

SEQ ID NO: 1354874 - RNA, 22 nt, Human
uuacuacuaaaggggaaaaaaa

SEQ ID NO: 1354875 - RNA, 22 nt, Human
uucaacacucuaaucaauaaau

SEQ ID NO: 1354876 - RNA, 23 nt, Human
uucacagugaagaacacaaagcc

SEQ ID NO: 1354877 - RNA, 21 nt, Human
uucaccaccccagucaccacc

SEQ ID NO: 1354878 - RNA, 25 nt, Human
uuccaacacuaaaccacaagguacc

SEQ ID NO: 1354879 - RNA, 24 nt, Human
uuccuccucugaaagcagguggau

SEQ ID NO: 1354880 - RNA, 29 nt, Human
uucuuagagacccccaaaccugcagcccc

SEQ ID NO: 1354881 - RNA, 21 nt, Human
uugcucuucccuucauaaaaa

SEQ ID NO: 1354882 - RNA, 20 nt, Human
uuucacagugaagaacacaa

SEQ ID NO: 1354883 - RNA, 24 nt, Human
uuuggccuuugguuccuccucugg

SEQ ID NO: 1354884 - RNA, 22 nt, Human
aaagaaucucggguuaugaggg

SEQ ID NO: 1354885 - RNA, 21 nt, Human
aagagcccacaaagaaucucg

SEQ ID NO: 1354886 - RNA, 26 nt, Human
acaccaccucaaaggcaggggaacgc

SEQ ID NO: 1354887 - RNA, 20 nt, Human
agacaggaauaaaaaugagc

SEQ ID NO: 1354888 - RNA, 25 nt, Human
agacaggaauaaaaaugagcucugc

SEQ ID NO: 1354889 - RNA, 26 nt, Human
agacaggaauaaaaaugaggggaccc

SEQ ID NO: 1354890 - RNA, 18 nt, Human
agggaggggcuggccgug

SEQ ID NO: 1354891 - RNA, 23 nt, Human
agggcagacugagguaggagagc

SEQ ID NO: 1354892 - RNA, 19 nt, Human
cagcagggaagcgauggga

SEQ ID NO: 1354893 - RNA, 21 nt, Human
cauuccaggguagggcagacu

SEQ ID NO: 1354894 - RNA, 22 nt, Human
ccgucuggaaaacucucugagu

SEQ ID NO: 1354895 - RNA, 18 nt, Human
cuacugggccguccuggu

SEQ ID NO: 1354896 - RNA, 20 nt, Human
uccaggguagggcagacuga

SEQ ID NO: 1354897 - RNA, 21 nt, Human
uggaaaacucucugaguucug

SEQ ID NO: 1354898 - RNA, 22 nt, Human
uggaaaacucucugaguucugg

SEQ ID NO: 1354899 - RNA, 30 nt, Human
uuugcacgauugcagacaggaauaaaaauu

SEQ ID NO: 1354900 - RNA, 19 nt, Human
aaaacaaacaaacaaaaaa

SEQ ID NO: 1354901 - RNA, 22 nt, Human
aaacaaaaaauauagagcaggg

SEQ ID NO: 1354902 - RNA, 23 nt, Human
aaacaaacaaaaaauauagagca

SEQ ID NO: 1354903 - RNA, 20 nt, Human
aaaguagcaccaugagagca

SEQ ID NO: 1354904 - RNA, 19 nt, Human
aacacugugaaaccccguc

SEQ ID NO: 1354905 - RNA, 20 nt, Human
aacacugugaaaccccgucu

SEQ ID NO: 1354906 - RNA, 21 nt, Human
aacacugugaaaccccgucuc

SEQ ID NO: 1354907 - RNA, 23 nt, Human
aagaaucccauugucccugcccu

SEQ ID NO: 1354908 - RNA, 27 nt, Human
aaggcgcucagcucagacugcagaagc

SEQ ID NO: 1354909 - RNA, 22 nt, Human
aauccugaccucugcggacaua

SEQ ID NO: 1354910 - RNA, 18 nt, Human
aaugaucuugucuccugg

SEQ ID NO: 1354911 - RNA, 24 nt, Human
aauugcuugaacccgggaggugga

SEQ ID NO: 1354912 - RNA, 24 nt, Human
aauugcuuuaaccugggaccugga

SEQ ID NO: 1354913 - RNA, 18 nt, Human
acaaagagacagagaagc

SEQ ID NO: 1354914 - RNA, 21 nt, Human
acaaagaguaucagagggaaa

SEQ ID NO: 1354915 - RNA, 20 nt, Human
acaccuuggcggcaucauaa

SEQ ID NO: 1354916 - RNA, 19 nt, Human
acacggugagacucccucu

SEQ ID NO: 1354917 - RNA, 20 nt, Human
acacggugagacucccucuc

SEQ ID NO: 1354918 - RNA, 24 nt, Human
acacggugagacucccucucaaaa

SEQ ID NO: 1354919 - RNA, 25 nt, Human
acagagcaagauuuguuucauuuag

SEQ ID NO: 1354920 - RNA, 24 nt, Human
accaauauggugaaaccccaucuc

SEQ ID NO: 1354921 - RNA, 18 nt, Human
accaccuucuauugaggc

SEQ ID NO: 1354922 - RNA, 18 nt, Human
accaccuucugucucuug

SEQ ID NO: 1354923 - RNA, 24 nt, Human
accccaucucuacuaaaaauacaa

SEQ ID NO: 1354924 - RNA, 24 nt, Human
accccgucucuacuaaaaauacaa

SEQ ID NO: 1354925 - RNA, 24 nt, Human
accuggagguugcagugagccgag

SEQ ID NO: 1354926 - RNA, 23 nt, Human
accuggauggcagagcaagacuc

SEQ ID NO: 1354927 - RNA, 18 nt, Human
acgcaacucugccuccca

SEQ ID NO: 1354928 - RNA, 18 nt, Human
acuacuguugggguggug

SEQ ID NO: 1354929 - RNA, 21 nt, Human
acucuugccucuuuagacaaa

SEQ ID NO: 1354930 - RNA, 19 nt, Human
acugcaccaaccccagccc

SEQ ID NO: 1354931 - RNA, 24 nt, Human
acugcacucaaaccuggauggugg

SEQ ID NO: 1354932 - RNA, 18 nt, Human
acugcacuccagccuggg

SEQ ID NO: 1354933 - RNA, 23 nt, Human
acugcacuccagccugggugaca

SEQ ID NO: 1354934 - RNA, 18 nt, Human
acuuugggaggcugaggc

SEQ ID NO: 1354935 - RNA, 21 nt, Human
agaaaagaccuuccagucaga

SEQ ID NO: 1354936 - RNA, 24 nt, Human
agacagacugaccgaccgaccaga

SEQ ID NO: 1354937 - RNA, 24 nt, Human
agacaggagaauugcuugaacccg

SEQ ID NO: 1354938 - RNA, 18 nt, Human
agacuggacauugaaaau

SEQ ID NO: 1354939 - RNA, 18 nt, Human
agagaucacaccacugca

SEQ ID NO: 1354940 - RNA, 20 nt, Human
agagggaacuggcccccggu

SEQ ID NO: 1354941 - RNA, 20 nt, Human
agaggucaggggagggaaau

SEQ ID NO: 1354942 - RNA, 20 nt, Human
agaguaaauucacagccaga

SEQ ID NO: 1354943 - RNA, 18 nt, Human
agcaagacuccauccccc

SEQ ID NO: 1354944 - RNA, 24 nt, Human
agcacuuugggaggccgaggaggg

SEQ ID NO: 1354945 - RNA, 23 nt, Human
agcagacaguaaaacacagacaa

SEQ ID NO: 1354946 - RNA, 19 nt, Human
agcaggcaccaggccaccc

SEQ ID NO: 1354947 - RNA, 23 nt, Human
agccgggcaugguggcacgugcc

SEQ ID NO: 1354948 - RNA, 24 nt, Human
agccugaccaauauggugaaaccc

SEQ ID NO: 1354949 - RNA, 22 nt, Human
agccugggugacacggugagac

SEQ ID NO: 1354950 - RNA, 24 nt, Human
agccugggugacacggugagacuc

SEQ ID NO: 1354951 - RNA, 19 nt, Human
agcuaugaucacaccugug

SEQ ID NO: 1354952 - RNA, 19 nt, Human
aggaagccccaaacaugca

SEQ ID NO: 1354953 - RNA, 22 nt, Human
aggaagccccaaacaugcauga

SEQ ID NO: 1354954 - RNA, 22 nt, Human
aggaaggagggacuaagagggu

SEQ ID NO: 1354955 - RNA, 22 nt, Human
aggagauuacuacuguuggggu

SEQ ID NO: 1354956 - RNA, 24 nt, Human
aggagggcggaucaugaagucagg

SEQ ID NO: 1354957 - RNA, 22 nt, Human
aggcagugcucaucaaagugcc

SEQ ID NO: 1354958 - RNA, 20 nt, Human
aggccgaggagggcggauca

SEQ ID NO: 1354959 - RNA, 24 nt, Human
aggcgcgguggcucacgccaguaa

SEQ ID NO: 1354960 - RNA, 24 nt, Human
aggcugagacaggagaauugcuug

SEQ ID NO: 1354961 - RNA, 18 nt, Human
aggcugaggcgaguggau

SEQ ID NO: 1354962 - RNA, 27 nt, Human
agggaagagaugaaggaagggggaccc

SEQ ID NO: 1354963 - RNA, 23 nt, Human
agggugcaguggcacgccugugg

SEQ ID NO: 1354964 - RNA, 25 nt, Human
agguggagguugcagugacaacggu

SEQ ID NO: 1354965 - RNA, 22 nt, Human
agguggagguugcagugagaag

SEQ ID NO: 1354966 - RNA, 24 nt, Human
agguggagguugcagugagaagag

SEQ ID NO: 1354967 - RNA, 18 nt, Human
aguggcucagccucucug

SEQ ID NO: 1354968 - RNA, 18 nt, Human
auauauauacacauauau

SEQ ID NO: 1354969 - RNA, 24 nt, Human
aucacaccacugcacucaaaccug

SEQ ID NO: 1354970 - RNA, 24 nt, Human
aucgugccacugcacuccagccug

SEQ ID NO: 1354971 - RNA, 23 nt, Human
aucugcgugucgacugcaggcac

SEQ ID NO: 1354972 - RNA, 20 nt, Human
auggugaaaccccaucucua

SEQ ID NO: 1354973 - RNA, 20 nt, Human
caaaaaggcacaaagaguau

SEQ ID NO: 1354974 - RNA, 20 nt, Human
caaaguagcaccaugagagc

SEQ ID NO: 1354975 - RNA, 19 nt, Human
caagcugaaauaauauccu

SEQ ID NO: 1354976 - RNA, 19 nt, Human
caccaggccaccccuccgc

SEQ ID NO: 1354977 - RNA, 20 nt, Human
caccaugagagcaaaggucu

SEQ ID NO: 1354978 - RNA, 23 nt, Human
cacccagccacccugaccaccuu

SEQ ID NO: 1354979 - RNA, 21 nt, Human
caccuguaguaguuacuuggg

SEQ ID NO: 1354980 - RNA, 24 nt, Human
cacgccaguaaucccagcacuuug

SEQ ID NO: 1354981 - RNA, 19 nt, Human
cacuccagccugggugaca

SEQ ID NO: 1354982 - RNA, 19 nt, Human
cacuccagccugggugaca

SEQ ID NO: 1354983 - RNA, 24 nt, Human
cacuccagccugggugacacggug

SEQ ID NO: 1354984 - RNA, 24 nt, Human
cacugcacucaaaccuggauggca

SEQ ID NO: 1354985 - RNA, 19 nt, Human
cacugcacuccagccuggg

SEQ ID NO: 1354986 - RNA, 21 nt, Human
cacugcacuccagccugggug

SEQ ID NO: 1354987 - RNA, 22 nt, Human
cacugcacuccagccuggguga

SEQ ID NO: 1354988 - RNA, 23 nt, Human
cacugcacuccagccugggugac

SEQ ID NO: 1354989 - RNA, 24 nt, Human
cacugcacuccagccugggugaca

SEQ ID NO: 1354990 - RNA, 24 nt, Human
cacuucacuccagccuaggcaaca

SEQ ID NO: 1354991 - RNA, 21 nt, Human
cagagcaagacuccauccccc

SEQ ID NO: 1354992 - RNA, 21 nt, Human
cagcaacccugccauaauacc

SEQ ID NO: 1354993 - RNA, 23 nt, Human
cagcacuuugggaggccgaggag

SEQ ID NO: 1354994 - RNA, 28 nt, Human
cagcacuuugggaggccgaggagggcgg

SEQ ID NO: 1354995 - RNA, 18 nt, Human
cagccacggaaccugcca

SEQ ID NO: 1354996 - RNA, 24 nt, Human
cagcuauucgggaggcugaggcag

SEQ ID NO: 1354997 - RNA, 21 nt, Human
cagcucagacugcagaagcaa

SEQ ID NO: 1354998 - RNA, 18 nt, Human
cagcugguugagacugga

SEQ ID NO: 1354999 - RNA, 24 nt, Human
cagcuuccuccucguaaagcagga

SEQ ID NO: 1355000 - RNA, 21 nt, Human
caggcacagagggaggucggg

SEQ ID NO: 1355001 - RNA, 20 nt, Human
caguagguccacuuugggaa

SEQ ID NO: 1355002 - RNA, 23 nt, Human
cagugaugacgccaaaguagcac

SEQ ID NO: 1355003 - RNA, 19 nt, Human
cagugcucaucaaagugcc

SEQ ID NO: 1355004 - RNA, 19 nt, Human
caucugggacaaacaccgc

SEQ ID NO: 1355005 - RNA, 18 nt, Human
ccaaccccagcccucugg

SEQ ID NO: 1355006 - RNA, 18 nt, Human
ccaacggccucaccccag

SEQ ID NO: 1355007 - RNA, 20 nt, Human
ccacugcacuccagccuggg

SEQ ID NO: 1355008 - RNA, 20 nt, Human
ccacugcacuccagccuggg

SEQ ID NO: 1355009 - RNA, 21 nt, Human
ccacugcacuccagccugggu

SEQ ID NO: 1355010 - RNA, 21 nt, Human
ccacugcacuccagccugggu

SEQ ID NO: 1355011 - RNA, 23 nt, Human
ccacugcacuccagccuggguga

SEQ ID NO: 1355012 - RNA, 24 nt, Human
ccacugcacuccagccugggugac

SEQ ID NO: 1355013 - RNA, 20 nt, Human
ccacuucacuccagccuagg

SEQ ID NO: 1355014 - RNA, 20 nt, Human
ccacuucacuccagccuagg

SEQ ID NO: 1355015 - RNA, 21 nt, Human
ccacuucacuccagccuaggc

SEQ ID NO: 1355016 - RNA, 21 nt, Human
ccaggccaccccuccgcuccc

SEQ ID NO: 1355017 - RNA, 21 nt, Human
ccagggcccugggaccggagc

SEQ ID NO: 1355018 - RNA, 22 nt, Human
ccaguaaucccagcacuuuggg

SEQ ID NO: 1355019 - RNA, 19 nt, Human
cccacacacacauaaaugu

SEQ ID NO: 1355020 - RNA, 23 nt, Human
cccacagcauuuagaccaaaacc

SEQ ID NO: 1355021 - RNA, 19 nt, Human
cccauugucccugcccugg

SEQ ID NO: 1355022 - RNA, 21 nt, Human
ccccaaaugagccacuccagu

SEQ ID NO: 1355023 - RNA, 21 nt, Human
cccgggagguggagguugcag

SEQ ID NO: 1355024 - RNA, 18 nt, Human
cccugggcuacaaggccc

SEQ ID NO: 1355025 - RNA, 24 nt, Human
ccugaccaauauggugaaacccca

SEQ ID NO: 1355026 - RNA, 23 nt, Human
ccugcgggccgagucaaugagcu

SEQ ID NO: 1355027 - RNA, 19 nt, Human
ccuggaggacugaggaaug

SEQ ID NO: 1355028 - RNA, 23 nt, Human
ccuggcuaacacugugaaacccc

SEQ ID NO: 1355029 - RNA, 24 nt, Human
ccuggcuaacacugugaaaccccg

SEQ ID NO: 1355030 - RNA, 21 nt, Human
ccugggaccuggagguugcag

SEQ ID NO: 1355031 - RNA, 18 nt, Human
ccuggguacagcaaggcu

SEQ ID NO: 1355032 - RNA, 22 nt, Human
ccugggugacacggugagacuc

SEQ ID NO: 1355033 - RNA, 19 nt, Human
ccuguagucccagcuauuc

SEQ ID NO: 1355034 - RNA, 21 nt, Human
ccuguagucccagcuauucgg

SEQ ID NO: 1355035 - RNA, 22 nt, Human
ccuguagucccagcuauucggg

SEQ ID NO: 1355036 - RNA, 19 nt, Human
ccugugguucuagcuacuc

SEQ ID NO: 1355037 - RNA, 24 nt, Human
cgagaccauccuggcuaacacugu

SEQ ID NO: 1355038 - RNA, 18 nt, Human
cgccaaaguagcaccaug

SEQ ID NO: 1355039 - RNA, 24 nt, Human
cgccugugguucuagcuacucagg

SEQ ID NO: 1355040 - RNA, 23 nt, Human
cgggagguggagguugcagugag

SEQ ID NO: 1355041 - RNA, 21 nt, Human
cuaucugccuagauugugcuu

SEQ ID NO: 1355042 - RNA, 24 nt, Human
cucacgccaguaaucccagcacuu

SEQ ID NO: 1355043 - RNA, 20 nt, Human
cugaauccaccuccugcuuc

SEQ ID NO: 1355044 - RNA, 27 nt, Human
cugcuguguucccaguuucuagaagug

SEQ ID NO: 1355045 - RNA, 21 nt, Human
cuggcccccgguccaucccuc

SEQ ID NO: 1355046 - RNA, 19 nt, Human
cuggguagacauggggcug

SEQ ID NO: 1355047 - RNA, 20 nt, Human
cugguguugaacacaacuga

SEQ ID NO: 1355048 - RNA, 22 nt, Human
cuucagcuuccugguaaauucc

SEQ ID NO: 1355049 - RNA, 21 nt, Human
cuuuccucuuucuuuaauucu

SEQ ID NO: 1355050 - RNA, 20 nt, Human
gaaggaaggagggacuaaga

SEQ ID NO: 1355051 - RNA, 21 nt, Human
gaaggaaggagggacuaagag

SEQ ID NO: 1355052 - RNA, 19 nt, Human
gagaagcaguccaagccuc

SEQ ID NO: 1355053 - RNA, 23 nt, Human
gagaauugcuugaacccgggagg

SEQ ID NO: 1355054 - RNA, 23 nt, Human
gagaucgugccacugcacuccag

SEQ ID NO: 1355055 - RNA, 18 nt, Human
gaggaauggaugcucuga

SEQ ID NO: 1355056 - RNA, 22 nt, Human
gaggcugagacaggagaauugc

SEQ ID NO: 1355057 - RNA, 23 nt, Human
gagguugcagugagccgagaucg

SEQ ID NO: 1355058 - RNA, 18 nt, Human
gagucagagggaagagau

SEQ ID NO: 1355059 - RNA, 24 nt, Human
gaucagcugaggucaguaguucaa

SEQ ID NO: 1355060 - RNA, 18 nt, Human
gaucaugaagucaggaga

SEQ ID NO: 1355061 - RNA, 18 nt, Human
gauugcuuaugcccagga

SEQ ID NO: 1355062 - RNA, 24 nt, Human
gcaauccugaccucugcggacaua

SEQ ID NO: 1355063 - RNA, 22 nt, Human
gcacacuuuguccaucuggaaa

SEQ ID NO: 1355064 - RNA, 19 nt, Human
gcacagagggaggucgggg

SEQ ID NO: 1355065 - RNA, 25 nt, Human
gcagagcaagacuccaucccccccc

SEQ ID NO: 1355066 - RNA, 21 nt, Human
gcaggagcgacuguuggggug

SEQ ID NO: 1355067 - RNA, 19 nt, Human
gccacugcacuccagccug

SEQ ID NO: 1355068 - RNA, 24 nt, Human
gccacugcacuccagccuggguga

SEQ ID NO: 1355069 - RNA, 23 nt, Human
gccacuucacuccagccuaggca

SEQ ID NO: 1355070 - RNA, 20 nt, Human
gccgagaucgugccacugca

SEQ ID NO: 1355071 - RNA, 24 nt, Human
gcucugggccgcuggcugcacugg

SEQ ID NO: 1355072 - RNA, 25 nt, Human
gcugcaguaagcuaugaucacaccu

SEQ ID NO: 1355073 - RNA, 22 nt, Human
gcuuuggcuggcccacugcugu

SEQ ID NO: 1355074 - RNA, 18 nt, Human
ggagguugcagugagaag

SEQ ID NO: 1355075 - RNA, 24 nt, Human
ggagguugcagugagaagagauca

SEQ ID NO: 1355076 - RNA, 20 nt, Human
ggagguugcagugagccgag

SEQ ID NO: 1355077 - RNA, 22 nt, Human
ggagguugcagugagccgagau

SEQ ID NO: 1355078 - RNA, 24 nt, Human
ggagguugcagugagccgagaucg

SEQ ID NO: 1355079 - RNA, 20 nt, Human
ggauauguguggauggaugg

SEQ ID NO: 1355080 - RNA, 18 nt, Human
ggauggcagagcaagacu

SEQ ID NO: 1355081 - RNA, 19 nt, Human
ggaugguggacgggaggca

SEQ ID NO: 1355082 - RNA, 22 nt, Human
ggaugguggacgggaggcagug

SEQ ID NO: 1355083 - RNA, 23 nt, Human
ggcaacaccuggcuagcucuagu

SEQ ID NO: 1355084 - RNA, 20 nt, Human
ggccauaggacuuacagagc

SEQ ID NO: 1355085 - RNA, 18 nt, Human
ggccgaggagggcggauc

SEQ ID NO: 1355086 - RNA, 18 nt, Human
ggcggaucaugaagucag

SEQ ID NO: 1355087 - RNA, 21 nt, Human
ggcucacgccaguaaucccag

SEQ ID NO: 1355088 - RNA, 19 nt, Human
ggcuuuggcuggcccacug

SEQ ID NO: 1355089 - RNA, 20 nt, Human
ggguacagcaaggcuuucau

SEQ ID NO: 1355090 - RNA, 23 nt, Human
ggguacuuugggaggcugaggcg

SEQ ID NO: 1355091 - RNA, 24 nt, Human
gggugcaguggugugcaccuguag

SEQ ID NO: 1355092 - RNA, 21 nt, Human
ggucaguucucagccucucag

SEQ ID NO: 1355093 - RNA, 24 nt, Human
gguggcucacgccaguaaucccag

SEQ ID NO: 1355094 - RNA, 20 nt, Human
guaaauuccucaaacuccuu

SEQ ID NO: 1355095 - RNA, 21 nt, Human
guaaauuccucaaacuccuua

SEQ ID NO: 1355096 - RNA, 26 nt, Human
gugaccuuaaaaaugugcuggacaua

SEQ ID NO: 1355097 - RNA, 19 nt, Human
gugcaguggugugcaccug

SEQ ID NO: 1355098 - RNA, 19 nt, Human
gugcugagcuucccugagc

SEQ ID NO: 1355099 - RNA, 24 nt, Human
guggcucacgccaguaaucccagc

SEQ ID NO: 1355100 - RNA, 22 nt, Human
guggugugcaccuguaguaguu

SEQ ID NO: 1355101 - RNA, 20 nt, Human
uaaaacacagacaagacagc

SEQ ID NO: 1355102 - RNA, 22 nt, Human
uaaacacaacaaagagacagag

SEQ ID NO: 1355103 - RNA, 27 nt, Human
uaaacacaacaaagagacagagaagca

SEQ ID NO: 1355104 - RNA, 21 nt, Human
uaaagcagggugcaguggcac

SEQ ID NO: 1355105 - RNA, 24 nt, Human
uaacacugugaaaccccgucucua

SEQ ID NO: 1355106 - RNA, 21 nt, Human
uaagauagggaagcuaaaagc

SEQ ID NO: 1355107 - RNA, 22 nt, Human
uagaaugggugggugguuguaa

SEQ ID NO: 1355108 - RNA, 24 nt, Human
uagauagauagacagacugaccga

SEQ ID NO: 1355109 - RNA, 24 nt, Human
uagcagaauaccaaaauacacuuu

SEQ ID NO: 1355110 - RNA, 23 nt, Human
uagccacuucacuccagccuagg

SEQ ID NO: 1355111 - RNA, 22 nt, Human
uaggcaacauaaggagacccca

SEQ ID NO: 1355112 - RNA, 19 nt, Human
uagucccagcuauucggga

SEQ ID NO: 1355113 - RNA, 20 nt, Human
uauaagcagccagaaagagc

SEQ ID NO: 1355114 - RNA, 18 nt, Human
uauauauacacauauaua

SEQ ID NO: 1355115 - RNA, 24 nt, Human
uauguagaaagggcagaggucagg

SEQ ID NO: 1355116 - RNA, 23 nt, Human
ucacaccacugcacucaaaccug

SEQ ID NO: 1355117 - RNA, 20 nt, Human
ucaccagggaaaaagaacuc

SEQ ID NO: 1355118 - RNA, 20 nt, Human
ucaggugggcucuggugggc

SEQ ID NO: 1355119 - RNA, 18 nt, Human
ucaugaagucaggagauc

SEQ ID NO: 1355120 - RNA, 24 nt, Human
ucaugaagucaggagaucgagacc

SEQ ID NO: 1355121 - RNA, 20 nt, Human
uccaaugaaugaaagaaucc

SEQ ID NO: 1355122 - RNA, 21 nt, Human
uccagagggaacuggcccccg

SEQ ID NO: 1355123 - RNA, 23 nt, Human
uccagccugggugacacggugag

SEQ ID NO: 1355124 - RNA, 24 nt, Human
uccagccugggugacacggugaga

SEQ ID NO: 1355125 - RNA, 20 nt, Human
uccauccccccccaaaaaua

SEQ ID NO: 1355126 - RNA, 22 nt, Human
uccauccccccccaaaaauaua

SEQ ID NO: 1355127 - RNA, 22 nt, Human
ucccuuacugcaccaaccccag

SEQ ID NO: 1355128 - RNA, 20 nt, Human
uccggcaacaccuggcuagc

SEQ ID NO: 1355129 - RNA, 20 nt, Human
ucgggaggcugaggcagaau

SEQ ID NO: 1355130 - RNA, 23 nt, Human
ucgugccacugcacuccagccug

SEQ ID NO: 1355131 - RNA, 22 nt, Human
ucuaacuauaagcagccagaaa

SEQ ID NO: 1355132 - RNA, 24 nt, Human
ucucuacuaaaaauacaaaaaauu

SEQ ID NO: 1355133 - RNA, 23 nt, Human
ucucuacuaaaaauacaaaaauu

SEQ ID NO: 1355134 - RNA, 20 nt, Human
ucugucagcgggaggccaua

SEQ ID NO: 1355135 - RNA, 23 nt, Human
ucuugccucuuuagacaaaguga

SEQ ID NO: 1355136 - RNA, 21 nt, Human
ucuugcuuuucuuuggcguuu

SEQ ID NO: 1355137 - RNA, 22 nt, Human
ucuuuccucuuucuuuaauucu

SEQ ID NO: 1355138 - RNA, 19 nt, Human
ugaaaccccaucucuacua

SEQ ID NO: 1355139 - RNA, 22 nt, Human
ugaaggaaggagggacuaagag

SEQ ID NO: 1355140 - RNA, 23 nt, Human
ugaagugggaggauugcuuaugc

SEQ ID NO: 1355141 - RNA, 24 nt, Human
ugaauccuuaaaaacucuuagucu

SEQ ID NO: 1355142 - RNA, 18 nt, Human
ugaaugaaagaaucccau

SEQ ID NO: 1355143 - RNA, 22 nt, Human
ugacacggugagacucccucuc

SEQ ID NO: 1355144 - RNA, 24 nt, Human
ugaccaauauggugaaaccccauc

SEQ ID NO: 1355145 - RNA, 25 nt, Human
ugaccuuaaaaaugugcuggacaua

SEQ ID NO: 1355146 - RNA, 24 nt, Human
ugagacaggagaauugcuugaacc

SEQ ID NO: 1355147 - RNA, 25 nt, Human
ugagacaggagaauugcuugaaccc

SEQ ID NO: 1355148 - RNA, 21 nt, Human
ugagagaggcagagacccugc

SEQ ID NO: 1355149 - RNA, 20 nt, Human
ugagaucauucugcaagaau

SEQ ID NO: 1355150 - RNA, 22 nt, Human
ugagccgagaucgugccacugc

SEQ ID NO: 1355151 - RNA, 23 nt, Human
ugaggcugcaguaagcuaugauc

SEQ ID NO: 1355152 - RNA, 23 nt, Human
ugcaggagcgacuguuggggugc

SEQ ID NO: 1355153 - RNA, 26 nt, Human
ugcccaccuaagccaccuaagcugua

SEQ ID NO: 1355154 - RNA, 26 nt, Human
ugcccagccacggaaccugccaagca

SEQ ID NO: 1355155 - RNA, 24 nt, Human
ugccuguagucccagcuauucggg

SEQ ID NO: 1355156 - RNA, 21 nt, Human
uggaaaaugaucuugucuccu

SEQ ID NO: 1355157 - RNA, 19 nt, Human
uggacagauguggccccac

SEQ ID NO: 1355158 - RNA, 24 nt, Human
uggaucagcugaggucaguaguuc

SEQ ID NO: 1355159 - RNA, 19 nt, Human
uggcccuccucuccaucuc

SEQ ID NO: 1355160 - RNA, 20 nt, Human
uggcggcaucauaaugggcg

SEQ ID NO: 1355161 - RNA, 24 nt, Human
uggcucacgccaguaaucccagca

SEQ ID NO: 1355162 - RNA, 24 nt, Human
uggcucagccucucugagcuccag

SEQ ID NO: 1355163 - RNA, 24 nt, Human
ugggaccuggagguugcagugagc

SEQ ID NO: 1355164 - RNA, 19 nt, Human
ugggaggccgaggagggcg

SEQ ID NO: 1355165 - RNA, 24 nt, Human
ugggaggccgaggagggcggauca

SEQ ID NO: 1355166 - RNA, 20 nt, Human
ugggaggcugagacaggaga

SEQ ID NO: 1355167 - RNA, 24 nt, Human
ugggaggcugaggcgaguggauca

SEQ ID NO: 1355168 - RNA, 21 nt, Human
ugggagggggugcugaagggc

SEQ ID NO: 1355169 - RNA, 18 nt, Human
ugggcagguagagcugca

SEQ ID NO: 1355170 - RNA, 23 nt, Human
ugggcucugggccgcuggcugca

SEQ ID NO: 1355171 - RNA, 24 nt, Human
uggggcugaauccaccuccugcuu

SEQ ID NO: 1355172 - RNA, 19 nt, Human
ugggguggugacacaugca

SEQ ID NO: 1355173 - RNA, 21 nt, Human
ugggguggugacacaugcagg

SEQ ID NO: 1355174 - RNA, 22 nt, Human
ugggguggugacacaugcagga

SEQ ID NO: 1355175 - RNA, 19 nt, Human
ugggucaguucucagccuc

SEQ ID NO: 1355176 - RNA, 21 nt, Human
uggugcugggagggggugcug

SEQ ID NO: 1355177 - RNA, 18 nt, Human
ugguggacgggaggcagu

SEQ ID NO: 1355178 - RNA, 24 nt, Human
ugguggcacgugccuguaguccca

SEQ ID NO: 1355179 - RNA, 20 nt, Human
uguaaacaugugcuaauucu

SEQ ID NO: 1355180 - RNA, 18 nt, Human
ugucucaccaagcagcaa

SEQ ID NO: 1355181 - RNA, 18 nt, Human
ugugaauagccacuucac

SEQ ID NO: 1355182 - RNA, 21 nt, Human
uguuggggugcugagcuuccc

SEQ ID NO: 1355183 - RNA, 24 nt, Human
uuagccgggcaugguggcacgugc

SEQ ID NO: 1355184 - RNA, 18 nt, Human
uucaaggaaaucacuucu

SEQ ID NO: 1355185 - RNA, 23 nt, Human
uucacccauuccacccagccacc

SEQ ID NO: 1355186 - RNA, 24 nt, Human
uucacccucauacaaugggcccca

SEQ ID NO: 1355187 - RNA, 22 nt, Human
uuccagcucccuuucuagccuc

SEQ ID NO: 1355188 - RNA, 20 nt, Human
uuccucaaacuccuuaaagc

SEQ ID NO: 1355189 - RNA, 19 nt, Human
uuccugccaaccugguaga

SEQ ID NO: 1355190 - RNA, 22 nt, Human
uuccuguuucuuuccucuuucu

SEQ ID NO: 1355191 - RNA, 24 nt, Human
uugaacccgggagguggagguugc

SEQ ID NO: 1355192 - RNA, 18 nt, Human
uugcagugagccgagauc

SEQ ID NO: 1355193 - RNA, 21 nt, Human
uugcagugagccgagaucgug

SEQ ID NO: 1355194 - RNA, 22 nt, Human
uugcagugagccgagaucgugc

SEQ ID NO: 1355195 - RNA, 23 nt, Human
uugcagugagccgagaucgugcc

SEQ ID NO: 1355196 - RNA, 24 nt, Human
uugcuugaacccgggagguggagg

SEQ ID NO: 1355197 - RNA, 27 nt, Human
uugggaagggugcuagaaugggugaca

SEQ ID NO: 1355198 - RNA, 25 nt, Human
uugggaggccgaggagggcggauca

SEQ ID NO: 1355199 - RNA, 23 nt, Human
uugggaggcugagacaggagaau

SEQ ID NO: 1355200 - RNA, 25 nt, Human
uugggaggcugaggcgaguggauca

SEQ ID NO: 1355201 - RNA, 18 nt, Human
uuuaaccugggaccugga

SEQ ID NO: 1355202 - RNA, 21 nt, Human
uuuaaccugggaccuggaggu

SEQ ID NO: 1355203 - RNA, 18 nt, Human
uuuagaaaaacaaagcug

SEQ ID NO: 1355204 - RNA, 18 nt, Human
uuuccuguuucuuuccuc

SEQ ID NO: 1355205 - RNA, 20 nt, Human
uuucuugcuuuucuuuggcg

SEQ ID NO: 1355206 - RNA, 20 nt, Human
uuuguguuguagaguaaauu

SEQ ID NO: 1355207 - RNA, 21 nt, Human
aagacccagauuaugccucuc

SEQ ID NO: 1355208 - RNA, 20 nt, Human
acagcagcagagaggguugg

SEQ ID NO: 1355209 - RNA, 23 nt, Human
accacacccagugugggcugcag

SEQ ID NO: 1355210 - RNA, 24 nt, Human
acccagugugggcugcagcggggc

SEQ ID NO: 1355211 - RNA, 20 nt, Human
agccaccccgggcugagggc

SEQ ID NO: 1355212 - RNA, 21 nt, Human
agccagugagggccccggggc

SEQ ID NO: 1355213 - RNA, 20 nt, Human
aggcuuccugggggaagagg

SEQ ID NO: 1355214 - RNA, 18 nt, Human
agggugggggacaggggc

SEQ ID NO: 1355215 - RNA, 19 nt, Human
aucucagccaccccgggcu

SEQ ID NO: 1355216 - RNA, 22 nt, Human
caccacacccagugugggcugc

SEQ ID NO: 1355217 - RNA, 22 nt, Human
caccacggaccagaccuggcuc

SEQ ID NO: 1355218 - RNA, 23 nt, Human
caccccgggcugagggcugaaac

SEQ ID NO: 1355219 - RNA, 20 nt, Human
caggccuccaggccccaucu

SEQ ID NO: 1355220 - RNA, 23 nt, Human
cagugagggccccggggcugggc

SEQ ID NO: 1355221 - RNA, 19 nt, Human
ccaggccucggccuuccag

SEQ ID NO: 1355222 - RNA, 23 nt, Human
cccacagucaacaccagcggguu

SEQ ID NO: 1355223 - RNA, 18 nt, Human
ccccugcugggugcgggg

SEQ ID NO: 1355224 - RNA, 19 nt, Human
ccccuuccuccaggccucc

SEQ ID NO: 1355225 - RNA, 19 nt, Human
cccgggcugagggcugaaa

SEQ ID NO: 1355226 - RNA, 26 nt, Human
ccucaagacccagauuaugccucucc

SEQ ID NO: 1355227 - RNA, 20 nt, Human
ccuccaggccccaucucucc

SEQ ID NO: 1355228 - RNA, 20 nt, Human
ccuccaggccucggccuucc

SEQ ID NO: 1355229 - RNA, 23 nt, Human
ccuccaguucuacucaguccacu

SEQ ID NO: 1355230 - RNA, 18 nt, Human
ccucucccaccuccccca

SEQ ID NO: 1355231 - RNA, 20 nt, Human
ccugcaccucccucucccuu

SEQ ID NO: 1355232 - RNA, 19 nt, Human
ccuuccagccaaggaugag

SEQ ID NO: 1355233 - RNA, 22 nt, Human
ccuuccagccaaggaugagggc

SEQ ID NO: 1355234 - RNA, 23 nt, Human
cucccuuuguccuucuuuccacc

SEQ ID NO: 1355235 - RNA, 19 nt, Human
cuggagccagugagggccc

SEQ ID NO: 1355236 - RNA, 20 nt, Human
cuuuguccuucuuuccaccu

SEQ ID NO: 1355237 - RNA, 23 nt, Human
cuuuguccuucuuuccaccucug

SEQ ID NO: 1355238 - RNA, 19 nt, Human
gacaggcucccacugggcc

SEQ ID NO: 1355239 - RNA, 19 nt, Human
gaccuggcucaagucauag

SEQ ID NO: 1355240 - RNA, 22 nt, Human
gacuccuguccuccaguucuac

SEQ ID NO: 1355241 - RNA, 19 nt, Human
gagcgaccugcaccucccu

SEQ ID NO: 1355242 - RNA, 21 nt, Human
gagggccaugggagggucagg

SEQ ID NO: 1355243 - RNA, 18 nt, Human
gccaaggaugagggcacc

SEQ ID NO: 1355244 - RNA, 24 nt, Human
gccgggugggaguccuggagaggg

SEQ ID NO: 1355245 - RNA, 20 nt, Human
ggaccagaccuggcucaagu

SEQ ID NO: 1355246 - RNA, 21 nt, Human
ggagaggcuggacugcccaca

SEQ ID NO: 1355247 - RNA, 18 nt, Human
ggaggggccaucugcagg

SEQ ID NO: 1355248 - RNA, 22 nt, Human
ggcacagaggccuggggcacca

SEQ ID NO: 1355249 - RNA, 23 nt, Human
ggccauggaaacagcagcagaga

SEQ ID NO: 1355250 - RNA, 19 nt, Human
ggccgggugugugaggagu

SEQ ID NO: 1355251 - RNA, 26 nt, Human
ggccucaggugacuuuauauggccuc

SEQ ID NO: 1355252 - RNA, 23 nt, Human
ggccuggccccuuccuccaggcc

SEQ ID NO: 1355253 - RNA, 26 nt, Human
gggccaugggagggucaggguggggg

SEQ ID NO: 1355254 - RNA, 19 nt, Human
gggccgggugugugaggag

SEQ ID NO: 1355255 - RNA, 20 nt, Human
gggcugcagcggggcccccc

SEQ ID NO: 1355256 - RNA, 18 nt, Human
gggcugggcagguccgag

SEQ ID NO: 1355257 - RNA, 22 nt, Human
gggucagggugggggacagggg

SEQ ID NO: 1355258 - RNA, 19 nt, Human
ggugggaguccuggagagg

SEQ ID NO: 1355259 - RNA, 22 nt, Human
uaccgggcccuccugagugccu

SEQ ID NO: 1355260 - RNA, 22 nt, Human
ucaaauggggagaggcuggacu

SEQ ID NO: 1355261 - RNA, 22 nt, Human
uccaggccccaucucuggagac

SEQ ID NO: 1355262 - RNA, 24 nt, Human
uccaggccccaucucuggagacuu

SEQ ID NO: 1355263 - RNA, 23 nt, Human
uccaggccuccaggccccaucuc

SEQ ID NO: 1355264 - RNA, 25 nt, Human
ucccugagcgaccugcaccucccuc

SEQ ID NO: 1355265 - RNA, 19 nt, Human
ucccugggcccugugcucc

SEQ ID NO: 1355266 - RNA, 21 nt, Human
uccuggagccagugagggccc

SEQ ID NO: 1355267 - RNA, 18 nt, Human
uccugggggaagaggugc

SEQ ID NO: 1355268 - RNA, 23 nt, Human
uccugggggaagaggugccugag

SEQ ID NO: 1355269 - RNA, 19 nt, Human
uccuucuuuccaccucugg

SEQ ID NO: 1355270 - RNA, 21 nt, Human
uccuucuuuccaccucuggag

SEQ ID NO: 1355271 - RNA, 19 nt, Human
ucucagccaccccgggcug

SEQ ID NO: 1355272 - RNA, 20 nt, Human
ucucagccaccccgggcuga

SEQ ID NO: 1355273 - RNA, 26 nt, Human
ucuccagacuccuccaggccucggcc

SEQ ID NO: 1355274 - RNA, 21 nt, Human
ucucccaccucccccaccuca

SEQ ID NO: 1355275 - RNA, 25 nt, Human
ucucccuuuguccuucuuuccaccu

SEQ ID NO: 1355276 - RNA, 19 nt, Human
ugaaacguccucaagaccc

SEQ ID NO: 1355277 - RNA, 22 nt, Human
ugaaacguccucaagacccaga

SEQ ID NO: 1355278 - RNA, 18 nt, Human
ugagggccccggggcugg

SEQ ID NO: 1355279 - RNA, 25 nt, Human
ugccucucccaccucccccaccuca

SEQ ID NO: 1355280 - RNA, 22 nt, Human
uggccccuuccuccaggccucc

SEQ ID NO: 1355281 - RNA, 23 nt, Human
uggccccuuccuccaggccucca

SEQ ID NO: 1355282 - RNA, 19 nt, Human
ugggccauggaaacagcag

SEQ ID NO: 1355283 - RNA, 20 nt, Human
uggggagaggcuggacugcc

SEQ ID NO: 1355284 - RNA, 18 nt, Human
ugggggacaggggcgcag

SEQ ID NO: 1355285 - RNA, 22 nt, Human
ugggugcgggggacaccacgga

SEQ ID NO: 1355286 - RNA, 22 nt, Human
uuggaggggccaucugcaggcg

SEQ ID NO: 1355287 - RNA, 18 nt, Human
uuguccuucuuuccaccu

SEQ ID NO: 1355288 - RNA, 19 nt, Human
aaagaagaguaguacaaua

SEQ ID NO: 1355289 - RNA, 19 nt, Human
aaaggagacaaauuuauga

SEQ ID NO: 1355290 - RNA, 20 nt, Human
aauucagaauuuucagaagu

SEQ ID NO: 1355291 - RNA, 19 nt, Human
acaacucuggagauuugcc

SEQ ID NO: 1355292 - RNA, 19 nt, Human
acacccccuuaccccaccc

SEQ ID NO: 1355293 - RNA, 20 nt, Human
acccccuuaccccacccauc

SEQ ID NO: 1355294 - RNA, 19 nt, Human
aguguagauuggugaagau

SEQ ID NO: 1355295 - RNA, 26 nt, Human
auucagaauuuucagaagucauauuu

SEQ ID NO: 1355296 - RNA, 21 nt, Human
caagcaguggacauacacccu

SEQ ID NO: 1355297 - RNA, 25 nt, Human
cacacacccccuuacccccccugag

SEQ ID NO: 1355298 - RNA, 19 nt, Human
cacccccuuaccccaccca

SEQ ID NO: 1355299 - RNA, 22 nt, Human
cacccccuuaccccacccaucu

SEQ ID NO: 1355300 - RNA, 23 nt, Human
cacccccuuaccccacccaucuu

SEQ ID NO: 1355301 - RNA, 21 nt, Human
cagggaaaacggaguaaggga

SEQ ID NO: 1355302 - RNA, 25 nt, Human
cagguaaauggcucuugaaaggaca

SEQ ID NO: 1355303 - RNA, 21 nt, Human
caugguguuccuuggcugagc

SEQ ID NO: 1355304 - RNA, 23 nt, Human
cauuacacuugggguuacagacu

SEQ ID NO: 1355305 - RNA, 23 nt, Human
cauuccuaggugguagcaggaca

SEQ ID NO: 1355306 - RNA, 21 nt, Human
ccaaauguuuguguucucagg

SEQ ID NO: 1355307 - RNA, 18 nt, Human
ccagugucuguuaccauc

SEQ ID NO: 1355308 - RNA, 21 nt, Human
ccccaguaccauaauuaccuc

SEQ ID NO: 1355309 - RNA, 21 nt, Human
cuuagggaaguugcagggaaa

SEQ ID NO: 1355310 - RNA, 19 nt, Human
gaaaaaaaauugaagugga

SEQ ID NO: 1355311 - RNA, 18 nt, Human
gaguuucuagaaaaaucc

SEQ ID NO: 1355312 - RNA, 21 nt, Human
gcuuuucuucucuguguguga

SEQ ID NO: 1355313 - RNA, 20 nt, Human
ggcucuugaaaggacaguuu

SEQ ID NO: 1355314 - RNA, 24 nt, Human
gggaaaacggaguaagggaaaugg

SEQ ID NO: 1355315 - RNA, 19 nt, Human
gggucuguauagccaacug

SEQ ID NO: 1355316 - RNA, 19 nt, Human
gguuacagacuccaguguc

SEQ ID NO: 1355317 - RNA, 19 nt, Human
guaagaguccaauuucuuu

SEQ ID NO: 1355318 - RNA, 24 nt, Human
guguucucagggaacacagcacau

SEQ ID NO: 1355319 - RNA, 24 nt, Human
uaaccugguggagaacccgucgca

SEQ ID NO: 1355320 - RNA, 18 nt, Human
uaagcuaauuuucuggcu

SEQ ID NO: 1355321 - RNA, 22 nt, Human
uaccccacccaucuucaagcug

SEQ ID NO: 1355322 - RNA, 19 nt, Human
uauaguguagauuggugaa

SEQ ID NO: 1355323 - RNA, 19 nt, Human
ucaaaaacuugauuuugaa

SEQ ID NO: 1355324 - RNA, 26 nt, Human
uccagguaaauggcucuugaaaggac

SEQ ID NO: 1355325 - RNA, 19 nt, Human
ucucugugugugaugagug

SEQ ID NO: 1355326 - RNA, 21 nt, Human
ugaaaaaaaauugaaguggaa

SEQ ID NO: 1355327 - RNA, 22 nt, Human
ugaaaggacaguuucuagaaaa

SEQ ID NO: 1355328 - RNA, 19 nt, Human
uggcauaaagaagaguagu

SEQ ID NO: 1355329 - RNA, 19 nt, Human
uggcugagcaccaugaccu

SEQ ID NO: 1355330 - RNA, 24 nt, Human
ugggccaagaauucaagccuaagu

SEQ ID NO: 1355331 - RNA, 21 nt, Human
ugugaugaguguuuuucuugg

SEQ ID NO: 1355332 - RNA, 19 nt, Human
uucaugcagaagugagaga

SEQ ID NO: 1355333 - RNA, 23 nt, Human
uucucugugugugaugaguguuu

SEQ ID NO: 1355334 - RNA, 19 nt, Human
uuggugacuucaugcagaa

SEQ ID NO: 1355335 - RNA, 21 nt, Human
aagcggcuccuuuucuccccu

SEQ ID NO: 1355336 - RNA, 22 nt, Human
aaggaggaaagcccccgcagug

SEQ ID NO: 1355337 - RNA, 22 nt, Human
agcaaccaacaaggaggaaagc

SEQ ID NO: 1355338 - RNA, 20 nt, Human
cagcaccaggggcuacgaga

SEQ ID NO: 1355339 - RNA, 20 nt, Human
ccacaguggcaggucccagg

SEQ ID NO: 1355340 - RNA, 18 nt, Human
ccagggaugggcacaggg

SEQ ID NO: 1355341 - RNA, 19 nt, Human
ccaggggcuacgagaggag

SEQ ID NO: 1355342 - RNA, 24 nt, Human
cccacucagcaaccaacaaggagg

SEQ ID NO: 1355343 - RNA, 21 nt, Human
cccccaugcagucagcaccag

SEQ ID NO: 1355344 - RNA, 18 nt, Human
cccgcagugcucggccag

SEQ ID NO: 1355345 - RNA, 19 nt, Human
cccgcgcgcgguccacgug

SEQ ID NO: 1355346 - RNA, 19 nt, Human
ccgcgccaucgccaccagg

SEQ ID NO: 1355347 - RNA, 22 nt, Human
ccuuuucuccccuuggccgccc

SEQ ID NO: 1355348 - RNA, 19 nt, Human
cgccaccagggagcgcccc

SEQ ID NO: 1355349 - RNA, 18 nt, Human
cggccagugccgcgccau

SEQ ID NO: 1355350 - RNA, 25 nt, Human
cuccagcgccagcccccaugcaguc

SEQ ID NO: 1355351 - RNA, 20 nt, Human
gauccugcgugaggcugaag

SEQ ID NO: 1355352 - RNA, 23 nt, Human
gcaaccaacaaggaggaaagccc

SEQ ID NO: 1355353 - RNA, 22 nt, Human
gcggcgcggggaggagccgcac

SEQ ID NO: 1355354 - RNA, 18 nt, Human
gggcacaggggugguaga

SEQ ID NO: 1355355 - RNA, 24 nt, Human
ggggaggagccgcacgccacagug

SEQ ID NO: 1355356 - RNA, 18 nt, Human
ucaggggugagggaaggg

SEQ ID NO: 1355357 - RNA, 21 nt, Human
uggcaagggaggcagaagcgg

SEQ ID NO: 1355358 - RNA, 24 nt, Human
uggcaagggaggcagaagcggcuc

SEQ ID NO: 1355359 - RNA, 21 nt, Human
aaagauguauauucugaugcc

SEQ ID NO: 1355360 - RNA, 20 nt, Human
aaaggauuucccacacagau

SEQ ID NO: 1355361 - RNA, 25 nt, Human
aaaggcuuugccacauucaugacau

SEQ ID NO: 1355362 - RNA, 21 nt, Human
aaccauuauuaccugucuucu

SEQ ID NO: 1355363 - RNA, 22 nt, Human
aagacgcuuuaaaggcuuugcc

SEQ ID NO: 1355364 - RNA, 18 nt, Human
aagccucugacacauaca

SEQ ID NO: 1355365 - RNA, 24 nt, Human
aagucacuauugccaggacagcac

SEQ ID NO: 1355366 - RNA, 23 nt, Human
aaucaccucccaaugggccccac

SEQ ID NO: 1355367 - RNA, 23 nt, Human
aauuuuuucugaagaucuugcca

SEQ ID NO: 1355368 - RNA, 19 nt, Human
acaaauaaaagauuuccca

SEQ ID NO: 1355369 - RNA, 20 nt, Human
acauuuauaugguuucuuuc

SEQ ID NO: 1355370 - RNA, 20 nt, Human
acauuuauaugguuucuuuc

SEQ ID NO: 1355371 - RNA, 19 nt, Human
acucuuuccauuuugaugu

SEQ ID NO: 1355372 - RNA, 27 nt, Human
agaauucuugccacacguauuacacuu

SEQ ID NO: 1355373 - RNA, 24 nt, Human
aggguuucuguccagugugacucc

SEQ ID NO: 1355374 - RNA, 26 nt, Human
aggguuucuguccagugugacuccuu

SEQ ID NO: 1355375 - RNA, 19 nt, Human
agugaauacuagcuuaaaa

SEQ ID NO: 1355376 - RNA, 23 nt, Human
auaaagucucccuucaguuugaa

SEQ ID NO: 1355377 - RNA, 30 nt, Human
aucacauuuauaugguuucuuuccugcauu

SEQ ID NO: 1355378 - RNA, 22 nt, Human
auuacaauuccacagggauuuc

SEQ ID NO: 1355379 - RNA, 18 nt, Human
auucauaaagucucccuu

SEQ ID NO: 1355380 - RNA, 18 nt, Human
caauacuggagauuacaa

SEQ ID NO: 1355381 - RNA, 22 nt, Human
caauacuggagauuacaauucc

SEQ ID NO: 1355382 - RNA, 21 nt, Human
cacauacaucacauugauaug

SEQ ID NO: 1355383 - RNA, 22 nt, Human
cagccagaccucaagagaaguc

SEQ ID NO: 1355384 - RNA, 20 nt, Human
cauucauuacauauguaggg

SEQ ID NO: 1355385 - RNA, 23 nt, Human
cauucauuacauauguaggguug

SEQ ID NO: 1355386 - RNA, 24 nt, Human
cauuucauacaucuaugcccuuuu

SEQ ID NO: 1355387 - RNA, 20 nt, Human
ccaaugggccccaccuccaa

SEQ ID NO: 1355388 - RNA, 22 nt, Human
ccacacucauuacauuugaagg

SEQ ID NO: 1355389 - RNA, 24 nt, Human
ccacagggauuucaagagaagggg

SEQ ID NO: 1355390 - RNA, 24 nt, Human
ccacuuccaugauucaaucaccuc

SEQ ID NO: 1355391 - RNA, 25 nt, Human
ccucugaugauuaauaaggcuggaa

SEQ ID NO: 1355392 - RNA, 24 nt, Human
cucuaguaugaauacucuuuccau

SEQ ID NO: 1355393 - RNA, 18 nt, Human
cuguccagugugacuccu

SEQ ID NO: 1355394 - RNA, 21 nt, Human
cuucuaaacagccagaccuca

SEQ ID NO: 1355395 - RNA, 19 nt, Human
gaacucuaguaaagguuuu

SEQ ID NO: 1355396 - RNA, 21 nt, Human
gaauacucuuuccauuuugau

SEQ ID NO: 1355397 - RNA, 19 nt, Human
gacuaaaggaauucccaca

SEQ ID NO: 1355398 - RNA, 19 nt, Human
gccugagcgacaaauaaaa

SEQ ID NO: 1355399 - RNA, 21 nt, Human
ggaaaacaaccgcccaaaggc

SEQ ID NO: 1355400 - RNA, 25 nt, Human
ggaaaacaaccgcccaaaggcuuug

SEQ ID NO: 1355401 - RNA, 18 nt, Human
ggacaacgucuaaggccu

SEQ ID NO: 1355402 - RNA, 20 nt, Human
gggccccaccuccaauacug

SEQ ID NO: 1355403 - RNA, 18 nt, Human
uaaaaaccuuagcaugca

SEQ ID NO: 1355404 - RNA, 19 nt, Human
uaaaggauuucccacacag

SEQ ID NO: 1355405 - RNA, 21 nt, Human
uaagauggacacgcugacuaa

SEQ ID NO: 1355406 - RNA, 21 nt, Human
uaagauggacacgcugacuaa

SEQ ID NO: 1355407 - RNA, 21 nt, Human
uaauuaccuagauuuacaagu

SEQ ID NO: 1355408 - RNA, 22 nt, Human
uagugaguuccaaugccugggg

SEQ ID NO: 1355409 - RNA, 24 nt, Human
uauacauccuggaauauauauaca

SEQ ID NO: 1355410 - RNA, 19 nt, Human
uauaugauuuccuuucagu

SEQ ID NO: 1355411 - RNA, 20 nt, Human
uaugaauuuuuucugaagau

SEQ ID NO: 1355412 - RNA, 18 nt, Human
uauuguuucucuccacug

SEQ ID NO: 1355413 - RNA, 22 nt, Human
ucacauggugagaaugagggca

SEQ ID NO: 1355414 - RNA, 18 nt, Human
ucagccagacgugacuca

SEQ ID NO: 1355415 - RNA, 23 nt, Human
ucccaaugggccccaccuccaau

SEQ ID NO: 1355416 - RNA, 20 nt, Human
ucuaagauggacacgcugac

SEQ ID NO: 1355417 - RNA, 20 nt, Human
ucuaagauggacacgcugac

SEQ ID NO: 1355418 - RNA, 22 nt, Human
ucuccaguaugaacugucugau

SEQ ID NO: 1355419 - RNA, 20 nt, Human
ucucuccaguaugaacuguc

SEQ ID NO: 1355420 - RNA, 18 nt, Human
ucucuuaugacaaguagu

SEQ ID NO: 1355421 - RNA, 20 nt, Human
ucuguccagugugacuccuu

SEQ ID NO: 1355422 - RNA, 18 nt, Human
ugacacauacauuuauau

SEQ ID NO: 1355423 - RNA, 20 nt, Human
ugacuaaaggauuucccaca

SEQ ID NO: 1355424 - RNA, 19 nt, Human
ugacuauguugaucucuuu

SEQ ID NO: 1355425 - RNA, 21 nt, Human
ugacuuacaagaugugaacua

SEQ ID NO: 1355426 - RNA, 18 nt, Human
ugaguguggagcccugau

SEQ ID NO: 1355427 - RNA, 23 nt, Human
ugaugaacugcaaggugggaacu

SEQ ID NO: 1355428 - RNA, 22 nt, Human
ugaugaagucuaagauggacac

SEQ ID NO: 1355429 - RNA, 19 nt, Human
ugauuguuuucuacauccc

SEQ ID NO: 1355430 - RNA, 19 nt, Human
ugcaagguuucucuacagu

SEQ ID NO: 1355431 - RNA, 24 nt, Human
ugccacauacaucacauuuauaug

SEQ ID NO: 1355432 - RNA, 22 nt, Human
ugccacauucauuacauaugua

SEQ ID NO: 1355433 - RNA, 22 nt, Human
ugccaggacagcaccaagggga

SEQ ID NO: 1355434 - RNA, 24 nt, Human
uggaagacgcuuuaaaggcuuugc

SEQ ID NO: 1355435 - RNA, 20 nt, Human
ugguggaaggcaaagcgggu

SEQ ID NO: 1355436 - RNA, 18 nt, Human
uguaagguuucucuccgg

SEQ ID NO: 1355437 - RNA, 24 nt, Human
uguauacauccuggaauauauaua

SEQ ID NO: 1355438 - RNA, 22 nt, Human
uguauuguuucucuccacugug

SEQ ID NO: 1355439 - RNA, 18 nt, Human
ugucuauugaguguggag

SEQ ID NO: 1355440 - RNA, 27 nt, Human
ugucuuacaaaauaugaauuuuuucug

SEQ ID NO: 1355441 - RNA, 20 nt, Human
uguggagaaacuaaacaacc

SEQ ID NO: 1355442 - RNA, 21 nt, Human
uguggagaaacuaaacaacca

SEQ ID NO: 1355443 - RNA, 21 nt, Human
uuaaaggcuuugccacauuca

SEQ ID NO: 1355444 - RNA, 22 nt, Human
uuaguagugaggcccgaugaaa

SEQ ID NO: 1355445 - RNA, 19 nt, Human
uuccaugauucaaucaccu

SEQ ID NO: 1355446 - RNA, 21 nt, Human
uucccacacucauuacauuua

SEQ ID NO: 1355447 - RNA, 25 nt, Human
uucucuguaguauguauccucugau

SEQ ID NO: 1355448 - RNA, 23 nt, Human
uuguauuguuucucuccacugug

SEQ ID NO: 1355449 - RNA, 19 nt, Human
uuuacugaagaccuugcca

SEQ ID NO: 1355450 - RNA, 19 nt, Human
uuuguaugguuucucucca

SEQ ID NO: 1355451 - RNA, 23 nt, Human
aaacuccugggcuugagcaaucc

SEQ ID NO: 1355452 - RNA, 19 nt, Human
aaagugcuaggauuacagg

SEQ ID NO: 1355453 - RNA, 24 nt, Human
aaagugcuaggauuacagguguga

SEQ ID NO: 1355454 - RNA, 26 nt, Human
aagugcuaggauuacaggugugagcc

SEQ ID NO: 1355455 - RNA, 21 nt, Human
acagacacaugccaagggccu

SEQ ID NO: 1355456 - RNA, 21 nt, Human
acagugaaaggccuguaggga

SEQ ID NO: 1355457 - RNA, 21 nt, Human
acaugagaaaauccaacaguu

SEQ ID NO: 1355458 - RNA, 23 nt, Human
accacugccccuggccuuucaaa

SEQ ID NO: 1355459 - RNA, 25 nt, Human
acccuccugucuuggcuuucuauug

SEQ ID NO: 1355460 - RNA, 19 nt, Human
acuagccuuuuuuuucuuu

SEQ ID NO: 1355461 - RNA, 22 nt, Human
agaguacuuuuuaaucagucuu

SEQ ID NO: 1355462 - RNA, 22 nt, Human
agauuauaggcaugaaccacug

SEQ ID NO: 1355463 - RNA, 20 nt, Human
agcaauccucuugccucggc

SEQ ID NO: 1355464 - RNA, 24 nt, Human
agcuauugcuauucaauggagacg

SEQ ID NO: 1355465 - RNA, 25 nt, Human
agguuggagugcaguggcgcgaucu

SEQ ID NO: 1355466 - RNA, 23 nt, Human
aguagcugggauugcaggcaugu

SEQ ID NO: 1355467 - RNA, 21 nt, Human
agugcaguggcgcgaucucag

SEQ ID NO: 1355468 - RNA, 23 nt, Human
agugcaguggcgcgaucucagcu

SEQ ID NO: 1355469 - RNA, 24 nt, Human
agugcaguggcgcgaucucagcuc

SEQ ID NO: 1355470 - RNA, 20 nt, Human
augguguuucaccauauugg

SEQ ID NO: 1355471 - RNA, 21 nt, Human
auucuccugccucagccuccc

SEQ ID NO: 1355472 - RNA, 24 nt, Human
auuuaacuguucucucuuccauuu

SEQ ID NO: 1355473 - RNA, 23 nt, Human
caaacuccugaccuugugaucca

SEQ ID NO: 1355474 - RNA, 24 nt, Human
caaagugcuaggauuacaggugug

SEQ ID NO: 1355475 - RNA, 21 nt, Human
caacaguugcaaauuaugcca

SEQ ID NO: 1355476 - RNA, 22 nt, Human
caagcaauucuccugccucagc

SEQ ID NO: 1355477 - RNA, 22 nt, Human
caagugacccuccugucuuggc

SEQ ID NO: 1355478 - RNA, 27 nt, Human
caagugacccuccugucuuggcuuucu

SEQ ID NO: 1355479 - RNA, 21 nt, Human
cacacaauccauuuguguggu

SEQ ID NO: 1355480 - RNA, 20 nt, Human
cacaggguccaggcauuucc

SEQ ID NO: 1355481 - RNA, 21 nt, Human
caccauauuggccaggcuggu

SEQ ID NO: 1355482 - RNA, 24 nt, Human
caccauauuggccaggcuggucuc

SEQ ID NO: 1355483 - RNA, 27 nt, Human
caccauauuggccaggcuggucucaaa

SEQ ID NO: 1355484 - RNA, 24 nt, Human
cacccagguuggagugcaguggcg

SEQ ID NO: 1355485 - RNA, 23 nt, Human
caccugccucaaccucccaaagu

SEQ ID NO: 1355486 - RNA, 18 nt, Human
cagcagcacugugccugu

SEQ ID NO: 1355487 - RNA, 21 nt, Human
cagcagcacugugccugucag

SEQ ID NO: 1355488 - RNA, 20 nt, Human
caggaaaagugugugcuaac

SEQ ID NO: 1355489 - RNA, 20 nt, Human
caggcaugugccaccacgcc

SEQ ID NO: 1355490 - RNA, 23 nt, Human
cagucccugaugaacucucuucc

SEQ ID NO: 1355491 - RNA, 20 nt, Human
cagucuuugcuaaacagcag

SEQ ID NO: 1355492 - RNA, 24 nt, Human
cauauuggccaggcuggucucaaa

SEQ ID NO: 1355493 - RNA, 23 nt, Human
caugaaccacugccccuggccuu

SEQ ID NO: 1355494 - RNA, 23 nt, Human
caugaaccacugccccuggccuu

SEQ ID NO: 1355495 - RNA, 21 nt, Human
ccaaagugcuaggauuacagg

SEQ ID NO: 1355496 - RNA, 24 nt, Human
ccaaagugcuaggauuacaggugu

SEQ ID NO: 1355497 - RNA, 20 nt, Human
ccaccacgccuggcuaauuu

SEQ ID NO: 1355498 - RNA, 26 nt, Human
ccaccugccucaaccucccaaagugc

SEQ ID NO: 1355499 - RNA, 23 nt, Human
ccacugcgcccagccaauuacau

SEQ ID NO: 1355500 - RNA, 19 nt, Human
ccccuggccuuucaaaccc

SEQ ID NO: 1355501 - RNA, 23 nt, Human
cccgaguagcugggauugcaggc

SEQ ID NO: 1355502 - RNA, 24 nt, Human
cccgaguagcugggauugcaggca

SEQ ID NO: 1355503 - RNA, 19 nt, Human
cccugaugaacucucuucc

SEQ ID NO: 1355504 - RNA, 24 nt, Human
ccgaguagcugggauugcaggcau

SEQ ID NO: 1355505 - RNA, 24 nt, Human
ccuccuggauucaagcaauucucc

SEQ ID NO: 1355506 - RNA, 19 nt, Human
ccugaccuugugauccacc

SEQ ID NO: 1355507 - RNA, 21 nt, Human
ccugaccuugugauccaccug

SEQ ID NO: 1355508 - RNA, 23 nt, Human
ccuggauucaagcaauucuccug

SEQ ID NO: 1355509 - RNA, 21 nt, Human
ccuuggcacacacaauccauu

SEQ ID NO: 1355510 - RNA, 24 nt, Human
cgcucugucacccagguuggagug

SEQ ID NO: 1355511 - RNA, 25 nt, Human
cuaaagucauggcgugcucuauuuc

SEQ ID NO: 1355512 - RNA, 20 nt, Human
cuacucaagaacauguucca

SEQ ID NO: 1355513 - RNA, 19 nt, Human
cuagugauuugguaggucu

SEQ ID NO: 1355514 - RNA, 27 nt, Human
cucacugcaacaaccucugccuccugg

SEQ ID NO: 1355515 - RNA, 23 nt, Human
cucagccucccgaguagcuggga

SEQ ID NO: 1355516 - RNA, 24 nt, Human
cuccugaccuugugauccaccugc

SEQ ID NO: 1355517 - RNA, 22 nt, Human
cuccugccucagccucccgagu

SEQ ID NO: 1355518 - RNA, 23 nt, Human
cuccugggcuugagcaauccucu

SEQ ID NO: 1355519 - RNA, 24 nt, Human
cucgcucugucacccaagcuggag

SEQ ID NO: 1355520 - RNA, 24 nt, Human
cucgcucugucacccagguuggag

SEQ ID NO: 1355521 - RNA, 26 nt, Human
cucugauuuaacuguucucucuucca

SEQ ID NO: 1355522 - RNA, 24 nt, Human
cugcaacaaccucugccuccugga

SEQ ID NO: 1355523 - RNA, 18 nt, Human
cugcaucgucucuccuac

SEQ ID NO: 1355524 - RNA, 19 nt, Human
cugcaucgucucuccuacg

SEQ ID NO: 1355525 - RNA, 24 nt, Human
cugccucaaccucccaaagugcua

SEQ ID NO: 1355526 - RNA, 23 nt, Human
cugccucagccucccgaguagcu

SEQ ID NO: 1355527 - RNA, 19 nt, Human
cugcgcccagccaauuaca

SEQ ID NO: 1355528 - RNA, 22 nt, Human
gaccuugugauccaccugccuc

SEQ ID NO: 1355529 - RNA, 23 nt, Human
gaccuugugauccaccugccuca

SEQ ID NO: 1355530 - RNA, 25 nt, Human
gagcaauccucuugccucggccucu

SEQ ID NO: 1355531 - RNA, 26 nt, Human
gaguagcuggaacuacagacacaugc

SEQ ID NO: 1355532 - RNA, 18 nt, Human
gauuacaggugugagcca

SEQ ID NO: 1355533 - RNA, 22 nt, Human
gauuacaggugugagccacugc

SEQ ID NO: 1355534 - RNA, 22 nt, Human
gauuacaggugugagccacugc

SEQ ID NO: 1355535 - RNA, 18 nt, Human
gauugcaggcaugugcca

SEQ ID NO: 1355536 - RNA, 23 nt, Human
gccucaaccucccaaagugcuag

SEQ ID NO: 1355537 - RNA, 20 nt, Human
gccucagccucccgaguagc

SEQ ID NO: 1355538 - RNA, 20 nt, Human
gccucggccucuugaguagc

SEQ ID NO: 1355539 - RNA, 21 nt, Human
gccucggccucuugaguagcu

SEQ ID NO: 1355540 - RNA, 25 nt, Human
gcucugucacccaagcuggaguaca

SEQ ID NO: 1355541 - RNA, 19 nt, Human
gcucugucacccagguugg

SEQ ID NO: 1355542 - RNA, 24 nt, Human
gcuggaguacaaauggcaagauca

SEQ ID NO: 1355543 - RNA, 22 nt, Human
ggauuacaggugugagccacug

SEQ ID NO: 1355544 - RNA, 23 nt, Human
ggcuggucucaaacuccugaccu

SEQ ID NO: 1355545 - RNA, 20 nt, Human
ggucucaaacuccugaccuu

SEQ ID NO: 1355546 - RNA, 21 nt, Human
ggucucuaaaucagacaaucu

SEQ ID NO: 1355547 - RNA, 22 nt, Human
gguguuucaccauauuggccag

SEQ ID NO: 1355548 - RNA, 24 nt, Human
guagagcacagcagcacugugccu

SEQ ID NO: 1355549 - RNA, 20 nt, Human
guagcugggauugcaggcau

SEQ ID NO: 1355550 - RNA, 22 nt, Human
gucuuggcuuucuauugugcug

SEQ ID NO: 1355551 - RNA, 24 nt, Human
gugauccaccugccucaaccuccc

SEQ ID NO: 1355552 - RNA, 18 nt, Human
gugcugagauuauaggca

SEQ ID NO: 1355553 - RNA, 19 nt, Human
gugcugagauuauaggcau

SEQ ID NO: 1355554 - RNA, 21 nt, Human
guugauuacugcuagaacuua

SEQ ID NO: 1355555 - RNA, 20 nt, Human
uacagacacaugccaagggc

SEQ ID NO: 1355556 - RNA, 19 nt, Human
uacaggugugagccacugc

SEQ ID NO: 1355557 - RNA, 24 nt, Human
uacaggugugagccacugcgccca

SEQ ID NO: 1355558 - RNA, 24 nt, Human
uagaaacgcuccucaucuaaugaa

SEQ ID NO: 1355559 - RNA, 18 nt, Human
uagagcacagcagcacug

SEQ ID NO: 1355560 - RNA, 28 nt, Human
uagccuuuuuuuucuuuugagacagggu

SEQ ID NO: 1355561 - RNA, 19 nt, Human
uaggauuacaggugugagc

SEQ ID NO: 1355562 - RNA, 21 nt, Human
uaggauuacaggugugagcca

SEQ ID NO: 1355563 - RNA, 22 nt, Human
uaggauuacaggugugagccac

SEQ ID NO: 1355564 - RNA, 22 nt, Human
uaggauuacaggugugagccac

SEQ ID NO: 1355565 - RNA, 24 nt, Human
uaggauuacaggugugagccacug

SEQ ID NO: 1355566 - RNA, 18 nt, Human
uaggcaugaaccacugcc

SEQ ID NO: 1355567 - RNA, 24 nt, Human
uaguagauaugguguuucaccaua

SEQ ID NO: 1355568 - RNA, 18 nt, Human
uaguauagacucucggau

SEQ ID NO: 1355569 - RNA, 19 nt, Human
uauuuugacuuguuggccu

SEQ ID NO: 1355570 - RNA, 19 nt, Human
ucaagcaauucuccugccu

SEQ ID NO: 1355571 - RNA, 24 nt, Human
ucacccagguuggagugcaguggc

SEQ ID NO: 1355572 - RNA, 19 nt, Human
ucacgguuuuguuauucuc

SEQ ID NO: 1355573 - RNA, 20 nt, Human
ucagccucccgaguagcugg

SEQ ID NO: 1355574 - RNA, 20 nt, Human
ucauggucauuuguagagca

SEQ ID NO: 1355575 - RNA, 23 nt, Human
uccaggaaacuggauagaaacgc

SEQ ID NO: 1355576 - RNA, 23 nt, Human
ucccaaagugcuaggauuacagg

SEQ ID NO: 1355577 - RNA, 24 nt, Human
ucccgaguagcugggauugcaggc

SEQ ID NO: 1355578 - RNA, 19 nt, Human
uccuccugagagaauucua

SEQ ID NO: 1355579 - RNA, 21 nt, Human
uccuggauucaagcaauucuc

SEQ ID NO: 1355580 - RNA, 24 nt, Human
uccuggauucaagcaauucuccug

SEQ ID NO: 1355581 - RNA, 24 nt, Human
uccugggcuugagcaauccucuug

SEQ ID NO: 1355582 - RNA, 24 nt, Human
ucgcucugucacccagguuggagu

SEQ ID NO: 1355583 - RNA, 23 nt, Human
ucggccucuugaguagcuggaac

SEQ ID NO: 1355584 - RNA, 22 nt, Human
ucuaaaucagacaaucuuuaau

SEQ ID NO: 1355585 - RNA, 23 nt, Human
ucucaaacuccugggcuugagca

SEQ ID NO: 1355586 - RNA, 23 nt, Human
ucuccaggcaucaagugacccuc

SEQ ID NO: 1355587 - RNA, 24 nt, Human
ucucgcucugucacccaagcugga

SEQ ID NO: 1355588 - RNA, 25 nt, Human
ucucgcucugucacccaagcuggag

SEQ ID NO: 1355589 - RNA, 26 nt, Human
ucucgcucugucacccaagcuggagu

SEQ ID NO: 1355590 - RNA, 19 nt, Human
ucucgcucugucacccagg

SEQ ID NO: 1355591 - RNA, 23 nt, Human
ucucgcucugucacccagguugg

SEQ ID NO: 1355592 - RNA, 24 nt, Human
ucucgcucugucacccagguugga

SEQ ID NO: 1355593 - RNA, 24 nt, Human
ucucuacucugauuuaacuguucu

SEQ ID NO: 1355594 - RNA, 21 nt, Human
ucucuguccaccuccaugguc

SEQ ID NO: 1355595 - RNA, 24 nt, Human
ucugccuccuggauucaagcaauu

SEQ ID NO: 1355596 - RNA, 24 nt, Human
ucugucacccaagcuggaguacaa

SEQ ID NO: 1355597 - RNA, 24 nt, Human
ucugucacccagguuggagugcag

SEQ ID NO: 1355598 - RNA, 18 nt, Human
ucuugaguagcuggaacu

SEQ ID NO: 1355599 - RNA, 20 nt, Human
ucuuggcuuucuauugugcu

SEQ ID NO: 1355600 - RNA, 19 nt, Human
ugaagucagcccugucauc

SEQ ID NO: 1355601 - RNA, 22 nt, Human
ugaauccuacucaagaacaugu

SEQ ID NO: 1355602 - RNA, 22 nt, Human
ugagacagggucucgcucuguc

SEQ ID NO: 1355603 - RNA, 22 nt, Human
ugagacggagucucgcucuguc

SEQ ID NO: 1355604 - RNA, 22 nt, Human
ugagagaauucuauggccacgu

SEQ ID NO: 1355605 - RNA, 21 nt, Human
ugagauuauaggcaugaacca

SEQ ID NO: 1355606 - RNA, 23 nt, Human
ugagauuauaggcaugaaccacu

SEQ ID NO: 1355607 - RNA, 24 nt, Human
ugagauuauaggcaugaaccacug

SEQ ID NO: 1355608 - RNA, 19 nt, Human
ugagcaauccucuugccuc

SEQ ID NO: 1355609 - RNA, 20 nt, Human
ugcaauaagcaugaugacug

SEQ ID NO: 1355610 - RNA, 22 nt, Human
ugcaguggcgcgaucucagcuc

SEQ ID NO: 1355611 - RNA, 24 nt, Human
ugcccauacuuaucuugaucucca

SEQ ID NO: 1355612 - RNA, 19 nt, Human
ugccccuggccuuucaaac

SEQ ID NO: 1355613 - RNA, 24 nt, Human
ugccucaaccucccaaagugcuag

SEQ ID NO: 1355614 - RNA, 24 nt, Human
ugccucagccucccgaguagcugg

SEQ ID NO: 1355615 - RNA, 20 nt, Human
ugccucggccucuugaguaa

SEQ ID NO: 1355616 - RNA, 22 nt, Human
ugccucggccucuugaguagcu

SEQ ID NO: 1355617 - RNA, 20 nt, Human
ugcuacguugcccauacuua

SEQ ID NO: 1355618 - RNA, 24 nt, Human
ugcuaggauuacaggugugagcca

SEQ ID NO: 1355619 - RNA, 21 nt, Human
uggaacuacagacacaugcca

SEQ ID NO: 1355620 - RNA, 23 nt, Human
uggaacuacagacacaugccaag

SEQ ID NO: 1355621 - RNA, 26 nt, Human
uggaacuacagacacaugccaagggc

SEQ ID NO: 1355622 - RNA, 23 nt, Human
uggagugcaguggcgcgaucuca

SEQ ID NO: 1355623 - RNA, 24 nt, Human
uggagugcaguggcgcgaucucag

SEQ ID NO: 1355624 - RNA, 21 nt, Human
uggauucaagcaauucuccug

SEQ ID NO: 1355625 - RNA, 24 nt, Human
uggauucaagcaauucuccugccu

SEQ ID NO: 1355626 - RNA, 24 nt, Human
uggcacacacaauccauuugugug

SEQ ID NO: 1355627 - RNA, 24 nt, Human
uggccaggcuggucucaaacuccu

SEQ ID NO: 1355628 - RNA, 24 nt, Human
uggcgcgaucucagcucacugcaa

SEQ ID NO: 1355629 - RNA, 18 nt, Human
ugggauugcaggcaugug

SEQ ID NO: 1355630 - RNA, 21 nt, Human
ugggauugcaggcaugugcca

SEQ ID NO: 1355631 - RNA, 24 nt, Human
ugggauugcaggcaugugccacca

SEQ ID NO: 1355632 - RNA, 24 nt, Human
ugggcuugagcaauccucuugccu

SEQ ID NO: 1355633 - RNA, 23 nt, Human
uggucucuaaaucagacaaucuu

SEQ ID NO: 1355634 - RNA, 24 nt, Human
ugguguuucaccauauuggccagg

SEQ ID NO: 1355635 - RNA, 18 nt, Human
uguagggaugggccuugc

SEQ ID NO: 1355636 - RNA, 23 nt, Human
uguauaaagccuucugcacaggg

SEQ ID NO: 1355637 - RNA, 21 nt, Human
ugucacccagguuggagugca

SEQ ID NO: 1355638 - RNA, 21 nt, Human
uucaacuuuauuguuccaaac

SEQ ID NO: 1355639 - RNA, 21 nt, Human
uucaagcaauucuccugccuc

SEQ ID NO: 1355640 - RNA, 24 nt, Human
uucaagcaauucuccugccucagc

SEQ ID NO: 1355641 - RNA, 22 nt, Human
uucccauaaaaaucccuguguc

SEQ ID NO: 1355642 - RNA, 22 nt, Human
uugagacagggucucgcucugu

SEQ ID NO: 1355643 - RNA, 23 nt, Human
uugcacccuuuauacacaucaua

SEQ ID NO: 1355644 - RNA, 21 nt, Human
uugcccauacuuaucuugauc

SEQ ID NO: 1355645 - RNA, 24 nt, Human
uuuaacuguucucucuuccauuug

SEQ ID NO: 1355646 - RNA, 26 nt, Human
uuuauaguagauaugguguuucacca

SEQ ID NO: 1355647 - RNA, 22 nt, Human
uuucaccaaagaugaauguuuc

SEQ ID NO: 1355648 - RNA, 24 nt, Human
uuucaccauauuggccaggcuggu

SEQ ID NO: 1355649 - RNA, 19 nt, Human
uuugacuuguuggccuugg

SEQ ID NO: 1355650 - RNA, 22 nt, Human
uuuuguagggaugggccuugcu

SEQ ID NO: 1355651 - RNA, 25 nt, Human
uuuuuuucuuuugagacagggucuc

SEQ ID NO: 1355652 - RNA, 22 nt, Human
uuuuuuuucuuuugagacaggg

SEQ ID NO: 1355653 - RNA, 25 nt, Human
uuuuuuuuuuuugagacggagucuc

SEQ ID NO: 1355654 - RNA, 22 nt, Human
uuuuuuuuuuuuuugagacgga

SEQ ID NO: 1355655 - RNA, 22 nt, Human
aaauauuggagaacuagagacu

SEQ ID NO: 1355656 - RNA, 23 nt, Human
agacugaauuaucgcuuguguaa

SEQ ID NO: 1355657 - RNA, 20 nt, Human
agcaugcaguaucauaaaua

SEQ ID NO: 1355658 - RNA, 22 nt, Human
auuucgauugaagaccuugcca

SEQ ID NO: 1355659 - RNA, 24 nt, Human
cagcauacauaauccaucuguaug

SEQ ID NO: 1355660 - RNA, 19 nt, Human
caguaucauaaauauugga

SEQ ID NO: 1355661 - RNA, 25 nt, Human
cucucucaugaaugaauuaucucau

SEQ ID NO: 1355662 - RNA, 22 nt, Human
cuugugccugaagaccuugcca

SEQ ID NO: 1355663 - RNA, 18 nt, Human
gaccauuuccacaugccc

SEQ ID NO: 1355664 - RNA, 20 nt, Human
gagacugaauuaucgcuugu

SEQ ID NO: 1355665 - RNA, 18 nt, Human
uccauaguaaugguccuu

SEQ ID NO: 1355666 - RNA, 21 nt, Human
ugaauaauagccucagcauac

SEQ ID NO: 1355667 - RNA, 24 nt, Human
ugcuaugauuucucuuuaguaugg

SEQ ID NO: 1355668 - RNA, 23 nt, Human
uggaccuucgacaugcaucgcgu

SEQ ID NO: 1355669 - RNA, 21 nt, Human
uggcaggccucaagagaccug

SEQ ID NO: 1355670 - RNA, 21 nt, Human
uguaagaacucucucaugaau

SEQ ID NO: 1355671 - RNA, 21 nt, Human
ugugccugaagaccuugccac

SEQ ID NO: 1355672 - RNA, 22 nt, Human
uguugauuaaugcuagaacuua

SEQ ID NO: 1355673 - RNA, 23 nt, Human
uuacuaaagaucuuaccacacac

SEQ ID NO: 1355674 - RNA, 21 nt, Human
uuauuacuaaagaucuuacca

SEQ ID NO: 1355675 - RNA, 19 nt, Human
uucauaagguuucucucca

SEQ ID NO: 1355676 - RNA, 20 nt, Human
uucauccaagauguauguuu

SEQ ID NO: 1355677 - RNA, 23 nt, Human
acaaaaauguccacagccagagc

SEQ ID NO: 1355678 - RNA, 22 nt, Human
acagaugugcacuccuagugcc

SEQ ID NO: 1355679 - RNA, 22 nt, Human
acagcagacaaaaauguccaca

SEQ ID NO: 1355680 - RNA, 30 nt, Human
acauggcuuccucccugaggagcaucuccu

SEQ ID NO: 1355681 - RNA, 20 nt, Human
aggagucacuccuuagaacc

SEQ ID NO: 1355682 - RNA, 21 nt, Human
aggccucauggccaagacccu

SEQ ID NO: 1355683 - RNA, 25 nt, Human
aucuuugcucugcgugugcugaaag

SEQ ID NO: 1355684 - RNA, 21 nt, Human
cacuccuuagaaccccgagcg

SEQ ID NO: 1355685 - RNA, 21 nt, Human
cagccuggacuucuguuacca

SEQ ID NO: 1355686 - RNA, 25 nt, Human
cagccuggacuucuguuaccauggg

SEQ ID NO: 1355687 - RNA, 24 nt, Human
ccacagcagacaaaaauguccaca

SEQ ID NO: 1355688 - RNA, 26 nt, Human
ccacgccucuaaacgucccccagacg

SEQ ID NO: 1355689 - RNA, 23 nt, Human
ccacugccaccucugcguccgga

SEQ ID NO: 1355690 - RNA, 22 nt, Human
cccccagacggcauuggggcuc

SEQ ID NO: 1355691 - RNA, 19 nt, Human
cucacccgccacagagcca

SEQ ID NO: 1355692 - RNA, 23 nt, Human
cuuagaaccccgagcggcugucc

SEQ ID NO: 1355693 - RNA, 26 nt, Human
cuuagaaccccgagcggcuguccagg

SEQ ID NO: 1355694 - RNA, 25 nt, Human
gaaucagccucagccuggacuucug

SEQ ID NO: 1355695 - RNA, 19 nt, Human
gcacuccuagugccacgcc

SEQ ID NO: 1355696 - RNA, 20 nt, Human
gcuuccaacgaucuuugcuc

SEQ ID NO: 1355697 - RNA, 22 nt, Human
uauuacacugcccacucacacc

SEQ ID NO: 1355698 - RNA, 19 nt, Human
ucauggccaacuuucucag

SEQ ID NO: 1355699 - RNA, 20 nt, Human
uccaacgaucuuugcucugc

SEQ ID NO: 1355700 - RNA, 22 nt, Human
uccacagccagagcuccaaagc

SEQ ID NO: 1355701 - RNA, 19 nt, Human
ucccacacuggggcuucca

SEQ ID NO: 1355702 - RNA, 21 nt, Human
ucccccagacggcauuggggc

SEQ ID NO: 1355703 - RNA, 18 nt, Human
ucccugaggagcaucucc

SEQ ID NO: 1355704 - RNA, 18 nt, Human
ugucaugcucacagaugu

SEQ ID NO: 1355705 - RNA, 21 nt, Human
aaaaaaaaaacaagaaaaaga

SEQ ID NO: 1355706 - RNA, 20 nt, Human
aaaaaacaagaaaaagaaaa

SEQ ID NO: 1355707 - RNA, 27 nt, Human
aaaaaacaggccaggcacaguggcuca

SEQ ID NO: 1355708 - RNA, 19 nt, Human
aaaaaccuugccacauuca

SEQ ID NO: 1355709 - RNA, 22 nt, Human
aaaaucacaaagagucagccaa

SEQ ID NO: 1355710 - RNA, 21 nt, Human
aaacaggccaggcacaguggc

SEQ ID NO: 1355711 - RNA, 19 nt, Human
aaagugcuggaauuacagg

SEQ ID NO: 1355712 - RNA, 24 nt, Human
aaagugcuggaauuacaggcauga

SEQ ID NO: 1355713 - RNA, 21 nt, Human
aaaucaacaaacucaggucaa

SEQ ID NO: 1355714 - RNA, 25 nt, Human
aaaugcaacuggaacuaacaaacac

SEQ ID NO: 1355715 - RNA, 20 nt, Human
aacacggugaaacccagucu

SEQ ID NO: 1355716 - RNA, 21 nt, Human
aacacggugaaacccagucuc

SEQ ID NO: 1355717 - RNA, 24 nt, Human
aaccugggcgacagagcaagacuc

SEQ ID NO: 1355718 - RNA, 18 nt, Human
aagaaaaagaaaauaaag

SEQ ID NO: 1355719 - RNA, 23 nt, Human
aagaaaaagaaaauaaaggcugg

SEQ ID NO: 1355720 - RNA, 24 nt, Human
aagaaaaucacaaagagucagcca

SEQ ID NO: 1355721 - RNA, 18 nt, Human
aagaaacaaaaaacaggc

SEQ ID NO: 1355722 - RNA, 22 nt, Human
aagaaacaaaaaacaggccagg

SEQ ID NO: 1355723 - RNA, 18 nt, Human
aaggugugauuguugauu

SEQ ID NO: 1355724 - RNA, 26 nt, Human
aagugcuggaauuacaggcaugagcc

SEQ ID NO: 1355725 - RNA, 19 nt, Human
aaguggagguugcagugag

SEQ ID NO: 1355726 - RNA, 18 nt, Human
aauuacaggcaugagcca

SEQ ID NO: 1355727 - RNA, 18 nt, Human
aauugcuugaaccuggga

SEQ ID NO: 1355728 - RNA, 18 nt, Human
aauugcuugaaccuggga

SEQ ID NO: 1355729 - RNA, 24 nt, Human
aauugcuugaaccugggaagugga

SEQ ID NO: 1355730 - RNA, 24 nt, Human
aauugcuugaaccugggaggagga

SEQ ID NO: 1355731 - RNA, 24 nt, Human
acagagcaagacuccaucucaaaa

SEQ ID NO: 1355732 - RNA, 26 nt, Human
acaggccaggcacaguggcucacucc

SEQ ID NO: 1355733 - RNA, 19 nt, Human
accacuguacuuuagccgg

SEQ ID NO: 1355734 - RNA, 18 nt, Human
acccagucucuacuaaaa

SEQ ID NO: 1355735 - RNA, 23 nt, Human
accugggcgacagagcaagacuc

SEQ ID NO: 1355736 - RNA, 18 nt, Human
acugaaaacuuugugaca

SEQ ID NO: 1355737 - RNA, 18 nt, Human
acugcacuccaaccuggg

SEQ ID NO: 1355738 - RNA, 24 nt, Human
acugcacuccaaccugggcgacag

SEQ ID NO: 1355739 - RNA, 22 nt, Human
agaauugcuugaaccugggagg

SEQ ID NO: 1355740 - RNA, 24 nt, Human
agacugaggcaggagaauugcuug

SEQ ID NO: 1355741 - RNA, 24 nt, Human
agagaccauucuggcuaacacggu

SEQ ID NO: 1355742 - RNA, 23 nt, Human
agccaaaaugcaacuggaacuaa

SEQ ID NO: 1355743 - RNA, 24 nt, Human
aggaggagguugcagugagcugag

SEQ ID NO: 1355744 - RNA, 24 nt, Human
aggcacaguggcucacuccuguaa

SEQ ID NO: 1355745 - RNA, 22 nt, Human
aggcaggagaauugcuugaacc

SEQ ID NO: 1355746 - RNA, 22 nt, Human
aggcaggagaauugcuugaacc

SEQ ID NO: 1355747 - RNA, 24 nt, Human
aggcaggagaauugcuugaaccug

SEQ ID NO: 1355748 - RNA, 24 nt, Human
aggcaggagaauugcuugaaccug

SEQ ID NO: 1355749 - RNA, 21 nt, Human
aggcugaggcaggagaauugc

SEQ ID NO: 1355750 - RNA, 24 nt, Human
aggcugaggcaggagaauugcuug

SEQ ID NO: 1355751 - RNA, 18 nt, Human
agugaccuuggacugaag

SEQ ID NO: 1355752 - RNA, 24 nt, Human
aguggcucacuccuguaaucucag

SEQ ID NO: 1355753 - RNA, 24 nt, Human
aucgugccacugcacuccaaccug

SEQ ID NO: 1355754 - RNA, 20 nt, Human
augacaugaccuucuguaaa

SEQ ID NO: 1355755 - RNA, 23 nt, Human
augauuaaaaacauguauaaaua

SEQ ID NO: 1355756 - RNA, 27 nt, Human
caaaaaauuacccaggugugguggcac

SEQ ID NO: 1355757 - RNA, 19 nt, Human
caaaaugcaacuggaacua

SEQ ID NO: 1355758 - RNA, 20 nt, Human
caaagagucagccaaaaugc

SEQ ID NO: 1355759 - RNA, 18 nt, Human
caaagugcuggaauuaca

SEQ ID NO: 1355760 - RNA, 23 nt, Human
caaagugcuggaauuacaggcau

SEQ ID NO: 1355761 - RNA, 24 nt, Human
caaagugcuggaauuacaggcaug

SEQ ID NO: 1355762 - RNA, 20 nt, Human
caacagucuuuagaagucaa

SEQ ID NO: 1355763 - RNA, 24 nt, Human
caacuguagugucagcuacuuggg

SEQ ID NO: 1355764 - RNA, 21 nt, Human
caagacuccaucucaaaaaaa

SEQ ID NO: 1355765 - RNA, 21 nt, Human
caaugugaauuuucuuaugug

SEQ ID NO: 1355766 - RNA, 23 nt, Human
caccaaaaauuaguugaauuucc

SEQ ID NO: 1355767 - RNA, 18 nt, Human
cacgugugaaucauuccc

SEQ ID NO: 1355768 - RNA, 23 nt, Human
cacuccaaccugggcgacagagc

SEQ ID NO: 1355769 - RNA, 24 nt, Human
cacuccuguaaucucagcacuuug

SEQ ID NO: 1355770 - RNA, 23 nt, Human
cacugcacuccaaccugggcgac

SEQ ID NO: 1355771 - RNA, 24 nt, Human
cacugcacuccaaccugggcgaca

SEQ ID NO: 1355772 - RNA, 27 nt, Human
cacugcacuccaaccugggcgacagag

SEQ ID NO: 1355773 - RNA, 18 nt, Human
cagcacuuugggaggugg

SEQ ID NO: 1355774 - RNA, 24 nt, Human
cagguacuuggaaggcugaggcag

SEQ ID NO: 1355775 - RNA, 21 nt, Human
cauaggaugaagcuugacuga

SEQ ID NO: 1355776 - RNA, 23 nt, Human
ccaaaaugcaacuggaacuaaca

SEQ ID NO: 1355777 - RNA, 21 nt, Human
ccacugcacuccaaccugggc

SEQ ID NO: 1355778 - RNA, 24 nt, Human
ccacugcacuccaaccugggcgac

SEQ ID NO: 1355779 - RNA, 20 nt, Human
ccagggagacgagguuccua

SEQ ID NO: 1355780 - RNA, 22 nt, Human
ccaucucaaaaaaaaaacaaga

SEQ ID NO: 1355781 - RNA, 24 nt, Human
ccaucuguuggcuaggcuguucuc

SEQ ID NO: 1355782 - RNA, 24 nt, Human
ccauggcccccagugcaauccucu

SEQ ID NO: 1355783 - RNA, 23 nt, Human
cccgaaagccuugucacaaaccu

SEQ ID NO: 1355784 - RNA, 21 nt, Human
cccugaaugucaauagacccu

SEQ ID NO: 1355785 - RNA, 23 nt, Human
ccuaccugucuuugccucucaaa

SEQ ID NO: 1355786 - RNA, 24 nt, Human
ccugaggaagagccaucccugacu

SEQ ID NO: 1355787 - RNA, 21 nt, Human
ccugggaaguggagguugcag

SEQ ID NO: 1355788 - RNA, 24 nt, Human
cucacuccuguaaucucagcacuu

SEQ ID NO: 1355789 - RNA, 22 nt, Human
cucaggucaaggcugauuugac

SEQ ID NO: 1355790 - RNA, 18 nt, Human
cuccaaugaugugcaaug

SEQ ID NO: 1355791 - RNA, 21 nt, Human
cuccaguaugaauugccuuau

SEQ ID NO: 1355792 - RNA, 23 nt, Human
cuccaucucaaaaaaaaaacaag

SEQ ID NO: 1355793 - RNA, 23 nt, Human
cuccuguaaucucagcacuuugg

SEQ ID NO: 1355794 - RNA, 24 nt, Human
cuccuguaaucucagcacuuuggg

SEQ ID NO: 1355795 - RNA, 20 nt, Human
cucuccagugugaauucuag

SEQ ID NO: 1355796 - RNA, 26 nt, Human
cugagcaggguccaggcauuuccacu

SEQ ID NO: 1355797 - RNA, 18 nt, Human
cuggcuaacacggugaaa

SEQ ID NO: 1355798 - RNA, 21 nt, Human
cuggcuaacacggugaaaccc

SEQ ID NO: 1355799 - RNA, 20 nt, Human
cuguagucccagguacuugg

SEQ ID NO: 1355800 - RNA, 23 nt, Human
cuugauggugaauaaguggugac

SEQ ID NO: 1355801 - RNA, 19 nt, Human
cuuguaagguuucucucca

SEQ ID NO: 1355802 - RNA, 19 nt, Human
cuuguaagguuucucucca

SEQ ID NO: 1355803 - RNA, 19 nt, Human
cuuguaagguuucucucca

SEQ ID NO: 1355804 - RNA, 18 nt, Human
cuuuccucuuccucuucu

SEQ ID NO: 1355805 - RNA, 20 nt, Human
cuuugccucucaaagugcug

SEQ ID NO: 1355806 - RNA, 18 nt, Human
gaaguggagguugcagug

SEQ ID NO: 1355807 - RNA, 21 nt, Human
gaaugucaauagacccugagg

SEQ ID NO: 1355808 - RNA, 21 nt, Human
gaauuacaggcaugagccaug

SEQ ID NO: 1355809 - RNA, 19 nt, Human
gacgagguuccuauaauuc

SEQ ID NO: 1355810 - RNA, 23 nt, Human
gagguugcagugagcugagaucg

SEQ ID NO: 1355811 - RNA, 24 nt, Human
gccacugcacuccaaccugggcga

SEQ ID NO: 1355812 - RNA, 24 nt, Human
gcuaacacggugaaacccagucuc

SEQ ID NO: 1355813 - RNA, 20 nt, Human
gcugagaucgugccacugca

SEQ ID NO: 1355814 - RNA, 24 nt, Human
ggagaugacaccacuguacuuuag

SEQ ID NO: 1355815 - RNA, 23 nt, Human
ggaggaggagguugcagugagcu

SEQ ID NO: 1355816 - RNA, 22 nt, Human
ggagguugcagugagcggagau

SEQ ID NO: 1355817 - RNA, 23 nt, Human
ggagguugcagugagcggagaug

SEQ ID NO: 1355818 - RNA, 22 nt, Human
ggagguugcagugagcugagau

SEQ ID NO: 1355819 - RNA, 24 nt, Human
ggagguugcagugagcugagaucg

SEQ ID NO: 1355820 - RNA, 19 nt, Human
ggguggaucauaaagucag

SEQ ID NO: 1355821 - RNA, 19 nt, Human
guauaaaguccucugagca

SEQ ID NO: 1355822 - RNA, 24 nt, Human
gugacugcccacuaaaggguuugc

SEQ ID NO: 1355823 - RNA, 24 nt, Human
guugcagugagcugagaucgugcc

SEQ ID NO: 1355824 - RNA, 22 nt, Human
uaaagaaacaaaaaacaggcca

SEQ ID NO: 1355825 - RNA, 22 nt, Human
uaacacggugaaacccagucuc

SEQ ID NO: 1355826 - RNA, 24 nt, Human
uaacacggugaaacccagucucua

SEQ ID NO: 1355827 - RNA, 24 nt, Human
uacaggcaugagccauggccccca

SEQ ID NO: 1355828 - RNA, 23 nt, Human
uaccugucuuugccucucaaagu

SEQ ID NO: 1355829 - RNA, 20 nt, Human
uagaauaacagcaccaaaaa

SEQ ID NO: 1355830 - RNA, 19 nt, Human
uauggcuuuucuccagugu

SEQ ID NO: 1355831 - RNA, 24 nt, Human
ucaaagugcuggaauuacaggcau

SEQ ID NO: 1355832 - RNA, 18 nt, Human
ucagaagauagagaccau

SEQ ID NO: 1355833 - RNA, 19 nt, Human
uccaucucaaaaaaaaaac

SEQ ID NO: 1355834 - RNA, 21 nt, Human
ucccuauaccauggauugcuu

SEQ ID NO: 1355835 - RNA, 19 nt, Human
uccuccugagagaauucua

SEQ ID NO: 1355836 - RNA, 23 nt, Human
ucgugccacugcacuccaaccug

SEQ ID NO: 1355837 - RNA, 18 nt, Human
ucucaaaaaaaaaacaag

SEQ ID NO: 1355838 - RNA, 24 nt, Human
ucucaaagugcuggaauuacaggc

SEQ ID NO: 1355839 - RNA, 22 nt, Human
ucucuacuaaaaacacaaaaaa

SEQ ID NO: 1355840 - RNA, 21 nt, Human
ucucuccagugugaauucuag

SEQ ID NO: 1355841 - RNA, 23 nt, Human
ucuggcuaacacggugaaaccca

SEQ ID NO: 1355842 - RNA, 21 nt, Human
ucuguagucccagguacuugg

SEQ ID NO: 1355843 - RNA, 19 nt, Human
ucuguaugguuucucuuca

SEQ ID NO: 1355844 - RNA, 24 nt, Human
ucuguuggcuaggcuguucucaaa

SEQ ID NO: 1355845 - RNA, 23 nt, Human
ugaaaacuuuugucacauuccuc

SEQ ID NO: 1355846 - RNA, 22 nt, Human
ugaaacaacugucuccaaaagg

SEQ ID NO: 1355847 - RNA, 24 nt, Human
ugaaccugggaaguggagguugca

SEQ ID NO: 1355848 - RNA, 24 nt, Human
ugaaccugggaggaggagguugca

SEQ ID NO: 1355849 - RNA, 25 nt, Human
ugacagaccaaaacuccagggagac

SEQ ID NO: 1355850 - RNA, 24 nt, Human
ugacaugaccuucuguaaagaaaa

SEQ ID NO: 1355851 - RNA, 19 nt, Human
ugacuccuuugcuuuccuc

SEQ ID NO: 1355852 - RNA, 22 nt, Human
ugagagaauucuauggccacgu

SEQ ID NO: 1355853 - RNA, 19 nt, Human
ugagaucgugccacugcac

SEQ ID NO: 1355854 - RNA, 22 nt, Human
ugagcugagaucgugccacugc

SEQ ID NO: 1355855 - RNA, 24 nt, Human
ugaggcaggagaauugcuugaacc

SEQ ID NO: 1355856 - RNA, 24 nt, Human
ugaggcaggagaauugcuugaacc

SEQ ID NO: 1355857 - RNA, 25 nt, Human
ugaggcaggagaauugcuugaaccu

SEQ ID NO: 1355858 - RNA, 25 nt, Human
ugaggcaggagaauugcuugaaccu

SEQ ID NO: 1355859 - RNA, 24 nt, Human
ugauuaaaaaccaugucacauuca

SEQ ID NO: 1355860 - RNA, 22 nt, Human
ugauuguugauuaaaaaccaug

SEQ ID NO: 1355861 - RNA, 31 nt, Human
ugcaaaaaccuugucacaaaccuuaccucuu

SEQ ID NO: 1355862 - RNA, 22 nt, Human
ugcaacuggaacuaacaaacac

SEQ ID NO: 1355863 - RNA, 20 nt, Human
uggaaggcugaggcaggaga

SEQ ID NO: 1355864 - RNA, 20 nt, Human
uggaaggcugaggcaggaga

SEQ ID NO: 1355865 - RNA, 18 nt, Human
uggaauuacaggcaugag

SEQ ID NO: 1355866 - RNA, 21 nt, Human
uggaauuacaggcaugagcca

SEQ ID NO: 1355867 - RNA, 22 nt, Human
uggaauuacaggcaugagccau

SEQ ID NO: 1355868 - RNA, 22 nt, Human
uggaauuacaggcaugagccau

SEQ ID NO: 1355869 - RNA, 29 nt, Human
uggaauuacaggcaugagccauggccccc

SEQ ID NO: 1355870 - RNA, 25 nt, Human
uggcccccagugcaauccucuuaac

SEQ ID NO: 1355871 - RNA, 20 nt, Human
uggcccccagugcaauccuu

SEQ ID NO: 1355872 - RNA, 21 nt, Human
uggcuaggcuguucucaaacu

SEQ ID NO: 1355873 - RNA, 21 nt, Human
uggcucacuccuguaaucuca

SEQ ID NO: 1355874 - RNA, 22 nt, Human
uggcucacuccuguaaucucag

SEQ ID NO: 1355875 - RNA, 24 nt, Human
uggcucacuccuguaaucucagca

SEQ ID NO: 1355876 - RNA, 19 nt, Human
ugggaaaaguagcucccau

SEQ ID NO: 1355877 - RNA, 24 nt, Human
ugggaaguggagguugcagugagc

SEQ ID NO: 1355878 - RNA, 24 nt, Human
ugggaggaggagguugcagugagc

SEQ ID NO: 1355879 - RNA, 18 nt, Human
uggggugccacgugugaa

SEQ ID NO: 1355880 - RNA, 23 nt, Human
uguaagguuucucuccacuauga

SEQ ID NO: 1355881 - RNA, 23 nt, Human
uguauaaaguccucugagcaggg

SEQ ID NO: 1355882 - RNA, 23 nt, Human
uguaugguuucucuucaauguga

SEQ ID NO: 1355883 - RNA, 24 nt, Human
ugugaaguaaacgcuuugccacaa

SEQ ID NO: 1355884 - RNA, 22 nt, Human
ugugaauuuugaccaacggucu

SEQ ID NO: 1355885 - RNA, 21 nt, Human
ugugagguuucucuccuguau

SEQ ID NO: 1355886 - RNA, 18 nt, Human
ugugguggcacacaacug

SEQ ID NO: 1355887 - RNA, 24 nt, Human
uguuaaaucaacaaacucagguca

SEQ ID NO: 1355888 - RNA, 23 nt, Human
uuagaagucaauccgcccgccgc

SEQ ID NO: 1355889 - RNA, 21 nt, Human
uucacuguggauucuccaaug

SEQ ID NO: 1355890 - RNA, 24 nt, Human
uugaaccugggaaguggagguugc

SEQ ID NO: 1355891 - RNA, 24 nt, Human
uugaaccugggaggaggagguugc

SEQ ID NO: 1355892 - RNA, 18 nt, Human
uugcagugagcggagaug

SEQ ID NO: 1355893 - RNA, 20 nt, Human
uugcagugagcggagaugac

SEQ ID NO: 1355894 - RNA, 18 nt, Human
uugcagugagcugagauc

SEQ ID NO: 1355895 - RNA, 21 nt, Human
uugcagugagcugagaucgug

SEQ ID NO: 1355896 - RNA, 22 nt, Human
uugcagugagcugagaucgugc

SEQ ID NO: 1355897 - RNA, 24 nt, Human
uugcuugaaccugggaaguggagg

SEQ ID NO: 1355898 - RNA, 18 nt, Human
uugcuugaaccugggagg

SEQ ID NO: 1355899 - RNA, 24 nt, Human
uugcuugaaccugggaggaggagg

SEQ ID NO: 1355900 - RNA, 23 nt, Human
uuggaaggcugaggcaggagaau

SEQ ID NO: 1355901 - RNA, 23 nt, Human
uugggagacugaggcaggagaau

SEQ ID NO: 1355902 - RNA, 19 nt, Human
uuuauaagguuucucucca

SEQ ID NO: 1355903 - RNA, 22 nt, Human
uuuccucuuccucuucuggguu

SEQ ID NO: 1355904 - RNA, 19 nt, Human
uuuguaagguuucucucca

SEQ ID NO: 1355905 - RNA, 24 nt, Human
uuuguuaaagaaacaaaaaacagg

SEQ ID NO: 1355906 - RNA, 21 nt, Human
acacacccucugcuucagcuu

SEQ ID NO: 1355907 - RNA, 19 nt, Human
acuuuccucuuggaucugu

SEQ ID NO: 1355908 - RNA, 20 nt, Human
aggcagccugguacaggcag

SEQ ID NO: 1355909 - RNA, 23 nt, Human
caaauaaauccucaguuguucga

SEQ ID NO: 1355910 - RNA, 24 nt, Human
caucaaguugagacuuuucccaag

SEQ ID NO: 1355911 - RNA, 24 nt, Human
ccccaucaaguugagacuuuuccc

SEQ ID NO: 1355912 - RNA, 20 nt, Human
ccucugcuucagcuugggag

SEQ ID NO: 1355913 - RNA, 24 nt, Human
ccucugcuuugcuguuaucagagg

SEQ ID NO: 1355914 - RNA, 24 nt, Human
cuguucuguuccuccauccucaug

SEQ ID NO: 1355915 - RNA, 22 nt, Human
gagacacgaacacacccucugc

SEQ ID NO: 1355916 - RNA, 24 nt, Human
gagacacgaacacacccucugcuu

SEQ ID NO: 1355917 - RNA, 26 nt, Human
uacuuaaaauauggaaacuaaucaag

SEQ ID NO: 1355918 - RNA, 20 nt, Human
ucaaguugagacuuuuccca

SEQ ID NO: 1355919 - RNA, 24 nt, Human
uccaaguacuuuccucuuggaucu

SEQ ID NO: 1355920 - RNA, 20 nt, Human
uccauccucaugugaguaag

SEQ ID NO: 1355921 - RNA, 20 nt, Human
uccccggaaucuuuucuucc

SEQ ID NO: 1355922 - RNA, 21 nt, Human
uccccggaaucuuuucuucca

SEQ ID NO: 1355923 - RNA, 20 nt, Human
uccucaugugaguaaggguu

SEQ ID NO: 1355924 - RNA, 24 nt, Human
uccucaugugaguaaggguuuugg

SEQ ID NO: 1355925 - RNA, 19 nt, Human
uccucugcuuugcuguuau

SEQ ID NO: 1355926 - RNA, 22 nt, Human
uccuugggucuccucugcuuug

SEQ ID NO: 1355927 - RNA, 24 nt, Human
ugcuguuaucagaggcacuuuugg

SEQ ID NO: 1355928 - RNA, 25 nt, Human
ugucuaaaccacuuucuguuuaccc

SEQ ID NO: 1355929 - RNA, 20 nt, Human
uguucuguuccuccauccuc

SEQ ID NO: 1355930 - RNA, 19 nt, Human
uuagcagugaugcuacccc

SEQ ID NO: 1355931 - RNA, 19 nt, Human
uucauucauugcuuagcag

SEQ ID NO: 1355932 - RNA, 21 nt, Human
uuuggccuuugccaggcagcc

SEQ ID NO: 1355933 - RNA, 21 nt, Human
aaauagcugcacccugacuuu

SEQ ID NO: 1355934 - RNA, 21 nt, Human
aaccucuucguuucucuccug

SEQ ID NO: 1355935 - RNA, 20 nt, Human
aagccacaugcagacccgga

SEQ ID NO: 1355936 - RNA, 18 nt, Human
aagggcaaguuggggggc

SEQ ID NO: 1355937 - RNA, 19 nt, Human
aagggcaaguuggggggcc

SEQ ID NO: 1355938 - RNA, 19 nt, Human
aagggcccuuggaauguca

SEQ ID NO: 1355939 - RNA, 21 nt, Human
acaccagguuccgggccuggu

SEQ ID NO: 1355940 - RNA, 22 nt, Human
acacucaccaucucggcguaca

SEQ ID NO: 1355941 - RNA, 23 nt, Human
acccgcugccuugucuggccuca

SEQ ID NO: 1355942 - RNA, 23 nt, Human
acccgcugccuugucugggggag

SEQ ID NO: 1355943 - RNA, 19 nt, Human
acgcuccguccccacaagc

SEQ ID NO: 1355944 - RNA, 23 nt, Human
acgcugccacagcuccagcacca

SEQ ID NO: 1355945 - RNA, 28 nt, Human
acgcugccacagcuccagcaccacaagc

SEQ ID NO: 1355946 - RNA, 19 nt, Human
agaacugguagccagccca

SEQ ID NO: 1355947 - RNA, 18 nt, Human
agaaggagggcaggacaa

SEQ ID NO: 1355948 - RNA, 20 nt, Human
agagcuccucaggguuuggg

SEQ ID NO: 1355949 - RNA, 21 nt, Human
agcagcggcggcggaaccggc

SEQ ID NO: 1355950 - RNA, 19 nt, Human
agccagugucugaaggcgc

SEQ ID NO: 1355951 - RNA, 20 nt, Human
agcggugcagcaggagccug

SEQ ID NO: 1355952 - RNA, 18 nt, Human
aggaggaggcugcggagc

SEQ ID NO: 1355953 - RNA, 21 nt, Human
agggagcacgguguugaggcg

SEQ ID NO: 1355954 - RNA, 21 nt, Human
agggucuuguuccccaugaca

SEQ ID NO: 1355955 - RNA, 20 nt, Human
agucccugcaucacugugcg

SEQ ID NO: 1355956 - RNA, 20 nt, Human
auagccagaauauuccuagc

SEQ ID NO: 1355957 - RNA, 21 nt, Human
auggcggcaggcccccaggcc

SEQ ID NO: 1355958 - RNA, 19 nt, Human
auggggcugcagaggagcc

SEQ ID NO: 1355959 - RNA, 20 nt, Human
caaggacaggcuuccccguc

SEQ ID NO: 1355960 - RNA, 22 nt, Human
caauagccagaauauuccuagc

SEQ ID NO: 1355961 - RNA, 23 nt, Human
caauagcggugcagcaggagccu

SEQ ID NO: 1355962 - RNA, 24 nt, Human
caccagaaccucuucguuucucuc

SEQ ID NO: 1355963 - RNA, 21 nt, Human
cacugaccuccauagcccgca

SEQ ID NO: 1355964 - RNA, 22 nt, Human
cacugggcuguacggugugcuu

SEQ ID NO: 1355965 - RNA, 18 nt, Human
cagaaggaggugcuggaa

SEQ ID NO: 1355966 - RNA, 22 nt, Human
cagaauauuccuagcaucuugc

SEQ ID NO: 1355967 - RNA, 19 nt, Human
cagagggcgcuugcagucc

SEQ ID NO: 1355968 - RNA, 22 nt, Human
cagagggcgcuugcaguccucu

SEQ ID NO: 1355969 - RNA, 19 nt, Human
cagcagcggcggcggaacc

SEQ ID NO: 1355970 - RNA, 19 nt, Human
cagccagaccauugggggc

SEQ ID NO: 1355971 - RNA, 21 nt, Human
cagccaguccuccgcuguggc

SEQ ID NO: 1355972 - RNA, 19 nt, Human
cagccccugcugcccccac

SEQ ID NO: 1355973 - RNA, 22 nt, Human
cagcgcacuccagaccaccccc

SEQ ID NO: 1355974 - RNA, 18 nt, Human
cagcggcggcggaaccgg

SEQ ID NO: 1355975 - RNA, 24 nt, Human
cagcucccucagcaguuucuccca

SEQ ID NO: 1355976 - RNA, 21 nt, Human
cagcuucugaaugaggacccu

SEQ ID NO: 1355977 - RNA, 22 nt, Human
caggaaauagcugcacccugac

SEQ ID NO: 1355978 - RNA, 23 nt, Human
caggaagaccacccgaaugaagg

SEQ ID NO: 1355979 - RNA, 18 nt, Human
caggaucugauuggacac

SEQ ID NO: 1355980 - RNA, 22 nt, Human
caggggugguuggaaauccguc

SEQ ID NO: 1355981 - RNA, 24 nt, Human
cauagcccgcaggcauugccccuc

SEQ ID NO: 1355982 - RNA, 22 nt, Human
caugcagacccggaggugagcu

SEQ ID NO: 1355983 - RNA, 19 nt, Human
cauguggggccugcagagc

SEQ ID NO: 1355984 - RNA, 23 nt, Human
cauugaggaccccauggccauuc

SEQ ID NO: 1355985 - RNA, 18 nt, Human
ccaacuccuuuacaaggg

SEQ ID NO: 1355986 - RNA, 20 nt, Human
ccacaugcagacccggaggu

SEQ ID NO: 1355987 - RNA, 24 nt, Human
ccacccccgccuguccugcccacc

SEQ ID NO: 1355988 - RNA, 23 nt, Human
ccacuggucuuuauacuuggccu

SEQ ID NO: 1355989 - RNA, 21 nt, Human
ccagaacaaagaaggagggca

SEQ ID NO: 1355990 - RNA, 20 nt, Human
ccagaccauugggggccacc

SEQ ID NO: 1355991 - RNA, 20 nt, Human
ccagcuguccugccagugcc

SEQ ID NO: 1355992 - RNA, 18 nt, Human
ccauucagugaccuggca

SEQ ID NO: 1355993 - RNA, 19 nt, Human
cccacaagcucuccuugcc

SEQ ID NO: 1355994 - RNA, 24 nt, Human
cccacaagcucuccuugccccaga

SEQ ID NO: 1355995 - RNA, 23 nt, Human
cccaggccaggaucuaccagaac

SEQ ID NO: 1355996 - RNA, 18 nt, Human
cccauggccaugucuugc

SEQ ID NO: 1355997 - RNA, 19 nt, Human
ccccagaagucacgcugcc

SEQ ID NO: 1355998 - RNA, 21 nt, Human
ccccagaagucacgcugccac

SEQ ID NO: 1355999 - RNA, 21 nt, Human
cccgcaggcauugccccuccu

SEQ ID NO: 1356000 - RNA, 24 nt, Human
cccugaacugucuguccagacccc

SEQ ID NO: 1356001 - RNA, 23 nt, Human
cccugacuuugggccuccucggg

SEQ ID NO: 1356002 - RNA, 20 nt, Human
cccuuacuguccacugcgug

SEQ ID NO: 1356003 - RNA, 20 nt, Human
cccuuacuguccacugcgug

SEQ ID NO: 1356004 - RNA, 23 nt, Human
ccgucauggggagggucuuguuc

SEQ ID NO: 1356005 - RNA, 18 nt, Human
ccucaauggccauccucu

SEQ ID NO: 1356006 - RNA, 21 nt, Human
ccucaauggccauccucuuua

SEQ ID NO: 1356007 - RNA, 24 nt, Human
ccugaagccgacugccucugaggc

SEQ ID NO: 1356008 - RNA, 24 nt, Human
ccugcagggccagggaauggggcu

SEQ ID NO: 1356009 - RNA, 19 nt, Human
cgcacuccagaccaccccc

SEQ ID NO: 1356010 - RNA, 25 nt, Human
cgcacuccagaccacccccgccugu

SEQ ID NO: 1356011 - RNA, 22 nt, Human
cgccagcagcggcggcggaacc

SEQ ID NO: 1356012 - RNA, 22 nt, Human
cgcccagcgccggcggcggcac

SEQ ID NO: 1356013 - RNA, 22 nt, Human
cgcccucuuccuuccccaacuc

SEQ ID NO: 1356014 - RNA, 23 nt, Human
cgcccucuuccuuccccaacucc

SEQ ID NO: 1356015 - RNA, 23 nt, Human
cucacaggaugccaagaucucgc

SEQ ID NO: 1356016 - RNA, 22 nt, Human
cucaggguuugggugcacuggc

SEQ ID NO: 1356017 - RNA, 19 nt, Human
cucauacacucaccaucuc

SEQ ID NO: 1356018 - RNA, 25 nt, Human
cuccucaggguuugggugcacuggc

SEQ ID NO: 1356019 - RNA, 22 nt, Human
cucgcccuuggccaggcccagc

SEQ ID NO: 1356020 - RNA, 24 nt, Human
cugcagcgcacuccagaccacccc

SEQ ID NO: 1356021 - RNA, 26 nt, Human
cugcccaccguccccaucccacaucg

SEQ ID NO: 1356022 - RNA, 18 nt, Human
cugccuugucuggccuca

SEQ ID NO: 1356023 - RNA, 20 nt, Human
cuggggcugaggguugaggu

SEQ ID NO: 1356024 - RNA, 23 nt, Human
cuucacguucucccgggccucca

SEQ ID NO: 1356025 - RNA, 21 nt, Human
cuuccuguccaggcugguggc

SEQ ID NO: 1356026 - RNA, 21 nt, Human
cuuggggaagccuucaguccc

SEQ ID NO: 1356027 - RNA, 20 nt, Human
cuuuauacuuggccugauuc

SEQ ID NO: 1356028 - RNA, 19 nt, Human
gaacuuggagccgaaggug

SEQ ID NO: 1356029 - RNA, 19 nt, Human
gaggaccccauggccauuc

SEQ ID NO: 1356030 - RNA, 21 nt, Human
gaggaggcugcggagcugcca

SEQ ID NO: 1356031 - RNA, 21 nt, Human
gagggcuguugguagcaggag

SEQ ID NO: 1356032 - RNA, 24 nt, Human
gaggggcaauagcggugcagcagg

SEQ ID NO: 1356033 - RNA, 18 nt, Human
gauacagccccugcugcc

SEQ ID NO: 1356034 - RNA, 22 nt, Human
gauggcggcaggcccccaggcc

SEQ ID NO: 1356035 - RNA, 20 nt, Human
gcaggcccgacggugggauc

SEQ ID NO: 1356036 - RNA, 20 nt, Human
gccacucgcugcuccuuggc

SEQ ID NO: 1356037 - RNA, 23 nt, Human
gccagcaccucaauggccauccu

SEQ ID NO: 1356038 - RNA, 24 nt, Human
gcccuuacuguccacugcgugguu

SEQ ID NO: 1356039 - RNA, 22 nt, Human
gcggugcagcaggagccugcag

SEQ ID NO: 1356040 - RNA, 22 nt, Human
gcucuggggcugaggguugagg

SEQ ID NO: 1356041 - RNA, 21 nt, Human
gcucuuugccacauuugcggc

SEQ ID NO: 1356042 - RNA, 24 nt, Human
gcugcagaggagccagugucugaa

SEQ ID NO: 1356043 - RNA, 20 nt, Human
gcugcagcgcacuccagacc

SEQ ID NO: 1356044 - RNA, 20 nt, Human
gcuggauccuucggauuccg

SEQ ID NO: 1356045 - RNA, 24 nt, Human
gcugggacgcugucccccaaccca

SEQ ID NO: 1356046 - RNA, 24 nt, Human
gcuugcaguccucugccagcuccc

SEQ ID NO: 1356047 - RNA, 18 nt, Human
ggacaaggggcaggcagc

SEQ ID NO: 1356048 - RNA, 21 nt, Human
ggacaaggggcaggcagcgcc

SEQ ID NO: 1356049 - RNA, 21 nt, Human
ggacaccagguuccgggccug

SEQ ID NO: 1356050 - RNA, 21 nt, Human
ggagcagcugcagguccuugc

SEQ ID NO: 1356051 - RNA, 24 nt, Human
ggaggagguugaggcaguucaugc

SEQ ID NO: 1356052 - RNA, 22 nt, Human
ggaggcccaucuggggcucagg

SEQ ID NO: 1356053 - RNA, 20 nt, Human
ggcaggacaaggggcaggca

SEQ ID NO: 1356054 - RNA, 22 nt, Human
ggccagagaagggggcugaggg

SEQ ID NO: 1356055 - RNA, 22 nt, Human
ggcgccagcagcggcggcggaa

SEQ ID NO: 1356056 - RNA, 22 nt, Human
ggcugcagaggagccagugucu

SEQ ID NO: 1356057 - RNA, 26 nt, Human
ggcugguggcuuugggcugauagguc

SEQ ID NO: 1356058 - RNA, 18 nt, Human
gggaauggggcugcagag

SEQ ID NO: 1356059 - RNA, 20 nt, Human
gggcugaggggcaauagcgg

SEQ ID NO: 1356060 - RNA, 20 nt, Human
gggcuuggcuugcuuggccu

SEQ ID NO: 1356061 - RNA, 30 nt, Human
gucacgcugccacagcuccagcaccacaag

SEQ ID NO: 1356062 - RNA, 25 nt, Human
guccacugcgugguucagcuccacc

SEQ ID NO: 1356063 - RNA, 20 nt, Human
gucccgagugaaguggagga

SEQ ID NO: 1356064 - RNA, 22 nt, Human
gugggcuggaugcucuugggga

SEQ ID NO: 1356065 - RNA, 21 nt, Human
gugucugggcccauguggggc

SEQ ID NO: 1356066 - RNA, 24 nt, Human
uaagauaggcagcugcuucucucc

SEQ ID NO: 1356067 - RNA, 19 nt, Human
uacaccagaaccucuucgu

SEQ ID NO: 1356068 - RNA, 21 nt, Human
uagcccgcaggcauugccccu

SEQ ID NO: 1356069 - RNA, 20 nt, Human
uagcugcacccugacuuugg

SEQ ID NO: 1356070 - RNA, 23 nt, Human
uaguaguggggcuuauugaaggu

SEQ ID NO: 1356071 - RNA, 21 nt, Human
uauuucaguggaaaauuacag

SEQ ID NO: 1356072 - RNA, 19 nt, Human
ucacgcugccacagcucca

SEQ ID NO: 1356073 - RNA, 20 nt, Human
ucagcuccccaugguuccug

SEQ ID NO: 1356074 - RNA, 21 nt, Human
ucaguuagucccugcaucacu

SEQ ID NO: 1356075 - RNA, 21 nt, Human
uccagcaccacaagcgguggg

SEQ ID NO: 1356076 - RNA, 21 nt, Human
uccagcuguccugccagugcc

SEQ ID NO: 1356077 - RNA, 26 nt, Human
uccaggaggaauaugggcgcgaugcc

SEQ ID NO: 1356078 - RNA, 21 nt, Human
ucccagcccuccuccucgccc

SEQ ID NO: 1356079 - RNA, 19 nt, Human
uccccacaagcucuccuug

SEQ ID NO: 1356080 - RNA, 21 nt, Human
uccccacuccauacucccagc

SEQ ID NO: 1356081 - RNA, 19 nt, Human
uccgguccuggagauccag

SEQ ID NO: 1356082 - RNA, 21 nt, Human
uccucaggguuugggugcacu

SEQ ID NO: 1356083 - RNA, 24 nt, Human
uccucaggguuugggugcacuggc

SEQ ID NO: 1356084 - RNA, 19 nt, Human
uccucggggccuaaagcgg

SEQ ID NO: 1356085 - RNA, 19 nt, Human
uccuggccagagaaggggg

SEQ ID NO: 1356086 - RNA, 24 nt, Human
uccugucucccuccaccucccagg

SEQ ID NO: 1356087 - RNA, 19 nt, Human
uccuugggcuuggcuugcu

SEQ ID NO: 1356088 - RNA, 25 nt, Human
uccuugggcuuggcuugcuuggccu

SEQ ID NO: 1356089 - RNA, 18 nt, Human
ucgcugcuccuuggccac

SEQ ID NO: 1356090 - RNA, 19 nt, Human
ucucagggccccugugccc

SEQ ID NO: 1356091 - RNA, 22 nt, Human
ucugcagucagacagggcuggg

SEQ ID NO: 1356092 - RNA, 23 nt, Human
ucugcagucagacagggcugggc

SEQ ID NO: 1356093 - RNA, 22 nt, Human
ucugggcccauguggggccugc

SEQ ID NO: 1356094 - RNA, 21 nt, Human
ucuucuccaccgggcuccaga

SEQ ID NO: 1356095 - RNA, 19 nt, Human
ucuuugccacauuugcggc

SEQ ID NO: 1356096 - RNA, 22 nt, Human
ugacauccgagaaguuggggca

SEQ ID NO: 1356097 - RNA, 19 nt, Human
ugaccuggcauccugccag

SEQ ID NO: 1356098 - RNA, 18 nt, Human
ugcagcaggagccugcag

SEQ ID NO: 1356099 - RNA, 19 nt, Human
ugcaggaggaggcugcgga

SEQ ID NO: 1356100 - RNA, 19 nt, Human
ugcaguagaugaagggcaa

SEQ ID NO: 1356101 - RNA, 22 nt, Human
ugcaguccucugccagcucccu

SEQ ID NO: 1356102 - RNA, 21 nt, Human
ugccaagccacaugcagaccc

SEQ ID NO: 1356103 - RNA, 18 nt, Human
ugccagccuugggggcac

SEQ ID NO: 1356104 - RNA, 20 nt, Human
ugccaucccaggggugguug

SEQ ID NO: 1356105 - RNA, 22 nt, Human
ugcguggaauguguuaucucuu

SEQ ID NO: 1356106 - RNA, 24 nt, Human
ugcuucucuauccuggucacuuca

SEQ ID NO: 1356107 - RNA, 22 nt, Human
uggaggaucagcucacaggaug

SEQ ID NO: 1356108 - RNA, 23 nt, Human
uggcggagcagcugcagguccuu

SEQ ID NO: 1356109 - RNA, 29 nt, Human
uggcggcaggcccccaggccccucuucuu

SEQ ID NO: 1356110 - RNA, 23 nt, Human
uggcucagcuccccaugguuccu

SEQ ID NO: 1356111 - RNA, 25 nt, Human
uggcucagcuccccaugguuccuga

SEQ ID NO: 1356112 - RNA, 23 nt, Human
uggcugugguucaggaagaccac

SEQ ID NO: 1356113 - RNA, 22 nt, Human
ugggcuggaugcucuuggggag

SEQ ID NO: 1356114 - RNA, 19 nt, Human
uggggcucagggagcacgg

SEQ ID NO: 1356115 - RNA, 22 nt, Human
uggggcucagggagcacggugu

SEQ ID NO: 1356116 - RNA, 21 nt, Human
ugguaguaguggggcuuauug

SEQ ID NO: 1356117 - RNA, 19 nt, Human
ugguguuguaccagggcac

SEQ ID NO: 1356118 - RNA, 18 nt, Human
uguccaggcugguggcuu

SEQ ID NO: 1356119 - RNA, 19 nt, Human
uguccugcccaccgucccc

SEQ ID NO: 1356120 - RNA, 20 nt, Human
uguccugcccaccgucccca

SEQ ID NO: 1356121 - RNA, 25 nt, Human
uguccugcccaccguccccauccca

SEQ ID NO: 1356122 - RNA, 21 nt, Human
uguccuuguugggggccagcc

SEQ ID NO: 1356123 - RNA, 19 nt, Human
ugucugaaggcgcacaagg

SEQ ID NO: 1356124 - RNA, 23 nt, Human
uguguaugccccauucuuccagg

SEQ ID NO: 1356125 - RNA, 24 nt, Human
uguguaugccccauucuuccaggg

SEQ ID NO: 1356126 - RNA, 24 nt, Human
ugugucacccuggcggagcagcug

SEQ ID NO: 1356127 - RNA, 21 nt, Human
uguugaugucuauguccagga

SEQ ID NO: 1356128 - RNA, 22 nt, Human
uuccgaaggccccaggccagga

SEQ ID NO: 1356129 - RNA, 24 nt, Human
uugcuuggccuuuugggccaguuc

SEQ ID NO: 1356130 - RNA, 21 nt, Human
uuggcuugcuuggccuuuugg

SEQ ID NO: 1356131 - RNA, 23 nt, Human
uugggcuuggcuugcuuggccuu

SEQ ID NO: 1356132 - RNA, 23 nt, Human
uuuaaaguugggcaucaugguac

SEQ ID NO: 1356133 - RNA, 19 nt, Human
uuucggggugugagcuuug

SEQ ID NO: 1356134 - RNA, 22 nt, Human
uuugccuacuccucacugcaga

SEQ ID NO: 1356135 - RNA, 21 nt, Human
uuuucggggugugagcuuugg

SEQ ID NO: 1356136 - RNA, 22 nt, Human
aagcagucaugaguuugcccac

SEQ ID NO: 1356137 - RNA, 22 nt, Human
aagcgauugcccucagcaaacc

SEQ ID NO: 1356138 - RNA, 25 nt, Human
aagggcccugagcuuuacacagccc

SEQ ID NO: 1356139 - RNA, 25 nt, Human
accucaaggagcucagcaccaggaa

SEQ ID NO: 1356140 - RNA, 19 nt, Human
agugagaaggcggguggaa

SEQ ID NO: 1356141 - RNA, 23 nt, Human
cagacaccacuggcagcgacaaa

SEQ ID NO: 1356142 - RNA, 21 nt, Human
cagcaaccuccuucuucuucc

SEQ ID NO: 1356143 - RNA, 23 nt, Human
cagcgacaaaacgccgcauccac

SEQ ID NO: 1356144 - RNA, 23 nt, Human
ccaacagcccagcaccauaccca

SEQ ID NO: 1356145 - RNA, 23 nt, Human
ccgagcccgaaccucuccagaca

SEQ ID NO: 1356146 - RNA, 25 nt, Human
ccucuaguggacaagggcccugagc

SEQ ID NO: 1356147 - RNA, 19 nt, Human
cgagcccgaaccucuccag

SEQ ID NO: 1356148 - RNA, 24 nt, Human
cgccgcauccacguccgaaaacgc

SEQ ID NO: 1356149 - RNA, 25 nt, Human
cuccuucuucuuccuucauugcuuc

SEQ ID NO: 1356150 - RNA, 26 nt, Human
cucuccagacaccacuggcagcgaca

SEQ ID NO: 1356151 - RNA, 20 nt, Human
gaaaauaguggauaacaugg

SEQ ID NO: 1356152 - RNA, 18 nt, Human
gauauccaaggccagcaa

SEQ ID NO: 1356153 - RNA, 22 nt, Human
ggccuucggcucccaacagccc

SEQ ID NO: 1356154 - RNA, 20 nt, Human
ggcucccaacagcccagcac

SEQ ID NO: 1356155 - RNA, 28 nt, Human
uaacauggacuauacgucuuugucucuu

SEQ ID NO: 1356156 - RNA, 21 nt, Human
uaaccucaaggagcucagcac

SEQ ID NO: 1356157 - RNA, 19 nt, Human
uacgucuuugucucuucug

SEQ ID NO: 1356158 - RNA, 19 nt, Human
uagauaaccucaaggagcu

SEQ ID NO: 1356159 - RNA, 21 nt, Human
uaguggauaacauggacuaua

SEQ ID NO: 1356160 - RNA, 21 nt, Human
ucaggggacaccuugccucua

SEQ ID NO: 1356161 - RNA, 22 nt, Human
uccagacaccacuggcagcgac

SEQ ID NO: 1356162 - RNA, 19 nt, Human
ucggcucccaacagcccag

SEQ ID NO: 1356163 - RNA, 23 nt, Human
ucuucugugcucagaaaauagug

SEQ ID NO: 1356164 - RNA, 18 nt, Human
ugagaaggcggguggaag

SEQ ID NO: 1356165 - RNA, 23 nt, Human
ugauauccaaggccagcaaccuc

SEQ ID NO: 1356166 - RNA, 23 nt, Human
ugcccacaucgugcauucaugau

SEQ ID NO: 1356167 - RNA, 24 nt, Human
ugggccuucggcucccaacagccc

SEQ ID NO: 1356168 - RNA, 21 nt, Human
uuaggcaaaagagauagugag

SEQ ID NO: 1356169 - RNA, 22 nt, Human
uuugccaugaaguuuuugaagu

SEQ ID NO: 1356170 - RNA, 19 nt, Human
aauguggggacagugggga

SEQ ID NO: 1356171 - RNA, 19 nt, Human
acauuaauaaaaaaaacca

SEQ ID NO: 1356172 - RNA, 21 nt, Human
agguggcuuuuauuuacagaa

SEQ ID NO: 1356173 - RNA, 21 nt, Human
auaaccccucccaucccuuaa

SEQ ID NO: 1356174 - RNA, 23 nt, Human
gggaagcccgcugaaaacccaga

SEQ ID NO: 1356175 - RNA, 23 nt, Human
ggggacaguggggacuguccaac

SEQ ID NO: 1356176 - RNA, 18 nt, Human
gucccugggaagcccgcu

SEQ ID NO: 1356177 - RNA, 23 nt, Human
uaaaugacaaauaaccccuccca

SEQ ID NO: 1356178 - RNA, 18 nt, Human
ugacaaauaaccccuccc

SEQ ID NO: 1356179 - RNA, 22 nt, Human
ugacaaauaaccccucccaucc

SEQ ID NO: 1356180 - RNA, 24 nt, Human
uggcuuuuauuuacagaauuuaau

SEQ ID NO: 1356181 - RNA, 20 nt, Human
uuacagaauuuaaugugggg

SEQ ID NO: 1356182 - RNA, 20 nt, Human
ccccaccccgcggcaucaga

SEQ ID NO: 1356183 - RNA, 21 nt, Human
ucacagugucauuuacaggca

SEQ ID NO: 1356184 - RNA, 25 nt, Human
uucacagugucauuuacaggcagcc

SEQ ID NO: 1356185 - RNA, 18 nt, Human
aagcucucuccaagucau

SEQ ID NO: 1356186 - RNA, 20 nt, Human
aauuuuuucagugcaaaacc

SEQ ID NO: 1356187 - RNA, 19 nt, Human
accaagcagguaacauucc

SEQ ID NO: 1356188 - RNA, 18 nt, Human
acucacagaccccaaaau

SEQ ID NO: 1356189 - RNA, 22 nt, Human
acucacagaccccaaaauaaaa

SEQ ID NO: 1356190 - RNA, 23 nt, Human
aggcucuuucacguaguuugccu

SEQ ID NO: 1356191 - RNA, 21 nt, Human
agggaaaaaagaaauggaacg

SEQ ID NO: 1356192 - RNA, 19 nt, Human
agugguccaauucagcaau

SEQ ID NO: 1356193 - RNA, 23 nt, Human
auaaaaagcaguucugugcugcc

SEQ ID NO: 1356194 - RNA, 24 nt, Human
aucacaauugcaccaggaaugacc

SEQ ID NO: 1356195 - RNA, 20 nt, Human
augaaauuacuguaccaaag

SEQ ID NO: 1356196 - RNA, 26 nt, Human
caaccaagcagguaacauuguaauga

SEQ ID NO: 1356197 - RNA, 24 nt, Human
caagaaguacuugaguacugaaga

SEQ ID NO: 1356198 - RNA, 24 nt, Human
caaguaccugugauuucauuccug

SEQ ID NO: 1356199 - RNA, 23 nt, Human
caauaguacaaaucaugaguucc

SEQ ID NO: 1356200 - RNA, 21 nt, Human
caauccagacuaaaucccaga

SEQ ID NO: 1356201 - RNA, 21 nt, Human
cacaauccagacuaaauccca

SEQ ID NO: 1356202 - RNA, 21 nt, Human
cacacuuuaauaacgcuauaa

SEQ ID NO: 1356203 - RNA, 24 nt, Human
cagacauaauaauuuuucuguucu

SEQ ID NO: 1356204 - RNA, 19 nt, Human
cagaccccaaaauaaaaag

SEQ ID NO: 1356205 - RNA, 25 nt, Human
cagaccccaaaauaaaaagcaguuc

SEQ ID NO: 1356206 - RNA, 18 nt, Human
cagaguacagcagugggu

SEQ ID NO: 1356207 - RNA, 24 nt, Human
cagcaacaaccaagcagguaacau

SEQ ID NO: 1356208 - RNA, 19 nt, Human
cauaucauugccaugaaua

SEQ ID NO: 1356209 - RNA, 22 nt, Human
ccauucauucuggcuaaagaaa

SEQ ID NO: 1356210 - RNA, 23 nt, Human
cccccaaguaccugugauuucau

SEQ ID NO: 1356211 - RNA, 18 nt, Human
ccgcugccuccgccgugc

SEQ ID NO: 1356212 - RNA, 19 nt, Human
ccgcugccuccgccgugcc

SEQ ID NO: 1356213 - RNA, 20 nt, Human
ccuacacuaauccuagaaac

SEQ ID NO: 1356214 - RNA, 23 nt, Human
ccuaguuuaaagcaccacacaac

SEQ ID NO: 1356215 - RNA, 19 nt, Human
cgccgugcccggggcugcg

SEQ ID NO: 1356216 - RNA, 24 nt, Human
cgggagaggcgcaggacugcggcg

SEQ ID NO: 1356217 - RNA, 28 nt, Human
cggggcugcggagcgggagacaggggcg

SEQ ID NO: 1356218 - RNA, 18 nt, Human
cuaaaacugcaaugaccu

SEQ ID NO: 1356219 - RNA, 26 nt, Human
cucggcgccagccucgugccgguucc

SEQ ID NO: 1356220 - RNA, 18 nt, Human
gaaauggaacguuuacaa

SEQ ID NO: 1356221 - RNA, 23 nt, Human
gaacacagacauaauaauuuuuc

SEQ ID NO: 1356222 - RNA, 31 nt, Human
gcaacaaccaagcagguaacauucccaauuu

SEQ ID NO: 1356223 - RNA, 22 nt, Human
gcaagauugcuaauaccuaaga

SEQ ID NO: 1356224 - RNA, 18 nt, Human
gcccagggcuccgcugcc

SEQ ID NO: 1356225 - RNA, 20 nt, Human
gcccggggcugcggagcggg

SEQ ID NO: 1356226 - RNA, 22 nt, Human
ggagacaggggcgggagaggcg

SEQ ID NO: 1356227 - RNA, 21 nt, Human
gggaaaaaagaaauggaacgu

SEQ ID NO: 1356228 - RNA, 23 nt, Human
gggcgggagaggcgcaggacugc

SEQ ID NO: 1356229 - RNA, 24 nt, Human
gggcgggagaggcgcaggacugcg

SEQ ID NO: 1356230 - RNA, 20 nt, Human
gggcugcggagcgggagaca

SEQ ID NO: 1356231 - RNA, 21 nt, Human
guaccaaagccuuuuuuuccu

SEQ ID NO: 1356232 - RNA, 21 nt, Human
uaaaaagcaguucugugcugc

SEQ ID NO: 1356233 - RNA, 24 nt, Human
uaaaagaauccuuucccauuuaaa

SEQ ID NO: 1356234 - RNA, 23 nt, Human
uaaaaugccaaugagcaucaaaa

SEQ ID NO: 1356235 - RNA, 23 nt, Human
uaacauucccaauuugaguguca

SEQ ID NO: 1356236 - RNA, 24 nt, Human
uaagaaaaauagggccuuaaaaua

SEQ ID NO: 1356237 - RNA, 24 nt, Human
uaauacaguuccacaggguaaauu

SEQ ID NO: 1356238 - RNA, 22 nt, Human
uauaagcaagauugcuaauacc

SEQ ID NO: 1356239 - RNA, 25 nt, Human
uauaagcaagauugcuaauaccuaa

SEQ ID NO: 1356240 - RNA, 18 nt, Human
uaucaagucagcaacaac

SEQ ID NO: 1356241 - RNA, 22 nt, Human
uauuuuacagccauagagauca

SEQ ID NO: 1356242 - RNA, 18 nt, Human
uccacaggguaaauuguc

SEQ ID NO: 1356243 - RNA, 22 nt, Human
uccagacuaaaucccagaagau

SEQ ID NO: 1356244 - RNA, 23 nt, Human
uccaggauuaacccauuaaaaca

SEQ ID NO: 1356245 - RNA, 24 nt, Human
ucccaagggaacacagacauaaua

SEQ ID NO: 1356246 - RNA, 21 nt, Human
ucuuuggcaucugacaggauu

SEQ ID NO: 1356247 - RNA, 19 nt, Human
ugaauacauaucauugcca

SEQ ID NO: 1356248 - RNA, 23 nt, Human
ugaauacauaucauugccaugaa

SEQ ID NO: 1356249 - RNA, 23 nt, Human
ugaccugaugccaugcugaaugg

SEQ ID NO: 1356250 - RNA, 19 nt, Human
ugagucccaagggaacaca

SEQ ID NO: 1356251 - RNA, 23 nt, Human
ugauaguggaccuaguuuaaagc

SEQ ID NO: 1356252 - RNA, 21 nt, Human
ugauuguuguugucacuguuu

SEQ ID NO: 1356253 - RNA, 20 nt, Human
ugcaguugcgugcucuagaa

SEQ ID NO: 1356254 - RNA, 20 nt, Human
ugccagaaaucccaauucag

SEQ ID NO: 1356255 - RNA, 20 nt, Human
ugcccggggcugcggagcgg

SEQ ID NO: 1356256 - RNA, 24 nt, Human
ugcggagcgggagacaggggcggg

SEQ ID NO: 1356257 - RNA, 19 nt, Human
uggcuaaagaaaaaucaca

SEQ ID NO: 1356258 - RNA, 24 nt, Human
uguaaaauaaauacuuuguauccc

SEQ ID NO: 1356259 - RNA, 24 nt, Human
uguacaauuuccaaugagucccaa

SEQ ID NO: 1356260 - RNA, 23 nt, Human
uuacagccauagagaucaauaac

SEQ ID NO: 1356261 - RNA, 20 nt, Human
uucaagaaguacuugaguac

SEQ ID NO: 1356262 - RNA, 19 nt, Human
uuccaggaacacuuagcug

SEQ ID NO: 1356263 - RNA, 23 nt, Human
uucuuuagcaacaaauuaaacca

SEQ ID NO: 1356264 - RNA, 23 nt, Human
uuuuuuuuuuuuuuuuuuaaaag

SEQ ID NO: 1356265 - RNA, 19 nt, Human
aaaaggccacaagccacaa

SEQ ID NO: 1356266 - RNA, 22 nt, Human
aacugcaggcagagcugagagg

SEQ ID NO: 1356267 - RNA, 23 nt, Human
aacugcguaagcacagagaccca

SEQ ID NO: 1356268 - RNA, 23 nt, Human
acaauagcgcgggauauaaaaac

SEQ ID NO: 1356269 - RNA, 22 nt, Human
acgccuucugucgggcgccuua

SEQ ID NO: 1356270 - RNA, 26 nt, Human
agaaccacauaaauaucgaagaaguu

SEQ ID NO: 1356271 - RNA, 22 nt, Human
agaccucacaaccuucacaacu

SEQ ID NO: 1356272 - RNA, 21 nt, Human
agccacaaguuccuuuaaucu

SEQ ID NO: 1356273 - RNA, 19 nt, Human
cacaacacuucaaggagac

SEQ ID NO: 1356274 - RNA, 20 nt, Human
cacaacacuucaaggagacc

SEQ ID NO: 1356275 - RNA, 20 nt, Human
caccuccaccguugcaagaa

SEQ ID NO: 1356276 - RNA, 20 nt, Human
cacuuuucuccccuuccagg

SEQ ID NO: 1356277 - RNA, 19 nt, Human
cagagacccacgcucccuc

SEQ ID NO: 1356278 - RNA, 18 nt, Human
cagcagcgccucaucuca

SEQ ID NO: 1356279 - RNA, 25 nt, Human
cagcaggaaauugcaugaacugagc

SEQ ID NO: 1356280 - RNA, 21 nt, Human
cagcauaaagauuacugugga

SEQ ID NO: 1356281 - RNA, 18 nt, Human
cagccgagcaccuccacc

SEQ ID NO: 1356282 - RNA, 20 nt, Human
caggucaguccccauguuga

SEQ ID NO: 1356283 - RNA, 18 nt, Human
cauugcacaacaagcaac

SEQ ID NO: 1356284 - RNA, 20 nt, Human
cccacgcucccuccuuucca

SEQ ID NO: 1356285 - RNA, 25 nt, Human
cccuaauuagauucuggccugaaac

SEQ ID NO: 1356286 - RNA, 23 nt, Human
ccgcagcagcgccucaucucaca

SEQ ID NO: 1356287 - RNA, 28 nt, Human
ccucccacagcagccggcuguccuuaac

SEQ ID NO: 1356288 - RNA, 22 nt, Human
ccuuucuucucccugaaggagg

SEQ ID NO: 1356289 - RNA, 18 nt, Human
cgccuuauuccuucuuua

SEQ ID NO: 1356290 - RNA, 21 nt, Human
cggcagccguguuggaugcuu

SEQ ID NO: 1356291 - RNA, 24 nt, Human
cggcccuugcacaaaaaggccaca

SEQ ID NO: 1356292 - RNA, 24 nt, Human
cgggauauaaaaacacaagaacca

SEQ ID NO: 1356293 - RNA, 22 nt, Human
cguaagcacagagacccacgcu

SEQ ID NO: 1356294 - RNA, 22 nt, Human
cucacagcucauuaaccgccac

SEQ ID NO: 1356295 - RNA, 23 nt, Human
cugaauagacacauguacaugaa

SEQ ID NO: 1356296 - RNA, 22 nt, Human
cuguccuuaacgcugaugcucc

SEQ ID NO: 1356297 - RNA, 26 nt, Human
cuucacaacugcguaagcacagagac

SEQ ID NO: 1356298 - RNA, 23 nt, Human
gacacauguacaugaagcgccaa

SEQ ID NO: 1356299 - RNA, 23 nt, Human
gagcaccuccaccguugcaagaa

SEQ ID NO: 1356300 - RNA, 19 nt, Human
gaugcuuuucugggcgccu

SEQ ID NO: 1356301 - RNA, 25 nt, Human
gcacaaaaaggccacaagccacaag

SEQ ID NO: 1356302 - RNA, 22 nt, Human
gcagcagcggccgcagcagcgc

SEQ ID NO: 1356303 - RNA, 22 nt, Human
gccggcuguccuuaacgcugau

SEQ ID NO: 1356304 - RNA, 19 nt, Human
gcugccuccuuucuucucc

SEQ ID NO: 1356305 - RNA, 21 nt, Human
ggcucuguagcgauggugacg

SEQ ID NO: 1356306 - RNA, 21 nt, Human
guaucuaugucucuaaugcag

SEQ ID NO: 1356307 - RNA, 23 nt, Human
uaaaaacacaagaaccacauaaa

SEQ ID NO: 1356308 - RNA, 18 nt, Human
uaagacacaauagcgcgg

SEQ ID NO: 1356309 - RNA, 22 nt, Human
uaagcacagagacccacgcucc

SEQ ID NO: 1356310 - RNA, 21 nt, Human
uaaugcagcauaaagauuacu

SEQ ID NO: 1356311 - RNA, 21 nt, Human
uacacuuuucuccccuuccaa

SEQ ID NO: 1356312 - RNA, 21 nt, Human
uaccagccgagcaccuccacc

SEQ ID NO: 1356313 - RNA, 20 nt, Human
uagauucuggccugaaacuu

SEQ ID NO: 1356314 - RNA, 20 nt, Human
ucaacugcaggcagagcuga

SEQ ID NO: 1356315 - RNA, 21 nt, Human
uccacaacaaagacaaacgcc

SEQ ID NO: 1356316 - RNA, 19 nt, Human
uccccuuccaggcggcccu

SEQ ID NO: 1356317 - RNA, 21 nt, Human
uccccuuccaggcggcccuug

SEQ ID NO: 1356318 - RNA, 21 nt, Human
uccgcaaggccugaauagaca

SEQ ID NO: 1356319 - RNA, 24 nt, Human
ucgcugccuccuuucuucucccug

SEQ ID NO: 1356320 - RNA, 22 nt, Human
ucucccugaaggaggugggagu

SEQ ID NO: 1356321 - RNA, 23 nt, Human
ucucugcagcaggaaauugcaug

SEQ ID NO: 1356322 - RNA, 18 nt, Human
ucugcagcaggaaauugc

SEQ ID NO: 1356323 - RNA, 24 nt, Human
ucugcuucgcugccuccuuucuuc

SEQ ID NO: 1356324 - RNA, 23 nt, Human
ucuguagcgauggugacguggaa

SEQ ID NO: 1356325 - RNA, 22 nt, Human
ugaauagacacauguacaugaa

SEQ ID NO: 1356326 - RNA, 28 nt, Human
ugaauagacacauguacaugaagcgcca

SEQ ID NO: 1356327 - RNA, 20 nt, Human
ugcaagaacacaguacagca

SEQ ID NO: 1356328 - RNA, 22 nt, Human
ugcacaacaagcaacacaaaga

SEQ ID NO: 1356329 - RNA, 21 nt, Human
ugcagcaggaaauugcaugaa

SEQ ID NO: 1356330 - RNA, 21 nt, Human
ugccuccuuucuucucccuga

SEQ ID NO: 1356331 - RNA, 18 nt, Human
uggccugaaacuuuuggc

SEQ ID NO: 1356332 - RNA, 25 nt, Human
uuuuauggaugguaggcagagguca

SEQ ID NO: 1356333 - RNA, 22 nt, Human
uuuucauguaaacaguuuugcu

SEQ ID NO: 1356334 - RNA, 23 nt, Human
aaaaaaaaaagaaaaaaaaagaa

SEQ ID NO: 1356335 - RNA, 24 nt, Human
aaaaaaagaaaaaaaaagaaaaag

SEQ ID NO: 1356336 - RNA, 19 nt, Human
aaaaaagaaaaagaaacua

SEQ ID NO: 1356337 - RNA, 23 nt, Human
aaaagaaaaaaaaagaaaaagaa

SEQ ID NO: 1356338 - RNA, 27 nt, Human
aaaagaaaaagaaacuauuaugcagga

SEQ ID NO: 1356339 - RNA, 21 nt, Human
aaaagaaaacauaggcaaaga

SEQ ID NO: 1356340 - RNA, 19 nt, Human
aaaagaagaagaaagagca

SEQ ID NO: 1356341 - RNA, 22 nt, Human
aaaagaagaagaaagagcagaa

SEQ ID NO: 1356342 - RNA, 27 nt, Human
aaaagaagaagaaagagcagaaaagaa

SEQ ID NO: 1356343 - RNA, 23 nt, Human
aaacagaucagucuggaggagac

SEQ ID NO: 1356344 - RNA, 22 nt, Human
aaagaaaaaaaaagaaaaagaa

SEQ ID NO: 1356345 - RNA, 25 nt, Human
aaagaaagaagagguagaggaggau

SEQ ID NO: 1356346 - RNA, 23 nt, Human
aaccuaccccuuuccagccucua

SEQ ID NO: 1356347 - RNA, 25 nt, Human
aacuagcuguccccuucugggccuc

SEQ ID NO: 1356348 - RNA, 18 nt, Human
aagaaaaaaaaagaaaaa

SEQ ID NO: 1356349 - RNA, 26 nt, Human
aagaagaaaagaagaagaaagagcag

SEQ ID NO: 1356350 - RNA, 24 nt, Human
aagaagaagaaagagcagaaaaga

SEQ ID NO: 1356351 - RNA, 25 nt, Human
aagaagaagaaagagcagaaaagaa

SEQ ID NO: 1356352 - RNA, 21 nt, Human
aagacaggagaggaaaaaaga

SEQ ID NO: 1356353 - RNA, 21 nt, Human
aagagcagaaaagaaagaaga

SEQ ID NO: 1356354 - RNA, 22 nt, Human
aagcaauggaguaggagaagga

SEQ ID NO: 1356355 - RNA, 24 nt, Human
aaucgcuugaaccugggaggugga

SEQ ID NO: 1356356 - RNA, 21 nt, Human
aauggauggacagauggaugg

SEQ ID NO: 1356357 - RNA, 24 nt, Human
acuccccagugcaaaaaccuuggc

SEQ ID NO: 1356358 - RNA, 18 nt, Human
acugcacuccagccuggg

SEQ ID NO: 1356359 - RNA, 24 nt, Human
acugcacuccagccugggugacag

SEQ ID NO: 1356360 - RNA, 23 nt, Human
acuuugggggccagcuucuccag

SEQ ID NO: 1356361 - RNA, 23 nt, Human
agaaaagaaaacauaggcaaaga

SEQ ID NO: 1356362 - RNA, 22 nt, Human
agaaaagaaagaagagguagag

SEQ ID NO: 1356363 - RNA, 24 nt, Human
agaaaagaaagaagagguagagga

SEQ ID NO: 1356364 - RNA, 22 nt, Human
agaagaaaagaagaagaaagag

SEQ ID NO: 1356365 - RNA, 24 nt, Human
agaagcucggggcagcugacaccc

SEQ ID NO: 1356366 - RNA, 23 nt, Human
agacaggagaggaaaaaagaaaa

SEQ ID NO: 1356367 - RNA, 26 nt, Human
agacaggagaggaaaaaaggggaccc

SEQ ID NO: 1356368 - RNA, 24 nt, Human
agacugaggcaggagaaucgcuug

SEQ ID NO: 1356369 - RNA, 20 nt, Human
agaugaacagaaacagauca

SEQ ID NO: 1356370 - RNA, 23 nt, Human
agccgggugugguggugcacgcc

SEQ ID NO: 1356371 - RNA, 24 nt, Human
agccugggugacagaacgagacuc

SEQ ID NO: 1356372 - RNA, 21 nt, Human
agcuugccucucccugcucug

SEQ ID NO: 1356373 - RNA, 18 nt, Human
aggaaaaaagaaaagaaa

SEQ ID NO: 1356374 - RNA, 19 nt, Human
aggaguuuuaugcuauaga

SEQ ID NO: 1356375 - RNA, 23 nt, Human
aggcagcugcucugcccuaacuc

SEQ ID NO: 1356376 - RNA, 22 nt, Human
aggcaggagaaucgcuugaacc

SEQ ID NO: 1356377 - RNA, 24 nt, Human
aggcaggagaaucgcuugaaccug

SEQ ID NO: 1356378 - RNA, 18 nt, Human
aggcaggcaggcagcugc

SEQ ID NO: 1356379 - RNA, 20 nt, Human
aggcaggcaggcagcugcuc

SEQ ID NO: 1356380 - RNA, 24 nt, Human
agguggagguugcagugagccaag

SEQ ID NO: 1356381 - RNA, 18 nt, Human
aguccagauacaaaaggg

SEQ ID NO: 1356382 - RNA, 24 nt, Human
aucaugccacugcacuccagccug

SEQ ID NO: 1356383 - RNA, 23 nt, Human
auccuagagucuuucaaaaauga

SEQ ID NO: 1356384 - RNA, 21 nt, Human
augccacugcacuccagccug

SEQ ID NO: 1356385 - RNA, 23 nt, Human
auggaguaggagaaggagaaaaa

SEQ ID NO: 1356386 - RNA, 24 nt, Human
auggcucauacaaaccuaccccuu

SEQ ID NO: 1356387 - RNA, 24 nt, Human
caagaucaugccacugcacuccag

SEQ ID NO: 1356388 - RNA, 22 nt, Human
cacagcuagaaaagggagacac

SEQ ID NO: 1356389 - RNA, 26 nt, Human
cacaguccagauacaaaagggagucu

SEQ ID NO: 1356390 - RNA, 19 nt, Human
cacgccugaaaucccagcu

SEQ ID NO: 1356391 - RNA, 20 nt, Human
cacgccugaaaucccagcua

SEQ ID NO: 1356392 - RNA, 18 nt, Human
cacuccagccugggugac

SEQ ID NO: 1356393 - RNA, 24 nt, Human
cacuccagccugggugacagaacg

SEQ ID NO: 1356394 - RNA, 19 nt, Human
cacugcacuccagccuggg

SEQ ID NO: 1356395 - RNA, 21 nt, Human
cacugcacuccagccugggug

SEQ ID NO: 1356396 - RNA, 22 nt, Human
cacugcacuccagccuggguga

SEQ ID NO: 1356397 - RNA, 23 nt, Human
cacugcacuccagccugggugac

SEQ ID NO: 1356398 - RNA, 24 nt, Human
cacugcacuccagccugggugaca

SEQ ID NO: 1356399 - RNA, 25 nt, Human
cacugcacuccagccugggugacag

SEQ ID NO: 1356400 - RNA, 19 nt, Human
cagaagccuagcagcagag

SEQ ID NO: 1356401 - RNA, 19 nt, Human
cagcaagguacuggcaacc

SEQ ID NO: 1356402 - RNA, 21 nt, Human
cagcaggaacauaucuccaaa

SEQ ID NO: 1356403 - RNA, 20 nt, Human
cagccucuaggccuuugccu

SEQ ID NO: 1356404 - RNA, 20 nt, Human
cagcuucuccagaacucccc

SEQ ID NO: 1356405 - RNA, 21 nt, Human
caggaugcggaggagcccccu

SEQ ID NO: 1356406 - RNA, 23 nt, Human
cagugaggggagaaggcaggcag

SEQ ID NO: 1356407 - RNA, 23 nt, Human
cauaucuccaaaagugugggcca

SEQ ID NO: 1356408 - RNA, 20 nt, Human
ccacugcacuccagccuggg

SEQ ID NO: 1356409 - RNA, 20 nt, Human
ccacugcacuccagccuggg

SEQ ID NO: 1356410 - RNA, 21 nt, Human
ccacugcacuccagccugggu

SEQ ID NO: 1356411 - RNA, 21 nt, Human
ccacugcacuccagccugggu

SEQ ID NO: 1356412 - RNA, 24 nt, Human
ccacugcacuccagccugggugac

SEQ ID NO: 1356413 - RNA, 24 nt, Human
ccauauagccccuccuggccucca

SEQ ID NO: 1356414 - RNA, 20 nt, Human
ccaucuuccugaaccuuucc

SEQ ID NO: 1356415 - RNA, 21 nt, Human
cccccuggcucuaagcuccug

SEQ ID NO: 1356416 - RNA, 19 nt, Human
ccccuagcauccuagaguc

SEQ ID NO: 1356417 - RNA, 20 nt, Human
cccugcucuggauccuccuc

SEQ ID NO: 1356418 - RNA, 18 nt, Human
cccugggagcuguggggc

SEQ ID NO: 1356419 - RNA, 24 nt, Human
ccucaggcaacuagcuguccccuu

SEQ ID NO: 1356420 - RNA, 22 nt, Human
ccugaaaucccagcuacucagg

SEQ ID NO: 1356421 - RNA, 18 nt, Human
ccugaaccuuucccuccu

SEQ ID NO: 1356422 - RNA, 21 nt, Human
ccugggagguggagguugcag

SEQ ID NO: 1356423 - RNA, 22 nt, Human
ccugggugacagaacgagacuc

SEQ ID NO: 1356424 - RNA, 24 nt, Human
cgccugaaaucccagcuacucagg

SEQ ID NO: 1356425 - RNA, 21 nt, Human
cgcuugaaccugggaggugga

SEQ ID NO: 1356426 - RNA, 22 nt, Human
cucccaacugcuggaguagcug

SEQ ID NO: 1356427 - RNA, 22 nt, Human
cuccuggccagcaucagucugc

SEQ ID NO: 1356428 - RNA, 23 nt, Human
cucuacuaaaaauauaaaaaauu

SEQ ID NO: 1356429 - RNA, 24 nt, Human
cuggcucaaggagugaagugggca

SEQ ID NO: 1356430 - RNA, 24 nt, Human
cuggcugggcagaaauagccacac

SEQ ID NO: 1356431 - RNA, 24 nt, Human
cuucuccagaacuccccagugcaa

SEQ ID NO: 1356432 - RNA, 20 nt, Human
cuuugccuaggcuguucccc

SEQ ID NO: 1356433 - RNA, 19 nt, Human
gaaaaaagaaaagaaaaga

SEQ ID NO: 1356434 - RNA, 19 nt, Human
gaaaauauguucaagccuc

SEQ ID NO: 1356435 - RNA, 18 nt, Human
gaagaagaaaagaagaag

SEQ ID NO: 1356436 - RNA, 24 nt, Human
gaagaagaaaagaagaagaaagag

SEQ ID NO: 1356437 - RNA, 19 nt, Human
gaagagcugaggcccagca

SEQ ID NO: 1356438 - RNA, 21 nt, Human
gacagaacgagacuccgucuc

SEQ ID NO: 1356439 - RNA, 20 nt, Human
gagaaaugcacucugguuuu

SEQ ID NO: 1356440 - RNA, 23 nt, Human
gagaaucgcuugaaccugggagg

SEQ ID NO: 1356441 - RNA, 22 nt, Human
gagacaccaacuuaucucccuu

SEQ ID NO: 1356442 - RNA, 22 nt, Human
gagguugcagugagccaagauc

SEQ ID NO: 1356443 - RNA, 19 nt, Human
gaugagggaagaagaaaag

SEQ ID NO: 1356444 - RNA, 23 nt, Human
gauucucuuuaauuucccucuau

SEQ ID NO: 1356445 - RNA, 20 nt, Human
gcagcagaggcuucugggac

SEQ ID NO: 1356446 - RNA, 20 nt, Human
gccaagaucaugccacugca

SEQ ID NO: 1356447 - RNA, 19 nt, Human
gccacugcacuccagccug

SEQ ID NO: 1356448 - RNA, 24 nt, Human
gccacugcacuccagccuggguga

SEQ ID NO: 1356449 - RNA, 19 nt, Human
gccccuccuggccuccagc

SEQ ID NO: 1356450 - RNA, 21 nt, Human
gcucauacaaaccuaccccuu

SEQ ID NO: 1356451 - RNA, 25 nt, Human
ggaagaagaaaagaagaagaaagag

SEQ ID NO: 1356452 - RNA, 19 nt, Human
ggacaggaugcggaggagc

SEQ ID NO: 1356453 - RNA, 19 nt, Human
ggaggcugcuaugaucaug

SEQ ID NO: 1356454 - RNA, 20 nt, Human
ggagguugcagugagccaag

SEQ ID NO: 1356455 - RNA, 24 nt, Human
ggagguugcagugagccaagauca

SEQ ID NO: 1356456 - RNA, 22 nt, Human
ggauggaugaaggagggagggu

SEQ ID NO: 1356457 - RNA, 18 nt, Human
ggauugugagaaggaagg

SEQ ID NO: 1356458 - RNA, 18 nt, Human
ggcagcagaggcuucugg

SEQ ID NO: 1356459 - RNA, 19 nt, Human
ggcccauccaccaaggaug

SEQ ID NO: 1356460 - RNA, 18 nt, Human
gggggccagcuucuccag

SEQ ID NO: 1356461 - RNA, 24 nt, Human
gguggugcacgccugaaaucccag

SEQ ID NO: 1356462 - RNA, 22 nt, Human
guugcaucucccccuggcucua

SEQ ID NO: 1356463 - RNA, 24 nt, Human
guuucuccaaaccuggggagugug

SEQ ID NO: 1356464 - RNA, 19 nt, Human
uaaaaaaaaaaaagaaaaa

SEQ ID NO: 1356465 - RNA, 18 nt, Human
uagccccaaguuccagcc

SEQ ID NO: 1356466 - RNA, 21 nt, Human
ucaagguggaaugaguagaag

SEQ ID NO: 1356467 - RNA, 18 nt, Human
ucacucaaggcuucucuu

SEQ ID NO: 1356468 - RNA, 19 nt, Human
ucagucuggaggagacgga

SEQ ID NO: 1356469 - RNA, 22 nt, Human
ucaguggcuuccuacugcuucc

SEQ ID NO: 1356470 - RNA, 23 nt, Human
ucaugccacugcacuccagccug

SEQ ID NO: 1356471 - RNA, 22 nt, Human
uccacagcuagaaaagggagac

SEQ ID NO: 1356472 - RNA, 19 nt, Human
uccagauacaaaagggagu

SEQ ID NO: 1356473 - RNA, 21 nt, Human
uccagccgugccacuaucucu

SEQ ID NO: 1356474 - RNA, 24 nt, Human
uccagccugggugacagaacgaga

SEQ ID NO: 1356475 - RNA, 21 nt, Human
uccagcucugacacucugcau

SEQ ID NO: 1356476 - RNA, 20 nt, Human
ucccccuggcucuaagcucc

SEQ ID NO: 1356477 - RNA, 25 nt, Human
uccccugcuguugcaucucccccug

SEQ ID NO: 1356478 - RNA, 21 nt, Human
uccucccaugccaggcuucau

SEQ ID NO: 1356479 - RNA, 24 nt, Human
ucgcuugaaccugggagguggagg

SEQ ID NO: 1356480 - RNA, 19 nt, Human
ucucauaaaaaaaaaaaag

SEQ ID NO: 1356481 - RNA, 21 nt, Human
ucuccaaaagugugggccaag

SEQ ID NO: 1356482 - RNA, 22 nt, Human
ucuccaaaagugugggccaagu

SEQ ID NO: 1356483 - RNA, 18 nt, Human
ucucuguguguccucagg

SEQ ID NO: 1356484 - RNA, 24 nt, Human
ugaaccugggagguggagguugca

SEQ ID NO: 1356485 - RNA, 24 nt, Human
ugacacucugcauauucugggaug

SEQ ID NO: 1356486 - RNA, 20 nt, Human
ugaggcaggagaaucgcuug

SEQ ID NO: 1356487 - RNA, 24 nt, Human
ugaggcaggagaaucgcuugaacc

SEQ ID NO: 1356488 - RNA, 24 nt, Human
ugaggcaggagaaucgcuugaacc

SEQ ID NO: 1356489 - RNA, 19 nt, Human
ugaggcccagcaagguacu

SEQ ID NO: 1356490 - RNA, 21 nt, Human
ugaggcccagcaagguacugg

SEQ ID NO: 1356491 - RNA, 18 nt, Human
ugaggggagaaggcaggc

SEQ ID NO: 1356492 - RNA, 24 nt, Human
ugaugagggaagaagaaaagaaga

SEQ ID NO: 1356493 - RNA, 21 nt, Human
ugauucucuuuaauuucccuc

SEQ ID NO: 1356494 - RNA, 21 nt, Human
ugccaaaucucuuccccugcu

SEQ ID NO: 1356495 - RNA, 26 nt, Human
ugcccuugucccugccauuguggccc

SEQ ID NO: 1356496 - RNA, 18 nt, Human
ugcuggaguagcuggcug

SEQ ID NO: 1356497 - RNA, 23 nt, Human
uggaaugaguagaagcucggggc

SEQ ID NO: 1356498 - RNA, 18 nt, Human
uggaggcuaggcccauau

SEQ ID NO: 1356499 - RNA, 22 nt, Human
uggaguaggagaaggagaaaaa

SEQ ID NO: 1356500 - RNA, 22 nt, Human
uggauggacagauggauggaug

SEQ ID NO: 1356501 - RNA, 24 nt, Human
uggauggaugaaggagggagggug

SEQ ID NO: 1356502 - RNA, 19 nt, Human
uggcagcagaggcuucugg

SEQ ID NO: 1356503 - RNA, 20 nt, Human
uggcagcagaggcuucuggg

SEQ ID NO: 1356504 - RNA, 18 nt, Human
uggccaucuuccugaacc

SEQ ID NO: 1356505 - RNA, 22 nt, Human
uggccuccagcuugccucuccc

SEQ ID NO: 1356506 - RNA, 23 nt, Human
uggcucuaagcuccugugcuccu

SEQ ID NO: 1356507 - RNA, 18 nt, Human
ugggagguggagguugca

SEQ ID NO: 1356508 - RNA, 29 nt, Human
ugggagguggagguugcagugacaacggu

SEQ ID NO: 1356509 - RNA, 24 nt, Human
ugggagguggagguugcagugagc

SEQ ID NO: 1356510 - RNA, 18 nt, Human
uguccagcucugacacuc

SEQ ID NO: 1356511 - RNA, 20 nt, Human
uuagccgggugugguggugc

SEQ ID NO: 1356512 - RNA, 22 nt, Human
uuagccgggugugguggugcac

SEQ ID NO: 1356513 - RNA, 24 nt, Human
uuagccgggugugguggugcacgc

SEQ ID NO: 1356514 - RNA, 24 nt, Human
uuccaaugucagccauaggguacc

SEQ ID NO: 1356515 - RNA, 24 nt, Human
uugaaccugggagguggagguugc

SEQ ID NO: 1356516 - RNA, 20 nt, Human
uugcagugagccaagaucau

SEQ ID NO: 1356517 - RNA, 29 nt, Human
aaaauguccuggacuggguggggagggga

SEQ ID NO: 1356518 - RNA, 25 nt, Human
aacaggcagauccaaacauuuauac

SEQ ID NO: 1356519 - RNA, 20 nt, Human
agagaaaaggggggcauggg

SEQ ID NO: 1356520 - RNA, 21 nt, Human
agcgacaaucaacagaaagaa

SEQ ID NO: 1356521 - RNA, 21 nt, Human
agcugguggugcugggcaccu

SEQ ID NO: 1356522 - RNA, 21 nt, Human
aggaaagaccacccaccaaaa

SEQ ID NO: 1356523 - RNA, 21 nt, Human
agggaggagagaaaagggggg

SEQ ID NO: 1356524 - RNA, 20 nt, Human
aucaucaucuucuuccucuu

SEQ ID NO: 1356525 - RNA, 22 nt, Human
aucuucuucaucuucaucuuca

SEQ ID NO: 1356526 - RNA, 25 nt, Human
aucuucuucaucuucaucuucauca

SEQ ID NO: 1356527 - RNA, 19 nt, Human
caccuggcgggugccgcug

SEQ ID NO: 1356528 - RNA, 19 nt, Human
cagccagcuggagcgacaa

SEQ ID NO: 1356529 - RNA, 18 nt, Human
cagcuccuggacucuggg

SEQ ID NO: 1356530 - RNA, 22 nt, Human
caucaucuucuucaucuucauc

SEQ ID NO: 1356531 - RNA, 19 nt, Human
ccagcuccuggacucuggg

SEQ ID NO: 1356532 - RNA, 21 nt, Human
ccccccacauuucauuuuuuu

SEQ ID NO: 1356533 - RNA, 18 nt, Human
ccccugcacgcggccgcg

SEQ ID NO: 1356534 - RNA, 18 nt, Human
cccuucauccuggcccug

SEQ ID NO: 1356535 - RNA, 19 nt, Human
ccuggcccuggugcggucc

SEQ ID NO: 1356536 - RNA, 19 nt, Human
cgacaaucaacagaaagaa

SEQ ID NO: 1356537 - RNA, 19 nt, Human
cgccuccuccuccagcagc

SEQ ID NO: 1356538 - RNA, 24 nt, Human
cgccuccuccuccagcagccccug

SEQ ID NO: 1356539 - RNA, 22 nt, Human
cggccucgagccgccgccuccu

SEQ ID NO: 1356540 - RNA, 21 nt, Human
cuccagacggccucgagccgc

SEQ ID NO: 1356541 - RNA, 24 nt, Human
cuccagcagccccugcacgcggcc

SEQ ID NO: 1356542 - RNA, 27 nt, Human
cuccagcagccccugcacgcggccgcg

SEQ ID NO: 1356543 - RNA, 23 nt, Human
cucgcucuucuccaccucucuug

SEQ ID NO: 1356544 - RNA, 20 nt, Human
cuggcggccggcggcgcccu

SEQ ID NO: 1356545 - RNA, 22 nt, Human
cugguggugcugggcaccugca

SEQ ID NO: 1356546 - RNA, 22 nt, Human
cuucaucaucaucuucuuccuc

SEQ ID NO: 1356547 - RNA, 20 nt, Human
gagccgccgccuccuccucc

SEQ ID NO: 1356548 - RNA, 27 nt, Human
gaggaucuuggggagaugacgacgacg

SEQ ID NO: 1356549 - RNA, 22 nt, Human
ggacuggguggggagggucagc

SEQ ID NO: 1356550 - RNA, 27 nt, Human
ggaggagagaaaaggggggcaugggug

SEQ ID NO: 1356551 - RNA, 20 nt, Human
ggccggcggcgcccguccgg

SEQ ID NO: 1356552 - RNA, 19 nt, Human
ggcgaccgccggcgccgcc

SEQ ID NO: 1356553 - RNA, 25 nt, Human
ggcuggggcaggggugaggcugggc

SEQ ID NO: 1356554 - RNA, 22 nt, Human
ggggguccacuccuugacccuc

SEQ ID NO: 1356555 - RNA, 20 nt, Human
ggguccacuccuugacccuc

SEQ ID NO: 1356556 - RNA, 19 nt, Human
ggugguaggggagggagga

SEQ ID NO: 1356557 - RNA, 21 nt, Human
guccagcuccuggacucuggg

SEQ ID NO: 1356558 - RNA, 19 nt, Human
uaaacaggcagauccaaac

SEQ ID NO: 1356559 - RNA, 22 nt, Human
uccgagacgggugcgcuccaga

SEQ ID NO: 1356560 - RNA, 21 nt, Human
ucucgggcacuucagagcccu

SEQ ID NO: 1356561 - RNA, 21 nt, Human
ucuguuaugagggcugagggu

SEQ ID NO: 1356562 - RNA, 21 nt, Human
ucuucuccaccucucuugcug

SEQ ID NO: 1356563 - RNA, 24 nt, Human
ugacacaucaucuucuucaucuuc

SEQ ID NO: 1356564 - RNA, 22 nt, Human
ugagacagacacaaggggcaaa

SEQ ID NO: 1356565 - RNA, 21 nt, Human
ugagaugggggccggaauggg

SEQ ID NO: 1356566 - RNA, 18 nt, Human
ugaggagcagaugugugu

SEQ ID NO: 1356567 - RNA, 18 nt, Human
uggacuggguggggaggg

SEQ ID NO: 1356568 - RNA, 22 nt, Human
uggacuggguggggagggucag

SEQ ID NO: 1356569 - RNA, 22 nt, Human
uggcgggugccgcugcccgggg

SEQ ID NO: 1356570 - RNA, 23 nt, Human
uggggcaggggugaggcugggcg

SEQ ID NO: 1356571 - RNA, 21 nt, Human
ugggggccggaaugggcuggg

SEQ ID NO: 1356572 - RNA, 22 nt, Human
uggguggggagggucagccacc

SEQ ID NO: 1356573 - RNA, 18 nt, Human
uggugcgguccgcagggg

SEQ ID NO: 1356574 - RNA, 22 nt, Human
uuauacaggaaacaucuggcug

SEQ ID NO: 1356575 - RNA, 20 nt, Human
aagcccaaagccagcggcag

SEQ ID NO: 1356576 - RNA, 18 nt, Human
agcucggggugaaggcgg

SEQ ID NO: 1356577 - RNA, 19 nt, Human
aggaagaggccaccccagg

SEQ ID NO: 1356578 - RNA, 22 nt, Human
aggaagggggccggucccaggc

SEQ ID NO: 1356579 - RNA, 22 nt, Human
aggcauaaauaaaaagcgucca

SEQ ID NO: 1356580 - RNA, 19 nt, Human
aggcugggggcgggcaggg

SEQ ID NO: 1356581 - RNA, 19 nt, Human
agguacuggaacucccagc

SEQ ID NO: 1356582 - RNA, 21 nt, Human
auuuucacccccucccuccac

SEQ ID NO: 1356583 - RNA, 20 nt, Human
cagcggcaggggcucuugac

SEQ ID NO: 1356584 - RNA, 20 nt, Human
caggcugguggggcaggggg

SEQ ID NO: 1356585 - RNA, 21 nt, Human
ccaacagaggcugcccugccc

SEQ ID NO: 1356586 - RNA, 21 nt, Human
ccagacccucaggccaacaga

SEQ ID NO: 1356587 - RNA, 21 nt, Human
ccagccccgcuguuccgcucc

SEQ ID NO: 1356588 - RNA, 22 nt, Human
ccccaggaagggggccgguccc

SEQ ID NO: 1356589 - RNA, 22 nt, Human
cccccagcucugggaguuucca

SEQ ID NO: 1356590 - RNA, 21 nt, Human
cccccggggccgccgccgccg

SEQ ID NO: 1356591 - RNA, 24 nt, Human
cccccggggccgccgccgccgcuc

SEQ ID NO: 1356592 - RNA, 24 nt, Human
ccccggggccgccgccgccgcucc

SEQ ID NO: 1356593 - RNA, 21 nt, Human
cccucucucugccccuuccca

SEQ ID NO: 1356594 - RNA, 23 nt, Human
cccugcccagccccguuccgcag

SEQ ID NO: 1356595 - RNA, 21 nt, Human
cccugcugcccgcuucccucc

SEQ ID NO: 1356596 - RNA, 20 nt, Human
ccgccgcccugcugcccgcu

SEQ ID NO: 1356597 - RNA, 19 nt, Human
ccgccgccgcccugcugcc

SEQ ID NO: 1356598 - RNA, 20 nt, Human
ccgccgccgcccugcugccc

SEQ ID NO: 1356599 - RNA, 22 nt, Human
ccgccgccgcucccagccccgc

SEQ ID NO: 1356600 - RNA, 26 nt, Human
ccgccgccgcucccagccccgcuguu

SEQ ID NO: 1356601 - RNA, 27 nt, Human
cgccauuuucacccccucccuccacuu

SEQ ID NO: 1356602 - RNA, 21 nt, Human
cggccuggguggggaggcugg

SEQ ID NO: 1356603 - RNA, 21 nt, Human
cggggcacucaggcugguggg

SEQ ID NO: 1356604 - RNA, 19 nt, Human
cgugcucccgccgccgccc

SEQ ID NO: 1356605 - RNA, 20 nt, Human
cgugcucccgccgccgcccu

SEQ ID NO: 1356606 - RNA, 18 nt, Human
cucccacacuuucaaugg

SEQ ID NO: 1356607 - RNA, 21 nt, Human
cucccagcucauguguggucg

SEQ ID NO: 1356608 - RNA, 23 nt, Human
cucccagcucauguguggucggc

SEQ ID NO: 1356609 - RNA, 22 nt, Human
cugcugcccgcuucccuccggc

SEQ ID NO: 1356610 - RNA, 18 nt, Human
cuguagccgagaaaaggg

SEQ ID NO: 1356611 - RNA, 19 nt, Human
gaguuuccagucugaugga

SEQ ID NO: 1356612 - RNA, 19 nt, Human
gcggaggaagcccaaagcc

SEQ ID NO: 1356613 - RNA, 19 nt, Human
gcucugggaguuuccaguc

SEQ ID NO: 1356614 - RNA, 20 nt, Human
gcucugggaguuuccagucu

SEQ ID NO: 1356615 - RNA, 19 nt, Human
gcugcccugcccagccccg

SEQ ID NO: 1356616 - RNA, 18 nt, Human
ggaagacucagcccuauc

SEQ ID NO: 1356617 - RNA, 21 nt, Human
ggcagggcagggggaaugggg

SEQ ID NO: 1356618 - RNA, 19 nt, Human
ggcgcccucucucugcccu

SEQ ID NO: 1356619 - RNA, 21 nt, Human
ggcggaggaagcccaaagcca

SEQ ID NO: 1356620 - RNA, 19 nt, Human
ggcugguggggcagggggc

SEQ ID NO: 1356621 - RNA, 18 nt, Human
gggaggcugggggcgggc

SEQ ID NO: 1356622 - RNA, 18 nt, Human
ggucccaggccacggagg

SEQ ID NO: 1356623 - RNA, 20 nt, Human
gguucagaaauuaaaacauu

SEQ ID NO: 1356624 - RNA, 23 nt, Human
guuccgcaggcuaacacuagugc

SEQ ID NO: 1356625 - RNA, 24 nt, Human
ucaggcggaggaagcccaaagcca

SEQ ID NO: 1356626 - RNA, 18 nt, Human
ucuugacccgcuccagcu

SEQ ID NO: 1356627 - RNA, 22 nt, Human
ugccggccuggguggggaggcu

SEQ ID NO: 1356628 - RNA, 22 nt, Human
uggagucaguguccggggcggc

SEQ ID NO: 1356629 - RNA, 21 nt, Human
uggccagguugccggccuggg

SEQ ID NO: 1356630 - RNA, 21 nt, Human
uggccagguugccggccuggg

SEQ ID NO: 1356631 - RNA, 18 nt, Human
uggggaggcccacccagg

SEQ ID NO: 1356632 - RNA, 18 nt, Human
ugggggcgggcagggcag

SEQ ID NO: 1356633 - RNA, 26 nt, Human
ugggggcgggcagggcagggggaaug

SEQ ID NO: 1356634 - RNA, 21 nt, Human
uguagccgagaaaagggcaaa

SEQ ID NO: 1356635 - RNA, 26 nt, Human
uugaggacgugcucccgccgccgccc

SEQ ID NO: 1356636 - RNA, 19 nt, Human
uuuucacccccucccucca

SEQ ID NO: 1356637 - RNA, 21 nt, Human
aacauccuauaacacacagga

SEQ ID NO: 1356638 - RNA, 25 nt, Human
aagccuauuuuacuugugaaacuaa

SEQ ID NO: 1356639 - RNA, 23 nt, Human
acacaaauacucaccaugguuaa

SEQ ID NO: 1356640 - RNA, 24 nt, Human
acacacaggacaggcccccacaac

SEQ ID NO: 1356641 - RNA, 21 nt, Human
acacaggacaggcccccacaa

SEQ ID NO: 1356642 - RNA, 21 nt, Human
agaauuaucuggucccagaug

SEQ ID NO: 1356643 - RNA, 20 nt, Human
agauacacaaauacucacca

SEQ ID NO: 1356644 - RNA, 23 nt, Human
aggaggagcggacgcuguuccag

SEQ ID NO: 1356645 - RNA, 19 nt, Human
aggguccuggcugacuccu

SEQ ID NO: 1356646 - RNA, 22 nt, Human
agugguggggguggaggccagg

SEQ ID NO: 1356647 - RNA, 21 nt, Human
aguuuccuacccgccccccac

SEQ ID NO: 1356648 - RNA, 24 nt, Human
auaacacacaggacaggcccccac

SEQ ID NO: 1356649 - RNA, 20 nt, Human
augaggccaucgaggcccug

SEQ ID NO: 1356650 - RNA, 22 nt, Human
augcauuucuuagaacguaucc

SEQ ID NO: 1356651 - RNA, 23 nt, Human
auggccccccagcuccuccucag

SEQ ID NO: 1356652 - RNA, 24 nt, Human
auggcuggagauacuuuugguugu

SEQ ID NO: 1356653 - RNA, 22 nt, Human
caacucaucugcagggccgccu

SEQ ID NO: 1356654 - RNA, 19 nt, Human
caaggugggccagcagccc

SEQ ID NO: 1356655 - RNA, 22 nt, Human
cacagugguggggguggaggcc

SEQ ID NO: 1356656 - RNA, 19 nt, Human
caccagcagcagauugccu

SEQ ID NO: 1356657 - RNA, 22 nt, Human
caccagcagcagauugccuucu

SEQ ID NO: 1356658 - RNA, 19 nt, Human
cagagaccagagcccuccu

SEQ ID NO: 1356659 - RNA, 24 nt, Human
cagcucugaucguuggaagauaac

SEQ ID NO: 1356660 - RNA, 22 nt, Human
caggacaggcccccacaaccaa

SEQ ID NO: 1356661 - RNA, 19 nt, Human
caggcccccacaaccaaga

SEQ ID NO: 1356662 - RNA, 24 nt, Human
cauccaacuucuuuauguccacag

SEQ ID NO: 1356663 - RNA, 19 nt, Human
ccaccucugagcagugccc

SEQ ID NO: 1356664 - RNA, 21 nt, Human
ccaccucugagcagugccccc

SEQ ID NO: 1356665 - RNA, 20 nt, Human
ccagcugacccauggcaaaa

SEQ ID NO: 1356666 - RNA, 23 nt, Human
cccagugcgagaugaaccucaug

SEQ ID NO: 1356667 - RNA, 22 nt, Human
cccaguuuccuacccgcccccc

SEQ ID NO: 1356668 - RNA, 24 nt, Human
cccauggcaaaagaggcuugggac

SEQ ID NO: 1356669 - RNA, 22 nt, Human
cccauggccccccagcuccucc

SEQ ID NO: 1356670 - RNA, 20 nt, Human
cccguuuccucccagacugg

SEQ ID NO: 1356671 - RNA, 21 nt, Human
ccguggcugucccaaccaugc

SEQ ID NO: 1356672 - RNA, 21 nt, Human
ccguggugccuccguggcugu

SEQ ID NO: 1356673 - RNA, 21 nt, Human
ccuacaguauucaguacaguc

SEQ ID NO: 1356674 - RNA, 21 nt, Human
ccucagagaccagagcccucc

SEQ ID NO: 1356675 - RNA, 22 nt, Human
ccucagccucguugcuguccca

SEQ ID NO: 1356676 - RNA, 23 nt, Human
ccucugagcagugcccccagcuc

SEQ ID NO: 1356677 - RNA, 24 nt, Human
ccucugagcagugcccccagcuca

SEQ ID NO: 1356678 - RNA, 21 nt, Human
ccuuuugugacauuuggccau

SEQ ID NO: 1356679 - RNA, 21 nt, Human
cgaggcccuggaugcugccau

SEQ ID NO: 1356680 - RNA, 21 nt, Human
cgccuaaugaugcauuucuua

SEQ ID NO: 1356681 - RNA, 21 nt, Human
cgccuggagauggaccgccag

SEQ ID NO: 1356682 - RNA, 23 nt, Human
cuagagcacugcugaggugucug

SEQ ID NO: 1356683 - RNA, 20 nt, Human
cucagcuaccucucauccuc

SEQ ID NO: 1356684 - RNA, 22 nt, Human
cucauggccaagcucagcuacc

SEQ ID NO: 1356685 - RNA, 21 nt, Human
gacgcuguuccaguuggauga

SEQ ID NO: 1356686 - RNA, 24 nt, Human
gagagccagcucugaucguuggaa

SEQ ID NO: 1356687 - RNA, 19 nt, Human
gaggagcagcagaggcugg

SEQ ID NO: 1356688 - RNA, 18 nt, Human
gaucguuggaagauaacu

SEQ ID NO: 1356689 - RNA, 21 nt, Human
gcccccagcucacccuggggu

SEQ ID NO: 1356690 - RNA, 20 nt, Human
gccccccagcuccuccucag

SEQ ID NO: 1356691 - RNA, 18 nt, Human
gcgccuggagauggaccg

SEQ ID NO: 1356692 - RNA, 26 nt, Human
gcucugauuggcuaaccucagggugg

SEQ ID NO: 1356693 - RNA, 21 nt, Human
gcugacccauggcaaaagagg

SEQ ID NO: 1356694 - RNA, 22 nt, Human
gcuguuccuccacgcgugcccg

SEQ ID NO: 1356695 - RNA, 20 nt, Human
ggaggugucucauggcagcu

SEQ ID NO: 1356696 - RNA, 19 nt, Human
gggguuggggcugugacag

SEQ ID NO: 1356697 - RNA, 20 nt, Human
gguguacuggcuggaggugg

SEQ ID NO: 1356698 - RNA, 21 nt, Human
gugcccgucucugcaggagga

SEQ ID NO: 1356699 - RNA, 18 nt, Human
guguggcuaggaaagggu

SEQ ID NO: 1356700 - RNA, 22 nt, Human
uaaggugagagccagcucugau

SEQ ID NO: 1356701 - RNA, 19 nt, Human
uaggaaaggguuuguggca

SEQ ID NO: 1356702 - RNA, 21 nt, Human
uaggaaaggguuuguggcaga

SEQ ID NO: 1356703 - RNA, 21 nt, Human
uauaccaucuagguuugugug

SEQ ID NO: 1356704 - RNA, 21 nt, Human
ucccagugcgagaugaaccuc

SEQ ID NO: 1356705 - RNA, 23 nt, Human
ucccagugcgagaugaaccucau

SEQ ID NO: 1356706 - RNA, 21 nt, Human
uccuacccgccccccacuucu

SEQ ID NO: 1356707 - RNA, 22 nt, Human
uccuugaucuuuugggcucagu

SEQ ID NO: 1356708 - RNA, 21 nt, Human
ucucauggcagcugcuccagc

SEQ ID NO: 1356709 - RNA, 18 nt, Human
ucucauggcagcugcucu

SEQ ID NO: 1356710 - RNA, 24 nt, Human
ucucucgaugggcugacuuggccc

SEQ ID NO: 1356711 - RNA, 21 nt, Human
ucugcaaguauuuugacaagg

SEQ ID NO: 1356712 - RNA, 18 nt, Human
ucugcagggccgccugac

SEQ ID NO: 1356713 - RNA, 19 nt, Human
ucugugauugaggauuagc

SEQ ID NO: 1356714 - RNA, 22 nt, Human
ugaaccucauggccaagcucag

SEQ ID NO: 1356715 - RNA, 20 nt, Human
ugagggcugagccuggcugg

SEQ ID NO: 1356716 - RNA, 22 nt, Human
ugcuccagcggauaucccguuu

SEQ ID NO: 1356717 - RNA, 22 nt, Human
uggaagauaacuagagcacugc

SEQ ID NO: 1356718 - RNA, 18 nt, Human
uggcaaaagaggcuuggg

SEQ ID NO: 1356719 - RNA, 19 nt, Human
uggccccccagcuccuccu

SEQ ID NO: 1356720 - RNA, 23 nt, Human
uggcucagcagggaagacccugg

SEQ ID NO: 1356721 - RNA, 18 nt, Human
uggcugacuccuugaucu

SEQ ID NO: 1356722 - RNA, 18 nt, Human
ugggacagguggugacgc

SEQ ID NO: 1356723 - RNA, 19 nt, Human
ugggacagguggugacgcu

SEQ ID NO: 1356724 - RNA, 21 nt, Human
ugucccaaccaugccuuuugu

SEQ ID NO: 1356725 - RNA, 18 nt, Human
ugugauugaggauuagcu

SEQ ID NO: 1356726 - RNA, 21 nt, Human
uguguggcuaggaaaggguuu

SEQ ID NO: 1356727 - RNA, 21 nt, Human
uuaaggcccaguuguggcuac

SEQ ID NO: 1356728 - RNA, 21 nt, Human
uuagauacacaaauacucacc

SEQ ID NO: 1356729 - RNA, 25 nt, Human
uucagcauucaggcagugggugcug

SEQ ID NO: 1356730 - RNA, 18 nt, Human
uugcccuuuugugacauu

SEQ ID NO: 1356731 - RNA, 21 nt, Human
uuugguuagggugcucugaac

SEQ ID NO: 1356732 - RNA, 23 nt, Human
uuuuagauuuccuaaauggacuc

SEQ ID NO: 1356733 - RNA, 21 nt, Human
uuuugguugucacaguggugg

SEQ ID NO: 1356734 - RNA, 24 nt, Human
uuuugguugucacagugguggggg

SEQ ID NO: 1356735 - RNA, 19 nt, Human
aacuucugucucaucaaga

SEQ ID NO: 1356736 - RNA, 19 nt, Human
acccaggcuggagugcagu

SEQ ID NO: 1356737 - RNA, 23 nt, Human
acccaggcuggagugcaguggug

SEQ ID NO: 1356738 - RNA, 18 nt, Human
acucugucacccaggcug

SEQ ID NO: 1356739 - RNA, 25 nt, Human
acucugucacccaggcuggagugca

SEQ ID NO: 1356740 - RNA, 20 nt, Human
acugcaagcuccgccucccg

SEQ ID NO: 1356741 - RNA, 24 nt, Human
acugccccaacagugauucccuuu

SEQ ID NO: 1356742 - RNA, 21 nt, Human
agcuuuuguauacuaagaaca

SEQ ID NO: 1356743 - RNA, 25 nt, Human
aggcuggagugcaguggugccaucu

SEQ ID NO: 1356744 - RNA, 18 nt, Human
aguagcugggacuacagg

SEQ ID NO: 1356745 - RNA, 21 nt, Human
agugcaguggugccaucucag

SEQ ID NO: 1356746 - RNA, 21 nt, Human
auagccccauaauuucugaau

SEQ ID NO: 1356747 - RNA, 22 nt, Human
auggaagacagcauggcccaca

SEQ ID NO: 1356748 - RNA, 21 nt, Human
auucuccugccucagccuccc

SEQ ID NO: 1356749 - RNA, 22 nt, Human
caacagguacauagccccauaa

SEQ ID NO: 1356750 - RNA, 21 nt, Human
cacccaggcuggagugcagug

SEQ ID NO: 1356751 - RNA, 22 nt, Human
cacgccauucuccugccucagc

SEQ ID NO: 1356752 - RNA, 23 nt, Human
cacucugucacccaggcuggagu

SEQ ID NO: 1356753 - RNA, 24 nt, Human
cacucugucacccaggcuggagug

SEQ ID NO: 1356754 - RNA, 23 nt, Human
cccgaguagcugggacuacaggu

SEQ ID NO: 1356755 - RNA, 24 nt, Human
cccgaguagcugggacuacaggug

SEQ ID NO: 1356756 - RNA, 24 nt, Human
ccucccggguucacgccauucucc

SEQ ID NO: 1356757 - RNA, 23 nt, Human
ccugccucagccucccgaguagc

SEQ ID NO: 1356758 - RNA, 21 nt, Human
ccuugcucauccucauuucca

SEQ ID NO: 1356759 - RNA, 20 nt, Human
cgagagcccuagcugccaac

SEQ ID NO: 1356760 - RNA, 23 nt, Human
cgagagcccuagcugccaaccca

SEQ ID NO: 1356761 - RNA, 19 nt, Human
cgccucccggguucacgcc

SEQ ID NO: 1356762 - RNA, 24 nt, Human
cucacucugucacccaggcuggag

SEQ ID NO: 1356763 - RNA, 24 nt, Human
cucagccucccgaguagcugggac

SEQ ID NO: 1356764 - RNA, 21 nt, Human
cucccggguucacgccauucu

SEQ ID NO: 1356765 - RNA, 23 nt, Human
cugccucagccucccgaguagcu

SEQ ID NO: 1356766 - RNA, 21 nt, Human
gagagcccuagcugccaaccc

SEQ ID NO: 1356767 - RNA, 22 nt, Human
gagggacuggccuggaguggga

SEQ ID NO: 1356768 - RNA, 21 nt, Human
gcuggagugcaguggugccag

SEQ ID NO: 1356769 - RNA, 22 nt, Human
ggaagacagcauggcccacaac

SEQ ID NO: 1356770 - RNA, 23 nt, Human
guuugugccuuuggcccaacagg

SEQ ID NO: 1356771 - RNA, 24 nt, Human
ucacccaggcuggagugcaguggu

SEQ ID NO: 1356772 - RNA, 24 nt, Human
ucacucugucacccaggcuggagu

SEQ ID NO: 1356773 - RNA, 18 nt, Human
ucacugcaagcuccgccu

SEQ ID NO: 1356774 - RNA, 19 nt, Human
ucacugcaagcuccgccuc

SEQ ID NO: 1356775 - RNA, 24 nt, Human
ucacugcaagcuccgccucccggg

SEQ ID NO: 1356776 - RNA, 23 nt, Human
ucagccucccgaguagcugggac

SEQ ID NO: 1356777 - RNA, 19 nt, Human
ucagcucacugcaagcucc

SEQ ID NO: 1356778 - RNA, 23 nt, Human
ucccgaguagcugggacuacagg

SEQ ID NO: 1356779 - RNA, 24 nt, Human
ucccgaguagcugggacuacaggu

SEQ ID NO: 1356780 - RNA, 21 nt, Human
ucccggguucacgccauucuc

SEQ ID NO: 1356781 - RNA, 24 nt, Human
ucccggguucacgccauucuccug

SEQ ID NO: 1356782 - RNA, 24 nt, Human
uccugugguagaucagcuaccagg

SEQ ID NO: 1356783 - RNA, 23 nt, Human
ucucacucugucacccaggcugg

SEQ ID NO: 1356784 - RNA, 24 nt, Human
ucucacucugucacccaggcugga

SEQ ID NO: 1356785 - RNA, 26 nt, Human
ucucacucugucacccaggcuggagu

SEQ ID NO: 1356786 - RNA, 27 nt, Human
ucucacucugucacccaggcuggagug

SEQ ID NO: 1356787 - RNA, 24 nt, Human
ucuccugccucagccucccgagua

SEQ ID NO: 1356788 - RNA, 24 nt, Human
ucugucacccaggcuggagugcag

SEQ ID NO: 1356789 - RNA, 18 nt, Human
ugaaagugagggacuggc

SEQ ID NO: 1356790 - RNA, 22 nt, Human
ugagacggagucucacucuguc

SEQ ID NO: 1356791 - RNA, 22 nt, Human
ugcaguggugccaucucagcuc

SEQ ID NO: 1356792 - RNA, 24 nt, Human
ugccccaacagugauucccuuuca

SEQ ID NO: 1356793 - RNA, 24 nt, Human
ugccucagccucccgaguagcugg

SEQ ID NO: 1356794 - RNA, 20 nt, Human
ugccuuuggcccaacaggua

SEQ ID NO: 1356795 - RNA, 19 nt, Human
uggaaaguugggucuuuuu

SEQ ID NO: 1356796 - RNA, 18 nt, Human
uggagugcaguggugcca

SEQ ID NO: 1356797 - RNA, 28 nt, Human
uggagugcaguggugccauccuagcacg

SEQ ID NO: 1356798 - RNA, 23 nt, Human
uggagugcaguggugccaucuca

SEQ ID NO: 1356799 - RNA, 28 nt, Human
uggagugcaguggugccauggcucuagc

SEQ ID NO: 1356800 - RNA, 22 nt, Human
uggcaaagagugaaagugagga

SEQ ID NO: 1356801 - RNA, 23 nt, Human
uggcaaagagugaaagugaggga

SEQ ID NO: 1356802 - RNA, 24 nt, Human
uggugccaucucagcucacugcaa

SEQ ID NO: 1356803 - RNA, 25 nt, Human
uguuucccucuucuuuuauuuuuua

SEQ ID NO: 1356804 - RNA, 25 nt, Human
uugggugacuugauuggcccccucu

SEQ ID NO: 1356805 - RNA, 21 nt, Human
uuugucucugccuacuguccu

SEQ ID NO: 1356806 - RNA, 23 nt, Human
aaaaaagcaccuucauaagaacc

SEQ ID NO: 1356807 - RNA, 21 nt, Human
aaaccugcaggaaaaccaugc

SEQ ID NO: 1356808 - RNA, 21 nt, Human
aagacagguggaucacuugaa

SEQ ID NO: 1356809 - RNA, 19 nt, Human
aagcagaaugucuggaucu

SEQ ID NO: 1356810 - RNA, 19 nt, Human
aaggggaggauucccaagg

SEQ ID NO: 1356811 - RNA, 18 nt, Human
aagugcugggauuacagg

SEQ ID NO: 1356812 - RNA, 19 nt, Human
aagugcugggauuacaggc

SEQ ID NO: 1356813 - RNA, 21 nt, Human
aagugcugggauuacaggcau

SEQ ID NO: 1356814 - RNA, 23 nt, Human
aagugcugggauuacaggcauga

SEQ ID NO: 1356815 - RNA, 26 nt, Human
aagugcugggauuacaggcaugagcc

SEQ ID NO: 1356816 - RNA, 24 nt, Human
aauaagugcugggauuacaggcau

SEQ ID NO: 1356817 - RNA, 30 nt, Human
acaaacacuugaacuuacaguugcacaaaa

SEQ ID NO: 1356818 - RNA, 19 nt, Human
acaacauggcaaaaccuca

SEQ ID NO: 1356819 - RNA, 20 nt, Human
acaagguaauaagauaucac

SEQ ID NO: 1356820 - RNA, 23 nt, Human
acagcagaaagccacacagggca

SEQ ID NO: 1356821 - RNA, 20 nt, Human
acaggcuaaagugcuuugga

SEQ ID NO: 1356822 - RNA, 20 nt, Human
accacacccagcccaaaugg

SEQ ID NO: 1356823 - RNA, 18 nt, Human
accaggugcauuucugag

SEQ ID NO: 1356824 - RNA, 24 nt, Human
acccaggagguagagguugcagug

SEQ ID NO: 1356825 - RNA, 18 nt, Human
acugcacuccagccuggg

SEQ ID NO: 1356826 - RNA, 25 nt, Human
acugcacuccagccuggguaacaag

SEQ ID NO: 1356827 - RNA, 19 nt, Human
acuggauuacgguacuugu

SEQ ID NO: 1356828 - RNA, 22 nt, Human
agaaaaagaaagguaauuagaa

SEQ ID NO: 1356829 - RNA, 29 nt, Human
agacagaaaguauaaggaggagggacccc

SEQ ID NO: 1356830 - RNA, 26 nt, Human
agacagguggaucacuugaagucagg

SEQ ID NO: 1356831 - RNA, 24 nt, Human
agagguugcagugagccaagaucg

SEQ ID NO: 1356832 - RNA, 19 nt, Human
agauucagugcugaaggag

SEQ ID NO: 1356833 - RNA, 18 nt, Human
agcacucugagaaacugg

SEQ ID NO: 1356834 - RNA, 19 nt, Human
agccaccacacccagccca

SEQ ID NO: 1356835 - RNA, 21 nt, Human
agccaccacacccagcccaaa

SEQ ID NO: 1356836 - RNA, 18 nt, Human
agcccuggcacagcagaa

SEQ ID NO: 1356837 - RNA, 24 nt, Human
agccuggguaacaagagggagacu

SEQ ID NO: 1356838 - RNA, 25 nt, Human
agccuggguaacaagagggagacuu

SEQ ID NO: 1356839 - RNA, 18 nt, Human
aggagaaaaagaaaggua

SEQ ID NO: 1356840 - RNA, 19 nt, Human
aggagaaagggagaggccg

SEQ ID NO: 1356841 - RNA, 20 nt, Human
aggagacaggguuugagagc

SEQ ID NO: 1356842 - RNA, 22 nt, Human
aggagacaggguuugagagcag

SEQ ID NO: 1356843 - RNA, 23 nt, Human
aggaguucaagaccagcccggac

SEQ ID NO: 1356844 - RNA, 24 nt, Human
aggauaaggcaggaggauugcuug

SEQ ID NO: 1356845 - RNA, 23 nt, Human
aggcaggaggauugcuugaaccc

SEQ ID NO: 1356846 - RNA, 24 nt, Human
aggcaggaggauugcuugaaccca

SEQ ID NO: 1356847 - RNA, 22 nt, Human
aggcaguguaggccacuguugc

SEQ ID NO: 1356848 - RNA, 19 nt, Human
aggcgacauacauccuccu

SEQ ID NO: 1356849 - RNA, 22 nt, Human
agggaggaucgaaucagaccca

SEQ ID NO: 1356850 - RNA, 24 nt, Human
agguagagguugcagugagccaag

SEQ ID NO: 1356851 - RNA, 24 nt, Human
agugacucucaccuguaaucccag

SEQ ID NO: 1356852 - RNA, 27 nt, Human
agugauauuucucccauuugguaacga

SEQ ID NO: 1356853 - RNA, 18 nt, Human
agugaucgcaguaccugg

SEQ ID NO: 1356854 - RNA, 19 nt, Human
agugcugaaggaggaagag

SEQ ID NO: 1356855 - RNA, 18 nt, Human
agugcugggauuacaggc

SEQ ID NO: 1356856 - RNA, 19 nt, Human
agugcugggauuacaggca

SEQ ID NO: 1356857 - RNA, 20 nt, Human
auaaaagacagcugcccuga

SEQ ID NO: 1356858 - RNA, 23 nt, Human
aucacuugaagucaggaguucaa

SEQ ID NO: 1356859 - RNA, 24 nt, Human
aucgcgccacugcacuccagccug

SEQ ID NO: 1356860 - RNA, 24 nt, Human
augcauuggacaguuugauuguuc

SEQ ID NO: 1356861 - RNA, 19 nt, Human
auugcuugaacccaggagg

SEQ ID NO: 1356862 - RNA, 24 nt, Human
caagaucgcgccacugcacuccag

SEQ ID NO: 1356863 - RNA, 18 nt, Human
caagccccacaggcuaaa

SEQ ID NO: 1356864 - RNA, 25 nt, Human
cacaggaccacaggacuggggugaa

SEQ ID NO: 1356865 - RNA, 18 nt, Human
caccacacccagcccaaa

SEQ ID NO: 1356866 - RNA, 22 nt, Human
caccuguaaucccaguacuuug

SEQ ID NO: 1356867 - RNA, 23 nt, Human
caccuguaaucccaguacuuugg

SEQ ID NO: 1356868 - RNA, 24 nt, Human
caccuguaaucccaguacuuuggg

SEQ ID NO: 1356869 - RNA, 20 nt, Human
cacuaccugaucuccaagcc

SEQ ID NO: 1356870 - RNA, 18 nt, Human
cacugcacuccagccugg

SEQ ID NO: 1356871 - RNA, 19 nt, Human
cacugcacuccagccuggg

SEQ ID NO: 1356872 - RNA, 19 nt, Human
cacugcacuccagccuggg

SEQ ID NO: 1356873 - RNA, 22 nt, Human
cacugcacuccagccuggguaa

SEQ ID NO: 1356874 - RNA, 23 nt, Human
cacugcacuccagccuggguaac

SEQ ID NO: 1356875 - RNA, 24 nt, Human
cacugcacuccagccuggguaaca

SEQ ID NO: 1356876 - RNA, 23 nt, Human
cacuugaagucaggaguucaaga

SEQ ID NO: 1356877 - RNA, 21 nt, Human
cagauuuaauaagaaauuugc

SEQ ID NO: 1356878 - RNA, 20 nt, Human
cagcccggacaacauggcaa

SEQ ID NO: 1356879 - RNA, 19 nt, Human
cagcccuggcacagcagaa

SEQ ID NO: 1356880 - RNA, 20 nt, Human
cagcugcccugaagcagcca

SEQ ID NO: 1356881 - RNA, 21 nt, Human
cagcuggucccuccggggucc

SEQ ID NO: 1356882 - RNA, 20 nt, Human
cagggcgagaucacaggacc

SEQ ID NO: 1356883 - RNA, 24 nt, Human
cagguggaucacuugaagucagga

SEQ ID NO: 1356884 - RNA, 20 nt, Human
caguacuuugggaggcuaag

SEQ ID NO: 1356885 - RNA, 26 nt, Human
caguacuuugggaggcuaagacaggu

SEQ ID NO: 1356886 - RNA, 23 nt, Human
caucuguaaucccagcuacuugg

SEQ ID NO: 1356887 - RNA, 24 nt, Human
caucuguaaucccagcuacuuggg

SEQ ID NO: 1356888 - RNA, 20 nt, Human
cauugucauugauaacaucu

SEQ ID NO: 1356889 - RNA, 19 nt, Human
ccaaaugucccgguuccuc

SEQ ID NO: 1356890 - RNA, 22 nt, Human
ccaaccauuaacaaaaugagcc

SEQ ID NO: 1356891 - RNA, 20 nt, Human
ccacugcacuccagccuggg

SEQ ID NO: 1356892 - RNA, 20 nt, Human
ccacugcacuccagccuggg

SEQ ID NO: 1356893 - RNA, 21 nt, Human
ccacugcacuccagccugggu

SEQ ID NO: 1356894 - RNA, 22 nt, Human
ccacugcacuccagccugggua

SEQ ID NO: 1356895 - RNA, 24 nt, Human
ccacugcacuccagccuggguaac

SEQ ID NO: 1356896 - RNA, 24 nt, Human
cccacagcugcgaccauaaaagac

SEQ ID NO: 1356897 - RNA, 26 nt, Human
cccauuacucccccuuucauuuguuu

SEQ ID NO: 1356898 - RNA, 23 nt, Human
ccccacagcugcgaccauaaaag

SEQ ID NO: 1356899 - RNA, 22 nt, Human
cccccugagccauaaaaccagc

SEQ ID NO: 1356900 - RNA, 18 nt, Human
ccccugagccauaaaacc

SEQ ID NO: 1356901 - RNA, 21 nt, Human
cccuaaaaauuuugagggccc

SEQ ID NO: 1356902 - RNA, 18 nt, Human
ccgacagaaauaucaaac

SEQ ID NO: 1356903 - RNA, 18 nt, Human
ccucagggaugcauucuc

SEQ ID NO: 1356904 - RNA, 19 nt, Human
ccuccggggucccugacuu

SEQ ID NO: 1356905 - RNA, 24 nt, Human
ccugcaggaaaaccaugcccuaaa

SEQ ID NO: 1356906 - RNA, 18 nt, Human
cgagaagucagggacccc

SEQ ID NO: 1356907 - RNA, 25 nt, Human
cgagacucacuaccugaucuccaag

SEQ ID NO: 1356908 - RNA, 26 nt, Human
cgccacugcacuccagccuggguaac

SEQ ID NO: 1356909 - RNA, 21 nt, Human
cucaaguguuccaaucguacu

SEQ ID NO: 1356910 - RNA, 18 nt, Human
cucacuaacagcaugcaa

SEQ ID NO: 1356911 - RNA, 24 nt, Human
cucucaccuguaaucccaguacuu

SEQ ID NO: 1356912 - RNA, 26 nt, Human
cugaagcagccauuucagaggccuac

SEQ ID NO: 1356913 - RNA, 19 nt, Human
cugggucagaauggggagu

SEQ ID NO: 1356914 - RNA, 21 nt, Human
cuguaaucccagcuacuuggg

SEQ ID NO: 1356915 - RNA, 20 nt, Human
cuuaauagaauccuccagca

SEQ ID NO: 1356916 - RNA, 19 nt, Human
cuucuccugguugagcagg

SEQ ID NO: 1356917 - RNA, 23 nt, Human
cuugaagucaggaguucaagacc

SEQ ID NO: 1356918 - RNA, 21 nt, Human
gaaacagguuggagguaggua

SEQ ID NO: 1356919 - RNA, 19 nt, Human
gaaagaagagaaauauggc

SEQ ID NO: 1356920 - RNA, 22 nt, Human
gaagauaagcagcccagacuug

SEQ ID NO: 1356921 - RNA, 21 nt, Human
gagguagagguugcagugagc

SEQ ID NO: 1356922 - RNA, 18 nt, Human
gagguugcagugagccaa

SEQ ID NO: 1356923 - RNA, 18 nt, Human
gaucacuugaagucagga

SEQ ID NO: 1356924 - RNA, 24 nt, Human
gaucacuugaagucaggaguucaa

SEQ ID NO: 1356925 - RNA, 18 nt, Human
gauuacaggcaugagcca

SEQ ID NO: 1356926 - RNA, 21 nt, Human
gauuacaggcaugagccacca

SEQ ID NO: 1356927 - RNA, 22 nt, Human
gauuacaggcaugagccaccac

SEQ ID NO: 1356928 - RNA, 22 nt, Human
gcaggaggauugcuugaaccca

SEQ ID NO: 1356929 - RNA, 24 nt, Human
gcaguccagacauggcaauagcca

SEQ ID NO: 1356930 - RNA, 20 nt, Human
gccaagaucgcgccacugca

SEQ ID NO: 1356931 - RNA, 19 nt, Human
gccacugcacuccagccug

SEQ ID NO: 1356932 - RNA, 24 nt, Human
gccacugcacuccagccuggguaa

SEQ ID NO: 1356933 - RNA, 21 nt, Human
gccuucuucuccugguugagc

SEQ ID NO: 1356934 - RNA, 19 nt, Human
ggagaggccagagaccaaa

SEQ ID NO: 1356935 - RNA, 21 nt, Human
ggaggaagagaagaacagagg

SEQ ID NO: 1356936 - RNA, 19 nt, Human
ggauuacaggcaugagcca

SEQ ID NO: 1356937 - RNA, 24 nt, Human
ggcaucuguaaucccagcuacuug

SEQ ID NO: 1356938 - RNA, 19 nt, Human
ggcgacauacauccuccuc

SEQ ID NO: 1356939 - RNA, 22 nt, Human
ggggagggaguguacaaauagg

SEQ ID NO: 1356940 - RNA, 24 nt, Human
ggggagggaguguacaaauagggu

SEQ ID NO: 1356941 - RNA, 19 nt, Human
gggugcuccugggggagga

SEQ ID NO: 1356942 - RNA, 22 nt, Human
gguaaauggaggcagggcgaga

SEQ ID NO: 1356943 - RNA, 21 nt, Human
gguaauaagauaucacaaggu

SEQ ID NO: 1356944 - RNA, 22 nt, Human
ggucaucuguagcuccaggcau

SEQ ID NO: 1356945 - RNA, 24 nt, Human
gguggcaggcaucuguaaucccag

SEQ ID NO: 1356946 - RNA, 18 nt, Human
guaaagacaggcauagga

SEQ ID NO: 1356947 - RNA, 27 nt, Human
guaaagacaggcauaggaaaucacaag

SEQ ID NO: 1356948 - RNA, 19 nt, Human
guaaagcagaaugucugga

SEQ ID NO: 1356949 - RNA, 21 nt, Human
gugcauuucugaggcacagag

SEQ ID NO: 1356950 - RNA, 19 nt, Human
gugcugggauuacaggcau

SEQ ID NO: 1356951 - RNA, 24 nt, Human
uaaaagacagcugcccugaagcag

SEQ ID NO: 1356952 - RNA, 21 nt, Human
uaaaaucgaucauguauauau

SEQ ID NO: 1356953 - RNA, 23 nt, Human
uaaagugaaaauaaaucucuuag

SEQ ID NO: 1356954 - RNA, 23 nt, Human
uaaauguacaaaaguuagcaaga

SEQ ID NO: 1356955 - RNA, 19 nt, Human
uaacagcaauuaaagugaa

SEQ ID NO: 1356956 - RNA, 23 nt, Human
uaacccagagggaacauuagauc

SEQ ID NO: 1356957 - RNA, 26 nt, Human
uaagacagguggaucacuugaaguca

SEQ ID NO: 1356958 - RNA, 24 nt, Human
uaaggcaggaggauugcuugaacc

SEQ ID NO: 1356959 - RNA, 25 nt, Human
uaaggcaggaggauugcuugaaccc

SEQ ID NO: 1356960 - RNA, 24 nt, Human
uaagugcugggauuacaggcauga

SEQ ID NO: 1356961 - RNA, 24 nt, Human
uacaggcaugagccaccacaccca

SEQ ID NO: 1356962 - RNA, 21 nt, Human
uacgguacuuguaaguuuaau

SEQ ID NO: 1356963 - RNA, 23 nt, Human
uagaaauucuaaaaucugucaaa

SEQ ID NO: 1356964 - RNA, 26 nt, Human
uagaauccuccagcagucaucccucc

SEQ ID NO: 1356965 - RNA, 19 nt, Human
uagguaaacugaaaggcag

SEQ ID NO: 1356966 - RNA, 22 nt, Human
uauauauguuuaacacagaggu

SEQ ID NO: 1356967 - RNA, 25 nt, Human
uauauauguuuaacacagagguauu

SEQ ID NO: 1356968 - RNA, 20 nt, Human
uaugaggccucggagagggg

SEQ ID NO: 1356969 - RNA, 21 nt, Human
uaugaggccucggagaggggg

SEQ ID NO: 1356970 - RNA, 25 nt, Human
uauuucauccccacagcugcgacca

SEQ ID NO: 1356971 - RNA, 23 nt, Human
ucaaacacaaaugcucuacaauu

SEQ ID NO: 1356972 - RNA, 21 nt, Human
ucacagagaucccaugcuuca

SEQ ID NO: 1356973 - RNA, 24 nt, Human
ucacuaccugaucuccaagccaaa

SEQ ID NO: 1356974 - RNA, 18 nt, Human
ucacuguuauccuguucu

SEQ ID NO: 1356975 - RNA, 23 nt, Human
ucacuugaagucaggaguucaag

SEQ ID NO: 1356976 - RNA, 18 nt, Human
ucaggagacaggguuuga

SEQ ID NO: 1356977 - RNA, 21 nt, Human
ucagggaugcauucucuuucu

SEQ ID NO: 1356978 - RNA, 21 nt, Human
ucaggugagugaucgcaguac

SEQ ID NO: 1356979 - RNA, 24 nt, Human
ucagugauauuucucccauuugcu

SEQ ID NO: 1356980 - RNA, 21 nt, Human
uccagggcagacaucacaugu

SEQ ID NO: 1356981 - RNA, 22 nt, Human
uccauauaaaccugcaggaaaa

SEQ ID NO: 1356982 - RNA, 18 nt, Human
uccaugaaaucuucacaa

SEQ ID NO: 1356983 - RNA, 19 nt, Human
uccccacagcugcgaccau

SEQ ID NO: 1356984 - RNA, 21 nt, Human
uccugaggcgacauacauccu

SEQ ID NO: 1356985 - RNA, 23 nt, Human
ucgcgccacugcacuccagccug

SEQ ID NO: 1356986 - RNA, 21 nt, Human
ucuccaagccaaauaacagac

SEQ ID NO: 1356987 - RNA, 19 nt, Human
ucuggaucuacguugauac

SEQ ID NO: 1356988 - RNA, 21 nt, Human
ucuguaaggagaaaaagaaag

SEQ ID NO: 1356989 - RNA, 21 nt, Human
ucuguaaucccagcuacuugg

SEQ ID NO: 1356990 - RNA, 23 nt, Human
ucuucauccccuggcaguggcca

SEQ ID NO: 1356991 - RNA, 23 nt, Human
ugaacucagugcagcccuggcac

SEQ ID NO: 1356992 - RNA, 21 nt, Human
ugaagcagccauuucagaggc

SEQ ID NO: 1356993 - RNA, 18 nt, Human
ugaaggggaggauuccca

SEQ ID NO: 1356994 - RNA, 22 nt, Human
ugacucucaccuguaaucccag

SEQ ID NO: 1356995 - RNA, 24 nt, Human
ugacucucaccuguaaucccagua

SEQ ID NO: 1356996 - RNA, 19 nt, Human
ugacuucccgcaacaucuc

SEQ ID NO: 1356997 - RNA, 20 nt, Human
ugacuucccgcaacaucucu

SEQ ID NO: 1356998 - RNA, 22 nt, Human
ugagccaagaucgcgccacugc

SEQ ID NO: 1356999 - RNA, 21 nt, Human
ugagccaccacacccagccca

SEQ ID NO: 1357000 - RNA, 18 nt, Human
ugagccauaaaaccagca

SEQ ID NO: 1357001 - RNA, 24 nt, Human
ugauauuucucccauuugguaaca

SEQ ID NO: 1357002 - RNA, 24 nt, Human
ugcacaaaacuguugaauuuuaug

SEQ ID NO: 1357003 - RNA, 19 nt, Human
ugcagcagggagcagugac

SEQ ID NO: 1357004 - RNA, 19 nt, Human
ugccaaccauuaacaaaau

SEQ ID NO: 1357005 - RNA, 19 nt, Human
ugccauggcuucagcuggu

SEQ ID NO: 1357006 - RNA, 21 nt, Human
ugcgaccauaaaagacagcug

SEQ ID NO: 1357007 - RNA, 20 nt, Human
ugcuccugggggaggaagaa

SEQ ID NO: 1357008 - RNA, 18 nt, Human
uggagguagguaaagcag

SEQ ID NO: 1357009 - RNA, 21 nt, Human
uggaucacuugaagucaggag

SEQ ID NO: 1357010 - RNA, 24 nt, Human
uggaucacuugaagucaggaguuc

SEQ ID NO: 1357011 - RNA, 27 nt, Human
uggaucacuugaagucaggaguucaag

SEQ ID NO: 1357012 - RNA, 26 nt, Human
uggcaauagccaauuuccaaaguucu

SEQ ID NO: 1357013 - RNA, 19 nt, Human
uggcacagcagaaagccac

SEQ ID NO: 1357014 - RNA, 22 nt, Human
uggcaggcaucuguaaucccag

SEQ ID NO: 1357015 - RNA, 23 nt, Human
uggccaauugguguaaagagaga

SEQ ID NO: 1357016 - RNA, 24 nt, Human
ugggaggcuaagacagguggauca

SEQ ID NO: 1357017 - RNA, 18 nt, Human
ugggauuacaggcaugag

SEQ ID NO: 1357018 - RNA, 19 nt, Human
ugggauuacaggcaugagc

SEQ ID NO: 1357019 - RNA, 22 nt, Human
ugggauuacaggcaugagccac

SEQ ID NO: 1357020 - RNA, 23 nt, Human
ugggauuacaggcaugagccacc

SEQ ID NO: 1357021 - RNA, 24 nt, Human
ugggauuacaggcaugagccacca

SEQ ID NO: 1357022 - RNA, 24 nt, Human
ugggauuacaggcaugagccacca

SEQ ID NO: 1357023 - RNA, 18 nt, Human
ugggauuaguuagauggg

SEQ ID NO: 1357024 - RNA, 23 nt, Human
ugggauuaguuagaugggucucc

SEQ ID NO: 1357025 - RNA, 24 nt, Human
uggggaacuaauaaauguccauga

SEQ ID NO: 1357026 - RNA, 24 nt, Human
ugguggcaggcaucuguaauccca

SEQ ID NO: 1357027 - RNA, 19 nt, Human
ugguugagcagggcaacgg

SEQ ID NO: 1357028 - RNA, 20 nt, Human
ugguugagcagggcaacggu

SEQ ID NO: 1357029 - RNA, 22 nt, Human
ugucccauuacucccccuuuca

SEQ ID NO: 1357030 - RNA, 23 nt, Human
ugucuacuaaauguacaaaaguu

SEQ ID NO: 1357031 - RNA, 23 nt, Human
ugucuggaucuacguugauacug

SEQ ID NO: 1357032 - RNA, 23 nt, Human
uguuccaaucguacugcauuugc

SEQ ID NO: 1357033 - RNA, 21 nt, Human
uguuccuugcugagaaaaaga

SEQ ID NO: 1357034 - RNA, 25 nt, Human
uuaaaguaaagacaggcauaggaaa

SEQ ID NO: 1357035 - RNA, 24 nt, Human
uuauccuguucuuuuuucaaggug

SEQ ID NO: 1357036 - RNA, 26 nt, Human
uucagcuggucccuccggggucccug

SEQ ID NO: 1357037 - RNA, 22 nt, Human
uucauccccacagcugcgacca

SEQ ID NO: 1357038 - RNA, 20 nt, Human
uuccaaaguucuggguguuc

SEQ ID NO: 1357039 - RNA, 21 nt, Human
uucccauacuugcaguccaga

SEQ ID NO: 1357040 - RNA, 22 nt, Human
uugcagugagccaagaucgcgc

SEQ ID NO: 1357041 - RNA, 24 nt, Human
uugcuugaacccaggagguagagg

SEQ ID NO: 1357042 - RNA, 18 nt, Human
uuuccauauaaaccugca

SEQ ID NO: 1357043 - RNA, 19 nt, Human
uuuguggugaaaacauuua

SEQ ID NO: 1357044 - RNA, 23 nt, Human
uuuuccuggaaucaaaaugggag

SEQ ID NO: 1357045 - RNA, 19 nt, Human
aaacugcuuaguuccaacu

SEQ ID NO: 1357046 - RNA, 20 nt, Human
acacugcagggccaccagca

SEQ ID NO: 1357047 - RNA, 21 nt, Human
agacaggcagcuucuccuggg

SEQ ID NO: 1357048 - RNA, 18 nt, Human
aggaaagaauaaaguccg

SEQ ID NO: 1357049 - RNA, 20 nt, Human
agugacaguggcagucagga

SEQ ID NO: 1357050 - RNA, 23 nt, Human
caccagcagcagcugugcacuga

SEQ ID NO: 1357051 - RNA, 20 nt, Human
cagcagcagcugugcacuga

SEQ ID NO: 1357052 - RNA, 24 nt, Human
cagcagcagcugugcacugauguu

SEQ ID NO: 1357053 - RNA, 19 nt, Human
caggaggaggugugucaua

SEQ ID NO: 1357054 - RNA, 26 nt, Human
caggcaucguucauucaacacacauu

SEQ ID NO: 1357055 - RNA, 22 nt, Human
cccagccagccugccacggccg

SEQ ID NO: 1357056 - RNA, 22 nt, Human
ccuagaggaguucugcucugaa

SEQ ID NO: 1357057 - RNA, 25 nt, Human
cuugagugccuacuacaugccaaca

SEQ ID NO: 1357058 - RNA, 18 nt, Human
gccaacacugcuagaugc

SEQ ID NO: 1357059 - RNA, 19 nt, Human
ggcggcagcgcgcugcagc

SEQ ID NO: 1357060 - RNA, 22 nt, Human
guacacugcagggccaccagca

SEQ ID NO: 1357061 - RNA, 18 nt, Human
guggcagucaggaggagg

SEQ ID NO: 1357062 - RNA, 18 nt, Human
uaaaacuggcucccccag

SEQ ID NO: 1357063 - RNA, 22 nt, Human
uacagagccuguuuaccuauga

SEQ ID NO: 1357064 - RNA, 21 nt, Human
uaggagcaagggucaggaaag

SEQ ID NO: 1357065 - RNA, 20 nt, Human
uccuacuauaaaagcgaaau

SEQ ID NO: 1357066 - RNA, 22 nt, Human
uccuuacacgccaccucuugug

SEQ ID NO: 1357067 - RNA, 31 nt, Human
ugaaaacaaaaauuuauugcuucuccuuccc

SEQ ID NO: 1357068 - RNA, 21 nt, Human
ugaauuuacaaaaaaaaggau

SEQ ID NO: 1357069 - RNA, 19 nt, Human
ugacaguggcagucaggag

SEQ ID NO: 1357070 - RNA, 19 nt, Human
ugcuacagagguuuuuuug

SEQ ID NO: 1357071 - RNA, 23 nt, Human
uguagacaggcagcuucuccugg

SEQ ID NO: 1357072 - RNA, 18 nt, Human
uguuuugccuuccuacua

SEQ ID NO: 1357073 - RNA, 24 nt, Human
uuauugcuucuccuuccaaagcuu

SEQ ID NO: 1357074 - RNA, 21 nt, Human
uuccuacuauaaaagcgaaau

SEQ ID NO: 1357075 - RNA, 19 nt, Human
uucuugagugccuacuaca

SEQ ID NO: 1357076 - RNA, 21 nt, Human
uugguuuugagaggcuuuuuu

SEQ ID NO: 1357077 - RNA, 19 nt, Human
uuuacaaaaaaaaggauga

SEQ ID NO: 1357078 - RNA, 21 nt, Human
agaaaccccaaguacuagccc

SEQ ID NO: 1357079 - RNA, 21 nt, Human
agcaggucucuuuagaagccc

SEQ ID NO: 1357080 - RNA, 23 nt, Human
auagcccauccuugucacaaccc

SEQ ID NO: 1357081 - RNA, 19 nt, Human
caaaaagucuccaaauucc

SEQ ID NO: 1357082 - RNA, 23 nt, Human
cacaacccaagaagcaaucccuc

SEQ ID NO: 1357083 - RNA, 22 nt, Human
cauccuugucacaacccaagaa

SEQ ID NO: 1357084 - RNA, 19 nt, Human
cccaagaagcaaucccucc

SEQ ID NO: 1357085 - RNA, 26 nt, Human
ccuauagaaaccccaaguacuagccc

SEQ ID NO: 1357086 - RNA, 20 nt, Human
cugcccccacuccacuccca

SEQ ID NO: 1357087 - RNA, 23 nt, Human
gaaaaagggauauauuuacaaac

SEQ ID NO: 1357088 - RNA, 23 nt, Human
gcaaucccuccauuggccacacu

SEQ ID NO: 1357089 - RNA, 18 nt, Human
uggggucagcccuugccc

SEQ ID NO: 1357090 - RNA, 19 nt, Human
aaaaagaaauacaacauga

SEQ ID NO: 1357091 - RNA, 21 nt, Human
aaaaaucagcagaaauccacu

SEQ ID NO: 1357092 - RNA, 22 nt, Human
aaaagaaacauaggcagauaug

SEQ ID NO: 1357093 - RNA, 20 nt, Human
aaaaggaaggcgaaucaaaa

SEQ ID NO: 1357094 - RNA, 25 nt, Human
aaacaaccaaauccaaaaagacccc

SEQ ID NO: 1357095 - RNA, 23 nt, Human
aaaucacuugaggucaggaguuc

SEQ ID NO: 1357096 - RNA, 25 nt, Human
aaaucacuugaggucaggaguucaa

SEQ ID NO: 1357097 - RNA, 18 nt, Human
aaauuccaacgccaagaa

SEQ ID NO: 1357098 - RNA, 22 nt, Human
aacaacaaaauaggguacugag

SEQ ID NO: 1357099 - RNA, 20 nt, Human
aacaacaacaacaacaaaau

SEQ ID NO: 1357100 - RNA, 18 nt, Human
aacauggugaaaccccgc

SEQ ID NO: 1357101 - RNA, 20 nt, Human
aacauggugaaaccccgccu

SEQ ID NO: 1357102 - RNA, 21 nt, Human
aacauggugaaaccccgccuc

SEQ ID NO: 1357103 - RNA, 21 nt, Human
aaccccgccucuaccaaaaau

SEQ ID NO: 1357104 - RNA, 20 nt, Human
aacucugucucaaacaacaa

SEQ ID NO: 1357105 - RNA, 20 nt, Human
aagugaaaacaggcaaagaa

SEQ ID NO: 1357106 - RNA, 18 nt, Human
aaucacuugaggucagga

SEQ ID NO: 1357107 - RNA, 24 nt, Human
aaucacuugaggucaggaguucaa

SEQ ID NO: 1357108 - RNA, 24 nt, Human
acaaacaucucagcauacaucccu

SEQ ID NO: 1357109 - RNA, 20 nt, Human
acaacaacaacaacaaaaua

SEQ ID NO: 1357110 - RNA, 21 nt, Human
acaaccaaauccaaaaagacc

SEQ ID NO: 1357111 - RNA, 22 nt, Human
acaaccaaauccaaaaagaccc

SEQ ID NO: 1357112 - RNA, 18 nt, Human
acagaggaauuaaaaugg

SEQ ID NO: 1357113 - RNA, 24 nt, Human
accaacauggugaaaccccgccuc

SEQ ID NO: 1357114 - RNA, 19 nt, Human
acugcacuccauccuggca

SEQ ID NO: 1357115 - RNA, 24 nt, Human
acuugaggucaggaguucaagacc

SEQ ID NO: 1357116 - RNA, 22 nt, Human
agaaauccacuaugucaauguc

SEQ ID NO: 1357117 - RNA, 19 nt, Human
agaauucaguaugccuucc

SEQ ID NO: 1357118 - RNA, 23 nt, Human
agccucuagauaagaguuuuacc

SEQ ID NO: 1357119 - RNA, 24 nt, Human
agccugaccaacauggugaaaccc

SEQ ID NO: 1357120 - RNA, 22 nt, Human
agcgcaguggcucacgucugua

SEQ ID NO: 1357121 - RNA, 18 nt, Human
aggaacaccacacucuca

SEQ ID NO: 1357122 - RNA, 18 nt, Human
aggaagcaagcaauguca

SEQ ID NO: 1357123 - RNA, 24 nt, Human
aggaaggcgaaucaaacaaccaaa

SEQ ID NO: 1357124 - RNA, 22 nt, Human
aggacagagacucaacagagga

SEQ ID NO: 1357125 - RNA, 23 nt, Human
aggaggcugaggcaagaggauca

SEQ ID NO: 1357126 - RNA, 18 nt, Human
aggcaagaggaucaccug

SEQ ID NO: 1357127 - RNA, 18 nt, Human
aggcaagaggaucaccug

SEQ ID NO: 1357128 - RNA, 24 nt, Human
aggcaagaggaucaccugagccca

SEQ ID NO: 1357129 - RNA, 23 nt, Human
aggcaggaagcaagcaaugucaa

SEQ ID NO: 1357130 - RNA, 24 nt, Human
aggcggagguugcagugagccaag

SEQ ID NO: 1357131 - RNA, 24 nt, Human
aggcugaggcaagaggaucaccug

SEQ ID NO: 1357132 - RNA, 21 nt, Human
aggucaaggugggcaaaucac

SEQ ID NO: 1357133 - RNA, 23 nt, Human
aggugggcaaaucacuugagguc

SEQ ID NO: 1357134 - RNA, 26 nt, Human
aggugggcaaaucacuugaggucagg

SEQ ID NO: 1357135 - RNA, 18 nt, Human
aguggcucacgucuguag

SEQ ID NO: 1357136 - RNA, 18 nt, Human
auaugguagaaaguauug

SEQ ID NO: 1357137 - RNA, 24 nt, Human
aucacuugaggucaggaguucaag

SEQ ID NO: 1357138 - RNA, 20 nt, Human
aucaucucaucagcaaaauc

SEQ ID NO: 1357139 - RNA, 24 nt, Human
aucgcaccacugcacuccauccug

SEQ ID NO: 1357140 - RNA, 18 nt, Human
auguaucuaucucuauca

SEQ ID NO: 1357141 - RNA, 19 nt, Human
caaaaauuaggcgggugug

SEQ ID NO: 1357142 - RNA, 21 nt, Human
caaacaacaacaacaacaaaa

SEQ ID NO: 1357143 - RNA, 24 nt, Human
caaaucacuugaggucaggaguuc

SEQ ID NO: 1357144 - RNA, 22 nt, Human
caacagaacacaaauaaagaua

SEQ ID NO: 1357145 - RNA, 24 nt, Human
caacauggugaaaccccgccucua

SEQ ID NO: 1357146 - RNA, 24 nt, Human
caaccaaauccaaaaagaccccag

SEQ ID NO: 1357147 - RNA, 24 nt, Human
caagaggaucaccugagcccagga

SEQ ID NO: 1357148 - RNA, 24 nt, Human
caaggugggcaaaucacuugaggu

SEQ ID NO: 1357149 - RNA, 26 nt, Human
caaggugggcaaaucacuugagguca

SEQ ID NO: 1357150 - RNA, 24 nt, Human
cacaaacuccagcggccaccuccc

SEQ ID NO: 1357151 - RNA, 19 nt, Human
cacuaguggccaaugaagu

SEQ ID NO: 1357152 - RNA, 20 nt, Human
cacugcacuccauccuggca

SEQ ID NO: 1357153 - RNA, 21 nt, Human
cacugcacuccauccuggcag

SEQ ID NO: 1357154 - RNA, 23 nt, Human
cacuugaggucaggaguucaaga

SEQ ID NO: 1357155 - RNA, 21 nt, Human
cagcggccaccucccacuucc

SEQ ID NO: 1357156 - RNA, 24 nt, Human
caguacucucaauguuuaguauca

SEQ ID NO: 1357157 - RNA, 19 nt, Human
caguccacagggggaggga

SEQ ID NO: 1357158 - RNA, 21 nt, Human
caucagcaaaaucccaaauca

SEQ ID NO: 1357159 - RNA, 22 nt, Human
cauccaucucuuacguguuucc

SEQ ID NO: 1357160 - RNA, 20 nt, Human
cauggguuuagccucuagau

SEQ ID NO: 1357161 - RNA, 19 nt, Human
ccacugcacuccauccugg

SEQ ID NO: 1357162 - RNA, 19 nt, Human
ccacugcacuccauccugg

SEQ ID NO: 1357163 - RNA, 20 nt, Human
ccacugcacuccauccuggc

SEQ ID NO: 1357164 - RNA, 23 nt, Human
ccacugcacuccauccuggcaga

SEQ ID NO: 1357165 - RNA, 24 nt, Human
ccacugcacuccauccuggcagac

SEQ ID NO: 1357166 - RNA, 22 nt, Human
ccagcgccgcaguccacagggg

SEQ ID NO: 1357167 - RNA, 21 nt, Human
ccgaaagccucgccuuucucc

SEQ ID NO: 1357168 - RNA, 23 nt, Human
ccugaccaacauggugaaacccc

SEQ ID NO: 1357169 - RNA, 24 nt, Human
ccugaccaacauggugaaaccccg

SEQ ID NO: 1357170 - RNA, 22 nt, Human
ccuguaaucugagcuacucagg

SEQ ID NO: 1357171 - RNA, 19 nt, Human
cgaaucaaacaaccaaauc

SEQ ID NO: 1357172 - RNA, 24 nt, Human
cgccuguaaucugagcuacucagg

SEQ ID NO: 1357173 - RNA, 20 nt, Human
cucgcguucccgcggcggcg

SEQ ID NO: 1357174 - RNA, 20 nt, Human
cucuaccaaaaauacaaaaa

SEQ ID NO: 1357175 - RNA, 24 nt, Human
cugagcccaggaggcggagguugc

SEQ ID NO: 1357176 - RNA, 19 nt, Human
gaaaagaaacauaggcaga

SEQ ID NO: 1357177 - RNA, 18 nt, Human
gagcaaaaacucugucuc

SEQ ID NO: 1357178 - RNA, 23 nt, Human
gagguugcagugagccaagaucg

SEQ ID NO: 1357179 - RNA, 23 nt, Human
gaguugcuggagccggacacuug

SEQ ID NO: 1357180 - RNA, 20 nt, Human
gauaagaguuuuaccuuauc

SEQ ID NO: 1357181 - RNA, 24 nt, Human
gaucaccugagcccaggaggcgga

SEQ ID NO: 1357182 - RNA, 20 nt, Human
gccaagaucgcaccacugca

SEQ ID NO: 1357183 - RNA, 24 nt, Human
gcccaggaggcggagguugcagug

SEQ ID NO: 1357184 - RNA, 21 nt, Human
gccucuagauaagaguuuuac

SEQ ID NO: 1357185 - RNA, 22 nt, Human
gcggccacacaaacuccagcgg

SEQ ID NO: 1357186 - RNA, 21 nt, Human
gcgggugugguggcacgcgcc

SEQ ID NO: 1357187 - RNA, 22 nt, Human
ggaggcggagguugcagugagc

SEQ ID NO: 1357188 - RNA, 20 nt, Human
ggagguugcagugagccaag

SEQ ID NO: 1357189 - RNA, 24 nt, Human
ggagguugcagugagccaagaucg

SEQ ID NO: 1357190 - RNA, 19 nt, Human
ggaugcacaaacaucucag

SEQ ID NO: 1357191 - RNA, 25 nt, Human
ggcaaaucacuugaggucaggaguu

SEQ ID NO: 1357192 - RNA, 19 nt, Human
ggcguccacacgccgggca

SEQ ID NO: 1357193 - RNA, 21 nt, Human
ggcugagcgcaguggcucacg

SEQ ID NO: 1357194 - RNA, 22 nt, Human
gggagggaggacgaacaagagg

SEQ ID NO: 1357195 - RNA, 23 nt, Human
ggugugguggcacgcgccuguaa

SEQ ID NO: 1357196 - RNA, 24 nt, Human
guagaaaauuccaacgccaagaaa

SEQ ID NO: 1357197 - RNA, 23 nt, Human
guauaccaaguaccuuacgaaau

SEQ ID NO: 1357198 - RNA, 18 nt, Human
uaaaaagcaguacucuca

SEQ ID NO: 1357199 - RNA, 25 nt, Human
uaaaaagcaguacucucaauguuua

SEQ ID NO: 1357200 - RNA, 24 nt, Human
uaaaaggcaggaagcaagcaaugu

SEQ ID NO: 1357201 - RNA, 23 nt, Human
uaacaaaaacguaauauauggua

SEQ ID NO: 1357202 - RNA, 23 nt, Human
uaaggcauacauaugucaaaaaa

SEQ ID NO: 1357203 - RNA, 24 nt, Human
uacaaaaauuaggcggguguggug

SEQ ID NO: 1357204 - RNA, 22 nt, Human
uacaaaguaaaauuagguggug

SEQ ID NO: 1357205 - RNA, 21 nt, Human
uaccaaaaauacaaaaauuag

SEQ ID NO: 1357206 - RNA, 23 nt, Human
uaccaaguaccuuacgaaauuca

SEQ ID NO: 1357207 - RNA, 20 nt, Human
uacuauguaacgaauacugu

SEQ ID NO: 1357208 - RNA, 22 nt, Human
uagaauuaguuaagaauuacuc

SEQ ID NO: 1357209 - RNA, 24 nt, Human
uaggaggucaaggugggcaaauca

SEQ ID NO: 1357210 - RNA, 22 nt, Human
uaugacuacugcugaaaagcag

SEQ ID NO: 1357211 - RNA, 24 nt, Human
uaugucaaaaaaggaaggcgaauc

SEQ ID NO: 1357212 - RNA, 22 nt, Human
ucaaacaacaacaacaacaaaa

SEQ ID NO: 1357213 - RNA, 26 nt, Human
ucaaacaaccaaauccaaaaagaccc

SEQ ID NO: 1357214 - RNA, 20 nt, Human
ucacuaguggccaaugaagu

SEQ ID NO: 1357215 - RNA, 20 nt, Human
ucagcaaaaucccaaaucaa

SEQ ID NO: 1357216 - RNA, 24 nt, Human
ucaguaacuggauuuuuaaccaaa

SEQ ID NO: 1357217 - RNA, 24 nt, Human
ucaguaugccuuccuacaaaaucu

SEQ ID NO: 1357218 - RNA, 28 nt, Human
ucagucuauuucaaagcauggucccuca

SEQ ID NO: 1357219 - RNA, 19 nt, Human
ucaucagauuuuccaauug

SEQ ID NO: 1357220 - RNA, 22 nt, Human
ucauuggcuuaagaaaucgaaa

SEQ ID NO: 1357221 - RNA, 21 nt, Human
uccgggagcguguggcgucca

SEQ ID NO: 1357222 - RNA, 27 nt, Human
uccuggcagacgagcaaaaggaguuuc

SEQ ID NO: 1357223 - RNA, 23 nt, Human
ucgcaccacugcacuccauccug

SEQ ID NO: 1357224 - RNA, 20 nt, Human
ucuauggcugagcgcagugg

SEQ ID NO: 1357225 - RNA, 18 nt, Human
ucucacucugcagagccc

SEQ ID NO: 1357226 - RNA, 20 nt, Human
ucucacucugcagagcccga

SEQ ID NO: 1357227 - RNA, 22 nt, Human
ucucacucugcagagcccgaaa

SEQ ID NO: 1357228 - RNA, 18 nt, Human
ucucagcauacaucccuc

SEQ ID NO: 1357229 - RNA, 22 nt, Human
ucuuucaaagacaacacaauaa

SEQ ID NO: 1357230 - RNA, 25 nt, Human
ugaaaagcagaaauucauuggcuua

SEQ ID NO: 1357231 - RNA, 25 nt, Human
ugaaaagcagaaauucauuggcuua

SEQ ID NO: 1357232 - RNA, 21 nt, Human
ugacauucaacagaacagcca

SEQ ID NO: 1357233 - RNA, 18 nt, Human
ugaccaacauggugaaac

SEQ ID NO: 1357234 - RNA, 20 nt, Human
ugacuaacuucacuaguggc

SEQ ID NO: 1357235 - RNA, 20 nt, Human
ugaggcaagaggaucaccug

SEQ ID NO: 1357236 - RNA, 24 nt, Human
ugaggcaagaggaucaccugagcc

SEQ ID NO: 1357237 - RNA, 25 nt, Human
ugaggcaagaggaucaccugagccc

SEQ ID NO: 1357238 - RNA, 23 nt, Human
ugcuuaaaguuugcacuacagga

SEQ ID NO: 1357239 - RNA, 23 nt, Human
uggagccggacacuugcuaacuc

SEQ ID NO: 1357240 - RNA, 18 nt, Human
uggaggggaggacagaga

SEQ ID NO: 1357241 - RNA, 20 nt, Human
uggcacgcgccuguaaucug

SEQ ID NO: 1357242 - RNA, 24 nt, Human
ugggcaaaucacuugaggucagga

SEQ ID NO: 1357243 - RNA, 26 nt, Human
ugucaaaaaaggaaggcgaaucaaac

SEQ ID NO: 1357244 - RNA, 22 nt, Human
ugucucaaacaacaacaacaac

SEQ ID NO: 1357245 - RNA, 23 nt, Human
uuaaacaccaguaagauaugaca

SEQ ID NO: 1357246 - RNA, 18 nt, Human
uuaaauacuugauccaac

SEQ ID NO: 1357247 - RNA, 22 nt, Human
uugcagugagccaagaucgcac

SEQ ID NO: 1357248 - RNA, 21 nt, Human
uugcuggagccggacacuugc

SEQ ID NO: 1357249 - RNA, 23 nt, Human
uuuauuaaaagguaaaaggcagg

SEQ ID NO: 1357250 - RNA, 20 nt, Human
aaaggaaggcaaaauuccua

SEQ ID NO: 1357251 - RNA, 24 nt, Human
aacgucaaugaagccuccuggcau

SEQ ID NO: 1357252 - RNA, 23 nt, Human
aaggagguuuguguccagcugga

SEQ ID NO: 1357253 - RNA, 24 nt, Human
agccuccuggcauugucggaaaua

SEQ ID NO: 1357254 - RNA, 22 nt, Human
aggaaaaagcacuacugugaag

SEQ ID NO: 1357255 - RNA, 19 nt, Human
agggagaaauucaaaaaaa

SEQ ID NO: 1357256 - RNA, 19 nt, Human
cacacaaugcuauauucaa

SEQ ID NO: 1357257 - RNA, 18 nt, Human
cacuuuagagagcuggga

SEQ ID NO: 1357258 - RNA, 23 nt, Human
cagcacaauuaggaagagacaau

SEQ ID NO: 1357259 - RNA, 22 nt, Human
cagggccgcggcggacacggcc

SEQ ID NO: 1357260 - RNA, 21 nt, Human
cagucgacuucaacuuaaugc

SEQ ID NO: 1357261 - RNA, 21 nt, Human
cuacaacgucaaugaagccuc

SEQ ID NO: 1357262 - RNA, 24 nt, Human
cucuuaguccugacacccuggagu

SEQ ID NO: 1357263 - RNA, 18 nt, Human
cugcccucugcugggccu

SEQ ID NO: 1357264 - RNA, 20 nt, Human
cugcugggccucuuuggcag

SEQ ID NO: 1357265 - RNA, 24 nt, Human
cugguggacagaagacaaaggaag

SEQ ID NO: 1357266 - RNA, 18 nt, Human
cuuaguccugacacccug

SEQ ID NO: 1357267 - RNA, 22 nt, Human
cuuuuuggcagcauauuuccgg

SEQ ID NO: 1357268 - RNA, 23 nt, Human
gagagaaggccugguggacagaa

SEQ ID NO: 1357269 - RNA, 21 nt, Human
gagguuuguguccagcuggag

SEQ ID NO: 1357270 - RNA, 19 nt, Human
gauucguggacgaagucuc

SEQ ID NO: 1357271 - RNA, 23 nt, Human
gcaacucuggcuugaucuuagaa

SEQ ID NO: 1357272 - RNA, 25 nt, Human
gcagguuaaaaugcaaauccaagug

SEQ ID NO: 1357273 - RNA, 19 nt, Human
gccugguggacagaagaca

SEQ ID NO: 1357274 - RNA, 26 nt, Human
gcucuugggaaaucugcuguuuugug

SEQ ID NO: 1357275 - RNA, 19 nt, Human
ggacagaagacaaaggaag

SEQ ID NO: 1357276 - RNA, 21 nt, Human
uacacaaguuuauuaacacag

SEQ ID NO: 1357277 - RNA, 22 nt, Human
uauugccccucggaccucgcag

SEQ ID NO: 1357278 - RNA, 19 nt, Human
ucaaaaaaaugaugggggu

SEQ ID NO: 1357279 - RNA, 21 nt, Human
ucgcagggccgcggcggacac

SEQ ID NO: 1357280 - RNA, 22 nt, Human
ucucuuaguccugacacccugg

SEQ ID NO: 1357281 - RNA, 23 nt, Human
ugacuucucuuaguccugacacc

SEQ ID NO: 1357282 - RNA, 18 nt, Human
ugagaacugaugggaaag

SEQ ID NO: 1357283 - RNA, 18 nt, Human
ugccaaagucccaacaua

SEQ ID NO: 1357284 - RNA, 22 nt, Human
ugggaaaggugguguggauucg

SEQ ID NO: 1357285 - RNA, 19 nt, Human
ugggaaaucugcuguuuug

SEQ ID NO: 1357286 - RNA, 22 nt, Human
uguggauucguggacgaagucu

SEQ ID NO: 1357287 - RNA, 19 nt, Human
uucucuuaguccugacacc

SEQ ID NO: 1357288 - RNA, 23 nt, Human
uugugggcucuucuuucuuaucu

SEQ ID NO: 1357289 - RNA, 24 nt, Human
uuuugugacuucucuuaguccuga

SEQ ID NO: 1357290 - RNA, 25 nt, Human
aaaaagccauaaagacuuccuuugc

SEQ ID NO: 1357291 - RNA, 24 nt, Human
aaaagggagauuucaugaacagaa

SEQ ID NO: 1357292 - RNA, 26 nt, Human
aaacagcugagaaacaacaaaauucu

SEQ ID NO: 1357293 - RNA, 22 nt, Human
aaacaguaucuuacucacuaau

SEQ ID NO: 1357294 - RNA, 19 nt, Human
aacacccugauaaaaucua

SEQ ID NO: 1357295 - RNA, 22 nt, Human
aagaaugguggggaggaaucac

SEQ ID NO: 1357296 - RNA, 18 nt, Human
aaucaguuuuaaucacug

SEQ ID NO: 1357297 - RNA, 18 nt, Human
acagaaacauugggcucc

SEQ ID NO: 1357298 - RNA, 20 nt, Human
acagacaaaauuuguuuuug

SEQ ID NO: 1357299 - RNA, 22 nt, Human
acagagguuuuuacuuuuuccu

SEQ ID NO: 1357300 - RNA, 18 nt, Human
agaaaaaagccauaaaga

SEQ ID NO: 1357301 - RNA, 23 nt, Human
caaaaacacccugauaaaaucua

SEQ ID NO: 1357302 - RNA, 24 nt, Human
caacacaaccccacaguuguuaua

SEQ ID NO: 1357303 - RNA, 23 nt, Human
caagaauaugguaugccauccca

SEQ ID NO: 1357304 - RNA, 24 nt, Human
cauuaaauugcaucacuaaaaaug

SEQ ID NO: 1357305 - RNA, 21 nt, Human
cccuggguuucacgcauuguu

SEQ ID NO: 1357306 - RNA, 22 nt, Human
cuacucagagcuaacacaacag

SEQ ID NO: 1357307 - RNA, 22 nt, Human
cucagagcuaacacaacagcau

SEQ ID NO: 1357308 - RNA, 19 nt, Human
cuggaaugaauaacugcuc

SEQ ID NO: 1357309 - RNA, 20 nt, Human
cuuugacaaaaacacccuga

SEQ ID NO: 1357310 - RNA, 18 nt, Human
gacaaaaacacccugaua

SEQ ID NO: 1357311 - RNA, 19 nt, Human
uaaaaacaguaucuuacuc

SEQ ID NO: 1357312 - RNA, 21 nt, Human
uaaacaaaucacaaauaacau

SEQ ID NO: 1357313 - RNA, 20 nt, Human
uaaauugcaucacuaaaaau

SEQ ID NO: 1357314 - RNA, 23 nt, Human
uaaccugcuuugacaaaaacacc

SEQ ID NO: 1357315 - RNA, 24 nt, Human
uacuuuauaacucacaaaaauaua

SEQ ID NO: 1357316 - RNA, 20 nt, Human
uagaaaagggcagucagaau

SEQ ID NO: 1357317 - RNA, 21 nt, Human
ucagagcuaacacaacagcau

SEQ ID NO: 1357318 - RNA, 21 nt, Human
ugauagauuuuaagaaccaag

SEQ ID NO: 1357319 - RNA, 19 nt, Human
ugccaucccacccaaacuu

SEQ ID NO: 1357320 - RNA, 22 nt, Human
ugcucaaaaaagcaguacagcu

SEQ ID NO: 1357321 - RNA, 20 nt, Human
uguuaaagguccagcuagaa

SEQ ID NO: 1357322 - RNA, 21 nt, Human
uguuaaagguccagcuagaaa

SEQ ID NO: 1357323 - RNA, 21 nt, Human
uuaagaaccaagaauauggua

SEQ ID NO: 1357324 - RNA, 23 nt, Human
uuaauucucaacacaaccccaca

SEQ ID NO: 1357325 - RNA, 20 nt, Human
uucuaaauucugggacuagu

SEQ ID NO: 1357326 - RNA, 18 nt, Human
uuucaugaacagaaacau

SEQ ID NO: 1357327 - RNA, 22 nt, Human
aaaaaaaaaaaaaauuagccag

SEQ ID NO: 1357328 - RNA, 22 nt, Human
aaaaaaacuaguccgggugugg

SEQ ID NO: 1357329 - RNA, 19 nt, Human
aaagaaaaaaagaaagaaa

SEQ ID NO: 1357330 - RNA, 18 nt, Human
aacauggugaaaccccgc

SEQ ID NO: 1357331 - RNA, 20 nt, Human
aacauggugaaaccccgccu

SEQ ID NO: 1357332 - RNA, 21 nt, Human
aacauggugaaaccccgccuc

SEQ ID NO: 1357333 - RNA, 20 nt, Human
aacauggugaaacccugccu

SEQ ID NO: 1357334 - RNA, 21 nt, Human
aacauggugaaacccugccuc

SEQ ID NO: 1357335 - RNA, 24 nt, Human
aaucacuugaacccgggaggcgga

SEQ ID NO: 1357336 - RNA, 24 nt, Human
aaucacuuguacccgggaggcaga

SEQ ID NO: 1357337 - RNA, 20 nt, Human
acaaugaaaaggccagcugg

SEQ ID NO: 1357338 - RNA, 21 nt, Human
acacaguaucucccccauagc

SEQ ID NO: 1357339 - RNA, 23 nt, Human
acagagagagacacugucucaaa

SEQ ID NO: 1357340 - RNA, 20 nt, Human
acagagcaagacuccgucuc

SEQ ID NO: 1357341 - RNA, 24 nt, Human
acagagcaagacuccgucucagaa

SEQ ID NO: 1357342 - RNA, 23 nt, Human
accccgccucuacuaaaauacaa

SEQ ID NO: 1357343 - RNA, 24 nt, Human
acccugccucuacuaaaaauacaa

SEQ ID NO: 1357344 - RNA, 21 nt, Human
acuaaaauacaaaaaaacuag

SEQ ID NO: 1357345 - RNA, 19 nt, Human
acucguagggcuucucccc

SEQ ID NO: 1357346 - RNA, 24 nt, Human
acugcacuccagccugggcgacag

SEQ ID NO: 1357347 - RNA, 26 nt, Human
acugcacuccagccugggcgacagag

SEQ ID NO: 1357348 - RNA, 24 nt, Human
acugcacucuagccugggugacag

SEQ ID NO: 1357349 - RNA, 26 nt, Human
acugcacucuagccugggugacagag

SEQ ID NO: 1357350 - RNA, 19 nt, Human
agaaauuaaaggccagccu

SEQ ID NO: 1357351 - RNA, 24 nt, Human
agcacuuugggaggccgaggcggg

SEQ ID NO: 1357352 - RNA, 22 nt, Human
agccuggccaacauggugaaac

SEQ ID NO: 1357353 - RNA, 24 nt, Human
agccuggccaacauggugaaaccc

SEQ ID NO: 1357354 - RNA, 24 nt, Human
agccugggcgacagagcaagacuc

SEQ ID NO: 1357355 - RNA, 23 nt, Human
aggaagaccgcaggggagucuga

SEQ ID NO: 1357356 - RNA, 20 nt, Human
aggaggugggagcgguugcu

SEQ ID NO: 1357357 - RNA, 25 nt, Human
aggaggugggagcgguugcugaagc

SEQ ID NO: 1357358 - RNA, 21 nt, Human
aggcagaaguuucagugagcc

SEQ ID NO: 1357359 - RNA, 24 nt, Human
aggcagaaguuucagugagccgag

SEQ ID NO: 1357360 - RNA, 26 nt, Human
aggcagaucgccugauguuaggaguu

SEQ ID NO: 1357361 - RNA, 18 nt, Human
aggcaggagaaucacuug

SEQ ID NO: 1357362 - RNA, 24 nt, Human
aggcaggagaaucacuuguacccg

SEQ ID NO: 1357363 - RNA, 26 nt, Human
aggcaggcagaucgccugauguuagg

SEQ ID NO: 1357364 - RNA, 18 nt, Human
aggccgaggcggguggau

SEQ ID NO: 1357365 - RNA, 21 nt, Human
aggcggagguugcagugagcc

SEQ ID NO: 1357366 - RNA, 24 nt, Human
aggcggagguugcagugagccgag

SEQ ID NO: 1357367 - RNA, 24 nt, Human
aggcggguggauaacgaagucagg

SEQ ID NO: 1357368 - RNA, 25 nt, Human
aggcggugcuggaggaggugggagc

SEQ ID NO: 1357369 - RNA, 24 nt, Human
aggcugagguaggggaaucacuug

SEQ ID NO: 1357370 - RNA, 18 nt, Human
agguaggggaaucacuug

SEQ ID NO: 1357371 - RNA, 24 nt, Human
agguaggggaaucacuugaacccg

SEQ ID NO: 1357372 - RNA, 24 nt, Human
agguugaggcaggagaaucacuug

SEQ ID NO: 1357373 - RNA, 24 nt, Human
aucacugcacuccagccugggcga

SEQ ID NO: 1357374 - RNA, 21 nt, Human
aucgccugauguuaggaguuc

SEQ ID NO: 1357375 - RNA, 24 nt, Human
aucgcuccacugcacucuagccug

SEQ ID NO: 1357376 - RNA, 24 nt, Human
aucugcgcgaaggccuuggcgcac

SEQ ID NO: 1357377 - RNA, 19 nt, Human
augccuguaaucccagcac

SEQ ID NO: 1357378 - RNA, 24 nt, Human
auugcaucacugcacuccagccug

SEQ ID NO: 1357379 - RNA, 18 nt, Human
caaagaaaaaaagaaaga

SEQ ID NO: 1357380 - RNA, 24 nt, Human
caacauggugaaaccccgccucua

SEQ ID NO: 1357381 - RNA, 24 nt, Human
caacauggugaaacccugccucua

SEQ ID NO: 1357382 - RNA, 23 nt, Human
caagacuccgucucagaaaaaaa

SEQ ID NO: 1357383 - RNA, 21 nt, Human
caagcuucucugagccucggu

SEQ ID NO: 1357384 - RNA, 19 nt, Human
caaggcaggcagaucgccu

SEQ ID NO: 1357385 - RNA, 22 nt, Human
cacucggggcagguguagggcc

SEQ ID NO: 1357386 - RNA, 23 nt, Human
cacucggggcagguguagggccg

SEQ ID NO: 1357387 - RNA, 18 nt, Human
cacucuagccugggugac

SEQ ID NO: 1357388 - RNA, 22 nt, Human
cacucuagccugggugacagag

SEQ ID NO: 1357389 - RNA, 19 nt, Human
cacugcacuccagccuggg

SEQ ID NO: 1357390 - RNA, 20 nt, Human
cacugcacuccagccugggc

SEQ ID NO: 1357391 - RNA, 20 nt, Human
cacugcacuccagccugggc

SEQ ID NO: 1357392 - RNA, 20 nt, Human
cacugcacuccagccugggc

SEQ ID NO: 1357393 - RNA, 22 nt, Human
cacugcacuccagccugggcga

SEQ ID NO: 1357394 - RNA, 23 nt, Human
cacugcacuccagccugggcgac

SEQ ID NO: 1357395 - RNA, 24 nt, Human
cacugcacuccagccugggcgaca

SEQ ID NO: 1357396 - RNA, 27 nt, Human
cacugcacuccagccugggcgacagag

SEQ ID NO: 1357397 - RNA, 19 nt, Human
cacugcacucuagccuggg

SEQ ID NO: 1357398 - RNA, 19 nt, Human
cacugcacucuagccuggg

SEQ ID NO: 1357399 - RNA, 22 nt, Human
cacugcacucuagccuggguga

SEQ ID NO: 1357400 - RNA, 23 nt, Human
cacugcacucuagccugggugac

SEQ ID NO: 1357401 - RNA, 24 nt, Human
cacugcacucuagccugggugaca

SEQ ID NO: 1357402 - RNA, 24 nt, Human
cacugcacucuagccugggugaca

SEQ ID NO: 1357403 - RNA, 24 nt, Human
cagaucgccugauguuaggaguuc

SEQ ID NO: 1357404 - RNA, 22 nt, Human
cagcacuuugggaggccgaggc

SEQ ID NO: 1357405 - RNA, 24 nt, Human
cagcacuuugggaggccgaggcgg

SEQ ID NO: 1357406 - RNA, 21 nt, Human
cagcacuuugggaugccaagg

SEQ ID NO: 1357407 - RNA, 24 nt, Human
cagcacuuugggaugccaaggcag

SEQ ID NO: 1357408 - RNA, 21 nt, Human
cagcgguagggcuucuccucc

SEQ ID NO: 1357409 - RNA, 24 nt, Human
cagcuacucgggaggcugagguag

SEQ ID NO: 1357410 - RNA, 22 nt, Human
caggaagcgucggggauaacac

SEQ ID NO: 1357411 - RNA, 21 nt, Human
cagucuuagcccugugucuuc

SEQ ID NO: 1357412 - RNA, 20 nt, Human
caugccuguaaucccagcac

SEQ ID NO: 1357413 - RNA, 24 nt, Human
caugccuguaaucccagcacuuug

SEQ ID NO: 1357414 - RNA, 26 nt, Human
cauugugagguuggaaaggaggcccu

SEQ ID NO: 1357415 - RNA, 20 nt, Human
ccacugcacucuagccuggg

SEQ ID NO: 1357416 - RNA, 20 nt, Human
ccacugcacucuagccuggg

SEQ ID NO: 1357417 - RNA, 20 nt, Human
ccacugcacucuagccuggg

SEQ ID NO: 1357418 - RNA, 20 nt, Human
ccacugcacucuagccuggg

SEQ ID NO: 1357419 - RNA, 21 nt, Human
ccacugcacucuagccugggu

SEQ ID NO: 1357420 - RNA, 24 nt, Human
ccacugcacucuagccugggugac

SEQ ID NO: 1357421 - RNA, 22 nt, Human
ccacugugugcccucaggcaag

SEQ ID NO: 1357422 - RNA, 20 nt, Human
cccacugugugcccucaggc

SEQ ID NO: 1357423 - RNA, 19 nt, Human
cccagcacuuugggaugcc

SEQ ID NO: 1357424 - RNA, 21 nt, Human
cccaggcgcgcugcaccuccg

SEQ ID NO: 1357425 - RNA, 19 nt, Human
cccauagcauugugagguu

SEQ ID NO: 1357426 - RNA, 26 nt, Human
cccuggcugaaagcuuuggagcucau

SEQ ID NO: 1357427 - RNA, 22 nt, Human
ccuagccaacauggugaaaccc

SEQ ID NO: 1357428 - RNA, 23 nt, Human
ccuagccaacauggugaaacccc

SEQ ID NO: 1357429 - RNA, 24 nt, Human
ccuagccaacauggugaaaccccg

SEQ ID NO: 1357430 - RNA, 18 nt, Human
ccuccgggaacugcuguc

SEQ ID NO: 1357431 - RNA, 21 nt, Human
ccuccgggaacugcugucguc

SEQ ID NO: 1357432 - RNA, 22 nt, Human
ccuggccaacauggugaaaccc

SEQ ID NO: 1357433 - RNA, 24 nt, Human
ccuggccaacauggugaaacccug

SEQ ID NO: 1357434 - RNA, 22 nt, Human
ccugggcgacagagcaagacuc

SEQ ID NO: 1357435 - RNA, 22 nt, Human
ccuguaaucccagcacuuuggg

SEQ ID NO: 1357436 - RNA, 20 nt, Human
ccuguagucccagcacuuug

SEQ ID NO: 1357437 - RNA, 21 nt, Human
ccuguagucccagcuacucgg

SEQ ID NO: 1357438 - RNA, 22 nt, Human
ccuguagucccagcuacucggg

SEQ ID NO: 1357439 - RNA, 24 nt, Human
cgagaccauccuagccaacauggu

SEQ ID NO: 1357440 - RNA, 24 nt, Human
cgagauugcaucacugcacuccag

SEQ ID NO: 1357441 - RNA, 24 nt, Human
cgaggcggguggauaacgaaguca

SEQ ID NO: 1357442 - RNA, 23 nt, Human
cgccgcacuuguagggccgcucu

SEQ ID NO: 1357443 - RNA, 23 nt, Human
cgccuguagucccagcuacucgg

SEQ ID NO: 1357444 - RNA, 24 nt, Human
cgccuguagucccagcuacucggg

SEQ ID NO: 1357445 - RNA, 24 nt, Human
cgggaggcggagguugcagugagc

SEQ ID NO: 1357446 - RNA, 22 nt, Human
cggguggauaacgaagucagga

SEQ ID NO: 1357447 - RNA, 18 nt, Human
cucaaagaaaaaaagaaa

SEQ ID NO: 1357448 - RNA, 23 nt, Human
cucagaaaaaaaaaaaaaaaaaa

SEQ ID NO: 1357449 - RNA, 24 nt, Human
cucaggccuguagucccagcacuu

SEQ ID NO: 1357450 - RNA, 24 nt, Human
cucaugccuguaaucccagcacuu

SEQ ID NO: 1357451 - RNA, 23 nt, Human
cuccacugcacucuagccugggu

SEQ ID NO: 1357452 - RNA, 22 nt, Human
cuccccaggcgcgcugcaccuc

SEQ ID NO: 1357453 - RNA, 23 nt, Human
cuccuguaauuuuaacuacucgg

SEQ ID NO: 1357454 - RNA, 20 nt, Human
cucuacuaaaaauacaaaaa

SEQ ID NO: 1357455 - RNA, 20 nt, Human
cugaaggccuugccgcacuc

SEQ ID NO: 1357456 - RNA, 22 nt, Human
cugcaccuccgggaacugcugu

SEQ ID NO: 1357457 - RNA, 21 nt, Human
cuguugacagguuucuccucc

SEQ ID NO: 1357458 - RNA, 19 nt, Human
cuuugggaugccaaggcag

SEQ ID NO: 1357459 - RNA, 19 nt, Human
gaaacccugccucuacuaa

SEQ ID NO: 1357460 - RNA, 19 nt, Human
gaagagcgcgccgcagucc

SEQ ID NO: 1357461 - RNA, 23 nt, Human
gaaguuucagugagccgagaucg

SEQ ID NO: 1357462 - RNA, 24 nt, Human
gacagagcaagacuccgucucaga

SEQ ID NO: 1357463 - RNA, 20 nt, Human
gagaucgcuccacugcacuc

SEQ ID NO: 1357464 - RNA, 18 nt, Human
gaggagaagcugaaggcc

SEQ ID NO: 1357465 - RNA, 18 nt, Human
gaggcggugcuggaggag

SEQ ID NO: 1357466 - RNA, 24 nt, Human
gagguaggggaaucacuugaaccc

SEQ ID NO: 1357467 - RNA, 23 nt, Human
gagguugcagugagccgagauug

SEQ ID NO: 1357468 - RNA, 18 nt, Human
gauaacgaagucaggaga

SEQ ID NO: 1357469 - RNA, 18 nt, Human
gaucgccugauguuagga

SEQ ID NO: 1357470 - RNA, 24 nt, Human
gaucgccugauguuaggaguucga

SEQ ID NO: 1357471 - RNA, 24 nt, Human
gcacuccagccugggcgacagagc

SEQ ID NO: 1357472 - RNA, 24 nt, Human
gccaacauggugaaaccccgccuc

SEQ ID NO: 1357473 - RNA, 22 nt, Human
gccaacauggugaaacccugcc

SEQ ID NO: 1357474 - RNA, 24 nt, Human
gccaacauggugaaacccugccuc

SEQ ID NO: 1357475 - RNA, 18 nt, Human
gcccgugugcacgcgccg

SEQ ID NO: 1357476 - RNA, 18 nt, Human
gcgcggaggagaagcuga

SEQ ID NO: 1357477 - RNA, 20 nt, Human
gcucgcccgugugcgugcgc

SEQ ID NO: 1357478 - RNA, 21 nt, Human
gcugaggagaagcggaaggcc

SEQ ID NO: 1357479 - RNA, 22 nt, Human
ggagguugcagugagccgagau

SEQ ID NO: 1357480 - RNA, 24 nt, Human
ggagguugcagugagccgagauug

SEQ ID NO: 1357481 - RNA, 21 nt, Human
ggaugccaaggcaggcagauc

SEQ ID NO: 1357482 - RNA, 23 nt, Human
ggccuguagucccagcacuuugg

SEQ ID NO: 1357483 - RNA, 23 nt, Human
ggcgcgguggcucaugccuguaa

SEQ ID NO: 1357484 - RNA, 23 nt, Human
ggcugggcgcgguggcucaugcc

SEQ ID NO: 1357485 - RNA, 21 nt, Human
ggcugucaggaugccucuccu

SEQ ID NO: 1357486 - RNA, 23 nt, Human
gggaaucacuugaacccgggagg

SEQ ID NO: 1357487 - RNA, 23 nt, Human
gggaggcugagguaggggaauca

SEQ ID NO: 1357488 - RNA, 23 nt, Human
gguaggagcgguugcugaaggcc

SEQ ID NO: 1357489 - RNA, 23 nt, Human
gguggcucaugccuguaauccca

SEQ ID NO: 1357490 - RNA, 24 nt, Human
gguggcucaugccuguaaucccag

SEQ ID NO: 1357491 - RNA, 24 nt, Human
ggugugguggccgggcgccuguag

SEQ ID NO: 1357492 - RNA, 21 nt, Human
gugaaaccccgccucuacuaa

SEQ ID NO: 1357493 - RNA, 24 nt, Human
guggccgggcgccuguagucccag

SEQ ID NO: 1357494 - RNA, 21 nt, Human
guggugcuggaucagguagga

SEQ ID NO: 1357495 - RNA, 19 nt, Human
guugcagugagccgagauu

SEQ ID NO: 1357496 - RNA, 23 nt, Human
uaacacaguaucucccccauagc

SEQ ID NO: 1357497 - RNA, 24 nt, Human
uaacgaagucaggagaucgagacc

SEQ ID NO: 1357498 - RNA, 24 nt, Human
uaacuacucgggagguugaggcag

SEQ ID NO: 1357499 - RNA, 21 nt, Human
uagccugggugacagagagag

SEQ ID NO: 1357500 - RNA, 24 nt, Human
uagcucaggccuguagucccagca

SEQ ID NO: 1357501 - RNA, 20 nt, Human
ucaaagaaaaaaagaaagaa

SEQ ID NO: 1357502 - RNA, 20 nt, Human
ucacugcacuccagccuggg

SEQ ID NO: 1357503 - RNA, 21 nt, Human
ucacugcacuccagccugggc

SEQ ID NO: 1357504 - RNA, 24 nt, Human
ucacugcacuccagccugggcgac

SEQ ID NO: 1357505 - RNA, 24 nt, Human
ucacuugaacccgggaggcggagg

SEQ ID NO: 1357506 - RNA, 23 nt, Human
ucagaaaaaaaaaaaaaaaaaaa

SEQ ID NO: 1357507 - RNA, 22 nt, Human
ucaggccuguagucccagcacu

SEQ ID NO: 1357508 - RNA, 22 nt, Human
ucaugccuguaaucccagcacu

SEQ ID NO: 1357509 - RNA, 23 nt, Human
uccacggcuucuuggggccucca

SEQ ID NO: 1357510 - RNA, 24 nt, Human
uccacugcacucuagccuggguga

SEQ ID NO: 1357511 - RNA, 24 nt, Human
uccagccugggcgacagagcaaga

SEQ ID NO: 1357512 - RNA, 23 nt, Human
uccccaggcgcgcugcaccuccg

SEQ ID NO: 1357513 - RNA, 20 nt, Human
uccccggugugcacgaugug

SEQ ID NO: 1357514 - RNA, 23 nt, Human
uccgucucagaaaaaaaaaaaaa

SEQ ID NO: 1357515 - RNA, 29 nt, Human
uccgucucagaaaaaaaaaaaaaaaaaaa

SEQ ID NO: 1357516 - RNA, 24 nt, Human
ucgagacagccuggccaacauggu

SEQ ID NO: 1357517 - RNA, 19 nt, Human
ucgccgcacuuguagggcc

SEQ ID NO: 1357518 - RNA, 23 nt, Human
ucgccugauguuaggaguucgag

SEQ ID NO: 1357519 - RNA, 25 nt, Human
ucgggaggcugagguaggggaauca

SEQ ID NO: 1357520 - RNA, 20 nt, Human
ucuagccugggugacagaga

SEQ ID NO: 1357521 - RNA, 20 nt, Human
ucuucuggugcucuauaagc

SEQ ID NO: 1357522 - RNA, 22 nt, Human
ugagccgagaucgcuccacugc

SEQ ID NO: 1357523 - RNA, 22 nt, Human
ugagccgagauugcaucacugc

SEQ ID NO: 1357524 - RNA, 20 nt, Human
ugaggcaggagaaucacuug

SEQ ID NO: 1357525 - RNA, 24 nt, Human
ugaggcaggagaaucacuuguacc

SEQ ID NO: 1357526 - RNA, 20 nt, Human
ugagguaggggaaucacuug

SEQ ID NO: 1357527 - RNA, 21 nt, Human
ugagguaggggaaucacuuga

SEQ ID NO: 1357528 - RNA, 24 nt, Human
ugagguaggggaaucacuugaacc

SEQ ID NO: 1357529 - RNA, 18 nt, Human
ugagucaggcgugggagc

SEQ ID NO: 1357530 - RNA, 21 nt, Human
ugagucaggcgugggagcugg

SEQ ID NO: 1357531 - RNA, 23 nt, Human
ugagucaggcgugggagcugggc

SEQ ID NO: 1357532 - RNA, 21 nt, Human
ugcaucacugcacuccagccu

SEQ ID NO: 1357533 - RNA, 20 nt, Human
ugccaaggcaggcagaucgc

SEQ ID NO: 1357534 - RNA, 21 nt, Human
ugccaaggcaggcagaucgcc

SEQ ID NO: 1357535 - RNA, 23 nt, Human
ugccuguaaucccagcacuuugg

SEQ ID NO: 1357536 - RNA, 23 nt, Human
uggcagggguaaggccgcucucc

SEQ ID NO: 1357537 - RNA, 23 nt, Human
uggccaacauggugaaacccugc

SEQ ID NO: 1357538 - RNA, 24 nt, Human
uggcgcacuggccgcacgcguagu

SEQ ID NO: 1357539 - RNA, 22 nt, Human
uggcucaugccuguaaucccag

SEQ ID NO: 1357540 - RNA, 24 nt, Human
uggcucaugccuguaaucccagca

SEQ ID NO: 1357541 - RNA, 18 nt, Human
uggcuuggguagcagcag

SEQ ID NO: 1357542 - RNA, 22 nt, Human
uggcuuggguagcagcagggcu

SEQ ID NO: 1357543 - RNA, 21 nt, Human
ugggagcugggcaaaggcguc

SEQ ID NO: 1357544 - RNA, 22 nt, Human
ugggaggccgaggcggguggau

SEQ ID NO: 1357545 - RNA, 25 nt, Human
ugguggccgggcgccuguaguccca

SEQ ID NO: 1357546 - RNA, 23 nt, Human
uguagucccagcacuuugggaug

SEQ ID NO: 1357547 - RNA, 18 nt, Human
ugucggaugagcgcggag

SEQ ID NO: 1357548 - RNA, 20 nt, Human
ugugcgugcgcuggugcugc

SEQ ID NO: 1357549 - RNA, 19 nt, Human
uguugagucaggcguggga

SEQ ID NO: 1357550 - RNA, 23 nt, Human
uguugagucaggcgugggagcug

SEQ ID NO: 1357551 - RNA, 24 nt, Human
uuaggcugggcgcgguggcucaug

SEQ ID NO: 1357552 - RNA, 25 nt, Human
uucugcugguccacgcggguuucug

SEQ ID NO: 1357553 - RNA, 24 nt, Human
uugaacccgggaggcggagguugc

SEQ ID NO: 1357554 - RNA, 18 nt, Human
uugcagugagccgagauu

SEQ ID NO: 1357555 - RNA, 20 nt, Human
uugcagugagccgagauugc

SEQ ID NO: 1357556 - RNA, 21 nt, Human
uugcagugagccgagauugca

SEQ ID NO: 1357557 - RNA, 23 nt, Human
uugcaucacugcacuccagccug

SEQ ID NO: 1357558 - RNA, 20 nt, Human
uuucagugagccgagaucgc

SEQ ID NO: 1357559 - RNA, 21 nt, Human
uuucagugagccgagaucgcu

SEQ ID NO: 1357560 - RNA, 21 nt, Human
aaaaaaacauacaaacacauu

SEQ ID NO: 1357561 - RNA, 25 nt, Human
aaacuaauuucacaaacaaccuuua

SEQ ID NO: 1357562 - RNA, 23 nt, Human
aacacagcaguuuagaagauaaa

SEQ ID NO: 1357563 - RNA, 22 nt, Human
aacuaauuucacaaacaaccuu

SEQ ID NO: 1357564 - RNA, 23 nt, Human
acuccugagauucuaaaaaggga

SEQ ID NO: 1357565 - RNA, 23 nt, Human
agacaucugaaacuauuaggcac

SEQ ID NO: 1357566 - RNA, 22 nt, Human
auagaacgcauauuuacuaaca

SEQ ID NO: 1357567 - RNA, 19 nt, Human
cauaucuucaguuacaacc

SEQ ID NO: 1357568 - RNA, 18 nt, Human
cuuucaacacagcaguuu

SEQ ID NO: 1357569 - RNA, 21 nt, Human
gggguguuuuagguaauuuuu

SEQ ID NO: 1357570 - RNA, 20 nt, Human
uaaggcaucaaugauuaaaa

SEQ ID NO: 1357571 - RNA, 20 nt, Human
uaccccacuacuccugagau

SEQ ID NO: 1357572 - RNA, 22 nt, Human
uagaugauucuaagaacagcac

SEQ ID NO: 1357573 - RNA, 19 nt, Human
uaguaaauauucaaacaua

SEQ ID NO: 1357574 - RNA, 24 nt, Human
uauaaaaaacuaagacaucugaaa

SEQ ID NO: 1357575 - RNA, 18 nt, Human
uccaaaauaccuucugac

SEQ ID NO: 1357576 - RNA, 19 nt, Human
uccaaaauaccuucugacc

SEQ ID NO: 1357577 - RNA, 24 nt, Human
uccuaaaaaaaaaacauacaaacu

SEQ ID NO: 1357578 - RNA, 27 nt, Human
uccuccuuaauaugaaacucuuccaaa

SEQ ID NO: 1357579 - RNA, 24 nt, Human
ucuccuaaaaaaaaaacauacaaa

SEQ ID NO: 1357580 - RNA, 21 nt, Human
ucuuccaaaauaccuucugac

SEQ ID NO: 1357581 - RNA, 24 nt, Human
ugaagcaugaacccaggcugagaa

SEQ ID NO: 1357582 - RNA, 20 nt, Human
ugagguguauuaaugaugaa

SEQ ID NO: 1357583 - RNA, 18 nt, Human
ugcuguggagcgcaagug

SEQ ID NO: 1357584 - RNA, 18 nt, Human
uggcacauuauacauaug

SEQ ID NO: 1357585 - RNA, 19 nt, Human
uuagaaaagauguuuucuu

SEQ ID NO: 1357586 - RNA, 22 nt, Human
uuagaaaagauguuuucuuuug

SEQ ID NO: 1357587 - RNA, 18 nt, Human
uuuuaagaacuuaaaauu

SEQ ID NO: 1357588 - RNA, 19 nt, Human
aaaaacaccuaaugggcac

SEQ ID NO: 1357589 - RNA, 19 nt, Human
aaaaauaacugcuuugaac

SEQ ID NO: 1357590 - RNA, 19 nt, Human
aaaccuacacuuguacccc

SEQ ID NO: 1357591 - RNA, 24 nt, Human
aaaccuacacuuguaccccagaac

SEQ ID NO: 1357592 - RNA, 21 nt, Human
aaaccuccugacaacacagcc

SEQ ID NO: 1357593 - RNA, 25 nt, Human
aaagaaaccuccugacaacacagcc

SEQ ID NO: 1357594 - RNA, 23 nt, Human
aaauaaucuguacaacagaccuc

SEQ ID NO: 1357595 - RNA, 22 nt, Human
aacuaaagacaaaguucuacaa

SEQ ID NO: 1357596 - RNA, 19 nt, Human
aagaaaaggaaugagauga

SEQ ID NO: 1357597 - RNA, 19 nt, Human
aagaaagggaggaaagaga

SEQ ID NO: 1357598 - RNA, 20 nt, Human
aagcucccacaggccugagc

SEQ ID NO: 1357599 - RNA, 19 nt, Human
aaugaugaaaacacacgga

SEQ ID NO: 1357600 - RNA, 23 nt, Human
acaccacuauaacccuuuauagc

SEQ ID NO: 1357601 - RNA, 20 nt, Human
accugggcuaugaaauaauc

SEQ ID NO: 1357602 - RNA, 18 nt, Human
acuaaagacaaaguucua

SEQ ID NO: 1357603 - RNA, 26 nt, Human
acucagcagugagcaacacuuauuuu

SEQ ID NO: 1357604 - RNA, 18 nt, Human
agaaagggaggaaagaga

SEQ ID NO: 1357605 - RNA, 23 nt, Human
agaagcucccacaggccugagca

SEQ ID NO: 1357606 - RNA, 24 nt, Human
agacagccaaguaaaaagggccga

SEQ ID NO: 1357607 - RNA, 22 nt, Human
agagacgggauuuccgccaugu

SEQ ID NO: 1357608 - RNA, 18 nt, Human
agccaagcagaacaccag

SEQ ID NO: 1357609 - RNA, 21 nt, Human
agccaagcagaacaccagaaa

SEQ ID NO: 1357610 - RNA, 22 nt, Human
agccuuguaagccaccagacug

SEQ ID NO: 1357611 - RNA, 18 nt, Human
agguauccaguaagaggc

SEQ ID NO: 1357612 - RNA, 20 nt, Human
aguggggaggagccuggccu

SEQ ID NO: 1357613 - RNA, 22 nt, Human
augaugaaaacacacggacacc

SEQ ID NO: 1357614 - RNA, 20 nt, Human
auggaguuggaagccauuau

SEQ ID NO: 1357615 - RNA, 18 nt, Human
caaaugcaaggacauuuu

SEQ ID NO: 1357616 - RNA, 22 nt, Human
caacaacacgcacuggggccuu

SEQ ID NO: 1357617 - RNA, 23 nt, Human
caauaaaaacacaacuauggaua

SEQ ID NO: 1357618 - RNA, 19 nt, Human
caaugagaugaccuuauuu

SEQ ID NO: 1357619 - RNA, 23 nt, Human
cacaauuccagaaaagacugccu

SEQ ID NO: 1357620 - RNA, 22 nt, Human
cacaggccugagcacugggagg

SEQ ID NO: 1357621 - RNA, 23 nt, Human
caccagaaagaacuaccuacgcc

SEQ ID NO: 1357622 - RNA, 27 nt, Human
cacccuucaaagugucugugagccuaa

SEQ ID NO: 1357623 - RNA, 22 nt, Human
cacgcuguuccccaacuucuga

SEQ ID NO: 1357624 - RNA, 18 nt, Human
cagaaagaacuaccuacg

SEQ ID NO: 1357625 - RNA, 22 nt, Human
cagaacaccagaaagaagggag

SEQ ID NO: 1357626 - RNA, 23 nt, Human
cagcauaguaaccuggaauucag

SEQ ID NO: 1357627 - RNA, 19 nt, Human
ccaccagacugacagaaag

SEQ ID NO: 1357628 - RNA, 22 nt, Human
ccaccggcaacaccagccccag

SEQ ID NO: 1357629 - RNA, 26 nt, Human
ccagaaagaacuaccuaacgggggcg

SEQ ID NO: 1357630 - RNA, 24 nt, Human
ccagaaagaacuaccuacgcccca

SEQ ID NO: 1357631 - RNA, 20 nt, Human
cccuguccuggucacccuuc

SEQ ID NO: 1357632 - RNA, 21 nt, Human
ccuacacuuguaccccagaac

SEQ ID NO: 1357633 - RNA, 22 nt, Human
ccuccguuacaaaaguuuaccu

SEQ ID NO: 1357634 - RNA, 23 nt, Human
ccuggcagaagcucccacaggcc

SEQ ID NO: 1357635 - RNA, 20 nt, Human
ccuucuuucccuuuucaucc

SEQ ID NO: 1357636 - RNA, 24 nt, Human
cgaacauacuauuaacaucacugu

SEQ ID NO: 1357637 - RNA, 24 nt, Human
cgccauguugcccacgcuguuccc

SEQ ID NO: 1357638 - RNA, 19 nt, Human
cgggacaauggcaaaagga

SEQ ID NO: 1357639 - RNA, 21 nt, Human
cgggacaauggcaaaaggaga

SEQ ID NO: 1357640 - RNA, 26 nt, Human
cuaaagacaaaguucuacaacaccac

SEQ ID NO: 1357641 - RNA, 20 nt, Human
cugaucccucugccuacucc

SEQ ID NO: 1357642 - RNA, 19 nt, Human
cuggggccuuuuggagggu

SEQ ID NO: 1357643 - RNA, 22 nt, Human
gaacuccuggauucaaauaccu

SEQ ID NO: 1357644 - RNA, 24 nt, Human
gaacugaucccucugccuacucca

SEQ ID NO: 1357645 - RNA, 18 nt, Human
gaagccuuguaagccacc

SEQ ID NO: 1357646 - RNA, 24 nt, Human
gacuuucauuuugugagucaagaa

SEQ ID NO: 1357647 - RNA, 19 nt, Human
gagcauggaaggagggaga

SEQ ID NO: 1357648 - RNA, 19 nt, Human
gaggagccuggccucuccu

SEQ ID NO: 1357649 - RNA, 23 nt, Human
gagggcucuaucuaaggaaaaug

SEQ ID NO: 1357650 - RNA, 21 nt, Human
gaguuucccaccaagacuacc

SEQ ID NO: 1357651 - RNA, 18 nt, Human
gcacuggggccuuuugga

SEQ ID NO: 1357652 - RNA, 20 nt, Human
ggaaggagggagaggaucag

SEQ ID NO: 1357653 - RNA, 18 nt, Human
ggaaugagaugagaagag

SEQ ID NO: 1357654 - RNA, 20 nt, Human
ggagacugagaaaaagaaac

SEQ ID NO: 1357655 - RNA, 22 nt, Human
gggagaggaucaguaaaaacac

SEQ ID NO: 1357656 - RNA, 20 nt, Human
ggugagaagacagacagaaa

SEQ ID NO: 1357657 - RNA, 20 nt, Human
guaaaaacaccuaaugggca

SEQ ID NO: 1357658 - RNA, 22 nt, Human
guccuucuuucccuuuucaucc

SEQ ID NO: 1357659 - RNA, 22 nt, Human
gugagccuaauuugucaugguu

SEQ ID NO: 1357660 - RNA, 24 nt, Human
guggggaggagccuggccucuccu

SEQ ID NO: 1357661 - RNA, 22 nt, Human
uaaaaagaguuucccaccaaga

SEQ ID NO: 1357662 - RNA, 19 nt, Human
uaaaaagggcucccuggca

SEQ ID NO: 1357663 - RNA, 18 nt, Human
uaaaauaaauguuagaaa

SEQ ID NO: 1357664 - RNA, 21 nt, Human
uaaaaugaauauaauaacuuu

SEQ ID NO: 1357665 - RNA, 22 nt, Human
uaaaaugaauauaauaacuuug

SEQ ID NO: 1357666 - RNA, 21 nt, Human
uaacaggcuucaucgcuaguc

SEQ ID NO: 1357667 - RNA, 23 nt, Human
uaaggccagccguggcuacauaa

SEQ ID NO: 1357668 - RNA, 19 nt, Human
uaccuaaaaagaguuuccc

SEQ ID NO: 1357669 - RNA, 19 nt, Human
uaccugggcuaugaaauaa

SEQ ID NO: 1357670 - RNA, 19 nt, Human
uagaaaaagaaaaggaaug

SEQ ID NO: 1357671 - RNA, 19 nt, Human
uagccauaguuuugccucu

SEQ ID NO: 1357672 - RNA, 20 nt, Human
uauacuauaaaugaaauggg

SEQ ID NO: 1357673 - RNA, 24 nt, Human
ucaaauaccugauaauuaaaggau

SEQ ID NO: 1357674 - RNA, 24 nt, Human
ucagaguugagauuuuaagauagu

SEQ ID NO: 1357675 - RNA, 27 nt, Human
ucauccaauaaacccuguccuggucac

SEQ ID NO: 1357676 - RNA, 22 nt, Human
ucccucugccuacuccaaacag

SEQ ID NO: 1357677 - RNA, 18 nt, Human
ucccuggcagaagcuccc

SEQ ID NO: 1357678 - RNA, 21 nt, Human
ugacaacacagccaagcagaa

SEQ ID NO: 1357679 - RNA, 18 nt, Human
ugagaaaaagaaaccucc

SEQ ID NO: 1357680 - RNA, 19 nt, Human
ugagaaaaagaaaccuccu

SEQ ID NO: 1357681 - RNA, 18 nt, Human
ugagaagacagacagaaa

SEQ ID NO: 1357682 - RNA, 20 nt, Human
ugagaagagagaaaaucaga

SEQ ID NO: 1357683 - RNA, 23 nt, Human
ugagaagagagaaaaucagaguu

SEQ ID NO: 1357684 - RNA, 23 nt, Human
ugagaugagaagagagaaaauca

SEQ ID NO: 1357685 - RNA, 21 nt, Human
ugagcaaacuaacaugaaaua

SEQ ID NO: 1357686 - RNA, 24 nt, Human
ugagccuaauuugucaugguugug

SEQ ID NO: 1357687 - RNA, 19 nt, Human
ugauauuuuggcaguuacu

SEQ ID NO: 1357688 - RNA, 18 nt, Human
ugcaaggacauuuuucua

SEQ ID NO: 1357689 - RNA, 25 nt, Human
ugcaaggacauuuuucuagaugcag

SEQ ID NO: 1357690 - RNA, 21 nt, Human
uggaaggagggagaggaucag

SEQ ID NO: 1357691 - RNA, 24 nt, Human
uggaggguggagcauggaaggagg

SEQ ID NO: 1357692 - RNA, 22 nt, Human
uggcagaagcucccacaggccu

SEQ ID NO: 1357693 - RNA, 25 nt, Human
ugggaggaaugcgcacuggggugga

SEQ ID NO: 1357694 - RNA, 23 nt, Human
ugggcacgaggcuuaauaccugg

SEQ ID NO: 1357695 - RNA, 28 nt, Human
ugggguggagccucaggaaguucacgcc

SEQ ID NO: 1357696 - RNA, 23 nt, Human
ugucugugagccuaauuugucau

SEQ ID NO: 1357697 - RNA, 19 nt, Human
ugugcuaucaaaugcaagg

SEQ ID NO: 1357698 - RNA, 23 nt, Human
uguugcagcauaguaaccuggaa

SEQ ID NO: 1357699 - RNA, 19 nt, Human
uuaaaauaaauguuagaaa

SEQ ID NO: 1357700 - RNA, 22 nt, Human
uuaggccaauaaaaaagaacga

SEQ ID NO: 1357701 - RNA, 26 nt, Human
uuccacuaauauuaauuucaagaauc

SEQ ID NO: 1357702 - RNA, 20 nt, Human
uugugaacugaucccucugc

SEQ ID NO: 1357703 - RNA, 20 nt, Human
uuuaaaaugaauauaauaac

SEQ ID NO: 1357704 - RNA, 23 nt, Human
uuugaaaucuguuuuugcugcuu

SEQ ID NO: 1357705 - RNA, 22 nt, Human
aaaaaagggaaagaaacugaca

SEQ ID NO: 1357706 - RNA, 21 nt, Human
aaaacaaacacaugaagcauu

SEQ ID NO: 1357707 - RNA, 24 nt, Human
aaacaaacacaugaagcauuaaga

SEQ ID NO: 1357708 - RNA, 23 nt, Human
aaagaaagcaguugacugugagc

SEQ ID NO: 1357709 - RNA, 21 nt, Human
aacaaaacaaaucuaagagga

SEQ ID NO: 1357710 - RNA, 24 nt, Human
aacaauauccaucccuaaagcaag

SEQ ID NO: 1357711 - RNA, 24 nt, Human
aagaaugaacagagaccuauuagc

SEQ ID NO: 1357712 - RNA, 23 nt, Human
aagccauaaaauauucaagagac

SEQ ID NO: 1357713 - RNA, 20 nt, Human
acaaaacaaaucuaagagga

SEQ ID NO: 1357714 - RNA, 26 nt, Human
acaaacuuuauaaaacuggaccaaaa

SEQ ID NO: 1357715 - RNA, 23 nt, Human
acaacaauauccaucccuaaagc

SEQ ID NO: 1357716 - RNA, 22 nt, Human
acacagauguccuugggacuuu

SEQ ID NO: 1357717 - RNA, 19 nt, Human
acacucauaacccacagca

SEQ ID NO: 1357718 - RNA, 20 nt, Human
accauccaauuaaugcucau

SEQ ID NO: 1357719 - RNA, 19 nt, Human
acccagaaccaccagagaa

SEQ ID NO: 1357720 - RNA, 19 nt, Human
acucuuguccaguucuuga

SEQ ID NO: 1357721 - RNA, 23 nt, Human
acuuaaguuucaagaauugaaga

SEQ ID NO: 1357722 - RNA, 19 nt, Human
agagacaaugaagguagcc

SEQ ID NO: 1357723 - RNA, 21 nt, Human
agcaauuagcaaagaccuaca

SEQ ID NO: 1357724 - RNA, 23 nt, Human
agccaagaaugaacagagaccua

SEQ ID NO: 1357725 - RNA, 19 nt, Human
aguugacugugagcacuug

SEQ ID NO: 1357726 - RNA, 22 nt, Human
aucaugguuagaggccaaguga

SEQ ID NO: 1357727 - RNA, 21 nt, Human
auccugcuucacuaguucuuu

SEQ ID NO: 1357728 - RNA, 21 nt, Human
caaaaagccccauuccugaua

SEQ ID NO: 1357729 - RNA, 27 nt, Human
caaaacaaacacaugaagcauuaagac

SEQ ID NO: 1357730 - RNA, 22 nt, Human
caaaaugucuccaaaaagcccc

SEQ ID NO: 1357731 - RNA, 20 nt, Human
caaauaaacaaaacaaaucu

SEQ ID NO: 1357732 - RNA, 20 nt, Human
caagaaugaacagagaccua

SEQ ID NO: 1357733 - RNA, 24 nt, Human
caagagacaaugaagguagcaaga

SEQ ID NO: 1357734 - RNA, 21 nt, Human
cacugcccucuugugggggag

SEQ ID NO: 1357735 - RNA, 21 nt, Human
cagaagacauaucaaaacaaa

SEQ ID NO: 1357736 - RNA, 20 nt, Human
cagaauaaaaucagaaaguc

SEQ ID NO: 1357737 - RNA, 20 nt, Human
cagcauuccccaugugccuc

SEQ ID NO: 1357738 - RNA, 18 nt, Human
cagccuccaaagggaaaa

SEQ ID NO: 1357739 - RNA, 21 nt, Human
cauuucuuucuguuuugucug

SEQ ID NO: 1357740 - RNA, 18 nt, Human
ccaaaguacuauuuacaa

SEQ ID NO: 1357741 - RNA, 21 nt, Human
ccagaagacauaucaaaacaa

SEQ ID NO: 1357742 - RNA, 23 nt, Human
cccacagcacugucucaccaaac

SEQ ID NO: 1357743 - RNA, 19 nt, Human
ccuccuuuucuucucccca

SEQ ID NO: 1357744 - RNA, 23 nt, Human
ccuuccuuccuugcucauugucc

SEQ ID NO: 1357745 - RNA, 23 nt, Human
cuaaagaaagcaguugacuguga

SEQ ID NO: 1357746 - RNA, 22 nt, Human
cuaccuauuauuccaauugugc

SEQ ID NO: 1357747 - RNA, 22 nt, Human
cuauaucugcagauuuaaaacc

SEQ ID NO: 1357748 - RNA, 25 nt, Human
cucccucacuccaucaauaacauuc

SEQ ID NO: 1357749 - RNA, 20 nt, Human
cucuuagaaggcagcaguuc

SEQ ID NO: 1357750 - RNA, 22 nt, Human
cuuucccucuaccuauuauucc

SEQ ID NO: 1357751 - RNA, 19 nt, Human
gaaauaaagccaagaauga

SEQ ID NO: 1357752 - RNA, 24 nt, Human
gaacagagaccuauuagcaaagaa

SEQ ID NO: 1357753 - RNA, 21 nt, Human
gacaaugaagguagcaagaga

SEQ ID NO: 1357754 - RNA, 22 nt, Human
gauaaauuuccuguagcuuucu

SEQ ID NO: 1357755 - RNA, 25 nt, Human
gccuuccuuccuugcucauuguccu

SEQ ID NO: 1357756 - RNA, 25 nt, Human
gcucauuguccucuucucuuuggcu

SEQ ID NO: 1357757 - RNA, 22 nt, Human
ggaacugagacaugaaugaugg

SEQ ID NO: 1357758 - RNA, 18 nt, Human
ggcaugggguggggaaag

SEQ ID NO: 1357759 - RNA, 22 nt, Human
ggccagaagacauaucaaaaca

SEQ ID NO: 1357760 - RNA, 21 nt, Human
gggacuuucacaauuugaagu

SEQ ID NO: 1357761 - RNA, 20 nt, Human
guagaaccagaauaaaauca

SEQ ID NO: 1357762 - RNA, 22 nt, Human
guagcuuucuuucuauuuuucu

SEQ ID NO: 1357763 - RNA, 19 nt, Human
guccucuucucuuuggcuc

SEQ ID NO: 1357764 - RNA, 23 nt, Human
uaaagccaagaaugaacagagac

SEQ ID NO: 1357765 - RNA, 21 nt, Human
uaaauaucuugauacauacca

SEQ ID NO: 1357766 - RNA, 25 nt, Human
uacagaaugcagcaaucaugguuag

SEQ ID NO: 1357767 - RNA, 24 nt, Human
uacauaccaaugguacccagaacu

SEQ ID NO: 1357768 - RNA, 20 nt, Human
uacccagaaccaccagagaa

SEQ ID NO: 1357769 - RNA, 21 nt, Human
uacccagaaccaccagagaau

SEQ ID NO: 1357770 - RNA, 18 nt, Human
uaccuuaauuccuccaaa

SEQ ID NO: 1357771 - RNA, 25 nt, Human
uacguuuaucuucaccacauagaaa

SEQ ID NO: 1357772 - RNA, 23 nt, Human
uagaaccagaauaaaaucagaaa

SEQ ID NO: 1357773 - RNA, 21 nt, Human
uagagacauuucuuucuguuu

SEQ ID NO: 1357774 - RNA, 23 nt, Human
uagagacauuucuuucuguuuug

SEQ ID NO: 1357775 - RNA, 19 nt, Human
uagaggccaagugaaguag

SEQ ID NO: 1357776 - RNA, 24 nt, Human
uagaguacagcaaguaagauacua

SEQ ID NO: 1357777 - RNA, 22 nt, Human
uagccuaggacaaacuuaaguu

SEQ ID NO: 1357778 - RNA, 23 nt, Human
uaggaaagagcacaguuguccuu

SEQ ID NO: 1357779 - RNA, 22 nt, Human
uagguaccuccacuggagccuu

SEQ ID NO: 1357780 - RNA, 23 nt, Human
uauaucugcagauuuaaaaccuc

SEQ ID NO: 1357781 - RNA, 22 nt, Human
uaucaguaaacaaauuuuccaa

SEQ ID NO: 1357782 - RNA, 23 nt, Human
uauuauuccaauugugcaucaca

SEQ ID NO: 1357783 - RNA, 20 nt, Human
uauuccaauugugcaucacu

SEQ ID NO: 1357784 - RNA, 22 nt, Human
ucaaaaaguaauuguaaaagca

SEQ ID NO: 1357785 - RNA, 18 nt, Human
ucacuaguucuuucccuc

SEQ ID NO: 1357786 - RNA, 28 nt, Human
ucaguguucucucugcucccugucuucu

SEQ ID NO: 1357787 - RNA, 19 nt, Human
uccaaaaagccccauuccu

SEQ ID NO: 1357788 - RNA, 23 nt, Human
uccaaaaugucuccaaaaagccc

SEQ ID NO: 1357789 - RNA, 25 nt, Human
uccaaaaugucuccaaaaagcccca

SEQ ID NO: 1357790 - RNA, 22 nt, Human
ucuauguaccccacauucuaaa

SEQ ID NO: 1357791 - RNA, 23 nt, Human
ucuauguaccccacauucuaaag

SEQ ID NO: 1357792 - RNA, 24 nt, Human
ucuuuguagaaccagaauaaaauc

SEQ ID NO: 1357793 - RNA, 20 nt, Human
ugaaauuaucaggcuauguu

SEQ ID NO: 1357794 - RNA, 22 nt, Human
ugaaguagcagccuccaaaggg

SEQ ID NO: 1357795 - RNA, 22 nt, Human
ugaaguccaaaaugucuccaaa

SEQ ID NO: 1357796 - RNA, 18 nt, Human
ugauuccaggucucuccu

SEQ ID NO: 1357797 - RNA, 20 nt, Human
ugccucuguaccuuaauucu

SEQ ID NO: 1357798 - RNA, 23 nt, Human
uggaauaacaaagagaauuagag

SEQ ID NO: 1357799 - RNA, 23 nt, Human
uggaccaaaaaagggaaagaaac

SEQ ID NO: 1357800 - RNA, 18 nt, Human
ugggggagggcauggggu

SEQ ID NO: 1357801 - RNA, 24 nt, Human
uguccaaugguaagccauaaaaua

SEQ ID NO: 1357802 - RNA, 26 nt, Human
uguuuugucugccuuccuuccuugcu

SEQ ID NO: 1357803 - RNA, 18 nt, Human
uuagaaauaaagccaaga

SEQ ID NO: 1357804 - RNA, 20 nt, Human
uuagcaaagaaaaaaucaug

SEQ ID NO: 1357805 - RNA, 22 nt, Human
uugacugugagcacuuggauuc

SEQ ID NO: 1357806 - RNA, 19 nt, Human
uugugggggagggcauggg

SEQ ID NO: 1357807 - RNA, 21 nt, Human
uuuccuguagcuuucuuucua

SEQ ID NO: 1357808 - RNA, 22 nt, Human
uuuguagaaccagaauaaaauc

SEQ ID NO: 1357809 - RNA, 20 nt, Human
aaacaaacagaaacauggga

SEQ ID NO: 1357810 - RNA, 22 nt, Human
aaacaaacagaaacaugggaca

SEQ ID NO: 1357811 - RNA, 19 nt, Human
aaacagguuucauucugca

SEQ ID NO: 1357812 - RNA, 22 nt, Human
aaacauauacgacugucccucc

SEQ ID NO: 1357813 - RNA, 20 nt, Human
aaagacccagcagcaggagg

SEQ ID NO: 1357814 - RNA, 23 nt, Human
aacuaaaaucccggagaagccca

SEQ ID NO: 1357815 - RNA, 18 nt, Human
aagcugcauucuaccucc

SEQ ID NO: 1357816 - RNA, 18 nt, Human
aaggaccagccccugaag

SEQ ID NO: 1357817 - RNA, 20 nt, Human
aaggaggggucugggcggua

SEQ ID NO: 1357818 - RNA, 24 nt, Human
acauccagcaggagugaccaugcc

SEQ ID NO: 1357819 - RNA, 23 nt, Human
agaaugggagggaaaggaagggc

SEQ ID NO: 1357820 - RNA, 21 nt, Human
agcaacaccuuuauuacuagc

SEQ ID NO: 1357821 - RNA, 23 nt, Human
agccaucucaggauuaaagaccc

SEQ ID NO: 1357822 - RNA, 24 nt, Human
aggaaguccgugcacaggcagauc

SEQ ID NO: 1357823 - RNA, 21 nt, Human
agggggccauggagaaggacc

SEQ ID NO: 1357824 - RNA, 18 nt, Human
aucagacacuugaucuca

SEQ ID NO: 1357825 - RNA, 22 nt, Human
caaaaggcucacugccccaaca

SEQ ID NO: 1357826 - RNA, 20 nt, Human
caaacagaaacaugggacaa

SEQ ID NO: 1357827 - RNA, 20 nt, Human
caaagcaggaucccucccuu

SEQ ID NO: 1357828 - RNA, 24 nt, Human
caacaacuucuauggcuccccaga

SEQ ID NO: 1357829 - RNA, 23 nt, Human
caagaccccugaacacacuagcu

SEQ ID NO: 1357830 - RNA, 22 nt, Human
cacaggcagaucugcuggugcc

SEQ ID NO: 1357831 - RNA, 21 nt, Human
caccaaacagucagcagugcu

SEQ ID NO: 1357832 - RNA, 21 nt, Human
caccagagguuggacagcgcc

SEQ ID NO: 1357833 - RNA, 24 nt, Human
caccaugucccuggauggagagac

SEQ ID NO: 1357834 - RNA, 20 nt, Human
cagcaacaccuuuauuacua

SEQ ID NO: 1357835 - RNA, 19 nt, Human
cagcagugcuucuggauga

SEQ ID NO: 1357836 - RNA, 20 nt, Human
cagccccugaagccaucuca

SEQ ID NO: 1357837 - RNA, 19 nt, Human
caggaucccucccuuguca

SEQ ID NO: 1357838 - RNA, 20 nt, Human
caggcagaucugcuggugcc

SEQ ID NO: 1357839 - RNA, 22 nt, Human
caucaccaacugccgcucacag

SEQ ID NO: 1357840 - RNA, 18 nt, Human
caugcccagccccacacc

SEQ ID NO: 1357841 - RNA, 20 nt, Human
cauuuauauguucuugucug

SEQ ID NO: 1357842 - RNA, 22 nt, Human
ccagacauccagcaggagugac

SEQ ID NO: 1357843 - RNA, 19 nt, Human
ccagugucuaggugucuuc

SEQ ID NO: 1357844 - RNA, 21 nt, Human
ccauggagaaggaccagcccc

SEQ ID NO: 1357845 - RNA, 18 nt, Human
cccacaccugaaauggga

SEQ ID NO: 1357846 - RNA, 22 nt, Human
ccccaacagcaaccaccaaaca

SEQ ID NO: 1357847 - RNA, 19 nt, Human
ccccacaagcucccucccu

SEQ ID NO: 1357848 - RNA, 23 nt, Human
ccccagagcucuccagaucaagu

SEQ ID NO: 1357849 - RNA, 21 nt, Human
ccccugaacacacuagcucug

SEQ ID NO: 1357850 - RNA, 21 nt, Human
ccugaagaccuuucaucaaag

SEQ ID NO: 1357851 - RNA, 19 nt, Human
ccugcagucaggcuguugg

SEQ ID NO: 1357852 - RNA, 21 nt, Human
ccugcagucaggcuguugggc

SEQ ID NO: 1357853 - RNA, 20 nt, Human
ccugcucuggaugagggugg

SEQ ID NO: 1357854 - RNA, 24 nt, Human
ccuggcucuuguucacuccuucca

SEQ ID NO: 1357855 - RNA, 18 nt, Human
ccuugcacugaggcccuc

SEQ ID NO: 1357856 - RNA, 24 nt, Human
cucacugccccaacagcaaccacc

SEQ ID NO: 1357857 - RNA, 21 nt, Human
cucagaauggacaaaaggcuc

SEQ ID NO: 1357858 - RNA, 20 nt, Human
cucauggcccgaguucccaa

SEQ ID NO: 1357859 - RNA, 21 nt, Human
cuccagcuggagaccugggcu

SEQ ID NO: 1357860 - RNA, 25 nt, Human
cuccugaacuaaaaucccggagaag

SEQ ID NO: 1357861 - RNA, 26 nt, Human
cuccuggcucuuguucacuccuucca

SEQ ID NO: 1357862 - RNA, 23 nt, Human
cugaacuaaaaucccggagaagc

SEQ ID NO: 1357863 - RNA, 24 nt, Human
cuggaggcaagaccccugaacaca

SEQ ID NO: 1357864 - RNA, 19 nt, Human
cugguauuucccuaggucc

SEQ ID NO: 1357865 - RNA, 19 nt, Human
cuucucauuuucauccugg

SEQ ID NO: 1357866 - RNA, 23 nt, Human
gaacacacuagcucugaggacac

SEQ ID NO: 1357867 - RNA, 19 nt, Human
gaggagaaaccagcccaau

SEQ ID NO: 1357868 - RNA, 23 nt, Human
gaggggucugggcgguagagcuu

SEQ ID NO: 1357869 - RNA, 19 nt, Human
gaucaugggacugggaagg

SEQ ID NO: 1357870 - RNA, 21 nt, Human
gcaggguugacauucccucca

SEQ ID NO: 1357871 - RNA, 24 nt, Human
gcccaaacaaacagaaacauggga

SEQ ID NO: 1357872 - RNA, 24 nt, Human
gcgaucaugggacugggaaggagg

SEQ ID NO: 1357873 - RNA, 24 nt, Human
ggacugggaaggaggggucugggc

SEQ ID NO: 1357874 - RNA, 23 nt, Human
ggagaaaccagcccaaucucaga

SEQ ID NO: 1357875 - RNA, 24 nt, Human
ggagggaaaggaagggcagaaugg

SEQ ID NO: 1357876 - RNA, 18 nt, Human
ggcuggggcgaucauggg

SEQ ID NO: 1357877 - RNA, 23 nt, Human
ggguuugcaaaauggcugagaua

SEQ ID NO: 1357878 - RNA, 24 nt, Human
guccuucaugcuuccuuccucagu

SEQ ID NO: 1357879 - RNA, 18 nt, Human
guccuugguuuucaccuu

SEQ ID NO: 1357880 - RNA, 22 nt, Human
uaaagacccagcagcaggaggg

SEQ ID NO: 1357881 - RNA, 21 nt, Human
uaaccugagacauucccugaa

SEQ ID NO: 1357882 - RNA, 20 nt, Human
uagcaucugugccuaggaug

SEQ ID NO: 1357883 - RNA, 22 nt, Human
uaggcccugcagaagcaucucc

SEQ ID NO: 1357884 - RNA, 18 nt, Human
uaggugucuucugagguu

SEQ ID NO: 1357885 - RNA, 19 nt, Human
uaggugucuucugagguug

SEQ ID NO: 1357886 - RNA, 23 nt, Human
uauccugaguggcaggcuugggu

SEQ ID NO: 1357887 - RNA, 24 nt, Human
uauuacuagcaaaacccugcagag

SEQ ID NO: 1357888 - RNA, 21 nt, Human
ucacugccccaacagcaacca

SEQ ID NO: 1357889 - RNA, 20 nt, Human
ucagaaugggagggaaagga

SEQ ID NO: 1357890 - RNA, 21 nt, Human
ucauucugcagaaagcuccuu

SEQ ID NO: 1357891 - RNA, 23 nt, Human
uccacaccaggacaacgauuggc

SEQ ID NO: 1357892 - RNA, 18 nt, Human
uccagaccugccccacaa

SEQ ID NO: 1357893 - RNA, 28 nt, Human
uccagcaggagugaccaugcccagcccu

SEQ ID NO: 1357894 - RNA, 21 nt, Human
uccaguagaggccacuggcug

SEQ ID NO: 1357895 - RNA, 19 nt, Human
ucccacaguaguccacacc

SEQ ID NO: 1357896 - RNA, 21 nt, Human
ucccagccagaaacucaggac

SEQ ID NO: 1357897 - RNA, 22 nt, Human
ucccuggauggagagaccccua

SEQ ID NO: 1357898 - RNA, 18 nt, Human
ucccuggucuccuggcuc

SEQ ID NO: 1357899 - RNA, 22 nt, Human
ucccuuguacagcagcugaaac

SEQ ID NO: 1357900 - RNA, 19 nt, Human
uccugcucuggaugagggu

SEQ ID NO: 1357901 - RNA, 22 nt, Human
uccugcucuggaugagggugga

SEQ ID NO: 1357902 - RNA, 18 nt, Human
uccuuguuuggcuuauuu

SEQ ID NO: 1357903 - RNA, 20 nt, Human
ucucaagcugcauucuaccu

SEQ ID NO: 1357904 - RNA, 20 nt, Human
ucucaggauuaaagacccag

SEQ ID NO: 1357905 - RNA, 30 nt, Human
ucugacaacuccuucucauuuucauccuuu

SEQ ID NO: 1357906 - RNA, 22 nt, Human
ucugcuggugccauuacacuaa

SEQ ID NO: 1357907 - RNA, 19 nt, Human
ucuggaugaggguggaaag

SEQ ID NO: 1357908 - RNA, 21 nt, Human
ugagauauguggagggggcca

SEQ ID NO: 1357909 - RNA, 24 nt, Human
ugaggaagucaucaacaccccggc

SEQ ID NO: 1357910 - RNA, 20 nt, Human
ugagggugaggugcugcucc

SEQ ID NO: 1357911 - RNA, 19 nt, Human
ugagguaguacaggaaguc

SEQ ID NO: 1357912 - RNA, 21 nt, Human
ugaggugcugcuccaggauga

SEQ ID NO: 1357913 - RNA, 20 nt, Human
ugauguaggguccauccacc

SEQ ID NO: 1357914 - RNA, 21 nt, Human
ugcaccacgugguggcagcac

SEQ ID NO: 1357915 - RNA, 19 nt, Human
ugcccaaacaaacagaaac

SEQ ID NO: 1357916 - RNA, 19 nt, Human
ugcccaaacaaacagaaac

SEQ ID NO: 1357917 - RNA, 28 nt, Human
ugcccagccccacaccugaaaugggacu

SEQ ID NO: 1357918 - RNA, 18 nt, Human
ugcgauaaggauguuucc

SEQ ID NO: 1357919 - RNA, 20 nt, Human
uggaaaggcuguaccuggua

SEQ ID NO: 1357920 - RNA, 24 nt, Human
uggagaccugggcuccugauacca

SEQ ID NO: 1357921 - RNA, 20 nt, Human
uggagggggccauggagaag

SEQ ID NO: 1357922 - RNA, 21 nt, Human
uggaugaggguggaaaggcug

SEQ ID NO: 1357923 - RNA, 19 nt, Human
uggcucuuguucacuccuu

SEQ ID NO: 1357924 - RNA, 19 nt, Human
uggcuuauuuuugaagcca

SEQ ID NO: 1357925 - RNA, 20 nt, Human
ugggagggaaaggaagggca

SEQ ID NO: 1357926 - RNA, 18 nt, Human
uggucaggaaggaugcuu

SEQ ID NO: 1357927 - RNA, 18 nt, Human
ugucaucuccagaccugc

SEQ ID NO: 1357928 - RNA, 20 nt, Human
ugucaucuccagaccugccc

SEQ ID NO: 1357929 - RNA, 22 nt, Human
uguggagggggccauggagaag

SEQ ID NO: 1357930 - RNA, 21 nt, Human
uguuucauucugaccaggguu

SEQ ID NO: 1357931 - RNA, 18 nt, Human
uuccaggcagccuuccac

SEQ ID NO: 1357932 - RNA, 22 nt, Human
uucccuagguccuugguuuuca

SEQ ID NO: 1357933 - RNA, 24 nt, Human
uucccuagguccuugguuuucacc

SEQ ID NO: 1357934 - RNA, 21 nt, Human
uuccugcagucaggcuguugg

SEQ ID NO: 1357935 - RNA, 20 nt, Human
uucuaccuccugaacuaaaa

SEQ ID NO: 1357936 - RNA, 21 nt, Human
uucucauuuucauccuggagg

SEQ ID NO: 1357937 - RNA, 21 nt, Human
uugaucucaagcugcauucua

SEQ ID NO: 1357938 - RNA, 22 nt, Human
acauuuauuaaggcaaaggcca

SEQ ID NO: 1357939 - RNA, 26 nt, Human
aggugaccuggaaggccuucggccuc

SEQ ID NO: 1357940 - RNA, 26 nt, Human
caagaccccagcucggucccgggugc

SEQ ID NO: 1357941 - RNA, 20 nt, Human
cagaacauggccaaggagcg

SEQ ID NO: 1357942 - RNA, 19 nt, Human
ccagcagaagcuaugaagc

SEQ ID NO: 1357943 - RNA, 18 nt, Human
ccagggccgccccauugg

SEQ ID NO: 1357944 - RNA, 21 nt, Human
ccccagggguccuggguccac

SEQ ID NO: 1357945 - RNA, 24 nt, Human
ccgcucagaacauggccaaggagc

SEQ ID NO: 1357946 - RNA, 23 nt, Human
ccuccaagaccccagcucggucc

SEQ ID NO: 1357947 - RNA, 21 nt, Human
ccuggguccaccccaggccag

SEQ ID NO: 1357948 - RNA, 21 nt, Human
cggucccgggugccaccuccu

SEQ ID NO: 1357949 - RNA, 20 nt, Human
ggguccuggguccaccccag

SEQ ID NO: 1357950 - RNA, 25 nt, Human
uaaggcaaaggccaagcuggccgcu

SEQ ID NO: 1357951 - RNA, 25 nt, Human
uccaagaccccagcucggucccggg

SEQ ID NO: 1357952 - RNA, 22 nt, Human
ucucaggugaccuggaaggccu

SEQ ID NO: 1357953 - RNA, 21 nt, Human
ugaccuggaaggccuucggcc

SEQ ID NO: 1357954 - RNA, 20 nt, Human
ugccaccuccuccgcuucug

SEQ ID NO: 1357955 - RNA, 25 nt, Human
uuaccaccacucagggcacccaggc

SEQ ID NO: 1357956 - RNA, 20 nt, Human
uugcuccacuuuaccaccac

SEQ ID NO: 1357957 - RNA, 22 nt, Human
aaaaaagacauccaggacugua

SEQ ID NO: 1357958 - RNA, 26 nt, Human
aaacacaaaaaaggaaagacauccag

SEQ ID NO: 1357959 - RNA, 19 nt, Human
aaacauaugccucaacaca

SEQ ID NO: 1357960 - RNA, 25 nt, Human
aaagaaaacacaaaaaaggaaagac

SEQ ID NO: 1357961 - RNA, 22 nt, Human
aaagaaagcacaaaaaagacau

SEQ ID NO: 1357962 - RNA, 27 nt, Human
aaagacauccagguuuauggacugaaa

SEQ ID NO: 1357963 - RNA, 24 nt, Human
aaagugcugggauuacaggcguga

SEQ ID NO: 1357964 - RNA, 21 nt, Human
aaauucuuaaccaaacaguuu

SEQ ID NO: 1357965 - RNA, 20 nt, Human
aacacaaaaaaggaaagaca

SEQ ID NO: 1357966 - RNA, 18 nt, Human
aagaaaacacaaaaaagg

SEQ ID NO: 1357967 - RNA, 21 nt, Human
aagcacaaaaaagacauccag

SEQ ID NO: 1357968 - RNA, 21 nt, Human
aagccucuaaacaauuuagug

SEQ ID NO: 1357969 - RNA, 18 nt, Human
aagcugcaggauauaaaa

SEQ ID NO: 1357970 - RNA, 19 nt, Human
aagugcugggauuacaggc

SEQ ID NO: 1357971 - RNA, 19 nt, Human
aagugcugggauuacaggc

SEQ ID NO: 1357972 - RNA, 26 nt, Human
aagugcugggauuacaggcgugagcc

SEQ ID NO: 1357973 - RNA, 18 nt, Human
acgggguuucaccguguu

SEQ ID NO: 1357974 - RNA, 19 nt, Human
acgggguuucaccguguua

SEQ ID NO: 1357975 - RNA, 20 nt, Human
acgggguuucaccguguuag

SEQ ID NO: 1357976 - RNA, 24 nt, Human
acgggguuucaccguguuagccag

SEQ ID NO: 1357977 - RNA, 26 nt, Human
acuggagcaagaaaaggaggcccagu

SEQ ID NO: 1357978 - RNA, 22 nt, Human
agaaagaaauaaagggcaucug

SEQ ID NO: 1357979 - RNA, 19 nt, Human
agagacgggguuucaccgu

SEQ ID NO: 1357980 - RNA, 22 nt, Human
agcaagaaaaggaggcccacuu

SEQ ID NO: 1357981 - RNA, 23 nt, Human
aggugcugacagcgaggagaacc

SEQ ID NO: 1357982 - RNA, 22 nt, Human
aguacuauucauucccaggcac

SEQ ID NO: 1357983 - RNA, 20 nt, Human
aguagagacgggguuucacc

SEQ ID NO: 1357984 - RNA, 21 nt, Human
aguagagacgggguuucaccg

SEQ ID NO: 1357985 - RNA, 23 nt, Human
aguagagacgggguuucaccgug

SEQ ID NO: 1357986 - RNA, 24 nt, Human
aguagagacgggguuucaccgugu

SEQ ID NO: 1357987 - RNA, 21 nt, Human
agugcuguaauaaacaugggg

SEQ ID NO: 1357988 - RNA, 19 nt, Human
aguguuugcuuuuguuuag

SEQ ID NO: 1357989 - RNA, 23 nt, Human
auagugcuguaauaaacaugggg

SEQ ID NO: 1357990 - RNA, 21 nt, Human
auggacacuuauguugauucc

SEQ ID NO: 1357991 - RNA, 21 nt, Human
auugauuuucuuuccuuugga

SEQ ID NO: 1357992 - RNA, 22 nt, Human
caaaaaaggaaagacauccagg

SEQ ID NO: 1357993 - RNA, 24 nt, Human
caaagugcugggauuacaggcgug

SEQ ID NO: 1357994 - RNA, 19 nt, Human
caacaauguuuacuugcaa

SEQ ID NO: 1357995 - RNA, 19 nt, Human
caacauguugacaacuaac

SEQ ID NO: 1357996 - RNA, 21 nt, Human
cacaaaaaaggaaagacaucc

SEQ ID NO: 1357997 - RNA, 21 nt, Human
cacaaaagggcguaaagacac

SEQ ID NO: 1357998 - RNA, 22 nt, Human
cacauuuucuuuauccauucau

SEQ ID NO: 1357999 - RNA, 18 nt, Human
caccguguuagccaggau

SEQ ID NO: 1358000 - RNA, 24 nt, Human
caccguguuagccaggaugguguc

SEQ ID NO: 1358001 - RNA, 24 nt, Human
caggcgugagccaccgugccuggc

SEQ ID NO: 1358002 - RNA, 20 nt, Human
caucugaauuggaaaggaga

SEQ ID NO: 1358003 - RNA, 20 nt, Human
ccaaagugcugggauuacag

SEQ ID NO: 1358004 - RNA, 22 nt, Human
ccaaagugcugggauuacaggc

SEQ ID NO: 1358005 - RNA, 22 nt, Human
ccaaagugcugggauuacaggc

SEQ ID NO: 1358006 - RNA, 24 nt, Human
ccaaagugcugggauuacaggcgu

SEQ ID NO: 1358007 - RNA, 22 nt, Human
ccaccgugccuggccuguggug

SEQ ID NO: 1358008 - RNA, 23 nt, Human
ccaccgugccuggccuguggugu

SEQ ID NO: 1358009 - RNA, 24 nt, Human
cccuccaguugcauucauguugcc

SEQ ID NO: 1358010 - RNA, 24 nt, Human
ccuacagcuaagaucauacugaac

SEQ ID NO: 1358011 - RNA, 20 nt, Human
ccucgugauccgccugucuc

SEQ ID NO: 1358012 - RNA, 22 nt, Human
ccugucucggccucccaaagug

SEQ ID NO: 1358013 - RNA, 21 nt, Human
cgcucccaucaauagugucca

SEQ ID NO: 1358014 - RNA, 24 nt, Human
cgugagccaccgugccuggccugu

SEQ ID NO: 1358015 - RNA, 18 nt, Human
cuccagauggccagccgc

SEQ ID NO: 1358016 - RNA, 24 nt, Human
cuccuggccucgugauccgccugu

SEQ ID NO: 1358017 - RNA, 23 nt, Human
cugaucaacaguguuugcuuuug

SEQ ID NO: 1358018 - RNA, 19 nt, Human
cuggagcaagaaaaggagg

SEQ ID NO: 1358019 - RNA, 23 nt, Human
cugucucggccucccaaagugcu

SEQ ID NO: 1358020 - RNA, 23 nt, Human
gaaagcacaaaaaagacauccag

SEQ ID NO: 1358021 - RNA, 25 nt, Human
gaaauaaacuuaaccgaggaaguaa

SEQ ID NO: 1358022 - RNA, 24 nt, Human
gagacgggguuucaccguguuagc

SEQ ID NO: 1358023 - RNA, 18 nt, Human
gauuacaggcgugagcca

SEQ ID NO: 1358024 - RNA, 21 nt, Human
gauuacaggcgugagccaccg

SEQ ID NO: 1358025 - RNA, 24 nt, Human
gauuacaggcgugagccaccgugc

SEQ ID NO: 1358026 - RNA, 22 nt, Human
gccagccgcucccaucaauagu

SEQ ID NO: 1358027 - RNA, 23 nt, Human
ggaaagacauccagguuuaugga

SEQ ID NO: 1358028 - RNA, 21 nt, Human
ggcaauuagguuagagaaaga

SEQ ID NO: 1358029 - RNA, 24 nt, Human
ggccucgugauccgccugucucgg

SEQ ID NO: 1358030 - RNA, 20 nt, Human
gggggugcagguaaggcuuu

SEQ ID NO: 1358031 - RNA, 23 nt, Human
gggguuucaccguguuagccagg

SEQ ID NO: 1358032 - RNA, 22 nt, Human
ggguuucaccguguuagccagg

SEQ ID NO: 1358033 - RNA, 19 nt, Human
ggugucgaucuccuggccu

SEQ ID NO: 1358034 - RNA, 23 nt, Human
guagagacgggguuucaccgugu

SEQ ID NO: 1358035 - RNA, 22 nt, Human
guauuccauuauauauguaugu

SEQ ID NO: 1358036 - RNA, 23 nt, Human
gucacaauauagugugcucgacc

SEQ ID NO: 1358037 - RNA, 24 nt, Human
uaaaagcaccuuagcugcauauuc

SEQ ID NO: 1358038 - RNA, 20 nt, Human
uaaagacaacccuacagcua

SEQ ID NO: 1358039 - RNA, 33 nt, Human
uaaccaaacaguuuagacucuaguuuauauuuu

SEQ ID NO: 1358040 - RNA, 21 nt, Human
uaagaucauacugaacgugga

SEQ ID NO: 1358041 - RNA, 18 nt, Human
uaaggucucuaccuaaaa

SEQ ID NO: 1358042 - RNA, 24 nt, Human
uaauuaauauucuaaaaugacuca

SEQ ID NO: 1358043 - RNA, 22 nt, Human
uacaggcgugagccaccgugcc

SEQ ID NO: 1358044 - RNA, 23 nt, Human
uacaggcgugagccaccgugccu

SEQ ID NO: 1358045 - RNA, 23 nt, Human
uacucuagcaaugaaauucuuaa

SEQ ID NO: 1358046 - RNA, 18 nt, Human
uagagacgggguuucacc

SEQ ID NO: 1358047 - RNA, 21 nt, Human
uagauuuuuggaaauucaguu

SEQ ID NO: 1358048 - RNA, 24 nt, Human
uauccuacgugauuuacaaauuca

SEQ ID NO: 1358049 - RNA, 24 nt, Human
uauugugaauagugcuguaauaaa

SEQ ID NO: 1358050 - RNA, 22 nt, Human
ucaauuaucuuuagugcuuucu

SEQ ID NO: 1358051 - RNA, 22 nt, Human
ucaccguguuagccaggauggu

SEQ ID NO: 1358052 - RNA, 27 nt, Human
ucaccuaagauaaugcccuccaguugc

SEQ ID NO: 1358053 - RNA, 24 nt, Human
ucccaaagugcugggauuacaggc

SEQ ID NO: 1358054 - RNA, 20 nt, Human
ucccaggcacuuaaauucau

SEQ ID NO: 1358055 - RNA, 20 nt, Human
ucucggccucccaaagugcu

SEQ ID NO: 1358056 - RNA, 22 nt, Human
ucugagaagaaaagucaggaaa

SEQ ID NO: 1358057 - RNA, 24 nt, Human
ucuuggcuauugugaauagugcug

SEQ ID NO: 1358058 - RNA, 25 nt, Human
ugaaagcauuuggcaaaauuaaacg

SEQ ID NO: 1358059 - RNA, 19 nt, Human
ugagaacaaaauguuagau

SEQ ID NO: 1358060 - RNA, 26 nt, Human
ugccucaacacaaaagggcguaaagg

SEQ ID NO: 1358061 - RNA, 21 nt, Human
ugccuggauuuaaguguaaga

SEQ ID NO: 1358062 - RNA, 21 nt, Human
ugcugacagcgaggagaaccc

SEQ ID NO: 1358063 - RNA, 24 nt, Human
ugcugggauuacaggcgugagcca

SEQ ID NO: 1358064 - RNA, 18 nt, Human
uggaaaaggugaaaaaug

SEQ ID NO: 1358065 - RNA, 18 nt, Human
ugggauuacaggcgugag

SEQ ID NO: 1358066 - RNA, 21 nt, Human
ugggauuacaggcgugagcca

SEQ ID NO: 1358067 - RNA, 22 nt, Human
ugggauuacaggcgugagccac

SEQ ID NO: 1358068 - RNA, 23 nt, Human
ugggauuacaggcgugagccacc

SEQ ID NO: 1358069 - RNA, 23 nt, Human
ugggauuacaggcgugagccacc

SEQ ID NO: 1358070 - RNA, 24 nt, Human
ugggauuacaggcgugagccaccg

SEQ ID NO: 1358071 - RNA, 19 nt, Human
ugggggugcagguaaggcu

SEQ ID NO: 1358072 - RNA, 33 nt, Human
uguuaccaugaaaacuggagcaagaaaaggagg

SEQ ID NO: 1358073 - RNA, 21 nt, Human
uuauugagaacaaaauguuag

SEQ ID NO: 1358074 - RNA, 21 nt, Human
uuguauuuuuaaaagcaccuu

SEQ ID NO: 1358075 - RNA, 19 nt, Human
uuucaccguguuagccagg

SEQ ID NO: 1358076 - RNA, 22 nt, Human
aaacagaaguucagagagagcc

SEQ ID NO: 1358077 - RNA, 20 nt, Human
acccgaaggcucccccacuc

SEQ ID NO: 1358078 - RNA, 27 nt, Human
acccgaaggcucccccacuccccauga

SEQ ID NO: 1358079 - RNA, 19 nt, Human
agagccaugaaguuacaug

SEQ ID NO: 1358080 - RNA, 22 nt, Human
aggggaaggaggggggugggau

SEQ ID NO: 1358081 - RNA, 22 nt, Human
auaaagaaacagaaguucagag

SEQ ID NO: 1358082 - RNA, 18 nt, Human
cacacuggacaucuuugc

SEQ ID NO: 1358083 - RNA, 26 nt, Human
cauccuugcuccagcguacccaggag

SEQ ID NO: 1358084 - RNA, 21 nt, Human
ccagaguccucccuaaaggag

SEQ ID NO: 1358085 - RNA, 27 nt, Human
ccaucuuacagauaaagaaacagaagu

SEQ ID NO: 1358086 - RNA, 23 nt, Human
ccgguauuuggacaguuuuccuu

SEQ ID NO: 1358087 - RNA, 23 nt, Human
ccugcggugugggaaccagaggc

SEQ ID NO: 1358088 - RNA, 19 nt, Human
cgaaggcucccccacuccc

SEQ ID NO: 1358089 - RNA, 19 nt, Human
cgugcaaagucucagagcu

SEQ ID NO: 1358090 - RNA, 20 nt, Human
cucccccacuccccaugaga

SEQ ID NO: 1358091 - RNA, 24 nt, Human
gaaguuacaugagauccucuacuu

SEQ ID NO: 1358092 - RNA, 23 nt, Human
gacaucuuugcugucgaucaagg

SEQ ID NO: 1358093 - RNA, 26 nt, Human
gauaaagaaacagaaguucagagaga

SEQ ID NO: 1358094 - RNA, 20 nt, Human
gccguucugccacacccgaa

SEQ ID NO: 1358095 - RNA, 23 nt, Human
ggaggggggugggauggggaggg

SEQ ID NO: 1358096 - RNA, 24 nt, Human
ggaggggggugggauggggaggga

SEQ ID NO: 1358097 - RNA, 19 nt, Human
ggauggggagggagggcgc

SEQ ID NO: 1358098 - RNA, 18 nt, Human
ggggggugggauggggag

SEQ ID NO: 1358099 - RNA, 23 nt, Human
guauuuggacaguuuuccuugag

SEQ ID NO: 1358100 - RNA, 21 nt, Human
gugggauggggagggagggcg

SEQ ID NO: 1358101 - RNA, 19 nt, Human
uacccaggagucgagccgg

SEQ ID NO: 1358102 - RNA, 19 nt, Human
uacuucaggugaucccugc

SEQ ID NO: 1358103 - RNA, 22 nt, Human
uacuucaggugaucccugcggu

SEQ ID NO: 1358104 - RNA, 18 nt, Human
ucccacggagaauggggc

SEQ ID NO: 1358105 - RNA, 22 nt, Human
uccccaugagaaucuaucccac

SEQ ID NO: 1358106 - RNA, 20 nt, Human
ucccccacuccccaugagaa

SEQ ID NO: 1358107 - RNA, 21 nt, Human
ucccccacuccccaugagaau

SEQ ID NO: 1358108 - RNA, 24 nt, Human
uccuugcuccagcguacccaggag

SEQ ID NO: 1358109 - RNA, 24 nt, Human
ucgaggggaaggagggggguggga

SEQ ID NO: 1358110 - RNA, 21 nt, Human
ucugccacacccgaaggcucc

SEQ ID NO: 1358111 - RNA, 19 nt, Human
ugggauggggagggagggc

SEQ ID NO: 1358112 - RNA, 18 nt, Human
uucaggugaucccugcgg

SEQ ID NO: 1358113 - RNA, 23 nt, Human
uucugcucaccuuaugaauucca

SEQ ID NO: 1358114 - RNA, 22 nt, Human
aaacuucuggcagccccagccc

SEQ ID NO: 1358115 - RNA, 19 nt, Human
aagaagaaagcucaaaucu

SEQ ID NO: 1358116 - RNA, 20 nt, Human
aagcagcauaccuuuauaau

SEQ ID NO: 1358117 - RNA, 18 nt, Human
aaggaaaaacuucuggca

SEQ ID NO: 1358118 - RNA, 18 nt, Human
aagugcugaaaccuucuc

SEQ ID NO: 1358119 - RNA, 18 nt, Human
accccccgcgaggcgggg

SEQ ID NO: 1358120 - RNA, 18 nt, Human
accugaauauaaaggccc

SEQ ID NO: 1358121 - RNA, 22 nt, Human
agaaagcagguuauuugcaauc

SEQ ID NO: 1358122 - RNA, 23 nt, Human
agaagaaagcucaaaucuuccga

SEQ ID NO: 1358123 - RNA, 20 nt, Human
agagagaaaagauggcagcu

SEQ ID NO: 1358124 - RNA, 18 nt, Human
aggcaccccccacgagag

SEQ ID NO: 1358125 - RNA, 18 nt, Human
auccccucuuccccccug

SEQ ID NO: 1358126 - RNA, 21 nt, Human
cacccccgcgaggcagggacu

SEQ ID NO: 1358127 - RNA, 18 nt, Human
caccuggaggacuguggg

SEQ ID NO: 1358128 - RNA, 23 nt, Human
cacuggcgccuggaggacugugg

SEQ ID NO: 1358129 - RNA, 21 nt, Human
cagaaagaaagcagguuauuu

SEQ ID NO: 1358130 - RNA, 24 nt, Human
cagaggugggaggcaccccccucu

SEQ ID NO: 1358131 - RNA, 20 nt, Human
cagccccagcccuggggcua

SEQ ID NO: 1358132 - RNA, 20 nt, Human
cagccccagcccuggggcua

SEQ ID NO: 1358133 - RNA, 21 nt, Human
cagcucgggaacagaaagaaa

SEQ ID NO: 1358134 - RNA, 19 nt, Human
cagcuggacuuuuaaccca

SEQ ID NO: 1358135 - RNA, 23 nt, Human
cagcuggacuuuuaacccaaacu

SEQ ID NO: 1358136 - RNA, 18 nt, Human
ccaccuggaggacugugg

SEQ ID NO: 1358137 - RNA, 22 nt, Human
ccagccccugguucccccacug

SEQ ID NO: 1358138 - RNA, 19 nt, Human
cccagcccuggggcuaccc

SEQ ID NO: 1358139 - RNA, 23 nt, Human
ccccacuggcucuuaggaccccc

SEQ ID NO: 1358140 - RNA, 21 nt, Human
cccccacgagaguggggacug

SEQ ID NO: 1358141 - RNA, 19 nt, Human
cccccaucgcagagguggg

SEQ ID NO: 1358142 - RNA, 18 nt, Human
ccccccacgagagugggg

SEQ ID NO: 1358143 - RNA, 18 nt, Human
cccccccgaggcagagau

SEQ ID NO: 1358144 - RNA, 24 nt, Human
ccccccgaggcagagauugagagc

SEQ ID NO: 1358145 - RNA, 23 nt, Human
ccccccggguucuuaggaccccc

SEQ ID NO: 1358146 - RNA, 21 nt, Human
ccccccuggcucuggggaccc

SEQ ID NO: 1358147 - RNA, 23 nt, Human
cccccggguucuuaggaccccca

SEQ ID NO: 1358148 - RNA, 21 nt, Human
cccccuggcucuggggacccc

SEQ ID NO: 1358149 - RNA, 21 nt, Human
cccccuggcucuggggacccc

SEQ ID NO: 1358150 - RNA, 21 nt, Human
cccccuggcucuugggacucc

SEQ ID NO: 1358151 - RNA, 22 nt, Human
cccccuggcucuugggacuccc

SEQ ID NO: 1358152 - RNA, 19 nt, Human
ccccggguucuuaggaccc

SEQ ID NO: 1358153 - RNA, 22 nt, Human
ccccuggcucuggggaccccca

SEQ ID NO: 1358154 - RNA, 22 nt, Human
ccccuggcucuugggacuccca

SEQ ID NO: 1358155 - RNA, 24 nt, Human
ccccuggcugugaguacccccauc

SEQ ID NO: 1358156 - RNA, 25 nt, Human
cccgaggcagagauugagagccagc

SEQ ID NO: 1358157 - RNA, 21 nt, Human
cccuggcucuugggacuccca

SEQ ID NO: 1358158 - RNA, 24 nt, Human
cgggaacagaaagaaagcagguua

SEQ ID NO: 1358159 - RNA, 18 nt, Human
cuaagauccuuaggaccc

SEQ ID NO: 1358160 - RNA, 23 nt, Human
cuacccgaucugacaaagccuuu

SEQ ID NO: 1358161 - RNA, 24 nt, Human
cugagagccagucccucuuccccc

SEQ ID NO: 1358162 - RNA, 21 nt, Human
cugcaagcagcugggagcgcg

SEQ ID NO: 1358163 - RNA, 18 nt, Human
cuucucuuggcuuagcgc

SEQ ID NO: 1358164 - RNA, 25 nt, Human
gaaaaacuucuggcagccccagccc

SEQ ID NO: 1358165 - RNA, 23 nt, Human
gagaaaucuccaucacucuugcc

SEQ ID NO: 1358166 - RNA, 22 nt, Human
gcaggagggggaggcaacccca

SEQ ID NO: 1358167 - RNA, 25 nt, Human
gcugagauccauccccucuuccccc

SEQ ID NO: 1358168 - RNA, 18 nt, Human
gggcccuggcugaggccg

SEQ ID NO: 1358169 - RNA, 21 nt, Human
gggcggggacccggaaacuuu

SEQ ID NO: 1358170 - RNA, 22 nt, Human
gguaugagguguucaagaagaa

SEQ ID NO: 1358171 - RNA, 19 nt, Human
guccgaacgcagcucggga

SEQ ID NO: 1358172 - RNA, 26 nt, Human
gugucuugcaccugcugacaaccuca

SEQ ID NO: 1358173 - RNA, 21 nt, Human
guuaaaggaaaaacuucuggc

SEQ ID NO: 1358174 - RNA, 23 nt, Human
uaagcagcauaccuuuauaaucc

SEQ ID NO: 1358175 - RNA, 18 nt, Human
uacgucucuaaacaacua

SEQ ID NO: 1358176 - RNA, 26 nt, Human
uacgucucuaaacaacuagacagguu

SEQ ID NO: 1358177 - RNA, 27 nt, Human
uagcgcaggagaaaucuccaucacucu

SEQ ID NO: 1358178 - RNA, 19 nt, Human
uaggagcugugggguuucg

SEQ ID NO: 1358179 - RNA, 21 nt, Human
uaguacaagaagcaaauaagc

SEQ ID NO: 1358180 - RNA, 23 nt, Human
ucacucuugccuuuucaguccug

SEQ ID NO: 1358181 - RNA, 18 nt, Human
ucccucuucccccccugg

SEQ ID NO: 1358182 - RNA, 18 nt, Human
ucgcaggagggggaggca

SEQ ID NO: 1358183 - RNA, 19 nt, Human
ucuaaaggauggccccccu

SEQ ID NO: 1358184 - RNA, 23 nt, Human
ucucuaaacaacuagacagguuu

SEQ ID NO: 1358185 - RNA, 26 nt, Human
ucucuaaacaacuagacagguuucua

SEQ ID NO: 1358186 - RNA, 21 nt, Human
ucucuugaucccacuggcgcc

SEQ ID NO: 1358187 - RNA, 22 nt, Human
ugacaaccucaagacaaaccga

SEQ ID NO: 1358188 - RNA, 23 nt, Human
ugagagccagucccucuuccccc

SEQ ID NO: 1358189 - RNA, 20 nt, Human
ugagagcuauccccucuucc

SEQ ID NO: 1358190 - RNA, 20 nt, Human
ugagagcuauccccucuucc

SEQ ID NO: 1358191 - RNA, 23 nt, Human
ugagauccauccccucuuccccc

SEQ ID NO: 1358192 - RNA, 30 nt, Human
ugaugguaagcagcauaccuuuauaauccc

SEQ ID NO: 1358193 - RNA, 23 nt, Human
ugcgugggauuuacaauaagaca

SEQ ID NO: 1358194 - RNA, 21 nt, Human
uggcugugaguacccccaucg

SEQ ID NO: 1358195 - RNA, 22 nt, Human
uuaacccaaacuguggggcccu

SEQ ID NO: 1358196 - RNA, 24 nt, Human
uucuuaggagcugugggguuucgu

SEQ ID NO: 1358197 - RNA, 22 nt, Human
uuucaacaucugcaagcagcug

SEQ ID NO: 1358198 - RNA, 21 nt, Human
acagcggccacgcccuggggc

SEQ ID NO: 1358199 - RNA, 20 nt, Human
agcagcagcgggagguucag

SEQ ID NO: 1358200 - RNA, 24 nt, Human
augaguucggcggccacaguggcc

SEQ ID NO: 1358201 - RNA, 18 nt, Human
cacagcucugccuccugc

SEQ ID NO: 1358202 - RNA, 18 nt, Human
cacagcucugccuccugc

SEQ ID NO: 1358203 - RNA, 20 nt, Human
cagcaccuuggguugggggc

SEQ ID NO: 1358204 - RNA, 22 nt, Human
cagcaccuuggguugggggcgg

SEQ ID NO: 1358205 - RNA, 21 nt, Human
cagcagcagcagcagcagcgg

SEQ ID NO: 1358206 - RNA, 23 nt, Human
cagcagcagcagcagcagcggga

SEQ ID NO: 1358207 - RNA, 20 nt, Human
cagcagcagcagcgggaggu

SEQ ID NO: 1358208 - RNA, 20 nt, Human
cagcggccacgcccuggggc

SEQ ID NO: 1358209 - RNA, 25 nt, Human
cagcgggagguucagcggggucaga

SEQ ID NO: 1358210 - RNA, 20 nt, Human
ccaugcccaucaggguuuau

SEQ ID NO: 1358211 - RNA, 28 nt, Human
cccacagcucugccuccugcugcagagg

SEQ ID NO: 1358212 - RNA, 21 nt, Human
ccuguggccagacagggugga

SEQ ID NO: 1358213 - RNA, 19 nt, Human
ccuuggguugggggcgggg

SEQ ID NO: 1358214 - RNA, 20 nt, Human
cgcccuggggcgguggccug

SEQ ID NO: 1358215 - RNA, 19 nt, Human
cggggcugggcgggacaug

SEQ ID NO: 1358216 - RNA, 20 nt, Human
cuuggguugggggcggggcu

SEQ ID NO: 1358217 - RNA, 20 nt, Human
gcagcagcagcagcgggagg

SEQ ID NO: 1358218 - RNA, 19 nt, Human
gccacaguggcccccagca

SEQ ID NO: 1358219 - RNA, 21 nt, Human
ggggcgguggccugugcagcu

SEQ ID NO: 1358220 - RNA, 18 nt, Human
ggguugggggcggggcug

SEQ ID NO: 1358221 - RNA, 21 nt, Human
ucagcaccuuggguugggggc

SEQ ID NO: 1358222 - RNA, 22 nt, Human
ucccacagcucugccuccugcu

SEQ ID NO: 1358223 - RNA, 24 nt, Human
ucggcggccacaguggcccccagc

SEQ ID NO: 1358224 - RNA, 21 nt, Human
ucuguaacagcggccacgccc

SEQ ID NO: 1358225 - RNA, 21 nt, Human
ugccuguggccagacagggug

SEQ ID NO: 1358226 - RNA, 21 nt, Human
uggaggcggugccuguggcca

SEQ ID NO: 1358227 - RNA, 19 nt, Human
uggguugggggcggggcug

SEQ ID NO: 1358228 - RNA, 21 nt, Human
uggguugggggcggggcuggg

SEQ ID NO: 1358229 - RNA, 22 nt, Human
uggguugggggcggggcugggc

SEQ ID NO: 1358230 - RNA, 20 nt, Human
aaacggguccgcauagucuu

SEQ ID NO: 1358231 - RNA, 23 nt, Human
acccccuuccuccaggggcuauc

SEQ ID NO: 1358232 - RNA, 21 nt, Human
accccuuacuccaaggcccca

SEQ ID NO: 1358233 - RNA, 24 nt, Human
agcucuggaacccccuuccuccag

SEQ ID NO: 1358234 - RNA, 20 nt, Human
aggagaagaaagguuugaaa

SEQ ID NO: 1358235 - RNA, 18 nt, Human
aggcagagaggugguaag

SEQ ID NO: 1358236 - RNA, 24 nt, Human
agggugguggugguggaggucacc

SEQ ID NO: 1358237 - RNA, 21 nt, Human
caaagccggcugcuucccagg

SEQ ID NO: 1358238 - RNA, 20 nt, Human
caaccccuuacuccaaggcc

SEQ ID NO: 1358239 - RNA, 23 nt, Human
caccucugcccuaaggucggaaa

SEQ ID NO: 1358240 - RNA, 21 nt, Human
cagaaucugcgcucgcuucuc

SEQ ID NO: 1358241 - RNA, 20 nt, Human
cagcccggggacggcgccgg

SEQ ID NO: 1358242 - RNA, 21 nt, Human
cagggaccuucucuggggcuc

SEQ ID NO: 1358243 - RNA, 24 nt, Human
cagggauuccucuuuccccagcuc

SEQ ID NO: 1358244 - RNA, 22 nt, Human
ccaccccccaaagccggcugcu

SEQ ID NO: 1358245 - RNA, 23 nt, Human
ccaggagaagaaagguuugaaag

SEQ ID NO: 1358246 - RNA, 18 nt, Human
cccaccccccaaagccgg

SEQ ID NO: 1358247 - RNA, 19 nt, Human
ccccaaagccggcugcuuc

SEQ ID NO: 1358248 - RNA, 18 nt, Human
ccccaggagcccuuuccc

SEQ ID NO: 1358249 - RNA, 24 nt, Human
cccccaaagccggcugcuucccag

SEQ ID NO: 1358250 - RNA, 21 nt, Human
ccccccaaagccggcugcuuc

SEQ ID NO: 1358251 - RNA, 23 nt, Human
ccccccaaagccggcugcuuccc

SEQ ID NO: 1358252 - RNA, 22 nt, Human
ccccuucucuccccacccccca

SEQ ID NO: 1358253 - RNA, 24 nt, Human
ccccuucucuccccaccccccaaa

SEQ ID NO: 1358254 - RNA, 18 nt, Human
cccgagccccuccccuuc

SEQ ID NO: 1358255 - RNA, 20 nt, Human
cccuccccuucucuccccac

SEQ ID NO: 1358256 - RNA, 21 nt, Human
cccuccccuucucuccccacc

SEQ ID NO: 1358257 - RNA, 24 nt, Human
cccuuacuccaaggccccaggagc

SEQ ID NO: 1358258 - RNA, 24 nt, Human
ccuccgacggucugggguggaagu

SEQ ID NO: 1358259 - RNA, 18 nt, Human
ccugcugagccuucgcca

SEQ ID NO: 1358260 - RNA, 22 nt, Human
cggaggcagagaggugguaagg

SEQ ID NO: 1358261 - RNA, 24 nt, Human
cggccuggggacugcacaguuccc

SEQ ID NO: 1358262 - RNA, 22 nt, Human
cggggacggaggcagagaggug

SEQ ID NO: 1358263 - RNA, 24 nt, Human
cuccaggggcuauccuuucucucc

SEQ ID NO: 1358264 - RNA, 19 nt, Human
cuccccaccccccaaagcu

SEQ ID NO: 1358265 - RNA, 18 nt, Human
cucccucccccgucagcc

SEQ ID NO: 1358266 - RNA, 18 nt, Human
cucuccccaccccccaaa

SEQ ID NO: 1358267 - RNA, 20 nt, Human
cucugcccgagccccucccc

SEQ ID NO: 1358268 - RNA, 22 nt, Human
cugaaacucccuaccaucccag

SEQ ID NO: 1358269 - RNA, 23 nt, Human
cuuacuccaaggccccaggagcc

SEQ ID NO: 1358270 - RNA, 20 nt, Human
gaaacucccuaccaucccag

SEQ ID NO: 1358271 - RNA, 19 nt, Human
gaacccccuuccuccaggg

SEQ ID NO: 1358272 - RNA, 18 nt, Human
gagaggguggugguggug

SEQ ID NO: 1358273 - RNA, 19 nt, Human
gagccggggcggccugggg

SEQ ID NO: 1358274 - RNA, 23 nt, Human
gccagucugaaacucccuaccau

SEQ ID NO: 1358275 - RNA, 24 nt, Human
gccagucugaaacucccuaccauc

SEQ ID NO: 1358276 - RNA, 19 nt, Human
gccccaggagcccuuuccc

SEQ ID NO: 1358277 - RNA, 21 nt, Human
gccccaggagcccuuucccuu

SEQ ID NO: 1358278 - RNA, 18 nt, Human
gcuccugaagcuccugcu

SEQ ID NO: 1358279 - RNA, 20 nt, Human
gcucuggaacccccuuccuc

SEQ ID NO: 1358280 - RNA, 18 nt, Human
ggcacagggcuggguaca

SEQ ID NO: 1358281 - RNA, 19 nt, Human
ggcccggagccggggcggc

SEQ ID NO: 1358282 - RNA, 24 nt, Human
gggagagggugguggugguggagg

SEQ ID NO: 1358283 - RNA, 21 nt, Human
ggguggaagucggggacggag

SEQ ID NO: 1358284 - RNA, 22 nt, Human
gucuuccccaaaccucuuacca

SEQ ID NO: 1358285 - RNA, 19 nt, Human
uacuggaucccaggagaag

SEQ ID NO: 1358286 - RNA, 23 nt, Human
uacuggaucccaggagaagaaag

SEQ ID NO: 1358287 - RNA, 21 nt, Human
uagcucuggaacccccuuccu

SEQ ID NO: 1358288 - RNA, 21 nt, Human
ucacagccgggcugugucugc

SEQ ID NO: 1358289 - RNA, 19 nt, Human
uccaaggccccaggagccc

SEQ ID NO: 1358290 - RNA, 23 nt, Human
uccaaggccccaggagcccuuuc

SEQ ID NO: 1358291 - RNA, 24 nt, Human
uccagacaaccccuuacuccaagg

SEQ ID NO: 1358292 - RNA, 21 nt, Human
uccccaaaccucuuaccagac

SEQ ID NO: 1358293 - RNA, 21 nt, Human
uccccaccccccaaagccggc

SEQ ID NO: 1358294 - RNA, 20 nt, Human
ucccccgucagcccggggac

SEQ ID NO: 1358295 - RNA, 18 nt, Human
ucccucugcccgagcccc

SEQ ID NO: 1358296 - RNA, 18 nt, Human
uccucuuuccccagcucc

SEQ ID NO: 1358297 - RNA, 21 nt, Human
ucuccagcuucuacuggaucc

SEQ ID NO: 1358298 - RNA, 25 nt, Human
ugccucuggcccggagccggggcgg

SEQ ID NO: 1358299 - RNA, 20 nt, Human
uggcaagagccacagcccuc

SEQ ID NO: 1358300 - RNA, 19 nt, Human
uggcccggagccggggcgg

SEQ ID NO: 1358301 - RNA, 21 nt, Human
uggggcuccugaagcuccugc

SEQ ID NO: 1358302 - RNA, 23 nt, Human
uuccccagcuccagacaaccccc

SEQ ID NO: 1358303 - RNA, 18 nt, Human
uuccucuuuccccagcuc

SEQ ID NO: 1358304 - RNA, 21 nt, Human
uuccucuuuccccagcuccag

SEQ ID NO: 1358305 - RNA, 24 nt, Human
uuucacagccgggcugugucugcu

SEQ ID NO: 1358306 - RNA, 18 nt, Human
uuucagggaccuucucug

SEQ ID NO: 1358307 - RNA, 22 nt, Human
uuuccccagcuccagacaaccc

SEQ ID NO: 1358308 - RNA, 20 nt, Human
aaaaaaaaaauccaugguga

SEQ ID NO: 1358309 - RNA, 20 nt, Human
aaaacaucacaguuuuaaag

SEQ ID NO: 1358310 - RNA, 23 nt, Human
aaaaggucuaaaaggaguaaaga

SEQ ID NO: 1358311 - RNA, 25 nt, Human
aagagaaaaaggucuaaaaggagua

SEQ ID NO: 1358312 - RNA, 20 nt, Human
aagcagccagggggcucugu

SEQ ID NO: 1358313 - RNA, 20 nt, Human
aaugacagaggaguguggaa

SEQ ID NO: 1358314 - RNA, 24 nt, Human
aaugagaaaggcaggagugaggga

SEQ ID NO: 1358315 - RNA, 18 nt, Human
accacagccaugcuguag

SEQ ID NO: 1358316 - RNA, 23 nt, Human
accacagccaugcuguaggugcu

SEQ ID NO: 1358317 - RNA, 19 nt, Human
acuagggcacauuucuuuu

SEQ ID NO: 1358318 - RNA, 19 nt, Human
acucaugaucggucuccuc

SEQ ID NO: 1358319 - RNA, 23 nt, Human
acuggagucuguggggcuggggu

SEQ ID NO: 1358320 - RNA, 19 nt, Human
agacgaaagcuaucaggcc

SEQ ID NO: 1358321 - RNA, 21 nt, Human
agacgaaagcuaucaggccua

SEQ ID NO: 1358322 - RNA, 25 nt, Human
agcuggaagguggcgcuccgccgac

SEQ ID NO: 1358323 - RNA, 25 nt, Human
aggaagccacuggagucuguggggc

SEQ ID NO: 1358324 - RNA, 20 nt, Human
aggaagcuguggacuggugg

SEQ ID NO: 1358325 - RNA, 21 nt, Human
aggcaauggcagcaguccggc

SEQ ID NO: 1358326 - RNA, 19 nt, Human
aggcaggagugagggaaug

SEQ ID NO: 1358327 - RNA, 22 nt, Human
aggccuuggaggcuuuguaacc

SEQ ID NO: 1358328 - RNA, 18 nt, Human
agggacccaguggggcac

SEQ ID NO: 1358329 - RNA, 22 nt, Human
aggugcucugcguguacaaagu

SEQ ID NO: 1358330 - RNA, 22 nt, Human
agugagugaggucagaaaggga

SEQ ID NO: 1358331 - RNA, 18 nt, Human
agugugcagucaaggcug

SEQ ID NO: 1358332 - RNA, 18 nt, Human
auagagagacgaaagcua

SEQ ID NO: 1358333 - RNA, 19 nt, Human
auguggacuccauggaagg

SEQ ID NO: 1358334 - RNA, 25 nt, Human
caaaaaaaaaauccauggugaacaa

SEQ ID NO: 1358335 - RNA, 18 nt, Human
caagacaaaggcaauggc

SEQ ID NO: 1358336 - RNA, 21 nt, Human
caagaugaucucccacuccaa

SEQ ID NO: 1358337 - RNA, 21 nt, Human
cacccaccgcgaaucugugca

SEQ ID NO: 1358338 - RNA, 25 nt, Human
cacccagcuccccucccagagccag

SEQ ID NO: 1358339 - RNA, 22 nt, Human
cacucaugaucggucuccuccu

SEQ ID NO: 1358340 - RNA, 18 nt, Human
cacuccaaagagaaaaag

SEQ ID NO: 1358341 - RNA, 23 nt, Human
cacuuuagaaaggaagcugugga

SEQ ID NO: 1358342 - RNA, 18 nt, Human
cagaaagacuaaacagcg

SEQ ID NO: 1358343 - RNA, 22 nt, Human
cagaacgaggugaugugugaag

SEQ ID NO: 1358344 - RNA, 23 nt, Human
cagaccccacccuggaggaguua

SEQ ID NO: 1358345 - RNA, 18 nt, Human
cagcccaaccucccgguc

SEQ ID NO: 1358346 - RNA, 18 nt, Human
cagcccccgggcccggcc

SEQ ID NO: 1358347 - RNA, 22 nt, Human
cagcucaagacaaaggcaaugg

SEQ ID NO: 1358348 - RNA, 23 nt, Human
ccaaaaccacuagggcacauuuc

SEQ ID NO: 1358349 - RNA, 22 nt, Human
ccacuccaaagagaaaaagguc

SEQ ID NO: 1358350 - RNA, 20 nt, Human
ccacugcccagaccccaccc

SEQ ID NO: 1358351 - RNA, 20 nt, Human
ccagcuccccucccagagcc

SEQ ID NO: 1358352 - RNA, 21 nt, Human
ccaggccagagugguagagcc

SEQ ID NO: 1358353 - RNA, 25 nt, Human
cccaaaaaaaaaauccauggugaac

SEQ ID NO: 1358354 - RNA, 20 nt, Human
cccacugcccagaccccacc

SEQ ID NO: 1358355 - RNA, 20 nt, Human
ccccaaaaaaaaaauccaug

SEQ ID NO: 1358356 - RNA, 25 nt, Human
ccccacccaccgcgaaucugugcag

SEQ ID NO: 1358357 - RNA, 19 nt, Human
cccccaaaaaaaaaaucca

SEQ ID NO: 1358358 - RNA, 20 nt, Human
cccccaaaaaaaaaauccau

SEQ ID NO: 1358359 - RNA, 20 nt, Human
ccccccaaaaaaaaaaucca

SEQ ID NO: 1358360 - RNA, 21 nt, Human
ccccccccaaaaaaaaaaucc

SEQ ID NO: 1358361 - RNA, 18 nt, Human
cccccgggcccggccacu

SEQ ID NO: 1358362 - RNA, 23 nt, Human
ccuccacauagagagacgaaagc

SEQ ID NO: 1358363 - RNA, 18 nt, Human
ccuccugaacuucccacc

SEQ ID NO: 1358364 - RNA, 18 nt, Human
ccuggguggcuccugccu

SEQ ID NO: 1358365 - RNA, 21 nt, Human
ccuguaagccuugagaaaauu

SEQ ID NO: 1358366 - RNA, 19 nt, Human
cgggguuaauguacagaaa

SEQ ID NO: 1358367 - RNA, 19 nt, Human
cguggggaagcagccaggg

SEQ ID NO: 1358368 - RNA, 22 nt, Human
cuaaacagcgucagucaaagcc

SEQ ID NO: 1358369 - RNA, 21 nt, Human
cuccaaagagaaaaaggucua

SEQ ID NO: 1358370 - RNA, 23 nt, Human
cuccugaggaauguccuggggac

SEQ ID NO: 1358371 - RNA, 19 nt, Human
cugcauguucuccuaagca

SEQ ID NO: 1358372 - RNA, 21 nt, Human
cuggcagcuccccacccaccg

SEQ ID NO: 1358373 - RNA, 21 nt, Human
cuguggcugugacgcacccuu

SEQ ID NO: 1358374 - RNA, 19 nt, Human
cuucucuggagaggccaca

SEQ ID NO: 1358375 - RNA, 25 nt, Human
gaaugaaacagggaaggguggggcu

SEQ ID NO: 1358376 - RNA, 18 nt, Human
gacaaaugagaaaggcag

SEQ ID NO: 1358377 - RNA, 19 nt, Human
gacccaguggggcacccag

SEQ ID NO: 1358378 - RNA, 18 nt, Human
gagaaagucagggaaaag

SEQ ID NO: 1358379 - RNA, 22 nt, Human
gaggcuuuguaaccucucggua

SEQ ID NO: 1358380 - RNA, 19 nt, Human
gagggacccaguggggcac

SEQ ID NO: 1358381 - RNA, 18 nt, Human
gauuacagugugcaguca

SEQ ID NO: 1358382 - RNA, 24 nt, Human
gcccaggcgaggccucacuguggc

SEQ ID NO: 1358383 - RNA, 19 nt, Human
gcgcuucucaaccuacacc

SEQ ID NO: 1358384 - RNA, 21 nt, Human
gcuccugccuccccacugccc

SEQ ID NO: 1358385 - RNA, 21 nt, Human
gcuggggugaagucuccaggg

SEQ ID NO: 1358386 - RNA, 22 nt, Human
ggaaaagcgcagcccccggggg

SEQ ID NO: 1358387 - RNA, 21 nt, Human
ggccauguggacuccauggaa

SEQ ID NO: 1358388 - RNA, 22 nt, Human
gggaaaagcgcagcccccgggc

SEQ ID NO: 1358389 - RNA, 22 nt, Human
ggggcuggggugaagucuccag

SEQ ID NO: 1358390 - RNA, 19 nt, Human
ggugggccccaggccucag

SEQ ID NO: 1358391 - RNA, 19 nt, Human
ggugggcugguggcuggag

SEQ ID NO: 1358392 - RNA, 25 nt, Human
guagagccaccccccaaguugucag

SEQ ID NO: 1358393 - RNA, 19 nt, Human
gugcagccuccaccaaaac

SEQ ID NO: 1358394 - RNA, 22 nt, Human
uaaaauuaaggccccccccccc

SEQ ID NO: 1358395 - RNA, 21 nt, Human
uaaggcccccccccccaaaaa

SEQ ID NO: 1358396 - RNA, 18 nt, Human
uaagugagugaggucaga

SEQ ID NO: 1358397 - RNA, 23 nt, Human
uacagaaagacuaaacagcguca

SEQ ID NO: 1358398 - RNA, 20 nt, Human
uagcaaaauucugugacgug

SEQ ID NO: 1358399 - RNA, 18 nt, Human
uaucaggccuagacaggc

SEQ ID NO: 1358400 - RNA, 24 nt, Human
ucaccuggguggcuccugccuccc

SEQ ID NO: 1358401 - RNA, 19 nt, Human
ucccacccagcuccccucc

SEQ ID NO: 1358402 - RNA, 21 nt, Human
ucccaccuccugaacuuccca

SEQ ID NO: 1358403 - RNA, 26 nt, Human
uccccacugcccagaccccacccugg

SEQ ID NO: 1358404 - RNA, 19 nt, Human
uccccaggugauuacagug

SEQ ID NO: 1358405 - RNA, 22 nt, Human
uccugaacuucccacccagcuc

SEQ ID NO: 1358406 - RNA, 19 nt, Human
uccuggggacgcugggcag

SEQ ID NO: 1358407 - RNA, 24 nt, Human
uccuggggacgcugggcagggugg

SEQ ID NO: 1358408 - RNA, 20 nt, Human
ucgcccaguagacauaccgu

SEQ ID NO: 1358409 - RNA, 23 nt, Human
ucuccagcucaagacaaaggcug

SEQ ID NO: 1358410 - RNA, 18 nt, Human
ucuccuaagcaccugguc

SEQ ID NO: 1358411 - RNA, 21 nt, Human
ugaaacagggaaggguggggc

SEQ ID NO: 1358412 - RNA, 23 nt, Human
ugaaggaaugaaacagggaaggg

SEQ ID NO: 1358413 - RNA, 18 nt, Human
ugagaaaggcaggaguga

SEQ ID NO: 1358414 - RNA, 24 nt, Human
ugagaaaggcaggagugagggaaa

SEQ ID NO: 1358415 - RNA, 22 nt, Human
ugaggaauguccuggggacgcu

SEQ ID NO: 1358416 - RNA, 20 nt, Human
ugaggucagaaagggacaaa

SEQ ID NO: 1358417 - RNA, 25 nt, Human
ugcccaggcgaggccucacuguggc

SEQ ID NO: 1358418 - RNA, 19 nt, Human
ugccucggguucccauuag

SEQ ID NO: 1358419 - RNA, 20 nt, Human
ugccucggguucccauuagg

SEQ ID NO: 1358420 - RNA, 20 nt, Human
ugcguggggaagcagccagg

SEQ ID NO: 1358421 - RNA, 23 nt, Human
uggaggaguuaaaucagcauuug

SEQ ID NO: 1358422 - RNA, 23 nt, Human
uggcuccugccuccccacugccc

SEQ ID NO: 1358423 - RNA, 18 nt, Human
uggcuggaguucuccuug

SEQ ID NO: 1358424 - RNA, 25 nt, Human
ugggagggacccaguggggcaccca

SEQ ID NO: 1358425 - RNA, 21 nt, Human
uggguggcuccugccucccca

SEQ ID NO: 1358426 - RNA, 19 nt, Human
uguccuggggacgcugggc

SEQ ID NO: 1358427 - RNA, 19 nt, Human
uuaggaagcuggaaggugg

SEQ ID NO: 1358428 - RNA, 18 nt, Human
uuccaagaugaucuccca

SEQ ID NO: 1358429 - RNA, 21 nt, Human
uuccaagaugaucucccacuc

SEQ ID NO: 1358430 - RNA, 20 nt, Human
uuccaggcuuggccaccuuc

SEQ ID NO: 1358431 - RNA, 19 nt, Human
aaacauuccugccugcuga

SEQ ID NO: 1358432 - RNA, 19 nt, Human
aaaccaaacuucuccauuu

SEQ ID NO: 1358433 - RNA, 21 nt, Human
aaagcaggguggggcauugcc

SEQ ID NO: 1358434 - RNA, 23 nt, Human
aaagguagauaaauccaugaaga

SEQ ID NO: 1358435 - RNA, 19 nt, Human
aaagugcugggauuacaga

SEQ ID NO: 1358436 - RNA, 24 nt, Human
aaagugcugggauuacagauguga

SEQ ID NO: 1358437 - RNA, 18 nt, Human
aaaugggaaaaacaaacu

SEQ ID NO: 1358438 - RNA, 24 nt, Human
aacaaacucggcccaggauucauc

SEQ ID NO: 1358439 - RNA, 19 nt, Human
aacaaagccaccaggaagu

SEQ ID NO: 1358440 - RNA, 20 nt, Human
aaccaaacuucuccauuucc

SEQ ID NO: 1358441 - RNA, 23 nt, Human
aaccagucuccuaucuuaaaguu

SEQ ID NO: 1358442 - RNA, 20 nt, Human
aaccuggagacagagagggc

SEQ ID NO: 1358443 - RNA, 21 nt, Human
aaccuggagacagagagggcu

SEQ ID NO: 1358444 - RNA, 19 nt, Human
aacucccaucucuacucuc

SEQ ID NO: 1358445 - RNA, 18 nt, Human
aaggcagcuuucuguucc

SEQ ID NO: 1358446 - RNA, 21 nt, Human
aaguagcugggacuacggcau

SEQ ID NO: 1358447 - RNA, 18 nt, Human
aagucaagcugggacacu

SEQ ID NO: 1358448 - RNA, 25 nt, Human
aagucguccucccaccuuggccucc

SEQ ID NO: 1358449 - RNA, 18 nt, Human
aagugcugggauuacaga

SEQ ID NO: 1358450 - RNA, 20 nt, Human
acaccaccacacccagcuaa

SEQ ID NO: 1358451 - RNA, 20 nt, Human
acagaacaggagauucccuc

SEQ ID NO: 1358452 - RNA, 24 nt, Human
acagagcaccugguagaaggggca

SEQ ID NO: 1358453 - RNA, 21 nt, Human
acaguguaaacaaagccacca

SEQ ID NO: 1358454 - RNA, 20 nt, Human
accccaguggcgucuggcau

SEQ ID NO: 1358455 - RNA, 22 nt, Human
acuccagcucacuccucacguu

SEQ ID NO: 1358456 - RNA, 26 nt, Human
acuccugccucaaccuuccaaguagc

SEQ ID NO: 1358457 - RNA, 19 nt, Human
acuggagugcaguggcacg

SEQ ID NO: 1358458 - RNA, 19 nt, Human
agacaaguccccuacccuu

SEQ ID NO: 1358459 - RNA, 18 nt, Human
agagacuucuucagaggg

SEQ ID NO: 1358460 - RNA, 20 nt, Human
agagauguuccucaucucug

SEQ ID NO: 1358461 - RNA, 20 nt, Human
agauaaugucagcaucugug

SEQ ID NO: 1358462 - RNA, 21 nt, Human
agcagucaccagaaccuggag

SEQ ID NO: 1358463 - RNA, 19 nt, Human
agccacaggccccccaccu

SEQ ID NO: 1358464 - RNA, 21 nt, Human
agccacaggccccccaccuug

SEQ ID NO: 1358465 - RNA, 24 nt, Human
agcuaacauuacuaguuacuccgc

SEQ ID NO: 1358466 - RNA, 21 nt, Human
agcucaguggaucccaccccc

SEQ ID NO: 1358467 - RNA, 18 nt, Human
aggaaaaaccagcacaaa

SEQ ID NO: 1358468 - RNA, 20 nt, Human
aggaggccuucucagauagg

SEQ ID NO: 1358469 - RNA, 23 nt, Human
agggaucaaggaucugcaaaggu

SEQ ID NO: 1358470 - RNA, 19 nt, Human
agggguuucuugccagcca

SEQ ID NO: 1358471 - RNA, 19 nt, Human
aggguaucucugaaagaaa

SEQ ID NO: 1358472 - RNA, 21 nt, Human
agugcaguggcacgauuauag

SEQ ID NO: 1358473 - RNA, 23 nt, Human
agugcaguggcacgauuauagcu

SEQ ID NO: 1358474 - RNA, 24 nt, Human
agugcugggauuacagaugugagc

SEQ ID NO: 1358475 - RNA, 22 nt, Human
aucacauccucaaagggaucaa

SEQ ID NO: 1358476 - RNA, 24 nt, Human
aucacauccucaaagggaucaagg

SEQ ID NO: 1358477 - RNA, 24 nt, Human
augaagaugaggaaaaaccagcac

SEQ ID NO: 1358478 - RNA, 20 nt, Human
augccaccagggccuugggu

SEQ ID NO: 1358479 - RNA, 26 nt, Human
auuauacacagccacaggccccccac

SEQ ID NO: 1358480 - RNA, 25 nt, Human
caaacuccugggcucaagucguccu

SEQ ID NO: 1358481 - RNA, 22 nt, Human
caaaguaaaugcuagauggagc

SEQ ID NO: 1358482 - RNA, 20 nt, Human
cacacugugucgucauucug

SEQ ID NO: 1358483 - RNA, 24 nt, Human
cagcccacggagggugagccaaag

SEQ ID NO: 1358484 - RNA, 21 nt, Human
cagccugggauaggcacccuu

SEQ ID NO: 1358485 - RNA, 24 nt, Human
caguguaaacaaagccaccaggaa

SEQ ID NO: 1358486 - RNA, 21 nt, Human
ccaaagugcugggauuacaga

SEQ ID NO: 1358487 - RNA, 22 nt, Human
ccaaagugcugggauuacagau

SEQ ID NO: 1358488 - RNA, 24 nt, Human
ccaaagugcugggauuacagaugu

SEQ ID NO: 1358489 - RNA, 19 nt, Human
ccaucugcuucuugucggg

SEQ ID NO: 1358490 - RNA, 21 nt, Human
cccaacacuugucuccuggcu

SEQ ID NO: 1358491 - RNA, 18 nt, Human
ccccaccuugcacuucca

SEQ ID NO: 1358492 - RNA, 18 nt, Human
ccccucaucuucuuccca

SEQ ID NO: 1358493 - RNA, 19 nt, Human
ccccugaggucugggggug

SEQ ID NO: 1358494 - RNA, 20 nt, Human
ccccugaggucugggggugg

SEQ ID NO: 1358495 - RNA, 24 nt, Human
cccuucaacacuuuuucuggacaa

SEQ ID NO: 1358496 - RNA, 27 nt, Human
cccuucaggucucuccuaccuaacaaa

SEQ ID NO: 1358497 - RNA, 21 nt, Human
cccuuuuccugcuccccucau

SEQ ID NO: 1358498 - RNA, 18 nt, Human
ccuaugccaccagggccu

SEQ ID NO: 1358499 - RNA, 18 nt, Human
ccucaggugccuaugcca

SEQ ID NO: 1358500 - RNA, 26 nt, Human
ccucccaccuuggccucccaaagugc

SEQ ID NO: 1358501 - RNA, 19 nt, Human
ccucuggaaagggugcuga

SEQ ID NO: 1358502 - RNA, 20 nt, Human
ccuggcucuuccaguaccuc

SEQ ID NO: 1358503 - RNA, 18 nt, Human
ccugggcucaagucgucc

SEQ ID NO: 1358504 - RNA, 23 nt, Human
ccuuugaauauccgcuuccucag

SEQ ID NO: 1358505 - RNA, 19 nt, Human
cggcccaggauucaucucc

SEQ ID NO: 1358506 - RNA, 21 nt, Human
cuaacaaaccaaacuucucca

SEQ ID NO: 1358507 - RNA, 25 nt, Human
cucacugcaaacuugaacuucugga

SEQ ID NO: 1358508 - RNA, 19 nt, Human
cucaguggaucccaccccc

SEQ ID NO: 1358509 - RNA, 21 nt, Human
cucaguggaucccacccccac

SEQ ID NO: 1358510 - RNA, 20 nt, Human
cucaguguuucucauguccc

SEQ ID NO: 1358511 - RNA, 21 nt, Human
cucaguguuucucauguccca

SEQ ID NO: 1358512 - RNA, 25 nt, Human
cuccuggcucuuccaguaccucuug

SEQ ID NO: 1358513 - RNA, 25 nt, Human
cuccugggcucaagucguccuccca

SEQ ID NO: 1358514 - RNA, 19 nt, Human
cucuccuaaauuaccccaa

SEQ ID NO: 1358515 - RNA, 18 nt, Human
cugacccagauacuacgc

SEQ ID NO: 1358516 - RNA, 21 nt, Human
cugauccacuucaauucauac

SEQ ID NO: 1358517 - RNA, 21 nt, Human
cugcuccccucaucuucuucc

SEQ ID NO: 1358518 - RNA, 19 nt, Human
cugcucccuccucuugccc

SEQ ID NO: 1358519 - RNA, 20 nt, Human
cuggacuccugccucaaccu

SEQ ID NO: 1358520 - RNA, 19 nt, Human
cuuaaaguucccuaccuuc

SEQ ID NO: 1358521 - RNA, 31 nt, Human
cuucccauccuuugaauauccgcuuccucaa

SEQ ID NO: 1358522 - RNA, 19 nt, Human
cuugccccugaggucuggg

SEQ ID NO: 1358523 - RNA, 18 nt, Human
gaaaaacaaacucggccc

SEQ ID NO: 1358524 - RNA, 20 nt, Human
gaacuucuggacuccugccu

SEQ ID NO: 1358525 - RNA, 21 nt, Human
gacugucauagaaagcaacca

SEQ ID NO: 1358526 - RNA, 22 nt, Human
gagcuguucuuuaauuuguccu

SEQ ID NO: 1358527 - RNA, 21 nt, Human
gaugaggaaaaaccagcacaa

SEQ ID NO: 1358528 - RNA, 18 nt, Human
gauuacagaugugagcca

SEQ ID NO: 1358529 - RNA, 24 nt, Human
gcagcugugggcacagcuucagca

SEQ ID NO: 1358530 - RNA, 18 nt, Human
gcaugccagcgagacaga

SEQ ID NO: 1358531 - RNA, 19 nt, Human
gcccuuuuccugcuccccu

SEQ ID NO: 1358532 - RNA, 22 nt, Human
gcuccaagagagaucaacacag

SEQ ID NO: 1358533 - RNA, 18 nt, Human
gcugaagccagggagcca

SEQ ID NO: 1358534 - RNA, 19 nt, Human
ggaaaaacaaacucggccc

SEQ ID NO: 1358535 - RNA, 22 nt, Human
ggaaaaacaaacucggcccagg

SEQ ID NO: 1358536 - RNA, 19 nt, Human
ggaaaaaccagcacaaaaa

SEQ ID NO: 1358537 - RNA, 21 nt, Human
ggaacucccucuccuagccaa

SEQ ID NO: 1358538 - RNA, 25 nt, Human
ggacaaacagacauaaucuccauaa

SEQ ID NO: 1358539 - RNA, 22 nt, Human
ggacuccugccucaaccuucca

SEQ ID NO: 1358540 - RNA, 21 nt, Human
ggacugugccuugagggacgg

SEQ ID NO: 1358541 - RNA, 24 nt, Human
ggaggggcguuugccauuacugag

SEQ ID NO: 1358542 - RNA, 23 nt, Human
ggcccuuuuccugcuccccucau

SEQ ID NO: 1358543 - RNA, 19 nt, Human
gggaacucccucuccuagc

SEQ ID NO: 1358544 - RNA, 21 nt, Human
gggaagugcaagggguugggg

SEQ ID NO: 1358545 - RNA, 25 nt, Human
gggaggggcguuugccauuacugag

SEQ ID NO: 1358546 - RNA, 21 nt, Human
gugcaaaagacauguuucagu

SEQ ID NO: 1358547 - RNA, 21 nt, Human
guuuuccccuuucuuuuucuu

SEQ ID NO: 1358548 - RNA, 23 nt, Human
uaaacaaagccaccaggaaguuc

SEQ ID NO: 1358549 - RNA, 21 nt, Human
uaaaguucccuaccuucuaga

SEQ ID NO: 1358550 - RNA, 26 nt, Human
uaaauccucugcaaccugauaucccu

SEQ ID NO: 1358551 - RNA, 18 nt, Human
uaacaaaccaaacuucuc

SEQ ID NO: 1358552 - RNA, 26 nt, Human
uaacaaaccaaacuucuccauuuccu

SEQ ID NO: 1358553 - RNA, 19 nt, Human
uacaccacuugaaugugcc

SEQ ID NO: 1358554 - RNA, 19 nt, Human
uacgcuuuucccauccucu

SEQ ID NO: 1358555 - RNA, 24 nt, Human
uacggcauacaccaccacacccag

SEQ ID NO: 1358556 - RNA, 18 nt, Human
uacugaggcuugaguagg

SEQ ID NO: 1358557 - RNA, 21 nt, Human
uagaaagcaaccagucuccua

SEQ ID NO: 1358558 - RNA, 19 nt, Human
uagaggccauuggggcuga

SEQ ID NO: 1358559 - RNA, 26 nt, Human
uaguaaacugcuuuuagcugcaugga

SEQ ID NO: 1358560 - RNA, 23 nt, Human
uaucaggauguguccacuucuug

SEQ ID NO: 1358561 - RNA, 19 nt, Human
uauggaccuuucccugaga

SEQ ID NO: 1358562 - RNA, 22 nt, Human
uauucaaacuggauaaucuaau

SEQ ID NO: 1358563 - RNA, 19 nt, Human
ucacucccacuugcaagca

SEQ ID NO: 1358564 - RNA, 21 nt, Human
ucaguguuucucaugucccau

SEQ ID NO: 1358565 - RNA, 18 nt, Human
ucauagaaagcaaccagu

SEQ ID NO: 1358566 - RNA, 21 nt, Human
uccaagaaacaaaccagaaua

SEQ ID NO: 1358567 - RNA, 22 nt, Human
uccaaguagcugggacuacggc

SEQ ID NO: 1358568 - RNA, 23 nt, Human
uccaaguagcugggacuacggca

SEQ ID NO: 1358569 - RNA, 23 nt, Human
uccaaguagcugggacuacggca

SEQ ID NO: 1358570 - RNA, 22 nt, Human
uccauacaacucccaucucuac

SEQ ID NO: 1358571 - RNA, 20 nt, Human
uccaugaagaugaggaaaaa

SEQ ID NO: 1358572 - RNA, 18 nt, Human
ucccaaagugcugggauu

SEQ ID NO: 1358573 - RNA, 23 nt, Human
ucccaaagugcugggauuacaga

SEQ ID NO: 1358574 - RNA, 19 nt, Human
uccccuacccuuacuucca

SEQ ID NO: 1358575 - RNA, 21 nt, Human
ucccucuggaucugggaucug

SEQ ID NO: 1358576 - RNA, 21 nt, Human
uccucuggaaagggugcugaa

SEQ ID NO: 1358577 - RNA, 21 nt, Human
uccugggcucaagucguccuc

SEQ ID NO: 1358578 - RNA, 22 nt, Human
uccugggcucaagucguccucc

SEQ ID NO: 1358579 - RNA, 24 nt, Human
uccuuggaucucugugcucccccc

SEQ ID NO: 1358580 - RNA, 21 nt, Human
ucucaaacuccugggcucaag

SEQ ID NO: 1358581 - RNA, 18 nt, Human
ucuccauaagccccuuca

SEQ ID NO: 1358582 - RNA, 22 nt, Human
ucucgcucuuucacccagacug

SEQ ID NO: 1358583 - RNA, 24 nt, Human
ucucgcucuuucacccagacugga

SEQ ID NO: 1358584 - RNA, 19 nt, Human
ucucgcuuuuuugcccaga

SEQ ID NO: 1358585 - RNA, 23 nt, Human
ucucgcuuuuuugcccagacugg

SEQ ID NO: 1358586 - RNA, 19 nt, Human
ucucugugccccuggcacu

SEQ ID NO: 1358587 - RNA, 21 nt, Human
ucugcuucuugucgggaccau

SEQ ID NO: 1358588 - RNA, 20 nt, Human
ucugggggugggaaaggcuc

SEQ ID NO: 1358589 - RNA, 20 nt, Human
ucuguagcuuuuaucacauc

SEQ ID NO: 1358590 - RNA, 22 nt, Human
ucuguagcuuuuaucacauccu

SEQ ID NO: 1358591 - RNA, 22 nt, Human
ucuguuuuccccuuucuuuuuc

SEQ ID NO: 1358592 - RNA, 20 nt, Human
ucuucacaacccacagaaca

SEQ ID NO: 1358593 - RNA, 24 nt, Human
ucuugagccucucuguuuggaccc

SEQ ID NO: 1358594 - RNA, 21 nt, Human
ucuugagccucucuguuuucc

SEQ ID NO: 1358595 - RNA, 24 nt, Human
ucuugagccucucuguuuuccccu

SEQ ID NO: 1358596 - RNA, 20 nt, Human
ucuugccccugaggucuggg

SEQ ID NO: 1358597 - RNA, 21 nt, Human
ucuugucgggaccaugacuga

SEQ ID NO: 1358598 - RNA, 25 nt, Human
ucuuucuuuuuaguuuuagagaugg

SEQ ID NO: 1358599 - RNA, 20 nt, Human
ugaaaaaguauaucuggagc

SEQ ID NO: 1358600 - RNA, 23 nt, Human
ugaaaaaguauaucuggagcuaa

SEQ ID NO: 1358601 - RNA, 19 nt, Human
ugaaaccacaaguaauagc

SEQ ID NO: 1358602 - RNA, 20 nt, Human
ugaaaccacaaguaauagca

SEQ ID NO: 1358603 - RNA, 26 nt, Human
ugacugucauagaaagcaaccagucu

SEQ ID NO: 1358604 - RNA, 29 nt, Human
ugagccucucuguuuuccccuuucuuuuu

SEQ ID NO: 1358605 - RNA, 26 nt, Human
ugagcuagcugcaguuuuuuuuuucc

SEQ ID NO: 1358606 - RNA, 25 nt, Human
ugagcuugguggggggaggggcguu

SEQ ID NO: 1358607 - RNA, 19 nt, Human
ugaggcuugaguagguggu

SEQ ID NO: 1358608 - RNA, 21 nt, Human
ugcaaccugauaucccugggc

SEQ ID NO: 1358609 - RNA, 21 nt, Human
ugcaccuaccacacugugucg

SEQ ID NO: 1358610 - RNA, 19 nt, Human
ugcauggagaaauuagggu

SEQ ID NO: 1358611 - RNA, 20 nt, Human
ugccaucugcuucuugucgg

SEQ ID NO: 1358612 - RNA, 21 nt, Human
ugccccuggcacuuaacacag

SEQ ID NO: 1358613 - RNA, 24 nt, Human
ugccucaaccuuccaaguagcugg

SEQ ID NO: 1358614 - RNA, 22 nt, Human
ugcucccacagcuucccaacac

SEQ ID NO: 1358615 - RNA, 18 nt, Human
ugcugggauuacagaugu

SEQ ID NO: 1358616 - RNA, 24 nt, Human
ugcugggauuacagaugugagcca

SEQ ID NO: 1358617 - RNA, 19 nt, Human
ugcuuucuggcuuuugacu

SEQ ID NO: 1358618 - RNA, 19 nt, Human
ugcuuucuggcuuuugacu

SEQ ID NO: 1358619 - RNA, 21 nt, Human
ugcuuuuagcugcauggagaa

SEQ ID NO: 1358620 - RNA, 24 nt, Human
ugcuuuuagcugcauggagaaauu

SEQ ID NO: 1358621 - RNA, 26 nt, Human
uggaacagaguagguucuuaguagau

SEQ ID NO: 1358622 - RNA, 19 nt, Human
uggagugcaguggcacgau

SEQ ID NO: 1358623 - RNA, 19 nt, Human
uggagugcaguggcacgau

SEQ ID NO: 1358624 - RNA, 21 nt, Human
uggagugcaguggcacgauua

SEQ ID NO: 1358625 - RNA, 25 nt, Human
uggcaacagggacaaacagacauaa

SEQ ID NO: 1358626 - RNA, 18 nt, Human
uggcacgauuauagcuca

SEQ ID NO: 1358627 - RNA, 24 nt, Human
uggcacgauuauagcucacugcaa

SEQ ID NO: 1358628 - RNA, 21 nt, Human
uggcaugccagcgagacagaa

SEQ ID NO: 1358629 - RNA, 23 nt, Human
ugggacuacggcauacaccacca

SEQ ID NO: 1358630 - RNA, 18 nt, Human
ugggauuacagaugugag

SEQ ID NO: 1358631 - RNA, 19 nt, Human
ugggauuacagaugugagc

SEQ ID NO: 1358632 - RNA, 21 nt, Human
ugggauuacagaugugagcca

SEQ ID NO: 1358633 - RNA, 22 nt, Human
ugggauuacagaugugagccac

SEQ ID NO: 1358634 - RNA, 22 nt, Human
ugggauuacagaugugagccac

SEQ ID NO: 1358635 - RNA, 27 nt, Human
ugggauuacagaugugagccacuucuc

SEQ ID NO: 1358636 - RNA, 19 nt, Human
uggggucucgcucuuucac

SEQ ID NO: 1358637 - RNA, 19 nt, Human
ugggugcagcccacggagg

SEQ ID NO: 1358638 - RNA, 20 nt, Human
ugguagaaggggcagcugug

SEQ ID NO: 1358639 - RNA, 18 nt, Human
uggucuagcucaguggaa

SEQ ID NO: 1358640 - RNA, 19 nt, Human
ugugccaucugcuucuugu

SEQ ID NO: 1358641 - RNA, 22 nt, Human
ugugcucccacagcuucccaac

SEQ ID NO: 1358642 - RNA, 19 nt, Human
uguuauggggaaaauagag

SEQ ID NO: 1358643 - RNA, 21 nt, Human
uuaaacauuccugccugcuga

SEQ ID NO: 1358644 - RNA, 19 nt, Human
uuaaggcagcuuucuguuc

SEQ ID NO: 1358645 - RNA, 24 nt, Human
uucacaacccacagaacaggagau

SEQ ID NO: 1358646 - RNA, 24 nt, Human
uucaggaaauagaugguguauuca

SEQ ID NO: 1358647 - RNA, 19 nt, Human
uuccagguggggggcucuc

SEQ ID NO: 1358648 - RNA, 22 nt, Human
uucccuucacccuguucacacc

SEQ ID NO: 1358649 - RNA, 28 nt, Human
uuccucaggcuacuucucaguccucuau

SEQ ID NO: 1358650 - RNA, 24 nt, Human
uucuggacuccugccucaaccuuc

SEQ ID NO: 1358651 - RNA, 21 nt, Human
uugaagacauauuuaugccaa

SEQ ID NO: 1358652 - RNA, 18 nt, Human
uugaauauccgcuuccuc

SEQ ID NO: 1358653 - RNA, 24 nt, Human
uugccccugaggucuggggguggg

SEQ ID NO: 1358654 - RNA, 20 nt, Human
uuggaaggugauuucagaau

SEQ ID NO: 1358655 - RNA, 24 nt, Human
uuggaucucugugcucccacagcu

SEQ ID NO: 1358656 - RNA, 18 nt, Human
uuggccucccaaagugcu

SEQ ID NO: 1358657 - RNA, 24 nt, Human
uuggggcugauccacuucaauuca

SEQ ID NO: 1358658 - RNA, 22 nt, Human
uuucccauacaucccucaucag

SEQ ID NO: 1358659 - RNA, 24 nt, Human
uuuccugcuccccucaucuucuuc

SEQ ID NO: 1358660 - RNA, 18 nt, Human
uuuuuauagagauggcgu

SEQ ID NO: 1358661 - RNA, 21 nt, Human
aaaaacaaauagagucgagug

SEQ ID NO: 1358662 - RNA, 24 nt, Human
aaaaaggcaaacaggugucgcgga

SEQ ID NO: 1358663 - RNA, 26 nt, Human
aaaaauaaaugagggaaggagcugac

SEQ ID NO: 1358664 - RNA, 20 nt, Human
aaaacaaauagagucgagug

SEQ ID NO: 1358665 - RNA, 26 nt, Human
aaaaccaacaaccucaugcaguguug

SEQ ID NO: 1358666 - RNA, 20 nt, Human
aaaacgcucuaccccccaca

SEQ ID NO: 1358667 - RNA, 20 nt, Human
aaacaaaaccaacaaccuca

SEQ ID NO: 1358668 - RNA, 23 nt, Human
aaacgaacacccccagcauuggu

SEQ ID NO: 1358669 - RNA, 23 nt, Human
aaagccuccagacaaggcagucc

SEQ ID NO: 1358670 - RNA, 18 nt, Human
aacaaagccuccagacaa

SEQ ID NO: 1358671 - RNA, 18 nt, Human
aacauucccuucuucccu

SEQ ID NO: 1358672 - RNA, 20 nt, Human
aagagagugggcuugaagga

SEQ ID NO: 1358673 - RNA, 19 nt, Human
aaggagcugacgacugggg

SEQ ID NO: 1358674 - RNA, 20 nt, Human
aaggcaccuggagucugggu

SEQ ID NO: 1358675 - RNA, 21 nt, Human
acaaaaccaacaaccucaugc

SEQ ID NO: 1358676 - RNA, 24 nt, Human
acacaacuuaacaaaaagggaacc

SEQ ID NO: 1358677 - RNA, 21 nt, Human
acacaacuuaacaaaaauaaa

SEQ ID NO: 1358678 - RNA, 19 nt, Human
accuuugcaaggcaccugg

SEQ ID NO: 1358679 - RNA, 25 nt, Human
agcagcagcagcagcaauccuggcu

SEQ ID NO: 1358680 - RNA, 20 nt, Human
aggaagaaaaagagaaagaa

SEQ ID NO: 1358681 - RNA, 18 nt, Human
aggaggaagaaaaagaga

SEQ ID NO: 1358682 - RNA, 21 nt, Human
agggaugcuggaaggaaagau

SEQ ID NO: 1358683 - RNA, 20 nt, Human
agguggucaguaaagggaug

SEQ ID NO: 1358684 - RNA, 22 nt, Human
aguaaagggaugcuggaaggaa

SEQ ID NO: 1358685 - RNA, 25 nt, Human
auaaaacaaaacaaaaccaacaacc

SEQ ID NO: 1358686 - RNA, 27 nt, Human
auaaaacaaaacaaaaccaacaaccuc

SEQ ID NO: 1358687 - RNA, 23 nt, Human
augaaucacgugaaagaaaaggc

SEQ ID NO: 1358688 - RNA, 19 nt, Human
auggcucccagcuuccacc

SEQ ID NO: 1358689 - RNA, 18 nt, Human
caaaaauaaaugagggaa

SEQ ID NO: 1358690 - RNA, 23 nt, Human
caaaacaaaaccaacaaccucau

SEQ ID NO: 1358691 - RNA, 20 nt, Human
caaaaccaacaaccucaugc

SEQ ID NO: 1358692 - RNA, 18 nt, Human
caaugaaagggguguugg

SEQ ID NO: 1358693 - RNA, 21 nt, Human
cacaaugccugauccucagga

SEQ ID NO: 1358694 - RNA, 18 nt, Human
cacacaaagcagauuagc

SEQ ID NO: 1358695 - RNA, 19 nt, Human
cacacaacuuaacaaaaau

SEQ ID NO: 1358696 - RNA, 22 nt, Human
cacauggcucccagcuuccacc

SEQ ID NO: 1358697 - RNA, 21 nt, Human
cacccccuuucccucugauuu

SEQ ID NO: 1358698 - RNA, 19 nt, Human
cacccuuugagauccacac

SEQ ID NO: 1358699 - RNA, 23 nt, Human
cacccuuugagauccacacacuu

SEQ ID NO: 1358700 - RNA, 25 nt, Human
cagaagguacauugcuuuuuauaca

SEQ ID NO: 1358701 - RNA, 18 nt, Human
caucauuuucauccagaa

SEQ ID NO: 1358702 - RNA, 19 nt, Human
cccaucuggcuggccugga

SEQ ID NO: 1358703 - RNA, 22 nt, Human
ccccaucauccuuuccauccug

SEQ ID NO: 1358704 - RNA, 21 nt, Human
cccccacauggcucccagcuu

SEQ ID NO: 1358705 - RNA, 22 nt, Human
cccccaucauccuuuccauccu

SEQ ID NO: 1358706 - RNA, 19 nt, Human
cccuaugcacaaacaggau

SEQ ID NO: 1358707 - RNA, 19 nt, Human
cccuucuucccucagaucc

SEQ ID NO: 1358708 - RNA, 21 nt, Human
cccuugcuucccacacacccc

SEQ ID NO: 1358709 - RNA, 20 nt, Human
ccucccucccuugcuuccca

SEQ ID NO: 1358710 - RNA, 20 nt, Human
ccucugauuuguguucugga

SEQ ID NO: 1358711 - RNA, 18 nt, Human
cgagaugaacaaagccuc

SEQ ID NO: 1358712 - RNA, 21 nt, Human
cuaaagugucaauuauuaaac

SEQ ID NO: 1358713 - RNA, 21 nt, Human
cuaccccccacauggcuccca

SEQ ID NO: 1358714 - RNA, 20 nt, Human
cugcaaagaagaugcaagaa

SEQ ID NO: 1358715 - RNA, 23 nt, Human
cuggguuugucauuuaaaguuuu

SEQ ID NO: 1358716 - RNA, 20 nt, Human
gaagaaaaagagaaagaaac

SEQ ID NO: 1358717 - RNA, 18 nt, Human
gaagagagugggcuugaa

SEQ ID NO: 1358718 - RNA, 20 nt, Human
gagaaggaagugggcggagg

SEQ ID NO: 1358719 - RNA, 23 nt, Human
gagggcaauuauuccuccuguga

SEQ ID NO: 1358720 - RNA, 19 nt, Human
gaguggggugcuggugugu

SEQ ID NO: 1358721 - RNA, 20 nt, Human
gcagucccaucuggcuggcc

SEQ ID NO: 1358722 - RNA, 21 nt, Human
ggcaggaguagcagcagcagc

SEQ ID NO: 1358723 - RNA, 19 nt, Human
gggcggagggucaggaagu

SEQ ID NO: 1358724 - RNA, 25 nt, Human
guagcagcagcagcagcaauccugg

SEQ ID NO: 1358725 - RNA, 21 nt, Human
gugggcggagggucaggaagu

SEQ ID NO: 1358726 - RNA, 20 nt, Human
uaaaaacccuaugcacaaaa

SEQ ID NO: 1358727 - RNA, 19 nt, Human
uaaaaacgcucuacccccc

SEQ ID NO: 1358728 - RNA, 21 nt, Human
uaaaaacgcucuaccccccac

SEQ ID NO: 1358729 - RNA, 24 nt, Human
uaaaaauaauucacacaacuuaac

SEQ ID NO: 1358730 - RNA, 23 nt, Human
uaaaauaaaugcuaaugauauuu

SEQ ID NO: 1358731 - RNA, 21 nt, Human
uaaagaacuuuucuccauguc

SEQ ID NO: 1358732 - RNA, 21 nt, Human
uaacaaaaauaaaugagggaa

SEQ ID NO: 1358733 - RNA, 20 nt, Human
uaagacaauauucacuaagc

SEQ ID NO: 1358734 - RNA, 18 nt, Human
uagagucgaguggggugc

SEQ ID NO: 1358735 - RNA, 24 nt, Human
uagagucgaguggggugcuggugu

SEQ ID NO: 1358736 - RNA, 23 nt, Human
uagcagcagcagcagcaauccug

SEQ ID NO: 1358737 - RNA, 18 nt, Human
uaguacagcugaacaccc

SEQ ID NO: 1358738 - RNA, 21 nt, Human
uauaaagauaaauugcacccu

SEQ ID NO: 1358739 - RNA, 18 nt, Human
ucacuaagcccuuugagc

SEQ ID NO: 1358740 - RNA, 24 nt, Human
uccacacacuugauuuacaacuga

SEQ ID NO: 1358741 - RNA, 20 nt, Human
ucccacacaccccaaaaaga

SEQ ID NO: 1358742 - RNA, 23 nt, Human
ucccuugcuucccacacacccca

SEQ ID NO: 1358743 - RNA, 23 nt, Human
ucuaaagugucaauuauuaaaca

SEQ ID NO: 1358744 - RNA, 21 nt, Human
ucugauuuguguucuggaggg

SEQ ID NO: 1358745 - RNA, 22 nt, Human
ucuuagccaauuuguaaaccuu

SEQ ID NO: 1358746 - RNA, 21 nt, Human
ugaaagaaaaggccaaucagu

SEQ ID NO: 1358747 - RNA, 25 nt, Human
ugaaguuguggaggugggagggcuc

SEQ ID NO: 1358748 - RNA, 25 nt, Human
ugagggaaggagcugacgacugggg

SEQ ID NO: 1358749 - RNA, 22 nt, Human
ugaguguaaccaagagguacag

SEQ ID NO: 1358750 - RNA, 23 nt, Human
ugcaagaaacgaacacccccagc

SEQ ID NO: 1358751 - RNA, 24 nt, Human
ugccaggauucagaggcuuuuugg

SEQ ID NO: 1358752 - RNA, 24 nt, Human
ugccccuacagcaguuaaaaacag

SEQ ID NO: 1358753 - RNA, 24 nt, Human
ugccugauccucagguuuuaacau

SEQ ID NO: 1358754 - RNA, 21 nt, Human
uggaaugcugucacacaaagc

SEQ ID NO: 1358755 - RNA, 22 nt, Human
uggaaugcugucacacaaagca

SEQ ID NO: 1358756 - RNA, 19 nt, Human
uggagggagaggggauuau

SEQ ID NO: 1358757 - RNA, 21 nt, Human
uggcucccagcuuccaccugc

SEQ ID NO: 1358758 - RNA, 24 nt, Human
ugguaguacagcugaacacccccu

SEQ ID NO: 1358759 - RNA, 23 nt, Human
uggucaguaaagggaugcuggaa

SEQ ID NO: 1358760 - RNA, 22 nt, Human
uuaaaaacccuaugcacaaaca

SEQ ID NO: 1358761 - RNA, 21 nt, Human
uucaauaguuugcuauuuguu

SEQ ID NO: 1358762 - RNA, 26 nt, Human
uucauacacaaugaucccaaaggagg

SEQ ID NO: 1358763 - RNA, 20 nt, Human
uuuaagaagguauuaagaga

SEQ ID NO: 1358764 - RNA, 24 nt, Human
uuucuaguauauuuauuuacuccu

SEQ ID NO: 1358765 - RNA, 20 nt, Human
caggaaaugcuauagagagc

SEQ ID NO: 1358766 - RNA, 19 nt, Human
cagguaaggcgauaccugc

SEQ ID NO: 1358767 - RNA, 19 nt, Human
ccacugcaccccggcucag

SEQ ID NO: 1358768 - RNA, 20 nt, Human
ccacugcaccccggcucagu

SEQ ID NO: 1358769 - RNA, 21 nt, Human
ccacugcaccccggcucagug

SEQ ID NO: 1358770 - RNA, 19 nt, Human
cucccgcugccacugcacc

SEQ ID NO: 1358771 - RNA, 21 nt, Human
cugcagguuggugggccuggc

SEQ ID NO: 1358772 - RNA, 23 nt, Human
uacucucccgcugccacugcacc

SEQ ID NO: 1358773 - RNA, 22 nt, Human
uagcaaaauaacagcuagaaaa

SEQ ID NO: 1358774 - RNA, 25 nt, Human
ucucccgcugccacugcaccccggc

SEQ ID NO: 1358775 - RNA, 19 nt, Human
ucuuggaauuuagccaggc

SEQ ID NO: 1358776 - RNA, 18 nt, Human
ugccaaauagcaaaauaa

SEQ ID NO: 1358777 - RNA, 20 nt, Human
ugcuauagagagccagucuc

SEQ ID NO: 1358778 - RNA, 18 nt, Human
uuuuuuuuuuuuuuuuug

SEQ ID NO: 1358779 - RNA, 19 nt, Human
uuuuuuuuuuuuuuuuugg

SEQ ID NO: 1358780 - RNA, 20 nt, Human
agagacuaacaaggccugga

SEQ ID NO: 1358781 - RNA, 21 nt, Human
agcccaggggguagcgaaaga

SEQ ID NO: 1358782 - RNA, 23 nt, Human
aggggguagcgaaagagaggagg

SEQ ID NO: 1358783 - RNA, 19 nt, Human
cagcuuccuuggcucuuug

SEQ ID NO: 1358784 - RNA, 24 nt, Human
caucuucgcccaccaccacaggga

SEQ ID NO: 1358785 - RNA, 24 nt, Human
ccauuccggcugggugcccugccu

SEQ ID NO: 1358786 - RNA, 19 nt, Human
cccugccucccuccagccc

SEQ ID NO: 1358787 - RNA, 19 nt, Human
ccucccuccagcccagggg

SEQ ID NO: 1358788 - RNA, 18 nt, Human
ccugccucccuccagccc

SEQ ID NO: 1358789 - RNA, 19 nt, Human
cuacagcuuccuuggcucu

SEQ ID NO: 1358790 - RNA, 20 nt, Human
cuuccagucuuuacauucaa

SEQ ID NO: 1358791 - RNA, 23 nt, Human
gagccuacccguuuuuuuuuuuu

SEQ ID NO: 1358792 - RNA, 20 nt, Human
gggacgcgggggagggagcc

SEQ ID NO: 1358793 - RNA, 21 nt, Human
gguagcgaaagagaggaggga

SEQ ID NO: 1358794 - RNA, 24 nt, Human
guccucuucuacagcuuccuuggc

SEQ ID NO: 1358795 - RNA, 23 nt, Human
uccuaucucacaucuccaguugu

SEQ ID NO: 1358796 - RNA, 23 nt, Human
uccucuucuacagcuuccuuggc

SEQ ID NO: 1358797 - RNA, 21 nt, Human
uccuuggcucuuugugccuau

SEQ ID NO: 1358798 - RNA, 18 nt, Human
ucuccaguuguaugucuc

SEQ ID NO: 1358799 - RNA, 18 nt, Human
ugcccugccucccuccag

SEQ ID NO: 1358800 - RNA, 22 nt, Human
ugcccugccucccuccagccca

SEQ ID NO: 1358801 - RNA, 21 nt, Human
ugccgaagagcugggcauuug

SEQ ID NO: 1358802 - RNA, 24 nt, Human
uuuuuuaagcguccucuucuacag

SEQ ID NO: 1358803 - RNA, 24 nt, Human
aagcaauucacccaccuuggccuc

SEQ ID NO: 1358804 - RNA, 20 nt, Human
aagcugcuaggauuacaggc

SEQ ID NO: 1358805 - RNA, 24 nt, Human
aagcugcuaggauuacaggcauga

SEQ ID NO: 1358806 - RNA, 24 nt, Human
aagucgcugagauuacaggcaugu

SEQ ID NO: 1358807 - RNA, 22 nt, Human
aauucuacuccaggacauacau

SEQ ID NO: 1358808 - RNA, 23 nt, Human
acaggccaucaaacagcagcagc

SEQ ID NO: 1358809 - RNA, 23 nt, Human
accuucucauagaugucuugcua

SEQ ID NO: 1358810 - RNA, 19 nt, Human
acgggguuuugcauguugg

SEQ ID NO: 1358811 - RNA, 22 nt, Human
acgggguuuugcauguuggcca

SEQ ID NO: 1358812 - RNA, 23 nt, Human
acgggguuuugcauguuggccag

SEQ ID NO: 1358813 - RNA, 24 nt, Human
acgggguuuugcauguuggccagg

SEQ ID NO: 1358814 - RNA, 25 nt, Human
acucugucgcccaggcuggacugca

SEQ ID NO: 1358815 - RNA, 24 nt, Human
acugcagugcuacgaucucagcuc

SEQ ID NO: 1358816 - RNA, 18 nt, Human
agagcacaggccaucaaa

SEQ ID NO: 1358817 - RNA, 19 nt, Human
agauuacaggcaugugcca

SEQ ID NO: 1358818 - RNA, 24 nt, Human
agauuacaggcaugugccaucaug

SEQ ID NO: 1358819 - RNA, 21 nt, Human
agcaauucacccaccuuggcc

SEQ ID NO: 1358820 - RNA, 20 nt, Human
agcaauucuccaccucagcc

SEQ ID NO: 1358821 - RNA, 19 nt, Human
aggacauacauugaucuua

SEQ ID NO: 1358822 - RNA, 23 nt, Human
auaguagggaugucugugaauac

SEQ ID NO: 1358823 - RNA, 20 nt, Human
aucugucacccagccuggag

SEQ ID NO: 1358824 - RNA, 20 nt, Human
auuuauaccauuuacuccuc

SEQ ID NO: 1358825 - RNA, 24 nt, Human
auuuuuguauuuuuaguggagacg

SEQ ID NO: 1358826 - RNA, 26 nt, Human
caagcaauucuccaccucagccuccc

SEQ ID NO: 1358827 - RNA, 22 nt, Human
caauggagaaguuuauuaucuu

SEQ ID NO: 1358828 - RNA, 24 nt, Human
caauucacccaccuuggccuccca

SEQ ID NO: 1358829 - RNA, 22 nt, Human
caccuaaaugccaacccagagc

SEQ ID NO: 1358830 - RNA, 24 nt, Human
caccucagccucccaagucgcuga

SEQ ID NO: 1358831 - RNA, 24 nt, Human
cacucugucgcccaggcuggacug

SEQ ID NO: 1358832 - RNA, 23 nt, Human
cacugcaaccucugccuuauggg

SEQ ID NO: 1358833 - RNA, 18 nt, Human
caggacauacauugaucu

SEQ ID NO: 1358834 - RNA, 26 nt, Human
cagugugauucuucaugaggcccaaa

SEQ ID NO: 1358835 - RNA, 21 nt, Human
caugccuggcuaauuuuugua

SEQ ID NO: 1358836 - RNA, 19 nt, Human
caugugccaucaugccugg

SEQ ID NO: 1358837 - RNA, 18 nt, Human
cauguuggccaggcuggu

SEQ ID NO: 1358838 - RNA, 18 nt, Human
cauguuggccaggcuggu

SEQ ID NO: 1358839 - RNA, 18 nt, Human
cauguuggccaggcuggu

SEQ ID NO: 1358840 - RNA, 24 nt, Human
cauguuggccaggcugguuuugaa

SEQ ID NO: 1358841 - RNA, 24 nt, Human
ccaagcugcuaggauuacaggcau

SEQ ID NO: 1358842 - RNA, 23 nt, Human
ccaagucgcugagauuacaggca

SEQ ID NO: 1358843 - RNA, 24 nt, Human
ccaagucgcugagauuacaggcau

SEQ ID NO: 1358844 - RNA, 18 nt, Human
ccaucaaacagcagcagc

SEQ ID NO: 1358845 - RNA, 19 nt, Human
cccaccuuggccucccaag

SEQ ID NO: 1358846 - RNA, 24 nt, Human
ccgcaaaauagucauuaguagcuc

SEQ ID NO: 1358847 - RNA, 24 nt, Human
ccugaccucaagcaauucacccac

SEQ ID NO: 1358848 - RNA, 24 nt, Human
ccuuauggguucaagcaauucucc

SEQ ID NO: 1358849 - RNA, 24 nt, Human
cucaagcaauucacccaccuuggc

SEQ ID NO: 1358850 - RNA, 19 nt, Human
cucacugcaaccucugccu

SEQ ID NO: 1358851 - RNA, 24 nt, Human
cucauaucaccuaaaugccaaccc

SEQ ID NO: 1358852 - RNA, 22 nt, Human
cuccaccucagccucccaaguc

SEQ ID NO: 1358853 - RNA, 21 nt, Human
cucccaagcugcuaggauuac

SEQ ID NO: 1358854 - RNA, 21 nt, Human
cucccaagucgcugagauuac

SEQ ID NO: 1358855 - RNA, 24 nt, Human
cugcaaccucugccuuauggguuc

SEQ ID NO: 1358856 - RNA, 25 nt, Human
cugugaauaaaaucuuccgaagucc

SEQ ID NO: 1358857 - RNA, 18 nt, Human
cuuuuuuuuuuuuuuuug

SEQ ID NO: 1358858 - RNA, 24 nt, Human
gaccucaagcaauucacccaccuu

SEQ ID NO: 1358859 - RNA, 24 nt, Human
gacgggguuuugcauguuggccag

SEQ ID NO: 1358860 - RNA, 23 nt, Human
gagacgggguuuugcauguuggc

SEQ ID NO: 1358861 - RNA, 24 nt, Human
gauuacaggcaugagccuccaugc

SEQ ID NO: 1358862 - RNA, 18 nt, Human
gauuacaggcaugugcca

SEQ ID NO: 1358863 - RNA, 24 nt, Human
gauuacaggcaugugccaucaugc

SEQ ID NO: 1358864 - RNA, 19 nt, Human
gcauguuggccaggcuggu

SEQ ID NO: 1358865 - RNA, 21 nt, Human
ggaaaaccauucaucuguuuc

SEQ ID NO: 1358866 - RNA, 21 nt, Human
ggauuacaggcaugagccucc

SEQ ID NO: 1358867 - RNA, 24 nt, Human
ggauuacaggcaugagccuccaug

SEQ ID NO: 1358868 - RNA, 24 nt, Human
ggcugguuuugaauuccugaccuc

SEQ ID NO: 1358869 - RNA, 22 nt, Human
gggguuuugcauguuggccagg

SEQ ID NO: 1358870 - RNA, 22 nt, Human
guggagacgggguuuugcaugu

SEQ ID NO: 1358871 - RNA, 22 nt, Human
uaaucugucacccagccuggag

SEQ ID NO: 1358872 - RNA, 24 nt, Human
uaauuuuuguauuuuuaguggaga

SEQ ID NO: 1358873 - RNA, 24 nt, Human
uacaggcaugagccuccaugccca

SEQ ID NO: 1358874 - RNA, 22 nt, Human
uacaggcaugugccaucaugcc

SEQ ID NO: 1358875 - RNA, 21 nt, Human
uacauugaucuuauaaauuug

SEQ ID NO: 1358876 - RNA, 18 nt, Human
uaggauuacaggcaugag

SEQ ID NO: 1358877 - RNA, 24 nt, Human
uaggauuacaggcaugagccucca

SEQ ID NO: 1358878 - RNA, 23 nt, Human
uaguggagacgggguuuugcaug

SEQ ID NO: 1358879 - RNA, 18 nt, Human
ucacugcaaccucuaccu

SEQ ID NO: 1358880 - RNA, 24 nt, Human
ucacugcaaccucugccuuauggg

SEQ ID NO: 1358881 - RNA, 24 nt, Human
ucccaagcugcuaggauuacaggc

SEQ ID NO: 1358882 - RNA, 24 nt, Human
ucccaagucgcugagauuacaggc

SEQ ID NO: 1358883 - RNA, 19 nt, Human
uccgaagucccucccucau

SEQ ID NO: 1358884 - RNA, 23 nt, Human
ucgcccaggcuggacugcagugc

SEQ ID NO: 1358885 - RNA, 23 nt, Human
ucucacucugucgcccaggcugg

SEQ ID NO: 1358886 - RNA, 24 nt, Human
ucucacucugucgcccaggcugga

SEQ ID NO: 1358887 - RNA, 26 nt, Human
ucucacucugucgcccaggcuggacu

SEQ ID NO: 1358888 - RNA, 24 nt, Human
ucugucacccagccuggaguguag

SEQ ID NO: 1358889 - RNA, 27 nt, Human
ucuucuucuucuuuuuuuuuuuuuuuu

SEQ ID NO: 1358890 - RNA, 18 nt, Human
ucuuuuuuuuuuuuuuuu

SEQ ID NO: 1358891 - RNA, 24 nt, Human
ugaauuccugaccucaagcaauuc

SEQ ID NO: 1358892 - RNA, 24 nt, Human
ugacacgaucucagcucacugcaa

SEQ ID NO: 1358893 - RNA, 24 nt, Human
ugaccucaagcaauucacccaccu

SEQ ID NO: 1358894 - RNA, 26 nt, Human
ugagacagagucuugcuuaaucuguc

SEQ ID NO: 1358895 - RNA, 21 nt, Human
ugagacgaggucacagagguc

SEQ ID NO: 1358896 - RNA, 18 nt, Human
ugagauuacaggcaugug

SEQ ID NO: 1358897 - RNA, 19 nt, Human
ugagauuacaggcaugugc

SEQ ID NO: 1358898 - RNA, 21 nt, Human
ugagauuacaggcaugugcca

SEQ ID NO: 1358899 - RNA, 21 nt, Human
ugagauuacaggcaugugcca

SEQ ID NO: 1358900 - RNA, 22 nt, Human
ugagauuacaggcaugugccau

SEQ ID NO: 1358901 - RNA, 23 nt, Human
ugagauuacaggcaugugccauc

SEQ ID NO: 1358902 - RNA, 24 nt, Human
ugagauuacaggcaugugccauca

SEQ ID NO: 1358903 - RNA, 24 nt, Human
ugcuacgaucucagcucacugcaa

SEQ ID NO: 1358904 - RNA, 20 nt, Human
ugcuaggauuacaggcauga

SEQ ID NO: 1358905 - RNA, 19 nt, Human
uggaguguagugacacgau

SEQ ID NO: 1358906 - RNA, 23 nt, Human
uggaguguagugacacgaucuca

SEQ ID NO: 1358907 - RNA, 24 nt, Human
uggccaggcugguuuugaauuccu

SEQ ID NO: 1358908 - RNA, 20 nt, Human
uggguucaagcaauucucca

SEQ ID NO: 1358909 - RNA, 19 nt, Human
uguaagagagagaagagua

SEQ ID NO: 1358910 - RNA, 22 nt, Human
uguagugacacgaucucagcuc

SEQ ID NO: 1358911 - RNA, 21 nt, Human
ugucgcccaggcuggacugca

SEQ ID NO: 1358912 - RNA, 28 nt, Human
ugugaauaaaaucuuccgaagucccucc

SEQ ID NO: 1358913 - RNA, 19 nt, Human
uguguagugggaggggcac

SEQ ID NO: 1358914 - RNA, 18 nt, Human
uuaguggagacgggguuu

SEQ ID NO: 1358915 - RNA, 18 nt, Human
uuaguggagacgggguuu

SEQ ID NO: 1358916 - RNA, 23 nt, Human
uuaguggagacgggguuuugcau

SEQ ID NO: 1358917 - RNA, 23 nt, Human
uucaagcaauucuccaccucagc

SEQ ID NO: 1358918 - RNA, 21 nt, Human
uucacccaccuuggccuccca

SEQ ID NO: 1358919 - RNA, 18 nt, Human
uucaucuguuucuucuuc

SEQ ID NO: 1358920 - RNA, 27 nt, Human
uuccugaccucaagcaauucacccacc

SEQ ID NO: 1358921 - RNA, 26 nt, Human
uucuucuuuuuuuuuuuuuuuugaga

SEQ ID NO: 1358922 - RNA, 18 nt, Human
uugcauguuggccaggcu

SEQ ID NO: 1358923 - RNA, 23 nt, Human
uuguauuuuuaguggagacgggg

SEQ ID NO: 1358924 - RNA, 18 nt, Human
uuucuuuuuuuuuuuuug

SEQ ID NO: 1358925 - RNA, 19 nt, Human
uuugagaaggagucucacu

SEQ ID NO: 1358926 - RNA, 21 nt, Human
uuuugaauuccugaccucaag

SEQ ID NO: 1358927 - RNA, 22 nt, Human
uuuugcauguuggccaggcugg

SEQ ID NO: 1358928 - RNA, 21 nt, Human
uuuuuaguggagacgggguuu

SEQ ID NO: 1358929 - RNA, 24 nt, Human
uuuuuaguggagacgggguuuugc

SEQ ID NO: 1358930 - RNA, 20 nt, Human
uuuuuguauuuuuaguggag

SEQ ID NO: 1358931 - RNA, 20 nt, Human
uuuuuuuuuuugagacagag

SEQ ID NO: 1358932 - RNA, 26 nt, Human
uuuuuuuuuuuugagaaggagucuca

SEQ ID NO: 1358933 - RNA, 24 nt, Human
uuuuuuuuuuuugagacagagucu

SEQ ID NO: 1358934 - RNA, 20 nt, Human
aacaauacaauagaacaacu

SEQ ID NO: 1358935 - RNA, 22 nt, Human
aauacauagacucuuuuccuua

SEQ ID NO: 1358936 - RNA, 22 nt, Human
aaugcuuucccacauuccauac

SEQ ID NO: 1358937 - RNA, 19 nt, Human
accaagugcuuacauucac

SEQ ID NO: 1358938 - RNA, 18 nt, Human
aucaagggaugacuguac

SEQ ID NO: 1358939 - RNA, 21 nt, Human
cagagccgagcaccgagcgcc

SEQ ID NO: 1358940 - RNA, 20 nt, Human
cagcgcagguggguggagaa

SEQ ID NO: 1358941 - RNA, 21 nt, Human
cagguccuccggacggcuccc

SEQ ID NO: 1358942 - RNA, 18 nt, Human
cauggcucacggagugcu

SEQ ID NO: 1358943 - RNA, 22 nt, Human
ccaauacccagcagguaucaag

SEQ ID NO: 1358944 - RNA, 21 nt, Human
ccggacggcucccgcugccaa

SEQ ID NO: 1358945 - RNA, 18 nt, Human
ccucugggaagcgcgccu

SEQ ID NO: 1358946 - RNA, 20 nt, Human
cuccucugggaagcgcgccu

SEQ ID NO: 1358947 - RNA, 22 nt, Human
cugccaaugcggguucccgcgg

SEQ ID NO: 1358948 - RNA, 23 nt, Human
gcgggacacaggcugccacggaa

SEQ ID NO: 1358949 - RNA, 22 nt, Human
uaaaagggacuggacauggcuc

SEQ ID NO: 1358950 - RNA, 21 nt, Human
uaaaauuaauaaaugcuuucc

SEQ ID NO: 1358951 - RNA, 23 nt, Human
uaaacaauacaauagaacaacua

SEQ ID NO: 1358952 - RNA, 22 nt, Human
ucaaccacacacuccucuggga

SEQ ID NO: 1358953 - RNA, 25 nt, Human
ugaaacaaagaaacuuuaagggagc

SEQ ID NO: 1358954 - RNA, 22 nt, Human
ugaaacaaagaaacuuuaaugu

SEQ ID NO: 1358955 - RNA, 21 nt, Human
uggaaagaaacugaaauuacu

SEQ ID NO: 1358956 - RNA, 23 nt, Human
uggaaagaaacugaaauuacuua

SEQ ID NO: 1358957 - RNA, 20 nt, Human
uucacagggucuaucuccaa

SEQ ID NO: 1358958 - RNA, 24 nt, Human
uugauaggcugacaauuacugcau

SEQ ID NO: 1358959 - RNA, 24 nt, Human
aaaaggcucaugaccagcucugcc

SEQ ID NO: 1358960 - RNA, 19 nt, Human
aaacugcugggauuacaga

SEQ ID NO: 1358961 - RNA, 22 nt, Human
aagcaguuugccaggacucggg

SEQ ID NO: 1358962 - RNA, 22 nt, Human
aaggcucaugaccagcucugcc

SEQ ID NO: 1358963 - RNA, 24 nt, Human
acuccuggccucaagcgauucucu

SEQ ID NO: 1358964 - RNA, 20 nt, Human
agcuaauaaagaacaaagac

SEQ ID NO: 1358965 - RNA, 20 nt, Human
agcuggccucaaacuccugg

SEQ ID NO: 1358966 - RNA, 24 nt, Human
agcuggccucaaacuccuggccuc

SEQ ID NO: 1358967 - RNA, 22 nt, Human
caaacugcugggauuacagaca

SEQ ID NO: 1358968 - RNA, 20 nt, Human
caagcgauucucuugccuca

SEQ ID NO: 1358969 - RNA, 21 nt, Human
caagcgauucucuugccucag

SEQ ID NO: 1358970 - RNA, 21 nt, Human
ccaaacuugaaaaagaaaauc

SEQ ID NO: 1358971 - RNA, 20 nt, Human
cccaaacuugaaaaagaaaa

SEQ ID NO: 1358972 - RNA, 25 nt, Human
cccaaacuugaaaaagaaaaucuaa

SEQ ID NO: 1358973 - RNA, 24 nt, Human
cccaaacuugugcaaauccaguga

SEQ ID NO: 1358974 - RNA, 18 nt, Human
ccccaggcaagcaguuug

SEQ ID NO: 1358975 - RNA, 20 nt, Human
ccuggccucaagcgauucuc

SEQ ID NO: 1358976 - RNA, 24 nt, Human
cugcaggugaggcacacucagaac

SEQ ID NO: 1358977 - RNA, 18 nt, Human
gauuacagacaucaccau

SEQ ID NO: 1358978 - RNA, 24 nt, Human
gcaaacugcugggauuacagacau

SEQ ID NO: 1358979 - RNA, 20 nt, Human
gggguccuugcuccgggaag

SEQ ID NO: 1358980 - RNA, 18 nt, Human
ucagcuaauaaagaacaa

SEQ ID NO: 1358981 - RNA, 19 nt, Human
ucagcuaauaaagaacaaa

SEQ ID NO: 1358982 - RNA, 19 nt, Human
ucccggacccagguggcuc

SEQ ID NO: 1358983 - RNA, 18 nt, Human
ucguucugcuguccccaa

SEQ ID NO: 1358984 - RNA, 23 nt, Human
ucuugcuaugucacucuagcugg

SEQ ID NO: 1358985 - RNA, 19 nt, Human
ugaaaaagaaaaucuaagu

SEQ ID NO: 1358986 - RNA, 20 nt, Human
ugcugggauuacagacauca

SEQ ID NO: 1358987 - RNA, 20 nt, Human
uggccucaaacuccuggccu

SEQ ID NO: 1358988 - RNA, 18 nt, Human
uggccucaagcgauucuc

SEQ ID NO: 1358989 - RNA, 24 nt, Human
uggccucaagcgauucucuugccu

SEQ ID NO: 1358990 - RNA, 20 nt, Human
ugggauuacagacaucacca

SEQ ID NO: 1358991 - RNA, 21 nt, Human
ugucaagucguucugcugucc

SEQ ID NO: 1358992 - RNA, 21 nt, Human
uuugcaaacugcugggauuac

SEQ ID NO: 1358993 - RNA, 19 nt, Human
aaagcgcugggaccacagg

SEQ ID NO: 1358994 - RNA, 24 nt, Human
aaagcgcugggaccacaggcauga

SEQ ID NO: 1358995 - RNA, 26 nt, Human
aagcgcugggaccacaggcaugagcc

SEQ ID NO: 1358996 - RNA, 24 nt, Human
accauauugaccaggcuggucucg

SEQ ID NO: 1358997 - RNA, 19 nt, Human
agaagccagguuccugaag

SEQ ID NO: 1358998 - RNA, 24 nt, Human
agguuccugaagguuuccugcauc

SEQ ID NO: 1358999 - RNA, 26 nt, Human
auggagcgacagaagcuauggcggag

SEQ ID NO: 1359000 - RNA, 24 nt, Human
augggguuucaccauauugaccag

SEQ ID NO: 1359001 - RNA, 24 nt, Human
caaagaccacugaauccauuuccc

SEQ ID NO: 1359002 - RNA, 24 nt, Human
caaagcgcugggaccacaggcaug

SEQ ID NO: 1359003 - RNA, 23 nt, Human
cacaggcaugagccacugcaccc

SEQ ID NO: 1359004 - RNA, 21 nt, Human
caccauauugaccaggcuggu

SEQ ID NO: 1359005 - RNA, 24 nt, Human
caccauauugaccaggcuggucuc

SEQ ID NO: 1359006 - RNA, 19 nt, Human
cagaagcuauggcggaggc

SEQ ID NO: 1359007 - RNA, 20 nt, Human
cagaagcuauggcggaggca

SEQ ID NO: 1359008 - RNA, 24 nt, Human
cauauugaccaggcuggucucgaa

SEQ ID NO: 1359009 - RNA, 20 nt, Human
cauccucaaagaccacugaa

SEQ ID NO: 1359010 - RNA, 24 nt, Human
ccaaagcgcugggaccacaggcau

SEQ ID NO: 1359011 - RNA, 21 nt, Human
ccacugaauccauuucccggc

SEQ ID NO: 1359012 - RNA, 24 nt, Human
ccagcuaaacuacucccaaaaauu

SEQ ID NO: 1359013 - RNA, 19 nt, Human
cccaugauuugagggaaac

SEQ ID NO: 1359014 - RNA, 19 nt, Human
cccgaccucccuuuggugc

SEQ ID NO: 1359015 - RNA, 20 nt, Human
ccucaaagaccacugaaucc

SEQ ID NO: 1359016 - RNA, 19 nt, Human
ccucgugguccgccugccu

SEQ ID NO: 1359017 - RNA, 21 nt, Human
ccugccucggccucccaaagc

SEQ ID NO: 1359018 - RNA, 25 nt, Human
cggcuuccagguguccuggccuccu

SEQ ID NO: 1359019 - RNA, 24 nt, Human
cuacugaccucgugguccgccugc

SEQ ID NO: 1359020 - RNA, 23 nt, Human
cucaaagaccacugaauccauuu

SEQ ID NO: 1359021 - RNA, 19 nt, Human
cugaagguuuccugcauca

SEQ ID NO: 1359022 - RNA, 23 nt, Human
cugccucggccucccaaagcgcu

SEQ ID NO: 1359023 - RNA, 18 nt, Human
cuggucccucucggggcc

SEQ ID NO: 1359024 - RNA, 23 nt, Human
gaccacaggcaugagccacugca

SEQ ID NO: 1359025 - RNA, 22 nt, Human
gaccucgugguccgccugccuc

SEQ ID NO: 1359026 - RNA, 24 nt, Human
gaccucgugguccgccugccucgg

SEQ ID NO: 1359027 - RNA, 18 nt, Human
gagaugggguuucaccau

SEQ ID NO: 1359028 - RNA, 23 nt, Human
gagaugggguuucaccauauuga

SEQ ID NO: 1359029 - RNA, 22 nt, Human
gccuccucuccacggaucccuc

SEQ ID NO: 1359030 - RNA, 20 nt, Human
ggaccacaggcaugagccac

SEQ ID NO: 1359031 - RNA, 22 nt, Human
ggaccacaggcaugagccacug

SEQ ID NO: 1359032 - RNA, 22 nt, Human
gggguuucaccauauugaccag

SEQ ID NO: 1359033 - RNA, 19 nt, Human
ggucucgaacuacugaccu

SEQ ID NO: 1359034 - RNA, 22 nt, Human
guucccaugauuugagggaaac

SEQ ID NO: 1359035 - RNA, 22 nt, Human
uaaacuacucccaaaaauuuuu

SEQ ID NO: 1359036 - RNA, 19 nt, Human
uaguagagaugggguuuca

SEQ ID NO: 1359037 - RNA, 23 nt, Human
uaguagagaugggguuucaccau

SEQ ID NO: 1359038 - RNA, 26 nt, Human
uaguagagaugggguuucaccauauu

SEQ ID NO: 1359039 - RNA, 23 nt, Human
ucacaucuacauccucaaagacc

SEQ ID NO: 1359040 - RNA, 22 nt, Human
uccaacucuguguccuagguau

SEQ ID NO: 1359041 - RNA, 18 nt, Human
ucccaaagcgcugggacc

SEQ ID NO: 1359042 - RNA, 24 nt, Human
ucccaaagcgcugggaccacaggc

SEQ ID NO: 1359043 - RNA, 18 nt, Human
ucucgaacuacugaccuc

SEQ ID NO: 1359044 - RNA, 21 nt, Human
ucugggaaggauccagcaaag

SEQ ID NO: 1359045 - RNA, 24 nt, Human
ucuucugggaaggauccagcaaag

SEQ ID NO: 1359046 - RNA, 21 nt, Human
ugaccaggcuggucucgaacu

SEQ ID NO: 1359047 - RNA, 21 nt, Human
ugccucggccucccaaagcgc

SEQ ID NO: 1359048 - RNA, 24 nt, Human
ugccucggccucccaaagcgcugg

SEQ ID NO: 1359049 - RNA, 20 nt, Human
ugggaaggauccagcaaagc

SEQ ID NO: 1359050 - RNA, 25 nt, Human
ugggaaggauccagcaaagcccacu

SEQ ID NO: 1359051 - RNA, 21 nt, Human
ugggaccacaggcaugagcca

SEQ ID NO: 1359052 - RNA, 22 nt, Human
ugggaccacaggcaugagccac

SEQ ID NO: 1359053 - RNA, 24 nt, Human
ugggaccacaggcaugagccacug

SEQ ID NO: 1359054 - RNA, 24 nt, Human
ugggaccacaggcaugagccacug

SEQ ID NO: 1359055 - RNA, 26 nt, Human
ugggaccacaggcaugagccacugca

SEQ ID NO: 1359056 - RNA, 24 nt, Human
ugggguuucaccauauugaccagg

SEQ ID NO: 1359057 - RNA, 18 nt, Human
uggugcaagacgcccucg

SEQ ID NO: 1359058 - RNA, 18 nt, Human
uuaguagagaugggguuu

SEQ ID NO: 1359059 - RNA, 22 nt, Human
uuaguagagaugggguuucacc

SEQ ID NO: 1359060 - RNA, 24 nt, Human
uuaguagagaugggguuucaccau

SEQ ID NO: 1359061 - RNA, 21 nt, Human
uuggauucgguggcuucuagg

SEQ ID NO: 1359062 - RNA, 24 nt, Human
uuuuuaguagagaugggguuucac

SEQ ID NO: 1359063 - RNA, 27 nt, Human
uuuuucagaagccagguuccugaaggu

SEQ ID NO: 1359064 - RNA, 23 nt, Human
uuuuuuaguagagaugggguuuc

SEQ ID NO: 1359065 - RNA, 24 nt, Human
uuuuuuuuuuuuuuaguagagaug

SEQ ID NO: 1359066 - RNA, 23 nt, Human
uuuuuuuuuuuuuuuuaguagag

SEQ ID NO: 1359067 - RNA, 23 nt, Human
aaaaagaaaaaaaaaauacagaa

SEQ ID NO: 1359068 - RNA, 19 nt, Human
aaaaauuaggaccaagaua

SEQ ID NO: 1359069 - RNA, 22 nt, Human
aaaagaaaaaaaaaauacagaa

SEQ ID NO: 1359070 - RNA, 18 nt, Human
aaaaugaauggggagaag

SEQ ID NO: 1359071 - RNA, 18 nt, Human
aaaauuagcugggcgugg

SEQ ID NO: 1359072 - RNA, 22 nt, Human
aaacuccgucucuacuaaaaaa

SEQ ID NO: 1359073 - RNA, 24 nt, Human
aaagugcugggauuacaggcguga

SEQ ID NO: 1359074 - RNA, 24 nt, Human
aaagugcugggauuacaggcguga

SEQ ID NO: 1359075 - RNA, 20 nt, Human
aacacgaugaaacuccgucu

SEQ ID NO: 1359076 - RNA, 21 nt, Human
aacacgaugaaacuccgucuc

SEQ ID NO: 1359077 - RNA, 20 nt, Human
aacauagugaagccccgucu

SEQ ID NO: 1359078 - RNA, 21 nt, Human
aacauagugaagccccgucuc

SEQ ID NO: 1359079 - RNA, 20 nt, Human
aacccggaggcgagaucaug

SEQ ID NO: 1359080 - RNA, 18 nt, Human
aagaugccugggauuuug

SEQ ID NO: 1359081 - RNA, 23 nt, Human
aaggaaccagaagaagugaaggc

SEQ ID NO: 1359082 - RNA, 24 nt, Human
aagugauccaccugccuuagccuc

SEQ ID NO: 1359083 - RNA, 18 nt, Human
aagugcuggaauuacagg

SEQ ID NO: 1359084 - RNA, 19 nt, Human
aagugcugggauuacaggc

SEQ ID NO: 1359085 - RNA, 19 nt, Human
aagugcugggauuacaggc

SEQ ID NO: 1359086 - RNA, 19 nt, Human
aagugcugggauuacaggc

SEQ ID NO: 1359087 - RNA, 19 nt, Human
aagugcugggauuacaggc

SEQ ID NO: 1359088 - RNA, 27 nt, Human
aauaacggccgggcacgguggcucaua

SEQ ID NO: 1359089 - RNA, 24 nt, Human
aaucacuugaacccaggaggugga

SEQ ID NO: 1359090 - RNA, 21 nt, Human
aauuacagguaagcuaccgug

SEQ ID NO: 1359091 - RNA, 19 nt, Human
aauugcuugaacccggagg

SEQ ID NO: 1359092 - RNA, 19 nt, Human
acacgaugaaacuccgucu

SEQ ID NO: 1359093 - RNA, 20 nt, Human
acagagcaagacuccgucuc

SEQ ID NO: 1359094 - RNA, 24 nt, Human
acagagcaagacuccgucucaaaa

SEQ ID NO: 1359095 - RNA, 24 nt, Human
acagagcgagacucugucucaaaa

SEQ ID NO: 1359096 - RNA, 18 nt, Human
acaggguuucacuauguu

SEQ ID NO: 1359097 - RNA, 19 nt, Human
acaggguuucacuauguug

SEQ ID NO: 1359098 - RNA, 24 nt, Human
acaggguuucacuauguugcccag

SEQ ID NO: 1359099 - RNA, 20 nt, Human
acauguuaguaugcagcugc

SEQ ID NO: 1359100 - RNA, 18 nt, Human
accagaagaagugaaggc

SEQ ID NO: 1359101 - RNA, 19 nt, Human
accggaagaaaugaaggcu

SEQ ID NO: 1359102 - RNA, 23 nt, Human
accucagccucccaaagugcugg

SEQ ID NO: 1359103 - RNA, 24 nt, Human
accucaucucuacuaaaaauauaa

SEQ ID NO: 1359104 - RNA, 18 nt, Human
acgccacugcacuccagc

SEQ ID NO: 1359105 - RNA, 21 nt, Human
acgccacugcacuccagccug

SEQ ID NO: 1359106 - RNA, 19 nt, Human
acgggguuucaccguguca

SEQ ID NO: 1359107 - RNA, 20 nt, Human
acgggguuucaccgugucag

SEQ ID NO: 1359108 - RNA, 24 nt, Human
acgggguuucaccgugucagccag

SEQ ID NO: 1359109 - RNA, 25 nt, Human
acuauguugcccaggcugguauuga

SEQ ID NO: 1359110 - RNA, 25 nt, Human
acuccgucucuacuaaaaaauacaa

SEQ ID NO: 1359111 - RNA, 22 nt, Human
acugaggcaggagaauggcgug

SEQ ID NO: 1359112 - RNA, 20 nt, Human
acugcaacauccagcuccug

SEQ ID NO: 1359113 - RNA, 24 nt, Human
acugcacuccagccugggcaacag

SEQ ID NO: 1359114 - RNA, 24 nt, Human
acugcacuccagccugggugacag

SEQ ID NO: 1359115 - RNA, 26 nt, Human
acugcacuccagccugggugacagag

SEQ ID NO: 1359116 - RNA, 23 nt, Human
agacaggguuucacuauguugcc

SEQ ID NO: 1359117 - RNA, 19 nt, Human
agaucagaaaaugcuuucc

SEQ ID NO: 1359118 - RNA, 24 nt, Human
agcacuuugggagacugaggcggg

SEQ ID NO: 1359119 - RNA, 20 nt, Human
agcacuuugggaggcuaagg

SEQ ID NO: 1359120 - RNA, 24 nt, Human
agcacuuugggaggcugaggcagg

SEQ ID NO: 1359121 - RNA, 18 nt, Human
agccaagugugguggugc

SEQ ID NO: 1359122 - RNA, 24 nt, Human
agccugaggcaggagaauugcuug

SEQ ID NO: 1359123 - RNA, 24 nt, Human
agccugggcaacagaacaagacuc

SEQ ID NO: 1359124 - RNA, 24 nt, Human
agccugggugacagagcgagacuc

SEQ ID NO: 1359125 - RNA, 21 nt, Human
agcuccuggguucaagugauu

SEQ ID NO: 1359126 - RNA, 27 nt, Human
agcuccuggguucaagugauucuccuu

SEQ ID NO: 1359127 - RNA, 19 nt, Human
agcugggcgugguggcggu

SEQ ID NO: 1359128 - RNA, 19 nt, Human
agcugggugcaguggcuca

SEQ ID NO: 1359129 - RNA, 23 nt, Human
aggaguucaagaccaguguggcc

SEQ ID NO: 1359130 - RNA, 23 nt, Human
aggaguucgagacgaaccuggcc

SEQ ID NO: 1359131 - RNA, 21 nt, Human
aggcaggagaauggcgugaac

SEQ ID NO: 1359132 - RNA, 27 nt, Human
aggcaggagaauggcgugaacccagga

SEQ ID NO: 1359133 - RNA, 24 nt, Human
aggcaggagaauugcuugaacccg

SEQ ID NO: 1359134 - RNA, 18 nt, Human
aggcagguggaucaccug

SEQ ID NO: 1359135 - RNA, 22 nt, Human
aggcagguggaucaccugaggu

SEQ ID NO: 1359136 - RNA, 26 nt, Human
aggcagguggaucaccugaggucagg

SEQ ID NO: 1359137 - RNA, 26 nt, Human
aggcagguggaucacuucaggucagg

SEQ ID NO: 1359138 - RNA, 20 nt, Human
aggcgcccaccaccacgccc

SEQ ID NO: 1359139 - RNA, 24 nt, Human
aggcgggcagaucacgaggucagg

SEQ ID NO: 1359140 - RNA, 19 nt, Human
aggcgugaaccaccgugcc

SEQ ID NO: 1359141 - RNA, 23 nt, Human
aggcgugagccacuguguccggc

SEQ ID NO: 1359142 - RNA, 24 nt, Human
aggcugaagugcaaugcugugauc

SEQ ID NO: 1359143 - RNA, 21 nt, Human
aggcugaggcagguggaucac

SEQ ID NO: 1359144 - RNA, 24 nt, Human
aggcugaggcagguggaucaccug

SEQ ID NO: 1359145 - RNA, 24 nt, Human
aggcuggggcaggagaaucacuug

SEQ ID NO: 1359146 - RNA, 23 nt, Human
aggcuuuucacauucccuucauu

SEQ ID NO: 1359147 - RNA, 24 nt, Human
agguggagcuugcagugagcugag

SEQ ID NO: 1359148 - RNA, 20 nt, Human
agguggagguggcagugaac

SEQ ID NO: 1359149 - RNA, 22 nt, Human
agguggagguggcagugaacag

SEQ ID NO: 1359150 - RNA, 22 nt, Human
agguggaucaccugaggucagg

SEQ ID NO: 1359151 - RNA, 22 nt, Human
aguagcgaugggguuuugccau

SEQ ID NO: 1359152 - RNA, 18 nt, Human
aguagcugggacuacagg

SEQ ID NO: 1359153 - RNA, 18 nt, Human
aguagcugggacuacagg

SEQ ID NO: 1359154 - RNA, 19 nt, Human
aguagcugggacuacaggc

SEQ ID NO: 1359155 - RNA, 19 nt, Human
aguagcugggacuacaggc

SEQ ID NO: 1359156 - RNA, 24 nt, Human
agugcaaugcugugaucuuggcuc

SEQ ID NO: 1359157 - RNA, 20 nt, Human
agugcaguggcgcgaucucg

SEQ ID NO: 1359158 - RNA, 23 nt, Human
agugcaguggcgcgaucucgguu

SEQ ID NO: 1359159 - RNA, 24 nt, Human
agugcaguggcgcgaucucgguuc

SEQ ID NO: 1359160 - RNA, 18 nt, Human
agugcugggauuacaggc

SEQ ID NO: 1359161 - RNA, 18 nt, Human
agugcugggauuacaggc

SEQ ID NO: 1359162 - RNA, 24 nt, Human
aguggcucaugccuguaugcacag

SEQ ID NO: 1359163 - RNA, 24 nt, Human
aguggcucaugccugucaucccag

SEQ ID NO: 1359164 - RNA, 24 nt, Human
aucacgccacugcacuccagccug

SEQ ID NO: 1359165 - RNA, 24 nt, Human
aucacuucaggucaggaguucaag

SEQ ID NO: 1359166 - RNA, 24 nt, Human
aucaugccacugcacuccagccug

SEQ ID NO: 1359167 - RNA, 19 nt, Human
augacacugaaaggaacca

SEQ ID NO: 1359168 - RNA, 24 nt, Human
augccacugcacuccagccugggc

SEQ ID NO: 1359169 - RNA, 21 nt, Human
auggggagaaggccgggugca

SEQ ID NO: 1359170 - RNA, 20 nt, Human
augggguuuugccauguuag

SEQ ID NO: 1359171 - RNA, 24 nt, Human
augggguuuugccauguuagccag

SEQ ID NO: 1359172 - RNA, 18 nt, Human
auucauaggguuuuccuc

SEQ ID NO: 1359173 - RNA, 18 nt, Human
auucuccugccucagccu

SEQ ID NO: 1359174 - RNA, 24 nt, Human
auuuuuguauuuuugguagagaca

SEQ ID NO: 1359175 - RNA, 27 nt, Human
caaaaaaaaagaaaugaacggggagag

SEQ ID NO: 1359176 - RNA, 24 nt, Human
caaagugcugggauuacaggcgug

SEQ ID NO: 1359177 - RNA, 24 nt, Human
caaagugcugggauuacaggcgug

SEQ ID NO: 1359178 - RNA, 24 nt, Human
caacauagugaagccccgucucua

SEQ ID NO: 1359179 - RNA, 21 nt, Human
caagacuccgucucaaaaaaa

SEQ ID NO: 1359180 - RNA, 21 nt, Human
caagcaauucuccugccucag

SEQ ID NO: 1359181 - RNA, 28 nt, Human
caagcaauucuccugccucagucuccca

SEQ ID NO: 1359182 - RNA, 22 nt, Human
caagugauccaccugccuuagc

SEQ ID NO: 1359183 - RNA, 20 nt, Human
caagugauucuccugccuca

SEQ ID NO: 1359184 - RNA, 22 nt, Human
caagugauucuccugccucagc

SEQ ID NO: 1359185 - RNA, 18 nt, Human
caaugccacucagaucag

SEQ ID NO: 1359186 - RNA, 22 nt, Human
cacaaagucacucugaagaaca

SEQ ID NO: 1359187 - RNA, 18 nt, Human
cacaccuguaauccuagg

SEQ ID NO: 1359188 - RNA, 27 nt, Human
cacagcacuuugggaggcugaggcagg

SEQ ID NO: 1359189 - RNA, 20 nt, Human
cacauucccuucauuuacag

SEQ ID NO: 1359190 - RNA, 24 nt, Human
caccaugccuggcuaauuuuugua

SEQ ID NO: 1359191 - RNA, 18 nt, Human
caccgugucagccaggau

SEQ ID NO: 1359192 - RNA, 23 nt, Human
caccgugucagccaggauggucu

SEQ ID NO: 1359193 - RNA, 23 nt, Human
caccugaggucaggaguucgaga

SEQ ID NO: 1359194 - RNA, 20 nt, Human
caccuguaaucccagcuacu

SEQ ID NO: 1359195 - RNA, 24 nt, Human
caccuguaaucccagcuacuuggg

SEQ ID NO: 1359196 - RNA, 21 nt, Human
caccuguagucccagcuacuc

SEQ ID NO: 1359197 - RNA, 24 nt, Human
caccuguagucccagcuacucagg

SEQ ID NO: 1359198 - RNA, 22 nt, Human
cacgccauucuccugcuucagc

SEQ ID NO: 1359199 - RNA, 18 nt, Human
cacuauguugcccaggcu

SEQ ID NO: 1359200 - RNA, 19 nt, Human
cacuauguugcccaggcug

SEQ ID NO: 1359201 - RNA, 31 nt, Human
cacuauguugcccaggcugguauugaacucc

SEQ ID NO: 1359202 - RNA, 22 nt, Human
cacuccagccugggugacagag

SEQ ID NO: 1359203 - RNA, 23 nt, Human
cacuccagccugggugacagagc

SEQ ID NO: 1359204 - RNA, 24 nt, Human
cacuccagccugggugacagagcg

SEQ ID NO: 1359205 - RNA, 21 nt, Human
cacugcaaccuccgccuccca

SEQ ID NO: 1359206 - RNA, 19 nt, Human
cacugcacuccagccuggg

SEQ ID NO: 1359207 - RNA, 19 nt, Human
cacugcacuccagccuggg

SEQ ID NO: 1359208 - RNA, 19 nt, Human
cacugcacuccagccuggg

SEQ ID NO: 1359209 - RNA, 21 nt, Human
cacugcacuccagccugggca

SEQ ID NO: 1359210 - RNA, 22 nt, Human
cacugcacuccagccugggcaa

SEQ ID NO: 1359211 - RNA, 23 nt, Human
cacugcacuccagccugggcaac

SEQ ID NO: 1359212 - RNA, 24 nt, Human
cacugcacuccagccugggcaaca

SEQ ID NO: 1359213 - RNA, 27 nt, Human
cacugcacuccagccugggcaacagaa

SEQ ID NO: 1359214 - RNA, 22 nt, Human
cacugcacuccagccuggguga

SEQ ID NO: 1359215 - RNA, 23 nt, Human
cacugcacuccagccugggugac

SEQ ID NO: 1359216 - RNA, 24 nt, Human
cacugcacuccagccugggugaca

SEQ ID NO: 1359217 - RNA, 25 nt, Human
cacugcacuccagccugggugacag

SEQ ID NO: 1359218 - RNA, 22 nt, Human
cagaacaagacucaucucaaac

SEQ ID NO: 1359219 - RNA, 22 nt, Human
cagcacuuugggagacugaggc

SEQ ID NO: 1359220 - RNA, 24 nt, Human
cagcacuuugggagacugaggcgg

SEQ ID NO: 1359221 - RNA, 24 nt, Human
cagcacuuugggaggcuaaggcag

SEQ ID NO: 1359222 - RNA, 25 nt, Human
cagcacuuugggaggcuaaggcagg

SEQ ID NO: 1359223 - RNA, 24 nt, Human
cagcacuuugggaggcugaggcag

SEQ ID NO: 1359224 - RNA, 26 nt, Human
cagcacuuugggaggcugaggcaggu

SEQ ID NO: 1359225 - RNA, 20 nt, Human
cagccuccugaguagcuggg

SEQ ID NO: 1359226 - RNA, 24 nt, Human
cagcuacuugggaggcuggggcag

SEQ ID NO: 1359227 - RNA, 19 nt, Human
caggagccugaggcaggag

SEQ ID NO: 1359228 - RNA, 29 nt, Human
caggagguggagcuugcagugacaacggu

SEQ ID NO: 1359229 - RNA, 20 nt, Human
caggagguggagguggcagu

SEQ ID NO: 1359230 - RNA, 21 nt, Human
caggcgcccaccaccacgccc

SEQ ID NO: 1359231 - RNA, 24 nt, Human
caggguuucacuauguugcccagg

SEQ ID NO: 1359232 - RNA, 24 nt, Human
cagguggaucacuucaggucagga

SEQ ID NO: 1359233 - RNA, 18 nt, Human
cagugaacagagauggaa

SEQ ID NO: 1359234 - RNA, 24 nt, Human
cauaccuguaaucccagcacuuug

SEQ ID NO: 1359235 - RNA, 24 nt, Human
caugccuguaugcacagcacuuug

SEQ ID NO: 1359236 - RNA, 21 nt, Human
cauguuagccaggcuggucuc

SEQ ID NO: 1359237 - RNA, 24 nt, Human
cauguuagccaggcuggucucgaa

SEQ ID NO: 1359238 - RNA, 22 nt, Human
ccaaagugcugggauuacaggc

SEQ ID NO: 1359239 - RNA, 22 nt, Human
ccaaagugcugggauuacaggc

SEQ ID NO: 1359240 - RNA, 22 nt, Human
ccaaagugcugggauuacaggc

SEQ ID NO: 1359241 - RNA, 22 nt, Human
ccaaagugcugggauuacaggc

SEQ ID NO: 1359242 - RNA, 24 nt, Human
ccaaagugcugggauuacaggcgu

SEQ ID NO: 1359243 - RNA, 24 nt, Human
ccaaagugcugggauuacaggcgu

SEQ ID NO: 1359244 - RNA, 20 nt, Human
ccacugcacuccagccuggg

SEQ ID NO: 1359245 - RNA, 20 nt, Human
ccacugcacuccagccuggg

SEQ ID NO: 1359246 - RNA, 20 nt, Human
ccacugcacuccagccuggg

SEQ ID NO: 1359247 - RNA, 20 nt, Human
ccacugcacuccagccuggg

SEQ ID NO: 1359248 - RNA, 21 nt, Human
ccacugcacuccagccugggc

SEQ ID NO: 1359249 - RNA, 23 nt, Human
ccacugcacuccagccugggcaa

SEQ ID NO: 1359250 - RNA, 24 nt, Human
ccacugcacuccagccugggcaac

SEQ ID NO: 1359251 - RNA, 21 nt, Human
ccacugcacuccagccugggu

SEQ ID NO: 1359252 - RNA, 21 nt, Human
ccacugcacuccagccugggu

SEQ ID NO: 1359253 - RNA, 23 nt, Human
ccacugcacuccagccuggguga

SEQ ID NO: 1359254 - RNA, 23 nt, Human
ccacugcacuccagccuggguga

SEQ ID NO: 1359255 - RNA, 24 nt, Human
ccacugcacuccagccugggugac

SEQ ID NO: 1359256 - RNA, 23 nt, Human
ccauguagcugggauuacaggca

SEQ ID NO: 1359257 - RNA, 24 nt, Human
ccauguagcugggauuacaggcau

SEQ ID NO: 1359258 - RNA, 19 nt, Human
ccauguuagccaggcuggu

SEQ ID NO: 1359259 - RNA, 22 nt, Human
ccauguuagccaggcuggucuc

SEQ ID NO: 1359260 - RNA, 23 nt, Human
ccauguuagccaggcuggucucg

SEQ ID NO: 1359261 - RNA, 21 nt, Human
cccaccaccacgcccagcuag

SEQ ID NO: 1359262 - RNA, 23 nt, Human
cccagguucaagcaauucuccug

SEQ ID NO: 1359263 - RNA, 19 nt, Human
cccauguagcugggauuac

SEQ ID NO: 1359264 - RNA, 23 nt, Human
ccccgucucuacuaaaaauacaa

SEQ ID NO: 1359265 - RNA, 23 nt, Human
cccgaguagcugggacuacaggc

SEQ ID NO: 1359266 - RNA, 24 nt, Human
cccgaguagcugggacuacaggcg

SEQ ID NO: 1359267 - RNA, 26 nt, Human
ccgcccaccucagccucccaaagugc

SEQ ID NO: 1359268 - RNA, 26 nt, Human
ccgccucccagguucaagcaauucuu

SEQ ID NO: 1359269 - RNA, 22 nt, Human
ccucagcgacagagcaagacuc

SEQ ID NO: 1359270 - RNA, 24 nt, Human
ccucccagguucaagcaauucucc

SEQ ID NO: 1359271 - RNA, 24 nt, Human
ccuccuggauucacgccauucucc

SEQ ID NO: 1359272 - RNA, 21 nt, Human
ccugaccucaagugauccacc

SEQ ID NO: 1359273 - RNA, 23 nt, Human
ccugaccucaagugauccaccug

SEQ ID NO: 1359274 - RNA, 23 nt, Human
ccugaccucaagugauccaccug

SEQ ID NO: 1359275 - RNA, 21 nt, Human
ccugaccucaggugaucugcc

SEQ ID NO: 1359276 - RNA, 23 nt, Human
ccugaccucaggugaucugccug

SEQ ID NO: 1359277 - RNA, 22 nt, Human
ccugaggucaggaguucgagac

SEQ ID NO: 1359278 - RNA, 23 nt, Human
ccugaguagcugggacuacaggc

SEQ ID NO: 1359279 - RNA, 24 nt, Human
ccugaguagcugggacuacaggca

SEQ ID NO: 1359280 - RNA, 23 nt, Human
ccugccucagccuccugaguagc

SEQ ID NO: 1359281 - RNA, 24 nt, Human
ccugccucagucucccauguagcu

SEQ ID NO: 1359282 - RNA, 22 nt, Human
ccugccuuggucucccaaagug

SEQ ID NO: 1359283 - RNA, 24 nt, Human
ccugccuuggucucccaaagugcu

SEQ ID NO: 1359284 - RNA, 24 nt, Human
ccugcuucagccucccgaguagcu

SEQ ID NO: 1359285 - RNA, 23 nt, Human
ccuggccaacauagugaagcccc

SEQ ID NO: 1359286 - RNA, 24 nt, Human
ccuggccaacauagugaagccccg

SEQ ID NO: 1359287 - RNA, 23 nt, Human
ccuggcuaacacgaugaaacucc

SEQ ID NO: 1359288 - RNA, 22 nt, Human
ccugggugacagagcgagacuc

SEQ ID NO: 1359289 - RNA, 23 nt, Human
ccuggguucaagugauucuccuc

SEQ ID NO: 1359290 - RNA, 23 nt, Human
ccuggguucaagugauucuccug

SEQ ID NO: 1359291 - RNA, 21 nt, Human
ccuguaaucccagcuacuugg

SEQ ID NO: 1359292 - RNA, 21 nt, Human
ccuguagucccagcuacucag

SEQ ID NO: 1359293 - RNA, 20 nt, Human
ccugucaucccagcacuuug

SEQ ID NO: 1359294 - RNA, 24 nt, Human
cgagacgaaccuggccaacauagu

SEQ ID NO: 1359295 - RNA, 24 nt, Human
cgagaucaugccacugcacuccag

SEQ ID NO: 1359296 - RNA, 30 nt, Human
cgaugggguuuugccauguuagccaggcuu

SEQ ID NO: 1359297 - RNA, 22 nt, Human
cgggcagaucacgaggucagga

SEQ ID NO: 1359298 - RNA, 19 nt, Human
cgugagccacuguguccgg

SEQ ID NO: 1359299 - RNA, 24 nt, Human
cgugauccgcccaccucagccucc

SEQ ID NO: 1359300 - RNA, 19 nt, Human
cuacuaaaaaauacaaaaa

SEQ ID NO: 1359301 - RNA, 23 nt, Human
cucaagugauccaccugccuuag

SEQ ID NO: 1359302 - RNA, 24 nt, Human
cucacugcaaccuccgccucccag

SEQ ID NO: 1359303 - RNA, 24 nt, Human
cucagccuccugaguagcugggac

SEQ ID NO: 1359304 - RNA, 23 nt, Human
cucagucucccauguagcuggga

SEQ ID NO: 1359305 - RNA, 24 nt, Human
cucauaccuguaaucccagcacuu

SEQ ID NO: 1359306 - RNA, 22 nt, Human
cucaucucaaacaacaacaaaa

SEQ ID NO: 1359307 - RNA, 24 nt, Human
cucaugccuguaugcacagcacuu

SEQ ID NO: 1359308 - RNA, 23 nt, Human
cucaugccugucaucccagcacu

SEQ ID NO: 1359309 - RNA, 24 nt, Human
cucaugccugucaucccagcacuu

SEQ ID NO: 1359310 - RNA, 26 nt, Human
cuccugaccucaggugaucugccugc

SEQ ID NO: 1359311 - RNA, 22 nt, Human
cuccugaccucgugauccgccc

SEQ ID NO: 1359312 - RNA, 22 nt, Human
cuccugccucagccuccugagu

SEQ ID NO: 1359313 - RNA, 21 nt, Human
cuccuggauucacgccauucu

SEQ ID NO: 1359314 - RNA, 20 nt, Human
cuccuggguucaagugauuc

SEQ ID NO: 1359315 - RNA, 21 nt, Human
cuccuggguucaagugauucu

SEQ ID NO: 1359316 - RNA, 25 nt, Human
cugaggcaggagaauggcgugaacc

SEQ ID NO: 1359317 - RNA, 23 nt, Human
cugcaaccuccgccucccagguu

SEQ ID NO: 1359318 - RNA, 24 nt, Human
cugcaaccuccgccucccagguuc

SEQ ID NO: 1359319 - RNA, 19 nt, Human
cugcaagcucugccuccug

SEQ ID NO: 1359320 - RNA, 23 nt, Human
cugccucagccuccugaguagcu

SEQ ID NO: 1359321 - RNA, 24 nt, Human
cugccuuggucucccaaagugcug

SEQ ID NO: 1359322 - RNA, 18 nt, Human
cuggcuaacacgaugaaa

SEQ ID NO: 1359323 - RNA, 21 nt, Human
cuguaaucccagcuacuuggg

SEQ ID NO: 1359324 - RNA, 23 nt, Human
cuucaggucaggaguucaagacc

SEQ ID NO: 1359325 - RNA, 21 nt, Human
cuugaacccaggagguggagg

SEQ ID NO: 1359326 - RNA, 19 nt, Human
cuugcagugagcugagauc

SEQ ID NO: 1359327 - RNA, 20 nt, Human
cuuuuuuuuucagauggagu

SEQ ID NO: 1359328 - RNA, 20 nt, Human
gaaaaugaauggggagaagg

SEQ ID NO: 1359329 - RNA, 19 nt, Human
gaaacuccgucucuacuaa

SEQ ID NO: 1359330 - RNA, 22 nt, Human
gaacaaaaaauuaggaccaaga

SEQ ID NO: 1359331 - RNA, 19 nt, Human
gaacaagacucaucucaaa

SEQ ID NO: 1359332 - RNA, 19 nt, Human
gaagaagugaaggcuuugc

SEQ ID NO: 1359333 - RNA, 19 nt, Human
gaagccccgucucuacuaa

SEQ ID NO: 1359334 - RNA, 24 nt, Human
gaaggccgggugcaguggcucaug

SEQ ID NO: 1359335 - RNA, 19 nt, Human
gaagugcuggaauuacagg

SEQ ID NO: 1359336 - RNA, 24 nt, Human
gacagagcaagacuccgucucaaa

SEQ ID NO: 1359337 - RNA, 24 nt, Human
gacagagcgagacucugucucaaa

SEQ ID NO: 1359338 - RNA, 24 nt, Human
gaccucaagugauccaccugccuu

SEQ ID NO: 1359339 - RNA, 24 nt, Human
gaccucaggugaucugccugccuu

SEQ ID NO: 1359340 - RNA, 22 nt, Human
gaccucgugauccgcccaccuc

SEQ ID NO: 1359341 - RNA, 24 nt, Human
gaccucgugauccgcccaccucag

SEQ ID NO: 1359342 - RNA, 19 nt, Human
gacucaucucaaacaacaa

SEQ ID NO: 1359343 - RNA, 19 nt, Human
gacucugucucaaaaagaa

SEQ ID NO: 1359344 - RNA, 23 nt, Human
gagaaucacuugaacccaggagg

SEQ ID NO: 1359345 - RNA, 18 nt, Human
gagaccauccuggcuaac

SEQ ID NO: 1359346 - RNA, 24 nt, Human
gagacgggguuucaccgugucagc

SEQ ID NO: 1359347 - RNA, 23 nt, Human
gagaucacgccacugcacuccag

SEQ ID NO: 1359348 - RNA, 18 nt, Human
gaggcuggggcaggagaa

SEQ ID NO: 1359349 - RNA, 24 nt, Human
gaguagcugggacuacaggcacgc

SEQ ID NO: 1359350 - RNA, 25 nt, Human
gaguagcugggacuacaggcgccca

SEQ ID NO: 1359351 - RNA, 24 nt, Human
gaucaccugaggucaggaguucga

SEQ ID NO: 1359352 - RNA, 18 nt, Human
gaucacuucaggucagga

SEQ ID NO: 1359353 - RNA, 24 nt, Human
gaucacuucaggucaggaguucaa

SEQ ID NO: 1359354 - RNA, 18 nt, Human
gauuacaggcaugugcca

SEQ ID NO: 1359355 - RNA, 22 nt, Human
gauuacaggcaugugccaccau

SEQ ID NO: 1359356 - RNA, 20 nt, Human
gauuacaggcgugaaccacc

SEQ ID NO: 1359357 - RNA, 21 nt, Human
gauuacaggcgugaaccaccg

SEQ ID NO: 1359358 - RNA, 18 nt, Human
gauuacaggcgugagcca

SEQ ID NO: 1359359 - RNA, 21 nt, Human
gauuacaggcgugagccacug

SEQ ID NO: 1359360 - RNA, 24 nt, Human
gauuacaggcgugagccacugugu

SEQ ID NO: 1359361 - RNA, 21 nt, Human
gauucuccugccucagccucc

SEQ ID NO: 1359362 - RNA, 22 nt, Human
gcaaccuccgccucccagguuc

SEQ ID NO: 1359363 - RNA, 24 nt, Human
gcacuccagccugggugacagagc

SEQ ID NO: 1359364 - RNA, 22 nt, Human
gcaggagaaucacuugaaccca

SEQ ID NO: 1359365 - RNA, 22 nt, Human
gcaggagaauggcgugaaccca

SEQ ID NO: 1359366 - RNA, 21 nt, Human
gccaacauagugaagccccgu

SEQ ID NO: 1359367 - RNA, 24 nt, Human
gccaacauagugaagccccgucuc

SEQ ID NO: 1359368 - RNA, 19 nt, Human
gccacugcacuccagccug

SEQ ID NO: 1359369 - RNA, 22 nt, Human
gccacugcacuccagccugggc

SEQ ID NO: 1359370 - RNA, 24 nt, Human
gccacugcacuccagccugggcaa

SEQ ID NO: 1359371 - RNA, 24 nt, Human
gccacugcacuccagccuggguga

SEQ ID NO: 1359372 - RNA, 18 nt, Human
gccacugugggauauggc

SEQ ID NO: 1359373 - RNA, 20 nt, Human
gccauguuagccaggcuggu

SEQ ID NO: 1359374 - RNA, 24 nt, Human
gccucagucucccauguagcuggg

SEQ ID NO: 1359375 - RNA, 22 nt, Human
gccuuggucucccaaagugcug

SEQ ID NO: 1359376 - RNA, 24 nt, Human
gccuuggucucccaaagugcuggg

SEQ ID NO: 1359377 - RNA, 19 nt, Human
gcgagaucaugccacugca

SEQ ID NO: 1359378 - RNA, 20 nt, Human
gcggucaccuguaaucccag

SEQ ID NO: 1359379 - RNA, 24 nt, Human
gcuccuggguucaagugauucucc

SEQ ID NO: 1359380 - RNA, 20 nt, Human
gcugagaucacgccacugca

SEQ ID NO: 1359381 - RNA, 23 nt, Human
gcugguauugaacuccugaccuc

SEQ ID NO: 1359382 - RNA, 23 nt, Human
gcuggucucgaacuccugaccuc

SEQ ID NO: 1359383 - RNA, 19 nt, Human
gcuuuuuuuuucagaugga

SEQ ID NO: 1359384 - RNA, 18 nt, Human
ggagcuugcagugagcug

SEQ ID NO: 1359385 - RNA, 23 nt, Human
ggagcuugcagugagcugagauc

SEQ ID NO: 1359386 - RNA, 24 nt, Human
ggagcuugcagugagcugagauca

SEQ ID NO: 1359387 - RNA, 23 nt, Human
ggagcuugcagugagcuggcuag

SEQ ID NO: 1359388 - RNA, 24 nt, Human
ggagguggcagugaacagagaugg

SEQ ID NO: 1359389 - RNA, 18 nt, Human
ggagucucacucugcugg

SEQ ID NO: 1359390 - RNA, 22 nt, Human
ggaucaccugaggucaggaguu

SEQ ID NO: 1359391 - RNA, 24 nt, Human
ggauggucuugaucuccugaccuc

SEQ ID NO: 1359392 - RNA, 24 nt, Human
ggauuacaggcaugugccaccaug

SEQ ID NO: 1359393 - RNA, 20 nt, Human
ggcacgguggcucauaccug

SEQ ID NO: 1359394 - RNA, 23 nt, Human
ggcacgguggcucauaccuguaa

SEQ ID NO: 1359395 - RNA, 22 nt, Human
ggcaggagaaucacuugaaccc

SEQ ID NO: 1359396 - RNA, 23 nt, Human
ggccgggugcaguggcucaugcc

SEQ ID NO: 1359397 - RNA, 21 nt, Human
ggcggucaccuguaaucccag

SEQ ID NO: 1359398 - RNA, 23 nt, Human
ggcgugguggcggucaccuguaa

SEQ ID NO: 1359399 - RNA, 24 nt, Human
ggcugguauugaacuccugaccuc

SEQ ID NO: 1359400 - RNA, 24 nt, Human
ggcuggucucgaacuccugaccuc

SEQ ID NO: 1359401 - RNA, 22 nt, Human
gggcagaucacgaggucaggag

SEQ ID NO: 1359402 - RNA, 25 nt, Human
gggcagaucacgaggucaggagauu

SEQ ID NO: 1359403 - RNA, 18 nt, Human
gggcaggagaaucacuug

SEQ ID NO: 1359404 - RNA, 23 nt, Human
gggguuucaccgugucagccagg

SEQ ID NO: 1359405 - RNA, 22 nt, Human
gggguuuugccauguuagccag

SEQ ID NO: 1359406 - RNA, 23 nt, Human
gggugcaguggcucaugccugua

SEQ ID NO: 1359407 - RNA, 22 nt, Human
ggguuucaccgugucagccagg

SEQ ID NO: 1359408 - RNA, 20 nt, Human
gguacaguggcguaaucucg

SEQ ID NO: 1359409 - RNA, 19 nt, Human
ggucucgaacuccugaccu

SEQ ID NO: 1359410 - RNA, 21 nt, Human
ggugcaguggcucaugccugu

SEQ ID NO: 1359411 - RNA, 24 nt, Human
gguggcaggcaccuguagucccag

SEQ ID NO: 1359412 - RNA, 24 nt, Human
gguggcggucaccuguaaucccag

SEQ ID NO: 1359413 - RNA, 23 nt, Human
gguggcucauaccuguaauccca

SEQ ID NO: 1359414 - RNA, 24 nt, Human
gguggcucauaccuguaaucccag

SEQ ID NO: 1359415 - RNA, 24 nt, Human
gguggugcacaccuguaauccuag

SEQ ID NO: 1359416 - RNA, 22 nt, Human
ggugugguggcaggcaccugua

SEQ ID NO: 1359417 - RNA, 24 nt, Human
guaauauugacucacaauguccaa

SEQ ID NO: 1359418 - RNA, 18 nt, Human
guagagacaggguuucac

SEQ ID NO: 1359419 - RNA, 22 nt, Human
guagagacaggguuucacuaug

SEQ ID NO: 1359420 - RNA, 23 nt, Human
guagagacgggguuucaccgugu

SEQ ID NO: 1359421 - RNA, 23 nt, Human
guagcgaugggguuuugccaugu

SEQ ID NO: 1359422 - RNA, 22 nt, Human
guagcugggauuacaggcaugu

SEQ ID NO: 1359423 - RNA, 24 nt, Human
gugacagagcgagacucugucuca

SEQ ID NO: 1359424 - RNA, 22 nt, Human
gugauccaccugccuuagccuc

SEQ ID NO: 1359425 - RNA, 24 nt, Human
gugauccgcccaccucagccuccc

SEQ ID NO: 1359426 - RNA, 24 nt, Human
gugauucuccugccucagccuccu

SEQ ID NO: 1359427 - RNA, 20 nt, Human
guggagcuugcagugagcug

SEQ ID NO: 1359428 - RNA, 21 nt, Human
guggaucaccugaggucagga

SEQ ID NO: 1359429 - RNA, 23 nt, Human
guggcucauaccuguaaucccag

SEQ ID NO: 1359430 - RNA, 21 nt, Human
gugggacaacugaaugcuucc

SEQ ID NO: 1359431 - RNA, 24 nt, Human
guuucacuauguugcccaggcugg

SEQ ID NO: 1359432 - RNA, 22 nt, Human
uaacacgaugaaacuccgucuc

SEQ ID NO: 1359433 - RNA, 24 nt, Human
uaacacgaugaaacuccgucucua

SEQ ID NO: 1359434 - RNA, 25 nt, Human
uaacagcugggugcaguggcucaug

SEQ ID NO: 1359435 - RNA, 24 nt, Human
uaaggcagguggaucacuucaggu

SEQ ID NO: 1359436 - RNA, 26 nt, Human
uaaggcagguggaucacuucagguca

SEQ ID NO: 1359437 - RNA, 20 nt, Human
uaaguccuuuugugaauuau

SEQ ID NO: 1359438 - RNA, 23 nt, Human
uaauccuaggaaucuuuuuccuc

SEQ ID NO: 1359439 - RNA, 24 nt, Human
uaauuuuuguauuuuugguagaga

SEQ ID NO: 1359440 - RNA, 20 nt, Human
uaauuuuuuguauuuuuaga

SEQ ID NO: 1359441 - RNA, 22 nt, Human
uaauuuuuuguauuuuuaguag

SEQ ID NO: 1359442 - RNA, 24 nt, Human
uacaaaaggaucugauacaaugga

SEQ ID NO: 1359443 - RNA, 22 nt, Human
uacaggcacgcgccaccaugcc

SEQ ID NO: 1359444 - RNA, 24 nt, Human
uacaggcaugugccaccaugccca

SEQ ID NO: 1359445 - RNA, 23 nt, Human
uacaggcgugagccacugugucc

SEQ ID NO: 1359446 - RNA, 23 nt, Human
uacaggcgugagccacugugucc

SEQ ID NO: 1359447 - RNA, 21 nt, Human
uaccauguggguuucaaugcc

SEQ ID NO: 1359448 - RNA, 23 nt, Human
uaccuguaaucccagcacuuugg

SEQ ID NO: 1359449 - RNA, 24 nt, Human
uaccuguaaucccagcacuuuggg

SEQ ID NO: 1359450 - RNA, 20 nt, Human
uacuguuucucuccagugug

SEQ ID NO: 1359451 - RNA, 22 nt, Human
uagagacaggguuucacuaugu

SEQ ID NO: 1359452 - RNA, 18 nt, Human
uagcaaaucugaaggcuu

SEQ ID NO: 1359453 - RNA, 24 nt, Human
uagccaggcuggucucgaacuccu

SEQ ID NO: 1359454 - RNA, 19 nt, Human
uagccucuggaagugcugg

SEQ ID NO: 1359455 - RNA, 22 nt, Human
uagcgaugggguuuugccaugu

SEQ ID NO: 1359456 - RNA, 25 nt, Human
uaggaccaagauaaauguucuaagu

SEQ ID NO: 1359457 - RNA, 21 nt, Human
uaguagagacgggguuucacc

SEQ ID NO: 1359458 - RNA, 24 nt, Human
uaguagagacgggguuucaccgug

SEQ ID NO: 1359459 - RNA, 26 nt, Human
uaguagagacgggguuucaccguugg

SEQ ID NO: 1359460 - RNA, 24 nt, Human
uaguagcgaugggguuuugccaug

SEQ ID NO: 1359461 - RNA, 18 nt, Human
uauguugcccaggcuggu

SEQ ID NO: 1359462 - RNA, 20 nt, Human
uauguugcccaggcugguau

SEQ ID NO: 1359463 - RNA, 24 nt, Human
uauguugcccaggcugguauugaa

SEQ ID NO: 1359464 - RNA, 21 nt, Human
ucaagugauccaccugccuua

SEQ ID NO: 1359465 - RNA, 19 nt, Human
ucaagugauucuccugccu

SEQ ID NO: 1359466 - RNA, 24 nt, Human
ucaccgugucagccaggauggucu

SEQ ID NO: 1359467 - RNA, 20 nt, Human
ucaccugaggucaggaguuc

SEQ ID NO: 1359468 - RNA, 23 nt, Human
ucaccuguaaucccagcuacuug

SEQ ID NO: 1359469 - RNA, 24 nt, Human
ucacgaggucaggagauugagacc

SEQ ID NO: 1359470 - RNA, 23 nt, Human
ucacgccacugcacuccagccug

SEQ ID NO: 1359471 - RNA, 22 nt, Human
ucacuauguugcccaggcuggu

SEQ ID NO: 1359472 - RNA, 23 nt, Human
ucacucuuguugcccaggcugaa

SEQ ID NO: 1359473 - RNA, 24 nt, Human
ucacugcaacauccagcuccuggg

SEQ ID NO: 1359474 - RNA, 19 nt, Human
ucacugcaaccuccgccuc

SEQ ID NO: 1359475 - RNA, 24 nt, Human
ucacugcaaccuccgccucccagg

SEQ ID NO: 1359476 - RNA, 25 nt, Human
ucacugcaaccuccgccucccaggu

SEQ ID NO: 1359477 - RNA, 26 nt, Human
ucacugcaaccuccgccucccagguu

SEQ ID NO: 1359478 - RNA, 18 nt, Human
ucacugcaagcucugccu

SEQ ID NO: 1359479 - RNA, 19 nt, Human
ucacugcaagcucugccuc

SEQ ID NO: 1359480 - RNA, 23 nt, Human
ucacugcaagcucugccuccugg

SEQ ID NO: 1359481 - RNA, 24 nt, Human
ucacuucaggucaggaguucaaga

SEQ ID NO: 1359482 - RNA, 23 nt, Human
ucagccgggugugguggcaggca

SEQ ID NO: 1359483 - RNA, 18 nt, Human
ucagccucccaaagugcu

SEQ ID NO: 1359484 - RNA, 23 nt, Human
ucagccucccgaguagcugggac

SEQ ID NO: 1359485 - RNA, 23 nt, Human
ucagccuccugaguagcugggac

SEQ ID NO: 1359486 - RNA, 22 nt, Human
ucauacuguuucucuccagugu

SEQ ID NO: 1359487 - RNA, 23 nt, Human
ucaugccacugcacuccagccug

SEQ ID NO: 1359488 - RNA, 23 nt, Human
uccagccugggugacagagcgag

SEQ ID NO: 1359489 - RNA, 24 nt, Human
uccagccugggugacagagcgaga

SEQ ID NO: 1359490 - RNA, 24 nt, Human
ucccaaagugcugggauuacaggc

SEQ ID NO: 1359491 - RNA, 24 nt, Human
ucccaaagugcugggauuacaggc

SEQ ID NO: 1359492 - RNA, 21 nt, Human
ucccagguucaagcaauucuc

SEQ ID NO: 1359493 - RNA, 24 nt, Human
ucccagguucaagcaauucuccug

SEQ ID NO: 1359494 - RNA, 24 nt, Human
ucccauguagcugggauuacaggc

SEQ ID NO: 1359495 - RNA, 24 nt, Human
ucccgaguagcugggacuacaggc

SEQ ID NO: 1359496 - RNA, 21 nt, Human
uccgcccaccucagccuccca

SEQ ID NO: 1359497 - RNA, 24 nt, Human
uccugaguagcugggacuacaggc

SEQ ID NO: 1359498 - RNA, 24 nt, Human
uccuggauucacgccauucuccug

SEQ ID NO: 1359499 - RNA, 21 nt, Human
uccuggguucaagugauucuc

SEQ ID NO: 1359500 - RNA, 24 nt, Human
uccuggguucaagugauucuccug

SEQ ID NO: 1359501 - RNA, 19 nt, Human
ucucagaggguuucucucu

SEQ ID NO: 1359502 - RNA, 23 nt, Human
ucucgaacuccugaccucaggug

SEQ ID NO: 1359503 - RNA, 21 nt, Human
ucucuacuaaaaauacaaaaa

SEQ ID NO: 1359504 - RNA, 21 nt, Human
ucucuacuaaaaauauaaaaa

SEQ ID NO: 1359505 - RNA, 24 nt, Human
ucuggaagugcuggaauuacaggu

SEQ ID NO: 1359506 - RNA, 20 nt, Human
ucugucgccgcuggagugca

SEQ ID NO: 1359507 - RNA, 22 nt, Human
ucugucucaaaaagaaaaaaaa

SEQ ID NO: 1359508 - RNA, 23 nt, Human
ucugucucaaaaagaaaaaaaaa

SEQ ID NO: 1359509 - RNA, 20 nt, Human
ucuuccuguuugaaaggaag

SEQ ID NO: 1359510 - RNA, 18 nt, Human
ucuugcucugucgccgcc

SEQ ID NO: 1359511 - RNA, 20 nt, Human
ucuugcucugucgccgcugg

SEQ ID NO: 1359512 - RNA, 21 nt, Human
ucuugcucugucgccgcugga

SEQ ID NO: 1359513 - RNA, 20 nt, Human
ugaacagagauggaaccacu

SEQ ID NO: 1359514 - RNA, 23 nt, Human
ugaacccaggagguggagguggc

SEQ ID NO: 1359515 - RNA, 21 nt, Human
ugaagaacaugagauaacuuu

SEQ ID NO: 1359516 - RNA, 19 nt, Human
ugaagugcaaugcugugau

SEQ ID NO: 1359517 - RNA, 23 nt, Human
ugaagugcaaugcugugaucuug

SEQ ID NO: 1359518 - RNA, 24 nt, Human
ugaagugcaaugcugugaucuugg

SEQ ID NO: 1359519 - RNA, 24 nt, Human
ugaccucaagugauccaccugccu

SEQ ID NO: 1359520 - RNA, 18 nt, Human
ugaccucaggugaucugc

SEQ ID NO: 1359521 - RNA, 20 nt, Human
ugaccucaggugaucugccu

SEQ ID NO: 1359522 - RNA, 24 nt, Human
ugaccucaggugaucugccugccu

SEQ ID NO: 1359523 - RNA, 22 nt, Human
ugagcugagaucacgccacugc

SEQ ID NO: 1359524 - RNA, 24 nt, Human
ugaggcaggagaauggcgugaacc

SEQ ID NO: 1359525 - RNA, 25 nt, Human
ugaggcaggagaauggcgugaaccc

SEQ ID NO: 1359526 - RNA, 24 nt, Human
ugaggcaggagaauugcuugaacc

SEQ ID NO: 1359527 - RNA, 25 nt, Human
ugaggcaggagaauugcuugaaccc

SEQ ID NO: 1359528 - RNA, 20 nt, Human
ugaggcagguggaucaccug

SEQ ID NO: 1359529 - RNA, 24 nt, Human
ugaggcagguggaucaccugaggu

SEQ ID NO: 1359530 - RNA, 26 nt, Human
ugaggcagguggaucaccugagguca

SEQ ID NO: 1359531 - RNA, 24 nt, Human
ugaggcgggcagaucacgagguca

SEQ ID NO: 1359532 - RNA, 22 nt, Human
ugaguccuuucaugcaccagaa

SEQ ID NO: 1359533 - RNA, 24 nt, Human
ugauccgcccaccucagccuccca

SEQ ID NO: 1359534 - RNA, 23 nt, Human
ugcaaugcugugaucuuggcucc

SEQ ID NO: 1359535 - RNA, 21 nt, Human
ugcaucugaaguugaguggca

SEQ ID NO: 1359536 - RNA, 18 nt, Human
ugccacucagaucagaaa

SEQ ID NO: 1359537 - RNA, 24 nt, Human
ugccacugcacuccagccugggca

SEQ ID NO: 1359538 - RNA, 24 nt, Human
ugccauguuagccaggcuggucuc

SEQ ID NO: 1359539 - RNA, 27 nt, Human
ugccauguuagccaggcuggucucgaa

SEQ ID NO: 1359540 - RNA, 24 nt, Human
ugcccaggcugguauugaacuccu

SEQ ID NO: 1359541 - RNA, 24 nt, Human
ugccucagccuccugaguagcugg

SEQ ID NO: 1359542 - RNA, 24 nt, Human
ugccucagucucccauguagcugg

SEQ ID NO: 1359543 - RNA, 19 nt, Human
ugccuccuggauucacgcc

SEQ ID NO: 1359544 - RNA, 24 nt, Human
ugccugucaucccagcacuuuggg

SEQ ID NO: 1359545 - RNA, 19 nt, Human
ugccuuggucucccaaagu

SEQ ID NO: 1359546 - RNA, 18 nt, Human
ugcuggaauuacagguaa

SEQ ID NO: 1359547 - RNA, 23 nt, Human
ugcugggauuacaggcgugaacc

SEQ ID NO: 1359548 - RNA, 24 nt, Human
ugcugggauuacaggcgugagcca

SEQ ID NO: 1359549 - RNA, 24 nt, Human
ugcuucagccucccgaguagcugg

SEQ ID NO: 1359550 - RNA, 22 nt, Human
uggaagugcuggaauuacaggu

SEQ ID NO: 1359551 - RNA, 20 nt, Human
uggaauuacagguaagcuac

SEQ ID NO: 1359552 - RNA, 21 nt, Human
uggaauuacagguaagcuacc

SEQ ID NO: 1359553 - RNA, 21 nt, Human
uggaauuacagguaagcuacc

SEQ ID NO: 1359554 - RNA, 22 nt, Human
uggaauuacagguaagcuaccg

SEQ ID NO: 1359555 - RNA, 23 nt, Human
uggagugcaguggcgcgaucucg

SEQ ID NO: 1359556 - RNA, 24 nt, Human
uggagugcaguggcgcgaucucgg

SEQ ID NO: 1359557 - RNA, 24 nt, Human
uggaucaccugaggucaggaguuc

SEQ ID NO: 1359558 - RNA, 27 nt, Human
uggaucaccugaggucaggaguucgag

SEQ ID NO: 1359559 - RNA, 24 nt, Human
uggaucacuucaggucaggaguuc

SEQ ID NO: 1359560 - RNA, 20 nt, Human
uggauucacgccauucuccu

SEQ ID NO: 1359561 - RNA, 19 nt, Human
uggcacugagauauuuuau

SEQ ID NO: 1359562 - RNA, 19 nt, Human
uggcaguggaagaaaugaa

SEQ ID NO: 1359563 - RNA, 19 nt, Human
uggcguaaucucgggucac

SEQ ID NO: 1359564 - RNA, 19 nt, Human
uggcuacaaaaggaucuga

SEQ ID NO: 1359565 - RNA, 21 nt, Human
uggcucauaccuguaauccca

SEQ ID NO: 1359566 - RNA, 24 nt, Human
uggcucauaccuguaaucccagca

SEQ ID NO: 1359567 - RNA, 19 nt, Human
uggcucaugccuguaugcc

SEQ ID NO: 1359568 - RNA, 21 nt, Human
uggcucaugccugucauccca

SEQ ID NO: 1359569 - RNA, 24 nt, Human
uggcucaugccugucaucccagca

SEQ ID NO: 1359570 - RNA, 21 nt, Human
ugggacuacaggcacgcgcca

SEQ ID NO: 1359571 - RNA, 22 nt, Human
ugggacuacaggcacgcgccac

SEQ ID NO: 1359572 - RNA, 24 nt, Human
ugggacuacaggcacgcgccacca

SEQ ID NO: 1359573 - RNA, 21 nt, Human
ugggacuacaggcgcccacca

SEQ ID NO: 1359574 - RNA, 24 nt, Human
ugggacuacaggcgcccaccacca

SEQ ID NO: 1359575 - RNA, 24 nt, Human
ugggagacugaggcgggcagauca

SEQ ID NO: 1359576 - RNA, 18 nt, Human
ugggaggcuaaggcaggu

SEQ ID NO: 1359577 - RNA, 24 nt, Human
ugggaggcuaaggcagguggauca

SEQ ID NO: 1359578 - RNA, 24 nt, Human
ugggaggcugaggcagguggauca

SEQ ID NO: 1359579 - RNA, 24 nt, Human
ugggaggcuggggcaggagaauca

SEQ ID NO: 1359580 - RNA, 21 nt, Human
ugggauauggcacaaagucac

SEQ ID NO: 1359581 - RNA, 18 nt, Human
ugggauuacaggcaugug

SEQ ID NO: 1359582 - RNA, 21 nt, Human
ugggauuacaggcaugugcca

SEQ ID NO: 1359583 - RNA, 22 nt, Human
ugggauuacaggcaugugccac

SEQ ID NO: 1359584 - RNA, 24 nt, Human
ugggauuacaggcaugugccacca

SEQ ID NO: 1359585 - RNA, 19 nt, Human
ugggauuacaggcgugaac

SEQ ID NO: 1359586 - RNA, 21 nt, Human
ugggauuacaggcgugaacca

SEQ ID NO: 1359587 - RNA, 22 nt, Human
ugggauuacaggcgugaaccac

SEQ ID NO: 1359588 - RNA, 23 nt, Human
ugggauuacaggcgugaaccacc

SEQ ID NO: 1359589 - RNA, 23 nt, Human
ugggauuacaggcgugaaccacc

SEQ ID NO: 1359590 - RNA, 24 nt, Human
ugggauuacaggcgugaaccaccg

SEQ ID NO: 1359591 - RNA, 21 nt, Human
ugggauuacaggcgugagcca

SEQ ID NO: 1359592 - RNA, 22 nt, Human
ugggauuacaggcgugagccac

SEQ ID NO: 1359593 - RNA, 22 nt, Human
ugggauuacaggcgugagccac

SEQ ID NO: 1359594 - RNA, 22 nt, Human
ugggauuacaggcgugagccac

SEQ ID NO: 1359595 - RNA, 24 nt, Human
ugggauuacaggcgugagccacug

SEQ ID NO: 1359596 - RNA, 26 nt, Human
ugggauuacaggcgugagccacugug

SEQ ID NO: 1359597 - RNA, 23 nt, Human
uggggagaaggccgggugcagug

SEQ ID NO: 1359598 - RNA, 20 nt, Human
uggggcaggagaaucacuug

SEQ ID NO: 1359599 - RNA, 24 nt, Human
uggggcaggagaaucacuugaacc

SEQ ID NO: 1359600 - RNA, 24 nt, Human
ugggguacaguggcguaaucucgg

SEQ ID NO: 1359601 - RNA, 24 nt, Human
ugggguuuugccauguuagccagg

SEQ ID NO: 1359602 - RNA, 23 nt, Human
uggguucaagugauucuccugcc

SEQ ID NO: 1359603 - RNA, 24 nt, Human
uggguucaagugauucuccugccu

SEQ ID NO: 1359604 - RNA, 24 nt, Human
ugguagagacaggguuucacuaug

SEQ ID NO: 1359605 - RNA, 24 nt, Human
ugguggcaggcaccuguaguccca

SEQ ID NO: 1359606 - RNA, 24 nt, Human
ugguggcggucaccuguaauccca

SEQ ID NO: 1359607 - RNA, 22 nt, Human
ugguggugcacaccuguaaucc

SEQ ID NO: 1359608 - RNA, 19 nt, Human
uguagcugggauuacaggc

SEQ ID NO: 1359609 - RNA, 24 nt, Human
uguagcugggauuacaggcaugug

SEQ ID NO: 1359610 - RNA, 21 nt, Human
uguauuuuuaguagcgauggg

SEQ ID NO: 1359611 - RNA, 21 nt, Human
ugucagccaggauggucuuga

SEQ ID NO: 1359612 - RNA, 24 nt, Human
ugucgccgcuggagugcaguggcg

SEQ ID NO: 1359613 - RNA, 23 nt, Human
ugugguggcaggcaccuguaguc

SEQ ID NO: 1359614 - RNA, 24 nt, Human
uguucucagccucagcgacagagc

SEQ ID NO: 1359615 - RNA, 18 nt, Human
uuagccucuggaagugcu

SEQ ID NO: 1359616 - RNA, 18 nt, Human
uuagcugggcgugguggc

SEQ ID NO: 1359617 - RNA, 18 nt, Human
uuaguagagacgggguuu

SEQ ID NO: 1359618 - RNA, 22 nt, Human
uuaguagagacgggguuucacc

SEQ ID NO: 1359619 - RNA, 24 nt, Human
uuaguagagacgggguuucaccgu

SEQ ID NO: 1359620 - RNA, 18 nt, Human
uuaguagcgaugggguuu

SEQ ID NO: 1359621 - RNA, 18 nt, Human
uuaguagcgaugggguuu

SEQ ID NO: 1359622 - RNA, 24 nt, Human
uuaguagcgaugggguuuugccau

SEQ ID NO: 1359623 - RNA, 21 nt, Human
uucaagcaauucuccugccuc

SEQ ID NO: 1359624 - RNA, 25 nt, Human
uucaagcaauucuccugccucaguc

SEQ ID NO: 1359625 - RNA, 21 nt, Human
uucaagugauucuccugccuc

SEQ ID NO: 1359626 - RNA, 23 nt, Human
uucaagugauucuccugccucag

SEQ ID NO: 1359627 - RNA, 24 nt, Human
uucaagugauucuccugccucagc

SEQ ID NO: 1359628 - RNA, 24 nt, Human
uucacucuuguugcccaggcugaa

SEQ ID NO: 1359629 - RNA, 24 nt, Human
uucagccucccgaguagcugggac

SEQ ID NO: 1359630 - RNA, 24 nt, Human
uucaugauacugaaaugcaguaga

SEQ ID NO: 1359631 - RNA, 18 nt, Human
uugcagugagcugagauc

SEQ ID NO: 1359632 - RNA, 20 nt, Human
uugcagugagcugagaucac

SEQ ID NO: 1359633 - RNA, 21 nt, Human
uugcagugagcugagaucacg

SEQ ID NO: 1359634 - RNA, 24 nt, Human
uugccauguuagccaggcuggucu

SEQ ID NO: 1359635 - RNA, 18 nt, Human
uugcccaggcugaagugc

SEQ ID NO: 1359636 - RNA, 25 nt, Human
uugggagacugaggcgggcagauca

SEQ ID NO: 1359637 - RNA, 25 nt, Human
uugggaggcuaaggcagguggauca

SEQ ID NO: 1359638 - RNA, 25 nt, Human
uugggaggcugaggcagguggauca

SEQ ID NO: 1359639 - RNA, 24 nt, Human
uugguagagacaggguuucacuau

SEQ ID NO: 1359640 - RNA, 23 nt, Human
uuguugcccaggcugaagugcaa

SEQ ID NO: 1359641 - RNA, 23 nt, Human
uuucacuauguugcccaggcugg

SEQ ID NO: 1359642 - RNA, 24 nt, Human
uuucacucuuguugcccaggcuga

SEQ ID NO: 1359643 - RNA, 18 nt, Human
uuucaugguacugaaugg

SEQ ID NO: 1359644 - RNA, 19 nt, Human
uuuuccucaggagccugag

SEQ ID NO: 1359645 - RNA, 23 nt, Human
uuuugccauguuagccaggcugg

SEQ ID NO: 1359646 - RNA, 24 nt, Human
uuuuuaguagagacgggguuucac

SEQ ID NO: 1359647 - RNA, 21 nt, Human
uuuuuaguagcgaugggguuu

SEQ ID NO: 1359648 - RNA, 21 nt, Human
uuuuuaguagcgaugggguuu

SEQ ID NO: 1359649 - RNA, 22 nt, Human
uuuuugguagagacaggguuuc

SEQ ID NO: 1359650 - RNA, 24 nt, Human
uuuuugguagagacaggguuucac

SEQ ID NO: 1359651 - RNA, 20 nt, Human
uuuuuguauuuuugguagag

SEQ ID NO: 1359652 - RNA, 23 nt, Human
uuuuuuaguagagacgggguuuc

SEQ ID NO: 1359653 - RNA, 24 nt, Human
uuuuuuguauuuuuaguagcgaug

SEQ ID NO: 1359654 - RNA, 22 nt, Human
uuuuuuguauuuuuuaguagag

SEQ ID NO: 1359655 - RNA, 25 nt, Human
uuuuuuguauuuuuuaguagagacg

SEQ ID NO: 1359656 - RNA, 21 nt, Human
aaacuuguaagagaggauaau

SEQ ID NO: 1359657 - RNA, 22 nt, Human
aacagucaggacccucagcuga

SEQ ID NO: 1359658 - RNA, 24 nt, Human
aagguuuuuagcuucuuugugaug

SEQ ID NO: 1359659 - RNA, 20 nt, Human
acauucaugguuucucuuga

SEQ ID NO: 1359660 - RNA, 22 nt, Human
accuuuucuuccacuugauuga

SEQ ID NO: 1359661 - RNA, 21 nt, Human
acugaagcuugugcaugcauc

SEQ ID NO: 1359662 - RNA, 21 nt, Human
agaacagcaaauauugcagaa

SEQ ID NO: 1359663 - RNA, 18 nt, Human
agaagaggcgcucugaug

SEQ ID NO: 1359664 - RNA, 21 nt, Human
agacagggacauuuaagucug

SEQ ID NO: 1359665 - RNA, 18 nt, Human
agacuguccauucuuaga

SEQ ID NO: 1359666 - RNA, 21 nt, Human
aggagaagaggcgcucugaug

SEQ ID NO: 1359667 - RNA, 21 nt, Human
cacugcguacauucauagggu

SEQ ID NO: 1359668 - RNA, 22 nt, Human
cacuugaggaggcagacugucc

SEQ ID NO: 1359669 - RNA, 24 nt, Human
cagcucgucaaagucaaaguccag

SEQ ID NO: 1359670 - RNA, 24 nt, Human
cauuucauccauuugaucuucaau

SEQ ID NO: 1359671 - RNA, 20 nt, Human
ccagcuuuguuccauugcug

SEQ ID NO: 1359672 - RNA, 24 nt, Human
cccacacugcguacauucauaggg

SEQ ID NO: 1359673 - RNA, 20 nt, Human
cuaccaugcauucaaaggug

SEQ ID NO: 1359674 - RNA, 19 nt, Human
cugcugccuuuuguucagc

SEQ ID NO: 1359675 - RNA, 20 nt, Human
cuugugcaugcaucacauag

SEQ ID NO: 1359676 - RNA, 20 nt, Human
gaagguucugggcagaccug

SEQ ID NO: 1359677 - RNA, 24 nt, Human
gaggucuguuggauuuugcuugag

SEQ ID NO: 1359678 - RNA, 23 nt, Human
gcagaacagcaaauauugcagaa

SEQ ID NO: 1359679 - RNA, 21 nt, Human
gccaugguuuucagcuccauc

SEQ ID NO: 1359680 - RNA, 19 nt, Human
ggccccuacugggaagugc

SEQ ID NO: 1359681 - RNA, 20 nt, Human
ggguucgaacauccuccuuu

SEQ ID NO: 1359682 - RNA, 19 nt, Human
gucugcagaaguuucugcu

SEQ ID NO: 1359683 - RNA, 20 nt, Human
uaacagucaggacccucagc

SEQ ID NO: 1359684 - RNA, 25 nt, Human
uaguuagccauuuugucuaaucuuu

SEQ ID NO: 1359685 - RNA, 20 nt, Human
uauccagaaugcauucuuau

SEQ ID NO: 1359686 - RNA, 18 nt, Human
ucaccagcaggggcugca

SEQ ID NO: 1359687 - RNA, 21 nt, Human
uccuuuggaggagaagaggcg

SEQ ID NO: 1359688 - RNA, 19 nt, Human
ucuacacuguuuauucuag

SEQ ID NO: 1359689 - RNA, 22 nt, Human
ucucuugauuguguguccuacc

SEQ ID NO: 1359690 - RNA, 24 nt, Human
ucugaagccuucuucucucagcuc

SEQ ID NO: 1359691 - RNA, 22 nt, Human
ugaaucagcuacugaagcuuuu

SEQ ID NO: 1359692 - RNA, 21 nt, Human
ugaggugucaguuggccccua

SEQ ID NO: 1359693 - RNA, 23 nt, Human
ugccugauccuuccucuggaagc

SEQ ID NO: 1359694 - RNA, 23 nt, Human
ugcguacauucauaggguuuuuu

SEQ ID NO: 1359695 - RNA, 27 nt, Human
ugcucugguuucuccccaucuuugugg

SEQ ID NO: 1359696 - RNA, 18 nt, Human
ugcugggaggacugcuac

SEQ ID NO: 1359697 - RNA, 18 nt, Human
ugggcagaccugaagggu

SEQ ID NO: 1359698 - RNA, 20 nt, Human
uggugugguuguccuuucug

SEQ ID NO: 1359699 - RNA, 23 nt, Human
uggugugguuguccuuucuguuu

SEQ ID NO: 1359700 - RNA, 24 nt, Human
uguuguugccugauccuuccucug

SEQ ID NO: 1359701 - RNA, 18 nt, Human
uguuuguuaguuuuccuu

SEQ ID NO: 1359702 - RNA, 25 nt, Human
uuaagucugcagaaguuucugcugc

SEQ ID NO: 1359703 - RNA, 20 nt, Human
uuagaucucaaacuccaugc

SEQ ID NO: 1359704 - RNA, 21 nt, Human
uuagaucucaaacuccaugcu

SEQ ID NO: 1359705 - RNA, 21 nt, Human
uucagcuauccagaaugcauu

SEQ ID NO: 1359706 - RNA, 21 nt, Human
uucugcucugguuucucccca

SEQ ID NO: 1359707 - RNA, 21 nt, Human
uuggugugguuguccuuucug

SEQ ID NO: 1359708 - RNA, 19 nt, Human
uuguaagagaggauaaugc

SEQ ID NO: 1359709 - RNA, 20 nt, Human
uuguaagagaggauaaugcu

SEQ ID NO: 1359710 - RNA, 24 nt, Human
uuguugccugauccuuccucugga

SEQ ID NO: 1359711 - RNA, 23 nt, Human
uuugaucuucaauuacugauacc

SEQ ID NO: 1359712 - RNA, 21 nt, Human
uuugugguuuuaucuacuuuu

SEQ ID NO: 1359713 - RNA, 21 nt, Human
aaaagaagagaaauuauggaa

SEQ ID NO: 1359714 - RNA, 21 nt, Human
aaauauccagcaaagcccacu

SEQ ID NO: 1359715 - RNA, 20 nt, Human
aagcaagcugaaugcuuucc

SEQ ID NO: 1359716 - RNA, 22 nt, Human
aagcaagcugaaugcuuuccca

SEQ ID NO: 1359717 - RNA, 22 nt, Human
aaguucacagccacauccuuaa

SEQ ID NO: 1359718 - RNA, 21 nt, Human
acacuccugaaguuucuccug

SEQ ID NO: 1359719 - RNA, 25 nt, Human
acccgagucgaaauccgcgcaugac

SEQ ID NO: 1359720 - RNA, 21 nt, Human
auagcuucuuaauuauuuaaa

SEQ ID NO: 1359721 - RNA, 23 nt, Human
auguucuggucuuuccacuuuuu

SEQ ID NO: 1359722 - RNA, 19 nt, Human
cacuccugaaguuucuccu

SEQ ID NO: 1359723 - RNA, 18 nt, Human
cagaucccaaccgccgcc

SEQ ID NO: 1359724 - RNA, 19 nt, Human
caguuaauuguuuacauuc

SEQ ID NO: 1359725 - RNA, 27 nt, Human
cauacggauucucucucguaugagucc

SEQ ID NO: 1359726 - RNA, 20 nt, Human
cauccuuaaaagccacuggg

SEQ ID NO: 1359727 - RNA, 23 nt, Human
cauucuuagggcgccucuccucu

SEQ ID NO: 1359728 - RNA, 22 nt, Human
cccacaaugcuuacauucuuag

SEQ ID NO: 1359729 - RNA, 22 nt, Human
ccccacagaccgcugcuccucc

SEQ ID NO: 1359730 - RNA, 24 nt, Human
ccccacagaccgcugcuccuccua

SEQ ID NO: 1359731 - RNA, 21 nt, Human
ccucccguggcccccgcacaa

SEQ ID NO: 1359732 - RNA, 19 nt, Human
cggagcugcacaaaagggc

SEQ ID NO: 1359733 - RNA, 22 nt, Human
cuccacugugaguccuuuuaga

SEQ ID NO: 1359734 - RNA, 21 nt, Human
cuccagugugaauuuuuucau

SEQ ID NO: 1359735 - RNA, 20 nt, Human
cugggaaauauccagcaaag

SEQ ID NO: 1359736 - RNA, 19 nt, Human
cugugacacuccugaaguu

SEQ ID NO: 1359737 - RNA, 23 nt, Human
cuuagggcgccucuccucugugc

SEQ ID NO: 1359738 - RNA, 22 nt, Human
gaacugggguaaaaguuucucc

SEQ ID NO: 1359739 - RNA, 19 nt, Human
gaggcugugggccccacag

SEQ ID NO: 1359740 - RNA, 20 nt, Human
gcagauaugaaugcuuuccc

SEQ ID NO: 1359741 - RNA, 22 nt, Human
gccccacagaccgcugcuccuc

SEQ ID NO: 1359742 - RNA, 20 nt, Human
gucgggcugcgggcgcggag

SEQ ID NO: 1359743 - RNA, 21 nt, Human
uagggcgccucuccucugugc

SEQ ID NO: 1359744 - RNA, 24 nt, Human
ucacacacaaagcugucacaugau

SEQ ID NO: 1359745 - RNA, 18 nt, Human
ucccaaccgccgcccucg

SEQ ID NO: 1359746 - RNA, 18 nt, Human
ucccuguagagauucuuc

SEQ ID NO: 1359747 - RNA, 22 nt, Human
ucuccacaaugacugucuucuu

SEQ ID NO: 1359748 - RNA, 24 nt, Human
ucuccaguguguguccuucccaag

SEQ ID NO: 1359749 - RNA, 18 nt, Human
ucuccugggguuuuggua

SEQ ID NO: 1359750 - RNA, 19 nt, Human
ucugaagacuuucccacau

SEQ ID NO: 1359751 - RNA, 23 nt, Human
ucugacggcuuucccacauugcu

SEQ ID NO: 1359752 - RNA, 21 nt, Human
ucugggaaauauccagcaaag

SEQ ID NO: 1359753 - RNA, 28 nt, Human
ucugugcaacuuucauguauuugaaaag

SEQ ID NO: 1359754 - RNA, 18 nt, Human
ugaggcugaucugacggc

SEQ ID NO: 1359755 - RNA, 21 nt, Human
uggcagauaugaaugcuuucc

SEQ ID NO: 1359756 - RNA, 20 nt, Human
ugggccccacagaccgcugc

SEQ ID NO: 1359757 - RNA, 21 nt, Human
ugugaauuuuuucauguguuu

SEQ ID NO: 1359758 - RNA, 19 nt, Human
uguucuggucuuuccacuu

SEQ ID NO: 1359759 - RNA, 22 nt, Human
uguucuggucuuuccacuuuuu

SEQ ID NO: 1359760 - RNA, 20 nt, Human
uguuuugcauguauucaaac

SEQ ID NO: 1359761 - RNA, 23 nt, Human
uuaauuguuuacauucauuauuu

SEQ ID NO: 1359762 - RNA, 22 nt, Human
uucauagaguuucugccaagug

SEQ ID NO: 1359763 - RNA, 24 nt, Human
uucaugauauugaaaagaacugga

SEQ ID NO: 1359764 - RNA, 23 nt, Human
uucauguguuugaaauaacuugg

SEQ ID NO: 1359765 - RNA, 21 nt, Human
uucccuguagagauucuucug

SEQ ID NO: 1359766 - RNA, 20 nt, Human
uucuggucuuuccacuuuuu

SEQ ID NO: 1359767 - RNA, 22 nt, Human
uugaaugcuuguuugcauuccu

SEQ ID NO: 1359768 - RNA, 22 nt, Human
uugcauuccuuacauucauagg

SEQ ID NO: 1359769 - RNA, 21 nt, Human
uuggcagaauaaaaguguuuc

SEQ ID NO: 1359770 - RNA, 19 nt, Human
uuuauaggguuucucucca

SEQ ID NO: 1359771 - RNA, 22 nt, Human
aaacccaaaacacacaacacga

SEQ ID NO: 1359772 - RNA, 19 nt, Human
aagccugagaaaacccaaa

SEQ ID NO: 1359773 - RNA, 24 nt, Human
acacacaguguguuguuucugacc

SEQ ID NO: 1359774 - RNA, 23 nt, Human
acccaaaacacacaacacgauuu

SEQ ID NO: 1359775 - RNA, 23 nt, Human
acucugaggugcauucacugagg

SEQ ID NO: 1359776 - RNA, 24 nt, Human
agaaaacccaaaacacacaacacg

SEQ ID NO: 1359777 - RNA, 23 nt, Human
agagcuggagucccaccuugagc

SEQ ID NO: 1359778 - RNA, 24 nt, Human
agauggcuguuuacuucagcuugg

SEQ ID NO: 1359779 - RNA, 22 nt, Human
agcuuggccuucugugcaaaca

SEQ ID NO: 1359780 - RNA, 25 nt, Human
aggaggccccugagaacugcgggac

SEQ ID NO: 1359781 - RNA, 23 nt, Human
aggccccuuuucugcuggaaaug

SEQ ID NO: 1359782 - RNA, 21 nt, Human
aggugagcuuccaggaguagu

SEQ ID NO: 1359783 - RNA, 24 nt, Human
auucacugaggugagcuuccagga

SEQ ID NO: 1359784 - RNA, 21 nt, Human
caaagcugcugugcugaaugc

SEQ ID NO: 1359785 - RNA, 20 nt, Human
caagcaggaggccccugaga

SEQ ID NO: 1359786 - RNA, 24 nt, Human
caagccugagaaaacccaaaacac

SEQ ID NO: 1359787 - RNA, 22 nt, Human
cacacagaagccgccacagcca

SEQ ID NO: 1359788 - RNA, 23 nt, Human
cacacagaagccgccacagccag

SEQ ID NO: 1359789 - RNA, 20 nt, Human
cacacagaagccgccacagg

SEQ ID NO: 1359790 - RNA, 20 nt, Human
caccauguaguucccaaggu

SEQ ID NO: 1359791 - RNA, 18 nt, Human
caccucaaagcugcugug

SEQ ID NO: 1359792 - RNA, 21 nt, Human
cacgugcgugacaggcagagc

SEQ ID NO: 1359793 - RNA, 20 nt, Human
cagcacuccauccagagaaa

SEQ ID NO: 1359794 - RNA, 18 nt, Human
cagcauucugaggacguu

SEQ ID NO: 1359795 - RNA, 24 nt, Human
ccaccaggcccuguauucgcggca

SEQ ID NO: 1359796 - RNA, 22 nt, Human
cccaagugaacuuccacagcac

SEQ ID NO: 1359797 - RNA, 21 nt, Human
cccaccagcccugggccucug

SEQ ID NO: 1359798 - RNA, 23 nt, Human
cccuuuucugcuggaaauggucu

SEQ ID NO: 1359799 - RNA, 21 nt, Human
ccugagaaaacccaaaacaca

SEQ ID NO: 1359800 - RNA, 19 nt, Human
cgcggcagcucuuggacuc

SEQ ID NO: 1359801 - RNA, 18 nt, Human
cgcuccggcccaccagcc

SEQ ID NO: 1359802 - RNA, 19 nt, Human
cgcuccggcccaccagccc

SEQ ID NO: 1359803 - RNA, 23 nt, Human
cgugauuuauaaaauacccagau

SEQ ID NO: 1359804 - RNA, 19 nt, Human
cgugcgugacaggcagagc

SEQ ID NO: 1359805 - RNA, 23 nt, Human
cucaagcaggaggccccugagaa

SEQ ID NO: 1359806 - RNA, 21 nt, Human
cucguaguuuaucaagcaauu

SEQ ID NO: 1359807 - RNA, 21 nt, Human
cucuucauuuuaaaaaaagga

SEQ ID NO: 1359808 - RNA, 19 nt, Human
cuggaaauggucuuuuccc

SEQ ID NO: 1359809 - RNA, 21 nt, Human
cuggcacacagaagccgccac

SEQ ID NO: 1359810 - RNA, 21 nt, Human
gauggcuguuuacuucagcuu

SEQ ID NO: 1359811 - RNA, 18 nt, Human
gccacgcuuccacaggac

SEQ ID NO: 1359812 - RNA, 18 nt, Human
gccacgcuuccacaggac

SEQ ID NO: 1359813 - RNA, 18 nt, Human
gccacgcuuccacaggac

SEQ ID NO: 1359814 - RNA, 18 nt, Human
gcucaagcaggaggcccc

SEQ ID NO: 1359815 - RNA, 28 nt, Human
gcuggcugguggcuauggggugaggaag

SEQ ID NO: 1359816 - RNA, 22 nt, Human
ggacaaaucuuaggauauucuu

SEQ ID NO: 1359817 - RNA, 19 nt, Human
ggaggccccugagaacugc

SEQ ID NO: 1359818 - RNA, 22 nt, Human
guccaaacccgagaaaccucaa

SEQ ID NO: 1359819 - RNA, 21 nt, Human
gugggcuucuccgcagagcuc

SEQ ID NO: 1359820 - RNA, 22 nt, Human
guggggcagcuggcacacagaa

SEQ ID NO: 1359821 - RNA, 20 nt, Human
guuguuucugaccuuugccc

SEQ ID NO: 1359822 - RNA, 20 nt, Human
uaaaaagagagugagccaau

SEQ ID NO: 1359823 - RNA, 28 nt, Human
uaagcagaaaucaucaacaaucaacggg

SEQ ID NO: 1359824 - RNA, 18 nt, Human
uaagcgcacacgugcgug

SEQ ID NO: 1359825 - RNA, 20 nt, Human
uacuucagcuuggccuucug

SEQ ID NO: 1359826 - RNA, 19 nt, Human
uaggagagucuuagugaug

SEQ ID NO: 1359827 - RNA, 21 nt, Human
uauaaaauacccagauggcug

SEQ ID NO: 1359828 - RNA, 23 nt, Human
uauaaauaacuugccauuaaaaa

SEQ ID NO: 1359829 - RNA, 20 nt, Human
uauggggugaggaagguccg

SEQ ID NO: 1359830 - RNA, 19 nt, Human
uccaagccugagaaaaccc

SEQ ID NO: 1359831 - RNA, 23 nt, Human
uccaagccugagaaaacccaaaa

SEQ ID NO: 1359832 - RNA, 24 nt, Human
uccacaggacggcaagcgcagacg

SEQ ID NO: 1359833 - RNA, 24 nt, Human
uccaugaaucaaggugaauuuccg

SEQ ID NO: 1359834 - RNA, 18 nt, Human
ucccaaggucagcaccuu

SEQ ID NO: 1359835 - RNA, 18 nt, Human
uccgcagagcucaagcag

SEQ ID NO: 1359836 - RNA, 21 nt, Human
ucgcggcagcucuuggacucu

SEQ ID NO: 1359837 - RNA, 21 nt, Human
ucucagagcuggcuguuugca

SEQ ID NO: 1359838 - RNA, 19 nt, Human
ucuccgcagagcucaagca

SEQ ID NO: 1359839 - RNA, 22 nt, Human
ucugacuagaugaggccggggc

SEQ ID NO: 1359840 - RNA, 23 nt, Human
ucuggacggucagcauucugagg

SEQ ID NO: 1359841 - RNA, 25 nt, Human
ucuuggacucugaggugcauucacu

SEQ ID NO: 1359842 - RNA, 19 nt, Human
ugaaagccuggaccccacc

SEQ ID NO: 1359843 - RNA, 18 nt, Human
ugaaucaaggugaauuuc

SEQ ID NO: 1359844 - RNA, 22 nt, Human
ugacaggcagagccacgcuucc

SEQ ID NO: 1359845 - RNA, 22 nt, Human
ugacaggcagagccacgcuucc

SEQ ID NO: 1359846 - RNA, 22 nt, Human
ugacaggcagagccacgcuucc

SEQ ID NO: 1359847 - RNA, 22 nt, Human
ugagaaaacccaaaacacacaa

SEQ ID NO: 1359848 - RNA, 28 nt, Human
ugaugugcacuaagcgcacacgugcggu

SEQ ID NO: 1359849 - RNA, 22 nt, Human
ugcuggcugguggcuauggggu

SEQ ID NO: 1359850 - RNA, 18 nt, Human
uggauuuuacaagcuggc

SEQ ID NO: 1359851 - RNA, 19 nt, Human
uuagcagaaaucuuuuaaa

SEQ ID NO: 1359852 - RNA, 19 nt, Human
uugaaagccuggaccccac

SEQ ID NO: 1359853 - RNA, 20 nt, Human
uuuuuugucaacaugaauag

SEQ ID NO: 1359854 - RNA, 18 nt, Human
aaaagagaaacaagaaga

SEQ ID NO: 1359855 - RNA, 23 nt, Human
aaaauauucaauaacacuaaaau

SEQ ID NO: 1359856 - RNA, 23 nt, Human
aaagugcgggauuacagguguga

SEQ ID NO: 1359857 - RNA, 19 nt, Human
aagcaccacauucucaaau

SEQ ID NO: 1359858 - RNA, 19 nt, Human
aaugaaaaauggaacaggg

SEQ ID NO: 1359859 - RNA, 21 nt, Human
acaagaagaauauuaaacagu

SEQ ID NO: 1359860 - RNA, 21 nt, Human
acagaaauaaucccagugcuu

SEQ ID NO: 1359861 - RNA, 22 nt, Human
acauacuauucacugagaaaau

SEQ ID NO: 1359862 - RNA, 21 nt, Human
acauuggccaggcuggucucg

SEQ ID NO: 1359863 - RNA, 24 nt, Human
accuugugaucugcccgccucagc

SEQ ID NO: 1359864 - RNA, 25 nt, Human
acucugucccccaggcuggagugca

SEQ ID NO: 1359865 - RNA, 21 nt, Human
agaaauaaucccagugcuuua

SEQ ID NO: 1359866 - RNA, 23 nt, Human
agagaauuuaucagugaauggga

SEQ ID NO: 1359867 - RNA, 21 nt, Human
agcaccacauucucaaauagc

SEQ ID NO: 1359868 - RNA, 21 nt, Human
aggcagcaucucccuuuuagc

SEQ ID NO: 1359869 - RNA, 25 nt, Human
aggcuggagugcaguggcacaaucu

SEQ ID NO: 1359870 - RNA, 24 nt, Human
aggugacuauaauauuuuauucau

SEQ ID NO: 1359871 - RNA, 18 nt, Human
aguagcugggacuacagg

SEQ ID NO: 1359872 - RNA, 19 nt, Human
aguagcugggacuacaggc

SEQ ID NO: 1359873 - RNA, 21 nt, Human
agugcaguggcacaaucucag

SEQ ID NO: 1359874 - RNA, 24 nt, Human
agugcaguggcacaaucucaguuc

SEQ ID NO: 1359875 - RNA, 18 nt, Human
auauaucucccuaagcau

SEQ ID NO: 1359876 - RNA, 24 nt, Human
augggguuucaccacauuggccag

SEQ ID NO: 1359877 - RNA, 23 nt, Human
auuagcuacagaaauaaucccag

SEQ ID NO: 1359878 - RNA, 24 nt, Human
auuuuuguguuuuuaguagagaug

SEQ ID NO: 1359879 - RNA, 23 nt, Human
caaagugcgggauuacaggugug

SEQ ID NO: 1359880 - RNA, 24 nt, Human
caaagugcgggauuacagguguga

SEQ ID NO: 1359881 - RNA, 18 nt, Human
caaauacucaucaagguc

SEQ ID NO: 1359882 - RNA, 24 nt, Human
caaauacucaucaaggucaaagau

SEQ ID NO: 1359883 - RNA, 23 nt, Human
caaccuccaccucccggguucaa

SEQ ID NO: 1359884 - RNA, 22 nt, Human
caagugauuuuccugccucagc

SEQ ID NO: 1359885 - RNA, 24 nt, Human
cacauuggccaggcuggucucgaa

SEQ ID NO: 1359886 - RNA, 21 nt, Human
caccacauuggccaggcuggu

SEQ ID NO: 1359887 - RNA, 24 nt, Human
caccacauuggccaggcuggucuc

SEQ ID NO: 1359888 - RNA, 27 nt, Human
caccacauuggccaggcuggucucgaa

SEQ ID NO: 1359889 - RNA, 23 nt, Human
caccauaccuggcuaauuuuugu

SEQ ID NO: 1359890 - RNA, 22 nt, Human
cacuaaaauaacuguaagucag

SEQ ID NO: 1359891 - RNA, 24 nt, Human
cacucugucccccaggcuggagug

SEQ ID NO: 1359892 - RNA, 21 nt, Human
cacugcaaccuccaccucccg

SEQ ID NO: 1359893 - RNA, 23 nt, Human
cacugcaaccuccaccucccggg

SEQ ID NO: 1359894 - RNA, 21 nt, Human
cagcaaccaaucaaagacuga

SEQ ID NO: 1359895 - RNA, 20 nt, Human
cagcuaauucuacuaaggcc

SEQ ID NO: 1359896 - RNA, 20 nt, Human
ccaaagugcgggauuacagg

SEQ ID NO: 1359897 - RNA, 23 nt, Human
ccaaagugcgggauuacaggugu

SEQ ID NO: 1359898 - RNA, 24 nt, Human
ccaccucccggguucaagugauuu

SEQ ID NO: 1359899 - RNA, 24 nt, Human
cccaaagugcgggauuacaggugu

SEQ ID NO: 1359900 - RNA, 19 nt, Human
ccccaggcuggagugcagu

SEQ ID NO: 1359901 - RNA, 23 nt, Human
cccgaguagcugggacuacaggc

SEQ ID NO: 1359902 - RNA, 24 nt, Human
cccgaguagcugggacuacaggcg

SEQ ID NO: 1359903 - RNA, 23 nt, Human
cccggguucaagugauuuuccuc

SEQ ID NO: 1359904 - RNA, 23 nt, Human
cccggguucaagugauuuuccug

SEQ ID NO: 1359905 - RNA, 22 nt, Human
ccgcggccgcuaccuccagagc

SEQ ID NO: 1359906 - RNA, 18 nt, Human
ccucccaaagugcgggau

SEQ ID NO: 1359907 - RNA, 20 nt, Human
ccucccggguucaagugauu

SEQ ID NO: 1359908 - RNA, 27 nt, Human
ccucucagcaaccaaucaaagacugag

SEQ ID NO: 1359909 - RNA, 23 nt, Human
ccugccucagccucccgaguagc

SEQ ID NO: 1359910 - RNA, 24 nt, Human
ccugccucagccucccgaguagcu

SEQ ID NO: 1359911 - RNA, 24 nt, Human
cgggauuacaggugugagccacag

SEQ ID NO: 1359912 - RNA, 24 nt, Human
cggguucaagugauuuuccugccu

SEQ ID NO: 1359913 - RNA, 21 nt, Human
cuaaaauaacuguaagucagc

SEQ ID NO: 1359914 - RNA, 24 nt, Human
cucacucugucccccaggcuggag

SEQ ID NO: 1359915 - RNA, 24 nt, Human
cucagccucccgaguagcugggac

SEQ ID NO: 1359916 - RNA, 24 nt, Human
cuccugaccuugugaucugcccgc

SEQ ID NO: 1359917 - RNA, 18 nt, Human
cugcaaccuccaccuccc

SEQ ID NO: 1359918 - RNA, 23 nt, Human
cugcaaccuccaccucccggguu

SEQ ID NO: 1359919 - RNA, 24 nt, Human
cugcaaccuccaccucccggguuc

SEQ ID NO: 1359920 - RNA, 19 nt, Human
cuuuagaaauacuuaauua

SEQ ID NO: 1359921 - RNA, 18 nt, Human
cuuuuagccccgcccucc

SEQ ID NO: 1359922 - RNA, 24 nt, Human
gaaucuugcaaaaauuaaaaaccc

SEQ ID NO: 1359923 - RNA, 24 nt, Human
gaccuugugaucugcccgccucag

SEQ ID NO: 1359924 - RNA, 24 nt, Human
gacuacaggcgcccgccaccauac

SEQ ID NO: 1359925 - RNA, 20 nt, Human
gagaugggguuucaccacau

SEQ ID NO: 1359926 - RNA, 24 nt, Human
gagaugggguuucaccacauuggc

SEQ ID NO: 1359927 - RNA, 25 nt, Human
gaguagcugggacuacaggcgcccg

SEQ ID NO: 1359928 - RNA, 22 nt, Human
gauaaaagagaaacaagaagaa

SEQ ID NO: 1359929 - RNA, 20 nt, Human
gaugguagaaugccaggacc

SEQ ID NO: 1359930 - RNA, 18 nt, Human
gauuacaggugugagcca

SEQ ID NO: 1359931 - RNA, 22 nt, Human
gauuacaggugugagccacagc

SEQ ID NO: 1359932 - RNA, 21 nt, Human
gauuuuccugccucagccucc

SEQ ID NO: 1359933 - RNA, 22 nt, Human
gccucagccucccaaagugcgg

SEQ ID NO: 1359934 - RNA, 19 nt, Human
gcuggagugcaguggcaca

SEQ ID NO: 1359935 - RNA, 24 nt, Human
ggaaaacucaccaauuuguaaaag

SEQ ID NO: 1359936 - RNA, 25 nt, Human
ggacaggacauguggaagaagagaa

SEQ ID NO: 1359937 - RNA, 23 nt, Human
ggaggaggcguuugcuaaacggg

SEQ ID NO: 1359938 - RNA, 23 nt, Human
ggcuggucucgaacuccugaccu

SEQ ID NO: 1359939 - RNA, 18 nt, Human
gggauuacaggugugagc

SEQ ID NO: 1359940 - RNA, 18 nt, Human
gggauuacaggugugagc

SEQ ID NO: 1359941 - RNA, 20 nt, Human
gggauuacaggugugagcca

SEQ ID NO: 1359942 - RNA, 21 nt, Human
gggauuacaggugugagccac

SEQ ID NO: 1359943 - RNA, 25 nt, Human
gggauuacaggugugagccacagcg

SEQ ID NO: 1359944 - RNA, 18 nt, Human
gggguuucaccacauugg

SEQ ID NO: 1359945 - RNA, 22 nt, Human
gggguuucaccacauuggccag

SEQ ID NO: 1359946 - RNA, 22 nt, Human
ggguucaagugauuuuccugcc

SEQ ID NO: 1359947 - RNA, 23 nt, Human
ggguucaagugauuuuccugccu

SEQ ID NO: 1359948 - RNA, 22 nt, Human
ggguuucaccacauuggccagg

SEQ ID NO: 1359949 - RNA, 20 nt, Human
ggucucgaacuccugaccuu

SEQ ID NO: 1359950 - RNA, 21 nt, Human
guagaaugccaggaccuuuug

SEQ ID NO: 1359951 - RNA, 24 nt, Human
gugaucugcccgccucagccuccc

SEQ ID NO: 1359952 - RNA, 24 nt, Human
gugauuuuccugccucagccuccc

SEQ ID NO: 1359953 - RNA, 23 nt, Human
uaaaaacccuguaucaucaucaa

SEQ ID NO: 1359954 - RNA, 20 nt, Human
uaaaauuucuaagccacuau

SEQ ID NO: 1359955 - RNA, 18 nt, Human
uaaacggaugggaacugg

SEQ ID NO: 1359956 - RNA, 21 nt, Human
uaacacuaaaauauagaauau

SEQ ID NO: 1359957 - RNA, 22 nt, Human
uaauuuuuguguuuuuaguaga

SEQ ID NO: 1359958 - RNA, 24 nt, Human
uaauuuuuguguuuuuaguagaga

SEQ ID NO: 1359959 - RNA, 22 nt, Human
uacacagauaaaagagaaacaa

SEQ ID NO: 1359960 - RNA, 23 nt, Human
uacaggugugagccacagcgccc

SEQ ID NO: 1359961 - RNA, 18 nt, Human
uacuaaggccauauuaaa

SEQ ID NO: 1359962 - RNA, 18 nt, Human
uagaaaacaaaggccacu

SEQ ID NO: 1359963 - RNA, 23 nt, Human
uagaaugccaggaccuuuuguga

SEQ ID NO: 1359964 - RNA, 25 nt, Human
uagaaugccaggaccuuuugugaua

SEQ ID NO: 1359965 - RNA, 25 nt, Human
uagccaccgauuacauuucacacua

SEQ ID NO: 1359966 - RNA, 20 nt, Human
uagccccgccucucagcaac

SEQ ID NO: 1359967 - RNA, 23 nt, Human
uagccccgccucucagcaaccaa

SEQ ID NO: 1359968 - RNA, 19 nt, Human
uaguagagaugggguuuca

SEQ ID NO: 1359969 - RNA, 23 nt, Human
uaguagagaugggguuucaccac

SEQ ID NO: 1359970 - RNA, 25 nt, Human
uaguagagaugggguuucaccacau

SEQ ID NO: 1359971 - RNA, 22 nt, Human
uaugaaauuugauuuucaauga

SEQ ID NO: 1359972 - RNA, 21 nt, Human
uauuuuauucaucuauuuuca

SEQ ID NO: 1359973 - RNA, 19 nt, Human
ucaagugauuuuccugccu

SEQ ID NO: 1359974 - RNA, 23 nt, Human
ucacugcaaccuccaccucccgg

SEQ ID NO: 1359975 - RNA, 23 nt, Human
ucacugcaaccuccaccucccgg

SEQ ID NO: 1359976 - RNA, 24 nt, Human
ucacugcaaccuccaccucccggg

SEQ ID NO: 1359977 - RNA, 25 nt, Human
ucacugcaaccuccaccucccgggu

SEQ ID NO: 1359978 - RNA, 26 nt, Human
ucacugcaaccuccaccucccggguu

SEQ ID NO: 1359979 - RNA, 23 nt, Human
ucagccucccgaguagcugggac

SEQ ID NO: 1359980 - RNA, 22 nt, Human
ucccaaagugcgggauuacagg

SEQ ID NO: 1359981 - RNA, 24 nt, Human
ucccccaggcuggagugcaguggc

SEQ ID NO: 1359982 - RNA, 24 nt, Human
ucccgaguagcugggacuacaggc

SEQ ID NO: 1359983 - RNA, 18 nt, Human
ucccggguucaagugauu

SEQ ID NO: 1359984 - RNA, 24 nt, Human
ucccggguucaagugauuuuccug

SEQ ID NO: 1359985 - RNA, 27 nt, Human
ucucaaauagcuaugguaagaucaaau

SEQ ID NO: 1359986 - RNA, 21 nt, Human
ucucacucugucccccaggcu

SEQ ID NO: 1359987 - RNA, 23 nt, Human
ucucacucugucccccaggcugg

SEQ ID NO: 1359988 - RNA, 24 nt, Human
ucucacucugucccccaggcugga

SEQ ID NO: 1359989 - RNA, 19 nt, Human
ucucgaacuccugaccuug

SEQ ID NO: 1359990 - RNA, 21 nt, Human
ucugcccgccucagccuccca

SEQ ID NO: 1359991 - RNA, 19 nt, Human
ucugucccccaggcuggag

SEQ ID NO: 1359992 - RNA, 24 nt, Human
ucugucccccaggcuggagugcag

SEQ ID NO: 1359993 - RNA, 22 nt, Human
ugagaaaauagaauggcaaaga

SEQ ID NO: 1359994 - RNA, 22 nt, Human
ugagacagagucucacucuguc

SEQ ID NO: 1359995 - RNA, 26 nt, Human
ugagacagagucucacucuguccccc

SEQ ID NO: 1359996 - RNA, 24 nt, Human
ugccucagccucccgaguagcugg

SEQ ID NO: 1359997 - RNA, 18 nt, Human
uggagugcaguggcacaa

SEQ ID NO: 1359998 - RNA, 23 nt, Human
uggagugcaguggcacaaucuca

SEQ ID NO: 1359999 - RNA, 24 nt, Human
uggagugcaguggcacaaucucag

SEQ ID NO: 1360000 - RNA, 24 nt, Human
uggcacaaucucaguucacugcaa

SEQ ID NO: 1360001 - RNA, 24 nt, Human
uggccaggcuggucucgaacuccu

SEQ ID NO: 1360002 - RNA, 21 nt, Human
ugggacuacaggcgcccgcca

SEQ ID NO: 1360003 - RNA, 22 nt, Human
ugggacuacaggcgcccgccac

SEQ ID NO: 1360004 - RNA, 24 nt, Human
ugggacuacaggcgcccgccacca

SEQ ID NO: 1360005 - RNA, 25 nt, Human
ugggacuacaggcgcccgccaccau

SEQ ID NO: 1360006 - RNA, 24 nt, Human
ugggguuucaccacauuggccagg

SEQ ID NO: 1360007 - RNA, 19 nt, Human
ugucaaggacaggacaugu

SEQ ID NO: 1360008 - RNA, 19 nt, Human
uguggaagaagagaagcca

SEQ ID NO: 1360009 - RNA, 21 nt, Human
uuaaaacgaugagaauguagc

SEQ ID NO: 1360010 - RNA, 18 nt, Human
uuaguagagaugggguuu

SEQ ID NO: 1360011 - RNA, 22 nt, Human
uuaguagagaugggguuucacc

SEQ ID NO: 1360012 - RNA, 24 nt, Human
uuaguagagaugggguuucaccac

SEQ ID NO: 1360013 - RNA, 25 nt, Human
uuaguagagaugggguuucaccaca

SEQ ID NO: 1360014 - RNA, 24 nt, Human
uuauauacugcgaugacauucagc

SEQ ID NO: 1360015 - RNA, 21 nt, Human
uucaagugauuuuccugccuc

SEQ ID NO: 1360016 - RNA, 23 nt, Human
uucaagugauuuuccugccucag

SEQ ID NO: 1360017 - RNA, 24 nt, Human
uucaagugauuuuccugccucagc

SEQ ID NO: 1360018 - RNA, 19 nt, Human
uucacugagaaaauagaau

SEQ ID NO: 1360019 - RNA, 26 nt, Human
uuuccuuuuuccuuuuuuuuucuuuu

SEQ ID NO: 1360020 - RNA, 27 nt, Human
uuuccuuuuuccuuuuuuuuucuuuuu

SEQ ID NO: 1360021 - RNA, 27 nt, Human
uuugaucaagggccacuauuuccucuu

SEQ ID NO: 1360022 - RNA, 24 nt, Human
uuuguguuuuuaguagagaugggg

SEQ ID NO: 1360023 - RNA, 24 nt, Human
uuuuuaguagagaugggguuucac

SEQ ID NO: 1360024 - RNA, 18 nt, Human
uuuuuccuuuuuuuuucu

SEQ ID NO: 1360025 - RNA, 20 nt, Human
uuuuuguguuuuuaguagag

SEQ ID NO: 1360026 - RNA, 26 nt, Human
uuuuuuuuucuuuuuuuuuuuugggg

SEQ ID NO: 1360027 - RNA, 26 nt, Human
uuuuuuuuuuuugagacagagucuca

SEQ ID NO: 1360028 - RNA, 19 nt, Human
aaccccaugaaccauccuc

SEQ ID NO: 1360029 - RNA, 20 nt, Human
aaccccaugaaccauccucc

SEQ ID NO: 1360030 - RNA, 20 nt, Human
aagcugccuugggggugagc

SEQ ID NO: 1360031 - RNA, 21 nt, Human
aauggcaucagccccaaguga

SEQ ID NO: 1360032 - RNA, 18 nt, Human
acaggaauccgucagugg

SEQ ID NO: 1360033 - RNA, 18 nt, Human
acgaggcgguguggagca

SEQ ID NO: 1360034 - RNA, 20 nt, Human
agaggcugaggagcuuccuu

SEQ ID NO: 1360035 - RNA, 22 nt, Human
agcauuucuagggcugaggcag

SEQ ID NO: 1360036 - RNA, 19 nt, Human
agccagcucucuuccugcc

SEQ ID NO: 1360037 - RNA, 24 nt, Human
aggaucauuuuucucugguuauca

SEQ ID NO: 1360038 - RNA, 18 nt, Human
auaaggguuagugguguu

SEQ ID NO: 1360039 - RNA, 19 nt, Human
auccagguugaauugugcc

SEQ ID NO: 1360040 - RNA, 20 nt, Human
auuuccagaaccucuucucc

SEQ ID NO: 1360041 - RNA, 18 nt, Human
caacacgaggcggugugg

SEQ ID NO: 1360042 - RNA, 19 nt, Human
caccuacggcgcgaugggu

SEQ ID NO: 1360043 - RNA, 19 nt, Human
caccuuggaaaaagaaaaa

SEQ ID NO: 1360044 - RNA, 19 nt, Human
caggaggaccccagugaug

SEQ ID NO: 1360045 - RNA, 23 nt, Human
caggccccgaggagaaucuucca

SEQ ID NO: 1360046 - RNA, 25 nt, Human
cagggccagccccaaggcucuugca

SEQ ID NO: 1360047 - RNA, 21 nt, Human
caucccgcaagcuuucaggcc

SEQ ID NO: 1360048 - RNA, 18 nt, Human
ccacucguccucucacaa

SEQ ID NO: 1360049 - RNA, 20 nt, Human
ccaggccuuuuuugacaaga

SEQ ID NO: 1360050 - RNA, 24 nt, Human
ccagguuuggacugguacacgggc

SEQ ID NO: 1360051 - RNA, 25 nt, Human
cccaugaaccauccucugcccaagg

SEQ ID NO: 1360052 - RNA, 21 nt, Human
ccccgcauacccaacaauugg

SEQ ID NO: 1360053 - RNA, 18 nt, Human
ccuagaucuacaaacaga

SEQ ID NO: 1360054 - RNA, 23 nt, Human
cgcgcgcauuugguuuuguuguu

SEQ ID NO: 1360055 - RNA, 23 nt, Human
cgugggcaccuuggaaaaagaaa

SEQ ID NO: 1360056 - RNA, 20 nt, Human
cugcaugcagacaggcugag

SEQ ID NO: 1360057 - RNA, 23 nt, Human
cugggucccaucccucccagguu

SEQ ID NO: 1360058 - RNA, 18 nt, Human
cuugcugcuggugcaagu

SEQ ID NO: 1360059 - RNA, 22 nt, Human
gaccauaguauucaaugauccg

SEQ ID NO: 1360060 - RNA, 23 nt, Human
gacugggccugaggaggaggagu

SEQ ID NO: 1360061 - RNA, 18 nt, Human
gcacagagaggcgacuag

SEQ ID NO: 1360062 - RNA, 18 nt, Human
gccccgaggagaaucuuc

SEQ ID NO: 1360063 - RNA, 20 nt, Human
gccugcuuucccagauggag

SEQ ID NO: 1360064 - RNA, 19 nt, Human
gcucccuccuaccuccaag

SEQ ID NO: 1360065 - RNA, 19 nt, Human
ggaaaaagaaaaacuuaau

SEQ ID NO: 1360066 - RNA, 18 nt, Human
ggaggaagaagcugccuu

SEQ ID NO: 1360067 - RNA, 18 nt, Human
ggagugcgauaaccccau

SEQ ID NO: 1360068 - RNA, 22 nt, Human
ggauaccacaggggagaaacag

SEQ ID NO: 1360069 - RNA, 19 nt, Human
ggauaugcacaccgucccu

SEQ ID NO: 1360070 - RNA, 23 nt, Human
ggcaguccauugucagcuggugu

SEQ ID NO: 1360071 - RNA, 18 nt, Human
ggccugaggaggaggagu

SEQ ID NO: 1360072 - RNA, 24 nt, Human
ggccugaggaggaggaguuauuca

SEQ ID NO: 1360073 - RNA, 22 nt, Human
ggcucccuccuaccuccaagga

SEQ ID NO: 1360074 - RNA, 23 nt, Human
gggccagccccaaggcucuugca

SEQ ID NO: 1360075 - RNA, 23 nt, Human
gguuauagaaaaggggaaaggga

SEQ ID NO: 1360076 - RNA, 18 nt, Human
guugcagaggccacucgu

SEQ ID NO: 1360077 - RNA, 20 nt, Human
uaaaauggcaucagccccaa

SEQ ID NO: 1360078 - RNA, 23 nt, Human
uaaaauggcaucagccccaagug

SEQ ID NO: 1360079 - RNA, 20 nt, Human
uaagguagcugugaguaagc

SEQ ID NO: 1360080 - RNA, 24 nt, Human
uacacgggcuacuuuucugauguu

SEQ ID NO: 1360081 - RNA, 18 nt, Human
uaccacaggggagaaaca

SEQ ID NO: 1360082 - RNA, 22 nt, Human
uaccacaggggagaaacaggag

SEQ ID NO: 1360083 - RNA, 22 nt, Human
uacgugucuuccagccagcucu

SEQ ID NO: 1360084 - RNA, 18 nt, Human
uaggagaaauuggcccag

SEQ ID NO: 1360085 - RNA, 18 nt, Human
uaggcgagaucagugacc

SEQ ID NO: 1360086 - RNA, 19 nt, Human
uaggcggagguaugcggca

SEQ ID NO: 1360087 - RNA, 18 nt, Human
ucagggccagccccaagg

SEQ ID NO: 1360088 - RNA, 22 nt, Human
ucagugaccgaugugcaugcac

SEQ ID NO: 1360089 - RNA, 18 nt, Human
ucccagauggaggggugg

SEQ ID NO: 1360090 - RNA, 23 nt, Human
uccccauauccacaggaauccgu

SEQ ID NO: 1360091 - RNA, 21 nt, Human
ucccucuugaucuucaggggg

SEQ ID NO: 1360092 - RNA, 19 nt, Human
ugaaccauccucugcccaa

SEQ ID NO: 1360093 - RNA, 21 nt, Human
ugacaagacacaauugaggua

SEQ ID NO: 1360094 - RNA, 19 nt, Human
ugccuugggggugagcuug

SEQ ID NO: 1360095 - RNA, 21 nt, Human
ugcugaguaucacaguguagg

SEQ ID NO: 1360096 - RNA, 22 nt, Human
ugcugggucccaucccucccag

SEQ ID NO: 1360097 - RNA, 18 nt, Human
uggacugguacacgggcc

SEQ ID NO: 1360098 - RNA, 22 nt, Human
uggaggaagaagcugccuuggg

SEQ ID NO: 1360099 - RNA, 22 nt, Human
uggaggcauugacuguuagggu

SEQ ID NO: 1360100 - RNA, 22 nt, Human
uggaggggugguagguccacug

SEQ ID NO: 1360101 - RNA, 26 nt, Human
uggaggggugguagguccacugggga

SEQ ID NO: 1360102 - RNA, 21 nt, Human
uggcaguccauugucagcugg

SEQ ID NO: 1360103 - RNA, 19 nt, Human
uggcccagacaaacacuua

SEQ ID NO: 1360104 - RNA, 21 nt, Human
ugggauaccacaggggagaaa

SEQ ID NO: 1360105 - RNA, 22 nt, Human
ugggaugccuguaaguaagggg

SEQ ID NO: 1360106 - RNA, 20 nt, Human
ugguaaguguccaggacugc

SEQ ID NO: 1360107 - RNA, 19 nt, Human
ugguuggaacccggagagc

SEQ ID NO: 1360108 - RNA, 22 nt, Human
uguuaggguuuggugacggguu

SEQ ID NO: 1360109 - RNA, 24 nt, Human
uguucacucauaaagcucccccgc

SEQ ID NO: 1360110 - RNA, 23 nt, Human
uuaagacagcaauuggagauguu

SEQ ID NO: 1360111 - RNA, 27 nt, Human
uuagaaggagaccaggcuccagggggu

SEQ ID NO: 1360112 - RNA, 21 nt, Human
uuccagccagcucucuuccug

SEQ ID NO: 1360113 - RNA, 21 nt, Human
uuccccauauccacaggaauc

SEQ ID NO: 1360114 - RNA, 26 nt, Human
uuccugaggagugaaagugagucugg

SEQ ID NO: 1360115 - RNA, 21 nt, Human
uugaucuucaggggguacgug

SEQ ID NO: 1360116 - RNA, 22 nt, Human
uugcgcgagcauuucuagggcu

SEQ ID NO: 1360117 - RNA, 20 nt, Human
uugcugggucccaucccucc

SEQ ID NO: 1360118 - RNA, 24 nt, Human
uugcugggucccaucccucccagg

SEQ ID NO: 1360119 - RNA, 19 nt, Human
uugggggugagcuugaccc

SEQ ID NO: 1360120 - RNA, 18 nt, Human
uugguuggaacccggaga

SEQ ID NO: 1360121 - RNA, 24 nt, Human
uuucugauguuugaagcgauuucc

SEQ ID NO: 1360122 - RNA, 23 nt, Human
aaaugaagagaucucugaggucc

SEQ ID NO: 1360123 - RNA, 18 nt, Human
aacccugagccccugagc

SEQ ID NO: 1360124 - RNA, 24 nt, Human
aagagaagcugagccauugcaaug

SEQ ID NO: 1360125 - RNA, 30 nt, Human
acacagcaugcuguucucccuguacccccu

SEQ ID NO: 1360126 - RNA, 18 nt, Human
agagcgcccuggguucuu

SEQ ID NO: 1360127 - RNA, 21 nt, Human
agaguaguaucccccacacag

SEQ ID NO: 1360128 - RNA, 21 nt, Human
agccauugcaaugaguccaga

SEQ ID NO: 1360129 - RNA, 24 nt, Human
agcgcccuggguucuuuuccccag

SEQ ID NO: 1360130 - RNA, 25 nt, Human
aggagauggggugggggcuggucaa

SEQ ID NO: 1360131 - RNA, 20 nt, Human
aggugucggugaggggugga

SEQ ID NO: 1360132 - RNA, 28 nt, Human
cagcccuacuggagacgggcugugugac

SEQ ID NO: 1360133 - RNA, 24 nt, Human
caugcuguucucccuguaccccca

SEQ ID NO: 1360134 - RNA, 20 nt, Human
ccccugagcucaagugcagg

SEQ ID NO: 1360135 - RNA, 18 nt, Human
cccugagccccugagcuc

SEQ ID NO: 1360136 - RNA, 21 nt, Human
cccugaggaggacugcagagg

SEQ ID NO: 1360137 - RNA, 20 nt, Human
ccuggcuugagcuucaucgg

SEQ ID NO: 1360138 - RNA, 18 nt, Human
cggagaggagauggggug

SEQ ID NO: 1360139 - RNA, 24 nt, Human
cgguagcggggcugggguggacac

SEQ ID NO: 1360140 - RNA, 21 nt, Human
gaaggugcaggagagagucca

SEQ ID NO: 1360141 - RNA, 19 nt, Human
gagaggagauggggugggg

SEQ ID NO: 1360142 - RNA, 24 nt, Human
gagcgggguccuggggguccuguu

SEQ ID NO: 1360143 - RNA, 25 nt, Human
gcccuggguucuuuuccccagcccu

SEQ ID NO: 1360144 - RNA, 23 nt, Human
gcucaagugcagggauggccggu

SEQ ID NO: 1360145 - RNA, 19 nt, Human
gcugggguggacaccgggg

SEQ ID NO: 1360146 - RNA, 25 nt, Human
ggagaggagauggggugggggcugg

SEQ ID NO: 1360147 - RNA, 22 nt, Human
ggcaggcgugucagcacaaccc

SEQ ID NO: 1360148 - RNA, 22 nt, Human
gggcauagagaagacagguugg

SEQ ID NO: 1360149 - RNA, 23 nt, Human
gguccuguugggcccugaggagg

SEQ ID NO: 1360150 - RNA, 22 nt, Human
ggugaagaaggugcaggagaga

SEQ ID NO: 1360151 - RNA, 23 nt, Human
gugaagcaggugauggggacccu

SEQ ID NO: 1360152 - RNA, 23 nt, Human
uccagauuugcagaaagagcugu

SEQ ID NO: 1360153 - RNA, 20 nt, Human
uccugcaggggcuacagaug

SEQ ID NO: 1360154 - RNA, 18 nt, Human
ugaagcaggugaugggga

SEQ ID NO: 1360155 - RNA, 24 nt, Human
ugcagaaagagcuguuaaucagug

SEQ ID NO: 1360156 - RNA, 21 nt, Human
ugccuggagguuuauggacag

SEQ ID NO: 1360157 - RNA, 22 nt, Human
ugccuggagguuuauggacagg

SEQ ID NO: 1360158 - RNA, 18 nt, Human
uggacggugaagaaggug

SEQ ID NO: 1360159 - RNA, 25 nt, Human
uggcacuuguggcagaggguucccc

SEQ ID NO: 1360160 - RNA, 21 nt, Human
uggcagaggguuccaaaguca

SEQ ID NO: 1360161 - RNA, 18 nt, Human
ugggagcgggguccuggg

SEQ ID NO: 1360162 - RNA, 21 nt, Human
ugggagcgggguccugggggu

SEQ ID NO: 1360163 - RNA, 24 nt, Human
uggggugggggcuggucaaagcag

SEQ ID NO: 1360164 - RNA, 22 nt, Human
ugugaaaugaagagaucucuga

SEQ ID NO: 1360165 - RNA, 21 nt, Human
uucaccugugaaaugaagaga

SEQ ID NO: 1360166 - RNA, 20 nt, Human
aaacagaacaauccuguggu

SEQ ID NO: 1360167 - RNA, 18 nt, Human
acagacacccugucccuc

SEQ ID NO: 1360168 - RNA, 19 nt, Human
acccugucccucccuccuc

SEQ ID NO: 1360169 - RNA, 23 nt, Human
acccugucccucccuccucacca

SEQ ID NO: 1360170 - RNA, 22 nt, Human
acggaggcccauucaacacugg

SEQ ID NO: 1360171 - RNA, 25 nt, Human
acuucacacaucccugggagguggg

SEQ ID NO: 1360172 - RNA, 21 nt, Human
agauuuccagcugcucagaca

SEQ ID NO: 1360173 - RNA, 20 nt, Human
agccaucagugggaggaaga

SEQ ID NO: 1360174 - RNA, 18 nt, Human
agcccaggagacccugcc

SEQ ID NO: 1360175 - RNA, 18 nt, Human
agcccaggagacccugcc

SEQ ID NO: 1360176 - RNA, 22 nt, Human
aggaaacugaggcuggcccaau

SEQ ID NO: 1360177 - RNA, 23 nt, Human
aggggcaggcccagcuggggccc

SEQ ID NO: 1360178 - RNA, 22 nt, Human
caaugccacagggccaggggca

SEQ ID NO: 1360179 - RNA, 18 nt, Human
cacaagaggaauuacugc

SEQ ID NO: 1360180 - RNA, 20 nt, Human
cacccugucccucccuccuc

SEQ ID NO: 1360181 - RNA, 21 nt, Human
cacccugucccucccuccuca

SEQ ID NO: 1360182 - RNA, 23 nt, Human
cacccugucccucccuccucacc

SEQ ID NO: 1360183 - RNA, 20 nt, Human
cacuccccauuuaggauccc

SEQ ID NO: 1360184 - RNA, 25 nt, Human
cagacccaggcccacaacgucucca

SEQ ID NO: 1360185 - RNA, 23 nt, Human
cagcccaggcuuguggacagcag

SEQ ID NO: 1360186 - RNA, 21 nt, Human
cagccgcugcgagcacgccug

SEQ ID NO: 1360187 - RNA, 22 nt, Human
caggcuggugggccuuuaaggc

SEQ ID NO: 1360188 - RNA, 23 nt, Human
cagguuguguggagcugaguggu

SEQ ID NO: 1360189 - RNA, 19 nt, Human
ccaaagcgggugcagggac

SEQ ID NO: 1360190 - RNA, 21 nt, Human
ccaaugccacagggccagggg

SEQ ID NO: 1360191 - RNA, 18 nt, Human
cccaacucuggaagccga

SEQ ID NO: 1360192 - RNA, 26 nt, Human
cccacaacgucuccacuggcauccgu

SEQ ID NO: 1360193 - RNA, 24 nt, Human
cccacaagaggaauuacugccucu

SEQ ID NO: 1360194 - RNA, 19 nt, Human
cccaccuccucggcccuga

SEQ ID NO: 1360195 - RNA, 22 nt, Human
cccaccuccucggcccugacuc

SEQ ID NO: 1360196 - RNA, 19 nt, Human
cccagggcguggcaugggg

SEQ ID NO: 1360197 - RNA, 21 nt, Human
cccuguugccguccacucccc

SEQ ID NO: 1360198 - RNA, 20 nt, Human
ccgcugcgagcacgccuggu

SEQ ID NO: 1360199 - RNA, 22 nt, Human
ccugacuucacacaucccuggg

SEQ ID NO: 1360200 - RNA, 21 nt, Human
ccugcaccggaggacguccuc

SEQ ID NO: 1360201 - RNA, 27 nt, Human
ccugggagguggguggaacugccuucc

SEQ ID NO: 1360202 - RNA, 23 nt, Human
ccuuccgcccuguugccguccac

SEQ ID NO: 1360203 - RNA, 19 nt, Human
ccuugccaauuccccccca

SEQ ID NO: 1360204 - RNA, 21 nt, Human
cgugcccacucccaccuccuc

SEQ ID NO: 1360205 - RNA, 18 nt, Human
cucccaccuccucggccc

SEQ ID NO: 1360206 - RNA, 24 nt, Human
cucccaccuccucggcccugacuc

SEQ ID NO: 1360207 - RNA, 19 nt, Human
cuccccauuuaggauccca

SEQ ID NO: 1360208 - RNA, 19 nt, Human
cugccggaguccugaccca

SEQ ID NO: 1360209 - RNA, 21 nt, Human
cugugguaggacaacagccau

SEQ ID NO: 1360210 - RNA, 19 nt, Human
cuuccugacccaacucugg

SEQ ID NO: 1360211 - RNA, 19 nt, Human
gacccaacucuggaagccg

SEQ ID NO: 1360212 - RNA, 23 nt, Human
gagugggcagcagacccaggccc

SEQ ID NO: 1360213 - RNA, 21 nt, Human
gcagaaccuugcccacaagag

SEQ ID NO: 1360214 - RNA, 22 nt, Human
gcagggacgggccgagggggcu

SEQ ID NO: 1360215 - RNA, 21 nt, Human
gcaggggacaggggcggaggu

SEQ ID NO: 1360216 - RNA, 18 nt, Human
gcccugcgcccacacaca

SEQ ID NO: 1360217 - RNA, 21 nt, Human
ggcagggggcaggggacaggg

SEQ ID NO: 1360218 - RNA, 21 nt, Human
gggacaggggcggagguagaa

SEQ ID NO: 1360219 - RNA, 22 nt, Human
gggcagcagacccaggcccaca

SEQ ID NO: 1360220 - RNA, 25 nt, Human
gggcaggcuggugggccuuuaaggc

SEQ ID NO: 1360221 - RNA, 18 nt, Human
gggcaggggacaggggcg

SEQ ID NO: 1360222 - RNA, 24 nt, Human
gggccaggggcaggcccagcuggg

SEQ ID NO: 1360223 - RNA, 23 nt, Human
gggggcagggggcaggggacagg

SEQ ID NO: 1360224 - RNA, 21 nt, Human
gggugcagggacgggccgagg

SEQ ID NO: 1360225 - RNA, 20 nt, Human
gguuguguggagcugagugg

SEQ ID NO: 1360226 - RNA, 21 nt, Human
guggugugagccucacccugc

SEQ ID NO: 1360227 - RNA, 25 nt, Human
ucaacacugggcagacacacucagc

SEQ ID NO: 1360228 - RNA, 22 nt, Human
ucagauuuccagcugcucagac

SEQ ID NO: 1360229 - RNA, 18 nt, Human
uccacuggcauccguagg

SEQ ID NO: 1360230 - RNA, 21 nt, Human
ucccacaagacaggccuuccu

SEQ ID NO: 1360231 - RNA, 18 nt, Human
ucccuccucaccagcccc

SEQ ID NO: 1360232 - RNA, 22 nt, Human
uccucaccagccccugcccccu

SEQ ID NO: 1360233 - RNA, 23 nt, Human
uccucaccagccccugcccccuc

SEQ ID NO: 1360234 - RNA, 21 nt, Human
uccugacccaacucuggaagc

SEQ ID NO: 1360235 - RNA, 21 nt, Human
uccugaggacauggauggggg

SEQ ID NO: 1360236 - RNA, 19 nt, Human
ugaauagagacguccugca

SEQ ID NO: 1360237 - RNA, 21 nt, Human
ugaauagagacguccugcacc

SEQ ID NO: 1360238 - RNA, 23 nt, Human
ugacacaaagugcauuuaaagag

SEQ ID NO: 1360239 - RNA, 23 nt, Human
ugacagaugaggaaacugaggcu

SEQ ID NO: 1360240 - RNA, 21 nt, Human
ugacccaacucuggaagccga

SEQ ID NO: 1360241 - RNA, 18 nt, Human
ugacuucacacaucccug

SEQ ID NO: 1360242 - RNA, 20 nt, Human
ugcccacaagaggaauuacu

SEQ ID NO: 1360243 - RNA, 23 nt, Human
ugcccacucccaccuccucggcc

SEQ ID NO: 1360244 - RNA, 18 nt, Human
ugcccccuccaaccaguu

SEQ ID NO: 1360245 - RNA, 19 nt, Human
ugccggaguccugacccac

SEQ ID NO: 1360246 - RNA, 24 nt, Human
ugccggcacccugaacucgguccc

SEQ ID NO: 1360247 - RNA, 19 nt, Human
ugcuaagugagagauguuc

SEQ ID NO: 1360248 - RNA, 18 nt, Human
ugggaggaagaguccggg

SEQ ID NO: 1360249 - RNA, 22 nt, Human
ugggaggaagaguccgggcagg

SEQ ID NO: 1360250 - RNA, 23 nt, Human
uggguggaacugccuucccauuu

SEQ ID NO: 1360251 - RNA, 19 nt, Human
uguccccgugcccacuccc

SEQ ID NO: 1360252 - RNA, 20 nt, Human
uguggacagcagggcucggc

SEQ ID NO: 1360253 - RNA, 19 nt, Human
uguguggagcugaguggug

SEQ ID NO: 1360254 - RNA, 25 nt, Human
uuguguggagcugaguggugugagc

SEQ ID NO: 1360255 - RNA, 22 nt, Human
aaaaagaaaaaaaaaggcaagg

SEQ ID NO: 1360256 - RNA, 19 nt, Human
aaaaagagacagugagaga

SEQ ID NO: 1360257 - RNA, 25 nt, Human
aagaaaaaaaaaggcaaggcgccgg

SEQ ID NO: 1360258 - RNA, 22 nt, Human
aagcaaguugccaagaaagccc

SEQ ID NO: 1360259 - RNA, 21 nt, Human
aagcccgcuggccaaguucgg

SEQ ID NO: 1360260 - RNA, 22 nt, Human
aagcucccagcagcagcaacuu

SEQ ID NO: 1360261 - RNA, 21 nt, Human
aagcugcacccagcgccuugg

SEQ ID NO: 1360262 - RNA, 21 nt, Human
aaggcaaggcgccgggagcac

SEQ ID NO: 1360263 - RNA, 22 nt, Human
aaguucuugggcagcagaagag

SEQ ID NO: 1360264 - RNA, 25 nt, Human
acagugagagaaagaaaaagaaaaa

SEQ ID NO: 1360265 - RNA, 23 nt, Human
acuuggguucuucuggcauuuuu

SEQ ID NO: 1360266 - RNA, 25 nt, Human
agaaaaaaaaaggcaaggcgccggg

SEQ ID NO: 1360267 - RNA, 19 nt, Human
agaaaaagaaaaaaaaagg

SEQ ID NO: 1360268 - RNA, 23 nt, Human
agaaaaagaaaaaaaaaggcaag

SEQ ID NO: 1360269 - RNA, 18 nt, Human
agaaggaggagcagguag

SEQ ID NO: 1360270 - RNA, 18 nt, Human
aggagccucccaaagucc

SEQ ID NO: 1360271 - RNA, 22 nt, Human
aggcaaggcgccgggagcacag

SEQ ID NO: 1360272 - RNA, 25 nt, Human
cacccaccccaaguucuugggcagc

SEQ ID NO: 1360273 - RNA, 21 nt, Human
caccccaaguucuugggcagc

SEQ ID NO: 1360274 - RNA, 25 nt, Human
cagaaggaggagcagguagggaaau

SEQ ID NO: 1360275 - RNA, 22 nt, Human
cagcucaagcucccagcagcag

SEQ ID NO: 1360276 - RNA, 23 nt, Human
caggcagauuccaaaggcuuggg

SEQ ID NO: 1360277 - RNA, 18 nt, Human
ccaggguuccauggagaa

SEQ ID NO: 1360278 - RNA, 24 nt, Human
cccaaaacugagcacauaagccuu

SEQ ID NO: 1360279 - RNA, 18 nt, Human
ccuccuucccuccuuucc

SEQ ID NO: 1360280 - RNA, 19 nt, Human
ccuccuucccuccuuucca

SEQ ID NO: 1360281 - RNA, 26 nt, Human
ccugaggcugccugacucuaaacccu

SEQ ID NO: 1360282 - RNA, 22 nt, Human
ccuuacaccgugacaaugacua

SEQ ID NO: 1360283 - RNA, 23 nt, Human
cgcccaugaagaccaguccaucu

SEQ ID NO: 1360284 - RNA, 22 nt, Human
cucagaccucucucuuuagaac

SEQ ID NO: 1360285 - RNA, 20 nt, Human
cuccuucccuccuuuccauc

SEQ ID NO: 1360286 - RNA, 21 nt, Human
cugggggucucggggaaagcu

SEQ ID NO: 1360287 - RNA, 19 nt, Human
cuuaagaccuccguggaga

SEQ ID NO: 1360288 - RNA, 21 nt, Human
gacucuaaacccuuuuggcug

SEQ ID NO: 1360289 - RNA, 19 nt, Human
gcagcagaagaggucauag

SEQ ID NO: 1360290 - RNA, 21 nt, Human
gccgggagcacagugggucca

SEQ ID NO: 1360291 - RNA, 24 nt, Human
gcguccccaaaacugagcacauaa

SEQ ID NO: 1360292 - RNA, 26 nt, Human
gcucacaggagccucccaaaguccuu

SEQ ID NO: 1360293 - RNA, 22 nt, Human
gcuugugugugcgugcgugugu

SEQ ID NO: 1360294 - RNA, 23 nt, Human
ggcacucuggggugcgcgccgau

SEQ ID NO: 1360295 - RNA, 23 nt, Human
gggcacucuggggugcgcgcccc

SEQ ID NO: 1360296 - RNA, 22 nt, Human
gugacaaugacuaagccuuuaa

SEQ ID NO: 1360297 - RNA, 22 nt, Human
gugaugauuuuucagauuuugg

SEQ ID NO: 1360298 - RNA, 21 nt, Human
gugugugcgugcgugugugug

SEQ ID NO: 1360299 - RNA, 18 nt, Human
gugugugugugugugugu

SEQ ID NO: 1360300 - RNA, 19 nt, Human
uaaaauaaacagugucugc

SEQ ID NO: 1360301 - RNA, 23 nt, Human
uacacaacuccuagccugcagga

SEQ ID NO: 1360302 - RNA, 24 nt, Human
uauuucaaugguuuuugguuacau

SEQ ID NO: 1360303 - RNA, 21 nt, Human
ucagcucucaacaaucccaca

SEQ ID NO: 1360304 - RNA, 21 nt, Human
uccaucugggggucucgggga

SEQ ID NO: 1360305 - RNA, 21 nt, Human
ucccgcacaaccaagcuccag

SEQ ID NO: 1360306 - RNA, 23 nt, Human
ucccgcacaaccaagcuccagca

SEQ ID NO: 1360307 - RNA, 20 nt, Human
ucuccaguuaccacccaccc

SEQ ID NO: 1360308 - RNA, 21 nt, Human
ucuccaguuaccacccacccc

SEQ ID NO: 1360309 - RNA, 24 nt, Human
ugaagaccaguccaucucagcuca

SEQ ID NO: 1360310 - RNA, 20 nt, Human
ugagugcuugugugugcgug

SEQ ID NO: 1360311 - RNA, 19 nt, Human
ugcagucacuuuuuuaagc

SEQ ID NO: 1360312 - RNA, 25 nt, Human
ugcgugcgugugugugugugugugg

SEQ ID NO: 1360313 - RNA, 21 nt, Human
ugcgugugugugugugugugu

SEQ ID NO: 1360314 - RNA, 21 nt, Human
ugcgugugugugugugugugu

SEQ ID NO: 1360315 - RNA, 19 nt, Human
uggagcguccccaaaacug

SEQ ID NO: 1360316 - RNA, 20 nt, Human
ugucucugccuuaagaccuc

SEQ ID NO: 1360317 - RNA, 21 nt, Human
ugugcgugcgugugugugugu

SEQ ID NO: 1360318 - RNA, 30 nt, Human
ugugugcgugcgugugugugugugugugug

SEQ ID NO: 1360319 - RNA, 20 nt, Human
ugugugugcgugcgugugug

SEQ ID NO: 1360320 - RNA, 21 nt, Human
ugugugugcgugcgugugugu

SEQ ID NO: 1360321 - RNA, 21 nt, Human
ugugugugcgugcgugugugu

SEQ ID NO: 1360322 - RNA, 22 nt, Human
uguguguguguguguguccgag

SEQ ID NO: 1360323 - RNA, 18 nt, Human
ugugugugugugugugug

SEQ ID NO: 1360324 - RNA, 24 nt, Human
uguuuuauuauuccagaauuuuuu

SEQ ID NO: 1360325 - RNA, 20 nt, Human
uuaaaugaauaugacuuggg

SEQ ID NO: 1360326 - RNA, 24 nt, Human
uucuuugcagcugaucacuuugau

SEQ ID NO: 1360327 - RNA, 24 nt, Human
uugcauucagaauaaagauucuau

SEQ ID NO: 1360328 - RNA, 20 nt, Human
uuuacuuuuauuucaauggu

SEQ ID NO: 1360329 - RNA, 18 nt, Human
aacucagguguccuccuc

SEQ ID NO: 1360330 - RNA, 22 nt, Human
aagaaccucgacacuggcaccg

SEQ ID NO: 1360331 - RNA, 18 nt, Human
acacccacaccggaacgc

SEQ ID NO: 1360332 - RNA, 22 nt, Human
acccacaccggaacgcaacauc

SEQ ID NO: 1360333 - RNA, 20 nt, Human
accuggcucucgucggggac

SEQ ID NO: 1360334 - RNA, 21 nt, Human
agaaccucgacacuggcaccg

SEQ ID NO: 1360335 - RNA, 25 nt, Human
agagacguaaacucagguguccucc

SEQ ID NO: 1360336 - RNA, 23 nt, Human
agcuaagcagaaagaaccucgac

SEQ ID NO: 1360337 - RNA, 18 nt, Human
caaaacgcagauggcgga

SEQ ID NO: 1360338 - RNA, 19 nt, Human
cagauggcggaguuaagug

SEQ ID NO: 1360339 - RNA, 19 nt, Human
cagcugaggugagcagcag

SEQ ID NO: 1360340 - RNA, 21 nt, Human
cagguguccuccuccguaguc

SEQ ID NO: 1360341 - RNA, 22 nt, Human
cccacacccacaccggaacgca

SEQ ID NO: 1360342 - RNA, 20 nt, Human
cgcggccuacggggauuuau

SEQ ID NO: 1360343 - RNA, 20 nt, Human
cggaggcacacccacaccca

SEQ ID NO: 1360344 - RNA, 19 nt, Human
cuccuccguagucggcucc

SEQ ID NO: 1360345 - RNA, 22 nt, Human
gaggcacacccacacccacacc

SEQ ID NO: 1360346 - RNA, 20 nt, Human
gcucaaaacgcagauggcgg

SEQ ID NO: 1360347 - RNA, 21 nt, Human
gcuuccacgcaugcuacugcg

SEQ ID NO: 1360348 - RNA, 27 nt, Human
ggcacacccacacccacaccggaacgc

SEQ ID NO: 1360349 - RNA, 22 nt, Human
guaaacucagguguccuccucc

SEQ ID NO: 1360350 - RNA, 18 nt, Human
uccacgcaugcuacugcg

SEQ ID NO: 1360351 - RNA, 24 nt, Human
uccacgcaugcuacugcgugcucc

SEQ ID NO: 1360352 - RNA, 22 nt, Human
ucccucaacaaacaagaucagc

SEQ ID NO: 1360353 - RNA, 25 nt, Human
ucccucaacaaacaagaucagcagc

SEQ ID NO: 1360354 - RNA, 21 nt, Human
ucggaggcacacccacaccca

SEQ ID NO: 1360355 - RNA, 22 nt, Human
uggaagagacguaaacucaggu

SEQ ID NO: 1360356 - RNA, 23 nt, Human
uggaagagacguaaacucaggug

SEQ ID NO: 1360357 - RNA, 21 nt, Human
uucaauuuuauuauaguccca

SEQ ID NO: 1360358 - RNA, 21 nt, Human
uuuauccgcagcccccggauc

SEQ ID NO: 1360359 - RNA, 27 nt, Human
aaaccgccccauacaagagggccccgg

SEQ ID NO: 1360360 - RNA, 20 nt, Human
aaagugcugggauugcaggc

SEQ ID NO: 1360361 - RNA, 22 nt, Human
aaagugcugggauugcaggcgu

SEQ ID NO: 1360362 - RNA, 24 nt, Human
aaagugcugggauugcaggcguga

SEQ ID NO: 1360363 - RNA, 23 nt, Human
aaaugacccuuugauuaugaagc

SEQ ID NO: 1360364 - RNA, 22 nt, Human
aagaagucaauccauccaaagc

SEQ ID NO: 1360365 - RNA, 24 nt, Human
aagaagucaauccauccaaagcca

SEQ ID NO: 1360366 - RNA, 23 nt, Human
aagaauggccccagaacaggaca

SEQ ID NO: 1360367 - RNA, 21 nt, Human
aagaggccccggccugggccc

SEQ ID NO: 1360368 - RNA, 22 nt, Human
aagcugcccuuguccgggggcc

SEQ ID NO: 1360369 - RNA, 28 nt, Human
aaguaucagaggacugcaacauaaaacc

SEQ ID NO: 1360370 - RNA, 22 nt, Human
aagucaauccauccaaagccag

SEQ ID NO: 1360371 - RNA, 24 nt, Human
aagucaauccauccaaagccagaa

SEQ ID NO: 1360372 - RNA, 25 nt, Human
aagugauccucccaccuuggccucc

SEQ ID NO: 1360373 - RNA, 19 nt, Human
aagugcugggauugcaggc

SEQ ID NO: 1360374 - RNA, 19 nt, Human
aagugcugggauugcaggc

SEQ ID NO: 1360375 - RNA, 26 nt, Human
aagugcugggauugcaggcgugagcc

SEQ ID NO: 1360376 - RNA, 24 nt, Human
aauaagaaacaagacuuuccauca

SEQ ID NO: 1360377 - RNA, 19 nt, Human
acaaaccagaaaaugaccc

SEQ ID NO: 1360378 - RNA, 22 nt, Human
acaggaaaaaacagcgccugga

SEQ ID NO: 1360379 - RNA, 21 nt, Human
acaguaucuuuccugucuuuc

SEQ ID NO: 1360380 - RNA, 23 nt, Human
acagugcuggggcaacccugugc

SEQ ID NO: 1360381 - RNA, 23 nt, Human
acccugccugccaggcacucagc

SEQ ID NO: 1360382 - RNA, 19 nt, Human
acccugugccuacacaaaa

SEQ ID NO: 1360383 - RNA, 22 nt, Human
acggucuuccccacacuccuga

SEQ ID NO: 1360384 - RNA, 24 nt, Human
agaaaaugacccuuugauuaugaa

SEQ ID NO: 1360385 - RNA, 18 nt, Human
agacaggguuucacccau

SEQ ID NO: 1360386 - RNA, 23 nt, Human
agagcagugguacaaucacagcu

SEQ ID NO: 1360387 - RNA, 25 nt, Human
agaggcaggcccgaccccccaaggg

SEQ ID NO: 1360388 - RNA, 26 nt, Human
agccaaccuaagaggcaggaugaugc

SEQ ID NO: 1360389 - RNA, 22 nt, Human
agccacaguccaaaaauacuaa

SEQ ID NO: 1360390 - RNA, 25 nt, Human
aggaaaaaacagcgccuggacagga

SEQ ID NO: 1360391 - RNA, 23 nt, Human
agggaaaagguggaaacuccuga

SEQ ID NO: 1360392 - RNA, 24 nt, Human
aggguuucacccauguugcccagg

SEQ ID NO: 1360393 - RNA, 20 nt, Human
aguaucugggacuacaggcg

SEQ ID NO: 1360394 - RNA, 19 nt, Human
aucaacccucccuccgucc

SEQ ID NO: 1360395 - RNA, 20 nt, Human
augggccggguuuccgugac

SEQ ID NO: 1360396 - RNA, 23 nt, Human
caaauuuacuacuuagaguacag

SEQ ID NO: 1360397 - RNA, 18 nt, Human
caacccucccuccgucca

SEQ ID NO: 1360398 - RNA, 19 nt, Human
caagugauccucccaccuu

SEQ ID NO: 1360399 - RNA, 27 nt, Human
caagugauccucccaccuuggccuccu

SEQ ID NO: 1360400 - RNA, 22 nt, Human
caagugauccuccugccucagc

SEQ ID NO: 1360401 - RNA, 27 nt, Human
caagugauccuccugccucagcuuccu

SEQ ID NO: 1360402 - RNA, 23 nt, Human
caauacaccuggcucucaucauc

SEQ ID NO: 1360403 - RNA, 18 nt, Human
cacacgguuucaguuacc

SEQ ID NO: 1360404 - RNA, 21 nt, Human
cacacugccccaggcuggcca

SEQ ID NO: 1360405 - RNA, 20 nt, Human
caccacacgcaggccucagc

SEQ ID NO: 1360406 - RNA, 18 nt, Human
caccuuuggucgacgguc

SEQ ID NO: 1360407 - RNA, 23 nt, Human
cacgcaggccucagccaaccuaa

SEQ ID NO: 1360408 - RNA, 24 nt, Human
cacugugaggacacugggguugcu

SEQ ID NO: 1360409 - RNA, 22 nt, Human
cagaaagaaucaagaagucaau

SEQ ID NO: 1360410 - RNA, 18 nt, Human
cagaagguucucacuucc

SEQ ID NO: 1360411 - RNA, 19 nt, Human
cagccccucacaacagucc

SEQ ID NO: 1360412 - RNA, 21 nt, Human
cagcucacugcagacuuaacc

SEQ ID NO: 1360413 - RNA, 20 nt, Human
cagcuuccugaguaucuggg

SEQ ID NO: 1360414 - RNA, 23 nt, Human
caggacaguggugaugcuggcga

SEQ ID NO: 1360415 - RNA, 22 nt, Human
caggagacgcccccacagggcu

SEQ ID NO: 1360416 - RNA, 25 nt, Human
caggguuucacccauguugcccagg

SEQ ID NO: 1360417 - RNA, 19 nt, Human
caucgcggugauguggugc

SEQ ID NO: 1360418 - RNA, 23 nt, Human
cauguugcccaggcuggucuuga

SEQ ID NO: 1360419 - RNA, 24 nt, Human
cauguugcccaggcuggucuugaa

SEQ ID NO: 1360420 - RNA, 23 nt, Human
ccacccccaggggugcucggagg

SEQ ID NO: 1360421 - RNA, 24 nt, Human
ccaccguaugcuccuucccauccc

SEQ ID NO: 1360422 - RNA, 22 nt, Human
ccagaaagaaucaagaagucaa

SEQ ID NO: 1360423 - RNA, 22 nt, Human
ccaggcccucaagagcugggaa

SEQ ID NO: 1360424 - RNA, 19 nt, Human
ccauccacgccacccugcc

SEQ ID NO: 1360425 - RNA, 21 nt, Human
ccauguugcccaggcuggucu

SEQ ID NO: 1360426 - RNA, 23 nt, Human
cccauguugcccaggcuggucuu

SEQ ID NO: 1360427 - RNA, 26 nt, Human
cccauguugcccaggcuggucuugaa

SEQ ID NO: 1360428 - RNA, 22 nt, Human
ccccacagggcuggagcuucua

SEQ ID NO: 1360429 - RNA, 20 nt, Human
ccccacgcucgccucccucc

SEQ ID NO: 1360430 - RNA, 21 nt, Human
cccccacagggcuggagcuuc

SEQ ID NO: 1360431 - RNA, 19 nt, Human
cccgggccugggcacuccc

SEQ ID NO: 1360432 - RNA, 19 nt, Human
cccugccaggcugugcugc

SEQ ID NO: 1360433 - RNA, 20 nt, Human
cccugccugccaggcacuca

SEQ ID NO: 1360434 - RNA, 21 nt, Human
ccgccccauacaagagggccc

SEQ ID NO: 1360435 - RNA, 18 nt, Human
ccgcugcgcccagccugu

SEQ ID NO: 1360436 - RNA, 21 nt, Human
ccgcugcgcccagccuguuua

SEQ ID NO: 1360437 - RNA, 21 nt, Human
ccgggggccgcggcuggaagc

SEQ ID NO: 1360438 - RNA, 28 nt, Human
ccgucggcauggucuguuguguuccccc

SEQ ID NO: 1360439 - RNA, 23 nt, Human
ccuaaagugcugggauugcaggc

SEQ ID NO: 1360440 - RNA, 24 nt, Human
ccuagccucaagugauccucccac

SEQ ID NO: 1360441 - RNA, 18 nt, Human
ccucccaccuuggccucc

SEQ ID NO: 1360442 - RNA, 22 nt, Human
ccucccaccuuggccuccuaaa

SEQ ID NO: 1360443 - RNA, 22 nt, Human
ccuccugccucagcuuccugag

SEQ ID NO: 1360444 - RNA, 24 nt, Human
ccugaguaucugggacuacaggcg

SEQ ID NO: 1360445 - RNA, 18 nt, Human
ccugccaggcugugcugc

SEQ ID NO: 1360446 - RNA, 24 nt, Human
ccugccucagcuuccugaguaucu

SEQ ID NO: 1360447 - RNA, 19 nt, Human
ccuggacaggauucgggac

SEQ ID NO: 1360448 - RNA, 24 nt, Human
ccuggccaggugagggcgaucacu

SEQ ID NO: 1360449 - RNA, 22 nt, Human
ccuggcccugguuccuuuuggu

SEQ ID NO: 1360450 - RNA, 19 nt, Human
ccugugucccugccugucu

SEQ ID NO: 1360451 - RNA, 18 nt, Human
ccuuuaagggaaaaggug

SEQ ID NO: 1360452 - RNA, 21 nt, Human
cguacaggaaaaaacagcgcc

SEQ ID NO: 1360453 - RNA, 18 nt, Human
cguccacgcaaaaaacaa

SEQ ID NO: 1360454 - RNA, 23 nt, Human
cguccugagagaccacugaacac

SEQ ID NO: 1360455 - RNA, 24 nt, Human
cuaaagugcugggauugcaggcgu

SEQ ID NO: 1360456 - RNA, 24 nt, Human
cuacccaggagacgcccccacagg

SEQ ID NO: 1360457 - RNA, 24 nt, Human
cucaagugauccucccaccuuggc

SEQ ID NO: 1360458 - RNA, 20 nt, Human
cucaagugauccuccugccu

SEQ ID NO: 1360459 - RNA, 24 nt, Human
cucaagugauccuccugccucagc

SEQ ID NO: 1360460 - RNA, 21 nt, Human
cucacaacagucccccuuaca

SEQ ID NO: 1360461 - RNA, 18 nt, Human
cucacacugccccaggcu

SEQ ID NO: 1360462 - RNA, 24 nt, Human
cucacuuccuacuuuguguuccac

SEQ ID NO: 1360463 - RNA, 18 nt, Human
cucagacuugaucacagg

SEQ ID NO: 1360464 - RNA, 22 nt, Human
cucagccaaccuaagaggcagg

SEQ ID NO: 1360465 - RNA, 19 nt, Human
cuccugaccuauaagaaaa

SEQ ID NO: 1360466 - RNA, 22 nt, Human
cucuggcucaagugauccuccu

SEQ ID NO: 1360467 - RNA, 23 nt, Human
cugccugccaggcacucagcagc

SEQ ID NO: 1360468 - RNA, 18 nt, Human
cuggaagcucuugguccc

SEQ ID NO: 1360469 - RNA, 22 nt, Human
cuggccaccguaugcuccuucc

SEQ ID NO: 1360470 - RNA, 19 nt, Human
cugggacaucaacccuccc

SEQ ID NO: 1360471 - RNA, 18 nt, Human
gaaaaaacagcgccugga

SEQ ID NO: 1360472 - RNA, 22 nt, Human
gaaaaaacagcgccuggacagg

SEQ ID NO: 1360473 - RNA, 21 nt, Human
gaacacggcccaggggucuuc

SEQ ID NO: 1360474 - RNA, 21 nt, Human
gacagccagaacuccaccccc

SEQ ID NO: 1360475 - RNA, 24 nt, Human
gagcagccguccugcugggacauc

SEQ ID NO: 1360476 - RNA, 23 nt, Human
gagugcggugcgagcggagaggc

SEQ ID NO: 1360477 - RNA, 21 nt, Human
gaugggaagaggccccggccu

SEQ ID NO: 1360478 - RNA, 23 nt, Human
gauguggugcuuggguccaagaa

SEQ ID NO: 1360479 - RNA, 22 nt, Human
gcaacauaaaaccgccccauac

SEQ ID NO: 1360480 - RNA, 18 nt, Human
gcaggcccgacccgggcc

SEQ ID NO: 1360481 - RNA, 20 nt, Human
gccccggccucgaagacaag

SEQ ID NO: 1360482 - RNA, 24 nt, Human
gcccugguuccuuuugguuacaga

SEQ ID NO: 1360483 - RNA, 21 nt, Human
gccggggucucgggcggagcu

SEQ ID NO: 1360484 - RNA, 24 nt, Human
gccucagcuuccugaguaucuggg

SEQ ID NO: 1360485 - RNA, 19 nt, Human
gcggagcuggcuggcacag

SEQ ID NO: 1360486 - RNA, 21 nt, Human
gcucagggccccugccaggcu

SEQ ID NO: 1360487 - RNA, 23 nt, Human
gcuggucuugaacuccuagccuc

SEQ ID NO: 1360488 - RNA, 22 nt, Human
ggaagcauuugugcacagcccc

SEQ ID NO: 1360489 - RNA, 19 nt, Human
ggagcuggcuggcacagaa

SEQ ID NO: 1360490 - RNA, 21 nt, Human
ggcaaaaccagaaagaaucaa

SEQ ID NO: 1360491 - RNA, 22 nt, Human
ggccgcggcuggaagcucuugg

SEQ ID NO: 1360492 - RNA, 19 nt, Human
ggccugggcccgggagcuc

SEQ ID NO: 1360493 - RNA, 21 nt, Human
ggcucaagugauccuccugcc

SEQ ID NO: 1360494 - RNA, 22 nt, Human
ggcugagaacuccgcucagggc

SEQ ID NO: 1360495 - RNA, 24 nt, Human
ggcuggucuugaacuccuagccuc

SEQ ID NO: 1360496 - RNA, 24 nt, Human
gggccgcggcuggaagcucuuggu

SEQ ID NO: 1360497 - RNA, 23 nt, Human
guagagacaggguuucacccaug

SEQ ID NO: 1360498 - RNA, 24 nt, Human
gugauccuccugccucagcuuccu

SEQ ID NO: 1360499 - RNA, 23 nt, Human
gugguacaaucacagcucacugc

SEQ ID NO: 1360500 - RNA, 24 nt, Human
uaaagugcugggauugcaggcgug

SEQ ID NO: 1360501 - RNA, 23 nt, Human
uaaccucuggcucaagugauccu

SEQ ID NO: 1360502 - RNA, 19 nt, Human
uaagaaaaacagccagaug

SEQ ID NO: 1360503 - RNA, 22 nt, Human
uaagaaacaagacuuuccauca

SEQ ID NO: 1360504 - RNA, 28 nt, Human
uaaggacaccacacgcaggcuggagacc

SEQ ID NO: 1360505 - RNA, 22 nt, Human
uacgaauacaaacacgaaaaca

SEQ ID NO: 1360506 - RNA, 23 nt, Human
uacguacaggaaaaaacagcgcc

SEQ ID NO: 1360507 - RNA, 20 nt, Human
uacuuuguguuccacuuuuu

SEQ ID NO: 1360508 - RNA, 23 nt, Human
uagagacaggguuucacccaugu

SEQ ID NO: 1360509 - RNA, 20 nt, Human
uagccucaagugauccuccc

SEQ ID NO: 1360510 - RNA, 19 nt, Human
ucaaaggaaaugaacuggc

SEQ ID NO: 1360511 - RNA, 25 nt, Human
ucaagugauccucccaccuuggccu

SEQ ID NO: 1360512 - RNA, 22 nt, Human
ucaauccauccaaagccagaag

SEQ ID NO: 1360513 - RNA, 30 nt, Human
ucaauccauccaaagccagaagguucucaa

SEQ ID NO: 1360514 - RNA, 22 nt, Human
ucacaacagucccccuuacaca

SEQ ID NO: 1360515 - RNA, 18 nt, Human
ucacaguaagcucacgcc

SEQ ID NO: 1360516 - RNA, 23 nt, Human
ucacugcagacuuaaccucuggc

SEQ ID NO: 1360517 - RNA, 21 nt, Human
ucagaaaguaucagaggacug

SEQ ID NO: 1360518 - RNA, 19 nt, Human
uccacgguggcugcgucac

SEQ ID NO: 1360519 - RNA, 20 nt, Human
uccagaaauaaaccauucau

SEQ ID NO: 1360520 - RNA, 22 nt, Human
ucccaguuucuccaaugguucu

SEQ ID NO: 1360521 - RNA, 24 nt, Human
uccggcucuguugcucaggcugga

SEQ ID NO: 1360522 - RNA, 24 nt, Human
uccuaaagugcugggauugcaggc

SEQ ID NO: 1360523 - RNA, 24 nt, Human
uccugaguaucugggacuacaggc

SEQ ID NO: 1360524 - RNA, 23 nt, Human
ucgacggucuuccccacacuccu

SEQ ID NO: 1360525 - RNA, 24 nt, Human
ucgcggugauguggugcuuggguc

SEQ ID NO: 1360526 - RNA, 19 nt, Human
ucuaaggacaccacacgca

SEQ ID NO: 1360527 - RNA, 18 nt, Human
ucucuccauccugcauuc

SEQ ID NO: 1360528 - RNA, 19 nt, Human
ucucuggccuggcccuggu

SEQ ID NO: 1360529 - RNA, 22 nt, Human
ucuggcucaagugauccuccug

SEQ ID NO: 1360530 - RNA, 21 nt, Human
ucuugaacuccuagccucaag

SEQ ID NO: 1360531 - RNA, 21 nt, Human
ugaauuucucuuuaaagcuuu

SEQ ID NO: 1360532 - RNA, 23 nt, Human
ugacccacaggcaacuuuggcac

SEQ ID NO: 1360533 - RNA, 22 nt, Human
ugaccuauaagaaaaacagcca

SEQ ID NO: 1360534 - RNA, 26 nt, Human
ugaccuauaagaaaaacagccagaug

SEQ ID NO: 1360535 - RNA, 22 nt, Human
ugagacaggguccggcucuguu

SEQ ID NO: 1360536 - RNA, 24 nt, Human
ugcacgggucacugcguccaggcc

SEQ ID NO: 1360537 - RNA, 22 nt, Human
ugcacugugaggacacuggggu

SEQ ID NO: 1360538 - RNA, 18 nt, Human
ugcagaaacacccuccua

SEQ ID NO: 1360539 - RNA, 19 nt, Human
ugcaggcgugagccgcugc

SEQ ID NO: 1360540 - RNA, 23 nt, Human
ugccaggcacucagcagccaucu

SEQ ID NO: 1360541 - RNA, 24 nt, Human
ugcccaggcuggucuugaacuccu

SEQ ID NO: 1360542 - RNA, 21 nt, Human
ugccccacgcucgccucccuc

SEQ ID NO: 1360543 - RNA, 24 nt, Human
ugccccacgcucgccucccuccca

SEQ ID NO: 1360544 - RNA, 18 nt, Human
ugccggggucucgggcgg

SEQ ID NO: 1360545 - RNA, 24 nt, Human
ugccucagcuuccugaguaucugg

SEQ ID NO: 1360546 - RNA, 20 nt, Human
ugcgucacggcucacgugca

SEQ ID NO: 1360547 - RNA, 21 nt, Human
ugcucggaggggcucgcggcc

SEQ ID NO: 1360548 - RNA, 23 nt, Human
uggaaacuccugaccuauaagaa

SEQ ID NO: 1360549 - RNA, 20 nt, Human
uggcacagacgggcugagaa

SEQ ID NO: 1360550 - RNA, 25 nt, Human
uggccuggcccugguuccuuuuggu

SEQ ID NO: 1360551 - RNA, 24 nt, Human
ugggacuacaggcgggugacacca

SEQ ID NO: 1360552 - RNA, 18 nt, Human
ugggauugcaggcgugag

SEQ ID NO: 1360553 - RNA, 19 nt, Human
ugggauugcaggcgugagc

SEQ ID NO: 1360554 - RNA, 20 nt, Human
ugggauugcaggcgugagcc

SEQ ID NO: 1360555 - RNA, 20 nt, Human
ugggauugcaggcgugagcc

SEQ ID NO: 1360556 - RNA, 21 nt, Human
ugggauugcaggcgugagccg

SEQ ID NO: 1360557 - RNA, 22 nt, Human
ugggucagagugcggugcgagc

SEQ ID NO: 1360558 - RNA, 24 nt, Human
ugguacaaucacagcucacugcag

SEQ ID NO: 1360559 - RNA, 18 nt, Human
uggugaugcuggcgacuc

SEQ ID NO: 1360560 - RNA, 18 nt, Human
uggugcgagccuaacugc

SEQ ID NO: 1360561 - RNA, 25 nt, Human
uguagagacaggguuucacccaugu

SEQ ID NO: 1360562 - RNA, 18 nt, Human
ugugaggacacugggguu

SEQ ID NO: 1360563 - RNA, 20 nt, Human
uuaagaauggccccagaaca

SEQ ID NO: 1360564 - RNA, 20 nt, Human
uuacagaaugguaucagggc

SEQ ID NO: 1360565 - RNA, 28 nt, Human
uucaggcaaaaccagaaagaaucaagaa

SEQ ID NO: 1360566 - RNA, 21 nt, Human
uuccagaaauaaaccauucau

SEQ ID NO: 1360567 - RNA, 23 nt, Human
uuccagaaauaaaccauucauga

SEQ ID NO: 1360568 - RNA, 19 nt, Human
uucucuggccuggcccugg

SEQ ID NO: 1360569 - RNA, 23 nt, Human
uucugcacaaagcauuuucaaaa

SEQ ID NO: 1360570 - RNA, 23 nt, Human
uugcucaggcuggagagcagugg

SEQ ID NO: 1360571 - RNA, 24 nt, Human
uugcucaggcuggagagcaguggu

SEQ ID NO: 1360572 - RNA, 18 nt, Human
uuggccuccuaaagugcu

SEQ ID NO: 1360573 - RNA, 23 nt, Human
uuucacccauguugcccaggcug

SEQ ID NO: 1360574 - RNA, 24 nt, Human
uuucacccauguugcccaggcugg

SEQ ID NO: 1360575 - RNA, 25 nt, Human
uuuguagagacaggguuucacccau

SEQ ID NO: 1360576 - RNA, 22 nt, Human
uuuguguuccacuuuuuuuuuu

SEQ ID NO: 1360577 - RNA, 23 nt, Human
uuuuuuuuuuuucaaaggaaaug

SEQ ID NO: 1360578 - RNA, 20 nt, Human
aacaugguuccuggaggagg

SEQ ID NO: 1360579 - RNA, 21 nt, Human
aagcuccaaacaugguuccug

SEQ ID NO: 1360580 - RNA, 19 nt, Human
aauaauaaugugguuucuu

SEQ ID NO: 1360581 - RNA, 19 nt, Human
accagccccaaguagggcc

SEQ ID NO: 1360582 - RNA, 19 nt, Human
agcagcaugaaucaguuuc

SEQ ID NO: 1360583 - RNA, 18 nt, Human
agucagggucuugaugug

SEQ ID NO: 1360584 - RNA, 24 nt, Human
aguucagauuuaaacucuguuuca

SEQ ID NO: 1360585 - RNA, 20 nt, Human
aucuuuggcaucauuucuag

SEQ ID NO: 1360586 - RNA, 19 nt, Human
auggagcaugugguggacc

SEQ ID NO: 1360587 - RNA, 22 nt, Human
caaauguuguauuugaaacauc

SEQ ID NO: 1360588 - RNA, 23 nt, Human
caaggcauauuaaaacuucugag

SEQ ID NO: 1360589 - RNA, 20 nt, Human
caaguagggccgagcgguag

SEQ ID NO: 1360590 - RNA, 25 nt, Human
cacauuuaaaugaccaggaucaucu

SEQ ID NO: 1360591 - RNA, 25 nt, Human
cagcaguccgagcugccaaccaauu

SEQ ID NO: 1360592 - RNA, 22 nt, Human
caguccgagcugccaaccaauu

SEQ ID NO: 1360593 - RNA, 22 nt, Human
caucaagugcauuaggaucuuu

SEQ ID NO: 1360594 - RNA, 21 nt, Human
ccacuggaaacaauggaccac

SEQ ID NO: 1360595 - RNA, 22 nt, Human
ccacuuuagaaagcuucucuua

SEQ ID NO: 1360596 - RNA, 18 nt, Human
ccuccaggaccagcccca

SEQ ID NO: 1360597 - RNA, 24 nt, Human
ccuccaggaccagccccaaguagg

SEQ ID NO: 1360598 - RNA, 20 nt, Human
ccuccauagcgccaagcugc

SEQ ID NO: 1360599 - RNA, 22 nt, Human
ccuccauagcgccaagcugcuc

SEQ ID NO: 1360600 - RNA, 21 nt, Human
ccuucagaaugugggguuggg

SEQ ID NO: 1360601 - RNA, 19 nt, Human
cuccauagcgccaagcugc

SEQ ID NO: 1360602 - RNA, 21 nt, Human
cuccuccaggaccagccccaa

SEQ ID NO: 1360603 - RNA, 21 nt, Human
cugacccaacggugagggacc

SEQ ID NO: 1360604 - RNA, 24 nt, Human
cugauucucacuuucaaaauauau

SEQ ID NO: 1360605 - RNA, 19 nt, Human
cugcuugggcuuccuccuc

SEQ ID NO: 1360606 - RNA, 20 nt, Human
gaggaauaaagccggggcca

SEQ ID NO: 1360607 - RNA, 22 nt, Human
gaucagucaaaguugcuuuuga

SEQ ID NO: 1360608 - RNA, 22 nt, Human
gcaccauuuuccgauugacugu

SEQ ID NO: 1360609 - RNA, 19 nt, Human
gcaguccgagcugccaacc

SEQ ID NO: 1360610 - RNA, 19 nt, Human
gcauauuaaaacuucugag

SEQ ID NO: 1360611 - RNA, 21 nt, Human
ggaaacaucauccuacggucc

SEQ ID NO: 1360612 - RNA, 19 nt, Human
ggaaauaaccugcuuuuga

SEQ ID NO: 1360613 - RNA, 20 nt, Human
ggaggagguugggggaaagg

SEQ ID NO: 1360614 - RNA, 21 nt, Human
ggagguugggggaaaggaggu

SEQ ID NO: 1360615 - RNA, 20 nt, Human
gggguugggguaaaauccag

SEQ ID NO: 1360616 - RNA, 24 nt, Human
gguaagcucuuccuuuguuuuguc

SEQ ID NO: 1360617 - RNA, 18 nt, Human
guugggguaaaauccagg

SEQ ID NO: 1360618 - RNA, 19 nt, Human
guuucuuucuccuucuaag

SEQ ID NO: 1360619 - RNA, 23 nt, Human
guuucuuucuccuucuaaggcuu

SEQ ID NO: 1360620 - RNA, 19 nt, Human
uaaaucauugagguuucuu

SEQ ID NO: 1360621 - RNA, 22 nt, Human
uacaaaauacuguccugagaac

SEQ ID NO: 1360622 - RNA, 22 nt, Human
uacuguccugagaacuguaauu

SEQ ID NO: 1360623 - RNA, 21 nt, Human
uacuuaaacugaaaaugagau

SEQ ID NO: 1360624 - RNA, 21 nt, Human
uagcagcaugaaucaguuucu

SEQ ID NO: 1360625 - RNA, 19 nt, Human
uagggccgagcgguagcgc

SEQ ID NO: 1360626 - RNA, 19 nt, Human
uauggcgaacgcucucugc

SEQ ID NO: 1360627 - RNA, 20 nt, Human
uauuugaaacaucaagugca

SEQ ID NO: 1360628 - RNA, 22 nt, Human
ucagaaggagcccugugagcau

SEQ ID NO: 1360629 - RNA, 23 nt, Human
ucaggcacauuuaaaugaccagg

SEQ ID NO: 1360630 - RNA, 23 nt, Human
ucagguagugcugccacaauucu

SEQ ID NO: 1360631 - RNA, 24 nt, Human
ucaguuucuucaaagcuccuuugg

SEQ ID NO: 1360632 - RNA, 19 nt, Human
uccacuggaaacaauggac

SEQ ID NO: 1360633 - RNA, 18 nt, Human
ucccauggagaugagagg

SEQ ID NO: 1360634 - RNA, 21 nt, Human
ucccuugauagaaaauaaccu

SEQ ID NO: 1360635 - RNA, 19 nt, Human
uccgauugacuguucacuu

SEQ ID NO: 1360636 - RNA, 18 nt, Human
uccuccaggaccagcccc

SEQ ID NO: 1360637 - RNA, 23 nt, Human
ucuaucagaauuagaauaaaauc

SEQ ID NO: 1360638 - RNA, 19 nt, Human
ucugaguucugcuggucca

SEQ ID NO: 1360639 - RNA, 23 nt, Human
ucugaguucugcugguccagaca

SEQ ID NO: 1360640 - RNA, 20 nt, Human
ucuggauguucaguagcagg

SEQ ID NO: 1360641 - RNA, 24 nt, Human
ucuucaagcacagcagccugaucu

SEQ ID NO: 1360642 - RNA, 19 nt, Human
ucuucuucaagaucuuugg

SEQ ID NO: 1360643 - RNA, 19 nt, Human
ucuuucuccuucuaaggcu

SEQ ID NO: 1360644 - RNA, 24 nt, Human
ugagaaaaguguaaucacuuaagu

SEQ ID NO: 1360645 - RNA, 19 nt, Human
ugagaucagucaaaguugc

SEQ ID NO: 1360646 - RNA, 24 nt, Human
ugaugguccagaggauucccuggg

SEQ ID NO: 1360647 - RNA, 25 nt, Human
ugauuuucuuuaucauucagaacuu

SEQ ID NO: 1360648 - RNA, 19 nt, Human
ugcaaauggagcauguggu

SEQ ID NO: 1360649 - RNA, 23 nt, Human
ugcucuggcggucaccgcaguua

SEQ ID NO: 1360650 - RNA, 24 nt, Human
uggauagauguuucucauugcaaa

SEQ ID NO: 1360651 - RNA, 18 nt, Human
uggaugaaaguaaggagg

SEQ ID NO: 1360652 - RNA, 25 nt, Human
ugggggaaaggagguccucuucucg

SEQ ID NO: 1360653 - RNA, 21 nt, Human
ugguucuccucuuuuauuggu

SEQ ID NO: 1360654 - RNA, 22 nt, Human
uguauuugaaacaucaagugca

SEQ ID NO: 1360655 - RNA, 22 nt, Human
ugucagaaggagcccugugagc

SEQ ID NO: 1360656 - RNA, 20 nt, Human
ugucucauacucucagguaa

SEQ ID NO: 1360657 - RNA, 23 nt, Human
uguggaggaagagcugaaucagg

SEQ ID NO: 1360658 - RNA, 22 nt, Human
uguuguauuugaaacaucaagu

SEQ ID NO: 1360659 - RNA, 19 nt, Human
uuagaauaaaaucugucuu

SEQ ID NO: 1360660 - RNA, 21 nt, Human
uuagaauaaaaucugucuucc

SEQ ID NO: 1360661 - RNA, 23 nt, Human
uucaagcacagcagccugaucuu

SEQ ID NO: 1360662 - RNA, 22 nt, Human
uucagaugaaggcugacccaac

SEQ ID NO: 1360663 - RNA, 19 nt, Human
uuccuuuguuuuguccacu

SEQ ID NO: 1360664 - RNA, 25 nt, Human
uugcaaauggagcaugugguggacc

SEQ ID NO: 1360665 - RNA, 20 nt, Human
uugggguaaaauccaggucu

SEQ ID NO: 1360666 - RNA, 20 nt, Human
aggaggguguuguggcaguu

SEQ ID NO: 1360667 - RNA, 18 nt, Human
aggcacugacagccuccg

SEQ ID NO: 1360668 - RNA, 22 nt, Human
auaagcccccacccagaagcuc

SEQ ID NO: 1360669 - RNA, 22 nt, Human
ccuccagcucccccaugccugg

SEQ ID NO: 1360670 - RNA, 19 nt, Human
cgucuugccccuguaggac

SEQ ID NO: 1360671 - RNA, 22 nt, Human
cuccagcucccccaugccuggu

SEQ ID NO: 1360672 - RNA, 24 nt, Human
cuccagcucccccaugccuggucc

SEQ ID NO: 1360673 - RNA, 20 nt, Human
cucccccaugccugguccug

SEQ ID NO: 1360674 - RNA, 23 nt, Human
cucccucuguucuagucccugcc

SEQ ID NO: 1360675 - RNA, 21 nt, Human
cugaggaggguguuguggcag

SEQ ID NO: 1360676 - RNA, 18 nt, Human
gacuggggguggauaggg

SEQ ID NO: 1360677 - RNA, 24 nt, Human
gagauaagcccccacccagaagcu

SEQ ID NO: 1360678 - RNA, 21 nt, Human
gcccuggggacugggggugga

SEQ ID NO: 1360679 - RNA, 21 nt, Human
ggggacuggggguggauaggg

SEQ ID NO: 1360680 - RNA, 25 nt, Human
guccuugcgaggcacaugucgaggg

SEQ ID NO: 1360681 - RNA, 23 nt, Human
uccugggggaggagauaagcccc

SEQ ID NO: 1360682 - RNA, 22 nt, Human
ucuagucccugccuccagcucc

SEQ ID NO: 1360683 - RNA, 18 nt, Human
ucuccagguggcucccuc

SEQ ID NO: 1360684 - RNA, 21 nt, Human
ugccccuguaggacaggggcu

SEQ ID NO: 1360685 - RNA, 27 nt, Human
uggcucccucuguucuagucccugccu

SEQ ID NO: 1360686 - RNA, 27 nt, Human
aaaaagagaaauauuuaaaauugacua

SEQ ID NO: 1360687 - RNA, 20 nt, Human
aaaaauaaauccuagacuua

SEQ ID NO: 1360688 - RNA, 22 nt, Human
aaaacuccaaguuccaagccuc

SEQ ID NO: 1360689 - RNA, 25 nt, Human
aaauaaauccuagacuuaacacuga

SEQ ID NO: 1360690 - RNA, 19 nt, Human
aacaagaauaauuuaggac

SEQ ID NO: 1360691 - RNA, 19 nt, Human
aacacagucaaaccauauc

SEQ ID NO: 1360692 - RNA, 18 nt, Human
aaggacuuacaagagcaa

SEQ ID NO: 1360693 - RNA, 20 nt, Human
aaguaaucaagaaaaaccag

SEQ ID NO: 1360694 - RNA, 25 nt, Human
aauuaccucccacuaggucccuccc

SEQ ID NO: 1360695 - RNA, 19 nt, Human
acaacggggguagaggaau

SEQ ID NO: 1360696 - RNA, 18 nt, Human
acacggcagcaaagaggg

SEQ ID NO: 1360697 - RNA, 18 nt, Human
accaaaaauaucaaaaca

SEQ ID NO: 1360698 - RNA, 22 nt, Human
acucacaguucugcauggcuuc

SEQ ID NO: 1360699 - RNA, 18 nt, Human
agaaaaaccagcuuuagg

SEQ ID NO: 1360700 - RNA, 19 nt, Human
agaagcuuuaaaaagagaa

SEQ ID NO: 1360701 - RNA, 22 nt, Human
agcaagcaauggauaaucucaa

SEQ ID NO: 1360702 - RNA, 22 nt, Human
aggaaaaaaauaaacaauguga

SEQ ID NO: 1360703 - RNA, 24 nt, Human
aggaaaaaaauaaacaaugugaag

SEQ ID NO: 1360704 - RNA, 19 nt, Human
aggaaaaugcaagugagaa

SEQ ID NO: 1360705 - RNA, 21 nt, Human
aggcagaggcucccaaaccuc

SEQ ID NO: 1360706 - RNA, 21 nt, Human
aucguucugucccugaccccu

SEQ ID NO: 1360707 - RNA, 18 nt, Human
augacaccaaaaauauca

SEQ ID NO: 1360708 - RNA, 21 nt, Human
augagaacagcagcauggggg

SEQ ID NO: 1360709 - RNA, 20 nt, Human
auguauguguguuuauguau

SEQ ID NO: 1360710 - RNA, 23 nt, Human
caaauucuuaacucauuccaaca

SEQ ID NO: 1360711 - RNA, 22 nt, Human
caagaauaauuuaggacuucca

SEQ ID NO: 1360712 - RNA, 23 nt, Human
caagaauaauuuaggacuuccaa

SEQ ID NO: 1360713 - RNA, 23 nt, Human
caccaaaaauaucaaaacacaac

SEQ ID NO: 1360714 - RNA, 21 nt, Human
cagcaaaaauugagcuucuca

SEQ ID NO: 1360715 - RNA, 18 nt, Human
cagcuggagucagagcaa

SEQ ID NO: 1360716 - RNA, 21 nt, Human
cagggcagcaaaaauugagcu

SEQ ID NO: 1360717 - RNA, 23 nt, Human
ccaaaaauggggcuacaggcccc

SEQ ID NO: 1360718 - RNA, 21 nt, Human
ccaaauucuuaacucauucca

SEQ ID NO: 1360719 - RNA, 24 nt, Human
ccuagacuuaacacugauaagaaa

SEQ ID NO: 1360720 - RNA, 25 nt, Human
ccuugcugacaaaaaauaaauccua

SEQ ID NO: 1360721 - RNA, 23 nt, Human
cguucugucccugaccccuccca

SEQ ID NO: 1360722 - RNA, 21 nt, Human
cucaaaacuccaaguuccaag

SEQ ID NO: 1360723 - RNA, 19 nt, Human
gaaguaaacacauccuucu

SEQ ID NO: 1360724 - RNA, 21 nt, Human
gagccuguaaaaucaaaacca

SEQ ID NO: 1360725 - RNA, 21 nt, Human
gcaaaaauugagcuucucaag

SEQ ID NO: 1360726 - RNA, 24 nt, Human
ggaaaaggaaguaaacacauccuu

SEQ ID NO: 1360727 - RNA, 18 nt, Human
ggaaaaugcaagugagaa

SEQ ID NO: 1360728 - RNA, 20 nt, Human
ggcagcaaaaauugagcuuc

SEQ ID NO: 1360729 - RNA, 22 nt, Human
uaaaaucugacauccgauauug

SEQ ID NO: 1360730 - RNA, 19 nt, Human
uaaacacauccuucuucac

SEQ ID NO: 1360731 - RNA, 20 nt, Human
uaagccaauggaggauacca

SEQ ID NO: 1360732 - RNA, 21 nt, Human
uaaggccccuaccaucuggcu

SEQ ID NO: 1360733 - RNA, 21 nt, Human
uaaugggugcuacauguaugu

SEQ ID NO: 1360734 - RNA, 22 nt, Human
uaaugggugcuacauguaugug

SEQ ID NO: 1360735 - RNA, 21 nt, Human
uaauuaccucccacuaggucc

SEQ ID NO: 1360736 - RNA, 18 nt, Human
uacaaggaaacugauguu

SEQ ID NO: 1360737 - RNA, 22 nt, Human
uacauguauguguguuuaugua

SEQ ID NO: 1360738 - RNA, 23 nt, Human
uaccucccacuaggucccuccca

SEQ ID NO: 1360739 - RNA, 19 nt, Human
uaggaaaaugcaagugaga

SEQ ID NO: 1360740 - RNA, 22 nt, Human
uaggaaaaugcaagugagaauu

SEQ ID NO: 1360741 - RNA, 23 nt, Human
uaggugccacugcaggagcuggg

SEQ ID NO: 1360742 - RNA, 23 nt, Human
uauaaaaccaccagaucuuguga

SEQ ID NO: 1360743 - RNA, 21 nt, Human
uaucaaaacacaacaggaggc

SEQ ID NO: 1360744 - RNA, 22 nt, Human
ucaaaaccaaguuaauuacugc

SEQ ID NO: 1360745 - RNA, 21 nt, Human
ucaugaauaggcugaggugaa

SEQ ID NO: 1360746 - RNA, 20 nt, Human
ucaugagaacagcagcaugg

SEQ ID NO: 1360747 - RNA, 21 nt, Human
uccaaaaauggggcuacaggc

SEQ ID NO: 1360748 - RNA, 24 nt, Human
uccaaagaauagauaaggccccua

SEQ ID NO: 1360749 - RNA, 25 nt, Human
uccaaagaauagauaaggccccuac

SEQ ID NO: 1360750 - RNA, 20 nt, Human
uccuacugcucuaggcccag

SEQ ID NO: 1360751 - RNA, 21 nt, Human
ucuagcucuuuuguuauauug

SEQ ID NO: 1360752 - RNA, 23 nt, Human
ucucauguacucacuuuuuaaaa

SEQ ID NO: 1360753 - RNA, 21 nt, Human
ugaagauauucccuuccuuua

SEQ ID NO: 1360754 - RNA, 25 nt, Human
ugacucacaguucugcauggcuugg

SEQ ID NO: 1360755 - RNA, 21 nt, Human
ugaggugaacagugacucucc

SEQ ID NO: 1360756 - RNA, 20 nt, Human
ugcucuaggcccagcuuagc

SEQ ID NO: 1360757 - RNA, 24 nt, Human
uggcagcaagcaauggauaaucuc

SEQ ID NO: 1360758 - RNA, 19 nt, Human
uggcugguuugcagaaggu

SEQ ID NO: 1360759 - RNA, 23 nt, Human
ugggagaaauuguccaaaaaugg

SEQ ID NO: 1360760 - RNA, 19 nt, Human
uggguaaauaaacccauca

SEQ ID NO: 1360761 - RNA, 23 nt, Human
uggguaaauaaacccaucacaaa

SEQ ID NO: 1360762 - RNA, 21 nt, Human
ugggugcuacauguaugugug

SEQ ID NO: 1360763 - RNA, 19 nt, Human
ugguaggguuuauauagua

SEQ ID NO: 1360764 - RNA, 21 nt, Human
uguauguguguuuauguaugu

SEQ ID NO: 1360765 - RNA, 18 nt, Human
uguguguuuauguaugua

SEQ ID NO: 1360766 - RNA, 18 nt, Human
uguguguuuauguaugua

SEQ ID NO: 1360767 - RNA, 20 nt, Human
uguguuuauguauguacaua

SEQ ID NO: 1360768 - RNA, 22 nt, Human
uuaagcccagaguuuacacugg

SEQ ID NO: 1360769 - RNA, 21 nt, Human
uuagggagcuaucuguggaag

SEQ ID NO: 1360770 - RNA, 23 nt, Human
uuaggugccacugcaggagcugg

SEQ ID NO: 1360771 - RNA, 19 nt, Human
uuccaacggucccccaaau

SEQ ID NO: 1360772 - RNA, 22 nt, Human
uucuucagggcagcaaaaauug

SEQ ID NO: 1360773 - RNA, 18 nt, Human
uugcagaaggucacugca

SEQ ID NO: 1360774 - RNA, 24 nt, Human
uuggcagaagcuuuaaaaagagaa

SEQ ID NO: 1360775 - RNA, 23 nt, Human
uuuaaaaucugacauccgauauu

SEQ ID NO: 1360776 - RNA, 20 nt, Human
uuugcagaaggucacugcau

SEQ ID NO: 1360777 - RNA, 20 nt, Human
aauccuacuucugccauuua

SEQ ID NO: 1360778 - RNA, 18 nt, Human
aauccuggucucuccuac

SEQ ID NO: 1360779 - RNA, 19 nt, Human
accgcucccgccaauccug

SEQ ID NO: 1360780 - RNA, 24 nt, Human
caggauccuccaccucccguugcu

SEQ ID NO: 1360781 - RNA, 20 nt, Human
ccaggauccuccaccucccg

SEQ ID NO: 1360782 - RNA, 21 nt, Human
ccaucccuuccuuuucgcccu

SEQ ID NO: 1360783 - RNA, 29 nt, Human
ccccucgcugcuguguauucuccuugcag

SEQ ID NO: 1360784 - RNA, 18 nt, Human
ccccucucuuccucucuc

SEQ ID NO: 1360785 - RNA, 20 nt, Human
ccccucucuuccucucuccc

SEQ ID NO: 1360786 - RNA, 23 nt, Human
cccgccccgcgucagcgcagaag

SEQ ID NO: 1360787 - RNA, 20 nt, Human
ccguugcuuugccucuccuc

SEQ ID NO: 1360788 - RNA, 18 nt, Human
ccuccaggauccuccacc

SEQ ID NO: 1360789 - RNA, 22 nt, Human
ccucccguugcuuugccucucc

SEQ ID NO: 1360790 - RNA, 23 nt, Human
ccucgcugcuguguauucuccuu

SEQ ID NO: 1360791 - RNA, 22 nt, Human
ccucuggccgucagcuuccagg

SEQ ID NO: 1360792 - RNA, 21 nt, Human
ccuuccuuuucgcccuccccg

SEQ ID NO: 1360793 - RNA, 20 nt, Human
ccuugcagacaccuccagga

SEQ ID NO: 1360794 - RNA, 19 nt, Human
cgccccgcccccgggugcc

SEQ ID NO: 1360795 - RNA, 19 nt, Human
cgccccgcccccgggugcc

SEQ ID NO: 1360796 - RNA, 21 nt, Human
cuuagacuaucacauccugcc

SEQ ID NO: 1360797 - RNA, 22 nt, Human
cuugcagacaccuccaggaucc

SEQ ID NO: 1360798 - RNA, 21 nt, Human
cuuguucauuuguaacaucag

SEQ ID NO: 1360799 - RNA, 19 nt, Human
gcagaagucgcuggguccg

SEQ ID NO: 1360800 - RNA, 21 nt, Human
gccacaucgggucgccccgcc

SEQ ID NO: 1360801 - RNA, 20 nt, Human
uagcugugcgaucuugaaca

SEQ ID NO: 1360802 - RNA, 19 nt, Human
ucaggaacugcuucuuuuc

SEQ ID NO: 1360803 - RNA, 23 nt, Human
ucaggaacugcuucuuuuccucc

SEQ ID NO: 1360804 - RNA, 22 nt, Human
uccccgccacaucgggucgccc

SEQ ID NO: 1360805 - RNA, 19 nt, Human
ucccucuggccgucagcuu

SEQ ID NO: 1360806 - RNA, 21 nt, Human
ucccucuggccgucagcuucc

SEQ ID NO: 1360807 - RNA, 23 nt, Human
uccuccuucucucuucuagaaga

SEQ ID NO: 1360808 - RNA, 22 nt, Human
uccuugcagacaccuccaggau

SEQ ID NO: 1360809 - RNA, 21 nt, Human
ucgccccgcccccgggugccu

SEQ ID NO: 1360810 - RNA, 22 nt, Human
ucgcugcuguguauucuccuug

SEQ ID NO: 1360811 - RNA, 20 nt, Human
ucuccuacuccuccccgcca

SEQ ID NO: 1360812 - RNA, 22 nt, Human
ucuccuacuccuccccgccaca

SEQ ID NO: 1360813 - RNA, 20 nt, Human
ucucugggagauccuuguuc

SEQ ID NO: 1360814 - RNA, 20 nt, Human
ugcuuugccucuccucugug

SEQ ID NO: 1360815 - RNA, 20 nt, Human
uggagaaaagaaaauagggu

SEQ ID NO: 1360816 - RNA, 24 nt, Human
ugugaccacccuucccucccucug

SEQ ID NO: 1360817 - RNA, 26 nt, Human
ugugaccacccuucccucccucuggc

SEQ ID NO: 1360818 - RNA, 22 nt, Human
uucccuggguucacaauccuac

SEQ ID NO: 1360819 - RNA, 24 nt, Human
uuccuccuucucucuucuagaaga

SEQ ID NO: 1360820 - RNA, 19 nt, Human
uuuaaagaggaaaaaaaau

SEQ ID NO: 1360821 - RNA, 23 nt, Human
uuuuccuccuucucucuucuaga

SEQ ID NO: 1360822 - RNA, 19 nt, Human
acaugcuuggagcuuagga

SEQ ID NO: 1360823 - RNA, 22 nt, Human
agacagguuuauugacacuccu

SEQ ID NO: 1360824 - RNA, 23 nt, Human
aggagggccccgggguucugggg

SEQ ID NO: 1360825 - RNA, 19 nt, Human
aggaugggggcuccugggc

SEQ ID NO: 1360826 - RNA, 20 nt, Human
aggcagcagauccgugauua

SEQ ID NO: 1360827 - RNA, 21 nt, Human
aggcagggcuaggaccaggcc

SEQ ID NO: 1360828 - RNA, 23 nt, Human
aggcagggcuaggaccaggccca

SEQ ID NO: 1360829 - RNA, 18 nt, Human
aggcccaggugggcgggc

SEQ ID NO: 1360830 - RNA, 18 nt, Human
aggccuccccucacccag

SEQ ID NO: 1360831 - RNA, 22 nt, Human
aggcugagcaggagcccggggc

SEQ ID NO: 1360832 - RNA, 20 nt, Human
cacaguggccgaggcagggc

SEQ ID NO: 1360833 - RNA, 20 nt, Human
cacuaacccucuugcacccc

SEQ ID NO: 1360834 - RNA, 21 nt, Human
cacuaacccucuugcaccccc

SEQ ID NO: 1360835 - RNA, 22 nt, Human
cagcagagagggagacccaggg

SEQ ID NO: 1360836 - RNA, 23 nt, Human
cagcggccucuccagccccagcc

SEQ ID NO: 1360837 - RNA, 19 nt, Human
caguggccgaggcagggcu

SEQ ID NO: 1360838 - RNA, 25 nt, Human
cauggcccccagaugaggacccaag

SEQ ID NO: 1360839 - RNA, 26 nt, Human
cauucagacugguggucaggagaccc

SEQ ID NO: 1360840 - RNA, 22 nt, Human
cccagggcaggggggagccuca

SEQ ID NO: 1360841 - RNA, 25 nt, Human
ccccagaugaggacccaagcuccug

SEQ ID NO: 1360842 - RNA, 18 nt, Human
cccuccugcucccuuccc

SEQ ID NO: 1360843 - RNA, 25 nt, Human
ccugcaccacacgccuucccaggaa

SEQ ID NO: 1360844 - RNA, 24 nt, Human
ccuucagucaagacagcugggagg

SEQ ID NO: 1360845 - RNA, 24 nt, Human
cgaggcagggcuaggaccaggccc

SEQ ID NO: 1360846 - RNA, 19 nt, Human
cugcaccacacgccuuccc

SEQ ID NO: 1360847 - RNA, 22 nt, Human
cugcucccuucccacaugcagg

SEQ ID NO: 1360848 - RNA, 20 nt, Human
cuucccaggaaggccucccc

SEQ ID NO: 1360849 - RNA, 21 nt, Human
cuugcacccccuuccugaucc

SEQ ID NO: 1360850 - RNA, 23 nt, Human
gaccaggcccaggugggcgggca

SEQ ID NO: 1360851 - RNA, 23 nt, Human
gagagcaggagggccccgggguu

SEQ ID NO: 1360852 - RNA, 18 nt, Human
gagcaggagggccccggg

SEQ ID NO: 1360853 - RNA, 20 nt, Human
gaggagcaccucugccuggc

SEQ ID NO: 1360854 - RNA, 24 nt, Human
ggagcagcagagagggagacccag

SEQ ID NO: 1360855 - RNA, 22 nt, Human
ggagggccccgggguucugggg

SEQ ID NO: 1360856 - RNA, 26 nt, Human
ggccgaggcagggcuaggaccaggcc

SEQ ID NO: 1360857 - RNA, 21 nt, Human
gggagcagcagagagggagac

SEQ ID NO: 1360858 - RNA, 26 nt, Human
ggggaaggggcccagggcaggggaaa

SEQ ID NO: 1360859 - RNA, 23 nt, Human
ggggagccucauacgagucuggc

SEQ ID NO: 1360860 - RNA, 24 nt, Human
ggugccacugugagcacaggccug

SEQ ID NO: 1360861 - RNA, 23 nt, Human
gguucuggggagcagcagagagg

SEQ ID NO: 1360862 - RNA, 21 nt, Human
uaggaugggggcuccugggca

SEQ ID NO: 1360863 - RNA, 22 nt, Human
uaggaugggggcuccugggcag

SEQ ID NO: 1360864 - RNA, 20 nt, Human
ucacccagccaggcccuccu

SEQ ID NO: 1360865 - RNA, 23 nt, Human
ucccagagcgaucuuuaggaccc

SEQ ID NO: 1360866 - RNA, 23 nt, Human
ucccaggaaggccuccccucacc

SEQ ID NO: 1360867 - RNA, 20 nt, Human
uccugggcaguggggaaggg

SEQ ID NO: 1360868 - RNA, 24 nt, Human
ucuccagccccagcccccaggacc

SEQ ID NO: 1360869 - RNA, 19 nt, Human
ucuggcuggcacaaggcug

SEQ ID NO: 1360870 - RNA, 22 nt, Human
ugagcaggagcccggggcucac

SEQ ID NO: 1360871 - RNA, 24 nt, Human
ugaggagcaccucugccuggccca

SEQ ID NO: 1360872 - RNA, 24 nt, Human
ugcuggugccacugugagcacagg

SEQ ID NO: 1360873 - RNA, 21 nt, Human
ugcuuggagcuuaggaugggg

SEQ ID NO: 1360874 - RNA, 22 nt, Human
uggcccagacaugcuuggagcu

SEQ ID NO: 1360875 - RNA, 18 nt, Human
ugggacgcuggcucccag

SEQ ID NO: 1360876 - RNA, 18 nt, Human
ugggcaguggggaagggg

SEQ ID NO: 1360877 - RNA, 19 nt, Human
ugggcaguggggaaggggc

SEQ ID NO: 1360878 - RNA, 18 nt, Human
uguggagagcaggagggc

SEQ ID NO: 1360879 - RNA, 21 nt, Human
uuaggaccccuucugcucccc

SEQ ID NO: 1360880 - RNA, 25 nt, Human
uugcacccccuuccugauccucgug

SEQ ID NO: 1360881 - RNA, 19 nt, Human
uuuaggaccccuucugcuc

SEQ ID NO: 1360882 - RNA, 23 nt, Human
uuuuuuuuuuuuuuuuucgcacu

SEQ ID NO: 1360883 - RNA, 25 nt, Human
uuuuuuuuuuuuuuuuucgcacuga

SEQ ID NO: 1360884 - RNA, 27 nt, Human
uuuuuuuuuuuuuuuuuuuuuucgggg

SEQ ID NO: 1360885 - RNA, 24 nt, Human
aaaaauauacaauaauuaaccuuc

SEQ ID NO: 1360886 - RNA, 18 nt, Human
aaacagacuugacugaaa

SEQ ID NO: 1360887 - RNA, 26 nt, Human
aauuauaaagcuuuucugccauagga

SEQ ID NO: 1360888 - RNA, 19 nt, Human
acaguggcugcuacccauu

SEQ ID NO: 1360889 - RNA, 28 nt, Human
acauuucugaagaagcaaacaaacagac

SEQ ID NO: 1360890 - RNA, 24 nt, Human
accaaauucucuuuaaggacauag

SEQ ID NO: 1360891 - RNA, 22 nt, Human
agauuauacucuuauaagugua

SEQ ID NO: 1360892 - RNA, 28 nt, Human
auuauauuuccuuucucugaccuucagg

SEQ ID NO: 1360893 - RNA, 23 nt, Human
auuuccuuucucugcucauaauu

SEQ ID NO: 1360894 - RNA, 23 nt, Human
caaaaaacguguuauauacuuaa

SEQ ID NO: 1360895 - RNA, 22 nt, Human
caauaagcacauuuuuucaaau

SEQ ID NO: 1360896 - RNA, 26 nt, Human
cagcauugaacagacuugccugaaag

SEQ ID NO: 1360897 - RNA, 21 nt, Human
ccacaguggauggagcagcac

SEQ ID NO: 1360898 - RNA, 19 nt, Human
gaaagcaaacaaauaacuu

SEQ ID NO: 1360899 - RNA, 19 nt, Human
gcaaacaaacagacuugac

SEQ ID NO: 1360900 - RNA, 24 nt, Human
gcaauuauaaagcuuuucugccau

SEQ ID NO: 1360901 - RNA, 19 nt, Human
guggauggagcagcacaag

SEQ ID NO: 1360902 - RNA, 23 nt, Human
uaaaaaacauuucugaagaagca

SEQ ID NO: 1360903 - RNA, 23 nt, Human
uaaaaauaucuuuuauucuucaa

SEQ ID NO: 1360904 - RNA, 21 nt, Human
uacagaauuagaguuccauga

SEQ ID NO: 1360905 - RNA, 19 nt, Human
uacagcauugaacagacuu

SEQ ID NO: 1360906 - RNA, 21 nt, Human
uaccacaucaaccaaauuacc

SEQ ID NO: 1360907 - RNA, 21 nt, Human
uauacuuaaauaaauguguua

SEQ ID NO: 1360908 - RNA, 20 nt, Human
ucaaauagccguagucuaac

SEQ ID NO: 1360909 - RNA, 20 nt, Human
ucaguguuuucauuucagcu

SEQ ID NO: 1360910 - RNA, 22 nt, Human
ucaucauaaaaauaucuuuuau

SEQ ID NO: 1360911 - RNA, 22 nt, Human
uccaaauacaagcaacaguaaa

SEQ ID NO: 1360912 - RNA, 23 nt, Human
ucugaagaagcaaacaaacagac

SEQ ID NO: 1360913 - RNA, 22 nt, Human
ugaaagcaaacaaauaacuuua

SEQ ID NO: 1360914 - RNA, 24 nt, Human
ugaagaagcaaacaaacagacuug

SEQ ID NO: 1360915 - RNA, 21 nt, Human
ugagauuguaaaaaacauuuc

SEQ ID NO: 1360916 - RNA, 22 nt, Human
ugaguccaaauacaagcaacag

SEQ ID NO: 1360917 - RNA, 19 nt, Human
ugccauaggauauaaucca

SEQ ID NO: 1360918 - RNA, 20 nt, Human
uggaauaacaaaauauagua

SEQ ID NO: 1360919 - RNA, 19 nt, Human
uggacaguggcugcuaccc

SEQ ID NO: 1360920 - RNA, 21 nt, Human
uguaaaaaacauuucugaaga

SEQ ID NO: 1360921 - RNA, 18 nt, Human
uuacucucaucauaaaaa

SEQ ID NO: 1360922 - RNA, 24 nt, Human
uuagaguuuacaacuauuuuaaug

SEQ ID NO: 1360923 - RNA, 18 nt, Human
uuauagaaaugaauccau

SEQ ID NO: 1360924 - RNA, 24 nt, Human
uuauauuuccuuucucugcucaua

SEQ ID NO: 1360925 - RNA, 20 nt, Human
uuccuuucucugcucauaau

SEQ ID NO: 1360926 - RNA, 23 nt, Human
uugggucaugauuucaaaacauu

SEQ ID NO: 1360927 - RNA, 26 nt, Human
uuucugccauaggauauaauccacag

SEQ ID NO: 1360928 - RNA, 23 nt, Human
uuuucaguguuuucauuucagcu

SEQ ID NO: 1360929 - RNA, 18 nt, Human
uuuuuuuuuuuuuuuuug

SEQ ID NO: 1360930 - RNA, 23 nt, Human
agaaaauggaacaucucaaauau

SEQ ID NO: 1360931 - RNA, 23 nt, Human
caaaaacaucuccacacuguucc

SEQ ID NO: 1360932 - RNA, 23 nt, Human
caagacaaaaacaucuccacacu

SEQ ID NO: 1360933 - RNA, 20 nt, Human
cucuggguggcacagacggc

SEQ ID NO: 1360934 - RNA, 23 nt, Human
cucuggguggcacagacggcugc

SEQ ID NO: 1360935 - RNA, 22 nt, Human
gugaaucuuuuauuuggacaag

SEQ ID NO: 1360936 - RNA, 21 nt, Human
uagcggcccgccggcucuggg

SEQ ID NO: 1360937 - RNA, 20 nt, Human
uauacagaaaauggaacauc

SEQ ID NO: 1360938 - RNA, 21 nt, Human
ucuccggggaccuagcggccc

SEQ ID NO: 1360939 - RNA, 21 nt, Human
uuuuuuuuuuuuacuggugaa

SEQ ID NO: 1360940 - RNA, 19 nt, Human
uuuuuuuuuuuuuuacugg

SEQ ID NO: 1360941 - RNA, 24 nt, Human
cagaggucuuuuuuuuuuuuuaaa

SEQ ID NO: 1360942 - RNA, 21 nt, Human
aaaaagaacucucucugugag

SEQ ID NO: 1360943 - RNA, 21 nt, Human
aaacaacaacaaaaagaacuc

SEQ ID NO: 1360944 - RNA, 18 nt, Human
aaaugaaggagcuuugua

SEQ ID NO: 1360945 - RNA, 19 nt, Human
aaggagcuuuguaaauuuu

SEQ ID NO: 1360946 - RNA, 19 nt, Human
aauuucugcccaggaucuc

SEQ ID NO: 1360947 - RNA, 21 nt, Human
acaaaucucucucaaauguau

SEQ ID NO: 1360948 - RNA, 23 nt, Human
acacuccaucaccagugccgccu

SEQ ID NO: 1360949 - RNA, 21 nt, Human
acacuggguacaucucccagu

SEQ ID NO: 1360950 - RNA, 22 nt, Human
acagugaaacgcacccucucca

SEQ ID NO: 1360951 - RNA, 18 nt, Human
acccacaaagcaagaccu

SEQ ID NO: 1360952 - RNA, 26 nt, Human
acccauccccguccccaccccccccu

SEQ ID NO: 1360953 - RNA, 23 nt, Human
accccccccuccaccgcugggcc

SEQ ID NO: 1360954 - RNA, 24 nt, Human
acccuggccuggaccuccagcccu

SEQ ID NO: 1360955 - RNA, 22 nt, Human
acuccaucaccagugccgccuu

SEQ ID NO: 1360956 - RNA, 18 nt, Human
agaagccggaguuggccc

SEQ ID NO: 1360957 - RNA, 21 nt, Human
agaagggcccagaacucagua

SEQ ID NO: 1360958 - RNA, 20 nt, Human
agauuuccuccaagccacau

SEQ ID NO: 1360959 - RNA, 21 nt, Human
agcaugguccaugcugcagcc

SEQ ID NO: 1360960 - RNA, 21 nt, Human
aggagggaggggggcgcaggc

SEQ ID NO: 1360961 - RNA, 21 nt, Human
aguggagagucucaucccgug

SEQ ID NO: 1360962 - RNA, 23 nt, Human
aucccaaccuaccucccagucuu

SEQ ID NO: 1360963 - RNA, 27 nt, Human
auccccguccccaccccccccuccacc

SEQ ID NO: 1360964 - RNA, 21 nt, Human
auccgggagggaagcuccggc

SEQ ID NO: 1360965 - RNA, 20 nt, Human
augccuuuugccagcugcag

SEQ ID NO: 1360966 - RNA, 22 nt, Human
cacacuccaucaccagugccgc

SEQ ID NO: 1360967 - RNA, 24 nt, Human
cacacuccaucaccagugccgccu

SEQ ID NO: 1360968 - RNA, 22 nt, Human
cacccacccacaaagcaagacc

SEQ ID NO: 1360969 - RNA, 24 nt, Human
caccccccccuccaccgcugggcc

SEQ ID NO: 1360970 - RNA, 20 nt, Human
cacccuggccuggaccucca

SEQ ID NO: 1360971 - RNA, 19 nt, Human
cacgauaaaggaaggagag

SEQ ID NO: 1360972 - RNA, 22 nt, Human
cagaagggcccagaacucagua

SEQ ID NO: 1360973 - RNA, 20 nt, Human
cagagcaggcugucuccccu

SEQ ID NO: 1360974 - RNA, 23 nt, Human
cagagcugcggccugacugacgc

SEQ ID NO: 1360975 - RNA, 19 nt, Human
cagcgggcggagaggaggg

SEQ ID NO: 1360976 - RNA, 19 nt, Human
cagcugcagugagauucug

SEQ ID NO: 1360977 - RNA, 18 nt, Human
cagcugcuguggucagag

SEQ ID NO: 1360978 - RNA, 19 nt, Human
cauccccguccccaccccc

SEQ ID NO: 1360979 - RNA, 22 nt, Human
ccacaccccacagugaaacgca

SEQ ID NO: 1360980 - RNA, 24 nt, Human
ccacagugaaacgcacccucucca

SEQ ID NO: 1360981 - RNA, 18 nt, Human
ccacccccggauuuuccc

SEQ ID NO: 1360982 - RNA, 28 nt, Human
ccagaggccccacacuccaucaccaggg

SEQ ID NO: 1360983 - RNA, 19 nt, Human
cccagaggccccacacucc

SEQ ID NO: 1360984 - RNA, 21 nt, Human
cccccccuccaccgcugggcc

SEQ ID NO: 1360985 - RNA, 23 nt, Human
cccccccuccaccgcugggccca

SEQ ID NO: 1360986 - RNA, 21 nt, Human
ccccccuccaccgcugggccc

SEQ ID NO: 1360987 - RNA, 23 nt, Human
ccccguccccaccccccccucca

SEQ ID NO: 1360988 - RNA, 19 nt, Human
cccgggcggcgaggcgggg

SEQ ID NO: 1360989 - RNA, 18 nt, Human
cccuucacagcugcugug

SEQ ID NO: 1360990 - RNA, 25 nt, Human
ccuccagcccuguuagggcuaaggc

SEQ ID NO: 1360991 - RNA, 19 nt, Human
ccuggccuggaccuccagc

SEQ ID NO: 1360992 - RNA, 19 nt, Human
ccuugcccaccacuuucuu

SEQ ID NO: 1360993 - RNA, 18 nt, Human
ccuuuugccagcugcagu

SEQ ID NO: 1360994 - RNA, 25 nt, Human
cgcaagcccgcgggucuugggccuc

SEQ ID NO: 1360995 - RNA, 21 nt, Human
cgcacccucuccagcucacug

SEQ ID NO: 1360996 - RNA, 18 nt, Human
cggccagcgggcggagag

SEQ ID NO: 1360997 - RNA, 23 nt, Human
cgucagggccccgugacccaucc

SEQ ID NO: 1360998 - RNA, 21 nt, Human
cuccaagccacaugaggacuc

SEQ ID NO: 1360999 - RNA, 21 nt, Human
cuccacaccccacagugaaac

SEQ ID NO: 1361000 - RNA, 20 nt, Human
cucuagcuucagggcgccag

SEQ ID NO: 1361001 - RNA, 18 nt, Human
cucuccagcucacugagc

SEQ ID NO: 1361002 - RNA, 23 nt, Human
cugaaacaucuauuagacguugg

SEQ ID NO: 1361003 - RNA, 22 nt, Human
cugcaauuuuauuuuaauuuga

SEQ ID NO: 1361004 - RNA, 21 nt, Human
cuggaccgacgggccucuaga

SEQ ID NO: 1361005 - RNA, 20 nt, Human
cuucacagcugcugugguca

SEQ ID NO: 1361006 - RNA, 19 nt, Human
cuucccagaggccccacac

SEQ ID NO: 1361007 - RNA, 24 nt, Human
cuuggagaucccuggcggccaccc

SEQ ID NO: 1361008 - RNA, 19 nt, Human
gagagcuggccaaugccuu

SEQ ID NO: 1361009 - RNA, 18 nt, Human
gagaggagggaggggggc

SEQ ID NO: 1361010 - RNA, 20 nt, Human
gcagaagccggaguuggccc

SEQ ID NO: 1361011 - RNA, 22 nt, Human
gcagaaucuuuagacuacacag

SEQ ID NO: 1361012 - RNA, 22 nt, Human
gcauccauccccagccugggau

SEQ ID NO: 1361013 - RNA, 18 nt, Human
gccgcccgcgcucggguu

SEQ ID NO: 1361014 - RNA, 18 nt, Human
gccuggaccuccagcccu

SEQ ID NO: 1361015 - RNA, 19 nt, Human
gccuuuugccagcugcagu

SEQ ID NO: 1361016 - RNA, 22 nt, Human
ggccagcgggcggagaggaggg

SEQ ID NO: 1361017 - RNA, 18 nt, Human
ggccccgugacccauccc

SEQ ID NO: 1361018 - RNA, 23 nt, Human
gggaagcuccggccgcccagccc

SEQ ID NO: 1361019 - RNA, 19 nt, Human
ggguuuuccgcagcggagc

SEQ ID NO: 1361020 - RNA, 23 nt, Human
ggugggggagaccuaaacucaag

SEQ ID NO: 1361021 - RNA, 19 nt, Human
guccccaccccccccucca

SEQ ID NO: 1361022 - RNA, 18 nt, Human
uaaaggaaggagagaagg

SEQ ID NO: 1361023 - RNA, 20 nt, Human
uaaaggaaggagagaagggg

SEQ ID NO: 1361024 - RNA, 19 nt, Human
uaacugcgggacccgucag

SEQ ID NO: 1361025 - RNA, 22 nt, Human
uaaggccacuuacagaggcuga

SEQ ID NO: 1361026 - RNA, 22 nt, Human
ucaauaaacaacaacaaaaaga

SEQ ID NO: 1361027 - RNA, 23 nt, Human
ucaauaaacaacaacaaaaagaa

SEQ ID NO: 1361028 - RNA, 21 nt, Human
ucaccagugccgccuuggagg

SEQ ID NO: 1361029 - RNA, 20 nt, Human
ucacccuggccuggaccucc

SEQ ID NO: 1361030 - RNA, 18 nt, Human
uccaucaccagugccgcc

SEQ ID NO: 1361031 - RNA, 25 nt, Human
uccaucaccagugccgccuuggagg

SEQ ID NO: 1361032 - RNA, 20 nt, Human
uccauccccagccugggaug

SEQ ID NO: 1361033 - RNA, 20 nt, Human
uccaugcugcagccucagag

SEQ ID NO: 1361034 - RNA, 18 nt, Human
ucccaaccuaccucccag

SEQ ID NO: 1361035 - RNA, 21 nt, Human
ucccagauggcaguggagagu

SEQ ID NO: 1361036 - RNA, 20 nt, Human
uccccaccccccccuccacc

SEQ ID NO: 1361037 - RNA, 28 nt, Human
uccccaccccccccuccaccgcugggcc

SEQ ID NO: 1361038 - RNA, 22 nt, Human
uccccguccccaccccccccuc

SEQ ID NO: 1361039 - RNA, 18 nt, Human
ucccuggcggccaccccc

SEQ ID NO: 1361040 - RNA, 24 nt, Human
ucccuggcggccacccccggauuu

SEQ ID NO: 1361041 - RNA, 19 nt, Human
uccgcagcggagcuccgag

SEQ ID NO: 1361042 - RNA, 20 nt, Human
ucucccagucacccuggccu

SEQ ID NO: 1361043 - RNA, 21 nt, Human
ucuuaggggcccuugcccacc

SEQ ID NO: 1361044 - RNA, 20 nt, Human
ucuuggguuugccaagacac

SEQ ID NO: 1361045 - RNA, 22 nt, Human
ugaaaaaauaggaacucgggca

SEQ ID NO: 1361046 - RNA, 21 nt, Human
ugaccaaaaugcagcuucaac

SEQ ID NO: 1361047 - RNA, 23 nt, Human
ugacccauccccguccccacccc

SEQ ID NO: 1361048 - RNA, 21 nt, Human
ugagaaauaaagauuuccucc

SEQ ID NO: 1361049 - RNA, 21 nt, Human
ugaggagacaacaaaccucgg

SEQ ID NO: 1361050 - RNA, 18 nt, Human
ugaggugguaggaguuca

SEQ ID NO: 1361051 - RNA, 24 nt, Human
ugaguaaagggauuucugagagcu

SEQ ID NO: 1361052 - RNA, 19 nt, Human
ugcccgcaugcaggucagg

SEQ ID NO: 1361053 - RNA, 19 nt, Human
uggcagcugggggugagga

SEQ ID NO: 1361054 - RNA, 24 nt, Human
uggccuggaccuccagcccuguua

SEQ ID NO: 1361055 - RNA, 19 nt, Human
uggcugagggaagaaaggg

SEQ ID NO: 1361056 - RNA, 22 nt, Human
ugggaaaaauuaaauaugggug

SEQ ID NO: 1361057 - RNA, 18 nt, Human
uguuuggucuugcuucuu

SEQ ID NO: 1361058 - RNA, 21 nt, Human
uucaauaaacaacaacaaaaa

SEQ ID NO: 1361059 - RNA, 20 nt, Human
uucacagcugcuguggucag

SEQ ID NO: 1361060 - RNA, 18 nt, Human
uucccuggcgcaucccgg

SEQ ID NO: 1361061 - RNA, 18 nt, Human
uuucuuggguuugccaag

SEQ ID NO: 1361062 - RNA, 18 nt, Human
uuucuuggguuugccaag

SEQ ID NO: 1361063 - RNA, 20 nt, Human
aaacaaagacaauuaacaug

SEQ ID NO: 1361064 - RNA, 21 nt, Human
acagggaagcuuacaacaaaa

SEQ ID NO: 1361065 - RNA, 21 nt, Human
accagagggagaaacaaagac

SEQ ID NO: 1361066 - RNA, 24 nt, Human
acuuaaguuuucucuacuuauaac

SEQ ID NO: 1361067 - RNA, 20 nt, Human
agacaggaucucacgggauu

SEQ ID NO: 1361068 - RNA, 25 nt, Human
agagggagagaggacacagggaagc

SEQ ID NO: 1361069 - RNA, 18 nt, Human
aggggagggggaagggag

SEQ ID NO: 1361070 - RNA, 21 nt, Human
auguuaggaauguuuuaagca

SEQ ID NO: 1361071 - RNA, 20 nt, Human
caaaggagacaggaucucac

SEQ ID NO: 1361072 - RNA, 24 nt, Human
caauauuauucauccaggaccaaa

SEQ ID NO: 1361073 - RNA, 21 nt, Human
cacagcuuucugagccccuac

SEQ ID NO: 1361074 - RNA, 26 nt, Human
caguacaaagcuuucacagcguggaa

SEQ ID NO: 1361075 - RNA, 23 nt, Human
caugucucagaucuugaggaaaa

SEQ ID NO: 1361076 - RNA, 20 nt, Human
ccagcuggaaccuccucuca

SEQ ID NO: 1361077 - RNA, 22 nt, Human
cccagcuggaaccuccucucac

SEQ ID NO: 1361078 - RNA, 21 nt, Human
cugagccccuacuugacccag

SEQ ID NO: 1361079 - RNA, 18 nt, Human
cuuuuaacauuccuuuua

SEQ ID NO: 1361080 - RNA, 20 nt, Human
gcuuuauuaagcagagugac

SEQ ID NO: 1361081 - RNA, 22 nt, Human
ggaaaugagugaguuucacagc

SEQ ID NO: 1361082 - RNA, 22 nt, Human
gggaagaaaacacaggcgcaaa

SEQ ID NO: 1361083 - RNA, 18 nt, Human
ggggaagggagagaggga

SEQ ID NO: 1361084 - RNA, 22 nt, Human
uaaacucucuaaggcaggaaau

SEQ ID NO: 1361085 - RNA, 22 nt, Human
uaaggucugcuggucacagaaa

SEQ ID NO: 1361086 - RNA, 22 nt, Human
uagcuuucuuggggaagaaaac

SEQ ID NO: 1361087 - RNA, 23 nt, Human
uauguguggugggaagauguuac

SEQ ID NO: 1361088 - RNA, 22 nt, Human
ucaauauuauucauccaggacc

SEQ ID NO: 1361089 - RNA, 18 nt, Human
ucauccaggaccaaagua

SEQ ID NO: 1361090 - RNA, 19 nt, Human
uccuugaaaauacuucucc

SEQ ID NO: 1361091 - RNA, 18 nt, Human
ucuccuucauagcggaga

SEQ ID NO: 1361092 - RNA, 19 nt, Human
ucugagccccuacuugacc

SEQ ID NO: 1361093 - RNA, 21 nt, Human
ugacccaggaagcccagcugg

SEQ ID NO: 1361094 - RNA, 20 nt, Human
ugagccccuacuugacccag

SEQ ID NO: 1361095 - RNA, 24 nt, Human
ugaggaaaacuggaauuguaacuu

SEQ ID NO: 1361096 - RNA, 22 nt, Human
ugagugaguuucacagcuuucu

SEQ ID NO: 1361097 - RNA, 22 nt, Human
ugcagcgggauggcaaaggaga

SEQ ID NO: 1361098 - RNA, 20 nt, Human
uggaaccuccucucacuuuc

SEQ ID NO: 1361099 - RNA, 18 nt, Human
uggaaggggucccgagcg

SEQ ID NO: 1361100 - RNA, 26 nt, Human
ugggcuuuuaacauuccuuuuaguuu

SEQ ID NO: 1361101 - RNA, 21 nt, Human
uguggugggaagauguuacca

SEQ ID NO: 1361102 - RNA, 20 nt, Human
uucaggggagggggaaggga

SEQ ID NO: 1361103 - RNA, 22 nt, Human
uuucaggggagggggaagggag

SEQ ID NO: 1361104 - RNA, 19 nt, Human
aaacaaugacuaaaugagc

SEQ ID NO: 1361105 - RNA, 23 nt, Human
aaagaaugagcccagagccugag

SEQ ID NO: 1361106 - RNA, 21 nt, Human
aaagcauuggcaaagccagca

SEQ ID NO: 1361107 - RNA, 21 nt, Human
aaagcuuugcaugcauuuguu

SEQ ID NO: 1361108 - RNA, 22 nt, Human
aaagggggauuuucagcagcug

SEQ ID NO: 1361109 - RNA, 22 nt, Human
aaagugucucacccaaauccua

SEQ ID NO: 1361110 - RNA, 23 nt, Human
aacacaggcagcuuuucucagca

SEQ ID NO: 1361111 - RNA, 18 nt, Human
aacccaaggcccuagcag

SEQ ID NO: 1361112 - RNA, 18 nt, Human
aacccacucgcuuucccu

SEQ ID NO: 1361113 - RNA, 20 nt, Human
aacuccuuggcuuaccuagu

SEQ ID NO: 1361114 - RNA, 21 nt, Human
aagaaugaaaaugagaaaaau

SEQ ID NO: 1361115 - RNA, 23 nt, Human
aagcaguggccuccuggucagcu

SEQ ID NO: 1361116 - RNA, 19 nt, Human
aagccagcacaucugugac

SEQ ID NO: 1361117 - RNA, 21 nt, Human
aagccugccugcagggccgcc

SEQ ID NO: 1361118 - RNA, 21 nt, Human
aaggaagcuccaguuguagcc

SEQ ID NO: 1361119 - RNA, 26 nt, Human
aagugucucacccaaauccuacagcc

SEQ ID NO: 1361120 - RNA, 23 nt, Human
aauuuuuuuaaucaucagcugcu

SEQ ID NO: 1361121 - RNA, 28 nt, Human
acacaccccaagagguagagggaacgcc

SEQ ID NO: 1361122 - RNA, 19 nt, Human
acauccacccaauccacac

SEQ ID NO: 1361123 - RNA, 21 nt, Human
accacagcaacacaggcagcu

SEQ ID NO: 1361124 - RNA, 18 nt, Human
acccggaagcuggcucug

SEQ ID NO: 1361125 - RNA, 24 nt, Human
acccuagagaaucuucacuggaua

SEQ ID NO: 1361126 - RNA, 25 nt, Human
acgcaaggcuacacaccaugcacac

SEQ ID NO: 1361127 - RNA, 22 nt, Human
acucaggcccuaggcucugcag

SEQ ID NO: 1361128 - RNA, 21 nt, Human
agaaagacauauccuuccuaa

SEQ ID NO: 1361129 - RNA, 25 nt, Human
agaaagacauauccuuccuaacuca

SEQ ID NO: 1361130 - RNA, 19 nt, Human
agaaucagaaagcauggug

SEQ ID NO: 1361131 - RNA, 19 nt, Human
agaucucugcacacggugc

SEQ ID NO: 1361132 - RNA, 21 nt, Human
agcaaauagccaaaaacauaa

SEQ ID NO: 1361133 - RNA, 21 nt, Human
agcagagggagcuucucuaga

SEQ ID NO: 1361134 - RNA, 18 nt, Human
agccaaaaacauaacugc

SEQ ID NO: 1361135 - RNA, 20 nt, Human
agcccaccaacaaaaauuug

SEQ ID NO: 1361136 - RNA, 25 nt, Human
agcuggcuugaagccccugaauggu

SEQ ID NO: 1361137 - RNA, 20 nt, Human
aggagcccaucccugugcuc

SEQ ID NO: 1361138 - RNA, 22 nt, Human
aggagcuacgucaguuaaggca

SEQ ID NO: 1361139 - RNA, 21 nt, Human
aggcaaagaaugagcccagag

SEQ ID NO: 1361140 - RNA, 19 nt, Human
aggcagcuuucuagucuuu

SEQ ID NO: 1361141 - RNA, 20 nt, Human
aggcagggaugcugaggaug

SEQ ID NO: 1361142 - RNA, 21 nt, Human
aggcaucgugagacacaggug

SEQ ID NO: 1361143 - RNA, 23 nt, Human
aggcgcagguccacuagggcgug

SEQ ID NO: 1361144 - RNA, 20 nt, Human
aggugccagaaaugucaaaa

SEQ ID NO: 1361145 - RNA, 20 nt, Human
agugugcucuuuuacccuug

SEQ ID NO: 1361146 - RNA, 22 nt, Human
auaauucauuuguaucaacaaa

SEQ ID NO: 1361147 - RNA, 22 nt, Human
auaccagagccaauucagaaga

SEQ ID NO: 1361148 - RNA, 18 nt, Human
aucgauacuaugucaguu

SEQ ID NO: 1361149 - RNA, 23 nt, Human
augaggcugcaggagcugaggaa

SEQ ID NO: 1361150 - RNA, 24 nt, Human
caaacaaacaaugcauuauugucc

SEQ ID NO: 1361151 - RNA, 24 nt, Human
caaggaaaagugucucacccaaau

SEQ ID NO: 1361152 - RNA, 23 nt, Human
caauauguaaaacaagacugccu

SEQ ID NO: 1361153 - RNA, 26 nt, Human
cacaaauggcagcucacaaauauucc

SEQ ID NO: 1361154 - RNA, 19 nt, Human
cacaccguggagcaaugug

SEQ ID NO: 1361155 - RNA, 20 nt, Human
cacaccguggagcaaugugg

SEQ ID NO: 1361156 - RNA, 24 nt, Human
caccugcagaugccgcacucagca

SEQ ID NO: 1361157 - RNA, 25 nt, Human
caccugucagcauagcucggccgcu

SEQ ID NO: 1361158 - RNA, 24 nt, Human
cacucuggaaacacucaaccuaag

SEQ ID NO: 1361159 - RNA, 21 nt, Human
cacugugcuggcuugggggau

SEQ ID NO: 1361160 - RNA, 21 nt, Human
cagacacaggcggguuagggc

SEQ ID NO: 1361161 - RNA, 22 nt, Human
cagcagaaccagaggugccaga

SEQ ID NO: 1361162 - RNA, 22 nt, Human
cagcauagcucggccgcuucug

SEQ ID NO: 1361163 - RNA, 23 nt, Human
cagcucacaaauauuccucuaaa

SEQ ID NO: 1361164 - RNA, 25 nt, Human
caguacuacugugugaucauaugaa

SEQ ID NO: 1361165 - RNA, 18 nt, Human
caguggccuccuggucag

SEQ ID NO: 1361166 - RNA, 19 nt, Human
caguggccuccuggucagc

SEQ ID NO: 1361167 - RNA, 28 nt, Human
caucaacuuuccuuccucaugaucugca

SEQ ID NO: 1361168 - RNA, 23 nt, Human
caugccauugcuacccggaagcu

SEQ ID NO: 1361169 - RNA, 22 nt, Human
ccaagagguagauaucgucacc

SEQ ID NO: 1361170 - RNA, 20 nt, Human
ccagaccacuccuccacucc

SEQ ID NO: 1361171 - RNA, 23 nt, Human
cccaagagguagauaucgucacc

SEQ ID NO: 1361172 - RNA, 25 nt, Human
cccacauauggauauauuagaaaaa

SEQ ID NO: 1361173 - RNA, 18 nt, Human
cccaucaagccugccugc

SEQ ID NO: 1361174 - RNA, 22 nt, Human
cccccauuuugcagauggggaa

SEQ ID NO: 1361175 - RNA, 21 nt, Human
ccccgugggcuggcuuuccug

SEQ ID NO: 1361176 - RNA, 23 nt, Human
cccgugccaaggcgugacuagga

SEQ ID NO: 1361177 - RNA, 24 nt, Human
cccgugccaaggcgugacuaggac

SEQ ID NO: 1361178 - RNA, 20 nt, Human
cccugcuucuauaagcugca

SEQ ID NO: 1361179 - RNA, 19 nt, Human
ccuaagcccuggaugcagg

SEQ ID NO: 1361180 - RNA, 23 nt, Human
ccuagaaacgccuucucggcuga

SEQ ID NO: 1361181 - RNA, 21 nt, Human
ccuagggaggcaucaggcacu

SEQ ID NO: 1361182 - RNA, 24 nt, Human
ccuagggugacaugacagcccaua

SEQ ID NO: 1361183 - RNA, 22 nt, Human
ccucaagagacgugcaaaccaa

SEQ ID NO: 1361184 - RNA, 19 nt, Human
ccucagccuaagaagucca

SEQ ID NO: 1361185 - RNA, 22 nt, Human
ccuccagccuggaacccaaggc

SEQ ID NO: 1361186 - RNA, 24 nt, Human
ccuccagccuggaacccaaggccc

SEQ ID NO: 1361187 - RNA, 21 nt, Human
ccucccuuaaaauucagcaga

SEQ ID NO: 1361188 - RNA, 19 nt, Human
ccugaccugaaccgggugu

SEQ ID NO: 1361189 - RNA, 19 nt, Human
ccugcauuccuccagccug

SEQ ID NO: 1361190 - RNA, 23 nt, Human
ccugcauuccuccagccuggaac

SEQ ID NO: 1361191 - RNA, 22 nt, Human
ccugcugggggggcagggcagg

SEQ ID NO: 1361192 - RNA, 24 nt, Human
ccuggaacccaaggcccuagcagg

SEQ ID NO: 1361193 - RNA, 18 nt, Human
ccuggaccaagaggaaca

SEQ ID NO: 1361194 - RNA, 20 nt, Human
ccuggaccaagaggaacagc

SEQ ID NO: 1361195 - RNA, 23 nt, Human
ccugugaugacuggaaccggggc

SEQ ID NO: 1361196 - RNA, 27 nt, Human
ccuuccuaacucaugcuccaaauaccu

SEQ ID NO: 1361197 - RNA, 19 nt, Human
cgaaagcauuggcaaagcc

SEQ ID NO: 1361198 - RNA, 23 nt, Human
cgaaagcauuggcaaagccagca

SEQ ID NO: 1361199 - RNA, 22 nt, Human
cgacaguacccuagggugacug

SEQ ID NO: 1361200 - RNA, 23 nt, Human
cgucacccccauuuugcagaugg

SEQ ID NO: 1361201 - RNA, 25 nt, Human
cuaaaacuaguacuauggaauagaa

SEQ ID NO: 1361202 - RNA, 21 nt, Human
cuaaagccuaugcgaagccca

SEQ ID NO: 1361203 - RNA, 24 nt, Human
cuacacaccaugcacaccuccacu

SEQ ID NO: 1361204 - RNA, 21 nt, Human
cucaaccuaagcccuggaugc

SEQ ID NO: 1361205 - RNA, 29 nt, Human
cucacagacacgcaaggcuacacaccauu

SEQ ID NO: 1361206 - RNA, 26 nt, Human
cucagcaucacggaccccuccgaggg

SEQ ID NO: 1361207 - RNA, 21 nt, Human
cuccaaauaccuaucggucca

SEQ ID NO: 1361208 - RNA, 23 nt, Human
cuccauacagccuagggccccuc

SEQ ID NO: 1361209 - RNA, 23 nt, Human
cugcacacggugcuucaugcccu

SEQ ID NO: 1361210 - RNA, 22 nt, Human
cuggaccaagaggaacagcaac

SEQ ID NO: 1361211 - RNA, 21 nt, Human
cuggcuugaagccccugaaug

SEQ ID NO: 1361212 - RNA, 18 nt, Human
cuguuggcucucagcagc

SEQ ID NO: 1361213 - RNA, 20 nt, Human
cuuaacuuuguguacauacc

SEQ ID NO: 1361214 - RNA, 20 nt, Human
cuuagauuacuucuguguug

SEQ ID NO: 1361215 - RNA, 23 nt, Human
cuucaaaauauugacuguacaaa

SEQ ID NO: 1361216 - RNA, 20 nt, Human
cuugaagccccugaaugguc

SEQ ID NO: 1361217 - RNA, 22 nt, Human
cuuucccuccuuaaauuaccuc

SEQ ID NO: 1361218 - RNA, 23 nt, Human
gaaaagcuuuacuaacacagccc

SEQ ID NO: 1361219 - RNA, 18 nt, Human
gaaaggugggaaagacag

SEQ ID NO: 1361220 - RNA, 20 nt, Human
gaagcagaagcuaauugaaa

SEQ ID NO: 1361221 - RNA, 19 nt, Human
gacaagaaaauuucugagc

SEQ ID NO: 1361222 - RNA, 23 nt, Human
gaccucaagcugcaucuuccaaa

SEQ ID NO: 1361223 - RNA, 21 nt, Human
gagcugaggaaggaaggccug

SEQ ID NO: 1361224 - RNA, 23 nt, Human
gagcugaggaaggaaggccuggg

SEQ ID NO: 1361225 - RNA, 21 nt, Human
gcaauucaaaacuuggcgcuc

SEQ ID NO: 1361226 - RNA, 21 nt, Human
gcagaugugcugggcgcuccc

SEQ ID NO: 1361227 - RNA, 25 nt, Human
gcauuccuccagccuggaacccaag

SEQ ID NO: 1361228 - RNA, 18 nt, Human
ggaaagacagacaggaag

SEQ ID NO: 1361229 - RNA, 23 nt, Human
ggcgcagguccacuagggcgugc

SEQ ID NO: 1361230 - RNA, 21 nt, Human
ggcucuccuagaagcucuggg

SEQ ID NO: 1361231 - RNA, 24 nt, Human
ggcuggcuuuccuggaagaagucc

SEQ ID NO: 1361232 - RNA, 20 nt, Human
gggcaucuuugcucucuccu

SEQ ID NO: 1361233 - RNA, 18 nt, Human
gggggauccugugaugac

SEQ ID NO: 1361234 - RNA, 23 nt, Human
gggggcagggcagggcugugagc

SEQ ID NO: 1361235 - RNA, 24 nt, Human
ggggggcagggcagggcugugagc

SEQ ID NO: 1361236 - RNA, 20 nt, Human
gucauccauugaauggucug

SEQ ID NO: 1361237 - RNA, 22 nt, Human
guccacacagccaccauauccu

SEQ ID NO: 1361238 - RNA, 21 nt, Human
guccagucccccagaccucaa

SEQ ID NO: 1361239 - RNA, 19 nt, Human
gucgagauauuccaguacu

SEQ ID NO: 1361240 - RNA, 22 nt, Human
gugcugggcgcucccaucaagc

SEQ ID NO: 1361241 - RNA, 19 nt, Human
gugggcggccugggccagc

SEQ ID NO: 1361242 - RNA, 20 nt, Human
uaaaacccacucgcuuuccc

SEQ ID NO: 1361243 - RNA, 19 nt, Human
uaaacuaggaugaggcugc

SEQ ID NO: 1361244 - RNA, 18 nt, Human
uaacuccuuggcuuaccu

SEQ ID NO: 1361245 - RNA, 19 nt, Human
uacagccuagggccccucu

SEQ ID NO: 1361246 - RNA, 25 nt, Human
uacccagugaaaagcuuuacuaaca

SEQ ID NO: 1361247 - RNA, 20 nt, Human
uaccuugcuucacacuuugg

SEQ ID NO: 1361248 - RNA, 21 nt, Human
uaccuugcuucacacuuuggu

SEQ ID NO: 1361249 - RNA, 18 nt, Human
uagagcugucuuguaacu

SEQ ID NO: 1361250 - RNA, 19 nt, Human
uagcaggcaggcuguuugc

SEQ ID NO: 1361251 - RNA, 21 nt, Human
uagccaaaaacauaacugcau

SEQ ID NO: 1361252 - RNA, 21 nt, Human
uagcucggccgcuucugcccc

SEQ ID NO: 1361253 - RNA, 21 nt, Human
uaggaccagaagaaucagaaa

SEQ ID NO: 1361254 - RNA, 26 nt, Human
uaggaccagaagaaucagaaagcuga

SEQ ID NO: 1361255 - RNA, 22 nt, Human
uaggcucugcaguacgcucuuc

SEQ ID NO: 1361256 - RNA, 23 nt, Human
ucaaaaaauaucuagucauucca

SEQ ID NO: 1361257 - RNA, 19 nt, Human
ucaaacaguugaaugucgu

SEQ ID NO: 1361258 - RNA, 20 nt, Human
ucacuauaugguggcagaau

SEQ ID NO: 1361259 - RNA, 19 nt, Human
ucacuuaggagcuacguca

SEQ ID NO: 1361260 - RNA, 23 nt, Human
ucagcagccuggaaugccagcuc

SEQ ID NO: 1361261 - RNA, 21 nt, Human
ucaguccagucccccagaccu

SEQ ID NO: 1361262 - RNA, 21 nt, Human
uccaaauaccuaucgguccaa

SEQ ID NO: 1361263 - RNA, 18 nt, Human
uccaaggaccccucuugc

SEQ ID NO: 1361264 - RNA, 20 nt, Human
uccacacagccaccauaucc

SEQ ID NO: 1361265 - RNA, 21 nt, Human
uccacacagccaccauauccu

SEQ ID NO: 1361266 - RNA, 18 nt, Human
ucccacaagucagccagg

SEQ ID NO: 1361267 - RNA, 18 nt, Human
ucccuccaggucuguuuc

SEQ ID NO: 1361268 - RNA, 18 nt, Human
uccuggagaacagcuuug

SEQ ID NO: 1361269 - RNA, 19 nt, Human
uccuggccaaacaaaaaaa

SEQ ID NO: 1361270 - RNA, 20 nt, Human
ucuaaagccuaugcgaagcc

SEQ ID NO: 1361271 - RNA, 22 nt, Human
ucuagagcugucuuguaacucc

SEQ ID NO: 1361272 - RNA, 22 nt, Human
ucucugccaccuugaacuacag

SEQ ID NO: 1361273 - RNA, 23 nt, Human
ucugcaguacgcucuucccacaa

SEQ ID NO: 1361274 - RNA, 19 nt, Human
ucugugaacaucacuuagg

SEQ ID NO: 1361275 - RNA, 21 nt, Human
ucuuagucuauggggcucucc

SEQ ID NO: 1361276 - RNA, 21 nt, Human
ugacaugacagcccauauauc

SEQ ID NO: 1361277 - RNA, 19 nt, Human
ugacugugggcggccuggg

SEQ ID NO: 1361278 - RNA, 22 nt, Human
ugagaguagcaacauagaggca

SEQ ID NO: 1361279 - RNA, 21 nt, Human
ugagcccagagccugagauuc

SEQ ID NO: 1361280 - RNA, 23 nt, Human
ugagcccagagccugagauucaa

SEQ ID NO: 1361281 - RNA, 19 nt, Human
ugagggugaggcccugcug

SEQ ID NO: 1361282 - RNA, 22 nt, Human
ugagggugaggcccugcugggg

SEQ ID NO: 1361283 - RNA, 18 nt, Human
ugcaccugcagaugccgc

SEQ ID NO: 1361284 - RNA, 22 nt, Human
ugcaggaggcagggaugcugag

SEQ ID NO: 1361285 - RNA, 22 nt, Human
ugcucagagagaugggacucca

SEQ ID NO: 1361286 - RNA, 25 nt, Human
ugcugggaugugcuaaugccuaggg

SEQ ID NO: 1361287 - RNA, 19 nt, Human
uggaaacacucaaccuaag

SEQ ID NO: 1361288 - RNA, 22 nt, Human
uggaaacacucaaccuaagccc

SEQ ID NO: 1361289 - RNA, 19 nt, Human
uggaaaggugggaaagaca

SEQ ID NO: 1361290 - RNA, 21 nt, Human
uggaauagaaaaggaaaagug

SEQ ID NO: 1361291 - RNA, 24 nt, Human
uggaaugccagcucucaugcccuc

SEQ ID NO: 1361292 - RNA, 20 nt, Human
uggaccaagaggaacagcaa

SEQ ID NO: 1361293 - RNA, 24 nt, Human
uggagaaagacauauccuuccuaa

SEQ ID NO: 1361294 - RNA, 20 nt, Human
uggagaacagcuuugcuauu

SEQ ID NO: 1361295 - RNA, 22 nt, Human
uggagugcagagggauuggcau

SEQ ID NO: 1361296 - RNA, 19 nt, Human
uggauguccuuuccuggag

SEQ ID NO: 1361297 - RNA, 19 nt, Human
uggauuaaaucucuugagc

SEQ ID NO: 1361298 - RNA, 22 nt, Human
uggcagaggcaaagaaugagcc

SEQ ID NO: 1361299 - RNA, 22 nt, Human
uggcguaacucagcaucacgga

SEQ ID NO: 1361300 - RNA, 19 nt, Human
ugggcccccggaucuaugu

SEQ ID NO: 1361301 - RNA, 24 nt, Human
ugggcgcucccaucaagccugccu

SEQ ID NO: 1361302 - RNA, 23 nt, Human
uggggaaaaauccagaaaagggg

SEQ ID NO: 1361303 - RNA, 20 nt, Human
uggggaugacccugcacugc

SEQ ID NO: 1361304 - RNA, 20 nt, Human
uggucucuucugaacacacc

SEQ ID NO: 1361305 - RNA, 24 nt, Human
ugguggaguccgaaagcauuggcc

SEQ ID NO: 1361306 - RNA, 23 nt, Human
uguaaaacaagacugccuuguuu

SEQ ID NO: 1361307 - RNA, 21 nt, Human
uguaacuccuuggcuuaccua

SEQ ID NO: 1361308 - RNA, 21 nt, Human
uguccuguaagcagagggagc

SEQ ID NO: 1361309 - RNA, 19 nt, Human
ugugguggaggcauuauga

SEQ ID NO: 1361310 - RNA, 18 nt, Human
uguuugcuugcuugugug

SEQ ID NO: 1361311 - RNA, 23 nt, Human
uuaaacacaaauggcagcucaca

SEQ ID NO: 1361312 - RNA, 23 nt, Human
uuagagaaagcuggauuaaaucu

SEQ ID NO: 1361313 - RNA, 21 nt, Human
uuagagugcugggaugugcua

SEQ ID NO: 1361314 - RNA, 19 nt, Human
uuagauuacuucuguguug

SEQ ID NO: 1361315 - RNA, 19 nt, Human
uuaguccucagccuaagaa

SEQ ID NO: 1361316 - RNA, 18 nt, Human
uuccaaaauuccauggau

SEQ ID NO: 1361317 - RNA, 19 nt, Human
uucuuguccacacagccac

SEQ ID NO: 1361318 - RNA, 19 nt, Human
uugaauggucuguuccuga

SEQ ID NO: 1361319 - RNA, 24 nt, Human
uugaccaaaauagcaguaauuuca

SEQ ID NO: 1361320 - RNA, 18 nt, Human
uugauagaacaagcaaaa

SEQ ID NO: 1361321 - RNA, 19 nt, Human
uuuauuaguuuuaucuuug

SEQ ID NO: 1361322 - RNA, 21 nt, Human
uuuguaucaacaaacaaacaa

SEQ ID NO: 1361323 - RNA, 20 nt, Human
aaacaaaaucgaggcaggga

SEQ ID NO: 1361324 - RNA, 22 nt, Human
aaggagauggaucuaucccagg

SEQ ID NO: 1361325 - RNA, 24 nt, Human
acaaaacucuggaaccuccagcag

SEQ ID NO: 1361326 - RNA, 20 nt, Human
accagcguuagcuguaauga

SEQ ID NO: 1361327 - RNA, 24 nt, Human
accccucaucagagccgaaagccg

SEQ ID NO: 1361328 - RNA, 23 nt, Human
agaaaaaagagcuggaaaaaaga

SEQ ID NO: 1361329 - RNA, 22 nt, Human
agaaggagauggaucuauccca

SEQ ID NO: 1361330 - RNA, 25 nt, Human
agaaggagauggaucuaucccaggg

SEQ ID NO: 1361331 - RNA, 19 nt, Human
agaauggagaggaaagaag

SEQ ID NO: 1361332 - RNA, 23 nt, Human
agagccgaaagccggcaagagcc

SEQ ID NO: 1361333 - RNA, 23 nt, Human
agcugaccugaaaugcccacccc

SEQ ID NO: 1361334 - RNA, 18 nt, Human
agggagccgggagccagc

SEQ ID NO: 1361335 - RNA, 24 nt, Human
aguggggaguggagccuucggagg

SEQ ID NO: 1361336 - RNA, 18 nt, Human
aguguuauucacggauga

SEQ ID NO: 1361337 - RNA, 19 nt, Human
aucuugacaaguggcggag

SEQ ID NO: 1361338 - RNA, 22 nt, Human
caaaacucuggaaccuccagca

SEQ ID NO: 1361339 - RNA, 19 nt, Human
caaaaucgaggcagggaca

SEQ ID NO: 1361340 - RNA, 21 nt, Human
caaaggucauuugcgcuuuuc

SEQ ID NO: 1361341 - RNA, 27 nt, Human
caagagccauucaucagccgaccuggu

SEQ ID NO: 1361342 - RNA, 22 nt, Human
cacagccagguccagcucgccc

SEQ ID NO: 1361343 - RNA, 23 nt, Human
cacagccagguccagcucgcccc

SEQ ID NO: 1361344 - RNA, 18 nt, Human
caccccccauuuuguugg

SEQ ID NO: 1361345 - RNA, 18 nt, Human
cacugccaccuccucggg

SEQ ID NO: 1361346 - RNA, 22 nt, Human
cacuucuagcccaaacuuugga

SEQ ID NO: 1361347 - RNA, 24 nt, Human
cagaccccucaucagagccgaaag

SEQ ID NO: 1361348 - RNA, 23 nt, Human
cccaccaggggcugguaaggaag

SEQ ID NO: 1361349 - RNA, 19 nt, Human
ccccgaaaacuccggcccg

SEQ ID NO: 1361350 - RNA, 20 nt, Human
ccccgaaaacuccggcccgg

SEQ ID NO: 1361351 - RNA, 21 nt, Human
ccccucaucagagccgaaagc

SEQ ID NO: 1361352 - RNA, 22 nt, Human
cccuucucgccuuccuccuccc

SEQ ID NO: 1361353 - RNA, 20 nt, Human
ccgccgccuuggaggaggcu

SEQ ID NO: 1361354 - RNA, 22 nt, Human
ccuaacucacacaauguagcac

SEQ ID NO: 1361355 - RNA, 23 nt, Human
ccuccccgguccucccgcucgcg

SEQ ID NO: 1361356 - RNA, 22 nt, Human
ccucgggugacucagcugaccu

SEQ ID NO: 1361357 - RNA, 21 nt, Human
ccuggggggcagacaauuguu

SEQ ID NO: 1361358 - RNA, 22 nt, Human
ccuggggggcagacaauuguuc

SEQ ID NO: 1361359 - RNA, 21 nt, Human
ccuuccuccucccucgccucc

SEQ ID NO: 1361360 - RNA, 23 nt, Human
cgaaagaacacuguggaaaggaa

SEQ ID NO: 1361361 - RNA, 18 nt, Human
cgacucuagauucuuccc

SEQ ID NO: 1361362 - RNA, 23 nt, Human
cgcuuacuaccaagacuucucua

SEQ ID NO: 1361363 - RNA, 21 nt, Human
cggccugguccgccgccuugg

SEQ ID NO: 1361364 - RNA, 23 nt, Human
cgggagccagcgcugcgguggga

SEQ ID NO: 1361365 - RNA, 22 nt, Human
cguagacaguaagagggagucu

SEQ ID NO: 1361366 - RNA, 21 nt, Human
cucccggguccgccccuggcc

SEQ ID NO: 1361367 - RNA, 21 nt, Human
cugaaaaacuuugaaucucau

SEQ ID NO: 1361368 - RNA, 19 nt, Human
cugaaccccgaaaacuccg

SEQ ID NO: 1361369 - RNA, 22 nt, Human
cugcagacagggggcgggagcu

SEQ ID NO: 1361370 - RNA, 24 nt, Human
cugcagugcccaccaggggcuggu

SEQ ID NO: 1361371 - RNA, 19 nt, Human
cuggaggggccggcgggcg

SEQ ID NO: 1361372 - RNA, 20 nt, Human
cuuacgaucauguccggauu

SEQ ID NO: 1361373 - RNA, 27 nt, Human
cuuuccgucacuagcgccccgagagcc

SEQ ID NO: 1361374 - RNA, 19 nt, Human
cuuuuuuuuucccucccac

SEQ ID NO: 1361375 - RNA, 24 nt, Human
gacgaaagaacacuguggaaagga

SEQ ID NO: 1361376 - RNA, 18 nt, Human
gaggaaagaagaguagua

SEQ ID NO: 1361377 - RNA, 21 nt, Human
gaucuggcccuucucgccuuc

SEQ ID NO: 1361378 - RNA, 22 nt, Human
gcaaacaaaaucgaggcaggga

SEQ ID NO: 1361379 - RNA, 22 nt, Human
gccaagauuuauuaccauuucu

SEQ ID NO: 1361380 - RNA, 22 nt, Human
gccccgagagccgggucggguu

SEQ ID NO: 1361381 - RNA, 20 nt, Human
gcccuucucgccuuccuccu

SEQ ID NO: 1361382 - RNA, 20 nt, Human
ggacucccggguccgccccu

SEQ ID NO: 1361383 - RNA, 23 nt, Human
ggccuaggugcuugaaccugggg

SEQ ID NO: 1361384 - RNA, 25 nt, Human
ggccuaggugcuugaaccugggggg

SEQ ID NO: 1361385 - RNA, 18 nt, Human
ggccugguccgccgccuu

SEQ ID NO: 1361386 - RNA, 19 nt, Human
ggccugguccgccgccuug

SEQ ID NO: 1361387 - RNA, 24 nt, Human
gggggagggcuuuccugcagacag

SEQ ID NO: 1361388 - RNA, 19 nt, Human
gggggcgggagcuagggag

SEQ ID NO: 1361389 - RNA, 21 nt, Human
gguaaggaagucugaguguuu

SEQ ID NO: 1361390 - RNA, 22 nt, Human
guaaugaggauucuagaaaaaa

SEQ ID NO: 1361391 - RNA, 18 nt, Human
gucugaguguuuacugcc

SEQ ID NO: 1361392 - RNA, 18 nt, Human
gugcuugaaccugggggg

SEQ ID NO: 1361393 - RNA, 20 nt, Human
guggcggagcggaggaguca

SEQ ID NO: 1361394 - RNA, 22 nt, Human
uaagaaggaacugggcuagaga

SEQ ID NO: 1361395 - RNA, 24 nt, Human
uaagaaggaacugggcuagagaca

SEQ ID NO: 1361396 - RNA, 23 nt, Human
uaaggaagucugaguguuuacug

SEQ ID NO: 1361397 - RNA, 18 nt, Human
uagaaaaaagagcuggaa

SEQ ID NO: 1361398 - RNA, 18 nt, Human
uauaauaauaagaauggc

SEQ ID NO: 1361399 - RNA, 18 nt, Human
ucagaggcucugcaaagg

SEQ ID NO: 1361400 - RNA, 19 nt, Human
ucccuucccuguccaaagg

SEQ ID NO: 1361401 - RNA, 23 nt, Human
uccugcagacagggggcgggagc

SEQ ID NO: 1361402 - RNA, 22 nt, Human
ucggagcuacaaaacucuggaa

SEQ ID NO: 1361403 - RNA, 23 nt, Human
ucugaggggagaauggagaggaa

SEQ ID NO: 1361404 - RNA, 25 nt, Human
ugaaucucauguaagaaggaacugg

SEQ ID NO: 1361405 - RNA, 25 nt, Human
ugaggauucuagaaaaaagagcugg

SEQ ID NO: 1361406 - RNA, 19 nt, Human
ugccaccuccucgggugac

SEQ ID NO: 1361407 - RNA, 18 nt, Human
ugcugcagugcccaccag

SEQ ID NO: 1361408 - RNA, 21 nt, Human
ugcuugaaccuggggggcaga

SEQ ID NO: 1361409 - RNA, 18 nt, Human
uggaaaggaaggcgcggg

SEQ ID NO: 1361410 - RNA, 24 nt, Human
uggaggaggcuggaggggccggcg

SEQ ID NO: 1361411 - RNA, 21 nt, Human
uggcccuucucgccuuccucc

SEQ ID NO: 1361412 - RNA, 18 nt, Human
uggcggagcggaggaguc

SEQ ID NO: 1361413 - RNA, 21 nt, Human
ugggcuagagacaggagccaa

SEQ ID NO: 1361414 - RNA, 21 nt, Human
uggggaguggagccuucggag

SEQ ID NO: 1361415 - RNA, 24 nt, Human
ugucuugcacugccaccuccucgg

SEQ ID NO: 1361416 - RNA, 20 nt, Human
ugugggaacuaggccacaaa

SEQ ID NO: 1361417 - RNA, 22 nt, Human
uuaccagcguuagcuguaauga

SEQ ID NO: 1361418 - RNA, 20 nt, Human
uucccuguccaaaggucauu

SEQ ID NO: 1361419 - RNA, 25 nt, Human
uugaaccuggggggcagacaauugu

SEQ ID NO: 1361420 - RNA, 23 nt, Human
uugcacugccaccuccucgggug

SEQ ID NO: 1361421 - RNA, 22 nt, Human
aaaaacaggagauucuagccua

SEQ ID NO: 1361422 - RNA, 22 nt, Human
aaaacaaauauauauuggcuug

SEQ ID NO: 1361423 - RNA, 20 nt, Human
aaacacauaggaggagcugc

SEQ ID NO: 1361424 - RNA, 24 nt, Human
aaacacgaucuuguauaacugaca

SEQ ID NO: 1361425 - RNA, 22 nt, Human
aaccaccuuccaguacuaaccc

SEQ ID NO: 1361426 - RNA, 24 nt, Human
aacuuuauaaacagaauucuggcu

SEQ ID NO: 1361427 - RNA, 23 nt, Human
aagaaauggaauaucuaacaagu

SEQ ID NO: 1361428 - RNA, 18 nt, Human
aagcagauagaucccaaa

SEQ ID NO: 1361429 - RNA, 18 nt, Human
aagcagauagaucccaaa

SEQ ID NO: 1361430 - RNA, 19 nt, Human
aagcagauagaucccaaaa

SEQ ID NO: 1361431 - RNA, 23 nt, Human
aagcagauagaucccaaaacaga

SEQ ID NO: 1361432 - RNA, 18 nt, Human
aaguguuaacaaagugga

SEQ ID NO: 1361433 - RNA, 25 nt, Human
aauaucuaacaaguucuuaggugac

SEQ ID NO: 1361434 - RNA, 24 nt, Human
aaugugcugagauuauaggcguga

SEQ ID NO: 1361435 - RNA, 23 nt, Human
acaaaacaaauauauauuggcuu

SEQ ID NO: 1361436 - RNA, 26 nt, Human
acaaaguggagucacucaugccaaau

SEQ ID NO: 1361437 - RNA, 20 nt, Human
acacaaacuuuggagaacac

SEQ ID NO: 1361438 - RNA, 21 nt, Human
acacugcugcuccaaaaaaua

SEQ ID NO: 1361439 - RNA, 21 nt, Human
accacaucaguggacgugcac

SEQ ID NO: 1361440 - RNA, 26 nt, Human
acuaaaacacauaggaggagcugguc

SEQ ID NO: 1361441 - RNA, 22 nt, Human
agauuauaggcgugagccaccg

SEQ ID NO: 1361442 - RNA, 19 nt, Human
aggcgugagccaccgugcc

SEQ ID NO: 1361443 - RNA, 23 nt, Human
aggcgugagccaccgugccuggc

SEQ ID NO: 1361444 - RNA, 21 nt, Human
aggugacgggggcaggggggc

SEQ ID NO: 1361445 - RNA, 21 nt, Human
auagaucccaaaacagacgag

SEQ ID NO: 1361446 - RNA, 20 nt, Human
aucaauaagaaaucagauaa

SEQ ID NO: 1361447 - RNA, 23 nt, Human
aucaauaagaaaucagauaaagc

SEQ ID NO: 1361448 - RNA, 26 nt, Human
aucacauguuuccaacuuaaccuaga

SEQ ID NO: 1361449 - RNA, 23 nt, Human
augaccgaaucaccuaauaggcc

SEQ ID NO: 1361450 - RNA, 21 nt, Human
caaaccagaggucaggaaagc

SEQ ID NO: 1361451 - RNA, 25 nt, Human
caaaccccuggguucaagugauccu

SEQ ID NO: 1361452 - RNA, 22 nt, Human
caagugauccuccugccucagc

SEQ ID NO: 1361453 - RNA, 27 nt, Human
caagugauccuccugccucagccuccc

SEQ ID NO: 1361454 - RNA, 27 nt, Human
caagugauccuccugccucagccuccc

SEQ ID NO: 1361455 - RNA, 24 nt, Human
caaugugcugagauuauaggcgug

SEQ ID NO: 1361456 - RNA, 26 nt, Human
ccaaaacagacgaguuuuuccuaaaa

SEQ ID NO: 1361457 - RNA, 24 nt, Human
ccaaugugcugagauuauaggcgu

SEQ ID NO: 1361458 - RNA, 20 nt, Human
ccacagcagcuccugaaaca

SEQ ID NO: 1361459 - RNA, 19 nt, Human
ccaccuuccaguacuaacc

SEQ ID NO: 1361460 - RNA, 24 nt, Human
cccaacacuauugcaccagggauu

SEQ ID NO: 1361461 - RNA, 24 nt, Human
cccacagcagcuccugaaacaguu

SEQ ID NO: 1361462 - RNA, 19 nt, Human
cccagaaaaaaauuacguc

SEQ ID NO: 1361463 - RNA, 23 nt, Human
cccaggucagagggcagaagagc

SEQ ID NO: 1361464 - RNA, 20 nt, Human
cccgcaacacugcugcucca

SEQ ID NO: 1361465 - RNA, 22 nt, Human
cccgcaacacugcugcuccaaa

SEQ ID NO: 1361466 - RNA, 18 nt, Human
cccuggguucaagugauc

SEQ ID NO: 1361467 - RNA, 24 nt, Human
cccuggguucaagugauccuccug

SEQ ID NO: 1361468 - RNA, 23 nt, Human
ccgaaucaccuaauaggccccaa

SEQ ID NO: 1361469 - RNA, 21 nt, Human
ccucccgcaacacugcugcuc

SEQ ID NO: 1361470 - RNA, 25 nt, Human
ccugaguaaauucccuuguguuucu

SEQ ID NO: 1361471 - RNA, 21 nt, Human
ccugccucagccucccaaugu

SEQ ID NO: 1361472 - RNA, 22 nt, Human
ccuggguucaagugauccuccu

SEQ ID NO: 1361473 - RNA, 23 nt, Human
ccuggguucaagugauccuccug

SEQ ID NO: 1361474 - RNA, 19 nt, Human
cgucaacgcuaacaaaaca

SEQ ID NO: 1361475 - RNA, 21 nt, Human
cuaacacacaaacuuuggaga

SEQ ID NO: 1361476 - RNA, 23 nt, Human
cuaacccccaaauucuuuuuacu

SEQ ID NO: 1361477 - RNA, 19 nt, Human
cuauggauuaagccaagag

SEQ ID NO: 1361478 - RNA, 23 nt, Human
cucaaaccagaggucaggaaagc

SEQ ID NO: 1361479 - RNA, 20 nt, Human
cuccugaaacaguucuggaa

SEQ ID NO: 1361480 - RNA, 23 nt, Human
cugccucagccucccaaugugcu

SEQ ID NO: 1361481 - RNA, 24 nt, Human
gaaucaccuaauaggccccaacuc

SEQ ID NO: 1361482 - RNA, 18 nt, Human
gauuauaggcgugagcca

SEQ ID NO: 1361483 - RNA, 24 nt, Human
gauuauaggcgugagccaccgugc

SEQ ID NO: 1361484 - RNA, 20 nt, Human
gcaaagaaaagaaacacgau

SEQ ID NO: 1361485 - RNA, 20 nt, Human
gcaggggggcaaagaaaaga

SEQ ID NO: 1361486 - RNA, 24 nt, Human
gcuccaaaaaauaucaauaagaaa

SEQ ID NO: 1361487 - RNA, 23 nt, Human
ggcugagaaguacaagaccauga

SEQ ID NO: 1361488 - RNA, 23 nt, Human
gggcagaagagcaagagacggug

SEQ ID NO: 1361489 - RNA, 23 nt, Human
gggcaggggggcaaagaaaagaa

SEQ ID NO: 1361490 - RNA, 18 nt, Human
ggggcaaagaaaagaaac

SEQ ID NO: 1361491 - RNA, 21 nt, Human
ggguucaagugauccuccugc

SEQ ID NO: 1361492 - RNA, 27 nt, Human
ggugacgggggcaggggggcaaagaaa

SEQ ID NO: 1361493 - RNA, 19 nt, Human
gucaggaaagccuucccag

SEQ ID NO: 1361494 - RNA, 24 nt, Human
gugauccuccugccucagccuccc

SEQ ID NO: 1361495 - RNA, 21 nt, Human
gugcugagauuauaggcguga

SEQ ID NO: 1361496 - RNA, 19 nt, Human
uaaaacacauaggaggagc

SEQ ID NO: 1361497 - RNA, 27 nt, Human
uaaaaugacaguguuuuaaccugagua

SEQ ID NO: 1361498 - RNA, 19 nt, Human
uaacaaaguggagucacuc

SEQ ID NO: 1361499 - RNA, 22 nt, Human
uaacaaaguggagucacucaug

SEQ ID NO: 1361500 - RNA, 22 nt, Human
uaacacacaaacuuuggagaac

SEQ ID NO: 1361501 - RNA, 23 nt, Human
uaacacacaaacuuuggagaaca

SEQ ID NO: 1361502 - RNA, 23 nt, Human
uaaccaacuacaaugcaaacaag

SEQ ID NO: 1361503 - RNA, 24 nt, Human
uaaccuaaccacuccccucaucaa

SEQ ID NO: 1361504 - RNA, 26 nt, Human
uaagaaagcagauagaucccaaaaca

SEQ ID NO: 1361505 - RNA, 20 nt, Human
uaagaaaucagauaaagcaa

SEQ ID NO: 1361506 - RNA, 18 nt, Human
uaaguuucuaacacacaa

SEQ ID NO: 1361507 - RNA, 20 nt, Human
uacaaugcaaacaagcaaaa

SEQ ID NO: 1361508 - RNA, 22 nt, Human
uagaacaaggccucuccccguc

SEQ ID NO: 1361509 - RNA, 18 nt, Human
uagccuaccugagucaga

SEQ ID NO: 1361510 - RNA, 19 nt, Human
uauaaccaacuacaaugca

SEQ ID NO: 1361511 - RNA, 20 nt, Human
uauaacuaacccacucccaa

SEQ ID NO: 1361512 - RNA, 23 nt, Human
uauaggcgugagccaccgugccu

SEQ ID NO: 1361513 - RNA, 26 nt, Human
uauauauauacacuucccaaccaccu

SEQ ID NO: 1361514 - RNA, 19 nt, Human
ucaagugauccuccugccu

SEQ ID NO: 1361515 - RNA, 18 nt, Human
ucacuguaucuuuuuuua

SEQ ID NO: 1361516 - RNA, 24 nt, Human
ucccaaugugcugagauuauaggc

SEQ ID NO: 1361517 - RNA, 27 nt, Human
uccuccugccucagccucccaaugugc

SEQ ID NO: 1361518 - RNA, 21 nt, Human
ucuaacacacaaacuuuggag

SEQ ID NO: 1361519 - RNA, 23 nt, Human
ucuuguauaacugacaauggcua

SEQ ID NO: 1361520 - RNA, 24 nt, Human
ugaccgaaucaccuaauaggcccc

SEQ ID NO: 1361521 - RNA, 19 nt, Human
ugaccucccgcaacacugc

SEQ ID NO: 1361522 - RNA, 21 nt, Human
ugagauuauaggcgugagcca

SEQ ID NO: 1361523 - RNA, 22 nt, Human
ugagauuauaggcgugagccac

SEQ ID NO: 1361524 - RNA, 23 nt, Human
ugagauuauaggcgugagccacc

SEQ ID NO: 1361525 - RNA, 23 nt, Human
ugagauuauaggcgugagccacc

SEQ ID NO: 1361526 - RNA, 24 nt, Human
ugagauuauaggcgugagccaccg

SEQ ID NO: 1361527 - RNA, 18 nt, Human
ugagcccacaagcuauag

SEQ ID NO: 1361528 - RNA, 24 nt, Human
ugcacugaccuccuucucccacag

SEQ ID NO: 1361529 - RNA, 24 nt, Human
ugccucagccucccaaugugcuga

SEQ ID NO: 1361530 - RNA, 22 nt, Human
uggagaacacauucaaaccaca

SEQ ID NO: 1361531 - RNA, 20 nt, Human
uggcuugaauauaaaaugac

SEQ ID NO: 1361532 - RNA, 20 nt, Human
ugggaauaauaaccuuucaa

SEQ ID NO: 1361533 - RNA, 19 nt, Human
uggguucaagugauccucc

SEQ ID NO: 1361534 - RNA, 20 nt, Human
uggguucaagugauccuccu

SEQ ID NO: 1361535 - RNA, 23 nt, Human
uggguucaagugauccuccugcc

SEQ ID NO: 1361536 - RNA, 24 nt, Human
uggguucaagugauccuccugccu

SEQ ID NO: 1361537 - RNA, 25 nt, Human
uuaacccuuauaaaaaaaaaguaaa

SEQ ID NO: 1361538 - RNA, 19 nt, Human
uucaaaccacaucagugga

SEQ ID NO: 1361539 - RNA, 21 nt, Human
uucaagugauccuccugccuc

SEQ ID NO: 1361540 - RNA, 23 nt, Human
uucaagugauccuccugccucag

SEQ ID NO: 1361541 - RNA, 24 nt, Human
uucaagugauccuccugccucagc

SEQ ID NO: 1361542 - RNA, 21 nt, Human
uucauuuuacaucaucccagg

SEQ ID NO: 1361543 - RNA, 20 nt, Human
uugaaaaucuaaagaguuug

SEQ ID NO: 1361544 - RNA, 28 nt, Human
uuuuuuaauguuaucacauguuuccaac

SEQ ID NO: 1361545 - RNA, 26 nt, Human
aaacuacacaaccucaagggcaggcu

SEQ ID NO: 1361546 - RNA, 23 nt, Human
aaaggaaacugaagugcauuucu

SEQ ID NO: 1361547 - RNA, 22 nt, Human
aaagugcugggacuguaagcgu

SEQ ID NO: 1361548 - RNA, 24 nt, Human
aaagugcugggacuguaagcguga

SEQ ID NO: 1361549 - RNA, 22 nt, Human
aacccugcuccuugaugaccac

SEQ ID NO: 1361550 - RNA, 22 nt, Human
aagcacccucuagagugcagcc

SEQ ID NO: 1361551 - RNA, 23 nt, Human
aagcgugagccacugugcccggc

SEQ ID NO: 1361552 - RNA, 21 nt, Human
aagcucaagugauccuccugc

SEQ ID NO: 1361553 - RNA, 22 nt, Human
aagcucaagugauccuccugcc

SEQ ID NO: 1361554 - RNA, 19 nt, Human
aagugcugggacuguaagc

SEQ ID NO: 1361555 - RNA, 26 nt, Human
aagugcugggacuguaagcgugagcc

SEQ ID NO: 1361556 - RNA, 22 nt, Human
aaguguuucuaagguccaaaac

SEQ ID NO: 1361557 - RNA, 22 nt, Human
acaauuaauuuuaccaccauuu

SEQ ID NO: 1361558 - RNA, 23 nt, Human
accccaucucuacuaaaaauaca

SEQ ID NO: 1361559 - RNA, 23 nt, Human
accucagccucuugaguagcugg

SEQ ID NO: 1361560 - RNA, 26 nt, Human
acucuguugcccaggcuggagugaca

SEQ ID NO: 1361561 - RNA, 20 nt, Human
acugaagugcauuucuuaga

SEQ ID NO: 1361562 - RNA, 24 nt, Human
agaagacuacaaguucugugaggg

SEQ ID NO: 1361563 - RNA, 18 nt, Human
agacucucuugaagauuu

SEQ ID NO: 1361564 - RNA, 24 nt, Human
agcagccaggguggaagugggggc

SEQ ID NO: 1361565 - RNA, 19 nt, Human
agcugcaggccuccagggg

SEQ ID NO: 1361566 - RNA, 20 nt, Human
aggagguggggaggggaugg

SEQ ID NO: 1361567 - RNA, 18 nt, Human
agggaauggugaggaugg

SEQ ID NO: 1361568 - RNA, 19 nt, Human
agguggggaggggauggcu

SEQ ID NO: 1361569 - RNA, 19 nt, Human
agugacaccugagccugug

SEQ ID NO: 1361570 - RNA, 24 nt, Human
agugauucuccugccucagccucc

SEQ ID NO: 1361571 - RNA, 21 nt, Human
agugcaguggugcgaucacag

SEQ ID NO: 1361572 - RNA, 24 nt, Human
agugcaguggugcgaucacagcuc

SEQ ID NO: 1361573 - RNA, 18 nt, Human
aguucugugagggcaggg

SEQ ID NO: 1361574 - RNA, 25 nt, Human
caaacuccuaagcucaagugauccu

SEQ ID NO: 1361575 - RNA, 22 nt, Human
caaagcacccucuagagugcag

SEQ ID NO: 1361576 - RNA, 22 nt, Human
caacaccuggcuaauuuuugua

SEQ ID NO: 1361577 - RNA, 23 nt, Human
caagggcaaagggccagcagcca

SEQ ID NO: 1361578 - RNA, 20 nt, Human
caagugauucuccugccuca

SEQ ID NO: 1361579 - RNA, 22 nt, Human
caagugauucuccugccucagc

SEQ ID NO: 1361580 - RNA, 24 nt, Human
cacaauuuagggcuuuuucugucc

SEQ ID NO: 1361581 - RNA, 24 nt, Human
cacccgagcuggagugcaguggug

SEQ ID NO: 1361582 - RNA, 24 nt, Human
cacucuguugcccaggcuggagug

SEQ ID NO: 1361583 - RNA, 19 nt, Human
cacugugcccggccagaau

SEQ ID NO: 1361584 - RNA, 23 nt, Human
cagcaugggggagggaauggugg

SEQ ID NO: 1361585 - RNA, 20 nt, Human
cagccuccugaguagcuggg

SEQ ID NO: 1361586 - RNA, 18 nt, Human
caggagguggggagggga

SEQ ID NO: 1361587 - RNA, 18 nt, Human
caggcuuuguugagcccc

SEQ ID NO: 1361588 - RNA, 19 nt, Human
caggguggaagugggggca

SEQ ID NO: 1361589 - RNA, 21 nt, Human
cagguggagcugaugguggca

SEQ ID NO: 1361590 - RNA, 22 nt, Human
cagguuucugcuggaagcauca

SEQ ID NO: 1361591 - RNA, 19 nt, Human
cagugugcacaugcacaug

SEQ ID NO: 1361592 - RNA, 27 nt, Human
cauggucagguaucugucggcugggac

SEQ ID NO: 1361593 - RNA, 20 nt, Human
cauuuuacauaaaaggaaac

SEQ ID NO: 1361594 - RNA, 23 nt, Human
ccagaaucaaucuuuuuuuuuuu

SEQ ID NO: 1361595 - RNA, 19 nt, Human
ccaggguggaagugggggc

SEQ ID NO: 1361596 - RNA, 23 nt, Human
cccaaguaccuccccacuguccu

SEQ ID NO: 1361597 - RNA, 29 nt, Human
cccaaguaccuccccacuguccucuccac

SEQ ID NO: 1361598 - RNA, 21 nt, Human
cccacauagcuugugcaucuu

SEQ ID NO: 1361599 - RNA, 19 nt, Human
cccagguggagcugauggu

SEQ ID NO: 1361600 - RNA, 22 nt, Human
ccccacuguccucuccacucug

SEQ ID NO: 1361601 - RNA, 23 nt, Human
ccccgguucaagugauucuccuc

SEQ ID NO: 1361602 - RNA, 23 nt, Human
ccccgguucaagugauucuccug

SEQ ID NO: 1361603 - RNA, 18 nt, Human
cccuuucuucuuucaggc

SEQ ID NO: 1361604 - RNA, 24 nt, Human
ccucucaccucagccucuugagua

SEQ ID NO: 1361605 - RNA, 20 nt, Human
ccugccggguaacucagagu

SEQ ID NO: 1361606 - RNA, 23 nt, Human
ccugccucagccuccugaguagc

SEQ ID NO: 1361607 - RNA, 20 nt, Human
ccugcuggguaccucaaccc

SEQ ID NO: 1361608 - RNA, 21 nt, Human
ccugcuggguaccucaaccca

SEQ ID NO: 1361609 - RNA, 20 nt, Human
ccugcuggguaccucaaccu

SEQ ID NO: 1361610 - RNA, 19 nt, Human
ccuugaacuccugggcuca

SEQ ID NO: 1361611 - RNA, 21 nt, Human
ccuugaacuccugggcucacu

SEQ ID NO: 1361612 - RNA, 24 nt, Human
cggagucucacucuguugcccagg

SEQ ID NO: 1361613 - RNA, 24 nt, Human
cggggucucacuggguugcccagg

SEQ ID NO: 1361614 - RNA, 24 nt, Human
cucaagugauccuccugccugagu

SEQ ID NO: 1361615 - RNA, 23 nt, Human
cucaccucagccucuugaguagc

SEQ ID NO: 1361616 - RNA, 24 nt, Human
cucaccucagccucuugaguagcu

SEQ ID NO: 1361617 - RNA, 24 nt, Human
cucacucuguugcccaggcuggag

SEQ ID NO: 1361618 - RNA, 25 nt, Human
cucacugcaaccuccaacuccccgg

SEQ ID NO: 1361619 - RNA, 24 nt, Human
cucagccucuugaguagcugggac

SEQ ID NO: 1361620 - RNA, 18 nt, Human
cuccccgguucaagugau

SEQ ID NO: 1361621 - RNA, 23 nt, Human
cuccccgguucaagugauucucc

SEQ ID NO: 1361622 - RNA, 22 nt, Human
cuccugggcucacuugcuccuc

SEQ ID NO: 1361623 - RNA, 24 nt, Human
cucuugaguagcugggaccacagg

SEQ ID NO: 1361624 - RNA, 23 nt, Human
cugccucagccuccugaguagcu

SEQ ID NO: 1361625 - RNA, 18 nt, Human
cugcuggguaccucaacc

SEQ ID NO: 1361626 - RNA, 18 nt, Human
cugcuggguaccucaacc

SEQ ID NO: 1361627 - RNA, 27 nt, Human
cuuaagauccuacugcagaaaccuuuu

SEQ ID NO: 1361628 - RNA, 23 nt, Human
cuugaagauuuucuaaugccuag

SEQ ID NO: 1361629 - RNA, 19 nt, Human
cuugcgcgaagauagucac

SEQ ID NO: 1361630 - RNA, 24 nt, Human
cuugcuccucucaccucagccucu

SEQ ID NO: 1361631 - RNA, 22 nt, Human
cuuuggacggaaguggggugga

SEQ ID NO: 1361632 - RNA, 19 nt, Human
gaacacccaaguaccuccc

SEQ ID NO: 1361633 - RNA, 26 nt, Human
gaacacuuaagggucccaacaucuga

SEQ ID NO: 1361634 - RNA, 18 nt, Human
gacacaguggagaucaag

SEQ ID NO: 1361635 - RNA, 18 nt, Human
gacuguaagcgugagcca

SEQ ID NO: 1361636 - RNA, 21 nt, Human
gacuguaagcgugagccacug

SEQ ID NO: 1361637 - RNA, 24 nt, Human
gagcugcuuguaggaaacgcuggc

SEQ ID NO: 1361638 - RNA, 27 nt, Human
gaguagcugggaccacaggcacauguc

SEQ ID NO: 1361639 - RNA, 21 nt, Human
gagugacauaaucucggcuca

SEQ ID NO: 1361640 - RNA, 24 nt, Human
gagugcaguggugcgaucacagcu

SEQ ID NO: 1361641 - RNA, 20 nt, Human
gaguucccuccuucugcccc

SEQ ID NO: 1361642 - RNA, 22 nt, Human
gcaaccuccaacuccccgguuc

SEQ ID NO: 1361643 - RNA, 20 nt, Human
gcagccuugaacuccugggc

SEQ ID NO: 1361644 - RNA, 23 nt, Human
ggaaaccucucauggagcugcuu

SEQ ID NO: 1361645 - RNA, 21 nt, Human
ggcaggcugugguacggggcu

SEQ ID NO: 1361646 - RNA, 21 nt, Human
ggcauccuuuggaccccacug

SEQ ID NO: 1361647 - RNA, 18 nt, Human
gggcaaagggccagcagc

SEQ ID NO: 1361648 - RNA, 19 nt, Human
gggcaggagguggggaggg

SEQ ID NO: 1361649 - RNA, 21 nt, Human
gggcaggagguggggagggga

SEQ ID NO: 1361650 - RNA, 30 nt, Human
gggcaggagguggggaggggauggcuggaa

SEQ ID NO: 1361651 - RNA, 20 nt, Human
ggggagggaauggugaggau

SEQ ID NO: 1361652 - RNA, 22 nt, Human
gggucucacuggguugcccagg

SEQ ID NO: 1361653 - RNA, 21 nt, Human
gguggugacgguggcugugca

SEQ ID NO: 1361654 - RNA, 21 nt, Human
gguucaagugauucuccugcc

SEQ ID NO: 1361655 - RNA, 21 nt, Human
guaggaaacgcuggcuggcug

SEQ ID NO: 1361656 - RNA, 24 nt, Human
gugauucuccugccucagccuccu

SEQ ID NO: 1361657 - RNA, 19 nt, Human
gugcacucacuugagggca

SEQ ID NO: 1361658 - RNA, 23 nt, Human
gugguuccuaacucuccccagaa

SEQ ID NO: 1361659 - RNA, 21 nt, Human
guugcccaggcuagucucaaa

SEQ ID NO: 1361660 - RNA, 18 nt, Human
uaaaaggaaacugaagug

SEQ ID NO: 1361661 - RNA, 23 nt, Human
uaaacuacacaaccucaagggca

SEQ ID NO: 1361662 - RNA, 24 nt, Human
uaaagugcugggacuguaagcgug

SEQ ID NO: 1361663 - RNA, 22 nt, Human
uaagacggagucucacucuguu

SEQ ID NO: 1361664 - RNA, 18 nt, Human
uaagauccuacugcagaa

SEQ ID NO: 1361665 - RNA, 23 nt, Human
uaagugguuccuaacucucccca

SEQ ID NO: 1361666 - RNA, 24 nt, Human
uagcauuuuaaguggaaaccucuc

SEQ ID NO: 1361667 - RNA, 19 nt, Human
uagggugccugggacacag

SEQ ID NO: 1361668 - RNA, 20 nt, Human
uagguggugacgguggcugu

SEQ ID NO: 1361669 - RNA, 23 nt, Human
uagguggugacgguggcuguggu

SEQ ID NO: 1361670 - RNA, 26 nt, Human
uaucuaaacuacacaaccucaagggc

SEQ ID NO: 1361671 - RNA, 22 nt, Human
uaugaagccugcuggguaccuc

SEQ ID NO: 1361672 - RNA, 18 nt, Human
ucaagagcagucuggacu

SEQ ID NO: 1361673 - RNA, 18 nt, Human
ucaagugauccuccugcc

SEQ ID NO: 1361674 - RNA, 19 nt, Human
ucaagugauucuccugccu

SEQ ID NO: 1361675 - RNA, 24 nt, Human
ucacucuguugcccaggcuggagu

SEQ ID NO: 1361676 - RNA, 19 nt, Human
ucacugcaaccuccaacuc

SEQ ID NO: 1361677 - RNA, 24 nt, Human
ucacugcaaccuccaacuccccgg

SEQ ID NO: 1361678 - RNA, 27 nt, Human
ucacugcaaccuccaacuccccgguuc

SEQ ID NO: 1361679 - RNA, 19 nt, Human
ucacuugagggcagagauc

SEQ ID NO: 1361680 - RNA, 20 nt, Human
ucagccuccugaguagcugg

SEQ ID NO: 1361681 - RNA, 23 nt, Human
ucagccucuugaguagcugggac

SEQ ID NO: 1361682 - RNA, 24 nt, Human
ucauugcagccuugaacuccuggg

SEQ ID NO: 1361683 - RNA, 19 nt, Human
uccagguuucugcuggaag

SEQ ID NO: 1361684 - RNA, 21 nt, Human
uccccgguucaagugauucuc

SEQ ID NO: 1361685 - RNA, 24 nt, Human
uccccgguucaagugauucuccug

SEQ ID NO: 1361686 - RNA, 22 nt, Human
uccuuaagugguuccuaacucu

SEQ ID NO: 1361687 - RNA, 26 nt, Human
uccuugcagacaucugucauggcacg

SEQ ID NO: 1361688 - RNA, 18 nt, Human
ucuagagugcagccagcu

SEQ ID NO: 1361689 - RNA, 23 nt, Human
ucucacucuguugcccaggcugg

SEQ ID NO: 1361690 - RNA, 24 nt, Human
ucucacucuguugcccaggcugga

SEQ ID NO: 1361691 - RNA, 25 nt, Human
ucucacucuguugcccaggcuggag

SEQ ID NO: 1361692 - RNA, 26 nt, Human
ucucacucuguugcccaggcuggagu

SEQ ID NO: 1361693 - RNA, 25 nt, Human
ucucacucuugucacccgagcugga

SEQ ID NO: 1361694 - RNA, 19 nt, Human
ucucacuggguugcccagg

SEQ ID NO: 1361695 - RNA, 22 nt, Human
ucuccacucuguccuuccuaca

SEQ ID NO: 1361696 - RNA, 24 nt, Human
ucuccugccucagccuccugagua

SEQ ID NO: 1361697 - RNA, 19 nt, Human
ucucuacuaaaaauacaga

SEQ ID NO: 1361698 - RNA, 21 nt, Human
ucugccccugcuggacaaaug

SEQ ID NO: 1361699 - RNA, 27 nt, Human
ucugucggcugggacaaaccggggucc

SEQ ID NO: 1361700 - RNA, 22 nt, Human
ucuguugcccaggcuggaguga

SEQ ID NO: 1361701 - RNA, 24 nt, Human
ucuugaguagcugggaccacaggc

SEQ ID NO: 1361702 - RNA, 19 nt, Human
ugaaaccccaucucuacua

SEQ ID NO: 1361703 - RNA, 18 nt, Human
ugaaagacucaacgaacc

SEQ ID NO: 1361704 - RNA, 25 nt, Human
ugaacuccugggcucacuugcuccu

SEQ ID NO: 1361705 - RNA, 18 nt, Human
ugaauaaaccagguccua

SEQ ID NO: 1361706 - RNA, 19 nt, Human
ugagaugucaucguaccga

SEQ ID NO: 1361707 - RNA, 21 nt, Human
ugagauuccaagaaaagucuu

SEQ ID NO: 1361708 - RNA, 18 nt, Human
ugaguuaaacccugcucc

SEQ ID NO: 1361709 - RNA, 19 nt, Human
ugaguucccuccuucugcc

SEQ ID NO: 1361710 - RNA, 20 nt, Human
ugauucuccugccucagccu

SEQ ID NO: 1361711 - RNA, 19 nt, Human
ugccccacugagccaucug

SEQ ID NO: 1361712 - RNA, 24 nt, Human
ugccucagccuccugaguagcugg

SEQ ID NO: 1361713 - RNA, 19 nt, Human
ugccugggacacaguggag

SEQ ID NO: 1361714 - RNA, 20 nt, Human
ugcugcuuaaagaacuuaag

SEQ ID NO: 1361715 - RNA, 21 nt, Human
uggaagugggggcaggaggug

SEQ ID NO: 1361716 - RNA, 19 nt, Human
uggagugcaguggugcgau

SEQ ID NO: 1361717 - RNA, 21 nt, Human
uggagugcaguggugcgauca

SEQ ID NO: 1361718 - RNA, 21 nt, Human
uggcuggacuccugauucuuu

SEQ ID NO: 1361719 - RNA, 18 nt, Human
ugggacaaaccucccagg

SEQ ID NO: 1361720 - RNA, 21 nt, Human
ugggacuguaagcgugagcca

SEQ ID NO: 1361721 - RNA, 22 nt, Human
ugggacuguaagcgugagccac

SEQ ID NO: 1361722 - RNA, 24 nt, Human
ugggacuguaagcgugagccacug

SEQ ID NO: 1361723 - RNA, 20 nt, Human
uggggaggggauggcuggac

SEQ ID NO: 1361724 - RNA, 21 nt, Human
uggggcagaagacuacaaguu

SEQ ID NO: 1361725 - RNA, 24 nt, Human
uggguugcccaggcuagucucaaa

SEQ ID NO: 1361726 - RNA, 24 nt, Human
uuaaagugcugggacuguaagcgu

SEQ ID NO: 1361727 - RNA, 21 nt, Human
uucaagugauucuccugccuc

SEQ ID NO: 1361728 - RNA, 23 nt, Human
uucaagugauucuccugccucag

SEQ ID NO: 1361729 - RNA, 24 nt, Human
uucaagugauucuccugccucagc

SEQ ID NO: 1361730 - RNA, 23 nt, Human
uuccaagaaaagucuuauuucag

SEQ ID NO: 1361731 - RNA, 20 nt, Human
uugaacacccaaguaccucc

SEQ ID NO: 1361732 - RNA, 22 nt, Human
uugaagauuuucuaaugccuag

SEQ ID NO: 1361733 - RNA, 18 nt, Human
uugagggcagagaucaga

SEQ ID NO: 1361734 - RNA, 23 nt, Human
uugcagccuugaacuccugggcu

SEQ ID NO: 1361735 - RNA, 23 nt, Human
uugucacccgagcuggagugcag

SEQ ID NO: 1361736 - RNA, 21 nt, Human
uuguugagccccagguggagc

SEQ ID NO: 1361737 - RNA, 24 nt, Human
uuucuauuucaagagcagucugga

SEQ ID NO: 1361738 - RNA, 22 nt, Human
aaagucccauggcgagugccag

SEQ ID NO: 1361739 - RNA, 22 nt, Human
aaucuuacuucccuaaccucac

SEQ ID NO: 1361740 - RNA, 24 nt, Human
aaugcagugguauggucucggcuc

SEQ ID NO: 1361741 - RNA, 20 nt, Human
acaaccaugaauccuacaua

SEQ ID NO: 1361742 - RNA, 18 nt, Human
acacaggugugugccacc

SEQ ID NO: 1361743 - RNA, 18 nt, Human
acauugacaagcaagugu

SEQ ID NO: 1361744 - RNA, 24 nt, Human
accacguuggccaggcuggucuug

SEQ ID NO: 1361745 - RNA, 24 nt, Human
acccaggcuggaaugcagugguau

SEQ ID NO: 1361746 - RNA, 20 nt, Human
acgagguuucaccacguugg

SEQ ID NO: 1361747 - RNA, 24 nt, Human
acgagguuucaccacguuggccag

SEQ ID NO: 1361748 - RNA, 20 nt, Human
acucuguggaaagguugggg

SEQ ID NO: 1361749 - RNA, 19 nt, Human
acuuggggaacuuuucugu

SEQ ID NO: 1361750 - RNA, 23 nt, Human
agagcuacuuacgauuuagauaa

SEQ ID NO: 1361751 - RNA, 18 nt, Human
agcaggaugugggugggg

SEQ ID NO: 1361752 - RNA, 19 nt, Human
agcuguaacacucaccgca

SEQ ID NO: 1361753 - RNA, 22 nt, Human
aggaaggcugggcugggacagc

SEQ ID NO: 1361754 - RNA, 24 nt, Human
aggugauccgcccacuuuggccuc

SEQ ID NO: 1361755 - RNA, 27 nt, Human
agguguggagggaaaggugugggcagg

SEQ ID NO: 1361756 - RNA, 21 nt, Human
agguucaagugauucuccugc

SEQ ID NO: 1361757 - RNA, 22 nt, Human
agguucaagugauucuccugcc

SEQ ID NO: 1361758 - RNA, 23 nt, Human
agguucaagugauucuccugccu

SEQ ID NO: 1361759 - RNA, 18 nt, Human
aguagcugggagugcagg

SEQ ID NO: 1361760 - RNA, 24 nt, Human
agugguauggucucggcucacugc

SEQ ID NO: 1361761 - RNA, 21 nt, Human
aucagcacucugugucuagcu

SEQ ID NO: 1361762 - RNA, 23 nt, Human
auggcagagcacacacagauaga

SEQ ID NO: 1361763 - RNA, 22 nt, Human
auggggacuuggggaacuuuuc

SEQ ID NO: 1361764 - RNA, 23 nt, Human
caaccucuaccucccagguucaa

SEQ ID NO: 1361765 - RNA, 22 nt, Human
caagugauucuccugccugagc

SEQ ID NO: 1361766 - RNA, 24 nt, Human
caauuuuuguauuuuuaguauaga

SEQ ID NO: 1361767 - RNA, 22 nt, Human
cacacaggugugugccaccaca

SEQ ID NO: 1361768 - RNA, 24 nt, Human
cacaggugugugccaccacaccca

SEQ ID NO: 1361769 - RNA, 21 nt, Human
caccacguuggccaggcuggu

SEQ ID NO: 1361770 - RNA, 23 nt, Human
caccacguuggccaggcuggucu

SEQ ID NO: 1361771 - RNA, 24 nt, Human
caccacguuggccaggcuggucuu

SEQ ID NO: 1361772 - RNA, 27 nt, Human
caccacguuggccaggcuggucuugaa

SEQ ID NO: 1361773 - RNA, 23 nt, Human
caccagaaggaaccagcagcucc

SEQ ID NO: 1361774 - RNA, 19 nt, Human
caccagaaggaagaaacuc

SEQ ID NO: 1361775 - RNA, 21 nt, Human
caccagaaggaagaaacucca

SEQ ID NO: 1361776 - RNA, 20 nt, Human
caccaggcacccccauucau

SEQ ID NO: 1361777 - RNA, 24 nt, Human
caccgaucugcgcucugucaaaac

SEQ ID NO: 1361778 - RNA, 24 nt, Human
cacguuggccaggcuggucuugaa

SEQ ID NO: 1361779 - RNA, 23 nt, Human
cacugaccugcagcccccaggac

SEQ ID NO: 1361780 - RNA, 21 nt, Human
cacugcaaccucuaccuccca

SEQ ID NO: 1361781 - RNA, 24 nt, Human
cagauagaccaaagguaaugccag

SEQ ID NO: 1361782 - RNA, 21 nt, Human
cagcagcuccagacacgccac

SEQ ID NO: 1361783 - RNA, 21 nt, Human
cagcgagaccaagaacccacc

SEQ ID NO: 1361784 - RNA, 20 nt, Human
cagcuccacuuuucccuccu

SEQ ID NO: 1361785 - RNA, 23 nt, Human
caggcacccccauucaucagucc

SEQ ID NO: 1361786 - RNA, 27 nt, Human
cauugacaagcaagugugucauaacca

SEQ ID NO: 1361787 - RNA, 20 nt, Human
ccaccacacccagccaauuu

SEQ ID NO: 1361788 - RNA, 26 nt, Human
ccagaaggaaccagcagcuccagaca

SEQ ID NO: 1361789 - RNA, 24 nt, Human
ccagacacaccaucuuuaagaacu

SEQ ID NO: 1361790 - RNA, 20 nt, Human
ccaugccuucacucuccagu

SEQ ID NO: 1361791 - RNA, 27 nt, Human
cccaccagaaggaagaaacuccagaca

SEQ ID NO: 1361792 - RNA, 23 nt, Human
cccagguucaagugauucuccuc

SEQ ID NO: 1361793 - RNA, 23 nt, Human
cccagguucaagugauucuccug

SEQ ID NO: 1361794 - RNA, 19 nt, Human
ccccgugcauagacagggu

SEQ ID NO: 1361795 - RNA, 23 nt, Human
cccgaguagcugggagugcaggu

SEQ ID NO: 1361796 - RNA, 21 nt, Human
ccgaucugcgcucugucaaaa

SEQ ID NO: 1361797 - RNA, 19 nt, Human
ccucaggugauccgcccac

SEQ ID NO: 1361798 - RNA, 24 nt, Human
ccucccagguucaagugauucucc

SEQ ID NO: 1361799 - RNA, 21 nt, Human
ccucuuuggcauuggcgucca

SEQ ID NO: 1361800 - RNA, 20 nt, Human
ccugcuaggguccccuuuca

SEQ ID NO: 1361801 - RNA, 24 nt, Human
ccuggccucaggugauccgcccac

SEQ ID NO: 1361802 - RNA, 19 nt, Human
ccuggugauuagaaugagg

SEQ ID NO: 1361803 - RNA, 19 nt, Human
ccuguccauccucacacuu

SEQ ID NO: 1361804 - RNA, 18 nt, Human
ccuguggucagguuggag

SEQ ID NO: 1361805 - RNA, 18 nt, Human
cgaacccaccagaaggaa

SEQ ID NO: 1361806 - RNA, 19 nt, Human
cgagaccaagaacccacca

SEQ ID NO: 1361807 - RNA, 24 nt, Human
cgagguuucaccacguuggccagg

SEQ ID NO: 1361808 - RNA, 24 nt, Human
cgcucugucacccaggcuggaaug

SEQ ID NO: 1361809 - RNA, 20 nt, Human
cggggagguguggagggaaa

SEQ ID NO: 1361810 - RNA, 22 nt, Human
cguuggccaggcuggucuugaa

SEQ ID NO: 1361811 - RNA, 19 nt, Human
cuagcagcccucgcucacu

SEQ ID NO: 1361812 - RNA, 22 nt, Human
cuauuccaaagaggacuguggu

SEQ ID NO: 1361813 - RNA, 24 nt, Human
cucacugcaaccucuaccucccag

SEQ ID NO: 1361814 - RNA, 19 nt, Human
cucccagguucaagugauu

SEQ ID NO: 1361815 - RNA, 21 nt, Human
cucgcucugucacccaggcug

SEQ ID NO: 1361816 - RNA, 22 nt, Human
cucucuguaaaacggaccaauc

SEQ ID NO: 1361817 - RNA, 22 nt, Human
cucucuguaaaauggaccaauc

SEQ ID NO: 1361818 - RNA, 23 nt, Human
cucugucacccaggcuggaaugc

SEQ ID NO: 1361819 - RNA, 27 nt, Human
cucuuuggcauuggcguccacucuggg

SEQ ID NO: 1361820 - RNA, 19 nt, Human
cugaagccagugagaccac

SEQ ID NO: 1361821 - RNA, 20 nt, Human
cugaagccagugagaccacg

SEQ ID NO: 1361822 - RNA, 25 nt, Human
cugaagccagugagaccacgaaccc

SEQ ID NO: 1361823 - RNA, 23 nt, Human
cugcaaccucuaccucccagguu

SEQ ID NO: 1361824 - RNA, 24 nt, Human
cugcaaccucuaccucccagguuc

SEQ ID NO: 1361825 - RNA, 23 nt, Human
cugccugagccucccgaguagcu

SEQ ID NO: 1361826 - RNA, 19 nt, Human
cuggaaugcagugguaugg

SEQ ID NO: 1361827 - RNA, 19 nt, Human
cuguaaaacggaccaauca

SEQ ID NO: 1361828 - RNA, 19 nt, Human
cuguaaaauggaccaauca

SEQ ID NO: 1361829 - RNA, 20 nt, Human
cugucaaaacggaccaauca

SEQ ID NO: 1361830 - RNA, 20 nt, Human
cuugcuacaaccaugaaucc

SEQ ID NO: 1361831 - RNA, 23 nt, Human
cuugcugcugcucacucucuggg

SEQ ID NO: 1361832 - RNA, 23 nt, Human
cuuuaugagcuguaacacucacc

SEQ ID NO: 1361833 - RNA, 21 nt, Human
gaagaaacuccagacacaucu

SEQ ID NO: 1361834 - RNA, 24 nt, Human
gaagccggcuggacuucuccuacc

SEQ ID NO: 1361835 - RNA, 23 nt, Human
gaccacgaacccaccagaaggaa

SEQ ID NO: 1361836 - RNA, 20 nt, Human
gagaccacgaacccaccaga

SEQ ID NO: 1361837 - RNA, 23 nt, Human
gagcacacacagauagaccaaag

SEQ ID NO: 1361838 - RNA, 19 nt, Human
gaucagaaugacaagcccc

SEQ ID NO: 1361839 - RNA, 21 nt, Human
gccccugaaggagaaacggca

SEQ ID NO: 1361840 - RNA, 24 nt, Human
gccucaccaggcacccccauucau

SEQ ID NO: 1361841 - RNA, 19 nt, Human
gcgccgccuuuaugagcug

SEQ ID NO: 1361842 - RNA, 24 nt, Human
gcuagguuucauugcacugaccug

SEQ ID NO: 1361843 - RNA, 20 nt, Human
gcugggacagcagccugugg

SEQ ID NO: 1361844 - RNA, 23 nt, Human
gcuggucuugaacuccuggccuc

SEQ ID NO: 1361845 - RNA, 21 nt, Human
ggcugggacagcagccugugg

SEQ ID NO: 1361846 - RNA, 24 nt, Human
ggcuggucuugaacuccuggccuc

SEQ ID NO: 1361847 - RNA, 19 nt, Human
ggugggugccgggaggccc

SEQ ID NO: 1361848 - RNA, 22 nt, Human
gucaaaacggaccaaucagcuc

SEQ ID NO: 1361849 - RNA, 21 nt, Human
gugaaggguaguuuuaagaca

SEQ ID NO: 1361850 - RNA, 24 nt, Human
gugauucuccugccugagccuccc

SEQ ID NO: 1361851 - RNA, 23 nt, Human
guggagggaaaggugugggcagg

SEQ ID NO: 1361852 - RNA, 20 nt, Human
uaaaauggaccaaucagcaa

SEQ ID NO: 1361853 - RNA, 24 nt, Human
uaaaauggaccaaucagcaggaug

SEQ ID NO: 1361854 - RNA, 18 nt, Human
uaacacucaccgcaaaag

SEQ ID NO: 1361855 - RNA, 19 nt, Human
uaacacucaccgcaaaagu

SEQ ID NO: 1361856 - RNA, 22 nt, Human
uaaggguaagagccagugggcu

SEQ ID NO: 1361857 - RNA, 22 nt, Human
uaccucccagguucaagugauu

SEQ ID NO: 1361858 - RNA, 31 nt, Human
uacucugcuuccuugugaaggguaguuuuaa

SEQ ID NO: 1361859 - RNA, 19 nt, Human
uaggguccccuuucacgcu

SEQ ID NO: 1361860 - RNA, 20 nt, Human
uaggugcugcaaagucccau

SEQ ID NO: 1361861 - RNA, 24 nt, Human
uaguauagacgagguuucaccacg

SEQ ID NO: 1361862 - RNA, 19 nt, Human
uaucugaaggaacaaacuc

SEQ ID NO: 1361863 - RNA, 19 nt, Human
ucaagugauucuccugccu

SEQ ID NO: 1361864 - RNA, 20 nt, Human
ucaccaggcacccccauuca

SEQ ID NO: 1361865 - RNA, 19 nt, Human
ucacccaggcuggaaugca

SEQ ID NO: 1361866 - RNA, 20 nt, Human
ucacucucggugccucuuug

SEQ ID NO: 1361867 - RNA, 23 nt, Human
ucacugcaaccucuaccucccag

SEQ ID NO: 1361868 - RNA, 24 nt, Human
ucacugcaaccucuaccucccagg

SEQ ID NO: 1361869 - RNA, 21 nt, Human
ucagcaagugccugcugggcu

SEQ ID NO: 1361870 - RNA, 22 nt, Human
uccagacacaccaucuuuaaga

SEQ ID NO: 1361871 - RNA, 22 nt, Human
uccagacacgccaccuuuaaga

SEQ ID NO: 1361872 - RNA, 23 nt, Human
uccagcgugggucuccaaacuug

SEQ ID NO: 1361873 - RNA, 21 nt, Human
ucccagguucaagugauucuc

SEQ ID NO: 1361874 - RNA, 24 nt, Human
ucccagguucaagugauucuccug

SEQ ID NO: 1361875 - RNA, 23 nt, Human
ucccgaguagcugggagugcagg

SEQ ID NO: 1361876 - RNA, 24 nt, Human
ucccgaguagcugggagugcaggu

SEQ ID NO: 1361877 - RNA, 21 nt, Human
uccucacacuugcuacaacca

SEQ ID NO: 1361878 - RNA, 23 nt, Human
uccucacacuugcuacaaccaug

SEQ ID NO: 1361879 - RNA, 20 nt, Human
uccuuggcugaccugcagga

SEQ ID NO: 1361880 - RNA, 19 nt, Human
ucucgcucugucacccagg

SEQ ID NO: 1361881 - RNA, 23 nt, Human
ucucgcucugucacccaggcugg

SEQ ID NO: 1361882 - RNA, 24 nt, Human
ucucgcucugucacccaggcugga

SEQ ID NO: 1361883 - RNA, 26 nt, Human
ucucgcucugucacccaggcuggaau

SEQ ID NO: 1361884 - RNA, 27 nt, Human
ucucgcucugucacccaggcuggaaug

SEQ ID NO: 1361885 - RNA, 21 nt, Human
ucucuggggcuggcugaggcc

SEQ ID NO: 1361886 - RNA, 24 nt, Human
ucugucacccaggcuggaaugcag

SEQ ID NO: 1361887 - RNA, 20 nt, Human
ucuugaacuccuggccucag

SEQ ID NO: 1361888 - RNA, 22 nt, Human
ugaaggaacaaacuccagacac

SEQ ID NO: 1361889 - RNA, 21 nt, Human
ugagaaaauggaaggucagag

SEQ ID NO: 1361890 - RNA, 23 nt, Human
ugagaaaauggaaggucagagaa

SEQ ID NO: 1361891 - RNA, 23 nt, Human
ugagaagacugcugagaucagaa

SEQ ID NO: 1361892 - RNA, 18 nt, Human
ugagaccacgaacccacc

SEQ ID NO: 1361893 - RNA, 19 nt, Human
ugagaccacgaacccacca

SEQ ID NO: 1361894 - RNA, 21 nt, Human
ugagaccacgaacccaccaga

SEQ ID NO: 1361895 - RNA, 24 nt, Human
ugagagaagccggcuggacuucuc

SEQ ID NO: 1361896 - RNA, 23 nt, Human
ugagcuguaacacucaccgcgaa

SEQ ID NO: 1361897 - RNA, 23 nt, Human
ugauguguggacucuguggaaag

SEQ ID NO: 1361898 - RNA, 23 nt, Human
ugcagcccccaggacuguccccu

SEQ ID NO: 1361899 - RNA, 18 nt, Human
ugcagugguauggucucg

SEQ ID NO: 1361900 - RNA, 22 nt, Human
ugcagugguauggucucggcuc

SEQ ID NO: 1361901 - RNA, 19 nt, Human
ugcccaagcuaggugcugc

SEQ ID NO: 1361902 - RNA, 24 nt, Human
ugccugagccucccgaguagcugg

SEQ ID NO: 1361903 - RNA, 21 nt, Human
ugcuacaaccaugaauccuac

SEQ ID NO: 1361904 - RNA, 20 nt, Human
uggaaugcagugguaugguc

SEQ ID NO: 1361905 - RNA, 23 nt, Human
uggaaugcagugguauggucucg

SEQ ID NO: 1361906 - RNA, 24 nt, Human
uggaaugcagugguauggucucgg

SEQ ID NO: 1361907 - RNA, 21 nt, Human
uggacacacaggugugugcca

SEQ ID NO: 1361908 - RNA, 23 nt, Human
uggacacacaggugugugccacc

SEQ ID NO: 1361909 - RNA, 24 nt, Human
uggccaggcuggucuugaacuccu

SEQ ID NO: 1361910 - RNA, 18 nt, Human
uggccucaggugauccgc

SEQ ID NO: 1361911 - RNA, 24 nt, Human
uggccucaggugauccgcccacuu

SEQ ID NO: 1361912 - RNA, 22 nt, Human
uggggcuggcugaggccggagc

SEQ ID NO: 1361913 - RNA, 22 nt, Human
uguaaaacggaccaaucagcuc

SEQ ID NO: 1361914 - RNA, 20 nt, Human
ugucauaaccauguugcaac

SEQ ID NO: 1361915 - RNA, 19 nt, Human
ugucuaaagacacccaagu

SEQ ID NO: 1361916 - RNA, 25 nt, Human
ugugcgcacacacggguucuaggug

SEQ ID NO: 1361917 - RNA, 23 nt, Human
ugugcgccgccuuuaugagcugu

SEQ ID NO: 1361918 - RNA, 24 nt, Human
ugugucuagcuaaagguuuguaaa

SEQ ID NO: 1361919 - RNA, 20 nt, Human
ugugugccaccacacccagc

SEQ ID NO: 1361920 - RNA, 24 nt, Human
uucaagugauucuccugccugagc

SEQ ID NO: 1361921 - RNA, 22 nt, Human
uuccuacacgcuuccuuggcug

SEQ ID NO: 1361922 - RNA, 23 nt, Human
uucuaaaucagcucuaaggccac

SEQ ID NO: 1361923 - RNA, 25 nt, Human
uugaagucagcgagaccacgaaccc

SEQ ID NO: 1361924 - RNA, 21 nt, Human
uugcugcugcucacucucugg

SEQ ID NO: 1361925 - RNA, 22 nt, Human
uuguauuuuuaguauagacgag

SEQ ID NO: 1361926 - RNA, 21 nt, Human
uuucaccacguuggccaggcu

SEQ ID NO: 1361927 - RNA, 24 nt, Human
uuuuuaguauagacgagguuucac

SEQ ID NO: 1361928 - RNA, 23 nt, Human
uuuuuguauuuuuaguauagacg

SEQ ID NO: 1361929 - RNA, 21 nt, Human
aaaacagcagaaagguuaaag

SEQ ID NO: 1361930 - RNA, 20 nt, Human
aaaagaaacuucaacugccu

SEQ ID NO: 1361931 - RNA, 24 nt, Human
aaaaugcaagaauaaaauggaaca

SEQ ID NO: 1361932 - RNA, 21 nt, Human
aaacaaaaaguuggagguagc

SEQ ID NO: 1361933 - RNA, 22 nt, Human
aaagaaaaaucagggaaaagga

SEQ ID NO: 1361934 - RNA, 20 nt, Human
aaagaaacuucaacugccuc

SEQ ID NO: 1361935 - RNA, 19 nt, Human
aaagauacccacucugucc

SEQ ID NO: 1361936 - RNA, 22 nt, Human
aaagauacccacucuguccaca

SEQ ID NO: 1361937 - RNA, 22 nt, Human
aaaggacacaaaagaaacuuca

SEQ ID NO: 1361938 - RNA, 24 nt, Human
aaaggacacaaaagaaacuucaac

SEQ ID NO: 1361939 - RNA, 23 nt, Human
aaaggcuguccagacagcucugg

SEQ ID NO: 1361940 - RNA, 24 nt, Human
aaagucucuccacuguguccacac

SEQ ID NO: 1361941 - RNA, 22 nt, Human
aacuucccuguuguuaggggga

SEQ ID NO: 1361942 - RNA, 20 nt, Human
aagaaaaaucagggaaaagg

SEQ ID NO: 1361943 - RNA, 19 nt, Human
aagaagaguaagagcaaga

SEQ ID NO: 1361944 - RNA, 22 nt, Human
aagauacauagcucagccaugg

SEQ ID NO: 1361945 - RNA, 23 nt, Human
aaugcaagaauaaaauggaacaa

SEQ ID NO: 1361946 - RNA, 21 nt, Human
aauggauucagugaucauagu

SEQ ID NO: 1361947 - RNA, 18 nt, Human
acacaacgaggcaggcac

SEQ ID NO: 1361948 - RNA, 26 nt, Human
acacaacgaggcaggcacuguggccc

SEQ ID NO: 1361949 - RNA, 20 nt, Human
acagacaauaaacaacuaag

SEQ ID NO: 1361950 - RNA, 18 nt, Human
acagcuucauuugcagag

SEQ ID NO: 1361951 - RNA, 23 nt, Human
acaggaaaggcuguccagacagc

SEQ ID NO: 1361952 - RNA, 19 nt, Human
acugcagcugccacaugcc

SEQ ID NO: 1361953 - RNA, 21 nt, Human
acugugugcugggcacugcuc

SEQ ID NO: 1361954 - RNA, 20 nt, Human
agacaggauugggagcuggg

SEQ ID NO: 1361955 - RNA, 24 nt, Human
agacaggauugggagcugggagug

SEQ ID NO: 1361956 - RNA, 23 nt, Human
agacggucuugaaggucuagaac

SEQ ID NO: 1361957 - RNA, 22 nt, Human
agagaaguauucagggcccaga

SEQ ID NO: 1361958 - RNA, 21 nt, Human
agagcaacccauugucuaagg

SEQ ID NO: 1361959 - RNA, 19 nt, Human
agagcaagagccuuggcug

SEQ ID NO: 1361960 - RNA, 18 nt, Human
agagccugaaggccagug

SEQ ID NO: 1361961 - RNA, 20 nt, Human
agauacccacucuguccaca

SEQ ID NO: 1361962 - RNA, 21 nt, Human
agcauucuaggcagagggaaa

SEQ ID NO: 1361963 - RNA, 21 nt, Human
agccauggaguucacagcuuc

SEQ ID NO: 1361964 - RNA, 22 nt, Human
agcuaguucugaacuuuuccuc

SEQ ID NO: 1361965 - RNA, 24 nt, Human
aggaaagagcauucuaggcagagg

SEQ ID NO: 1361966 - RNA, 23 nt, Human
aggcaaaaauaaaauggagggac

SEQ ID NO: 1361967 - RNA, 20 nt, Human
aggcaaaggugguggaaugg

SEQ ID NO: 1361968 - RNA, 26 nt, Human
aggcaggaagugguagaaaggggacc

SEQ ID NO: 1361969 - RNA, 23 nt, Human
aggcuuagaagucacacuaaaau

SEQ ID NO: 1361970 - RNA, 20 nt, Human
aguaucccugguccccaccu

SEQ ID NO: 1361971 - RNA, 25 nt, Human
auaaaauggaacaauagaguauguc

SEQ ID NO: 1361972 - RNA, 23 nt, Human
auaaagagcagauuuauguccca

SEQ ID NO: 1361973 - RNA, 23 nt, Human
caaaagaaacuucaacugccuca

SEQ ID NO: 1361974 - RNA, 23 nt, Human
caagaagagccugaaggccagug

SEQ ID NO: 1361975 - RNA, 19 nt, Human
caagaagguuuagguggga

SEQ ID NO: 1361976 - RNA, 26 nt, Human
caagaagguuuaggugggaaagccaa

SEQ ID NO: 1361977 - RNA, 21 nt, Human
caagcauugaccugagacagg

SEQ ID NO: 1361978 - RNA, 27 nt, Human
caagucccaugaaagaaaaaucaggga

SEQ ID NO: 1361979 - RNA, 22 nt, Human
cacaaaagaaacuucaacugcc

SEQ ID NO: 1361980 - RNA, 21 nt, Human
cacaaugugaccaagaauuga

SEQ ID NO: 1361981 - RNA, 22 nt, Human
cacacuaaaaucagguugaauc

SEQ ID NO: 1361982 - RNA, 23 nt, Human
cacucuguccacaaaaauggcuu

SEQ ID NO: 1361983 - RNA, 20 nt, Human
cagacaauaaacaacuaagc

SEQ ID NO: 1361984 - RNA, 21 nt, Human
cagcagaaagguuaaagucaa

SEQ ID NO: 1361985 - RNA, 23 nt, Human
caggggcuucaaggaaaccucaa

SEQ ID NO: 1361986 - RNA, 18 nt, Human
cagugcagagcaacccau

SEQ ID NO: 1361987 - RNA, 19 nt, Human
cauaaggccuggcauguag

SEQ ID NO: 1361988 - RNA, 18 nt, Human
caugggcccuauuccaag

SEQ ID NO: 1361989 - RNA, 26 nt, Human
ccagacagcucuggggagaggccaga

SEQ ID NO: 1361990 - RNA, 19 nt, Human
ccugaaggccaguguagcu

SEQ ID NO: 1361991 - RNA, 19 nt, Human
cgaggcaggcacuguggcc

SEQ ID NO: 1361992 - RNA, 18 nt, Human
cgugcaugccaaagaugg

SEQ ID NO: 1361993 - RNA, 18 nt, Human
cucauuuaucuccucccc

SEQ ID NO: 1361994 - RNA, 22 nt, Human
cuccuccccuuacacagcaguc

SEQ ID NO: 1361995 - RNA, 23 nt, Human
cucugugaccuugagaaucuuau

SEQ ID NO: 1361996 - RNA, 23 nt, Human
cugagacaggauugggagcuggg

SEQ ID NO: 1361997 - RNA, 23 nt, Human
cugcagcuagaaaaaugcaagaa

SEQ ID NO: 1361998 - RNA, 20 nt, Human
cugugugcugggcacugcuc

SEQ ID NO: 1361999 - RNA, 22 nt, Human
cugugugcugggcacugcucuu

SEQ ID NO: 1362000 - RNA, 19 nt, Human
gaaagaaaaaucagggaaa

SEQ ID NO: 1362001 - RNA, 27 nt, Human
gaacuggggccaggagccugucaucuc

SEQ ID NO: 1362002 - RNA, 22 nt, Human
gaaguagacucuuuuauacaga

SEQ ID NO: 1362003 - RNA, 20 nt, Human
gaaucccagcucuaucacuu

SEQ ID NO: 1362004 - RNA, 24 nt, Human
gacaggauugggagcugggaguga

SEQ ID NO: 1362005 - RNA, 24 nt, Human
gaccuauuaucucucucaagcauu

SEQ ID NO: 1362006 - RNA, 22 nt, Human
gaguagaaauaaaguugguaug

SEQ ID NO: 1362007 - RNA, 18 nt, Human
gaguagaaaugauacacg

SEQ ID NO: 1362008 - RNA, 22 nt, Human
gauauaaaggacacaaaagaaa

SEQ ID NO: 1362009 - RNA, 20 nt, Human
gcaaguucuucaagacucaa

SEQ ID NO: 1362010 - RNA, 18 nt, Human
gcuagaaaaaugcaagaa

SEQ ID NO: 1362011 - RNA, 24 nt, Human
gcucaagaagagccugaaggccag

SEQ ID NO: 1362012 - RNA, 19 nt, Human
ggagccugucaucucaauu

SEQ ID NO: 1362013 - RNA, 23 nt, Human
ggcaggcacuguggcccaggugg

SEQ ID NO: 1362014 - RNA, 21 nt, Human
gggaaacacaaaugugaaggc

SEQ ID NO: 1362015 - RNA, 22 nt, Human
gggaagaagaguaagagcaaga

SEQ ID NO: 1362016 - RNA, 22 nt, Human
gucagagaaguauucagggccc

SEQ ID NO: 1362017 - RNA, 23 nt, Human
gucagagaaguauucagggccca

SEQ ID NO: 1362018 - RNA, 19 nt, Human
guccagacagcucugggga

SEQ ID NO: 1362019 - RNA, 20 nt, Human
uaaaaaucugccacauaaau

SEQ ID NO: 1362020 - RNA, 20 nt, Human
uaagagcaagaagguuuagg

SEQ ID NO: 1362021 - RNA, 19 nt, Human
uaagggacaacauauaaua

SEQ ID NO: 1362022 - RNA, 20 nt, Human
uacugcagcugccacaugcc

SEQ ID NO: 1362023 - RNA, 19 nt, Human
uagaagaacugguccucau

SEQ ID NO: 1362024 - RNA, 23 nt, Human
uagagaguccaauauaagaaaau

SEQ ID NO: 1362025 - RNA, 19 nt, Human
uagaguaugucuggucucc

SEQ ID NO: 1362026 - RNA, 18 nt, Human
uagcagcugaugauaugg

SEQ ID NO: 1362027 - RNA, 24 nt, Human
uagcuaauuuacuaauuaauucac

SEQ ID NO: 1362028 - RNA, 23 nt, Human
uaggaccaauaugaaagguguuc

SEQ ID NO: 1362029 - RNA, 22 nt, Human
uagggccagcugaccauuuccu

SEQ ID NO: 1362030 - RNA, 24 nt, Human
uaguaaucuuucuguuauuggucc

SEQ ID NO: 1362031 - RNA, 21 nt, Human
uaguucugaacuuuuccuccu

SEQ ID NO: 1362032 - RNA, 20 nt, Human
uaguuguugugucuccucau

SEQ ID NO: 1362033 - RNA, 23 nt, Human
uaugcacuauuucaaucugugua

SEQ ID NO: 1362034 - RNA, 25 nt, Human
uaugucccagggaaacuguaucuug

SEQ ID NO: 1362035 - RNA, 25 nt, Human
ucaaagacagccucucuaagagggu

SEQ ID NO: 1362036 - RNA, 23 nt, Human
ucagccauggaguucacagcuuc

SEQ ID NO: 1362037 - RNA, 23 nt, Human
ucagucucaacagugcuauucug

SEQ ID NO: 1362038 - RNA, 23 nt, Human
uccacaaaaauggcuuaucagca

SEQ ID NO: 1362039 - RNA, 23 nt, Human
uccacauacugcagcugccacaa

SEQ ID NO: 1362040 - RNA, 20 nt, Human
uccacuauccuuccaaaaau

SEQ ID NO: 1362041 - RNA, 18 nt, Human
uccaguuuccaacuucug

SEQ ID NO: 1362042 - RNA, 24 nt, Human
ucccauuucugagagcaagagcug

SEQ ID NO: 1362043 - RNA, 24 nt, Human
ucucaggggcuucaaggaaaccuc

SEQ ID NO: 1362044 - RNA, 18 nt, Human
ucuccacacuucauuugg

SEQ ID NO: 1362045 - RNA, 23 nt, Human
ucuguuucauauuuaacaaaacc

SEQ ID NO: 1362046 - RNA, 23 nt, Human
ugaaagaaaaaucagggaaaagg

SEQ ID NO: 1362047 - RNA, 18 nt, Human
ugaaggcuuugaguagaa

SEQ ID NO: 1362048 - RNA, 19 nt, Human
ugaccaaaauguccccaca

SEQ ID NO: 1362049 - RNA, 22 nt, Human
ugagaggccugaaggaaagugc

SEQ ID NO: 1362050 - RNA, 22 nt, Human
ugcaagaauaaaauggaacaau

SEQ ID NO: 1362051 - RNA, 22 nt, Human
ugcagcuagaaaaaugcaagaa

SEQ ID NO: 1362052 - RNA, 21 nt, Human
ugccacaugcccuuguagagc

SEQ ID NO: 1362053 - RNA, 20 nt, Human
ugcccagcugggaacugggg

SEQ ID NO: 1362054 - RNA, 20 nt, Human
uggaagaaggaauagaucau

SEQ ID NO: 1362055 - RNA, 24 nt, Human
uggaagaaggaauagaucauauug

SEQ ID NO: 1362056 - RNA, 19 nt, Human
uggagcaugauuaggauaa

SEQ ID NO: 1362057 - RNA, 23 nt, Human
uggagguagcaagaauggaagaa

SEQ ID NO: 1362058 - RNA, 26 nt, Human
uggagguagcaagaauggaagaagga

SEQ ID NO: 1362059 - RNA, 23 nt, Human
uggcuggucauugagaggccuga

SEQ ID NO: 1362060 - RNA, 21 nt, Human
ugggaaaacagcagaaagguu

SEQ ID NO: 1362061 - RNA, 18 nt, Human
ugggaaagccaaauggca

SEQ ID NO: 1362062 - RNA, 21 nt, Human
ugggauuucuuaaaaccuuuu

SEQ ID NO: 1362063 - RNA, 21 nt, Human
ugguggaaugggcuagcauga

SEQ ID NO: 1362064 - RNA, 21 nt, Human
ugugaaccacaagcuuaugca

SEQ ID NO: 1362065 - RNA, 21 nt, Human
ugugcugggcacugcucuuga

SEQ ID NO: 1362066 - RNA, 21 nt, Human
uguguacaggcaauucccaug

SEQ ID NO: 1362067 - RNA, 23 nt, Human
uguguacaggcaauucccaugca

SEQ ID NO: 1362068 - RNA, 21 nt, Human
uguguagaggccuggaggcca

SEQ ID NO: 1362069 - RNA, 18 nt, Human
uguuagggggauauaaag

SEQ ID NO: 1362070 - RNA, 24 nt, Human
uguuucccauuucugagagcaaga

SEQ ID NO: 1362071 - RNA, 19 nt, Human
uuaaacauucuugaacuga

SEQ ID NO: 1362072 - RNA, 25 nt, Human
uuauuugaaaauuugaggaaagagc

SEQ ID NO: 1362073 - RNA, 22 nt, Human
uuccuccugucuuguuucaauu

SEQ ID NO: 1362074 - RNA, 24 nt, Human
uucuucaucugaaaaaaggaguua

SEQ ID NO: 1362075 - RNA, 24 nt, Human
uugaacugauaguuggaaaacaaa

SEQ ID NO: 1362076 - RNA, 23 nt, Human
uuuaauauuucauuaccagugaa

SEQ ID NO: 1362077 - RNA, 19 nt, Human
uuuauacagaguggucaaa

SEQ ID NO: 1362078 - RNA, 20 nt, Human
uuuggcauauuuuagcuaau

SEQ ID NO: 1362079 - RNA, 26 nt, Human
uuuuaugugaauguacacaaugaaug

SEQ ID NO: 1362080 - RNA, 20 nt, Human
aagaagaggauccuccaggu

SEQ ID NO: 1362081 - RNA, 21 nt, Human
caagaagaggauccuccaggu

SEQ ID NO: 1362082 - RNA, 22 nt, Human
cuguagcugcugccaccaagaa

SEQ ID NO: 1362083 - RNA, 22 nt, Human
gcugccaccaagaagaggaucc

SEQ ID NO: 1362084 - RNA, 18 nt, Human
ugccaccaagaagaggau

SEQ ID NO: 1362085 - RNA, 18 nt, Human
ugggacuagggagccucc

SEQ ID NO: 1362086 - RNA, 22 nt, Human
aaaucauaaaaaguacuggaau

SEQ ID NO: 1362087 - RNA, 21 nt, Human
agacuguuuacuggcucgauu

SEQ ID NO: 1362088 - RNA, 18 nt, Human
aggcaggucgccgccgga

SEQ ID NO: 1362089 - RNA, 22 nt, Human
ccugguaaaggccuccagaacc

SEQ ID NO: 1362090 - RNA, 18 nt, Human
cggccgggaaggcgacgg

SEQ ID NO: 1362091 - RNA, 21 nt, Human
cugguaaaggccuccagaacc

SEQ ID NO: 1362092 - RNA, 22 nt, Human
ucagaggcaggucgccgccgga

SEQ ID NO: 1362093 - RNA, 23 nt, Human
uggaaugaaaauacagguagugg

SEQ ID NO: 1362094 - RNA, 24 nt, Human
uuacuggcucgauucuagcucugu

SEQ ID NO: 1362095 - RNA, 22 nt, Human
aauuaagauuuuuagccaaaau

SEQ ID NO: 1362096 - RNA, 23 nt, Human
accucaaucuuuuccucuuugaa

SEQ ID NO: 1362097 - RNA, 22 nt, Human
agcuacuaagauauucuuacac

SEQ ID NO: 1362098 - RNA, 19 nt, Human
ccucaaucuuuuccucuuu

SEQ ID NO: 1362099 - RNA, 27 nt, Human
cuacagguggacagaacagcgcgaguc

SEQ ID NO: 1362100 - RNA, 18 nt, Human
gacacuggcaggcacugg

SEQ ID NO: 1362101 - RNA, 25 nt, Human
gacagaacaacuccuaggaaaggga

SEQ ID NO: 1362102 - RNA, 25 nt, Human
uauuauaaugaugaacgagacaaaa

SEQ ID NO: 1362103 - RNA, 18 nt, Human
ucaaaaguaaauuuggcu

SEQ ID NO: 1362104 - RNA, 19 nt, Human
ucuccuggagcucagaagc

SEQ ID NO: 1362105 - RNA, 20 nt, Human
ucuccuggagcucagaagcu

SEQ ID NO: 1362106 - RNA, 23 nt, Human
ugguggcacacaucucuaguccc

SEQ ID NO: 1362107 - RNA, 18 nt, Human
uguuuauuuaucaaacag

SEQ ID NO: 1362108 - RNA, 18 nt, Human
uuccagugaguaccucaa

SEQ ID NO: 1362109 - RNA, 18 nt, Human
uuggccgggcaugguggc

SEQ ID NO: 1362110 - RNA, 24 nt, Human
uuuuuuuuuuuuuuuuuuaacuug

SEQ ID NO: 1362111 - RNA, 23 nt, Human
aaaaaacagcacagcaaaguuac

SEQ ID NO: 1362112 - RNA, 20 nt, Human
aaaaauucuccuuugcauca

SEQ ID NO: 1362113 - RNA, 20 nt, Human
aaaaggccaagaugccuaca

SEQ ID NO: 1362114 - RNA, 22 nt, Human
aaaaggccaagaugccuacaaa

SEQ ID NO: 1362115 - RNA, 24 nt, Human
aaaaggccaagaugccuacaaaag

SEQ ID NO: 1362116 - RNA, 24 nt, Human
aaaaggccaagaugccuacaaaag

SEQ ID NO: 1362117 - RNA, 21 nt, Human
aaagcacucugucaaagccaa

SEQ ID NO: 1362118 - RNA, 20 nt, Human
aaagccaaauauccuccagg

SEQ ID NO: 1362119 - RNA, 20 nt, Human
aagaaaaaugcugccuccug

SEQ ID NO: 1362120 - RNA, 19 nt, Human
aagaugccuacaaaaguaa

SEQ ID NO: 1362121 - RNA, 23 nt, Human
aauacucuggauucuuaaguaac

SEQ ID NO: 1362122 - RNA, 21 nt, Human
acuuugaaaaauaguauagga

SEQ ID NO: 1362123 - RNA, 20 nt, Human
agaaagcaaaucugcagcaa

SEQ ID NO: 1362124 - RNA, 22 nt, Human
agcaauguccuuaauacccacu

SEQ ID NO: 1362125 - RNA, 20 nt, Human
agcacucugucaaagccaaa

SEQ ID NO: 1362126 - RNA, 21 nt, Human
agcucgucccggccggcugcc

SEQ ID NO: 1362127 - RNA, 21 nt, Human
aggcauaauaaugaucuuccu

SEQ ID NO: 1362128 - RNA, 21 nt, Human
aguaucuacagaagaauaagc

SEQ ID NO: 1362129 - RNA, 21 nt, Human
aucacuucaucaucaggaaac

SEQ ID NO: 1362130 - RNA, 23 nt, Human
aucaucaggaaacaguuccaagg

SEQ ID NO: 1362131 - RNA, 24 nt, Human
augcugccuccugaagauguauuc

SEQ ID NO: 1362132 - RNA, 22 nt, Human
auguuucagauguacacugagu

SEQ ID NO: 1362133 - RNA, 22 nt, Human
caacacgauaaaaauucuccuu

SEQ ID NO: 1362134 - RNA, 21 nt, Human
cacauuccaaacccaagacac

SEQ ID NO: 1362135 - RNA, 23 nt, Human
cacauuccaaacccaagacacua

SEQ ID NO: 1362136 - RNA, 20 nt, Human
cagacaacugcucaaaaaac

SEQ ID NO: 1362137 - RNA, 20 nt, Human
cagauguacacugaguauuu

SEQ ID NO: 1362138 - RNA, 19 nt, Human
cagcaaaguuacccuccgc

SEQ ID NO: 1362139 - RNA, 22 nt, Human
cagcaauguccuuaauacccac

SEQ ID NO: 1362140 - RNA, 23 nt, Human
cagcaguauuucuauaauaaugc

SEQ ID NO: 1362141 - RNA, 22 nt, Human
caguuucuguuacaacuaggga

SEQ ID NO: 1362142 - RNA, 25 nt, Human
cauucuacugccaucccaaauauaa

SEQ ID NO: 1362143 - RNA, 22 nt, Human
cauucucaaaacaaaaccugag

SEQ ID NO: 1362144 - RNA, 21 nt, Human
ccaaauauccuccaggaacuc

SEQ ID NO: 1362145 - RNA, 20 nt, Human
ccacaauuccuucuccaaau

SEQ ID NO: 1362146 - RNA, 22 nt, Human
cccaagacacuaauacucugga

SEQ ID NO: 1362147 - RNA, 25 nt, Human
cccaagacacuaauacucuggauuc

SEQ ID NO: 1362148 - RNA, 21 nt, Human
ccccggcgucucggcgggacc

SEQ ID NO: 1362149 - RNA, 18 nt, Human
cgccaaccccagcccagg

SEQ ID NO: 1362150 - RNA, 20 nt, Human
cgucccggccggcugcccca

SEQ ID NO: 1362151 - RNA, 19 nt, Human
cuguucccaacauguuucc

SEQ ID NO: 1362152 - RNA, 22 nt, Human
cuuccaucuuguuugcugccac

SEQ ID NO: 1362153 - RNA, 21 nt, Human
gaagauguauucccuaacucc

SEQ ID NO: 1362154 - RNA, 20 nt, Human
gagcacaaaccaaaccauaa

SEQ ID NO: 1362155 - RNA, 20 nt, Human
gcaagguccuguacggggua

SEQ ID NO: 1362156 - RNA, 19 nt, Human
gccaaauauccuccaggaa

SEQ ID NO: 1362157 - RNA, 23 nt, Human
gccagcguuccaccaaccaguuu

SEQ ID NO: 1362158 - RNA, 24 nt, Human
guccaaaacacuuuuggaccccaa

SEQ ID NO: 1362159 - RNA, 24 nt, Human
gucguguuucagcuccggcgccag

SEQ ID NO: 1362160 - RNA, 23 nt, Human
gugaacucgccaaccccagccca

SEQ ID NO: 1362161 - RNA, 19 nt, Human
guuuccuucacgucguguu

SEQ ID NO: 1362162 - RNA, 21 nt, Human
uaaccauaacccucagucuuc

SEQ ID NO: 1362163 - RNA, 21 nt, Human
uaauguacuuauuguacaucc

SEQ ID NO: 1362164 - RNA, 19 nt, Human
uacacaguuuucauuggaa

SEQ ID NO: 1362165 - RNA, 21 nt, Human
uacccacucuaugaugucuuc

SEQ ID NO: 1362166 - RNA, 20 nt, Human
uauugcaaaucacuucauca

SEQ ID NO: 1362167 - RNA, 21 nt, Human
ucaaagcacucugucaaagcc

SEQ ID NO: 1362168 - RNA, 22 nt, Human
ucaaagcacucugucaaagcca

SEQ ID NO: 1362169 - RNA, 20 nt, Human
ucaaagcacucugucaaagg

SEQ ID NO: 1362170 - RNA, 18 nt, Human
ucaauuguuucuucagua

SEQ ID NO: 1362171 - RNA, 20 nt, Human
uccaaauaaaccugcaucga

SEQ ID NO: 1362172 - RNA, 22 nt, Human
uccaaggccugcucauagcaac

SEQ ID NO: 1362173 - RNA, 18 nt, Human
uccaauguccaaaacacu

SEQ ID NO: 1362174 - RNA, 19 nt, Human
uccacaauuccuucuccaa

SEQ ID NO: 1362175 - RNA, 23 nt, Human
uccaccaaccaguuugcaacacg

SEQ ID NO: 1362176 - RNA, 24 nt, Human
uccaccaaccaguuugcaacacga

SEQ ID NO: 1362177 - RNA, 19 nt, Human
ucccaacauguuuccucac

SEQ ID NO: 1362178 - RNA, 20 nt, Human
ucccuauucuguaaaaucga

SEQ ID NO: 1362179 - RNA, 23 nt, Human
uccuggacgcccagacagugcuc

SEQ ID NO: 1362180 - RNA, 21 nt, Human
ucgaugcuacacuuccaggga

SEQ ID NO: 1362181 - RNA, 27 nt, Human
ucgccaaccccagcccaggcggaagcu

SEQ ID NO: 1362182 - RNA, 22 nt, Human
ucugcaaggaccgcgacaccag

SEQ ID NO: 1362183 - RNA, 21 nt, Human
ugaaaaguguguacugaaaag

SEQ ID NO: 1362184 - RNA, 23 nt, Human
ugagagcaucaagcucuucagcc

SEQ ID NO: 1362185 - RNA, 24 nt, Human
ugcaaggaccgcgacaccagcucg

SEQ ID NO: 1362186 - RNA, 18 nt, Human
ugcaucgacaguuucugu

SEQ ID NO: 1362187 - RNA, 18 nt, Human
uggagcacaaaccaaacc

SEQ ID NO: 1362188 - RNA, 22 nt, Human
uggagcacaaaccaaaccauaa

SEQ ID NO: 1362189 - RNA, 23 nt, Human
uggcaaauggauaccagcaaugu

SEQ ID NO: 1362190 - RNA, 24 nt, Human
uguucaucaucaagcuggagcaca

SEQ ID NO: 1362191 - RNA, 21 nt, Human
uuaccagcuuuuaaauguucu

SEQ ID NO: 1362192 - RNA, 25 nt, Human
uuagcaaacaugcuuaguauuccag

SEQ ID NO: 1362193 - RNA, 23 nt, Human
uucagcuccggcgccaggcugag

SEQ ID NO: 1362194 - RNA, 19 nt, Human
uuccaaggccugcucauag

SEQ ID NO: 1362195 - RNA, 21 nt, Human
uugcaacacgauaaaaauucu

SEQ ID NO: 1362196 - RNA, 21 nt, Human
uugcugcauuauaaauuguau

SEQ ID NO: 1362197 - RNA, 18 nt, Human
uuuaagaaaaaaggccaa

SEQ ID NO: 1362198 - RNA, 24 nt, Human
uuuacacaguuuucauuggaaaac

SEQ ID NO: 1362199 - RNA, 22 nt, Human
uuucacaauuagcacuuucacc

SEQ ID NO: 1362200 - RNA, 25 nt, Human
uuucaguguuucccaauuacaaguu

SEQ ID NO: 1362201 - RNA, 19 nt, Human
uuuguacuuguugaugcuc

SEQ ID NO: 1362202 - RNA, 22 nt, Human
uuuuugcaacauccauuucaca

SEQ ID NO: 1362203 - RNA, 25 nt, Human
aaaagaacaaaacuggaggcaucac

SEQ ID NO: 1362204 - RNA, 26 nt, Human
aaacaucaugguacugguaccaaaac

SEQ ID NO: 1362205 - RNA, 20 nt, Human
aacagagcccucagaaauaa

SEQ ID NO: 1362206 - RNA, 21 nt, Human
aagcaggagaaggaaauaaag

SEQ ID NO: 1362207 - RNA, 24 nt, Human
aaggcuacaguaaccaaaacauca

SEQ ID NO: 1362208 - RNA, 19 nt, Human
acacuaauaacagacaaac

SEQ ID NO: 1362209 - RNA, 23 nt, Human
acagagcccucagaaauaaugcc

SEQ ID NO: 1362210 - RNA, 23 nt, Human
agaaaaccccaucgucucagccc

SEQ ID NO: 1362211 - RNA, 19 nt, Human
aggauucccuauuuaauaa

SEQ ID NO: 1362212 - RNA, 27 nt, Human
aguaacaagugaauuuuacaaaagaaa

SEQ ID NO: 1362213 - RNA, 19 nt, Human
auggaacagaacagagccc

SEQ ID NO: 1362214 - RNA, 24 nt, Human
caaaaaucacaagcauucuuauac

SEQ ID NO: 1362215 - RNA, 25 nt, Human
caaaacaucaugguacugguaccaa

SEQ ID NO: 1362216 - RNA, 20 nt, Human
caaacagagagccaaaucau

SEQ ID NO: 1362217 - RNA, 23 nt, Human
caaacuauacuacaaggcuacag

SEQ ID NO: 1362218 - RNA, 24 nt, Human
caaccaagcaaucaggagugccaa

SEQ ID NO: 1362219 - RNA, 22 nt, Human
caagcaaucaggagugccaaga

SEQ ID NO: 1362220 - RNA, 22 nt, Human
caagugaauuuuacaaaagaaa

SEQ ID NO: 1362221 - RNA, 18 nt, Human
cacuaauaacagacaaac

SEQ ID NO: 1362222 - RNA, 27 nt, Human
cacuccuauucaacauaguguuggaag

SEQ ID NO: 1362223 - RNA, 18 nt, Human
cagagucucaggauacaa

SEQ ID NO: 1362224 - RNA, 18 nt, Human
cagcacaaaaacuguacu

SEQ ID NO: 1362225 - RNA, 18 nt, Human
cauacugcccaagguaau

SEQ ID NO: 1362226 - RNA, 20 nt, Human
cauauguagaaagccaaaac

SEQ ID NO: 1362227 - RNA, 21 nt, Human
ccaaaagaacaaaacuggagg

SEQ ID NO: 1362228 - RNA, 19 nt, Human
cccaaaaucuccuuaaccu

SEQ ID NO: 1362229 - RNA, 29 nt, Human
cccaaaaucuccuuaaccugauaagcaac

SEQ ID NO: 1362230 - RNA, 21 nt, Human
cccaucgucucagcccaaaau

SEQ ID NO: 1362231 - RNA, 27 nt, Human
ccccaucaagcuaccaaugacuuucuu

SEQ ID NO: 1362232 - RNA, 20 nt, Human
ccccgcaccccacaacaggc

SEQ ID NO: 1362233 - RNA, 23 nt, Human
ccccgcaccccacaacaggcccu

SEQ ID NO: 1362234 - RNA, 19 nt, Human
ccccucuccccgcaccccc

SEQ ID NO: 1362235 - RNA, 20 nt, Human
ccgcaccccacaacaggccc

SEQ ID NO: 1362236 - RNA, 24 nt, Human
cuaugagugagaacaugugguguu

SEQ ID NO: 1362237 - RNA, 21 nt, Human
cucauugccaagucaucccua

SEQ ID NO: 1362238 - RNA, 18 nt, Human
cugagaaugaugguuucc

SEQ ID NO: 1362239 - RNA, 24 nt, Human
cugcacccauuaacucaucauuua

SEQ ID NO: 1362240 - RNA, 21 nt, Human
cuuucuucacagaauuggaaa

SEQ ID NO: 1362241 - RNA, 23 nt, Human
gaaauaaaagaggauacaaagaa

SEQ ID NO: 1362242 - RNA, 20 nt, Human
gaguuuguuuguuuuuuuuu

SEQ ID NO: 1362243 - RNA, 18 nt, Human
gcccaaaaucuccuuaac

SEQ ID NO: 1362244 - RNA, 23 nt, Human
gcccaaaaucuccuuaaccugau

SEQ ID NO: 1362245 - RNA, 24 nt, Human
gcccacuuguugauuggguuguuu

SEQ ID NO: 1362246 - RNA, 30 nt, Human
ggaaaaaacuacuuuaaaguucauauggaa

SEQ ID NO: 1362247 - RNA, 24 nt, Human
ggaaaggauucccuauuuaauaaa

SEQ ID NO: 1362248 - RNA, 19 nt, Human
ggaauccaacuuacaaggg

SEQ ID NO: 1362249 - RNA, 23 nt, Human
ggccagggcaaucaagcaggaga

SEQ ID NO: 1362250 - RNA, 22 nt, Human
guaaaacacaacuuuggucuga

SEQ ID NO: 1362251 - RNA, 20 nt, Human
gucuuauagaagaaucuuga

SEQ ID NO: 1362252 - RNA, 20 nt, Human
guucauuguagauucuggau

SEQ ID NO: 1362253 - RNA, 23 nt, Human
uaacagacaaacagagagccaaa

SEQ ID NO: 1362254 - RNA, 22 nt, Human
uaaccagcacuucagucuuaua

SEQ ID NO: 1362255 - RNA, 23 nt, Human
uaagccaaaagaacaaaacugga

SEQ ID NO: 1362256 - RNA, 19 nt, Human
uacaaagaaauggaagaac

SEQ ID NO: 1362257 - RNA, 20 nt, Human
uaccugacuucaaacuauac

SEQ ID NO: 1362258 - RNA, 21 nt, Human
uagauucuggauauuagcccu

SEQ ID NO: 1362259 - RNA, 19 nt, Human
uagauugcaaaaaucacca

SEQ ID NO: 1362260 - RNA, 21 nt, Human
uaggaaaagaggaagucaaau

SEQ ID NO: 1362261 - RNA, 26 nt, Human
uaucccuccccucuccccgcacccca

SEQ ID NO: 1362262 - RNA, 22 nt, Human
uauuuaauaaauggugguggaa

SEQ ID NO: 1362263 - RNA, 25 nt, Human
ucagaugaguagauugcaaaaauca

SEQ ID NO: 1362264 - RNA, 24 nt, Human
uccccgcaccccacaacaggcccu

SEQ ID NO: 1362265 - RNA, 19 nt, Human
uccccucuccccgcacccc

SEQ ID NO: 1362266 - RNA, 21 nt, Human
ugacaaaccugacaaaaacaa

SEQ ID NO: 1362267 - RNA, 20 nt, Human
ugagaacaugugguguuugg

SEQ ID NO: 1362268 - RNA, 24 nt, Human
ugagaaugaugguuuccagcuuca

SEQ ID NO: 1362269 - RNA, 19 nt, Human
ugagugaacucccauucac

SEQ ID NO: 1362270 - RNA, 23 nt, Human
ugagugaacucccauucacaauu

SEQ ID NO: 1362271 - RNA, 19 nt, Human
ugagugagaacauguggug

SEQ ID NO: 1362272 - RNA, 24 nt, Human
ugagugagaacaugugguguuugg

SEQ ID NO: 1362273 - RNA, 23 nt, Human
ugaguucauuguagauucuggau

SEQ ID NO: 1362274 - RNA, 26 nt, Human
ugcaaaaaucacaagcauucuuauac

SEQ ID NO: 1362275 - RNA, 30 nt, Human
ugccaagaucgcaugauuuauguaaaacaa

SEQ ID NO: 1362276 - RNA, 20 nt, Human
ugccaagucaucccuaagcc

SEQ ID NO: 1362277 - RNA, 19 nt, Human
ugccauguuggugugcugc

SEQ ID NO: 1362278 - RNA, 21 nt, Human
uggaaccaaaagagagcccuc

SEQ ID NO: 1362279 - RNA, 21 nt, Human
uggaaccaaaagagagcccuc

SEQ ID NO: 1362280 - RNA, 20 nt, Human
uggccagggcaaucaagcag

SEQ ID NO: 1362281 - RNA, 21 nt, Human
ugguuuccagcuucacccaug

SEQ ID NO: 1362282 - RNA, 23 nt, Human
uguaaaacacaacuuuggucuga

SEQ ID NO: 1362283 - RNA, 19 nt, Human
ugugcaaaaaucacaagga

SEQ ID NO: 1362284 - RNA, 18 nt, Human
uguuacguauguauacau

SEQ ID NO: 1362285 - RNA, 22 nt, Human
uguugauuggguuguuuuuuuc

SEQ ID NO: 1362286 - RNA, 26 nt, Human
uuauacacuaauaacagacaaacaga

SEQ ID NO: 1362287 - RNA, 24 nt, Human
uucauuguagauucuggauauuag

SEQ ID NO: 1362288 - RNA, 20 nt, Human
uugccaagucaucccuaagc

SEQ ID NO: 1362289 - RNA, 21 nt, Human
uuuccagcuucacccauguuc

SEQ ID NO: 1362290 - RNA, 18 nt, Human
aaucaccgagagaaagag

SEQ ID NO: 1362291 - RNA, 22 nt, Human
aauccgugggggcgucucccuc

SEQ ID NO: 1362292 - RNA, 22 nt, Human
acugucccgcccucaccggaaa

SEQ ID NO: 1362293 - RNA, 22 nt, Human
aggcugggaagugggagcgcgg

SEQ ID NO: 1362294 - RNA, 19 nt, Human
agugcccaccugggcgccc

SEQ ID NO: 1362295 - RNA, 19 nt, Human
cacacaccccugccucucc

SEQ ID NO: 1362296 - RNA, 18 nt, Human
cacaguaaccaccggggu

SEQ ID NO: 1362297 - RNA, 19 nt, Human
cacccucauucccaaaaag

SEQ ID NO: 1362298 - RNA, 19 nt, Human
cagcgcucggucggcggcu

SEQ ID NO: 1362299 - RNA, 24 nt, Human
ccaugcacugagcugcgauccuuc

SEQ ID NO: 1362300 - RNA, 19 nt, Human
cccaccugggcgcccucuc

SEQ ID NO: 1362301 - RNA, 19 nt, Human
ccccugccucuccucgccc

SEQ ID NO: 1362302 - RNA, 25 nt, Human
ccgaacguuaguaagcauaaugaca

SEQ ID NO: 1362303 - RNA, 20 nt, Human
ccgagagaaagaggaggugu

SEQ ID NO: 1362304 - RNA, 21 nt, Human
ccgcacacucgcacgcguccg

SEQ ID NO: 1362305 - RNA, 19 nt, Human
ccgccgccgccgucgucca

SEQ ID NO: 1362306 - RNA, 18 nt, Human
ccggugcuguccuccagg

SEQ ID NO: 1362307 - RNA, 20 nt, Human
ccuccaggcugggaaguggg

SEQ ID NO: 1362308 - RNA, 23 nt, Human
ccuccaggcugggaagugggagc

SEQ ID NO: 1362309 - RNA, 19 nt, Human
ccuuccccgcuucccgccg

SEQ ID NO: 1362310 - RNA, 22 nt, Human
cgagcagaccagacugucccgc

SEQ ID NO: 1362311 - RNA, 24 nt, Human
cgcacacucgcacgcguccgcgcg

SEQ ID NO: 1362312 - RNA, 20 nt, Human
cgcacgcguccgcgcggccg

SEQ ID NO: 1362313 - RNA, 21 nt, Human
cgcuuucgccgccgccgccgu

SEQ ID NO: 1362314 - RNA, 23 nt, Human
cgcuuucgccgccgccgccgucg

SEQ ID NO: 1362315 - RNA, 24 nt, Human
cggaaacaaguuggcuccgggguc

SEQ ID NO: 1362316 - RNA, 20 nt, Human
cgugagaaguugcgagugcc

SEQ ID NO: 1362317 - RNA, 21 nt, Human
cugagcugcgauccuuccccg

SEQ ID NO: 1362318 - RNA, 19 nt, Human
cuuccccgcuucccgccgc

SEQ ID NO: 1362319 - RNA, 18 nt, Human
gaagaagccagaggaccc

SEQ ID NO: 1362320 - RNA, 18 nt, Human
gaggcgccccgggcuccc

SEQ ID NO: 1362321 - RNA, 23 nt, Human
gcacacucgcacgcguccgcgcg

SEQ ID NO: 1362322 - RNA, 20 nt, Human
gcgauccuuccccgcuuccc

SEQ ID NO: 1362323 - RNA, 24 nt, Human
gcgcggcggggcgaauccgugggg

SEQ ID NO: 1362324 - RNA, 23 nt, Human
ggacagccagcgcucggucggcg

SEQ ID NO: 1362325 - RNA, 19 nt, Human
ggccggugcuguccuccag

SEQ ID NO: 1362326 - RNA, 22 nt, Human
gggcuugugagggaaggaaggc

SEQ ID NO: 1362327 - RNA, 18 nt, Human
ggggucacuuggucuugc

SEQ ID NO: 1362328 - RNA, 20 nt, Human
uacgcgagcacaguaaccac

SEQ ID NO: 1362329 - RNA, 21 nt, Human
ucaacggcgacgguugccaag

SEQ ID NO: 1362330 - RNA, 27 nt, Human
ucauccgcuuucgccgccgccgccguc

SEQ ID NO: 1362331 - RNA, 21 nt, Human
uccaggcugggaagugggagc

SEQ ID NO: 1362332 - RNA, 18 nt, Human
ucccgccgcagcucggag

SEQ ID NO: 1362333 - RNA, 22 nt, Human
uccgcacacucgcacgcguccg

SEQ ID NO: 1362334 - RNA, 24 nt, Human
uccgcacacucgcacgcguccgcg

SEQ ID NO: 1362335 - RNA, 18 nt, Human
uccgcgcggccgacccau

SEQ ID NO: 1362336 - RNA, 23 nt, Human
uccgugccgcgaggcgccccggg

SEQ ID NO: 1362337 - RNA, 24 nt, Human
uccgugggggcgucucccuccguc

SEQ ID NO: 1362338 - RNA, 23 nt, Human
ucgccgccgccgccgucguccac

SEQ ID NO: 1362339 - RNA, 22 nt, Human
ucucuuccagguugcuaauacg

SEQ ID NO: 1362340 - RNA, 19 nt, Human
ugccauucuggcccagacc

SEQ ID NO: 1362341 - RNA, 19 nt, Human
ugcgguugagcaucucgcc

SEQ ID NO: 1362342 - RNA, 20 nt, Human
ugcgguugagcaucucgccc

SEQ ID NO: 1362343 - RNA, 24 nt, Human
uggcgccugcgggggagccgguuu

SEQ ID NO: 1362344 - RNA, 22 nt, Human
ugggaagaagccagaggacccg

SEQ ID NO: 1362345 - RNA, 19 nt, Human
ugggaagugggagcgcggu

SEQ ID NO: 1362346 - RNA, 19 nt, Human
ugggaagugggagcgcggu

SEQ ID NO: 1362347 - RNA, 22 nt, Human
ugucccgcccucaccggaaaca

SEQ ID NO: 1362348 - RNA, 19 nt, Human
uguugggggucacuugguc

SEQ ID NO: 1362349 - RNA, 22 nt, Human
uuucgccgccgccgccgucguc

SEQ ID NO: 1362350 - RNA, 19 nt, Human
aaaaaugugaggguucugg

SEQ ID NO: 1362351 - RNA, 23 nt, Human
aaauccuaggcuucaccugaaac

SEQ ID NO: 1362352 - RNA, 21 nt, Human
aacagcagcacguuaacaaaa

SEQ ID NO: 1362353 - RNA, 24 nt, Human
aacccauagcagaugggcagcccc

SEQ ID NO: 1362354 - RNA, 23 nt, Human
aagacaugacucaaaaugaaaua

SEQ ID NO: 1362355 - RNA, 22 nt, Human
aagcugcaggugaaaccuccau

SEQ ID NO: 1362356 - RNA, 23 nt, Human
acaaaacgaaaauguggggcccc

SEQ ID NO: 1362357 - RNA, 18 nt, Human
acaaagcagacugaaagc

SEQ ID NO: 1362358 - RNA, 18 nt, Human
acacaaacacuugaaccc

SEQ ID NO: 1362359 - RNA, 18 nt, Human
acaggguuucaccauguu

SEQ ID NO: 1362360 - RNA, 21 nt, Human
acaggguuucaccauguuggc

SEQ ID NO: 1362361 - RNA, 24 nt, Human
acaggguuucaccauguuggccag

SEQ ID NO: 1362362 - RNA, 20 nt, Human
acagugacaaagauaaaauu

SEQ ID NO: 1362363 - RNA, 24 nt, Human
accauguuggccaggcuggucucg

SEQ ID NO: 1362364 - RNA, 19 nt, Human
acuagcagggacuacaggc

SEQ ID NO: 1362365 - RNA, 19 nt, Human
acuguucugaaauggggau

SEQ ID NO: 1362366 - RNA, 21 nt, Human
agaaaacuguucugaaauggg

SEQ ID NO: 1362367 - RNA, 24 nt, Human
agacccccacaggcacccugguga

SEQ ID NO: 1362368 - RNA, 20 nt, Human
agagacugccuugcccaugg

SEQ ID NO: 1362369 - RNA, 19 nt, Human
agccacagccaucuggacc

SEQ ID NO: 1362370 - RNA, 24 nt, Human
agcucuaucacccaggcuggagug

SEQ ID NO: 1362371 - RNA, 25 nt, Human
aggaaacagcagcacguuaacaaaa

SEQ ID NO: 1362372 - RNA, 19 nt, Human
aggaaaccgaggucuggag

SEQ ID NO: 1362373 - RNA, 20 nt, Human
aggccacuggcacagcaggg

SEQ ID NO: 1362374 - RNA, 20 nt, Human
aggccccugccccaacccau

SEQ ID NO: 1362375 - RNA, 21 nt, Human
aggcugagagcuggcaccaca

SEQ ID NO: 1362376 - RNA, 25 nt, Human
aggcuggagugcaguggcgcgaucu

SEQ ID NO: 1362377 - RNA, 24 nt, Human
aggcugggagcuagcagagaccua

SEQ ID NO: 1362378 - RNA, 19 nt, Human
agguggcucaccaggcagg

SEQ ID NO: 1362379 - RNA, 24 nt, Human
agugagaggaauaccugggagaga

SEQ ID NO: 1362380 - RNA, 20 nt, Human
agugcaguggcgcgaucucg

SEQ ID NO: 1362381 - RNA, 23 nt, Human
agugcaguggcgcgaucucggcu

SEQ ID NO: 1362382 - RNA, 24 nt, Human
agugcaguggcgcgaucucggcuc

SEQ ID NO: 1362383 - RNA, 22 nt, Human
auccacauaauguaaucgcacc

SEQ ID NO: 1362384 - RNA, 18 nt, Human
auggggcugcuuuuagac

SEQ ID NO: 1362385 - RNA, 21 nt, Human
caaaacacagugacaaagaua

SEQ ID NO: 1362386 - RNA, 21 nt, Human
caaaacgaaaauguggggccc

SEQ ID NO: 1362387 - RNA, 20 nt, Human
caagcgauucuccugccuca

SEQ ID NO: 1362388 - RNA, 22 nt, Human
cacaacuugcugggauuccaga

SEQ ID NO: 1362389 - RNA, 23 nt, Human
caccacacacugguuucuaaauc

SEQ ID NO: 1362390 - RNA, 22 nt, Human
caccagcccugcauccuggacc

SEQ ID NO: 1362391 - RNA, 24 nt, Human
caccagcccugcauccuggaccac

SEQ ID NO: 1362392 - RNA, 21 nt, Human
caccauguuggccaggcuggu

SEQ ID NO: 1362393 - RNA, 24 nt, Human
caccauguuggccaggcuggucuc

SEQ ID NO: 1362394 - RNA, 27 nt, Human
caccauguuggccaggcuggucucgaa

SEQ ID NO: 1362395 - RNA, 24 nt, Human
cacccaggcuggagugcaguggcg

SEQ ID NO: 1362396 - RNA, 18 nt, Human
caccugugacaccagccc

SEQ ID NO: 1362397 - RNA, 23 nt, Human
cacucuggagcagcucucgggcc

SEQ ID NO: 1362398 - RNA, 19 nt, Human
cagacaaagcagacugaaa

SEQ ID NO: 1362399 - RNA, 21 nt, Human
cagacauucuaacugcuuucc

SEQ ID NO: 1362400 - RNA, 20 nt, Human
cagacugaaagcugcaggug

SEQ ID NO: 1362401 - RNA, 19 nt, Human
cagaugggcagcccccggg

SEQ ID NO: 1362402 - RNA, 21 nt, Human
cagccuaagugauccacauaa

SEQ ID NO: 1362403 - RNA, 24 nt, Human
caggguuucaccauguuggccagg

SEQ ID NO: 1362404 - RNA, 21 nt, Human
caguauuacuuuuuacagaac

SEQ ID NO: 1362405 - RNA, 18 nt, Human
cauccucaaacaucagac

SEQ ID NO: 1362406 - RNA, 24 nt, Human
cauguuggccaggcuggucucgaa

SEQ ID NO: 1362407 - RNA, 23 nt, Human
ccacagacugccaucuuagccuu

SEQ ID NO: 1362408 - RNA, 19 nt, Human
ccacagccaucuggaccca

SEQ ID NO: 1362409 - RNA, 22 nt, Human
ccacaggccccugccccaaccc

SEQ ID NO: 1362410 - RNA, 19 nt, Human
ccacauguugugcuccagg

SEQ ID NO: 1362411 - RNA, 22 nt, Human
ccacauguugugcuccaggccu

SEQ ID NO: 1362412 - RNA, 23 nt, Human
ccaccgagagaggcuccaaguac

SEQ ID NO: 1362413 - RNA, 22 nt, Human
ccacgcccagcuaauuuuugua

SEQ ID NO: 1362414 - RNA, 18 nt, Human
ccacuggcacagcagggc

SEQ ID NO: 1362415 - RNA, 18 nt, Human
ccagaagacaugacucaa

SEQ ID NO: 1362416 - RNA, 24 nt, Human
ccagagccccacugguauccguac

SEQ ID NO: 1362417 - RNA, 18 nt, Human
ccaugaaauugcaauucc

SEQ ID NO: 1362418 - RNA, 19 nt, Human
cccaagaggguagguggcu

SEQ ID NO: 1362419 - RNA, 20 nt, Human
cccacaggccccugccccaa

SEQ ID NO: 1362420 - RNA, 20 nt, Human
cccagguucaagcgauucuc

SEQ ID NO: 1362421 - RNA, 23 nt, Human
cccagguucaagcgauucuccug

SEQ ID NO: 1362422 - RNA, 19 nt, Human
ccccacugguauccguacc

SEQ ID NO: 1362423 - RNA, 19 nt, Human
ccccgagacccgaggccca

SEQ ID NO: 1362424 - RNA, 23 nt, Human
ccccgagacccgaggcccaacuc

SEQ ID NO: 1362425 - RNA, 20 nt, Human
ccccugccccaacccauagc

SEQ ID NO: 1362426 - RNA, 19 nt, Human
cccgagacccgaggcccaa

SEQ ID NO: 1362427 - RNA, 18 nt, Human
cccugccccaacccauag

SEQ ID NO: 1362428 - RNA, 18 nt, Human
ccgcuccugacacccaca

SEQ ID NO: 1362429 - RNA, 24 nt, Human
ccguaccacgcuguuccuggcugu

SEQ ID NO: 1362430 - RNA, 21 nt, Human
ccuccagcucuaucacccagg

SEQ ID NO: 1362431 - RNA, 18 nt, Human
ccugagagauuuucuagc

SEQ ID NO: 1362432 - RNA, 18 nt, Human
ccugauccugaaaugaca

SEQ ID NO: 1362433 - RNA, 20 nt, Human
ccuggaccacuuagaagcuc

SEQ ID NO: 1362434 - RNA, 28 nt, Human
ccuuucccaaaaggaggaugucucuaaa

SEQ ID NO: 1362435 - RNA, 22 nt, Human
cgccuccacgcccagcuaauuu

SEQ ID NO: 1362436 - RNA, 19 nt, Human
cgcgccuccacgcccagcu

SEQ ID NO: 1362437 - RNA, 19 nt, Human
cgcuguuccuggcuguggc

SEQ ID NO: 1362438 - RNA, 23 nt, Human
cuaaaucucuggcuuggauuuua

SEQ ID NO: 1362439 - RNA, 22 nt, Human
cuagcagggacuacaggcacgc

SEQ ID NO: 1362440 - RNA, 22 nt, Human
cuccccgguuuuagaagugacu

SEQ ID NO: 1362441 - RNA, 27 nt, Human
cucuacuggucacacaccugugacacc

SEQ ID NO: 1362442 - RNA, 23 nt, Human
cucuaucacccaggcuggagugc

SEQ ID NO: 1362443 - RNA, 21 nt, Human
cugagagauuuucuagcccag

SEQ ID NO: 1362444 - RNA, 28 nt, Human
cugauagacaacuaaaugcccaagaggg

SEQ ID NO: 1362445 - RNA, 20 nt, Human
cugccucacccucuugacua

SEQ ID NO: 1362446 - RNA, 22 nt, Human
cugcugggcccacauguugugc

SEQ ID NO: 1362447 - RNA, 19 nt, Human
cuggagcagcucucgggcc

SEQ ID NO: 1362448 - RNA, 24 nt, Human
cuucccagguucaagcgauucucc

SEQ ID NO: 1362449 - RNA, 18 nt, Human
cuucugggcacaaagccc

SEQ ID NO: 1362450 - RNA, 21 nt, Human
gacccgaggcccaacucggca

SEQ ID NO: 1362451 - RNA, 22 nt, Human
gaggcaacuucauccaaacuga

SEQ ID NO: 1362452 - RNA, 19 nt, Human
gccacagccaucuggaccc

SEQ ID NO: 1362453 - RNA, 22 nt, Human
gcccagcuaauuuuuguauuuu

SEQ ID NO: 1362454 - RNA, 19 nt, Human
gccccgagacccgaggccc

SEQ ID NO: 1362455 - RNA, 18 nt, Human
gccuagagccccgagacc

SEQ ID NO: 1362456 - RNA, 21 nt, Human
gccuuauuucccaagcguggg

SEQ ID NO: 1362457 - RNA, 21 nt, Human
gcgcauguuccuaacgugccc

SEQ ID NO: 1362458 - RNA, 22 nt, Human
gcuacuucggcuucccagguuc

SEQ ID NO: 1362459 - RNA, 23 nt, Human
gcucaccaggcaggacuggcuac

SEQ ID NO: 1362460 - RNA, 19 nt, Human
gcucuaucacccaggcugg

SEQ ID NO: 1362461 - RNA, 22 nt, Human
gcucuaucacccaggcuggagu

SEQ ID NO: 1362462 - RNA, 19 nt, Human
gcuggagugcaguggcgcg

SEQ ID NO: 1362463 - RNA, 22 nt, Human
gcugggcccacauguugugcuc

SEQ ID NO: 1362464 - RNA, 22 nt, Human
ggaaaagaccagagccccacug

SEQ ID NO: 1362465 - RNA, 22 nt, Human
ggaaggugccacacggugcugg

SEQ ID NO: 1362466 - RNA, 18 nt, Human
ggaagguucccuuugcac

SEQ ID NO: 1362467 - RNA, 21 nt, Human
ggacuggucuuugcacacugu

SEQ ID NO: 1362468 - RNA, 19 nt, Human
ggagcagggugugacuggc

SEQ ID NO: 1362469 - RNA, 25 nt, Human
ggcauccucccacaggccccugccc

SEQ ID NO: 1362470 - RNA, 21 nt, Human
ggccgcauuccagccacagcc

SEQ ID NO: 1362471 - RNA, 19 nt, Human
gggaugccuucuuccugga

SEQ ID NO: 1362472 - RNA, 23 nt, Human
gggaugccuucuuccuggaaacc

SEQ ID NO: 1362473 - RNA, 22 nt, Human
ggguuucaccauguuggccagg

SEQ ID NO: 1362474 - RNA, 21 nt, Human
ggugcagauacugaggacugg

SEQ ID NO: 1362475 - RNA, 23 nt, Human
gguucuggggaaggugccacacg

SEQ ID NO: 1362476 - RNA, 21 nt, Human
gguuuuagaagugacuucucc

SEQ ID NO: 1362477 - RNA, 21 nt, Human
guagagacaggguuucaccau

SEQ ID NO: 1362478 - RNA, 18 nt, Human
guccucucaggcauggag

SEQ ID NO: 1362479 - RNA, 23 nt, Human
gugacuucucccauccccaccga

SEQ ID NO: 1362480 - RNA, 22 nt, Human
uaaaccuauaugaggggacuga

SEQ ID NO: 1362481 - RNA, 22 nt, Human
uaacaaaaauuaguaacagaca

SEQ ID NO: 1362482 - RNA, 23 nt, Human
uaacaaaaauuaguaacagacau

SEQ ID NO: 1362483 - RNA, 21 nt, Human
uaagauaaaagccaaaacuuu

SEQ ID NO: 1362484 - RNA, 22 nt, Human
uaagugaaauaagauaaaagcc

SEQ ID NO: 1362485 - RNA, 26 nt, Human
uaagugaaauaagauaaaagccaaaa

SEQ ID NO: 1362486 - RNA, 23 nt, Human
uaauuuuuguauuuuuguagaga

SEQ ID NO: 1362487 - RNA, 19 nt, Human
uacaaaccacagacugcca

SEQ ID NO: 1362488 - RNA, 22 nt, Human
uacaggcacgcgccuccacgcc

SEQ ID NO: 1362489 - RNA, 21 nt, Human
uaccaagucucguggucuucu

SEQ ID NO: 1362490 - RNA, 18 nt, Human
uaccugggagagagacug

SEQ ID NO: 1362491 - RNA, 23 nt, Human
uacuggucacacaccugugacac

SEQ ID NO: 1362492 - RNA, 21 nt, Human
uagagacaggguuucaccaug

SEQ ID NO: 1362493 - RNA, 22 nt, Human
uagagacaggguuucaccaugu

SEQ ID NO: 1362494 - RNA, 21 nt, Human
uagcagaugggcagcccccuc

SEQ ID NO: 1362495 - RNA, 18 nt, Human
uagcagggacuacaggca

SEQ ID NO: 1362496 - RNA, 18 nt, Human
uaguuggcacccacccuc

SEQ ID NO: 1362497 - RNA, 23 nt, Human
uauuccaggaaacaacaaucaaa

SEQ ID NO: 1362498 - RNA, 22 nt, Human
ucacacaccugugacaccagcc

SEQ ID NO: 1362499 - RNA, 22 nt, Human
ucacccaggcuggagugcagug

SEQ ID NO: 1362500 - RNA, 21 nt, Human
ucaggccacuggcacagcagg

SEQ ID NO: 1362501 - RNA, 19 nt, Human
ucauuaggaaccaugaaau

SEQ ID NO: 1362502 - RNA, 27 nt, Human
ucauucauucaugcauucauucauucc

SEQ ID NO: 1362503 - RNA, 24 nt, Human
uccagcucuaucacccaggcugga

SEQ ID NO: 1362504 - RNA, 25 nt, Human
uccagcucuaucacccaggcuggag

SEQ ID NO: 1362505 - RNA, 21 nt, Human
uccaggccuagggcaggaggu

SEQ ID NO: 1362506 - RNA, 21 nt, Human
ucccagguucaagcgauucuc

SEQ ID NO: 1362507 - RNA, 24 nt, Human
ucccagguucaagcgauucuccug

SEQ ID NO: 1362508 - RNA, 19 nt, Human
ucccuccagcucuaucacc

SEQ ID NO: 1362509 - RNA, 21 nt, Human
uccuggaccacuuagaagcuc

SEQ ID NO: 1362510 - RNA, 23 nt, Human
uccugggggagugcagaccccca

SEQ ID NO: 1362511 - RNA, 22 nt, Human
ucuaaaucucuggcuuggauuu

SEQ ID NO: 1362512 - RNA, 24 nt, Human
ucuaucacccaggcuggagugcag

SEQ ID NO: 1362513 - RNA, 21 nt, Human
ucucaggaggauaccuugacc

SEQ ID NO: 1362514 - RNA, 20 nt, Human
ucuccgggugguucuaacuc

SEQ ID NO: 1362515 - RNA, 22 nt, Human
ucucuaaauccaaaccuaguug

SEQ ID NO: 1362516 - RNA, 18 nt, Human
ucucucaggaggauaccu

SEQ ID NO: 1362517 - RNA, 24 nt, Human
ucuugacuagcagggacuacaggc

SEQ ID NO: 1362518 - RNA, 19 nt, Human
ugaaagaaggaagagaggg

SEQ ID NO: 1362519 - RNA, 28 nt, Human
ugaaauaagugaaauaagauaaaagcca

SEQ ID NO: 1362520 - RNA, 19 nt, Human
ugaagacagugacugcaga

SEQ ID NO: 1362521 - RNA, 20 nt, Human
ugacaccagcccugcauccu

SEQ ID NO: 1362522 - RNA, 21 nt, Human
ugagagauuuucuagcccagc

SEQ ID NO: 1362523 - RNA, 20 nt, Human
ugagcaggaggggcaggcgc

SEQ ID NO: 1362524 - RNA, 18 nt, Human
ugauagacaacuaaaugc

SEQ ID NO: 1362525 - RNA, 24 nt, Human
ugauagacaacuaaaugcccaaga

SEQ ID NO: 1362526 - RNA, 23 nt, Human
ugcaauuccucggggaaggagcg

SEQ ID NO: 1362527 - RNA, 19 nt, Human
ugccacacggugcuggggg

SEQ ID NO: 1362528 - RNA, 20 nt, Human
ugccauggaaggcugggagc

SEQ ID NO: 1362529 - RNA, 21 nt, Human
ugccauggaaggcugggagcu

SEQ ID NO: 1362530 - RNA, 28 nt, Human
ugccucacccucuugacuagcagggacu

SEQ ID NO: 1362531 - RNA, 23 nt, Human
ugccugaaugagauguaggaaac

SEQ ID NO: 1362532 - RNA, 23 nt, Human
uggaccacuuagaagcucagcuu

SEQ ID NO: 1362533 - RNA, 23 nt, Human
uggagugcaguggcgcgaucucg

SEQ ID NO: 1362534 - RNA, 24 nt, Human
uggagugcaguggcgcgaucucgg

SEQ ID NO: 1362535 - RNA, 23 nt, Human
uggccaggcuggucucgaacucc

SEQ ID NO: 1362536 - RNA, 19 nt, Human
uggcucaccaggcaggacu

SEQ ID NO: 1362537 - RNA, 21 nt, Human
ugggaaaagaccagagcccca

SEQ ID NO: 1362538 - RNA, 19 nt, Human
uggggaacacacaaacacu

SEQ ID NO: 1362539 - RNA, 20 nt, Human
ugguauccguaccacgcugu

SEQ ID NO: 1362540 - RNA, 24 nt, Human
uguagagacaggguuucaccaugu

SEQ ID NO: 1362541 - RNA, 18 nt, Human
uguauugauggggcugcu

SEQ ID NO: 1362542 - RNA, 23 nt, Human
uguggaugaggaaaccgaggucu

SEQ ID NO: 1362543 - RNA, 18 nt, Human
uguugugcuccaggccua

SEQ ID NO: 1362544 - RNA, 22 nt, Human
uguugugcuccaggccuagggc

SEQ ID NO: 1362545 - RNA, 22 nt, Human
uuaacaaaaauuaguaacagac

SEQ ID NO: 1362546 - RNA, 23 nt, Human
uuaacaaaaauuaguaacagaca

SEQ ID NO: 1362547 - RNA, 21 nt, Human
uucaagcgauucuccugccuc

SEQ ID NO: 1362548 - RNA, 23 nt, Human
uucaagcgauucuccugccucac

SEQ ID NO: 1362549 - RNA, 23 nt, Human
uuccagccacagccaucuggacc

SEQ ID NO: 1362550 - RNA, 19 nt, Human
uugacuagcagggacuaca

SEQ ID NO: 1362551 - RNA, 21 nt, Human
uugaggcaacuucauccaaac

SEQ ID NO: 1362552 - RNA, 21 nt, Human
uuggggaaaagcuguagaaac

SEQ ID NO: 1362553 - RNA, 24 nt, Human
uuguagagacaggguuucaccaug

SEQ ID NO: 1362554 - RNA, 24 nt, Human
uuucaccauguuggccaggcuggu

SEQ ID NO: 1362555 - RNA, 20 nt, Human
uuucccauuuuguggaugag

SEQ ID NO: 1362556 - RNA, 21 nt, Human
uuuccuuucccaaaaggagga

SEQ ID NO: 1362557 - RNA, 18 nt, Human
uuuguagagacaggguuu

SEQ ID NO: 1362558 - RNA, 24 nt, Human
uuuguagagacaggguuucaccau

SEQ ID NO: 1362559 - RNA, 23 nt, Human
uuuuuguagagacaggguuucac

SEQ ID NO: 1362560 - RNA, 25 nt, Human
aaaaagaacaaaaagaagaaaacaa

SEQ ID NO: 1362561 - RNA, 18 nt, Human
aaaagaagaaaacaaaua

SEQ ID NO: 1362562 - RNA, 22 nt, Human
aaagaacaaaaagaagaaaaca

SEQ ID NO: 1362563 - RNA, 19 nt, Human
aagaagaaaacaaauaaaa

SEQ ID NO: 1362564 - RNA, 20 nt, Human
aagaagaaaacaaauaaaau

SEQ ID NO: 1362565 - RNA, 22 nt, Human
aagaagaaaacaaauaaaauuu

SEQ ID NO: 1362566 - RNA, 23 nt, Human
aagaagaaaacaaauaaaauuuc

SEQ ID NO: 1362567 - RNA, 25 nt, Human
aaggagcugcuacagggaaacaggc

SEQ ID NO: 1362568 - RNA, 22 nt, Human
aaugggucaaaauccaaaaucc

SEQ ID NO: 1362569 - RNA, 18 nt, Human
acacacacgcacacacac

SEQ ID NO: 1362570 - RNA, 23 nt, Human
accaaggaaauuaccuaaaacaa

SEQ ID NO: 1362571 - RNA, 18 nt, Human
agcaaaaagaacaaaaag

SEQ ID NO: 1362572 - RNA, 23 nt, Human
agcaaaaagaacaaaaagaagaa

SEQ ID NO: 1362573 - RNA, 25 nt, Human
agcaaaaagaacaaaaagaagaaaa

SEQ ID NO: 1362574 - RNA, 23 nt, Human
caacauggaaugaacauauuccc

SEQ ID NO: 1362575 - RNA, 19 nt, Human
cacaccacacagaaauaag

SEQ ID NO: 1362576 - RNA, 28 nt, Human
cacgcacacacacaaaguuuggaauuuu

SEQ ID NO: 1362577 - RNA, 23 nt, Human
cacuuuucuccuucuccagcaau

SEQ ID NO: 1362578 - RNA, 23 nt, Human
cagaaagaaagcuggggccagua

SEQ ID NO: 1362579 - RNA, 21 nt, Human
cagagguaauuugagguuuac

SEQ ID NO: 1362580 - RNA, 22 nt, Human
cagcaauaaggagcugcuacag

SEQ ID NO: 1362581 - RNA, 19 nt, Human
ccccauugcccucauaagc

SEQ ID NO: 1362582 - RNA, 22 nt, Human
ccucuggcuaagagauccagag

SEQ ID NO: 1362583 - RNA, 19 nt, Human
cuuacuuguaaaaaaaauc

SEQ ID NO: 1362584 - RNA, 22 nt, Human
gaagaaaacaaauaaaauuuca

SEQ ID NO: 1362585 - RNA, 21 nt, Human
gagcugcuacagggaaacagg

SEQ ID NO: 1362586 - RNA, 23 nt, Human
gcacuuuucuccuucuccagcaa

SEQ ID NO: 1362587 - RNA, 23 nt, Human
gcccuggacuauaaggacuucug

SEQ ID NO: 1362588 - RNA, 18 nt, Human
ggcccuggacuauaagga

SEQ ID NO: 1362589 - RNA, 24 nt, Human
guuuggaauuuuauccuacauaug

SEQ ID NO: 1362590 - RNA, 18 nt, Human
uaaaauggaggucaaaga

SEQ ID NO: 1362591 - RNA, 18 nt, Human
uaaaauuucacaccacac

SEQ ID NO: 1362592 - RNA, 19 nt, Human
uaaauaugcugcuuugcca

SEQ ID NO: 1362593 - RNA, 25 nt, Human
uaacagaaagaaagcuggggccaga

SEQ ID NO: 1362594 - RNA, 20 nt, Human
uacagggaaacaggcccugg

SEQ ID NO: 1362595 - RNA, 22 nt, Human
uacauauaagcaaaaagaacaa

SEQ ID NO: 1362596 - RNA, 26 nt, Human
uaccaaggaaauuaccuaaaacaaag

SEQ ID NO: 1362597 - RNA, 24 nt, Human
uauacacacacgcacacacacaaa

SEQ ID NO: 1362598 - RNA, 22 nt, Human
uauauggauguauguauacaca

SEQ ID NO: 1362599 - RNA, 21 nt, Human
ucaaaauccaaaauccaauga

SEQ ID NO: 1362600 - RNA, 21 nt, Human
ucccaugcaaaugugugaaag

SEQ ID NO: 1362601 - RNA, 26 nt, Human
ugcuaacagaaagaaagcuggggcca

SEQ ID NO: 1362602 - RNA, 25 nt, Human
uguauacacacacgcacacacacag

SEQ ID NO: 1362603 - RNA, 22 nt, Human
uguauacacacacgcacacagu

SEQ ID NO: 1362604 - RNA, 20 nt, Human
uuccucuggcuaagagaucc

SEQ ID NO: 1362605 - RNA, 25 nt, Human
uuccucuggcuaagagauccagagg

SEQ ID NO: 1362606 - RNA, 18 nt, Human
aaaaaaaaaaaaaaaagc

SEQ ID NO: 1362607 - RNA, 20 nt, Human
aaaaaaaaaaaagcugccau

SEQ ID NO: 1362608 - RNA, 26 nt, Human
aaaaaaaaauccuuucuuucuacaga

SEQ ID NO: 1362609 - RNA, 21 nt, Human
aaacauccuaaaaagaaaaag

SEQ ID NO: 1362610 - RNA, 22 nt, Human
aaagaaaaagaaaaaaaaaucc

SEQ ID NO: 1362611 - RNA, 20 nt, Human
aaagcuuccccaugucacuu

SEQ ID NO: 1362612 - RNA, 30 nt, Human
aaagguaccucaacaaaagcacaucaaggg

SEQ ID NO: 1362613 - RNA, 26 nt, Human
aacaauaaaaggagaaccuuaagaga

SEQ ID NO: 1362614 - RNA, 20 nt, Human
aagcgcagaugccugggacc

SEQ ID NO: 1362615 - RNA, 24 nt, Human
aaggcaucauugucccuugccuaa

SEQ ID NO: 1362616 - RNA, 23 nt, Human
aauuaccucucccuugucuccac

SEQ ID NO: 1362617 - RNA, 21 nt, Human
aauugcuuauuuuuauuuuuu

SEQ ID NO: 1362618 - RNA, 20 nt, Human
accucaacaaaagcacauca

SEQ ID NO: 1362619 - RNA, 23 nt, Human
agaacgucuccacauaaaacucu

SEQ ID NO: 1362620 - RNA, 21 nt, Human
aggcauucaacaagaggaaac

SEQ ID NO: 1362621 - RNA, 22 nt, Human
aggcauucaacaagaggaaaca

SEQ ID NO: 1362622 - RNA, 24 nt, Human
agguaccuuuuaugaaaaggacuu

SEQ ID NO: 1362623 - RNA, 21 nt, Human
agguacguacuacucuaccuu

SEQ ID NO: 1362624 - RNA, 20 nt, Human
aucaccauagacaaguuuuu

SEQ ID NO: 1362625 - RNA, 18 nt, Human
auccaucuuuccuuccaa

SEQ ID NO: 1362626 - RNA, 21 nt, Human
caacaagaggaaacagguacc

SEQ ID NO: 1362627 - RNA, 22 nt, Human
caacacgucucuuaaaaugcuc

SEQ ID NO: 1362628 - RNA, 24 nt, Human
caagcgcagaugccugggacccug

SEQ ID NO: 1362629 - RNA, 24 nt, Human
caauaaaaggagaaccuuaagaga

SEQ ID NO: 1362630 - RNA, 22 nt, Human
cacauaaaacucuuaacaccuu

SEQ ID NO: 1362631 - RNA, 23 nt, Human
cauuaugcuucucuaaagggcua

SEQ ID NO: 1362632 - RNA, 21 nt, Human
ccaugucacuucucaaacauc

SEQ ID NO: 1362633 - RNA, 18 nt, Human
cuaaaaagaaaaagaaaa

SEQ ID NO: 1362634 - RNA, 21 nt, Human
cuaaaaagaaaaagaaaaaaa

SEQ ID NO: 1362635 - RNA, 25 nt, Human
cuagauuacaaaaagucaaagccaa

SEQ ID NO: 1362636 - RNA, 18 nt, Human
cucaaaaaaaaaaaaaaa

SEQ ID NO: 1362637 - RNA, 23 nt, Human
cuccacauaaaacucuuaacacc

SEQ ID NO: 1362638 - RNA, 21 nt, Human
cuccuagauuacaaaaaguca

SEQ ID NO: 1362639 - RNA, 28 nt, Human
gauaacaauaaaaggagaaccgguaccc

SEQ ID NO: 1362640 - RNA, 19 nt, Human
gaugauaacaauaaaagga

SEQ ID NO: 1362641 - RNA, 23 nt, Human
gucacuucucaaacauccuaaaa

SEQ ID NO: 1362642 - RNA, 19 nt, Human
guccaaggcaucauugucc

SEQ ID NO: 1362643 - RNA, 23 nt, Human
gucuccacauaaaacucuuaaca

SEQ ID NO: 1362644 - RNA, 21 nt, Human
uaauagaaaccggagcugcug

SEQ ID NO: 1362645 - RNA, 18 nt, Human
uaccucaacaaaagcaca

SEQ ID NO: 1362646 - RNA, 22 nt, Human
uagcaagugugccuuauuuucu

SEQ ID NO: 1362647 - RNA, 19 nt, Human
uauaugaauuacguaugua

SEQ ID NO: 1362648 - RNA, 24 nt, Human
ucaaaaaaaaaaaaaaaaaagcuu

SEQ ID NO: 1362649 - RNA, 28 nt, Human
ucaaacauccuaaaaagaaaaagaaaaa

SEQ ID NO: 1362650 - RNA, 22 nt, Human
ucaaauccacauucggccgcgc

SEQ ID NO: 1362651 - RNA, 23 nt, Human
ucagcaagccuuaucaauaauac

SEQ ID NO: 1362652 - RNA, 23 nt, Human
ucauuucuacuucucacacaugc

SEQ ID NO: 1362653 - RNA, 23 nt, Human
uccgucucaaaaaaaaaaaaaaa

SEQ ID NO: 1362654 - RNA, 26 nt, Human
uccgucucaaaaaaaaaaaaaaaaaa

SEQ ID NO: 1362655 - RNA, 27 nt, Human
uccuaaaaagaaaaagaaaaaaaaauc

SEQ ID NO: 1362656 - RNA, 24 nt, Human
ucuauauacaacacgucucuuaaa

SEQ ID NO: 1362657 - RNA, 18 nt, Human
ucucaaaaaaaaaaaaaa

SEQ ID NO: 1362658 - RNA, 30 nt, Human
ucucaaacauccuaaaaagaaaaagaaaag

SEQ ID NO: 1362659 - RNA, 22 nt, Human
ucuccacauaaaacucuuaaca

SEQ ID NO: 1362660 - RNA, 21 nt, Human
ucugaacuucaagucaccaua

SEQ ID NO: 1362661 - RNA, 18 nt, Human
ucuuccuugcuuaguaga

SEQ ID NO: 1362662 - RNA, 23 nt, Human
ugaaagguaccucaacaaaagca

SEQ ID NO: 1362663 - RNA, 20 nt, Human
ugagaaggccaaauuuaaug

SEQ ID NO: 1362664 - RNA, 20 nt, Human
uggcagccggauggaugcga

SEQ ID NO: 1362665 - RNA, 28 nt, Human
ugucaagauaaagaaaacucagcauucc

SEQ ID NO: 1362666 - RNA, 25 nt, Human
uuaaucaccauagacaaguuuuuac

SEQ ID NO: 1362667 - RNA, 25 nt, Human
uuagucaaacagucuuaccaguacc

SEQ ID NO: 1362668 - RNA, 19 nt, Human
uucaaguuaaguccacagu

SEQ ID NO: 1362669 - RNA, 18 nt, Human
uucacauagcaagugugc

SEQ ID NO: 1362670 - RNA, 21 nt, Human
uucggccgcgcugccaccugc

SEQ ID NO: 1362671 - RNA, 22 nt, Human
uucuacagagguacguacuacu

SEQ ID NO: 1362672 - RNA, 25 nt, Human
uuuaacauuuuuaauaaaucucuca

SEQ ID NO: 1362673 - RNA, 18 nt, Human
uuuacaagaacgucucca

SEQ ID NO: 1362674 - RNA, 25 nt, Human
acagcucuggccacgcuggcgggag

SEQ ID NO: 1362675 - RNA, 19 nt, Human
agagcagcgguagcacacc

SEQ ID NO: 1362676 - RNA, 21 nt, Human
agagcagcgguagcacaccgg

SEQ ID NO: 1362677 - RNA, 21 nt, Human
agagcagcgguagcacaccgg

SEQ ID NO: 1362678 - RNA, 19 nt, Human
agaggaaggaggaaggacg

SEQ ID NO: 1362679 - RNA, 23 nt, Human
agcccucagcuuugggagggccc

SEQ ID NO: 1362680 - RNA, 19 nt, Human
aggcagggguggacucccg

SEQ ID NO: 1362681 - RNA, 22 nt, Human
aucccagcccuucccuccccug

SEQ ID NO: 1362682 - RNA, 18 nt, Human
caaaagcacaagaaugca

SEQ ID NO: 1362683 - RNA, 23 nt, Human
caaaagcacaagaaugcaaaccg

SEQ ID NO: 1362684 - RNA, 20 nt, Human
caccaggccuuaccuggcug

SEQ ID NO: 1362685 - RNA, 22 nt, Human
cagcacgcagcucccgccuucc

SEQ ID NO: 1362686 - RNA, 26 nt, Human
cagcccuucccuccccuggcaccucc

SEQ ID NO: 1362687 - RNA, 18 nt, Human
cagcucccgccuucccgc

SEQ ID NO: 1362688 - RNA, 19 nt, Human
ccaccacugaggcaggggu

SEQ ID NO: 1362689 - RNA, 21 nt, Human
ccacgggcugcagcccucagc

SEQ ID NO: 1362690 - RNA, 20 nt, Human
ccauguccgcgcgccgcccc

SEQ ID NO: 1362691 - RNA, 23 nt, Human
cccaccacugaggcaggggugga

SEQ ID NO: 1362692 - RNA, 24 nt, Human
cccaccacugaggcagggguggac

SEQ ID NO: 1362693 - RNA, 27 nt, Human
cccagcgccguggccuccaggucuccg

SEQ ID NO: 1362694 - RNA, 18 nt, Human
ccccucggcgccccccgg

SEQ ID NO: 1362695 - RNA, 21 nt, Human
cccucagcuuugggagggccc

SEQ ID NO: 1362696 - RNA, 22 nt, Human
cccuccccuggcaccucccaaa

SEQ ID NO: 1362697 - RNA, 23 nt, Human
cccuccccuggcaccucccaaaa

SEQ ID NO: 1362698 - RNA, 22 nt, Human
ccgcucaggagcugccgccgcc

SEQ ID NO: 1362699 - RNA, 23 nt, Human
ccgcucaggagcugccgccgccu

SEQ ID NO: 1362700 - RNA, 19 nt, Human
ccgggauccggccccccuc

SEQ ID NO: 1362701 - RNA, 21 nt, Human
ccucaccaggccuuaccuggc

SEQ ID NO: 1362702 - RNA, 22 nt, Human
ccuccauguccgcgcgccgccc

SEQ ID NO: 1362703 - RNA, 24 nt, Human
ccuccauguccgcgcgccgccccu

SEQ ID NO: 1362704 - RNA, 18 nt, Human
ccuggugacuuccuggug

SEQ ID NO: 1362705 - RNA, 25 nt, Human
cgccguggccuccaggucuccgcag

SEQ ID NO: 1362706 - RNA, 23 nt, Human
cgcgcgccgccccucggcgcccc

SEQ ID NO: 1362707 - RNA, 23 nt, Human
cggugcgacagcucuggccacgc

SEQ ID NO: 1362708 - RNA, 22 nt, Human
cucaggagcugccgccgccucc

SEQ ID NO: 1362709 - RNA, 24 nt, Human
cucugaggccccacgggcugcagc

SEQ ID NO: 1362710 - RNA, 26 nt, Human
cuggcaccaguggcgccgcagcuuuc

SEQ ID NO: 1362711 - RNA, 22 nt, Human
cuggccaaccaagaggccaagu

SEQ ID NO: 1362712 - RNA, 18 nt, Human
cuggccacgcuggcggga

SEQ ID NO: 1362713 - RNA, 24 nt, Human
cuggugacuuccuggugggccugg

SEQ ID NO: 1362714 - RNA, 19 nt, Human
cuuuuaauccugaacauuc

SEQ ID NO: 1362715 - RNA, 20 nt, Human
gaggaaggacgcucacggug

SEQ ID NO: 1362716 - RNA, 21 nt, Human
gccuggccaaccaagaggcca

SEQ ID NO: 1362717 - RNA, 18 nt, Human
gccuucccgcucaggagc

SEQ ID NO: 1362718 - RNA, 20 nt, Human
ggagaggaaggaggaaggaa

SEQ ID NO: 1362719 - RNA, 22 nt, Human
ggagcugccgccgccuccgccu

SEQ ID NO: 1362720 - RNA, 22 nt, Human
guagagcagcgguagcacaccg

SEQ ID NO: 1362721 - RNA, 20 nt, Human
ucccagauucagcuugucuc

SEQ ID NO: 1362722 - RNA, 24 nt, Human
ucccagcaucccagcccuucccuc

SEQ ID NO: 1362723 - RNA, 18 nt, Human
ucccagcccuucccuccc

SEQ ID NO: 1362724 - RNA, 19 nt, Human
uccggccccccucucggcc

SEQ ID NO: 1362725 - RNA, 18 nt, Human
ugacucuggcaccagugg

SEQ ID NO: 1362726 - RNA, 18 nt, Human
ugccagcaacaacagguc

SEQ ID NO: 1362727 - RNA, 18 nt, Human
uggcagcccggagaggaa

SEQ ID NO: 1362728 - RNA, 26 nt, Human
uuaauccugaacauucuugaagcaug

SEQ ID NO: 1362729 - RNA, 21 nt, Human
uugguagagcagcgguagcuu

SEQ ID NO: 1362730 - RNA, 21 nt, Human
aaagugccugguccuccaagc

SEQ ID NO: 1362731 - RNA, 21 nt, Human
aacccucauuuaaacccucuc

SEQ ID NO: 1362732 - RNA, 23 nt, Human
aacccucuccccgcaaccuucua

SEQ ID NO: 1362733 - RNA, 19 nt, Human
aagcgcaucuccugaacaa

SEQ ID NO: 1362734 - RNA, 22 nt, Human
aagcgcaucuccugaacaauuc

SEQ ID NO: 1362735 - RNA, 20 nt, Human
accccaaacaccaaaggcuc

SEQ ID NO: 1362736 - RNA, 24 nt, Human
acccucauuuaaacccucuccccg

SEQ ID NO: 1362737 - RNA, 19 nt, Human
aggaaaccccaaacaccaa

SEQ ID NO: 1362738 - RNA, 21 nt, Human
aggaaaccccaaacaccaaag

SEQ ID NO: 1362739 - RNA, 23 nt, Human
caacuuacucaacacuccuccca

SEQ ID NO: 1362740 - RNA, 22 nt, Human
caccccaagcgcaucuccugaa

SEQ ID NO: 1362741 - RNA, 27 nt, Human
cacuccucccacuucaggaaaccccaa

SEQ ID NO: 1362742 - RNA, 26 nt, Human
cacuuccuuccccugggucaguccca

SEQ ID NO: 1362743 - RNA, 20 nt, Human
cagcccacgaacugcccuuc

SEQ ID NO: 1362744 - RNA, 22 nt, Human
cagcccacgaacugcccuuccu

SEQ ID NO: 1362745 - RNA, 18 nt, Human
cagcgccgccgcccccgc

SEQ ID NO: 1362746 - RNA, 22 nt, Human
cagucccaggauaucuaccccc

SEQ ID NO: 1362747 - RNA, 27 nt, Human
ccaaaggcuccccagucacucucaggg

SEQ ID NO: 1362748 - RNA, 20 nt, Human
cccacgaacugcccuuccuc

SEQ ID NO: 1362749 - RNA, 23 nt, Human
cccacuucaggaaaccccaaaca

SEQ ID NO: 1362750 - RNA, 21 nt, Human
ccccaaacaccaaaggcuccc

SEQ ID NO: 1362751 - RNA, 22 nt, Human
ccccaaacaccaaaggcucccc

SEQ ID NO: 1362752 - RNA, 18 nt, Human
ccccacaggcuccccaga

SEQ ID NO: 1362753 - RNA, 21 nt, Human
ccccccacaggcuccccagac

SEQ ID NO: 1362754 - RNA, 19 nt, Human
cccccgcgccgcuggccgc

SEQ ID NO: 1362755 - RNA, 19 nt, Human
ccccugggucagucccagg

SEQ ID NO: 1362756 - RNA, 23 nt, Human
cccgcaaccuucuacaggccauc

SEQ ID NO: 1362757 - RNA, 21 nt, Human
cccgcaggcgaagggccgcag

SEQ ID NO: 1362758 - RNA, 21 nt, Human
cccgcgccgcuggccgccgcg

SEQ ID NO: 1362759 - RNA, 26 nt, Human
cccugggucagucccaggauaucuac

SEQ ID NO: 1362760 - RNA, 19 nt, Human
cccuugccgcacuccccgc

SEQ ID NO: 1362761 - RNA, 18 nt, Human
ccgcaaccuucuacaggc

SEQ ID NO: 1362762 - RNA, 20 nt, Human
ccgccgcgugcgcgcgccgg

SEQ ID NO: 1362763 - RNA, 19 nt, Human
ccgcgccgcuggccgccgc

SEQ ID NO: 1362764 - RNA, 20 nt, Human
ccgcgccgcuggccgccgcg

SEQ ID NO: 1362765 - RNA, 20 nt, Human
ccgcuggccgccgcgugcgc

SEQ ID NO: 1362766 - RNA, 25 nt, Human
ccucccacuucaggaaaccccaaac

SEQ ID NO: 1362767 - RNA, 23 nt, Human
ccugaacaauucuuccguggagg

SEQ ID NO: 1362768 - RNA, 21 nt, Human
cgcacgaagcccuugccgcac

SEQ ID NO: 1362769 - RNA, 20 nt, Human
cgccgccgcccccgcgccgc

SEQ ID NO: 1362770 - RNA, 22 nt, Human
cgcuggccgccgcgugcgcgcg

SEQ ID NO: 1362771 - RNA, 20 nt, Human
cuccccgcaggcgaagggcu

SEQ ID NO: 1362772 - RNA, 20 nt, Human
cugaaggccucgccgcacuc

SEQ ID NO: 1362773 - RNA, 21 nt, Human
gcagcgccgccgcccccgcgc

SEQ ID NO: 1362774 - RNA, 19 nt, Human
gccgcacucgccacagccg

SEQ ID NO: 1362775 - RNA, 21 nt, Human
gccgcacucgccacagccgug

SEQ ID NO: 1362776 - RNA, 20 nt, Human
ggcuccccagacggcagccu

SEQ ID NO: 1362777 - RNA, 23 nt, Human
uacucaacacuccucccacuuca

SEQ ID NO: 1362778 - RNA, 26 nt, Human
uauagcaccgggaaagaccaacuuac

SEQ ID NO: 1362779 - RNA, 22 nt, Human
ucaggaaaccccaaacaccaaa

SEQ ID NO: 1362780 - RNA, 18 nt, Human
ucccacuucaggaaaccc

SEQ ID NO: 1362781 - RNA, 21 nt, Human
ucccacuucaggaaaccccaa

SEQ ID NO: 1362782 - RNA, 25 nt, Human
uccccacuuccuuccccugggucag

SEQ ID NO: 1362783 - RNA, 21 nt, Human
uccccagacggcagccucccg

SEQ ID NO: 1362784 - RNA, 22 nt, Human
uccccagacggcagccucccgc

SEQ ID NO: 1362785 - RNA, 21 nt, Human
uccccagucacucucagauug

SEQ ID NO: 1362786 - RNA, 26 nt, Human
ucuaccccccacaggcuccccagacg

SEQ ID NO: 1362787 - RNA, 20 nt, Human
ucuccugaacaauucuuccg

SEQ ID NO: 1362788 - RNA, 22 nt, Human
ugccgcacucgccacagccgug

SEQ ID NO: 1362789 - RNA, 20 nt, Human
ugucccucccgccccuuccc

SEQ ID NO: 1362790 - RNA, 22 nt, Human
uucccaccccagcccacgaacu

SEQ ID NO: 1362791 - RNA, 22 nt, Human
uugccgcacuccccgcaggcug

SEQ ID NO: 1362792 - RNA, 19 nt, Human
aaaaacacgacucuccacc

SEQ ID NO: 1362793 - RNA, 24 nt, Human
aaaaacacgacucuccaccaugug

SEQ ID NO: 1362794 - RNA, 25 nt, Human
aaaaaccaaagugccaguacaggca

SEQ ID NO: 1362795 - RNA, 19 nt, Human
aaaaagaaauucuuagccc

SEQ ID NO: 1362796 - RNA, 24 nt, Human
aaacaaguuucuuuuaauguuccu

SEQ ID NO: 1362797 - RNA, 23 nt, Human
aaacaggcuacguuucaguccuu

SEQ ID NO: 1362798 - RNA, 21 nt, Human
aaagucuuucccuucucuagc

SEQ ID NO: 1362799 - RNA, 22 nt, Human
aacaguguccagaguuaccacc

SEQ ID NO: 1362800 - RNA, 27 nt, Human
aacuuuuugcuuucucccuuuucuccu

SEQ ID NO: 1362801 - RNA, 18 nt, Human
aagaaaaaugaaucccau

SEQ ID NO: 1362802 - RNA, 20 nt, Human
aagccaccuaaggggcugcc

SEQ ID NO: 1362803 - RNA, 18 nt, Human
aaggggcugccucgacug

SEQ ID NO: 1362804 - RNA, 19 nt, Human
aagguuugaaauacugguu

SEQ ID NO: 1362805 - RNA, 18 nt, Human
aaguagguacaagaucag

SEQ ID NO: 1362806 - RNA, 20 nt, Human
aagucaaaaacaaaaaccaa

SEQ ID NO: 1362807 - RNA, 20 nt, Human
aauaacuauagaacagaaac

SEQ ID NO: 1362808 - RNA, 23 nt, Human
acaaaacaccaagcucacaccac

SEQ ID NO: 1362809 - RNA, 24 nt, Human
acaaaacaccaagcucacaccaca

SEQ ID NO: 1362810 - RNA, 19 nt, Human
acaccacaaaacaaagaau

SEQ ID NO: 1362811 - RNA, 18 nt, Human
acauuguuuuaauuugcu

SEQ ID NO: 1362812 - RNA, 22 nt, Human
accaaagugccaguacaggcau

SEQ ID NO: 1362813 - RNA, 22 nt, Human
accaagcucacaccacaugcac

SEQ ID NO: 1362814 - RNA, 18 nt, Human
accacaugcacaccacaa

SEQ ID NO: 1362815 - RNA, 21 nt, Human
accacaugcacaccacaaaac

SEQ ID NO: 1362816 - RNA, 22 nt, Human
accacaugcacaccacaaaaca

SEQ ID NO: 1362817 - RNA, 26 nt, Human
accucggugaccugaugaauacacug

SEQ ID NO: 1362818 - RNA, 22 nt, Human
acugcaagcucugacagccagg

SEQ ID NO: 1362819 - RNA, 19 nt, Human
acugcagcuccuagcagcu

SEQ ID NO: 1362820 - RNA, 18 nt, Human
acuuguggaccuccccuc

SEQ ID NO: 1362821 - RNA, 19 nt, Human
acuuuggcaucucugugaa

SEQ ID NO: 1362822 - RNA, 23 nt, Human
agaaauccaagccaggucaaacc

SEQ ID NO: 1362823 - RNA, 24 nt, Human
agauuguuuguguaauuuuuccug

SEQ ID NO: 1362824 - RNA, 22 nt, Human
aggaagagguuuuuuauuuggc

SEQ ID NO: 1362825 - RNA, 19 nt, Human
aggcauagacagggaaacc

SEQ ID NO: 1362826 - RNA, 22 nt, Human
agggaaaaggggagguugggga

SEQ ID NO: 1362827 - RNA, 19 nt, Human
agggauacauuugucuggc

SEQ ID NO: 1362828 - RNA, 22 nt, Human
agggguuucucccgaggcuuca

SEQ ID NO: 1362829 - RNA, 24 nt, Human
aguagcauuauacaaacaaguuuc

SEQ ID NO: 1362830 - RNA, 26 nt, Human
agucaaaaacaaaaaccaaagugcca

SEQ ID NO: 1362831 - RNA, 24 nt, Human
agucaagucaaaaacaaaaaccaa

SEQ ID NO: 1362832 - RNA, 18 nt, Human
aguugcugcuugaagcac

SEQ ID NO: 1362833 - RNA, 20 nt, Human
auaacuauagaacagaaaca

SEQ ID NO: 1362834 - RNA, 22 nt, Human
aucgcuguaacucaauuucacc

SEQ ID NO: 1362835 - RNA, 18 nt, Human
auuaaagcaaugaguuca

SEQ ID NO: 1362836 - RNA, 19 nt, Human
auugucuuuguuguacugu

SEQ ID NO: 1362837 - RNA, 20 nt, Human
auuuguuuggggauuucuuu

SEQ ID NO: 1362838 - RNA, 21 nt, Human
caaaaacacgacucuccacca

SEQ ID NO: 1362839 - RNA, 21 nt, Human
caaaaacccacagccccuaag

SEQ ID NO: 1362840 - RNA, 21 nt, Human
caaaaacccacagccccuaag

SEQ ID NO: 1362841 - RNA, 23 nt, Human
caaaaacccacagccccuaagaa

SEQ ID NO: 1362842 - RNA, 22 nt, Human
caaaacaccaagcucacaccac

SEQ ID NO: 1362843 - RNA, 18 nt, Human
caaaaucagaguauccag

SEQ ID NO: 1362844 - RNA, 26 nt, Human
caaaaucagaguauccagaaauccaa

SEQ ID NO: 1362845 - RNA, 18 nt, Human
caaacacgggggccaucc

SEQ ID NO: 1362846 - RNA, 24 nt, Human
caaacauauuuauuuuuuauucug

SEQ ID NO: 1362847 - RNA, 23 nt, Human
caaacccagccuuuuucugcagu

SEQ ID NO: 1362848 - RNA, 21 nt, Human
caaagugccaguacaggcaug

SEQ ID NO: 1362849 - RNA, 22 nt, Human
caaauaaagacucaggauuaaa

SEQ ID NO: 1362850 - RNA, 21 nt, Human
caacacugggaucacuggugc

SEQ ID NO: 1362851 - RNA, 19 nt, Human
caacauaguuccuagagga

SEQ ID NO: 1362852 - RNA, 20 nt, Human
caacugccugccuauuuauu

SEQ ID NO: 1362853 - RNA, 24 nt, Human
caagcaauucaagucaagucaaaa

SEQ ID NO: 1362854 - RNA, 20 nt, Human
caagccaggucaaaccaaaa

SEQ ID NO: 1362855 - RNA, 21 nt, Human
caagcuggccagaguccccug

SEQ ID NO: 1362856 - RNA, 25 nt, Human
caagucaaaaacaaaaaccaaagug

SEQ ID NO: 1362857 - RNA, 23 nt, Human
caagucaagucaaaaacaaaaac

SEQ ID NO: 1362858 - RNA, 25 nt, Human
cacaaaaacacgacucuccaccaug

SEQ ID NO: 1362859 - RNA, 18 nt, Human
cacaccacaaaacaaaga

SEQ ID NO: 1362860 - RNA, 21 nt, Human
cacaccacaaaacaaagaaug

SEQ ID NO: 1362861 - RNA, 24 nt, Human
caccaaaccagaaucaaaaccaaa

SEQ ID NO: 1362862 - RNA, 21 nt, Human
caccacaugcacaccacaaaa

SEQ ID NO: 1362863 - RNA, 23 nt, Human
caccacaugcacaccacaaaacc

SEQ ID NO: 1362864 - RNA, 21 nt, Human
caccagcuguaaccaaguguc

SEQ ID NO: 1362865 - RNA, 21 nt, Human
cacugcugcugccugcccucu

SEQ ID NO: 1362866 - RNA, 23 nt, Human
cagaaauccaagccaggucaaac

SEQ ID NO: 1362867 - RNA, 25 nt, Human
cagacaaaacuccucagacaccaga

SEQ ID NO: 1362868 - RNA, 18 nt, Human
cagcacaggagggguugg

SEQ ID NO: 1362869 - RNA, 19 nt, Human
cagcagcacaggagggguu

SEQ ID NO: 1362870 - RNA, 22 nt, Human
cagcagcacaggagggguuggc

SEQ ID NO: 1362871 - RNA, 22 nt, Human
cagccaguacaacugcagcucc

SEQ ID NO: 1362872 - RNA, 20 nt, Human
cagccccuaagaauucucuc

SEQ ID NO: 1362873 - RNA, 21 nt, Human
caggacgagucacagacaaaa

SEQ ID NO: 1362874 - RNA, 21 nt, Human
caggaugacagucuggggucc

SEQ ID NO: 1362875 - RNA, 23 nt, Human
cagggccccacaguuuggguuaa

SEQ ID NO: 1362876 - RNA, 23 nt, Human
caggucaaaccaaaaccaaagua

SEQ ID NO: 1362877 - RNA, 22 nt, Human
caggugcuugagggagcagggg

SEQ ID NO: 1362878 - RNA, 18 nt, Human
caguauacugcugcucuc

SEQ ID NO: 1362879 - RNA, 25 nt, Human
caguugcugccaaggcccucaaaca

SEQ ID NO: 1362880 - RNA, 19 nt, Human
caugaugagcuucugcaug

SEQ ID NO: 1362881 - RNA, 25 nt, Human
caugcacaccacaaaacaaagaaug

SEQ ID NO: 1362882 - RNA, 18 nt, Human
caugugauccccaauacc

SEQ ID NO: 1362883 - RNA, 21 nt, Human
ccaaaccagaaucaaaaccaa

SEQ ID NO: 1362884 - RNA, 21 nt, Human
ccaaagugccaguacaggcau

SEQ ID NO: 1362885 - RNA, 20 nt, Human
ccaagccaggucaaaccaaa

SEQ ID NO: 1362886 - RNA, 20 nt, Human
ccaagucagccacaaacacc

SEQ ID NO: 1362887 - RNA, 18 nt, Human
ccaccuuugucauguccc

SEQ ID NO: 1362888 - RNA, 20 nt, Human
ccagaaucaaaaccaaaauc

SEQ ID NO: 1362889 - RNA, 24 nt, Human
ccagcagcacaggagggguuggcu

SEQ ID NO: 1362890 - RNA, 20 nt, Human
ccaguacaggcaugccgugg

SEQ ID NO: 1362891 - RNA, 21 nt, Human
ccagugcauguuccucuagcc

SEQ ID NO: 1362892 - RNA, 24 nt, Human
ccauccuuccuccaucacuugucc

SEQ ID NO: 1362893 - RNA, 23 nt, Human
cccaaacccaccaagguggaagc

SEQ ID NO: 1362894 - RNA, 22 nt, Human
cccacauauccaguauagucca

SEQ ID NO: 1362895 - RNA, 29 nt, Human
ccccaauaccuuugccgucuucuguaccc

SEQ ID NO: 1362896 - RNA, 21 nt, Human
cccccagaguucaauaggccc

SEQ ID NO: 1362897 - RNA, 18 nt, Human
ccccccuuuucccuugcc

SEQ ID NO: 1362898 - RNA, 25 nt, Human
cccccuuuucccuugccucuuuggg

SEQ ID NO: 1362899 - RNA, 25 nt, Human
ccccuuuucccuugccucuuugggg

SEQ ID NO: 1362900 - RNA, 26 nt, Human
cccgaauuaaagcaaugaguucagcc

SEQ ID NO: 1362901 - RNA, 19 nt, Human
cccuggggaaacgaucugg

SEQ ID NO: 1362902 - RNA, 22 nt, Human
ccgccuuugugaccucauacaa

SEQ ID NO: 1362903 - RNA, 19 nt, Human
ccuacaaugaggguuuuaa

SEQ ID NO: 1362904 - RNA, 23 nt, Human
ccucccucugccuggagaaaguc

SEQ ID NO: 1362905 - RNA, 20 nt, Human
ccuuucccaguuaagagaau

SEQ ID NO: 1362906 - RNA, 25 nt, Human
cggaagggggcagaugcugcuuuuu

SEQ ID NO: 1362907 - RNA, 25 nt, Human
cgucuugugcccauguggcaggccc

SEQ ID NO: 1362908 - RNA, 18 nt, Human
cucacaccacaugcacac

SEQ ID NO: 1362909 - RNA, 21 nt, Human
cucccgaggcuucaccuccuc

SEQ ID NO: 1362910 - RNA, 22 nt, Human
cucuccaccaugugcccauccu

SEQ ID NO: 1362911 - RNA, 18 nt, Human
cucugugcccacauaucc

SEQ ID NO: 1362912 - RNA, 23 nt, Human
cugcaagcucugacagccaggcu

SEQ ID NO: 1362913 - RNA, 24 nt, Human
cugcaagcucugacagccaggcug

SEQ ID NO: 1362914 - RNA, 20 nt, Human
cugcugccugcccucuuagc

SEQ ID NO: 1362915 - RNA, 21 nt, Human
cugcugcugccugcccucuua

SEQ ID NO: 1362916 - RNA, 21 nt, Human
cuggacuuucuucuuuucccu

SEQ ID NO: 1362917 - RNA, 21 nt, Human
cuggucuuaggcuccgguaga

SEQ ID NO: 1362918 - RNA, 18 nt, Human
cugugauguguucauccc

SEQ ID NO: 1362919 - RNA, 21 nt, Human
cuucaccuccucucuugucua

SEQ ID NO: 1362920 - RNA, 24 nt, Human
cuucggggucacucugcagggguu

SEQ ID NO: 1362921 - RNA, 21 nt, Human
cuugaagcacccuucaccuuu

SEQ ID NO: 1362922 - RNA, 18 nt, Human
cuuguuaccuccacacuu

SEQ ID NO: 1362923 - RNA, 21 nt, Human
cuuuccuuuaacucaugaaag

SEQ ID NO: 1362924 - RNA, 18 nt, Human
gaacaugagcaacuggug

SEQ ID NO: 1362925 - RNA, 20 nt, Human
gaccucauaccauauuuccc

SEQ ID NO: 1362926 - RNA, 22 nt, Human
gagaaguggcgaccucauacca

SEQ ID NO: 1362927 - RNA, 21 nt, Human
gagaauuuucacuuuuagugg

SEQ ID NO: 1362928 - RNA, 20 nt, Human
gagauucuggaugagcccaa

SEQ ID NO: 1362929 - RNA, 18 nt, Human
gagcaggggggcugucac

SEQ ID NO: 1362930 - RNA, 18 nt, Human
gagggagcaggggggcug

SEQ ID NO: 1362931 - RNA, 19 nt, Human
gagggguuucucccgaggc

SEQ ID NO: 1362932 - RNA, 19 nt, Human
gaguauacauacaauaagc

SEQ ID NO: 1362933 - RNA, 21 nt, Human
gagucacagacaaaacuccuc

SEQ ID NO: 1362934 - RNA, 24 nt, Human
gauaagcacacugauuacacugcc

SEQ ID NO: 1362935 - RNA, 19 nt, Human
gcacagccaguacaacugc

SEQ ID NO: 1362936 - RNA, 23 nt, Human
gccacucauuaucuuuccaguuu

SEQ ID NO: 1362937 - RNA, 20 nt, Human
gccaucuuuucacucucuga

SEQ ID NO: 1362938 - RNA, 18 nt, Human
gccccaccaaguaauugu

SEQ ID NO: 1362939 - RNA, 23 nt, Human
gcuauuucuaauaacugugaugu

SEQ ID NO: 1362940 - RNA, 22 nt, Human
gcucacaccacaugcacaccac

SEQ ID NO: 1362941 - RNA, 20 nt, Human
gcugugguggauccagguug

SEQ ID NO: 1362942 - RNA, 19 nt, Human
gcuucagcaacagugucca

SEQ ID NO: 1362943 - RNA, 23 nt, Human
ggaauuccccaaacccaccaagg

SEQ ID NO: 1362944 - RNA, 21 nt, Human
ggcucuuuggagguccuugag

SEQ ID NO: 1362945 - RNA, 21 nt, Human
gggaaaaggggagguugggga

SEQ ID NO: 1362946 - RNA, 20 nt, Human
gggagcaggggggcugucac

SEQ ID NO: 1362947 - RNA, 18 nt, Human
gggagguuggggagaaac

SEQ ID NO: 1362948 - RNA, 22 nt, Human
ggggaacagcuggaccuugucu

SEQ ID NO: 1362949 - RNA, 20 nt, Human
ggguuuucugggcuuggucu

SEQ ID NO: 1362950 - RNA, 24 nt, Human
ggugcuugagggagcaggggggcu

SEQ ID NO: 1362951 - RNA, 18 nt, Human
guccaaaauuuaagaaaa

SEQ ID NO: 1362952 - RNA, 19 nt, Human
guuggcuucccccuucugg

SEQ ID NO: 1362953 - RNA, 20 nt, Human
uaagagagcuuuccuguauc

SEQ ID NO: 1362954 - RNA, 22 nt, Human
uaagccaccuaaggggcugccu

SEQ ID NO: 1362955 - RNA, 19 nt, Human
uaagccuccaccugcccag

SEQ ID NO: 1362956 - RNA, 21 nt, Human
uaauugcugcagcuaacaggu

SEQ ID NO: 1362957 - RNA, 27 nt, Human
uacacguucucccuuuuuccaaugggg

SEQ ID NO: 1362958 - RNA, 21 nt, Human
uacaguauuuucucauacagu

SEQ ID NO: 1362959 - RNA, 22 nt, Human
uacauacaauaagccucacaca

SEQ ID NO: 1362960 - RNA, 21 nt, Human
uacccugcacaucucucuucu

SEQ ID NO: 1362961 - RNA, 21 nt, Human
uaccugggagcgcucucagga

SEQ ID NO: 1362962 - RNA, 19 nt, Human
uacugcugcucucucaggg

SEQ ID NO: 1362963 - RNA, 24 nt, Human
uagcaaguaguccaaggccagucu

SEQ ID NO: 1362964 - RNA, 24 nt, Human
uagcaauacaccuacaaugagggu

SEQ ID NO: 1362965 - RNA, 19 nt, Human
uagccaccagggccaggug

SEQ ID NO: 1362966 - RNA, 23 nt, Human
uagcccaaauaacacauggccaa

SEQ ID NO: 1362967 - RNA, 19 nt, Human
uagcuaauacugcaaaguu

SEQ ID NO: 1362968 - RNA, 23 nt, Human
uaguuguuuagagagguaggcca

SEQ ID NO: 1362969 - RNA, 21 nt, Human
uauuuuagccaccagggccag

SEQ ID NO: 1362970 - RNA, 19 nt, Human
ucaaaaguggggagccucu

SEQ ID NO: 1362971 - RNA, 21 nt, Human
ucaaauggagugggcaaguuc

SEQ ID NO: 1362972 - RNA, 24 nt, Human
ucaagacaaaacaccaagcucaca

SEQ ID NO: 1362973 - RNA, 21 nt, Human
ucaaugguuauauggggauuu

SEQ ID NO: 1362974 - RNA, 21 nt, Human
ucacaccacaugcacaccaca

SEQ ID NO: 1362975 - RNA, 22 nt, Human
ucacaccacaugcacaccacaa

SEQ ID NO: 1362976 - RNA, 24 nt, Human
ucacuagcaauacaccuacaauga

SEQ ID NO: 1362977 - RNA, 23 nt, Human
ucagccacaaacaccagcccauu

SEQ ID NO: 1362978 - RNA, 19 nt, Human
ucagccacugcauugaucc

SEQ ID NO: 1362979 - RNA, 22 nt, Human
ucaguccaauaacccuucugcc

SEQ ID NO: 1362980 - RNA, 23 nt, Human
ucaguccaauaacccuucugcca

SEQ ID NO: 1362981 - RNA, 18 nt, Human
ucaguguaaauguuuaca

SEQ ID NO: 1362982 - RNA, 24 nt, Human
uccacaaacuccuccuucagcugc

SEQ ID NO: 1362983 - RNA, 26 nt, Human
uccacaaacuccuccuucagcugcua

SEQ ID NO: 1362984 - RNA, 21 nt, Human
uccacagucugcaaaaaccca

SEQ ID NO: 1362985 - RNA, 26 nt, Human
uccauccuuccuccaucacuuguccu

SEQ ID NO: 1362986 - RNA, 27 nt, Human
ucccccagaguucaauaggcccuuuuc

SEQ ID NO: 1362987 - RNA, 19 nt, Human
ucccgaggcuucaccuccu

SEQ ID NO: 1362988 - RNA, 22 nt, Human
ucccuugccucuuuggggggac

SEQ ID NO: 1362989 - RNA, 21 nt, Human
uccuucagcugcuagcaagua

SEQ ID NO: 1362990 - RNA, 21 nt, Human
uccuugagcccagucccccuc

SEQ ID NO: 1362991 - RNA, 26 nt, Human
uccuugaucaucuauuuguaggcagu

SEQ ID NO: 1362992 - RNA, 21 nt, Human
ucuccugucuuauaaacuagg

SEQ ID NO: 1362993 - RNA, 21 nt, Human
ucugcaaaaacccacagcccc

SEQ ID NO: 1362994 - RNA, 23 nt, Human
ucugcaguuuucuucuaaugucu

SEQ ID NO: 1362995 - RNA, 23 nt, Human
ucuggcuucagcaacagugucca

SEQ ID NO: 1362996 - RNA, 23 nt, Human
ucuggugcuggcagauucagcuc

SEQ ID NO: 1362997 - RNA, 20 nt, Human
ucuuguggguugacaaagcu

SEQ ID NO: 1362998 - RNA, 21 nt, Human
ucuuguggguugacaaagcuu

SEQ ID NO: 1362999 - RNA, 23 nt, Human
ugaagggcugguacacaaaaaca

SEQ ID NO: 1363000 - RNA, 21 nt, Human
ugacauacuuucccuaaacua

SEQ ID NO: 1363001 - RNA, 18 nt, Human
ugagcagggccccuuccu

SEQ ID NO: 1363002 - RNA, 21 nt, Human
ugagccucuaagucagugcag

SEQ ID NO: 1363003 - RNA, 21 nt, Human
ugaguagcauuauacaaacaa

SEQ ID NO: 1363004 - RNA, 19 nt, Human
ugaguugaagugcccuggg

SEQ ID NO: 1363005 - RNA, 23 nt, Human
ugcaggaauuccccaaacccacc

SEQ ID NO: 1363006 - RNA, 21 nt, Human
ugccaagggagggguuucucc

SEQ ID NO: 1363007 - RNA, 18 nt, Human
ugccagggggaacagcug

SEQ ID NO: 1363008 - RNA, 21 nt, Human
ugccagguugagcagggcccc

SEQ ID NO: 1363009 - RNA, 21 nt, Human
ugcccuggggaaacgaucugg

SEQ ID NO: 1363010 - RNA, 23 nt, Human
ugccuggagaaaguccuuuucuu

SEQ ID NO: 1363011 - RNA, 21 nt, Human
ugcgucacuguuuuggcaagg

SEQ ID NO: 1363012 - RNA, 19 nt, Human
ugcucaggaugacagucug

SEQ ID NO: 1363013 - RNA, 22 nt, Human
uggaaaccauuuuccaaauaaa

SEQ ID NO: 1363014 - RNA, 21 nt, Human
uggaagcucacugguguccuc

SEQ ID NO: 1363015 - RNA, 21 nt, Human
uggacucaaaaguggggagcc

SEQ ID NO: 1363016 - RNA, 20 nt, Human
uggcagaggcgcaagcacug

SEQ ID NO: 1363017 - RNA, 21 nt, Human
uggccaacccacuucuaaugu

SEQ ID NO: 1363018 - RNA, 20 nt, Human
uggccagaguccccugcagg

SEQ ID NO: 1363019 - RNA, 23 nt, Human
uggccuagggauacauuugucug

SEQ ID NO: 1363020 - RNA, 20 nt, Human
uggccuucugggcucuccuc

SEQ ID NO: 1363021 - RNA, 21 nt, Human
uggcugcacaagcaucaaauc

SEQ ID NO: 1363022 - RNA, 18 nt, Human
uggguugacaaagcugcu

SEQ ID NO: 1363023 - RNA, 19 nt, Human
uguaaccaagugucuaugu

SEQ ID NO: 1363024 - RNA, 21 nt, Human
uguaugccagggggaacagcu

SEQ ID NO: 1363025 - RNA, 23 nt, Human
ugucagaucagguagccccaggg

SEQ ID NO: 1363026 - RNA, 22 nt, Human
uguggaccuccccucuaauuaa

SEQ ID NO: 1363027 - RNA, 20 nt, Human
uguggccuucugggcucucc

SEQ ID NO: 1363028 - RNA, 22 nt, Human
ugugggguuuccauacugcuuc

SEQ ID NO: 1363029 - RNA, 19 nt, Human
uguuauacaacuucugucc

SEQ ID NO: 1363030 - RNA, 18 nt, Human
uuaaaacuccaacugcca

SEQ ID NO: 1363031 - RNA, 22 nt, Human
uuaaaugagcugccaagggagg

SEQ ID NO: 1363032 - RNA, 22 nt, Human
uuaauccuguuucuugacauac

SEQ ID NO: 1363033 - RNA, 24 nt, Human
uuacacugcaagcucugacagcca

SEQ ID NO: 1363034 - RNA, 27 nt, Human
uuacaguauuuucucauacagugucgu

SEQ ID NO: 1363035 - RNA, 21 nt, Human
uuagagcuugcggcuuuucag

SEQ ID NO: 1363036 - RNA, 24 nt, Human
uuauuuugugucugauccauguuu

SEQ ID NO: 1363037 - RNA, 21 nt, Human
uucaagugauuccugaccuag

SEQ ID NO: 1363038 - RNA, 20 nt, Human
uucaguuuucaccaaaccag

SEQ ID NO: 1363039 - RNA, 18 nt, Human
uucaucccugcaaaccca

SEQ ID NO: 1363040 - RNA, 22 nt, Human
uuccaaguagcccaaauaacac

SEQ ID NO: 1363041 - RNA, 19 nt, Human
uuccaguauacugcugcuc

SEQ ID NO: 1363042 - RNA, 19 nt, Human
uucccuugccucuuugggg

SEQ ID NO: 1363043 - RNA, 23 nt, Human
uuccuguaucgguuuagccuuug

SEQ ID NO: 1363044 - RNA, 19 nt, Human
uugcugggauccccauuca

SEQ ID NO: 1363045 - RNA, 18 nt, Human
uugcuuucucccuuuucu

SEQ ID NO: 1363046 - RNA, 20 nt, Human
uuggaaauucuggugcuggc

SEQ ID NO: 1363047 - RNA, 21 nt, Human
uuggagguccuugagcccagu

SEQ ID NO: 1363048 - RNA, 20 nt, Human
uuggggagaaacugagaagg

SEQ ID NO: 1363049 - RNA, 18 nt, Human
uuucaaaaauggugguug

SEQ ID NO: 1363050 - RNA, 23 nt, Human
uuuccaccguggacacaaacagg

SEQ ID NO: 1363051 - RNA, 24 nt, Human
uuuccauacugcuucuaauaauug

SEQ ID NO: 1363052 - RNA, 23 nt, Human
uuucuccugucuuauaaacuagg

SEQ ID NO: 1363053 - RNA, 23 nt, Human
uuucuuuuucuucuguucuaguu

SEQ ID NO: 1363054 - RNA, 22 nt, Human
uuugcuuucucccuuuucuccu

SEQ ID NO: 1363055 - RNA, 21 nt, Human
uuuggcaagggcugacaaaug

SEQ ID NO: 1363056 - RNA, 22 nt, Human
uuuguggccuucugggcucucc

SEQ ID NO: 1363057 - RNA, 24 nt, Human
uuuuacacggcugugguggaucca

SEQ ID NO: 1363058 - RNA, 20 nt, Human
uuuuccacaaacuccuccuu

SEQ ID NO: 1363059 - RNA, 23 nt, Human
uuuuccacaaacuccuccuucag

SEQ ID NO: 1363060 - RNA, 23 nt, Human
uuuugcuuucucccuuuucuccu

SEQ ID NO: 1363061 - RNA, 27 nt, Human
aaacaaaaacgagggcugacugggacc

SEQ ID NO: 1363062 - RNA, 21 nt, Human
aaacaaaagcccuugcguagc

SEQ ID NO: 1363063 - RNA, 20 nt, Human
aaaccgguggccaggaggaa

SEQ ID NO: 1363064 - RNA, 20 nt, Human
aaagucacugguuuaauauc

SEQ ID NO: 1363065 - RNA, 20 nt, Human
aaccccaucaauucagucag

SEQ ID NO: 1363066 - RNA, 18 nt, Human
aacuggaagcuuggggac

SEQ ID NO: 1363067 - RNA, 22 nt, Human
aagaagcaugaauaagacaggc

SEQ ID NO: 1363068 - RNA, 24 nt, Human
aagacaggacauggggcucacaga

SEQ ID NO: 1363069 - RNA, 21 nt, Human
aaggggccucgggccuccugu

SEQ ID NO: 1363070 - RNA, 18 nt, Human
acaaaggucaaauccugg

SEQ ID NO: 1363071 - RNA, 21 nt, Human
acacaaauuaaacaaaaacga

SEQ ID NO: 1363072 - RNA, 18 nt, Human
acagcuucuacagggcca

SEQ ID NO: 1363073 - RNA, 19 nt, Human
acaggcggggcauaacagu

SEQ ID NO: 1363074 - RNA, 22 nt, Human
agacagguauuccacaaccugg

SEQ ID NO: 1363075 - RNA, 22 nt, Human
agagggaggccugggcucugag

SEQ ID NO: 1363076 - RNA, 20 nt, Human
agagguauugcagcaugcug

SEQ ID NO: 1363077 - RNA, 22 nt, Human
agcaaaaugacugggguccuca

SEQ ID NO: 1363078 - RNA, 20 nt, Human
agcagcucuugccagccagu

SEQ ID NO: 1363079 - RNA, 19 nt, Human
agcagggaugugugggggg

SEQ ID NO: 1363080 - RNA, 22 nt, Human
agccagugcugaggcucugaca

SEQ ID NO: 1363081 - RNA, 19 nt, Human
agccuggcugauggaaucc

SEQ ID NO: 1363082 - RNA, 18 nt, Human
aggcugggucuucaggug

SEQ ID NO: 1363083 - RNA, 20 nt, Human
agggcugacugggaccagga

SEQ ID NO: 1363084 - RNA, 24 nt, Human
agguggugucccugcacaucugcu

SEQ ID NO: 1363085 - RNA, 25 nt, Human
agucacugguuuaauaucuugggaa

SEQ ID NO: 1363086 - RNA, 22 nt, Human
aguggcguaggcugcaagagga

SEQ ID NO: 1363087 - RNA, 19 nt, Human
auuuaugaaaugcuuccuu

SEQ ID NO: 1363088 - RNA, 21 nt, Human
cacuguacugcuucacagagc

SEQ ID NO: 1363089 - RNA, 24 nt, Human
cagagguauugcagcaugcuguug

SEQ ID NO: 1363090 - RNA, 24 nt, Human
cagccagugacacuaccccuuccu

SEQ ID NO: 1363091 - RNA, 19 nt, Human
cagcugggcuucccagggg

SEQ ID NO: 1363092 - RNA, 18 nt, Human
cagguaaaagaagcauga

SEQ ID NO: 1363093 - RNA, 21 nt, Human
caucgacaugaacaaacaaaa

SEQ ID NO: 1363094 - RNA, 19 nt, Human
caugugccacgucaccucc

SEQ ID NO: 1363095 - RNA, 18 nt, Human
ccacccagggcagagcca

SEQ ID NO: 1363096 - RNA, 26 nt, Human
ccacgaagaaagguuuaaagaauccc

SEQ ID NO: 1363097 - RNA, 21 nt, Human
ccacgucaccucccuugucug

SEQ ID NO: 1363098 - RNA, 22 nt, Human
ccagcucaguggagugagacac

SEQ ID NO: 1363099 - RNA, 24 nt, Human
ccagcucaguggagugagacacug

SEQ ID NO: 1363100 - RNA, 19 nt, Human
cccaacuggaagcuugggg

SEQ ID NO: 1363101 - RNA, 21 nt, Human
cccccaugugccacgucaccu

SEQ ID NO: 1363102 - RNA, 20 nt, Human
cccuacagguaaaagaagca

SEQ ID NO: 1363103 - RNA, 18 nt, Human
cccucccagccuccaacc

SEQ ID NO: 1363104 - RNA, 23 nt, Human
cccucugggaucuccaccaucca

SEQ ID NO: 1363105 - RNA, 21 nt, Human
cccugcacaucugcuuugcag

SEQ ID NO: 1363106 - RNA, 22 nt, Human
ccuacagguaaaagaagcauga

SEQ ID NO: 1363107 - RNA, 20 nt, Human
ccuagagaagucacaaagcu

SEQ ID NO: 1363108 - RNA, 18 nt, Human
ccucauuauggaagaaca

SEQ ID NO: 1363109 - RNA, 22 nt, Human
ccucggcaggguggggagaagg

SEQ ID NO: 1363110 - RNA, 23 nt, Human
ccucgggccuccuguagcucugc

SEQ ID NO: 1363111 - RNA, 22 nt, Human
ccucuggcugggaccucagccc

SEQ ID NO: 1363112 - RNA, 19 nt, Human
ccucugggaucuccaccau

SEQ ID NO: 1363113 - RNA, 21 nt, Human
ccucugggaucuccaccaucc

SEQ ID NO: 1363114 - RNA, 24 nt, Human
ccugaagcaccacuaaaaugcuag

SEQ ID NO: 1363115 - RNA, 25 nt, Human
ccugggcccugucaacccucccaga

SEQ ID NO: 1363116 - RNA, 22 nt, Human
ccuucaacaaacacuuaaaaaa

SEQ ID NO: 1363117 - RNA, 22 nt, Human
cgacaugaacaaacaaaagccc

SEQ ID NO: 1363118 - RNA, 23 nt, Human
cucacaggguccugacaaaggcc

SEQ ID NO: 1363119 - RNA, 25 nt, Human
cucccuagcaauggcugaccucuag

SEQ ID NO: 1363120 - RNA, 18 nt, Human
cucuggucaggggagggg

SEQ ID NO: 1363121 - RNA, 20 nt, Human
cugaagcugcaacucucugc

SEQ ID NO: 1363122 - RNA, 19 nt, Human
cugacaaccucggcagggu

SEQ ID NO: 1363123 - RNA, 23 nt, Human
cugagggucuacaggccagaggg

SEQ ID NO: 1363124 - RNA, 22 nt, Human
cuggcugggaccucagccccca

SEQ ID NO: 1363125 - RNA, 23 nt, Human
cugggcucugaggccugugccug

SEQ ID NO: 1363126 - RNA, 19 nt, Human
cugugccuguguggccucu

SEQ ID NO: 1363127 - RNA, 21 nt, Human
gaagaaagguuuaaagaaucc

SEQ ID NO: 1363128 - RNA, 24 nt, Human
gaaggggccucgggccuccuguag

SEQ ID NO: 1363129 - RNA, 22 nt, Human
gaagucacaaagcucacaccca

SEQ ID NO: 1363130 - RNA, 18 nt, Human
gacaugaacaaacaaaag

SEQ ID NO: 1363131 - RNA, 20 nt, Human
gaccuggagccuggcugaug

SEQ ID NO: 1363132 - RNA, 20 nt, Human
gauccacucaagaccucaca

SEQ ID NO: 1363133 - RNA, 18 nt, Human
gcaggcugggucuucagg

SEQ ID NO: 1363134 - RNA, 18 nt, Human
gccaggaggaguucuuga

SEQ ID NO: 1363135 - RNA, 18 nt, Human
gccaggauuuaaagucac

SEQ ID NO: 1363136 - RNA, 19 nt, Human
gccucgggccuccuguagc

SEQ ID NO: 1363137 - RNA, 19 nt, Human
gcucugaggccugugccug

SEQ ID NO: 1363138 - RNA, 20 nt, Human
gcugggcagggacgcugcgg

SEQ ID NO: 1363139 - RNA, 21 nt, Human
ggaaaagcagauccacucaag

SEQ ID NO: 1363140 - RNA, 28 nt, Human
ggaaagagcagaaaaucaaccgguaccc

SEQ ID NO: 1363141 - RNA, 19 nt, Human
ggagaaggccagacucagg

SEQ ID NO: 1363142 - RNA, 22 nt, Human
ggcagagucaccggggcuggcc

SEQ ID NO: 1363143 - RNA, 19 nt, Human
ggccagagggaggccuggg

SEQ ID NO: 1363144 - RNA, 21 nt, Human
ggcccagccccccccaggaag

SEQ ID NO: 1363145 - RNA, 23 nt, Human
ggccucagcugggcuuccuuggc

SEQ ID NO: 1363146 - RNA, 18 nt, Human
ggcugccacccagggcag

SEQ ID NO: 1363147 - RNA, 20 nt, Human
gggaagacuauaacacaaug

SEQ ID NO: 1363148 - RNA, 18 nt, Human
ggggaccuggagccuggc

SEQ ID NO: 1363149 - RNA, 18 nt, Human
guggugucccugcacauc

SEQ ID NO: 1363150 - RNA, 22 nt, Human
guuaaaaacaucgacaugaaca

SEQ ID NO: 1363151 - RNA, 23 nt, Human
guuaaaaacaucgacaugaacaa

SEQ ID NO: 1363152 - RNA, 21 nt, Human
uaaaaaaaaaucccuacaggu

SEQ ID NO: 1363153 - RNA, 23 nt, Human
uaaaaacaucgacaugaacaaac

SEQ ID NO: 1363154 - RNA, 27 nt, Human
uaaaagaagcaugaauaagacaggcgg

SEQ ID NO: 1363155 - RNA, 20 nt, Human
uaaacaaaaacgagggcuga

SEQ ID NO: 1363156 - RNA, 19 nt, Human
uaaguacagaagucacuaa

SEQ ID NO: 1363157 - RNA, 23 nt, Human
uacagggcagggaagacuauaac

SEQ ID NO: 1363158 - RNA, 24 nt, Human
uacugcuucacagagcuguuacag

SEQ ID NO: 1363159 - RNA, 19 nt, Human
uagagauaugugugcuucg

SEQ ID NO: 1363160 - RNA, 21 nt, Human
uagcuuaauaauuccaaggua

SEQ ID NO: 1363161 - RNA, 23 nt, Human
uaggcugcaagaggacaagcuaa

SEQ ID NO: 1363162 - RNA, 22 nt, Human
uaucccagaugaugguaauaug

SEQ ID NO: 1363163 - RNA, 23 nt, Human
uaucccagaugaugguaauaugc

SEQ ID NO: 1363164 - RNA, 22 nt, Human
uauggaagaacaaauagcuuua

SEQ ID NO: 1363165 - RNA, 21 nt, Human
uaugucauccuucaacaaaca

SEQ ID NO: 1363166 - RNA, 22 nt, Human
uaugucauccuucaacaaacac

SEQ ID NO: 1363167 - RNA, 19 nt, Human
ucacaaagcucacacccag

SEQ ID NO: 1363168 - RNA, 19 nt, Human
ucacagagcuguuacaggg

SEQ ID NO: 1363169 - RNA, 22 nt, Human
ucacuggcuucagccuccucuc

SEQ ID NO: 1363170 - RNA, 23 nt, Human
ucaggcucagcucuaagugcugu

SEQ ID NO: 1363171 - RNA, 22 nt, Human
ucagguggugucccugcacauc

SEQ ID NO: 1363172 - RNA, 20 nt, Human
uccaccauccacaguguguu

SEQ ID NO: 1363173 - RNA, 24 nt, Human
uccagaugaugcuuacucccuggc

SEQ ID NO: 1363174 - RNA, 23 nt, Human
ucccuagcaauggcugaccucua

SEQ ID NO: 1363175 - RNA, 21 nt, Human
ucuacaggccagagggaggcc

SEQ ID NO: 1363176 - RNA, 22 nt, Human
ucucgccuaagagagucucuca

SEQ ID NO: 1363177 - RNA, 25 nt, Human
ucuuugggugggagcaagauccagg

SEQ ID NO: 1363178 - RNA, 24 nt, Human
ugaaaagaguacaucagaagcuaa

SEQ ID NO: 1363179 - RNA, 19 nt, Human
ugaaauaccacaacagcag

SEQ ID NO: 1363180 - RNA, 21 nt, Human
ugaaaugggggcaaugucccc

SEQ ID NO: 1363181 - RNA, 19 nt, Human
ugaacaaacaaaagcccuu

SEQ ID NO: 1363182 - RNA, 19 nt, Human
ugaacaaacaaaagcccuu

SEQ ID NO: 1363183 - RNA, 20 nt, Human
ugaacaggaaggggccucgg

SEQ ID NO: 1363184 - RNA, 20 nt, Human
ugacaaaggccacuuccagc

SEQ ID NO: 1363185 - RNA, 18 nt, Human
ugaccucuagcauacucu

SEQ ID NO: 1363186 - RNA, 18 nt, Human
ugagugauccuggcuucc

SEQ ID NO: 1363187 - RNA, 23 nt, Human
ugauuuacaugcuuauuuuccuu

SEQ ID NO: 1363188 - RNA, 23 nt, Human
ugcauuauaguuaaaaacaucga

SEQ ID NO: 1363189 - RNA, 23 nt, Human
ugccacgucaccucccuugucug

SEQ ID NO: 1363190 - RNA, 21 nt, Human
ugcuguggcugagaauuuucc

SEQ ID NO: 1363191 - RNA, 23 nt, Human
uggaagcuuggggaccuggagcc

SEQ ID NO: 1363192 - RNA, 20 nt, Human
uggaucacugagcacagcuu

SEQ ID NO: 1363193 - RNA, 20 nt, Human
uggcagcugggcuucccagg

SEQ ID NO: 1363194 - RNA, 24 nt, Human
uggcagcugggcuucccaggggcu

SEQ ID NO: 1363195 - RNA, 21 nt, Human
uggccaaacccaacuggaagc

SEQ ID NO: 1363196 - RNA, 22 nt, Human
uggccaaacccaacuggaagcu

SEQ ID NO: 1363197 - RNA, 20 nt, Human
uggcguaggcugcaagagga

SEQ ID NO: 1363198 - RNA, 18 nt, Human
uggcuaaagggcacagag

SEQ ID NO: 1363199 - RNA, 21 nt, Human
uggcuaaagggcacagagugg

SEQ ID NO: 1363200 - RNA, 19 nt, Human
uggcugaccucuagcauac

SEQ ID NO: 1363201 - RNA, 21 nt, Human
uggcugauggaauccacaaag

SEQ ID NO: 1363202 - RNA, 22 nt, Human
ugggaaagagcagaaaaucaac

SEQ ID NO: 1363203 - RNA, 23 nt, Human
ugggaagauguccauuuuuugga

SEQ ID NO: 1363204 - RNA, 24 nt, Human
ugggaagauguccauuuuuuggau

SEQ ID NO: 1363205 - RNA, 19 nt, Human
ugggaccaggagagugagu

SEQ ID NO: 1363206 - RNA, 21 nt, Human
ugggagcaagauccaggcauc

SEQ ID NO: 1363207 - RNA, 23 nt, Human
ugggagcaagauccaggcaucag

SEQ ID NO: 1363208 - RNA, 18 nt, Human
ugggcucugaggccugug

SEQ ID NO: 1363209 - RNA, 24 nt, Human
uggggugggaagauguccauuuuu

SEQ ID NO: 1363210 - RNA, 19 nt, Human
ugucaacccucccagaaau

SEQ ID NO: 1363211 - RNA, 23 nt, Human
uguccccuaggccuuuuccuccu

SEQ ID NO: 1363212 - RNA, 18 nt, Human
uguguggggggguggcaa

SEQ ID NO: 1363213 - RNA, 18 nt, Human
uguuuguggguaaugaca

SEQ ID NO: 1363214 - RNA, 25 nt, Human
uuaaaaaauguuugaaaaccccauc

SEQ ID NO: 1363215 - RNA, 18 nt, Human
uuccuuggcagugucugu

SEQ ID NO: 1363216 - RNA, 23 nt, Human
uugcaacaucuugcugaggacug

SEQ ID NO: 1363217 - RNA, 22 nt, Human
uuuguagagagguggcagcugg

SEQ ID NO: 1363218 - RNA, 22 nt, Human
aaagaggcaaaaggagcccaaa

SEQ ID NO: 1363219 - RNA, 20 nt, Human
aaccucugccuccuggcuuc

SEQ ID NO: 1363220 - RNA, 24 nt, Human
aacuaaggucaggaguuugagacc

SEQ ID NO: 1363221 - RNA, 19 nt, Human
aacugcaaccucugccucc

SEQ ID NO: 1363222 - RNA, 24 nt, Human
aauuuuguauuuuuaguagaaaug

SEQ ID NO: 1363223 - RNA, 21 nt, Human
acacuguuuugauuauuauag

SEQ ID NO: 1363224 - RNA, 24 nt, Human
accauguuggucaggcuggucuug

SEQ ID NO: 1363225 - RNA, 21 nt, Human
acugcaaccucugccuccugg

SEQ ID NO: 1363226 - RNA, 23 nt, Human
acugcaaccucugccuccuggcu

SEQ ID NO: 1363227 - RNA, 24 nt, Human
acuucaaccucccaaaaugcugag

SEQ ID NO: 1363228 - RNA, 21 nt, Human
agaagguggaagggcaaagag

SEQ ID NO: 1363229 - RNA, 24 nt, Human
agagauucuccucccucagccucc

SEQ ID NO: 1363230 - RNA, 20 nt, Human
agcacaauuuguugaaaaua

SEQ ID NO: 1363231 - RNA, 18 nt, Human
aggccgaggugggcagau

SEQ ID NO: 1363232 - RNA, 22 nt, Human
aggugggcagaucaacuaaggu

SEQ ID NO: 1363233 - RNA, 22 nt, Human
aguagaaaugggguuucaccau

SEQ ID NO: 1363234 - RNA, 23 nt, Human
aguagcugggauuacaggcaugu

SEQ ID NO: 1363235 - RNA, 18 nt, Human
agugcaauggugugaucu

SEQ ID NO: 1363236 - RNA, 22 nt, Human
aguggcuuaugccuguaauccc

SEQ ID NO: 1363237 - RNA, 24 nt, Human
aguggcuuaugccuguaaucccgg

SEQ ID NO: 1363238 - RNA, 20 nt, Human
aucaacuaaggucaggaguu

SEQ ID NO: 1363239 - RNA, 20 nt, Human
augccuguaaucccggcacu

SEQ ID NO: 1363240 - RNA, 23 nt, Human
augggguuucaccauguugguca

SEQ ID NO: 1363241 - RNA, 24 nt, Human
augggguuucaccauguuggucag

SEQ ID NO: 1363242 - RNA, 23 nt, Human
auuaauuuuuuuuuuauuauuau

SEQ ID NO: 1363243 - RNA, 24 nt, Human
auuaauuuuuuuuuuauuauuauu

SEQ ID NO: 1363244 - RNA, 18 nt, Human
auuagauuuggucagaug

SEQ ID NO: 1363245 - RNA, 18 nt, Human
caaaaugcugaguuuaca

SEQ ID NO: 1363246 - RNA, 21 nt, Human
caccauguuggucaggcuggu

SEQ ID NO: 1363247 - RNA, 23 nt, Human
caccauguuggucaggcuggucu

SEQ ID NO: 1363248 - RNA, 24 nt, Human
caccauguuggucaggcuggucuu

SEQ ID NO: 1363249 - RNA, 24 nt, Human
cacucuuguugccuaggcuggagu

SEQ ID NO: 1363250 - RNA, 24 nt, Human
cacuucaaccucccaaaaugcuga

SEQ ID NO: 1363251 - RNA, 24 nt, Human
cagaucaacuaaggucaggaguuu

SEQ ID NO: 1363252 - RNA, 24 nt, Human
cauguuggucaggcuggucuugaa

SEQ ID NO: 1363253 - RNA, 20 nt, Human
ccacuaugcccagcccaauc

SEQ ID NO: 1363254 - RNA, 26 nt, Human
ccacuucaaccucccaaagggcccuc

SEQ ID NO: 1363255 - RNA, 19 nt, Human
cccaaugcuaucccucccc

SEQ ID NO: 1363256 - RNA, 20 nt, Human
ccccaccacaguccccagaa

SEQ ID NO: 1363257 - RNA, 23 nt, Human
cccgaguagcugggauuacaggc

SEQ ID NO: 1363258 - RNA, 24 nt, Human
cccgaguagcugggauuacaggca

SEQ ID NO: 1363259 - RNA, 23 nt, Human
ccgaguagcugggauuacaggca

SEQ ID NO: 1363260 - RNA, 24 nt, Human
ccgaguagcugggauuacaggcau

SEQ ID NO: 1363261 - RNA, 19 nt, Human
ccuaggcuggagugcaaug

SEQ ID NO: 1363262 - RNA, 28 nt, Human
ccuccagcuucguucuuuuugggccgcc

SEQ ID NO: 1363263 - RNA, 19 nt, Human
ccucccccaucccccgacc

SEQ ID NO: 1363264 - RNA, 24 nt, Human
ccuccuggcuucaagagauucucc

SEQ ID NO: 1363265 - RNA, 24 nt, Human
ccugaccucaggugauccacccac

SEQ ID NO: 1363266 - RNA, 22 nt, Human
ccuguaaucccggcacuuuggg

SEQ ID NO: 1363267 - RNA, 24 nt, Human
cgaggugggcagaucaacuaaggu

SEQ ID NO: 1363268 - RNA, 26 nt, Human
cgaggugggcagaucaacuaagguca

SEQ ID NO: 1363269 - RNA, 23 nt, Human
cgcuauuuuggaucucuuucaca

SEQ ID NO: 1363270 - RNA, 24 nt, Human
cggcacuuugggaggccgaggugg

SEQ ID NO: 1363271 - RNA, 24 nt, Human
cuaacugcaaccucugccuccugg

SEQ ID NO: 1363272 - RNA, 22 nt, Human
cuaugcccagcccaaucauaug

SEQ ID NO: 1363273 - RNA, 23 nt, Human
cuauuuguaguuuauugagcauu

SEQ ID NO: 1363274 - RNA, 24 nt, Human
cucagccucccgaguagcugggau

SEQ ID NO: 1363275 - RNA, 18 nt, Human
cucccaaucuguggcuug

SEQ ID NO: 1363276 - RNA, 23 nt, Human
cucccaaugcuaucccuccccca

SEQ ID NO: 1363277 - RNA, 19 nt, Human
cucccccaucccccgaccc

SEQ ID NO: 1363278 - RNA, 23 nt, Human
cucccucagccucccgaguagcu

SEQ ID NO: 1363279 - RNA, 23 nt, Human
cucccucagccucccgaguagcu

SEQ ID NO: 1363280 - RNA, 18 nt, Human
cucuuguugccuaggcug

SEQ ID NO: 1363281 - RNA, 25 nt, Human
cugcaacaguuuuacaucuuccccu

SEQ ID NO: 1363282 - RNA, 23 nt, Human
cugcaaccucugccuccuggcuu

SEQ ID NO: 1363283 - RNA, 24 nt, Human
cugcacccacuaacucgucaucua

SEQ ID NO: 1363284 - RNA, 26 nt, Human
cuuaggauuuucuauauacaggaucc

SEQ ID NO: 1363285 - RNA, 23 nt, Human
cuuauaaucuuauagcauuugcu

SEQ ID NO: 1363286 - RNA, 21 nt, Human
cuucaagagauucuccucccu

SEQ ID NO: 1363287 - RNA, 22 nt, Human
cuuguugccuaggcuggagugc

SEQ ID NO: 1363288 - RNA, 24 nt, Human
cuuguugccuaggcuggagugcaa

SEQ ID NO: 1363289 - RNA, 21 nt, Human
cuuuauauauguuccuggauu

SEQ ID NO: 1363290 - RNA, 23 nt, Human
cuuugggaggccgaggugggcag

SEQ ID NO: 1363291 - RNA, 24 nt, Human
gaaaugggguuucaccauguuggu

SEQ ID NO: 1363292 - RNA, 19 nt, Human
gaaguccaagaucaaggug

SEQ ID NO: 1363293 - RNA, 24 nt, Human
gaccucaggugauccacccacuuc

SEQ ID NO: 1363294 - RNA, 25 nt, Human
gaguagcugggauuacaggcaugug

SEQ ID NO: 1363295 - RNA, 24 nt, Human
gaucaacuaaggucaggaguuuga

SEQ ID NO: 1363296 - RNA, 18 nt, Human
gauuacaggcaugugcca

SEQ ID NO: 1363297 - RNA, 24 nt, Human
gauuacaggcaugugccaccaugc

SEQ ID NO: 1363298 - RNA, 21 nt, Human
gauuuuuuuuuuuuuuuaaga

SEQ ID NO: 1363299 - RNA, 18 nt, Human
gauuuuuuuuuuuuuuuu

SEQ ID NO: 1363300 - RNA, 23 nt, Human
gcacuuugggaggccgagguggg

SEQ ID NO: 1363301 - RNA, 19 nt, Human
gcagcuaaaaaaucugugc

SEQ ID NO: 1363302 - RNA, 24 nt, Human
gccuaggcuggagugcaauggugu

SEQ ID NO: 1363303 - RNA, 19 nt, Human
gccuguaaucccggcacuu

SEQ ID NO: 1363304 - RNA, 25 nt, Human
gcuaaaaaaucugugcuuaacccaa

SEQ ID NO: 1363305 - RNA, 20 nt, Human
gcugaguuuacaagcuugaa

SEQ ID NO: 1363306 - RNA, 24 nt, Human
gcuggagugcaauggugugaucug

SEQ ID NO: 1363307 - RNA, 23 nt, Human
gcuggucuugaacuccugaccuc

SEQ ID NO: 1363308 - RNA, 22 nt, Human
ggaagggcaaagaggcaaaagg

SEQ ID NO: 1363309 - RNA, 24 nt, Human
ggauuacaggcaugugccaccaug

SEQ ID NO: 1363310 - RNA, 19 nt, Human
ggauuugcaaauauuuucu

SEQ ID NO: 1363311 - RNA, 18 nt, Human
ggcaaagaggcaaaagga

SEQ ID NO: 1363312 - RNA, 25 nt, Human
ggcagaucaacuaaggucaggaguu

SEQ ID NO: 1363313 - RNA, 22 nt, Human
ggcuggagugcaauggugugau

SEQ ID NO: 1363314 - RNA, 24 nt, Human
ggcuggucuugaacuccugaccuc

SEQ ID NO: 1363315 - RNA, 22 nt, Human
gggguuucaccauguuggucag

SEQ ID NO: 1363316 - RNA, 23 nt, Human
gggguuucaccauguuggucagg

SEQ ID NO: 1363317 - RNA, 19 nt, Human
ggucaggaguuugagacca

SEQ ID NO: 1363318 - RNA, 19 nt, Human
ggucuugaacuccugaccu

SEQ ID NO: 1363319 - RNA, 23 nt, Human
ggugcaguggcuuaugccuguaa

SEQ ID NO: 1363320 - RNA, 18 nt, Human
guagcugggauuacaggc

SEQ ID NO: 1363321 - RNA, 20 nt, Human
guagcugggauuacaggcau

SEQ ID NO: 1363322 - RNA, 24 nt, Human
gugauccacccacuucaaccuccc

SEQ ID NO: 1363323 - RNA, 22 nt, Human
guggaagggcaaagaggcaaaa

SEQ ID NO: 1363324 - RNA, 23 nt, Human
uaaaaguagugagacaugacuuc

SEQ ID NO: 1363325 - RNA, 23 nt, Human
uaacuauaggcuuuucauaaaug

SEQ ID NO: 1363326 - RNA, 19 nt, Human
uaacugcaaccucugccuc

SEQ ID NO: 1363327 - RNA, 21 nt, Human
uaacugcaaccucugccuccu

SEQ ID NO: 1363328 - RNA, 23 nt, Human
uaacugcaaccucugccuccugg

SEQ ID NO: 1363329 - RNA, 24 nt, Human
uaacugcaaccucugccuccuggc

SEQ ID NO: 1363330 - RNA, 18 nt, Human
uaagugggcugggugcag

SEQ ID NO: 1363331 - RNA, 21 nt, Human
uaauuuuguauuuuuaguaga

SEQ ID NO: 1363332 - RNA, 19 nt, Human
uacaauugaauugccucag

SEQ ID NO: 1363333 - RNA, 24 nt, Human
uacaggcaugugccaccaugccca

SEQ ID NO: 1363334 - RNA, 22 nt, Human
uagaaaugggguuucaccaugu

SEQ ID NO: 1363335 - RNA, 23 nt, Human
uagcaugggguauuaaauuucuu

SEQ ID NO: 1363336 - RNA, 24 nt, Human
uaguagaaaugggguuucaccaug

SEQ ID NO: 1363337 - RNA, 25 nt, Human
uaguagaaaugggguuucaccaugu

SEQ ID NO: 1363338 - RNA, 20 nt, Human
uaugccuguaaucccggcac

SEQ ID NO: 1363339 - RNA, 24 nt, Human
uaugccuguaaucccggcacuuug

SEQ ID NO: 1363340 - RNA, 23 nt, Human
uaugguguuaacuauaggcuuuu

SEQ ID NO: 1363341 - RNA, 18 nt, Human
ucaacauuuuguaguuga

SEQ ID NO: 1363342 - RNA, 19 nt, Human
ucaacuaaggucaggaguu

SEQ ID NO: 1363343 - RNA, 22 nt, Human
ucacucuuguugccuaggcugg

SEQ ID NO: 1363344 - RNA, 23 nt, Human
ucacucuuguugccuaggcugga

SEQ ID NO: 1363345 - RNA, 20 nt, Human
ucagaugcuuuuucuguacc

SEQ ID NO: 1363346 - RNA, 20 nt, Human
ucagccucccgaguagcugg

SEQ ID NO: 1363347 - RNA, 21 nt, Human
ucaugcacuggcuagaacccc

SEQ ID NO: 1363348 - RNA, 25 nt, Human
uccaagaucaaggugccaguaaggc

SEQ ID NO: 1363349 - RNA, 18 nt, Human
ucccaaugcuaucccucc

SEQ ID NO: 1363350 - RNA, 21 nt, Human
ucccccaucccccgaccccac

SEQ ID NO: 1363351 - RNA, 24 nt, Human
ucccgaguagcugggauuacaggc

SEQ ID NO: 1363352 - RNA, 24 nt, Human
ucccucagccucccgaguagcugg

SEQ ID NO: 1363353 - RNA, 24 nt, Human
ucucccaaucuguggcuugacuuu

SEQ ID NO: 1363354 - RNA, 23 nt, Human
ucucccaaugcuaucccuccccc

SEQ ID NO: 1363355 - RNA, 19 nt, Human
ucuccucccucagccuccc

SEQ ID NO: 1363356 - RNA, 23 nt, Human
ucugcaacaguuuuacaucuucc

SEQ ID NO: 1363357 - RNA, 21 nt, Human
ucuucuuugguaaaaugauga

SEQ ID NO: 1363358 - RNA, 23 nt, Human
ucuugaacuccugaccucaggug

SEQ ID NO: 1363359 - RNA, 19 nt, Human
ucuuguugccuaggcugga

SEQ ID NO: 1363360 - RNA, 19 nt, Human
ugaaccacuaugcccagcc

SEQ ID NO: 1363361 - RNA, 23 nt, Human
ugaacugacuauaaaugugaagg

SEQ ID NO: 1363362 - RNA, 21 nt, Human
ugaccucaggugauccaccca

SEQ ID NO: 1363363 - RNA, 22 nt, Human
ugaccucaggugauccacccac

SEQ ID NO: 1363364 - RNA, 24 nt, Human
ugaccucaggugauccacccacuu

SEQ ID NO: 1363365 - RNA, 19 nt, Human
ugaguguauaaaucuggua

SEQ ID NO: 1363366 - RNA, 20 nt, Human
ugagugugaguccuccagcc

SEQ ID NO: 1363367 - RNA, 23 nt, Human
ugagugugaguccuccagcuucg

SEQ ID NO: 1363368 - RNA, 20 nt, Human
ugccuaggcuggagugcaau

SEQ ID NO: 1363369 - RNA, 24 nt, Human
ugccuaggcuggagugcaauggug

SEQ ID NO: 1363370 - RNA, 23 nt, Human
ugccuguaaucccggcacuuugg

SEQ ID NO: 1363371 - RNA, 23 nt, Human
ugccuguaaucccggcacuuugg

SEQ ID NO: 1363372 - RNA, 19 nt, Human
uggagugcaauggugugau

SEQ ID NO: 1363373 - RNA, 22 nt, Human
uggagugcaauggugugaucug

SEQ ID NO: 1363374 - RNA, 23 nt, Human
uggagugcaauggugugaucugg

SEQ ID NO: 1363375 - RNA, 22 nt, Human
uggaucucuuucacaggaauuu

SEQ ID NO: 1363376 - RNA, 23 nt, Human
uggaucucuuucacaggaauuuu

SEQ ID NO: 1363377 - RNA, 20 nt, Human
uggcuuaugccuguaauccc

SEQ ID NO: 1363378 - RNA, 24 nt, Human
uggcuuaugccuguaaucccggca

SEQ ID NO: 1363379 - RNA, 20 nt, Human
uggcuucaagagauucuccu

SEQ ID NO: 1363380 - RNA, 22 nt, Human
ugggaaguccaagaucaaggug

SEQ ID NO: 1363381 - RNA, 24 nt, Human
ugggaaguccaagaucaaggugcc

SEQ ID NO: 1363382 - RNA, 20 nt, Human
ugggaggccgaggugggcag

SEQ ID NO: 1363383 - RNA, 24 nt, Human
ugggaggccgaggugggcagauca

SEQ ID NO: 1363384 - RNA, 18 nt, Human
ugggauuacaggcaugug

SEQ ID NO: 1363385 - RNA, 21 nt, Human
ugggauuacaggcaugugcca

SEQ ID NO: 1363386 - RNA, 22 nt, Human
ugggauuacaggcaugugccac

SEQ ID NO: 1363387 - RNA, 24 nt, Human
ugggauuacaggcaugugccacca

SEQ ID NO: 1363388 - RNA, 24 nt, Human
ugggcagaucaacuaaggucagga

SEQ ID NO: 1363389 - RNA, 20 nt, Human
ugggcugggugcaguggcuu

SEQ ID NO: 1363390 - RNA, 24 nt, Human
ugggguuucaccauguuggucagg

SEQ ID NO: 1363391 - RNA, 24 nt, Human
uggucaggcuggucuugaacuccu

SEQ ID NO: 1363392 - RNA, 25 nt, Human
uguauaaauucuuuuuauauguaga

SEQ ID NO: 1363393 - RNA, 20 nt, Human
ugucuucuuuaauuucucuc

SEQ ID NO: 1363394 - RNA, 23 nt, Human
ugugcagguuaguuacauaugua

SEQ ID NO: 1363395 - RNA, 22 nt, Human
uguuuugauuauuauagcuuua

SEQ ID NO: 1363396 - RNA, 21 nt, Human
uguuuugugcugcuauaacag

SEQ ID NO: 1363397 - RNA, 23 nt, Human
uuaaauuccugggauaaucccau

SEQ ID NO: 1363398 - RNA, 18 nt, Human
uuaguagaaaugggguuu

SEQ ID NO: 1363399 - RNA, 22 nt, Human
uuaguagaaaugggguuucacc

SEQ ID NO: 1363400 - RNA, 24 nt, Human
uuaguagaaaugggguuucaccau

SEQ ID NO: 1363401 - RNA, 19 nt, Human
uucaaccucccaaaaugcu

SEQ ID NO: 1363402 - RNA, 24 nt, Human
uucacucuuguugccuaggcugga

SEQ ID NO: 1363403 - RNA, 22 nt, Human
uugaaccacuaugcccagccca

SEQ ID NO: 1363404 - RNA, 19 nt, Human
uugcccauuuaaaaauggg

SEQ ID NO: 1363405 - RNA, 18 nt, Human
uugccuaggcuggagugc

SEQ ID NO: 1363406 - RNA, 25 nt, Human
uugggaggccgaggugggcagauca

SEQ ID NO: 1363407 - RNA, 25 nt, Human
uugguaaaaugaugauucaaauuuu

SEQ ID NO: 1363408 - RNA, 23 nt, Human
uuguauuuuuaguagaaaugggg

SEQ ID NO: 1363409 - RNA, 24 nt, Human
uuucaccauguuggucaggcuggu

SEQ ID NO: 1363410 - RNA, 24 nt, Human
uuucacucuuguugccuaggcugg

SEQ ID NO: 1363411 - RNA, 22 nt, Human
uuucucauugcuuuuuccugac

SEQ ID NO: 1363412 - RNA, 22 nt, Human
uuugcaaauauuuucucccaau

SEQ ID NO: 1363413 - RNA, 25 nt, Human
uuuggucagaugcuuuuucuguacc

SEQ ID NO: 1363414 - RNA, 18 nt, Human
uuuuguauuuuuaguaga

SEQ ID NO: 1363415 - RNA, 24 nt, Human
uuuuuaguagaaaugggguuucac

SEQ ID NO: 1363416 - RNA, 21 nt, Human
uuuuuuauucauuuggaauua

SEQ ID NO: 1363417 - RNA, 20 nt, Human
aaacaacaacaaaaacaaga

SEQ ID NO: 1363418 - RNA, 26 nt, Human
aacaaccuuguagaacacacaagagc

SEQ ID NO: 1363419 - RNA, 19 nt, Human
aaccaaacagguucuaaaa

SEQ ID NO: 1363420 - RNA, 23 nt, Human
aaggaaaacaacaacaaaaacaa

SEQ ID NO: 1363421 - RNA, 25 nt, Human
aaguagaaaauaaaagaaggaggga

SEQ ID NO: 1363422 - RNA, 18 nt, Human
agaaaagaaagcacugag

SEQ ID NO: 1363423 - RNA, 18 nt, Human
agaaggagggaguaagag

SEQ ID NO: 1363424 - RNA, 27 nt, Human
agaaggagggaguaagagcggacagaa

SEQ ID NO: 1363425 - RNA, 20 nt, Human
agaggccccuggggagggug

SEQ ID NO: 1363426 - RNA, 24 nt, Human
agcaagcaaugaugaacuguguaa

SEQ ID NO: 1363427 - RNA, 24 nt, Human
aguaaguagaaaauaaaagaagga

SEQ ID NO: 1363428 - RNA, 22 nt, Human
auuuauucuuaaccaaacaggu

SEQ ID NO: 1363429 - RNA, 19 nt, Human
caacaacaaaaacaagaua

SEQ ID NO: 1363430 - RNA, 23 nt, Human
caagagcccccucagagaacugg

SEQ ID NO: 1363431 - RNA, 19 nt, Human
gaaaauaaaagaaggaggg

SEQ ID NO: 1363432 - RNA, 22 nt, Human
gaacacacaagagcccccucag

SEQ ID NO: 1363433 - RNA, 23 nt, Human
gagggaguaagagcggacagaag

SEQ ID NO: 1363434 - RNA, 19 nt, Human
gagggugugucuggcagcu

SEQ ID NO: 1363435 - RNA, 27 nt, Human
guagaacacacaagagcccccucagag

SEQ ID NO: 1363436 - RNA, 18 nt, Human
uaaaagaaggagggagua

SEQ ID NO: 1363437 - RNA, 18 nt, Human
uaaccaaacagguucuaa

SEQ ID NO: 1363438 - RNA, 22 nt, Human
uaauauacaccaugaacaaccu

SEQ ID NO: 1363439 - RNA, 20 nt, Human
uagaacacacaagagccccc

SEQ ID NO: 1363440 - RNA, 21 nt, Human
ucacucugcaccugcaccgcg

SEQ ID NO: 1363441 - RNA, 24 nt, Human
ucacucugcaccugcaccgcggaa

SEQ ID NO: 1363442 - RNA, 23 nt, Human
ucagugcauauuguuaaaaggaa

SEQ ID NO: 1363443 - RNA, 26 nt, Human
uccccggaugaauagagaggccccug

SEQ ID NO: 1363444 - RNA, 19 nt, Human
ugaacaaccuuguagaaca

SEQ ID NO: 1363445 - RNA, 24 nt, Human
ugaacaaccuuguagaacacacaa

SEQ ID NO: 1363446 - RNA, 20 nt, Human
ugaggacacaaacagccagu

SEQ ID NO: 1363447 - RNA, 19 nt, Human
uggggagggugugucuggc

SEQ ID NO: 1363448 - RNA, 22 nt, Human
aaagaggaggccuggggacagc

SEQ ID NO: 1363449 - RNA, 20 nt, Human
aagaaggaaaaaugggacau

SEQ ID NO: 1363450 - RNA, 23 nt, Human
aagcagaaccacagauaauaaag

SEQ ID NO: 1363451 - RNA, 18 nt, Human
agaaccacagauaauaaa

SEQ ID NO: 1363452 - RNA, 19 nt, Human
agccccgcccucccugcac

SEQ ID NO: 1363453 - RNA, 22 nt, Human
aggccuggggacagcugaggug

SEQ ID NO: 1363454 - RNA, 19 nt, Human
auaauaaagaaagaggagg

SEQ ID NO: 1363455 - RNA, 19 nt, Human
ccccgcccucccugcaccu

SEQ ID NO: 1363456 - RNA, 23 nt, Human
cccucccugcaccugcuccugac

SEQ ID NO: 1363457 - RNA, 18 nt, Human
ccugcaccugcuccugac

SEQ ID NO: 1363458 - RNA, 18 nt, Human
ccuuccuccuuccuuucc

SEQ ID NO: 1363459 - RNA, 25 nt, Human
cgcccucccugcaccugcuccugac

SEQ ID NO: 1363460 - RNA, 22 nt, Human
gaggugcuggcgaggagggaga

SEQ ID NO: 1363461 - RNA, 24 nt, Human
gcccucccugcaccugcuccugac

SEQ ID NO: 1363462 - RNA, 27 nt, Human
ggaaaaaugggacauucaggaacuugu

SEQ ID NO: 1363463 - RNA, 23 nt, Human
ggaaaauuugccuuccuccuucc

SEQ ID NO: 1363464 - RNA, 22 nt, Human
uaggaaaguuccuaguaauuag

SEQ ID NO: 1363465 - RNA, 19 nt, Human
ucuugcacaggagguccag

SEQ ID NO: 1363466 - RNA, 22 nt, Human
ugagcugaugaggaagccccgc

SEQ ID NO: 1363467 - RNA, 22 nt, Human
ugaugaggaagccccgcccucc

SEQ ID NO: 1363468 - RNA, 21 nt, Human
ugggacauucaggaacuugua

SEQ ID NO: 1363469 - RNA, 20 nt, Human
uggggacagcugaggugcug

SEQ ID NO: 1363470 - RNA, 24 nt, Human
uuccuccuuccuuuccuaccacaa

SEQ ID NO: 1363471 - RNA, 23 nt, Human
uuugccuuccuccuuccuuuccu

SEQ ID NO: 1363472 - RNA, 19 nt, Human
cccugagaucccagcuggg

SEQ ID NO: 1363473 - RNA, 24 nt, Human
aaccugggcucucuucuuaggagc

SEQ ID NO: 1363474 - RNA, 20 nt, Human
acaaaccauccugugaagcc

SEQ ID NO: 1363475 - RNA, 20 nt, Human
acugcaccagcugcagggag

SEQ ID NO: 1363476 - RNA, 22 nt, Human
acugccucagcucagcacagcu

SEQ ID NO: 1363477 - RNA, 24 nt, Human
acugccucagcucagcacagcugc

SEQ ID NO: 1363478 - RNA, 21 nt, Human
agauggugaagguguaaccag

SEQ ID NO: 1363479 - RNA, 22 nt, Human
agcacagcugccuccuuccuca

SEQ ID NO: 1363480 - RNA, 20 nt, Human
auggugacucgacucuugag

SEQ ID NO: 1363481 - RNA, 19 nt, Human
auguggccugugacagagc

SEQ ID NO: 1363482 - RNA, 21 nt, Human
caagaagaggauccuucaggu

SEQ ID NO: 1363483 - RNA, 18 nt, Human
caagugggcuggccuucu

SEQ ID NO: 1363484 - RNA, 21 nt, Human
caccucaggcccagacugcac

SEQ ID NO: 1363485 - RNA, 24 nt, Human
cacugccucagcucagcacagcug

SEQ ID NO: 1363486 - RNA, 18 nt, Human
cagcacagcugccuccuu

SEQ ID NO: 1363487 - RNA, 23 nt, Human
cagcacagcugccuccuuccuca

SEQ ID NO: 1363488 - RNA, 24 nt, Human
cagcacagcugccuccuuccucag

SEQ ID NO: 1363489 - RNA, 22 nt, Human
caucacauccacucaaagcccu

SEQ ID NO: 1363490 - RNA, 18 nt, Human
ccauggagaagacaaacc

SEQ ID NO: 1363491 - RNA, 21 nt, Human
cccaggcuucuucaccucagg

SEQ ID NO: 1363492 - RNA, 21 nt, Human
ccccaggcuucuucaccucag

SEQ ID NO: 1363493 - RNA, 21 nt, Human
ccuccuuccucaggcuuucug

SEQ ID NO: 1363494 - RNA, 23 nt, Human
ccuccuuccucaggcuuucugga

SEQ ID NO: 1363495 - RNA, 21 nt, Human
cgacucuugagggacggguug

SEQ ID NO: 1363496 - RNA, 20 nt, Human
cgcacaguaauacacagccg

SEQ ID NO: 1363497 - RNA, 22 nt, Human
cgcacaguaauacacagccgug

SEQ ID NO: 1363498 - RNA, 21 nt, Human
cucagcucagcacagcugccu

SEQ ID NO: 1363499 - RNA, 24 nt, Human
cucgcacaguaauacacagccgug

SEQ ID NO: 1363500 - RNA, 21 nt, Human
cucggccguguccucagccuu

SEQ ID NO: 1363501 - RNA, 24 nt, Human
gagcucagcuucagggagaacugg

SEQ ID NO: 1363502 - RNA, 20 nt, Human
gagugggcaccuguugcugc

SEQ ID NO: 1363503 - RNA, 26 nt, Human
gcucagcuucagggagaagggaacgc

SEQ ID NO: 1363504 - RNA, 22 nt, Human
gcugccaucaagaagaggaucc

SEQ ID NO: 1363505 - RNA, 23 nt, Human
ggucacagagcucagcuucaggg

SEQ ID NO: 1363506 - RNA, 24 nt, Human
uaauacacagccguguccgcggcg

SEQ ID NO: 1363507 - RNA, 22 nt, Human
uaggagaccuucacugaggccc

SEQ ID NO: 1363508 - RNA, 22 nt, Human
uaggggcuucuccagaggaggg

SEQ ID NO: 1363509 - RNA, 24 nt, Human
ucaaagcccuguccaggggucuau

SEQ ID NO: 1363510 - RNA, 24 nt, Human
ugacagacguguccauggagaaga

SEQ ID NO: 1363511 - RNA, 23 nt, Human
ugauauggugacucgacucuuga

SEQ ID NO: 1363512 - RNA, 19 nt, Human
ugccucagcucagcacagc

SEQ ID NO: 1363513 - RNA, 19 nt, Human
uucagguccaguccauggu

SEQ ID NO: 1363514 - RNA, 18 nt, Human
uuccucaggcuuucugaa

SEQ ID NO: 1363515 - RNA, 24 nt, Human
uucgcacaguaauacucggccgug

SEQ ID NO: 1363516 - RNA, 21 nt, Human
aagcacucucuaagacugcuu

SEQ ID NO: 1363517 - RNA, 22 nt, Human
acugccucagcugccuugggcu

SEQ ID NO: 1363518 - RNA, 20 nt, Human
agaacaaucacagagacaaa

SEQ ID NO: 1363519 - RNA, 21 nt, Human
agccuuggcgacaggaaaaga

SEQ ID NO: 1363520 - RNA, 20 nt, Human
aggagaaaaagaauacacag

SEQ ID NO: 1363521 - RNA, 21 nt, Human
aggcaagcuggguuuuaggcu

SEQ ID NO: 1363522 - RNA, 19 nt, Human
aguagccaauagccuaaaa

SEQ ID NO: 1363523 - RNA, 26 nt, Human
agucugguggcugaggacuuacacuu

SEQ ID NO: 1363524 - RNA, 23 nt, Human
cacuuucuucuguccucucauga

SEQ ID NO: 1363525 - RNA, 20 nt, Human
caggaaaagaaaaaaaaaaa

SEQ ID NO: 1363526 - RNA, 19 nt, Human
ccccuucucuguucugacu

SEQ ID NO: 1363527 - RNA, 20 nt, Human
cccguggugcaguauaacag

SEQ ID NO: 1363528 - RNA, 22 nt, Human
ccuccaccagggccagccccaa

SEQ ID NO: 1363529 - RNA, 19 nt, Human
cggucagacccacccucuc

SEQ ID NO: 1363530 - RNA, 21 nt, Human
cuagaagcaggugaguagcaa

SEQ ID NO: 1363531 - RNA, 25 nt, Human
cuagcagcaagaagucacuuucuuc

SEQ ID NO: 1363532 - RNA, 24 nt, Human
cuccuccaccagggccagccccaa

SEQ ID NO: 1363533 - RNA, 22 nt, Human
cucucacccuugacacuccaaa

SEQ ID NO: 1363534 - RNA, 20 nt, Human
cucuguucugacuucucuca

SEQ ID NO: 1363535 - RNA, 18 nt, Human
cugggcuccuccaccagg

SEQ ID NO: 1363536 - RNA, 23 nt, Human
gaacuuaauucacuccagaacaa

SEQ ID NO: 1363537 - RNA, 18 nt, Human
gccucagcugccuugggc

SEQ ID NO: 1363538 - RNA, 20 nt, Human
gccuugggcuucaugcccug

SEQ ID NO: 1363539 - RNA, 24 nt, Human
gcgacaggaaaagaaaaaaaaaaa

SEQ ID NO: 1363540 - RNA, 19 nt, Human
ggccaaggcuuuguuagaa

SEQ ID NO: 1363541 - RNA, 22 nt, Human
gguggcugaggacuuacacuuu

SEQ ID NO: 1363542 - RNA, 22 nt, Human
uaacagucugguggcugaggac

SEQ ID NO: 1363543 - RNA, 20 nt, Human
uaacuugaagaccuggccuc

SEQ ID NO: 1363544 - RNA, 18 nt, Human
uaaguugacuuuuaauga

SEQ ID NO: 1363545 - RNA, 19 nt, Human
uagaagcaggugaguagca

SEQ ID NO: 1363546 - RNA, 22 nt, Human
uagagguucugcuguuauuucc

SEQ ID NO: 1363547 - RNA, 22 nt, Human
uagcagcaagaagucacuuucu

SEQ ID NO: 1363548 - RNA, 21 nt, Human
ucaaaacuagcagcaagaagu

SEQ ID NO: 1363549 - RNA, 20 nt, Human
ucacagagacaaagacaggc

SEQ ID NO: 1363550 - RNA, 19 nt, Human
uccuucaaaacuagcagca

SEQ ID NO: 1363551 - RNA, 19 nt, Human
ucucuguucugacuucucu

SEQ ID NO: 1363552 - RNA, 22 nt, Human
ucugcgauacaauguccuucaa

SEQ ID NO: 1363553 - RNA, 21 nt, Human
ucuuuaguucgagguagaggu

SEQ ID NO: 1363554 - RNA, 19 nt, Human
ugacacuccaaauugugcu

SEQ ID NO: 1363555 - RNA, 21 nt, Human
ugagcuagaagcaggugagua

SEQ ID NO: 1363556 - RNA, 23 nt, Human
ugcccugggcuccuccaccaggg

SEQ ID NO: 1363557 - RNA, 23 nt, Human
uggccucugcgauacaauguccu

SEQ ID NO: 1363558 - RNA, 22 nt, Human
uggcgacaggaaaagaaaaaaa

SEQ ID NO: 1363559 - RNA, 25 nt, Human
uggguuuuuuuuccccuucucuguu

SEQ ID NO: 1363560 - RNA, 19 nt, Human
uggugcaguauaacagucu

SEQ ID NO: 1363561 - RNA, 18 nt, Human
ugugcugggaguggccaa

SEQ ID NO: 1363562 - RNA, 20 nt, Human
uucucuucaugccccucuca

SEQ ID NO: 1363563 - RNA, 21 nt, Human
uugggcuucaugcccugggcu

SEQ ID NO: 1363564 - RNA, 21 nt, Human
uuuuccccuucucuguucuga

SEQ ID NO: 1363565 - RNA, 22 nt, Human
aaaaaaaaaaaaaaaagcaaag

SEQ ID NO: 1363566 - RNA, 26 nt, Human
aaaaaaaaaaaaaaaagcaaagcaaa

SEQ ID NO: 1363567 - RNA, 22 nt, Human
aaaaaaaaaaagcaaagcaaag

SEQ ID NO: 1363568 - RNA, 22 nt, Human
aaaaaagcaaagcaaagcaaag

SEQ ID NO: 1363569 - RNA, 21 nt, Human
aaaaguucuucucuagaagaa

SEQ ID NO: 1363570 - RNA, 25 nt, Human
aaacaaaaaaaauauuauuuucuga

SEQ ID NO: 1363571 - RNA, 18 nt, Human
aaacaaacaaagaaaacc

SEQ ID NO: 1363572 - RNA, 20 nt, Human
aaacaaacaaagaaaacccu

SEQ ID NO: 1363573 - RNA, 24 nt, Human
aaagugcugggauuacagguguga

SEQ ID NO: 1363574 - RNA, 19 nt, Human
aacaaagaaaacccuagcc

SEQ ID NO: 1363575 - RNA, 21 nt, Human
aagcaaagcaaagcaaaguaa

SEQ ID NO: 1363576 - RNA, 20 nt, Human
aagcaaggugugcuauugug

SEQ ID NO: 1363577 - RNA, 24 nt, Human
aagcucuaagucccuggaucagcc

SEQ ID NO: 1363578 - RNA, 22 nt, Human
aagggaagaaagcaaacugaag

SEQ ID NO: 1363579 - RNA, 20 nt, Human
aaguagcugggacuacaggc

SEQ ID NO: 1363580 - RNA, 20 nt, Human
aaguagcugggacuacaggc

SEQ ID NO: 1363581 - RNA, 24 nt, Human
aaguagcugggacuacaggcgugc

SEQ ID NO: 1363582 - RNA, 18 nt, Human
aagugcugggauuacagg

SEQ ID NO: 1363583 - RNA, 19 nt, Human
aagugcugggauuacaggu

SEQ ID NO: 1363584 - RNA, 20 nt, Human
aaugcaguggugcaaucuug

SEQ ID NO: 1363585 - RNA, 24 nt, Human
aaugcaguggugcaaucuuggcuc

SEQ ID NO: 1363586 - RNA, 22 nt, Human
accauguuggccaggauggucu

SEQ ID NO: 1363587 - RNA, 21 nt, Human
agaaaacccuagccugguucc

SEQ ID NO: 1363588 - RNA, 19 nt, Human
agaagagauccuuggggga

SEQ ID NO: 1363589 - RNA, 19 nt, Human
aggcccaaacaaacaaaga

SEQ ID NO: 1363590 - RNA, 19 nt, Human
aggugugagacaccgcgcc

SEQ ID NO: 1363591 - RNA, 24 nt, Human
aguaaacaccuccaucuuauguaa

SEQ ID NO: 1363592 - RNA, 21 nt, Human
aguaaguggucuccagugaaa

SEQ ID NO: 1363593 - RNA, 24 nt, Human
auacaaaaaaaaaaaaaaaaaaaa

SEQ ID NO: 1363594 - RNA, 22 nt, Human
aucaguuacucuccacugugaa

SEQ ID NO: 1363595 - RNA, 24 nt, Human
augugguuucaccauguuggccag

SEQ ID NO: 1363596 - RNA, 21 nt, Human
auucuccugccucagccuccc

SEQ ID NO: 1363597 - RNA, 23 nt, Human
caaacaaacaaagaaaacccuag

SEQ ID NO: 1363598 - RNA, 24 nt, Human
caaacaaacaaagaaaacccuagc

SEQ ID NO: 1363599 - RNA, 25 nt, Human
caaacugaaggcuuuaucacauuca

SEQ ID NO: 1363600 - RNA, 18 nt, Human
caaaguaaguggucucca

SEQ ID NO: 1363601 - RNA, 24 nt, Human
caaagugcugggauuacaggugug

SEQ ID NO: 1363602 - RNA, 22 nt, Human
caagcaauucuccugccucagc

SEQ ID NO: 1363603 - RNA, 27 nt, Human
caagcaauucuccugccucagccuccc

SEQ ID NO: 1363604 - RNA, 22 nt, Human
caccaccaugcccagcuaauuu

SEQ ID NO: 1363605 - RNA, 18 nt, Human
caccauguuggccaggau

SEQ ID NO: 1363606 - RNA, 22 nt, Human
caccauguuggccaggaugguc

SEQ ID NO: 1363607 - RNA, 23 nt, Human
caccauguuggccaggauggucu

SEQ ID NO: 1363608 - RNA, 24 nt, Human
caccauguuggccaggauggucuu

SEQ ID NO: 1363609 - RNA, 21 nt, Human
caccucaggaaaagccaugaa

SEQ ID NO: 1363610 - RNA, 21 nt, Human
cacucauaggguuugucucca

SEQ ID NO: 1363611 - RNA, 24 nt, Human
cacuucagccucccaaagugcugg

SEQ ID NO: 1363612 - RNA, 19 nt, Human
cagccaccucaggaaaagc

SEQ ID NO: 1363613 - RNA, 19 nt, Human
ccaaacaaacaaagaaaac

SEQ ID NO: 1363614 - RNA, 20 nt, Human
ccaaagugcugggauuacag

SEQ ID NO: 1363615 - RNA, 21 nt, Human
ccaaagugcugggauuacagg

SEQ ID NO: 1363616 - RNA, 21 nt, Human
ccaaagugcugggauuacagg

SEQ ID NO: 1363617 - RNA, 24 nt, Human
ccaaagugcugggauuacaggugu

SEQ ID NO: 1363618 - RNA, 18 nt, Human
ccacugugaacuguacaa

SEQ ID NO: 1363619 - RNA, 23 nt, Human
ccagcuaauuuuugcauuuugua

SEQ ID NO: 1363620 - RNA, 23 nt, Human
ccauaaaacccaaaaccggauuu

SEQ ID NO: 1363621 - RNA, 23 nt, Human
cccaaguagcugggacuacaggc

SEQ ID NO: 1363622 - RNA, 24 nt, Human
cccaaguagcugggacuacaggcg

SEQ ID NO: 1363623 - RNA, 23 nt, Human
cccacacuuacuacauucauaga

SEQ ID NO: 1363624 - RNA, 22 nt, Human
ccccuggcuaaaggccuuccca

SEQ ID NO: 1363625 - RNA, 26 nt, Human
ccgccuccuggguucaagcaauucuu

SEQ ID NO: 1363626 - RNA, 19 nt, Human
ccuccgccuccuggguuca

SEQ ID NO: 1363627 - RNA, 24 nt, Human
ccuccuggguucaagcaauucucc

SEQ ID NO: 1363628 - RNA, 23 nt, Human
ccugccucagccucccaaguagc

SEQ ID NO: 1363629 - RNA, 18 nt, Human
ccuggcuaaaggccuucc

SEQ ID NO: 1363630 - RNA, 23 nt, Human
ccuggguucaagcaauucuccug

SEQ ID NO: 1363631 - RNA, 24 nt, Human
cgugaucugcccacuucagccucc

SEQ ID NO: 1363632 - RNA, 23 nt, Human
cgugcaccaccaugcccagcuaa

SEQ ID NO: 1363633 - RNA, 24 nt, Human
cucagccucccaaguagcugggac

SEQ ID NO: 1363634 - RNA, 21 nt, Human
cuccuggguucaagcaauucu

SEQ ID NO: 1363635 - RNA, 22 nt, Human
cucuugaccucgugaucugccc

SEQ ID NO: 1363636 - RNA, 23 nt, Human
cugccucagccucccaaguagcu

SEQ ID NO: 1363637 - RNA, 20 nt, Human
cugcuauauacuucagcagc

SEQ ID NO: 1363638 - RNA, 19 nt, Human
cugugcgcuagaguucccc

SEQ ID NO: 1363639 - RNA, 20 nt, Human
cuucagcagccugccuuuag

SEQ ID NO: 1363640 - RNA, 19 nt, Human
gacauuuuccugauuuuuc

SEQ ID NO: 1363641 - RNA, 23 nt, Human
gaccccuggcuaaaggccuuccc

SEQ ID NO: 1363642 - RNA, 24 nt, Human
gaccucgugaucugcccacuucag

SEQ ID NO: 1363643 - RNA, 24 nt, Human
gacuacaggcgugcaccaccaugc

SEQ ID NO: 1363644 - RNA, 18 nt, Human
gauuacaggugugagaca

SEQ ID NO: 1363645 - RNA, 22 nt, Human
gauuacaggugugagacaccgc

SEQ ID NO: 1363646 - RNA, 18 nt, Human
ggaagaaagcaaacugaa

SEQ ID NO: 1363647 - RNA, 24 nt, Human
ggacuacaggcgugcaccaccaug

SEQ ID NO: 1363648 - RNA, 22 nt, Human
ggauugcugcuauauacuucag

SEQ ID NO: 1363649 - RNA, 21 nt, Human
gguuucaccauguuggccagg

SEQ ID NO: 1363650 - RNA, 21 nt, Human
guagaaaugugguuucaccau

SEQ ID NO: 1363651 - RNA, 20 nt, Human
gugaaauaccuaacuguacc

SEQ ID NO: 1363652 - RNA, 24 nt, Human
gugaucugcccacuucagccuccc

SEQ ID NO: 1363653 - RNA, 19 nt, Human
guuucaccauguuggccag

SEQ ID NO: 1363654 - RNA, 22 nt, Human
uaacagaauaaaaacguuuuga

SEQ ID NO: 1363655 - RNA, 22 nt, Human
uaacuguaccuuagggucuggu

SEQ ID NO: 1363656 - RNA, 27 nt, Human
uaaguaaacaccuccaucuuauguaaa

SEQ ID NO: 1363657 - RNA, 22 nt, Human
uaagucccuggaucagccugca

SEQ ID NO: 1363658 - RNA, 20 nt, Human
uaaguuuugacuuaacuuca

SEQ ID NO: 1363659 - RNA, 25 nt, Human
uaaucuggagaaauguuuuagccau

SEQ ID NO: 1363660 - RNA, 20 nt, Human
uaauuuuugcauuuuguaga

SEQ ID NO: 1363661 - RNA, 19 nt, Human
uaccuccgccuccuggguu

SEQ ID NO: 1363662 - RNA, 19 nt, Human
uagaguuccccacacuuac

SEQ ID NO: 1363663 - RNA, 19 nt, Human
uagccauaaaacccaaaac

SEQ ID NO: 1363664 - RNA, 19 nt, Human
ucaagcaauucuccugccu

SEQ ID NO: 1363665 - RNA, 24 nt, Human
ucaccauguuggccaggauggucu

SEQ ID NO: 1363666 - RNA, 18 nt, Human
ucacugcuaccuccgccu

SEQ ID NO: 1363667 - RNA, 23 nt, Human
ucacugcuaccuccgccuccugg

SEQ ID NO: 1363668 - RNA, 24 nt, Human
ucacugcuaccuccgccuccuggg

SEQ ID NO: 1363669 - RNA, 27 nt, Human
ucacugcuaccuccgccuccuggguuc

SEQ ID NO: 1363670 - RNA, 20 nt, Human
ucagccucccaaguagcugg

SEQ ID NO: 1363671 - RNA, 21 nt, Human
ucauacaaaaaaaaaaaaaaa

SEQ ID NO: 1363672 - RNA, 24 nt, Human
ucauacaaaaaaaaaaaaaaaaaa

SEQ ID NO: 1363673 - RNA, 23 nt, Human
uccagccaccucaggaaaagcca

SEQ ID NO: 1363674 - RNA, 23 nt, Human
ucccaaagugcugggauuacagg

SEQ ID NO: 1363675 - RNA, 24 nt, Human
ucccaaguagcugggacuacaggc

SEQ ID NO: 1363676 - RNA, 25 nt, Human
uccccacacuuacuacauucauaga

SEQ ID NO: 1363677 - RNA, 24 nt, Human
uccgccuccuggguucaagcaauu

SEQ ID NO: 1363678 - RNA, 21 nt, Human
uccuggguucaagcaauucuc

SEQ ID NO: 1363679 - RNA, 24 nt, Human
uccuggguucaagcaauucuccug

SEQ ID NO: 1363680 - RNA, 21 nt, Human
uccuugggggaaacugaauuu

SEQ ID NO: 1363681 - RNA, 21 nt, Human
ucuacagggcucaagaagggg

SEQ ID NO: 1363682 - RNA, 21 nt, Human
ucuccaaaaggaaaaccauaa

SEQ ID NO: 1363683 - RNA, 26 nt, Human
ucuccugccucagccucccaaguagc

SEQ ID NO: 1363684 - RNA, 24 nt, Human
ucugacuuuuuagcaaggucucaa

SEQ ID NO: 1363685 - RNA, 21 nt, Human
ucugcccacuucagccuccca

SEQ ID NO: 1363686 - RNA, 21 nt, Human
ucugugauggguaagugaagc

SEQ ID NO: 1363687 - RNA, 24 nt, Human
ucuugcaguguaacauagcuaucu

SEQ ID NO: 1363688 - RNA, 22 nt, Human
ugagacaccgcgcccagccucc

SEQ ID NO: 1363689 - RNA, 24 nt, Human
ugaucugcccacuucagccuccca

SEQ ID NO: 1363690 - RNA, 19 nt, Human
ugcaggcaagagagcuggg

SEQ ID NO: 1363691 - RNA, 22 nt, Human
ugcaguggugcaaucuuggcuc

SEQ ID NO: 1363692 - RNA, 21 nt, Human
ugcccaaagguuuucccacac

SEQ ID NO: 1363693 - RNA, 24 nt, Human
ugccucagccucccaaguagcugg

SEQ ID NO: 1363694 - RNA, 23 nt, Human
ugcgcuagaguuccccacacuua

SEQ ID NO: 1363695 - RNA, 24 nt, Human
ugcugggauuacaggugugagaca

SEQ ID NO: 1363696 - RNA, 24 nt, Human
uggaaugcaguggugcaaucuugg

SEQ ID NO: 1363697 - RNA, 23 nt, Human
uggagucuugcuuuguggccaug

SEQ ID NO: 1363698 - RNA, 22 nt, Human
uggauaucugcccaaagguuuu

SEQ ID NO: 1363699 - RNA, 25 nt, Human
uggcagcgucuuaacucuuggaaac

SEQ ID NO: 1363700 - RNA, 24 nt, Human
uggccaggauggucuugaucucuu

SEQ ID NO: 1363701 - RNA, 21 nt, Human
ugggacuacaggcgugcacca

SEQ ID NO: 1363702 - RNA, 24 nt, Human
ugggacuacaggcgugcaccacca

SEQ ID NO: 1363703 - RNA, 25 nt, Human
ugggacuacaggcgugcaccaccau

SEQ ID NO: 1363704 - RNA, 18 nt, Human
ugggauuacaggugugag

SEQ ID NO: 1363705 - RNA, 18 nt, Human
ugggauuacaggugugag

SEQ ID NO: 1363706 - RNA, 19 nt, Human
ugggauuacaggugugaga

SEQ ID NO: 1363707 - RNA, 21 nt, Human
ugggauuacaggugugagaca

SEQ ID NO: 1363708 - RNA, 22 nt, Human
ugggauuacaggugugagacac

SEQ ID NO: 1363709 - RNA, 23 nt, Human
ugggauuacaggugugagacacc

SEQ ID NO: 1363710 - RNA, 24 nt, Human
ugggauuacaggugugagacaccg

SEQ ID NO: 1363711 - RNA, 23 nt, Human
uggguaagugaagccauaagcca

SEQ ID NO: 1363712 - RNA, 21 nt, Human
uggguucaagcaauucuccug

SEQ ID NO: 1363713 - RNA, 23 nt, Human
uggguucaagcaauucuccugcc

SEQ ID NO: 1363714 - RNA, 24 nt, Human
uggguucaagcaauucuccugccu

SEQ ID NO: 1363715 - RNA, 23 nt, Human
uggugccaugaaaugcaucuaaa

SEQ ID NO: 1363716 - RNA, 19 nt, Human
ugguuucaccauguuggcc

SEQ ID NO: 1363717 - RNA, 18 nt, Human
ugucauauauauauauau

SEQ ID NO: 1363718 - RNA, 20 nt, Human
ugugaagaauuuauagacua

SEQ ID NO: 1363719 - RNA, 21 nt, Human
ugugauggguaagugaagcca

SEQ ID NO: 1363720 - RNA, 24 nt, Human
ugugguuucaccauguuggccagg

SEQ ID NO: 1363721 - RNA, 19 nt, Human
uguugaaugaaagaugacu

SEQ ID NO: 1363722 - RNA, 21 nt, Human
uguuuuagccauaaaacccaa

SEQ ID NO: 1363723 - RNA, 19 nt, Human
uuaaucuacacaaagacuc

SEQ ID NO: 1363724 - RNA, 20 nt, Human
uuacaggugugagacaccgc

SEQ ID NO: 1363725 - RNA, 22 nt, Human
uuagccauaaaacccaaaaccg

SEQ ID NO: 1363726 - RNA, 21 nt, Human
uucaagcaauucuccugccuc

SEQ ID NO: 1363727 - RNA, 24 nt, Human
uucaagcaauucuccugccucagc

SEQ ID NO: 1363728 - RNA, 20 nt, Human
uucccacacucauuacacuc

SEQ ID NO: 1363729 - RNA, 19 nt, Human
uugacauuuaaguuuugac

SEQ ID NO: 1363730 - RNA, 24 nt, Human
uuguagaaaugugguuucaccaug

SEQ ID NO: 1363731 - RNA, 19 nt, Human
uuucaccauguuggccagg

SEQ ID NO: 1363732 - RNA, 20 nt, Human
uuucaccauguuggccagga

SEQ ID NO: 1363733 - RNA, 19 nt, Human
uuucugauuugguugugua

SEQ ID NO: 1363734 - RNA, 19 nt, Human
uuugguuguguaaucgugg

SEQ ID NO: 1363735 - RNA, 19 nt, Human
uuuguagaaaugugguuuc

SEQ ID NO: 1363736 - RNA, 24 nt, Human
uuuguagaaaugugguuucaccau

SEQ ID NO: 1363737 - RNA, 22 nt, Human
uuuugacuuaacuucaggagau

SEQ ID NO: 1363738 - RNA, 21 nt, Human
uuuugucauauauauauauau

SEQ ID NO: 1363739 - RNA, 20 nt, Human
aaaacuugguucaaacagau

SEQ ID NO: 1363740 - RNA, 21 nt, Human
aaaagaaaacuugguucaaaa

SEQ ID NO: 1363741 - RNA, 21 nt, Human
aaagaaggcaauccgaaugaa

SEQ ID NO: 1363742 - RNA, 24 nt, Human
aaagauaucaccagaagcuacgua

SEQ ID NO: 1363743 - RNA, 18 nt, Human
aaagcuccuacaugccuu

SEQ ID NO: 1363744 - RNA, 21 nt, Human
aagaaagcuccuacaugccuu

SEQ ID NO: 1363745 - RNA, 20 nt, Human
aauagaccuguuguugcaaa

SEQ ID NO: 1363746 - RNA, 24 nt, Human
agaucauuucuggcaagaaagcuc

SEQ ID NO: 1363747 - RNA, 21 nt, Human
agcaagugggagaagaaaaga

SEQ ID NO: 1363748 - RNA, 22 nt, Human
aggacaaaugcugacuuuggca

SEQ ID NO: 1363749 - RNA, 23 nt, Human
aucacagguagaagaccugccag

SEQ ID NO: 1363750 - RNA, 23 nt, Human
caaaaccagucaaaauccuacca

SEQ ID NO: 1363751 - RNA, 20 nt, Human
caaacagaucacacaaggga

SEQ ID NO: 1363752 - RNA, 28 nt, Human
caaacagaucacacaagggaacccagga

SEQ ID NO: 1363753 - RNA, 23 nt, Human
cacaaggaaauugaaagaaggca

SEQ ID NO: 1363754 - RNA, 19 nt, Human
cacaagggaacccaggaca

SEQ ID NO: 1363755 - RNA, 30 nt, Human
cacacaaaaaucuugguaaaagaacuagaa

SEQ ID NO: 1363756 - RNA, 24 nt, Human
cagcgauguucugcuggcuguggu

SEQ ID NO: 1363757 - RNA, 20 nt, Human
ccccauguccucgcacacca

SEQ ID NO: 1363758 - RNA, 21 nt, Human
ccccauguccucgcacaccaa

SEQ ID NO: 1363759 - RNA, 19 nt, Human
gaacccaggacaaaugcug

SEQ ID NO: 1363760 - RNA, 21 nt, Human
gaagcccaaacugcugagcaa

SEQ ID NO: 1363761 - RNA, 21 nt, Human
gcgauguucugcuggcugugg

SEQ ID NO: 1363762 - RNA, 21 nt, Human
gcgauguucugcuggcugugg

SEQ ID NO: 1363763 - RNA, 21 nt, Human
gcugugguaaaaggugggagg

SEQ ID NO: 1363764 - RNA, 19 nt, Human
uaaagagaaaguuaagagu

SEQ ID NO: 1363765 - RNA, 21 nt, Human
uaggugguaccccaugucccc

SEQ ID NO: 1363766 - RNA, 18 nt, Human
ucacauccaucaccauuu

SEQ ID NO: 1363767 - RNA, 20 nt, Human
ugaaaagauaucaccagaag

SEQ ID NO: 1363768 - RNA, 22 nt, Human
uggaagcccaaacugcugagca

SEQ ID NO: 1363769 - RNA, 20 nt, Human
uggcaagaaagcuccuacau

SEQ ID NO: 1363770 - RNA, 24 nt, Human
ugggagaagaaaagaaaacuuggu

SEQ ID NO: 1363771 - RNA, 25 nt, Human
uucuuagccuugaagaagcaucuua

SEQ ID NO: 1363772 - RNA, 25 nt, Human
aaaacaaaaacaaaaagaagcagca

SEQ ID NO: 1363773 - RNA, 23 nt, Human
aaacaaaaacaaaaagaagcagc

SEQ ID NO: 1363774 - RNA, 19 nt, Human
aacauccuguccuccagga

SEQ ID NO: 1363775 - RNA, 21 nt, Human
aagggaaaaaagguuaacaaa

SEQ ID NO: 1363776 - RNA, 23 nt, Human
aauuucuaccccugucauuaaaa

SEQ ID NO: 1363777 - RNA, 18 nt, Human
acaaaaagaagcagcaac

SEQ ID NO: 1363778 - RNA, 24 nt, Human
acauccuguccuccaggaguucca

SEQ ID NO: 1363779 - RNA, 21 nt, Human
acuuauagagcuggaaagaga

SEQ ID NO: 1363780 - RNA, 24 nt, Human
agaaaauccccucuggggccugaa

SEQ ID NO: 1363781 - RNA, 19 nt, Human
agaaaugaaugacuagaua

SEQ ID NO: 1363782 - RNA, 21 nt, Human
agaaucacccagaaaaucccc

SEQ ID NO: 1363783 - RNA, 21 nt, Human
agaaucacccagaaaauccuu

SEQ ID NO: 1363784 - RNA, 19 nt, Human
caaaaagaagcagcaacuu

SEQ ID NO: 1363785 - RNA, 26 nt, Human
caaaacaaaaacaaaaagaagcagca

SEQ ID NO: 1363786 - RNA, 26 nt, Human
caaaucccuggccugaaugcaaaucu

SEQ ID NO: 1363787 - RNA, 23 nt, Human
caagcagauaucugccuggagga

SEQ ID NO: 1363788 - RNA, 25 nt, Human
cacucaaaacaaaaacaaaaagaag

SEQ ID NO: 1363789 - RNA, 22 nt, Human
cagaaaauccccucuggggccu

SEQ ID NO: 1363790 - RNA, 20 nt, Human
cagccuagggaaagucaucc

SEQ ID NO: 1363791 - RNA, 18 nt, Human
cagggucauguucugccc

SEQ ID NO: 1363792 - RNA, 22 nt, Human
ccacauguaucgcguucaucuc

SEQ ID NO: 1363793 - RNA, 19 nt, Human
ccacccaaacugaggcaaa

SEQ ID NO: 1363794 - RNA, 24 nt, Human
ccauucccaugagaggcuuuccua

SEQ ID NO: 1363795 - RNA, 18 nt, Human
cccccgagacccugccag

SEQ ID NO: 1363796 - RNA, 23 nt, Human
cccccgagacccugccagcugag

SEQ ID NO: 1363797 - RNA, 26 nt, Human
cccccgagacccugccagcugagguc

SEQ ID NO: 1363798 - RNA, 22 nt, Human
cccucuggggccugaacuucug

SEQ ID NO: 1363799 - RNA, 23 nt, Human
cgagacccugccagcugaggucc

SEQ ID NO: 1363800 - RNA, 24 nt, Human
cuaagauugguuucagaaguguca

SEQ ID NO: 1363801 - RNA, 21 nt, Human
cucaaaacaaaaacaaaaaga

SEQ ID NO: 1363802 - RNA, 21 nt, Human
cucagccuagggaaagucauc

SEQ ID NO: 1363803 - RNA, 18 nt, Human
cugaggcaaaccacaggc

SEQ ID NO: 1363804 - RNA, 21 nt, Human
cuggaacccccuuggcuaugc

SEQ ID NO: 1363805 - RNA, 24 nt, Human
cuggaacccccuuggcuaugccca

SEQ ID NO: 1363806 - RNA, 18 nt, Human
cuucaaaaaauucuguuc

SEQ ID NO: 1363807 - RNA, 22 nt, Human
cuuuuuuuuccucuuucuuaaa

SEQ ID NO: 1363808 - RNA, 27 nt, Human
gacaacuuuucaacagggaggucccac

SEQ ID NO: 1363809 - RNA, 22 nt, Human
gaucacucaaaacaaaaacaaa

SEQ ID NO: 1363810 - RNA, 20 nt, Human
gauuuuuccuucuuaaggga

SEQ ID NO: 1363811 - RNA, 19 nt, Human
gcauucucucuggggagaa

SEQ ID NO: 1363812 - RNA, 20 nt, Human
gcccuggaacccccuuggcu

SEQ ID NO: 1363813 - RNA, 19 nt, Human
ggcacuucaaaaaauucug

SEQ ID NO: 1363814 - RNA, 21 nt, Human
ggcaggacaacuuuucaacag

SEQ ID NO: 1363815 - RNA, 19 nt, Human
guuuaaagcccccgagacc

SEQ ID NO: 1363816 - RNA, 18 nt, Human
uaaaagucauucuuuccc

SEQ ID NO: 1363817 - RNA, 25 nt, Human
uaaagcccccgagacccugccagcu

SEQ ID NO: 1363818 - RNA, 20 nt, Human
uaacaaggcacuucaaaaaa

SEQ ID NO: 1363819 - RNA, 22 nt, Human
uaagggaaaaaagguuaacaaa

SEQ ID NO: 1363820 - RNA, 25 nt, Human
uaccccuaaucuuggaaaugccauu

SEQ ID NO: 1363821 - RNA, 19 nt, Human
uaucgcguucaucucucua

SEQ ID NO: 1363822 - RNA, 19 nt, Human
uaugcaagaaauaugaaca

SEQ ID NO: 1363823 - RNA, 25 nt, Human
ucacucaaaacaaaaacaaaaagaa

SEQ ID NO: 1363824 - RNA, 22 nt, Human
ucagccucuugcucccaauuuc

SEQ ID NO: 1363825 - RNA, 21 nt, Human
ucucuaguggcauucucucug

SEQ ID NO: 1363826 - RNA, 19 nt, Human
ugaaaaacauccuguccuc

SEQ ID NO: 1363827 - RNA, 20 nt, Human
ugaaaaacauccuguccucc

SEQ ID NO: 1363828 - RNA, 24 nt, Human
ugaaaaacauccuguccuccagga

SEQ ID NO: 1363829 - RNA, 24 nt, Human
ugaaacaaagaaucacccagaaaa

SEQ ID NO: 1363830 - RNA, 26 nt, Human
ugaaacaaagaaucacccagaaaauc

SEQ ID NO: 1363831 - RNA, 24 nt, Human
ugacuagauaaaugacuggaaaua

SEQ ID NO: 1363832 - RNA, 20 nt, Human
ugagguccagccauaagcag

SEQ ID NO: 1363833 - RNA, 19 nt, Human
uggaaagagacauaagccu

SEQ ID NO: 1363834 - RNA, 25 nt, Human
uggaaagagacauaagccuaugaua

SEQ ID NO: 1363835 - RNA, 23 nt, Human
uggaaaugccauucccaugagag

SEQ ID NO: 1363836 - RNA, 23 nt, Human
uggaucacucaaaacaaaaacaa

SEQ ID NO: 1363837 - RNA, 18 nt, Human
uguucugcccccucucua

SEQ ID NO: 1363838 - RNA, 20 nt, Human
uguucugcccccucucuagu

SEQ ID NO: 1363839 - RNA, 22 nt, Human
uuaaauuuugucaaggguccac

SEQ ID NO: 1363840 - RNA, 22 nt, Human
uuuaaagcccccgagacccugc

SEQ ID NO: 1363841 - RNA, 25 nt, Human
aggagcugcgcagucgcaccgagcc

SEQ ID NO: 1363842 - RNA, 24 nt, Human
cacacgcaggcuuccccgcccccu

SEQ ID NO: 1363843 - RNA, 22 nt, Human
caccgagcccggaacggacccu

SEQ ID NO: 1363844 - RNA, 22 nt, Human
cacgcaggcuuccccgcccccu

SEQ ID NO: 1363845 - RNA, 21 nt, Human
cagaaccggguccagagccgg

SEQ ID NO: 1363846 - RNA, 24 nt, Human
cagaaccggguccagagccgggga

SEQ ID NO: 1363847 - RNA, 23 nt, Human
cagagccggggagggggcgggcu

SEQ ID NO: 1363848 - RNA, 18 nt, Human
ccaccgaggaagcgccga

SEQ ID NO: 1363849 - RNA, 23 nt, Human
cccgcccccugcggggaggagac

SEQ ID NO: 1363850 - RNA, 18 nt, Human
ccgagcugcgcacacgca

SEQ ID NO: 1363851 - RNA, 19 nt, Human
cgacccggggaagccaccg

SEQ ID NO: 1363852 - RNA, 22 nt, Human
gaaccggguccagagccgggga

SEQ ID NO: 1363853 - RNA, 21 nt, Human
gaagucuccccgaacuuaccu

SEQ ID NO: 1363854 - RNA, 22 nt, Human
gcagucgcaccgagcccggaac

SEQ ID NO: 1363855 - RNA, 20 nt, Human
ggaacggacccucccacaga

SEQ ID NO: 1363856 - RNA, 24 nt, Human
gggaagccaccgaggaagcgccga

SEQ ID NO: 1363857 - RNA, 19 nt, Human
gugcaugggcugcuguggu

SEQ ID NO: 1363858 - RNA, 25 nt, Human
uauauaucuuucauuaugccaucuu

SEQ ID NO: 1363859 - RNA, 24 nt, Human
uccaagagaagacaggagacugcc

SEQ ID NO: 1363860 - RNA, 21 nt, Human
ucugugugcaugggcugcugu

SEQ ID NO: 1363861 - RNA, 21 nt, Human
uugcuaaacugucuucugcau

SEQ ID NO: 1363862 - RNA, 21 nt, Human
aaaaaaagagaaagaaaagga

SEQ ID NO: 1363863 - RNA, 20 nt, Human
aaaaaagagaaagaaaagga

SEQ ID NO: 1363864 - RNA, 23 nt, Human
aaaagagaaagaaaaggaaagag

SEQ ID NO: 1363865 - RNA, 21 nt, Human
acucugaaaaaaagagaaaga

SEQ ID NO: 1363866 - RNA, 24 nt, Human
acuguacuccagccugggcaacag

SEQ ID NO: 1363867 - RNA, 25 nt, Human
acuguacuccagccugggcaacaga

SEQ ID NO: 1363868 - RNA, 20 nt, Human
agaagaaggaggaaggaaag

SEQ ID NO: 1363869 - RNA, 18 nt, Human
agagaaagaaaaggaaag

SEQ ID NO: 1363870 - RNA, 20 nt, Human
agagaaagaaaaggaaagag

SEQ ID NO: 1363871 - RNA, 18 nt, Human
agagagaagaaggaggaa

SEQ ID NO: 1363872 - RNA, 24 nt, Human
agccugggcaacagagugcaacuc

SEQ ID NO: 1363873 - RNA, 24 nt, Human
aucgugccacuguacuccagccug

SEQ ID NO: 1363874 - RNA, 18 nt, Human
cacuguacuccagccugg

SEQ ID NO: 1363875 - RNA, 19 nt, Human
cacuguacuccagccuggg

SEQ ID NO: 1363876 - RNA, 20 nt, Human
cacuguacuccagccugggc

SEQ ID NO: 1363877 - RNA, 21 nt, Human
cacuguacuccagccugggca

SEQ ID NO: 1363878 - RNA, 23 nt, Human
cacuguacuccagccugggcaac

SEQ ID NO: 1363879 - RNA, 24 nt, Human
cacuguacuccagccugggcaaca

SEQ ID NO: 1363880 - RNA, 20 nt, Human
ccacuguacuccagccuggg

SEQ ID NO: 1363881 - RNA, 20 nt, Human
ccacuguacuccagccuggg

SEQ ID NO: 1363882 - RNA, 21 nt, Human
ccacuguacuccagccugggc

SEQ ID NO: 1363883 - RNA, 22 nt, Human
ccacuguacuccagccugggca

SEQ ID NO: 1363884 - RNA, 23 nt, Human
ccacuguacuccagccugggcaa

SEQ ID NO: 1363885 - RNA, 24 nt, Human
ccacuguacuccagccugggcaac

SEQ ID NO: 1363886 - RNA, 21 nt, Human
gcaacagagugcaacucugaa

SEQ ID NO: 1363887 - RNA, 22 nt, Human
gccacuguacuccagccugggc

SEQ ID NO: 1363888 - RNA, 23 nt, Human
gccacuguacuccagccugggca

SEQ ID NO: 1363889 - RNA, 24 nt, Human
gccacuguacuccagccugggcaa

SEQ ID NO: 1363890 - RNA, 27 nt, Human
ggcaacagagugcaacucugaaaaaaa

SEQ ID NO: 1363891 - RNA, 24 nt, Human
guacuccagccugggcaacagagu

SEQ ID NO: 1363892 - RNA, 22 nt, Human
uacuccagccugggcaacagag

SEQ ID NO: 1363893 - RNA, 24 nt, Human
uacuccagccugggcaacagagug

SEQ ID NO: 1363894 - RNA, 23 nt, Human
ucgugccacuguacuccagccug

SEQ ID NO: 1363895 - RNA, 18 nt, Human
ucugaaaaaaagagaaag

SEQ ID NO: 1363896 - RNA, 22 nt, Human
ucugaaaaaaagagaaagaaaa

SEQ ID NO: 1363897 - RNA, 20 nt, Human
ugaaaaaaagagaaagaaaa

SEQ ID NO: 1363898 - RNA, 23 nt, Human
ugaaaaaaagagaaagaaaagga

SEQ ID NO: 1363899 - RNA, 21 nt, Human
ugcaacucugaaaaaaagaga

SEQ ID NO: 1363900 - RNA, 24 nt, Human
aaaaaaaaaaaccguagcugagga

SEQ ID NO: 1363901 - RNA, 19 nt, Human
aacagagucaccuugcugg

SEQ ID NO: 1363902 - RNA, 23 nt, Human
aagaacaguugcucucuccucuc

SEQ ID NO: 1363903 - RNA, 18 nt, Human
aagcaccagggaccuaca

SEQ ID NO: 1363904 - RNA, 24 nt, Human
aagguaagcaaauagccaagacca

SEQ ID NO: 1363905 - RNA, 20 nt, Human
aagugcaguacuggaagcac

SEQ ID NO: 1363906 - RNA, 22 nt, Human
acacagcccucuccugagcccu

SEQ ID NO: 1363907 - RNA, 18 nt, Human
acagugugagccuagaau

SEQ ID NO: 1363908 - RNA, 18 nt, Human
acuggaagcaccagggac

SEQ ID NO: 1363909 - RNA, 20 nt, Human
acuggcagggucccagggcu

SEQ ID NO: 1363910 - RNA, 23 nt, Human
agauacaucuagaccagagcuga

SEQ ID NO: 1363911 - RNA, 18 nt, Human
aggaagggaaaaaaaaag

SEQ ID NO: 1363912 - RNA, 24 nt, Human
aggcagccggaacuuggucuugau

SEQ ID NO: 1363913 - RNA, 24 nt, Human
aggggugaagugcuucugccuccg

SEQ ID NO: 1363914 - RNA, 18 nt, Human
agguaagcaaauagccaa

SEQ ID NO: 1363915 - RNA, 22 nt, Human
agguucuuggcacgauuggcuu

SEQ ID NO: 1363916 - RNA, 20 nt, Human
aguacuggaagcaccaggga

SEQ ID NO: 1363917 - RNA, 22 nt, Human
augaggucaagggcagggcccc

SEQ ID NO: 1363918 - RNA, 24 nt, Human
caaaaaggaagggaaaaaaaaaga

SEQ ID NO: 1363919 - RNA, 21 nt, Human
cagcccucuccugagcccuug

SEQ ID NO: 1363920 - RNA, 21 nt, Human
cagguccuccaagaucuucuc

SEQ ID NO: 1363921 - RNA, 22 nt, Human
caguacuggaagcaccagggac

SEQ ID NO: 1363922 - RNA, 20 nt, Human
caucuagaccagagcugacc

SEQ ID NO: 1363923 - RNA, 23 nt, Human
ccaaaaaaaaaaaaaaaaaaaaa

SEQ ID NO: 1363924 - RNA, 23 nt, Human
ccccugccaaaaaaaaaaaaaaa

SEQ ID NO: 1363925 - RNA, 25 nt, Human
cccugagcugacccuuggugacccu

SEQ ID NO: 1363926 - RNA, 23 nt, Human
cccugccaaaaaaaaaaaaaaaa

SEQ ID NO: 1363927 - RNA, 19 nt, Human
cccuuccaggggcagagga

SEQ ID NO: 1363928 - RNA, 18 nt, Human
ccuagcccugagcugacc

SEQ ID NO: 1363929 - RNA, 19 nt, Human
ccucaagagcuggggcgga

SEQ ID NO: 1363930 - RNA, 20 nt, Human
ccucuuacccuuaucacuaa

SEQ ID NO: 1363931 - RNA, 18 nt, Human
ccugcgcuuuugucuuga

SEQ ID NO: 1363932 - RNA, 23 nt, Human
cuagaaugaaaugggcagagaaa

SEQ ID NO: 1363933 - RNA, 21 nt, Human
cucaucccucugggcucuagu

SEQ ID NO: 1363934 - RNA, 20 nt, Human
cucucuccucucaucccucu

SEQ ID NO: 1363935 - RNA, 23 nt, Human
cuuaucaagauccagguccucca

SEQ ID NO: 1363936 - RNA, 21 nt, Human
cuuaucacuagggcacagcug

SEQ ID NO: 1363937 - RNA, 26 nt, Human
cuugacaaggacagugugagccuaga

SEQ ID NO: 1363938 - RNA, 22 nt, Human
gaccaugggccugcaaaaagga

SEQ ID NO: 1363939 - RNA, 19 nt, Human
gaccuagugcccauagugg

SEQ ID NO: 1363940 - RNA, 19 nt, Human
gacucugaggggugaagug

SEQ ID NO: 1363941 - RNA, 18 nt, Human
gagaagaccucugcucuu

SEQ ID NO: 1363942 - RNA, 19 nt, Human
gaggucaagggcagggccc

SEQ ID NO: 1363943 - RNA, 21 nt, Human
gccaaaaaaaaaaaaaaaaaa

SEQ ID NO: 1363944 - RNA, 20 nt, Human
gccaauuccagguccacugg

SEQ ID NO: 1363945 - RNA, 18 nt, Human
gcggugcagcacuccugg

SEQ ID NO: 1363946 - RNA, 21 nt, Human
ggagcagaugaggucaagggc

SEQ ID NO: 1363947 - RNA, 22 nt, Human
ggcaaagugcaguacuggaagc

SEQ ID NO: 1363948 - RNA, 19 nt, Human
ggccuggagcccgaggggg

SEQ ID NO: 1363949 - RNA, 22 nt, Human
gggaaaaaaaaagaaagaacag

SEQ ID NO: 1363950 - RNA, 28 nt, Human
guccccugccaaaaaaaaaaaaaaaaaa

SEQ ID NO: 1363951 - RNA, 19 nt, Human
gugauggccagguucuugg

SEQ ID NO: 1363952 - RNA, 24 nt, Human
uaagccuagauacaucuagaccag

SEQ ID NO: 1363953 - RNA, 27 nt, Human
uacaguaagaggaaagggaggugguac

SEQ ID NO: 1363954 - RNA, 22 nt, Human
uagauacaucuagaccagagcu

SEQ ID NO: 1363955 - RNA, 18 nt, Human
uagcccugagcugacccu

SEQ ID NO: 1363956 - RNA, 26 nt, Human
ucaccuugcuggcagcuuuuugcgcu

SEQ ID NO: 1363957 - RNA, 18 nt, Human
ucacuagggcacagcugg

SEQ ID NO: 1363958 - RNA, 19 nt, Human
ucaggaaaugaagucaaag

SEQ ID NO: 1363959 - RNA, 21 nt, Human
uccuccaagaucuucucauca

SEQ ID NO: 1363960 - RNA, 19 nt, Human
ucugcagagagugguuggu

SEQ ID NO: 1363961 - RNA, 18 nt, Human
ugagagagcaacacagcc

SEQ ID NO: 1363962 - RNA, 19 nt, Human
ugagagagcaacacagccc

SEQ ID NO: 1363963 - RNA, 21 nt, Human
ugagccugacaucucuccucu

SEQ ID NO: 1363964 - RNA, 24 nt, Human
ugaggaaagaaggugaagaguugg

SEQ ID NO: 1363965 - RNA, 18 nt, Human
ugcuucagagggccuugc

SEQ ID NO: 1363966 - RNA, 20 nt, Human
uggaaaugguuuuuccuagc

SEQ ID NO: 1363967 - RNA, 19 nt, Human
uggcacaaguagaaagauc

SEQ ID NO: 1363968 - RNA, 20 nt, Human
uggccagguucuuggcacga

SEQ ID NO: 1363969 - RNA, 21 nt, Human
uggcuugguggcgaacaacca

SEQ ID NO: 1363970 - RNA, 22 nt, Human
uguacaaaaaagugggccccca

SEQ ID NO: 1363971 - RNA, 23 nt, Human
aaaaaacaaaaaacccaaacugc

SEQ ID NO: 1363972 - RNA, 18 nt, Human
aaaaaacccaaacugcaa

SEQ ID NO: 1363973 - RNA, 18 nt, Human
aaaaaacccaaacugcaa

SEQ ID NO: 1363974 - RNA, 21 nt, Human
aaaaaacccaaacugcaaagg

SEQ ID NO: 1363975 - RNA, 22 nt, Human
aaaaaacccaaacugcaaaggc

SEQ ID NO: 1363976 - RNA, 21 nt, Human
aaaaaagaaggagaagucugg

SEQ ID NO: 1363977 - RNA, 20 nt, Human
aaaacacacagagcaaauaa

SEQ ID NO: 1363978 - RNA, 24 nt, Human
aaaaccuugucucuccaaaaaaca

SEQ ID NO: 1363979 - RNA, 24 nt, Human
aaacgcacaucaacaaacacacaa

SEQ ID NO: 1363980 - RNA, 22 nt, Human
aaacuggaacaaggaaaaacaa

SEQ ID NO: 1363981 - RNA, 20 nt, Human
aacauggcaaaaccuugucu

SEQ ID NO: 1363982 - RNA, 19 nt, Human
aaccccggcaaugaaacuc

SEQ ID NO: 1363983 - RNA, 21 nt, Human
aagaggaguauguugccagug

SEQ ID NO: 1363984 - RNA, 24 nt, Human
aagaugcagccaaauguggaacua

SEQ ID NO: 1363985 - RNA, 20 nt, Human
aaggaaaaacaaaaaccaga

SEQ ID NO: 1363986 - RNA, 21 nt, Human
aaggaccuguacugcucaccu

SEQ ID NO: 1363987 - RNA, 23 nt, Human
acaaaaacacacagagcaaauaa

SEQ ID NO: 1363988 - RNA, 27 nt, Human
acaaaaaccagauaugguaugugucug

SEQ ID NO: 1363989 - RNA, 18 nt, Human
acacacagagcaaauaac

SEQ ID NO: 1363990 - RNA, 23 nt, Human
agaguagauaugggaagggccaa

SEQ ID NO: 1363991 - RNA, 23 nt, Human
agccugggcaacauggcaaaacc

SEQ ID NO: 1363992 - RNA, 24 nt, Human
agccugggcaacauggcaaaaccu

SEQ ID NO: 1363993 - RNA, 22 nt, Human
aggaaaaacaaaaaccagauau

SEQ ID NO: 1363994 - RNA, 22 nt, Human
aggaacaguacagaaauguggg

SEQ ID NO: 1363995 - RNA, 23 nt, Human
aggaguccgagaccagccugggc

SEQ ID NO: 1363996 - RNA, 24 nt, Human
aggcaugguggcucaugccuguaa

SEQ ID NO: 1363997 - RNA, 20 nt, Human
agggcaaaaaagaaggagaa

SEQ ID NO: 1363998 - RNA, 18 nt, Human
agguggguucagugggga

SEQ ID NO: 1363999 - RNA, 27 nt, Human
agugacagaaacuggaacaaggaaaaa

SEQ ID NO: 1364000 - RNA, 19 nt, Human
agugcacaggguuuggcaa

SEQ ID NO: 1364001 - RNA, 24 nt, Human
aguggcuguugcccuccuccagcc

SEQ ID NO: 1364002 - RNA, 25 nt, Human
auaugcacaaacgcacaucaacaaa

SEQ ID NO: 1364003 - RNA, 21 nt, Human
aucccauccuauccuuacccu

SEQ ID NO: 1364004 - RNA, 22 nt, Human
aucuguaauggagaaaacccac

SEQ ID NO: 1364005 - RNA, 19 nt, Human
augaaacucacgcauaugc

SEQ ID NO: 1364006 - RNA, 26 nt, Human
augaaacucacgcauaugcacaaacg

SEQ ID NO: 1364007 - RNA, 22 nt, Human
caaaaaacccaaacugcaaagg

SEQ ID NO: 1364008 - RNA, 18 nt, Human
caaaaaccagauauggua

SEQ ID NO: 1364009 - RNA, 21 nt, Human
caaauguggaacuaagguggg

SEQ ID NO: 1364010 - RNA, 22 nt, Human
caacauggcaaaaccuugucuc

SEQ ID NO: 1364011 - RNA, 24 nt, Human
caacauggcaaaaccuugucucuc

SEQ ID NO: 1364012 - RNA, 20 nt, Human
caacuaggcagugacagaaa

SEQ ID NO: 1364013 - RNA, 20 nt, Human
caagaugcagccaaaugugg

SEQ ID NO: 1364014 - RNA, 24 nt, Human
caaugaaacucacgcauaugcaca

SEQ ID NO: 1364015 - RNA, 19 nt, Human
cacacaacuaggcagugac

SEQ ID NO: 1364016 - RNA, 23 nt, Human
caggccaggcaugguggcucaug

SEQ ID NO: 1364017 - RNA, 18 nt, Human
caugccuguaauccuggg

SEQ ID NO: 1364018 - RNA, 24 nt, Human
cauggagcaacgccuuaugugaau

SEQ ID NO: 1364019 - RNA, 20 nt, Human
cauugaguaaagagcagggu

SEQ ID NO: 1364020 - RNA, 23 nt, Human
ccaaccccggcaaugaaacucac

SEQ ID NO: 1364021 - RNA, 27 nt, Human
ccacaauugugccccaaccccggccgg

SEQ ID NO: 1364022 - RNA, 25 nt, Human
ccaggaguccgagaccagccugggc

SEQ ID NO: 1364023 - RNA, 23 nt, Human
ccccaaccccggcaaugaaacuc

SEQ ID NO: 1364024 - RNA, 22 nt, Human
ccuacaaguccaugugugcuga

SEQ ID NO: 1364025 - RNA, 24 nt, Human
ccucauggccccaguccacaauug

SEQ ID NO: 1364026 - RNA, 21 nt, Human
ccugggcaacauggcaaaacc

SEQ ID NO: 1364027 - RNA, 24 nt, Human
ccugggcaacauggcaaaaccuug

SEQ ID NO: 1364028 - RNA, 24 nt, Human
cuaaaacucaaaccuacuacguac

SEQ ID NO: 1364029 - RNA, 24 nt, Human
cucaugccuguaauccugggauuu

SEQ ID NO: 1364030 - RNA, 23 nt, Human
cuccaaaaaacaaaaaacccaaa

SEQ ID NO: 1364031 - RNA, 24 nt, Human
cucuccaaaaaacaaaaaacccaa

SEQ ID NO: 1364032 - RNA, 22 nt, Human
cugaagucccuauagcaaccac

SEQ ID NO: 1364033 - RNA, 22 nt, Human
cugccucccaugugaccauuca

SEQ ID NO: 1364034 - RNA, 24 nt, Human
cuggaacaaggaaaaacaaaaacc

SEQ ID NO: 1364035 - RNA, 24 nt, Human
cuggaguuggcauaauucaagaug

SEQ ID NO: 1364036 - RNA, 21 nt, Human
cuguacugcucaccuauacau

SEQ ID NO: 1364037 - RNA, 18 nt, Human
cuguugcccuccuccagc

SEQ ID NO: 1364038 - RNA, 20 nt, Human
cuguugcccuccuccagccc

SEQ ID NO: 1364039 - RNA, 22 nt, Human
cuugucucuccaaaaaacaaaa

SEQ ID NO: 1364040 - RNA, 24 nt, Human
gcaaaaaagaaggagaagucugga

SEQ ID NO: 1364041 - RNA, 20 nt, Human
gcaaaaccuugucucuccaa

SEQ ID NO: 1364042 - RNA, 22 nt, Human
gccaggcaugguggcucaugcc

SEQ ID NO: 1364043 - RNA, 22 nt, Human
gcccaggaguccgagaccagcc

SEQ ID NO: 1364044 - RNA, 21 nt, Human
ggaacuaagguggguucagug

SEQ ID NO: 1364045 - RNA, 20 nt, Human
ggcaauaaaucuguaaugga

SEQ ID NO: 1364046 - RNA, 23 nt, Human
ggcuguugcccuccuccagcccu

SEQ ID NO: 1364047 - RNA, 20 nt, Human
gggaagggccaagaggagua

SEQ ID NO: 1364048 - RNA, 24 nt, Human
gggaagggccaagaggaguauguu

SEQ ID NO: 1364049 - RNA, 18 nt, Human
ggguugggccugauaagg

SEQ ID NO: 1364050 - RNA, 24 nt, Human
gguggcucaugccuguaauccugg

SEQ ID NO: 1364051 - RNA, 21 nt, Human
gguggcugcugggccuaaaac

SEQ ID NO: 1364052 - RNA, 23 nt, Human
gguggcugcugggccuaaaacuc

SEQ ID NO: 1364053 - RNA, 18 nt, Human
uaaagcucuccauauagc

SEQ ID NO: 1364054 - RNA, 25 nt, Human
uaaaucuguaauggagaaaacccac

SEQ ID NO: 1364055 - RNA, 23 nt, Human
uaaguggcucaagugauguuuau

SEQ ID NO: 1364056 - RNA, 19 nt, Human
uacccuuagagguacgugc

SEQ ID NO: 1364057 - RNA, 23 nt, Human
uacguaaacuugacauacguagu

SEQ ID NO: 1364058 - RNA, 18 nt, Human
uacguagggcccaaaggu

SEQ ID NO: 1364059 - RNA, 19 nt, Human
uaguugacacauaauaauu

SEQ ID NO: 1364060 - RNA, 23 nt, Human
uauagcaaccaccuuacucuuca

SEQ ID NO: 1364061 - RNA, 25 nt, Human
uauuaaaaacccaaauugcaggcca

SEQ ID NO: 1364062 - RNA, 23 nt, Human
uauuccucucuguuucuuugccc

SEQ ID NO: 1364063 - RNA, 21 nt, Human
ucacccucuucccaugcuccc

SEQ ID NO: 1364064 - RNA, 20 nt, Human
ucagcucacccucuucccuc

SEQ ID NO: 1364065 - RNA, 22 nt, Human
ucaugugacauauuccagcugu

SEQ ID NO: 1364066 - RNA, 23 nt, Human
uccaaaaaacaaaaaacccaaac

SEQ ID NO: 1364067 - RNA, 20 nt, Human
uccaugugugcugaaguccc

SEQ ID NO: 1364068 - RNA, 22 nt, Human
ucccaugugaccauucacccga

SEQ ID NO: 1364069 - RNA, 23 nt, Human
ucccuauagcaaccaccuuacuc

SEQ ID NO: 1364070 - RNA, 18 nt, Human
ucccugaggggauaaagc

SEQ ID NO: 1364071 - RNA, 23 nt, Human
ucgaugccaauacagagugcaca

SEQ ID NO: 1364072 - RNA, 23 nt, Human
ucuccaaaaaacaaaaaacccaa

SEQ ID NO: 1364073 - RNA, 23 nt, Human
ucuguaauggagaaaaccggggc

SEQ ID NO: 1364074 - RNA, 24 nt, Human
ugaaagaaccuggaggcuauuaaa

SEQ ID NO: 1364075 - RNA, 22 nt, Human
ugacagaaacuggaacaaggaa

SEQ ID NO: 1364076 - RNA, 18 nt, Human
ugacuagcugagcgacaa

SEQ ID NO: 1364077 - RNA, 23 nt, Human
ugagcccaggaguccgagaccag

SEQ ID NO: 1364078 - RNA, 24 nt, Human
ugccccaaccccggcaaugaaacu

SEQ ID NO: 1364079 - RNA, 20 nt, Human
uggaacaaggaaaaacaaaa

SEQ ID NO: 1364080 - RNA, 22 nt, Human
uggaacaaggaaaaacaaaaac

SEQ ID NO: 1364081 - RNA, 22 nt, Human
uggcucaugccuguaauccugg

SEQ ID NO: 1364082 - RNA, 21 nt, Human
uggcuugagcccaggaguccg

SEQ ID NO: 1364083 - RNA, 21 nt, Human
ugggaagggccaagaggagua

SEQ ID NO: 1364084 - RNA, 19 nt, Human
ugguaauagauaugaacac

SEQ ID NO: 1364085 - RNA, 22 nt, Human
ugguggcucaugccuguaaucc

SEQ ID NO: 1364086 - RNA, 27 nt, Human
ugucccuguugcuaucaggugauugau

SEQ ID NO: 1364087 - RNA, 21 nt, Human
ugugucuggggaaagaggggu

SEQ ID NO: 1364088 - RNA, 22 nt, Human
uuacauaucaaggaccuguacu

SEQ ID NO: 1364089 - RNA, 20 nt, Human
uuaugugaauauuccucucu

SEQ ID NO: 1364090 - RNA, 25 nt, Human
uucaaagugaaaauauuugcuucuu

SEQ ID NO: 1364091 - RNA, 20 nt, Human
uucccaugcucccucccugg

SEQ ID NO: 1364092 - RNA, 21 nt, Human
uugguaauagauaugaacacc

SEQ ID NO: 1364093 - RNA, 24 nt, Human
aaagugcugggauuauaggcguga

SEQ ID NO: 1364094 - RNA, 20 nt, Human
aaccucugccuccuggcuuc

SEQ ID NO: 1364095 - RNA, 19 nt, Human
aagugcugggauuauaggc

SEQ ID NO: 1364096 - RNA, 19 nt, Human
aagugcugggauuauaggc

SEQ ID NO: 1364097 - RNA, 26 nt, Human
aagugcugggauuauaggcgugagcc

SEQ ID NO: 1364098 - RNA, 21 nt, Human
acaggcacucaccaccaugcc

SEQ ID NO: 1364099 - RNA, 24 nt, Human
acccuggaucccuccuccccaccu

SEQ ID NO: 1364100 - RNA, 23 nt, Human
accucagccucccaaagugcugg

SEQ ID NO: 1364101 - RNA, 18 nt, Human
acgcugcaggcaccaccu

SEQ ID NO: 1364102 - RNA, 18 nt, Human
acgggguuucuccauguu

SEQ ID NO: 1364103 - RNA, 19 nt, Human
acgggguuucuccauguug

SEQ ID NO: 1364104 - RNA, 24 nt, Human
acgggguuucuccauguugcccag

SEQ ID NO: 1364105 - RNA, 21 nt, Human
acugacacccuucuggugguc

SEQ ID NO: 1364106 - RNA, 23 nt, Human
acugcaaccucugccuccuggcu

SEQ ID NO: 1364107 - RNA, 21 nt, Human
agagaaaggguggaggcugcc

SEQ ID NO: 1364108 - RNA, 23 nt, Human
agauguauuuuuguuuuuuucuc

SEQ ID NO: 1364109 - RNA, 20 nt, Human
agcagguggagcauccaagc

SEQ ID NO: 1364110 - RNA, 24 nt, Human
aggugauccgcccaccucagccuc

SEQ ID NO: 1364111 - RNA, 20 nt, Human
agguggcccaaggguagagg

SEQ ID NO: 1364112 - RNA, 19 nt, Human
agguugccaggccuugccc

SEQ ID NO: 1364113 - RNA, 21 nt, Human
aguagcugggauuacaggcac

SEQ ID NO: 1364114 - RNA, 20 nt, Human
agugauucuccugccucagc

SEQ ID NO: 1364115 - RNA, 24 nt, Human
agugauucuccugccucagccucc

SEQ ID NO: 1364116 - RNA, 24 nt, Human
caaagugcugggauuauaggcgug

SEQ ID NO: 1364117 - RNA, 23 nt, Human
caacagccugucccaaauagccu

SEQ ID NO: 1364118 - RNA, 23 nt, Human
cacccuggaucccuccuccccac

SEQ ID NO: 1364119 - RNA, 25 nt, Human
cacccuggaucccuccuccccaccu

SEQ ID NO: 1364120 - RNA, 25 nt, Human
caccgaguuagcuggggagcucacu

SEQ ID NO: 1364121 - RNA, 26 nt, Human
caccugcuccugccacggccccucug

SEQ ID NO: 1364122 - RNA, 21 nt, Human
cacugacacccuucugguggu

SEQ ID NO: 1364123 - RNA, 18 nt, Human
cacugcaaccucugccuc

SEQ ID NO: 1364124 - RNA, 21 nt, Human
cacugcaaccucugccuccug

SEQ ID NO: 1364125 - RNA, 20 nt, Human
cacugccccgagauacgaga

SEQ ID NO: 1364126 - RNA, 18 nt, Human
cagcaacagccuguccca

SEQ ID NO: 1364127 - RNA, 20 nt, Human
cagcacuugggcagcaggug

SEQ ID NO: 1364128 - RNA, 21 nt, Human
cagcacuugggcagcaggugg

SEQ ID NO: 1364129 - RNA, 26 nt, Human
cagcagguggagcauccaagccuccu

SEQ ID NO: 1364130 - RNA, 23 nt, Human
cagcugcuggggcuggugggggu

SEQ ID NO: 1364131 - RNA, 23 nt, Human
caucucugaccccguucuugucu

SEQ ID NO: 1364132 - RNA, 23 nt, Human
cauguugcccaggcuggucucaa

SEQ ID NO: 1364133 - RNA, 24 nt, Human
cauguugcccaggcuggucucaaa

SEQ ID NO: 1364134 - RNA, 21 nt, Human
cauugggcuuugcaggccagg

SEQ ID NO: 1364135 - RNA, 22 nt, Human
ccaaagugcugggauuauaggc

SEQ ID NO: 1364136 - RNA, 24 nt, Human
ccaaagugcugggauuauaggcgu

SEQ ID NO: 1364137 - RNA, 23 nt, Human
ccaagccuccuguggccacgggc

SEQ ID NO: 1364138 - RNA, 19 nt, Human
ccacaaggacccccuccuc

SEQ ID NO: 1364139 - RNA, 24 nt, Human
ccacagccugauucucugaucugg

SEQ ID NO: 1364140 - RNA, 21 nt, Human
ccaccacccacuucuucuaag

SEQ ID NO: 1364141 - RNA, 18 nt, Human
ccagagccuggcacagag

SEQ ID NO: 1364142 - RNA, 18 nt, Human
ccaggcuggagugaaaug

SEQ ID NO: 1364143 - RNA, 24 nt, Human
ccauguugcccaggcuggucucaa

SEQ ID NO: 1364144 - RNA, 23 nt, Human
cccaaggguagagggcagagcac

SEQ ID NO: 1364145 - RNA, 21 nt, Human
ccccagaggcuuugguuucag

SEQ ID NO: 1364146 - RNA, 22 nt, Human
ccccggcccgagugcagaccuc

SEQ ID NO: 1364147 - RNA, 23 nt, Human
cccgaccccagcacuugggcagc

SEQ ID NO: 1364148 - RNA, 23 nt, Human
cccgaguagcugggauuacaggc

SEQ ID NO: 1364149 - RNA, 24 nt, Human
cccgaguagcugggauuacaggca

SEQ ID NO: 1364150 - RNA, 26 nt, Human
cccuccuccccaccugccacccgagg

SEQ ID NO: 1364151 - RNA, 20 nt, Human
cccugagccacccacucuuc

SEQ ID NO: 1364152 - RNA, 20 nt, Human
cccuggaucccuccucccca

SEQ ID NO: 1364153 - RNA, 22 nt, Human
cccuuuuccucagcaguguccc

SEQ ID NO: 1364154 - RNA, 23 nt, Human
ccgaguagcugggauuacaggca

SEQ ID NO: 1364155 - RNA, 26 nt, Human
ccgcccaccucagccucccaaagugc

SEQ ID NO: 1364156 - RNA, 19 nt, Human
ccgcccgccuccuggcugc

SEQ ID NO: 1364157 - RNA, 24 nt, Human
ccuccuggcuucuagugauucucc

SEQ ID NO: 1364158 - RNA, 21 nt, Human
ccucuuuaauaaaaagggugu

SEQ ID NO: 1364159 - RNA, 24 nt, Human
ccugaacucaggugauccgcccac

SEQ ID NO: 1364160 - RNA, 23 nt, Human
ccuggcuucuagugauucuccug

SEQ ID NO: 1364161 - RNA, 20 nt, Human
ccugggcacugaggggcugu

SEQ ID NO: 1364162 - RNA, 23 nt, Human
ccuggucaaagccuccuuuuucc

SEQ ID NO: 1364163 - RNA, 20 nt, Human
ccuuugagagccaaggugga

SEQ ID NO: 1364164 - RNA, 19 nt, Human
cgcugcaggcaccaccugc

SEQ ID NO: 1364165 - RNA, 20 nt, Human
cgcugcaggcaccaccugcu

SEQ ID NO: 1364166 - RNA, 23 nt, Human
cggacagauggacagaugaauca

SEQ ID NO: 1364167 - RNA, 24 nt, Human
cgggguuucuccauguugcccagg

SEQ ID NO: 1364168 - RNA, 21 nt, Human
cguggccacaaggacccccuc

SEQ ID NO: 1364169 - RNA, 27 nt, Human
cuagugauucuccugccucagccuccc

SEQ ID NO: 1364170 - RNA, 24 nt, Human
cucacugcaaccucugccuccugg

SEQ ID NO: 1364171 - RNA, 23 nt, Human
cucagccucccgaguagcuggga

SEQ ID NO: 1364172 - RNA, 19 nt, Human
cuccauguugcccaggcug

SEQ ID NO: 1364173 - RNA, 24 nt, Human
cuccauguugcccaggcuggucuc

SEQ ID NO: 1364174 - RNA, 18 nt, Human
cuccugccacggccccuc

SEQ ID NO: 1364175 - RNA, 22 nt, Human
cuccugccucagccucccgagu

SEQ ID NO: 1364176 - RNA, 23 nt, Human
cuccugcggguggcagcgggggc

SEQ ID NO: 1364177 - RNA, 20 nt, Human
cuccuuuuuccacccgcucc

SEQ ID NO: 1364178 - RNA, 21 nt, Human
cucuuguuguccaggcuggag

SEQ ID NO: 1364179 - RNA, 19 nt, Human
cugcaaccucugccuccug

SEQ ID NO: 1364180 - RNA, 23 nt, Human
cugcaaccucugccuccuggcuu

SEQ ID NO: 1364181 - RNA, 23 nt, Human
cugccucagccucccgaguagcu

SEQ ID NO: 1364182 - RNA, 27 nt, Human
cuggaauaaaugaaccaaacucaggug

SEQ ID NO: 1364183 - RNA, 19 nt, Human
cuggggcuggugggggugg

SEQ ID NO: 1364184 - RNA, 25 nt, Human
cugucccuaugggagaacauuuugu

SEQ ID NO: 1364185 - RNA, 22 nt, Human
cuugcucuuguuguccaggcug

SEQ ID NO: 1364186 - RNA, 24 nt, Human
cuugcucuuguuguccaggcugga

SEQ ID NO: 1364187 - RNA, 26 nt, Human
gaaaagagggacacagucuuugucgg

SEQ ID NO: 1364188 - RNA, 23 nt, Human
gaaacgggguuucuccauguugc

SEQ ID NO: 1364189 - RNA, 24 nt, Human
gaacucaggugauccgcccaccuc

SEQ ID NO: 1364190 - RNA, 18 nt, Human
gacacccuucuggugguc

SEQ ID NO: 1364191 - RNA, 19 nt, Human
gacagcaacagccuguccc

SEQ ID NO: 1364192 - RNA, 22 nt, Human
gacagcaacagccugucccaaa

SEQ ID NO: 1364193 - RNA, 19 nt, Human
gaccugggcacugaggggc

SEQ ID NO: 1364194 - RNA, 27 nt, Human
gagaacaauggaaaggacgcugcaggc

SEQ ID NO: 1364195 - RNA, 20 nt, Human
gaggcugucguggccacaag

SEQ ID NO: 1364196 - RNA, 25 nt, Human
gaguagcugggauuacaggcacuca

SEQ ID NO: 1364197 - RNA, 20 nt, Human
gaucccuccuccccaccugc

SEQ ID NO: 1364198 - RNA, 21 nt, Human
gaucugccgucccaucggggg

SEQ ID NO: 1364199 - RNA, 24 nt, Human
gauuacaggcacucaccaccaugc

SEQ ID NO: 1364200 - RNA, 18 nt, Human
gauuauaggcgugagcca

SEQ ID NO: 1364201 - RNA, 21 nt, Human
gauuauaggcgugagccaccg

SEQ ID NO: 1364202 - RNA, 24 nt, Human
gauuauaggcgugagccaccguac

SEQ ID NO: 1364203 - RNA, 25 nt, Human
gcagaaggggagggagcccaauccg

SEQ ID NO: 1364204 - RNA, 22 nt, Human
gcaggggucggaggcugagugu

SEQ ID NO: 1364205 - RNA, 23 nt, Human
gccacgggcuucaccccacccug

SEQ ID NO: 1364206 - RNA, 20 nt, Human
gccaggugggcucugcagug

SEQ ID NO: 1364207 - RNA, 20 nt, Human
gccucagccucccgaguagc

SEQ ID NO: 1364208 - RNA, 23 nt, Human
gccuggcuaauuuuuuguauuuu

SEQ ID NO: 1364209 - RNA, 21 nt, Human
gcucacugcaaccucugccuc

SEQ ID NO: 1364210 - RNA, 21 nt, Human
gcucuuguuguccaggcugga

SEQ ID NO: 1364211 - RNA, 18 nt, Human
gcugcaggcaccaccugc

SEQ ID NO: 1364212 - RNA, 20 nt, Human
gcugcuggggcugguggggg

SEQ ID NO: 1364213 - RNA, 24 nt, Human
ggacagauggacagaugaaucaaa

SEQ ID NO: 1364214 - RNA, 21 nt, Human
ggagcauccaagccuccugug

SEQ ID NO: 1364215 - RNA, 18 nt, Human
ggaucccuccuccccacc

SEQ ID NO: 1364216 - RNA, 20 nt, Human
ggcagagcacccccaguggg

SEQ ID NO: 1364217 - RNA, 21 nt, Human
ggcagcugcaggggucggagg

SEQ ID NO: 1364218 - RNA, 21 nt, Human
gggcagcagguggcccaaggg

SEQ ID NO: 1364219 - RNA, 19 nt, Human
ggggagggagcccaauccg

SEQ ID NO: 1364220 - RNA, 18 nt, Human
ggggggcagcugcagggg

SEQ ID NO: 1364221 - RNA, 23 nt, Human
gggguuucuccauguugcccagg

SEQ ID NO: 1364222 - RNA, 23 nt, Human
ggucggaggcugagugugucagg

SEQ ID NO: 1364223 - RNA, 20 nt, Human
gguugguggggggcagcugc

SEQ ID NO: 1364224 - RNA, 24 nt, Human
gugauccgcccaccucagccuccc

SEQ ID NO: 1364225 - RNA, 24 nt, Human
gugauucuccugccucagccuccc

SEQ ID NO: 1364226 - RNA, 22 nt, Human
guggccacgggcuucaccccac

SEQ ID NO: 1364227 - RNA, 22 nt, Human
guuucaggcugugucugucccc

SEQ ID NO: 1364228 - RNA, 18 nt, Human
uaaagcagcugcuggggc

SEQ ID NO: 1364229 - RNA, 22 nt, Human
uaauuuuuuguauuuuuaguag

SEQ ID NO: 1364230 - RNA, 24 nt, Human
uaguagaaacgggguuucuccaug

SEQ ID NO: 1364231 - RNA, 20 nt, Human
ucaacacaauguacccacag

SEQ ID NO: 1364232 - RNA, 21 nt, Human
ucacagggccuagggcgggcg

SEQ ID NO: 1364233 - RNA, 19 nt, Human
ucacugcaaccucugccuc

SEQ ID NO: 1364234 - RNA, 23 nt, Human
ucacugcaaccucugccuccugg

SEQ ID NO: 1364235 - RNA, 24 nt, Human
ucacugcaaccucugccuccuggc

SEQ ID NO: 1364236 - RNA, 18 nt, Human
ucagccucccaaagugcu

SEQ ID NO: 1364237 - RNA, 20 nt, Human
ucagccucccgaguagcugg

SEQ ID NO: 1364238 - RNA, 24 nt, Human
ucccaaagugcugggauuauaggc

SEQ ID NO: 1364239 - RNA, 19 nt, Human
ucccaaauagccuucccgu

SEQ ID NO: 1364240 - RNA, 24 nt, Human
ucccgaguagcugggauuacaggc

SEQ ID NO: 1364241 - RNA, 26 nt, Human
ucccucuuuaauaaaaagggugucca

SEQ ID NO: 1364242 - RNA, 23 nt, Human
uccgcacggugacacuuuugggg

SEQ ID NO: 1364243 - RNA, 21 nt, Human
uccgcccaccucagccuccca

SEQ ID NO: 1364244 - RNA, 21 nt, Human
uccugcggguggcagcggggg

SEQ ID NO: 1364245 - RNA, 20 nt, Human
uccuuuuuccacccgcuccu

SEQ ID NO: 1364246 - RNA, 25 nt, Human
ucgagauggagaaaagagggacaca

SEQ ID NO: 1364247 - RNA, 25 nt, Human
ucuaagucagggcugaggagaaauc

SEQ ID NO: 1364248 - RNA, 26 nt, Human
ucuaagucagggcugaggagaaaucc

SEQ ID NO: 1364249 - RNA, 23 nt, Human
ucuagugauucuccugccucagc

SEQ ID NO: 1364250 - RNA, 24 nt, Human
ucucaacacaauguacccacagcc

SEQ ID NO: 1364251 - RNA, 19 nt, Human
ucugcagugacucuucagg

SEQ ID NO: 1364252 - RNA, 23 nt, Human
ucuugcucuuguuguccaggcug

SEQ ID NO: 1364253 - RNA, 24 nt, Human
ucuugcucuuguuguccaggcugg

SEQ ID NO: 1364254 - RNA, 25 nt, Human
ucuugcucuuguuguccaggcugga

SEQ ID NO: 1364255 - RNA, 18 nt, Human
ugaacucaggugauccgc

SEQ ID NO: 1364256 - RNA, 20 nt, Human
ugaauggugggguugguggg

SEQ ID NO: 1364257 - RNA, 24 nt, Human
ugauccgcccaccucagccuccca

SEQ ID NO: 1364258 - RNA, 20 nt, Human
ugauucuccugccucagccu

SEQ ID NO: 1364259 - RNA, 21 nt, Human
ugcagcuggaauaaaugaacc

SEQ ID NO: 1364260 - RNA, 25 nt, Human
ugcauuuggucggagggcuguaggu

SEQ ID NO: 1364261 - RNA, 26 nt, Human
ugccagcuuggggaggcccagggacg

SEQ ID NO: 1364262 - RNA, 24 nt, Human
ugcccaggcuggucucaaacuccu

SEQ ID NO: 1364263 - RNA, 24 nt, Human
ugccucagccucccgaguagcugg

SEQ ID NO: 1364264 - RNA, 20 nt, Human
ugcucggcagacagcaacag

SEQ ID NO: 1364265 - RNA, 24 nt, Human
ugcucuuguuguccaggcuggagu

SEQ ID NO: 1364266 - RNA, 18 nt, Human
ugcuggggcugguggggg

SEQ ID NO: 1364267 - RNA, 23 nt, Human
ugcuggggcugguggggguggag

SEQ ID NO: 1364268 - RNA, 20 nt, Human
uggaaaggacgcugcaggca

SEQ ID NO: 1364269 - RNA, 20 nt, Human
uggaagcugcagggaaggga

SEQ ID NO: 1364270 - RNA, 22 nt, Human
uggaauaaaugaaccaaacuca

SEQ ID NO: 1364271 - RNA, 22 nt, Human
uggagaaaagagggacacaguc

SEQ ID NO: 1364272 - RNA, 21 nt, Human
uggcugcccacuguccaucua

SEQ ID NO: 1364273 - RNA, 20 nt, Human
uggcuucuagugauucuccu

SEQ ID NO: 1364274 - RNA, 19 nt, Human
ugggauuacaggcacucac

SEQ ID NO: 1364275 - RNA, 21 nt, Human
ugggauuacaggcacucacca

SEQ ID NO: 1364276 - RNA, 22 nt, Human
ugggauuacaggcacucaccac

SEQ ID NO: 1364277 - RNA, 24 nt, Human
ugggauuacaggcacucaccacca

SEQ ID NO: 1364278 - RNA, 18 nt, Human
ugggauuauaggcgugag

SEQ ID NO: 1364279 - RNA, 21 nt, Human
ugggauuauaggcgugagcca

SEQ ID NO: 1364280 - RNA, 22 nt, Human
ugggauuauaggcgugagccac

SEQ ID NO: 1364281 - RNA, 23 nt, Human
ugggauuauaggcgugagccacc

SEQ ID NO: 1364282 - RNA, 23 nt, Human
ugggauuauaggcgugagccacc

SEQ ID NO: 1364283 - RNA, 24 nt, Human
ugggauuauaggcgugagccaccg

SEQ ID NO: 1364284 - RNA, 19 nt, Human
uggggcuggugggggugga

SEQ ID NO: 1364285 - RNA, 22 nt, Human
uggggcugguggggguggaggc

SEQ ID NO: 1364286 - RNA, 18 nt, Human
ugggguugguggggggca

SEQ ID NO: 1364287 - RNA, 19 nt, Human
ugggguugguggggggcag

SEQ ID NO: 1364288 - RNA, 24 nt, Human
ugguggggggcagcugcagggguc

SEQ ID NO: 1364289 - RNA, 20 nt, Human
uggugggguugguggggggc

SEQ ID NO: 1364290 - RNA, 21 nt, Human
uguccaggcuggagugaaaug

SEQ ID NO: 1364291 - RNA, 24 nt, Human
uguccaggcuggagugaaauggca

SEQ ID NO: 1364292 - RNA, 21 nt, Human
ugugaccgaccaccacuuacc

SEQ ID NO: 1364293 - RNA, 19 nt, Human
uguugucggggcgccagcu

SEQ ID NO: 1364294 - RNA, 22 nt, Human
uuaguagaaacgggguuucucc

SEQ ID NO: 1364295 - RNA, 24 nt, Human
uuaguagaaacgggguuucuccau

SEQ ID NO: 1364296 - RNA, 19 nt, Human
uucagagcaugcauuaaag

SEQ ID NO: 1364297 - RNA, 20 nt, Human
uucgagauggagaaaagagg

SEQ ID NO: 1364298 - RNA, 18 nt, Human
uucuagugauucuccugc

SEQ ID NO: 1364299 - RNA, 23 nt, Human
uucuagugauucuccugccucag

SEQ ID NO: 1364300 - RNA, 26 nt, Human
uucucccuuuuccucagcaguguccc

SEQ ID NO: 1364301 - RNA, 23 nt, Human
uugcucuuguuguccaggcugga

SEQ ID NO: 1364302 - RNA, 18 nt, Human
uugguggggggcagcugc

SEQ ID NO: 1364303 - RNA, 23 nt, Human
uuguauuuuuaguagaaacgggg

SEQ ID NO: 1364304 - RNA, 21 nt, Human
uuguccaggcuggagugaaau

SEQ ID NO: 1364305 - RNA, 20 nt, Human
uugucggggcgccagcuguc

SEQ ID NO: 1364306 - RNA, 21 nt, Human
uuguuguccaggcuggaguga

SEQ ID NO: 1364307 - RNA, 23 nt, Human
uuucuccauguugcccaggcugg

SEQ ID NO: 1364308 - RNA, 19 nt, Human
uuuuuguauuuuuaguaga

SEQ ID NO: 1364309 - RNA, 20 nt, Human
uuuuuguuuuuuucucccuu

SEQ ID NO: 1364310 - RNA, 18 nt, Human
uuuuuuguauuuuuagua

SEQ ID NO: 1364311 - RNA, 24 nt, Human
aaaaggcaggacagaauuacaaug

SEQ ID NO: 1364312 - RNA, 19 nt, Human
aaaauccacccgagugcac

SEQ ID NO: 1364313 - RNA, 19 nt, Human
aaacccacagaaaauccac

SEQ ID NO: 1364314 - RNA, 18 nt, Human
aaaggcugcucaggcagg

SEQ ID NO: 1364315 - RNA, 18 nt, Human
aaaguccuucagcuucuc

SEQ ID NO: 1364316 - RNA, 18 nt, Human
aaauggagggacugccca

SEQ ID NO: 1364317 - RNA, 21 nt, Human
aaccaggaaggagccauagcc

SEQ ID NO: 1364318 - RNA, 23 nt, Human
aaccaggaaggagccauagccca

SEQ ID NO: 1364319 - RNA, 21 nt, Human
aacccugguucccccagcccc

SEQ ID NO: 1364320 - RNA, 28 nt, Human
aagagcagcaaggagcugaccgguaccc

SEQ ID NO: 1364321 - RNA, 19 nt, Human
aagcggcuguuugaggagc

SEQ ID NO: 1364322 - RNA, 22 nt, Human
aagcugacacccgcuguccuga

SEQ ID NO: 1364323 - RNA, 21 nt, Human
aagcuggucuccacacagugc

SEQ ID NO: 1364324 - RNA, 19 nt, Human
aaggagacgcgcugcugcu

SEQ ID NO: 1364325 - RNA, 21 nt, Human
aaggagacgcgcugcugcugc

SEQ ID NO: 1364326 - RNA, 20 nt, Human
acacaugcacacauggcuac

SEQ ID NO: 1364327 - RNA, 18 nt, Human
acaugggggucaggcaag

SEQ ID NO: 1364328 - RNA, 21 nt, Human
acccacagaaaauccacccga

SEQ ID NO: 1364329 - RNA, 23 nt, Human
acccagagccucacuuguucagg

SEQ ID NO: 1364330 - RNA, 23 nt, Human
acccgagugcacugagcacgcca

SEQ ID NO: 1364331 - RNA, 21 nt, Human
acccugguucccccagccccc

SEQ ID NO: 1364332 - RNA, 21 nt, Human
accuugauggccuucuugcug

SEQ ID NO: 1364333 - RNA, 21 nt, Human
accuugcuccugcuccuucug

SEQ ID NO: 1364334 - RNA, 24 nt, Human
acucccugcuuccucucuagcccc

SEQ ID NO: 1364335 - RNA, 21 nt, Human
acugacuuccgcaaccaccug

SEQ ID NO: 1364336 - RNA, 19 nt, Human
agaaguccagagcucuaca

SEQ ID NO: 1364337 - RNA, 22 nt, Human
agacagaaguccccgccccagc

SEQ ID NO: 1364338 - RNA, 24 nt, Human
agagcagggguugggcagaaagca

SEQ ID NO: 1364339 - RNA, 20 nt, Human
agaggcacggggaaauggag

SEQ ID NO: 1364340 - RNA, 19 nt, Human
agcaaggagcugacagagc

SEQ ID NO: 1364341 - RNA, 18 nt, Human
agcagaccugcagggccc

SEQ ID NO: 1364342 - RNA, 20 nt, Human
agcagcgcuggguacaagcu

SEQ ID NO: 1364343 - RNA, 18 nt, Human
agcagcuuguccuggcug

SEQ ID NO: 1364344 - RNA, 18 nt, Human
agccaccucccagccacc

SEQ ID NO: 1364345 - RNA, 22 nt, Human
agccgggagguggggaacaggg

SEQ ID NO: 1364346 - RNA, 25 nt, Human
agcuguguggccucaagccagccuu

SEQ ID NO: 1364347 - RNA, 21 nt, Human
aggaagaaaaaggcaggacag

SEQ ID NO: 1364348 - RNA, 23 nt, Human
aggaagaaaaaggcaggacagaa

SEQ ID NO: 1364349 - RNA, 26 nt, Human
aggaaggagccauagcccaggcagga

SEQ ID NO: 1364350 - RNA, 20 nt, Human
aggaaugaggaacccagagc

SEQ ID NO: 1364351 - RNA, 20 nt, Human
aggacacaggggcaugggga

SEQ ID NO: 1364352 - RNA, 21 nt, Human
aggagccaccucccagccacc

SEQ ID NO: 1364353 - RNA, 24 nt, Human
aggagcuggggguggugguggggg

SEQ ID NO: 1364354 - RNA, 18 nt, Human
aggcaaaagcagcgcugg

SEQ ID NO: 1364355 - RNA, 22 nt, Human
aggcaagggcucugaagucagg

SEQ ID NO: 1364356 - RNA, 22 nt, Human
aggcaggagggcugaggaccuc

SEQ ID NO: 1364357 - RNA, 20 nt, Human
agggaagcaggucugagcaa

SEQ ID NO: 1364358 - RNA, 19 nt, Human
agggcugaggaccucuggu

SEQ ID NO: 1364359 - RNA, 25 nt, Human
auacagcagugaagcugaaaugaaa

SEQ ID NO: 1364360 - RNA, 22 nt, Human
aucagcugccaccccaucccag

SEQ ID NO: 1364361 - RNA, 22 nt, Human
auccaguccuccugguguguga

SEQ ID NO: 1364362 - RNA, 20 nt, Human
augaggaacccagagccuca

SEQ ID NO: 1364363 - RNA, 20 nt, Human
caagcacuucacagccccuc

SEQ ID NO: 1364364 - RNA, 25 nt, Human
caauggccugcaccuggcuccggcu

SEQ ID NO: 1364365 - RNA, 19 nt, Human
cacccugcagagcuggacc

SEQ ID NO: 1364366 - RNA, 23 nt, Human
caccuccccucaaacgaggagcc

SEQ ID NO: 1364367 - RNA, 23 nt, Human
cacgcacacaggaaaguccuuca

SEQ ID NO: 1364368 - RNA, 25 nt, Human
cacuccccagcccuccaaggccacu

SEQ ID NO: 1364369 - RNA, 20 nt, Human
cacugagcacgccagaaauc

SEQ ID NO: 1364370 - RNA, 24 nt, Human
cacuuaacaaacccacagaaaauc

SEQ ID NO: 1364371 - RNA, 20 nt, Human
cagagaugccuggagggaaa

SEQ ID NO: 1364372 - RNA, 24 nt, Human
cagagcaacggcccaagucugggu

SEQ ID NO: 1364373 - RNA, 22 nt, Human
cagagcugccaggccaggcccu

SEQ ID NO: 1364374 - RNA, 20 nt, Human
cagcauccaguccuccuggu

SEQ ID NO: 1364375 - RNA, 18 nt, Human
cagccucagaggcacggg

SEQ ID NO: 1364376 - RNA, 19 nt, Human
cagccuccucugggggaca

SEQ ID NO: 1364377 - RNA, 18 nt, Human
caggacacaggggcaugg

SEQ ID NO: 1364378 - RNA, 20 nt, Human
cagggcuggaggggaggagg

SEQ ID NO: 1364379 - RNA, 21 nt, Human
caggggccagcuggcaagagc

SEQ ID NO: 1364380 - RNA, 20 nt, Human
cagggucgaggaguugacgg

SEQ ID NO: 1364381 - RNA, 19 nt, Human
caucccagucagccuccuc

SEQ ID NO: 1364382 - RNA, 19 nt, Human
caugacacuccccagcccu

SEQ ID NO: 1364383 - RNA, 21 nt, Human
caugacacuccccagcccucc

SEQ ID NO: 1364384 - RNA, 22 nt, Human
caugugcccuaggggaagcagg

SEQ ID NO: 1364385 - RNA, 24 nt, Human
ccaaggcccuccgaccgcaggcuc

SEQ ID NO: 1364386 - RNA, 21 nt, Human
ccagagccucacuuguucagg

SEQ ID NO: 1364387 - RNA, 22 nt, Human
ccagcuuucgcuccuucaugcu

SEQ ID NO: 1364388 - RNA, 19 nt, Human
ccaggauggccaagggaug

SEQ ID NO: 1364389 - RNA, 23 nt, Human
ccaggccgggccucccgcccaca

SEQ ID NO: 1364390 - RNA, 22 nt, Human
ccagggcccgcucaccuugcuc

SEQ ID NO: 1364391 - RNA, 21 nt, Human
ccagucauccucguccuccuc

SEQ ID NO: 1364392 - RNA, 21 nt, Human
cccacagaaaauccacccgag

SEQ ID NO: 1364393 - RNA, 22 nt, Human
cccacccccaugacacucccca

SEQ ID NO: 1364394 - RNA, 19 nt, Human
cccagagccucacuuguuc

SEQ ID NO: 1364395 - RNA, 20 nt, Human
cccaguagccucaggacaca

SEQ ID NO: 1364396 - RNA, 20 nt, Human
ccccaagaggcucagagggc

SEQ ID NO: 1364397 - RNA, 25 nt, Human
ccccacccccaugacacuccccagc

SEQ ID NO: 1364398 - RNA, 19 nt, Human
ccccacccugcagagcugg

SEQ ID NO: 1364399 - RNA, 21 nt, Human
ccccacgcuggggaggccaga

SEQ ID NO: 1364400 - RNA, 18 nt, Human
ccccaugacacuccccag

SEQ ID NO: 1364401 - RNA, 22 nt, Human
ccccaugacacuccccagcccu

SEQ ID NO: 1364402 - RNA, 19 nt, Human
cccccaagucccucuucug

SEQ ID NO: 1364403 - RNA, 22 nt, Human
cccccaugacacuccccagccc

SEQ ID NO: 1364404 - RNA, 21 nt, Human
cccccuaggauucccagucau

SEQ ID NO: 1364405 - RNA, 19 nt, Human
cccccugcacaccuccugc

SEQ ID NO: 1364406 - RNA, 22 nt, Human
cccccuggcuccuggcccaugu

SEQ ID NO: 1364407 - RNA, 21 nt, Human
ccccucggcccugccuucugg

SEQ ID NO: 1364408 - RNA, 20 nt, Human
ccccugagcuagccaugcuc

SEQ ID NO: 1364409 - RNA, 30 nt, Human; identical to SEQ ID NO: 504575

SEQ ID NO: 1364410 - RNA, 24 nt, Human
cccgcccacaccccucggcccugc

SEQ ID NO: 1364411 - RNA, 21 nt, Human
cccucaaacgaggagccccac

SEQ ID NO: 1364412 - RNA, 19 nt, Human
cccuccgaccgcaggcucc

SEQ ID NO: 1364413 - RNA, 20 nt, Human
cccuggacuggagccgggag

SEQ ID NO: 1364414 - RNA, 18 nt, Human
ccgcaaccaccugagcgc

SEQ ID NO: 1364415 - RNA, 23 nt, Human
ccucccgagccgagccaccccag

SEQ ID NO: 1364416 - RNA, 19 nt, Human
ccucccgcccacaccccuc

SEQ ID NO: 1364417 - RNA, 21 nt, Human
ccucugguggcagcccagggc

SEQ ID NO: 1364418 - RNA, 18 nt, Human
ccugcacaccuccugcuu

SEQ ID NO: 1364419 - RNA, 24 nt, Human
ccugcaccuggcuccggcucugcu

SEQ ID NO: 1364420 - RNA, 25 nt, Human
ccuggcccaugugcugguccccugg

SEQ ID NO: 1364421 - RNA, 18 nt, Human
ccugggagggccaggaug

SEQ ID NO: 1364422 - RNA, 22 nt, Human
ccuucugcuucuucuucuccag

SEQ ID NO: 1364423 - RNA, 23 nt, Human
ccuucuggccauacagguucuag

SEQ ID NO: 1364424 - RNA, 23 nt, Human
cgcagcuuggccuugccgaugcc

SEQ ID NO: 1364425 - RNA, 20 nt, Human
cggcccagggcgggcagcgg

SEQ ID NO: 1364426 - RNA, 25 nt, Human
cuacaggggccgcgguuggccaggg

SEQ ID NO: 1364427 - RNA, 20 nt, Human
cuacaguuugaaagccacua

SEQ ID NO: 1364428 - RNA, 21 nt, Human
cucaaaaccauagugcccagg

SEQ ID NO: 1364429 - RNA, 21 nt, Human
cucagaggcacggggaaaugg

SEQ ID NO: 1364430 - RNA, 21 nt, Human
cucaguagggacaggcccuau

SEQ ID NO: 1364431 - RNA, 18 nt, Human
cuccacuauggcucccaa

SEQ ID NO: 1364432 - RNA, 19 nt, Human
cuccacuauggcucccaaa

SEQ ID NO: 1364433 - RNA, 21 nt, Human
cuccuccccagcauccagucc

SEQ ID NO: 1364434 - RNA, 20 nt, Human
cuccugucacaguuugagcu

SEQ ID NO: 1364435 - RNA, 19 nt, Human
cucggcccugccuucuggc

SEQ ID NO: 1364436 - RNA, 23 nt, Human
cucucaguagggacaggcccuau

SEQ ID NO: 1364437 - RNA, 23 nt, Human
cucucccacaucaucaggggcac

SEQ ID NO: 1364438 - RNA, 19 nt, Human
cugacacacgggcaaaggc

SEQ ID NO: 1364439 - RNA, 18 nt, Human
cugagcccauguuccucu

SEQ ID NO: 1364440 - RNA, 22 nt, Human
cugcucaggcagggcuggggaa

SEQ ID NO: 1364441 - RNA, 20 nt, Human
cugcucuaccugcugggaga

SEQ ID NO: 1364442 - RNA, 18 nt, Human
cuggauccuguggcgggg

SEQ ID NO: 1364443 - RNA, 21 nt, Human
cuguaccugugucugaugccc

SEQ ID NO: 1364444 - RNA, 22 nt, Human
cuguaccugugucugaugcccu

SEQ ID NO: 1364445 - RNA, 24 nt, Human
cugugugcagauacucccugcuuc

SEQ ID NO: 1364446 - RNA, 24 nt, Human
cuuccucucuagcccccacccugc

SEQ ID NO: 1364447 - RNA, 20 nt, Human
cuuggcacuggagaacaccu

SEQ ID NO: 1364448 - RNA, 24 nt, Human
cuuggccuugccgaugcccccagc

SEQ ID NO: 1364449 - RNA, 24 nt, Human
gaaacccugguucccccagccccc

SEQ ID NO: 1364450 - RNA, 20 nt, Human
gaagacauacuucuuguacc

SEQ ID NO: 1364451 - RNA, 23 nt, Human
gacacaggggcauggggacuacc

SEQ ID NO: 1364452 - RNA, 24 nt, Human
gagaacaccuguggacacagggac

SEQ ID NO: 1364453 - RNA, 24 nt, Human
gagcagcaaggagcugacagagcu

SEQ ID NO: 1364454 - RNA, 18 nt, Human
gagcagggguugggcaga

SEQ ID NO: 1364455 - RNA, 19 nt, Human
gagccugcugggagggaag

SEQ ID NO: 1364456 - RNA, 18 nt, Human
gagcugggggugguggug

SEQ ID NO: 1364457 - RNA, 21 nt, Human
gcacuggagaacaccugugga

SEQ ID NO: 1364458 - RNA, 18 nt, Human
gcagccagcagaccugca

SEQ ID NO: 1364459 - RNA, 18 nt, Human
gcagcccagggcuuccag

SEQ ID NO: 1364460 - RNA, 24 nt, Human
gcagcgcuggguacaagcucaaaa

SEQ ID NO: 1364461 - RNA, 19 nt, Human
gcaggggccagcuggcaag

SEQ ID NO: 1364462 - RNA, 21 nt, Human
gccaaggagaccuucucucca

SEQ ID NO: 1364463 - RNA, 20 nt, Human
gcccaagucugggucugggg

SEQ ID NO: 1364464 - RNA, 22 nt, Human
gcccacaccccucggcccugcc

SEQ ID NO: 1364465 - RNA, 26 nt, Human
gccuggagggaaaaggcugagugagg

SEQ ID NO: 1364466 - RNA, 18 nt, Human
gccugggccaaggagacc

SEQ ID NO: 1364467 - RNA, 21 nt, Human
gccugggcgagaagaaagccc

SEQ ID NO: 1364468 - RNA, 18 nt, Human
gcgcgggcauccugugug

SEQ ID NO: 1364469 - RNA, 23 nt, Human
gcuccugcuccuucugcuucuuc

SEQ ID NO: 1364470 - RNA, 20 nt, Human
gcuguguggccucaagccag

SEQ ID NO: 1364471 - RNA, 25 nt, Human
ggaaacccugguucccccagccccc

SEQ ID NO: 1364472 - RNA, 18 nt, Human
ggaaugaggaacccagag

SEQ ID NO: 1364473 - RNA, 21 nt, Human
ggaccucugguggcagcccag

SEQ ID NO: 1364474 - RNA, 18 nt, Human
ggacuggagccgggaggu

SEQ ID NO: 1364475 - RNA, 24 nt, Human
ggacuggagccgggagguggggaa

SEQ ID NO: 1364476 - RNA, 18 nt, Human
ggagaccuucucuccaau

SEQ ID NO: 1364477 - RNA, 19 nt, Human
ggagcugacagagcugaug

SEQ ID NO: 1364478 - RNA, 22 nt, Human
ggagcugggggugguggugggg

SEQ ID NO: 1364479 - RNA, 21 nt, Human
ggagggcugaggaccucuggu

SEQ ID NO: 1364480 - RNA, 21 nt, Human
ggaggggaggaggcgaucuug

SEQ ID NO: 1364481 - RNA, 23 nt, Human
ggauccuguggcgggggcgucuc

SEQ ID NO: 1364482 - RNA, 19 nt, Human
ggcacggggaaauggaggg

SEQ ID NO: 1364483 - RNA, 18 nt, Human
ggcaggaagaggguggag

SEQ ID NO: 1364484 - RNA, 25 nt, Human
ggcugaccauugccuuggaccgcuc

SEQ ID NO: 1364485 - RNA, 18 nt, Human
ggcugcugcgguggcggc

SEQ ID NO: 1364486 - RNA, 19 nt, Human
gggaaauggagggacugcc

SEQ ID NO: 1364487 - RNA, 21 nt, Human
gggcagccucagaggcacggg

SEQ ID NO: 1364488 - RNA, 21 nt, Human
gggccccaagaggcucagagg

SEQ ID NO: 1364489 - RNA, 18 nt, Human
gggccccucaccagcccc

SEQ ID NO: 1364490 - RNA, 18 nt, Human
ggggaacagggcaaggag

SEQ ID NO: 1364491 - RNA, 23 nt, Human
ggggucgaccacuucccugggag

SEQ ID NO: 1364492 - RNA, 22 nt, Human
ggguacuuggcacuggagaaca

SEQ ID NO: 1364493 - RNA, 19 nt, Human
gggugguggugggggcggu

SEQ ID NO: 1364494 - RNA, 22 nt, Human
ggugggagugggggugcacugg

SEQ ID NO: 1364495 - RNA, 22 nt, Human
ggugggggcgguggggguggug

SEQ ID NO: 1364496 - RNA, 20 nt, Human
gguggugggggcgguggggg

SEQ ID NO: 1364497 - RNA, 23 nt, Human
guaccugugucugaugcccuggg

SEQ ID NO: 1364498 - RNA, 25 nt, Human
gucaccuccccucaaacgaggagcc

SEQ ID NO: 1364499 - RNA, 23 nt, Human
guccagggggcggugcuugcucu

SEQ ID NO: 1364500 - RNA, 19 nt, Human
guggcgcaggcugggugga

SEQ ID NO: 1364501 - RNA, 21 nt, Human
guggcugcugcgguggcggca

SEQ ID NO: 1364502 - RNA, 18 nt, Human
guuccgucacccccuccc

SEQ ID NO: 1364503 - RNA, 18 nt, Human
uacacaugcacacauggc

SEQ ID NO: 1364504 - RNA, 23 nt, Human
uacagcagugaagcugaaaugaa

SEQ ID NO: 1364505 - RNA, 22 nt, Human
uaccuacagaggugacaugggg

SEQ ID NO: 1364506 - RNA, 23 nt, Human
uaggggaagcaggggccagcugg

SEQ ID NO: 1364507 - RNA, 18 nt, Human
ucagagcaacggcccaag

SEQ ID NO: 1364508 - RNA, 24 nt, Human
ucagagcaacggcccaagucuggg

SEQ ID NO: 1364509 - RNA, 24 nt, Human
ucagagccucagucgaucccugac

SEQ ID NO: 1364510 - RNA, 22 nt, Human
ucagaggcacggggaaauggag

SEQ ID NO: 1364511 - RNA, 23 nt, Human
ucaggagcugggggugguggugg

SEQ ID NO: 1364512 - RNA, 19 nt, Human
ucagggcuggaggggagga

SEQ ID NO: 1364513 - RNA, 18 nt, Human
uccaaggccacuguguuu

SEQ ID NO: 1364514 - RNA, 23 nt, Human
uccagcuuucgcuccuucaugcu

SEQ ID NO: 1364515 - RNA, 21 nt, Human
ucccaaaccaggaaggagcca

SEQ ID NO: 1364516 - RNA, 22 nt, Human
ucccaaaccaggaaggagccau

SEQ ID NO: 1364517 - RNA, 22 nt, Human
ucccagucauccucguccuccu

SEQ ID NO: 1364518 - RNA, 21 nt, Human
uccccacccccaugacacucc

SEQ ID NO: 1364519 - RNA, 18 nt, Human
uccccagcauccaguccu

SEQ ID NO: 1364520 - RNA, 24 nt, Human
uccccagcccuccaaggccacugu

SEQ ID NO: 1364521 - RNA, 21 nt, Human
ucccugcacucucaguaggga

SEQ ID NO: 1364522 - RNA, 22 nt, Human
ucccugcuuccucucuagcccc

SEQ ID NO: 1364523 - RNA, 21 nt, Human
uccucugccuguggcugcugc

SEQ ID NO: 1364524 - RNA, 26 nt, Human
ucgcuccuucaugcugcgcagcuugg

SEQ ID NO: 1364525 - RNA, 23 nt, Human
ucggcccugccuucuggccauac

SEQ ID NO: 1364526 - RNA, 23 nt, Human
ucuagcccccacccugcagagcu

SEQ ID NO: 1364527 - RNA, 21 nt, Human
ucuccaauggccugcaccugg

SEQ ID NO: 1364528 - RNA, 24 nt, Human
ucuccaauggccugcaccuggcuc

SEQ ID NO: 1364529 - RNA, 25 nt, Human
ucuccaauggccugcaccuggcucc

SEQ ID NO: 1364530 - RNA, 28 nt, Human
ucuccacacagugcugguuccgucaccc

SEQ ID NO: 1364531 - RNA, 26 nt, Human
ucucuaaaaauaucucaggaggcugc

SEQ ID NO: 1364532 - RNA, 18 nt, Human
ucugguggcagcccaggg

SEQ ID NO: 1364533 - RNA, 19 nt, Human
ucugguggcagcccagggc

SEQ ID NO: 1364534 - RNA, 23 nt, Human
ugaaauggaaacuauucaaaaaa

SEQ ID NO: 1364535 - RNA, 20 nt, Human
ugaagagauccgacaucaag

SEQ ID NO: 1364536 - RNA, 21 nt, Human
ugaagagcagcaaggagcuga

SEQ ID NO: 1364537 - RNA, 21 nt, Human
ugacacacgggcaaaggcucc

SEQ ID NO: 1364538 - RNA, 18 nt, Human
ugacacuccccagcccuc

SEQ ID NO: 1364539 - RNA, 22 nt, Human
ugacacuccccagcccuccaag

SEQ ID NO: 1364540 - RNA, 22 nt, Human
ugagaaagcggcuguuugagga

SEQ ID NO: 1364541 - RNA, 19 nt, Human
ugagcuuagagaggaaagc

SEQ ID NO: 1364542 - RNA, 18 nt, Human
ugagggugguugguggga

SEQ ID NO: 1364543 - RNA, 23 nt, Human
ugaugagaaagcggcuguuugag

SEQ ID NO: 1364544 - RNA, 23 nt, Human
ugcaccuggcuccggcucugcuc

SEQ ID NO: 1364545 - RNA, 18 nt, Human
ugcaggcgcucuggagca

SEQ ID NO: 1364546 - RNA, 23 nt, Human
ugccagggccgaucuuggugcca

SEQ ID NO: 1364547 - RNA, 20 nt, Human
ugcccuaggggaagcagggg

SEQ ID NO: 1364548 - RNA, 21 nt, Human
ugcccuggguccccacuaagc

SEQ ID NO: 1364549 - RNA, 21 nt, Human
ugcccuugaucuucucaaucu

SEQ ID NO: 1364550 - RNA, 21 nt, Human
ugccuccuacccuugcgccuc

SEQ ID NO: 1364551 - RNA, 18 nt, Human
ugccuggggucacagagc

SEQ ID NO: 1364552 - RNA, 20 nt, Human
ugccuuggaccgcucuuggc

SEQ ID NO: 1364553 - RNA, 20 nt, Human
ugcgguggcggcagaggagg

SEQ ID NO: 1364554 - RNA, 24 nt, Human
ugcuccccacccccugcacaccuc

SEQ ID NO: 1364555 - RNA, 24 nt, Human
ugcuccugcuccuucugcuucuuc

SEQ ID NO: 1364556 - RNA, 20 nt, Human
ugcucugacagucucaguug

SEQ ID NO: 1364557 - RNA, 20 nt, Human
ugcugcugcugucguccugc

SEQ ID NO: 1364558 - RNA, 18 nt, Human
ugcugggaagacccccaa

SEQ ID NO: 1364559 - RNA, 19 nt, Human
ugcuuggcaggaagagggu

SEQ ID NO: 1364560 - RNA, 20 nt, Human
uggaccccugagcuagccuc

SEQ ID NO: 1364561 - RNA, 25 nt, Human
uggauccuguggcgggggcgucucu

SEQ ID NO: 1364562 - RNA, 19 nt, Human
uggcaagagcagggguugg

SEQ ID NO: 1364563 - RNA, 21 nt, Human
uggcacuggagaacaccugug

SEQ ID NO: 1364564 - RNA, 22 nt, Human
uggcagcccagggcuuccagca

SEQ ID NO: 1364565 - RNA, 22 nt, Human
uggccaagggauggugaauauu

SEQ ID NO: 1364566 - RNA, 21 nt, Human
uggccuucuugcugcccuuga

SEQ ID NO: 1364567 - RNA, 21 nt, Human
uggcgcaggcuggguggagcc

SEQ ID NO: 1364568 - RNA, 24 nt, Human
uggcggcagaggagggauggaguc

SEQ ID NO: 1364569 - RNA, 18 nt, Human
uggcgggggcgucucugc

SEQ ID NO: 1364570 - RNA, 21 nt, Human
uggcucccuguccccaccccc

SEQ ID NO: 1364571 - RNA, 21 nt, Human
ugggagggccaggauggccaa

SEQ ID NO: 1364572 - RNA, 19 nt, Human
ugggcacugaugagaaagc

SEQ ID NO: 1364573 - RNA, 18 nt, Human
ugggcagcagggcagaga

SEQ ID NO: 1364574 - RNA, 19 nt, Human
ugggcugcuccccaccccc

SEQ ID NO: 1364575 - RNA, 22 nt, Human
uggggaggccagaccuuugaag

SEQ ID NO: 1364576 - RNA, 18 nt, Human
uggguacaagcucaaaac

SEQ ID NO: 1364577 - RNA, 23 nt, Human
ugguggcagcccagggcuuccag

SEQ ID NO: 1364578 - RNA, 22 nt, Human
uggugggggcgguggggguggu

SEQ ID NO: 1364579 - RNA, 21 nt, Human
ugguuggugggaaacccuggu

SEQ ID NO: 1364580 - RNA, 19 nt, Human
ugucauggagcccccuagg

SEQ ID NO: 1364581 - RNA, 18 nt, Human
uguccaagagccugcugg

SEQ ID NO: 1364582 - RNA, 24 nt, Human
uguccaagagccugcugggaggga

SEQ ID NO: 1364583 - RNA, 24 nt, Human
uguccccacccccaugacacuccc

SEQ ID NO: 1364584 - RNA, 21 nt, Human
uuacacaugcacacauggcua

SEQ ID NO: 1364585 - RNA, 23 nt, Human
uucaaaaaauugagaauuucuga

SEQ ID NO: 1364586 - RNA, 22 nt, Human
uucuccugggagggccaggaug

SEQ ID NO: 1364587 - RNA, 22 nt, Human
uugauggccuucuugcugcccu

SEQ ID NO: 1364588 - RNA, 22 nt, Human
uugccagggccgaucuuggugc

SEQ ID NO: 1364589 - RNA, 18 nt, Human
uugcugggaagaccccca

SEQ ID NO: 1364590 - RNA, 22 nt, Human
uuggugugccguuuucucugga

SEQ ID NO: 1364591 - RNA, 19 nt, Human
uugugccacuucuggaugc

SEQ ID NO: 1364592 - RNA, 22 nt, Human
accuuaagacaauguuaacagg

SEQ ID NO: 1364593 - RNA, 20 nt, Human
agaaguugccagcugcauuu

SEQ ID NO: 1364594 - RNA, 18 nt, Human
aggagcagacagacagca

SEQ ID NO: 1364595 - RNA, 19 nt, Human
agugcuugccagacuggcu

SEQ ID NO: 1364596 - RNA, 20 nt, Human
caagcugcgggcagagcuga

SEQ ID NO: 1364597 - RNA, 20 nt, Human
caccugggggagaaguugcc

SEQ ID NO: 1364598 - RNA, 21 nt, Human
cagcaggugggccagcccuuc

SEQ ID NO: 1364599 - RNA, 24 nt, Human
cagcccuugggacacuccugcccc

SEQ ID NO: 1364600 - RNA, 21 nt, Human
cagcucuuguuuugccagggg

SEQ ID NO: 1364601 - RNA, 20 nt, Human
ccagacuggcuugagcagca

SEQ ID NO: 1364602 - RNA, 23 nt, Human
ccaggggagagacauguacaagc

SEQ ID NO: 1364603 - RNA, 18 nt, Human
cgcucagagcgggaagag

SEQ ID NO: 1364604 - RNA, 21 nt, Human
cucuccccagaaggaccucga

SEQ ID NO: 1364605 - RNA, 21 nt, Human
cucuguccacuuacacucucc

SEQ ID NO: 1364606 - RNA, 19 nt, Human
gacacggugaacgaagggu

SEQ ID NO: 1364607 - RNA, 18 nt, Human
gacauguacaagcugcgg

SEQ ID NO: 1364608 - RNA, 18 nt, Human
gaccucgaggcugggcug

SEQ ID NO: 1364609 - RNA, 23 nt, Human
gagcaaaggccggcagcaggggg

SEQ ID NO: 1364610 - RNA, 20 nt, Human
gccagcccuugggacacucc

SEQ ID NO: 1364611 - RNA, 22 nt, Human
ggagagacauguacaagcugcg

SEQ ID NO: 1364612 - RNA, 25 nt, Human
gggaaggcaccugggggagaaguug

SEQ ID NO: 1364613 - RNA, 19 nt, Human
gggcagagcugaaucgcuc

SEQ ID NO: 1364614 - RNA, 20 nt, Human
guccacuuacacucucccca

SEQ ID NO: 1364615 - RNA, 22 nt, Human
uaggaggagcagacagacagca

SEQ ID NO: 1364616 - RNA, 25 nt, Human
uaggaggagcagacagacagcaggu

SEQ ID NO: 1364617 - RNA, 20 nt, Human
uauuuugagagauguuggaa

SEQ ID NO: 1364618 - RNA, 19 nt, Human
ugaugauuaaaacagaauc

SEQ ID NO: 1364619 - RNA, 24 nt, Human
ugaugauuaaaacagaaucuuggu

SEQ ID NO: 1364620 - RNA, 18 nt, Human
ugccaggggagagacaug

SEQ ID NO: 1364621 - RNA, 25 nt, Human
uggaagaaaacaauguaaaugauga

SEQ ID NO: 1364622 - RNA, 26 nt, Human
uggguuagggaggguauacgaggggg

SEQ ID NO: 1364623 - RNA, 20 nt, Human
uguaaaugaugauuaaaaca

SEQ ID NO: 1364624 - RNA, 20 nt, Human
uuaaaacagaaucuugguuc

SEQ ID NO: 1364625 - RNA, 21 nt, Human
uuaaaacagaaucuugguuca

SEQ ID NO: 1364626 - RNA, 25 nt, Human
uuugagagauguuggaagugaagga

SEQ ID NO: 1364627 - RNA, 18 nt, Human
uuuguucuuacucagaac

SEQ ID NO: 1364628 - RNA, 22 nt, Human
uuuuauuuugagagauguugga

SEQ ID NO: 1364629 - RNA, 23 nt, Human
aaaaaaaccagaccaccacuggg

SEQ ID NO: 1364630 - RNA, 20 nt, Human
aaaacaaaagcugacagaaa

SEQ ID NO: 1364631 - RNA, 22 nt, Human
aaaacaaaagcugacagaaaga

SEQ ID NO: 1364632 - RNA, 19 nt, Human
aaauggccauacaauccug

SEQ ID NO: 1364633 - RNA, 20 nt, Human
aacagaagaaccauguugga

SEQ ID NO: 1364634 - RNA, 20 nt, Human
aagcaggggcaggacacacg

SEQ ID NO: 1364635 - RNA, 21 nt, Human
acaaaagcugacagaaagacg

SEQ ID NO: 1364636 - RNA, 22 nt, Human
acaaugccaagcacacccaugc

SEQ ID NO: 1364637 - RNA, 22 nt, Human
acagaaagacggaugcugaaaa

SEQ ID NO: 1364638 - RNA, 22 nt, Human
acagaagaaccauguuggaugg

SEQ ID NO: 1364639 - RNA, 23 nt, Human
acauaagacccuccccgcugacu

SEQ ID NO: 1364640 - RNA, 23 nt, Human
acccuagauucucugggacucac

SEQ ID NO: 1364641 - RNA, 23 nt, Human
acgucgcgucgccgccgccgccc

SEQ ID NO: 1364642 - RNA, 22 nt, Human
agaaaagagaugacacugagaa

SEQ ID NO: 1364643 - RNA, 20 nt, Human
agaaggugcucaacaggccc

SEQ ID NO: 1364644 - RNA, 22 nt, Human
agaucuuucccaaaccugaaau

SEQ ID NO: 1364645 - RNA, 23 nt, Human
agcaacagaacgccgacuccagc

SEQ ID NO: 1364646 - RNA, 18 nt, Human
agcgccucucaaaggagu

SEQ ID NO: 1364647 - RNA, 21 nt, Human
agcuuugggaucuagucucag

SEQ ID NO: 1364648 - RNA, 23 nt, Human
aggcauucugagcuuugggaucu

SEQ ID NO: 1364649 - RNA, 20 nt, Human
agggauggggcgcccauucu

SEQ ID NO: 1364650 - RNA, 21 nt, Human
auaaaacaaaagcugacagaa

SEQ ID NO: 1364651 - RNA, 21 nt, Human
auaagacccuccccgcugacu

SEQ ID NO: 1364652 - RNA, 22 nt, Human
aucucugauaaaacaaaagcug

SEQ ID NO: 1364653 - RNA, 19 nt, Human
caaaaaaaaccagaccacc

SEQ ID NO: 1364654 - RNA, 20 nt, Human
caaaaccagaguucugcagg

SEQ ID NO: 1364655 - RNA, 19 nt, Human
caagauggggaccugauua

SEQ ID NO: 1364656 - RNA, 21 nt, Human
cacaaaaaaaaccagaccacc

SEQ ID NO: 1364657 - RNA, 21 nt, Human
cacacaggccucaaccggggc

SEQ ID NO: 1364658 - RNA, 18 nt, Human
cacaguuugcaacaggau

SEQ ID NO: 1364659 - RNA, 18 nt, Human
cacauccccccuugccau

SEQ ID NO: 1364660 - RNA, 23 nt, Human
caccagaagcaacagaacgccga

SEQ ID NO: 1364661 - RNA, 19 nt, Human
cacgauuccugggccuggc

SEQ ID NO: 1364662 - RNA, 20 nt, Human
cagaaggugcucaacaggcc

SEQ ID NO: 1364663 - RNA, 21 nt, Human
cagaaggugcucaacaggccc

SEQ ID NO: 1364664 - RNA, 22 nt, Human
cagagugauuccuggagaugca

SEQ ID NO: 1364665 - RNA, 18 nt, Human
cagcacacaggccucaac

SEQ ID NO: 1364666 - RNA, 25 nt, Human
cagcaggaagaaugauuucugugac

SEQ ID NO: 1364667 - RNA, 20 nt, Human
caggugguagcucucaucuc

SEQ ID NO: 1364668 - RNA, 23 nt, Human
caucucacaaaaaaaaccagacc

SEQ ID NO: 1364669 - RNA, 23 nt, Human
caucuuaucucugauaaaacaaa

SEQ ID NO: 1364670 - RNA, 18 nt, Human
cauggguccucuggacac

SEQ ID NO: 1364671 - RNA, 23 nt, Human
ccagcugccuaaccuugaccaag

SEQ ID NO: 1364672 - RNA, 21 nt, Human
ccaggugguagcucucaucuc

SEQ ID NO: 1364673 - RNA, 26 nt, Human
ccagucacuucagaucaguuaauucu

SEQ ID NO: 1364674 - RNA, 20 nt, Human
ccagucuguaccacgacagc

SEQ ID NO: 1364675 - RNA, 23 nt, Human
cccagaagcccaaacuucucagc

SEQ ID NO: 1364676 - RNA, 21 nt, Human
cccccgccgccuccuccuccu

SEQ ID NO: 1364677 - RNA, 23 nt, Human
cccgggccccgcgcggccccgag

SEQ ID NO: 1364678 - RNA, 18 nt, Human
cccuugaggagaaguugu

SEQ ID NO: 1364679 - RNA, 25 nt, Human
cccuugaggagaaguugugggggug

SEQ ID NO: 1364680 - RNA, 27 nt, Human
cccuugaggagaaguuguggggguggg

SEQ ID NO: 1364681 - RNA, 18 nt, Human
ccggccuccuggaccccc

SEQ ID NO: 1364682 - RNA, 21 nt, Human
ccuccuggacccccgccgccu

SEQ ID NO: 1364683 - RNA, 22 nt, Human
ccugacucugauggaaugugcu

SEQ ID NO: 1364684 - RNA, 21 nt, Human
ccuggacccccgccgccuccu

SEQ ID NO: 1364685 - RNA, 23 nt, Human
ccuggcccuguucacaguagcac

SEQ ID NO: 1364686 - RNA, 22 nt, Human
ccuugaggagaaguuguggggg

SEQ ID NO: 1364687 - RNA, 21 nt, Human
cgauggugggucaaaaccaga

SEQ ID NO: 1364688 - RNA, 18 nt, Human
cgcgucgccgccgccgcc

SEQ ID NO: 1364689 - RNA, 28 nt, Human
cggccuccuggacccccgccgccuccuu

SEQ ID NO: 1364690 - RNA, 22 nt, Human
cgucgcgucgccgccgccgccc

SEQ ID NO: 1364691 - RNA, 24 nt, Human
cuaacuuacuggcucucauuucac

SEQ ID NO: 1364692 - RNA, 19 nt, Human
cucacaaaaaaaaccagac

SEQ ID NO: 1364693 - RNA, 25 nt, Human
cucacaaaaaaaaccagaccaccac

SEQ ID NO: 1364694 - RNA, 20 nt, Human
cugaaaaccagccauauggu

SEQ ID NO: 1364695 - RNA, 26 nt, Human
cugaaaaccagccauaugguggacac

SEQ ID NO: 1364696 - RNA, 21 nt, Human
gacuggcucccagcagguaga

SEQ ID NO: 1364697 - RNA, 20 nt, Human
gcacccuagauucucuggga

SEQ ID NO: 1364698 - RNA, 21 nt, Human
gccagucuguaccacgacagc

SEQ ID NO: 1364699 - RNA, 20 nt, Human
gcccgggccccgcgcggccc

SEQ ID NO: 1364700 - RNA, 27 nt, Human
gcuuaaggccccuuccaacugccaguc

SEQ ID NO: 1364701 - RNA, 18 nt, Human
ggauuucaacccagaagc

SEQ ID NO: 1364702 - RNA, 22 nt, Human
ggcagaaaagagaugacacuga

SEQ ID NO: 1364703 - RNA, 20 nt, Human
ggggugggccugguggggag

SEQ ID NO: 1364704 - RNA, 23 nt, Human
gggugggccugguggggagggcg

SEQ ID NO: 1364705 - RNA, 20 nt, Human
gucgccgccgccgcccgggc

SEQ ID NO: 1364706 - RNA, 19 nt, Human
guggaacagaagaaccaug

SEQ ID NO: 1364707 - RNA, 23 nt, Human
uaaaacaaaagcugacagaaaga

SEQ ID NO: 1364708 - RNA, 19 nt, Human
uaaaaggucaugagcucug

SEQ ID NO: 1364709 - RNA, 21 nt, Human
uaacauaagacccuccccgcu

SEQ ID NO: 1364710 - RNA, 30 nt, Human
uacaagcuagaaaacuccagcucuggcacc

SEQ ID NO: 1364711 - RNA, 22 nt, Human
uaccacgacagcagugcugugg

SEQ ID NO: 1364712 - RNA, 20 nt, Human
uagaauugagcaugcccucc

SEQ ID NO: 1364713 - RNA, 19 nt, Human
uagauucucugggacucac

SEQ ID NO: 1364714 - RNA, 21 nt, Human
uagcucucaucucaucucaca

SEQ ID NO: 1364715 - RNA, 25 nt, Human
ucaccccucccagucacuucagauc

SEQ ID NO: 1364716 - RNA, 24 nt, Human
ucaccugauaacauaagacccucc

SEQ ID NO: 1364717 - RNA, 24 nt, Human
ucagaggcauucugagcuuuggga

SEQ ID NO: 1364718 - RNA, 23 nt, Human
ucagcacacaggccucaaccggg

SEQ ID NO: 1364719 - RNA, 20 nt, Human
ucaguuucuagcucuuccca

SEQ ID NO: 1364720 - RNA, 22 nt, Human
ucaguuucuagcucuucccaua

SEQ ID NO: 1364721 - RNA, 19 nt, Human
uccagauuuacaagcuaga

SEQ ID NO: 1364722 - RNA, 21 nt, Human
ucccaucccuguaucaugucc

SEQ ID NO: 1364723 - RNA, 22 nt, Human
ucccaucccuguaucauguccu

SEQ ID NO: 1364724 - RNA, 22 nt, Human
ucccugcccugcacccuagauu

SEQ ID NO: 1364725 - RNA, 18 nt, Human
uccuugguuccacauccc

SEQ ID NO: 1364726 - RNA, 23 nt, Human
ucgccgccgccgcccgggccccg

SEQ ID NO: 1364727 - RNA, 25 nt, Human
ucgcgacgucgcgucgccgccgccg

SEQ ID NO: 1364728 - RNA, 18 nt, Human
ucgcgucgccgccgccgc

SEQ ID NO: 1364729 - RNA, 24 nt, Human
ucucagaggcauucugagcuuugg

SEQ ID NO: 1364730 - RNA, 19 nt, Human
ucucugggacucacugcag

SEQ ID NO: 1364731 - RNA, 21 nt, Human
ucuggcacucagcacacaggc

SEQ ID NO: 1364732 - RNA, 25 nt, Human
ucugucuuuaagauucccguacuug

SEQ ID NO: 1364733 - RNA, 25 nt, Human
ucugugacaggaucaacuaacuuac

SEQ ID NO: 1364734 - RNA, 21 nt, Human
ugaccaagauggggaccugau

SEQ ID NO: 1364735 - RNA, 27 nt, Human
ugacuccugcucccugcccugcacccu

SEQ ID NO: 1364736 - RNA, 24 nt, Human
ugagacaggcugaaugcagagaau

SEQ ID NO: 1364737 - RNA, 25 nt, Human
ugagcaugcccuccuuucccauccc

SEQ ID NO: 1364738 - RNA, 22 nt, Human
ugagcgcaccauuccgaugcuu

SEQ ID NO: 1364739 - RNA, 18 nt, Human
ugaggagaaguugugggg

SEQ ID NO: 1364740 - RNA, 19 nt, Human
ugauucugguucucagagg

SEQ ID NO: 1364741 - RNA, 20 nt, Human
ugccaagcacacccaugcca

SEQ ID NO: 1364742 - RNA, 22 nt, Human
ugccaggcaguccuccugggcc

SEQ ID NO: 1364743 - RNA, 22 nt, Human
ugccagucuguaccacgacagc

SEQ ID NO: 1364744 - RNA, 25 nt, Human
uggaacagaagaaccauguuggaug

SEQ ID NO: 1364745 - RNA, 19 nt, Human
uggaaguuccagguggugc

SEQ ID NO: 1364746 - RNA, 20 nt, Human
uggcagaaaagagaugacac

SEQ ID NO: 1364747 - RNA, 19 nt, Human
uggccaggggucaauggga

SEQ ID NO: 1364748 - RNA, 18 nt, Human
uggcuggaugacuuuuag

SEQ ID NO: 1364749 - RNA, 20 nt, Human
ugggagccucucuuuuuccu

SEQ ID NO: 1364750 - RNA, 20 nt, Human
uggggagggcgauaggcugg

SEQ ID NO: 1364751 - RNA, 22 nt, Human
ugggggugggccugguggggag

SEQ ID NO: 1364752 - RNA, 19 nt, Human
ugugaaguuguuuuguuuu

SEQ ID NO: 1364753 - RNA, 19 nt, Human
ugugggggugggccuggug

SEQ ID NO: 1364754 - RNA, 24 nt, Human
uguuuuguuuuccucucucuuucc

SEQ ID NO: 1364755 - RNA, 23 nt, Human
uuaaaugcuaauacaaaaacauc

SEQ ID NO: 1364756 - RNA, 19 nt, Human
uucacaguuugcaacagga

SEQ ID NO: 1364757 - RNA, 22 nt, Human
uuccuggagaugcaaucuggga

SEQ ID NO: 1364758 - RNA, 19 nt, Human
uuccuucgguggcucuggc

SEQ ID NO: 1364759 - RNA, 18 nt, Human
uucucaccagaagcaaca

SEQ ID NO: 1364760 - RNA, 22 nt, Human
uugugggggugggccugguggg

SEQ ID NO: 1364761 - RNA, 18 nt, Human
uuuccaggugguagcucu

SEQ ID NO: 1364762 - RNA, 23 nt, Human
aaaaaaaaacaacaacuagagga

SEQ ID NO: 1364763 - RNA, 21 nt, Human
aaaaaaaacaacaacuagagg

SEQ ID NO: 1364764 - RNA, 22 nt, Human
aaaaaaaacaacaacuagagga

SEQ ID NO: 1364765 - RNA, 26 nt, Human
aaaaaacuuggucucagacccuagac

SEQ ID NO: 1364766 - RNA, 22 nt, Human
aaagaaaacaagccagcgaggg

SEQ ID NO: 1364767 - RNA, 24 nt, Human
aaagugcugggauuacaggcauga

SEQ ID NO: 1364768 - RNA, 19 nt, Human
aacacuuuggugaggcuga

SEQ ID NO: 1364769 - RNA, 22 nt, Human
aacacuuuggugaggcugaggc

SEQ ID NO: 1364770 - RNA, 20 nt, Human
aaccccuccccgaaaaaaaa

SEQ ID NO: 1364771 - RNA, 20 nt, Human
aagcccaggaguucgagacc

SEQ ID NO: 1364772 - RNA, 23 nt, Human
aagcgcuggcucggccaggugug

SEQ ID NO: 1364773 - RNA, 19 nt, Human
aaguagcugggauuacagg

SEQ ID NO: 1364774 - RNA, 25 nt, Human
aaguagcugggauuacaggcgcccg

SEQ ID NO: 1364775 - RNA, 19 nt, Human
aagugcugggauuacaggc

SEQ ID NO: 1364776 - RNA, 21 nt, Human
aagugcugggauuacaggcau

SEQ ID NO: 1364777 - RNA, 26 nt, Human
aagugcugggauuacaggcaugagcc

SEQ ID NO: 1364778 - RNA, 19 nt, Human
acaccacugcacuccagag

SEQ ID NO: 1364779 - RNA, 20 nt, Human
acaccacugcacuccagagc

SEQ ID NO: 1364780 - RNA, 20 nt, Human
acagcugaccccacacagcu

SEQ ID NO: 1364781 - RNA, 23 nt, Human
acaggcgcccgccaccacgcccg

SEQ ID NO: 1364782 - RNA, 19 nt, Human
acaggguuucgccaugcug

SEQ ID NO: 1364783 - RNA, 20 nt, Human
acaggguuucgccaugcugg

SEQ ID NO: 1364784 - RNA, 24 nt, Human
acaggguuucgccaugcuggccag

SEQ ID NO: 1364785 - RNA, 22 nt, Human
acccucacccccaggagccugc

SEQ ID NO: 1364786 - RNA, 23 nt, Human
acuaguucuucuuaccugggaag

SEQ ID NO: 1364787 - RNA, 20 nt, Human
agagggcagagacgguuggg

SEQ ID NO: 1364788 - RNA, 24 nt, Human
agaugggaggaucaccugagccug

SEQ ID NO: 1364789 - RNA, 19 nt, Human
agauuagacccuaagaggu

SEQ ID NO: 1364790 - RNA, 19 nt, Human
agauuuuuccccugccucc

SEQ ID NO: 1364791 - RNA, 19 nt, Human
agccaccgcacccagccca

SEQ ID NO: 1364792 - RNA, 20 nt, Human
agcgcuggcucggccaggug

SEQ ID NO: 1364793 - RNA, 21 nt, Human
agcgcuggcucggccaggugu

SEQ ID NO: 1364794 - RNA, 21 nt, Human
agcuggcccauggggaaccug

SEQ ID NO: 1364795 - RNA, 20 nt, Human
agcuugcaaaccuugggagu

SEQ ID NO: 1364796 - RNA, 19 nt, Human
aggagugugccuuggcccc

SEQ ID NO: 1364797 - RNA, 19 nt, Human
aggaguucgagaccagccu

SEQ ID NO: 1364798 - RNA, 18 nt, Human
aggcaacguacaugugcc

SEQ ID NO: 1364799 - RNA, 19 nt, Human
aggcagaagagucauuuaa

SEQ ID NO: 1364800 - RNA, 24 nt, Human
aggcagaagagucauuuaagccca

SEQ ID NO: 1364801 - RNA, 18 nt, Human
aggcaggcugagauggga

SEQ ID NO: 1364802 - RNA, 22 nt, Human
aggcaggggcagcagaagaggg

SEQ ID NO: 1364803 - RNA, 24 nt, Human
aggcugagaugggaggaucaccug

SEQ ID NO: 1364804 - RNA, 25 nt, Human
aggcuggagugcaguggcgugaucu

SEQ ID NO: 1364805 - RNA, 24 nt, Human
aggugauccacccgccgcagccuc

SEQ ID NO: 1364806 - RNA, 24 nt, Human
agucauuuaagcccaggaguucga

SEQ ID NO: 1364807 - RNA, 19 nt, Human
agugcaguggcgugaucuc

SEQ ID NO: 1364808 - RNA, 20 nt, Human
agugcaguggcgugaucucg

SEQ ID NO: 1364809 - RNA, 23 nt, Human
agugcaguggcgugaucucggcu

SEQ ID NO: 1364810 - RNA, 24 nt, Human
agugcaguggcgugaucucggcuc

SEQ ID NO: 1364811 - RNA, 18 nt, Human
agugcugggauuacaggc

SEQ ID NO: 1364812 - RNA, 20 nt, Human
aucacaccacugcacuccag

SEQ ID NO: 1364813 - RNA, 22 nt, Human
augagccaccgcacccagccca

SEQ ID NO: 1364814 - RNA, 26 nt, Human
caaaagaaaacaagccagcgagggca

SEQ ID NO: 1364815 - RNA, 23 nt, Human
caaagugcugggauuacaggcau

SEQ ID NO: 1364816 - RNA, 24 nt, Human
caaagugcugggauuacaggcaug

SEQ ID NO: 1364817 - RNA, 25 nt, Human
caacacuuuggugaggcugaggcag

SEQ ID NO: 1364818 - RNA, 22 nt, Human
caaguaauucuccugccucagc

SEQ ID NO: 1364819 - RNA, 27 nt, Human
caaguaauucuccugccucagccuccc

SEQ ID NO: 1364820 - RNA, 24 nt, Human
cacaccaguaaucccaacacuuug

SEQ ID NO: 1364821 - RNA, 18 nt, Human
cacaccuguagucccagc

SEQ ID NO: 1364822 - RNA, 22 nt, Human
cacagcucaauccucaguguuu

SEQ ID NO: 1364823 - RNA, 24 nt, Human
caccacgcccggcuaauuuuugua

SEQ ID NO: 1364824 - RNA, 23 nt, Human
caccaguaaucccaacacuuugg

SEQ ID NO: 1364825 - RNA, 23 nt, Human
cacccgccgcagccucucaaagu

SEQ ID NO: 1364826 - RNA, 18 nt, Human
caccgcacccagcccagg

SEQ ID NO: 1364827 - RNA, 19 nt, Human
caccgcacccagcccaggc

SEQ ID NO: 1364828 - RNA, 20 nt, Human
caccgcacccagcccaggcc

SEQ ID NO: 1364829 - RNA, 18 nt, Human
caccuggucucccggggc

SEQ ID NO: 1364830 - RNA, 23 nt, Human
caccuguagucccagcuacucgg

SEQ ID NO: 1364831 - RNA, 21 nt, Human
cacugaguggccuugggcaag

SEQ ID NO: 1364832 - RNA, 18 nt, Human
cacugcaacuucugccuc

SEQ ID NO: 1364833 - RNA, 21 nt, Human
cacugcaacuucugccuccca

SEQ ID NO: 1364834 - RNA, 23 nt, Human
cagacccucacccccaggagccu

SEQ ID NO: 1364835 - RNA, 18 nt, Human
cagcaaaaacagacucag

SEQ ID NO: 1364836 - RNA, 21 nt, Human
cagcaaaaacagacucagaca

SEQ ID NO: 1364837 - RNA, 25 nt, Human
cagcaaaaacagacucagacagacc

SEQ ID NO: 1364838 - RNA, 28 nt, Human
cagcaaaaacagacucagacagacccuc

SEQ ID NO: 1364839 - RNA, 30 nt, Human; identical to SEQ ID NO: 1298694

SEQ ID NO: 1364840 - RNA, 25 nt, Human
caggagccugcucccaaccggggcc

SEQ ID NO: 1364841 - RNA, 21 nt, Human
caggcgcccgccaccacgccc

SEQ ID NO: 1364842 - RNA, 24 nt, Human
caggguuucgccaugcuggccagg

SEQ ID NO: 1364843 - RNA, 23 nt, Human
cagugccggguucugucuggaag

SEQ ID NO: 1364844 - RNA, 21 nt, Human
cagugcugccacaaagcccug

SEQ ID NO: 1364845 - RNA, 24 nt, Human
caugcuggccaggcugaucucaaa

SEQ ID NO: 1364846 - RNA, 22 nt, Human
caugugccuggcagcacagcug

SEQ ID NO: 1364847 - RNA, 18 nt, Human
ccaaaagaaaacaagcca

SEQ ID NO: 1364848 - RNA, 22 nt, Human
ccaaaagaaaacaagccagcga

SEQ ID NO: 1364849 - RNA, 22 nt, Human
ccaaguagcugggauuacaggc

SEQ ID NO: 1364850 - RNA, 18 nt, Human
ccaccgcacccagcccag

SEQ ID NO: 1364851 - RNA, 20 nt, Human
ccaggaguucgagaccagcc

SEQ ID NO: 1364852 - RNA, 22 nt, Human
ccaugcuggccaggcugaucuc

SEQ ID NO: 1364853 - RNA, 23 nt, Human
cccaaguagcugggauuacaggc

SEQ ID NO: 1364854 - RNA, 23 nt, Human
cccaaguagcugggauuacaggc

SEQ ID NO: 1364855 - RNA, 22 nt, Human
cccaggcuggagugcaguggcg

SEQ ID NO: 1364856 - RNA, 20 nt, Human
cccagguucaaguaauucuc

SEQ ID NO: 1364857 - RNA, 23 nt, Human
cccagguucaaguaauucuccug

SEQ ID NO: 1364858 - RNA, 19 nt, Human
ccccaggagccugcuccca

SEQ ID NO: 1364859 - RNA, 20 nt, Human
cccccaggagccugcuccca

SEQ ID NO: 1364860 - RNA, 19 nt, Human
ccccugccuccugggcaga

SEQ ID NO: 1364861 - RNA, 22 nt, Human
cccgaaaaaaaaagaaagaaaa

SEQ ID NO: 1364862 - RNA, 20 nt, Human
cccuagaccuuauuagcagg

SEQ ID NO: 1364863 - RNA, 19 nt, Human
ccgaaaaaaaaagaaagaa

SEQ ID NO: 1364864 - RNA, 22 nt, Human
ccgcacccagcccaggcccguc

SEQ ID NO: 1364865 - RNA, 24 nt, Human
ccgccgcagccucucaaagugcug

SEQ ID NO: 1364866 - RNA, 24 nt, Human
ccucccagguucaaguaauucucc

SEQ ID NO: 1364867 - RNA, 21 nt, Human
ccuccccgaaaaaaaaagaaa

SEQ ID NO: 1364868 - RNA, 23 nt, Human
ccugccucagccucccaaguagc

SEQ ID NO: 1364869 - RNA, 18 nt, Human
ccugcucccaaccggggc

SEQ ID NO: 1364870 - RNA, 18 nt, Human
ccuggccucaggugaucc

SEQ ID NO: 1364871 - RNA, 22 nt, Human
ccuggccucaggugauccaccc

SEQ ID NO: 1364872 - RNA, 23 nt, Human
ccuggccucaggugauccacccg

SEQ ID NO: 1364873 - RNA, 21 nt, Human
ccuguagucccagcuacucgg

SEQ ID NO: 1364874 - RNA, 24 nt, Human
ccuguggcugggagcccaugaggc

SEQ ID NO: 1364875 - RNA, 22 nt, Human
ccuuauuagcaggcccuuccua

SEQ ID NO: 1364876 - RNA, 23 nt, Human
ccuugcucugucgcccaggcugg

SEQ ID NO: 1364877 - RNA, 24 nt, Human
ccuugcucugucgcccaggcugga

SEQ ID NO: 1364878 - RNA, 24 nt, Human
cgccaugcuggccaggcugaucuc

SEQ ID NO: 1364879 - RNA, 21 nt, Human
cggauuuccucaucugcgggg

SEQ ID NO: 1364880 - RNA, 18 nt, Human
cuagagcagcaaaaacag

SEQ ID NO: 1364881 - RNA, 19 nt, Human
cuaggaaacagggagaucc

SEQ ID NO: 1364882 - RNA, 28 nt, Human
cuaugacccugcuaugguuugaauguuu

SEQ ID NO: 1364883 - RNA, 24 nt, Human
cuauggacuucccagccuccagag

SEQ ID NO: 1364884 - RNA, 20 nt, Human
cucacaccuguagucccagc

SEQ ID NO: 1364885 - RNA, 23 nt, Human
cucacaccuguagucccagcuac

SEQ ID NO: 1364886 - RNA, 24 nt, Human
cucacugcaacuucugccucccag

SEQ ID NO: 1364887 - RNA, 24 nt, Human
cucacugcaacuucugccucccag

SEQ ID NO: 1364888 - RNA, 23 nt, Human
cucacugggcucugggcccucca

SEQ ID NO: 1364889 - RNA, 26 nt, Human
cucagacccuagaccuuauuagcagg

SEQ ID NO: 1364890 - RNA, 24 nt, Human
cucagccucccaaguagcugggau

SEQ ID NO: 1364891 - RNA, 20 nt, Human
cuccugggcagagauucugg

SEQ ID NO: 1364892 - RNA, 18 nt, Human
cucuccuagucugcccca

SEQ ID NO: 1364893 - RNA, 18 nt, Human
cucucuccccucacuccu

SEQ ID NO: 1364894 - RNA, 23 nt, Human
cugcaacuucugccucccagguu

SEQ ID NO: 1364895 - RNA, 24 nt, Human
cugcaacuucugccucccagguuc

SEQ ID NO: 1364896 - RNA, 23 nt, Human
cugccucagccucccaaguagcu

SEQ ID NO: 1364897 - RNA, 20 nt, Human
cugcugucuuucuguuucug

SEQ ID NO: 1364898 - RNA, 20 nt, Human
cuggaagccuucuuggggcc

SEQ ID NO: 1364899 - RNA, 25 nt, Human
cuggcccauggggaaccuguggcug

SEQ ID NO: 1364900 - RNA, 21 nt, Human
cuucagccuucuuccuaaauc

SEQ ID NO: 1364901 - RNA, 25 nt, Human
gaagcgcuggcucggccaggugugg

SEQ ID NO: 1364902 - RNA, 24 nt, Human
gacccugcuaugguuugggguagc

SEQ ID NO: 1364903 - RNA, 21 nt, Human
gacucacaccuguagucccag

SEQ ID NO: 1364904 - RNA, 20 nt, Human
gagaaggaacucuguagcuc

SEQ ID NO: 1364905 - RNA, 21 nt, Human
gagacagagccuugcucuguc

SEQ ID NO: 1364906 - RNA, 21 nt, Human
gagccugcucccaaccggggc

SEQ ID NO: 1364907 - RNA, 20 nt, Human
gagcgccagagugagauccu

SEQ ID NO: 1364908 - RNA, 19 nt, Human
gaggcaggggcagcagaag

SEQ ID NO: 1364909 - RNA, 18 nt, Human
gauuacaggcaugagcca

SEQ ID NO: 1364910 - RNA, 22 nt, Human
gauuacaggcaugagccaccgc

SEQ ID NO: 1364911 - RNA, 23 nt, Human
gauuacaggcaugagccaccgca

SEQ ID NO: 1364912 - RNA, 18 nt, Human
gauuacaggcgcccgcca

SEQ ID NO: 1364913 - RNA, 21 nt, Human
gcaaaaacagacucagacaga

SEQ ID NO: 1364914 - RNA, 22 nt, Human
gcaacuucugccucccagguuc

SEQ ID NO: 1364915 - RNA, 21 nt, Human
gcagcacagcugaccccacac

SEQ ID NO: 1364916 - RNA, 25 nt, Human
gcaggggcagcagaagagggcagag

SEQ ID NO: 1364917 - RNA, 22 nt, Human
gcccaggaguucgagaccagcc

SEQ ID NO: 1364918 - RNA, 20 nt, Human
gcccaggcuggagugcagug

SEQ ID NO: 1364919 - RNA, 24 nt, Human
gcccaggcuggagugcaguggcgu

SEQ ID NO: 1364920 - RNA, 22 nt, Human
gcccggcuaauuuuuguauuuu

SEQ ID NO: 1364921 - RNA, 25 nt, Human
gcucugucgcccaggcuggagugca

SEQ ID NO: 1364922 - RNA, 19 nt, Human
gcuggagugcaguggcgug

SEQ ID NO: 1364923 - RNA, 18 nt, Human
ggaagcucuccaccuggc

SEQ ID NO: 1364924 - RNA, 18 nt, Human
ggagagcacuaguguguc

SEQ ID NO: 1364925 - RNA, 19 nt, Human
ggagccugcucccaaccgg

SEQ ID NO: 1364926 - RNA, 20 nt, Human
ggaggcguaaagcuggccca

SEQ ID NO: 1364927 - RNA, 24 nt, Human
ggaucaccugagccugagaggcag

SEQ ID NO: 1364928 - RNA, 22 nt, Human
ggauuacaggcaugagccaccg

SEQ ID NO: 1364929 - RNA, 18 nt, Human
ggcccgucuuuccucucc

SEQ ID NO: 1364930 - RNA, 23 nt, Human
ggcgacagagcuacaggagugug

SEQ ID NO: 1364931 - RNA, 22 nt, Human
ggcuggagugcaguggcgugau

SEQ ID NO: 1364932 - RNA, 18 nt, Human
gggaaaaaaaaacaacaa

SEQ ID NO: 1364933 - RNA, 18 nt, Human
gggcagagauucuggaga

SEQ ID NO: 1364934 - RNA, 20 nt, Human
ggucucagacccuagaccuu

SEQ ID NO: 1364935 - RNA, 22 nt, Human
ggucucagacccuagaccuuau

SEQ ID NO: 1364936 - RNA, 24 nt, Human
ggugacucacaccuguagucccag

SEQ ID NO: 1364937 - RNA, 24 nt, Human
guaauucuccugccucagccuccc

SEQ ID NO: 1364938 - RNA, 18 nt, Human
guagcugggauuacaggc

SEQ ID NO: 1364939 - RNA, 24 nt, Human
gucauuuaagcccaggaguucgag

SEQ ID NO: 1364940 - RNA, 24 nt, Human
gugauccacccgccgcagccucuc

SEQ ID NO: 1364941 - RNA, 18 nt, Human
uaacuuaccccgucucag

SEQ ID NO: 1364942 - RNA, 23 nt, Human
uaagcccaggaguucgagaccag

SEQ ID NO: 1364943 - RNA, 20 nt, Human
uaauucuccugccucagccu

SEQ ID NO: 1364944 - RNA, 22 nt, Human
uaauuuuuguauuuuuauuaga

SEQ ID NO: 1364945 - RNA, 24 nt, Human
uacaggcaugagccaccgcaccca

SEQ ID NO: 1364946 - RNA, 23 nt, Human
uacaggcgcccgccaccacgccc

SEQ ID NO: 1364947 - RNA, 20 nt, Human
uacagugccggguucugucu

SEQ ID NO: 1364948 - RNA, 23 nt, Human
uaccccgucucagggaucuugcu

SEQ ID NO: 1364949 - RNA, 20 nt, Human
uagacacaggguuucgccau

SEQ ID NO: 1364950 - RNA, 22 nt, Human
uaggggcugagauuagaaaaaa

SEQ ID NO: 1364951 - RNA, 24 nt, Human
uauuagacacaggguuucgccaug

SEQ ID NO: 1364952 - RNA, 23 nt, Human
ucaaacaccuggccucaggugau

SEQ ID NO: 1364953 - RNA, 23 nt, Human
ucaaagugcugggauuacaggca

SEQ ID NO: 1364954 - RNA, 24 nt, Human
ucaaagugcugggauuacaggcau

SEQ ID NO: 1364955 - RNA, 23 nt, Human
ucacaccacugcacuccagagcg

SEQ ID NO: 1364956 - RNA, 24 nt, Human
ucaccugagccugagaggcagagu

SEQ ID NO: 1364957 - RNA, 21 nt, Human
ucacucaaccgcuccugccua

SEQ ID NO: 1364958 - RNA, 19 nt, Human
ucacucuguccucugucau

SEQ ID NO: 1364959 - RNA, 19 nt, Human
ucacugcaacuucugccuc

SEQ ID NO: 1364960 - RNA, 24 nt, Human
ucacugcaacuucugccucccagg

SEQ ID NO: 1364961 - RNA, 25 nt, Human
ucacugcaacuucugccucccaggu

SEQ ID NO: 1364962 - RNA, 18 nt, Human
ucagccucccaaguagcu

SEQ ID NO: 1364963 - RNA, 21 nt, Human
ucaggccacgagggcucugcc

SEQ ID NO: 1364964 - RNA, 22 nt, Human
ucauuuaagcccaggaguucga

SEQ ID NO: 1364965 - RNA, 27 nt, Human
uccacacucuagcuucaggacaucggg

SEQ ID NO: 1364966 - RNA, 24 nt, Human
ucccaaguagcugggauuacaggc

SEQ ID NO: 1364967 - RNA, 19 nt, Human
ucccagccuccagagcucu

SEQ ID NO: 1364968 - RNA, 24 nt, Human
ucccagccuccagagcucugagcc

SEQ ID NO: 1364969 - RNA, 21 nt, Human
ucccagguucaaguaauucuc

SEQ ID NO: 1364970 - RNA, 24 nt, Human
ucccagguucaaguaauucuccug

SEQ ID NO: 1364971 - RNA, 21 nt, Human
uccccgaaaaaaaaagaaaga

SEQ ID NO: 1364972 - RNA, 24 nt, Human
uccccgaaaaaaaaagaaagaaaa

SEQ ID NO: 1364973 - RNA, 18 nt, Human
ucccuggggcagggagcu

SEQ ID NO: 1364974 - RNA, 24 nt, Human
ucgcccaggcuggagugcaguggc

SEQ ID NO: 1364975 - RNA, 23 nt, Human
ucggccaggugugggggcucaca

SEQ ID NO: 1364976 - RNA, 24 nt, Human
ucucaaagugcugggauuacaggc

SEQ ID NO: 1364977 - RNA, 26 nt, Human
ucuccugccucagccucccaaguagc

SEQ ID NO: 1364978 - RNA, 24 nt, Human
ucugucgcccaggcuggagugcag

SEQ ID NO: 1364979 - RNA, 29 nt, Human
ugaaaugaggcaacguacaugugccccug

SEQ ID NO: 1364980 - RNA, 22 nt, Human
ugaaaugcgauugccacuguaa

SEQ ID NO: 1364981 - RNA, 26 nt, Human
ugaccccacacagcucaauccucagu

SEQ ID NO: 1364982 - RNA, 20 nt, Human
ugagaugggaggaucaccug

SEQ ID NO: 1364983 - RNA, 21 nt, Human
ugagaugggaggaucaccuga

SEQ ID NO: 1364984 - RNA, 24 nt, Human
ugagaugggaggaucaccugagcc

SEQ ID NO: 1364985 - RNA, 20 nt, Human
ugagccaauacauuucuguu

SEQ ID NO: 1364986 - RNA, 21 nt, Human
ugcaaugaucccuaaucacac

SEQ ID NO: 1364987 - RNA, 22 nt, Human
ugcaguggcgugaucucggcuc

SEQ ID NO: 1364988 - RNA, 24 nt, Human
ugccucagccucccaaguagcugg

SEQ ID NO: 1364989 - RNA, 22 nt, Human
ugccuccugggcagagauucug

SEQ ID NO: 1364990 - RNA, 24 nt, Human
ugcucugucgcccaggcuggagug

SEQ ID NO: 1364991 - RNA, 19 nt, Human
uggagugcaguggcgugau

SEQ ID NO: 1364992 - RNA, 23 nt, Human
uggagugcaguggcgugaucucg

SEQ ID NO: 1364993 - RNA, 24 nt, Human
uggagugcaguggcgugaucucgg

SEQ ID NO: 1364994 - RNA, 21 nt, Human
uggcagcacagcugaccccac

SEQ ID NO: 1364995 - RNA, 23 nt, Human
uggcaugguaauggaaaccugcu

SEQ ID NO: 1364996 - RNA, 23 nt, Human
uggccucaggugauccacccgcc

SEQ ID NO: 1364997 - RNA, 21 nt, Human
uggccugccuggcgugagcuc

SEQ ID NO: 1364998 - RNA, 20 nt, Human
uggcgugaucucggcucacu

SEQ ID NO: 1364999 - RNA, 18 nt, Human
uggcugggagcccaugag

SEQ ID NO: 1365000 - RNA, 18 nt, Human
ugggauuacaggcaugag

SEQ ID NO: 1365001 - RNA, 19 nt, Human
ugggauuacaggcaugagc

SEQ ID NO: 1365002 - RNA, 21 nt, Human
ugggauuacaggcaugagcca

SEQ ID NO: 1365003 - RNA, 22 nt, Human
ugggauuacaggcaugagccac

SEQ ID NO: 1365004 - RNA, 23 nt, Human
ugggauuacaggcaugagccacc

SEQ ID NO: 1365005 - RNA, 24 nt, Human
ugggauuacaggcaugagccaccg

SEQ ID NO: 1365006 - RNA, 24 nt, Human
ugggauuacaggcaugagccaccg

SEQ ID NO: 1365007 - RNA, 26 nt, Human
ugggauuacaggcaugagccaccgca

SEQ ID NO: 1365008 - RNA, 21 nt, Human
ugggauuacaggcgcccgcca

SEQ ID NO: 1365009 - RNA, 22 nt, Human
ugggauuacaggcgcccgccac

SEQ ID NO: 1365010 - RNA, 24 nt, Human
ugggauuacaggcgcccgccacca

SEQ ID NO: 1365011 - RNA, 24 nt, Human
uggugacucacaccuguaguccca

SEQ ID NO: 1365012 - RNA, 24 nt, Human
ugucaugggaagaugcagaagggu

SEQ ID NO: 1365013 - RNA, 24 nt, Human
ugucugggugagaaggaacucugu

SEQ ID NO: 1365014 - RNA, 24 nt, Human
uuauuagacacaggguuucgccau

SEQ ID NO: 1365015 - RNA, 21 nt, Human
uucaaguaauucuccugccuc

SEQ ID NO: 1365016 - RNA, 23 nt, Human
uucaaguaauucuccugccucag

SEQ ID NO: 1365017 - RNA, 24 nt, Human
uucaaguaauucuccugccucagc

SEQ ID NO: 1365018 - RNA, 22 nt, Human
uuccuaagcacaaauuagguuu

SEQ ID NO: 1365019 - RNA, 24 nt, Human
uugaaaugcgauugccacuguaac

SEQ ID NO: 1365020 - RNA, 24 nt, Human
uugcucugucgcccaggcuggagu

SEQ ID NO: 1365021 - RNA, 26 nt, Human
uuggugaggcugaggcagaagaguca

SEQ ID NO: 1365022 - RNA, 21 nt, Human
uuucgccaugcuggccaggcu

SEQ ID NO: 1365023 - RNA, 22 nt, Human
uuucuggcuuaggcccacuggc

SEQ ID NO: 1365024 - RNA, 20 nt, Human
uuuuguauuuuuauuagaca

SEQ ID NO: 1365025 - RNA, 24 nt, Human
uuuuuauuagacacaggguuucgc

SEQ ID NO: 1365026 - RNA, 18 nt, Human
uuuuuguauuuuuauuag

SEQ ID NO: 1365027 - RNA, 23 nt, Human
aaacccagccugggaggagcugu

SEQ ID NO: 1365028 - RNA, 20 nt, Human
aaagagggccugcaggggug

SEQ ID NO: 1365029 - RNA, 23 nt, Human
aaccacuuugccccaaacccagc

SEQ ID NO: 1365030 - RNA, 20 nt, Human
aaccuccgccuccugaauuc

SEQ ID NO: 1365031 - RNA, 22 nt, Human
aagaccagcaagagggccggga

SEQ ID NO: 1365032 - RNA, 23 nt, Human
aagaccagcaagagggccgggac

SEQ ID NO: 1365033 - RNA, 25 nt, Human
aagcaauccuccugccucagccucc

SEQ ID NO: 1365034 - RNA, 18 nt, Human
acacaggcagaggacacc

SEQ ID NO: 1365035 - RNA, 18 nt, Human
accauguuggccaggcug

SEQ ID NO: 1365036 - RNA, 21 nt, Human
acccagagccuuguguguccc

SEQ ID NO: 1365037 - RNA, 20 nt, Human
acccgcugccacccucccca

SEQ ID NO: 1365038 - RNA, 22 nt, Human
acccgcugccacccuccccacc

SEQ ID NO: 1365039 - RNA, 23 nt, Human
acccgcugccacccuccccaccg

SEQ ID NO: 1365040 - RNA, 22 nt, Human
acccgucucuccccuuccauca

SEQ ID NO: 1365041 - RNA, 19 nt, Human
agacagacaucuggauucu

SEQ ID NO: 1365042 - RNA, 24 nt, Human
agaggaacccacacagaacccaga

SEQ ID NO: 1365043 - RNA, 23 nt, Human
agcaaccacuuugccccaaaccc

SEQ ID NO: 1365044 - RNA, 18 nt, Human
agccccucucccugccuc

SEQ ID NO: 1365045 - RNA, 19 nt, Human
aggaaggaggggguggagg

SEQ ID NO: 1365046 - RNA, 20 nt, Human
aggaaggaggggguggaggg

SEQ ID NO: 1365047 - RNA, 21 nt, Human
aggaaggaggggguggagggc

SEQ ID NO: 1365048 - RNA, 25 nt, Human
aggaaucagcgugggugaucacggg

SEQ ID NO: 1365049 - RNA, 21 nt, Human
agggaggaaggagggggugga

SEQ ID NO: 1365050 - RNA, 23 nt, Human
agggccugcaggggugucccagg

SEQ ID NO: 1365051 - RNA, 22 nt, Human
aguagagaugggguuucaccau

SEQ ID NO: 1365052 - RNA, 20 nt, Human
agugcaguggcacaaucucg

SEQ ID NO: 1365053 - RNA, 24 nt, Human
agugcaguggcacaaucucggcuc

SEQ ID NO: 1365054 - RNA, 19 nt, Human
auccgugagaggaacccac

SEQ ID NO: 1365055 - RNA, 23 nt, Human
auccuccccaacccugggcgcca

SEQ ID NO: 1365056 - RNA, 21 nt, Human
auccuccugccucagccuccc

SEQ ID NO: 1365057 - RNA, 22 nt, Human
augggguuucaccauguuggcc

SEQ ID NO: 1365058 - RNA, 23 nt, Human
augggguuucaccauguuggcca

SEQ ID NO: 1365059 - RNA, 24 nt, Human
augggguuucaccauguuggccag

SEQ ID NO: 1365060 - RNA, 19 nt, Human
augugagcgcacacguaug

SEQ ID NO: 1365061 - RNA, 20 nt, Human
caaccuccgccuccugaauu

SEQ ID NO: 1365062 - RNA, 21 nt, Human
caagaccagcaagagggccgg

SEQ ID NO: 1365063 - RNA, 22 nt, Human
caagcaauccuccugccucagc

SEQ ID NO: 1365064 - RNA, 27 nt, Human
caagcaauccuccugccucagccuccc

SEQ ID NO: 1365065 - RNA, 26 nt, Human
caagcuccugaccucaggugauccaa

SEQ ID NO: 1365066 - RNA, 21 nt, Human
caagucccccccuuccacccc

SEQ ID NO: 1365067 - RNA, 22 nt, Human
cacagcccaggugugcuggucc

SEQ ID NO: 1365068 - RNA, 22 nt, Human
cacagccucacgugcaggugga

SEQ ID NO: 1365069 - RNA, 21 nt, Human
caccauguuggccaggcuggu

SEQ ID NO: 1365070 - RNA, 24 nt, Human
caccauguuggccaggcuggucuc

SEQ ID NO: 1365071 - RNA, 27 nt, Human
cacccccucccugcaggcuccacagcc

SEQ ID NO: 1365072 - RNA, 27 nt, Human
cacuuugccccaaacccagccugggag

SEQ ID NO: 1365073 - RNA, 22 nt, Human
cagcuacacccccaagagcagg

SEQ ID NO: 1365074 - RNA, 24 nt, Human
cagcucuccauccuccccaacccu

SEQ ID NO: 1365075 - RNA, 18 nt, Human
caggcuccacagcccagg

SEQ ID NO: 1365076 - RNA, 23 nt, Human
caggguuucagacccagggaacc

SEQ ID NO: 1365077 - RNA, 20 nt, Human
caggugccacacacacaugg

SEQ ID NO: 1365078 - RNA, 24 nt, Human
caggugccacacacacauggggug

SEQ ID NO: 1365079 - RNA, 18 nt, Human
cagguggagagacagaca

SEQ ID NO: 1365080 - RNA, 24 nt, Human
caggugugcugguccccagcucuc

SEQ ID NO: 1365081 - RNA, 21 nt, Human
caugucucgccagggaggaag

SEQ ID NO: 1365082 - RNA, 23 nt, Human
cauguuggccaggcuggucucaa

SEQ ID NO: 1365083 - RNA, 18 nt, Human
ccaacccugggcgccagc

SEQ ID NO: 1365084 - RNA, 22 nt, Human
ccaacgugcccacaggguccua

SEQ ID NO: 1365085 - RNA, 25 nt, Human
ccaauagcaaccacuuugccccaaa

SEQ ID NO: 1365086 - RNA, 23 nt, Human
ccaggacccgucucuccccuucc

SEQ ID NO: 1365087 - RNA, 24 nt, Human
ccagggaggaaggaggggguggag

SEQ ID NO: 1365088 - RNA, 19 nt, Human
cccacacagaacccagagc

SEQ ID NO: 1365089 - RNA, 20 nt, Human
cccacgcuggagugcagugg

SEQ ID NO: 1365090 - RNA, 21 nt, Human
ccccaaacccagccugggagg

SEQ ID NO: 1365091 - RNA, 19 nt, Human
cccccuuccacccccuccc

SEQ ID NO: 1365092 - RNA, 24 nt, Human
ccccgccucgggagccccucuccu

SEQ ID NO: 1365093 - RNA, 22 nt, Human
ccccucccugcaggcuccacag

SEQ ID NO: 1365094 - RNA, 25 nt, Human
ccccucccugcaggcuccacagccc

SEQ ID NO: 1365095 - RNA, 21 nt, Human
ccccuuccacccccucccugc

SEQ ID NO: 1365096 - RNA, 18 nt, Human
cccgcugccacccucccc

SEQ ID NO: 1365097 - RNA, 21 nt, Human
cccgcugccacccuccccacc

SEQ ID NO: 1365098 - RNA, 21 nt, Human
cccugggcgccagcuacaccc

SEQ ID NO: 1365099 - RNA, 22 nt, Human
cccugggcgccagcuacacccc

SEQ ID NO: 1365100 - RNA, 27 nt, Human
ccgccuccugaauucaagcaauccuuu

SEQ ID NO: 1365101 - RNA, 19 nt, Human
ccgcugccacccuccccac

SEQ ID NO: 1365102 - RNA, 21 nt, Human
ccuccauguuucuacuuggcc

SEQ ID NO: 1365103 - RNA, 22 nt, Human
ccuccauguuucuacuuggccu

SEQ ID NO: 1365104 - RNA, 25 nt, Human
ccuccugccucagccucccugguag

SEQ ID NO: 1365105 - RNA, 19 nt, Human
ccuccuguuccucuugagg

SEQ ID NO: 1365106 - RNA, 24 nt, Human
ccugaccucaggugauccacccac

SEQ ID NO: 1365107 - RNA, 23 nt, Human
ccugguagcugggacuacaggug

SEQ ID NO: 1365108 - RNA, 24 nt, Human
cgccuccugaauucaagcaauccu

SEQ ID NO: 1365109 - RNA, 20 nt, Human
cgcugccagccauggaauua

SEQ ID NO: 1365110 - RNA, 22 nt, Human
cggaggggcuggaagaagggga

SEQ ID NO: 1365111 - RNA, 21 nt, Human
cguaugucgcacauguaugug

SEQ ID NO: 1365112 - RNA, 22 nt, Human
cgucucuccccuuccaucaggg

SEQ ID NO: 1365113 - RNA, 24 nt, Human
cucagccucccugguagcugggac

SEQ ID NO: 1365114 - RNA, 20 nt, Human
cuccagcggggauggcaguu

SEQ ID NO: 1365115 - RNA, 18 nt, Human
cuccaggacccgucucuc

SEQ ID NO: 1365116 - RNA, 24 nt, Human
cugcaaccuccgccuccugaauuc

SEQ ID NO: 1365117 - RNA, 23 nt, Human
cugccucagccucccugguagcu

SEQ ID NO: 1365118 - RNA, 23 nt, Human
cuucaagucccccccuuccaccc

SEQ ID NO: 1365119 - RNA, 24 nt, Human
cuucaagucccccccuuccacccc

SEQ ID NO: 1365120 - RNA, 24 nt, Human
cuuguaguagagaugggguuucac

SEQ ID NO: 1365121 - RNA, 19 nt, Human
cuuugccccaaacccagcc

SEQ ID NO: 1365122 - RNA, 21 nt, Human
gaauagaagcugggcuucaag

SEQ ID NO: 1365123 - RNA, 18 nt, Human
gacccgucucuccccuuc

SEQ ID NO: 1365124 - RNA, 19 nt, Human
gacccgucucuccccuucc

SEQ ID NO: 1365125 - RNA, 22 nt, Human
gaccucaggugauccacccacc

SEQ ID NO: 1365126 - RNA, 21 nt, Human
gacuacaggugcacaccacca

SEQ ID NO: 1365127 - RNA, 21 nt, Human
gagacagacagacaucuggau

SEQ ID NO: 1365128 - RNA, 20 nt, Human
gagagaaagagggccugcag

SEQ ID NO: 1365129 - RNA, 20 nt, Human
gagaugggguuucaccaugu

SEQ ID NO: 1365130 - RNA, 24 nt, Human
gagaugggguuucaccauguuggc

SEQ ID NO: 1365131 - RNA, 19 nt, Human
gaggaaggaggggguggag

SEQ ID NO: 1365132 - RNA, 22 nt, Human
gcaaccuccgccuccugaauuc

SEQ ID NO: 1365133 - RNA, 22 nt, Human
gcccaauagcaaccacuuugcc

SEQ ID NO: 1365134 - RNA, 26 nt, Human
gcgcacacguaugucgcacauguaug

SEQ ID NO: 1365135 - RNA, 19 nt, Human
gcuccccugggcaggcugg

SEQ ID NO: 1365136 - RNA, 19 nt, Human
gcugcaaccuccgccuccu

SEQ ID NO: 1365137 - RNA, 19 nt, Human
gcuggagugcaguggcaca

SEQ ID NO: 1365138 - RNA, 23 nt, Human
gcuggucucaagcuccugaccuc

SEQ ID NO: 1365139 - RNA, 21 nt, Human
gcuucaagucccccccuucca

SEQ ID NO: 1365140 - RNA, 23 nt, Human
ggacccccuccauguuucuacuu

SEQ ID NO: 1365141 - RNA, 21 nt, Human
ggcgccccuuggagagaaaga

SEQ ID NO: 1365142 - RNA, 24 nt, Human
ggcuggucucaagcuccugaccuc

SEQ ID NO: 1365143 - RNA, 24 nt, Human
gggaggucaccaagcuggguagga

SEQ ID NO: 1365144 - RNA, 21 nt, Human
ggggaagugucuggcaugugg

SEQ ID NO: 1365145 - RNA, 19 nt, Human
ggggcuggaagaaggggaa

SEQ ID NO: 1365146 - RNA, 19 nt, Human
gggguggaccgagcaaggc

SEQ ID NO: 1365147 - RNA, 22 nt, Human
gggguuucaccauguuggccag

SEQ ID NO: 1365148 - RNA, 23 nt, Human
guagagaugggguuucaccaugu

SEQ ID NO: 1365149 - RNA, 24 nt, Human
guaguagagaugggguuucaccau

SEQ ID NO: 1365150 - RNA, 23 nt, Human
gucccccccuuccacccccuccc

SEQ ID NO: 1365151 - RNA, 24 nt, Human
uaauuucuguacuuguaguagaga

SEQ ID NO: 1365152 - RNA, 28 nt, Human
uacuaggccccccaggagaaagggcucc

SEQ ID NO: 1365153 - RNA, 22 nt, Human
uagagaugggguuucaccaugu

SEQ ID NO: 1365154 - RNA, 21 nt, Human
uaguagagaugggguuucacc

SEQ ID NO: 1365155 - RNA, 23 nt, Human
uaguagagaugggguuucaccau

SEQ ID NO: 1365156 - RNA, 24 nt, Human
uaguagagaugggguuucaccaug

SEQ ID NO: 1365157 - RNA, 26 nt, Human
uaguagagaugggguuucaccauguu

SEQ ID NO: 1365158 - RNA, 21 nt, Human
ucccagaaguggggauugaga

SEQ ID NO: 1365159 - RNA, 21 nt, Human
uccccaacccugggcgccagc

SEQ ID NO: 1365160 - RNA, 20 nt, Human
ucccugccuccccacggagg

SEQ ID NO: 1365161 - RNA, 21 nt, Human
ucccuggccacaugucucgcc

SEQ ID NO: 1365162 - RNA, 22 nt, Human
ucccugguagcugggacuacag

SEQ ID NO: 1365163 - RNA, 24 nt, Human
ucccugguagcugggacuacaggu

SEQ ID NO: 1365164 - RNA, 18 nt, Human
ucgcccacgcuggagugc

SEQ ID NO: 1365165 - RNA, 19 nt, Human
ucgcugcaaccuccgccuc

SEQ ID NO: 1365166 - RNA, 22 nt, Human
ucgcugcaaccuccgccuccug

SEQ ID NO: 1365167 - RNA, 23 nt, Human
ucgcugcaaccuccgccuccuga

SEQ ID NO: 1365168 - RNA, 27 nt, Human
ucgcugcaaccuccgccuccugaauuc

SEQ ID NO: 1365169 - RNA, 19 nt, Human
ucuccauccuccccaaccc

SEQ ID NO: 1365170 - RNA, 18 nt, Human
ucucuccccuuccaucag

SEQ ID NO: 1365171 - RNA, 24 nt, Human
ucugucgcccacgcuggagugcag

SEQ ID NO: 1365172 - RNA, 18 nt, Human
ucuugcucugucgcccac

SEQ ID NO: 1365173 - RNA, 23 nt, Human
ucuugcucugucgcccacgcugg

SEQ ID NO: 1365174 - RNA, 24 nt, Human
ucuugcucugucgcccacgcugga

SEQ ID NO: 1365175 - RNA, 21 nt, Human
ugaauucaagcaauccuccug

SEQ ID NO: 1365176 - RNA, 24 nt, Human
ugaauucaagcaauccuccugccu

SEQ ID NO: 1365177 - RNA, 19 nt, Human
ugaccucaggugauccacc

SEQ ID NO: 1365178 - RNA, 21 nt, Human
ugaccucaggugauccaccca

SEQ ID NO: 1365179 - RNA, 22 nt, Human
ugagggaggucaccaagcuggg

SEQ ID NO: 1365180 - RNA, 22 nt, Human
ugcaguggcacaaucucggcuc

SEQ ID NO: 1365181 - RNA, 19 nt, Human
ugccacacacacauggggu

SEQ ID NO: 1365182 - RNA, 19 nt, Human
ugccauggcaccuucaggg

SEQ ID NO: 1365183 - RNA, 24 nt, Human
ugccucagccucccugguagcugg

SEQ ID NO: 1365184 - RNA, 27 nt, Human
ugcuccagcggggauggcagugcuccu

SEQ ID NO: 1365185 - RNA, 24 nt, Human
ugcucugucgcccacgcuggagug

SEQ ID NO: 1365186 - RNA, 21 nt, Human
uggaaaucagauccgugagag

SEQ ID NO: 1365187 - RNA, 22 nt, Human
uggaagaaggggaagugucugg

SEQ ID NO: 1365188 - RNA, 23 nt, Human
uggagugcaguggcacaaucucg

SEQ ID NO: 1365189 - RNA, 24 nt, Human
uggagugcaguggcacaaucucgg

SEQ ID NO: 1365190 - RNA, 24 nt, Human
uggcacaaucucggcucgcugcaa

SEQ ID NO: 1365191 - RNA, 21 nt, Human
uggcagugcucccacuccucc

SEQ ID NO: 1365192 - RNA, 24 nt, Human
uggccaggcuggucucaagcuccu

SEQ ID NO: 1365193 - RNA, 22 nt, Human
ugggacuacaggugcacaccac

SEQ ID NO: 1365194 - RNA, 24 nt, Human
ugggacuacaggugcacaccacca

SEQ ID NO: 1365195 - RNA, 21 nt, Human
ugggaggagcugucugucuug

SEQ ID NO: 1365196 - RNA, 22 nt, Human
ugggguggaccgagcaaggcca

SEQ ID NO: 1365197 - RNA, 24 nt, Human
ugggguuucaccauguuggccagg

SEQ ID NO: 1365198 - RNA, 26 nt, Human
ugguagcugggacuacaggugcacac

SEQ ID NO: 1365199 - RNA, 20 nt, Human
ugguccccagcucuccaucc

SEQ ID NO: 1365200 - RNA, 22 nt, Human
ugucccagggcaggugccacac

SEQ ID NO: 1365201 - RNA, 22 nt, Human
ugucuugccauggcaccuucag

SEQ ID NO: 1365202 - RNA, 21 nt, Human
uucaagcaauccuccugccuc

SEQ ID NO: 1365203 - RNA, 24 nt, Human
uucaagcaauccuccugccucagc

SEQ ID NO: 1365204 - RNA, 24 nt, Human
uuucaccauguuggccaggcuggu

SEQ ID NO: 1365205 - RNA, 27 nt, Human
aaaaagcaccugcugcaccauaagccc

SEQ ID NO: 1365206 - RNA, 22 nt, Human
aaacaugaagaaaacggccugg

SEQ ID NO: 1365207 - RNA, 23 nt, Human
aaaccacacccccuguuccaacc

SEQ ID NO: 1365208 - RNA, 24 nt, Human
aaaguuuuauccgcuuucccauau

SEQ ID NO: 1365209 - RNA, 18 nt, Human
aagaacacccacaccccc

SEQ ID NO: 1365210 - RNA, 21 nt, Human
aagaaccagcucccagaaacc

SEQ ID NO: 1365211 - RNA, 22 nt, Human
aaggcagagagcugauggacug

SEQ ID NO: 1365212 - RNA, 22 nt, Human
aagggaacuucugggaccagcc

SEQ ID NO: 1365213 - RNA, 21 nt, Human
aaggugcuccagcgcaccaag

SEQ ID NO: 1365214 - RNA, 20 nt, Human
acaaacacaggcugugggcu

SEQ ID NO: 1365215 - RNA, 19 nt, Human
acacaggcugugggcugga

SEQ ID NO: 1365216 - RNA, 18 nt, Human
acaguaggcucgggaaug

SEQ ID NO: 1365217 - RNA, 20 nt, Human
accugggaugggguggggac

SEQ ID NO: 1365218 - RNA, 28 nt, Human
agaaaccacacccccuguuccaaccccc

SEQ ID NO: 1365219 - RNA, 24 nt, Human
agacgggcaccgagccacacuccc

SEQ ID NO: 1365220 - RNA, 19 nt, Human
aggaaacaaguguguccac

SEQ ID NO: 1365221 - RNA, 20 nt, Human
aggacucagaggaacuggca

SEQ ID NO: 1365222 - RNA, 21 nt, Human
aucuuuuaugugcugaaccag

SEQ ID NO: 1365223 - RNA, 21 nt, Human
auggaauuaagaaaaacaugc

SEQ ID NO: 1365224 - RNA, 24 nt, Human
auguuaggacacacccccaccugc

SEQ ID NO: 1365225 - RNA, 24 nt, Human
auuuggucuccaggugucaccuuu

SEQ ID NO: 1365226 - RNA, 20 nt, Human
cacacccccaccugcccucu

SEQ ID NO: 1365227 - RNA, 21 nt, Human
cacacccccuguuccaacccc

SEQ ID NO: 1365228 - RNA, 23 nt, Human
caccacgccagggugggcagggu

SEQ ID NO: 1365229 - RNA, 26 nt, Human
caccauaagcccaggaauguggcagc

SEQ ID NO: 1365230 - RNA, 24 nt, Human
cacccccuguuccaacccccagcc

SEQ ID NO: 1365231 - RNA, 20 nt, Human
cagcucccagaaaccacacc

SEQ ID NO: 1365232 - RNA, 22 nt, Human
cagcucccagaaaccacacccc

SEQ ID NO: 1365233 - RNA, 22 nt, Human
cauugccaucuccaagugcucu

SEQ ID NO: 1365234 - RNA, 21 nt, Human
ccacacccccuguuccaaccc

SEQ ID NO: 1365235 - RNA, 24 nt, Human
ccagaaaccacacccccuguucca

SEQ ID NO: 1365236 - RNA, 19 nt, Human
ccaggggucuggugucuuc

SEQ ID NO: 1365237 - RNA, 19 nt, Human
ccaguccccaggggguugc

SEQ ID NO: 1365238 - RNA, 23 nt, Human
ccagugcaaugaaaguuuuaucc

SEQ ID NO: 1365239 - RNA, 18 nt, Human
ccauggaauuaagaaaaa

SEQ ID NO: 1365240 - RNA, 21 nt, Human
cccacacccccuuguuacccu

SEQ ID NO: 1365241 - RNA, 18 nt, Human
cccagaaaccacaccccc

SEQ ID NO: 1365242 - RNA, 26 nt, Human
cccagccuggcuugagcguggggugg

SEQ ID NO: 1365243 - RNA, 24 nt, Human
ccccagaccuuuauaugcuucaga

SEQ ID NO: 1365244 - RNA, 21 nt, Human
cccccuguuccaacccccagc

SEQ ID NO: 1365245 - RNA, 20 nt, Human
cccuugguucucucugcagu

SEQ ID NO: 1365246 - RNA, 23 nt, Human
ccucaggagccugcuugugcucc

SEQ ID NO: 1365247 - RNA, 18 nt, Human
ccuggggucagccaggug

SEQ ID NO: 1365248 - RNA, 19 nt, Human
cggcaggcagccagccucc

SEQ ID NO: 1365249 - RNA, 20 nt, Human
cucccagaaaccacaccccc

SEQ ID NO: 1365250 - RNA, 24 nt, Human
cugauuuggaauuuaacauuuucc

SEQ ID NO: 1365251 - RNA, 25 nt, Human
cuggagccgggugggcagggcugca

SEQ ID NO: 1365252 - RNA, 22 nt, Human
cuuggcuuugugaggaaacgag

SEQ ID NO: 1365253 - RNA, 22 nt, Human
gaaccagcucccagaaaccaca

SEQ ID NO: 1365254 - RNA, 18 nt, Human
gaaccgaguguguccagg

SEQ ID NO: 1365255 - RNA, 18 nt, Human
gaagggucucaaguccag

SEQ ID NO: 1365256 - RNA, 19 nt, Human
gagcugacacuccacaaau

SEQ ID NO: 1365257 - RNA, 24 nt, Human
gagcugacacuccacaaaugaugc

SEQ ID NO: 1365258 - RNA, 20 nt, Human
gauguggcagcugcagcagg

SEQ ID NO: 1365259 - RNA, 21 nt, Human
gcaagcugggcaccccagggg

SEQ ID NO: 1365260 - RNA, 21 nt, Human
gcaaggcugaaaagaacaccc

SEQ ID NO: 1365261 - RNA, 25 nt, Human
gcaaggcugaaaagaacacccacac

SEQ ID NO: 1365262 - RNA, 21 nt, Human
gcacccacaugcuuagauagc

SEQ ID NO: 1365263 - RNA, 22 nt, Human
gcagagagcugauggacugucg

SEQ ID NO: 1365264 - RNA, 18 nt, Human
gcagcugcagcgggcuug

SEQ ID NO: 1365265 - RNA, 18 nt, Human
gcagcuguagcgggcuug

SEQ ID NO: 1365266 - RNA, 22 nt, Human
gccagggugggcaggguucugg

SEQ ID NO: 1365267 - RNA, 19 nt, Human
gccuggcuugagcgugggg

SEQ ID NO: 1365268 - RNA, 19 nt, Human
gcucccggcaggcagccag

SEQ ID NO: 1365269 - RNA, 23 nt, Human
ggaccuggggucagccagguggu

SEQ ID NO: 1365270 - RNA, 24 nt, Human
ggaccuggggucagccagguggug

SEQ ID NO: 1365271 - RNA, 19 nt, Human
ggacucagaggaacuggca

SEQ ID NO: 1365272 - RNA, 21 nt, Human
ggaggcggagcacugcugggg

SEQ ID NO: 1365273 - RNA, 21 nt, Human
ggaguuagggacuugggaggg

SEQ ID NO: 1365274 - RNA, 23 nt, Human
ggcaguuugugguuccugauuug

SEQ ID NO: 1365275 - RNA, 18 nt, Human
gggaccuggggucagcca

SEQ ID NO: 1365276 - RNA, 19 nt, Human
gggaugggguggggacagg

SEQ ID NO: 1365277 - RNA, 20 nt, Human
gggcaccgagccacacuccc

SEQ ID NO: 1365278 - RNA, 21 nt, Human
gggcaggguucuggagacggg

SEQ ID NO: 1365279 - RNA, 18 nt, Human
gggucucaaguccaggua

SEQ ID NO: 1365280 - RNA, 21 nt, Human
gggugggacuguguuggccag

SEQ ID NO: 1365281 - RNA, 22 nt, Human
ggugugaagggucucaagucca

SEQ ID NO: 1365282 - RNA, 18 nt, Human
gucaccuuucugccaugu

SEQ ID NO: 1365283 - RNA, 22 nt, Human
gucuucuucuguucuucaugcc

SEQ ID NO: 1365284 - RNA, 20 nt, Human
gugaccucugcaguacuccu

SEQ ID NO: 1365285 - RNA, 18 nt, Human
gugcucccggcaggcaga

SEQ ID NO: 1365286 - RNA, 19 nt, Human
gugcucccggcaggcagcc

SEQ ID NO: 1365287 - RNA, 22 nt, Human
guucugugacuucccugugacc

SEQ ID NO: 1365288 - RNA, 23 nt, Human
uaagaaaaacaugcaaaaauaau

SEQ ID NO: 1365289 - RNA, 21 nt, Human
uaagaaccagcucccagaaac

SEQ ID NO: 1365290 - RNA, 18 nt, Human
uaagggaguuagggacuu

SEQ ID NO: 1365291 - RNA, 18 nt, Human
uagcucgguggugaacag

SEQ ID NO: 1365292 - RNA, 24 nt, Human
uaguauuuugcagaugcuuuucuc

SEQ ID NO: 1365293 - RNA, 21 nt, Human
uccccaggcagcucucaggcu

SEQ ID NO: 1365294 - RNA, 22 nt, Human
uccccaggcagcucucaggcuc

SEQ ID NO: 1365295 - RNA, 19 nt, Human
ucccugcuucccacagcca

SEQ ID NO: 1365296 - RNA, 18 nt, Human
uccgcaggaccccgacca

SEQ ID NO: 1365297 - RNA, 25 nt, Human
uccugcauuuggucuccagguguca

SEQ ID NO: 1365298 - RNA, 22 nt, Human
ucuucuucuguucuucaugccc

SEQ ID NO: 1365299 - RNA, 25 nt, Human
ugaaaagaacacccacacccccuug

SEQ ID NO: 1365300 - RNA, 20 nt, Human
ugacaauaucuggcuggaag

SEQ ID NO: 1365301 - RNA, 22 nt, Human
ugacaauaucuggcuggaaggc

SEQ ID NO: 1365302 - RNA, 18 nt, Human
ugacuucccugugaccuc

SEQ ID NO: 1365303 - RNA, 19 nt, Human
ugaggaaacaagugugucc

SEQ ID NO: 1365304 - RNA, 20 nt, Human
ugaugcuggagccggguggg

SEQ ID NO: 1365305 - RNA, 24 nt, Human
ugcaaugacaauaucuggcuggaa

SEQ ID NO: 1365306 - RNA, 20 nt, Human
ugcauuuggucuccaggugu

SEQ ID NO: 1365307 - RNA, 22 nt, Human
ugcugcaccauaagcccaggaa

SEQ ID NO: 1365308 - RNA, 22 nt, Human
uggaggcggagcacugcugggg

SEQ ID NO: 1365309 - RNA, 18 nt, Human
uggauuuggccugaaggc

SEQ ID NO: 1365310 - RNA, 21 nt, Human
uggcagcugcagcagguuugg

SEQ ID NO: 1365311 - RNA, 21 nt, Human
uggccagaggccgagaggagg

SEQ ID NO: 1365312 - RNA, 20 nt, Human
uggcuugagcgugggguggg

SEQ ID NO: 1365313 - RNA, 23 nt, Human
ugggaccagccuugaaagauggg

SEQ ID NO: 1365314 - RNA, 18 nt, Human
ugggaugggguggggaca

SEQ ID NO: 1365315 - RNA, 18 nt, Human
ugggaugggguggggaca

SEQ ID NO: 1365316 - RNA, 21 nt, Human
uggggucagccagguggugac

SEQ ID NO: 1365317 - RNA, 21 nt, Human
uggggugggugggaggcaagc

SEQ ID NO: 1365318 - RNA, 21 nt, Human
uggggugugaagggucucaag

SEQ ID NO: 1365319 - RNA, 22 nt, Human
ugggugggaggcaagcugggca

SEQ ID NO: 1365320 - RNA, 23 nt, Human
uggugaccugggauggggugggg

SEQ ID NO: 1365321 - RNA, 21 nt, Human
uggugucuuccccaggcagcu

SEQ ID NO: 1365322 - RNA, 24 nt, Human
uguccagggauguggcagcuguag

SEQ ID NO: 1365323 - RNA, 19 nt, Human
ugugaagggucucaagucc

SEQ ID NO: 1365324 - RNA, 18 nt, Human
ugugagguucagcauugc

SEQ ID NO: 1365325 - RNA, 21 nt, Human
ugugagguucagcauugccau

SEQ ID NO: 1365326 - RNA, 24 nt, Human
uguggcagcugcagcagguuuggc

SEQ ID NO: 1365327 - RNA, 24 nt, Human
uguggcagcugcagcgggcuuggc

SEQ ID NO: 1365328 - RNA, 26 nt, Human
ugugugggcaaagggaacuucuggga

SEQ ID NO: 1365329 - RNA, 19 nt, Human
uuacaaacacaggcugugg

SEQ ID NO: 1365330 - RNA, 19 nt, Human
uuccaacccccagccuggc

SEQ ID NO: 1365331 - RNA, 23 nt, Human
uuccagugcaaugaaaguuuuau

SEQ ID NO: 1365332 - RNA, 24 nt, Human
uucccauauaaaaauucuucccac

SEQ ID NO: 1365333 - RNA, 22 nt, Human
uuccccaggcagcucucaggcu

SEQ ID NO: 1365334 - RNA, 20 nt, Human
uucuucuguucuucaugccc

SEQ ID NO: 1365335 - RNA, 27 nt, Human
uugaaaaaagcaccugcugcaccauaa

SEQ ID NO: 1365336 - RNA, 23 nt, Human
uugaugugcacucccccagaccu

SEQ ID NO: 1365337 - RNA, 24 nt, Human
uuggaggcggagcacugcuggggu

SEQ ID NO: 1365338 - RNA, 23 nt, Human
uuuauccgcuuucccauauaaaa

SEQ ID NO: 1365339 - RNA, 25 nt, Human
uuucuggucaugaugagcuuccacu

SEQ ID NO: 1365340 - RNA, 19 nt, Human
aaaaaaaaaaagaaaaaga

SEQ ID NO: 1365341 - RNA, 22 nt, Human
aaaaaaaaaagaaaaagaaaag

SEQ ID NO: 1365342 - RNA, 22 nt, Human
aaaagaaaaagaaaagcuuucc

SEQ ID NO: 1365343 - RNA, 22 nt, Human
aaaagcccugcacccacaaagg

SEQ ID NO: 1365344 - RNA, 20 nt, Human
aaacaggggcccgucuuccc

SEQ ID NO: 1365345 - RNA, 19 nt, Human
aaacugaaacugaaggcca

SEQ ID NO: 1365346 - RNA, 20 nt, Human
aaagaaaagcuuuccuggug

SEQ ID NO: 1365347 - RNA, 25 nt, Human
aaaggcaccaucugcucucagaaac

SEQ ID NO: 1365348 - RNA, 21 nt, Human
aacucugggcaaaguggggcc

SEQ ID NO: 1365349 - RNA, 23 nt, Human
aagaaaacagaagagaaguuuca

SEQ ID NO: 1365350 - RNA, 20 nt, Human
aagaugccgauggguuacaa

SEQ ID NO: 1365351 - RNA, 26 nt, Human
aagcuugcucgccagggcacaccgcc

SEQ ID NO: 1365352 - RNA, 21 nt, Human
aaguccaagaacuaaagcuga

SEQ ID NO: 1365353 - RNA, 21 nt, Human
aaguggggccagggaggucac

SEQ ID NO: 1365354 - RNA, 18 nt, Human
aauggccucacaggaggg

SEQ ID NO: 1365355 - RNA, 23 nt, Human
acaaaccucugcacaccccagag

SEQ ID NO: 1365356 - RNA, 21 nt, Human
acagccaaagaaaacagaaga

SEQ ID NO: 1365357 - RNA, 20 nt, Human
accccagccugcccaagggc

SEQ ID NO: 1365358 - RNA, 18 nt, Human
acgggaggcgccugcagg

SEQ ID NO: 1365359 - RNA, 22 nt, Human
agacagaggccacccaggccca

SEQ ID NO: 1365360 - RNA, 18 nt, Human
agagcugggaugcagggc

SEQ ID NO: 1365361 - RNA, 19 nt, Human
agaggaugauaggacuugu

SEQ ID NO: 1365362 - RNA, 19 nt, Human
agauggcaaacaggggccc

SEQ ID NO: 1365363 - RNA, 22 nt, Human
agcacguggcaaacgcgcagug

SEQ ID NO: 1365364 - RNA, 18 nt, Human
agcaggcagucuggggag

SEQ ID NO: 1365365 - RNA, 20 nt, Human
agcccugcacccacaaaggc

SEQ ID NO: 1365366 - RNA, 24 nt, Human
agcugcccgcccccaccgugcccc

SEQ ID NO: 1365367 - RNA, 24 nt, Human
agcuuccacaaggaaccugacggg

SEQ ID NO: 1365368 - RNA, 18 nt, Human
aggcagucuggggagggg

SEQ ID NO: 1365369 - RNA, 22 nt, Human
aggcugacaauuuccacaaaag

SEQ ID NO: 1365370 - RNA, 20 nt, Human
agggacuaaacgagcagcaa

SEQ ID NO: 1365371 - RNA, 22 nt, Human
agggagaaguuugaaaaacugg

SEQ ID NO: 1365372 - RNA, 26 nt, Human
agugcucagccugcugcaccacggau

SEQ ID NO: 1365373 - RNA, 19 nt, Human
aucucccuauuucucucca

SEQ ID NO: 1365374 - RNA, 25 nt, Human
caaagaacgcacuccuggcaagcga

SEQ ID NO: 1365375 - RNA, 18 nt, Human
caaaggcaccaucugcuc

SEQ ID NO: 1365376 - RNA, 28 nt, Human
cacaaaagcccugcacccacaaaggcac

SEQ ID NO: 1365377 - RNA, 19 nt, Human
cacacgcagcaggcucggc

SEQ ID NO: 1365378 - RNA, 24 nt, Human
caccacggaugaggggagcuucca

SEQ ID NO: 1365379 - RNA, 21 nt, Human
cacccacucacccucccacag

SEQ ID NO: 1365380 - RNA, 25 nt, Human
caccccagccugcccaagggccugg

SEQ ID NO: 1365381 - RNA, 24 nt, Human
caccccucuguccugucuacaaau

SEQ ID NO: 1365382 - RNA, 21 nt, Human
cacccucccacagggaacacc

SEQ ID NO: 1365383 - RNA, 24 nt, Human
cacugccaaugcccaagguuaccu

SEQ ID NO: 1365384 - RNA, 23 nt, Human
cacugcguucucaugcuggguuu

SEQ ID NO: 1365385 - RNA, 23 nt, Human
cacugcguucucaugcuggguuu

SEQ ID NO: 1365386 - RNA, 25 nt, Human
cacugcguucucaugcuggguuuuu

SEQ ID NO: 1365387 - RNA, 22 nt, Human
cacuuuguuauuuuucacaaag

SEQ ID NO: 1365388 - RNA, 21 nt, Human
cagaugcacauaauaaccuug

SEQ ID NO: 1365389 - RNA, 21 nt, Human
cagcaggggcagggggcaggc

SEQ ID NO: 1365390 - RNA, 18 nt, Human
cagcccagcgcgacacgg

SEQ ID NO: 1365391 - RNA, 21 nt, Human
cagccucugaaacgagcucaa

SEQ ID NO: 1365392 - RNA, 22 nt, Human
caggagagacgaacaugcccgg

SEQ ID NO: 1365393 - RNA, 22 nt, Human
cagggcacaccgcccguaacac

SEQ ID NO: 1365394 - RNA, 21 nt, Human
cagggcauuuuucaacaaaga

SEQ ID NO: 1365395 - RNA, 18 nt, Human
cagggggcaggcaccccu

SEQ ID NO: 1365396 - RNA, 23 nt, Human
ccagcccagcgcgacacggccuc

SEQ ID NO: 1365397 - RNA, 21 nt, Human
cccagagcugggaugcagggc

SEQ ID NO: 1365398 - RNA, 25 nt, Human
cccagccugcccaagggccugggag

SEQ ID NO: 1365399 - RNA, 18 nt, Human
cccaggagccuugugggg

SEQ ID NO: 1365400 - RNA, 21 nt, Human
ccccaccgugccccacaccca

SEQ ID NO: 1365401 - RNA, 19 nt, Human
ccccaugcuauacgugcuc

SEQ ID NO: 1365402 - RNA, 20 nt, Human
cccccgagauggcaaacagg

SEQ ID NO: 1365403 - RNA, 21 nt, Human
ccccugggcauuugguggggc

SEQ ID NO: 1365404 - RNA, 20 nt, Human
cccggaggcccaggagccuu

SEQ ID NO: 1365405 - RNA, 24 nt, Human
cccguaacacccacugcaggggca

SEQ ID NO: 1365406 - RNA, 25 nt, Human
ccgcccccaccgugccccacaccca

SEQ ID NO: 1365407 - RNA, 23 nt, Human
ccguaacacccacugcaggggca

SEQ ID NO: 1365408 - RNA, 20 nt, Human
ccucacccacucacccuccc

SEQ ID NO: 1365409 - RNA, 24 nt, Human
ccucacccacucacccucccacag

SEQ ID NO: 1365410 - RNA, 21 nt, Human
ccugaccccaaccguuaccac

SEQ ID NO: 1365411 - RNA, 26 nt, Human
ccugaccccaaccguuaccacccgac

SEQ ID NO: 1365412 - RNA, 21 nt, Human
ccugguucggcugauacagcc

SEQ ID NO: 1365413 - RNA, 22 nt, Human
cgcacuccuggcaagcgagucu

SEQ ID NO: 1365414 - RNA, 20 nt, Human
cgcccguaacacccacugca

SEQ ID NO: 1365415 - RNA, 19 nt, Human
cgcgacacggccucuguac

SEQ ID NO: 1365416 - RNA, 23 nt, Human
cggcugauacagccaaagaaaac

SEQ ID NO: 1365417 - RNA, 21 nt, Human
cucacccucccacagggaaca

SEQ ID NO: 1365418 - RNA, 23 nt, Human
cuccugguucggcugauacagcc

SEQ ID NO: 1365419 - RNA, 24 nt, Human
cugcacccacaaaggcaccaucug

SEQ ID NO: 1365420 - RNA, 18 nt, Human
cugcguucucaugcuggg

SEQ ID NO: 1365421 - RNA, 19 nt, Human
cuuccuggaugagaaacug

SEQ ID NO: 1365422 - RNA, 23 nt, Human
cuucuugggggccccaugggccc

SEQ ID NO: 1365423 - RNA, 23 nt, Human
cuugaauuugcuggggccuggga

SEQ ID NO: 1365424 - RNA, 23 nt, Human
cuugccccugggcauuugguggg

SEQ ID NO: 1365425 - RNA, 21 nt, Human
gaaaucaaggcaggccaggga

SEQ ID NO: 1365426 - RNA, 21 nt, Human
gaggggaugccggacucugcc

SEQ ID NO: 1365427 - RNA, 20 nt, Human
gcacguggcaaacgcgcagu

SEQ ID NO: 1365428 - RNA, 18 nt, Human
gcaggcuccagcugcucc

SEQ ID NO: 1365429 - RNA, 19 nt, Human
gcccgcccccaccgugccc

SEQ ID NO: 1365430 - RNA, 22 nt, Human
gccucacccacucacccuccca

SEQ ID NO: 1365431 - RNA, 18 nt, Human
gcugcaccacggaugagg

SEQ ID NO: 1365432 - RNA, 20 nt, Human
ggagaaguuugaaaaacugg

SEQ ID NO: 1365433 - RNA, 20 nt, Human
ggaggggaugccggacucug

SEQ ID NO: 1365434 - RNA, 19 nt, Human
ggaugccggacucugcccg

SEQ ID NO: 1365435 - RNA, 19 nt, Human
ggcaaaguggggccaggga

SEQ ID NO: 1365436 - RNA, 21 nt, Human
gggacuaaacgagcagcaaag

SEQ ID NO: 1365437 - RNA, 23 nt, Human
gggcacagaacugaggucagggg

SEQ ID NO: 1365438 - RNA, 20 nt, Human
gguguuuaaaaaaaaaaaaa

SEQ ID NO: 1365439 - RNA, 18 nt, Human
gucaccuuaaaauaaauu

SEQ ID NO: 1365440 - RNA, 21 nt, Human
gucgcagcccaggccucuccu

SEQ ID NO: 1365441 - RNA, 20 nt, Human
gugccagcaggggcaggggg

SEQ ID NO: 1365442 - RNA, 24 nt, Human
guggccucugccgucaccccagcc

SEQ ID NO: 1365443 - RNA, 25 nt, Human
guguuuaaaaaaaaaaaaaaaagaa

SEQ ID NO: 1365444 - RNA, 22 nt, Human
uaagaaaguauuaaacuucugu

SEQ ID NO: 1365445 - RNA, 22 nt, Human
uaagaaccaaaaguucgaaugc

SEQ ID NO: 1365446 - RNA, 22 nt, Human
uagaagacacuggaauggccuc

SEQ ID NO: 1365447 - RNA, 24 nt, Human
uagcuauaccuggggggaccccaa

SEQ ID NO: 1365448 - RNA, 19 nt, Human
uauuuugcauguuauuaac

SEQ ID NO: 1365449 - RNA, 18 nt, Human
ucacccacucacccuccc

SEQ ID NO: 1365450 - RNA, 19 nt, Human
ucagccucugaaacgagcu

SEQ ID NO: 1365451 - RNA, 22 nt, Human
uccacaaaagcccugcacccac

SEQ ID NO: 1365452 - RNA, 23 nt, Human
ucccacagggaacacccccgaga

SEQ ID NO: 1365453 - RNA, 22 nt, Human
ucccuggagacacaaaccucug

SEQ ID NO: 1365454 - RNA, 20 nt, Human
uccguggggaagguagcggg

SEQ ID NO: 1365455 - RNA, 20 nt, Human
uccuggaagaugccgauggg

SEQ ID NO: 1365456 - RNA, 19 nt, Human
ucgauuuuaaaaaggaucc

SEQ ID NO: 1365457 - RNA, 21 nt, Human
ucgcagcccaggccucuccug

SEQ ID NO: 1365458 - RNA, 20 nt, Human
ucuacaaaugcuguggcuca

SEQ ID NO: 1365459 - RNA, 24 nt, Human
ucucagagaugcaaagacagaggc

SEQ ID NO: 1365460 - RNA, 25 nt, Human
ucuccaagcaagcucacaucaaccc

SEQ ID NO: 1365461 - RNA, 18 nt, Human
ucucccuauuucucucca

SEQ ID NO: 1365462 - RNA, 25 nt, Human
ucucuggagcuucaaagcugcucuu

SEQ ID NO: 1365463 - RNA, 18 nt, Human
ucugccgucaccccagcc

SEQ ID NO: 1365464 - RNA, 25 nt, Human
ucuugccccugggcauuuggugggg

SEQ ID NO: 1365465 - RNA, 21 nt, Human
ucuuggcccagcacagaccuu

SEQ ID NO: 1365466 - RNA, 21 nt, Human
ugaauuugcuggggccuggga

SEQ ID NO: 1365467 - RNA, 22 nt, Human
ugacaauuuccacaaaagcccu

SEQ ID NO: 1365468 - RNA, 23 nt, Human
ugagaaacugaaacugaaggcca

SEQ ID NO: 1365469 - RNA, 24 nt, Human
ugagcagaggaugauaggacuugu

SEQ ID NO: 1365470 - RNA, 18 nt, Human
ugcaccacggaugagggg

SEQ ID NO: 1365471 - RNA, 22 nt, Human
ugcacccacaaaggcaccaucu

SEQ ID NO: 1365472 - RNA, 18 nt, Human
ugcagggcugcaggggug

SEQ ID NO: 1365473 - RNA, 19 nt, Human
ugccagcaggggcaggggg

SEQ ID NO: 1365474 - RNA, 21 nt, Human
ugccccacacccaccuuggaa

SEQ ID NO: 1365475 - RNA, 27 nt, Human
ugcugcaacuguuuacauguauuggga

SEQ ID NO: 1365476 - RNA, 19 nt, Human
ugcuggggccugggaaggu

SEQ ID NO: 1365477 - RNA, 20 nt, Human
ugcuggggccugggaagguc

SEQ ID NO: 1365478 - RNA, 18 nt, Human
ugcuguggccucugccgu

SEQ ID NO: 1365479 - RNA, 24 nt, Human
uggaaaaauaacagaugcacauaa

SEQ ID NO: 1365480 - RNA, 21 nt, Human
uggagaguccgcuucuugggg

SEQ ID NO: 1365481 - RNA, 23 nt, Human
uggagcuucaaagcugcucuugg

SEQ ID NO: 1365482 - RNA, 19 nt, Human
uggcacacgccccagucuc

SEQ ID NO: 1365483 - RNA, 19 nt, Human
uggccucugccgucacccc

SEQ ID NO: 1365484 - RNA, 20 nt, Human
uggggaggggaugccggacu

SEQ ID NO: 1365485 - RNA, 24 nt, Human
ugggggccccaugggcccccacuu

SEQ ID NO: 1365486 - RNA, 22 nt, Human
uggugcuguggccucugccguc

SEQ ID NO: 1365487 - RNA, 23 nt, Human
ugguggggcacagaacugagguc

SEQ ID NO: 1365488 - RNA, 23 nt, Human
uguggggaagggagccggguuuu

SEQ ID NO: 1365489 - RNA, 18 nt, Human
uguggggacucagccucu

SEQ ID NO: 1365490 - RNA, 24 nt, Human
uuaaaaaaaaaaaaaaaagaaaaa

SEQ ID NO: 1365491 - RNA, 22 nt, Human
uuaccacccgacuccuucucag

SEQ ID NO: 1365492 - RNA, 24 nt, Human
uuccugaccccaaccguuaccacc

SEQ ID NO: 1365493 - RNA, 21 nt, Human
uugguggggcacagaacugag

SEQ ID NO: 1365494 - RNA, 26 nt, Human
uuuaaaaaaaaaaaaaaaagaaaaag

SEQ ID NO: 1365495 - RNA, 21 nt, Human
uuucgcuucagggcauuuuuc

SEQ ID NO: 1365496 - RNA, 27 nt, Human
uuuuucaacaaagaacgcacuccuggg

SEQ ID NO: 1365497 - RNA, 24 nt, Human
aaaaaacaaaaagaguugacaggu

SEQ ID NO: 1365498 - RNA, 18 nt, Human
aaaauuagcugggcaugg

SEQ ID NO: 1365499 - RNA, 19 nt, Human
aaagugcuggaauuauagg

SEQ ID NO: 1365500 - RNA, 24 nt, Human
aaagugcuggaauuauaggcauga

SEQ ID NO: 1365501 - RNA, 20 nt, Human
aaagugcugggauuacaggc

SEQ ID NO: 1365502 - RNA, 24 nt, Human
aaagugcugggauuacaggccuga

SEQ ID NO: 1365503 - RNA, 19 nt, Human
aacacagugaaaccccauc

SEQ ID NO: 1365504 - RNA, 20 nt, Human
aacacagugaaaccccaucu

SEQ ID NO: 1365505 - RNA, 21 nt, Human
aacacagugaaaccccaucuc

SEQ ID NO: 1365506 - RNA, 21 nt, Human
aacacagugaaaccccaucuc

SEQ ID NO: 1365507 - RNA, 19 nt, Human
aacaugaugaaaccccauc

SEQ ID NO: 1365508 - RNA, 20 nt, Human
aacaugaugaaaccccaucu

SEQ ID NO: 1365509 - RNA, 20 nt, Human
aacaugaugaaaccccaucu

SEQ ID NO: 1365510 - RNA, 21 nt, Human
aacaugaugaaaccccaucuc

SEQ ID NO: 1365511 - RNA, 23 nt, Human
aagaaucacuugaaccugggagg

SEQ ID NO: 1365512 - RNA, 22 nt, Human
aagccuuggcaaagcucacaug

SEQ ID NO: 1365513 - RNA, 26 nt, Human
aagugcuggaauuauaggcaugagcc

SEQ ID NO: 1365514 - RNA, 19 nt, Human
aagugcugggauuacaggc

SEQ ID NO: 1365515 - RNA, 19 nt, Human
aagugcugggauuacaggc

SEQ ID NO: 1365516 - RNA, 26 nt, Human
aagugcugggauuacaggccugagcc

SEQ ID NO: 1365517 - RNA, 24 nt, Human
aaucacuugaaccugggaggcgga

SEQ ID NO: 1365518 - RNA, 21 nt, Human
aauuauaggcaugagccaccg

SEQ ID NO: 1365519 - RNA, 24 nt, Human
aauuauaggcaugagccaccgugc

SEQ ID NO: 1365520 - RNA, 19 nt, Human
acaagagugaaacuccauc

SEQ ID NO: 1365521 - RNA, 20 nt, Human
acaagagugaaacuccaucu

SEQ ID NO: 1365522 - RNA, 21 nt, Human
acaagagugaaacuccaucuc

SEQ ID NO: 1365523 - RNA, 19 nt, Human
acaagugcgaaaccccauc

SEQ ID NO: 1365524 - RNA, 18 nt, Human
acaaugucuguaaucugu

SEQ ID NO: 1365525 - RNA, 20 nt, Human
acacuguaauucaaaggaua

SEQ ID NO: 1365526 - RNA, 26 nt, Human
acagaacaggacagggauuuucaaag

SEQ ID NO: 1365527 - RNA, 24 nt, Human
acagcacuccagccugggugaaag

SEQ ID NO: 1365528 - RNA, 21 nt, Human
accagucuggcaaacaugaug

SEQ ID NO: 1365529 - RNA, 22 nt, Human
accauugcacuccagccugggc

SEQ ID NO: 1365530 - RNA, 24 nt, Human
accccaucucuacuaaaaauacaa

SEQ ID NO: 1365531 - RNA, 24 nt, Human
accccaucucuacuaaaaauacaa

SEQ ID NO: 1365532 - RNA, 18 nt, Human
acgggguuucacuauguu

SEQ ID NO: 1365533 - RNA, 23 nt, Human
acgggguuucacuauguuggcca

SEQ ID NO: 1365534 - RNA, 24 nt, Human
acgggguuucacuauguuggccag

SEQ ID NO: 1365535 - RNA, 24 nt, Human
acuauguuggccaggauggucuug

SEQ ID NO: 1365536 - RNA, 25 nt, Human
acuccagccugggugacaagaguga

SEQ ID NO: 1365537 - RNA, 18 nt, Human
agaagccuuggcaaagcu

SEQ ID NO: 1365538 - RNA, 23 nt, Human
agaaguugcagugagcugagauc

SEQ ID NO: 1365539 - RNA, 24 nt, Human
agaaguugcagugagcugagaucg

SEQ ID NO: 1365540 - RNA, 18 nt, Human
agacaauccaccugccuu

SEQ ID NO: 1365541 - RNA, 18 nt, Human
agacaauccaccugccuu

SEQ ID NO: 1365542 - RNA, 24 nt, Human
agcacuuuaggaugccgagguggg

SEQ ID NO: 1365543 - RNA, 24 nt, Human
agcacuuugggaggccgagguggg

SEQ ID NO: 1365544 - RNA, 19 nt, Human
agcagaaauugggcauaag

SEQ ID NO: 1365545 - RNA, 23 nt, Human
agccgggcaugguggcgggugcc

SEQ ID NO: 1365546 - RNA, 24 nt, Human
agccugggugaaagaccgagacuc

SEQ ID NO: 1365547 - RNA, 20 nt, Human
agcugggcaugguggugggc

SEQ ID NO: 1365548 - RNA, 24 nt, Human
aggaagcugaggcaggagaauggu

SEQ ID NO: 1365549 - RNA, 21 nt, Human
aggaguuggagaccagucugg

SEQ ID NO: 1365550 - RNA, 22 nt, Human
aggcagaagaaucacuugaacc

SEQ ID NO: 1365551 - RNA, 24 nt, Human
aggcagaagaaucacuugaaccug

SEQ ID NO: 1365552 - RNA, 20 nt, Human
aggcagaaguugcagugagc

SEQ ID NO: 1365553 - RNA, 24 nt, Human
aggcagaaguugcagugagcugag

SEQ ID NO: 1365554 - RNA, 18 nt, Human
aggcaggagaauggcuug

SEQ ID NO: 1365555 - RNA, 18 nt, Human
aggcaggagaauggugug

SEQ ID NO: 1365556 - RNA, 21 nt, Human
aggcaggagaauggugugaac

SEQ ID NO: 1365557 - RNA, 22 nt, Human
aggcaggagaauggugugaacc

SEQ ID NO: 1365558 - RNA, 24 nt, Human
aggcaggagaauggugugaaccug

SEQ ID NO: 1365559 - RNA, 19 nt, Human
aggcaugagccaccgugcc

SEQ ID NO: 1365560 - RNA, 20 nt, Human
aggcaugagccaccgugccu

SEQ ID NO: 1365561 - RNA, 23 nt, Human
aggcaugagccaccgugccuggc

SEQ ID NO: 1365562 - RNA, 21 nt, Human
aggccgaggugggcggaucac

SEQ ID NO: 1365563 - RNA, 24 nt, Human
aggcggagguugcagugagccgag

SEQ ID NO: 1365564 - RNA, 24 nt, Human
aggcugaggcagaagaaucacuug

SEQ ID NO: 1365565 - RNA, 24 nt, Human
aggcugaggcaggagaauggcuug

SEQ ID NO: 1365566 - RNA, 18 nt, Human
aggguuucuguccaguau

SEQ ID NO: 1365567 - RNA, 23 nt, Human
aggugauggauacuuuacccuaa

SEQ ID NO: 1365568 - RNA, 24 nt, Human
aggugcgguggcucacgccuguaa

SEQ ID NO: 1365569 - RNA, 21 nt, Human
agguggagguugcagugagcc

SEQ ID NO: 1365570 - RNA, 24 nt, Human
agguggagguugcagugagccgag

SEQ ID NO: 1365571 - RNA, 24 nt, Human
aggugggcggaucacaaggucagg

SEQ ID NO: 1365572 - RNA, 20 nt, Human
aguaagugacugaaggcugc

SEQ ID NO: 1365573 - RNA, 19 nt, Human
aguaaucccagcuacucgg

SEQ ID NO: 1365574 - RNA, 24 nt, Human
agucuggcaaacaugaugaaaccc

SEQ ID NO: 1365575 - RNA, 24 nt, Human
agugcugggauuacaggccugagc

SEQ ID NO: 1365576 - RNA, 24 nt, Human
aguggcgcaugccuguaaucccag

SEQ ID NO: 1365577 - RNA, 22 nt, Human
auauuguaggccugaaucaaaa

SEQ ID NO: 1365578 - RNA, 24 nt, Human
aucgugccacagcacuccagccug

SEQ ID NO: 1365579 - RNA, 24 nt, Human
aucgugccauugcacuccagccug

SEQ ID NO: 1365580 - RNA, 24 nt, Human
auugcacuccagccugggcaacaa

SEQ ID NO: 1365581 - RNA, 21 nt, Human
auugcacuccagccuggguga

SEQ ID NO: 1365582 - RNA, 24 nt, Human
auuguaccauugcacuccagccug

SEQ ID NO: 1365583 - RNA, 23 nt, Human
caaaaaacaaaaagaguugacag

SEQ ID NO: 1365584 - RNA, 24 nt, Human
caaagugcuggaauuauaggcaug

SEQ ID NO: 1365585 - RNA, 20 nt, Human
caagcuccuuucacuccaaa

SEQ ID NO: 1365586 - RNA, 22 nt, Human
cacagcacuccagccuggguga

SEQ ID NO: 1365587 - RNA, 24 nt, Human
cacagcacuccagccugggugaaa

SEQ ID NO: 1365588 - RNA, 23 nt, Human
caccaguaaucccagcuacucgg

SEQ ID NO: 1365589 - RNA, 24 nt, Human
caccaguaaucccagcuacucggg

SEQ ID NO: 1365590 - RNA, 24 nt, Human
cacgccuguaaucccagcacuuug

SEQ ID NO: 1365591 - RNA, 18 nt, Human
cacuauguuggccaggau

SEQ ID NO: 1365592 - RNA, 24 nt, Human
cacuauguuggccaggauggucuu

SEQ ID NO: 1365593 - RNA, 20 nt, Human
cacuccagccugggcaacaa

SEQ ID NO: 1365594 - RNA, 22 nt, Human
cacuccagccugggcaacaagu

SEQ ID NO: 1365595 - RNA, 23 nt, Human
cacuccagccugggcaacaagug

SEQ ID NO: 1365596 - RNA, 18 nt, Human
cacuccagccugggugaa

SEQ ID NO: 1365597 - RNA, 20 nt, Human
cacuccagccugggugaaag

SEQ ID NO: 1365598 - RNA, 23 nt, Human
cacuccagccugggugacaagag

SEQ ID NO: 1365599 - RNA, 24 nt, Human
cacuccagccugggugacaagagu

SEQ ID NO: 1365600 - RNA, 25 nt, Human
cacuccagccugggugacaagagug

SEQ ID NO: 1365601 - RNA, 21 nt, Human
cacuugaaccugggaggcgga

SEQ ID NO: 1365602 - RNA, 24 nt, Human
cagaugauccgccugccuuggccc

SEQ ID NO: 1365603 - RNA, 24 nt, Human
cagcacuuuaggaugccgaggugg

SEQ ID NO: 1365604 - RNA, 24 nt, Human
cagcacuuugggaggccgaggugg

SEQ ID NO: 1365605 - RNA, 26 nt, Human
cagcaugaauuaucgccaugucucuu

SEQ ID NO: 1365606 - RNA, 24 nt, Human
cagcuacucgggaggcugaggcag

SEQ ID NO: 1365607 - RNA, 24 nt, Human
caguuacuugagaggcugaggcag

SEQ ID NO: 1365608 - RNA, 24 nt, Human
caugccuguaaucccaguuacuug

SEQ ID NO: 1365609 - RNA, 23 nt, Human
caugccugucaucucagcacuuu

SEQ ID NO: 1365610 - RNA, 22 nt, Human
caugguggcgggugccuguagu

SEQ ID NO: 1365611 - RNA, 18 nt, Human
cauugcacuccagccugg

SEQ ID NO: 1365612 - RNA, 19 nt, Human
cauugcacuccagccuggg

SEQ ID NO: 1365613 - RNA, 19 nt, Human
cauugcacuccagccuggg

SEQ ID NO: 1365614 - RNA, 21 nt, Human
cauugcacuccagccugggca

SEQ ID NO: 1365615 - RNA, 24 nt, Human
cauugcacuccagccugggcaaca

SEQ ID NO: 1365616 - RNA, 21 nt, Human
cauugcacuccagccugggug

SEQ ID NO: 1365617 - RNA, 22 nt, Human
cauugcacuccagccuggguga

SEQ ID NO: 1365618 - RNA, 24 nt, Human
cauugcacuccagccugggugaca

SEQ ID NO: 1365619 - RNA, 25 nt, Human
cauugcacuccagccugggugacaa

SEQ ID NO: 1365620 - RNA, 22 nt, Human
ccaaagugcuggaauuauaggc

SEQ ID NO: 1365621 - RNA, 24 nt, Human
ccaaagugcuggaauuauaggcau

SEQ ID NO: 1365622 - RNA, 20 nt, Human
ccacagcacuccagccuggg

SEQ ID NO: 1365623 - RNA, 21 nt, Human
ccacagcacuccagccugggu

SEQ ID NO: 1365624 - RNA, 21 nt, Human
ccacagcacuccagccugggu

SEQ ID NO: 1365625 - RNA, 23 nt, Human
ccacagcacuccagccuggguga

SEQ ID NO: 1365626 - RNA, 21 nt, Human
ccagccugggugaaagaccga

SEQ ID NO: 1365627 - RNA, 23 nt, Human
ccaggcccaugguguggcgcugg

SEQ ID NO: 1365628 - RNA, 18 nt, Human
ccauugcacuccagccug

SEQ ID NO: 1365629 - RNA, 20 nt, Human
ccauugcacuccagccuggg

SEQ ID NO: 1365630 - RNA, 20 nt, Human
ccauugcacuccagccuggg

SEQ ID NO: 1365631 - RNA, 21 nt, Human
ccauugcacuccagccugggc

SEQ ID NO: 1365632 - RNA, 23 nt, Human
ccauugcacuccagccugggcaa

SEQ ID NO: 1365633 - RNA, 24 nt, Human
ccauugcacuccagccugggcaac

SEQ ID NO: 1365634 - RNA, 21 nt, Human
ccauugcacuccagccugggu

SEQ ID NO: 1365635 - RNA, 21 nt, Human
ccauugcacuccagccugggu

SEQ ID NO: 1365636 - RNA, 22 nt, Human
ccauugcacuccagccugggug

SEQ ID NO: 1365637 - RNA, 24 nt, Human
ccauugcacuccagccugggugac

SEQ ID NO: 1365638 - RNA, 23 nt, Human
ccccugauuugcgugaacuccug

SEQ ID NO: 1365639 - RNA, 24 nt, Human
cccggcuaacacagugaaacccca

SEQ ID NO: 1365640 - RNA, 23 nt, Human
ccucagguggggacaagaagugg

SEQ ID NO: 1365641 - RNA, 21 nt, Human
ccugaccucagacaauccacc

SEQ ID NO: 1365642 - RNA, 23 nt, Human
ccugaccucagacaauccaccug

SEQ ID NO: 1365643 - RNA, 18 nt, Human
ccugaccucagaugaucc

SEQ ID NO: 1365644 - RNA, 21 nt, Human
ccugaccucagaugauccgcc

SEQ ID NO: 1365645 - RNA, 23 nt, Human
ccugaccucagaugauccgccug

SEQ ID NO: 1365646 - RNA, 22 nt, Human
ccugccuuggcccuccaaagug

SEQ ID NO: 1365647 - RNA, 19 nt, Human
ccugggaggcggagguugc

SEQ ID NO: 1365648 - RNA, 21 nt, Human
ccugggagguggagguugcag

SEQ ID NO: 1365649 - RNA, 22 nt, Human
ccuguaaucccagcacuuuggg

SEQ ID NO: 1365650 - RNA, 22 nt, Human
ccuguaaucccaguuacuugag

SEQ ID NO: 1365651 - RNA, 21 nt, Human
ccuguagucccagcuacucag

SEQ ID NO: 1365652 - RNA, 24 nt, Human
cgagguggguggaccaucugaggu

SEQ ID NO: 1365653 - RNA, 23 nt, Human
cgccuguaaucccagcacuuugg

SEQ ID NO: 1365654 - RNA, 22 nt, Human
cggcuaacacagugaaacccca

SEQ ID NO: 1365655 - RNA, 24 nt, Human
cgggguuucacuauguuggccagg

SEQ ID NO: 1365656 - RNA, 19 nt, Human
cuaggcuuccagggggucc

SEQ ID NO: 1365657 - RNA, 22 nt, Human
cuaguaauagauuucaauaaga

SEQ ID NO: 1365658 - RNA, 18 nt, Human
cucaaaaacugagcuccc

SEQ ID NO: 1365659 - RNA, 22 nt, Human
cucacgccuguaaucccagcac

SEQ ID NO: 1365660 - RNA, 24 nt, Human
cucacgccuguaaucccagcacuu

SEQ ID NO: 1365661 - RNA, 24 nt, Human
cucaugccugucaucucagcacuu

SEQ ID NO: 1365662 - RNA, 22 nt, Human
cuccugaccucagacaauccac

SEQ ID NO: 1365663 - RNA, 26 nt, Human
cuccugaccucagaugauccgccugc

SEQ ID NO: 1365664 - RNA, 21 nt, Human
cugcaggucacagggccacag

SEQ ID NO: 1365665 - RNA, 23 nt, Human
cuggcaaacaugaugaaacccca

SEQ ID NO: 1365666 - RNA, 18 nt, Human
cugucugccuguggauuu

SEQ ID NO: 1365667 - RNA, 18 nt, Human
gaaagugcugggauuaca

SEQ ID NO: 1365668 - RNA, 21 nt, Human
gaccaucugaggucaggaguu

SEQ ID NO: 1365669 - RNA, 21 nt, Human
gaccaucugaggucaggaguu

SEQ ID NO: 1365670 - RNA, 23 nt, Human
gaccaucugaggucaggaguugg

SEQ ID NO: 1365671 - RNA, 24 nt, Human
gaccaucugaggucaggaguugga

SEQ ID NO: 1365672 - RNA, 23 nt, Human
gaccucagacaauccaccugccu

SEQ ID NO: 1365673 - RNA, 24 nt, Human
gaccucagaugauccgccugccuu

SEQ ID NO: 1365674 - RNA, 23 nt, Human
gagaucgugccacagcacuccag

SEQ ID NO: 1365675 - RNA, 23 nt, Human
gagauuguaccauugcacuccag

SEQ ID NO: 1365676 - RNA, 24 nt, Human
gaggugggcggaucacaaggucag

SEQ ID NO: 1365677 - RNA, 23 nt, Human
gagguggguggaccaucugaggu

SEQ ID NO: 1365678 - RNA, 25 nt, Human
gagguggguggaccaucugagguca

SEQ ID NO: 1365679 - RNA, 23 nt, Human
gagguugcagugagccgagaucg

SEQ ID NO: 1365680 - RNA, 23 nt, Human
gagguugcagugagccgagauug

SEQ ID NO: 1365681 - RNA, 18 nt, Human
gauuacaggccugagcca

SEQ ID NO: 1365682 - RNA, 22 nt, Human
gauuacaggccugagccacugc

SEQ ID NO: 1365683 - RNA, 23 nt, Human
gauuacaggccugagccacugca

SEQ ID NO: 1365684 - RNA, 21 nt, Human
gcaaacaugaugaaaccccau

SEQ ID NO: 1365685 - RNA, 18 nt, Human
gcaaagcucacaugaccu

SEQ ID NO: 1365686 - RNA, 23 nt, Human
gcagaagaaucacuugaaccugg

SEQ ID NO: 1365687 - RNA, 19 nt, Human
gccacagcacuccagccug

SEQ ID NO: 1365688 - RNA, 19 nt, Human
gccauugcacuccagccug

SEQ ID NO: 1365689 - RNA, 24 nt, Human
gccauugcacuccagccuggguga

SEQ ID NO: 1365690 - RNA, 20 nt, Human
gccuguaaucccaguuacuu

SEQ ID NO: 1365691 - RNA, 26 nt, Human
ggacaagaaguggaaaccuaugcaga

SEQ ID NO: 1365692 - RNA, 20 nt, Human
ggagguugcagugagccgag

SEQ ID NO: 1365693 - RNA, 22 nt, Human
ggagguugcagugagccgagau

SEQ ID NO: 1365694 - RNA, 22 nt, Human
ggagguugcagugagccgagau

SEQ ID NO: 1365695 - RNA, 24 nt, Human
ggagguugcagugagccgagaucg

SEQ ID NO: 1365696 - RNA, 24 nt, Human
ggagguugcagugagccgagauug

SEQ ID NO: 1365697 - RNA, 24 nt, Human
ggauggucuugaacuccugaccuc

SEQ ID NO: 1365698 - RNA, 18 nt, Human
ggccaggagaagccuugg

SEQ ID NO: 1365699 - RNA, 21 nt, Human
ggccaggugcgguggcucacg

SEQ ID NO: 1365700 - RNA, 18 nt, Human
ggcccuccaaagugcugg

SEQ ID NO: 1365701 - RNA, 21 nt, Human
ggcggaucacaaggucaggag

SEQ ID NO: 1365702 - RNA, 21 nt, Human
ggcucaugccugucaucucag

SEQ ID NO: 1365703 - RNA, 20 nt, Human
gggaggccgaggugggcgga

SEQ ID NO: 1365704 - RNA, 24 nt, Human
gggcgucguggcucaugccuguca

SEQ ID NO: 1365705 - RNA, 23 nt, Human
gggguuucacuauguuggccagg

SEQ ID NO: 1365706 - RNA, 22 nt, Human
ggguuucacuauguuggccagg

SEQ ID NO: 1365707 - RNA, 21 nt, Human
gguggaccaucugaggucagg

SEQ ID NO: 1365708 - RNA, 23 nt, Human
gguggcucacgccuguaauccca

SEQ ID NO: 1365709 - RNA, 24 nt, Human
gguggcucacgccuguaaucccag

SEQ ID NO: 1365710 - RNA, 23 nt, Human
guagaguuccucuucagcaugaa

SEQ ID NO: 1365711 - RNA, 18 nt, Human
gucagggcucgaucuuua

SEQ ID NO: 1365712 - RNA, 25 nt, Human
gugaaagaccgagacuccaucuaca

SEQ ID NO: 1365713 - RNA, 24 nt, Human
gugaaccugggagguggagguugc

SEQ ID NO: 1365714 - RNA, 19 nt, Human
guggcauaauggccaggug

SEQ ID NO: 1365715 - RNA, 21 nt, Human
guggcgcugggcugucugccu

SEQ ID NO: 1365716 - RNA, 23 nt, Human
guggcucacgccuguaaucccag

SEQ ID NO: 1365717 - RNA, 22 nt, Human
guggcucaugccugucaucuca

SEQ ID NO: 1365718 - RNA, 19 nt, Human
guugcagugagccgagauu

SEQ ID NO: 1365719 - RNA, 24 nt, Human
guugcagugagcugagaucgugcc

SEQ ID NO: 1365720 - RNA, 20 nt, Human
uaaaugcuagaggugaugga

SEQ ID NO: 1365721 - RNA, 24 nt, Human
uaacugaaguaucagcaaacugaa

SEQ ID NO: 1365722 - RNA, 26 nt, Human
uaagaaaaaaaauuuaagcuauggga

SEQ ID NO: 1365723 - RNA, 21 nt, Human
uaagcggcucggacccucagc

SEQ ID NO: 1365724 - RNA, 22 nt, Human
uacaggccugagccacugcacc

SEQ ID NO: 1365725 - RNA, 24 nt, Human
uaccauugcacuccagccugggca

SEQ ID NO: 1365726 - RNA, 20 nt, Human
uaccugcaggucacagggcc

SEQ ID NO: 1365727 - RNA, 21 nt, Human
uagaauggaacagaacaggaa

SEQ ID NO: 1365728 - RNA, 21 nt, Human
uagccgggcaugguggcgggu

SEQ ID NO: 1365729 - RNA, 24 nt, Human
uaguggcgcaugccuguaauccca

SEQ ID NO: 1365730 - RNA, 24 nt, Human
uaguuaaaggcuuucccacauuca

SEQ ID NO: 1365731 - RNA, 18 nt, Human
ucacaaggucaggagauu

SEQ ID NO: 1365732 - RNA, 22 nt, Human
ucacaaggucaggagauugacc

SEQ ID NO: 1365733 - RNA, 23 nt, Human
ucacacacgcaaaaaaaggagga

SEQ ID NO: 1365734 - RNA, 24 nt, Human
ucacuugaaccugggaggcggagg

SEQ ID NO: 1365735 - RNA, 25 nt, Human
ucacuugaaccugggaggcggaggu

SEQ ID NO: 1365736 - RNA, 18 nt, Human
ucagaguccagggcuagu

SEQ ID NO: 1365737 - RNA, 24 nt, Human
ucagaguccagggcuaguuaaagg

SEQ ID NO: 1365738 - RNA, 19 nt, Human
ucagggcucgaucuuuaac

SEQ ID NO: 1365739 - RNA, 21 nt, Human
ucaguguacuuuauucaucca

SEQ ID NO: 1365740 - RNA, 20 nt, Human
uccacagcgagugcccccgc

SEQ ID NO: 1365741 - RNA, 19 nt, Human
uccagccugggugacaaga

SEQ ID NO: 1365742 - RNA, 21 nt, Human
ucccugagugagcaauuccua

SEQ ID NO: 1365743 - RNA, 18 nt, Human
ucggacccucagcuggac

SEQ ID NO: 1365744 - RNA, 21 nt, Human
ucucuacuaaaaauacaaaaa

SEQ ID NO: 1365745 - RNA, 22 nt, Human
ucucuacuaaaaauacaaaaaa

SEQ ID NO: 1365746 - RNA, 20 nt, Human
ucugaggucaggaguuggag

SEQ ID NO: 1365747 - RNA, 23 nt, Human
ucugaggucaggaguuggagacc

SEQ ID NO: 1365748 - RNA, 19 nt, Human
ugaaaccccaucucuacua

SEQ ID NO: 1365749 - RNA, 19 nt, Human
ugaaaccccaucucuacua

SEQ ID NO: 1365750 - RNA, 18 nt, Human
ugaaagaccgagacucca

SEQ ID NO: 1365751 - RNA, 24 nt, Human
ugaaccugggaggcggagguugca

SEQ ID NO: 1365752 - RNA, 19 nt, Human
ugaaccugggagguggagg

SEQ ID NO: 1365753 - RNA, 24 nt, Human
ugaaccugggagguggagguugca

SEQ ID NO: 1365754 - RNA, 21 nt, Human
ugaaguaucagcaaacugaaa

SEQ ID NO: 1365755 - RNA, 23 nt, Human
ugacaugaggccaggagaagccu

SEQ ID NO: 1365756 - RNA, 18 nt, Human
ugaccucagaugauccgc

SEQ ID NO: 1365757 - RNA, 22 nt, Human
ugaccuucaagcuccuuucacu

SEQ ID NO: 1365758 - RNA, 22 nt, Human
ugagaacuuguggcugggcguc

SEQ ID NO: 1365759 - RNA, 24 nt, Human
ugagaggcugaggcagaagaauca

SEQ ID NO: 1365760 - RNA, 24 nt, Human
ugagaucgugccauugcacuccag

SEQ ID NO: 1365761 - RNA, 22 nt, Human
ugagcaauuccuaucccucuua

SEQ ID NO: 1365762 - RNA, 22 nt, Human
ugagccgagaucgugccacagc

SEQ ID NO: 1365763 - RNA, 22 nt, Human
ugagccgagauuguaccauugc

SEQ ID NO: 1365764 - RNA, 24 nt, Human
ugaggcagaagaaucacuugaacc

SEQ ID NO: 1365765 - RNA, 24 nt, Human
ugaggcagaagaaucacuugaacc

SEQ ID NO: 1365766 - RNA, 20 nt, Human
ugaggcaggagaauggcuuc

SEQ ID NO: 1365767 - RNA, 24 nt, Human
ugaggcaggagaauggugugaacc

SEQ ID NO: 1365768 - RNA, 24 nt, Human
ugaggcaggagaauggugugaacc

SEQ ID NO: 1365769 - RNA, 19 nt, Human
ugcacuccagccugggcaa

SEQ ID NO: 1365770 - RNA, 22 nt, Human
ugcacuccagccugggcaacaa

SEQ ID NO: 1365771 - RNA, 22 nt, Human
ugcacuccagccugggugacaa

SEQ ID NO: 1365772 - RNA, 23 nt, Human
ugcacuccagccugggugacaag

SEQ ID NO: 1365773 - RNA, 24 nt, Human
ugcaugagagggucgugaucgauu

SEQ ID NO: 1365774 - RNA, 20 nt, Human
ugccacagcacuccagccug

SEQ ID NO: 1365775 - RNA, 23 nt, Human
ugccauauaaggcauaaagauau

SEQ ID NO: 1365776 - RNA, 22 nt, Human
ugccauauucuucacacuugua

SEQ ID NO: 1365777 - RNA, 22 nt, Human
ugccuguaaucccaguuacuug

SEQ ID NO: 1365778 - RNA, 23 nt, Human
ugccuguaaucccaguuacuuga

SEQ ID NO: 1365779 - RNA, 24 nt, Human
ugccuguagucccagcuacucagg

SEQ ID NO: 1365780 - RNA, 19 nt, Human
uggaagcagaaauugggca

SEQ ID NO: 1365781 - RNA, 18 nt, Human
uggaauuauaggcaugag

SEQ ID NO: 1365782 - RNA, 21 nt, Human
uggaauuauaggcaugagcca

SEQ ID NO: 1365783 - RNA, 22 nt, Human
uggaauuauaggcaugagccac

SEQ ID NO: 1365784 - RNA, 23 nt, Human
uggaauuauaggcaugagccacc

SEQ ID NO: 1365785 - RNA, 24 nt, Human
uggaauuauaggcaugagccaccg

SEQ ID NO: 1365786 - RNA, 23 nt, Human
uggaccaucugaggucaggaguu

SEQ ID NO: 1365787 - RNA, 27 nt, Human
uggaccaucugaggucaggaguuggag

SEQ ID NO: 1365788 - RNA, 22 nt, Human
uggagguggugguaaaagcacu

SEQ ID NO: 1365789 - RNA, 21 nt, Human
uggcaaagcucacaugaccuu

SEQ ID NO: 1365790 - RNA, 19 nt, Human
uggcaaagugacaaguaga

SEQ ID NO: 1365791 - RNA, 24 nt, Human
uggccaggauggucuugaacuccu

SEQ ID NO: 1365792 - RNA, 24 nt, Human
uggccaggugcgguggcucacgcc

SEQ ID NO: 1365793 - RNA, 21 nt, Human
uggcgcaugccuguaauccca

SEQ ID NO: 1365794 - RNA, 22 nt, Human
uggcgcaugccuguaaucccag

SEQ ID NO: 1365795 - RNA, 24 nt, Human
uggcgggugccuguagucccagcu

SEQ ID NO: 1365796 - RNA, 22 nt, Human
uggcucacgccuguaaucccag

SEQ ID NO: 1365797 - RNA, 24 nt, Human
uggcucacgccuguaaucccagca

SEQ ID NO: 1365798 - RNA, 24 nt, Human
uggcugggcgucguggcucaugcc

SEQ ID NO: 1365799 - RNA, 20 nt, Human
uggcuugauaccaggaggca

SEQ ID NO: 1365800 - RNA, 23 nt, Human
ugggaacaauucaacucauuugc

SEQ ID NO: 1365801 - RNA, 19 nt, Human
ugggaggccgaggugggcg

SEQ ID NO: 1365802 - RNA, 24 nt, Human
ugggaggccgaggugggcggauca

SEQ ID NO: 1365803 - RNA, 29 nt, Human
ugggaggcggagguugcagugacaacggu

SEQ ID NO: 1365804 - RNA, 24 nt, Human
ugggaggcggagguugcagugagc

SEQ ID NO: 1365805 - RNA, 18 nt, Human
ugggagguggagguugca

SEQ ID NO: 1365806 - RNA, 29 nt, Human
ugggagguggagguugcagugacaacggu

SEQ ID NO: 1365807 - RNA, 24 nt, Human
ugggagguggagguugcagugagc

SEQ ID NO: 1365808 - RNA, 19 nt, Human
ugggauuacaggccugagc

SEQ ID NO: 1365809 - RNA, 21 nt, Human
ugggauuacaggccugagcca

SEQ ID NO: 1365810 - RNA, 22 nt, Human
ugggauuacaggccugagccac

SEQ ID NO: 1365811 - RNA, 22 nt, Human
ugggauuacaggccugagccac

SEQ ID NO: 1365812 - RNA, 24 nt, Human
ugggauuacaggccugagccacug

SEQ ID NO: 1365813 - RNA, 24 nt, Human
ugggauuacaggccugagccacug

SEQ ID NO: 1365814 - RNA, 23 nt, Human
ugggcaacaagugcgaaacccca

SEQ ID NO: 1365815 - RNA, 24 nt, Human
uggguggaccaucugaggucagga

SEQ ID NO: 1365816 - RNA, 24 nt, Human
ugguggcgggugccuguaguccca

SEQ ID NO: 1365817 - RNA, 24 nt, Human
uggugugaaccugggagguggagg

SEQ ID NO: 1365818 - RNA, 21 nt, Human
uguaggguuucuguccaguau

SEQ ID NO: 1365819 - RNA, 25 nt, Human
uguccaguauaaauuauguguaaua

SEQ ID NO: 1365820 - RNA, 19 nt, Human
uguggcaaccauauaaacg

SEQ ID NO: 1365821 - RNA, 22 nt, Human
uguggcugggcgucguggcuca

SEQ ID NO: 1365822 - RNA, 22 nt, Human
uuaaaguuaguggcauaauggc

SEQ ID NO: 1365823 - RNA, 22 nt, Human
uuagaauggaacagaacaggac

SEQ ID NO: 1365824 - RNA, 24 nt, Human
uuagccgggcaugguggcgggugc

SEQ ID NO: 1365825 - RNA, 18 nt, Human
uuagcugggcaugguggu

SEQ ID NO: 1365826 - RNA, 24 nt, Human
uuagcugggcaugguggugggcac

SEQ ID NO: 1365827 - RNA, 20 nt, Human
uucauacauuuccaggguuu

SEQ ID NO: 1365828 - RNA, 24 nt, Human
uuccucagacgggguuucacuaug

SEQ ID NO: 1365829 - RNA, 21 nt, Human
uucuauacaaugucuguaauc

SEQ ID NO: 1365830 - RNA, 24 nt, Human
uugaaccugggaggcggagguugc

SEQ ID NO: 1365831 - RNA, 25 nt, Human
uugagaggcugaggcagaagaauca

SEQ ID NO: 1365832 - RNA, 18 nt, Human
uugcagugagccgagauc

SEQ ID NO: 1365833 - RNA, 22 nt, Human
uugcagugagccgagaucgugc

SEQ ID NO: 1365834 - RNA, 23 nt, Human
uugcagugagccgagaucgugcc

SEQ ID NO: 1365835 - RNA, 19 nt, Human
uugcagugagccgagauug

SEQ ID NO: 1365836 - RNA, 22 nt, Human
uugcagugagccgagauuguac

SEQ ID NO: 1365837 - RNA, 18 nt, Human
uugcagugagcugagauc

SEQ ID NO: 1365838 - RNA, 21 nt, Human
uugcagugagcugagaucgug

SEQ ID NO: 1365839 - RNA, 22 nt, Human
uugcagugagcugagaucgugc

SEQ ID NO: 1365840 - RNA, 18 nt, Human
uuggagccuguaagcggc

SEQ ID NO: 1365841 - RNA, 25 nt, Human
uugggaggccgaggugggcggauca

SEQ ID NO: 1365842 - RNA, 23 nt, Human
uuguaccauugcacuccagccug

SEQ ID NO: 1365843 - RNA, 18 nt, Human
uuuacuucuucuuucuuu

SEQ ID NO: 1365844 - RNA, 19 nt, Human
uuucacuauguuggccagg

SEQ ID NO: 1365845 - RNA, 24 nt, Human
uuucauacauuuccaggguuucac

SEQ ID NO: 1365846 - RNA, 20 nt, Human
aaaaacaaauaaggccugac

SEQ ID NO: 1365847 - RNA, 26 nt, Human
aaacaaacaaaacuccacagaaacaa

SEQ ID NO: 1365848 - RNA, 19 nt, Human
aaacaaaucacagacacuu

SEQ ID NO: 1365849 - RNA, 21 nt, Human
aaacaaaucacagacacuuua

SEQ ID NO: 1365850 - RNA, 21 nt, Human
aaagcuugggagcacaaccaa

SEQ ID NO: 1365851 - RNA, 19 nt, Human
aaagguggaugugugggcu

SEQ ID NO: 1365852 - RNA, 20 nt, Human
aaaguccagauucagugugg

SEQ ID NO: 1365853 - RNA, 24 nt, Human
aacaaaauuuacaucaaccaauaa

SEQ ID NO: 1365854 - RNA, 21 nt, Human
aacaaacaaaacuccacagaa

SEQ ID NO: 1365855 - RNA, 23 nt, Human
aaccaaacccacagaugggccua

SEQ ID NO: 1365856 - RNA, 27 nt, Human
aaccucucccucuuucuccccacccac

SEQ ID NO: 1365857 - RNA, 25 nt, Human
aagcaggaauuuuacuugcacaugg

SEQ ID NO: 1365858 - RNA, 22 nt, Human
aagccuccgauacaaucacuua

SEQ ID NO: 1365859 - RNA, 18 nt, Human
aaguacacaaaaaucuca

SEQ ID NO: 1365860 - RNA, 20 nt, Human
aaguaguaagaagugucaga

SEQ ID NO: 1365861 - RNA, 24 nt, Human
aaucacagacacuuuaaaaagucc

SEQ ID NO: 1365862 - RNA, 24 nt, Human
acaugaagucuuuugaaagcacca

SEQ ID NO: 1365863 - RNA, 21 nt, Human
accucucccucuuucucccca

SEQ ID NO: 1365864 - RNA, 22 nt, Human
agaauaaagguggauguguggg

SEQ ID NO: 1365865 - RNA, 25 nt, Human
agcaaaacaaacaaaacuccacaga

SEQ ID NO: 1365866 - RNA, 26 nt, Human
agcaaaacaaacaaaacuccacagaa

SEQ ID NO: 1365867 - RNA, 21 nt, Human
aggccugacaacaaaucggaa

SEQ ID NO: 1365868 - RNA, 21 nt, Human
aguaagaagugucagaaaaga

SEQ ID NO: 1365869 - RNA, 20 nt, Human
augcacacagccccagaugu

SEQ ID NO: 1365870 - RNA, 22 nt, Human
auugcugaaagagcgcaggucu

SEQ ID NO: 1365871 - RNA, 24 nt, Human
caaaaaacaaauaaggccugacaa

SEQ ID NO: 1365872 - RNA, 23 nt, Human
caaaaagcaaaacaaacaaaacu

SEQ ID NO: 1365873 - RNA, 24 nt, Human
caaaaagcaaaacaaacaaaacuc

SEQ ID NO: 1365874 - RNA, 24 nt, Human
caaaacaaacaaaacuccacagaa

SEQ ID NO: 1365875 - RNA, 21 nt, Human
caaacaaaacuccacagaaac

SEQ ID NO: 1365876 - RNA, 23 nt, Human
caaguggacauagaaccucuccc

SEQ ID NO: 1365877 - RNA, 23 nt, Human
caaucacuuacaaaaaacaaaua

SEQ ID NO: 1365878 - RNA, 26 nt, Human
cacaaccaagaaaugguuaauggaac

SEQ ID NO: 1365879 - RNA, 23 nt, Human
cacagaugggccuaagccucuga

SEQ ID NO: 1365880 - RNA, 24 nt, Human
caccaguguuaggacagggucccc

SEQ ID NO: 1365881 - RNA, 23 nt, Human
cacccacaaauggugucccucca

SEQ ID NO: 1365882 - RNA, 19 nt, Human
cagcuccuuauuacagggg

SEQ ID NO: 1365883 - RNA, 22 nt, Human
cagugaaaaaaaaauguaaagc

SEQ ID NO: 1365884 - RNA, 21 nt, Human
cauagaaccucucccucuuuc

SEQ ID NO: 1365885 - RNA, 23 nt, Human
cauggcagucuacaaaaagcaaa

SEQ ID NO: 1365886 - RNA, 20 nt, Human
ccaaacccacagaugggccu

SEQ ID NO: 1365887 - RNA, 22 nt, Human
ccaaagauaacaauguucguaa

SEQ ID NO: 1365888 - RNA, 19 nt, Human
cccacagaugggccuaagc

SEQ ID NO: 1365889 - RNA, 19 nt, Human
cccaccugaccguccucuc

SEQ ID NO: 1365890 - RNA, 19 nt, Human
cccucuuucuccccaccca

SEQ ID NO: 1365891 - RNA, 25 nt, Human
ccguccucucauuacuccuggcuac

SEQ ID NO: 1365892 - RNA, 18 nt, Human
cggaauguuucaaacaaa

SEQ ID NO: 1365893 - RNA, 21 nt, Human
cgucuggcccagcagccacac

SEQ ID NO: 1365894 - RNA, 24 nt, Human
cuacaaaaagcaaaacaaacaaaa

SEQ ID NO: 1365895 - RNA, 19 nt, Human
cucucccucuuucucccca

SEQ ID NO: 1365896 - RNA, 21 nt, Human
cucucccucuuucuccccacc

SEQ ID NO: 1365897 - RNA, 21 nt, Human
cuggugacggagaagaauaaa

SEQ ID NO: 1365898 - RNA, 23 nt, Human
gaaaaaaaaauguaaagcuugag

SEQ ID NO: 1365899 - RNA, 19 nt, Human
gacaggguccccugaggcc

SEQ ID NO: 1365900 - RNA, 21 nt, Human
gagucaauucugaaacgcccu

SEQ ID NO: 1365901 - RNA, 19 nt, Human
gaguuuguuuauuuucuuc

SEQ ID NO: 1365902 - RNA, 25 nt, Human
gcaaaacaaacaaaacuccacagaa

SEQ ID NO: 1365903 - RNA, 25 nt, Human
gcaguggaaaugagucaauucugaa

SEQ ID NO: 1365904 - RNA, 18 nt, Human
ggagaguauuuguagcug

SEQ ID NO: 1365905 - RNA, 20 nt, Human
guaaagaugcacacagcccc

SEQ ID NO: 1365906 - RNA, 24 nt, Human
guaaagcuugagaaauucuccaag

SEQ ID NO: 1365907 - RNA, 18 nt, Human
uaaacaaaucacagacac

SEQ ID NO: 1365908 - RNA, 22 nt, Human
uaagccucugagucauuggcaa

SEQ ID NO: 1365909 - RNA, 22 nt, Human
uacaaaaagcaaaacaaacaaa

SEQ ID NO: 1365910 - RNA, 18 nt, Human
uauuucaccacuugagag

SEQ ID NO: 1365911 - RNA, 19 nt, Human
ucagaagggucucuccagc

SEQ ID NO: 1365912 - RNA, 20 nt, Human
uccacacaacuuaagccucc

SEQ ID NO: 1365913 - RNA, 23 nt, Human
uccccacccacaaaugguguccc

SEQ ID NO: 1365914 - RNA, 18 nt, Human
ucccucuuucuccccacc

SEQ ID NO: 1365915 - RNA, 21 nt, Human
ucuacaaaaagcaaaacaaac

SEQ ID NO: 1365916 - RNA, 21 nt, Human
ucucccucuuucuccccaccc

SEQ ID NO: 1365917 - RNA, 19 nt, Human
ugaaagcaccaggccucua

SEQ ID NO: 1365918 - RNA, 24 nt, Human
ugaauagugugucuccauuuguaa

SEQ ID NO: 1365919 - RNA, 23 nt, Human
ugaggccccgcugaugguggagg

SEQ ID NO: 1365920 - RNA, 25 nt, Human
ugaggccccgcugaugguggagggu

SEQ ID NO: 1365921 - RNA, 21 nt, Human
ugccagaggaaguucagggag

SEQ ID NO: 1365922 - RNA, 23 nt, Human
ugcugaaagagcgcaggucuugg

SEQ ID NO: 1365923 - RNA, 26 nt, Human
uggaggguccucagaagggucucucc

SEQ ID NO: 1365924 - RNA, 20 nt, Human
ugggagcacaaccaagaaau

SEQ ID NO: 1365925 - RNA, 18 nt, Human
ugguaaaaacauuaacga

SEQ ID NO: 1365926 - RNA, 18 nt, Human
uggugucccuccacuucu

SEQ ID NO: 1365927 - RNA, 22 nt, Human
uguauucaugaacacugcuuuu

SEQ ID NO: 1365928 - RNA, 22 nt, Human
ugucuugcaaacaaaucagagc

SEQ ID NO: 1365929 - RNA, 18 nt, Human
uguggaggcuccaggaaa

SEQ ID NO: 1365930 - RNA, 19 nt, Human
uguggaggcuccaggaaag

SEQ ID NO: 1365931 - RNA, 18 nt, Human
uugcugaaagagcgcagg

SEQ ID NO: 1365932 - RNA, 24 nt, Human
uuuagagauucacacuuuccugag

SEQ ID NO: 1365933 - RNA, 22 nt, Human
uuuauuuucuucagugaaaaaa

SEQ ID NO: 1365934 - RNA, 22 nt, Human
uuuguggaggcuccaggaaagc

SEQ ID NO: 1365935 - RNA, 23 nt, Human
aaaaacagcccaaugauucacac

SEQ ID NO: 1365936 - RNA, 21 nt, Human
aaagucaagauaaucaguaug

SEQ ID NO: 1365937 - RNA, 21 nt, Human
acacaacuagcaaagcaaacc

SEQ ID NO: 1365938 - RNA, 24 nt, Human
cacacaacuagcaaagcaaaccaa

SEQ ID NO: 1365939 - RNA, 23 nt, Human
cagacuacucagugaaggaaccu

SEQ ID NO: 1365940 - RNA, 21 nt, Human
cagauggaauagauucaacuc

SEQ ID NO: 1365941 - RNA, 23 nt, Human
ccaacaucaaucuaggagguaaa

SEQ ID NO: 1365942 - RNA, 26 nt, Human
ccaccaccggggccaccacgaccuaa

SEQ ID NO: 1365943 - RNA, 23 nt, Human
cccaccaccaccggggccaccac

SEQ ID NO: 1365944 - RNA, 23 nt, Human
cccagaugaauuuuaauuuuguu

SEQ ID NO: 1365945 - RNA, 18 nt, Human
cccggagcccaccaccac

SEQ ID NO: 1365946 - RNA, 18 nt, Human
cgcccggagcccaccacc

SEQ ID NO: 1365947 - RNA, 19 nt, Human
gccauucagaaauaaaagg

SEQ ID NO: 1365948 - RNA, 22 nt, Human
ggaauagauucaacucuauaaa

SEQ ID NO: 1365949 - RNA, 18 nt, Human
ggcaaauauugaagucag

SEQ ID NO: 1365950 - RNA, 18 nt, Human
ggcaaauauugaagucag

SEQ ID NO: 1365951 - RNA, 24 nt, Human
uaacaguggcucuaaaaacagccc

SEQ ID NO: 1365952 - RNA, 20 nt, Human
uaagauaguuacauagggac

SEQ ID NO: 1365953 - RNA, 18 nt, Human
uaaggauacuauaccaac

SEQ ID NO: 1365954 - RNA, 27 nt, Human
uagcacugaaacacuggguuuggauau

SEQ ID NO: 1365955 - RNA, 19 nt, Human
uauuaaggauacuauacca

SEQ ID NO: 1365956 - RNA, 21 nt, Human
uccaauccauuuucuucccca

SEQ ID NO: 1365957 - RNA, 23 nt, Human
ugguuuuugauauuuugauguuc

SEQ ID NO: 1365958 - RNA, 22 nt, Human
uguauacauaaauggcuuuaua

SEQ ID NO: 1365959 - RNA, 24 nt, Human
uguuauuuuuauugaguuuucaaa

SEQ ID NO: 1365960 - RNA, 21 nt, Human
uuaaguacacaauuuguaaau

SEQ ID NO: 1365961 - RNA, 24 nt, Human
uucacacaacuagcaaagcaaacc

SEQ ID NO: 1365962 - RNA, 21 nt, Human
uuccccaguauuucacuugua

SEQ ID NO: 1365963 - RNA, 24 nt, Human
uuuggcaaauauugaagucagaug

SEQ ID NO: 1365964 - RNA, 21 nt, Human
uuuuuuuuuuuuuuucccaga

SEQ ID NO: 1365965 - RNA, 22 nt, Human
uuuuuuuuuuuuuuuuucccag

SEQ ID NO: 1365966 - RNA, 19 nt, Human
aaaaacagagaggaggagg

SEQ ID NO: 1365967 - RNA, 23 nt, Human
aaaaacagagaggaggaggcaag

SEQ ID NO: 1365968 - RNA, 20 nt, Human
aaaaucccugaguaggccaa

SEQ ID NO: 1365969 - RNA, 22 nt, Human
aaacaaauaaaaacagagagga

SEQ ID NO: 1365970 - RNA, 19 nt, Human
aaagaaauaaaaaucccug

SEQ ID NO: 1365971 - RNA, 21 nt, Human
aaagcuuuuguagguugagaa

SEQ ID NO: 1365972 - RNA, 20 nt, Human
aaauaaacuacucauguuaa

SEQ ID NO: 1365973 - RNA, 28 nt, Human
aacaaauaaaaacagagaggaggaggcc

SEQ ID NO: 1365974 - RNA, 19 nt, Human
aaccugugcaacacagugc

SEQ ID NO: 1365975 - RNA, 21 nt, Human
aaugacaaagagucacagcac

SEQ ID NO: 1365976 - RNA, 23 nt, Human
aauguacaucuaagacagaugac

SEQ ID NO: 1365977 - RNA, 21 nt, Human
aauuacccuucaaaagacgau

SEQ ID NO: 1365978 - RNA, 18 nt, Human
acaaauaaaaacagagag

SEQ ID NO: 1365979 - RNA, 18 nt, Human
acacacacagacacauac

SEQ ID NO: 1365980 - RNA, 19 nt, Human
acacacacagacacauaca

SEQ ID NO: 1365981 - RNA, 19 nt, Human
acagacacauacacaaaca

SEQ ID NO: 1365982 - RNA, 22 nt, Human
acagagaggaggaggcaagaga

SEQ ID NO: 1365983 - RNA, 19 nt, Human
acauaacccagaaaacaga

SEQ ID NO: 1365984 - RNA, 25 nt, Human
agaaaggaaauuacccuucaaaaga

SEQ ID NO: 1365985 - RNA, 22 nt, Human
agaaauaugcuauucccaaacc

SEQ ID NO: 1365986 - RNA, 21 nt, Human
agaaauucuccuucuuucagu

SEQ ID NO: 1365987 - RNA, 22 nt, Human
agacaacagauacauaacccag

SEQ ID NO: 1365988 - RNA, 26 nt, Human
agacaacuaauccagaagcuguagca

SEQ ID NO: 1365989 - RNA, 24 nt, Human
agacacauacacaaacacacuuau

SEQ ID NO: 1365990 - RNA, 25 nt, Human
agacacauacacaaacacacuuauu

SEQ ID NO: 1365991 - RNA, 20 nt, Human
aggaggcaagagauaacaag

SEQ ID NO: 1365992 - RNA, 18 nt, Human
aggcaagagauaacaagg

SEQ ID NO: 1365993 - RNA, 24 nt, Human
aggcagaaaggaaauuacccuuca

SEQ ID NO: 1365994 - RNA, 18 nt, Human
aguuaccagcagggaaag

SEQ ID NO: 1365995 - RNA, 19 nt, Human
auaaauuugugaaaacaga

SEQ ID NO: 1365996 - RNA, 21 nt, Human
auaagaagguguccccaaaaa

SEQ ID NO: 1365997 - RNA, 23 nt, Human
auacacacacagacacauacaca

SEQ ID NO: 1365998 - RNA, 21 nt, Human
auauuucauauauaucauaca

SEQ ID NO: 1365999 - RNA, 21 nt, Human
aucacugaaaacagacaccac

SEQ ID NO: 1366000 - RNA, 20 nt, Human
augucacacacuccucuaac

SEQ ID NO: 1366001 - RNA, 25 nt, Human
caaauaaaaacagagaggaggaggc

SEQ ID NO: 1366002 - RNA, 22 nt, Human
cacagacacauacacaaacaca

SEQ ID NO: 1366003 - RNA, 22 nt, Human
cacauacacaaacacacuuauu

SEQ ID NO: 1366004 - RNA, 28 nt, Human
cacauacacaaacacacuuauuuguaua

SEQ ID NO: 1366005 - RNA, 24 nt, Human
cagaaaacagauuauccaagacaa

SEQ ID NO: 1366006 - RNA, 25 nt, Human
cagaaagaaugaaagcaugcuggau

SEQ ID NO: 1366007 - RNA, 24 nt, Human
cauaacccagaaaacagauuaucc

SEQ ID NO: 1366008 - RNA, 25 nt, Human
cauaacccagaaaacagauuaucca

SEQ ID NO: 1366009 - RNA, 19 nt, Human
cauauauaucauacauaug

SEQ ID NO: 1366010 - RNA, 23 nt, Human
cauauugccaaacuaaugccuaa

SEQ ID NO: 1366011 - RNA, 21 nt, Human
ccaacaaaaauaaacuacuca

SEQ ID NO: 1366012 - RNA, 21 nt, Human
cccaaaccauaaaugucacac

SEQ ID NO: 1366013 - RNA, 23 nt, Human
cccagaaaacagauuauccaaga

SEQ ID NO: 1366014 - RNA, 20 nt, Human
ccuccauaagaagguguccc

SEQ ID NO: 1366015 - RNA, 18 nt, Human
ccucuaacuggaaauaga

SEQ ID NO: 1366016 - RNA, 23 nt, Human
cuaagauaggcacucaauaaaua

SEQ ID NO: 1366017 - RNA, 22 nt, Human
cucaagaacauaaaaaguuuuc

SEQ ID NO: 1366018 - RNA, 22 nt, Human
cuccauaagaagguguccccaa

SEQ ID NO: 1366019 - RNA, 20 nt, Human
gaaauaugcuauucccaaag

SEQ ID NO: 1366020 - RNA, 24 nt, Human
gacaacagauacauaacccagaaa

SEQ ID NO: 1366021 - RNA, 21 nt, Human
gcaagguauuuauuuggcuaa

SEQ ID NO: 1366022 - RNA, 19 nt, Human
gccaaagacaacagauaca

SEQ ID NO: 1366023 - RNA, 18 nt, Human
uaaaaacagagaggagga

SEQ ID NO: 1366024 - RNA, 19 nt, Human
uaaaauauucuuacacucu

SEQ ID NO: 1366025 - RNA, 23 nt, Human
uaaaaugacaaagagucacagca

SEQ ID NO: 1366026 - RNA, 21 nt, Human
uaagaaaaaauccuucaaaac

SEQ ID NO: 1366027 - RNA, 23 nt, Human
uacacacacagacacauacacaa

SEQ ID NO: 1366028 - RNA, 18 nt, Human
uagaaauucuccuucuuu

SEQ ID NO: 1366029 - RNA, 22 nt, Human
uagaaauucuccuucuuucagu

SEQ ID NO: 1366030 - RNA, 21 nt, Human
uagacaacuaauccagaagcu

SEQ ID NO: 1366031 - RNA, 22 nt, Human
uaggccaaagacaacagauaca

SEQ ID NO: 1366032 - RNA, 20 nt, Human
uagguugagaaaaacuuccu

SEQ ID NO: 1366033 - RNA, 19 nt, Human
uauaaaagaaugagguaaa

SEQ ID NO: 1366034 - RNA, 27 nt, Human
uauaaaaugaauacacacacagacaca

SEQ ID NO: 1366035 - RNA, 19 nt, Human
uauauacaucauacauaua

SEQ ID NO: 1366036 - RNA, 23 nt, Human
uauauacaucauacauauacaga

SEQ ID NO: 1366037 - RNA, 28 nt, Human
uauauaucauacauaugacauauauaca

SEQ ID NO: 1366038 - RNA, 18 nt, Human
uauauguauauggcauau

SEQ ID NO: 1366039 - RNA, 20 nt, Human
uauauguauauggcauaugu

SEQ ID NO: 1366040 - RNA, 21 nt, Human
uauauguauauggcauaugug

SEQ ID NO: 1366041 - RNA, 24 nt, Human
uaugaaaaaccuugaaaacaaaua

SEQ ID NO: 1366042 - RNA, 21 nt, Human
uauucagaaagaaugaaagca

SEQ ID NO: 1366043 - RNA, 19 nt, Human
uauucuuacacucuggagc

SEQ ID NO: 1366044 - RNA, 22 nt, Human
uauuucaaaucagacaagguug

SEQ ID NO: 1366045 - RNA, 22 nt, Human
uccagaagcuguagcacaguua

SEQ ID NO: 1366046 - RNA, 22 nt, Human
ucccugaguaggccaaagacaa

SEQ ID NO: 1366047 - RNA, 21 nt, Human
ucuggaaggacacauaccaaa

SEQ ID NO: 1366048 - RNA, 24 nt, Human
ucuuuguaauagagaagugaaaau

SEQ ID NO: 1366049 - RNA, 20 nt, Human
ugaaaacaaauaaaaacaga

SEQ ID NO: 1366050 - RNA, 23 nt, Human
ugaaaacagagcaucacuauuuc

SEQ ID NO: 1366051 - RNA, 22 nt, Human
ugaaaagauaaauuugugaaaa

SEQ ID NO: 1366052 - RNA, 19 nt, Human
ugaaaauauuuccuucacu

SEQ ID NO: 1366053 - RNA, 24 nt, Human
ugaaagcaaaggcauaucauaguc

SEQ ID NO: 1366054 - RNA, 22 nt, Human
ugaaauagccaucacugaaaac

SEQ ID NO: 1366055 - RNA, 23 nt, Human
ugaaauagccaucacugaaaaca

SEQ ID NO: 1366056 - RNA, 24 nt, Human
ugacaaauaaauguacaucuaaga

SEQ ID NO: 1366057 - RNA, 18 nt, Human
ugacauauauacaucaua

SEQ ID NO: 1366058 - RNA, 23 nt, Human
ugacauauauacaucauacauau

SEQ ID NO: 1366059 - RNA, 19 nt, Human
ugagaaaaacuuccugaaa

SEQ ID NO: 1366060 - RNA, 19 nt, Human
uggcaagguauuuauuugg

SEQ ID NO: 1366061 - RNA, 26 nt, Human
ugguauauauguauauggcauaugug

SEQ ID NO: 1366062 - RNA, 18 nt, Human
ugucaauuucuuauuuuu

SEQ ID NO: 1366063 - RNA, 18 nt, Human
ugugcaacacagugcaca

SEQ ID NO: 1366064 - RNA, 21 nt, Human
uuacccuucaaaagacgauuu

SEQ ID NO: 1366065 - RNA, 21 nt, Human
uuccuguuugcugaugaacuu

SEQ ID NO: 1366066 - RNA, 23 nt, Human
uuccuguuugcugaugaacuuuu

SEQ ID NO: 1366067 - RNA, 21 nt, Human
uuccuucacuuuuuuguuucc

SEQ ID NO: 1366068 - RNA, 20 nt, Human
uuguauaaaaugaauacaca

SEQ ID NO: 1366069 - RNA, 22 nt, Human
uuuuaagaauuuggagacaauu

SEQ ID NO: 1366070 - RNA, 22 nt, Human
uuuucaaacuccuccauaagaa

SEQ ID NO: 1366071 - RNA, 20 nt, Human
aaagaaacaggagcugauga

SEQ ID NO: 1366072 - RNA, 21 nt, Human
aaauagcccuuaaaucugggc

SEQ ID NO: 1366073 - RNA, 23 nt, Human
aagaacagaaaaacaguauaccu

SEQ ID NO: 1366074 - RNA, 19 nt, Human
aagaagcagauugcugcuu

SEQ ID NO: 1366075 - RNA, 20 nt, Human
aagaagcagauugcugcuuu

SEQ ID NO: 1366076 - RNA, 21 nt, Human
aagaaugcaacauuccugaca

SEQ ID NO: 1366077 - RNA, 22 nt, Human
aagcuuucuuucuugagggauc

SEQ ID NO: 1366078 - RNA, 18 nt, Human
agaugucaaugaaaacug

SEQ ID NO: 1366079 - RNA, 18 nt, Human
agcgagugacagaaaugc

SEQ ID NO: 1366080 - RNA, 23 nt, Human
agcgagugacagaaaugcaguag

SEQ ID NO: 1366081 - RNA, 22 nt, Human
aguguccuuuucagcgagugac

SEQ ID NO: 1366082 - RNA, 21 nt, Human
aguuaaggaaagcuugugggu

SEQ ID NO: 1366083 - RNA, 22 nt, Human
auuuucuggcaagaagcagauu

SEQ ID NO: 1366084 - RNA, 22 nt, Human
caaaacccuguuguagagcaaa

SEQ ID NO: 1366085 - RNA, 22 nt, Human
caagaacagaaaaacaguauac

SEQ ID NO: 1366086 - RNA, 24 nt, Human
caagaacagaaaaacaguauaccu

SEQ ID NO: 1366087 - RNA, 21 nt, Human
caaggggugauuuugcccuuu

SEQ ID NO: 1366088 - RNA, 21 nt, Human
cagcaugaaaacgaacuaaca

SEQ ID NO: 1366089 - RNA, 20 nt, Human
caggagcugaugagaaguuc

SEQ ID NO: 1366090 - RNA, 18 nt, Human
caguagguagucucuuuc

SEQ ID NO: 1366091 - RNA, 21 nt, Human
caugaaaacgaacuaacacag

SEQ ID NO: 1366092 - RNA, 19 nt, Human
ccccuucuacccuaccuca

SEQ ID NO: 1366093 - RNA, 18 nt, Human
cccuuaaaucugggcccc

SEQ ID NO: 1366094 - RNA, 19 nt, Human
ccuaaaaagccccauggca

SEQ ID NO: 1366095 - RNA, 19 nt, Human
ccugacuccuugacuuugu

SEQ ID NO: 1366096 - RNA, 18 nt, Human
ccugggcauaauguagaa

SEQ ID NO: 1366097 - RNA, 18 nt, Human
ccuucuacccuaccucag

SEQ ID NO: 1366098 - RNA, 23 nt, Human
cgucuugcagcugaauaucuaaa

SEQ ID NO: 1366099 - RNA, 19 nt, Human
cuaccucagcauggugugg

SEQ ID NO: 1366100 - RNA, 20 nt, Human
cucagguaugucuuuaucag

SEQ ID NO: 1366101 - RNA, 19 nt, Human
cuccuuuccuagagaugaa

SEQ ID NO: 1366102 - RNA, 22 nt, Human
cugggccccuucauagcucaga

SEQ ID NO: 1366103 - RNA, 18 nt, Human
cuugcugugcccugucca

SEQ ID NO: 1366104 - RNA, 20 nt, Human
gaaauaacaagaacagaaaa

SEQ ID NO: 1366105 - RNA, 22 nt, Human
gaaauaagaaugcaacauuccu

SEQ ID NO: 1366106 - RNA, 23 nt, Human
gcacauuuagggugucaaaaaua

SEQ ID NO: 1366107 - RNA, 21 nt, Human
ggaaauaacaagaacagaaaa

SEQ ID NO: 1366108 - RNA, 19 nt, Human
gggccucugccugacuccu

SEQ ID NO: 1366109 - RNA, 19 nt, Human
gguguucuggccagacuga

SEQ ID NO: 1366110 - RNA, 23 nt, Human
guagagcaaaguccaggcuuguu

SEQ ID NO: 1366111 - RNA, 21 nt, Human
gucucuuucuccuuuccuaga

SEQ ID NO: 1366112 - RNA, 21 nt, Human
guggaacuauagguccaauaa

SEQ ID NO: 1366113 - RNA, 21 nt, Human
uaaaaagccccauggcaaggg

SEQ ID NO: 1366114 - RNA, 21 nt, Human
uaaaguaucaauugccugaaa

SEQ ID NO: 1366115 - RNA, 19 nt, Human
uaacaagaacagaaaaaca

SEQ ID NO: 1366116 - RNA, 21 nt, Human
uagagcaaaguccaggcuugu

SEQ ID NO: 1366117 - RNA, 18 nt, Human
uagguagucucuuucucc

SEQ ID NO: 1366118 - RNA, 20 nt, Human
ucagaagaaccugggcauaa

SEQ ID NO: 1366119 - RNA, 22 nt, Human
ucagaagaaccugggcauaaug

SEQ ID NO: 1366120 - RNA, 21 nt, Human
ucauucuggaaaaggcucugc

SEQ ID NO: 1366121 - RNA, 20 nt, Human
uccuagagaugaaaagaaac

SEQ ID NO: 1366122 - RNA, 24 nt, Human
uccuugcugugcccuguccaggga

SEQ ID NO: 1366123 - RNA, 22 nt, Human
uccuuuccuagagaugaaaaga

SEQ ID NO: 1366124 - RNA, 23 nt, Human
ucuccaaaagaugucaaugaaaa

SEQ ID NO: 1366125 - RNA, 22 nt, Human
ugaaaacgaacuaacacaguug

SEQ ID NO: 1366126 - RNA, 18 nt, Human
ugagaacaagaucuacag

SEQ ID NO: 1366127 - RNA, 20 nt, Human
ugccccuucuacccuaccuc

SEQ ID NO: 1366128 - RNA, 18 nt, Human
ugcugaagcucucugggc

SEQ ID NO: 1366129 - RNA, 23 nt, Human
ugcugaagcucucugggcuuuau

SEQ ID NO: 1366130 - RNA, 22 nt, Human
ugcuuuauccuaaaaagcccca

SEQ ID NO: 1366131 - RNA, 20 nt, Human
uggcaagggccucugccuga

SEQ ID NO: 1366132 - RNA, 23 nt, Human
uggggaaauaagaaugcaacauu

SEQ ID NO: 1366133 - RNA, 26 nt, Human
uggucauaccacucccuaugcaaaac

SEQ ID NO: 1366134 - RNA, 22 nt, Human
uguggacaaauggguuuaucua

SEQ ID NO: 1366135 - RNA, 22 nt, Human
uuccugacaucauggaggccca

SEQ ID NO: 1366136 - RNA, 24 nt, Human
uuuguggacaaauggguuuaucua

SEQ ID NO: 1366137 - RNA, 22 nt, Human
aaaaaguauuaugcugaaagca

SEQ ID NO: 1366138 - RNA, 22 nt, Human
aaucuuucugcaaauaaaaaac

SEQ ID NO: 1366139 - RNA, 25 nt, Human
cacacaaaacaugaaaauaucaaac

SEQ ID NO: 1366140 - RNA, 25 nt, Human
cauaagcacacaaaacaugaaaaua

SEQ ID NO: 1366141 - RNA, 23 nt, Human
cuugaaaauaucuuucaacauuu

SEQ ID NO: 1366142 - RNA, 24 nt, Human
uaaaaaauauggcaaacuaaccug

SEQ ID NO: 1366143 - RNA, 21 nt, Human
uaaaaaguauuaugcugaaag

SEQ ID NO: 1366144 - RNA, 18 nt, Human
uacagagacaaaugaugg

SEQ ID NO: 1366145 - RNA, 19 nt, Human
uaucaaacugaaaacuagu

SEQ ID NO: 1366146 - RNA, 19 nt, Human
ucuuucugcaaauaaaaaa

SEQ ID NO: 1366147 - RNA, 20 nt, Human
ugagaagauucaggcagcuc

SEQ ID NO: 1366148 - RNA, 22 nt, Human
ugugagaagauucaggcagcuc

SEQ ID NO: 1366149 - RNA, 23 nt, Human
uuaaccauaagcacacaaaacau

SEQ ID NO: 1366150 - RNA, 25 nt, Human
uucugcaaauaaaaaacaaaaacag

SEQ ID NO: 1366151 - RNA, 23 nt, Human
uuuuuuggccaugauuauacuga

SEQ ID NO: 1366152 - RNA, 20 nt, Human
aaaaaaaacuaaagaggcac

SEQ ID NO: 1366153 - RNA, 22 nt, Human
aaaaaaaacuaaagaggcacaa

SEQ ID NO: 1366154 - RNA, 27 nt, Human
aaaaaaacuaaagaggcacaacaacua

SEQ ID NO: 1366155 - RNA, 20 nt, Human
aaacgaauacaguuaaccua

SEQ ID NO: 1366156 - RNA, 21 nt, Human
aaacugcaaauaacucaaaua

SEQ ID NO: 1366157 - RNA, 21 nt, Human
aaagagagaguacugguugcc

SEQ ID NO: 1366158 - RNA, 20 nt, Human
aaaggcauuuucagaaagcu

SEQ ID NO: 1366159 - RNA, 23 nt, Human
aacaaaacauaaaaugugaauaa

SEQ ID NO: 1366160 - RNA, 25 nt, Human
aagaauggauaaauaauuugugaua

SEQ ID NO: 1366161 - RNA, 21 nt, Human
aaguggccgaggaaggaacag

SEQ ID NO: 1366162 - RNA, 19 nt, Human
aaguuguauugacuggaag

SEQ ID NO: 1366163 - RNA, 24 nt, Human
aaucucugccuccauugucaccuc

SEQ ID NO: 1366164 - RNA, 23 nt, Human
acacaccaagcauacugccaccu

SEQ ID NO: 1366165 - RNA, 19 nt, Human
acacaccuaaguccaaauc

SEQ ID NO: 1366166 - RNA, 21 nt, Human
accaucuuccccugauguguc

SEQ ID NO: 1366167 - RNA, 23 nt, Human
accuaagccaguugacccagaaa

SEQ ID NO: 1366168 - RNA, 20 nt, Human
accuaccagaaaggcuccaa

SEQ ID NO: 1366169 - RNA, 18 nt, Human
accucggggccuuugcac

SEQ ID NO: 1366170 - RNA, 22 nt, Human
acuaaagaggcacaacaacuaa

SEQ ID NO: 1366171 - RNA, 18 nt, Human
acucauggguuucugggc

SEQ ID NO: 1366172 - RNA, 19 nt, Human
acuccccaaacacccuggu

SEQ ID NO: 1366173 - RNA, 22 nt, Human
agaagccagauauucuaggccu

SEQ ID NO: 1366174 - RNA, 18 nt, Human
agcaaccuggaugaaccu

SEQ ID NO: 1366175 - RNA, 20 nt, Human
aggccccagguucugcccaa

SEQ ID NO: 1366176 - RNA, 20 nt, Human
agguguuguaguacuuagaa

SEQ ID NO: 1366177 - RNA, 23 nt, Human
aguuacuggggguuaggacuucg

SEQ ID NO: 1366178 - RNA, 21 nt, Human
auacugggcaccaagaggcca

SEQ ID NO: 1366179 - RNA, 26 nt, Human
aucaaaaaaaacuaaagaggcacaac

SEQ ID NO: 1366180 - RNA, 23 nt, Human
augaaguucagauacacacaccu

SEQ ID NO: 1366181 - RNA, 26 nt, Human
auucacaguuacuggggguuaggacu

SEQ ID NO: 1366182 - RNA, 21 nt, Human
caaaacauaaaaugugaauaa

SEQ ID NO: 1366183 - RNA, 21 nt, Human
caaaugcaaccugagacccug

SEQ ID NO: 1366184 - RNA, 21 nt, Human
caacacaccaagcauacugcc

SEQ ID NO: 1366185 - RNA, 20 nt, Human
caacagaaauguguuguguc

SEQ ID NO: 1366186 - RNA, 19 nt, Human
cacaaaauaaaauggagaa

SEQ ID NO: 1366187 - RNA, 20 nt, Human
cacacaccuaaguccaaauc

SEQ ID NO: 1366188 - RNA, 21 nt, Human
cacacugcauccaaacaaaau

SEQ ID NO: 1366189 - RNA, 22 nt, Human
cacagcaggcuguguggagaaa

SEQ ID NO: 1366190 - RNA, 18 nt, Human
caccaagcauacugccac

SEQ ID NO: 1366191 - RNA, 20 nt, Human
caccacacacuguugucacu

SEQ ID NO: 1366192 - RNA, 24 nt, Human
caccacacacuguugucacucaga

SEQ ID NO: 1366193 - RNA, 21 nt, Human
caccccaugaagcugcaccca

SEQ ID NO: 1366194 - RNA, 21 nt, Human
caccuaccagaaaggcuccaa

SEQ ID NO: 1366195 - RNA, 19 nt, Human
caccucaccaucuuccccu

SEQ ID NO: 1366196 - RNA, 19 nt, Human
cacugcauccaaacaaaau

SEQ ID NO: 1366197 - RNA, 24 nt, Human
cagaagaauggauaaauaauuugu

SEQ ID NO: 1366198 - RNA, 20 nt, Human
cagagcccugggcaaagguu

SEQ ID NO: 1366199 - RNA, 19 nt, Human
cagcaaaggugagcaagca

SEQ ID NO: 1366200 - RNA, 21 nt, Human
cagcagaaaaaugcauauuga

SEQ ID NO: 1366201 - RNA, 21 nt, Human
cagguuaaaacaaauuuauga

SEQ ID NO: 1366202 - RNA, 20 nt, Human
cauaacacucagucggcgca

SEQ ID NO: 1366203 - RNA, 20 nt, Human
ccaaaauaagaggaacacau

SEQ ID NO: 1366204 - RNA, 20 nt, Human
ccaagccuuccucgcccucc

SEQ ID NO: 1366205 - RNA, 18 nt, Human
ccaccccaugaagcugca

SEQ ID NO: 1366206 - RNA, 22 nt, Human
ccagccuuuucugaaggggaga

SEQ ID NO: 1366207 - RNA, 19 nt, Human
cccaaaugucaucugacca

SEQ ID NO: 1366208 - RNA, 21 nt, Human
ccccacgccaagccuuccucg

SEQ ID NO: 1366209 - RNA, 28 nt, Human
ccccacgccaagccuuccucgcccuccc

SEQ ID NO: 1366210 - RNA, 18 nt, Human
ccccagguucugcccaaa

SEQ ID NO: 1366211 - RNA, 21 nt, Human
ccccaugaagcugcacccagg

SEQ ID NO: 1366212 - RNA, 20 nt, Human
ccccuacccccuuaaugacu

SEQ ID NO: 1366213 - RNA, 21 nt, Human
ccccuuauucacuccccaaac

SEQ ID NO: 1366214 - RNA, 23 nt, Human
ccuaaacugcaaauaacucaaau

SEQ ID NO: 1366215 - RNA, 22 nt, Human
ccuaagccaguugacccagaaa

SEQ ID NO: 1366216 - RNA, 19 nt, Human
ccugagacccugagccaga

SEQ ID NO: 1366217 - RNA, 22 nt, Human
ccugcagagccacgggugggga

SEQ ID NO: 1366218 - RNA, 19 nt, Human
ccugcagauaucauccuuc

SEQ ID NO: 1366219 - RNA, 22 nt, Human
ccuguagguuuaaacauuuuca

SEQ ID NO: 1366220 - RNA, 23 nt, Human
ccuguccucaaauaucccugcag

SEQ ID NO: 1366221 - RNA, 18 nt, Human
ccuuccucgcccuccccu

SEQ ID NO: 1366222 - RNA, 22 nt, Human
cgccaagccuuccucgcccucc

SEQ ID NO: 1366223 - RNA, 18 nt, Human
cgcccuccccuccagccu

SEQ ID NO: 1366224 - RNA, 23 nt, Human
cgggcguccccacgccaagccuu

SEQ ID NO: 1366225 - RNA, 22 nt, Human
cuaaucuugaggaaacagacac

SEQ ID NO: 1366226 - RNA, 23 nt, Human
cuaaucuugaggaaacagacaca

SEQ ID NO: 1366227 - RNA, 21 nt, Human
cuacuuuuaauaacaccaugg

SEQ ID NO: 1366228 - RNA, 21 nt, Human
cuccucugagcacucuucccc

SEQ ID NO: 1366229 - RNA, 23 nt, Human
cugaaaccuguaggggaggcucc

SEQ ID NO: 1366230 - RNA, 27 nt, Human
cugccaaccuccccaauagccguggga

SEQ ID NO: 1366231 - RNA, 21 nt, Human
cugcugaggaagacucauggg

SEQ ID NO: 1366232 - RNA, 20 nt, Human
cuggaugaaccucacaagca

SEQ ID NO: 1366233 - RNA, 23 nt, Human
cuggcugcucgauauguuaguuu

SEQ ID NO: 1366234 - RNA, 23 nt, Human
cuggucaccuuccugcuccucca

SEQ ID NO: 1366235 - RNA, 20 nt, Human
cuuccucgcccuccccucca

SEQ ID NO: 1366236 - RNA, 20 nt, Human
gaaaagauccaaaggccuuu

SEQ ID NO: 1366237 - RNA, 19 nt, Human
gaacauaguucaacccaua

SEQ ID NO: 1366238 - RNA, 19 nt, Human
gaagcugcacccagguucc

SEQ ID NO: 1366239 - RNA, 18 nt, Human
gaagggguugagguccuc

SEQ ID NO: 1366240 - RNA, 22 nt, Human
gaauccugucuucccagguuga

SEQ ID NO: 1366241 - RNA, 23 nt, Human
gacggggcagggggaaaggguga

SEQ ID NO: 1366242 - RNA, 20 nt, Human
gacguggggagagaagccag

SEQ ID NO: 1366243 - RNA, 21 nt, Human
gagaauuugaaacauucugcu

SEQ ID NO: 1366244 - RNA, 21 nt, Human
gagacaggccccagguucugc

SEQ ID NO: 1366245 - RNA, 24 nt, Human
gaggaaacagacacauccaaauug

SEQ ID NO: 1366246 - RNA, 19 nt, Human
gaggccaaugagaguagga

SEQ ID NO: 1366247 - RNA, 24 nt, Human
gaucaaauggccauuuauggagaa

SEQ ID NO: 1366248 - RNA, 23 nt, Human
gauggaaauguucaacauuugau

SEQ ID NO: 1366249 - RNA, 19 nt, Human
gcagaauaccuggaacuca

SEQ ID NO: 1366250 - RNA, 19 nt, Human
gcccuccccuccagccuuu

SEQ ID NO: 1366251 - RNA, 18 nt, Human
gcgcggccgggcugcggg

SEQ ID NO: 1366252 - RNA, 18 nt, Human
gcugaggaagacucaugg

SEQ ID NO: 1366253 - RNA, 24 nt, Human
ggaagacucauggguuucugggcg

SEQ ID NO: 1366254 - RNA, 20 nt, Human
ggaggaaguuguuaagcuuu

SEQ ID NO: 1366255 - RNA, 23 nt, Human
ggagugaacucucuggggugaug

SEQ ID NO: 1366256 - RNA, 21 nt, Human
ggcauaaauuuccacagguag

SEQ ID NO: 1366257 - RNA, 19 nt, Human
ggccgggcugcggguggcc

SEQ ID NO: 1366258 - RNA, 18 nt, Human
ggccuuacaacuuuccug

SEQ ID NO: 1366259 - RNA, 24 nt, Human
ggcugcggguggccgggguccccg

SEQ ID NO: 1366260 - RNA, 21 nt, Human
gggcagggggaaagggugagg

SEQ ID NO: 1366261 - RNA, 24 nt, Human
gggcugcggguggccggggucccc

SEQ ID NO: 1366262 - RNA, 19 nt, Human
gggguugagguccucgucc

SEQ ID NO: 1366263 - RNA, 23 nt, Human
ggguuaggacuucgacauaucuu

SEQ ID NO: 1366264 - RNA, 24 nt, Human
guaaccucagacagcagcucaaau

SEQ ID NO: 1366265 - RNA, 25 nt, Human
guuccagagucuuuuaaaaauguca

SEQ ID NO: 1366266 - RNA, 22 nt, Human
uaaaaugugaauaaaagacuug

SEQ ID NO: 1366267 - RNA, 19 nt, Human
uaacacaccacacacuguu

SEQ ID NO: 1366268 - RNA, 19 nt, Human
uaacucaaauauucagcag

SEQ ID NO: 1366269 - RNA, 20 nt, Human
uaacuugauugcaucagcaa

SEQ ID NO: 1366270 - RNA, 24 nt, Human
uaaguccaaaucacacugcaucca

SEQ ID NO: 1366271 - RNA, 23 nt, Human
uaagucuuagaggguuacuuggg

SEQ ID NO: 1366272 - RNA, 23 nt, Human
uacacacaccuaaguccaaauca

SEQ ID NO: 1366273 - RNA, 26 nt, Human
uacacugcuagguuuauaccaagaga

SEQ ID NO: 1366274 - RNA, 18 nt, Human
uacaugucaagaagauaa

SEQ ID NO: 1366275 - RNA, 25 nt, Human
uaccuggaacucauauauugcugac

SEQ ID NO: 1366276 - RNA, 21 nt, Human
uacuucaaugugcaucucugu

SEQ ID NO: 1366277 - RNA, 18 nt, Human
uaucauugucacaguucu

SEQ ID NO: 1366278 - RNA, 20 nt, Human
uaucuaaaaaauucacaaaa

SEQ ID NO: 1366279 - RNA, 18 nt, Human
ucaaaaaaaacuaaagag

SEQ ID NO: 1366280 - RNA, 21 nt, Human
ucagccccauuggcaguugcu

SEQ ID NO: 1366281 - RNA, 24 nt, Human
ucagccccauuggcaguugcucag

SEQ ID NO: 1366282 - RNA, 18 nt, Human
ucauagaagaguuuccuu

SEQ ID NO: 1366283 - RNA, 22 nt, Human
uccaaucucugccuccauuguc

SEQ ID NO: 1366284 - RNA, 18 nt, Human
uccccgagcgggggaagg

SEQ ID NO: 1366285 - RNA, 18 nt, Human
ucccugcagauaucaucc

SEQ ID NO: 1366286 - RNA, 20 nt, Human
uccuaaccacucauaaugac

SEQ ID NO: 1366287 - RNA, 25 nt, Human
ucugacuucuccucugagcacucuu

SEQ ID NO: 1366288 - RNA, 20 nt, Human
ucugccaaccuccccaauag

SEQ ID NO: 1366289 - RNA, 19 nt, Human
ucugggcgcagcgcggccg

SEQ ID NO: 1366290 - RNA, 19 nt, Human
ucuucuaagcuuccugagu

SEQ ID NO: 1366291 - RNA, 20 nt, Human
ugaaacauucucaggugcuc

SEQ ID NO: 1366292 - RNA, 26 nt, Human
ugaaagcacaaugcaaugccacuaca

SEQ ID NO: 1366293 - RNA, 23 nt, Human
ugacaaaggaugaaguucagaua

SEQ ID NO: 1366294 - RNA, 22 nt, Human
ugaccugcagagacugugugag

SEQ ID NO: 1366295 - RNA, 19 nt, Human
ugaggaaacagacacaucc

SEQ ID NO: 1366296 - RNA, 19 nt, Human
ugaggaacauaguucaacc

SEQ ID NO: 1366297 - RNA, 18 nt, Human
ugagguccucguccggga

SEQ ID NO: 1366298 - RNA, 21 nt, Human
ugcaccagacggggcaggggg

SEQ ID NO: 1366299 - RNA, 19 nt, Human
ugccucaggauugguaagu

SEQ ID NO: 1366300 - RNA, 22 nt, Human
uggauaacacaagccaaagaga

SEQ ID NO: 1366301 - RNA, 20 nt, Human
uggauaacacaagccaaagg

SEQ ID NO: 1366302 - RNA, 18 nt, Human
uggccgaggaaggaacag

SEQ ID NO: 1366303 - RNA, 18 nt, Human
uggccgggguccccgagc

SEQ ID NO: 1366304 - RNA, 20 nt, Human
uggcugcagggagcaagugg

SEQ ID NO: 1366305 - RNA, 18 nt, Human
ugggagguacaaucccac

SEQ ID NO: 1366306 - RNA, 21 nt, Human
ugggcgcagcgcggccgggcu

SEQ ID NO: 1366307 - RNA, 21 nt, Human
ugguggcugcagggagcaagu

SEQ ID NO: 1366308 - RNA, 25 nt, Human
ugguugagggauuguuuuggagcac

SEQ ID NO: 1366309 - RNA, 18 nt, Human
ugucacaguucuggaugc

SEQ ID NO: 1366310 - RNA, 18 nt, Human
ugucacaguucuggaugc

SEQ ID NO: 1366311 - RNA, 20 nt, Human
ugucacaguucuggaugcuu

SEQ ID NO: 1366312 - RNA, 21 nt, Human
ugugaauaaaagacuugaaua

SEQ ID NO: 1366313 - RNA, 23 nt, Human
ugugcaccagacggggcaggggg

SEQ ID NO: 1366314 - RNA, 21 nt, Human
uguggcaacuguggucacugu

SEQ ID NO: 1366315 - RNA, 24 nt, Human
uuaaaucuuuuggagaaauuugaa

SEQ ID NO: 1366316 - RNA, 19 nt, Human
uuagucagcagaaaaaugc

SEQ ID NO: 1366317 - RNA, 20 nt, Human
uucaacccauaacacucagu

SEQ ID NO: 1366318 - RNA, 20 nt, Human
uucacaaaauagucacccau

SEQ ID NO: 1366319 - RNA, 19 nt, Human
uuccccuuauucacucccc

SEQ ID NO: 1366320 - RNA, 18 nt, Human
uuccugcuccuccaacac

SEQ ID NO: 1366321 - RNA, 22 nt, Human
uugaaaagcugggaagaaaagu

SEQ ID NO: 1366322 - RNA, 19 nt, Human
uugaggaaacagacacauc

SEQ ID NO: 1366323 - RNA, 19 nt, Human
uuucacaggacaugggaaa

SEQ ID NO: 1366324 - RNA, 18 nt, Human
uuuccugucucccacugg

SEQ ID NO: 1366325 - RNA, 24 nt, Human
uuuccugucucccacuggugcaaa

SEQ ID NO: 1366326 - RNA, 24 nt, Human
uuucugugagccugaauauuuuua

SEQ ID NO: 1366327 - RNA, 26 nt, Human
uuuggccccuccucugacuucucccc

SEQ ID NO: 1366328 - RNA, 19 nt, Human
uuuuauuuucacaggacau

SEQ ID NO: 1366329 - RNA, 19 nt, Human
aaaguccugucuggcucuu

SEQ ID NO: 1366330 - RNA, 23 nt, Human
aaccaccagcaggagaaaacaaa

SEQ ID NO: 1366331 - RNA, 21 nt, Human
aagcugccaguugcaaagucc

SEQ ID NO: 1366332 - RNA, 21 nt, Human
acaggugugauaaguuuccau

SEQ ID NO: 1366333 - RNA, 18 nt, Human
acauuuuuuaaacaaaac

SEQ ID NO: 1366334 - RNA, 20 nt, Human
accucacugccagaaaagag

SEQ ID NO: 1366335 - RNA, 23 nt, Human
aggaacaguuguaccgaaucuug

SEQ ID NO: 1366336 - RNA, 22 nt, Human
agggagcgugaaagacucaaag

SEQ ID NO: 1366337 - RNA, 24 nt, Human
auggagcaagaugugcccacaaga

SEQ ID NO: 1366338 - RNA, 21 nt, Human
cacugccagaaaagagaaugg

SEQ ID NO: 1366339 - RNA, 24 nt, Human
cagaaaagagaauggugcucaaau

SEQ ID NO: 1366340 - RNA, 19 nt, Human
cagaaugcccccuaccucu

SEQ ID NO: 1366341 - RNA, 20 nt, Human
cagaaugcccccuaccucuc

SEQ ID NO: 1366342 - RNA, 19 nt, Human
cagcaggagaaaacaaagg

SEQ ID NO: 1366343 - RNA, 21 nt, Human
cagcaggagaaaacaaaggga

SEQ ID NO: 1366344 - RNA, 23 nt, Human
cagcaggagaaaacaaagggaaa

SEQ ID NO: 1366345 - RNA, 19 nt, Human
cagccucagucaggaauga

SEQ ID NO: 1366346 - RNA, 22 nt, Human
caggaaugacaggaauaccugc

SEQ ID NO: 1366347 - RNA, 20 nt, Human
cagggacccugacauugggg

SEQ ID NO: 1366348 - RNA, 24 nt, Human
caucuaccuggauaagggcuccga

SEQ ID NO: 1366349 - RNA, 21 nt, Human
cauuguauuggaggauaaugg

SEQ ID NO: 1366350 - RNA, 23 nt, Human
cauuuuucagaaugcccccuacc

SEQ ID NO: 1366351 - RNA, 21 nt, Human
ccaaaaagaccugauuuuacc

SEQ ID NO: 1366352 - RNA, 22 nt, Human
ccaccagcaggagaaaacaaag

SEQ ID NO: 1366353 - RNA, 23 nt, Human
ccagaaggcaugggcauuguauu

SEQ ID NO: 1366354 - RNA, 23 nt, Human
ccccuuccaaaaagaccugauuu

SEQ ID NO: 1366355 - RNA, 20 nt, Human
cccuaacucaauaccggaaa

SEQ ID NO: 1366356 - RNA, 21 nt, Human
cucaauaccggaaaacggaca

SEQ ID NO: 1366357 - RNA, 19 nt, Human
cuccgagcuacagggaccc

SEQ ID NO: 1366358 - RNA, 20 nt, Human
cuugaagugaagaagaaagu

SEQ ID NO: 1366359 - RNA, 21 nt, Human
gaauuuaacucugaaccacca

SEQ ID NO: 1366360 - RNA, 22 nt, Human
ggacugaaggggcuaaccauga

SEQ ID NO: 1366361 - RNA, 24 nt, Human
uaaacaaaacuuagcugaaagccc

SEQ ID NO: 1366362 - RNA, 26 nt, Human
uaaacaaaacuuagcugaaagcccca

SEQ ID NO: 1366363 - RNA, 21 nt, Human
uacauaguguucacugggcag

SEQ ID NO: 1366364 - RNA, 19 nt, Human
ucuagagguggaggucuua

SEQ ID NO: 1366365 - RNA, 18 nt, Human
ugaagugaagaagaaagu

SEQ ID NO: 1366366 - RNA, 19 nt, Human
ugaauuggcaaaaaaaaaa

SEQ ID NO: 1366367 - RNA, 21 nt, Human
ugaauuggcaaaaaaaaaacc

SEQ ID NO: 1366368 - RNA, 22 nt, Human
ugaauuggcaaaaaaaaaaccc

SEQ ID NO: 1366369 - RNA, 20 nt, Human
ugauaaguuuccauaaaaac

SEQ ID NO: 1366370 - RNA, 23 nt, Human
ugccagaaaagagaauggugcuc

SEQ ID NO: 1366371 - RNA, 23 nt, Human
uuaaacaaaacuuagcugaaagc

SEQ ID NO: 1366372 - RNA, 22 nt, Human
uucagaagaagggagcgugaaa

SEQ ID NO: 1366373 - RNA, 19 nt, Human
uucagaaugcccccuaccu

SEQ ID NO: 1366374 - RNA, 20 nt, Human
uuguacauaugaaugaaauc

SEQ ID NO: 1366375 - RNA, 19 nt, Human
uuuaccucacugccagaaa

SEQ ID NO: 1366376 - RNA, 24 nt, Human
uuuguuguacauaugaaugaaauc

SEQ ID NO: 1366377 - RNA, 22 nt, Human
uuuuuuaaacaaaacuuagcug

SEQ ID NO: 1366378 - RNA, 21 nt, Human
aaacgcauagaaagcacuugc

SEQ ID NO: 1366379 - RNA, 19 nt, Human
aaacggcucagcccaggaa

SEQ ID NO: 1366380 - RNA, 21 nt, Human
aaagcacuugcugcaccccug

SEQ ID NO: 1366381 - RNA, 22 nt, Human
aaccugccgucuuugccacuuc

SEQ ID NO: 1366382 - RNA, 24 nt, Human
aaggagccggcccauccugcaggc

SEQ ID NO: 1366383 - RNA, 19 nt, Human
accaaggugaccagggggc

SEQ ID NO: 1366384 - RNA, 22 nt, Human
acccagguccucugaccuccuc

SEQ ID NO: 1366385 - RNA, 18 nt, Human
accccaugcuuccagccu

SEQ ID NO: 1366386 - RNA, 20 nt, Human
accggcuucccagccuugac

SEQ ID NO: 1366387 - RNA, 23 nt, Human
accucaccauucucagccuccag

SEQ ID NO: 1366388 - RNA, 24 nt, Human
accucagccccguccuuccuccag

SEQ ID NO: 1366389 - RNA, 23 nt, Human
accucuuuccuccucucuguccc

SEQ ID NO: 1366390 - RNA, 21 nt, Human
accugccgucuuugccacuuc

SEQ ID NO: 1366391 - RNA, 18 nt, Human
agccaggccuccugccug

SEQ ID NO: 1366392 - RNA, 23 nt, Human
agccaggccuccugccugaccuc

SEQ ID NO: 1366393 - RNA, 19 nt, Human
aggcagccugaauggggag

SEQ ID NO: 1366394 - RNA, 21 nt, Human
aggcagccugaauggggaggu

SEQ ID NO: 1366395 - RNA, 23 nt, Human
aggccuccugccugaccucccag

SEQ ID NO: 1366396 - RNA, 23 nt, Human
agggagggcccagaaccccaggg

SEQ ID NO: 1366397 - RNA, 25 nt, Human
aggugccaggucccaggucacuggu

SEQ ID NO: 1366398 - RNA, 21 nt, Human
aguugggggaagacagggcug

SEQ ID NO: 1366399 - RNA, 20 nt, Human
aucuccuccaggcaccccca

SEQ ID NO: 1366400 - RNA, 21 nt, Human
cacacacacgaccuugaugcc

SEQ ID NO: 1366401 - RNA, 20 nt, Human
cacagagccucccucacucc

SEQ ID NO: 1366402 - RNA, 20 nt, Human
caccccuggaaucucuugaa

SEQ ID NO: 1366403 - RNA, 21 nt, Human
cacccucccuccaaacggcuc

SEQ ID NO: 1366404 - RNA, 22 nt, Human
cacccucccuccaaacggcuca

SEQ ID NO: 1366405 - RNA, 20 nt, Human
cagagccucccucacuccuc

SEQ ID NO: 1366406 - RNA, 22 nt, Human
cagccucuuccacucccugccc

SEQ ID NO: 1366407 - RNA, 25 nt, Human
cagcugugcccacccucccuccaaa

SEQ ID NO: 1366408 - RNA, 18 nt, Human
caggcacccccaguucuc

SEQ ID NO: 1366409 - RNA, 24 nt, Human
caggcaucuucucacucccauuuu

SEQ ID NO: 1366410 - RNA, 18 nt, Human
cagggagggcccagaacc

SEQ ID NO: 1366411 - RNA, 24 nt, Human
caguggucacagcaggcccagcug

SEQ ID NO: 1366412 - RNA, 19 nt, Human
cauagaaagcacuugcugc

SEQ ID NO: 1366413 - RNA, 25 nt, Human
cauagaaagcacuugcugcaccccc

SEQ ID NO: 1366414 - RNA, 23 nt, Human
cauucagcaucuccuccaggcac

SEQ ID NO: 1366415 - RNA, 24 nt, Human
ccagcagagaucauaucccaggcc

SEQ ID NO: 1366416 - RNA, 22 nt, Human
ccagggaccccugcuccccgag

SEQ ID NO: 1366417 - RNA, 23 nt, Human
ccagguccaccugggccucccug

SEQ ID NO: 1366418 - RNA, 23 nt, Human
ccaguggcucucucaguuucucu

SEQ ID NO: 1366419 - RNA, 21 nt, Human
ccaugucagccaggcccuggg

SEQ ID NO: 1366420 - RNA, 24 nt, Human
cccagaaccccagggacucucagg

SEQ ID NO: 1366421 - RNA, 22 nt, Human
cccagccuugaccaccaguggc

SEQ ID NO: 1366422 - RNA, 21 nt, Human
cccagcugugcccacccuccc

SEQ ID NO: 1366423 - RNA, 31 nt, Human
cccaggacccuggaccucaccauucucaggg

SEQ ID NO: 1366424 - RNA, 21 nt, Human
ccccaaggacuucacguccuc

SEQ ID NO: 1366425 - RNA, 22 nt, Human
ccccaaggacuucacguccucc

SEQ ID NO: 1366426 - RNA, 21 nt, Human
ccccagguccaccugggccuc

SEQ ID NO: 1366427 - RNA, 20 nt, Human
cccccacccacacacacgac

SEQ ID NO: 1366428 - RNA, 19 nt, Human
ccccugacugugccugaga

SEQ ID NO: 1366429 - RNA, 19 nt, Human
cccguccuuccuccaggca

SEQ ID NO: 1366430 - RNA, 23 nt, Human
cccuucauccuccuuuagggccc

SEQ ID NO: 1366431 - RNA, 22 nt, Human
cccuugauggcagggagggccc

SEQ ID NO: 1366432 - RNA, 19 nt, Human
ccuccaaacggcucagccc

SEQ ID NO: 1366433 - RNA, 21 nt, Human
ccuccaaccucagccccugac

SEQ ID NO: 1366434 - RNA, 20 nt, Human
ccuccaggcacccccaguuc

SEQ ID NO: 1366435 - RNA, 19 nt, Human
ccucccuuguuuuucuucc

SEQ ID NO: 1366436 - RNA, 21 nt, Human
ccuccucuccucuucccuccc

SEQ ID NO: 1366437 - RNA, 18 nt, Human
ccucucugucccuugccu

SEQ ID NO: 1366438 - RNA, 21 nt, Human
ccucuggaucuccugaagcga

SEQ ID NO: 1366439 - RNA, 22 nt, Human
ccucuggaucuccugaagcgaa

SEQ ID NO: 1366440 - RNA, 22 nt, Human
ccucuuuccuccucucuguccc

SEQ ID NO: 1366441 - RNA, 18 nt, Human
ccugaagcgaagaagaaa

SEQ ID NO: 1366442 - RNA, 21 nt, Human
ccuggggcucugggcacagcc

SEQ ID NO: 1366443 - RNA, 25 nt, Human
ccuuaguugggggaagaccgggguc

SEQ ID NO: 1366444 - RNA, 20 nt, Human
ccuuuagggccccaggaccc

SEQ ID NO: 1366445 - RNA, 20 nt, Human
cgaagaagaaagaaacccau

SEQ ID NO: 1366446 - RNA, 22 nt, Human
cucaccauucucagccuccagg

SEQ ID NO: 1366447 - RNA, 19 nt, Human
cucaguuucucugucacau

SEQ ID NO: 1366448 - RNA, 19 nt, Human
cuccaaccucagccccuga

SEQ ID NO: 1366449 - RNA, 21 nt, Human
cuccagggaccccugcucccc

SEQ ID NO: 1366450 - RNA, 23 nt, Human
cuccccgagggaccucuuuccuc

SEQ ID NO: 1366451 - RNA, 18 nt, Human
cucccucacuccucagug

SEQ ID NO: 1366452 - RNA, 19 nt, Human
cuccuccaaccucagcccc

SEQ ID NO: 1366453 - RNA, 21 nt, Human
cuccucucuccauagaugucc

SEQ ID NO: 1366454 - RNA, 25 nt, Human
cucgccaggcaucuucucacuccca

SEQ ID NO: 1366455 - RNA, 21 nt, Human
cucuuccacucccugcccuuc

SEQ ID NO: 1366456 - RNA, 20 nt, Human
cugaagcgaagaagaaagaa

SEQ ID NO: 1366457 - RNA, 20 nt, Human
cugcugcccaccaccucagc

SEQ ID NO: 1366458 - RNA, 24 nt, Human
cugcugcccaccaccucagccccg

SEQ ID NO: 1366459 - RNA, 20 nt, Human
cuggaaggggaucuucacua

SEQ ID NO: 1366460 - RNA, 18 nt, Human
cugugccugagaccugcu

SEQ ID NO: 1366461 - RNA, 19 nt, Human
cuuaaagaugacuccaucc

SEQ ID NO: 1366462 - RNA, 21 nt, Human
cuuagcuuggagccaggaggu

SEQ ID NO: 1366463 - RNA, 24 nt, Human
cuuagcuuggagccaggaggugga

SEQ ID NO: 1366464 - RNA, 21 nt, Human
cuucauucagcaucuccucca

SEQ ID NO: 1366465 - RNA, 20 nt, Human
cuuccagccucgucugcucc

SEQ ID NO: 1366466 - RNA, 21 nt, Human
cuugaauccaggagguggagg

SEQ ID NO: 1366467 - RNA, 22 nt, Human
gaagugaagcuucaagggucca

SEQ ID NO: 1366468 - RNA, 24 nt, Human
gaagugaagcuucaaggguccagg

SEQ ID NO: 1366469 - RNA, 21 nt, Human
gagggcccagaaccccaggga

SEQ ID NO: 1366470 - RNA, 22 nt, Human
gauggcagggagggcccagaac

SEQ ID NO: 1366471 - RNA, 23 nt, Human
gcccauggggccuugggcauccu

SEQ ID NO: 1366472 - RNA, 21 nt, Human
gccuuaguugggggaagacag

SEQ ID NO: 1366473 - RNA, 20 nt, Human
gcuccccuucucuuuccucc

SEQ ID NO: 1366474 - RNA, 19 nt, Human
gcucucucaguuucucugu

SEQ ID NO: 1366475 - RNA, 19 nt, Human
gcugcccaccaccucagcc

SEQ ID NO: 1366476 - RNA, 21 nt, Human
gcugugcccacccucccucca

SEQ ID NO: 1366477 - RNA, 24 nt, Human
gcuuccagccucgucugcuccccu

SEQ ID NO: 1366478 - RNA, 19 nt, Human
gcuuuucugccaaagggac

SEQ ID NO: 1366479 - RNA, 18 nt, Human
ggagaguguggcggccuc

SEQ ID NO: 1366480 - RNA, 21 nt, Human
ggagggcccagaaccccaggg

SEQ ID NO: 1366481 - RNA, 27 nt, Human
ggccuuaguugggggaagacagggcug

SEQ ID NO: 1366482 - RNA, 18 nt, Human
ggugaggguacaggagag

SEQ ID NO: 1366483 - RNA, 21 nt, Human
guccaggagguucgcugucau

SEQ ID NO: 1366484 - RNA, 22 nt, Human
guggaggcugcccccacccaca

SEQ ID NO: 1366485 - RNA, 18 nt, Human
guggcccauggggccuug

SEQ ID NO: 1366486 - RNA, 22 nt, Human
guggcccauggggccuugggca

SEQ ID NO: 1366487 - RNA, 18 nt, Human
uaaaccaggugccagguc

SEQ ID NO: 1366488 - RNA, 18 nt, Human
uagcaucucuccucucuc

SEQ ID NO: 1366489 - RNA, 21 nt, Human
uagcuuggagccaggaggugg

SEQ ID NO: 1366490 - RNA, 22 nt, Human
uaguccucacccagguccucug

SEQ ID NO: 1366491 - RNA, 25 nt, Human
ucacagcaggcccagcugugcccac

SEQ ID NO: 1366492 - RNA, 22 nt, Human
ucacaucuggagcaaugguagg

SEQ ID NO: 1366493 - RNA, 24 nt, Human
ucagagccagcagagaucauaucc

SEQ ID NO: 1366494 - RNA, 21 nt, Human
uccaaacggcucagcccagga

SEQ ID NO: 1366495 - RNA, 18 nt, Human
uccaaccucagccccuga

SEQ ID NO: 1366496 - RNA, 19 nt, Human
uccaggagguggaggcugc

SEQ ID NO: 1366497 - RNA, 22 nt, Human
ucccaguggucacagcaggccc

SEQ ID NO: 1366498 - RNA, 20 nt, Human
ucccccagguccaccugggc

SEQ ID NO: 1366499 - RNA, 19 nt, Human
uccccgagggaccucuuuc

SEQ ID NO: 1366500 - RNA, 19 nt, Human
uccccuucucuuuccuccu

SEQ ID NO: 1366501 - RNA, 25 nt, Human
ucccugucacugcugcccaccaccu

SEQ ID NO: 1366502 - RNA, 19 nt, Human
uccggguagcaucucuccu

SEQ ID NO: 1366503 - RNA, 24 nt, Human
ucgcugagagcucagguccugggu

SEQ ID NO: 1366504 - RNA, 24 nt, Human
ugaagaaacgcauagaaagcacuu

SEQ ID NO: 1366505 - RNA, 21 nt, Human
ugaagcgaagaagaaagaaac

SEQ ID NO: 1366506 - RNA, 25 nt, Human
ugaccucccagccucuuccacuccc

SEQ ID NO: 1366507 - RNA, 23 nt, Human
ugaccuccucuccucuucccucc

SEQ ID NO: 1366508 - RNA, 19 nt, Human
ugacuuagcuuggagccag

SEQ ID NO: 1366509 - RNA, 24 nt, Human
ugacuugcagagugagcucggccu

SEQ ID NO: 1366510 - RNA, 18 nt, Human
ugcacgagaccgucuugc

SEQ ID NO: 1366511 - RNA, 23 nt, Human
ugcgugaugaagaggcugugcac

SEQ ID NO: 1366512 - RNA, 25 nt, Human
ugcuccccuucucuuuccuccucca

SEQ ID NO: 1366513 - RNA, 21 nt, Human
ugcuuccagccucgucugcuc

SEQ ID NO: 1366514 - RNA, 22 nt, Human
uggaucuuaaacagcaugcaaa

SEQ ID NO: 1366515 - RNA, 20 nt, Human
uggcagggagggcccagaac

SEQ ID NO: 1366516 - RNA, 23 nt, Human
uggccaaaaccucgccaggcauc

SEQ ID NO: 1366517 - RNA, 22 nt, Human
uggcggccucccccggcugcac

SEQ ID NO: 1366518 - RNA, 21 nt, Human
ugggccucccugucacugcug

SEQ ID NO: 1366519 - RNA, 21 nt, Human
ugugcccacccucccuccaaa

SEQ ID NO: 1366520 - RNA, 21 nt, Human
uuaguugggggaagacagggc

SEQ ID NO: 1366521 - RNA, 18 nt, Human
uucccagccuugaccacc

SEQ ID NO: 1366522 - RNA, 25 nt, Human
uucccagccuugaccaccaguggcu

SEQ ID NO: 1366523 - RNA, 19 nt, Human
uuccugccugcgcugggga

SEQ ID NO: 1366524 - RNA, 20 nt, Human
uuccugccugcgcuggggag

SEQ ID NO: 1366525 - RNA, 22 nt, Human
uuuccuccuccaaccucagccc

SEQ ID NO: 1366526 - RNA, 22 nt, Human
uuuuccuggggcucugggcaca

SEQ ID NO: 1366527 - RNA, 21 nt, Human
aaauacuuucuuccuggggcu

SEQ ID NO: 1366528 - RNA, 18 nt, Human
aagaagacugguucaucu

SEQ ID NO: 1366529 - RNA, 20 nt, Human
aaugcccaucaacccuuugc

SEQ ID NO: 1366530 - RNA, 25 nt, Human
acagacagacagugcugaguugggg

SEQ ID NO: 1366531 - RNA, 19 nt, Human
acggugguggcggcggcgg

SEQ ID NO: 1366532 - RNA, 19 nt, Human
acggugguggcggcggcgg

SEQ ID NO: 1366533 - RNA, 24 nt, Human
acuucacuccacugaaaucugguu

SEQ ID NO: 1366534 - RNA, 18 nt, Human
agaaagcaagcuaaccug

SEQ ID NO: 1366535 - RNA, 20 nt, Human
aggaucuuuuucucagaggg

SEQ ID NO: 1366536 - RNA, 22 nt, Human
aggaucuuuuucucagagggug

SEQ ID NO: 1366537 - RNA, 23 nt, Human
aggauggaggauuuagggaggaa

SEQ ID NO: 1366538 - RNA, 27 nt, Human
agggaggaagaaagcaagcuaaccugg

SEQ ID NO: 1366539 - RNA, 23 nt, Human
auaaaaggcuguucucagcacca

SEQ ID NO: 1366540 - RNA, 18 nt, Human
aucugguuggguaugaga

SEQ ID NO: 1366541 - RNA, 22 nt, Human
caaaacagccacccagauaagu

SEQ ID NO: 1366542 - RNA, 19 nt, Human
caaguuacagaaaacgcaa

SEQ ID NO: 1366543 - RNA, 21 nt, Human
cacggggcuuguuggcaggca

SEQ ID NO: 1366544 - RNA, 23 nt, Human
cacugcauuaccuggccaaaggc

SEQ ID NO: 1366545 - RNA, 24 nt, Human
cagaaaacgcaaauuuucauagca

SEQ ID NO: 1366546 - RNA, 20 nt, Human
cagugcugaguuggggaggu

SEQ ID NO: 1366547 - RNA, 25 nt, Human
cauugggucucucugaaaaaggccc

SEQ ID NO: 1366548 - RNA, 19 nt, Human
ccacccagauaaguccaug

SEQ ID NO: 1366549 - RNA, 24 nt, Human
cccacgcaucuagccuucugggca

SEQ ID NO: 1366550 - RNA, 21 nt, Human
cccaucacccgucccucugaa

SEQ ID NO: 1366551 - RNA, 24 nt, Human
ccccauaaaaggcuguucucagca

SEQ ID NO: 1366552 - RNA, 22 nt, Human
cccgucccucugaagaagcacg

SEQ ID NO: 1366553 - RNA, 21 nt, Human
cccuuugcgugcuguugcugc

SEQ ID NO: 1366554 - RNA, 18 nt, Human
cggugguggcggcggcgg

SEQ ID NO: 1366555 - RNA, 19 nt, Human
cuguucucagcaccaacau

SEQ ID NO: 1366556 - RNA, 18 nt, Human
gaaagauuaagguuccca

SEQ ID NO: 1366557 - RNA, 21 nt, Human
gaagaagacugguucaucuuc

SEQ ID NO: 1366558 - RNA, 18 nt, Human
gacccgaagcagggaggc

SEQ ID NO: 1366559 - RNA, 18 nt, Human
gaggauggaggauuuagg

SEQ ID NO: 1366560 - RNA, 21 nt, Human
gcacagacagacagugcugag

SEQ ID NO: 1366561 - RNA, 21 nt, Human
gcccauggcucagugcaagcc

SEQ ID NO: 1366562 - RNA, 21 nt, Human
ggaccugaauacuccuacccc

SEQ ID NO: 1366563 - RNA, 20 nt, Human
ggcggcggcggugguggcgg

SEQ ID NO: 1366564 - RNA, 21 nt, Human
gggcuuguucugacccgaagc

SEQ ID NO: 1366565 - RNA, 23 nt, Human
gguagugaggggaagaagacugg

SEQ ID NO: 1366566 - RNA, 23 nt, Human
gguggcggcggcggugguggcgg

SEQ ID NO: 1366567 - RNA, 25 nt, Human
gguggcggcggcggugguggcggug

SEQ ID NO: 1366568 - RNA, 19 nt, Human
ggugguggcggcggcggug

SEQ ID NO: 1366569 - RNA, 23 nt, Human
ggugguggcggcggcgguggugg

SEQ ID NO: 1366570 - RNA, 18 nt, Human
gugaauuaucuggaccag

SEQ ID NO: 1366571 - RNA, 20 nt, Human
guggcggcggcggugguggc

SEQ ID NO: 1366572 - RNA, 23 nt, Human
gugguggcggcggcggugguggc

SEQ ID NO: 1366573 - RNA, 26 nt, Human
uacggugguggcggcggcggugguga

SEQ ID NO: 1366574 - RNA, 21 nt, Human
uacucuugcugcugcugcugc

SEQ ID NO: 1366575 - RNA, 18 nt, Human
uaggaaggacgcaaagua

SEQ ID NO: 1366576 - RNA, 24 nt, Human
ucaauaaugagaggaaaaugcacc

SEQ ID NO: 1366577 - RNA, 20 nt, Human
ucacauuucucucuggcugu

SEQ ID NO: 1366578 - RNA, 22 nt, Human
uccauguggaaccuccucugug

SEQ ID NO: 1366579 - RNA, 21 nt, Human
ucccauaggaucacauccucc

SEQ ID NO: 1366580 - RNA, 21 nt, Human
uccgguggaaugaaggacaag

SEQ ID NO: 1366581 - RNA, 24 nt, Human
uccuccuccugcaccgccuuugac

SEQ ID NO: 1366582 - RNA, 19 nt, Human
ucguauguggcuccucccc

SEQ ID NO: 1366583 - RNA, 20 nt, Human
ucucugaaaaaggcccuuaa

SEQ ID NO: 1366584 - RNA, 21 nt, Human
ucuucuccugcucugccuucu

SEQ ID NO: 1366585 - RNA, 21 nt, Human
ucuugcugcugcugcugcugc

SEQ ID NO: 1366586 - RNA, 22 nt, Human
ucuugcugcugcugcugcugcc

SEQ ID NO: 1366587 - RNA, 21 nt, Human
ugaagaagcacgcacacucca

SEQ ID NO: 1366588 - RNA, 21 nt, Human
ugacccgaagcagggaggcag

SEQ ID NO: 1366589 - RNA, 25 nt, Human
ugcucugccuucuugauaaacacuc

SEQ ID NO: 1366590 - RNA, 21 nt, Human
ugcugcugcugcugcugcugc

SEQ ID NO: 1366591 - RNA, 21 nt, Human
ugcugcugcugcugcugcugc

SEQ ID NO: 1366592 - RNA, 21 nt, Human
ugcugcugcugcugcugcugc

SEQ ID NO: 1366593 - RNA, 21 nt, Human
ugcugcugcugcugcugcugc

SEQ ID NO: 1366594 - RNA, 21 nt, Human
ugcugcugcugcugcugcugc

SEQ ID NO: 1366595 - RNA, 21 nt, Human
ugcugcugcugcugcugcugc

SEQ ID NO: 1366596 - RNA, 21 nt, Human
ugcugcugcugcugcugcugc

SEQ ID NO: 1366597 - RNA, 21 nt, Human
uggaaugaaggacaagagaag

SEQ ID NO: 1366598 - RNA, 22 nt, Human
uggaggauuuagggaggaagaa

SEQ ID NO: 1366599 - RNA, 18 nt, Human
uggccaaaggccuuuggc

SEQ ID NO: 1366600 - RNA, 24 nt, Human
uggcggcggcggugguggcggugg

SEQ ID NO: 1366601 - RNA, 29 nt, Human
uggcggcggcggugguggcgguggcuggu

SEQ ID NO: 1366602 - RNA, 21 nt, Human
uggggcuuguucugacccgaa

SEQ ID NO: 1366603 - RNA, 18 nt, Human
ugguggcggcggcggugg

SEQ ID NO: 1366604 - RNA, 25 nt, Human
ugucugaggaucuuuuucucagaga

SEQ ID NO: 1366605 - RNA, 24 nt, Human
uuaucuggaccagauccuccuccu

SEQ ID NO: 1366606 - RNA, 18 nt, Human
uuccuuguuguguucaga

SEQ ID NO: 1366607 - RNA, 21 nt, Human
uuggggaggugggucuguggg

SEQ ID NO: 1366608 - RNA, 20 nt, Human
uuucucagaggguggggaug

SEQ ID NO: 1366609 - RNA, 19 nt, Human
uuuuagaaaagaaagauua

SEQ ID NO: 1366610 - RNA, 24 nt, Human
aaccaaguccacuccuggccagua

SEQ ID NO: 1366611 - RNA, 19 nt, Human
aaccaaugagaagguagcc

SEQ ID NO: 1366612 - RNA, 21 nt, Human
aaccagaugcccgggagccug

SEQ ID NO: 1366613 - RNA, 21 nt, Human
acagcccaagccguagaagcc

SEQ ID NO: 1366614 - RNA, 19 nt, Human
acgaaggcgcaguccucgc

SEQ ID NO: 1366615 - RNA, 19 nt, Human
agaccagcccuccucccca

SEQ ID NO: 1366616 - RNA, 18 nt, Human
agccagaggcaccaggcc

SEQ ID NO: 1366617 - RNA, 21 nt, Human
agcccuaaccaaguccacucu

SEQ ID NO: 1366618 - RNA, 23 nt, Human
agccuggccaguggaaguagccc

SEQ ID NO: 1366619 - RNA, 19 nt, Human
agcgguggcugcagcccuc

SEQ ID NO: 1366620 - RNA, 21 nt, Human
aggcagcgccccgacuggaag

SEQ ID NO: 1366621 - RNA, 19 nt, Human
agggaagggaagggguggg

SEQ ID NO: 1366622 - RNA, 19 nt, Human
aggggccugggcccggggc

SEQ ID NO: 1366623 - RNA, 18 nt, Human
aucuccucaggccacuag

SEQ ID NO: 1366624 - RNA, 20 nt, Human
caaccagaugcccgggagcc

SEQ ID NO: 1366625 - RNA, 18 nt, Human
caccaggcccuagcgggg

SEQ ID NO: 1366626 - RNA, 21 nt, Human
caccggucgccgauccagccc

SEQ ID NO: 1366627 - RNA, 20 nt, Human
cagcccaagccguagaagcc

SEQ ID NO: 1366628 - RNA, 22 nt, Human
cagcccaagccguagaagccgg

SEQ ID NO: 1366629 - RNA, 26 nt, Human
cagcccuccuccccaggcugggguca

SEQ ID NO: 1366630 - RNA, 19 nt, Human
cagcugacagcugaggggc

SEQ ID NO: 1366631 - RNA, 18 nt, Human
ccacaccggcggcgacag

SEQ ID NO: 1366632 - RNA, 21 nt, Human
cccccgccgggaggagcccau

SEQ ID NO: 1366633 - RNA, 25 nt, Human
ccccugaggagcggagaccagcccu

SEQ ID NO: 1366634 - RNA, 24 nt, Human
cccucccaucuuuggccaaugaga

SEQ ID NO: 1366635 - RNA, 20 nt, Human
cccuggaggucccgcggcgu

SEQ ID NO: 1366636 - RNA, 19 nt, Human
ccgcugccgcagucggcgc

SEQ ID NO: 1366637 - RNA, 18 nt, Human
ccgcugccgcagucgggg

SEQ ID NO: 1366638 - RNA, 23 nt, Human
ccucaggccacuagagucgcccc

SEQ ID NO: 1366639 - RNA, 23 nt, Human
ccucgaccaacgggaugggcccu

SEQ ID NO: 1366640 - RNA, 22 nt, Human
ccuggccaguggaaguagcccc

SEQ ID NO: 1366641 - RNA, 23 nt, Human
ccuggccaguggaaguagccccg

SEQ ID NO: 1366642 - RNA, 18 nt, Human
ccuugcacuggccacacc

SEQ ID NO: 1366643 - RNA, 18 nt, Human
cgacaguacuugccgcgg

SEQ ID NO: 1366644 - RNA, 21 nt, Human
cgcaaccuccgcuagccgcgc

SEQ ID NO: 1366645 - RNA, 23 nt, Human
cgccagagcacacugcuccaauc

SEQ ID NO: 1366646 - RNA, 18 nt, Human
cgcggcauggcggacagc

SEQ ID NO: 1366647 - RNA, 21 nt, Human
cgcgguagcccggcucgcagg

SEQ ID NO: 1366648 - RNA, 22 nt, Human
cggccgaggggggagcagcccu

SEQ ID NO: 1366649 - RNA, 19 nt, Human
cgggaugggcccuucccgc

SEQ ID NO: 1366650 - RNA, 23 nt, Human
cggucgccgauccagcccgcguu

SEQ ID NO: 1366651 - RNA, 22 nt, Human
cguguggggcagugggaggcca

SEQ ID NO: 1366652 - RNA, 18 nt, Human
cugacagcugaggggccu

SEQ ID NO: 1366653 - RNA, 22 nt, Human
cugagccaaugagacgcaaccu

SEQ ID NO: 1366654 - RNA, 23 nt, Human
cugcaggccugagcacaguccgc

SEQ ID NO: 1366655 - RNA, 23 nt, Human
cugcgaagcugagggagcugcgc

SEQ ID NO: 1366656 - RNA, 21 nt, Human
cugucuggucggagcgcucca

SEQ ID NO: 1366657 - RNA, 20 nt, Human
gacagcgguggcugcagccc

SEQ ID NO: 1366658 - RNA, 18 nt, Human
gacaugguuacaggcaug

SEQ ID NO: 1366659 - RNA, 19 nt, Human
gagccuccagccagaggca

SEQ ID NO: 1366660 - RNA, 21 nt, Human
gagccuccagccagaggcacc

SEQ ID NO: 1366661 - RNA, 22 nt, Human
gagcggcugcaggaccugagcc

SEQ ID NO: 1366662 - RNA, 20 nt, Human
gccacuagagucgccccugg

SEQ ID NO: 1366663 - RNA, 24 nt, Human
gccagagcacacugcuccaaucca

SEQ ID NO: 1366664 - RNA, 21 nt, Human
gcgcggugcccggccaauagg

SEQ ID NO: 1366665 - RNA, 21 nt, Human
gcgcugguugguuucuaggug

SEQ ID NO: 1366666 - RNA, 23 nt, Human
gcggagaccagcccuccucccca

SEQ ID NO: 1366667 - RNA, 18 nt, Human
ggagcagcccugcugggg

SEQ ID NO: 1366668 - RNA, 20 nt, Human
ggcagcugcaggccugagca

SEQ ID NO: 1366669 - RNA, 21 nt, Human
ggcgcugcgaagcugagggag

SEQ ID NO: 1366670 - RNA, 23 nt, Human
gggagccuccagccagaggcacc

SEQ ID NO: 1366671 - RNA, 26 nt, Human
gggcagaagugccucuggcugcaacc

SEQ ID NO: 1366672 - RNA, 18 nt, Human
gggcagugggaggccauc

SEQ ID NO: 1366673 - RNA, 24 nt, Human
ggggagaggcagcccgggcagaag

SEQ ID NO: 1366674 - RNA, 20 nt, Human
gggguggcgggcggcgcugc

SEQ ID NO: 1366675 - RNA, 24 nt, Human
gguggcaggcaccagugaccgggu

SEQ ID NO: 1366676 - RNA, 18 nt, Human
guggaguccgggcgggca

SEQ ID NO: 1366677 - RNA, 22 nt, Human
uaagaaagcuuuggccaagccc

SEQ ID NO: 1366678 - RNA, 19 nt, Human
uacaucuccucaggccacu

SEQ ID NO: 1366679 - RNA, 20 nt, Human
uagguggcaggcaccaguga

SEQ ID NO: 1366680 - RNA, 21 nt, Human
ucaaccagaugcccgggagcc

SEQ ID NO: 1366681 - RNA, 24 nt, Human
ucaggccacuagagucgccccugg

SEQ ID NO: 1366682 - RNA, 19 nt, Human
uccagcccgcguugcagcg

SEQ ID NO: 1366683 - RNA, 23 nt, Human
ucgcaguguccgcugccgcaguc

SEQ ID NO: 1366684 - RNA, 19 nt, Human
ucuauugggacggccaagg

SEQ ID NO: 1366685 - RNA, 19 nt, Human
ucuggcugcaaccaaugag

SEQ ID NO: 1366686 - RNA, 28 nt, Human
ugaccgggucgcacgugucccguacucg

SEQ ID NO: 1366687 - RNA, 22 nt, Human
ugagccaaugagacgcaaccuc

SEQ ID NO: 1366688 - RNA, 20 nt, Human
ugcaggccugagcacagucc

SEQ ID NO: 1366689 - RNA, 23 nt, Human
ugcaggccugagcacaguccgcg

SEQ ID NO: 1366690 - RNA, 19 nt, Human
ugcccgggagccuggccag

SEQ ID NO: 1366691 - RNA, 24 nt, Human
ugcuggcccuugcacuggccacac

SEQ ID NO: 1366692 - RNA, 19 nt, Human
uggcaggcaccagugaccg

SEQ ID NO: 1366693 - RNA, 23 nt, Human
ugggacggacuaagccccugagg

SEQ ID NO: 1366694 - RNA, 19 nt, Human
ugggaggccaucaaaacca

SEQ ID NO: 1366695 - RNA, 21 nt, Human
uggggucaaccagaugcccgg

SEQ ID NO: 1366696 - RNA, 18 nt, Human
uguccucguggcagcugc

SEQ ID NO: 1366697 - RNA, 20 nt, Human
uuaagaaagcuuuggccaag

SEQ ID NO: 1366698 - RNA, 25 nt, Human
aucuucauuccccugcaguuaagag

SEQ ID NO: 1366699 - RNA, 25 nt, Human
ccugcaguuaagagaaaccgggguc

SEQ ID NO: 1366700 - RNA, 20 nt, Human
uaagaaacagcuuaggauga

SEQ ID NO: 1366701 - RNA, 22 nt, Human
uaucuggaaacuuaauguagaa

SEQ ID NO: 1366702 - RNA, 21 nt, Human
ucagaagccuuaucuggaaac

SEQ ID NO: 1366703 - RNA, 20 nt, Human
ucuucauuccccugcaguua

SEQ ID NO: 1366704 - RNA, 23 nt, Human
ugucgaggacuagaaaucuucau

SEQ ID NO: 1366705 - RNA, 21 nt, Human
aaguugcuuuuugcuccccca

SEQ ID NO: 1366706 - RNA, 23 nt, Human
agaguggggccuuggguuccccg

SEQ ID NO: 1366707 - RNA, 18 nt, Human
agcgagaguggggccuug

SEQ ID NO: 1366708 - RNA, 24 nt, Human
agggggcagauccagaacagagca

SEQ ID NO: 1366709 - RNA, 21 nt, Human
aguaaagggggcagauccaga

SEQ ID NO: 1366710 - RNA, 22 nt, Human
aguaaagggggcagauccagaa

SEQ ID NO: 1366711 - RNA, 22 nt, Human
cauuuuaauuuggggugggggu

SEQ ID NO: 1366712 - RNA, 23 nt, Human
ccagaacagagcagaaacgguga

SEQ ID NO: 1366713 - RNA, 23 nt, Human
ccugugaacacuggagaacugga

SEQ ID NO: 1366714 - RNA, 25 nt, Human
ccuuggggaccagccaggcugaccc

SEQ ID NO: 1366715 - RNA, 25 nt, Human
cucccccauccuaaugccuugggga

SEQ ID NO: 1366716 - RNA, 23 nt, Human
gacuggggcaagaaagaaggggc

SEQ ID NO: 1366717 - RNA, 25 nt, Human
ggggaccagccaggcugacccaaau

SEQ ID NO: 1366718 - RNA, 24 nt, Human
uaacauuuuaauuugggguggggg

SEQ ID NO: 1366719 - RNA, 19 nt, Human
uaaugccuuggggaccagc

SEQ ID NO: 1366720 - RNA, 20 nt, Human
ucaccugugaacacuggaga

SEQ ID NO: 1366721 - RNA, 24 nt, Human
uccagaacagagcagaaacgguga

SEQ ID NO: 1366722 - RNA, 18 nt, Human
uccagcagcuuaacauuu

SEQ ID NO: 1366723 - RNA, 21 nt, Human
ugggguggggguggaagaaaa

SEQ ID NO: 1366724 - RNA, 18 nt, Human
aacccugagccccugagc

SEQ ID NO: 1366725 - RNA, 23 nt, Human
aagcagugugucccucagggagc

SEQ ID NO: 1366726 - RNA, 22 nt, Human
aaugaagagaucucugaggucc

SEQ ID NO: 1366727 - RNA, 30 nt, Human; identical to SEQ ID NO: 1360125

SEQ ID NO: 1366728 - RNA, 18 nt, Human
agagcgcccuggguucuu

SEQ ID NO: 1366729 - RNA, 21 nt, Human
agaguaguaucccccacacag

SEQ ID NO: 1366730 - RNA, 21 nt, Human
agccauugcaaugaguccaga

SEQ ID NO: 1366731 - RNA, 24 nt, Human
agcgcccuggguucuuuuccccag

SEQ ID NO: 1366732 - RNA, 25 nt, Human
aggagauggggugggggcuggucaa

SEQ ID NO: 1366733 - RNA, 23 nt, Human
aggaggagugacagggaggccug

SEQ ID NO: 1366734 - RNA, 19 nt, Human
aggcuggaagagaaccuga

SEQ ID NO: 1366735 - RNA, 24 nt, Human
agugacagggaggccuggauggug

SEQ ID NO: 1366736 - RNA, 19 nt, Human
caccugugaaaugaagaga

SEQ ID NO: 1366737 - RNA, 28 nt, Human
cagcccuacuggagacgggcugugugac

SEQ ID NO: 1366738 - RNA, 19 nt, Human
cagggaggccuggauggug

SEQ ID NO: 1366739 - RNA, 24 nt, Human
caugcuguucucccuguaccccca

SEQ ID NO: 1366740 - RNA, 20 nt, Human
ccccugagcucaagugcagg

SEQ ID NO: 1366741 - RNA, 18 nt, Human
cccugagccccugagcuc

SEQ ID NO: 1366742 - RNA, 18 nt, Human
cccuggacccuggggccu

SEQ ID NO: 1366743 - RNA, 19 nt, Human
cccuggacccuggggccuc

SEQ ID NO: 1366744 - RNA, 20 nt, Human
cccuggacccuggggccucc

SEQ ID NO: 1366745 - RNA, 20 nt, Human
ccuggcuugagcuucaucgg

SEQ ID NO: 1366746 - RNA, 24 nt, Human
cgguagcggggcugggguggacac

SEQ ID NO: 1366747 - RNA, 21 nt, Human
gaagguguaggagagagucca

SEQ ID NO: 1366748 - RNA, 19 nt, Human
gagaggagauggggugggg

SEQ ID NO: 1366749 - RNA, 20 nt, Human
gagguccccaggaggaguga

SEQ ID NO: 1366750 - RNA, 19 nt, Human
gcccuggacccuggggccc

SEQ ID NO: 1366751 - RNA, 19 nt, Human
gcccuggacccuggggccu

SEQ ID NO: 1366752 - RNA, 25 nt, Human
gcccuggguucuuuuccccagcccu

SEQ ID NO: 1366753 - RNA, 23 nt, Human
gcucaagugcagggauggccggu

SEQ ID NO: 1366754 - RNA, 19 nt, Human
gcugggguggacaccgggg

SEQ ID NO: 1366755 - RNA, 25 nt, Human
ggagaggagauggggugggggcugg

SEQ ID NO: 1366756 - RNA, 22 nt, Human
gggcauagagaagacagguugg

SEQ ID NO: 1366757 - RNA, 22 nt, Human
gguguuggugagggguggacag

SEQ ID NO: 1366758 - RNA, 23 nt, Human
gugaagcaggugauggggacccu

SEQ ID NO: 1366759 - RNA, 24 nt, Human
guucucccuguacccccaggggcu

SEQ ID NO: 1366760 - RNA, 19 nt, Human
uagcacucugggugcccuu

SEQ ID NO: 1366761 - RNA, 23 nt, Human
uccagauuugcagaaagagcugu

SEQ ID NO: 1366762 - RNA, 21 nt, Human
ugaaaugaagagaucucugag

SEQ ID NO: 1366763 - RNA, 18 nt, Human
ugaagcaggugaugggga

SEQ ID NO: 1366764 - RNA, 18 nt, Human
ugagguccccaggaggag

SEQ ID NO: 1366765 - RNA, 24 nt, Human
ugcagaaagagcuguuaaucagug

SEQ ID NO: 1366766 - RNA, 18 nt, Human
ugcccuggacccuggggc

SEQ ID NO: 1366767 - RNA, 21 nt, Human
ugccuggaggucuauggacag

SEQ ID NO: 1366768 - RNA, 25 nt, Human
ugccuggaggucuauggacaggcug

SEQ ID NO: 1366769 - RNA, 20 nt, Human
uggaagagaaccugagccau

SEQ ID NO: 1366770 - RNA, 18 nt, Human
uggacccuggggccuccc

SEQ ID NO: 1366771 - RNA, 19 nt, Human
uggaugguggagaaggugu

SEQ ID NO: 1366772 - RNA, 21 nt, Human
uggcagagggucccaaaguca

SEQ ID NO: 1366773 - RNA, 18 nt, Human
ugggagcgggguccuggg

SEQ ID NO: 1366774 - RNA, 24 nt, Human
uggggugggggcuggucaaagcag

SEQ ID NO: 1366775 - RNA, 22 nt, Human
ugugaaaugaagagaucucuga

SEQ ID NO: 1366776 - RNA, 18 nt, Human
uuauggcagaggguccca

SEQ ID NO: 1366777 - RNA, 23 nt, Human
uuccugcagaggcuacagaugug

SEQ ID NO: 1366778 - RNA, 26 nt, Human
aaaacaaaaacaaaaacaaauuccca

SEQ ID NO: 1366779 - RNA, 24 nt, Human
aaaacgagucuacacaaaaaccug

SEQ ID NO: 1366780 - RNA, 24 nt, Human
aaacaaaaacaaaaacaaauuccc

SEQ ID NO: 1366781 - RNA, 21 nt, Human
aaacaaacaggauguaacccc

SEQ ID NO: 1366782 - RNA, 23 nt, Human
aaagaaaugacaacacccacuaa

SEQ ID NO: 1366783 - RNA, 21 nt, Human
aaaguaaaagucacugcaagc

SEQ ID NO: 1366784 - RNA, 19 nt, Human
aaagugcggggauuacaga

SEQ ID NO: 1366785 - RNA, 23 nt, Human
aaaugcugcuuguacaaucuaag

SEQ ID NO: 1366786 - RNA, 25 nt, Human
aacacaaaaaacaaaaacaaaaaca

SEQ ID NO: 1366787 - RNA, 21 nt, Human
aacacacugaugaacauacaa

SEQ ID NO: 1366788 - RNA, 18 nt, Human
aacagucuucucaaaugu

SEQ ID NO: 1366789 - RNA, 19 nt, Human
aacaguuuggcaguuucuu

SEQ ID NO: 1366790 - RNA, 19 nt, Human
aacaugaugaaaccccauc

SEQ ID NO: 1366791 - RNA, 20 nt, Human
aacaugaugaaaccccaucu

SEQ ID NO: 1366792 - RNA, 21 nt, Human
aacaugaugaaaccccaucuc

SEQ ID NO: 1366793 - RNA, 21 nt, Human
aacaugaugaaaccccaucuc

SEQ ID NO: 1366794 - RNA, 22 nt, Human
aacuccagccugggugacagag

SEQ ID NO: 1366795 - RNA, 22 nt, Human
aagaaaaccacuagaacuaaaa

SEQ ID NO: 1366796 - RNA, 21 nt, Human
aagcagauucauggcacacaa

SEQ ID NO: 1366797 - RNA, 18 nt, Human
aagcaguccucccacuuc

SEQ ID NO: 1366798 - RNA, 20 nt, Human
aagccaaaauacaaaauagc

SEQ ID NO: 1366799 - RNA, 24 nt, Human
aagcgauucuccugccuuggccuc

SEQ ID NO: 1366800 - RNA, 18 nt, Human
aaggaacaaagcuuaaac

SEQ ID NO: 1366801 - RNA, 18 nt, Human
aaggaacccaaacagaag

SEQ ID NO: 1366802 - RNA, 18 nt, Human
aaggugcuccacaucacu

SEQ ID NO: 1366803 - RNA, 24 nt, Human
aaguaacugggauuacaggcgugu

SEQ ID NO: 1366804 - RNA, 25 nt, Human
aaguaacugggauuacaggcgugug

SEQ ID NO: 1366805 - RNA, 21 nt, Human
aagugacccaccauggagggu

SEQ ID NO: 1366806 - RNA, 22 nt, Human
aauauaaacaacuuuaaaauga

SEQ ID NO: 1366807 - RNA, 21 nt, Human
aauguugccuucaaacugggu

SEQ ID NO: 1366808 - RNA, 24 nt, Human
aauugcuugaaacugggaggugga

SEQ ID NO: 1366809 - RNA, 19 nt, Human
acaaaaaacaaaaacaaaa

SEQ ID NO: 1366810 - RNA, 24 nt, Human
acaaagugcggggauuacagaugu

SEQ ID NO: 1366811 - RNA, 22 nt, Human
acaaccucugccucccagguuc

SEQ ID NO: 1366812 - RNA, 21 nt, Human
acaauguugccuucaaacugg

SEQ ID NO: 1366813 - RNA, 28 nt, Human
acacaaaaaacaaaaacaaaagggaccc

SEQ ID NO: 1366814 - RNA, 23 nt, Human
acccacgcauaaagggacacaua

SEQ ID NO: 1366815 - RNA, 20 nt, Human
acccauuagcuaaaaugcaa

SEQ ID NO: 1366816 - RNA, 24 nt, Human
accccaucucuacuaaaaauacaa

SEQ ID NO: 1366817 - RNA, 19 nt, Human
accucaagugacccaccau

SEQ ID NO: 1366818 - RNA, 25 nt, Human
acucaggcuggagugcagcaacagu

SEQ ID NO: 1366819 - RNA, 23 nt, Human
acuccagccugggugacagagcg

SEQ ID NO: 1366820 - RNA, 18 nt, Human
acucugucacucaggcug

SEQ ID NO: 1366821 - RNA, 25 nt, Human
acucugucacucaggcuggagugca

SEQ ID NO: 1366822 - RNA, 27 nt, Human
acucuguugcccaggcuggagugcaau

SEQ ID NO: 1366823 - RNA, 23 nt, Human
acuuccuuucuaaaaauaagaaa

SEQ ID NO: 1366824 - RNA, 19 nt, Human
agacacaaggaacccaaac

SEQ ID NO: 1366825 - RNA, 23 nt, Human
agcacccugaccauaugccccac

SEQ ID NO: 1366826 - RNA, 24 nt, Human
agcacuuugggaggccgaggcagg

SEQ ID NO: 1366827 - RNA, 24 nt, Human
agccuggccaacaugaugaaaccc

SEQ ID NO: 1366828 - RNA, 19 nt, Human
aggaacucuuauucauugu

SEQ ID NO: 1366829 - RNA, 26 nt, Human
aggcaggcaaaugacuggaggccagg

SEQ ID NO: 1366830 - RNA, 25 nt, Human
aggccgaggcaggcaaaugacugga

SEQ ID NO: 1366831 - RNA, 20 nt, Human
agguggaggcuguaaugagc

SEQ ID NO: 1366832 - RNA, 25 nt, Human
agucuacacaaaaaccugcacauag

SEQ ID NO: 1366833 - RNA, 23 nt, Human
agugcaauggugugaucuuggcu

SEQ ID NO: 1366834 - RNA, 24 nt, Human
agugcaauggugugaucuuggcuc

SEQ ID NO: 1366835 - RNA, 23 nt, Human
auagaacacugcucagccauaaa

SEQ ID NO: 1366836 - RNA, 24 nt, Human
aucuuuaggguguuuaggugggag

SEQ ID NO: 1366837 - RNA, 26 nt, Human
caaaaaauaacuuuccaaaugagaac

SEQ ID NO: 1366838 - RNA, 19 nt, Human
caaacacaaaaaacaaaaa

SEQ ID NO: 1366839 - RNA, 20 nt, Human
caaacacaaaaaacaaaaac

SEQ ID NO: 1366840 - RNA, 28 nt, Human
caaacacaaaaaacaaaaacaaaaacaa

SEQ ID NO: 1366841 - RNA, 22 nt, Human
caaagugcggggauuacagaug

SEQ ID NO: 1366842 - RNA, 24 nt, Human
caaaugacuggaggccaggaguuc

SEQ ID NO: 1366843 - RNA, 20 nt, Human
caaaugagaacugaguaagg

SEQ ID NO: 1366844 - RNA, 20 nt, Human
caaccucugccucccagguu

SEQ ID NO: 1366845 - RNA, 23 nt, Human
caacuuuauucaugauagcccca

SEQ ID NO: 1366846 - RNA, 22 nt, Human
caagcgauucuccugccuuggc

SEQ ID NO: 1366847 - RNA, 27 nt, Human
caagcgauucuccugccuuggccuccc

SEQ ID NO: 1366848 - RNA, 21 nt, Human
cacaaaaaacaaaaacaaaaa

SEQ ID NO: 1366849 - RNA, 19 nt, Human
cacaauguugccuucaaac

SEQ ID NO: 1366850 - RNA, 19 nt, Human
cacaucuguaaucccagcu

SEQ ID NO: 1366851 - RNA, 24 nt, Human
cacuaaguuggccaggcuaaucuu

SEQ ID NO: 1366852 - RNA, 23 nt, Human
cacuagaacuaaaauucuggaca

SEQ ID NO: 1366853 - RNA, 18 nt, Human
cacuauaacuccagccug

SEQ ID NO: 1366854 - RNA, 24 nt, Human
cacuauaacuccagccugggugac

SEQ ID NO: 1366855 - RNA, 23 nt, Human
cacucugucacucaggcuggagu

SEQ ID NO: 1366856 - RNA, 24 nt, Human
cacucugucacucaggcuggagug

SEQ ID NO: 1366857 - RNA, 24 nt, Human
cacucuguugcccaggcuggagug

SEQ ID NO: 1366858 - RNA, 22 nt, Human
cacugcaggcuugacuucccag

SEQ ID NO: 1366859 - RNA, 22 nt, Human
cacugcucagccauaaaaagga

SEQ ID NO: 1366860 - RNA, 24 nt, Human
cagagucucacucuguugcccagg

SEQ ID NO: 1366861 - RNA, 24 nt, Human
cagcacuuugggaggccgaggcag

SEQ ID NO: 1366862 - RNA, 25 nt, Human
cagcacuuugggaggccgaggcagg

SEQ ID NO: 1366863 - RNA, 21 nt, Human
cagcagcuaggcuaaagcagg

SEQ ID NO: 1366864 - RNA, 23 nt, Human
cagccaccacaccuagccuauuc

SEQ ID NO: 1366865 - RNA, 24 nt, Human
caggcaaaugacuggaggccagga

SEQ ID NO: 1366866 - RNA, 22 nt, Human
caguagagccggaguuucacua

SEQ ID NO: 1366867 - RNA, 18 nt, Human
cauacugcuucucagagu

SEQ ID NO: 1366868 - RNA, 21 nt, Human
cauauagaaaaaaagaugaga

SEQ ID NO: 1366869 - RNA, 23 nt, Human
cauauagaaaaaaagaugagacu

SEQ ID NO: 1366870 - RNA, 23 nt, Human
caucuguaaucccagcuacucgg

SEQ ID NO: 1366871 - RNA, 20 nt, Human
caugagaauugcuugaaacu

SEQ ID NO: 1366872 - RNA, 22 nt, Human
ccaaguaacugggauuacaggc

SEQ ID NO: 1366873 - RNA, 24 nt, Human
ccaaguaacugggauuacaggcgu

SEQ ID NO: 1366874 - RNA, 20 nt, Human
ccacaauauucagcaaucag

SEQ ID NO: 1366875 - RNA, 19 nt, Human
ccagacaccucaccaauga

SEQ ID NO: 1366876 - RNA, 20 nt, Human
cccaaacagaaggaaauuca

SEQ ID NO: 1366877 - RNA, 19 nt, Human
cccaaguaacugggauuac

SEQ ID NO: 1366878 - RNA, 24 nt, Human
cccaaguaacugggauuacaggcg

SEQ ID NO: 1366879 - RNA, 22 nt, Human
cccacaugacagaagcuuaagu

SEQ ID NO: 1366880 - RNA, 20 nt, Human
cccaggcucaagcaguccuc

SEQ ID NO: 1366881 - RNA, 23 nt, Human
cccagguucaagcgauucuccug

SEQ ID NO: 1366882 - RNA, 20 nt, Human
cccuugcacuccguaagcag

SEQ ID NO: 1366883 - RNA, 21 nt, Human
ccgauaauuuaggggaaacuc

SEQ ID NO: 1366884 - RNA, 19 nt, Human
ccucccacuucagccucac

SEQ ID NO: 1366885 - RNA, 21 nt, Human
ccucccacuucagccucacaa

SEQ ID NO: 1366886 - RNA, 24 nt, Human
ccucccagguucaagcgauucucc

SEQ ID NO: 1366887 - RNA, 21 nt, Human
ccugaccucaagugacccacc

SEQ ID NO: 1366888 - RNA, 24 nt, Human
ccuggccaacaugaugaaacccca

SEQ ID NO: 1366889 - RNA, 18 nt, Human
ccugggugacagagcgac

SEQ ID NO: 1366890 - RNA, 20 nt, Human
ccuguaaucccagcacuuug

SEQ ID NO: 1366891 - RNA, 20 nt, Human
ccuucaaguaacacagaagu

SEQ ID NO: 1366892 - RNA, 20 nt, Human
ccuugcacuccguaagcagc

SEQ ID NO: 1366893 - RNA, 23 nt, Human
ccuugguauuuacccaaaggagc

SEQ ID NO: 1366894 - RNA, 26 nt, Human
cgaggcaggcaaaugacuggaggcca

SEQ ID NO: 1366895 - RNA, 23 nt, Human
cggaguuucacuaaguuggccag

SEQ ID NO: 1366896 - RNA, 24 nt, Human
cggaguuucacuaaguuggccagg

SEQ ID NO: 1366897 - RNA, 24 nt, Human
cuauaacuccagccugggugacag

SEQ ID NO: 1366898 - RNA, 25 nt, Human
cucaaacacaaaaaacaaaaacaaa

SEQ ID NO: 1366899 - RNA, 24 nt, Human
cucaagcaguccucccacuucagc

SEQ ID NO: 1366900 - RNA, 24 nt, Human
cucaagugacccaccauggagggu

SEQ ID NO: 1366901 - RNA, 24 nt, Human
cucacucugucacucaggcuggag

SEQ ID NO: 1366902 - RNA, 24 nt, Human
cucacucuguugcccaggcuggag

SEQ ID NO: 1366903 - RNA, 18 nt, Human
cucacugcaggcuugacu

SEQ ID NO: 1366904 - RNA, 25 nt, Human
cucagaguucucccuugcacucccu

SEQ ID NO: 1366905 - RNA, 18 nt, Human
cuccaaugacggcugggg

SEQ ID NO: 1366906 - RNA, 20 nt, Human
cuccucuauacuauaggucc

SEQ ID NO: 1366907 - RNA, 21 nt, Human
cugaccauaugccccacuccc

SEQ ID NO: 1366908 - RNA, 24 nt, Human
cugcucagccauaaaaaggaacag

SEQ ID NO: 1366909 - RNA, 18 nt, Human
cuggagugcagcaacagu

SEQ ID NO: 1366910 - RNA, 21 nt, Human
cuguaaucccagcuacucggg

SEQ ID NO: 1366911 - RNA, 24 nt, Human
cugucucaaacacaaaaaacaaaa

SEQ ID NO: 1366912 - RNA, 19 nt, Human
cuuacugcaaaucucccuc

SEQ ID NO: 1366913 - RNA, 24 nt, Human
gaaauucaccaucacugcuuccuu

SEQ ID NO: 1366914 - RNA, 20 nt, Human
gaguuccagaccagccuggc

SEQ ID NO: 1366915 - RNA, 18 nt, Human
gauuacagaugucagcca

SEQ ID NO: 1366916 - RNA, 18 nt, Human
gauuacaggcgugugcca

SEQ ID NO: 1366917 - RNA, 24 nt, Human
gccaacaugaugaaaccccaucuc

SEQ ID NO: 1366918 - RNA, 24 nt, Human
gcccaggcuggagugcaauggugu

SEQ ID NO: 1366919 - RNA, 19 nt, Human
gccuguaaucccagcacuu

SEQ ID NO: 1366920 - RNA, 22 nt, Human
gccuuccucccagggaagauuc

SEQ ID NO: 1366921 - RNA, 20 nt, Human
gcuaaaaugcaagagugaca

SEQ ID NO: 1366922 - RNA, 23 nt, Human
gcuaaucuugaacuccugaccuc

SEQ ID NO: 1366923 - RNA, 21 nt, Human
gcucacugcaggcuugacuuc

SEQ ID NO: 1366924 - RNA, 21 nt, Human
gcucgcuacaaccucugccuc

SEQ ID NO: 1366925 - RNA, 22 nt, Human
gcuggagugcagcaacagucag

SEQ ID NO: 1366926 - RNA, 27 nt, Human
ggacagaaaauccagacaccucaccaa

SEQ ID NO: 1366927 - RNA, 20 nt, Human
ggagcugaaaacgagucuaa

SEQ ID NO: 1366928 - RNA, 24 nt, Human
ggaggcuguaaugagcugggauca

SEQ ID NO: 1366929 - RNA, 19 nt, Human
ggcaguuucuuccaaaacu

SEQ ID NO: 1366930 - RNA, 24 nt, Human
ggcuaaucuugaacuccugaccuc

SEQ ID NO: 1366931 - RNA, 21 nt, Human
ggcugaugccuguaaucccag

SEQ ID NO: 1366932 - RNA, 22 nt, Human
ggcuggagugcaauggugugau

SEQ ID NO: 1366933 - RNA, 18 nt, Human
gggaaggagaaucuucac

SEQ ID NO: 1366934 - RNA, 23 nt, Human
gggauuacagaugucagccacca

SEQ ID NO: 1366935 - RNA, 22 nt, Human
ggggauuacagaugucagccac

SEQ ID NO: 1366936 - RNA, 20 nt, Human
ggguauuggcaucaccaaga

SEQ ID NO: 1366937 - RNA, 24 nt, Human
gggugugguggcugaugccuguaa

SEQ ID NO: 1366938 - RNA, 21 nt, Human
ggugcacaucuguaaucccag

SEQ ID NO: 1366939 - RNA, 24 nt, Human
gguggcugaugccuguaaucccag

SEQ ID NO: 1366940 - RNA, 24 nt, Human
gguggugcacaucuguaaucccag

SEQ ID NO: 1366941 - RNA, 20 nt, Human
guccuaccaauucaauguga

SEQ ID NO: 1366942 - RNA, 18 nt, Human
gucuucucaaaugugggg

SEQ ID NO: 1366943 - RNA, 21 nt, Human
gugaaaaaugucuacaacuua

SEQ ID NO: 1366944 - RNA, 24 nt, Human
uaaaaauaagaaaaccacuagaac

SEQ ID NO: 1366945 - RNA, 23 nt, Human
uaaaagucacugcaagcuuacac

SEQ ID NO: 1366946 - RNA, 22 nt, Human
uaaagcaggauaugagcacccu

SEQ ID NO: 1366947 - RNA, 18 nt, Human
uaaagggacacauacucu

SEQ ID NO: 1366948 - RNA, 19 nt, Human
uaaauucugaaacaaacag

SEQ ID NO: 1366949 - RNA, 19 nt, Human
uaacagggcugugcgagaa

SEQ ID NO: 1366950 - RNA, 24 nt, Human
uaacuccagccugggugacagagc

SEQ ID NO: 1366951 - RNA, 18 nt, Human
uaagaaaaccacuagaac

SEQ ID NO: 1366952 - RNA, 22 nt, Human
uaagaaaaccacuagaacuaaa

SEQ ID NO: 1366953 - RNA, 22 nt, Human
uaauuuuugcauuuucaguaga

SEQ ID NO: 1366954 - RNA, 22 nt, Human
uacagaugucagccaccacacc

SEQ ID NO: 1366955 - RNA, 18 nt, Human
uacaggaggggaaggaga

SEQ ID NO: 1366956 - RNA, 19 nt, Human
uacaggcgugugccacacc

SEQ ID NO: 1366957 - RNA, 25 nt, Human
uacugacagaaaaugaucuuuaggg

SEQ ID NO: 1366958 - RNA, 23 nt, Human
uagccccaaacuagaaacagccc

SEQ ID NO: 1366959 - RNA, 19 nt, Human
uauauacugacagaaaaug

SEQ ID NO: 1366960 - RNA, 19 nt, Human
ucacgucacuauaacucca

SEQ ID NO: 1366961 - RNA, 24 nt, Human
ucacgucacuauaacuccagccug

SEQ ID NO: 1366962 - RNA, 24 nt, Human
ucacuauaacuccagccuggguga

SEQ ID NO: 1366963 - RNA, 18 nt, Human
ucacucaggcuggagugc

SEQ ID NO: 1366964 - RNA, 24 nt, Human
ucacucugucacucaggcuggagu

SEQ ID NO: 1366965 - RNA, 24 nt, Human
ucacucuguugcccaggcuggagu

SEQ ID NO: 1366966 - RNA, 23 nt, Human
ucacugcaggcuugacuucccag

SEQ ID NO: 1366967 - RNA, 24 nt, Human
ucacugcaggcuugacuucccagg

SEQ ID NO: 1366968 - RNA, 23 nt, Human
uccaaaugagaacugaguaaggg

SEQ ID NO: 1366969 - RNA, 18 nt, Human
uccagccugggugacaga

SEQ ID NO: 1366970 - RNA, 22 nt, Human
uccagccugggugacagagcga

SEQ ID NO: 1366971 - RNA, 24 nt, Human
ucccaaguaacugggauuacaggc

SEQ ID NO: 1366972 - RNA, 21 nt, Human
ucccagguucaagcgauucuc

SEQ ID NO: 1366973 - RNA, 24 nt, Human
ucccagguucaagcgauucuccug

SEQ ID NO: 1366974 - RNA, 22 nt, Human
uccucccacuucagccucacaa

SEQ ID NO: 1366975 - RNA, 22 nt, Human
uccucuauacuauagguccuac

SEQ ID NO: 1366976 - RNA, 24 nt, Human
uccuuccuauacuuccuuucuaaa

SEQ ID NO: 1366977 - RNA, 19 nt, Human
ucgcuacaaccucugccuc

SEQ ID NO: 1366978 - RNA, 24 nt, Human
ucgcuacaaccucugccucccagg

SEQ ID NO: 1366979 - RNA, 25 nt, Human
ucgcuacaaccucugccucccaggu

SEQ ID NO: 1366980 - RNA, 23 nt, Human
ucucacucugucacucaggcugg

SEQ ID NO: 1366981 - RNA, 24 nt, Human
ucucacucugucacucaggcugga

SEQ ID NO: 1366982 - RNA, 23 nt, Human
ucucacucuguugcccaggcugg

SEQ ID NO: 1366983 - RNA, 24 nt, Human
ucucacucuguugcccaggcugga

SEQ ID NO: 1366984 - RNA, 26 nt, Human
ucucacucuguugcccaggcuggagu

SEQ ID NO: 1366985 - RNA, 21 nt, Human
ucucuacuaaaaauacaaaaa

SEQ ID NO: 1366986 - RNA, 21 nt, Human
ucuguaaucccagcuacucgg

SEQ ID NO: 1366987 - RNA, 24 nt, Human
ucugucacucaggcuggagugcag

SEQ ID NO: 1366988 - RNA, 18 nt, Human
ucuguugcccaggcugga

SEQ ID NO: 1366989 - RNA, 24 nt, Human
ucuguugcccaggcuggagugcaa

SEQ ID NO: 1366990 - RNA, 21 nt, Human
ucuugaacuccugaccucaag

SEQ ID NO: 1366991 - RNA, 20 nt, Human
ucuugauuuucauauaauca

SEQ ID NO: 1366992 - RNA, 22 nt, Human
ucuugauuuucauauaaucagg

SEQ ID NO: 1366993 - RNA, 23 nt, Human
ugaaacaaacaggauguaacccc

SEQ ID NO: 1366994 - RNA, 23 nt, Human
ugaaacaaacaggauguaacccc

SEQ ID NO: 1366995 - RNA, 30 nt, Human
ugaaacaaacaggauguaaccccaaaaaag

SEQ ID NO: 1366996 - RNA, 19 nt, Human
ugaaaccccaucucuacua

SEQ ID NO: 1366997 - RNA, 21 nt, Human
ugaaacugggagguggaggcu

SEQ ID NO: 1366998 - RNA, 21 nt, Human
ugacagaaaaugaucuuuagg

SEQ ID NO: 1366999 - RNA, 33 nt, Human
ugacauacauaccauucuccucuauacuauaau

SEQ ID NO: 1367000 - RNA, 25 nt, Human
ugacuucccaggcucaagcaguccu

SEQ ID NO: 1367001 - RNA, 20 nt, Human
ugagacagggucucacucug

SEQ ID NO: 1367002 - RNA, 21 nt, Human
ugagacagggucucacucugu

SEQ ID NO: 1367003 - RNA, 22 nt, Human
ugagacagggucucacucuguc

SEQ ID NO: 1367004 - RNA, 23 nt, Human
ugaggcaugagaauugcuugaaa

SEQ ID NO: 1367005 - RNA, 25 nt, Human
ugauacacuuaacauuuauucaccu

SEQ ID NO: 1367006 - RNA, 23 nt, Human
ugcaauggugugaucuuggcucc

SEQ ID NO: 1367007 - RNA, 19 nt, Human
ugcacuccguaagcagcag

SEQ ID NO: 1367008 - RNA, 21 nt, Human
ugcaggaggcaggcuauggga

SEQ ID NO: 1367009 - RNA, 18 nt, Human
ugcccaggcuggagugca

SEQ ID NO: 1367010 - RNA, 21 nt, Human
ugcccaggcuggagugcaaug

SEQ ID NO: 1367011 - RNA, 24 nt, Human
ugcccaggcuggagugcaauggug

SEQ ID NO: 1367012 - RNA, 23 nt, Human
ugccuguaaucccagcacuuugg

SEQ ID NO: 1367013 - RNA, 23 nt, Human
ugccuguaaucccagcacuuugg

SEQ ID NO: 1367014 - RNA, 24 nt, Human
ugccuguaaucccagcacuuuggg

SEQ ID NO: 1367015 - RNA, 21 nt, Human
uggacaugcauauagaaaaaa

SEQ ID NO: 1367016 - RNA, 24 nt, Human
uggaggguuuuaaauucugaaaca

SEQ ID NO: 1367017 - RNA, 19 nt, Human
uggagugcaauggugugau

SEQ ID NO: 1367018 - RNA, 23 nt, Human
uggagugcaauggugugaucuug

SEQ ID NO: 1367019 - RNA, 24 nt, Human
uggagugcaauggugugaucuugg

SEQ ID NO: 1367020 - RNA, 21 nt, Human
uggcaaaaugcugcuuguaca

SEQ ID NO: 1367021 - RNA, 19 nt, Human
uggcagauuaaguauauga

SEQ ID NO: 1367022 - RNA, 24 nt, Human
uggccaggcuaaucuugaacuccu

SEQ ID NO: 1367023 - RNA, 23 nt, Human
uggccucccaaguaacugggauu

SEQ ID NO: 1367024 - RNA, 22 nt, Human
uggcugaugccuguaaucccag

SEQ ID NO: 1367025 - RNA, 24 nt, Human
uggcugaugccuguaaucccagca

SEQ ID NO: 1367026 - RNA, 19 nt, Human
ugggaggccgaggcaggca

SEQ ID NO: 1367027 - RNA, 23 nt, Human
ugggaggccgaggcaggcaaaug

SEQ ID NO: 1367028 - RNA, 24 nt, Human
ugggagguggaggcuguaaugagc

SEQ ID NO: 1367029 - RNA, 18 nt, Human
ugggauuacaggcgugug

SEQ ID NO: 1367030 - RNA, 19 nt, Human
ugggauuacaggcgugugc

SEQ ID NO: 1367031 - RNA, 21 nt, Human
ugggauuacaggcgugugcca

SEQ ID NO: 1367032 - RNA, 22 nt, Human
ugggauuacaggcgugugccac

SEQ ID NO: 1367033 - RNA, 18 nt, Human
ugggugugguggcugaug

SEQ ID NO: 1367034 - RNA, 24 nt, Human
ugguggcugaugccuguaauccca

SEQ ID NO: 1367035 - RNA, 24 nt, Human
ugguggugcacaucuguaauccca

SEQ ID NO: 1367036 - RNA, 22 nt, Human
uguaaucccagcuacucgggaa

SEQ ID NO: 1367037 - RNA, 19 nt, Human
uguacaaucuaagggaugg

SEQ ID NO: 1367038 - RNA, 20 nt, Human
uguugcccaggcuggagugc

SEQ ID NO: 1367039 - RNA, 18 nt, Human
uuacccaaaggagcugaa

SEQ ID NO: 1367040 - RNA, 18 nt, Human
uuaguuguucaccuaaca

SEQ ID NO: 1367041 - RNA, 20 nt, Human
uucaagcgauucuccugccu

SEQ ID NO: 1367042 - RNA, 24 nt, Human
uucaagcgauucuccugccuuggc

SEQ ID NO: 1367043 - RNA, 22 nt, Human
uucaaguaacacagaaguagug

SEQ ID NO: 1367044 - RNA, 25 nt, Human
uucccaggcucaagcaguccuccca

SEQ ID NO: 1367045 - RNA, 21 nt, Human
uuccuuaugcuucccccuuca

SEQ ID NO: 1367046 - RNA, 27 nt, Human
uuccuucaauagcaaagagugaugcaa

SEQ ID NO: 1367047 - RNA, 21 nt, Human
uugaaacugggagguggaggc

SEQ ID NO: 1367048 - RNA, 20 nt, Human
uugauuuugacagagucuca

SEQ ID NO: 1367049 - RNA, 18 nt, Human
uugcccaggcuggagugc

SEQ ID NO: 1367050 - RNA, 24 nt, Human
uugcuugaaacugggagguggagg

SEQ ID NO: 1367051 - RNA, 18 nt, Human
uuggagccuuccucccag

SEQ ID NO: 1367052 - RNA, 21 nt, Human
uuucacuaaguuggccaggcu

SEQ ID NO: 1367053 - RNA, 24 nt, Human
uuuuuuuuucugagacagggucuc

SEQ ID NO: 1367054 - RNA, 20 nt, Human
aaacggaaucacagcaaagu

SEQ ID NO: 1367055 - RNA, 23 nt, Human
aaggggccugagcugggcagggc

SEQ ID NO: 1367056 - RNA, 24 nt, Human
aaggggccugagcugggcagggcu

SEQ ID NO: 1367057 - RNA, 21 nt, Human
acacugggccccggacccagc

SEQ ID NO: 1367058 - RNA, 22 nt, Human
acauacauccacacgcaccucc

SEQ ID NO: 1367059 - RNA, 23 nt, Human
acaugugcacaccacauacagug

SEQ ID NO: 1367060 - RNA, 21 nt, Human
accaaagccgccccagccuug

SEQ ID NO: 1367061 - RNA, 20 nt, Human
acgugcggcggcggcggcgg

SEQ ID NO: 1367062 - RNA, 19 nt, Human
agcacauuccugagcgcug

SEQ ID NO: 1367063 - RNA, 21 nt, Human
agcccucaccgcccccaccua

SEQ ID NO: 1367064 - RNA, 21 nt, Human
agccgccccagccuuggcccc

SEQ ID NO: 1367065 - RNA, 21 nt, Human
agcugcuggugcugccagggc

SEQ ID NO: 1367066 - RNA, 19 nt, Human
aggagagguaaccacagca

SEQ ID NO: 1367067 - RNA, 25 nt, Human
agggggcaggggcgucggcaucagg

SEQ ID NO: 1367068 - RNA, 24 nt, Human
auagaacaaauauuuacagauaca

SEQ ID NO: 1367069 - RNA, 21 nt, Human
caaagccgccccagccuuggc

SEQ ID NO: 1367070 - RNA, 27 nt, Human
caaccucaauggggaaggaaaggggcu

SEQ ID NO: 1367071 - RNA, 21 nt, Human
caacguggagcccucaccgcc

SEQ ID NO: 1367072 - RNA, 21 nt, Human
cacauacauccacacgcaccu

SEQ ID NO: 1367073 - RNA, 23 nt, Human
cacccuggauccuugggcugcuc

SEQ ID NO: 1367074 - RNA, 18 nt, Human
cacggugaagggcagggc

SEQ ID NO: 1367075 - RNA, 22 nt, Human
cagcucuggaguucccugcacc

SEQ ID NO: 1367076 - RNA, 20 nt, Human
caggcugcuguuuggcagcu

SEQ ID NO: 1367077 - RNA, 22 nt, Human
cauacauccacacgcaccuccc

SEQ ID NO: 1367078 - RNA, 29 nt, Human
caugugcacaccacauacauccacacgca

SEQ ID NO: 1367079 - RNA, 18 nt, Human
ccaggccuggcuguggag

SEQ ID NO: 1367080 - RNA, 21 nt, Human
ccccagccuuggccccuaggc

SEQ ID NO: 1367081 - RNA, 18 nt, Human
cccccaccuaccccaacc

SEQ ID NO: 1367082 - RNA, 21 nt, Human
cccccaccuaccccaaccuca

SEQ ID NO: 1367083 - RNA, 22 nt, Human
cccccaccuaccccaaccucaa

SEQ ID NO: 1367084 - RNA, 19 nt, Human
cccggggucccagcagggc

SEQ ID NO: 1367085 - RNA, 24 nt, Human
cccucaccgcccccaccuacccca

SEQ ID NO: 1367086 - RNA, 25 nt, Human
cccugcccggcaggcugcuguuugg

SEQ ID NO: 1367087 - RNA, 26 nt, Human
cccugcccggcaggcugcuguuuggc

SEQ ID NO: 1367088 - RNA, 22 nt, Human
ccgcccccaccuaccccaaccu

SEQ ID NO: 1367089 - RNA, 23 nt, Human
ccgcccccaccuaccccaaccuc

SEQ ID NO: 1367090 - RNA, 24 nt, Human
ccggagcacauuccugagcgcuga

SEQ ID NO: 1367091 - RNA, 23 nt, Human
ccucaauggggaaggaaaggggc

SEQ ID NO: 1367092 - RNA, 22 nt, Human
ccucuggccacaugugcacacc

SEQ ID NO: 1367093 - RNA, 23 nt, Human
cgcccccaccuaccccaaccuca

SEQ ID NO: 1367094 - RNA, 20 nt, Human
cgcgcacacaccucuggcca

SEQ ID NO: 1367095 - RNA, 22 nt, Human
cgcuacacugggccccggaccc

SEQ ID NO: 1367096 - RNA, 19 nt, Human
cggcggcggcgauccgggc

SEQ ID NO: 1367097 - RNA, 24 nt, Human
cuaugugccugcuccaggaguccc

SEQ ID NO: 1367098 - RNA, 25 nt, Human
cuccuuucuuuggcuuagaaguggg

SEQ ID NO: 1367099 - RNA, 24 nt, Human
cucuuccucgcugcuuacuccggg

SEQ ID NO: 1367100 - RNA, 21 nt, Human
cuggaguucccugcacccugg

SEQ ID NO: 1367101 - RNA, 21 nt, Human
cuggccccugugcuggcagga

SEQ ID NO: 1367102 - RNA, 20 nt, Human
cugggcagggcugcccgggc

SEQ ID NO: 1367103 - RNA, 18 nt, Human
cuggggcugcucccugcc

SEQ ID NO: 1367104 - RNA, 23 nt, Human
cuuggccccuaggccgccugggg

SEQ ID NO: 1367105 - RNA, 23 nt, Human
cuugggaccagugcugcucuucc

SEQ ID NO: 1367106 - RNA, 21 nt, Human
gaaggaagggccaggaaaagg

SEQ ID NO: 1367107 - RNA, 22 nt, Human
gaaguggggaaggaagggccag

SEQ ID NO: 1367108 - RNA, 18 nt, Human
gacugugugugugcugag

SEQ ID NO: 1367109 - RNA, 22 nt, Human
gagcugcuggugcugccagggc

SEQ ID NO: 1367110 - RNA, 24 nt, Human
gauuauggcuucagcacucugccg

SEQ ID NO: 1367111 - RNA, 23 nt, Human
gccccagccuuggccccuaggcc

SEQ ID NO: 1367112 - RNA, 21 nt, Human
gccccugugcuggcaggagcu

SEQ ID NO: 1367113 - RNA, 19 nt, Human
gcgcacacaccucuggcca

SEQ ID NO: 1367114 - RNA, 20 nt, Human
gcggcggcggcggcgauccg

SEQ ID NO: 1367115 - RNA, 24 nt, Human
gcggcggcggcggcgauccgggcg

SEQ ID NO: 1367116 - RNA, 22 nt, Human
gcuccaggagucccuggccccu

SEQ ID NO: 1367117 - RNA, 20 nt, Human
gcuugggaccagugcugcuc

SEQ ID NO: 1367118 - RNA, 22 nt, Human
ggagcccucaccgcccccaccu

SEQ ID NO: 1367119 - RNA, 21 nt, Human
ggccaggccuggcuguggagu

SEQ ID NO: 1367120 - RNA, 22 nt, Human
ggccugagcugggcagggcugc

SEQ ID NO: 1367121 - RNA, 22 nt, Human
ggcggcaaggagagguaaccac

SEQ ID NO: 1367122 - RNA, 18 nt, Human
ggcggcggcggcggcgau

SEQ ID NO: 1367123 - RNA, 22 nt, Human
ggcucacuaugugccugcucca

SEQ ID NO: 1367124 - RNA, 24 nt, Human
gggaaggaaaggggccugagcugg

SEQ ID NO: 1367125 - RNA, 24 nt, Human
gggaccagugcugcucuuccucgc

SEQ ID NO: 1367126 - RNA, 18 nt, Human
gggcagggcugcccgggc

SEQ ID NO: 1367127 - RNA, 19 nt, Human
gggcagugggaggugggca

SEQ ID NO: 1367128 - RNA, 18 nt, Human
gggcugggguacaggagc

SEQ ID NO: 1367129 - RNA, 24 nt, Human
ggggacaggcgcuacacugggccc

SEQ ID NO: 1367130 - RNA, 18 nt, Human
gguacaggagcaccugcc

SEQ ID NO: 1367131 - RNA, 19 nt, Human
gugcggcggcggcggcggc

SEQ ID NO: 1367132 - RNA, 22 nt, Human
gugcugcucuuccucgcugcuu

SEQ ID NO: 1367133 - RNA, 22 nt, Human
uacacugggccccggacccagc

SEQ ID NO: 1367134 - RNA, 22 nt, Human
uacaggagcaccugccucuccu

SEQ ID NO: 1367135 - RNA, 20 nt, Human
uauagaacaaauauuuacag

SEQ ID NO: 1367136 - RNA, 22 nt, Human
ucaccgcccccaccuaccccaa

SEQ ID NO: 1367137 - RNA, 19 nt, Human
ucccugcacccuggauccu

SEQ ID NO: 1367138 - RNA, 21 nt, Human
ucccugcacccuggauccuug

SEQ ID NO: 1367139 - RNA, 27 nt, Human
ucccugcccggcaggcugcuguuuggc

SEQ ID NO: 1367140 - RNA, 19 nt, Human
uccuugggcugcucucacu

SEQ ID NO: 1367141 - RNA, 22 nt, Human
ucgcgcacacaccucuggccac

SEQ ID NO: 1367142 - RNA, 22 nt, Human
ugaagggcagggccaggccugg

SEQ ID NO: 1367143 - RNA, 18 nt, Human
ugacagggcggcaaggag

SEQ ID NO: 1367144 - RNA, 23 nt, Human
ugagcuggaccgggaggccucuc

SEQ ID NO: 1367145 - RNA, 23 nt, Human
ugaguaccugggcgucagccaag

SEQ ID NO: 1367146 - RNA, 24 nt, Human
ugccagggcguguuggccaggaau

SEQ ID NO: 1367147 - RNA, 23 nt, Human
ugcggcggcggcggcggcgaucc

SEQ ID NO: 1367148 - RNA, 21 nt, Human
ugcugccagggcguguuggcc

SEQ ID NO: 1367149 - RNA, 21 nt, Human
uggagcccucaccgcccccac

SEQ ID NO: 1367150 - RNA, 23 nt, Human
uggcaagagcugcuggggacguc

SEQ ID NO: 1367151 - RNA, 18 nt, Human
uggcaagagcugcuggug

SEQ ID NO: 1367152 - RNA, 20 nt, Human
uggccccuaggccgccuggg

SEQ ID NO: 1367153 - RNA, 24 nt, Human
uggccccuaggccgccuggggacu

SEQ ID NO: 1367154 - RNA, 24 nt, Human
uggccuggggcugcucccugcccg

SEQ ID NO: 1367155 - RNA, 24 nt, Human
uggcuggggacaggcgcuacacug

SEQ ID NO: 1367156 - RNA, 20 nt, Human
ugggaggugggcagcucugg

SEQ ID NO: 1367157 - RNA, 21 nt, Human
ugggaggugggcagcucugga

SEQ ID NO: 1367158 - RNA, 22 nt, Human
ugggaggugggcagcucuggag

SEQ ID NO: 1367159 - RNA, 24 nt, Human
ugggaggugggcagcucuggaguu

SEQ ID NO: 1367160 - RNA, 20 nt, Human
ugggcagggcugcccgggcu

SEQ ID NO: 1367161 - RNA, 18 nt, Human
uggggaaggaaaggggcc

SEQ ID NO: 1367162 - RNA, 20 nt, Human
uggggauuauggcuucagca

SEQ ID NO: 1367163 - RNA, 19 nt, Human
ugggguacaggagcaccug

SEQ ID NO: 1367164 - RNA, 21 nt, Human
ugggguacaggagcaccugcc

SEQ ID NO: 1367165 - RNA, 23 nt, Human
ugguuggggauuauggcuucagc

SEQ ID NO: 1367166 - RNA, 21 nt, Human
ugucuggcgggaggcucauuc

SEQ ID NO: 1367167 - RNA, 24 nt, Human
ugucuggcgggaggcucauucucu

SEQ ID NO: 1367168 - RNA, 25 nt, Human
ugugcacaccacauacauccacacg

SEQ ID NO: 1367169 - RNA, 18 nt, Human
ugugcugagggggcagug

SEQ ID NO: 1367170 - RNA, 24 nt, Human
uguggagugggccagcugaguacc

SEQ ID NO: 1367171 - RNA, 22 nt, Human
uucccugcacccuggauccuug

SEQ ID NO: 1367172 - RNA, 18 nt, Human
aaaacccaaaaggggcua

SEQ ID NO: 1367173 - RNA, 18 nt, Human
aaaauaccauagaccggg

SEQ ID NO: 1367174 - RNA, 26 nt, Human
aaaauccuuccaaacuccaaaguaau

SEQ ID NO: 1367175 - RNA, 21 nt, Human
aaauggaauuggaggguaccc

SEQ ID NO: 1367176 - RNA, 21 nt, Human
aacacagugggacccccaccu

SEQ ID NO: 1367177 - RNA, 19 nt, Human
aauaccauagaccgggugg

SEQ ID NO: 1367178 - RNA, 23 nt, Human
acacacacacucaguccacaaua

SEQ ID NO: 1367179 - RNA, 20 nt, Human
accauagaccggguggcuca

SEQ ID NO: 1367180 - RNA, 24 nt, Human
agaagucuucuguguugagaccga

SEQ ID NO: 1367181 - RNA, 22 nt, Human
agaguagacagaaagaagcaag

SEQ ID NO: 1367182 - RNA, 21 nt, Human
agauaauguugaaauggaauu

SEQ ID NO: 1367183 - RNA, 22 nt, Human
agcaagaacucugugucucuaa

SEQ ID NO: 1367184 - RNA, 24 nt, Human
agcacuuugggaggccaagguggg

SEQ ID NO: 1367185 - RNA, 24 nt, Human
agccauagacaauauguaaacuaa

SEQ ID NO: 1367186 - RNA, 21 nt, Human
auaccucccaaaggccccacc

SEQ ID NO: 1367187 - RNA, 22 nt, Human
aucccauuugugaggguuccac

SEQ ID NO: 1367188 - RNA, 25 nt, Human
augaaguucucauaaaaacccaaaa

SEQ ID NO: 1367189 - RNA, 24 nt, Human
augaugugauucucucaccaaaug

SEQ ID NO: 1367190 - RNA, 25 nt, Human
auggcauucuucuugcugugucccc

SEQ ID NO: 1367191 - RNA, 22 nt, Human
caaaaauaccauagaccgggug

SEQ ID NO: 1367192 - RNA, 21 nt, Human
cacgaacuaaauaccucccaa

SEQ ID NO: 1367193 - RNA, 18 nt, Human
cacucaguccacaauacc

SEQ ID NO: 1367194 - RNA, 21 nt, Human
cagaaguucuggaggcccaga

SEQ ID NO: 1367195 - RNA, 20 nt, Human
cagauggcauucuucuugcu

SEQ ID NO: 1367196 - RNA, 24 nt, Human
cagcacuuugggaggccaaggugg

SEQ ID NO: 1367197 - RNA, 19 nt, Human
cagcccuacccuccaaucu

SEQ ID NO: 1367198 - RNA, 20 nt, Human
caggccagauuugacccaca

SEQ ID NO: 1367199 - RNA, 23 nt, Human
cagugggacccccaccucuacaa

SEQ ID NO: 1367200 - RNA, 22 nt, Human
cauaaaaacccaaaaggggcua

SEQ ID NO: 1367201 - RNA, 18 nt, Human
caugcgcaggaugugcag

SEQ ID NO: 1367202 - RNA, 23 nt, Human
cauuuaaacuauauuuaucuuug

SEQ ID NO: 1367203 - RNA, 22 nt, Human
ccacaaugucucuguagcagcu

SEQ ID NO: 1367204 - RNA, 18 nt, Human
ccagggaggguagagggg

SEQ ID NO: 1367205 - RNA, 19 nt, Human
ccagggaggguagaggggc

SEQ ID NO: 1367206 - RNA, 20 nt, Human
ccagggaggguagaggggcu

SEQ ID NO: 1367207 - RNA, 21 nt, Human
ccaggguuccaucauggucaa

SEQ ID NO: 1367208 - RNA, 21 nt, Human
ccagugcucuuuacuccuucc

SEQ ID NO: 1367209 - RNA, 27 nt, Human
cccaccucuacaaaauuuuuuuuaaaa

SEQ ID NO: 1367210 - RNA, 19 nt, Human
cccuccaaucuccagggag

SEQ ID NO: 1367211 - RNA, 20 nt, Human
cccuccaaucuccagggagg

SEQ ID NO: 1367212 - RNA, 21 nt, Human
ccucacacauuugcucacaga

SEQ ID NO: 1367213 - RNA, 19 nt, Human
ccucccaaaggccccaccu

SEQ ID NO: 1367214 - RNA, 26 nt, Human
ccucuuguuagcuucaggaugggggc

SEQ ID NO: 1367215 - RNA, 20 nt, Human
ccugcagaaaacauucugag

SEQ ID NO: 1367216 - RNA, 24 nt, Human
ccugugagaucugaguuaucucca

SEQ ID NO: 1367217 - RNA, 21 nt, Human
cucuuguuagcuucaggaugg

SEQ ID NO: 1367218 - RNA, 18 nt, Human
cuggucuccauaaacacc

SEQ ID NO: 1367219 - RNA, 22 nt, Human
cuguagcagcuacucaauucug

SEQ ID NO: 1367220 - RNA, 20 nt, Human
cugugucucuaaucccauuu

SEQ ID NO: 1367221 - RNA, 22 nt, Human
cuuccuggcauauaauuccuaa

SEQ ID NO: 1367222 - RNA, 24 nt, Human
cuuucagcccuacccuccaaucuc

SEQ ID NO: 1367223 - RNA, 26 nt, Human
cuuucuauccuuuuagugauuacucu

SEQ ID NO: 1367224 - RNA, 21 nt, Human
gaaacccucacacauuugcuc

SEQ ID NO: 1367225 - RNA, 20 nt, Human
gaacccaaagagggguggug

SEQ ID NO: 1367226 - RNA, 21 nt, Human
gacuaguuuggccaacacagu

SEQ ID NO: 1367227 - RNA, 19 nt, Human
gagggacaguccuggagac

SEQ ID NO: 1367228 - RNA, 19 nt, Human
gauuacucuagaguuaauc

SEQ ID NO: 1367229 - RNA, 21 nt, Human
gcacguggggagaaauccaca

SEQ ID NO: 1367230 - RNA, 24 nt, Human
gccauggugguuugcugcaccuau

SEQ ID NO: 1367231 - RNA, 21 nt, Human
ggagggacaguccuggagacu

SEQ ID NO: 1367232 - RNA, 26 nt, Human
ggguggugggaaucccaacuugaagc

SEQ ID NO: 1367233 - RNA, 22 nt, Human
guggcucccagcacuuugggag

SEQ ID NO: 1367234 - RNA, 24 nt, Human
uaaacaccaaggcaggauuagaag

SEQ ID NO: 1367235 - RNA, 18 nt, Human
uaaauguaaagaaguuaa

SEQ ID NO: 1367236 - RNA, 18 nt, Human
uaaccuguguuuuucccc

SEQ ID NO: 1367237 - RNA, 22 nt, Human
uaauauaaauuacaaagaccug

SEQ ID NO: 1367238 - RNA, 22 nt, Human
uacccaccugauauccacagca

SEQ ID NO: 1367239 - RNA, 21 nt, Human
uagguggcaggccagauuuga

SEQ ID NO: 1367240 - RNA, 24 nt, Human
uaguuuggccaacacagugggacc

SEQ ID NO: 1367241 - RNA, 20 nt, Human
uauuuacuaaaauagguggc

SEQ ID NO: 1367242 - RNA, 22 nt, Human
uauuuuauuuccuuucuccuuc

SEQ ID NO: 1367243 - RNA, 22 nt, Human
ucagaacucucuuccagcuuuu

SEQ ID NO: 1367244 - RNA, 23 nt, Human
ucccccaucagaacucucuucca

SEQ ID NO: 1367245 - RNA, 22 nt, Human
ucgauccugcuuccuggcauau

SEQ ID NO: 1367246 - RNA, 24 nt, Human
ucuaguguagaucugcuggugaug

SEQ ID NO: 1367247 - RNA, 25 nt, Human
ucucauaguucuagaggcuggguuc

SEQ ID NO: 1367248 - RNA, 20 nt, Human
ucucauaguucuagaggcuu

SEQ ID NO: 1367249 - RNA, 20 nt, Human
ucuccauaaacaccaaggcu

SEQ ID NO: 1367250 - RNA, 19 nt, Human
ucucuguagcagcuacuca

SEQ ID NO: 1367251 - RNA, 23 nt, Human
ucucuguagcagcuacucaauuc

SEQ ID NO: 1367252 - RNA, 21 nt, Human
ucugcuggugaugaauucuaa

SEQ ID NO: 1367253 - RNA, 23 nt, Human
ucuggaggcccagacuugcaacu

SEQ ID NO: 1367254 - RNA, 22 nt, Human
ucuuccagcuuucuguguugcu

SEQ ID NO: 1367255 - RNA, 23 nt, Human
ugaagcuagugggucagaaguuc

SEQ ID NO: 1367256 - RNA, 23 nt, Human
ugagaagaaacccucacacauuu

SEQ ID NO: 1367257 - RNA, 21 nt, Human
ugagaaggacuacccuagaua

SEQ ID NO: 1367258 - RNA, 24 nt, Human
ugagaccgacccagcuggugucca

SEQ ID NO: 1367259 - RNA, 21 nt, Human
ugauugagaaggacuacccuu

SEQ ID NO: 1367260 - RNA, 18 nt, Human
ugccuuagcacagauguc

SEQ ID NO: 1367261 - RNA, 19 nt, Human
ugcuaaugaguugacugau

SEQ ID NO: 1367262 - RNA, 21 nt, Human
ugcuuccagcugggauaauuu

SEQ ID NO: 1367263 - RNA, 23 nt, Human
uggcacguggggagaaauccaca

SEQ ID NO: 1367264 - RNA, 24 nt, Human
uggcagagaguagacagaaagaag

SEQ ID NO: 1367265 - RNA, 20 nt, Human
uggccaacacagugggaccc

SEQ ID NO: 1367266 - RNA, 22 nt, Human
ugggaggccaaggugggacuag

SEQ ID NO: 1367267 - RNA, 24 nt, Human
uggggaacacacacacucagucca

SEQ ID NO: 1367268 - RNA, 21 nt, Human
uggugaagacccucuuccugg

SEQ ID NO: 1367269 - RNA, 20 nt, Human
ugguguccacugcagaacug

SEQ ID NO: 1367270 - RNA, 23 nt, Human
ugugaugaucacuguuguagagu

SEQ ID NO: 1367271 - RNA, 25 nt, Human
uguuuuacacaguucacauuauuuu

SEQ ID NO: 1367272 - RNA, 20 nt, Human
uguuuuggcaauuuuuccuu

SEQ ID NO: 1367273 - RNA, 24 nt, Human
uuacacagguaaacgugugccaug

SEQ ID NO: 1367274 - RNA, 22 nt, Human
uuagcuucaggaugggggcugg

SEQ ID NO: 1367275 - RNA, 24 nt, Human
uuccuaaaauccuuccaaacucca

SEQ ID NO: 1367276 - RNA, 23 nt, Human
uucuagaggcuggguucuauaga

SEQ ID NO: 1367277 - RNA, 19 nt, Human
uugcugcaccuaucaauau

SEQ ID NO: 1367278 - RNA, 18 nt, Human
uuguuuuuugguauugau

SEQ ID NO: 1367279 - RNA, 19 nt, Human
aaaacacaggccccugagc

SEQ ID NO: 1367280 - RNA, 22 nt, Human
aaacagccaaugcaauuaaagc

SEQ ID NO: 1367281 - RNA, 24 nt, Human
aaagccagcaagagggagggauaa

SEQ ID NO: 1367282 - RNA, 19 nt, Human
aaagugcucucccaccucc

SEQ ID NO: 1367283 - RNA, 19 nt, Human
aacacugccccucuccucu

SEQ ID NO: 1367284 - RNA, 21 nt, Human
aagcgcuaacccagaaaacgg

SEQ ID NO: 1367285 - RNA, 19 nt, Human
aaugcaauuaaagccuaag

SEQ ID NO: 1367286 - RNA, 19 nt, Human
accacagucaccuccccug

SEQ ID NO: 1367287 - RNA, 22 nt, Human
accacagucaccuccccugacc

SEQ ID NO: 1367288 - RNA, 19 nt, Human
accugcagaggcuggaaca

SEQ ID NO: 1367289 - RNA, 20 nt, Human
acucagccaaugaaaagggc

SEQ ID NO: 1367290 - RNA, 19 nt, Human
acucuguuuuuccucagcc

SEQ ID NO: 1367291 - RNA, 22 nt, Human
acucuguuuuuccucagccccg

SEQ ID NO: 1367292 - RNA, 22 nt, Human
agagggagaggguuugagggcc

SEQ ID NO: 1367293 - RNA, 21 nt, Human
agaguggaauugggggccagu

SEQ ID NO: 1367294 - RNA, 23 nt, Human
agcgaggaggugaggccugggca

SEQ ID NO: 1367295 - RNA, 18 nt, Human
agcuuaggugccgcucgg

SEQ ID NO: 1367296 - RNA, 18 nt, Human
aggagggagaaggggcag

SEQ ID NO: 1367297 - RNA, 20 nt, Human
aggagggagaaggggcagug

SEQ ID NO: 1367298 - RNA, 18 nt, Human
aggcagagagggagaggg

SEQ ID NO: 1367299 - RNA, 18 nt, Human
aggcagagagggagaggg

SEQ ID NO: 1367300 - RNA, 18 nt, Human
aggggguggggugugcuu

SEQ ID NO: 1367301 - RNA, 24 nt, Human
agugcacagagcucucaggaggga

SEQ ID NO: 1367302 - RNA, 21 nt, Human
agugcaguccuugaagagugu

SEQ ID NO: 1367303 - RNA, 19 nt, Human
augaaaagggcuggccaca

SEQ ID NO: 1367304 - RNA, 20 nt, Human
caacagcagggaacucagcc

SEQ ID NO: 1367305 - RNA, 21 nt, Human
caccacgcacaacagcaggga

SEQ ID NO: 1367306 - RNA, 23 nt, Human
caccauaagaaacagccaaugca

SEQ ID NO: 1367307 - RNA, 22 nt, Human
cacccaccugcucaggcugagc

SEQ ID NO: 1367308 - RNA, 22 nt, Human
cacccucaagccuagggguugg

SEQ ID NO: 1367309 - RNA, 24 nt, Human
caccugcagaggcuggaacagcag

SEQ ID NO: 1367310 - RNA, 20 nt, Human
cacgcacaacagcagggaac

SEQ ID NO: 1367311 - RNA, 23 nt, Human
cagccaccaucaccuugucccuu

SEQ ID NO: 1367312 - RNA, 22 nt, Human
caggaggccaagcugggguugu

SEQ ID NO: 1367313 - RNA, 22 nt, Human
caggccccugagccuugcaccc

SEQ ID NO: 1367314 - RNA, 19 nt, Human
ccagccacauacaagguca

SEQ ID NO: 1367315 - RNA, 24 nt, Human
ccccaaacccagugcacagagcuc

SEQ ID NO: 1367316 - RNA, 23 nt, Human
ccccaugaucccgugaacaucca

SEQ ID NO: 1367317 - RNA, 26 nt, Human
ccccugagccuugcacccaccugcuc

SEQ ID NO: 1367318 - RNA, 21 nt, Human
cccucucccuucuuuccuccc

SEQ ID NO: 1367319 - RNA, 22 nt, Human
cccuucuuuccucccugguucc

SEQ ID NO: 1367320 - RNA, 22 nt, Human
ccuaucucugcagggccuggga

SEQ ID NO: 1367321 - RNA, 18 nt, Human
ccucugcgguagcaucag

SEQ ID NO: 1367322 - RNA, 21 nt, Human
ccuucuuuccucccugguucc

SEQ ID NO: 1367323 - RNA, 18 nt, Human
cgaggccacuaccuggcu

SEQ ID NO: 1367324 - RNA, 19 nt, Human
cgaggccacuaccuggcug

SEQ ID NO: 1367325 - RNA, 23 nt, Human
cuccacccucaagccuagggguu

SEQ ID NO: 1367326 - RNA, 22 nt, Human
cucccucucccuucuuuccucc

SEQ ID NO: 1367327 - RNA, 19 nt, Human
cucucccuucuuuccuccc

SEQ ID NO: 1367328 - RNA, 21 nt, Human
cucucccuucuuuccucccug

SEQ ID NO: 1367329 - RNA, 22 nt, Human
cucugcucaccuugcagcuuca

SEQ ID NO: 1367330 - RNA, 20 nt, Human
cucugggcaggucugccuuc

SEQ ID NO: 1367331 - RNA, 24 nt, Human
cugcuuccgagcccugggcauccu

SEQ ID NO: 1367332 - RNA, 22 nt, Human
cuggaacagcaggaguguggag

SEQ ID NO: 1367333 - RNA, 23 nt, Human
cuggaacagcaggaguguggagg

SEQ ID NO: 1367334 - RNA, 18 nt, Human
cuguagcauccuccuuac

SEQ ID NO: 1367335 - RNA, 22 nt, Human
cuugaaacauccaaucaagcgc

SEQ ID NO: 1367336 - RNA, 18 nt, Human
cuuuguggguguuuugua

SEQ ID NO: 1367337 - RNA, 24 nt, Human
cuuuuuuucuuucugcaguuccuu

SEQ ID NO: 1367338 - RNA, 22 nt, Human
gagccuagaagggacccugagg

SEQ ID NO: 1367339 - RNA, 19 nt, Human
gagcgugaccaccuccaug

SEQ ID NO: 1367340 - RNA, 21 nt, Human
gagcgugaccaccuccaugcc

SEQ ID NO: 1367341 - RNA, 21 nt, Human
gaggccaagcugggguugugg

SEQ ID NO: 1367342 - RNA, 18 nt, Human
gaggugaggccugggcag

SEQ ID NO: 1367343 - RNA, 21 nt, Human
gaggugaggccugggcaggag

SEQ ID NO: 1367344 - RNA, 19 nt, Human
gcaaauccagaugacuugc

SEQ ID NO: 1367345 - RNA, 21 nt, Human
gccuaagcccuucuuuguucc

SEQ ID NO: 1367346 - RNA, 19 nt, Human
gccuaaggugggccuggga

SEQ ID NO: 1367347 - RNA, 22 nt, Human
gccucauccccaaacccagugc

SEQ ID NO: 1367348 - RNA, 20 nt, Human
gccuggcucuccacccucaa

SEQ ID NO: 1367349 - RNA, 23 nt, Human
gccuggcucuccacccucaagcc

SEQ ID NO: 1367350 - RNA, 19 nt, Human
gcgcuaacccagaaaacgg

SEQ ID NO: 1367351 - RNA, 21 nt, Human
gcuggcgccucauccccaaac

SEQ ID NO: 1367352 - RNA, 21 nt, Human
ggcagugcaguccuugaagag

SEQ ID NO: 1367353 - RNA, 23 nt, Human
ggugggaacacugccccucuccu

SEQ ID NO: 1367354 - RNA, 24 nt, Human
guggguguuuuguauuuuaaagag

SEQ ID NO: 1367355 - RNA, 22 nt, Human
uaaaagcccuccagcaaagcca

SEQ ID NO: 1367356 - RNA, 19 nt, Human
uaaagagccacgcuggugc

SEQ ID NO: 1367357 - RNA, 21 nt, Human
uaacaccauaagaaacagcca

SEQ ID NO: 1367358 - RNA, 24 nt, Human
uaacagcacucaggccggaacuca

SEQ ID NO: 1367359 - RNA, 18 nt, Human
uaagaaacagccaaugca

SEQ ID NO: 1367360 - RNA, 22 nt, Human
uacagccaccaucaccuugucc

SEQ ID NO: 1367361 - RNA, 21 nt, Human
uaccuggcugcucauugagcc

SEQ ID NO: 1367362 - RNA, 22 nt, Human
uagcuaaagaacauguuucagg

SEQ ID NO: 1367363 - RNA, 18 nt, Human
ucaggaggggagagugga

SEQ ID NO: 1367364 - RNA, 21 nt, Human
uccccaaacccagugcacaga

SEQ ID NO: 1367365 - RNA, 21 nt, Human
uccccugaccaggcuggcgcc

SEQ ID NO: 1367366 - RNA, 21 nt, Human
ucccuaagccugaggccucca

SEQ ID NO: 1367367 - RNA, 19 nt, Human
ucccuucuuuccucccugg

SEQ ID NO: 1367368 - RNA, 23 nt, Human
ucucaugggugcccaggccuucu

SEQ ID NO: 1367369 - RNA, 20 nt, Human
ucucccaccuccaaucucuc

SEQ ID NO: 1367370 - RNA, 25 nt, Human
ucucccuucuuuccucccugguucc

SEQ ID NO: 1367371 - RNA, 19 nt, Human
ucugcccucugcgguagca

SEQ ID NO: 1367372 - RNA, 28 nt, Human
ucuggcaaaacugaagugaauucucaga

SEQ ID NO: 1367373 - RNA, 21 nt, Human
ucuguagcauccuccuuacug

SEQ ID NO: 1367374 - RNA, 22 nt, Human
ugaaaagggcuggccacagguu

SEQ ID NO: 1367375 - RNA, 26 nt, Human
ugaaaagggcuggccacagguucuca

SEQ ID NO: 1367376 - RNA, 18 nt, Human
ugacagaaauggggaaac

SEQ ID NO: 1367377 - RNA, 23 nt, Human
ugaccaggcuggcgccucauccc

SEQ ID NO: 1367378 - RNA, 18 nt, Human
ugaggcccggcuucuuuc

SEQ ID NO: 1367379 - RNA, 21 nt, Human
ugaggguggugcaugacuguc

SEQ ID NO: 1367380 - RNA, 20 nt, Human
ugcagaaagaccagggcccu

SEQ ID NO: 1367381 - RNA, 20 nt, Human
ugccccaugaucccgugaac

SEQ ID NO: 1367382 - RNA, 21 nt, Human
ugccucugcucaccuugcagc

SEQ ID NO: 1367383 - RNA, 24 nt, Human
ugccucugcucaccuugcagcuuu

SEQ ID NO: 1367384 - RNA, 24 nt, Human
ugcucaccuugcagcuucaccugc

SEQ ID NO: 1367385 - RNA, 19 nt, Human
ugcuggagcaggugggugg

SEQ ID NO: 1367386 - RNA, 19 nt, Human
uggaaccucccucucccuu

SEQ ID NO: 1367387 - RNA, 21 nt, Human
uggcaccacgcacaacagcag

SEQ ID NO: 1367388 - RNA, 21 nt, Human
ugggagccuagaagggacccu

SEQ ID NO: 1367389 - RNA, 24 nt, Human
ugggcacagccagguuuggugcug

SEQ ID NO: 1367390 - RNA, 18 nt, Human
ugggcaggagcggacagc

SEQ ID NO: 1367391 - RNA, 19 nt, Human
uggggcugggccuccaagc

SEQ ID NO: 1367392 - RNA, 25 nt, Human
uggggcugggccuccaagcccuugg

SEQ ID NO: 1367393 - RNA, 21 nt, Human
uguggaggugacggcaucauu

SEQ ID NO: 1367394 - RNA, 18 nt, Human
uguggggaaugggcacag

SEQ ID NO: 1367395 - RNA, 21 nt, Human
uguggggaaugggcacagcca

SEQ ID NO: 1367396 - RNA, 20 nt, Human
uucacuaacaccauaagaaa

SEQ ID NO: 1367397 - RNA, 24 nt, Human
uuccugugcuggagcaggugggug

SEQ ID NO: 1367398 - RNA, 19 nt, Human
uucggaaggccuuugaccc

SEQ ID NO: 1367399 - RNA, 21 nt, Human
uucuguagcauccuccuuacu

SEQ ID NO: 1367400 - RNA, 19 nt, Human
uuggggaagaaucccucug

SEQ ID NO: 1367401 - RNA, 20 nt, Human
uuggggaagaaucccucugg

SEQ ID NO: 1367402 - RNA, 18 nt, Human
uuguuuuguuuuuauaua

SEQ ID NO: 1367403 - RNA, 21 nt, Human
uuucaggguuuuuggcuuugu

SEQ ID NO: 1367404 - RNA, 21 nt, Human
uuugcaaaauucacuaacacc

SEQ ID NO: 1367405 - RNA, 19 nt, Human
aaagacuacucccagcuaa

SEQ ID NO: 1367406 - RNA, 19 nt, Human
aaggaggagggccccaagg

SEQ ID NO: 1367407 - RNA, 22 nt, Human
aaucuggucacugcccaugguc

SEQ ID NO: 1367408 - RNA, 19 nt, Human
acacagucaacucucccac

SEQ ID NO: 1367409 - RNA, 20 nt, Human
accuuggccuaucuucaguc

SEQ ID NO: 1367410 - RNA, 21 nt, Human
acucugagagacaguaucaaa

SEQ ID NO: 1367411 - RNA, 22 nt, Human
agaaggccuagaacguguagag

SEQ ID NO: 1367412 - RNA, 19 nt, Human
agagguggugaagggggcg

SEQ ID NO: 1367413 - RNA, 22 nt, Human
aggccuagaacguguagaggug

SEQ ID NO: 1367414 - RNA, 26 nt, Human
aggggcgguggugggggcggcggcgg

SEQ ID NO: 1367415 - RNA, 21 nt, Human
agguggcgauggcggcagggg

SEQ ID NO: 1367416 - RNA, 19 nt, Human
agguggugaagggggcggu

SEQ ID NO: 1367417 - RNA, 22 nt, Human
agucugaaguugcacucuuaug

SEQ ID NO: 1367418 - RNA, 25 nt, Human
auggcggcaggggcggugguggggg

SEQ ID NO: 1367419 - RNA, 21 nt, Human
auggcggcaggggcggugguu

SEQ ID NO: 1367420 - RNA, 22 nt, Human
cacaaacccuaaaguccaugug

SEQ ID NO: 1367421 - RNA, 18 nt, Human
cacaacuuuaaagcuauc

SEQ ID NO: 1367422 - RNA, 19 nt, Human
cacugucaaagacuacucc

SEQ ID NO: 1367423 - RNA, 19 nt, Human
cagcccuggacagagagcc

SEQ ID NO: 1367424 - RNA, 20 nt, Human
caggggcgguggugggggcg

SEQ ID NO: 1367425 - RNA, 24 nt, Human
caugugcagucuccauguucaagu

SEQ ID NO: 1367426 - RNA, 20 nt, Human
ccagcuaaucuuuacuguca

SEQ ID NO: 1367427 - RNA, 28 nt, Human
cccacugccgaacuugcuccccuuucaa

SEQ ID NO: 1367428 - RNA, 24 nt, Human
cccccucugauacagcagagguug

SEQ ID NO: 1367429 - RNA, 23 nt, Human
cgaccuuggccuaucuucagucu

SEQ ID NO: 1367430 - RNA, 25 nt, Human
cggcaggggcgguggugggggcggc

SEQ ID NO: 1367431 - RNA, 25 nt, Human
cuaaaaaaacacaaaugugagaaua

SEQ ID NO: 1367432 - RNA, 18 nt, Human
cucauacauucuaggauu

SEQ ID NO: 1367433 - RNA, 23 nt, Human
cuggcuauguucucacuguagcu

SEQ ID NO: 1367434 - RNA, 19 nt, Human
gaauccauuucuucaccaa

SEQ ID NO: 1367435 - RNA, 22 nt, Human
gacucacuggccccuccaggac

SEQ ID NO: 1367436 - RNA, 21 nt, Human
gagagccugcaaacgaguuuc

SEQ ID NO: 1367437 - RNA, 18 nt, Human
gagguggcgauggcggca

SEQ ID NO: 1367438 - RNA, 24 nt, Human
gcaaacgaguuuccuuaugccuaa

SEQ ID NO: 1367439 - RNA, 21 nt, Human
gcagucuccauguucaaguau

SEQ ID NO: 1367440 - RNA, 23 nt, Human
gcggcggcgaaggcccccucuga

SEQ ID NO: 1367441 - RNA, 24 nt, Human
gcggcggcggcgaaggcccccucu

SEQ ID NO: 1367442 - RNA, 29 nt, Human
ggggcgguggugggggcggcggcggcgac

SEQ ID NO: 1367443 - RNA, 20 nt, Human
gggggcggcggcggcgaagg

SEQ ID NO: 1367444 - RNA, 22 nt, Human
gucaacucucccacugccgaac

SEQ ID NO: 1367445 - RNA, 21 nt, Human
gugaaggaggagggccccaag

SEQ ID NO: 1367446 - RNA, 26 nt, Human
guggcgauggcggcaggggcgguggu

SEQ ID NO: 1367447 - RNA, 22 nt, Human
uaaaagucuguuucaggacaac

SEQ ID NO: 1367448 - RNA, 21 nt, Human
uaaaauaaacauaccuaagac

SEQ ID NO: 1367449 - RNA, 24 nt, Human
uaaaauaaacauaccuaagacuca

SEQ ID NO: 1367450 - RNA, 23 nt, Human
uaagacucacuggccccuccagg

SEQ ID NO: 1367451 - RNA, 23 nt, Human
uacuuggugucaugcccuuggac

SEQ ID NO: 1367452 - RNA, 20 nt, Human
uagcuuccguuuaucccaca

SEQ ID NO: 1367453 - RNA, 22 nt, Human
uccaggacaggaagcagcccug

SEQ ID NO: 1367454 - RNA, 24 nt, Human
ucuaaaaaaacacaaaugugagag

SEQ ID NO: 1367455 - RNA, 19 nt, Human
ucuacuuggugucaugccc

SEQ ID NO: 1367456 - RNA, 22 nt, Human
ucuuauguaaccgaauccauuu

SEQ ID NO: 1367457 - RNA, 18 nt, Human
ugaaauugucuuugggac

SEQ ID NO: 1367458 - RNA, 18 nt, Human
ugaaggaggagggcccca

SEQ ID NO: 1367459 - RNA, 21 nt, Human
ugaagggggcggugaaggagg

SEQ ID NO: 1367460 - RNA, 26 nt, Human
ugagaucagugacgaccuuggccucc

SEQ ID NO: 1367461 - RNA, 21 nt, Human
ugcccuuggacaggcuggcca

SEQ ID NO: 1367462 - RNA, 19 nt, Human
ugccuaaugucugaacuuc

SEQ ID NO: 1367463 - RNA, 18 nt, Human
ugggacuggcuauguucu

SEQ ID NO: 1367464 - RNA, 20 nt, Human
ugggggcggcggcggcgaag

SEQ ID NO: 1367465 - RNA, 21 nt, Human
ugggggcggcggcggcgaagg

SEQ ID NO: 1367466 - RNA, 18 nt, Human
uggugggggcggcggcgg

SEQ ID NO: 1367467 - RNA, 18 nt, Human
uguucucacuguagcuuc

SEQ ID NO: 1367468 - RNA, 24 nt, Human
uucucauacauucuaggauuucau

SEQ ID NO: 1367469 - RNA, 19 nt, Human
aaaaaaaaauucaggcuga

SEQ ID NO: 1367470 - RNA, 18 nt, Human
aaaaauaaaccuccccac

SEQ ID NO: 1367471 - RNA, 18 nt, Human
aaauaaaccuccccaccu

SEQ ID NO: 1367472 - RNA, 22 nt, Human
aaccuccgccucccagguuccc

SEQ ID NO: 1367473 - RNA, 24 nt, Human
aagaaugacuuaacacucuuaaau

SEQ ID NO: 1367474 - RNA, 22 nt, Human
aauaaugaugacagaaaaagaa

SEQ ID NO: 1367475 - RNA, 19 nt, Human
aaucagauuaccuaaaaug

SEQ ID NO: 1367476 - RNA, 20 nt, Human
acacaaauagcuuacagaca

SEQ ID NO: 1367477 - RNA, 19 nt, Human
acacuacaaaacaaucuac

SEQ ID NO: 1367478 - RNA, 24 nt, Human
accauguuggccgggcuggucuug

SEQ ID NO: 1367479 - RNA, 25 nt, Human
acccacccucuccccuugaaucccc

SEQ ID NO: 1367480 - RNA, 27 nt, Human
acccacccucuccccuugaauccccaa

SEQ ID NO: 1367481 - RNA, 23 nt, Human
accucacccagccuucucucuca

SEQ ID NO: 1367482 - RNA, 23 nt, Human
agaaaaaguuuuaagguaaauaa

SEQ ID NO: 1367483 - RNA, 24 nt, Human
agaagguuucaccauguuggccgg

SEQ ID NO: 1367484 - RNA, 24 nt, Human
agcgauucuccugccucagccucc

SEQ ID NO: 1367485 - RNA, 19 nt, Human
aggagccaccucacccagc

SEQ ID NO: 1367486 - RNA, 18 nt, Human
aggcaucccacacugaug

SEQ ID NO: 1367487 - RNA, 20 nt, Human
aggcaugcaccaccaagccc

SEQ ID NO: 1367488 - RNA, 25 nt, Human
aggcuggagugcaguggcacaaucu

SEQ ID NO: 1367489 - RNA, 19 nt, Human
agggugcugggaauacagg

SEQ ID NO: 1367490 - RNA, 24 nt, Human
aggugaucuacccaccucagccuc

SEQ ID NO: 1367491 - RNA, 22 nt, Human
agguuucaccauguuggccggg

SEQ ID NO: 1367492 - RNA, 22 nt, Human
agucugggucaggugccccucu

SEQ ID NO: 1367493 - RNA, 20 nt, Human
agugcaguggcacaaucucg

SEQ ID NO: 1367494 - RNA, 24 nt, Human
agugcaguggcacaaucucggcuc

SEQ ID NO: 1367495 - RNA, 21 nt, Human
aguggcuaggauuacaggcau

SEQ ID NO: 1367496 - RNA, 23 nt, Human
caaaacacacaaauagcuuacag

SEQ ID NO: 1367497 - RNA, 22 nt, Human
caagcgauucuccugccucagc

SEQ ID NO: 1367498 - RNA, 24 nt, Human
caccaagcccagcuaauuuucgua

SEQ ID NO: 1367499 - RNA, 21 nt, Human
caccauguuggccgggcuggu

SEQ ID NO: 1367500 - RNA, 23 nt, Human
caccauguuggccgggcuggucu

SEQ ID NO: 1367501 - RNA, 24 nt, Human
caccauguuggccgggcuggucuu

SEQ ID NO: 1367502 - RNA, 19 nt, Human
cacccucuacccacccucu

SEQ ID NO: 1367503 - RNA, 22 nt, Human
caccucacccagccuucucucu

SEQ ID NO: 1367504 - RNA, 22 nt, Human
caccucacccagccuucucucu

SEQ ID NO: 1367505 - RNA, 24 nt, Human
caccucagccucccagggugcugg

SEQ ID NO: 1367506 - RNA, 18 nt, Human
caccugagcaguauacau

SEQ ID NO: 1367507 - RNA, 21 nt, Human
cacugcaaccuccgccuccca

SEQ ID NO: 1367508 - RNA, 19 nt, Human
caggagccaccucacccag

SEQ ID NO: 1367509 - RNA, 23 nt, Human
caugcaccaccaagcccagcuaa

SEQ ID NO: 1367510 - RNA, 24 nt, Human
cauguuggccgggcuggucuugag

SEQ ID NO: 1367511 - RNA, 23 nt, Human
ccaagcccagcuaauuuucguac

SEQ ID NO: 1367512 - RNA, 21 nt, Human
ccacccucuccccuugaaucc

SEQ ID NO: 1367513 - RNA, 19 nt, Human
ccagggugcugggaauaca

SEQ ID NO: 1367514 - RNA, 20 nt, Human
cccaauaucuaacaugaucc

SEQ ID NO: 1367515 - RNA, 25 nt, Human
cccaauaucuaacaugaucccuaac

SEQ ID NO: 1367516 - RNA, 18 nt, Human
cccacccucuccccuuga

SEQ ID NO: 1367517 - RNA, 25 nt, Human
cccacccucuccccuugaaucccca

SEQ ID NO: 1367518 - RNA, 20 nt, Human
cccagguucaagcgauucuc

SEQ ID NO: 1367519 - RNA, 23 nt, Human
cccagguucaagcgauucuccug

SEQ ID NO: 1367520 - RNA, 18 nt, Human
ccccucuuauguacucac

SEQ ID NO: 1367521 - RNA, 18 nt, Human
ccucccuaguggcuagga

SEQ ID NO: 1367522 - RNA, 23 nt, Human
ccucuuauguacucacucaagcc

SEQ ID NO: 1367523 - RNA, 23 nt, Human
ccugccucagccucccuaguggc

SEQ ID NO: 1367524 - RNA, 24 nt, Human
ccugccucagccucccuaguggcu

SEQ ID NO: 1367525 - RNA, 21 nt, Human
cggcuaagcauuuacaaaugc

SEQ ID NO: 1367526 - RNA, 19 nt, Human
cuaagcauuuacaaaugcu

SEQ ID NO: 1367527 - RNA, 22 nt, Human
cuaaucuuaauacagaacagaa

SEQ ID NO: 1367528 - RNA, 26 nt, Human
cuacaacugaaguaauuuccuggaac

SEQ ID NO: 1367529 - RNA, 23 nt, Human
cuaguggcuaggauuacaggcau

SEQ ID NO: 1367530 - RNA, 24 nt, Human
cucacugcaaccuccgccucccag

SEQ ID NO: 1367531 - RNA, 23 nt, Human
cuccccaccucccauaaaaaaau

SEQ ID NO: 1367532 - RNA, 22 nt, Human
cucccuaccagacccuaagcuc

SEQ ID NO: 1367533 - RNA, 24 nt, Human
cuccgccucccagguucccagguu

SEQ ID NO: 1367534 - RNA, 19 nt, Human
cugaaggcaucccacacug

SEQ ID NO: 1367535 - RNA, 23 nt, Human
cugaccucaggugaucuacccac

SEQ ID NO: 1367536 - RNA, 23 nt, Human
cugcaaccuccgccucccagguu

SEQ ID NO: 1367537 - RNA, 24 nt, Human
cugcaaccuccgccucccagguuc

SEQ ID NO: 1367538 - RNA, 23 nt, Human
cugcaauuuaaaaaauaaaccuc

SEQ ID NO: 1367539 - RNA, 18 nt, Human
cuucaggagucaguucaa

SEQ ID NO: 1367540 - RNA, 23 nt, Human
cuuuaguggugaugugugagauu

SEQ ID NO: 1367541 - RNA, 24 nt, Human
cuuuuaguagaaagaagguuucac

SEQ ID NO: 1367542 - RNA, 21 nt, Human
gaagguuucaccauguuggcc

SEQ ID NO: 1367543 - RNA, 21 nt, Human
gaagguuucaccauguuggcc

SEQ ID NO: 1367544 - RNA, 24 nt, Human
gaagguuucaccauguuggccggg

SEQ ID NO: 1367545 - RNA, 24 nt, Human
gaccucaggugaucuacccaccuc

SEQ ID NO: 1367546 - RNA, 23 nt, Human
gauggcaugagcugaaggcaucc

SEQ ID NO: 1367547 - RNA, 24 nt, Human
gcgauucuccugccucagccuccc

SEQ ID NO: 1367548 - RNA, 19 nt, Human
gcuggagugcaguggcaca

SEQ ID NO: 1367549 - RNA, 22 nt, Human
ggauuacaggcaugcaccacca

SEQ ID NO: 1367550 - RNA, 24 nt, Human
ggcuggucuugagcugcugaccuc

SEQ ID NO: 1367551 - RNA, 19 nt, Human
ggucuugagcugcugaccu

SEQ ID NO: 1367552 - RNA, 21 nt, Human
guccaaucuuaugauguacag

SEQ ID NO: 1367553 - RNA, 24 nt, Human
gugaucuacccaccucagccuccc

SEQ ID NO: 1367554 - RNA, 21 nt, Human
gugcugggaauacaggcagga

SEQ ID NO: 1367555 - RNA, 20 nt, Human
guggcuaggauuacaggcau

SEQ ID NO: 1367556 - RNA, 24 nt, Human
guucccagguucaagcgauucucc

SEQ ID NO: 1367557 - RNA, 24 nt, Human
guugucuguuguccaggcuggagu

SEQ ID NO: 1367558 - RNA, 19 nt, Human
uaaaaaauaaaccucccca

SEQ ID NO: 1367559 - RNA, 25 nt, Human
uaaaaaauaaaccuccccaccuccc

SEQ ID NO: 1367560 - RNA, 19 nt, Human
uaaaccuccccaccuccca

SEQ ID NO: 1367561 - RNA, 18 nt, Human
uaaacgaaguucaaaugu

SEQ ID NO: 1367562 - RNA, 23 nt, Human
uaacaugaucccuaacacggcua

SEQ ID NO: 1367563 - RNA, 25 nt, Human
uaacaugaucccuaacacggcuaaa

SEQ ID NO: 1367564 - RNA, 24 nt, Human
uaacuucauuuucaaccaguuuuc

SEQ ID NO: 1367565 - RNA, 23 nt, Human
uaagaaugacuuaacacucuuaa

SEQ ID NO: 1367566 - RNA, 23 nt, Human
uaagguaaauaauauuucugucc

SEQ ID NO: 1367567 - RNA, 22 nt, Human
uaagugaacaaaaaaaaauacu

SEQ ID NO: 1367568 - RNA, 21 nt, Human
uaccaaaaaaaaaaaagauuc

SEQ ID NO: 1367569 - RNA, 20 nt, Human
uacccaccucagccucccag

SEQ ID NO: 1367570 - RNA, 21 nt, Human
uaggauuacaggcaugcacca

SEQ ID NO: 1367571 - RNA, 24 nt, Human
uaggauuacaggcaugcaccacca

SEQ ID NO: 1367572 - RNA, 21 nt, Human
uagguuauuggggaacagaug

SEQ ID NO: 1367573 - RNA, 24 nt, Human
uaguagaaagaagguuucaccaug

SEQ ID NO: 1367574 - RNA, 24 nt, Human
uaguggcuaggauuacaggcaugc

SEQ ID NO: 1367575 - RNA, 19 nt, Human
uaugcagaaaucagauuac

SEQ ID NO: 1367576 - RNA, 19 nt, Human
uauguacucacucaagcca

SEQ ID NO: 1367577 - RNA, 23 nt, Human
ucaaaacacacaaauagcuuaca

SEQ ID NO: 1367578 - RNA, 19 nt, Human
ucacugcaaccuccgccuc

SEQ ID NO: 1367579 - RNA, 24 nt, Human
ucacugcaaccuccgccucccagg

SEQ ID NO: 1367580 - RNA, 25 nt, Human
ucacugcaaccuccgccucccaggu

SEQ ID NO: 1367581 - RNA, 21 nt, Human
ucagccucccagggugcuggg

SEQ ID NO: 1367582 - RNA, 23 nt, Human
uccauuacuucugguaacaaugg

SEQ ID NO: 1367583 - RNA, 24 nt, Human
ucccagggugcugggaauacaggc

SEQ ID NO: 1367584 - RNA, 22 nt, Human
ucccagguucaagcgauucucc

SEQ ID NO: 1367585 - RNA, 24 nt, Human
ucccagguucaagcgauucuccug

SEQ ID NO: 1367586 - RNA, 25 nt, Human
ucccagguucaagcgauucuccugg

SEQ ID NO: 1367587 - RNA, 20 nt, Human
ucccauaaaaaaauaaauua

SEQ ID NO: 1367588 - RNA, 18 nt, Human
ucccucacccucuaccca

SEQ ID NO: 1367589 - RNA, 25 nt, Human
ucuaauacuaaucuuaauacagaac

SEQ ID NO: 1367590 - RNA, 21 nt, Human
ucuacccaccucagccuccca

SEQ ID NO: 1367591 - RNA, 22 nt, Human
ucuacccaccucagccucccag

SEQ ID NO: 1367592 - RNA, 20 nt, Human
ucuccaaaauuuugaauaga

SEQ ID NO: 1367593 - RNA, 25 nt, Human
ucuccugccucagccucccuagugg

SEQ ID NO: 1367594 - RNA, 18 nt, Human
ucuguuguccaggcugga

SEQ ID NO: 1367595 - RNA, 21 nt, Human
ucuuaauacagaacagaaauu

SEQ ID NO: 1367596 - RNA, 30 nt, Human
ucuugcuuuguugucuguuguccaggcugg

SEQ ID NO: 1367597 - RNA, 22 nt, Human
ucuuugguuacgaguaaguucu

SEQ ID NO: 1367598 - RNA, 21 nt, Human
ugaauaaacuguccaauguaa

SEQ ID NO: 1367599 - RNA, 21 nt, Human
ugaccucaggugaucuaccca

SEQ ID NO: 1367600 - RNA, 24 nt, Human
ugaccucaggugaucuacccaccu

SEQ ID NO: 1367601 - RNA, 24 nt, Human
ugaucuacccaccucagccuccca

SEQ ID NO: 1367602 - RNA, 24 nt, Human
ugccucagccucccuaguggcuag

SEQ ID NO: 1367603 - RNA, 25 nt, Human
ugcuuaguuuuuaacaucauccauu

SEQ ID NO: 1367604 - RNA, 23 nt, Human
uggaacaaaacuuaaaguacaaa

SEQ ID NO: 1367605 - RNA, 23 nt, Human
uggacucuugcuuuguugucugu

SEQ ID NO: 1367606 - RNA, 23 nt, Human
uggagugcaguggcacaaucucg

SEQ ID NO: 1367607 - RNA, 24 nt, Human
uggagugcaguggcacaaucucgg

SEQ ID NO: 1367608 - RNA, 24 nt, Human
uggcacaaucucggcucacugcaa

SEQ ID NO: 1367609 - RNA, 24 nt, Human
uggccgggcuggucuugagcugcu

SEQ ID NO: 1367610 - RNA, 22 nt, Human
ugggaauacaggcaggagccac

SEQ ID NO: 1367611 - RNA, 24 nt, Human
ugggaauacaggcaggagccaccu

SEQ ID NO: 1367612 - RNA, 23 nt, Human
ugguaagcauacccuuacuuuuc

SEQ ID NO: 1367613 - RNA, 20 nt, Human
uguccaggcuggagugcagu

SEQ ID NO: 1367614 - RNA, 21 nt, Human
uguccaggcuggagugcagug

SEQ ID NO: 1367615 - RNA, 22 nt, Human
uguccaggcuggagugcagugg

SEQ ID NO: 1367616 - RNA, 24 nt, Human
uguccaggcuggagugcaguggca

SEQ ID NO: 1367617 - RNA, 21 nt, Human
uguuaguaaagggugccaaua

SEQ ID NO: 1367618 - RNA, 19 nt, Human
uguuguccaggcuggagug

SEQ ID NO: 1367619 - RNA, 21 nt, Human
uguuguccaggcuggagugca

SEQ ID NO: 1367620 - RNA, 24 nt, Human
uuaguagaaagaagguuucaccau

SEQ ID NO: 1367621 - RNA, 23 nt, Human
uuauguacucacucaagccauaa

SEQ ID NO: 1367622 - RNA, 21 nt, Human
uucaagcgauucuccugccuc

SEQ ID NO: 1367623 - RNA, 23 nt, Human
uucaagcgauucuccugccucag

SEQ ID NO: 1367624 - RNA, 24 nt, Human
uucaagcgauucuccugccucagc

SEQ ID NO: 1367625 - RNA, 24 nt, Human
uuggacugcaauuuaaaaaauaaa

SEQ ID NO: 1367626 - RNA, 24 nt, Human
uuguccaggcuggagugcaguggc

SEQ ID NO: 1367627 - RNA, 21 nt, Human
uugucuguuguccaggcugga

SEQ ID NO: 1367628 - RNA, 24 nt, Human
uuguugucuguuguccaggcugga

SEQ ID NO: 1367629 - RNA, 20 nt, Human
uuuaaaaaauaaaccucccc

SEQ ID NO: 1367630 - RNA, 22 nt, Human
uuuacacuacaauaugcagaaa

SEQ ID NO: 1367631 - RNA, 24 nt, Human
uuucaccauguuggccgggcuggu

SEQ ID NO: 1367632 - RNA, 22 nt, Human
uuucuggccucugacauaaguu

SEQ ID NO: 1367633 - RNA, 24 nt, Human
uuuguugucuguuguccaggcugg

SEQ ID NO: 1367634 - RNA, 27 nt, Human
uuuuuacacuacaauaugcagaaauca

SEQ ID NO: 1367635 - RNA, 26 nt, Human
aaaacaaaacaaaacaaaacaaaacu

SEQ ID NO: 1367636 - RNA, 18 nt, Human
aaacaaaacaaaacaaaa

SEQ ID NO: 1367637 - RNA, 22 nt, Human
aaacaaaacaaaacaaaacaaa

SEQ ID NO: 1367638 - RNA, 22 nt, Human
aaacaaaacaaaacaaaacaaa

SEQ ID NO: 1367639 - RNA, 24 nt, Human
aacacagcucucaaacgugcagcu

SEQ ID NO: 1367640 - RNA, 20 nt, Human
aacagggugaaaccuugucu

SEQ ID NO: 1367641 - RNA, 21 nt, Human
aacagggugaaaccuugucuc

SEQ ID NO: 1367642 - RNA, 24 nt, Human
aaucacuugaacccaagaggucga

SEQ ID NO: 1367643 - RNA, 21 nt, Human
acaaaacaaaacaaaacaaaa

SEQ ID NO: 1367644 - RNA, 21 nt, Human
acaaaacaaaacaaaacaaaa

SEQ ID NO: 1367645 - RNA, 23 nt, Human
acaaaacaaaacaaaacaaaacu

SEQ ID NO: 1367646 - RNA, 22 nt, Human
acacagcucucaaacgugcagc

SEQ ID NO: 1367647 - RNA, 24 nt, Human
acagagcgagacucugucucaaaa

SEQ ID NO: 1367648 - RNA, 21 nt, Human
acagagggcacucuguccuga

SEQ ID NO: 1367649 - RNA, 24 nt, Human
accacugcauucuagucugggcga

SEQ ID NO: 1367650 - RNA, 22 nt, Human
accagacacagagggcacucug

SEQ ID NO: 1367651 - RNA, 20 nt, Human
accagccuugccaacagggu

SEQ ID NO: 1367652 - RNA, 24 nt, Human
accuugucucuacuaaaaguacaa

SEQ ID NO: 1367653 - RNA, 24 nt, Human
acugcauucuagucugggcgacag

SEQ ID NO: 1367654 - RNA, 24 nt, Human
agacucugucucaaaaauuaaaaa

SEQ ID NO: 1367655 - RNA, 22 nt, Human
agaggucgagguugcagugagc

SEQ ID NO: 1367656 - RNA, 24 nt, Human
agcacuucgggaggccgagguggg

SEQ ID NO: 1367657 - RNA, 21 nt, Human
aggaguuugagaccagccuug

SEQ ID NO: 1367658 - RNA, 18 nt, Human
aggcaggagaaucacuug

SEQ ID NO: 1367659 - RNA, 23 nt, Human
aggcaggagaaucacuugaaccc

SEQ ID NO: 1367660 - RNA, 24 nt, Human
aggcaggagaaucacuugaaccca

SEQ ID NO: 1367661 - RNA, 21 nt, Human
aggccgaggugggcagaucac

SEQ ID NO: 1367662 - RNA, 24 nt, Human
aggcugaggcaggagaaucacuug

SEQ ID NO: 1367663 - RNA, 20 nt, Human
aggucgagguugcagugagc

SEQ ID NO: 1367664 - RNA, 24 nt, Human
aggucgagguugcagugagcugag

SEQ ID NO: 1367665 - RNA, 26 nt, Human
aggugggcagaucaccuggcgucagg

SEQ ID NO: 1367666 - RNA, 19 nt, Human
aguccuccacuuaggagua

SEQ ID NO: 1367667 - RNA, 24 nt, Human
agucugggcgacagagcgagacuc

SEQ ID NO: 1367668 - RNA, 20 nt, Human
augcguggugaugggcaccu

SEQ ID NO: 1367669 - RNA, 24 nt, Human
auugcaccacugcauucuagucug

SEQ ID NO: 1367670 - RNA, 21 nt, Human
caaaacaaaacaaaacaaaac

SEQ ID NO: 1367671 - RNA, 24 nt, Human
caaaacaaaacaaaacaaaacaaa

SEQ ID NO: 1367672 - RNA, 22 nt, Human
caaaacaaaacaaaacaaaacu

SEQ ID NO: 1367673 - RNA, 19 nt, Human
caaaacaaaacaaaacuca

SEQ ID NO: 1367674 - RNA, 23 nt, Human
caaaacaaaacaaaacucauagg

SEQ ID NO: 1367675 - RNA, 24 nt, Human
caacagggugaaaccuugucucua

SEQ ID NO: 1367676 - RNA, 19 nt, Human
cacaaugcaggaucagaau

SEQ ID NO: 1367677 - RNA, 23 nt, Human
caccuauaaucccagccacuugg

SEQ ID NO: 1367678 - RNA, 24 nt, Human
caccuauaaucccagccacuuggg

SEQ ID NO: 1367679 - RNA, 19 nt, Human
cacugcauucuagucuggg

SEQ ID NO: 1367680 - RNA, 22 nt, Human
cacugcauucuagucugggcga

SEQ ID NO: 1367681 - RNA, 23 nt, Human
cacugcauucuagucugggcgac

SEQ ID NO: 1367682 - RNA, 24 nt, Human
cacugcauucuagucugggcgaca

SEQ ID NO: 1367683 - RNA, 24 nt, Human
cagaucaccuggcgucaggaguuu

SEQ ID NO: 1367684 - RNA, 21 nt, Human
cagcacuucgggaggccgagg

SEQ ID NO: 1367685 - RNA, 24 nt, Human
cagcacuucgggaggccgaggugg

SEQ ID NO: 1367686 - RNA, 24 nt, Human
cagccacuugggaggcugaggcag

SEQ ID NO: 1367687 - RNA, 18 nt, Human
caucaugguggcucccgc

SEQ ID NO: 1367688 - RNA, 23 nt, Human
cauucuagucugggcgacagagc

SEQ ID NO: 1367689 - RNA, 22 nt, Human
ccaagaggucgagguugcagug

SEQ ID NO: 1367690 - RNA, 19 nt, Human
ccacugcauucuagucugg

SEQ ID NO: 1367691 - RNA, 20 nt, Human
ccacugcauucuagucuggg

SEQ ID NO: 1367692 - RNA, 20 nt, Human
ccacugcauucuagucuggg

SEQ ID NO: 1367693 - RNA, 21 nt, Human
ccacugcauucuagucugggc

SEQ ID NO: 1367694 - RNA, 21 nt, Human
ccacugcauucuagucugggc

SEQ ID NO: 1367695 - RNA, 24 nt, Human
ccacugcauucuagucugggcgac

SEQ ID NO: 1367696 - RNA, 24 nt, Human
ccccagcuccuuuuuuggggccgc

SEQ ID NO: 1367697 - RNA, 24 nt, Human
cccgccuguaaucccagcacuucg

SEQ ID NO: 1367698 - RNA, 23 nt, Human
ccuauaaucccagccacuuggga

SEQ ID NO: 1367699 - RNA, 18 nt, Human
ccuccacuuaggaguaga

SEQ ID NO: 1367700 - RNA, 19 nt, Human
ccugaugcuagaauucuuc

SEQ ID NO: 1367701 - RNA, 23 nt, Human
ccuggcgucaggaguuugagacc

SEQ ID NO: 1367702 - RNA, 20 nt, Human
ccuguaaucccagcacuucg

SEQ ID NO: 1367703 - RNA, 22 nt, Human
ccuguaaucccagcacuucggg

SEQ ID NO: 1367704 - RNA, 24 nt, Human
ccuugccaacagggugaaaccuug

SEQ ID NO: 1367705 - RNA, 19 nt, Human
cgaggugggcagaucaccu

SEQ ID NO: 1367706 - RNA, 20 nt, Human
cgaggugggcagaucaccug

SEQ ID NO: 1367707 - RNA, 25 nt, Human
cgaggugggcagaucaccuggcguc

SEQ ID NO: 1367708 - RNA, 24 nt, Human
cgagguugcagugagcugagauug

SEQ ID NO: 1367709 - RNA, 24 nt, Human
cuaacugccauacuucccuuuaga

SEQ ID NO: 1367710 - RNA, 24 nt, Human
cucccgccuguaaucccagcacuu

SEQ ID NO: 1367711 - RNA, 21 nt, Human
cugagaaucaccaccagacac

SEQ ID NO: 1367712 - RNA, 21 nt, Human
cugggcgacagagcgagacuc

SEQ ID NO: 1367713 - RNA, 24 nt, Human
cugucucaaaaauuaaaaacaaaa

SEQ ID NO: 1367714 - RNA, 19 nt, Human
gaaaccuugucucuacuaa

SEQ ID NO: 1367715 - RNA, 19 nt, Human
gaaucacuugaacccaaga

SEQ ID NO: 1367716 - RNA, 24 nt, Human
gacagagcgagacucugucucaaa

SEQ ID NO: 1367717 - RNA, 20 nt, Human
gagauugcaccacugcauuc

SEQ ID NO: 1367718 - RNA, 29 nt, Human
gaggucgagguugcagugagcugagauug

SEQ ID NO: 1367719 - RNA, 21 nt, Human
gagguugcagugagcugagau

SEQ ID NO: 1367720 - RNA, 23 nt, Human
gagguugcagugagcugagauug

SEQ ID NO: 1367721 - RNA, 24 nt, Human
gagguugcagugagcugagauugg

SEQ ID NO: 1367722 - RNA, 24 nt, Human
gaucaccuggcgucaggaguuuga

SEQ ID NO: 1367723 - RNA, 22 nt, Human
gcaggagaaucacuugaaccca

SEQ ID NO: 1367724 - RNA, 19 nt, Human
gcaggaucagaaugugaug

SEQ ID NO: 1367725 - RNA, 24 nt, Human
gcauucuagucugggcgacagagc

SEQ ID NO: 1367726 - RNA, 24 nt, Human
gccaacagggugaaaccuugucuc

SEQ ID NO: 1367727 - RNA, 24 nt, Human
gcgacagagcgagacucugucuca

SEQ ID NO: 1367728 - RNA, 20 nt, Human
ggaaaugcucauuaaaguaa

SEQ ID NO: 1367729 - RNA, 22 nt, Human
ggaauucucucagccuuguccu

SEQ ID NO: 1367730 - RNA, 25 nt, Human
ggcagaucaccuggcgucaggaguu

SEQ ID NO: 1367731 - RNA, 19 nt, Human
gggaggccgaggugggcag

SEQ ID NO: 1367732 - RNA, 23 nt, Human
gggaggccgaggugggcagauca

SEQ ID NO: 1367733 - RNA, 24 nt, Human
gggcaccuauaaucccagccacuu

SEQ ID NO: 1367734 - RNA, 24 nt, Human
gguggcucccgccuguaaucccag

SEQ ID NO: 1367735 - RNA, 19 nt, Human
guugcagugagcugagauu

SEQ ID NO: 1367736 - RNA, 21 nt, Human
guugcagugagcugagauugc

SEQ ID NO: 1367737 - RNA, 20 nt, Human
guuggcuccuuccaccuuuu

SEQ ID NO: 1367738 - RNA, 24 nt, Human
uaaaaacaaaacaaaacaaaacaa

SEQ ID NO: 1367739 - RNA, 19 nt, Human
uacuuuaaucuucagcaac

SEQ ID NO: 1367740 - RNA, 23 nt, Human
uagaaagggccagucaugagaua

SEQ ID NO: 1367741 - RNA, 23 nt, Human
uauugaagagcucugguacucaa

SEQ ID NO: 1367742 - RNA, 23 nt, Human
ucaccuggcgucaggaguuugag

SEQ ID NO: 1367743 - RNA, 23 nt, Human
ucagcaacacaucaguaacacag

SEQ ID NO: 1367744 - RNA, 20 nt, Human
uccaccuuuuuggugagacu

SEQ ID NO: 1367745 - RNA, 18 nt, Human
ucccagccacuugggagg

SEQ ID NO: 1367746 - RNA, 21 nt, Human
ucuagucugggcgacagagcg

SEQ ID NO: 1367747 - RNA, 23 nt, Human
ucuagucugggcgacagagcgag

SEQ ID NO: 1367748 - RNA, 24 nt, Human
ucuagucugggcgacagagcgaga

SEQ ID NO: 1367749 - RNA, 21 nt, Human
ucucuacuaaaaguacaaaaa

SEQ ID NO: 1367750 - RNA, 22 nt, Human
ugaaaguccuccacuuaggagu

SEQ ID NO: 1367751 - RNA, 23 nt, Human
ugagaccagccuugccaacaggg

SEQ ID NO: 1367752 - RNA, 19 nt, Human
ugagauaggcucaugaaag

SEQ ID NO: 1367753 - RNA, 22 nt, Human
ugagcugagauugcaccacugc

SEQ ID NO: 1367754 - RNA, 24 nt, Human
ugaggcaggagaaucacuugaacc

SEQ ID NO: 1367755 - RNA, 25 nt, Human
ugaggcaggagaaucacuugaaccc

SEQ ID NO: 1367756 - RNA, 23 nt, Human
ugccaacagggugaaaccuuguc

SEQ ID NO: 1367757 - RNA, 21 nt, Human
ugccauacuucccuuuagaaa

SEQ ID NO: 1367758 - RNA, 21 nt, Human
uggcucccgccuguaauccca

SEQ ID NO: 1367759 - RNA, 22 nt, Human
uggcucccgccuguaaucccag

SEQ ID NO: 1367760 - RNA, 24 nt, Human
uggcucccgccuguaaucccagca

SEQ ID NO: 1367761 - RNA, 19 nt, Human
ugggaggcugaggcaggag

SEQ ID NO: 1367762 - RNA, 24 nt, Human
ugggaggcugaggcaggagaauca

SEQ ID NO: 1367763 - RNA, 24 nt, Human
ugggcagaucaccuggcgucagga

SEQ ID NO: 1367764 - RNA, 26 nt, Human
uggggcaagcuguucacaacgguucu

SEQ ID NO: 1367765 - RNA, 24 nt, Human
ugguggcucccgccuguaauccca

SEQ ID NO: 1367766 - RNA, 24 nt, Human
uguccuuucccuggggcaagcugu

SEQ ID NO: 1367767 - RNA, 25 nt, Human
ugucucaaaaauuaaaaacaaaaca

SEQ ID NO: 1367768 - RNA, 24 nt, Human
ugucugagaaucaccaccagacac

SEQ ID NO: 1367769 - RNA, 26 nt, Human
uuaaaaacaaaacaaaacaaaacaaa

SEQ ID NO: 1367770 - RNA, 25 nt, Human
uuaaucuucagcaacacaucaguaa

SEQ ID NO: 1367771 - RNA, 19 nt, Human
uugcagugagcugagauug

SEQ ID NO: 1367772 - RNA, 22 nt, Human
uugcagugagcugagauugcac

SEQ ID NO: 1367773 - RNA, 25 nt, Human
uugggaggcugaggcaggagaauca

SEQ ID NO: 1367774 - RNA, 23 nt, Human
uuuugugucucgguuggcuccuu

SEQ ID NO: 1367775 - RNA, 22 nt, Human
aaacccagccucccccuccuca

SEQ ID NO: 1367776 - RNA, 22 nt, Human
aaacccagccucccccuccuca

SEQ ID NO: 1367777 - RNA, 24 nt, Human
aaaucguuccagaccuccacauag

SEQ ID NO: 1367778 - RNA, 24 nt, Human
aaaucguuccagaccuccacauag

SEQ ID NO: 1367779 - RNA, 23 nt, Human
aacacaauuacccacacgcagca

SEQ ID NO: 1367780 - RNA, 19 nt, Human
aacccgcuccugcuccucc

SEQ ID NO: 1367781 - RNA, 19 nt, Human
aacccgcuccugcuccucc

SEQ ID NO: 1367782 - RNA, 18 nt, Human
aagaacccgcuccugcuc

SEQ ID NO: 1367783 - RNA, 18 nt, Human
aagaacccgcuccugcuc

SEQ ID NO: 1367784 - RNA, 18 nt, Human
aagagcugcgugaggagg

SEQ ID NO: 1367785 - RNA, 18 nt, Human
aagagcugcgugaggagg

SEQ ID NO: 1367786 - RNA, 18 nt, Human
aagcgaaaaagguuuccg

SEQ ID NO: 1367787 - RNA, 18 nt, Human
aagcgaaaaagguuuccg

SEQ ID NO: 1367788 - RNA, 19 nt, Human
aagugcuguuuccgccugg

SEQ ID NO: 1367789 - RNA, 19 nt, Human
aagugcuguuuccgccugg

SEQ ID NO: 1367790 - RNA, 23 nt, Human
accccaagcgaaaaagguuuccg

SEQ ID NO: 1367791 - RNA, 23 nt, Human
accccaagcgaaaaagguuuccg

SEQ ID NO: 1367792 - RNA, 18 nt, Human
accgggccagaaaagcuc

SEQ ID NO: 1367793 - RNA, 18 nt, Human
accgggccagaaaagcuc

SEQ ID NO: 1367794 - RNA, 21 nt, Human
acgcagcaagggggugcggag

SEQ ID NO: 1367795 - RNA, 21 nt, Human
agaugccuggugaugcagggg

SEQ ID NO: 1367796 - RNA, 22 nt, Human
agcgaaaaagguuuccgaggac

SEQ ID NO: 1367797 - RNA, 22 nt, Human
agcgaaaaagguuuccgaggac

SEQ ID NO: 1367798 - RNA, 23 nt, Human
agcgguucaugaaaucguuccag

SEQ ID NO: 1367799 - RNA, 23 nt, Human
agcgguucaugaaaucguuccag

SEQ ID NO: 1367800 - RNA, 23 nt, Human
aggcaggcccccgucugucucca

SEQ ID NO: 1367801 - RNA, 23 nt, Human
aggcaggcccccgucugucucca

SEQ ID NO: 1367802 - RNA, 22 nt, Human
aggcgcuggaggcucuuccgcc

SEQ ID NO: 1367803 - RNA, 22 nt, Human
aggcgcuggaggcucuuccgcc

SEQ ID NO: 1367804 - RNA, 24 nt, Human
agggcaggcaggcagcugggaagg

SEQ ID NO: 1367805 - RNA, 24 nt, Human
agggcaggcaggcagcugggaagg

SEQ ID NO: 1367806 - RNA, 18 nt, Human
agugauaaaaacccagcc

SEQ ID NO: 1367807 - RNA, 18 nt, Human
agugauaaaaacccagcc

SEQ ID NO: 1367808 - RNA, 23 nt, Human
auaaaaacccagccucccccucc

SEQ ID NO: 1367809 - RNA, 19 nt, Human
aucugccgcuuccccucca

SEQ ID NO: 1367810 - RNA, 19 nt, Human
aucugccgcuuccccucca

SEQ ID NO: 1367811 - RNA, 19 nt, Human
augccuggugaugcagggg

SEQ ID NO: 1367812 - RNA, 18 nt, Human
caagucccggagugggaa

SEQ ID NO: 1367813 - RNA, 19 nt, Human
caagucccggagugggaag

SEQ ID NO: 1367814 - RNA, 18 nt, Human
caaguccuggagugggaa

SEQ ID NO: 1367815 - RNA, 25 nt, Human
cacgcugucgccgccgccgccgccc

SEQ ID NO: 1367816 - RNA, 25 nt, Human
cacgcugucgccgccgccgccgccc

SEQ ID NO: 1367817 - RNA, 18 nt, Human
cagcacuggcugagauga

SEQ ID NO: 1367818 - RNA, 22 nt, Human
cagcagaagccucucgaagcug

SEQ ID NO: 1367819 - RNA, 22 nt, Human
cagcagaagccucucgaagcug

SEQ ID NO: 1367820 - RNA, 20 nt, Human
caggccucggcaaagaugcc

SEQ ID NO: 1367821 - RNA, 20 nt, Human
caggccucggcaaagaugcc

SEQ ID NO: 1367822 - RNA, 21 nt, Human
cauguacuggcagacagcgug

SEQ ID NO: 1367823 - RNA, 21 nt, Human
cauguacuggcagacagcgug

SEQ ID NO: 1367824 - RNA, 19 nt, Human
ccagaaaagcucaacgaug

SEQ ID NO: 1367825 - RNA, 19 nt, Human
ccagaaaagcucaacgaug

SEQ ID NO: 1367826 - RNA, 21 nt, Human
ccagguagcgaagaacccgcu

SEQ ID NO: 1367827 - RNA, 21 nt, Human
ccagguagcgaagaacccgcu

SEQ ID NO: 1367828 - RNA, 25 nt, Human
cccaagcgaaaaagguuuccgagga

SEQ ID NO: 1367829 - RNA, 25 nt, Human
cccaagcgaaaaagguuuccgagga

SEQ ID NO: 1367830 - RNA, 20 nt, Human
cccacacgcagcaagggggu

SEQ ID NO: 1367831 - RNA, 23 nt, Human
ccccaaaacacaauuacccacac

SEQ ID NO: 1367832 - RNA, 22 nt, Human
cccccaaaacacaauuacccac

SEQ ID NO: 1367833 - RNA, 18 nt, Human
ccccccagccuggcuccu

SEQ ID NO: 1367834 - RNA, 25 nt, Human
ccccuuggccuugggcacgaggucu

SEQ ID NO: 1367835 - RNA, 25 nt, Human
ccccuuggccuugggcacgaggucu

SEQ ID NO: 1367836 - RNA, 21 nt, Human
cccuccucacuugagcuucag

SEQ ID NO: 1367837 - RNA, 21 nt, Human
cccuccucacuugagcuucag

SEQ ID NO: 1367838 - RNA, 20 nt, Human
ccgccgccgccgcccggcag

SEQ ID NO: 1367839 - RNA, 20 nt, Human
ccgccgccgccgcccggcag

SEQ ID NO: 1367840 - RNA, 21 nt, Human
ccgccgccuccgggccgcacu

SEQ ID NO: 1367841 - RNA, 21 nt, Human
ccgccgccuccgggccgcacu

SEQ ID NO: 1367842 - RNA, 18 nt, Human
ccgccuggaagccgagag

SEQ ID NO: 1367843 - RNA, 18 nt, Human
ccgccuggaagccgagag

SEQ ID NO: 1367844 - RNA, 24 nt, Human
ccgcggggccgccaucagcugugc

SEQ ID NO: 1367845 - RNA, 23 nt, Human
ccgggccagaaaagcucaacgau

SEQ ID NO: 1367846 - RNA, 23 nt, Human
ccgggccagaaaagcucaacgau

SEQ ID NO: 1367847 - RNA, 21 nt, Human
ccuccagguagcgaagaaccc

SEQ ID NO: 1367848 - RNA, 21 nt, Human
ccuccagguagcgaagaaccc

SEQ ID NO: 1367849 - RNA, 19 nt, Human
ccucccccuccucacuuga

SEQ ID NO: 1367850 - RNA, 19 nt, Human
ccucccccuccucacuuga

SEQ ID NO: 1367851 - RNA, 23 nt, Human
ccugcagccugggccaggaggac

SEQ ID NO: 1367852 - RNA, 20 nt, Human
cgccagcgucuguugacugc

SEQ ID NO: 1367853 - RNA, 21 nt, Human
cgccagcgucuguugacugcc

SEQ ID NO: 1367854 - RNA, 21 nt, Human
cgccagcgucuguugacugcc

SEQ ID NO: 1367855 - RNA, 19 nt, Human
cgccgccgcccggcagggc

SEQ ID NO: 1367856 - RNA, 25 nt, Human
cgccuugcuccugcccucauccucc

SEQ ID NO: 1367857 - RNA, 23 nt, Human
cgcggggccgccaucagcugugc

SEQ ID NO: 1367858 - RNA, 23 nt, Human
cgcugucgccgccgccgccgccc

SEQ ID NO: 1367859 - RNA, 23 nt, Human
cgcugucgccgccgccgccgccc

SEQ ID NO: 1367860 - RNA, 21 nt, Human
cgcuugaggacggcucgcaga

SEQ ID NO: 1367861 - RNA, 21 nt, Human
cgcuugaggacggcucgcaga

SEQ ID NO: 1367862 - RNA, 24 nt, Human
cggcaggaaauccaggugccgauu

SEQ ID NO: 1367863 - RNA, 24 nt, Human
cggcaggaaauccaggugccgauu

SEQ ID NO: 1367864 - RNA, 21 nt, Human
cucaacgaugaagaaacagga

SEQ ID NO: 1367865 - RNA, 21 nt, Human
cucaacgaugaagaaacagga

SEQ ID NO: 1367866 - RNA, 23 nt, Human
cuccgcgccuugcuccugcccuc

SEQ ID NO: 1367867 - RNA, 23 nt, Human
cuccgcgccuugcuccugcccuc

SEQ ID NO: 1367868 - RNA, 19 nt, Human
cuccugcagccugggccag

SEQ ID NO: 1367869 - RNA, 23 nt, Human
cugagcaggggcugggaccaaga

SEQ ID NO: 1367870 - RNA, 23 nt, Human
cugagcaggggcugggaccaaga

SEQ ID NO: 1367871 - RNA, 19 nt, Human
cugccaagagcugcgugag

SEQ ID NO: 1367872 - RNA, 19 nt, Human
cugccaagagcugcgugag

SEQ ID NO: 1367873 - RNA, 24 nt, Human
cugcgugaggagggggcagaguga

SEQ ID NO: 1367874 - RNA, 24 nt, Human
cugcgugaggagggggcagaguga

SEQ ID NO: 1367875 - RNA, 23 nt, Human
cuggaggcucuuccgccccuugg

SEQ ID NO: 1367876 - RNA, 23 nt, Human
cuggaggcucuuccgccccuugg

SEQ ID NO: 1367877 - RNA, 18 nt, Human
cugggaggggcugagcag

SEQ ID NO: 1367878 - RNA, 18 nt, Human
cugggaggggcugagcag

SEQ ID NO: 1367879 - RNA, 19 nt, Human
cuucaccugggagcuggcu

SEQ ID NO: 1367880 - RNA, 19 nt, Human
cuucaccugggagcuggcu

SEQ ID NO: 1367881 - RNA, 23 nt, Human
cuucaucugccgcuuccccucca

SEQ ID NO: 1367882 - RNA, 23 nt, Human
cuucaucugccgcuuccccucca

SEQ ID NO: 1367883 - RNA, 24 nt, Human
gaagaaacaggaacaugcccaggu

SEQ ID NO: 1367884 - RNA, 19 nt, Human
gaagcacucgcggggugua

SEQ ID NO: 1367885 - RNA, 19 nt, Human
gaagcacucgcggggugua

SEQ ID NO: 1367886 - RNA, 18 nt, Human
gaagugcuguuuccgccu

SEQ ID NO: 1367887 - RNA, 18 nt, Human
gaagugcuguuuccgccu

SEQ ID NO: 1367888 - RNA, 22 nt, Human
gacaggagcagccccggcggca

SEQ ID NO: 1367889 - RNA, 22 nt, Human
gacaggagcagccccggcggca

SEQ ID NO: 1367890 - RNA, 22 nt, Human
gagcugcgugaggagggggcag

SEQ ID NO: 1367891 - RNA, 22 nt, Human
gagcugcgugaggagggggcag

SEQ ID NO: 1367892 - RNA, 18 nt, Human
gagcugggauggcauggg

SEQ ID NO: 1367893 - RNA, 18 nt, Human
gagcugggauggcauggg

SEQ ID NO: 1367894 - RNA, 20 nt, Human
gaggagggggcagagugaga

SEQ ID NO: 1367895 - RNA, 22 nt, Human
gagugggaagcuuggagcuggg

SEQ ID NO: 1367896 - RNA, 22 nt, Human
gagugggaagcuuggagcuggg

SEQ ID NO: 1367897 - RNA, 19 nt, Human
gccagcgucuguugacugc

SEQ ID NO: 1367898 - RNA, 23 nt, Human
gccgcacucgggguucuccagcg

SEQ ID NO: 1367899 - RNA, 23 nt, Human
gccgcacucgggguucuccagcg

SEQ ID NO: 1367900 - RNA, 23 nt, Human
gccuugcuccugcccucauccuc

SEQ ID NO: 1367901 - RNA, 18 nt, Human
gcggacaggagcagcccc

SEQ ID NO: 1367902 - RNA, 18 nt, Human
gcggacaggagcagcccc

SEQ ID NO: 1367903 - RNA, 21 nt, Human
gcggaggccccccagccuggc

SEQ ID NO: 1367904 - RNA, 23 nt, Human
ggagcagccccggcggcaggaaa

SEQ ID NO: 1367905 - RNA, 23 nt, Human
ggagcagccccggcggcaggaaa

SEQ ID NO: 1367906 - RNA, 23 nt, Human
ggaugcggcugcgcuugaggacg

SEQ ID NO: 1367907 - RNA, 23 nt, Human
ggaugcggcugcgcuugaggacg

SEQ ID NO: 1367908 - RNA, 19 nt, Human
gggcagagugagagagacc

SEQ ID NO: 1367909 - RNA, 19 nt, Human
gggcaggcaggcagcuggg

SEQ ID NO: 1367910 - RNA, 19 nt, Human
gggcaggcaggcagcuggg

SEQ ID NO: 1367911 - RNA, 20 nt, Human
gguuuuucucuccaaaaggg

SEQ ID NO: 1367912 - RNA, 20 nt, Human
gguuuuucucuccaaaaggg

SEQ ID NO: 1367913 - RNA, 22 nt, Human
gugagagagaccaccccaagcg

SEQ ID NO: 1367914 - RNA, 22 nt, Human
uaaaaacccagccucccccucc

SEQ ID NO: 1367915 - RNA, 19 nt, Human
uacaacaaaucacaccaaa

SEQ ID NO: 1367916 - RNA, 19 nt, Human
uacaacaaaucacaccaaa

SEQ ID NO: 1367917 - RNA, 21 nt, Human
uacaacaaaucacaccaaauu

SEQ ID NO: 1367918 - RNA, 21 nt, Human
uacaacaaaucacaccaaauu

SEQ ID NO: 1367919 - RNA, 22 nt, Human
uacaacaaaucacaccaaauuc

SEQ ID NO: 1367920 - RNA, 22 nt, Human
uacaacaaaucacaccaaauuc

SEQ ID NO: 1367921 - RNA, 19 nt, Human
uacacggccuggggggaca

SEQ ID NO: 1367922 - RNA, 19 nt, Human
uacacggccuggggggaca

SEQ ID NO: 1367923 - RNA, 26 nt, Human
uauuaaauuccccacuuucccccaaa

SEQ ID NO: 1367924 - RNA, 23 nt, Human
ucacaccaaauucauuaaaagug

SEQ ID NO: 1367925 - RNA, 23 nt, Human
ucacaccaaauucauuaaaagug

SEQ ID NO: 1367926 - RNA, 19 nt, Human
ucagcacuggccgagauga

SEQ ID NO: 1367927 - RNA, 22 nt, Human
ucaucugccgcuuccccuccag

SEQ ID NO: 1367928 - RNA, 22 nt, Human
ucaucugccgcuuccccuccag

SEQ ID NO: 1367929 - RNA, 21 nt, Human
uccaaaagggaaauuuaaaaa

SEQ ID NO: 1367930 - RNA, 21 nt, Human
uccaaaagggaaauuuaaaaa

SEQ ID NO: 1367931 - RNA, 20 nt, Human
uccauggggaugcggcugcg

SEQ ID NO: 1367932 - RNA, 20 nt, Human
uccauggggaugcggcugcg

SEQ ID NO: 1367933 - RNA, 21 nt, Human
ucccccaaaacacaauuaccc

SEQ ID NO: 1367934 - RNA, 22 nt, Human
ucccccaaaacacaauuaccca

SEQ ID NO: 1367935 - RNA, 26 nt, Human
ucgcacgcugucgccgccgccgccgg

SEQ ID NO: 1367936 - RNA, 26 nt, Human
ucgcacgcugucgccgccgccgccgg

SEQ ID NO: 1367937 - RNA, 19 nt, Human
ucgccgccgccgccgcccg

SEQ ID NO: 1367938 - RNA, 19 nt, Human
ucgccgccgccgccgcccg

SEQ ID NO: 1367939 - RNA, 19 nt, Human
ucuccagcgcgaccauggc

SEQ ID NO: 1367940 - RNA, 19 nt, Human
ucuccagcgcgaccauggc

SEQ ID NO: 1367941 - RNA, 25 nt, Human
ugaagaaacaggaacaugcccaggu

SEQ ID NO: 1367942 - RNA, 19 nt, Human
ugagagagaccaccccaag

SEQ ID NO: 1367943 - RNA, 19 nt, Human
ugagagagaccaccccaag

SEQ ID NO: 1367944 - RNA, 21 nt, Human
ugagagagaccaccccaagcg

SEQ ID NO: 1367945 - RNA, 19 nt, Human
ugaggagggggcagaguga

SEQ ID NO: 1367946 - RNA, 20 nt, Human
ugaggagggggcagagugaa

SEQ ID NO: 1367947 - RNA, 21 nt, Human
ugaggagggggcagagugaga

SEQ ID NO: 1367948 - RNA, 28 nt, Human
ugauaaaaacccagccucccccuccuca

SEQ ID NO: 1367949 - RNA, 28 nt, Human
ugauaaaaacccagccucccccuccuca

SEQ ID NO: 1367950 - RNA, 22 nt, Human
ugaugcagggggugccaagucc

SEQ ID NO: 1367951 - RNA, 22 nt, Human
ugaugcagggggugccaagucc

SEQ ID NO: 1367952 - RNA, 22 nt, Human
ugcaggccucggcaaagaugcc

SEQ ID NO: 1367953 - RNA, 22 nt, Human
ugcaggccucggcaaagaugcc

SEQ ID NO: 1367954 - RNA, 21 nt, Human
ugcagggggugccaagucccc

SEQ ID NO: 1367955 - RNA, 21 nt, Human
ugcagggggugccaagucccc

SEQ ID NO: 1367956 - RNA, 18 nt, Human
ugccaaguccccauccuc

SEQ ID NO: 1367957 - RNA, 18 nt, Human
ugccaaguccccauccuc

SEQ ID NO: 1367958 - RNA, 18 nt, Human
ugccagagcaccagaaau

SEQ ID NO: 1367959 - RNA, 18 nt, Human
ugccuggugaugcagggg

SEQ ID NO: 1367960 - RNA, 18 nt, Human
ugccuggugaugcagggg

SEQ ID NO: 1367961 - RNA, 21 nt, Human
ugccuggugaugcagggggug

SEQ ID NO: 1367962 - RNA, 18 nt, Human
ugcuccugcccucauccu

SEQ ID NO: 1367963 - RNA, 18 nt, Human
ugcuccugcccucauccu

SEQ ID NO: 1367964 - RNA, 21 nt, Human
uggaagccgagagucucuuca

SEQ ID NO: 1367965 - RNA, 21 nt, Human
uggaagccgagagucucuuca

SEQ ID NO: 1367966 - RNA, 22 nt, Human
uggcagacagcgugcagcagaa

SEQ ID NO: 1367967 - RNA, 22 nt, Human
uggcagacagcgugcagcagaa

SEQ ID NO: 1367968 - RNA, 21 nt, Human
uggcugggcgagguggcagcg

SEQ ID NO: 1367969 - RNA, 21 nt, Human
uggcugggcgagguggcagcg

SEQ ID NO: 1367970 - RNA, 22 nt, Human
uggcugggcgagguggcagcgg

SEQ ID NO: 1367971 - RNA, 22 nt, Human
uggcugggcgagguggcagcgg

SEQ ID NO: 1367972 - RNA, 22 nt, Human
uggcugggcgagguggcagcgg

SEQ ID NO: 1367973 - RNA, 22 nt, Human
uggcugggcgagguggcagcgg

SEQ ID NO: 1367974 - RNA, 24 nt, Human
uggcugggcgagguggcagcgggg

SEQ ID NO: 1367975 - RNA, 24 nt, Human
uggcugggcgagguggcagcgggg

SEQ ID NO: 1367976 - RNA, 18 nt, Human
ugggaaggggcagcagcc

SEQ ID NO: 1367977 - RNA, 18 nt, Human
ugggaaggggcagcagcc

SEQ ID NO: 1367978 - RNA, 20 nt, Human
ugggaaggggcagcagccgc

SEQ ID NO: 1367979 - RNA, 20 nt, Human
ugggaaggggcagcagccgc

SEQ ID NO: 1367980 - RNA, 23 nt, Human
ugggaggggcugagcaggggcug

SEQ ID NO: 1367981 - RNA, 23 nt, Human
ugggaggggcugagcaggggcug

SEQ ID NO: 1367982 - RNA, 23 nt, Human
ugggaggggcugagcaggggcug

SEQ ID NO: 1367983 - RNA, 23 nt, Human
ugggaggggcugagcaggggcug

SEQ ID NO: 1367984 - RNA, 24 nt, Human
ugggaggggcugagcaggggcugg

SEQ ID NO: 1367985 - RNA, 24 nt, Human
ugggaggggcugagcaggggcugg

SEQ ID NO: 1367986 - RNA, 18 nt, Human
ugguuuuucucuccaaaa

SEQ ID NO: 1367987 - RNA, 18 nt, Human
ugguuuuucucuccaaaa

SEQ ID NO: 1367988 - RNA, 21 nt, Human
uuccauggggaugcggcugcg

SEQ ID NO: 1367989 - RNA, 21 nt, Human
uuccauggggaugcggcugcg

SEQ ID NO: 1367990 - RNA, 24 nt, Human
uucucuccaaaagggaaauuuaaa

SEQ ID NO: 1367991 - RNA, 24 nt, Human
uucucuccaaaagggaaauuuaaa

SEQ ID NO: 1367992 - RNA, 22 nt, Human
uuuuugguuuuucucuccaaaa

SEQ ID NO: 1367993 - RNA, 22 nt, Human
uuuuugguuuuucucuccaaaa

SEQ ID NO: 1367994 - RNA, 18 nt, Human
uuuuuuuuuuuuuuuuug

SEQ ID NO: 1367995 - RNA, 22 nt, Human
uuuuuuuuuuuuuuuuugccag

SEQ ID NO: 1367996 - RNA, 21 nt, Human
aaacaaacgaaaccuguucuc

SEQ ID NO: 1367997 - RNA, 23 nt, Human
aagaacguggaggggagggggcg

SEQ ID NO: 1367998 - RNA, 20 nt, Human
aagcucguccugucccccuc

SEQ ID NO: 1367999 - RNA, 21 nt, Human
aaggggaaagggccuccccgg

SEQ ID NO: 1368000 - RNA, 19 nt, Human
aaggggggguccaggcagg

SEQ ID NO: 1368001 - RNA, 20 nt, Human
accgcgggcguaaaacaaac

SEQ ID NO: 1368002 - RNA, 21 nt, Human
acuaaaccccagauacacucc

SEQ ID NO: 1368003 - RNA, 18 nt, Human
acuccuggcugccccccc

SEQ ID NO: 1368004 - RNA, 22 nt, Human
agacaaagaccaggcagcugga

SEQ ID NO: 1368005 - RNA, 22 nt, Human
agaggggcaggacggcugcagg

SEQ ID NO: 1368006 - RNA, 20 nt, Human
agcauuuauuaggcaacugc

SEQ ID NO: 1368007 - RNA, 20 nt, Human
agccccagcggugaaguccc

SEQ ID NO: 1368008 - RNA, 20 nt, Human
agcucguccugucccccucu

SEQ ID NO: 1368009 - RNA, 26 nt, Human
agcuggaccucgggcagccucgacca

SEQ ID NO: 1368010 - RNA, 21 nt, Human
aggaagaacguggaggggagg

SEQ ID NO: 1368011 - RNA, 27 nt, Human
aggaagaacguggaggggagggggcgg

SEQ ID NO: 1368012 - RNA, 23 nt, Human
aggcagcuggaccucgggcagcc

SEQ ID NO: 1368013 - RNA, 18 nt, Human
aggcaggaggugcgguga

SEQ ID NO: 1368014 - RNA, 18 nt, Human
aggcccagagaggggcag

SEQ ID NO: 1368015 - RNA, 23 nt, Human
agucuggcgcuggccgggguggg

SEQ ID NO: 1368016 - RNA, 18 nt, Human
caaaacagacuaaacccc

SEQ ID NO: 1368017 - RNA, 23 nt, Human
caaaacagacuaaaccccagaua

SEQ ID NO: 1368018 - RNA, 19 nt, Human
caagcucguccuguccccc

SEQ ID NO: 1368019 - RNA, 24 nt, Human
cacacucuauuugagagaugggga

SEQ ID NO: 1368020 - RNA, 19 nt, Human
cacagcaacggccauuaga

SEQ ID NO: 1368021 - RNA, 22 nt, Human
cacagcaacggccauuagagcc

SEQ ID NO: 1368022 - RNA, 22 nt, Human
cacaggggagcggaaccggggg

SEQ ID NO: 1368023 - RNA, 22 nt, Human
caccccaggacagccccagcgg

SEQ ID NO: 1368024 - RNA, 20 nt, Human
caccggcccaguucgcccac

SEQ ID NO: 1368025 - RNA, 23 nt, Human
cagacuaaaccccagauacacuc

SEQ ID NO: 1368026 - RNA, 20 nt, Human
cagccucgaccacccagggc

SEQ ID NO: 1368027 - RNA, 22 nt, Human
cagcggugaaguccuccccauu

SEQ ID NO: 1368028 - RNA, 21 nt, Human
cagcuccugggggcuccagga

SEQ ID NO: 1368029 - RNA, 20 nt, Human
caggacagccccagcgguga

SEQ ID NO: 1368030 - RNA, 22 nt, Human
ccaccggcccaguucgcccacc

SEQ ID NO: 1368031 - RNA, 20 nt, Human
ccagagacccauaaagccca

SEQ ID NO: 1368032 - RNA, 18 nt, Human
cccauccaggaugugagg

SEQ ID NO: 1368033 - RNA, 20 nt, Human
ccccacaggggagcggaacc

SEQ ID NO: 1368034 - RNA, 19 nt, Human
ccccccagccccuucccgg

SEQ ID NO: 1368035 - RNA, 20 nt, Human
cccccucuccgcccuguccc

SEQ ID NO: 1368036 - RNA, 20 nt, Human
ccccuucccggaaggccuca

SEQ ID NO: 1368037 - RNA, 20 nt, Human
cccuggaagggcccaaggug

SEQ ID NO: 1368038 - RNA, 24 nt, Human
ccugggaguuaauggcuccccucu

SEQ ID NO: 1368039 - RNA, 22 nt, Human
ccugucccccucuccgcccugc

SEQ ID NO: 1368040 - RNA, 24 nt, Human
cgaccacccagggcagaggucagg

SEQ ID NO: 1368041 - RNA, 18 nt, Human
cgcccuggaagggcccaa

SEQ ID NO: 1368042 - RNA, 19 nt, Human
cguggaggggagggggcgg

SEQ ID NO: 1368043 - RNA, 18 nt, Human
cuccuagauccgugacuc

SEQ ID NO: 1368044 - RNA, 24 nt, Human
cucucccagcuccugggggcuccc

SEQ ID NO: 1368045 - RNA, 18 nt, Human
cucugugcgaccgucucc

SEQ ID NO: 1368046 - RNA, 22 nt, Human
cuggaccucgggcagccucgac

SEQ ID NO: 1368047 - RNA, 20 nt, Human
cuggcgccucgguuucccca

SEQ ID NO: 1368048 - RNA, 18 nt, Human
cugucccccucuccgccc

SEQ ID NO: 1368049 - RNA, 21 nt, Human
cugugccagggaagggggggu

SEQ ID NO: 1368050 - RNA, 23 nt, Human
cuuuacugccacgcaucagugcc

SEQ ID NO: 1368051 - RNA, 22 nt, Human
gaacguggaggggagggggcgg

SEQ ID NO: 1368052 - RNA, 24 nt, Human
gaaguccuccccauuccaguaccu

SEQ ID NO: 1368053 - RNA, 18 nt, Human
gagccgccucccccgccg

SEQ ID NO: 1368054 - RNA, 18 nt, Human
gccagcuggccagggcgg

SEQ ID NO: 1368055 - RNA, 20 nt, Human
gccccacaggggucugaccg

SEQ ID NO: 1368056 - RNA, 20 nt, Human
gcccuggaagggcccaaggu

SEQ ID NO: 1368057 - RNA, 24 nt, Human
gcggaaccgggggccagagaccca

SEQ ID NO: 1368058 - RNA, 19 nt, Human
gcggcagccgggccggggu

SEQ ID NO: 1368059 - RNA, 19 nt, Human
gcgguucuuagccgggggg

SEQ ID NO: 1368060 - RNA, 21 nt, Human
gcuccccucuccaaccccaac

SEQ ID NO: 1368061 - RNA, 27 nt, Human
gcuccccucuccaaccccaaccuuggc

SEQ ID NO: 1368062 - RNA, 20 nt, Human
gcuggggcccccgcaggucc

SEQ ID NO: 1368063 - RNA, 20 nt, Human
ggaaggggggguccaggcag

SEQ ID NO: 1368064 - RNA, 23 nt, Human
ggagcggaaccgggggccagaga

SEQ ID NO: 1368065 - RNA, 24 nt, Human
ggaggaagaacguggaggggaggg

SEQ ID NO: 1368066 - RNA, 18 nt, Human
ggaggggagggggcggca

SEQ ID NO: 1368067 - RNA, 18 nt, Human
ggcuccaggagucccuug

SEQ ID NO: 1368068 - RNA, 20 nt, Human
gggcggcagccgggccgggg

SEQ ID NO: 1368069 - RNA, 21 nt, Human
gggcguaaaacaaacgaaacc

SEQ ID NO: 1368070 - RNA, 26 nt, Human
gggcugcgcucccuccaggggcuuca

SEQ ID NO: 1368071 - RNA, 18 nt, Human
ggggaaacugaggcccag

SEQ ID NO: 1368072 - RNA, 23 nt, Human
ggggagggggcggcagccgggcc

SEQ ID NO: 1368073 - RNA, 23 nt, Human
ggggggcugcguaacgaaggacc

SEQ ID NO: 1368074 - RNA, 29 nt, Human
guaaaacaaacgaaaccuguucucccucc

SEQ ID NO: 1368075 - RNA, 21 nt, Human
gucucguucugagguucuggg

SEQ ID NO: 1368076 - RNA, 23 nt, Human
gugcuggccucuacgugcgguuc

SEQ ID NO: 1368077 - RNA, 18 nt, Human
uaaaacaaacgaaaccug

SEQ ID NO: 1368078 - RNA, 25 nt, Human
uaaaacaaacgaaaccuguucuccc

SEQ ID NO: 1368079 - RNA, 20 nt, Human
uaaaccccagauacacuccu

SEQ ID NO: 1368080 - RNA, 25 nt, Human
uaaaccccagauacacuccuagauc

SEQ ID NO: 1368081 - RNA, 21 nt, Human
uaccugagggccccacacccc

SEQ ID NO: 1368082 - RNA, 19 nt, Human
uaccuggcgccucgguuuc

SEQ ID NO: 1368083 - RNA, 19 nt, Human
uagauccgugacucgguga

SEQ ID NO: 1368084 - RNA, 21 nt, Human
uauuugagagauggggaaacu

SEQ ID NO: 1368085 - RNA, 25 nt, Human
uccaaaaucgaggcguccgcagggc

SEQ ID NO: 1368086 - RNA, 24 nt, Human
uccccauuccaguaccugcugccu

SEQ ID NO: 1368087 - RNA, 21 nt, Human
ucccccgccagcagcuggggc

SEQ ID NO: 1368088 - RNA, 23 nt, Human
ucccuccaggggcugcaggagga

SEQ ID NO: 1368089 - RNA, 18 nt, Human
uccgccucucccagcucc

SEQ ID NO: 1368090 - RNA, 23 nt, Human
ucuaccugagggccccacacccc

SEQ ID NO: 1368091 - RNA, 21 nt, Human
ucuccaaccccaaccuuggcu

SEQ ID NO: 1368092 - RNA, 22 nt, Human
ucucccagcuccugggggcucc

SEQ ID NO: 1368093 - RNA, 19 nt, Human
ucucccuccguccuggagc

SEQ ID NO: 1368094 - RNA, 24 nt, Human
ucugucucugugcgaccgucuccc

SEQ ID NO: 1368095 - RNA, 20 nt, Human
ugaaggggaaagggccuccc

SEQ ID NO: 1368096 - RNA, 23 nt, Human
ugaggcaggaggugcggugaggu

SEQ ID NO: 1368097 - RNA, 18 nt, Human
ugagggccccacaccccu

SEQ ID NO: 1368098 - RNA, 22 nt, Human
ugagguuucuuguaggggcugu

SEQ ID NO: 1368099 - RNA, 22 nt, Human
ugccccggccccacaggggucu

SEQ ID NO: 1368100 - RNA, 19 nt, Human
ugcccggcucacuuuugca

SEQ ID NO: 1368101 - RNA, 21 nt, Human
ugcccggcucacuuuugcagc

SEQ ID NO: 1368102 - RNA, 20 nt, Human
uggaggggagggggcggcag

SEQ ID NO: 1368103 - RNA, 18 nt, Human
uggccugggaguuaaugg

SEQ ID NO: 1368104 - RNA, 26 nt, Human
uggcuccccucuccaaccccaaccuu

SEQ ID NO: 1368105 - RNA, 18 nt, Human
uggcugcccccccagccc

SEQ ID NO: 1368106 - RNA, 21 nt, Human
ugggaacaaaacagacuaaac

SEQ ID NO: 1368107 - RNA, 23 nt, Human
ugggauguccccgcagcagcagg

SEQ ID NO: 1368108 - RNA, 18 nt, Human
ugggccuccaauacacag

SEQ ID NO: 1368109 - RNA, 24 nt, Human
uuaauggcuccccucuccaacccc

SEQ ID NO: 1368110 - RNA, 19 nt, Human
uuacugcuggcuuuguugc

SEQ ID NO: 1368111 - RNA, 18 nt, Human
uuccccauccaggaugug

SEQ ID NO: 1368112 - RNA, 23 nt, Human
aaaaaauauaaugaaacuccaaa

SEQ ID NO: 1368113 - RNA, 27 nt, Human
aaaacaaaaaauauaaugaaacuccaa

SEQ ID NO: 1368114 - RNA, 22 nt, Human
aaaacaaauucuuuucuuugga

SEQ ID NO: 1368115 - RNA, 23 nt, Human
aaaauaaaggcaguccauaggaa

SEQ ID NO: 1368116 - RNA, 26 nt, Human
aaacagaaaaugauuaaaggggaccc

SEQ ID NO: 1368117 - RNA, 23 nt, Human
aaacagaaaaugauuaaaguuca

SEQ ID NO: 1368118 - RNA, 19 nt, Human
aaagaaaccuugggggagg

SEQ ID NO: 1368119 - RNA, 20 nt, Human
aaagaaaccuugggggaggg

SEQ ID NO: 1368120 - RNA, 21 nt, Human
aaaguucaugaaaaaaaaacu

SEQ ID NO: 1368121 - RNA, 19 nt, Human
aaccauuaaaacaaauucu

SEQ ID NO: 1368122 - RNA, 25 nt, Human
aaccccgucucuacuaaaaauacaa

SEQ ID NO: 1368123 - RNA, 21 nt, Human
aagaaguauauuuaaacaaaa

SEQ ID NO: 1368124 - RNA, 22 nt, Human
aagaaucaauguucaaccacca

SEQ ID NO: 1368125 - RNA, 19 nt, Human
aagaucaaccaauuugcuc

SEQ ID NO: 1368126 - RNA, 21 nt, Human
aagcaaaugaccuuaggucua

SEQ ID NO: 1368127 - RNA, 24 nt, Human
aaucccuugaacccgggaggugga

SEQ ID NO: 1368128 - RNA, 22 nt, Human
aaugaaaaagccugaagaggga

SEQ ID NO: 1368129 - RNA, 24 nt, Human
acaaaaacaccaagcucuccucuc

SEQ ID NO: 1368130 - RNA, 23 nt, Human
accuguggucucagcuacucggg

SEQ ID NO: 1368131 - RNA, 20 nt, Human
acuaaaauaaaggcagucca

SEQ ID NO: 1368132 - RNA, 25 nt, Human
agaaaaugauuaaaguucaugaaaa

SEQ ID NO: 1368133 - RNA, 22 nt, Human
agaaaugcccaaauaaaaaaaa

SEQ ID NO: 1368134 - RNA, 21 nt, Human
agaacaauuaaauacaaagca

SEQ ID NO: 1368135 - RNA, 24 nt, Human
agcacuuugggaggccgagguggg

SEQ ID NO: 1368136 - RNA, 21 nt, Human
aggcagaaucccuugaacccg

SEQ ID NO: 1368137 - RNA, 22 nt, Human
aggcaguccauaggaagccuca

SEQ ID NO: 1368138 - RNA, 21 nt, Human
aggccgaggugggcggaucac

SEQ ID NO: 1368139 - RNA, 21 nt, Human
aggcugaggcagaaucccuug

SEQ ID NO: 1368140 - RNA, 20 nt, Human
auggcacuuuacaccccaaa

SEQ ID NO: 1368141 - RNA, 24 nt, Human
caacaaauucuaauaaggccaaaa

SEQ ID NO: 1368142 - RNA, 21 nt, Human
caccaccaugugugaagcccc

SEQ ID NO: 1368143 - RNA, 23 nt, Human
caccuguggucucagcuacucgg

SEQ ID NO: 1368144 - RNA, 24 nt, Human
caccuguggucucagcuacucggg

SEQ ID NO: 1368145 - RNA, 24 nt, Human
cacgccuguaaucccagcacuuug

SEQ ID NO: 1368146 - RNA, 24 nt, Human
cagcacuuugggaggccgaggugg

SEQ ID NO: 1368147 - RNA, 24 nt, Human
cagcuacucgggaggcugaggcag

SEQ ID NO: 1368148 - RNA, 23 nt, Human
caggccgggggugguggcucacg

SEQ ID NO: 1368149 - RNA, 28 nt, Human
ccaacaaucucccuuaacauucucauuc

SEQ ID NO: 1368150 - RNA, 19 nt, Human
ccauucugguuacuuggca

SEQ ID NO: 1368151 - RNA, 23 nt, Human
ccccaaacgagcaaaaguaacaa

SEQ ID NO: 1368152 - RNA, 21 nt, Human
cccgggagguggagguugcag

SEQ ID NO: 1368153 - RNA, 24 nt, Human
ccucucugaaaauacaggccgggg

SEQ ID NO: 1368154 - RNA, 21 nt, Human
ccuguggucucagcuacucgg

SEQ ID NO: 1368155 - RNA, 22 nt, Human
cgaggugggcggaucacguggu

SEQ ID NO: 1368156 - RNA, 24 nt, Human
cgccuguaaucccagcacuuuggg

SEQ ID NO: 1368157 - RNA, 19 nt, Human
cgggagguggagguugcag

SEQ ID NO: 1368158 - RNA, 18 nt, Human
cgucucuacuaaaccccg

SEQ ID NO: 1368159 - RNA, 24 nt, Human
cguggucaggagugauccgucucu

SEQ ID NO: 1368160 - RNA, 22 nt, Human
cucacgccuguaaucccagcac

SEQ ID NO: 1368161 - RNA, 24 nt, Human
cucacgccuguaaucccagcacuu

SEQ ID NO: 1368162 - RNA, 21 nt, Human
cuuagagcuccaacaacucuc

SEQ ID NO: 1368163 - RNA, 21 nt, Human
cuugaacccgggagguggagg

SEQ ID NO: 1368164 - RNA, 23 nt, Human
gaggugggcggaucacgugguca

SEQ ID NO: 1368165 - RNA, 19 nt, Human
ggaggggugauagggaagg

SEQ ID NO: 1368166 - RNA, 22 nt, Human
ggcggaucacguggucaggagu

SEQ ID NO: 1368167 - RNA, 21 nt, Human
ggcucacgccuguaaucccag

SEQ ID NO: 1368168 - RNA, 24 nt, Human
ggcugaggcagaaucccuugaacc

SEQ ID NO: 1368169 - RNA, 20 nt, Human
gggaggccgaggugggcgga

SEQ ID NO: 1368170 - RNA, 23 nt, Human
gggaggggugauagggaagggga

SEQ ID NO: 1368171 - RNA, 19 nt, Human
gggggaggggugauaggga

SEQ ID NO: 1368172 - RNA, 24 nt, Human
gggggaggggugauagggaagggg

SEQ ID NO: 1368173 - RNA, 25 nt, Human
gggggaggggugauagggaagggga

SEQ ID NO: 1368174 - RNA, 23 nt, Human
ggggugguggcucacgccuguaa

SEQ ID NO: 1368175 - RNA, 20 nt, Human
gggugaggugauguaaaccu

SEQ ID NO: 1368176 - RNA, 24 nt, Human
gguggcucacgccuguaaucccag

SEQ ID NO: 1368177 - RNA, 23 nt, Human
uaaaaaaaaauuccagaauugaa

SEQ ID NO: 1368178 - RNA, 24 nt, Human
uaaaauguaucaguccacaaaaca

SEQ ID NO: 1368179 - RNA, 22 nt, Human
uaaacaaaauuuaauacaacca

SEQ ID NO: 1368180 - RNA, 23 nt, Human
uaacuaagaacaauuaaauacaa

SEQ ID NO: 1368181 - RNA, 21 nt, Human
uaagauagauauuugucugaa

SEQ ID NO: 1368182 - RNA, 20 nt, Human
uacacaauuuaagaagggga

SEQ ID NO: 1368183 - RNA, 18 nt, Human
uacaccccaaacgagcaa

SEQ ID NO: 1368184 - RNA, 18 nt, Human
uagaggaaaaacagaaaa

SEQ ID NO: 1368185 - RNA, 20 nt, Human
uagauugaaaaaaaaguuga

SEQ ID NO: 1368186 - RNA, 24 nt, Human
uagcaaacucaucucuucugaccu

SEQ ID NO: 1368187 - RNA, 20 nt, Human
uagccgggugugguggcacg

SEQ ID NO: 1368188 - RNA, 20 nt, Human
uagcuagucaaaccuacugc

SEQ ID NO: 1368189 - RNA, 22 nt, Human
uaggaaacaaauaugaaccuua

SEQ ID NO: 1368190 - RNA, 24 nt, Human
uauaaaagaaucaauguucaacca

SEQ ID NO: 1368191 - RNA, 21 nt, Human
uaucaaaaaauaaaaacaaaa

SEQ ID NO: 1368192 - RNA, 23 nt, Human
uaucaaaaaauaaaaacaaaaaa

SEQ ID NO: 1368193 - RNA, 19 nt, Human
ucaauaaaaauuuaaauaa

SEQ ID NO: 1368194 - RNA, 21 nt, Human
ucacguggucaggagugaucc

SEQ ID NO: 1368195 - RNA, 24 nt, Human
ucagugggaagauuacaguagaaa

SEQ ID NO: 1368196 - RNA, 24 nt, Human
ucaucuaggaaauaaaaagguuac

SEQ ID NO: 1368197 - RNA, 19 nt, Human
ucccugaguauuuacauca

SEQ ID NO: 1368198 - RNA, 24 nt, Human
ucccuugaacccgggagguggagg

SEQ ID NO: 1368199 - RNA, 23 nt, Human
ucuaaagugucucuggaauuauu

SEQ ID NO: 1368200 - RNA, 26 nt, Human
ucuagaaucaugaauugaagauuauu

SEQ ID NO: 1368201 - RNA, 25 nt, Human
ucucuacuaaaaauacaaaaaaauu

SEQ ID NO: 1368202 - RNA, 24 nt, Human
ugaaaaaaaaguugaaauagcacu

SEQ ID NO: 1368203 - RNA, 22 nt, Human
ugaaacuccaaacauccaacaa

SEQ ID NO: 1368204 - RNA, 27 nt, Human
ugaaauagcacuagagaacuuaaggca

SEQ ID NO: 1368205 - RNA, 23 nt, Human
ugacaauaaugauagcuagcuag

SEQ ID NO: 1368206 - RNA, 21 nt, Human
ugaggcagaaucccuugaacc

SEQ ID NO: 1368207 - RNA, 22 nt, Human
ugaggcagaaucccuugaaccc

SEQ ID NO: 1368208 - RNA, 23 nt, Human
ugaggugauguaaaccuggcuuu

SEQ ID NO: 1368209 - RNA, 21 nt, Human
uggcaccacaaaaacaccaag

SEQ ID NO: 1368210 - RNA, 24 nt, Human
uggcacgcaccuguggucucagcu

SEQ ID NO: 1368211 - RNA, 24 nt, Human
uggcucacgccuguaaucccagca

SEQ ID NO: 1368212 - RNA, 19 nt, Human
ugggaggccgaggugggcg

SEQ ID NO: 1368213 - RNA, 24 nt, Human
ugggaggccgaggugggcggauca

SEQ ID NO: 1368214 - RNA, 22 nt, Human
ugggcggaucacguggucagga

SEQ ID NO: 1368215 - RNA, 24 nt, Human
ugguggcucacgccuguaauccca

SEQ ID NO: 1368216 - RNA, 19 nt, Human
uguaagauagauauuuguc

SEQ ID NO: 1368217 - RNA, 18 nt, Human
ugugguggcacgcaccug

SEQ ID NO: 1368218 - RNA, 23 nt, Human
ugugguggcacgcaccugugguc

SEQ ID NO: 1368219 - RNA, 19 nt, Human
uguucaaccaccaccaugu

SEQ ID NO: 1368220 - RNA, 18 nt, Human
uuagccgggugugguggc

SEQ ID NO: 1368221 - RNA, 20 nt, Human
uuagccgggugugguggcac

SEQ ID NO: 1368222 - RNA, 22 nt, Human
uuagccgggugugguggcacgc

SEQ ID NO: 1368223 - RNA, 22 nt, Human
uugaaaccauuaaaacaaauuc

SEQ ID NO: 1368224 - RNA, 24 nt, Human
uugaacccgggagguggagguugc

SEQ ID NO: 1368225 - RNA, 31 nt, Human
uuggcaccacaaaaacaccaagcucuccucc

SEQ ID NO: 1368226 - RNA, 25 nt, Human
uugggaggccgaggugggcggauca

SEQ ID NO: 1368227 - RNA, 24 nt, Human
uugggggaggggugauagggaagg

SEQ ID NO: 1368228 - RNA, 22 nt, Human
aagauauuuauugaggguuuac

SEQ ID NO: 1368229 - RNA, 24 nt, Human
agcuggcucggaccuguccaccuc

SEQ ID NO: 1368230 - RNA, 24 nt, Human
agcugugccguguggcugaggagu

SEQ ID NO: 1368231 - RNA, 24 nt, Human
agguagcugcuggccacguacuug

SEQ ID NO: 1368232 - RNA, 24 nt, Human
ccccugggauccugcagcuccagg

SEQ ID NO: 1368233 - RNA, 21 nt, Human
cccuguggguggggugggggc

SEQ ID NO: 1368234 - RNA, 19 nt, Human
ccugugggugggguggggg

SEQ ID NO: 1368235 - RNA, 21 nt, Human
cgagaagggcugaauggcuug

SEQ ID NO: 1368236 - RNA, 26 nt, Human
cgagaagggcugaauggcuugggaug

SEQ ID NO: 1368237 - RNA, 22 nt, Human
cuccccugggauccugcagcuc

SEQ ID NO: 1368238 - RNA, 25 nt, Human
cuccccugggauccugcagcuccag

SEQ ID NO: 1368239 - RNA, 23 nt, Human
cugcaggggccacugacuucucc

SEQ ID NO: 1368240 - RNA, 23 nt, Human
cugggauccugcagcuccaggcc

SEQ ID NO: 1368241 - RNA, 25 nt, Human
cugggauccugcagcuccaggcccc

SEQ ID NO: 1368242 - RNA, 23 nt, Human
gccccuguggguggggugggggc

SEQ ID NO: 1368243 - RNA, 22 nt, Human
gcucuguuuggagggcgugguc

SEQ ID NO: 1368244 - RNA, 20 nt, Human
ggauccugcagcuccaggcc

SEQ ID NO: 1368245 - RNA, 26 nt, Human
ggguacagcgagaagggcugaauggc

SEQ ID NO: 1368246 - RNA, 18 nt, Human
ggguggggugggggcugg

SEQ ID NO: 1368247 - RNA, 18 nt, Human
gucuucuccacgcucugg

SEQ ID NO: 1368248 - RNA, 26 nt, Human
uacagcgagaagggcugaauggcuug

SEQ ID NO: 1368249 - RNA, 19 nt, Human
ucaggcucagguagcugcu

SEQ ID NO: 1368250 - RNA, 23 nt, Human
ucaggcucagguagcugcuggcc

SEQ ID NO: 1368251 - RNA, 19 nt, Human
uccccugggauccugcagc

SEQ ID NO: 1368252 - RNA, 23 nt, Human
uccccugggauccugcagcucca

SEQ ID NO: 1368253 - RNA, 24 nt, Human
uccccugggauccugcagcuccag

SEQ ID NO: 1368254 - RNA, 22 nt, Human
ugacaaagauauuuauugaggg

SEQ ID NO: 1368255 - RNA, 18 nt, Human
ugcagagagagaccccuc

SEQ ID NO: 1368256 - RNA, 24 nt, Human
ugcagcuccaggccccugugggug

SEQ ID NO: 1368257 - RNA, 22 nt, Human
uggguacagcgagaagggcuga

SEQ ID NO: 1368258 - RNA, 20 nt, Human
uggguggggugggggcugga

SEQ ID NO: 1368259 - RNA, 18 nt, Human
ugugccguguggcugagg

SEQ ID NO: 1368260 - RNA, 21 nt, Human
uuggagggcguggucuucucc

SEQ ID NO: 1368261 - RNA, 18 nt, Human
aagaggcucucugccuuu

SEQ ID NO: 1368262 - RNA, 20 nt, Human
acccagagagcugagaagag

SEQ ID NO: 1368263 - RNA, 21 nt, Human
acccagagagcugagaagagu

SEQ ID NO: 1368264 - RNA, 20 nt, Human
agagcugagaagaguagcug

SEQ ID NO: 1368265 - RNA, 21 nt, Human
agaguagcugugaggcucagg

SEQ ID NO: 1368266 - RNA, 18 nt, Human
cagcuccccucagccugu

SEQ ID NO: 1368267 - RNA, 22 nt, Human
ccagacccagagagcugagaag

SEQ ID NO: 1368268 - RNA, 18 nt, Human
cccuaacccugcuccccu

SEQ ID NO: 1368269 - RNA, 19 nt, Human
cccuaacccugcuccccuu

SEQ ID NO: 1368270 - RNA, 18 nt, Human
cccucagccuguucuccu

SEQ ID NO: 1368271 - RNA, 24 nt, Human
ccggguagcaccucagcuccucuc

SEQ ID NO: 1368272 - RNA, 18 nt, Human
ccuaacccugcuccccuu

SEQ ID NO: 1368273 - RNA, 20 nt, Human
ccucagccuguucuccuucc

SEQ ID NO: 1368274 - RNA, 21 nt, Human
ccuguucuccuuccagaccca

SEQ ID NO: 1368275 - RNA, 20 nt, Human
cuccccucagccuguucucc

SEQ ID NO: 1368276 - RNA, 21 nt, Human
cuccggguagcaccucagcuc

SEQ ID NO: 1368277 - RNA, 19 nt, Human
cuccucucagcuccccuca

SEQ ID NO: 1368278 - RNA, 18 nt, Human
cuuucaggaacagcccua

SEQ ID NO: 1368279 - RNA, 18 nt, Human
gagaagaguagcugugag

SEQ ID NO: 1368280 - RNA, 21 nt, Human
gaguagcugugaggcucaggg

SEQ ID NO: 1368281 - RNA, 18 nt, Human
gccucagauucccaagug

SEQ ID NO: 1368282 - RNA, 18 nt, Human
ggcaggugggggugaaug

SEQ ID NO: 1368283 - RNA, 22 nt, Human
ggccggggccuggggggacgaa

SEQ ID NO: 1368284 - RNA, 19 nt, Human
ggccuggggggacgaaggu

SEQ ID NO: 1368285 - RNA, 18 nt, Human
gggccggggccugggggg

SEQ ID NO: 1368286 - RNA, 22 nt, Human
gggccuggggggacgaaggugg

SEQ ID NO: 1368287 - RNA, 20 nt, Human
ggggggacgaaggugguaug

SEQ ID NO: 1368288 - RNA, 19 nt, Human
uaaaaauaaugagagccag

SEQ ID NO: 1368289 - RNA, 19 nt, Human
ucaaaguuuuaacauaaaa

SEQ ID NO: 1368290 - RNA, 23 nt, Human
ucagcuccccucagccuguucuc

SEQ ID NO: 1368291 - RNA, 23 nt, Human
ucagcuccucucagcuccccuca

SEQ ID NO: 1368292 - RNA, 18 nt, Human
ucaggaacagcccuaacc

SEQ ID NO: 1368293 - RNA, 23 nt, Human
ugagagccaggaguggggccggg

SEQ ID NO: 1368294 - RNA, 22 nt, Human
ugccucagauucccaagugggc

SEQ ID NO: 1368295 - RNA, 22 nt, Human
uggcacacaggccucacccucc

SEQ ID NO: 1368296 - RNA, 26 nt, Human
ugggcaggugggggugaauggggcuc

SEQ ID NO: 1368297 - RNA, 19 nt, Human
uggggccggggccuggggg

SEQ ID NO: 1368298 - RNA, 23 nt, Human
uggggccggggccuggggggacg

SEQ ID NO: 1368299 - RNA, 19 nt, Human
ugggggugaauggggcucc

SEQ ID NO: 1368300 - RNA, 20 nt, Human
uucccaagugggcagguggg

SEQ ID NO: 1368301 - RNA, 20 nt, Human
cagucccuggggugcgaaaa

SEQ ID NO: 1368302 - RNA, 24 nt, Human
ccaggagcagucccuggggugcga

SEQ ID NO: 1368303 - RNA, 25 nt, Human
cucaauaauuauauauaaaauugcu

SEQ ID NO: 1368304 - RNA, 20 nt, Human
cucuucauugcagacaugua

SEQ ID NO: 1368305 - RNA, 22 nt, Human
cuuuccuucuuucccuuuuucu

SEQ ID NO: 1368306 - RNA, 20 nt, Human
gcaguuuuuccaauuggugu

SEQ ID NO: 1368307 - RNA, 20 nt, Human
ucauuuguauuuucucagca

SEQ ID NO: 1368308 - RNA, 20 nt, Human
ucucaugguaauccaaaugg

SEQ ID NO: 1368309 - RNA, 24 nt, Human
uucuuucccuuuuucucaugguaa

SEQ ID NO: 1368310 - RNA, 27 nt, Human
uugauagucuuuucauuuguauuuucu

SEQ ID NO: 1368311 - RNA, 25 nt, Human
aaaaaccacuaccguucauuaaguc

SEQ ID NO: 1368312 - RNA, 22 nt, Human
aaaaaugaaguuaaagcucaga

SEQ ID NO: 1368313 - RNA, 18 nt, Human
aacagaaaaccacagacu

SEQ ID NO: 1368314 - RNA, 24 nt, Human
aagcagcuuuaaaauccuccggga

SEQ ID NO: 1368315 - RNA, 20 nt, Human
aaugcacauuuucuuggguu

SEQ ID NO: 1368316 - RNA, 28 nt, Human
acacauuuccaagcaggucuugaccccg

SEQ ID NO: 1368317 - RNA, 22 nt, Human
acagcagaggagccugagugcc

SEQ ID NO: 1368318 - RNA, 21 nt, Human
acuaccguucauuaagucacc

SEQ ID NO: 1368319 - RNA, 21 nt, Human
acuuggccauuuuuaauccaa

SEQ ID NO: 1368320 - RNA, 21 nt, Human
agaaacuuuuuucuccuucag

SEQ ID NO: 1368321 - RNA, 24 nt, Human
agaaaguguaggggacuuaaacaa

SEQ ID NO: 1368322 - RNA, 24 nt, Human
agaaauacacauuuccaagcaggu

SEQ ID NO: 1368323 - RNA, 18 nt, Human
agcccugggccaaguuuc

SEQ ID NO: 1368324 - RNA, 20 nt, Human
agcccugggccaaguuuccc

SEQ ID NO: 1368325 - RNA, 25 nt, Human
agcuuuaagaauuauauucucuaau

SEQ ID NO: 1368326 - RNA, 21 nt, Human
aggaaggaggcaaaauccuuc

SEQ ID NO: 1368327 - RNA, 22 nt, Human
aggaugaccugguugauagucu

SEQ ID NO: 1368328 - RNA, 22 nt, Human
agugaguuucuuguaaucucag

SEQ ID NO: 1368329 - RNA, 23 nt, Human
auagaaacaagcuucuucuacau

SEQ ID NO: 1368330 - RNA, 18 nt, Human
auguucaccgacuuggaa

SEQ ID NO: 1368331 - RNA, 24 nt, Human
auucagacugcuucaacagaaaac

SEQ ID NO: 1368332 - RNA, 27 nt, Human
auucccagguucuaaugcacauuuucu

SEQ ID NO: 1368333 - RNA, 19 nt, Human
auuuaguggcauucuccuu

SEQ ID NO: 1368334 - RNA, 23 nt, Human
caacaagaagaggaaacauuuuc

SEQ ID NO: 1368335 - RNA, 24 nt, Human
caacaagaagaggaaacauuuuca

SEQ ID NO: 1368336 - RNA, 24 nt, Human
cacagcaaaaacccaccuuuaaag

SEQ ID NO: 1368337 - RNA, 18 nt, Human
cacugacaacaccuuugc

SEQ ID NO: 1368338 - RNA, 19 nt, Human
cagaaucuucagauucucc

SEQ ID NO: 1368339 - RNA, 21 nt, Human
cagcagaggagccugagugcc

SEQ ID NO: 1368340 - RNA, 22 nt, Human
cagcaggaaggaggcaaaaucc

SEQ ID NO: 1368341 - RNA, 19 nt, Human
caggaccaggguuaugcug

SEQ ID NO: 1368342 - RNA, 27 nt, Human
caguuuaagcucauuugagaaacuuuu

SEQ ID NO: 1368343 - RNA, 20 nt, Human
cauccucugggucaucuccc

SEQ ID NO: 1368344 - RNA, 18 nt, Human
caucuugggaaaauuguu

SEQ ID NO: 1368345 - RNA, 23 nt, Human
ccacccucaugaccuaucaucuc

SEQ ID NO: 1368346 - RNA, 18 nt, Human
ccagcucuuuuucccaca

SEQ ID NO: 1368347 - RNA, 22 nt, Human
ccgaaagacaaacaaaugguga

SEQ ID NO: 1368348 - RNA, 19 nt, Human
ccucaugaccuaucaucuc

SEQ ID NO: 1368349 - RNA, 19 nt, Human
ccucuggacacaauuccug

SEQ ID NO: 1368350 - RNA, 27 nt, Human
ccugagcccugggccaaguuucccaga

SEQ ID NO: 1368351 - RNA, 21 nt, Human
ccuucagaguaccguauucau

SEQ ID NO: 1368352 - RNA, 20 nt, Human
cgacuuggaagcaaucagca

SEQ ID NO: 1368353 - RNA, 22 nt, Human
cuagauggcuaaacaacaaaca

SEQ ID NO: 1368354 - RNA, 21 nt, Human
cucgcgguaauacccucucca

SEQ ID NO: 1368355 - RNA, 21 nt, Human
cugcaaauuucuuuggauuac

SEQ ID NO: 1368356 - RNA, 22 nt, Human
cugucacuacccuaauaagccc

SEQ ID NO: 1368357 - RNA, 19 nt, Human
cuuccagcucuuuuuccca

SEQ ID NO: 1368358 - RNA, 20 nt, Human
cuuggcauccucugggucau

SEQ ID NO: 1368359 - RNA, 23 nt, Human
cuuuaaaagcugucccacacgca

SEQ ID NO: 1368360 - RNA, 22 nt, Human
gaucaugguguaaguagauuca

SEQ ID NO: 1368361 - RNA, 20 nt, Human
gauuauggaaaaggccucuc

SEQ ID NO: 1368362 - RNA, 23 nt, Human
gccaucuucccauuguaucaucc

SEQ ID NO: 1368363 - RNA, 21 nt, Human
gccaugguaucauaaagcugg

SEQ ID NO: 1368364 - RNA, 23 nt, Human
gcuuaaagaaucacagaacuuag

SEQ ID NO: 1368365 - RNA, 22 nt, Human
gggugaggguaagaucaggugg

SEQ ID NO: 1368366 - RNA, 18 nt, Human
gguagugagcagagauug

SEQ ID NO: 1368367 - RNA, 20 nt, Human
uaaaauacaugcugcuguga

SEQ ID NO: 1368368 - RNA, 24 nt, Human
uaaacaacaaacauguauuucuca

SEQ ID NO: 1368369 - RNA, 20 nt, Human
uaaagcagcuuuaaaauccu

SEQ ID NO: 1368370 - RNA, 23 nt, Human
uaaaucacuugcaguuuaagcuc

SEQ ID NO: 1368371 - RNA, 19 nt, Human
uaacuacuccaagugacug

SEQ ID NO: 1368372 - RNA, 20 nt, Human
uaacuuuucaacaagaagag

SEQ ID NO: 1368373 - RNA, 19 nt, Human
uaccguucauuaagucacc

SEQ ID NO: 1368374 - RNA, 19 nt, Human
uacuggauagaaacaagcu

SEQ ID NO: 1368375 - RNA, 24 nt, Human
uagaaacaagcuucuucuacauuc

SEQ ID NO: 1368376 - RNA, 18 nt, Human
uauucauuuaucacagca

SEQ ID NO: 1368377 - RNA, 19 nt, Human
ucaacaagaagaggaaaca

SEQ ID NO: 1368378 - RNA, 19 nt, Human
ucaacagaaaaccacagac

SEQ ID NO: 1368379 - RNA, 21 nt, Human
ucacuuuucuuacauuaucuc

SEQ ID NO: 1368380 - RNA, 20 nt, Human
ucaggaacacuggaugcaag

SEQ ID NO: 1368381 - RNA, 19 nt, Human
ucaggugggaauccauacu

SEQ ID NO: 1368382 - RNA, 20 nt, Human
uccaaacaaauuugccaaua

SEQ ID NO: 1368383 - RNA, 18 nt, Human
uccacagcagugaguuuc

SEQ ID NO: 1368384 - RNA, 20 nt, Human
uccagaaucuucagauucuc

SEQ ID NO: 1368385 - RNA, 18 nt, Human
uccauggccacagcagag

SEQ ID NO: 1368386 - RNA, 22 nt, Human
uccauggccacagcagaggagc

SEQ ID NO: 1368387 - RNA, 21 nt, Human
ucccagguucuaaugcacauu

SEQ ID NO: 1368388 - RNA, 28 nt, Human
ucccagguucuaaugcacauuuucuugg

SEQ ID NO: 1368389 - RNA, 18 nt, Human
uccccgaaagacaaacaa

SEQ ID NO: 1368390 - RNA, 19 nt, Human
ucccuuggaagccagcagc

SEQ ID NO: 1368391 - RNA, 20 nt, Human
uccuggaggcuggaaaguuc

SEQ ID NO: 1368392 - RNA, 24 nt, Human
ucuugaggggugaggguaagauca

SEQ ID NO: 1368393 - RNA, 21 nt, Human
ucuugggaaaauuguugugag

SEQ ID NO: 1368394 - RNA, 22 nt, Human
ucuuggguucuguuugcuuguu

SEQ ID NO: 1368395 - RNA, 19 nt, Human
ucuuuuuauuuugggcaau

SEQ ID NO: 1368396 - RNA, 18 nt, Human
ugaacaaaacaguugaau

SEQ ID NO: 1368397 - RNA, 20 nt, Human
ugaacuagacaaugaauccc

SEQ ID NO: 1368398 - RNA, 19 nt, Human
ugaaugaccgauuucucuu

SEQ ID NO: 1368399 - RNA, 25 nt, Human
ugaauuugcauuucuugaaguuucu

SEQ ID NO: 1368400 - RNA, 27 nt, Human
ugacaacaccuuugccuuggcauccuc

SEQ ID NO: 1368401 - RNA, 26 nt, Human
ugacugagaaaaacuuaaauuagcau

SEQ ID NO: 1368402 - RNA, 22 nt, Human
ugagaaaaacuuaaauuagcau

SEQ ID NO: 1368403 - RNA, 23 nt, Human
ugagaaaauuuacaaaaacaaga

SEQ ID NO: 1368404 - RNA, 21 nt, Human
ugagacacgaguugggagucc

SEQ ID NO: 1368405 - RNA, 24 nt, Human
ugagcagagauuggagaacaagcc

SEQ ID NO: 1368406 - RNA, 18 nt, Human
ugagggcagaaacaaucu

SEQ ID NO: 1368407 - RNA, 23 nt, Human
ugagucuugggcaaaaacaacag

SEQ ID NO: 1368408 - RNA, 22 nt, Human
ugcaggcaacuuauccauuugu

SEQ ID NO: 1368409 - RNA, 22 nt, Human
uggaucccuaaggcaaguguuu

SEQ ID NO: 1368410 - RNA, 19 nt, Human
uggcauguggaucccuaag

SEQ ID NO: 1368411 - RNA, 21 nt, Human
uggcauguggaucccuaaggc

SEQ ID NO: 1368412 - RNA, 20 nt, Human
ugggaaaauuguugugagcc

SEQ ID NO: 1368413 - RNA, 23 nt, Human
ugggcaaaaacaacagauuugca

SEQ ID NO: 1368414 - RNA, 21 nt, Human
ugguagugagcagagauugga

SEQ ID NO: 1368415 - RNA, 19 nt, Human
ugugagccuuuccaggcug

SEQ ID NO: 1368416 - RNA, 23 nt, Human
uguuugcuuaaagaaucacagaa

SEQ ID NO: 1368417 - RNA, 18 nt, Human
uuaaaagacagcaaugaa

SEQ ID NO: 1368418 - RNA, 25 nt, Human
uuaauccucaaaacaacuagaggua

SEQ ID NO: 1368419 - RNA, 19 nt, Human
uuacuggauagaaacaagc

SEQ ID NO: 1368420 - RNA, 19 nt, Human
uuauggaaaaggccucucu

SEQ ID NO: 1368421 - RNA, 18 nt, Human
uucaucuauugcaaagac

SEQ ID NO: 1368422 - RNA, 21 nt, Human
uuccagcacgaccagacaucu

SEQ ID NO: 1368423 - RNA, 20 nt, Human
uuccauggccacagcagagg

SEQ ID NO: 1368424 - RNA, 18 nt, Human
uuccugagcccugggcca

SEQ ID NO: 1368425 - RNA, 18 nt, Human
uuccugagcccugggcca

SEQ ID NO: 1368426 - RNA, 21 nt, Human
uuccugagcccugggccaagu

SEQ ID NO: 1368427 - RNA, 25 nt, Human
uuccuuucuugcagcucaucaagug

SEQ ID NO: 1368428 - RNA, 18 nt, Human
uucuuccagcacgaccag

SEQ ID NO: 1368429 - RNA, 20 nt, Human
uucuuuggauuacccuuuuu

SEQ ID NO: 1368430 - RNA, 23 nt, Human
uugccgugucuuguaaaucgcac

SEQ ID NO: 1368431 - RNA, 23 nt, Human
uuguugugagccuuuccaggcug

SEQ ID NO: 1368432 - RNA, 25 nt, Human
uuuaagcucauuugagaaacuuuuu

SEQ ID NO: 1368433 - RNA, 24 nt, Human
uuuccagaaucuucagauucucca

SEQ ID NO: 1368434 - RNA, 18 nt, Human
uuugcuggaauauauuuu

SEQ ID NO: 1368435 - RNA, 23 nt, Human
acuggguacagggagaagggcug

SEQ ID NO: 1368436 - RNA, 24 nt, Human
agcuggcucggaccuguccaccuc

SEQ ID NO: 1368437 - RNA, 24 nt, Human
agcugugccguguggcugaggagu

SEQ ID NO: 1368438 - RNA, 20 nt, Human
cagagagagacgccuccccu

SEQ ID NO: 1368439 - RNA, 24 nt, Human
ccccugggauccugcagcuccagg

SEQ ID NO: 1368440 - RNA, 22 nt, Human
ccccuguggguggggugggggc

SEQ ID NO: 1368441 - RNA, 21 nt, Human
cccuguggguggggugggggc

SEQ ID NO: 1368442 - RNA, 19 nt, Human
ccugugggugggguggggg

SEQ ID NO: 1368443 - RNA, 22 nt, Human
cuccccugggauccugcagcuc

SEQ ID NO: 1368444 - RNA, 20 nt, Human
ggauccugcagcuccaggcc

SEQ ID NO: 1368445 - RNA, 19 nt, Human
ggguggggugggggcuggg

SEQ ID NO: 1368446 - RNA, 19 nt, Human
uccccugggauccugcagc

SEQ ID NO: 1368447 - RNA, 23 nt, Human
uccccugggauccugcagcucca

SEQ ID NO: 1368448 - RNA, 24 nt, Human
uccccugggauccugcagcuccag

SEQ ID NO: 1368449 - RNA, 21 nt, Human
ugaggguuuacuggguacagg

SEQ ID NO: 1368450 - RNA, 24 nt, Human
ugcagcuccaggccccugugggug

SEQ ID NO: 1368451 - RNA, 22 nt, Human
ugggauccugcagcuccaggcc

SEQ ID NO: 1368452 - RNA, 24 nt, Human
ugggauccugcagcuccaggcccc

SEQ ID NO: 1368453 - RNA, 22 nt, Human
uggguacagggagaagggcugg

SEQ ID NO: 1368454 - RNA, 19 nt, Human
uggguggggugggggcugg

SEQ ID NO: 1368455 - RNA, 18 nt, Human
ugugccguguggcugagg

SEQ ID NO: 1368456 - RNA, 19 nt, Human
aaaaacucagccagguccc

SEQ ID NO: 1368457 - RNA, 22 nt, Human
aaagaccccccaccacccacuc

SEQ ID NO: 1368458 - RNA, 18 nt, Human
aaccaccccacagccacc

SEQ ID NO: 1368459 - RNA, 20 nt, Human
aacccaaagaccccccacca

SEQ ID NO: 1368460 - RNA, 18 nt, Human
aacccccucucuagcuga

SEQ ID NO: 1368461 - RNA, 22 nt, Human
aacccugguuccgaagcccagg

SEQ ID NO: 1368462 - RNA, 26 nt, Human
aagaccccccaccacccacuccacag

SEQ ID NO: 1368463 - RNA, 22 nt, Human
aagcaaccaccccacagccacc

SEQ ID NO: 1368464 - RNA, 22 nt, Human
aagccugcugcuggcuaagcag

SEQ ID NO: 1368465 - RNA, 20 nt, Human
aaggacaggagccccuucug

SEQ ID NO: 1368466 - RNA, 22 nt, Human
aaggcacuguccaugcacuucc

SEQ ID NO: 1368467 - RNA, 27 nt, Human
aaggcacuguccaugcacuuccaacug

SEQ ID NO: 1368468 - RNA, 24 nt, Human
acccaaagaccccccaccacccac

SEQ ID NO: 1368469 - RNA, 20 nt, Human
acccagcccaugcuacgugg

SEQ ID NO: 1368470 - RNA, 24 nt, Human
acccaucaaguaaaucacccucuu

SEQ ID NO: 1368471 - RNA, 25 nt, Human
acucacugcccagaugcucccgggg

SEQ ID NO: 1368472 - RNA, 20 nt, Human
agaacugaggcacagagcca

SEQ ID NO: 1368473 - RNA, 18 nt, Human
agacaggcuggacacagc

SEQ ID NO: 1368474 - RNA, 20 nt, Human
agacaggcuggacacagcuc

SEQ ID NO: 1368475 - RNA, 25 nt, Human
agacaggcuggacacagcuggggac

SEQ ID NO: 1368476 - RNA, 21 nt, Human
agaccaagaaggccuugggca

SEQ ID NO: 1368477 - RNA, 21 nt, Human
agagauccccccucaacauca

SEQ ID NO: 1368478 - RNA, 19 nt, Human
agagccaagaaggucaggg

SEQ ID NO: 1368479 - RNA, 20 nt, Human
agauccuguggauggcggcu

SEQ ID NO: 1368480 - RNA, 24 nt, Human
agcauguaaacccaaagacccccc

SEQ ID NO: 1368481 - RNA, 21 nt, Human
aggaggaugcugaggugauuc

SEQ ID NO: 1368482 - RNA, 25 nt, Human
aggcaagggaaaaacucagccaggu

SEQ ID NO: 1368483 - RNA, 21 nt, Human
aggcaggaccaaacguaccca

SEQ ID NO: 1368484 - RNA, 18 nt, Human
aggcaggcaggcugggga

SEQ ID NO: 1368485 - RNA, 21 nt, Human
aggccaagccucuccaagcau

SEQ ID NO: 1368486 - RNA, 21 nt, Human
aggcugcuggggucaggaugu

SEQ ID NO: 1368487 - RNA, 22 nt, Human
aggcuggacacagcuggggaca

SEQ ID NO: 1368488 - RNA, 21 nt, Human
agggagauccuguggauggcg

SEQ ID NO: 1368489 - RNA, 23 nt, Human
aggucuccugagugcccuaccag

SEQ ID NO: 1368490 - RNA, 25 nt, Human
auguaaacccaaagaccccccacca

SEQ ID NO: 1368491 - RNA, 21 nt, Human
caaccaccccacagccaccug

SEQ ID NO: 1368492 - RNA, 23 nt, Human
caacgagggcagcuucagguccc

SEQ ID NO: 1368493 - RNA, 22 nt, Human
caagaaggccuugggcaugaug

SEQ ID NO: 1368494 - RNA, 18 nt, Human
caauccgcaugggggccc

SEQ ID NO: 1368495 - RNA, 26 nt, Human
cacagcaacacucaagagagcagcug

SEQ ID NO: 1368496 - RNA, 19 nt, Human
cacagucccccuugucuuc

SEQ ID NO: 1368497 - RNA, 23 nt, Human
cacagucccccuugucuucugcc

SEQ ID NO: 1368498 - RNA, 21 nt, Human
caccagccccaaccacaaguc

SEQ ID NO: 1368499 - RNA, 21 nt, Human
caccagcguggccugacagcg

SEQ ID NO: 1368500 - RNA, 22 nt, Human
caccccaugaagcaaccacccc

SEQ ID NO: 1368501 - RNA, 23 nt, Human
caccccaugaagcaaccacccca

SEQ ID NO: 1368502 - RNA, 21 nt, Human
cacccccccaagcuuucaccc

SEQ ID NO: 1368503 - RNA, 18 nt, Human
cacccuucccgcccagcu

SEQ ID NO: 1368504 - RNA, 19 nt, Human
cacccuucccgcccagcuc

SEQ ID NO: 1368505 - RNA, 21 nt, Human
cacccuucccgcccagcucaa

SEQ ID NO: 1368506 - RNA, 19 nt, Human
caccguggccuccacacag

SEQ ID NO: 1368507 - RNA, 19 nt, Human
caccucaucccugaagcuc

SEQ ID NO: 1368508 - RNA, 23 nt, Human
cacuuacgcagguggaugagggg

SEQ ID NO: 1368509 - RNA, 23 nt, Human
cagagcaucccucaugcccuggc

SEQ ID NO: 1368510 - RNA, 25 nt, Human
cagcaacacucaagagagcagcuga

SEQ ID NO: 1368511 - RNA, 21 nt, Human
cagcacacccaccccaccuug

SEQ ID NO: 1368512 - RNA, 24 nt, Human
cagcacacccaccccaccuugcag

SEQ ID NO: 1368513 - RNA, 22 nt, Human
cagcagcauguaaacccaaaga

SEQ ID NO: 1368514 - RNA, 18 nt, Human
cagccacagcaacacuca

SEQ ID NO: 1368515 - RNA, 22 nt, Human
cagccacagcaacacucaagag

SEQ ID NO: 1368516 - RNA, 19 nt, Human
cagccccucuccuggccac

SEQ ID NO: 1368517 - RNA, 22 nt, Human
cagccuucaaacaacaguagcc

SEQ ID NO: 1368518 - RNA, 27 nt, Human
cagcguacggccggcacaagagaggcu

SEQ ID NO: 1368519 - RNA, 20 nt, Human
cagcuucaggucccaggacc

SEQ ID NO: 1368520 - RNA, 24 nt, Human
caggcaggaccaaacguacccauc

SEQ ID NO: 1368521 - RNA, 18 nt, Human
caggcuggggacagugag

SEQ ID NO: 1368522 - RNA, 18 nt, Human
caggggcaccaagagcua

SEQ ID NO: 1368523 - RNA, 21 nt, Human
cagggugccccauaacccuga

SEQ ID NO: 1368524 - RNA, 20 nt, Human
cagggugccccauaacccuu

SEQ ID NO: 1368525 - RNA, 21 nt, Human
caggucccaggaccgugcccc

SEQ ID NO: 1368526 - RNA, 20 nt, Human
cagugggcuucuaaguuugg

SEQ ID NO: 1368527 - RNA, 24 nt, Human
ccaccguggccuccacacagcuag

SEQ ID NO: 1368528 - RNA, 26 nt, Human
ccacgcuaccuucaggcugaugucug

SEQ ID NO: 1368529 - RNA, 21 nt, Human
ccagcagcauguaaacccaaa

SEQ ID NO: 1368530 - RNA, 19 nt, Human
ccagcccagagcaucccuc

SEQ ID NO: 1368531 - RNA, 20 nt, Human
ccaggcaagggaaaaacuca

SEQ ID NO: 1368532 - RNA, 23 nt, Human
cccaaagaccccccaccacccac

SEQ ID NO: 1368533 - RNA, 26 nt, Human
cccaaagaccccccaccacccacucc

SEQ ID NO: 1368534 - RNA, 18 nt, Human
cccaaccacaagucccac

SEQ ID NO: 1368535 - RNA, 24 nt, Human
cccacagccaccugggucucugcu

SEQ ID NO: 1368536 - RNA, 25 nt, Human
cccaccuucuacaugcuccugaccc

SEQ ID NO: 1368537 - RNA, 18 nt, Human
ccccaaggaaaguucucu

SEQ ID NO: 1368538 - RNA, 19 nt, Human
ccccaccacccacuccaca

SEQ ID NO: 1368539 - RNA, 21 nt, Human
ccccagcacacccaccccacc

SEQ ID NO: 1368540 - RNA, 20 nt, Human
ccccaguaacucagaccugg

SEQ ID NO: 1368541 - RNA, 20 nt, Human
ccccauaacccugacacgga

SEQ ID NO: 1368542 - RNA, 24 nt, Human
cccccaguaacucagaccugguuu

SEQ ID NO: 1368543 - RNA, 19 nt, Human
ccccccaccacccacucca

SEQ ID NO: 1368544 - RNA, 22 nt, Human
ccccccaccacccacuccacag

SEQ ID NO: 1368545 - RNA, 19 nt, Human
cccccugcgcccaggcucu

SEQ ID NO: 1368546 - RNA, 24 nt, Human
cccggggcugagccagcccagagc

SEQ ID NO: 1368547 - RNA, 21 nt, Human
ccgggccagcagcaggaccuc

SEQ ID NO: 1368548 - RNA, 18 nt, Human
ccgugccugggggggcuc

SEQ ID NO: 1368549 - RNA, 24 nt, Human
ccuagaccuggcccugcagccaac

SEQ ID NO: 1368550 - RNA, 30 nt, Human
ccucaacaucauguggccaugcccccaguu

SEQ ID NO: 1368551 - RNA, 19 nt, Human
ccucaugacaggucuggga

SEQ ID NO: 1368552 - RNA, 22 nt, Human
ccucaugcccuggccccuagac

SEQ ID NO: 1368553 - RNA, 26 nt, Human
ccucucuagcugagggaaagauuugc

SEQ ID NO: 1368554 - RNA, 21 nt, Human
ccuggccacacaccagcccca

SEQ ID NO: 1368555 - RNA, 23 nt, Human
ccuggccacacaccagccccaac

SEQ ID NO: 1368556 - RNA, 21 nt, Human
cgacucaggcucucucggcag

SEQ ID NO: 1368557 - RNA, 18 nt, Human
cggcacaggcccagggcu

SEQ ID NO: 1368558 - RNA, 24 nt, Human
cggcguccagcauuucaaggaagg

SEQ ID NO: 1368559 - RNA, 24 nt, Human
cggcucuacuggugaagaccaaga

SEQ ID NO: 1368560 - RNA, 22 nt, Human
cucaugcccuggccccuagacc

SEQ ID NO: 1368561 - RNA, 18 nt, Human
cuccacaggacacccccc

SEQ ID NO: 1368562 - RNA, 24 nt, Human
cuccacaggacacccccccaagcu

SEQ ID NO: 1368563 - RNA, 18 nt, Human
cucccuccccuccaccaa

SEQ ID NO: 1368564 - RNA, 24 nt, Human
cuccugaccccccagggcccgggg

SEQ ID NO: 1368565 - RNA, 24 nt, Human
cuccuggccacacaccagccccaa

SEQ ID NO: 1368566 - RNA, 21 nt, Human
cucggggcccccagggugccc

SEQ ID NO: 1368567 - RNA, 18 nt, Human
cugcaccccaggcccaag

SEQ ID NO: 1368568 - RNA, 20 nt, Human
cugcaccccaggcccaagcc

SEQ ID NO: 1368569 - RNA, 18 nt, Human
cugcagccaacugccagg

SEQ ID NO: 1368570 - RNA, 18 nt, Human
cugccaggucuccugagg

SEQ ID NO: 1368571 - RNA, 21 nt, Human
cugcugcucaggcccagcagc

SEQ ID NO: 1368572 - RNA, 20 nt, Human
cugcuggcuaagcagguuga

SEQ ID NO: 1368573 - RNA, 23 nt, Human
cuggacacagcuggggacaggag

SEQ ID NO: 1368574 - RNA, 21 nt, Human
cuggccccuagaccuggcccc

SEQ ID NO: 1368575 - RNA, 21 nt, Human
cuggccccuagaccuggcccu

SEQ ID NO: 1368576 - RNA, 20 nt, Human
cugggggggcucccaggcag

SEQ ID NO: 1368577 - RNA, 20 nt, Human
cuguccaugcacuuccaacu

SEQ ID NO: 1368578 - RNA, 23 nt, Human
cuugagacaccaggcaacacagg

SEQ ID NO: 1368579 - RNA, 20 nt, Human
gaaacaccuccagggcaugc

SEQ ID NO: 1368580 - RNA, 24 nt, Human
gaagcccaggggcaccaagagcua

SEQ ID NO: 1368581 - RNA, 20 nt, Human
gacacagcuggggacaggag

SEQ ID NO: 1368582 - RNA, 22 nt, Human
gacacccccccaagcuuucacu

SEQ ID NO: 1368583 - RNA, 22 nt, Human
gagaugaagggaaacccugguu

SEQ ID NO: 1368584 - RNA, 20 nt, Human
gagggcagcuucagguccca

SEQ ID NO: 1368585 - RNA, 19 nt, Human
gcagcacucagaaagugcc

SEQ ID NO: 1368586 - RNA, 21 nt, Human
gcaggggcucacccuucccgc

SEQ ID NO: 1368587 - RNA, 21 nt, Human
gccaggaggaaugcagagacc

SEQ ID NO: 1368588 - RNA, 22 nt, Human
gccaggaggaaugcagagaccu

SEQ ID NO: 1368589 - RNA, 18 nt, Human
gcucucucccuccccucc

SEQ ID NO: 1368590 - RNA, 19 nt, Human
gcucucucccuccccucca

SEQ ID NO: 1368591 - RNA, 20 nt, Human
gcuggacacagcuggggaca

SEQ ID NO: 1368592 - RNA, 21 nt, Human
gcuugcucauauuuaauuagc

SEQ ID NO: 1368593 - RNA, 24 nt, Human
ggaccaaacguacccaucaaguaa

SEQ ID NO: 1368594 - RNA, 23 nt, Human
ggagccccuucugaauccugcuc

SEQ ID NO: 1368595 - RNA, 18 nt, Human
ggauguggcucccucccc

SEQ ID NO: 1368596 - RNA, 18 nt, Human
gggcccccagggugcccc

SEQ ID NO: 1368597 - RNA, 22 nt, Human
gguggacaggcuucaggguggc

SEQ ID NO: 1368598 - RNA, 27 nt, Human
guaaacccaaagaccccccaccaccca

SEQ ID NO: 1368599 - RNA, 20 nt, Human
guccccagcacacccacccc

SEQ ID NO: 1368600 - RNA, 20 nt, Human
guggaugaggggagagccuu

SEQ ID NO: 1368601 - RNA, 23 nt, Human
uaaauccccaaggaaaguucucu

SEQ ID NO: 1368602 - RNA, 18 nt, Human
uaaggcacuguccaugca

SEQ ID NO: 1368603 - RNA, 23 nt, Human
uagagggcgcccaggugauggug

SEQ ID NO: 1368604 - RNA, 21 nt, Human
uagcccccugcgcccaggcuc

SEQ ID NO: 1368605 - RNA, 18 nt, Human
uagggcauuguucacuga

SEQ ID NO: 1368606 - RNA, 21 nt, Human
uaggugacacgcacccagccc

SEQ ID NO: 1368607 - RNA, 23 nt, Human
ucaacaucauguggccaugcccc

SEQ ID NO: 1368608 - RNA, 20 nt, Human
ucacccuucccgcccagcuc

SEQ ID NO: 1368609 - RNA, 21 nt, Human
ucagaauguagcgaugacccc

SEQ ID NO: 1368610 - RNA, 19 nt, Human
uccacaggacaccccccca

SEQ ID NO: 1368611 - RNA, 23 nt, Human
uccacaggacacccccccaagcu

SEQ ID NO: 1368612 - RNA, 22 nt, Human
uccagcugcagcacgaugucgg

SEQ ID NO: 1368613 - RNA, 18 nt, Human
uccagugggcuucuaagu

SEQ ID NO: 1368614 - RNA, 18 nt, Human
uccccaaggaaaguucuc

SEQ ID NO: 1368615 - RNA, 18 nt, Human
ucccgggucacugagaug

SEQ ID NO: 1368616 - RNA, 25 nt, Human
ucccugaagcucucucccuccccuc

SEQ ID NO: 1368617 - RNA, 18 nt, Human
uccgcaugggggcccggg

SEQ ID NO: 1368618 - RNA, 22 nt, Human
uccucaugacaggucugggagg

SEQ ID NO: 1368619 - RNA, 19 nt, Human
uccuggccacacaccagcc

SEQ ID NO: 1368620 - RNA, 24 nt, Human
ucggcagccacagcaacacucaag

SEQ ID NO: 1368621 - RNA, 22 nt, Human
ucuucugccagccccucuccug

SEQ ID NO: 1368622 - RNA, 21 nt, Human
ugaaaccuuugaggcagguac

SEQ ID NO: 1368623 - RNA, 20 nt, Human
ugaacccccuguggcccacc

SEQ ID NO: 1368624 - RNA, 19 nt, Human
ugaagacccaccugcuggc

SEQ ID NO: 1368625 - RNA, 22 nt, Human
ugacccccaguaacucagaccu

SEQ ID NO: 1368626 - RNA, 21 nt, Human
ugacgccgagagcaggauggc

SEQ ID NO: 1368627 - RNA, 24 nt, Human
ugagagaacugaggcacagagcca

SEQ ID NO: 1368628 - RNA, 27 nt, Human
ugagagccaaauucagaucuggucaga

SEQ ID NO: 1368629 - RNA, 19 nt, Human
ugagaugaagggaaacccu

SEQ ID NO: 1368630 - RNA, 21 nt, Human
ugagaugaagggaaacccugg

SEQ ID NO: 1368631 - RNA, 24 nt, Human
ugaggugauucuagucucaaaaac

SEQ ID NO: 1368632 - RNA, 18 nt, Human
ugauuguguccuaugacc

SEQ ID NO: 1368633 - RNA, 20 nt, Human
ugauuuguuccagaccuuuc

SEQ ID NO: 1368634 - RNA, 19 nt, Human
ugccaggaggaaugcagag

SEQ ID NO: 1368635 - RNA, 22 nt, Human
ugccaggucuccugagugcccu

SEQ ID NO: 1368636 - RNA, 19 nt, Human
ugccccaacugccuggcua

SEQ ID NO: 1368637 - RNA, 21 nt, Human
ugccuugccaaacucaccagc

SEQ ID NO: 1368638 - RNA, 24 nt, Human
ugcucugggcaucugugccuugcc

SEQ ID NO: 1368639 - RNA, 24 nt, Human
uggcaucagcauuucugauugugu

SEQ ID NO: 1368640 - RNA, 24 nt, Human
uggcccaccuucuacaugcuccug

SEQ ID NO: 1368641 - RNA, 20 nt, Human
uggccccuagaccuggcccu

SEQ ID NO: 1368642 - RNA, 19 nt, Human
uggcuaagcagguugaggc

SEQ ID NO: 1368643 - RNA, 21 nt, Human
uggcuccuuggauggggcucc

SEQ ID NO: 1368644 - RNA, 21 nt, Human
ugggaggcuggcacuguuuuc

SEQ ID NO: 1368645 - RNA, 22 nt, Human
ugggcuucuaaguuuggggggc

SEQ ID NO: 1368646 - RNA, 22 nt, Human
uggggacagugagguggaggca

SEQ ID NO: 1368647 - RNA, 24 nt, Human
uggggacagugagguggaggcagc

SEQ ID NO: 1368648 - RNA, 24 nt, Human
uguaaacccaaagaccccccacca

SEQ ID NO: 1368649 - RNA, 18 nt, Human
uguccaugcacuuccaac

SEQ ID NO: 1368650 - RNA, 19 nt, Human
ugucguccagcugcagcac

SEQ ID NO: 1368651 - RNA, 22 nt, Human
ugucuucugccagccccucucc

SEQ ID NO: 1368652 - RNA, 18 nt, Human
uguggagacccaugcaga

SEQ ID NO: 1368653 - RNA, 19 nt, Human
uucuaaacagggucccaca

SEQ ID NO: 1368654 - RNA, 21 nt, Human
uugggauuuuucagaguuucc

SEQ ID NO: 1368655 - RNA, 18 nt, Human
uugguccgucuaccgggc

SEQ ID NO: 1368656 - RNA, 23 nt, Human
uugguccgucuaccgggccagca

SEQ ID NO: 1368657 - RNA, 24 nt, Human
uuucagaguuuccggcagaaguuc

SEQ ID NO: 1368658 - RNA, 20 nt, Human
uuuggggggcaggggcgguu

SEQ ID NO: 1368659 - RNA, 19 nt, Human
agagcaacauccagacucc

SEQ ID NO: 1368660 - RNA, 19 nt, Human
agcugccaaggagauccug

SEQ ID NO: 1368661 - RNA, 22 nt, Human
agcuuagaagaugccaucagug

SEQ ID NO: 1368662 - RNA, 21 nt, Human
caacauccagacuccagaaua

SEQ ID NO: 1368663 - RNA, 23 nt, Human
cagcacacucugucugagcaaca

SEQ ID NO: 1368664 - RNA, 18 nt, Human
caggccguccacaaacuu

SEQ ID NO: 1368665 - RNA, 25 nt, Human
cccuucuguucugagaugggggugg

SEQ ID NO: 1368666 - RNA, 22 nt, Human
ccuucuguucugagaugggggu

SEQ ID NO: 1368667 - RNA, 19 nt, Human
cucuggcuucccacccuuc

SEQ ID NO: 1368668 - RNA, 21 nt, Human
cucuggcuucccacccuucug

SEQ ID NO: 1368669 - RNA, 20 nt, Human
gaggcucuggcuucccaccc

SEQ ID NO: 1368670 - RNA, 19 nt, Human
ggcaguuaucucaucuuug

SEQ ID NO: 1368671 - RNA, 19 nt, Human
uaaaggucuuuacagagca

SEQ ID NO: 1368672 - RNA, 24 nt, Human
uagaagaugccaucagugacaaac

SEQ ID NO: 1368673 - RNA, 22 nt, Human
uccagaauacagcugccaagga

SEQ ID NO: 1368674 - RNA, 19 nt, Human
ucuguucugagaugggggu

SEQ ID NO: 1368675 - RNA, 18 nt, Human
ugagaugggggugguggg

SEQ ID NO: 1368676 - RNA, 20 nt, Human
ugagauggggguggugggca

SEQ ID NO: 1368677 - RNA, 20 nt, Human
uucaccuugaugcccagcac

SEQ ID NO: 1368678 - RNA, 24 nt, Human
aaaaaaaaagacuucacccaacua

SEQ ID NO: 1368679 - RNA, 19 nt, Human
aaaaagacuucacccaacu

SEQ ID NO: 1368680 - RNA, 24 nt, Human
aaaacaaacaaaaaaaaagacuuc

SEQ ID NO: 1368681 - RNA, 24 nt, Human
aaacaaacaaaaaaaaagacuuca

SEQ ID NO: 1368682 - RNA, 22 nt, Human
aacaagagugaaacuccgucua

SEQ ID NO: 1368683 - RNA, 23 nt, Human
aacaccccuccccugggaaacca

SEQ ID NO: 1368684 - RNA, 19 nt, Human
aacacggucaaaccccauc

SEQ ID NO: 1368685 - RNA, 20 nt, Human
aacacggucaaaccccaucu

SEQ ID NO: 1368686 - RNA, 21 nt, Human
aacacggucaaaccccaucuc

SEQ ID NO: 1368687 - RNA, 18 nt, Human
aacccuggggcagcuggc

SEQ ID NO: 1368688 - RNA, 18 nt, Human
aagcaggcgagaaucacc

SEQ ID NO: 1368689 - RNA, 20 nt, Human
aagcaggcgagaaucaccag

SEQ ID NO: 1368690 - RNA, 19 nt, Human
aaucacaaggugugggccu

SEQ ID NO: 1368691 - RNA, 21 nt, Human
acaaacaaaaaaaaagacuuc

SEQ ID NO: 1368692 - RNA, 20 nt, Human
acaagagugaaacuccgucu

SEQ ID NO: 1368693 - RNA, 26 nt, Human
acagagcccccagcaggcugucgcca

SEQ ID NO: 1368694 - RNA, 23 nt, Human
accacaccucccuugggccccaa

SEQ ID NO: 1368695 - RNA, 24 nt, Human
accaggggaagaacccuggggcag

SEQ ID NO: 1368696 - RNA, 24 nt, Human
accccaucucuacuaaaaauacaa

SEQ ID NO: 1368697 - RNA, 18 nt, Human
accucccuugggccccaa

SEQ ID NO: 1368698 - RNA, 25 nt, Human
acuccagccugggcaacaagaguga

SEQ ID NO: 1368699 - RNA, 18 nt, Human
acuucacuccagccuggg

SEQ ID NO: 1368700 - RNA, 25 nt, Human
acuucacuccagccugggcaacaag

SEQ ID NO: 1368701 - RNA, 24 nt, Human
agacaacaccccuccccugggaaa

SEQ ID NO: 1368702 - RNA, 21 nt, Human
agagugaaacuccgucuaaaa

SEQ ID NO: 1368703 - RNA, 24 nt, Human
agcacuuugggaggccgagguggg

SEQ ID NO: 1368704 - RNA, 21 nt, Human
agcaugguuugcaguaagaag

SEQ ID NO: 1368705 - RNA, 23 nt, Human
agccaggcgugguagugggugcc

SEQ ID NO: 1368706 - RNA, 22 nt, Human
agcuggggugagggguggugcc

SEQ ID NO: 1368707 - RNA, 23 nt, Human
aggaagagggggcagcccucgag

SEQ ID NO: 1368708 - RNA, 19 nt, Human
aggcagaggccuuggggau

SEQ ID NO: 1368709 - RNA, 21 nt, Human
aggccgagguggguggaucac

SEQ ID NO: 1368710 - RNA, 21 nt, Human
aggucccaagucccucugccu

SEQ ID NO: 1368711 - RNA, 24 nt, Human
agguggguggaucacgaggucagg

SEQ ID NO: 1368712 - RNA, 20 nt, Human
aguaagaagggcagagccag

SEQ ID NO: 1368713 - RNA, 27 nt, Human
aguaagaagggcagagccagggagaga

SEQ ID NO: 1368714 - RNA, 24 nt, Human
auccagggugugugggcugggaug

SEQ ID NO: 1368715 - RNA, 19 nt, Human
augaguaguggcccuccac

SEQ ID NO: 1368716 - RNA, 21 nt, Human
caaaaaaaaagacuucaccca

SEQ ID NO: 1368717 - RNA, 24 nt, Human
cacaccuauaaucccagcacuuug

SEQ ID NO: 1368718 - RNA, 22 nt, Human
cacagaaaacucagcagccuaa

SEQ ID NO: 1368719 - RNA, 26 nt, Human
cacagaaaacucagcagccuaaaccg

SEQ ID NO: 1368720 - RNA, 25 nt, Human
caccaagauccgucagaagcagcag

SEQ ID NO: 1368721 - RNA, 21 nt, Human
cacccaacuaacugugcuugu

SEQ ID NO: 1368722 - RNA, 18 nt, Human
caccccuccccugggaaa

SEQ ID NO: 1368723 - RNA, 27 nt, Human
caccuacagaacauuaagaugccagca

SEQ ID NO: 1368724 - RNA, 19 nt, Human
caccuauaaucccagcacu

SEQ ID NO: 1368725 - RNA, 24 nt, Human
caccuauaaucccagcacuuuggg

SEQ ID NO: 1368726 - RNA, 22 nt, Human
caccucccuugggccccaaccc

SEQ ID NO: 1368727 - RNA, 23 nt, Human
cacuccagccugggcaacaagag

SEQ ID NO: 1368728 - RNA, 24 nt, Human
cacuccagccugggcaacaagagu

SEQ ID NO: 1368729 - RNA, 25 nt, Human
cacuccagccugggcaacaagagug

SEQ ID NO: 1368730 - RNA, 24 nt, Human
cacuucacuccagccugggcaaca

SEQ ID NO: 1368731 - RNA, 20 nt, Human
cagagcucaggcugggcugu

SEQ ID NO: 1368732 - RNA, 24 nt, Human
cagcacuuugggaggccgaggugg

SEQ ID NO: 1368733 - RNA, 23 nt, Human
cagcaggcagcuggggugagggg

SEQ ID NO: 1368734 - RNA, 25 nt, Human
cagccccauucucccaggucccaag

SEQ ID NO: 1368735 - RNA, 21 nt, Human
cagccuaaaccgaccauggaa

SEQ ID NO: 1368736 - RNA, 23 nt, Human
cagcuggcuugucccagccaugc

SEQ ID NO: 1368737 - RNA, 23 nt, Human
caggccaagcuucucagagccac

SEQ ID NO: 1368738 - RNA, 24 nt, Human
caguaagaagggcagagccaggga

SEQ ID NO: 1368739 - RNA, 25 nt, Human
cauucuguguucugcaggcuggaag

SEQ ID NO: 1368740 - RNA, 20 nt, Human
ccacuucacuccagccuggg

SEQ ID NO: 1368741 - RNA, 22 nt, Human
ccacuucacuccagccugggca

SEQ ID NO: 1368742 - RNA, 23 nt, Human
ccacuucacuccagccugggcaa

SEQ ID NO: 1368743 - RNA, 24 nt, Human
ccacuucacuccagccugggcaac

SEQ ID NO: 1368744 - RNA, 20 nt, Human
cccacagccaggaauggagc

SEQ ID NO: 1368745 - RNA, 27 nt, Human
cccagccuugcccccauuaccgguucc

SEQ ID NO: 1368746 - RNA, 22 nt, Human
cccagcuccaggacgccggggc

SEQ ID NO: 1368747 - RNA, 18 nt, Human
ccccagaugacaccacac

SEQ ID NO: 1368748 - RNA, 24 nt, Human
ccccagaugacaccacaccucccu

SEQ ID NO: 1368749 - RNA, 18 nt, Human
ccccagcaggcugucgcc

SEQ ID NO: 1368750 - RNA, 19 nt, Human
ccccauucucccagguccc

SEQ ID NO: 1368751 - RNA, 22 nt, Human
cccccagcuccaggacgccggg

SEQ ID NO: 1368752 - RNA, 22 nt, Human
cccgaagccuccucucagcccc

SEQ ID NO: 1368753 - RNA, 24 nt, Human
ccgaagccuccucucagccccauu

SEQ ID NO: 1368754 - RNA, 23 nt, Human
ccuaaaccgaccauggaagaggc

SEQ ID NO: 1368755 - RNA, 21 nt, Human
ccuccagcgcgcaguagaggc

SEQ ID NO: 1368756 - RNA, 19 nt, Human
ccugagugcaccaaauaug

SEQ ID NO: 1368757 - RNA, 20 nt, Human
ccugcugccugcccaggucu

SEQ ID NO: 1368758 - RNA, 24 nt, Human
ccuggcuaacacggucaaacccca

SEQ ID NO: 1368759 - RNA, 22 nt, Human
ccuguagucccagcuacuaggg

SEQ ID NO: 1368760 - RNA, 24 nt, Human
ccuugggccccaacccgaagccuc

SEQ ID NO: 1368761 - RNA, 24 nt, Human
cgagaccauccuggcuaacacggu

SEQ ID NO: 1368762 - RNA, 24 nt, Human
cgagguggguggaucacgagguca

SEQ ID NO: 1368763 - RNA, 18 nt, Human
cuaaaacaaacaaaaaaa

SEQ ID NO: 1368764 - RNA, 19 nt, Human
cuaaaacaaacaaaaaaaa

SEQ ID NO: 1368765 - RNA, 24 nt, Human
cuaaaacaaacaaaaaaaaagacu

SEQ ID NO: 1368766 - RNA, 22 nt, Human
cucacaccuauaaucccagcac

SEQ ID NO: 1368767 - RNA, 24 nt, Human
cucacaccuauaaucccagcacuu

SEQ ID NO: 1368768 - RNA, 22 nt, Human
cuccagcgcgcaguagaggccc

SEQ ID NO: 1368769 - RNA, 23 nt, Human
cuccccagaugacaccacaccuc

SEQ ID NO: 1368770 - RNA, 21 nt, Human
cuccucucagccccauucucc

SEQ ID NO: 1368771 - RNA, 23 nt, Human
cucgggggagucuggggacaguc

SEQ ID NO: 1368772 - RNA, 24 nt, Human
cucucagccccauucucccagguc

SEQ ID NO: 1368773 - RNA, 19 nt, Human
cucuugacuagaccccaca

SEQ ID NO: 1368774 - RNA, 19 nt, Human
cugcccuuccagacaacac

SEQ ID NO: 1368775 - RNA, 18 nt, Human
cuggcuaacacggucaaa

SEQ ID NO: 1368776 - RNA, 23 nt, Human
cuggcuaacacggucaaacccca

SEQ ID NO: 1368777 - RNA, 19 nt, Human
cuuccagacaacaccccuc

SEQ ID NO: 1368778 - RNA, 19 nt, Human
gaaguaaacaucaucuucu

SEQ ID NO: 1368779 - RNA, 19 nt, Human
gacgccggggcuggcaggu

SEQ ID NO: 1368780 - RNA, 18 nt, Human
gagaggcagaggccuugg

SEQ ID NO: 1368781 - RNA, 18 nt, Human
gagguugcagugagccaa

SEQ ID NO: 1368782 - RNA, 19 nt, Human
gagguugcagugagccaag

SEQ ID NO: 1368783 - RNA, 19 nt, Human
gaugagaaagcaggcgaga

SEQ ID NO: 1368784 - RNA, 20 nt, Human
gccacagagcccccagcagg

SEQ ID NO: 1368785 - RNA, 22 nt, Human
gccacuucacuccagccugggc

SEQ ID NO: 1368786 - RNA, 21 nt, Human
gccagcaaccggcccggcgcg

SEQ ID NO: 1368787 - RNA, 19 nt, Human
gccuaaaccgaccauggaa

SEQ ID NO: 1368788 - RNA, 23 nt, Human
gccucugacucaugaaaucccgg

SEQ ID NO: 1368789 - RNA, 24 nt, Human
gccuggagguugcagugagccaag

SEQ ID NO: 1368790 - RNA, 21 nt, Human
gcuacuagggaggcugaggcu

SEQ ID NO: 1368791 - RNA, 19 nt, Human
gcugcagaagcacauccug

SEQ ID NO: 1368792 - RNA, 22 nt, Human
gcugcaucugaaccugcccuuc

SEQ ID NO: 1368793 - RNA, 18 nt, Human
ggaagcacagaaaacuca

SEQ ID NO: 1368794 - RNA, 19 nt, Human
ggagagccaggcagccuga

SEQ ID NO: 1368795 - RNA, 24 nt, Human
ggaggcugaggcuggccuggaggu

SEQ ID NO: 1368796 - RNA, 20 nt, Human
ggagguugcagugagccaag

SEQ ID NO: 1368797 - RNA, 20 nt, Human
ggagguugcagugagccaag

SEQ ID NO: 1368798 - RNA, 24 nt, Human
ggagguugcagugagccaagguca

SEQ ID NO: 1368799 - RNA, 24 nt, Human
ggcaccuuguguuuauuggaaaua

SEQ ID NO: 1368800 - RNA, 21 nt, Human
ggcccggcgcgguggcucaca

SEQ ID NO: 1368801 - RNA, 18 nt, Human
ggccugagccugcugccu

SEQ ID NO: 1368802 - RNA, 21 nt, Human
ggccuggagguugcagugagc

SEQ ID NO: 1368803 - RNA, 20 nt, Human
ggcgacaggagaggcccugc

SEQ ID NO: 1368804 - RNA, 21 nt, Human
ggcucacaccuauaaucccag

SEQ ID NO: 1368805 - RNA, 25 nt, Human
ggcuggaagcauggggcaggcugcu

SEQ ID NO: 1368806 - RNA, 21 nt, Human
ggcugucgccacuugugucca

SEQ ID NO: 1368807 - RNA, 22 nt, Human
ggggaagaacccuggggcagcu

SEQ ID NO: 1368808 - RNA, 20 nt, Human
ggggagucgggacuuccagg

SEQ ID NO: 1368809 - RNA, 21 nt, Human
ggggcuggcaggucugggggg

SEQ ID NO: 1368810 - RNA, 20 nt, Human
ggucccaagucccucugccu

SEQ ID NO: 1368811 - RNA, 22 nt, Human
ggugagggguggugccucugac

SEQ ID NO: 1368812 - RNA, 21 nt, Human
gguggaucacgaggucaggag

SEQ ID NO: 1368813 - RNA, 24 nt, Human
gguggauccacaaggcgggcuccc

SEQ ID NO: 1368814 - RNA, 24 nt, Human
gucacgccacuucacuccagccug

SEQ ID NO: 1368815 - RNA, 22 nt, Human
gugggcugggaugccccagccu

SEQ ID NO: 1368816 - RNA, 23 nt, Human
uaaggcacagcaugguuugcagu

SEQ ID NO: 1368817 - RNA, 18 nt, Human
uagaccccacagccagga

SEQ ID NO: 1368818 - RNA, 22 nt, Human
uagaccccacagccaggacccu

SEQ ID NO: 1368819 - RNA, 22 nt, Human
uagcccccagcuccaggacgcc

SEQ ID NO: 1368820 - RNA, 25 nt, Human
uaggcugcagaagcacauccugugu

SEQ ID NO: 1368821 - RNA, 24 nt, Human
uagugggugccuguagucccagcu

SEQ ID NO: 1368822 - RNA, 18 nt, Human
ucaccaggggaagaaccc

SEQ ID NO: 1368823 - RNA, 18 nt, Human
ucacgaggucaggagauc

SEQ ID NO: 1368824 - RNA, 24 nt, Human
ucacgaggucaggagaucgagacc

SEQ ID NO: 1368825 - RNA, 20 nt, Human
ucacucggagagccaggcag

SEQ ID NO: 1368826 - RNA, 18 nt, Human
uccacaaggcgggcuccc

SEQ ID NO: 1368827 - RNA, 24 nt, Human
uccagacaacaccccuccccuggg

SEQ ID NO: 1368828 - RNA, 22 nt, Human
ucccacccagagcucaggcugg

SEQ ID NO: 1368829 - RNA, 23 nt, Human
ucccacccagagcucaggcuggg

SEQ ID NO: 1368830 - RNA, 22 nt, Human
uccccagaugacaccacaccuu

SEQ ID NO: 1368831 - RNA, 20 nt, Human
uccccugggaaaccaauggg

SEQ ID NO: 1368832 - RNA, 25 nt, Human
uccuccaggaucuugugguccucca

SEQ ID NO: 1368833 - RNA, 23 nt, Human
ucgguggggugugguggauccac

SEQ ID NO: 1368834 - RNA, 24 nt, Human
ucucgggggagucuggggacaguc

SEQ ID NO: 1368835 - RNA, 19 nt, Human
ucucuacuaaaaauacaaa

SEQ ID NO: 1368836 - RNA, 18 nt, Human
ucuuucuguggccuugcu

SEQ ID NO: 1368837 - RNA, 25 nt, Human
ugacaccacaccucccuugggcccc

SEQ ID NO: 1368838 - RNA, 22 nt, Human
ugagaaagcaggcgagaaucaa

SEQ ID NO: 1368839 - RNA, 20 nt, Human
ugagccugcugccugcccag

SEQ ID NO: 1368840 - RNA, 23 nt, Human
ugaggcuggccuggagguugccg

SEQ ID NO: 1368841 - RNA, 19 nt, Human
ugaguaguggcccuccacu

SEQ ID NO: 1368842 - RNA, 24 nt, Human
ugagugcaccaaauauggaggcug

SEQ ID NO: 1368843 - RNA, 22 nt, Human
ugaguuggcagcaguggcauau

SEQ ID NO: 1368844 - RNA, 19 nt, Human
ugaucccacugguucuugg

SEQ ID NO: 1368845 - RNA, 20 nt, Human
ugccggggcuggcaggucuc

SEQ ID NO: 1368846 - RNA, 24 nt, Human
ugccucuaaaucuggaaggcugca

SEQ ID NO: 1368847 - RNA, 21 nt, Human
ugccucugacucaugaaaucc

SEQ ID NO: 1368848 - RNA, 23 nt, Human
ugccuguagucccagcuacuagg

SEQ ID NO: 1368849 - RNA, 24 nt, Human
ugccuguagucccagcuacuaggg

SEQ ID NO: 1368850 - RNA, 23 nt, Human
uggaagaggcugagaggcagagg

SEQ ID NO: 1368851 - RNA, 20 nt, Human
uggagguugcagugagccaa

SEQ ID NO: 1368852 - RNA, 21 nt, Human
uggagguugcagugagccaag

SEQ ID NO: 1368853 - RNA, 22 nt, Human
uggcagcaguggcauaucauag

SEQ ID NO: 1368854 - RNA, 22 nt, Human
uggcucacaccuauaaucccag

SEQ ID NO: 1368855 - RNA, 24 nt, Human
uggcucacaccuauaaucccagca

SEQ ID NO: 1368856 - RNA, 23 nt, Human
ugggaggccgagguggguggauc

SEQ ID NO: 1368857 - RNA, 24 nt, Human
ugggaggccgagguggguggauca

SEQ ID NO: 1368858 - RNA, 25 nt, Human
ugggcgccuccacucagccacuguc

SEQ ID NO: 1368859 - RNA, 18 nt, Human
uggggcaggcugcuuucc

SEQ ID NO: 1368860 - RNA, 21 nt, Human
ugggggcagaggaugaguugg

SEQ ID NO: 1368861 - RNA, 24 nt, Human
ugggggcagaggaugaguuggcag

SEQ ID NO: 1368862 - RNA, 22 nt, Human
uggggugagggguggugccucu

SEQ ID NO: 1368863 - RNA, 24 nt, Human
ugguagugggugccuguaguccca

SEQ ID NO: 1368864 - RNA, 21 nt, Human
uguagaaagagguugcauccc

SEQ ID NO: 1368865 - RNA, 21 nt, Human
uguccucccagugccucuaaa

SEQ ID NO: 1368866 - RNA, 19 nt, Human
ugugggcugggaugcccca

SEQ ID NO: 1368867 - RNA, 18 nt, Human
ugugguggauccacaagg

SEQ ID NO: 1368868 - RNA, 23 nt, Human
uguguagcuuaugcagcuucuag

SEQ ID NO: 1368869 - RNA, 21 nt, Human
uucccacccagagcucaggcu

SEQ ID NO: 1368870 - RNA, 22 nt, Human
uucugcaggcuggaagcauggg

SEQ ID NO: 1368871 - RNA, 18 nt, Human
uucuguggccuugcuggg

SEQ ID NO: 1368872 - RNA, 21 nt, Human
uucuguguucugcaggcugga

SEQ ID NO: 1368873 - RNA, 22 nt, Human
uugacuagaccccacagccagg

SEQ ID NO: 1368874 - RNA, 20 nt, Human
uugcagugagccaaggucac

SEQ ID NO: 1368875 - RNA, 19 nt, Human
uuggaaauauuccaccuac

SEQ ID NO: 1368876 - RNA, 19 nt, Human
uuggaaauauuccaccuca

SEQ ID NO: 1368877 - RNA, 25 nt, Human
uugggaggccgagguggguggauca

SEQ ID NO: 1368878 - RNA, 19 nt, Human
uugggccccaacccgaagc

SEQ ID NO: 1368879 - RNA, 22 nt, Human
aaaagcaacuguccuaaaaaac

SEQ ID NO: 1368880 - RNA, 26 nt, Human
aaagaaaaaaaagcaacuguccuaaa

SEQ ID NO: 1368881 - RNA, 19 nt, Human
aaagugccgggauuacagg

SEQ ID NO: 1368882 - RNA, 23 nt, Human
aaagugccgggauuacaggcauu

SEQ ID NO: 1368883 - RNA, 19 nt, Human
aaagugcugggauuacagg

SEQ ID NO: 1368884 - RNA, 24 nt, Human
aaagugcugggauuacaggcuuga

SEQ ID NO: 1368885 - RNA, 22 nt, Human
aaauaaccccaaaaccauaccc

SEQ ID NO: 1368886 - RNA, 25 nt, Human
aaauaaccccaaaaccauacccaaa

SEQ ID NO: 1368887 - RNA, 20 nt, Human
aaccaaauaaccccaaaacc

SEQ ID NO: 1368888 - RNA, 20 nt, Human
aaccaaauaaccccaaaacc

SEQ ID NO: 1368889 - RNA, 21 nt, Human
aaccaaauaaccccaaaacca

SEQ ID NO: 1368890 - RNA, 23 nt, Human
aaccaaauaaccccaaaaccaua

SEQ ID NO: 1368891 - RNA, 22 nt, Human
aaccuccugccucccaguaccc

SEQ ID NO: 1368892 - RNA, 22 nt, Human
aaccuuagcugcaaaaccuaaa

SEQ ID NO: 1368893 - RNA, 22 nt, Human
aacugcacacagcugaagaaaa

SEQ ID NO: 1368894 - RNA, 22 nt, Human
aagcaacauagugagaucccaa

SEQ ID NO: 1368895 - RNA, 22 nt, Human
aagcagcacaaccacuuaaacc

SEQ ID NO: 1368896 - RNA, 22 nt, Human
aaggccuuucaucccaucccca

SEQ ID NO: 1368897 - RNA, 20 nt, Human
aagggccauccauaccagca

SEQ ID NO: 1368898 - RNA, 19 nt, Human
aagugcugggauuacaggc

SEQ ID NO: 1368899 - RNA, 19 nt, Human
aagugcugggauuacaggc

SEQ ID NO: 1368900 - RNA, 26 nt, Human
aagugcugggauuacaggcuugagcc

SEQ ID NO: 1368901 - RNA, 22 nt, Human
acaaccaaauaaccccaaaacc

SEQ ID NO: 1368902 - RNA, 24 nt, Human
acaggguauugcuauguuggccag

SEQ ID NO: 1368903 - RNA, 19 nt, Human
acagguuuucuucaaauag

SEQ ID NO: 1368904 - RNA, 21 nt, Human
accauacccaaaaauacacug

SEQ ID NO: 1368905 - RNA, 24 nt, Human
acccaggcuggagugcaguggcau

SEQ ID NO: 1368906 - RNA, 23 nt, Human
accccaaaaccauacccaaaaau

SEQ ID NO: 1368907 - RNA, 25 nt, Human
acccgccucaaccucccaaagugcc

SEQ ID NO: 1368908 - RNA, 20 nt, Human
accuggcacaguggcucaca

SEQ ID NO: 1368909 - RNA, 21 nt, Human
acgccaggcuaauuuuuguau

SEQ ID NO: 1368910 - RNA, 25 nt, Human
acucugucacccaggcuggagugca

SEQ ID NO: 1368911 - RNA, 21 nt, Human
acugaacuccagccuggacug

SEQ ID NO: 1368912 - RNA, 19 nt, Human
acugcacacagcugaagaa

SEQ ID NO: 1368913 - RNA, 22 nt, Human
acuguagucccagcuacucugg

SEQ ID NO: 1368914 - RNA, 22 nt, Human
agaggacuucucacuccuguaa

SEQ ID NO: 1368915 - RNA, 23 nt, Human
agcagcacaaccacuuaaacccc

SEQ ID NO: 1368916 - RNA, 24 nt, Human
aggauggcaugaggccaggaguuc

SEQ ID NO: 1368917 - RNA, 19 nt, Human
aggcuggagugcaguggca

SEQ ID NO: 1368918 - RNA, 18 nt, Human
aggugauccacccgccuc

SEQ ID NO: 1368919 - RNA, 19 nt, Human
agguguucaaggcugcagu

SEQ ID NO: 1368920 - RNA, 21 nt, Human
agguucaagugauucuccugc

SEQ ID NO: 1368921 - RNA, 22 nt, Human
agguucaagugauucuccugcc

SEQ ID NO: 1368922 - RNA, 23 nt, Human
agguucaagugauucuccugccu

SEQ ID NO: 1368923 - RNA, 22 nt, Human
aguagagguaggguuucgccau

SEQ ID NO: 1368924 - RNA, 18 nt, Human
aguagcugggauuacaga

SEQ ID NO: 1368925 - RNA, 24 nt, Human
agugauucuccugccucagccucc

SEQ ID NO: 1368926 - RNA, 20 nt, Human
agugcaguggcauggucucg

SEQ ID NO: 1368927 - RNA, 23 nt, Human
agugcaguggcauggucucggcu

SEQ ID NO: 1368928 - RNA, 24 nt, Human
agugcaguggcauggucucggcuc

SEQ ID NO: 1368929 - RNA, 24 nt, Human
aguggcauggucucggcucacugc

SEQ ID NO: 1368930 - RNA, 22 nt, Human
aucccauccccacuucccuuca

SEQ ID NO: 1368931 - RNA, 21 nt, Human
auccuaagaauuaaagagaau

SEQ ID NO: 1368932 - RNA, 19 nt, Human
auuacaggugccugccacc

SEQ ID NO: 1368933 - RNA, 18 nt, Human
auucuccugccucagccu

SEQ ID NO: 1368934 - RNA, 24 nt, Human
auuuuuguauuuuuaguagaggua

SEQ ID NO: 1368935 - RNA, 19 nt, Human
auuuuuuuuuuuuaccuug

SEQ ID NO: 1368936 - RNA, 21 nt, Human
caaacuggaccuagagacuag

SEQ ID NO: 1368937 - RNA, 26 nt, Human
caaagugccgggauuacaggcauuuu

SEQ ID NO: 1368938 - RNA, 24 nt, Human
caaagugcugggauuacaggcuug

SEQ ID NO: 1368939 - RNA, 25 nt, Human
caaauaaccccaaaaccauacccaa

SEQ ID NO: 1368940 - RNA, 24 nt, Human
caacaggcaaaaaaauauauacaa

SEQ ID NO: 1368941 - RNA, 24 nt, Human
caacaucccaagaaaaagaguaac

SEQ ID NO: 1368942 - RNA, 19 nt, Human
caaccaaauaaccccaaaa

SEQ ID NO: 1368943 - RNA, 22 nt, Human
caaccaaauaaccccaaaacca

SEQ ID NO: 1368944 - RNA, 24 nt, Human
caacucagccucccaaagugcugg

SEQ ID NO: 1368945 - RNA, 23 nt, Human
caacugcuuaauaggcaucaccc

SEQ ID NO: 1368946 - RNA, 24 nt, Human
caagaggauggcaugaggccagga

SEQ ID NO: 1368947 - RNA, 22 nt, Human
caagcaauucuccugccuuagc

SEQ ID NO: 1368948 - RNA, 20 nt, Human
caagugauucuccugccuca

SEQ ID NO: 1368949 - RNA, 22 nt, Human
caagugauucuccugccucagc

SEQ ID NO: 1368950 - RNA, 26 nt, Human
cacagcugaagaaaaaagaaaaaaaa

SEQ ID NO: 1368951 - RNA, 24 nt, Human
caccaagcuuggguaauuuuugua

SEQ ID NO: 1368952 - RNA, 24 nt, Human
caccacgccaggcuaauuuuugua

SEQ ID NO: 1368953 - RNA, 23 nt, Human
cacccgccucaaccucccaaagu

SEQ ID NO: 1368954 - RNA, 18 nt, Human
cacuacaacuuccuucag

SEQ ID NO: 1368955 - RNA, 22 nt, Human
cacucugucacccaggcuggag

SEQ ID NO: 1368956 - RNA, 23 nt, Human
cacucugucacccaggcuggagu

SEQ ID NO: 1368957 - RNA, 25 nt, Human
cacugaacuccagccuggacuguga

SEQ ID NO: 1368958 - RNA, 21 nt, Human
cacugcaaccuccgccucccg

SEQ ID NO: 1368959 - RNA, 23 nt, Human
cacugcaaccuccgccucccggg

SEQ ID NO: 1368960 - RNA, 21 nt, Human
cagcacaaccacuuaaacccc

SEQ ID NO: 1368961 - RNA, 20 nt, Human
cagccuccugaguagcuggg

SEQ ID NO: 1368962 - RNA, 19 nt, Human
caggaucuuccacucauuu

SEQ ID NO: 1368963 - RNA, 24 nt, Human
caggguauugcuauguuggccagg

SEQ ID NO: 1368964 - RNA, 19 nt, Human
caggugccugccaccacgc

SEQ ID NO: 1368965 - RNA, 21 nt, Human
cauagcaacaugagaagcagg

SEQ ID NO: 1368966 - RNA, 24 nt, Human
cauagugagaucccaacucuaaaa

SEQ ID NO: 1368967 - RNA, 24 nt, Human
cauguuggccaggcugggcucgaa

SEQ ID NO: 1368968 - RNA, 24 nt, Human
ccaaagugccgggauuacaggcau

SEQ ID NO: 1368969 - RNA, 19 nt, Human
ccaaagugcugggauuaca

SEQ ID NO: 1368970 - RNA, 22 nt, Human
ccaaagugcugggauuacaggc

SEQ ID NO: 1368971 - RNA, 23 nt, Human
ccaaagugcugggauuacaggcu

SEQ ID NO: 1368972 - RNA, 20 nt, Human
ccaaauaaccccaaaaccau

SEQ ID NO: 1368973 - RNA, 20 nt, Human
ccaagaaaaagaguaacuuc

SEQ ID NO: 1368974 - RNA, 19 nt, Human
ccacaguaacuuaagaucu

SEQ ID NO: 1368975 - RNA, 22 nt, Human
ccacccaacucagccucccaaa

SEQ ID NO: 1368976 - RNA, 26 nt, Human
ccacccgccucaaccucccaaagugc

SEQ ID NO: 1368977 - RNA, 19 nt, Human
ccacugaacuccagccugg

SEQ ID NO: 1368978 - RNA, 19 nt, Human
ccacugaacuccagccugg

SEQ ID NO: 1368979 - RNA, 21 nt, Human
ccacugaacuccagccuggac

SEQ ID NO: 1368980 - RNA, 26 nt, Human
ccacuggacauaaccguaauuuguau

SEQ ID NO: 1368981 - RNA, 22 nt, Human
ccauguuggccaggcugggcuc

SEQ ID NO: 1368982 - RNA, 21 nt, Human
cccaaaaccauacccaaaaau

SEQ ID NO: 1368983 - RNA, 24 nt, Human
cccaaagugcugggauuacaggcu

SEQ ID NO: 1368984 - RNA, 20 nt, Human
cccagguucaagugauucuc

SEQ ID NO: 1368985 - RNA, 23 nt, Human
cccagguucaagugauucuccuc

SEQ ID NO: 1368986 - RNA, 22 nt, Human
cccauccccacuucccuucaga

SEQ ID NO: 1368987 - RNA, 19 nt, Human
ccccaaaaccauacccaaa

SEQ ID NO: 1368988 - RNA, 23 nt, Human
ccccaaaaccauacccaaaaaua

SEQ ID NO: 1368989 - RNA, 23 nt, Human
cccggguucaagcaauucuccug

SEQ ID NO: 1368990 - RNA, 24 nt, Human
ccgcccagguucaagugauucucc

SEQ ID NO: 1368991 - RNA, 27 nt, Human
ccgccucccggguucaagcaauucuuu

SEQ ID NO: 1368992 - RNA, 18 nt, Human
ccucccaguacccaggau

SEQ ID NO: 1368993 - RNA, 24 nt, Human
ccucccggguucaagcaauucucc

SEQ ID NO: 1368994 - RNA, 22 nt, Human
ccugaccucaggugauccaccc

SEQ ID NO: 1368995 - RNA, 26 nt, Human
ccugaccucaggugauccacccgccu

SEQ ID NO: 1368996 - RNA, 19 nt, Human
ccugaguagcugggauuac

SEQ ID NO: 1368997 - RNA, 23 nt, Human
ccugccucagccuccugaguagc

SEQ ID NO: 1368998 - RNA, 24 nt, Human
ccugccucagccuccugaguagcu

SEQ ID NO: 1368999 - RNA, 19 nt, Human
ccugcguaguugggauuac

SEQ ID NO: 1369000 - RNA, 22 nt, Human
ccugcguaguugggauuacagg

SEQ ID NO: 1369001 - RNA, 24 nt, Human
ccugcguaguugggauuacaggug

SEQ ID NO: 1369002 - RNA, 24 nt, Human
cgacuguagucccagcuacucugg

SEQ ID NO: 1369003 - RNA, 27 nt, Human
cgccauguuggccaggcugggcucgaa

SEQ ID NO: 1369004 - RNA, 24 nt, Human
cgccucaaccucccaaagugccgg

SEQ ID NO: 1369005 - RNA, 30 nt, Human
cgggauuacaggcauuuuaacaacaaccaa

SEQ ID NO: 1369006 - RNA, 25 nt, Human
cguaguugggauuacaggugccugc

SEQ ID NO: 1369007 - RNA, 22 nt, Human
cuacaauaccagcugaggcaag

SEQ ID NO: 1369008 - RNA, 18 nt, Human
cuagccaaggccucugca

SEQ ID NO: 1369009 - RNA, 27 nt, Human
cuauaaaauaccuaaaaacuuguuuuc

SEQ ID NO: 1369010 - RNA, 20 nt, Human
cucaccaugcaagagaggac

SEQ ID NO: 1369011 - RNA, 22 nt, Human
cucacuccuguaaacucaaaua

SEQ ID NO: 1369012 - RNA, 24 nt, Human
cucacucugucacccaggcuggag

SEQ ID NO: 1369013 - RNA, 24 nt, Human
cucacugcaaccuccgccucccgg

SEQ ID NO: 1369014 - RNA, 18 nt, Human
cucacugcaaccuuugcc

SEQ ID NO: 1369015 - RNA, 23 nt, Human
cucagccuccugaguagcuggga

SEQ ID NO: 1369016 - RNA, 22 nt, Human
cuccugccucagccuccugagu

SEQ ID NO: 1369017 - RNA, 21 nt, Human
cugaagaaaaaagaaaaaaaa

SEQ ID NO: 1369018 - RNA, 23 nt, Human
cugcaaccuccgccucccggguu

SEQ ID NO: 1369019 - RNA, 24 nt, Human
cugcaaccuccgccucccggguuc

SEQ ID NO: 1369020 - RNA, 24 nt, Human
cugcaaccuuugccgcccagguuc

SEQ ID NO: 1369021 - RNA, 19 nt, Human
cuggagugcaguggcaugg

SEQ ID NO: 1369022 - RNA, 21 nt, Human
cuuucaucccauccccacuuc

SEQ ID NO: 1369023 - RNA, 19 nt, Human
cuuugagacaggguauugc

SEQ ID NO: 1369024 - RNA, 19 nt, Human
gaaaucgaaaagucuagug

SEQ ID NO: 1369025 - RNA, 24 nt, Human
gaccucaggugauccacccgccuc

SEQ ID NO: 1369026 - RNA, 24 nt, Human
gaguagcugggauuacagacacac

SEQ ID NO: 1369027 - RNA, 22 nt, Human
gaucaacugaggucaacauccc

SEQ ID NO: 1369028 - RNA, 24 nt, Human
gauggcaugaggccaggaguucaa

SEQ ID NO: 1369029 - RNA, 24 nt, Human
gaugucaggugauccacccaacuc

SEQ ID NO: 1369030 - RNA, 18 nt, Human
gauuacagacacacacca

SEQ ID NO: 1369031 - RNA, 18 nt, Human
gauuacaggcuugagcca

SEQ ID NO: 1369032 - RNA, 21 nt, Human
gauuacaggcuugagccacca

SEQ ID NO: 1369033 - RNA, 24 nt, Human
gauuacaggcuugagccaccauac

SEQ ID NO: 1369034 - RNA, 18 nt, Human
gauuacaggugccugcca

SEQ ID NO: 1369035 - RNA, 24 nt, Human
gcaugaggccaggaguucaagacc

SEQ ID NO: 1369036 - RNA, 24 nt, Human
gcccagguucaagugauucuccug

SEQ ID NO: 1369037 - RNA, 19 nt, Human
gcuauguuggccaggcuag

SEQ ID NO: 1369038 - RNA, 24 nt, Human
gcucagguguucaaggcugcagug

SEQ ID NO: 1369039 - RNA, 19 nt, Human
gcuggagugcaguggcaug

SEQ ID NO: 1369040 - RNA, 21 nt, Human
gcugggauuacaggcuugagc

SEQ ID NO: 1369041 - RNA, 23 nt, Human
gcugggcucgaacuccugaccuc

SEQ ID NO: 1369042 - RNA, 24 nt, Human
ggagugccauuggcgcgaucucgg

SEQ ID NO: 1369043 - RNA, 19 nt, Human
ggauuacaggcuugagcca

SEQ ID NO: 1369044 - RNA, 19 nt, Human
ggccaggcugggcucgaac

SEQ ID NO: 1369045 - RNA, 24 nt, Human
ggcugggcucgaacuccugaccuc

SEQ ID NO: 1369046 - RNA, 22 nt, Human
ggguauugcuauguuggccagg

SEQ ID NO: 1369047 - RNA, 21 nt, Human
ggguuucgccauguuggccag

SEQ ID NO: 1369048 - RNA, 22 nt, Human
ggguuucgccauguuggccagg

SEQ ID NO: 1369049 - RNA, 23 nt, Human
guaaacacuaaguaacucaaaug

SEQ ID NO: 1369050 - RNA, 18 nt, Human
guaggguuucgccauguu

SEQ ID NO: 1369051 - RNA, 23 nt, Human
guaggguuucgccauguuggcca

SEQ ID NO: 1369052 - RNA, 24 nt, Human
guaggguuucgccauguuggccag

SEQ ID NO: 1369053 - RNA, 18 nt, Human
guaguaaacaagugcugg

SEQ ID NO: 1369054 - RNA, 20 nt, Human
guaguugggauuacaggugc

SEQ ID NO: 1369055 - RNA, 29 nt, Human
gucacuuggugauaccacuggggugugcc

SEQ ID NO: 1369056 - RNA, 24 nt, Human
gugauccacccaacucagccuccc

SEQ ID NO: 1369057 - RNA, 24 nt, Human
gugauccacccgccucaaccuccc

SEQ ID NO: 1369058 - RNA, 23 nt, Human
gugauucuccugccucagccucc

SEQ ID NO: 1369059 - RNA, 23 nt, Human
uaaaaccugaucaacugagguca

SEQ ID NO: 1369060 - RNA, 20 nt, Human
uaaauggcuucuuuguucca

SEQ ID NO: 1369061 - RNA, 24 nt, Human
uaacaggccauauuuaauuaaaaa

SEQ ID NO: 1369062 - RNA, 20 nt, Human
uaaccaacaccagucaaugc

SEQ ID NO: 1369063 - RNA, 19 nt, Human
uaauuuaaaagauggaaaa

SEQ ID NO: 1369064 - RNA, 23 nt, Human
uaauuuuuguauuuuuaguagag

SEQ ID NO: 1369065 - RNA, 19 nt, Human
uacaauaccagcugaggca

SEQ ID NO: 1369066 - RNA, 22 nt, Human
uacaggcuugagccaccauacc

SEQ ID NO: 1369067 - RNA, 24 nt, Human
uacaggugccugccaccacgccag

SEQ ID NO: 1369068 - RNA, 18 nt, Human
uacccaggaucuuccacu

SEQ ID NO: 1369069 - RNA, 22 nt, Human
uagaaaacuaaaauuagccagg

SEQ ID NO: 1369070 - RNA, 22 nt, Human
uagagguaggguuucgccaugu

SEQ ID NO: 1369071 - RNA, 21 nt, Human
uagcugcaaaaccuaaaaauc

SEQ ID NO: 1369072 - RNA, 24 nt, Human
uaggguuucgccauguuggccagg

SEQ ID NO: 1369073 - RNA, 24 nt, Human
uaguagagguaggguuucgccaug

SEQ ID NO: 1369074 - RNA, 21 nt, Human
uauaaaauaccuaaaaacuug

SEQ ID NO: 1369075 - RNA, 24 nt, Human
uauguuggccaggcuagucucaaa

SEQ ID NO: 1369076 - RNA, 20 nt, Human
uauuucaguguaccaaguau

SEQ ID NO: 1369077 - RNA, 18 nt, Human
ucaaaacauuuucugcag

SEQ ID NO: 1369078 - RNA, 21 nt, Human
ucaaaugccuugauauguaau

SEQ ID NO: 1369079 - RNA, 29 nt, Human
ucaacaggcaaaaaaauauauacaacagg

SEQ ID NO: 1369080 - RNA, 21 nt, Human
ucaacucaaauaugcaaccuc

SEQ ID NO: 1369081 - RNA, 19 nt, Human
ucaagugauucuccugccu

SEQ ID NO: 1369082 - RNA, 24 nt, Human
ucacccaggcuggagugcaguggc

SEQ ID NO: 1369083 - RNA, 24 nt, Human
ucacucugucacccaggcuggagu

SEQ ID NO: 1369084 - RNA, 23 nt, Human
ucacugcaaccuccgccucccgg

SEQ ID NO: 1369085 - RNA, 24 nt, Human
ucacugcaaccuccgccucccggg

SEQ ID NO: 1369086 - RNA, 25 nt, Human
ucacugcaaccuccgccucccgggu

SEQ ID NO: 1369087 - RNA, 26 nt, Human
ucacugcaaccuccgccucccggguu

SEQ ID NO: 1369088 - RNA, 18 nt, Human
ucacugcaaccuuugccg

SEQ ID NO: 1369089 - RNA, 21 nt, Human
ucacugcaaccuuugccgccc

SEQ ID NO: 1369090 - RNA, 24 nt, Human
ucacugcaaccuuugccgcccagg

SEQ ID NO: 1369091 - RNA, 25 nt, Human
ucacugcaaccuuugccgggguccc

SEQ ID NO: 1369092 - RNA, 26 nt, Human
ucacugcaaccuuugccgggguccuc

SEQ ID NO: 1369093 - RNA, 18 nt, Human
ucagccucccaaagugcu

SEQ ID NO: 1369094 - RNA, 20 nt, Human
ucagccuccugaguagcugg

SEQ ID NO: 1369095 - RNA, 27 nt, Human
ucaguauauagguggccuuacaaggcc

SEQ ID NO: 1369096 - RNA, 18 nt, Human
ucaucaaaaucaacaggc

SEQ ID NO: 1369097 - RNA, 22 nt, Human
ucauucccucgcugccuacuau

SEQ ID NO: 1369098 - RNA, 21 nt, Human
uccacccgccucaaccuccca

SEQ ID NO: 1369099 - RNA, 19 nt, Human
uccagccuggacugugaga

SEQ ID NO: 1369100 - RNA, 24 nt, Human
ucccaaagugccgggauuacaggc

SEQ ID NO: 1369101 - RNA, 24 nt, Human
ucccaaagugcugggauuacaggc

SEQ ID NO: 1369102 - RNA, 19 nt, Human
ucccagcuacucuggagga

SEQ ID NO: 1369103 - RNA, 21 nt, Human
ucccggguucaagcaauucuc

SEQ ID NO: 1369104 - RNA, 24 nt, Human
ucccggguucaagcaauucuccug

SEQ ID NO: 1369105 - RNA, 24 nt, Human
uccgccucccggguucaagcaauu

SEQ ID NO: 1369106 - RNA, 18 nt, Human
uccugaguagcugggauu

SEQ ID NO: 1369107 - RNA, 24 nt, Human
uccugcguaguugggauuacaggu

SEQ ID NO: 1369108 - RNA, 19 nt, Human
ucgccauguuggccaggcu

SEQ ID NO: 1369109 - RNA, 22 nt, Human
ucgcugccuacuauaaaccuua

SEQ ID NO: 1369110 - RNA, 23 nt, Human
ucucacucugucacccaggcugg

SEQ ID NO: 1369111 - RNA, 24 nt, Human
ucucacucugucacccaggcugga

SEQ ID NO: 1369112 - RNA, 26 nt, Human
ucucacucugucacccaggcuggagu

SEQ ID NO: 1369113 - RNA, 27 nt, Human
ucucacucugucacccaggcuggagug

SEQ ID NO: 1369114 - RNA, 21 nt, Human
ucuccugccuuagccuccugc

SEQ ID NO: 1369115 - RNA, 24 nt, Human
ucugucacccaggcuggagugcag

SEQ ID NO: 1369116 - RNA, 22 nt, Human
ugaagaaaaaagaaaaaaaagc

SEQ ID NO: 1369117 - RNA, 24 nt, Human
ugaagcagcacaaccacuuaaacc

SEQ ID NO: 1369118 - RNA, 19 nt, Human
ugaauggagugccauuggc

SEQ ID NO: 1369119 - RNA, 20 nt, Human
ugaauggagugccauuggcg

SEQ ID NO: 1369120 - RNA, 20 nt, Human
ugacauucacaaccacuccu

SEQ ID NO: 1369121 - RNA, 21 nt, Human
ugaccucaggugauccacccg

SEQ ID NO: 1369122 - RNA, 24 nt, Human
ugaccucaggugauccacccgccu

SEQ ID NO: 1369123 - RNA, 22 nt, Human
ugagacaggguauugcuauguu

SEQ ID NO: 1369124 - RNA, 26 nt, Human
ugaggcaagaggauggcaugaggcca

SEQ ID NO: 1369125 - RNA, 18 nt, Human
ugaggcacacugacugga

SEQ ID NO: 1369126 - RNA, 20 nt, Human
ugauucacuacaacuuccuu

SEQ ID NO: 1369127 - RNA, 19 nt, Human
ugcaaggauguaauuuaaa

SEQ ID NO: 1369128 - RNA, 23 nt, Human
ugcaauauaugcuuauuucucuu

SEQ ID NO: 1369129 - RNA, 19 nt, Human
ugcacacagcugaagaaaa

SEQ ID NO: 1369130 - RNA, 19 nt, Human
ugcagaaaaucuugaaauc

SEQ ID NO: 1369131 - RNA, 25 nt, Human
ugccgggauuacaggcauuuuaaca

SEQ ID NO: 1369132 - RNA, 24 nt, Human
ugccucagccuccugaguagcugg

SEQ ID NO: 1369133 - RNA, 20 nt, Human
ugccuuagccuccugcguag

SEQ ID NO: 1369134 - RNA, 24 nt, Human
ugcuauguuggccaggcuagucuc

SEQ ID NO: 1369135 - RNA, 20 nt, Human
uggagugcaguggcaugguc

SEQ ID NO: 1369136 - RNA, 23 nt, Human
uggagugcaguggcauggucucg

SEQ ID NO: 1369137 - RNA, 24 nt, Human
uggagugcaguggcauggucucgg

SEQ ID NO: 1369138 - RNA, 20 nt, Human
uggagugccauuggcgcgau

SEQ ID NO: 1369139 - RNA, 18 nt, Human
uggcacaguggcucacac

SEQ ID NO: 1369140 - RNA, 19 nt, Human
uggcauggucucggcucac

SEQ ID NO: 1369141 - RNA, 24 nt, Human
uggccaggcuagucucaaacuccu

SEQ ID NO: 1369142 - RNA, 24 nt, Human
uggccaggcugggcucgaacuccu

SEQ ID NO: 1369143 - RNA, 21 nt, Human
ugggauuacagacacacacca

SEQ ID NO: 1369144 - RNA, 24 nt, Human
ugggauuacagacacacaccacca

SEQ ID NO: 1369145 - RNA, 18 nt, Human
ugggauuacaggcuugag

SEQ ID NO: 1369146 - RNA, 21 nt, Human
ugggauuacaggcuugagcca

SEQ ID NO: 1369147 - RNA, 22 nt, Human
ugggauuacaggcuugagccac

SEQ ID NO: 1369148 - RNA, 24 nt, Human
ugggauuacaggcuugagccacca

SEQ ID NO: 1369149 - RNA, 25 nt, Human
ugggauuacaggcuugagccaccau

SEQ ID NO: 1369150 - RNA, 21 nt, Human
ugggauuacaggugccugcca

SEQ ID NO: 1369151 - RNA, 22 nt, Human
ugggauuacaggugccugccac

SEQ ID NO: 1369152 - RNA, 24 nt, Human
ugggauuacaggugccugccacca

SEQ ID NO: 1369153 - RNA, 27 nt, Human
uuaaacccccgggucaugaaaacauua

SEQ ID NO: 1369154 - RNA, 26 nt, Human
uuaaauguuccccaucucaccaugca

SEQ ID NO: 1369155 - RNA, 24 nt, Human
uuagccuccugcguaguugggauu

SEQ ID NO: 1369156 - RNA, 18 nt, Human
uuaguagagguaggguuu

SEQ ID NO: 1369157 - RNA, 22 nt, Human
uuaguagagguaggguuucgcc

SEQ ID NO: 1369158 - RNA, 24 nt, Human
uuaguagagguaggguuucgccau

SEQ ID NO: 1369159 - RNA, 24 nt, Human
uucaagcaauucuccugccuuagc

SEQ ID NO: 1369160 - RNA, 21 nt, Human
uucaagugauucuccugccuc

SEQ ID NO: 1369161 - RNA, 23 nt, Human
uucaagugauucuccugccucag

SEQ ID NO: 1369162 - RNA, 24 nt, Human
uucaagugauucuccugccucagc

SEQ ID NO: 1369163 - RNA, 24 nt, Human
uucccuuuuauaaauggcuucuuu

SEQ ID NO: 1369164 - RNA, 22 nt, Human
uugagacaggguauugcuaugu

SEQ ID NO: 1369165 - RNA, 22 nt, Human
uuuaaaagauggaaaaggugac

SEQ ID NO: 1369166 - RNA, 21 nt, Human
uuucgccauguuggccaggcu

SEQ ID NO: 1369167 - RNA, 23 nt, Human
uuuuuaguagagguaggguuucg

SEQ ID NO: 1369168 - RNA, 24 nt, Human
uuuuuaguagagguaggguuucgc

SEQ ID NO: 1369169 - RNA, 22 nt, Human
uuuuuauccuaagaauuaaaga

SEQ ID NO: 1369170 - RNA, 20 nt, Human
uuuuuguauuuuuaguagag

SEQ ID NO: 1369171 - RNA, 21 nt, Human
uuuuuuucuuuuuuuuuccag

SEQ ID NO: 1369172 - RNA, 24 nt, Human
aaaaaacauucaaauuaauucaua

SEQ ID NO: 1369173 - RNA, 25 nt, Human
aaccugagcgggguguccuggaagc

SEQ ID NO: 1369174 - RNA, 20 nt, Human
aagaggccuuuaggacucug

SEQ ID NO: 1369175 - RNA, 25 nt, Human
aagcgauccucccaccucggccuuc

SEQ ID NO: 1369176 - RNA, 21 nt, Human
aaggaucaugggguuaaggau

SEQ ID NO: 1369177 - RNA, 20 nt, Human
aagugcauuccaggccagga

SEQ ID NO: 1369178 - RNA, 18 nt, Human
acagauccaccucagaau

SEQ ID NO: 1369179 - RNA, 18 nt, Human
acagcugacuguaaguga

SEQ ID NO: 1369180 - RNA, 21 nt, Human
acgagccgugcagccuagagc

SEQ ID NO: 1369181 - RNA, 19 nt, Human
acuucagggacaccagggg

SEQ ID NO: 1369182 - RNA, 18 nt, Human
agacaaaguuuugccaug

SEQ ID NO: 1369183 - RNA, 26 nt, Human
agacaggaaggaaacacuaaagccag

SEQ ID NO: 1369184 - RNA, 23 nt, Human
agacagggaugccuccgagguug

SEQ ID NO: 1369185 - RNA, 18 nt, Human
agaggaagggggggaggg

SEQ ID NO: 1369186 - RNA, 20 nt, Human
agaggaagggggggaggggc

SEQ ID NO: 1369187 - RNA, 21 nt, Human
agaggaagggggggaggggca

SEQ ID NO: 1369188 - RNA, 20 nt, Human
agcaccacagauacugcggg

SEQ ID NO: 1369189 - RNA, 19 nt, Human
agccaccacacuuagccug

SEQ ID NO: 1369190 - RNA, 23 nt, Human
agccgagugagcagcguucagga

SEQ ID NO: 1369191 - RNA, 19 nt, Human
aggaagggggggaggggca

SEQ ID NO: 1369192 - RNA, 20 nt, Human
aggaagggggggaggggcag

SEQ ID NO: 1369193 - RNA, 24 nt, Human
aggaggccagagcaggcaagaggc

SEQ ID NO: 1369194 - RNA, 23 nt, Human
aggaggccagagcaggcaguggg

SEQ ID NO: 1369195 - RNA, 18 nt, Human
aggccagagcaggcaaga

SEQ ID NO: 1369196 - RNA, 18 nt, Human
agugcugggacuacaggc

SEQ ID NO: 1369197 - RNA, 24 nt, Human
auuugucacuagaagcccauugug

SEQ ID NO: 1369198 - RNA, 27 nt, Human
caagcgauccucccaccucggccuucc

SEQ ID NO: 1369199 - RNA, 23 nt, Human
caauaggacaacgggcauggccc

SEQ ID NO: 1369200 - RNA, 25 nt, Human
cacacuuagccugucggaguccuuu

SEQ ID NO: 1369201 - RNA, 21 nt, Human
cacagugaggucucaagacaa

SEQ ID NO: 1369202 - RNA, 25 nt, Human
caccacagauacugcgggcaaaucu

SEQ ID NO: 1369203 - RNA, 22 nt, Human
cagaaggacgcaggagaggggu

SEQ ID NO: 1369204 - RNA, 22 nt, Human
cagacacaaccucucagcccca

SEQ ID NO: 1369205 - RNA, 23 nt, Human
cagagcaccacagauacugcggg

SEQ ID NO: 1369206 - RNA, 18 nt, Human
cagagcaggcaagaggcc

SEQ ID NO: 1369207 - RNA, 18 nt, Human
cagugacguggggaaaac

SEQ ID NO: 1369208 - RNA, 20 nt, Human
cauguugcccaggcaggucc

SEQ ID NO: 1369209 - RNA, 24 nt, Human
cauguugcccaggcagguccugaa

SEQ ID NO: 1369210 - RNA, 21 nt, Human
ccagagcaccacagauacugc

SEQ ID NO: 1369211 - RNA, 22 nt, Human
ccaggaaaggagaaggagcccc

SEQ ID NO: 1369212 - RNA, 19 nt, Human
ccauguugcccaggcaggu

SEQ ID NO: 1369213 - RNA, 20 nt, Human
ccauguugcccaggcagguc

SEQ ID NO: 1369214 - RNA, 21 nt, Human
cccccaggccgcuugcacagu

SEQ ID NO: 1369215 - RNA, 23 nt, Human
cccgagugcugggacuacaggca

SEQ ID NO: 1369216 - RNA, 24 nt, Human
cccgagugcugggacuacaggcau

SEQ ID NO: 1369217 - RNA, 20 nt, Human
cccgccacgcccccaggccg

SEQ ID NO: 1369218 - RNA, 23 nt, Human
ccgagugcugggacuacaggcau

SEQ ID NO: 1369219 - RNA, 20 nt, Human
ccgccacgcccccaggccgc

SEQ ID NO: 1369220 - RNA, 22 nt, Human
ccgccacgcccccaggccgcuu

SEQ ID NO: 1369221 - RNA, 20 nt, Human
ccucagaauuuuuauuuuua

SEQ ID NO: 1369222 - RNA, 25 nt, Human
ccucccaccucggccuucccgagug

SEQ ID NO: 1369223 - RNA, 22 nt, Human
ccuccccgccacgcccccaggc

SEQ ID NO: 1369224 - RNA, 19 nt, Human
ccuccgagguugacaugaa

SEQ ID NO: 1369225 - RNA, 20 nt, Human
ccugggcucaagcgauccuc

SEQ ID NO: 1369226 - RNA, 20 nt, Human
ccuugacgaggggaggugga

SEQ ID NO: 1369227 - RNA, 24 nt, Human
cgagugagcagcguucaggagucc

SEQ ID NO: 1369228 - RNA, 19 nt, Human
cgagugcugggacuacagg

SEQ ID NO: 1369229 - RNA, 24 nt, Human
cgagugcugggacuacaggcauga

SEQ ID NO: 1369230 - RNA, 19 nt, Human
cgccacgcccccaggccgc

SEQ ID NO: 1369231 - RNA, 22 nt, Human
cgcccccaggccgcuugcacag

SEQ ID NO: 1369232 - RNA, 27 nt, Human
cgguauggagggugugggccgcacacg

SEQ ID NO: 1369233 - RNA, 21 nt, Human
cuaaagccagcacaggguguc

SEQ ID NO: 1369234 - RNA, 22 nt, Human
cuaaagccagcacagggugucc

SEQ ID NO: 1369235 - RNA, 23 nt, Human
cuaaagccagcacaggguguccc

SEQ ID NO: 1369236 - RNA, 24 nt, Human
cucaagcgauccucccaccucggc

SEQ ID NO: 1369237 - RNA, 22 nt, Human
cucccgggcauccccauccugg

SEQ ID NO: 1369238 - RNA, 22 nt, Human
cucuggggagaagaagucggca

SEQ ID NO: 1369239 - RNA, 23 nt, Human
cuggcugagcucaggagaguggg

SEQ ID NO: 1369240 - RNA, 20 nt, Human
cugggaaggaucaugggguu

SEQ ID NO: 1369241 - RNA, 20 nt, Human
gaaaggagaaggagccccca

SEQ ID NO: 1369242 - RNA, 19 nt, Human
gacgaggggagguggaggg

SEQ ID NO: 1369243 - RNA, 21 nt, Human
gacuacaggcaugagccacca

SEQ ID NO: 1369244 - RNA, 27 nt, Human
gagaauggugagaggaggccgguaccc

SEQ ID NO: 1369245 - RNA, 18 nt, Human
gagggugugggggugggc

SEQ ID NO: 1369246 - RNA, 19 nt, Human
gaucaugggguuaaggaug

SEQ ID NO: 1369247 - RNA, 22 nt, Human
gcauccccauccuggaagagac

SEQ ID NO: 1369248 - RNA, 18 nt, Human
gccacgcccccaggccgc

SEQ ID NO: 1369249 - RNA, 20 nt, Human
gcucuggggagaagaagucg

SEQ ID NO: 1369250 - RNA, 19 nt, Human
ggaagggggggaggggcag

SEQ ID NO: 1369251 - RNA, 21 nt, Human
ggacgcaggagaggggucagc

SEQ ID NO: 1369252 - RNA, 19 nt, Human
ggacuacaggcaugagcca

SEQ ID NO: 1369253 - RNA, 21 nt, Human
ggagaggggucagcuauaaug

SEQ ID NO: 1369254 - RNA, 20 nt, Human
ggcauggcccucccugaugg

SEQ ID NO: 1369255 - RNA, 22 nt, Human
gggcauccccauccuggaagag

SEQ ID NO: 1369256 - RNA, 18 nt, Human
gggcccagagcaccacag

SEQ ID NO: 1369257 - RNA, 26 nt, Human
ggggagguggagggagcaaggugaca

SEQ ID NO: 1369258 - RNA, 18 nt, Human
gggugugggggugggcgg

SEQ ID NO: 1369259 - RNA, 19 nt, Human
gggugugggggugggcggu

SEQ ID NO: 1369260 - RNA, 18 nt, Human
gguccugaacuccugggc

SEQ ID NO: 1369261 - RNA, 24 nt, Human
gugacgggaaggaugcagaaggga

SEQ ID NO: 1369262 - RNA, 19 nt, Human
gugcugggacuacaggcau

SEQ ID NO: 1369263 - RNA, 18 nt, Human
guuauaaaagccaggcuc

SEQ ID NO: 1369264 - RNA, 18 nt, Human
uaaggcaggcagaaccug

SEQ ID NO: 1369265 - RNA, 20 nt, Human
uaaggcaggcagaaccugag

SEQ ID NO: 1369266 - RNA, 19 nt, Human
uacagauccaccucagaau

SEQ ID NO: 1369267 - RNA, 21 nt, Human
uacaggcaugagccaccacac

SEQ ID NO: 1369268 - RNA, 24 nt, Human
uccaggccaggaagcauacgaggc

SEQ ID NO: 1369269 - RNA, 21 nt, Human
uccccgccacgcccccaggcc

SEQ ID NO: 1369270 - RNA, 23 nt, Human
ucccgagugcugggacuacaggc

SEQ ID NO: 1369271 - RNA, 20 nt, Human
ucccggggcaagugcauucc

SEQ ID NO: 1369272 - RNA, 19 nt, Human
uccuccuccuccuccccgc

SEQ ID NO: 1369273 - RNA, 21 nt, Human
uccuccuccuccuccccgcca

SEQ ID NO: 1369274 - RNA, 18 nt, Human
uccugaacuccugggcuc

SEQ ID NO: 1369275 - RNA, 23 nt, Human
uccugaacuccugggcucaagcg

SEQ ID NO: 1369276 - RNA, 21 nt, Human
uccugggcucaagcgauccuc

SEQ ID NO: 1369277 - RNA, 22 nt, Human
uccugggcucaagcgauccucc

SEQ ID NO: 1369278 - RNA, 24 nt, Human
uccugggcucaagcgauccuccca

SEQ ID NO: 1369279 - RNA, 18 nt, Human
ucucgaaggccacuauca

SEQ ID NO: 1369280 - RNA, 25 nt, Human
ugaacuccugggcucaagcgauccu

SEQ ID NO: 1369281 - RNA, 21 nt, Human
ugacagaaggacgcaggagag

SEQ ID NO: 1369282 - RNA, 22 nt, Human
ugagcgggguguccuggaagcc

SEQ ID NO: 1369283 - RNA, 21 nt, Human
ugagcucaggagagugggcac

SEQ ID NO: 1369284 - RNA, 31 nt, Human
ugccauguugcccaggcagguccugaacucc

SEQ ID NO: 1369285 - RNA, 21 nt, Human
uggagggugugggggugggcg

SEQ ID NO: 1369286 - RNA, 19 nt, Human
uggcaagaggaaggggggg

SEQ ID NO: 1369287 - RNA, 22 nt, Human
uggcaagaggaagggggggagg

SEQ ID NO: 1369288 - RNA, 21 nt, Human
uggcaagcaguuuggacaggu

SEQ ID NO: 1369289 - RNA, 21 nt, Human
uggcagagaauggugagagga

SEQ ID NO: 1369290 - RNA, 20 nt, Human
uggcuggcaguggaaggcag

SEQ ID NO: 1369291 - RNA, 18 nt, Human
ugggacuacaggcaugag

SEQ ID NO: 1369292 - RNA, 22 nt, Human
ugggacuacaggcaugagccac

SEQ ID NO: 1369293 - RNA, 24 nt, Human
ugggacuacaggcaugagccacca

SEQ ID NO: 1369294 - RNA, 24 nt, Human
ugggacuacaggcaugagccacca

SEQ ID NO: 1369295 - RNA, 23 nt, Human
ugggcucuuggaugucgugguuu

SEQ ID NO: 1369296 - RNA, 24 nt, Human
uggggaaaacgguauggaggguga

SEQ ID NO: 1369297 - RNA, 18 nt, Human
ugugacgggaaggaugca

SEQ ID NO: 1369298 - RNA, 19 nt, Human
ugugugacgggaaggaugc

SEQ ID NO: 1369299 - RNA, 18 nt, Human
uugauaauaaggugacuu

SEQ ID NO: 1369300 - RNA, 19 nt, Human
uuuggcaagaggaaggggg

SEQ ID NO: 1369301 - RNA, 19 nt, Human
uuuugccauguugcccagg

SEQ ID NO: 1369302 - RNA, 21 nt, Human
aaaaaaaccaggaaucaaaaa

SEQ ID NO: 1369303 - RNA, 18 nt, Human
aaaaaacaaaaaaaccag

SEQ ID NO: 1369304 - RNA, 28 nt, Human
aaaaaacaaaaaaaccaggaaucaaaag

SEQ ID NO: 1369305 - RNA, 23 nt, Human
aaaaaaccaggaaucaaaaacca

SEQ ID NO: 1369306 - RNA, 25 nt, Human
aaaaauaccccaaacaaaaaacaaa

SEQ ID NO: 1369307 - RNA, 21 nt, Human
aaaacaaaaaaaccaggaauc

SEQ ID NO: 1369308 - RNA, 24 nt, Human
aaaaggacauucccaauuucaacc

SEQ ID NO: 1369309 - RNA, 20 nt, Human
aaaauaccucaagauauuuu

SEQ ID NO: 1369310 - RNA, 23 nt, Human
aaacaaaaaaaccaggaaucaaa

SEQ ID NO: 1369311 - RNA, 24 nt, Human
aaacaaaaaacaaaaaaaccagga

SEQ ID NO: 1369312 - RNA, 23 nt, Human
aaagauauguuacccauuacucc

SEQ ID NO: 1369313 - RNA, 21 nt, Human
aaaugaccgaaaaaugcugaa

SEQ ID NO: 1369314 - RNA, 20 nt, Human
aaaugcaaaaucaaaugacc

SEQ ID NO: 1369315 - RNA, 22 nt, Human
aacaccagcacgcggcaagaga

SEQ ID NO: 1369316 - RNA, 20 nt, Human
aacaucugaacuccaacgcc

SEQ ID NO: 1369317 - RNA, 22 nt, Human
aaccaagcaaauuaaaaucaaa

SEQ ID NO: 1369318 - RNA, 21 nt, Human
aaccacuaaugguaaaaaucu

SEQ ID NO: 1369319 - RNA, 25 nt, Human
aacuguuuuccaauuugcucuccac

SEQ ID NO: 1369320 - RNA, 18 nt, Human
aagaacagcuaggauaca

SEQ ID NO: 1369321 - RNA, 23 nt, Human
aauauucuccucuuuugcacugu

SEQ ID NO: 1369322 - RNA, 25 nt, Human
acaaaaaaaccaggaaucaaaaacc

SEQ ID NO: 1369323 - RNA, 21 nt, Human
acaagaggaaauauucuccuc

SEQ ID NO: 1369324 - RNA, 25 nt, Human
acacacauacauaaacauacauaca

SEQ ID NO: 1369325 - RNA, 22 nt, Human
acauacccacacacauacauaa

SEQ ID NO: 1369326 - RNA, 19 nt, Human
acccauuacuccagcauga

SEQ ID NO: 1369327 - RNA, 19 nt, Human
accccgccucucccucucc

SEQ ID NO: 1369328 - RNA, 22 nt, Human
acgacggcggcggcggcggcuu

SEQ ID NO: 1369329 - RNA, 19 nt, Human
agaaguucuucugggucug

SEQ ID NO: 1369330 - RNA, 23 nt, Human
agcuacaauaguaagauccaacc

SEQ ID NO: 1369331 - RNA, 23 nt, Human
aggaaucaaaaaccaaaacaccc

SEQ ID NO: 1369332 - RNA, 24 nt, Human
aggguauagugagcagcuacaaua

SEQ ID NO: 1369333 - RNA, 18 nt, Human
agguagguucaaggccaa

SEQ ID NO: 1369334 - RNA, 25 nt, Human
auacacacauacccacacacauaca

SEQ ID NO: 1369335 - RNA, 19 nt, Human
auacucacuuuccauuaau

SEQ ID NO: 1369336 - RNA, 21 nt, Human
aucucuucagauuugaaaucc

SEQ ID NO: 1369337 - RNA, 18 nt, Human
auggagaacauccuucuc

SEQ ID NO: 1369338 - RNA, 24 nt, Human
augucuguaaaacuuuggaaccac

SEQ ID NO: 1369339 - RNA, 19 nt, Human
auuguuggucuugcaccuu

SEQ ID NO: 1369340 - RNA, 26 nt, Human
caaaaaaaccaggaaucaaaaaccaa

SEQ ID NO: 1369341 - RNA, 20 nt, Human
caaaaaacaaaaaaaccagg

SEQ ID NO: 1369342 - RNA, 24 nt, Human
caaaaaacaaaaaaaccaggaauc

SEQ ID NO: 1369343 - RNA, 27 nt, Human
caaaaaacaaaaaaaccaggaaucaaa

SEQ ID NO: 1369344 - RNA, 23 nt, Human
caaaaaccaaaacacccucaaac

SEQ ID NO: 1369345 - RNA, 26 nt, Human
caaaaauaccccaaacaaaaaacaaa

SEQ ID NO: 1369346 - RNA, 24 nt, Human
caaaacacccucaaacugcaccaa

SEQ ID NO: 1369347 - RNA, 23 nt, Human
caaaauaccucaagauauuuuaa

SEQ ID NO: 1369348 - RNA, 23 nt, Human
caaaccacuaaugguaaaaaucu

SEQ ID NO: 1369349 - RNA, 21 nt, Human
caagaaaagcacaagaggaaa

SEQ ID NO: 1369350 - RNA, 25 nt, Human
caagaaaagcacaagaggaaauauu

SEQ ID NO: 1369351 - RNA, 25 nt, Human
caagcugagggaacaaaaucuuaca

SEQ ID NO: 1369352 - RNA, 19 nt, Human
caauuucaaccuugcugaa

SEQ ID NO: 1369353 - RNA, 19 nt, Human
cacacauacccacacacau

SEQ ID NO: 1369354 - RNA, 20 nt, Human
cacacauacccacacacaua

SEQ ID NO: 1369355 - RNA, 22 nt, Human
cacacauacccacacacauaca

SEQ ID NO: 1369356 - RNA, 27 nt, Human
cacauacccacacacauacauaaacau

SEQ ID NO: 1369357 - RNA, 21 nt, Human
caccaaaaauaccccaaacaa

SEQ ID NO: 1369358 - RNA, 21 nt, Human
caccaauacuucauauuuuga

SEQ ID NO: 1369359 - RNA, 19 nt, Human
cacuguauacacacauacc

SEQ ID NO: 1369360 - RNA, 19 nt, Human
cagagguagguucaaggcc

SEQ ID NO: 1369361 - RNA, 19 nt, Human
caugccagcuuccaaaaac

SEQ ID NO: 1369362 - RNA, 25 nt, Human
caugucuguaaaacuuuggaaccac

SEQ ID NO: 1369363 - RNA, 22 nt, Human
ccaaaacacccucaaacugcac

SEQ ID NO: 1369364 - RNA, 24 nt, Human
ccaaaacacccucaaacugcacca

SEQ ID NO: 1369365 - RNA, 24 nt, Human
ccaaaacacccucaaacugcacca

SEQ ID NO: 1369366 - RNA, 21 nt, Human
ccaguggcaaaauaccucaag

SEQ ID NO: 1369367 - RNA, 26 nt, Human
cccaaacaaaaaacaaaaaggaguuc

SEQ ID NO: 1369368 - RNA, 21 nt, Human
cccaauuucaaccuugcugaa

SEQ ID NO: 1369369 - RNA, 24 nt, Human
cccacacacauacauaaacauaca

SEQ ID NO: 1369370 - RNA, 24 nt, Human
ccccaaacaaaaaacaaaaaaacc

SEQ ID NO: 1369371 - RNA, 18 nt, Human
ccccgccucucccucucc

SEQ ID NO: 1369372 - RNA, 26 nt, Human
ccccgccugcuuugcgcaucccucuu

SEQ ID NO: 1369373 - RNA, 23 nt, Human
ccucagccgagacagagaaagac

SEQ ID NO: 1369374 - RNA, 23 nt, Human
cgaaaaaugcugaacaaacagca

SEQ ID NO: 1369375 - RNA, 22 nt, Human
cgacggcggcggcggcggcggc

SEQ ID NO: 1369376 - RNA, 18 nt, Human
cgccucucccucuccggg

SEQ ID NO: 1369377 - RNA, 21 nt, Human
cgggagcagauccacgugaua

SEQ ID NO: 1369378 - RNA, 22 nt, Human
cuagguggaagaugaggaagaa

SEQ ID NO: 1369379 - RNA, 24 nt, Human
cuccacuguauacacacauaccca

SEQ ID NO: 1369380 - RNA, 22 nt, Human
cuuaccuccaaguccucuuaaa

SEQ ID NO: 1369381 - RNA, 23 nt, Human
cuuuugcacuguuauuuuauuuu

SEQ ID NO: 1369382 - RNA, 20 nt, Human
gaaaagcacaagaggaaaua

SEQ ID NO: 1369383 - RNA, 19 nt, Human
gaccccgccucucccucuc

SEQ ID NO: 1369384 - RNA, 23 nt, Human
gacggcggcggcggcggcggcgg

SEQ ID NO: 1369385 - RNA, 29 nt, Human
gagggaacaaaaucuuacaaaaggaggga

SEQ ID NO: 1369386 - RNA, 18 nt, Human
gccagcuuccaaaaacca

SEQ ID NO: 1369387 - RNA, 21 nt, Human
gccgaccccgccucucccucu

SEQ ID NO: 1369388 - RNA, 18 nt, Human
gcggcaagagaaagaugg

SEQ ID NO: 1369389 - RNA, 21 nt, Human
gcggcaagagaaagauggcug

SEQ ID NO: 1369390 - RNA, 21 nt, Human
gcggcggcggcggcgggagca

SEQ ID NO: 1369391 - RNA, 18 nt, Human
gcuaaacucuauauggag

SEQ ID NO: 1369392 - RNA, 19 nt, Human
gcugccucagccgagacag

SEQ ID NO: 1369393 - RNA, 23 nt, Human
gggaaaagaaaaguaacaaaugu

SEQ ID NO: 1369394 - RNA, 23 nt, Human
guaaaaaucucuucagauuugaa

SEQ ID NO: 1369395 - RNA, 24 nt, Human
guaaaaaucucuucagauuugaaa

SEQ ID NO: 1369396 - RNA, 18 nt, Human
gugauacagccgaccccg

SEQ ID NO: 1369397 - RNA, 18 nt, Human
gugucuuacggggggaaa

SEQ ID NO: 1369398 - RNA, 25 nt, Human
uaaaauaaauugagguguuuggaug

SEQ ID NO: 1369399 - RNA, 21 nt, Human
uaaggcaaccauaccaaagau

SEQ ID NO: 1369400 - RNA, 20 nt, Human
uaaguuaaucuaaggcaacc

SEQ ID NO: 1369401 - RNA, 24 nt, Human
uacaccaaaaauaccccaaacaaa

SEQ ID NO: 1369402 - RNA, 26 nt, Human
uacauacaccaaaaauaccccaaaca

SEQ ID NO: 1369403 - RNA, 27 nt, Human
uacccacacacauacauaaacauacau

SEQ ID NO: 1369404 - RNA, 20 nt, Human
uaccccaaacaaaaaacaaa

SEQ ID NO: 1369405 - RNA, 22 nt, Human
uaccccaaacaaaaaacaaaaa

SEQ ID NO: 1369406 - RNA, 19 nt, Human
uaccugcuguuaagaacag

SEQ ID NO: 1369407 - RNA, 18 nt, Human
uacuguguuuuaccagug

SEQ ID NO: 1369408 - RNA, 21 nt, Human
uagcaaaaaguaagcuucuau

SEQ ID NO: 1369409 - RNA, 24 nt, Human
uagcuugacacaaaaguugguagc

SEQ ID NO: 1369410 - RNA, 19 nt, Human
uauaaaacauaacaggaaa

SEQ ID NO: 1369411 - RNA, 21 nt, Human
uauacaaaauauuuauauuac

SEQ ID NO: 1369412 - RNA, 22 nt, Human
uauuagacagcaagagggaaac

SEQ ID NO: 1369413 - RNA, 21 nt, Human
uauuguuggucuugcaccuua

SEQ ID NO: 1369414 - RNA, 21 nt, Human
uauuuucuaaauuuuguccuu

SEQ ID NO: 1369415 - RNA, 21 nt, Human
ucaaaaaccaaaacacccuca

SEQ ID NO: 1369416 - RNA, 19 nt, Human
ucagccgagacagagaaag

SEQ ID NO: 1369417 - RNA, 19 nt, Human
uccaugccagcuuccaaaa

SEQ ID NO: 1369418 - RNA, 19 nt, Human
ucuacuggggagggaggag

SEQ ID NO: 1369419 - RNA, 18 nt, Human
ucuagcuugacacaaaag

SEQ ID NO: 1369420 - RNA, 21 nt, Human
ucucaagcuagguggaagaug

SEQ ID NO: 1369421 - RNA, 26 nt, Human
ucuccggggcagccuaucccgggagc

SEQ ID NO: 1369422 - RNA, 25 nt, Human
ucuucugggucugacuagguaaguu

SEQ ID NO: 1369423 - RNA, 20 nt, Human
ugaaaaacaggcauuuuugu

SEQ ID NO: 1369424 - RNA, 27 nt, Human
ugaaauccaagauacuccuccggccgg

SEQ ID NO: 1369425 - RNA, 20 nt, Human
ugaaaucuaccaaacuguaa

SEQ ID NO: 1369426 - RNA, 25 nt, Human
ugaaaucuaccaaacuguaacauca

SEQ ID NO: 1369427 - RNA, 21 nt, Human
ugaacuaguaacaggugaugu

SEQ ID NO: 1369428 - RNA, 19 nt, Human
ugaagaugaaguuguuccu

SEQ ID NO: 1369429 - RNA, 19 nt, Human
ugaccaggccauuuggaga

SEQ ID NO: 1369430 - RNA, 19 nt, Human
ugaggaaauccuccuaggg

SEQ ID NO: 1369431 - RNA, 22 nt, Human
ugaggaagaauauuaccaaaag

SEQ ID NO: 1369432 - RNA, 24 nt, Human
ugccucagccgagacagagaaaga

SEQ ID NO: 1369433 - RNA, 18 nt, Human
ugcuuugcgcaucccucu

SEQ ID NO: 1369434 - RNA, 24 nt, Human
uggaugaaaaaaaauacaagagcu

SEQ ID NO: 1369435 - RNA, 24 nt, Human
uggcuguaacaaaugcugauauag

SEQ ID NO: 1369436 - RNA, 19 nt, Human
ugggaggaagugcaaaaug

SEQ ID NO: 1369437 - RNA, 22 nt, Human
ugggaggaagugcaaaaugcaa

SEQ ID NO: 1369438 - RNA, 21 nt, Human
uggggagggaggaggauaaau

SEQ ID NO: 1369439 - RNA, 26 nt, Human
uguauacacacauacccacacacaua

SEQ ID NO: 1369440 - RNA, 26 nt, Human
uguauacacacauacccacacacaua

SEQ ID NO: 1369441 - RNA, 21 nt, Human
uuagugcuaguggcggcaggu

SEQ ID NO: 1369442 - RNA, 23 nt, Human
uuauucuaagcaugcaggagggu

SEQ ID NO: 1369443 - RNA, 22 nt, Human
uucaaccuugcugaaaaacagg

SEQ ID NO: 1369444 - RNA, 19 nt, Human
uuccucaagcugagggaac

SEQ ID NO: 1369445 - RNA, 20 nt, Human
uugaugaugggccaggaaau

SEQ ID NO: 1369446 - RNA, 18 nt, Human
uuggucuugcaccuuaga

SEQ ID NO: 1369447 - RNA, 23 nt, Human
uuuccaauuugcucuccacugua

SEQ ID NO: 1369448 - RNA, 24 nt, Human
uuuuuauuucuacuggggagggag

SEQ ID NO: 1369449 - RNA, 23 nt, Human
aagaagccccugucccugccuca

SEQ ID NO: 1369450 - RNA, 22 nt, Human
aaguaggggcuccucuuccagg

SEQ ID NO: 1369451 - RNA, 24 nt, Human
accacccacccagcauaccucccc

SEQ ID NO: 1369452 - RNA, 23 nt, Human
accagaaccuguuccuacucuga

SEQ ID NO: 1369453 - RNA, 20 nt, Human
accccaggaacacccaagcc

SEQ ID NO: 1369454 - RNA, 23 nt, Human
accccaggaacacccaagccuua

SEQ ID NO: 1369455 - RNA, 22 nt, Human
acccccccuuaauccccucccg

SEQ ID NO: 1369456 - RNA, 21 nt, Human
acccuggggugccugcuguga

SEQ ID NO: 1369457 - RNA, 24 nt, Human
agcuguguguacccaagaagcccc

SEQ ID NO: 1369458 - RNA, 21 nt, Human
aggggccgcuacuggcccccc

SEQ ID NO: 1369459 - RNA, 19 nt, Human
agugggugaccagcuagcu

SEQ ID NO: 1369460 - RNA, 23 nt, Human
augcaggcgccguuucugcauug

SEQ ID NO: 1369461 - RNA, 18 nt, Human
caacagucaccgcccaag

SEQ ID NO: 1369462 - RNA, 23 nt, Human
cacagguacucugcaggaccccc

SEQ ID NO: 1369463 - RNA, 24 nt, Human
caccgagcgaugcaggcgccguuu

SEQ ID NO: 1369464 - RNA, 20 nt, Human
cacuucgcacugccuaagug

SEQ ID NO: 1369465 - RNA, 24 nt, Human
caggaaaugcuauagagagccaau

SEQ ID NO: 1369466 - RNA, 22 nt, Human
caggcaccaacagucaccgccc

SEQ ID NO: 1369467 - RNA, 19 nt, Human
cagguaaggcgauaccugc

SEQ ID NO: 1369468 - RNA, 21 nt, Human
caguggggcaucuugcuccag

SEQ ID NO: 1369469 - RNA, 19 nt, Human
cccaagaagccccuguccc

SEQ ID NO: 1369470 - RNA, 24 nt, Human
cccacccagcauaccuccccaggc

SEQ ID NO: 1369471 - RNA, 25 nt, Human
cccacccagcauaccuccccaggca

SEQ ID NO: 1369472 - RNA, 21 nt, Human
cccagcauaccuccccaggca

SEQ ID NO: 1369473 - RNA, 18 nt, Human
ccccacacccaguggggc

SEQ ID NO: 1369474 - RNA, 18 nt, Human
ccccaggcagcgcccagg

SEQ ID NO: 1369475 - RNA, 18 nt, Human
ccccauacaggcagcucc

SEQ ID NO: 1369476 - RNA, 23 nt, Human
ccccuccugccugcuugcugccc

SEQ ID NO: 1369477 - RNA, 21 nt, Human
cccggggaggccccuccugcc

SEQ ID NO: 1369478 - RNA, 22 nt, Human
cccuaagggucagaugggcuuc

SEQ ID NO: 1369479 - RNA, 20 nt, Human
cccuccuguguccugccugc

SEQ ID NO: 1369480 - RNA, 21 nt, Human
cccugguccugcccacccccc

SEQ ID NO: 1369481 - RNA, 21 nt, Human
ccgcaaacucagggaucacca

SEQ ID NO: 1369482 - RNA, 18 nt, Human
ccgcuacuggccccccuc

SEQ ID NO: 1369483 - RNA, 21 nt, Human
ccuccgggacugccuggggcc

SEQ ID NO: 1369484 - RNA, 18 nt, Human
ccucggcaaggacaaggc

SEQ ID NO: 1369485 - RNA, 22 nt, Human
ccucuuccagguccgccuucug

SEQ ID NO: 1369486 - RNA, 19 nt, Human
ccugcagccucuucugccu

SEQ ID NO: 1369487 - RNA, 21 nt, Human
ccugcagccucuucugccucu

SEQ ID NO: 1369488 - RNA, 21 nt, Human
ccugcccuugcaccccaggaa

SEQ ID NO: 1369489 - RNA, 23 nt, Human
ccugcccuuguaccccaggaacc

SEQ ID NO: 1369490 - RNA, 23 nt, Human
ccugcugugaggccuuacugccc

SEQ ID NO: 1369491 - RNA, 20 nt, Human
ccuggagacaggccccugga

SEQ ID NO: 1369492 - RNA, 24 nt, Human
ccuggccuugccuugagaguuggc

SEQ ID NO: 1369493 - RNA, 18 nt, Human
ccuggggugccugcugug

SEQ ID NO: 1369494 - RNA, 20 nt, Human
ccuggugcuggcuguucccc

SEQ ID NO: 1369495 - RNA, 18 nt, Human
ccugucccuuucuccccu

SEQ ID NO: 1369496 - RNA, 19 nt, Human
ccuugagaguuggcugcaa

SEQ ID NO: 1369497 - RNA, 20 nt, Human
cgcaaacucagggaucacca

SEQ ID NO: 1369498 - RNA, 25 nt, Human
cggcaaaguuguucuucggggucug

SEQ ID NO: 1369499 - RNA, 18 nt, Human
cggccaagcagggcugcu

SEQ ID NO: 1369500 - RNA, 21 nt, Human
cggccacccggggaggccccu

SEQ ID NO: 1369501 - RNA, 26 nt, Human
cuaaccacccacccagcauaccuccc

SEQ ID NO: 1369502 - RNA, 18 nt, Human
cuaaguguggugggcuuu

SEQ ID NO: 1369503 - RNA, 23 nt, Human
cuccgggacugccuggggccucu

SEQ ID NO: 1369504 - RNA, 23 nt, Human
cucuguagcaucucagggcaguc

SEQ ID NO: 1369505 - RNA, 19 nt, Human
cugcagccucuucugccuc

SEQ ID NO: 1369506 - RNA, 23 nt, Human
cugcagccucuucugccucucgg

SEQ ID NO: 1369507 - RNA, 23 nt, Human
cugcagcucuugggucugcagga

SEQ ID NO: 1369508 - RNA, 21 nt, Human
cugcagguuggugggccuggc

SEQ ID NO: 1369509 - RNA, 22 nt, Human
cugccaggcugcucuugaucgu

SEQ ID NO: 1369510 - RNA, 20 nt, Human
cuggccugcccuugcacccc

SEQ ID NO: 1369511 - RNA, 23 nt, Human
cuggggccuggccuugccuugag

SEQ ID NO: 1369512 - RNA, 22 nt, Human
cuggggggaaucaaugugguuc

SEQ ID NO: 1369513 - RNA, 23 nt, Human
cuucggggucugcuucagugccg

SEQ ID NO: 1369514 - RNA, 18 nt, Human
cuugggucugcaggaggu

SEQ ID NO: 1369515 - RNA, 22 nt, Human
gagcccagggcuccgugggcag

SEQ ID NO: 1369516 - RNA, 19 nt, Human
gaggccccuccugccugcu

SEQ ID NO: 1369517 - RNA, 20 nt, Human
gaggguuagggcugggcuga

SEQ ID NO: 1369518 - RNA, 20 nt, Human
gcagaaggugccaugagccc

SEQ ID NO: 1369519 - RNA, 22 nt, Human
gccaucccuccuguguccugcc

SEQ ID NO: 1369520 - RNA, 24 nt, Human
gcccacccccccuuaauccccucc

SEQ ID NO: 1369521 - RNA, 26 nt, Human
gcccaggccaauguggggaagagggc

SEQ ID NO: 1369522 - RNA, 20 nt, Human
gcccuggagacaggccccug

SEQ ID NO: 1369523 - RNA, 19 nt, Human
gccuuggaggguucugggg

SEQ ID NO: 1369524 - RNA, 18 nt, Human
gcuccaggccuggucucg

SEQ ID NO: 1369525 - RNA, 22 nt, Human
gcugguugcgcugcugaaagug

SEQ ID NO: 1369526 - RNA, 23 nt, Human
ggaaggggcaggaucauuggggg

SEQ ID NO: 1369527 - RNA, 20 nt, Human
ggaggagggaggucugggga

SEQ ID NO: 1369528 - RNA, 18 nt, Human
ggcggccacccggggagc

SEQ ID NO: 1369529 - RNA, 20 nt, Human
ggggcaggaucauugggggg

SEQ ID NO: 1369530 - RNA, 18 nt, Human
ggggugugccgccgcccc

SEQ ID NO: 1369531 - RNA, 20 nt, Human
ggguuagggcugggcugagg

SEQ ID NO: 1369532 - RNA, 23 nt, Human
gucauggggcccuuagggugcag

SEQ ID NO: 1369533 - RNA, 19 nt, Human
gucccuuucuccccucuga

SEQ ID NO: 1369534 - RNA, 18 nt, Human
guccugcccacccccccu

SEQ ID NO: 1369535 - RNA, 19 nt, Human
guccugcccacccccccuu

SEQ ID NO: 1369536 - RNA, 21 nt, Human
guggagaccuuggggaaaugc

SEQ ID NO: 1369537 - RNA, 22 nt, Human
uagagcguggccgucaucugcu

SEQ ID NO: 1369538 - RNA, 20 nt, Human
uagcucaaagcaccgagcga

SEQ ID NO: 1369539 - RNA, 19 nt, Human
uaucaugagcccuggagac

SEQ ID NO: 1369540 - RNA, 18 nt, Human
ucaacauaguggaagcug

SEQ ID NO: 1369541 - RNA, 24 nt, Human
ucaugagcccuggagacaggcccc

SEQ ID NO: 1369542 - RNA, 21 nt, Human
uccccaggcagcgcccaggcc

SEQ ID NO: 1369543 - RNA, 20 nt, Human
ucccuaggcggccacccggg

SEQ ID NO: 1369544 - RNA, 22 nt, Human
ucccuaggcggccacccgggga

SEQ ID NO: 1369545 - RNA, 19 nt, Human
ucccugggaaagcuagcuu

SEQ ID NO: 1369546 - RNA, 18 nt, Human
ucccugguccugcccacc

SEQ ID NO: 1369547 - RNA, 19 nt, Human
ucccugguccugcccaccc

SEQ ID NO: 1369548 - RNA, 21 nt, Human
uccgggacugccuggggccuc

SEQ ID NO: 1369549 - RNA, 18 nt, Human
uccuccgggacugccugg

SEQ ID NO: 1369550 - RNA, 23 nt, Human
uccucuuccagguccgccuucug

SEQ ID NO: 1369551 - RNA, 23 nt, Human
uccugcccacccccccuuaaucc

SEQ ID NO: 1369552 - RNA, 18 nt, Human
uccugcugguugcgcugc

SEQ ID NO: 1369553 - RNA, 18 nt, Human
ucugccucucggcaaagu

SEQ ID NO: 1369554 - RNA, 19 nt, Human
ucuuggaauuuagccaggc

SEQ ID NO: 1369555 - RNA, 19 nt, Human
ugagcccagggcuccgugg

SEQ ID NO: 1369556 - RNA, 21 nt, Human
ugaggguuagggcugggcuga

SEQ ID NO: 1369557 - RNA, 21 nt, Human
ugaucgugaccccacacccag

SEQ ID NO: 1369558 - RNA, 22 nt, Human
ugcaagucagacccuacaaggc

SEQ ID NO: 1369559 - RNA, 18 nt, Human
ugccaaauagcaaaauaa

SEQ ID NO: 1369560 - RNA, 21 nt, Human
ugcccacccccccuuaauccc

SEQ ID NO: 1369561 - RNA, 26 nt, Human
ugcccacccccccuuaauccccuccc

SEQ ID NO: 1369562 - RNA, 18 nt, Human
ugcccuggugcuggcugu

SEQ ID NO: 1369563 - RNA, 22 nt, Human
ugccuggggccucuggcucccu

SEQ ID NO: 1369564 - RNA, 19 nt, Human
ugcgucuaaccacccaccc

SEQ ID NO: 1369565 - RNA, 21 nt, Human
uggagacaggccccuggagcu

SEQ ID NO: 1369566 - RNA, 24 nt, Human
ugggcagugccaucccuccugugu

SEQ ID NO: 1369567 - RNA, 23 nt, Human
uggggugccugcugugaggccuu

SEQ ID NO: 1369568 - RNA, 19 nt, Human
uggugaggguuagggcugg

SEQ ID NO: 1369569 - RNA, 21 nt, Human
uguccugcugguugcgcugcu

SEQ ID NO: 1369570 - RNA, 21 nt, Human
ugugccgccgcccccaucugc

SEQ ID NO: 1369571 - RNA, 19 nt, Human
uuaccuggccugcccuugc

SEQ ID NO: 1369572 - RNA, 21 nt, Human
uuagaggccucugcuuucucc

SEQ ID NO: 1369573 - RNA, 22 nt, Human
uuccccauacaggcagcuccug

SEQ ID NO: 1369574 - RNA, 22 nt, Human
uuccuccucuguaaagggaagc

SEQ ID NO: 1369575 - RNA, 18 nt, Human
uucgcaggggaaggggca

SEQ ID NO: 1369576 - RNA, 19 nt, Human
uugaaggagccgggcuggg

SEQ ID NO: 1369577 - RNA, 23 nt, Human
uugaucgugaccccacacccagu

SEQ ID NO: 1369578 - RNA, 24 nt, Human
uugccuugagaguuggcugcaagu

SEQ ID NO: 1369579 - RNA, 18 nt, Human
uugcuccaggccuggucu

SEQ ID NO: 1369580 - RNA, 18 nt, Human
aaacucaaucggcacuau

SEQ ID NO: 1369581 - RNA, 18 nt, Human
aacaagauccucccccug

SEQ ID NO: 1369582 - RNA, 19 nt, Human
aacugggcccacccaaagc

SEQ ID NO: 1369583 - RNA, 19 nt, Human
aagcucccccgcucugccu

SEQ ID NO: 1369584 - RNA, 19 nt, Human
agcacacacacauaugugc

SEQ ID NO: 1369585 - RNA, 25 nt, Human
aggacuguacuuugcuggacguggc

SEQ ID NO: 1369586 - RNA, 24 nt, Human
aguaagauuaaacugcccuauuuc

SEQ ID NO: 1369587 - RNA, 18 nt, Human
aguaggcucugccacugg

SEQ ID NO: 1369588 - RNA, 21 nt, Human
aguuauuucuuugacuauuac

SEQ ID NO: 1369589 - RNA, 21 nt, Human
cacacauaugugcacaaacac

SEQ ID NO: 1369590 - RNA, 19 nt, Human
cacggcaugaacggucacc

SEQ ID NO: 1369591 - RNA, 23 nt, Human
cacuucccgggcuccccacuccc

SEQ ID NO: 1369592 - RNA, 23 nt, Human
cagaacuucagaacacacggcau

SEQ ID NO: 1369593 - RNA, 23 nt, Human
cagcaagcucccccgcucugccu

SEQ ID NO: 1369594 - RNA, 18 nt, Human
ccaaagcaaaaaaaaaaa

SEQ ID NO: 1369595 - RNA, 22 nt, Human
ccaaagcaaaaaaaaaaaaaaa

SEQ ID NO: 1369596 - RNA, 26 nt, Human
ccaaagcaaaaaaaaaaaaaaaaaaa

SEQ ID NO: 1369597 - RNA, 23 nt, Human
ccacccaaagcaaaaaaaaaaaa

SEQ ID NO: 1369598 - RNA, 22 nt, Human
cccaaagcaaaaaaaaaaaaaa

SEQ ID NO: 1369599 - RNA, 23 nt, Human
cccaaagcaaaaaaaaaaaaaaa

SEQ ID NO: 1369600 - RNA, 20 nt, Human
ccccugaaaaaugccgacuu

SEQ ID NO: 1369601 - RNA, 22 nt, Human
cccgcucugccuccugcggccc

SEQ ID NO: 1369602 - RNA, 24 nt, Human
ccgcucagguuaaaagagccacgu

SEQ ID NO: 1369603 - RNA, 19 nt, Human
ccuccgggccccugucacc

SEQ ID NO: 1369604 - RNA, 21 nt, Human
ccuguguaggcagccauguuu

SEQ ID NO: 1369605 - RNA, 18 nt, Human
ccuucuucgcuuugagaa

SEQ ID NO: 1369606 - RNA, 22 nt, Human
cgcccgacacuucccgggcucc

SEQ ID NO: 1369607 - RNA, 21 nt, Human
cgcucugccuccugcggccca

SEQ ID NO: 1369608 - RNA, 20 nt, Human
cgggccccugucaccuccuc

SEQ ID NO: 1369609 - RNA, 18 nt, Human
cuauuccuuuuucuuagc

SEQ ID NO: 1369610 - RNA, 24 nt, Human
cuccacacgcccgacacuucccgg

SEQ ID NO: 1369611 - RNA, 22 nt, Human
cugauucucucuacuuucucac

SEQ ID NO: 1369612 - RNA, 18 nt, Human
gaacggucacccuccucu

SEQ ID NO: 1369613 - RNA, 23 nt, Human
gcaaaaaaaaaaaaaaaaaaaaa

SEQ ID NO: 1369614 - RNA, 19 nt, Human
gccauguuuucucuccagu

SEQ ID NO: 1369615 - RNA, 25 nt, Human
gcgguuccuguguaggcagccaugu

SEQ ID NO: 1369616 - RNA, 20 nt, Human
gcucccccgcucugccuccu

SEQ ID NO: 1369617 - RNA, 19 nt, Human
gcucucgggagauucaccc

SEQ ID NO: 1369618 - RNA, 23 nt, Human
guaacaagauccucccccugaaa

SEQ ID NO: 1369619 - RNA, 21 nt, Human
gucuugagcggugcugguauc

SEQ ID NO: 1369620 - RNA, 27 nt, Human
uaacaagauccucccccugaaaaaugc

SEQ ID NO: 1369621 - RNA, 19 nt, Human
uaguaggcucugccacugg

SEQ ID NO: 1369622 - RNA, 24 nt, Human
uauaagcacacacacauaugugca

SEQ ID NO: 1369623 - RNA, 25 nt, Human
ucagaacacacggcaugaacgguca

SEQ ID NO: 1369624 - RNA, 19 nt, Human
ucccgggcuccccacuccc

SEQ ID NO: 1369625 - RNA, 20 nt, Human
ucccgggcuccccacucccu

SEQ ID NO: 1369626 - RNA, 22 nt, Human
ucccuccgggccccugucaccu

SEQ ID NO: 1369627 - RNA, 21 nt, Human
uccuccgugguucagugugcu

SEQ ID NO: 1369628 - RNA, 24 nt, Human
ucgguaacaagauccucccccuga

SEQ ID NO: 1369629 - RNA, 18 nt, Human
ucuguaccuuuacuccuc

SEQ ID NO: 1369630 - RNA, 19 nt, Human
ugcacaaacaccaauauuc

SEQ ID NO: 1369631 - RNA, 23 nt, Human
ugcaucugaaacucaaucggcac

SEQ ID NO: 1369632 - RNA, 23 nt, Human
ugcuuugaaucucuaugucuaaa

SEQ ID NO: 1369633 - RNA, 26 nt, Human
uuagcagucacccauaaaacgcaaac

SEQ ID NO: 1369634 - RNA, 25 nt, Human
uucaaggguuauaagcacacacaca

SEQ ID NO: 1369635 - RNA, 23 nt, Human
uucccgggcuccccacucccucc

SEQ ID NO: 1369636 - RNA, 26 nt, Human
uuucucacugaugucauuuauucgau

SEQ ID NO: 1369637 - RNA, 21 nt, Human
aaaccaauaacgcauggacaa

SEQ ID NO: 1369638 - RNA, 19 nt, Human
aacaaaaucaccacugcca

SEQ ID NO: 1369639 - RNA, 18 nt, Human
aagaaagcacuacaugcg

SEQ ID NO: 1369640 - RNA, 23 nt, Human
aagaaguacucugucaacagcca

SEQ ID NO: 1369641 - RNA, 25 nt, Human
agaaaucagaaguuuccacggccuu

SEQ ID NO: 1369642 - RNA, 23 nt, Human
agacugagaagcccaagaaguac

SEQ ID NO: 1369643 - RNA, 24 nt, Human
agagguagaguagcuggauuaaag

SEQ ID NO: 1369644 - RNA, 26 nt, Human
aguaauaaaaauauaaaaaauauauc

SEQ ID NO: 1369645 - RNA, 20 nt, Human
auccccaacaagaaucagcc

SEQ ID NO: 1369646 - RNA, 24 nt, Human
caaguaacucuuuccugcuccaaa

SEQ ID NO: 1369647 - RNA, 24 nt, Human
cacggccuugcauuuccaauggug

SEQ ID NO: 1369648 - RNA, 23 nt, Human
cacucccaacucugauaaaguuu

SEQ ID NO: 1369649 - RNA, 22 nt, Human
cauuuuugcuauaagcugaaga

SEQ ID NO: 1369650 - RNA, 25 nt, Human
cucaaugcuuuuucucacauagacu

SEQ ID NO: 1369651 - RNA, 21 nt, Human
cucccaacucugauaaaguuu

SEQ ID NO: 1369652 - RNA, 20 nt, Human
cugaaaaucaaauccuuuuc

SEQ ID NO: 1369653 - RNA, 20 nt, Human
gaaucagcuuuucacacuca

SEQ ID NO: 1369654 - RNA, 23 nt, Human
gaucauuuuugcuauaagcugaa

SEQ ID NO: 1369655 - RNA, 22 nt, Human
ggacaaccauguuagugggcca

SEQ ID NO: 1369656 - RNA, 21 nt, Human
gggauccccaacaagaaucag

SEQ ID NO: 1369657 - RNA, 20 nt, Human
gguccaaagaaagcacuaca

SEQ ID NO: 1369658 - RNA, 18 nt, Human
gguuuggcaaucuuccua

SEQ ID NO: 1369659 - RNA, 23 nt, Human
gucuaggguuuuugaaaccaccc

SEQ ID NO: 1369660 - RNA, 19 nt, Human
guuuguuccaauccauuuu

SEQ ID NO: 1369661 - RNA, 18 nt, Human
uaacacucccaacucuga

SEQ ID NO: 1369662 - RNA, 28 nt, Human
uaauaaaaauauaaaaaauauaucaugu

SEQ ID NO: 1369663 - RNA, 23 nt, Human
uacaaaauauuuacaccaugucu

SEQ ID NO: 1369664 - RNA, 21 nt, Human
uacaaagaacaaaaucaccac

SEQ ID NO: 1369665 - RNA, 22 nt, Human
uagaagaagaaaucagaaguuu

SEQ ID NO: 1369666 - RNA, 19 nt, Human
uagcuaacuucaauguugc

SEQ ID NO: 1369667 - RNA, 18 nt, Human
uaguagaagaagaaaucc

SEQ ID NO: 1369668 - RNA, 25 nt, Human
uaguaggauuuuauacuaccuuuug

SEQ ID NO: 1369669 - RNA, 21 nt, Human
ucaaacagcuguacaaagaac

SEQ ID NO: 1369670 - RNA, 25 nt, Human
ucaaugcuuucaugugaugccauca

SEQ ID NO: 1369671 - RNA, 21 nt, Human
ucagcaggguucuauuggucc

SEQ ID NO: 1369672 - RNA, 22 nt, Human
ucaugagcugcaucagaacccu

SEQ ID NO: 1369673 - RNA, 23 nt, Human
uccaagacugagaagcccaagaa

SEQ ID NO: 1369674 - RNA, 18 nt, Human
ucucuuacugacucuuuu

SEQ ID NO: 1369675 - RNA, 24 nt, Human
ucuuaaauauaagccaauacucuu

SEQ ID NO: 1369676 - RNA, 24 nt, Human
ucuuccuaacacucccaacucuga

SEQ ID NO: 1369677 - RNA, 27 nt, Human
ugagaagcccaagaaguacucugucaa

SEQ ID NO: 1369678 - RNA, 22 nt, Human
ugccagcaaguaacucuuuccu

SEQ ID NO: 1369679 - RNA, 18 nt, Human
ugcuagcauuacaaacca

SEQ ID NO: 1369680 - RNA, 21 nt, Human
ugcucaaugcuuuuucucaca

SEQ ID NO: 1369681 - RNA, 21 nt, Human
uguacaaagaacaaaaucacc

SEQ ID NO: 1369682 - RNA, 28 nt, Human
uuaagauaaaguuugguuuuugguucau

SEQ ID NO: 1369683 - RNA, 22 nt, Human
uuaguagaagaagaaaucagaa

SEQ ID NO: 1369684 - RNA, 24 nt, Human
uucaauguugcuccuaggcugagu

SEQ ID NO: 1369685 - RNA, 19 nt, Human
uugaaaccacccaaagauc

SEQ ID NO: 1369686 - RNA, 24 nt, Human
uuugcuauaagcugaagaucuuuc

SEQ ID NO: 1369687 - RNA, 23 nt, Human
uuuguuccaauccauuuucauga

SEQ ID NO: 1369688 - RNA, 24 nt, Human
aaagugcugagauuagaggcguga

SEQ ID NO: 1369689 - RNA, 22 nt, Human
aaguagcugggauuacaggcac

SEQ ID NO: 1369690 - RNA, 27 nt, Human
aaguagcugggauuacaggcaccuguc

SEQ ID NO: 1369691 - RNA, 26 nt, Human
aagugcugagauuagaggcgugagcc

SEQ ID NO: 1369692 - RNA, 21 nt, Human
acaggcaccugucaccaugcc

SEQ ID NO: 1369693 - RNA, 21 nt, Human
aggcccgaauacagccggcag

SEQ ID NO: 1369694 - RNA, 25 nt, Human
aggcuggagugcaguggcacgaucu

SEQ ID NO: 1369695 - RNA, 20 nt, Human
aguccaguccaaggcccgaa

SEQ ID NO: 1369696 - RNA, 23 nt, Human
agugauucucaugccucggccuc

SEQ ID NO: 1369697 - RNA, 24 nt, Human
agugauucucaugccucggccucc

SEQ ID NO: 1369698 - RNA, 21 nt, Human
agugcaguggcacgaucucag

SEQ ID NO: 1369699 - RNA, 23 nt, Human
agugcaguggcacgaucucagcu

SEQ ID NO: 1369700 - RNA, 22 nt, Human
augccucggccucccaaguagc

SEQ ID NO: 1369701 - RNA, 23 nt, Human
augccucggccucccaaguagcu

SEQ ID NO: 1369702 - RNA, 24 nt, Human
caaagugcugagauuagaggcgug

SEQ ID NO: 1369703 - RNA, 22 nt, Human
caagugauucucaugccucggc

SEQ ID NO: 1369704 - RNA, 28 nt, Human
caagugauucucaugccucggccuccca

SEQ ID NO: 1369705 - RNA, 21 nt, Human
cacugcaaccuccgccucccg

SEQ ID NO: 1369706 - RNA, 23 nt, Human
cacugcaaccuccgccucccggg

SEQ ID NO: 1369707 - RNA, 28 nt, Human
caggaaccccaccgucccaaccuucagg

SEQ ID NO: 1369708 - RNA, 24 nt, Human
cauguuggccaggcuggucuugaa

SEQ ID NO: 1369709 - RNA, 22 nt, Human
ccaaagugcugagauuagaggc

SEQ ID NO: 1369710 - RNA, 24 nt, Human
ccaaagugcugagauuagaggcgu

SEQ ID NO: 1369711 - RNA, 23 nt, Human
ccaaguagcugggauuacaggca

SEQ ID NO: 1369712 - RNA, 19 nt, Human
ccauguuggccaggcuggu

SEQ ID NO: 1369713 - RNA, 21 nt, Human
ccauguuggccaggcuggucu

SEQ ID NO: 1369714 - RNA, 21 nt, Human
ccauguuggccaggcuggucu

SEQ ID NO: 1369715 - RNA, 23 nt, Human
cccaaguagcugggauuacaggc

SEQ ID NO: 1369716 - RNA, 24 nt, Human
cccaaguagcugggauuacaggca

SEQ ID NO: 1369717 - RNA, 20 nt, Human
cccggguucaagugauucuc

SEQ ID NO: 1369718 - RNA, 23 nt, Human
cccggguucaagugauucucaug

SEQ ID NO: 1369719 - RNA, 24 nt, Human
ccgccucccggguucaagugauuc

SEQ ID NO: 1369720 - RNA, 21 nt, Human
ccguagcuucucaguccaguc

SEQ ID NO: 1369721 - RNA, 18 nt, Human
ccugaccucagaugaucc

SEQ ID NO: 1369722 - RNA, 24 nt, Human
cgcucuggugcccaggcuggagug

SEQ ID NO: 1369723 - RNA, 24 nt, Human
cucacugcaaccuccgccucccgg

SEQ ID NO: 1369724 - RNA, 25 nt, Human
cucaugccucggccucccaaguagc

SEQ ID NO: 1369725 - RNA, 24 nt, Human
cuccauguuggccaggcuggucuu

SEQ ID NO: 1369726 - RNA, 20 nt, Human
cucccggguucaagugauuc

SEQ ID NO: 1369727 - RNA, 24 nt, Human
cucggccucccaaguagcugggau

SEQ ID NO: 1369728 - RNA, 23 nt, Human
cugcaaccuccgccucccggguu

SEQ ID NO: 1369729 - RNA, 24 nt, Human
cugcaaccuccgccucccggguuc

SEQ ID NO: 1369730 - RNA, 19 nt, Human
cuggugcccaggcuggagu

SEQ ID NO: 1369731 - RNA, 21 nt, Human
cugguggccgcgccaccuucc

SEQ ID NO: 1369732 - RNA, 26 nt, Human
gaauacagccggcaggaaccccaccg

SEQ ID NO: 1369733 - RNA, 23 nt, Human
gaccucagaugauccgcugucuu

SEQ ID NO: 1369734 - RNA, 18 nt, Human
gacggagucucgcucugg

SEQ ID NO: 1369735 - RNA, 24 nt, Human
gauuacaggcaccugucaccaugc

SEQ ID NO: 1369736 - RNA, 18 nt, Human
gauuagaggcgugagcca

SEQ ID NO: 1369737 - RNA, 19 nt, Human
gcccaggcuggagugcagu

SEQ ID NO: 1369738 - RNA, 21 nt, Human
gccucggccucccaaguagcu

SEQ ID NO: 1369739 - RNA, 19 nt, Human
gcuggagugcaguggcacg

SEQ ID NO: 1369740 - RNA, 23 nt, Human
gcuggucuugaacuccugaccuc

SEQ ID NO: 1369741 - RNA, 19 nt, Human
ggagucucgcucuggugcc

SEQ ID NO: 1369742 - RNA, 24 nt, Human
ggcuggucuugaacuccugaccuc

SEQ ID NO: 1369743 - RNA, 22 nt, Human
gggguuucuccauguuggccag

SEQ ID NO: 1369744 - RNA, 23 nt, Human
gggguuucuccauguuggccagg

SEQ ID NO: 1369745 - RNA, 22 nt, Human
ggguuucuccauguuggccagg

SEQ ID NO: 1369746 - RNA, 19 nt, Human
ggucuugaacuccugaccu

SEQ ID NO: 1369747 - RNA, 18 nt, Human
guagcugggauuacaggc

SEQ ID NO: 1369748 - RNA, 24 nt, Human
gucucgcucuggugcccaggcugg

SEQ ID NO: 1369749 - RNA, 24 nt, Human
gugcccaggcuggagugcaguggc

SEQ ID NO: 1369750 - RNA, 22 nt, Human
uacaggcaccugucaccaugcc

SEQ ID NO: 1369751 - RNA, 19 nt, Human
uagcuucucaguccagucc

SEQ ID NO: 1369752 - RNA, 23 nt, Human
ucacugcaaccuccgccucccgg

SEQ ID NO: 1369753 - RNA, 24 nt, Human
ucacugcaaccuccgccucccggg

SEQ ID NO: 1369754 - RNA, 25 nt, Human
ucacugcaaccuccgccucccgggu

SEQ ID NO: 1369755 - RNA, 27 nt, Human
ucacugcaaccuccgccucccggguuc

SEQ ID NO: 1369756 - RNA, 24 nt, Human
ucccaaagugcugagauuagaggc

SEQ ID NO: 1369757 - RNA, 24 nt, Human
ucccaaguagcugggauuacaggc

SEQ ID NO: 1369758 - RNA, 21 nt, Human
ucccggguucaagugauucuc

SEQ ID NO: 1369759 - RNA, 24 nt, Human
ucccggguucaagugauucucaug

SEQ ID NO: 1369760 - RNA, 19 nt, Human
ucuccaccguagcuucuca

SEQ ID NO: 1369761 - RNA, 23 nt, Human
ucucgcucuggugcccaggcugg

SEQ ID NO: 1369762 - RNA, 24 nt, Human
ucucgcucuggugcccaggcugga

SEQ ID NO: 1369763 - RNA, 22 nt, Human
ucuggugcccaggcuggagugc

SEQ ID NO: 1369764 - RNA, 24 nt, Human
ucuggugcccaggcuggagugcag

SEQ ID NO: 1369765 - RNA, 21 nt, Human
ucuucggccucccaaagugcu

SEQ ID NO: 1369766 - RNA, 19 nt, Human
ugaccucagaugauccgcu

SEQ ID NO: 1369767 - RNA, 22 nt, Human
ugaccucagaugauccgcuguc

SEQ ID NO: 1369768 - RNA, 23 nt, Human
ugaccucagaugauccgcugucu

SEQ ID NO: 1369769 - RNA, 22 nt, Human
ugcaguggcacgaucucagcuc

SEQ ID NO: 1369770 - RNA, 18 nt, Human
ugcccaggcuggagugca

SEQ ID NO: 1369771 - RNA, 21 nt, Human
ugcccaggcuggagugcagug

SEQ ID NO: 1369772 - RNA, 22 nt, Human
ugcccaggcuggagugcagugg

SEQ ID NO: 1369773 - RNA, 24 nt, Human
ugcccaggcuggagugcaguggca

SEQ ID NO: 1369774 - RNA, 21 nt, Human
ugccguggcccugaggccagc

SEQ ID NO: 1369775 - RNA, 21 nt, Human
ugccucggccucccaaguagc

SEQ ID NO: 1369776 - RNA, 24 nt, Human
ugccucggccucccaaguagcugg

SEQ ID NO: 1369777 - RNA, 23 nt, Human
uggagugcaguggcacgaucuca

SEQ ID NO: 1369778 - RNA, 24 nt, Human
uggagugcaguggcacgaucucag

SEQ ID NO: 1369779 - RNA, 24 nt, Human
uggcacgaucucagcucacugcaa

SEQ ID NO: 1369780 - RNA, 24 nt, Human
uggccaggcuggucuugaacuccu

SEQ ID NO: 1369781 - RNA, 22 nt, Human
ugggauuacaggcaccugucac

SEQ ID NO: 1369782 - RNA, 24 nt, Human
ugggauuacaggcaccugucacca

SEQ ID NO: 1369783 - RNA, 25 nt, Human
ugggauuacaggcaccugucaccau

SEQ ID NO: 1369784 - RNA, 21 nt, Human
uucaagugauucucaugccuc

SEQ ID NO: 1369785 - RNA, 21 nt, Human
uuucuccauguuggccaggcu

SEQ ID NO: 1369786 - RNA, 20 nt, Human
aagacaacuuggcuucugag

SEQ ID NO: 1369787 - RNA, 18 nt, Human
aagacacugagcacagcc

SEQ ID NO: 1369788 - RNA, 24 nt, Human
aagacacugagcacagcccagagc

SEQ ID NO: 1369789 - RNA, 20 nt, Human
aagagaacagagcggcacug

SEQ ID NO: 1369790 - RNA, 18 nt, Human
aagagacacuccagaggc

SEQ ID NO: 1369791 - RNA, 20 nt, Human
aaggaaagagaacagagcgg

SEQ ID NO: 1369792 - RNA, 18 nt, Human
aaggagaagagaugggga

SEQ ID NO: 1369793 - RNA, 19 nt, Human
aaguccucucucccuccac

SEQ ID NO: 1369794 - RNA, 18 nt, Human
aauucuaaaucaaaucac

SEQ ID NO: 1369795 - RNA, 21 nt, Human
aauucucucuagagaagagac

SEQ ID NO: 1369796 - RNA, 21 nt, Human
acacaaaagaaaggaaagcug

SEQ ID NO: 1369797 - RNA, 19 nt, Human
acaguagucagucucagcu

SEQ ID NO: 1369798 - RNA, 21 nt, Human
acaguuucucucuuucugccu

SEQ ID NO: 1369799 - RNA, 20 nt, Human
acaugaaaauuuccagaaau

SEQ ID NO: 1369800 - RNA, 18 nt, Human
accccagcuuuagcuacu

SEQ ID NO: 1369801 - RNA, 18 nt, Human
accccuccuacgcggacu

SEQ ID NO: 1369802 - RNA, 21 nt, Human
acucugacaguuucucucuuu

SEQ ID NO: 1369803 - RNA, 19 nt, Human
agaacuggcugaaacaaga

SEQ ID NO: 1369804 - RNA, 21 nt, Human
agaaggugauaaaaagagcac

SEQ ID NO: 1369805 - RNA, 19 nt, Human
agagaagagacacuccaga

SEQ ID NO: 1369806 - RNA, 18 nt, Human
agaggaagaagaggggga

SEQ ID NO: 1369807 - RNA, 21 nt, Human
agccacaugucucaccaggaa

SEQ ID NO: 1369808 - RNA, 20 nt, Human
agcccagagccaauaaaaga

SEQ ID NO: 1369809 - RNA, 18 nt, Human
agccuagaaggcagagca

SEQ ID NO: 1369810 - RNA, 22 nt, Human
agcuacugcaauuaugauuuuu

SEQ ID NO: 1369811 - RNA, 21 nt, Human
agcuugccgagggaugguggg

SEQ ID NO: 1369812 - RNA, 21 nt, Human
aggaagaagagggggaguggg

SEQ ID NO: 1369813 - RNA, 21 nt, Human
auaagauucagaggaagaagc

SEQ ID NO: 1369814 - RNA, 21 nt, Human
augcaguugggcugaccugac

SEQ ID NO: 1369815 - RNA, 24 nt, Human
augcuucccugguuuuagcacaca

SEQ ID NO: 1369816 - RNA, 24 nt, Human
caaagacacugagcacagcccagu

SEQ ID NO: 1369817 - RNA, 18 nt, Human
caaagcucugaugaagaa

SEQ ID NO: 1369818 - RNA, 18 nt, Human
caaaguaggagagaggcc

SEQ ID NO: 1369819 - RNA, 24 nt, Human
caaaucccaccaaaguccugacuc

SEQ ID NO: 1369820 - RNA, 21 nt, Human
caaaugauucauuuuccuaac

SEQ ID NO: 1369821 - RNA, 21 nt, Human
caaggcccugccaccuggcuu

SEQ ID NO: 1369822 - RNA, 22 nt, Human
cacaacagugaaaauuagugac

SEQ ID NO: 1369823 - RNA, 21 nt, Human
cacaaggguggcaggaggagg

SEQ ID NO: 1369824 - RNA, 23 nt, Human
cacacaaaagaaaggaaagcugc

SEQ ID NO: 1369825 - RNA, 19 nt, Human
cacccaugagagaugacuc

SEQ ID NO: 1369826 - RNA, 22 nt, Human
cacugggauuugaaaggggaac

SEQ ID NO: 1369827 - RNA, 19 nt, Human
cagaaaacacacaaaagaa

SEQ ID NO: 1369828 - RNA, 22 nt, Human
cagaggaaagcccaucucccuc

SEQ ID NO: 1369829 - RNA, 21 nt, Human
cagcuuuggggucuccagaaa

SEQ ID NO: 1369830 - RNA, 19 nt, Human
caggaguugggguggcacg

SEQ ID NO: 1369831 - RNA, 20 nt, Human
cagggucacauguggguuuc

SEQ ID NO: 1369832 - RNA, 23 nt, Human
caucucccuccagcuuugggguc

SEQ ID NO: 1369833 - RNA, 23 nt, Human
cauuuggccagccuggcuuuacu

SEQ ID NO: 1369834 - RNA, 19 nt, Human
ccacugcacugaggggggu

SEQ ID NO: 1369835 - RNA, 20 nt, Human
cccagagccaauaaaagauc

SEQ ID NO: 1369836 - RNA, 21 nt, Human
ccccugcaacuuugcggauuu

SEQ ID NO: 1369837 - RNA, 18 nt, Human
cccuccuacgcggacucc

SEQ ID NO: 1369838 - RNA, 21 nt, Human
cccugccaccuggcuuuacaa

SEQ ID NO: 1369839 - RNA, 19 nt, Human
ccucaagaucuuuguuucc

SEQ ID NO: 1369840 - RNA, 18 nt, Human
ccuccuacgcggacucca

SEQ ID NO: 1369841 - RNA, 22 nt, Human
ccugcagaacuggcugaaacaa

SEQ ID NO: 1369842 - RNA, 19 nt, Human
ccuguggcagguucuggga

SEQ ID NO: 1369843 - RNA, 18 nt, Human
cggcaguauucucggcug

SEQ ID NO: 1369844 - RNA, 19 nt, Human
cucacuccauuucauugaa

SEQ ID NO: 1369845 - RNA, 22 nt, Human
cuccagaaagaggcuggauuuc

SEQ ID NO: 1369846 - RNA, 24 nt, Human
cuccuacgcggacuccagucacau

SEQ ID NO: 1369847 - RNA, 20 nt, Human
cuccuggcagagggugagug

SEQ ID NO: 1369848 - RNA, 24 nt, Human
cucugaggccaaagacacugagca

SEQ ID NO: 1369849 - RNA, 19 nt, Human
cucuugagugggugcccag

SEQ ID NO: 1369850 - RNA, 23 nt, Human
cugcagccuaggggacagggcug

SEQ ID NO: 1369851 - RNA, 26 nt, Human
cugguccuaguccacaaggguggcag

SEQ ID NO: 1369852 - RNA, 22 nt, Human
cugugaguuaagccacaugucu

SEQ ID NO: 1369853 - RNA, 22 nt, Human
cuuuccuaaugcacaguaguca

SEQ ID NO: 1369854 - RNA, 23 nt, Human
cuuuccuugccucuucauaaaag

SEQ ID NO: 1369855 - RNA, 20 nt, Human
gaagaagagggggaguggga

SEQ ID NO: 1369856 - RNA, 18 nt, Human
gaagaggggagggcuucc

SEQ ID NO: 1369857 - RNA, 21 nt, Human
gaggggaaggaaagagaacag

SEQ ID NO: 1369858 - RNA, 22 nt, Human
gcagaaggaugagguggugagc

SEQ ID NO: 1369859 - RNA, 20 nt, Human
gcaguugggcugaccugaca

SEQ ID NO: 1369860 - RNA, 22 nt, Human
gccuaggggacagggcugcuug

SEQ ID NO: 1369861 - RNA, 19 nt, Human
ggaaaccugugaguuaagc

SEQ ID NO: 1369862 - RNA, 18 nt, Human
ggaaagcccaucucccuc

SEQ ID NO: 1369863 - RNA, 19 nt, Human
ggaaggaaagagaacagag

SEQ ID NO: 1369864 - RNA, 18 nt, Human
ggcgauauucagggguca

SEQ ID NO: 1369865 - RNA, 24 nt, Human
gggcuucccucaucuuccucaaga

SEQ ID NO: 1369866 - RNA, 20 nt, Human
ggggacugugaagaggggag

SEQ ID NO: 1369867 - RNA, 23 nt, Human
gggugaguggggaccuacgaggu

SEQ ID NO: 1369868 - RNA, 18 nt, Human
ggguuuccccuuuccuug

SEQ ID NO: 1369869 - RNA, 21 nt, Human
ggugaguggggaccuacgagg

SEQ ID NO: 1369870 - RNA, 18 nt, Human
gugaaauuauacucugac

SEQ ID NO: 1369871 - RNA, 20 nt, Human
gugcuggggcuccccaaggc

SEQ ID NO: 1369872 - RNA, 18 nt, Human
uaaaaagagcacucuuga

SEQ ID NO: 1369873 - RNA, 22 nt, Human
uaagaacacagaaaacacacaa

SEQ ID NO: 1369874 - RNA, 18 nt, Human
uaaguccucucucccucc

SEQ ID NO: 1369875 - RNA, 21 nt, Human
uaauuuccccucgauuccaca

SEQ ID NO: 1369876 - RNA, 21 nt, Human
uacacggccaauacuaacgcc

SEQ ID NO: 1369877 - RNA, 19 nt, Human
uaccaaaaucagggucaca

SEQ ID NO: 1369878 - RNA, 22 nt, Human
uaugaaacugaaaaucaaauca

SEQ ID NO: 1369879 - RNA, 22 nt, Human
ucaaucuguuggguaagaccuc

SEQ ID NO: 1369880 - RNA, 24 nt, Human
ucacauguggguuuccccuuuccu

SEQ ID NO: 1369881 - RNA, 21 nt, Human
ucaccaggaauaauuuaugcc

SEQ ID NO: 1369882 - RNA, 19 nt, Human
ucagcucuccugccuuacu

SEQ ID NO: 1369883 - RNA, 24 nt, Human
uccaaaugauucauuuuccuaccg

SEQ ID NO: 1369884 - RNA, 18 nt, Human
uccacaggagggaagacc

SEQ ID NO: 1369885 - RNA, 19 nt, Human
ucccaagucagcucuccug

SEQ ID NO: 1369886 - RNA, 19 nt, Human
uccccaaggcccugccacc

SEQ ID NO: 1369887 - RNA, 25 nt, Human
uccccaaggcccugccaccuggcuu

SEQ ID NO: 1369888 - RNA, 19 nt, Human
uccccagggaaauccugcc

SEQ ID NO: 1369889 - RNA, 23 nt, Human
uccccagggaaauccugccuccg

SEQ ID NO: 1369890 - RNA, 20 nt, Human
uccuguggcagguucuggga

SEQ ID NO: 1369891 - RNA, 18 nt, Human
ucugccucuucccucugc

SEQ ID NO: 1369892 - RNA, 20 nt, Human
ugaagaaacaagacuccuug

SEQ ID NO: 1369893 - RNA, 20 nt, Human
ugaagaggggagggcuuccc

SEQ ID NO: 1369894 - RNA, 20 nt, Human
ugaccugacaaagcccccag

SEQ ID NO: 1369895 - RNA, 18 nt, Human
ugacgcggagccgccccu

SEQ ID NO: 1369896 - RNA, 19 nt, Human
ugacucaaugccaaggccu

SEQ ID NO: 1369897 - RNA, 22 nt, Human
ugagaaaaagcaauagaugggg

SEQ ID NO: 1369898 - RNA, 20 nt, Human
ugagcacagcccagagccaa

SEQ ID NO: 1369899 - RNA, 23 nt, Human
ugagcacagcccagagccaauaa

SEQ ID NO: 1369900 - RNA, 24 nt, Human
ugagcuugccgagggaugguggga

SEQ ID NO: 1369901 - RNA, 22 nt, Human
ugaggagcccccacuggcuuca

SEQ ID NO: 1369902 - RNA, 19 nt, Human
ugaguccaucugacuuaag

SEQ ID NO: 1369903 - RNA, 19 nt, Human
ugagugaagacuuucccca

SEQ ID NO: 1369904 - RNA, 18 nt, Human
ugaugaagaaacaagacu

SEQ ID NO: 1369905 - RNA, 18 nt, Human
ugcaugcaguugggcuga

SEQ ID NO: 1369906 - RNA, 20 nt, Human
ugcauucaagcuucugcagc

SEQ ID NO: 1369907 - RNA, 18 nt, Human
ugccaaggccugaaguua

SEQ ID NO: 1369908 - RNA, 20 nt, Human
ugcuggggcuccccaaggcc

SEQ ID NO: 1369909 - RNA, 20 nt, Human
ugcuuguucaguuauuacug

SEQ ID NO: 1369910 - RNA, 18 nt, Human
uggcagagggugaguggg

SEQ ID NO: 1369911 - RNA, 25 nt, Human
uggcagagggugaguggggaccuuc

SEQ ID NO: 1369912 - RNA, 21 nt, Human
uggcaggaggaggguggaggc

SEQ ID NO: 1369913 - RNA, 22 nt, Human
uggcaggaggaggguggaggcu

SEQ ID NO: 1369914 - RNA, 23 nt, Human
uggccagccuggcuuuacuaaca

SEQ ID NO: 1369915 - RNA, 20 nt, Human
uggcugagcucuccugggcu

SEQ ID NO: 1369916 - RNA, 22 nt, Human
ugggaagggggcucccuguugg

SEQ ID NO: 1369917 - RNA, 20 nt, Human
ugggaugaagccuagaaggc

SEQ ID NO: 1369918 - RNA, 20 nt, Human
ugggcugaccugacaaagcc

SEQ ID NO: 1369919 - RNA, 20 nt, Human
uggggcuccccaaggcccug

SEQ ID NO: 1369920 - RNA, 18 nt, Human
ugggguggcacgucacca

SEQ ID NO: 1369921 - RNA, 22 nt, Human
ugucagcgaagcucugagugaa

SEQ ID NO: 1369922 - RNA, 22 nt, Human
ugucuguuuaaacacugaacuc

SEQ ID NO: 1369923 - RNA, 27 nt, Human
uguuuaaacacugaacucugguguuga

SEQ ID NO: 1369924 - RNA, 24 nt, Human
uuagcuccuggcagagggugagug

SEQ ID NO: 1369925 - RNA, 27 nt, Human
uuagcuccuggcagagggugagugggg

SEQ ID NO: 1369926 - RNA, 22 nt, Human
uucagaggaagaagcuuaugaa

SEQ ID NO: 1369927 - RNA, 25 nt, Human
uuccccuuuccuugccucuucauaa

SEQ ID NO: 1369928 - RNA, 24 nt, Human
uuuggugcaucccuuuguuucugu

SEQ ID NO: 1369929 - RNA, 19 nt, Human
aaagcacagcaugacuuca

SEQ ID NO: 1369930 - RNA, 19 nt, Human
aacaagccccauccucaga

SEQ ID NO: 1369931 - RNA, 22 nt, Human
aacucuuccccccacuccucug

SEQ ID NO: 1369932 - RNA, 21 nt, Human
agaggaaguaacuggcccaag

SEQ ID NO: 1369933 - RNA, 20 nt, Human
agcaaacaaguccgugagag

SEQ ID NO: 1369934 - RNA, 20 nt, Human
agcaucuaccauuccaaagc

SEQ ID NO: 1369935 - RNA, 25 nt, Human
agcaucuaccauuccaaagcacagc

SEQ ID NO: 1369936 - RNA, 23 nt, Human
agcuuugcacagagagggcagcc

SEQ ID NO: 1369937 - RNA, 23 nt, Human
aggccacccugagcaggccccag

SEQ ID NO: 1369938 - RNA, 19 nt, Human
caccaacaagccccauccu

SEQ ID NO: 1369939 - RNA, 22 nt, Human
caccaacaagccccauccucag

SEQ ID NO: 1369940 - RNA, 24 nt, Human
caccucauuucacaccaacaagcc

SEQ ID NO: 1369941 - RNA, 24 nt, Human
cacuccucugcccaaaacuccacc

SEQ ID NO: 1369942 - RNA, 23 nt, Human
cagcaaacaaguccgugagagca

SEQ ID NO: 1369943 - RNA, 19 nt, Human
caggaaggucuuccgggca

SEQ ID NO: 1369944 - RNA, 21 nt, Human
cauccuaggcccugacugccc

SEQ ID NO: 1369945 - RNA, 23 nt, Human
ccaaagcacagcaugacuucauc

SEQ ID NO: 1369946 - RNA, 19 nt, Human
ccaccgccacagcacuucg

SEQ ID NO: 1369947 - RNA, 23 nt, Human
ccaggccacccugagcaggcccc

SEQ ID NO: 1369948 - RNA, 19 nt, Human
ccccacuccucugcccaaa

SEQ ID NO: 1369949 - RNA, 19 nt, Human
ccccacuccucugcccaaa

SEQ ID NO: 1369950 - RNA, 20 nt, Human
ccccacuccucugcccaaaa

SEQ ID NO: 1369951 - RNA, 18 nt, Human
ccccgcugugcugcccga

SEQ ID NO: 1369952 - RNA, 19 nt, Human
ccccgcugugcugcccgag

SEQ ID NO: 1369953 - RNA, 19 nt, Human
cuccucugcccaaaacucc

SEQ ID NO: 1369954 - RNA, 22 nt, Human
cucggcuuuucaccugcuccuc

SEQ ID NO: 1369955 - RNA, 22 nt, Human
cugcccaaaacuccaccgccac

SEQ ID NO: 1369956 - RNA, 25 nt, Human
cuuccccccacuccucugcccaaaa

SEQ ID NO: 1369957 - RNA, 22 nt, Human
gagucccagccccgcugugcug

SEQ ID NO: 1369958 - RNA, 19 nt, Human
gcacuucggcaggcucggc

SEQ ID NO: 1369959 - RNA, 18 nt, Human
gcaggcucggcuuuucac

SEQ ID NO: 1369960 - RNA, 21 nt, Human
ggggggcugcugcccagggag

SEQ ID NO: 1369961 - RNA, 21 nt, Human
gucuuccgggcaggggcacag

SEQ ID NO: 1369962 - RNA, 23 nt, Human
gugagucccagccccgcugugcu

SEQ ID NO: 1369963 - RNA, 22 nt, Human
gugcugcccgaggguagaggag

SEQ ID NO: 1369964 - RNA, 19 nt, Human
guuccaggccacccugagc

SEQ ID NO: 1369965 - RNA, 20 nt, Human
uagagugagucccagccccg

SEQ ID NO: 1369966 - RNA, 22 nt, Human
uagagugagucccagccccgcu

SEQ ID NO: 1369967 - RNA, 23 nt, Human
uagagugagucccagccccgcug

SEQ ID NO: 1369968 - RNA, 21 nt, Human
ucauuucacaccaacaagccc

SEQ ID NO: 1369969 - RNA, 18 nt, Human
uccaaagcacagcaugac

SEQ ID NO: 1369970 - RNA, 19 nt, Human
uccuaggcccugacugccc

SEQ ID NO: 1369971 - RNA, 22 nt, Human
uccuaggcccugacugcccacc

SEQ ID NO: 1369972 - RNA, 24 nt, Human
uccucugcccaaaacuccaccgcc

SEQ ID NO: 1369973 - RNA, 19 nt, Human
ucuaccauuccaaagcaca

SEQ ID NO: 1369974 - RNA, 22 nt, Human
ucugcagcagcccggcuggccc

SEQ ID NO: 1369975 - RNA, 24 nt, Human
ucugcggagggucggguucugggg

SEQ ID NO: 1369976 - RNA, 19 nt, Human
ugcccaaaacuccaccgcc

SEQ ID NO: 1369977 - RNA, 26 nt, Human
ugcccaaaacuccaccgccacagcac

SEQ ID NO: 1369978 - RNA, 19 nt, Human
ugcggagggucggguucug

SEQ ID NO: 1369979 - RNA, 18 nt, Human
uggaagcuggggggcugc

SEQ ID NO: 1369980 - RNA, 23 nt, Human
uggggggcugcugcccagggagg

SEQ ID NO: 1369981 - RNA, 19 nt, Human
ugugcugcccgaggguaga

SEQ ID NO: 1369982 - RNA, 22 nt, Human
uuaaaagugagaaacucuuccc

SEQ ID NO: 1369983 - RNA, 21 nt, Human
uuccgggcaggggcacagcuu

SEQ ID NO: 1369984 - RNA, 19 nt, Human
uugcacagagagggcagcc

SEQ ID NO: 1369985 - RNA, 25 nt, Human
aaagcaaaugaggcagaaaggcccc

SEQ ID NO: 1369986 - RNA, 26 nt, Human
aaagcaaaugaggcagaaaggccccg

SEQ ID NO: 1369987 - RNA, 23 nt, Human
aacuaauuuuauuuuauuuuuua

SEQ ID NO: 1369988 - RNA, 20 nt, Human
aagaaguacaaaagauucug

SEQ ID NO: 1369989 - RNA, 21 nt, Human
aagcugagagaacacuccacg

SEQ ID NO: 1369990 - RNA, 21 nt, Human
acagaaucacccacauccugg

SEQ ID NO: 1369991 - RNA, 23 nt, Human
acccccgccccagguccuggcuc

SEQ ID NO: 1369992 - RNA, 22 nt, Human
agccugagcuugcuuacagccc

SEQ ID NO: 1369993 - RNA, 19 nt, Human
aggccccggccccaccccc

SEQ ID NO: 1369994 - RNA, 21 nt, Human
augugcagcagcagcagcagg

SEQ ID NO: 1369995 - RNA, 19 nt, Human
caagaaguacaaaagauuc

SEQ ID NO: 1369996 - RNA, 21 nt, Human
cacaccugcucccugacccca

SEQ ID NO: 1369997 - RNA, 18 nt, Human
caccgccugcuguggcau

SEQ ID NO: 1369998 - RNA, 23 nt, Human
caccugcucccugaccccagucu

SEQ ID NO: 1369999 - RNA, 26 nt, Human
cagcagcagcagcaggggcuuuagcu

SEQ ID NO: 1370000 - RNA, 21 nt, Human
cagcagcagcaggggcuuuag

SEQ ID NO: 1370001 - RNA, 20 nt, Human
cagcccaggcgcgggcccgg

SEQ ID NO: 1370002 - RNA, 23 nt, Human
cagcccaggcgcgggcccgggcc

SEQ ID NO: 1370003 - RNA, 19 nt, Human
cagcccccaccgccugcug

SEQ ID NO: 1370004 - RNA, 20 nt, Human
ccacaggcaagcccagcugc

SEQ ID NO: 1370005 - RNA, 18 nt, Human
ccagcagucccauagcua

SEQ ID NO: 1370006 - RNA, 23 nt, Human
cccacaggguuggagaggcaguc

SEQ ID NO: 1370007 - RNA, 18 nt, Human
ccccacccccgccccagg

SEQ ID NO: 1370008 - RNA, 18 nt, Human
cccccaccgccugcugug

SEQ ID NO: 1370009 - RNA, 22 nt, Human
cccccgccccagguccuggcuc

SEQ ID NO: 1370010 - RNA, 21 nt, Human
ccccggccccacccccgcccc

SEQ ID NO: 1370011 - RNA, 18 nt, Human
ccccugggcuggccuggg

SEQ ID NO: 1370012 - RNA, 20 nt, Human
cccgccaagucuccugucca

SEQ ID NO: 1370013 - RNA, 19 nt, Human
ccuccacaggcaagcccag

SEQ ID NO: 1370014 - RNA, 23 nt, Human
ccuccccagguacagaaucaccc

SEQ ID NO: 1370015 - RNA, 22 nt, Human
ccucugccccugaccccugggc

SEQ ID NO: 1370016 - RNA, 24 nt, Human
ccugaccccagucuuggcucaugc

SEQ ID NO: 1370017 - RNA, 24 nt, Human
ccugaccccugggcuggccuggga

SEQ ID NO: 1370018 - RNA, 18 nt, Human
ccuggacuaggagccagc

SEQ ID NO: 1370019 - RNA, 21 nt, Human
ccugggccgggagccgggggc

SEQ ID NO: 1370020 - RNA, 19 nt, Human
cuccacaggcaagcccagc

SEQ ID NO: 1370021 - RNA, 23 nt, Human
cuccacaggcaagcccagcugcu

SEQ ID NO: 1370022 - RNA, 24 nt, Human
cucugccccugaccccugggcugg

SEQ ID NO: 1370023 - RNA, 20 nt, Human
cugaccccugggcuggccuu

SEQ ID NO: 1370024 - RNA, 21 nt, Human
cugaggugugcaccucugccc

SEQ ID NO: 1370025 - RNA, 20 nt, Human
cuggagcaucucccgccaag

SEQ ID NO: 1370026 - RNA, 19 nt, Human
cugugaaacaucauuuuau

SEQ ID NO: 1370027 - RNA, 24 nt, Human
cuuacagcccacaggguuggagag

SEQ ID NO: 1370028 - RNA, 26 nt, Human
cuuucauugaaagcaaaugaggcaga

SEQ ID NO: 1370029 - RNA, 24 nt, Human
gaaagcaaaugaggcagaaaggcc

SEQ ID NO: 1370030 - RNA, 27 nt, Human
gaccuaagcugagagaaccggggguuc

SEQ ID NO: 1370031 - RNA, 20 nt, Human
gagcuugcuuacagcccaca

SEQ ID NO: 1370032 - RNA, 20 nt, Human
gcccacggaaccgucccagg

SEQ ID NO: 1370033 - RNA, 20 nt, Human
gcccgggccgggggagccug

SEQ ID NO: 1370034 - RNA, 22 nt, Human
gcccgggccgggggagccuggg

SEQ ID NO: 1370035 - RNA, 22 nt, Human
gccugggccgggagccgggggc

SEQ ID NO: 1370036 - RNA, 19 nt, Human
gcgaagcgcggcgcagccc

SEQ ID NO: 1370037 - RNA, 20 nt, Human
gcgccggacacguugcgaag

SEQ ID NO: 1370038 - RNA, 19 nt, Human
ggagaggcagucauacccc

SEQ ID NO: 1370039 - RNA, 22 nt, Human
ggagcaucucccgccaagucuc

SEQ ID NO: 1370040 - RNA, 21 nt, Human
ggagccugggccgggagccgg

SEQ ID NO: 1370041 - RNA, 21 nt, Human
ggcccgggccgggggagccug

SEQ ID NO: 1370042 - RNA, 24 nt, Human
ggcugcuuugaggcuuucauugaa

SEQ ID NO: 1370043 - RNA, 21 nt, Human
gggauguuagcuuugucugca

SEQ ID NO: 1370044 - RNA, 21 nt, Human
gucagagauagccuccccagg

SEQ ID NO: 1370045 - RNA, 22 nt, Human
gugugcaccucugccccugacc

SEQ ID NO: 1370046 - RNA, 23 nt, Human
uaagcugagagaacacuccacga

SEQ ID NO: 1370047 - RNA, 23 nt, Human
ucauacccccaugauuccuggac

SEQ ID NO: 1370048 - RNA, 31 nt, Human
ucauugaaagcaaaugaggcagaaaggcccc

SEQ ID NO: 1370049 - RNA, 23 nt, Human
uccccacgcagcccccaccgccu

SEQ ID NO: 1370050 - RNA, 22 nt, Human
ucccugaccccagucuuggcuc

SEQ ID NO: 1370051 - RNA, 20 nt, Human
ugaaagcaaaugaggcagaa

SEQ ID NO: 1370052 - RNA, 20 nt, Human
ugagagaacacuccacgaug

SEQ ID NO: 1370053 - RNA, 24 nt, Human
ugccccugaccccugggcuggccu

SEQ ID NO: 1370054 - RNA, 21 nt, Human
uggccugggaguguccccugu

SEQ ID NO: 1370055 - RNA, 19 nt, Human
uggcucaugcugaggugug

SEQ ID NO: 1370056 - RNA, 22 nt, Human
ugggauguuagcuuugucugca

SEQ ID NO: 1370057 - RNA, 22 nt, Human
ugggccgggagccgggggccag

SEQ ID NO: 1370058 - RNA, 20 nt, Human
ugucugggauguuagcuuug

SEQ ID NO: 1370059 - RNA, 18 nt, Human
ugugaaacaucauuuuau

SEQ ID NO: 1370060 - RNA, 19 nt, Human
uucaaacucgaggaagggg

SEQ ID NO: 1370061 - RNA, 21 nt, Human
uuugucugcagggguucccag

SEQ ID NO: 1370062 - RNA, 19 nt, Human
aaaauacucucauguccuc

SEQ ID NO: 1370063 - RNA, 28 nt, Human
aaaauacucucauguccucucagagccu

SEQ ID NO: 1370064 - RNA, 24 nt, Human
aaagaggaggucagucuccagagg

SEQ ID NO: 1370065 - RNA, 21 nt, Human
aaagcacuuuugcauccugug

SEQ ID NO: 1370066 - RNA, 22 nt, Human
aaaugacaacaucccuuuccca

SEQ ID NO: 1370067 - RNA, 22 nt, Human
aaccucuccuuggccuccucug

SEQ ID NO: 1370068 - RNA, 19 nt, Human
aagaauguguuagacuugg

SEQ ID NO: 1370069 - RNA, 21 nt, Human
aagagggagaaacaauaaggc

SEQ ID NO: 1370070 - RNA, 25 nt, Human
aagagggagaaacaauaaggcacag

SEQ ID NO: 1370071 - RNA, 21 nt, Human
aaguggcucauuuggggagaa

SEQ ID NO: 1370072 - RNA, 25 nt, Human
aaucaccagguuaggccaggaagaa

SEQ ID NO: 1370073 - RNA, 19 nt, Human
aaucuuggaauaacaauau

SEQ ID NO: 1370074 - RNA, 24 nt, Human
acaaacaaccucuccuuggccucc

SEQ ID NO: 1370075 - RNA, 21 nt, Human
acaaagagaagagggagaaac

SEQ ID NO: 1370076 - RNA, 24 nt, Human
acaaagagaagagggagaaacaau

SEQ ID NO: 1370077 - RNA, 21 nt, Human
acccuuggccucagguggcca

SEQ ID NO: 1370078 - RNA, 21 nt, Human
accuuugcccuuucucuggcu

SEQ ID NO: 1370079 - RNA, 22 nt, Human
accuuugcccuuucucuggcuu

SEQ ID NO: 1370080 - RNA, 19 nt, Human
agagcuggaaggaguggua

SEQ ID NO: 1370081 - RNA, 20 nt, Human
agaggaaacacaggugcugg

SEQ ID NO: 1370082 - RNA, 24 nt, Human
agaggaaaguggcucauuugggga

SEQ ID NO: 1370083 - RNA, 18 nt, Human
agccucuagccuucuccu

SEQ ID NO: 1370084 - RNA, 18 nt, Human
agcggugcuagagaccug

SEQ ID NO: 1370085 - RNA, 24 nt, Human
agcuugaggggucuucccagacac

SEQ ID NO: 1370086 - RNA, 18 nt, Human
aggaaaacugaggcucag

SEQ ID NO: 1370087 - RNA, 24 nt, Human
aggaaaacugaggcucagacagaa

SEQ ID NO: 1370088 - RNA, 24 nt, Human
aggagguuuggaggcaggggucca

SEQ ID NO: 1370089 - RNA, 23 nt, Human
aggcacaggaaagaggaggucag

SEQ ID NO: 1370090 - RNA, 21 nt, Human
agggcugggcugagcuguggg

SEQ ID NO: 1370091 - RNA, 22 nt, Human
agggcugggcugagcugugggu

SEQ ID NO: 1370092 - RNA, 22 nt, Human
agggugccaguggagaguggcg

SEQ ID NO: 1370093 - RNA, 19 nt, Human
aggugcuggaggauuaccu

SEQ ID NO: 1370094 - RNA, 19 nt, Human
agguggaggcugaggaaag

SEQ ID NO: 1370095 - RNA, 20 nt, Human
agucaccauggcugaauugg

SEQ ID NO: 1370096 - RNA, 25 nt, Human
agugccacccuuggccucagguggc

SEQ ID NO: 1370097 - RNA, 21 nt, Human
augagaaaacugagacccaga

SEQ ID NO: 1370098 - RNA, 22 nt, Human
auggaagcgucuucagaaauca

SEQ ID NO: 1370099 - RNA, 20 nt, Human
caacucccgguccaacuccu

SEQ ID NO: 1370100 - RNA, 20 nt, Human
cacaagcgccugacccaggg

SEQ ID NO: 1370101 - RNA, 22 nt, Human
cacagcaaguuagaggaaacac

SEQ ID NO: 1370102 - RNA, 22 nt, Human
cacagucauaaagaauguguua

SEQ ID NO: 1370103 - RNA, 20 nt, Human
cacauuugaguguagggucc

SEQ ID NO: 1370104 - RNA, 22 nt, Human
caccauggcugaauugggguuc

SEQ ID NO: 1370105 - RNA, 23 nt, Human
cacccguguuuacuuccuucagu

SEQ ID NO: 1370106 - RNA, 25 nt, Human
caccugcaaggacaagaaucagaga

SEQ ID NO: 1370107 - RNA, 23 nt, Human
caccuggagaggaaaguggcuca

SEQ ID NO: 1370108 - RNA, 23 nt, Human
cagaagagcuggaaggaguggua

SEQ ID NO: 1370109 - RNA, 24 nt, Human
cagcaagauaacuaaagacacuaa

SEQ ID NO: 1370110 - RNA, 19 nt, Human
cagcaccaccuuuugacaa

SEQ ID NO: 1370111 - RNA, 18 nt, Human
cagcagaagagcuggaag

SEQ ID NO: 1370112 - RNA, 20 nt, Human
cagcuuaggggagcaggccc

SEQ ID NO: 1370113 - RNA, 23 nt, Human
cagcuuaggggagcaggcccugu

SEQ ID NO: 1370114 - RNA, 20 nt, Human
caggcuucccagcuuagggg

SEQ ID NO: 1370115 - RNA, 19 nt, Human
caggguagcuuccugggcu

SEQ ID NO: 1370116 - RNA, 21 nt, Human
caguggcgaacaaagagaaga

SEQ ID NO: 1370117 - RNA, 22 nt, Human
caucccuuucccauccagcaag

SEQ ID NO: 1370118 - RNA, 18 nt, Human
cauccugggcuggcaucc

SEQ ID NO: 1370119 - RNA, 21 nt, Human
ccagacacccguguuuacuuc

SEQ ID NO: 1370120 - RNA, 20 nt, Human
ccagcaagauaacuaaagac

SEQ ID NO: 1370121 - RNA, 19 nt, Human
ccaguggcgaacaaagaga

SEQ ID NO: 1370122 - RNA, 18 nt, Human
ccccugaaccuccugggg

SEQ ID NO: 1370123 - RNA, 23 nt, Human
cccugagaacaggaacuacucau

SEQ ID NO: 1370124 - RNA, 23 nt, Human
ccuaaaauggguaccugcuaccc

SEQ ID NO: 1370125 - RNA, 22 nt, Human
ccucagguggccaauucagucc

SEQ ID NO: 1370126 - RNA, 19 nt, Human
ccugucucuucucugugcc

SEQ ID NO: 1370127 - RNA, 18 nt, Human
ccuuaccaguuugacauc

SEQ ID NO: 1370128 - RNA, 18 nt, Human
ccuugcccucacuuugca

SEQ ID NO: 1370129 - RNA, 22 nt, Human
ccuuuguuuguuaacugcucuu

SEQ ID NO: 1370130 - RNA, 21 nt, Human
cgcguggaggugaagaacaga

SEQ ID NO: 1370131 - RNA, 23 nt, Human
cucagcccuuaccaguuugaccg

SEQ ID NO: 1370132 - RNA, 18 nt, Human
cuccacaagcgccugacc

SEQ ID NO: 1370133 - RNA, 22 nt, Human
cuccacacugggccuugcccuc

SEQ ID NO: 1370134 - RNA, 21 nt, Human
cuccugggugggucaggggug

SEQ ID NO: 1370135 - RNA, 21 nt, Human
cuccuuggccuccucugugcc

SEQ ID NO: 1370136 - RNA, 20 nt, Human
cucugugccagggcugggcc

SEQ ID NO: 1370137 - RNA, 20 nt, Human
cugcuaccugccuucaccug

SEQ ID NO: 1370138 - RNA, 19 nt, Human
cuggcauauugcaugccug

SEQ ID NO: 1370139 - RNA, 22 nt, Human
cuuuccuguggcucuagccagc

SEQ ID NO: 1370140 - RNA, 21 nt, Human
cuuuguuuguuaacugcucuu

SEQ ID NO: 1370141 - RNA, 18 nt, Human
gagcagcuuuagccagga

SEQ ID NO: 1370142 - RNA, 20 nt, Human
gagcagcuuuagccaggaga

SEQ ID NO: 1370143 - RNA, 19 nt, Human
gagcaggcccuguccucca

SEQ ID NO: 1370144 - RNA, 20 nt, Human
gagccuccugaaugcucuuu

SEQ ID NO: 1370145 - RNA, 18 nt, Human
gagguuggagugccaccc

SEQ ID NO: 1370146 - RNA, 22 nt, Human
gcagaggaucugggauuugggg

SEQ ID NO: 1370147 - RNA, 18 nt, Human
gccuccucugugccucag

SEQ ID NO: 1370148 - RNA, 19 nt, Human
gcugaauugggguucaauc

SEQ ID NO: 1370149 - RNA, 18 nt, Human
gcuguugucuguaguucu

SEQ ID NO: 1370150 - RNA, 22 nt, Human
ggaaagggggucccugggugcu

SEQ ID NO: 1370151 - RNA, 19 nt, Human
ggaggcugaggaaaggggg

SEQ ID NO: 1370152 - RNA, 21 nt, Human
ggcacaucugcuaccugccuu

SEQ ID NO: 1370153 - RNA, 20 nt, Human
ggcugugggccauuuuugga

SEQ ID NO: 1370154 - RNA, 19 nt, Human
gggcaggucacagcagaag

SEQ ID NO: 1370155 - RNA, 18 nt, Human
gggcugggcugagcugug

SEQ ID NO: 1370156 - RNA, 26 nt, Human
uaaaauggguaccugcuacccaagug

SEQ ID NO: 1370157 - RNA, 25 nt, Human
uaaauccuguuuagaauuuaaaaaa

SEQ ID NO: 1370158 - RNA, 22 nt, Human
uacaugcgaagcccucucucca

SEQ ID NO: 1370159 - RNA, 21 nt, Human
uagcaaaaugauagaaauuuu

SEQ ID NO: 1370160 - RNA, 21 nt, Human
uagcuuccugggcugugggcc

SEQ ID NO: 1370161 - RNA, 21 nt, Human
uaguuugcuuuugagucuggu

SEQ ID NO: 1370162 - RNA, 18 nt, Human
uauuucagagcucggccu

SEQ ID NO: 1370163 - RNA, 22 nt, Human
ucagagcucggccugagaucuc

SEQ ID NO: 1370164 - RNA, 21 nt, Human
ucagccucuagccuucuccuu

SEQ ID NO: 1370165 - RNA, 21 nt, Human
ucaguccugggcuuuacugca

SEQ ID NO: 1370166 - RNA, 26 nt, Human
ucaucuuauccagcuggcuccucuua

SEQ ID NO: 1370167 - RNA, 18 nt, Human
uccccugaaccuccuggg

SEQ ID NO: 1370168 - RNA, 20 nt, Human
ucccucagccucuagccuuc

SEQ ID NO: 1370169 - RNA, 18 nt, Human
ucccugaggucaccgccc

SEQ ID NO: 1370170 - RNA, 20 nt, Human
ucccugggugcugccaggcc

SEQ ID NO: 1370171 - RNA, 18 nt, Human
uccugggcuuuacugcag

SEQ ID NO: 1370172 - RNA, 19 nt, Human
uccuugugggguccuuuau

SEQ ID NO: 1370173 - RNA, 21 nt, Human
ucuagccuucuccuuucaucc

SEQ ID NO: 1370174 - RNA, 21 nt, Human
ucucaggugccucugggcugg

SEQ ID NO: 1370175 - RNA, 24 nt, Human
ucuccugagacagacugaagaggc

SEQ ID NO: 1370176 - RNA, 20 nt, Human
ucugagugaucuggcauuuu

SEQ ID NO: 1370177 - RNA, 24 nt, Human
ucuggugcagccuuccaacuggca

SEQ ID NO: 1370178 - RNA, 21 nt, Human
ugaaaggagcuuuccguccua

SEQ ID NO: 1370179 - RNA, 23 nt, Human
ugaaugcaugcaugaacaaacaa

SEQ ID NO: 1370180 - RNA, 25 nt, Human
ugacaacaucccuuucccauccagc

SEQ ID NO: 1370181 - RNA, 21 nt, Human
ugacccaggguaccucucccu

SEQ ID NO: 1370182 - RNA, 19 nt, Human
ugagaaaacugagacccag

SEQ ID NO: 1370183 - RNA, 21 nt, Human
ugagacagacugaagaggccc

SEQ ID NO: 1370184 - RNA, 21 nt, Human
ugagaugcucacagucauaaa

SEQ ID NO: 1370185 - RNA, 23 nt, Human
ugagaugcucacagucauaaaga

SEQ ID NO: 1370186 - RNA, 19 nt, Human
ugaggaaagggggucccug

SEQ ID NO: 1370187 - RNA, 21 nt, Human
ugaggcuagucuuccagcugg

SEQ ID NO: 1370188 - RNA, 22 nt, Human
ugaggggucuucccagacaccc

SEQ ID NO: 1370189 - RNA, 21 nt, Human
ugcaaaauacucucauguccu

SEQ ID NO: 1370190 - RNA, 22 nt, Human
ugcaaggacaagaaucagagac

SEQ ID NO: 1370191 - RNA, 24 nt, Human
ugcagaggaucugggauuuggggg

SEQ ID NO: 1370192 - RNA, 24 nt, Human
ugcagcuugaggggucuucccaga

SEQ ID NO: 1370193 - RNA, 19 nt, Human
ugcaugccugaaggcagag

SEQ ID NO: 1370194 - RNA, 18 nt, Human
ugccucugggcuggcccu

SEQ ID NO: 1370195 - RNA, 18 nt, Human
ugcgaagcccucucucca

SEQ ID NO: 1370196 - RNA, 18 nt, Human
uggaaagauaaacugaau

SEQ ID NO: 1370197 - RNA, 18 nt, Human
uggaaagauaaacugaau

SEQ ID NO: 1370198 - RNA, 20 nt, Human
uggacagaacccaaauuguu

SEQ ID NO: 1370199 - RNA, 21 nt, Human
uggagaguggcguacuuccuc

SEQ ID NO: 1370200 - RNA, 19 nt, Human
uggcuucuggcccuuuccu

SEQ ID NO: 1370201 - RNA, 19 nt, Human
ugugccagaaaugacaaca

SEQ ID NO: 1370202 - RNA, 23 nt, Human
uguguaggccaaggagggugcca

SEQ ID NO: 1370203 - RNA, 23 nt, Human
ugugucacggaugaaugcaugca

SEQ ID NO: 1370204 - RNA, 22 nt, Human
uguuuauggaguccucaguagg

SEQ ID NO: 1370205 - RNA, 19 nt, Human
uuauggaguccucaguagg

SEQ ID NO: 1370206 - RNA, 24 nt, Human
uuccuguggcucuagccagccuuu

SEQ ID NO: 1370207 - RNA, 22 nt, Human
uucuauuuucccugacgucacu

SEQ ID NO: 1370208 - RNA, 22 nt, Human
uugagucuggugcagccuucca

SEQ ID NO: 1370209 - RNA, 18 nt, Human
uugcacauuugaguguag

SEQ ID NO: 1370210 - RNA, 20 nt, Human
uugcauggaaauagggaguu

SEQ ID NO: 1370211 - RNA, 19 nt, Human
uuuaggcuugugcaagagg

SEQ ID NO: 1370212 - RNA, 23 nt, Human
uuuucuguucuauuuucccugac

SEQ ID NO: 1370213 - RNA, 18 nt, Human
uuuugcauccugugggcu

SEQ ID NO: 1370214 - RNA, 20 nt, Human
aaaaaaaaaaaaacaaaaaa

SEQ ID NO: 1370215 - RNA, 26 nt, Human
aaaaaaaaacaaaaaaaaaaccccca

SEQ ID NO: 1370216 - RNA, 24 nt, Human
aaaaaaacaaaaaaaaaaccccca

SEQ ID NO: 1370217 - RNA, 30 nt, Human
aaaaaacaaaaaaaaaacccccacaaaaaa

SEQ ID NO: 1370218 - RNA, 21 nt, Human
aaaaaauucccugauucauca

SEQ ID NO: 1370219 - RNA, 28 nt, Human
aaaacaaaaaaaaaacccccacaaaaaa

SEQ ID NO: 1370220 - RNA, 26 nt, Human
aaacaacaacaaaaaaaaaaaaacaa

SEQ ID NO: 1370221 - RNA, 21 nt, Human
aacaacaaaaaaaaaaaaacc

SEQ ID NO: 1370222 - RNA, 18 nt, Human
aaccauauuuuuagaagu

SEQ ID NO: 1370223 - RNA, 21 nt, Human
aacgugaaaaagggguaucaa

SEQ ID NO: 1370224 - RNA, 21 nt, Human
aagaaacagcuggagacagaa

SEQ ID NO: 1370225 - RNA, 21 nt, Human
aagacagaggauccaccgaac

SEQ ID NO: 1370226 - RNA, 19 nt, Human
aagaccaugacaaguuugc

SEQ ID NO: 1370227 - RNA, 23 nt, Human
aagcagaucugguaggcuuagaa

SEQ ID NO: 1370228 - RNA, 23 nt, Human
aagcaggagagcagguuccaaga

SEQ ID NO: 1370229 - RNA, 18 nt, Human
aagcugccuuccucaaag

SEQ ID NO: 1370230 - RNA, 23 nt, Human
aagcuuuugaugaugugucuaau

SEQ ID NO: 1370231 - RNA, 22 nt, Human
aaucaugauccaucccaccuuu

SEQ ID NO: 1370232 - RNA, 22 nt, Human
acaaaaaaaaaacccccacaaa

SEQ ID NO: 1370233 - RNA, 27 nt, Human
acaacaacaaaaaaaaaaaaacaaaaa

SEQ ID NO: 1370234 - RNA, 19 nt, Human
acaacacaacuauaaaaac

SEQ ID NO: 1370235 - RNA, 23 nt, Human
acacaacuauaaaaacaaaccuc

SEQ ID NO: 1370236 - RNA, 27 nt, Human
accaaaauacuguauggguuacucuga

SEQ ID NO: 1370237 - RNA, 21 nt, Human
accacuuacauuuuguaauaa

SEQ ID NO: 1370238 - RNA, 19 nt, Human
acccccacaaaaaaaguac

SEQ ID NO: 1370239 - RNA, 18 nt, Human
accccucccuuccaccuc

SEQ ID NO: 1370240 - RNA, 19 nt, Human
acuaccuucgccuuccuag

SEQ ID NO: 1370241 - RNA, 22 nt, Human
acuauaaaaacaaaccucucaa

SEQ ID NO: 1370242 - RNA, 19 nt, Human
agaaaaaccuauacucaga

SEQ ID NO: 1370243 - RNA, 18 nt, Human
agacagaaaggauggacc

SEQ ID NO: 1370244 - RNA, 21 nt, Human
agacagaaaggauggaccagg

SEQ ID NO: 1370245 - RNA, 22 nt, Human
agacaucuguaaauggagaaaa

SEQ ID NO: 1370246 - RNA, 24 nt, Human
agagacaagaagcugcaguacaug

SEQ ID NO: 1370247 - RNA, 19 nt, Human
agcaggagagcagguucca

SEQ ID NO: 1370248 - RNA, 19 nt, Human
agccaccuugcugccaucc

SEQ ID NO: 1370249 - RNA, 21 nt, Human
agccaccuugcugccauccca

SEQ ID NO: 1370250 - RNA, 22 nt, Human
agggaccagcaagcaggagagc

SEQ ID NO: 1370251 - RNA, 18 nt, Human
aguacauguccaaagaua

SEQ ID NO: 1370252 - RNA, 18 nt, Human
aguuacaaagacagagga

SEQ ID NO: 1370253 - RNA, 24 nt, Human
auaaaaacaaaccucucaaacuca

SEQ ID NO: 1370254 - RNA, 19 nt, Human
auaaaaugcauuggucccc

SEQ ID NO: 1370255 - RNA, 21 nt, Human
auagcauuggaaguaaaaacc

SEQ ID NO: 1370256 - RNA, 24 nt, Human
auaguaaccucuaagcauuuuucc

SEQ ID NO: 1370257 - RNA, 20 nt, Human
aucccuagccaaaaaaggaa

SEQ ID NO: 1370258 - RNA, 21 nt, Human
auggcccaaaaacaacaacaa

SEQ ID NO: 1370259 - RNA, 23 nt, Human
caaaaaaaaaaaaacaaaaaaaa

SEQ ID NO: 1370260 - RNA, 19 nt, Human
caaaaaaaaaacccccaca

SEQ ID NO: 1370261 - RNA, 20 nt, Human
caaaauaguaaccucuaagc

SEQ ID NO: 1370262 - RNA, 18 nt, Human
caaagcaggggcauccca

SEQ ID NO: 1370263 - RNA, 21 nt, Human
caaaguguagugagaccucaa

SEQ ID NO: 1370264 - RNA, 21 nt, Human
caacaaaaaaaaaaaaacaaa

SEQ ID NO: 1370265 - RNA, 23 nt, Human
caagaauaaaaauaagcuuuuga

SEQ ID NO: 1370266 - RNA, 20 nt, Human
caccuugcugccaucccacu

SEQ ID NO: 1370267 - RNA, 21 nt, Human
cacuguacaccaacucaaggc

SEQ ID NO: 1370268 - RNA, 20 nt, Human
cagaaaaaaacucaacuuug

SEQ ID NO: 1370269 - RNA, 19 nt, Human
caggagccaccuugcugcc

SEQ ID NO: 1370270 - RNA, 19 nt, Human
cagggaccagcaagcagga

SEQ ID NO: 1370271 - RNA, 24 nt, Human
cauucuaaaauuacuuugguuuua

SEQ ID NO: 1370272 - RNA, 20 nt, Human
ccacuuacauuuuguaauaa

SEQ ID NO: 1370273 - RNA, 22 nt, Human
ccaguaauccaaaacagagaca

SEQ ID NO: 1370274 - RNA, 19 nt, Human
cccaaaaacaacaacaaaa

SEQ ID NO: 1370275 - RNA, 23 nt, Human
cccaaaaacaacaacaaaaaaaa

SEQ ID NO: 1370276 - RNA, 22 nt, Human
ccccucagaauaagaucacagu

SEQ ID NO: 1370277 - RNA, 20 nt, Human
ccccucccuuccaccucuaa

SEQ ID NO: 1370278 - RNA, 22 nt, Human
ccuugcugccaucccacuccuc

SEQ ID NO: 1370279 - RNA, 22 nt, Human
cucaugcauguacuacaaaauc

SEQ ID NO: 1370280 - RNA, 22 nt, Human
cugccaucccacuccucaucca

SEQ ID NO: 1370281 - RNA, 21 nt, Human
cuuggagaccccucccuucca

SEQ ID NO: 1370282 - RNA, 19 nt, Human
cuuuagcuaccaccucucc

SEQ ID NO: 1370283 - RNA, 20 nt, Human
gaccuuacccugucuuauag

SEQ ID NO: 1370284 - RNA, 20 nt, Human
gcacaucuguuaucuauuca

SEQ ID NO: 1370285 - RNA, 18 nt, Human
gcacugcuuccauucuuc

SEQ ID NO: 1370286 - RNA, 21 nt, Human
gcagagacuucauagcauugg

SEQ ID NO: 1370287 - RNA, 21 nt, Human
gccaucuuguuuuaaucugac

SEQ ID NO: 1370288 - RNA, 21 nt, Human
gcugcaguacauguccaaaga

SEQ ID NO: 1370289 - RNA, 20 nt, Human
ggaaauggaaguggguccca

SEQ ID NO: 1370290 - RNA, 22 nt, Human
ggagaccccucccuuccaccuc

SEQ ID NO: 1370291 - RNA, 23 nt, Human
ggcccaaaaacaacaacaaaaaa

SEQ ID NO: 1370292 - RNA, 25 nt, Human
guaauacaacacaacuauaaaaaca

SEQ ID NO: 1370293 - RNA, 23 nt, Human
guaggcuuagaaauggcccaaaa

SEQ ID NO: 1370294 - RNA, 24 nt, Human
uaaaaggacuucgaaaacuguaaa

SEQ ID NO: 1370295 - RNA, 21 nt, Human
uaaaaugcauugguccccugg

SEQ ID NO: 1370296 - RNA, 25 nt, Human
uaacauaugaagaaauaucaaacac

SEQ ID NO: 1370297 - RNA, 29 nt, Human
uaacauaugaagaaauaucaaacacccuc

SEQ ID NO: 1370298 - RNA, 21 nt, Human
uaaccucaguuacaaagacag

SEQ ID NO: 1370299 - RNA, 21 nt, Human
uaaccucuaagcauuuuuccc

SEQ ID NO: 1370300 - RNA, 18 nt, Human
uaaguuucuuucauuuuc

SEQ ID NO: 1370301 - RNA, 22 nt, Human
uacaaaaucgccaagugaccac

SEQ ID NO: 1370302 - RNA, 19 nt, Human
uacauacauaacaaaugug

SEQ ID NO: 1370303 - RNA, 21 nt, Human
uacgcacacauaaggaaacac

SEQ ID NO: 1370304 - RNA, 20 nt, Human
uacucuaggucuccagagca

SEQ ID NO: 1370305 - RNA, 21 nt, Human
uagcauuggaaguaaaaacca

SEQ ID NO: 1370306 - RNA, 18 nt, Human
uaucaaacacccuauucc

SEQ ID NO: 1370307 - RNA, 21 nt, Human
uaugguaacuacagaaaaaaa

SEQ ID NO: 1370308 - RNA, 22 nt, Human
uaugucacucauucuaaaauua

SEQ ID NO: 1370309 - RNA, 24 nt, Human
uauuacuacaaauacaauauacaa

SEQ ID NO: 1370310 - RNA, 19 nt, Human
ucaaauuuaucugcaguua

SEQ ID NO: 1370311 - RNA, 23 nt, Human
uccaaacuuggagaccccucccu

SEQ ID NO: 1370312 - RNA, 21 nt, Human
uccacugccacaggagccacc

SEQ ID NO: 1370313 - RNA, 18 nt, Human
uccacuuagguaagaaaa

SEQ ID NO: 1370314 - RNA, 26 nt, Human
uccauggcugaagucaaagcaggggc

SEQ ID NO: 1370315 - RNA, 24 nt, Human
ucccacuccucauccauggcugaa

SEQ ID NO: 1370316 - RNA, 21 nt, Human
ucgccaagugaccacuuacau

SEQ ID NO: 1370317 - RNA, 27 nt, Human
ucuguaaauggagaaaaaccggggucc

SEQ ID NO: 1370318 - RNA, 24 nt, Human
ugaagaaauaucaaacacccuauu

SEQ ID NO: 1370319 - RNA, 23 nt, Human
ugaauauggacgcacaauuuacc

SEQ ID NO: 1370320 - RNA, 23 nt, Human
ugaauuaaaagcugccuuccuca

SEQ ID NO: 1370321 - RNA, 20 nt, Human
ugacaaaaugaauauggacg

SEQ ID NO: 1370322 - RNA, 19 nt, Human
ugacacuaaauuccuaugu

SEQ ID NO: 1370323 - RNA, 19 nt, Human
ugaccaaaauacuguaugg

SEQ ID NO: 1370324 - RNA, 25 nt, Human
ugauagcacuauaaagucgaagucu

SEQ ID NO: 1370325 - RNA, 18 nt, Human
ugcagagacuucauagca

SEQ ID NO: 1370326 - RNA, 22 nt, Human
ugcauuacauaaauuacaugua

SEQ ID NO: 1370327 - RNA, 19 nt, Human
ugccauggucaagaaacag

SEQ ID NO: 1370328 - RNA, 21 nt, Human
uggaaggugagcauccuagga

SEQ ID NO: 1370329 - RNA, 21 nt, Human
uggaauauuacuacaaauaca

SEQ ID NO: 1370330 - RNA, 18 nt, Human
uggagaccccucccuucc

SEQ ID NO: 1370331 - RNA, 19 nt, Human
uggagccagaacacugcca

SEQ ID NO: 1370332 - RNA, 18 nt, Human
uggauaaccuuacaugaa

SEQ ID NO: 1370333 - RNA, 21 nt, Human
uggcacaacgugaaaaagggg

SEQ ID NO: 1370334 - RNA, 20 nt, Human
uggcauuuucugccaaagug

SEQ ID NO: 1370335 - RNA, 18 nt, Human
uggccauggcacuguaca

SEQ ID NO: 1370336 - RNA, 19 nt, Human
uggcccaaaaacaacaaca

SEQ ID NO: 1370337 - RNA, 23 nt, Human
uggcccaaaaacaacaacaaaaa

SEQ ID NO: 1370338 - RNA, 28 nt, Human
ugguuuuaagaucaaauagucuuucaaa

SEQ ID NO: 1370339 - RNA, 22 nt, Human
uguacaccaacucaaggcacuu

SEQ ID NO: 1370340 - RNA, 21 nt, Human
ugucuuauaggcgauacaacu

SEQ ID NO: 1370341 - RNA, 21 nt, Human
uuacaaagacagaggauccac

SEQ ID NO: 1370342 - RNA, 20 nt, Human
uuccugaccaaaauacugua

SEQ ID NO: 1370343 - RNA, 21 nt, Human
uucuccccucagaauaagauc

SEQ ID NO: 1370344 - RNA, 23 nt, Human
uugacacuaaauuccuauguaau

SEQ ID NO: 1370345 - RNA, 21 nt, Human
uugcaauguacgcacacauag

SEQ ID NO: 1370346 - RNA, 19 nt, Human
uugcugccaucccacuccu

SEQ ID NO: 1370347 - RNA, 23 nt, Human
uuuaauauuaaccauauucuaau

SEQ ID NO: 1370348 - RNA, 25 nt, Human
uuuacuccuacauacauaacaaaug

SEQ ID NO: 1370349 - RNA, 30 nt, Human
uuugguuuuaagaucaaauagucuuucaaa

SEQ ID NO: 1370350 - RNA, 18 nt, Human
uuuuuucuccucuuuaca

SEQ ID NO: 1370351 - RNA, 24 nt, Human
aagccccagcgccgggaaccccaa

SEQ ID NO: 1370352 - RNA, 19 nt, Human
aaggccccagggccuccaa

SEQ ID NO: 1370353 - RNA, 19 nt, Human
accagcuccgaccucuccc

SEQ ID NO: 1370354 - RNA, 19 nt, Human
acccugaggaggguuuggg

SEQ ID NO: 1370355 - RNA, 21 nt, Human
agcagaagccccagcgccggg

SEQ ID NO: 1370356 - RNA, 23 nt, Human
agcagggccaccacaaccucggu

SEQ ID NO: 1370357 - RNA, 18 nt, Human
agcuccagaauaguguag

SEQ ID NO: 1370358 - RNA, 21 nt, Human
agcugccuuucagcccuucca

SEQ ID NO: 1370359 - RNA, 21 nt, Human
aggcagaguuagaagcaugug

SEQ ID NO: 1370360 - RNA, 21 nt, Human
agggagcauggcuggaacuca

SEQ ID NO: 1370361 - RNA, 23 nt, Human
augagcagggccaccacaaccuc

SEQ ID NO: 1370362 - RNA, 21 nt, Human
augaugccguccagagccuca

SEQ ID NO: 1370363 - RNA, 18 nt, Human
caccaggcaugaggucac

SEQ ID NO: 1370364 - RNA, 20 nt, Human
cagaguucauccaaggcccc

SEQ ID NO: 1370365 - RNA, 23 nt, Human
cagcagggccaccuggcgggccc

SEQ ID NO: 1370366 - RNA, 25 nt, Human
cagggccaccuggcgggcccgaggc

SEQ ID NO: 1370367 - RNA, 23 nt, Human
cagugucugcagggccuccaggg

SEQ ID NO: 1370368 - RNA, 23 nt, Human
cauguagaugccuugcaugauuu

SEQ ID NO: 1370369 - RNA, 18 nt, Human
cccagcgccgggaacccc

SEQ ID NO: 1370370 - RNA, 20 nt, Human
cccagggugggcugggugug

SEQ ID NO: 1370371 - RNA, 22 nt, Human
ccccaggaaaugcuuguugcuc

SEQ ID NO: 1370372 - RNA, 23 nt, Human
ccccaggaaaugcuuguugcucu

SEQ ID NO: 1370373 - RNA, 22 nt, Human
ccccaggaagucuccaaauucc

SEQ ID NO: 1370374 - RNA, 19 nt, Human
ccccagggccuccaagaug

SEQ ID NO: 1370375 - RNA, 19 nt, Human
ccguccagagccucacagc

SEQ ID NO: 1370376 - RNA, 22 nt, Human
ccucacagccaaucuccucauc

SEQ ID NO: 1370377 - RNA, 19 nt, Human
ccuccagcagauccuggcu

SEQ ID NO: 1370378 - RNA, 18 nt, Human
ccucggucaugaaggagc

SEQ ID NO: 1370379 - RNA, 22 nt, Human
ccucugagcugccuuucagccc

SEQ ID NO: 1370380 - RNA, 19 nt, Human
ccuuggccucguccuucuc

SEQ ID NO: 1370381 - RNA, 22 nt, Human
ccuuggccucguccuucuccug

SEQ ID NO: 1370382 - RNA, 22 nt, Human
cgaggccagcugcaucaucucc

SEQ ID NO: 1370383 - RNA, 18 nt, Human
cgccgggaaccccaaggg

SEQ ID NO: 1370384 - RNA, 23 nt, Human
cgccgggaaccccaagggcauaa

SEQ ID NO: 1370385 - RNA, 21 nt, Human
cgcugugcacacacacguuca

SEQ ID NO: 1370386 - RNA, 24 nt, Human
cgggcagcagggccaccuggcggg

SEQ ID NO: 1370387 - RNA, 23 nt, Human
cgguaccacuccagcaccgagcu

SEQ ID NO: 1370388 - RNA, 24 nt, Human
cguccuugccugcgggguuggaga

SEQ ID NO: 1370389 - RNA, 26 nt, Human
cucagccuuggccucguccuucuccu

SEQ ID NO: 1370390 - RNA, 23 nt, Human
cuccagcaccgagcugagcauga

SEQ ID NO: 1370391 - RNA, 18 nt, Human
cuccucaucaggaucccc

SEQ ID NO: 1370392 - RNA, 22 nt, Human
cucgcacaggccgcuggcugcc

SEQ ID NO: 1370393 - RNA, 22 nt, Human
cucugagcugccuuucagcccu

SEQ ID NO: 1370394 - RNA, 18 nt, Human
cuggagccucugagcugc

SEQ ID NO: 1370395 - RNA, 23 nt, Human
cuggagccucugagcugccuuuc

SEQ ID NO: 1370396 - RNA, 18 nt, Human
gaccucucccgcaugccc

SEQ ID NO: 1370397 - RNA, 18 nt, Human
gaggaggguuuggggcuc

SEQ ID NO: 1370398 - RNA, 22 nt, Human
gccccagcgccgggaaccccaa

SEQ ID NO: 1370399 - RNA, 19 nt, Human
gcuccagaauaguguagag

SEQ ID NO: 1370400 - RNA, 23 nt, Human
gcucgcucaugggccuucccaga

SEQ ID NO: 1370401 - RNA, 22 nt, Human
ggagcuccagaauaguguagag

SEQ ID NO: 1370402 - RNA, 19 nt, Human
ggaguccuucccuggagcc

SEQ ID NO: 1370403 - RNA, 22 nt, Human
ggcaugaggucacuucaucaaa

SEQ ID NO: 1370404 - RNA, 20 nt, Human
ggccagcagcagguccuuua

SEQ ID NO: 1370405 - RNA, 18 nt, Human
gggaucaccuccagcgcc

SEQ ID NO: 1370406 - RNA, 19 nt, Human
ggggcacaugagcagggcc

SEQ ID NO: 1370407 - RNA, 18 nt, Human
gggguuggagauggggaa

SEQ ID NO: 1370408 - RNA, 21 nt, Human
guuggucucuuccuuaucucu

SEQ ID NO: 1370409 - RNA, 18 nt, Human
ucagugggagggggcaca

SEQ ID NO: 1370410 - RNA, 18 nt, Human
ucccagaguucauccaag

SEQ ID NO: 1370411 - RNA, 24 nt, Human
ucccuggagccucugagcugccuu

SEQ ID NO: 1370412 - RNA, 18 nt, Human
ucucauauagcuccuuuu

SEQ ID NO: 1370413 - RNA, 23 nt, Human
ucugcagggccuccagggucuga

SEQ ID NO: 1370414 - RNA, 27 nt, Human
ucugcuggggccccaggaagucuccaa

SEQ ID NO: 1370415 - RNA, 18 nt, Human
ucugucuucucuggcacc

SEQ ID NO: 1370416 - RNA, 20 nt, Human
ugagcagggccaccacaacc

SEQ ID NO: 1370417 - RNA, 19 nt, Human
ugauuucugggaucaccuc

SEQ ID NO: 1370418 - RNA, 18 nt, Human
uggcauaaucuucuuuau

SEQ ID NO: 1370419 - RNA, 19 nt, Human
ugggagggggcacaugagc

SEQ ID NO: 1370420 - RNA, 23 nt, Human
uggggccccaggaagucuccaaa

SEQ ID NO: 1370421 - RNA, 21 nt, Human
ugucugcagggccuccagggu

SEQ ID NO: 1370422 - RNA, 24 nt, Human
uguggcauaaucuucuuuaucaug

SEQ ID NO: 1370423 - RNA, 21 nt, Human
uguggcucagcugcauguaga

SEQ ID NO: 1370424 - RNA, 21 nt, Human
uguuguugccaccuucugucu

SEQ ID NO: 1370425 - RNA, 23 nt, Human
uucccagaguucauccaaggccc

SEQ ID NO: 1370426 - RNA, 25 nt, Human
uuguugccaccuucugucuucucug

SEQ ID NO: 1370427 - RNA, 27 nt, Human
uuguugccaccuucugucuucucuggc

SEQ ID NO: 1370428 - RNA, 22 nt, Human
uuuguuggucucuuccuuaucu

SEQ ID NO: 1370429 - RNA, 24 nt, Human
aacugaggccccagcagggggagg

SEQ ID NO: 1370430 - RNA, 24 nt, Human
acagcagcaggcgccgcccucuuc

SEQ ID NO: 1370431 - RNA, 20 nt, Human
agagagcuggcggcugcagg

SEQ ID NO: 1370432 - RNA, 25 nt, Human
agagcaguccaggaaagggguguag

SEQ ID NO: 1370433 - RNA, 23 nt, Human
agaggggcuggcaggccugcucu

SEQ ID NO: 1370434 - RNA, 18 nt, Human
agcuggcggcugcaggug

SEQ ID NO: 1370435 - RNA, 23 nt, Human
aggaaagggguguaggaaaaugc

SEQ ID NO: 1370436 - RNA, 19 nt, Human
aggaaagguauauggcggc

SEQ ID NO: 1370437 - RNA, 21 nt, Human
aggcaccgcaaucccagccca

SEQ ID NO: 1370438 - RNA, 20 nt, Human
aggcgccgcccucuucuugg

SEQ ID NO: 1370439 - RNA, 21 nt, Human
aggggcuggcaggccugcucu

SEQ ID NO: 1370440 - RNA, 21 nt, Human
auagaauguagcaaaaggccc

SEQ ID NO: 1370441 - RNA, 21 nt, Human
aucuugucagcagcccuucca

SEQ ID NO: 1370442 - RNA, 19 nt, Human
augaucucacccuccauga

SEQ ID NO: 1370443 - RNA, 21 nt, Human
caaggaacauacccagagagc

SEQ ID NO: 1370444 - RNA, 23 nt, Human
caaguuacagauggggaaacuga

SEQ ID NO: 1370445 - RNA, 21 nt, Human
caauagaacgggaucucagug

SEQ ID NO: 1370446 - RNA, 21 nt, Human
cacaauggaauacaaaaggaa

SEQ ID NO: 1370447 - RNA, 22 nt, Human
cacacaccucucauggaacccc

SEQ ID NO: 1370448 - RNA, 22 nt, Human
caccaaggcugcaaaugggggc

SEQ ID NO: 1370449 - RNA, 25 nt, Human
caccuauaaggacguuacagaucua

SEQ ID NO: 1370450 - RNA, 21 nt, Human
cagcagcaggcgccgcccucu

SEQ ID NO: 1370451 - RNA, 18 nt, Human
cagcagggggaggggaug

SEQ ID NO: 1370452 - RNA, 23 nt, Human
caggguaacacccaggacuggag

SEQ ID NO: 1370453 - RNA, 19 nt, Human
ccaucagccauucucaucu

SEQ ID NO: 1370454 - RNA, 24 nt, Human
cccccuagugacaccuauaaggac

SEQ ID NO: 1370455 - RNA, 24 nt, Human
ccgcaaucccagcccacgccuccc

SEQ ID NO: 1370456 - RNA, 23 nt, Human
cgcaaucccagcccacgccuccc

SEQ ID NO: 1370457 - RNA, 19 nt, Human
cgccgugccgggccagcgc

SEQ ID NO: 1370458 - RNA, 18 nt, Human
cuagaagcuuccacaaug

SEQ ID NO: 1370459 - RNA, 22 nt, Human
cugaggccccagcagggggagg

SEQ ID NO: 1370460 - RNA, 21 nt, Human
cuggagcuuggaucuccugcc

SEQ ID NO: 1370461 - RNA, 26 nt, Human
cugucacacaccucucauggaacccc

SEQ ID NO: 1370462 - RNA, 21 nt, Human
cuucucagccuccuagaagcu

SEQ ID NO: 1370463 - RNA, 21 nt, Human
gacuauggagaaugagaggaa

SEQ ID NO: 1370464 - RNA, 20 nt, Human
gcagcccuuccaugacaccc

SEQ ID NO: 1370465 - RNA, 18 nt, Human
gcaggggugggcuggggg

SEQ ID NO: 1370466 - RNA, 19 nt, Human
gcaggggugggcugggggc

SEQ ID NO: 1370467 - RNA, 19 nt, Human
ggaagugacuuccccccuc

SEQ ID NO: 1370468 - RNA, 20 nt, Human
ggcacaguggugaaaccugc

SEQ ID NO: 1370469 - RNA, 21 nt, Human
ggcacaguggugaaaccugca

SEQ ID NO: 1370470 - RNA, 20 nt, Human
ggcccguggucaaacugaua

SEQ ID NO: 1370471 - RNA, 18 nt, Human
ggcugcaaaugggggcag

SEQ ID NO: 1370472 - RNA, 19 nt, Human
gggcaggggugggcugggg

SEQ ID NO: 1370473 - RNA, 21 nt, Human
gggcaggggugggcugggggc

SEQ ID NO: 1370474 - RNA, 21 nt, Human
ggggaagguuggugggcucuc

SEQ ID NO: 1370475 - RNA, 22 nt, Human
ggggcaggggugggcugggggc

SEQ ID NO: 1370476 - RNA, 21 nt, Human
gggggcaggggugggcugggg

SEQ ID NO: 1370477 - RNA, 23 nt, Human
gugaaaccugcaaggaacauacc

SEQ ID NO: 1370478 - RNA, 23 nt, Human
uacaaaaggaaagguauauggcg

SEQ ID NO: 1370479 - RNA, 18 nt, Human
uacccagagagcuggcgg

SEQ ID NO: 1370480 - RNA, 19 nt, Human
uagaacgggaucucagugg

SEQ ID NO: 1370481 - RNA, 22 nt, Human
ucagacugccugucacacaccu

SEQ ID NO: 1370482 - RNA, 22 nt, Human
ucagcagcccuuccaugacacc

SEQ ID NO: 1370483 - RNA, 24 nt, Human
ucagcagcccuuccaugacacccu

SEQ ID NO: 1370484 - RNA, 20 nt, Human
uccacaauggaauacaaaag

SEQ ID NO: 1370485 - RNA, 20 nt, Human
uccaggaaagggguguagga

SEQ ID NO: 1370486 - RNA, 19 nt, Human
ucccagcccacgccucccg

SEQ ID NO: 1370487 - RNA, 23 nt, Human
ucuguggcuggaacacacgagac

SEQ ID NO: 1370488 - RNA, 22 nt, Human
ucuugucagcagcccuuccaug

SEQ ID NO: 1370489 - RNA, 20 nt, Human
ugagagaagggaagugacuu

SEQ ID NO: 1370490 - RNA, 22 nt, Human
ugauacgggguggggaagguug

SEQ ID NO: 1370491 - RNA, 18 nt, Human
uggaauacaaaaggaaag

SEQ ID NO: 1370492 - RNA, 22 nt, Human
ugggccaucaguuaauuacauc

SEQ ID NO: 1370493 - RNA, 24 nt, Human
ugggcucucagccaucagccauuc

SEQ ID NO: 1370494 - RNA, 18 nt, Human
uggggcacaguggugaaa

SEQ ID NO: 1370495 - RNA, 21 nt, Human
ugggggcaggggugggcuggg

SEQ ID NO: 1370496 - RNA, 23 nt, Human
ugggggcaggggugggcuggggg

SEQ ID NO: 1370497 - RNA, 24 nt, Human
uucccuaacaugaucucacccucc

SEQ ID NO: 1370498 - RNA, 23 nt, Human
uucuuuuccccauacucucagcc

SEQ ID NO: 1370499 - RNA, 25 nt, Human
uuuauuaaaucaauagaacgggauc

SEQ ID NO: 1370500 - RNA, 21 nt, Human
aaaaggccacagguagcgcag

SEQ ID NO: 1370501 - RNA, 21 nt, Human
aagcagccaggauggagcugg

SEQ ID NO: 1370502 - RNA, 18 nt, Human
acacagugaucuccaucu

SEQ ID NO: 1370503 - RNA, 22 nt, Human
acaggaaguagcagucagucca

SEQ ID NO: 1370504 - RNA, 22 nt, Human
accuucaucuccuuccugggaa

SEQ ID NO: 1370505 - RNA, 19 nt, Human
agagccauuuuuggccaga

SEQ ID NO: 1370506 - RNA, 23 nt, Human
agagcucagccacuacuccuggc

SEQ ID NO: 1370507 - RNA, 25 nt, Human
agaguucugggugggagacuugggg

SEQ ID NO: 1370508 - RNA, 19 nt, Human
agcagccaggauggagcug

SEQ ID NO: 1370509 - RNA, 18 nt, Human
aggcagcugguugugguu

SEQ ID NO: 1370510 - RNA, 19 nt, Human
aggccuccugaauguggua

SEQ ID NO: 1370511 - RNA, 19 nt, Human
aggcucuccugggucuccu

SEQ ID NO: 1370512 - RNA, 19 nt, Human
agggacuccagaguuuugc

SEQ ID NO: 1370513 - RNA, 22 nt, Human
aggugugagcugggccuguggg

SEQ ID NO: 1370514 - RNA, 21 nt, Human
caagcagccaggauggagcug

SEQ ID NO: 1370515 - RNA, 18 nt, Human
cacucugcucccuggagc

SEQ ID NO: 1370516 - RNA, 23 nt, Human
cacucugcucccuggagcugggu

SEQ ID NO: 1370517 - RNA, 22 nt, Human
cagcgaucacagagcucagcca

SEQ ID NO: 1370518 - RNA, 20 nt, Human
caggcccaagggugccccuc

SEQ ID NO: 1370519 - RNA, 21 nt, Human
caguccaggcugggccccucc

SEQ ID NO: 1370520 - RNA, 21 nt, Human
ccaggcugggccccuccaucc

SEQ ID NO: 1370521 - RNA, 22 nt, Human
ccaucgauuccuggggcaccgg

SEQ ID NO: 1370522 - RNA, 21 nt, Human
cccagacucugagugggaggc

SEQ ID NO: 1370523 - RNA, 24 nt, Human
cccccugcucaggccagcugggaa

SEQ ID NO: 1370524 - RNA, 22 nt, Human
ccccgggcccagccgcaagugc

SEQ ID NO: 1370525 - RNA, 22 nt, Human
ccccuccauccucgacacucug

SEQ ID NO: 1370526 - RNA, 24 nt, Human
ccccuccauccucgacacucugcu

SEQ ID NO: 1370527 - RNA, 24 nt, Human
cccgggcccagccgcaagugcugg

SEQ ID NO: 1370528 - RNA, 23 nt, Human
ccucucugggugauaauggaaac

SEQ ID NO: 1370529 - RNA, 24 nt, Human
ccugcuggcccaggcucuccuggg

SEQ ID NO: 1370530 - RNA, 27 nt, Human
ccuucaucuccuuccuggggggccgcc

SEQ ID NO: 1370531 - RNA, 19 nt, Human
cgagccaggugcuucuacc

SEQ ID NO: 1370532 - RNA, 22 nt, Human
cgccugcuuccccuuugagucc

SEQ ID NO: 1370533 - RNA, 24 nt, Human
cuaccuucaucuccuuccugggaa

SEQ ID NO: 1370534 - RNA, 18 nt, Human
cuccuggccagaggacau

SEQ ID NO: 1370535 - RNA, 23 nt, Human
cuccugggucuccuuucuguccu

SEQ ID NO: 1370536 - RNA, 19 nt, Human
cugaaggcccaacguagca

SEQ ID NO: 1370537 - RNA, 18 nt, Human
cuggcccaggcucuccug

SEQ ID NO: 1370538 - RNA, 19 nt, Human
cugggugggagacuugggg

SEQ ID NO: 1370539 - RNA, 23 nt, Human
cuguccacuuuccggcagcuuca

SEQ ID NO: 1370540 - RNA, 20 nt, Human
cuuuggggcccuucucucca

SEQ ID NO: 1370541 - RNA, 18 nt, Human
gaaguagcagucagucca

SEQ ID NO: 1370542 - RNA, 18 nt, Human
gacacucugcucccugga

SEQ ID NO: 1370543 - RNA, 24 nt, Human
gacccagacucugagugggaggcc

SEQ ID NO: 1370544 - RNA, 19 nt, Human
gagcgugggugggucuggu

SEQ ID NO: 1370545 - RNA, 23 nt, Human
gauaauggaaacagagacaggaa

SEQ ID NO: 1370546 - RNA, 20 nt, Human
gcagccgcuguuccaccccu

SEQ ID NO: 1370547 - RNA, 19 nt, Human
gcccaggcccaagggugcc

SEQ ID NO: 1370548 - RNA, 23 nt, Human
gcgggggcagguucucccggcgg

SEQ ID NO: 1370549 - RNA, 19 nt, Human
gguugcugggaacacuugc

SEQ ID NO: 1370550 - RNA, 20 nt, Human
ucacugcuccccgggcccag

SEQ ID NO: 1370551 - RNA, 23 nt, Human
ucaguccaggcugggccccucca

SEQ ID NO: 1370552 - RNA, 20 nt, Human
uccacaucacagcgaucaca

SEQ ID NO: 1370553 - RNA, 19 nt, Human
ucccuggagcuggguccac

SEQ ID NO: 1370554 - RNA, 23 nt, Human
uccucgacacucugcucccugga

SEQ ID NO: 1370555 - RNA, 21 nt, Human
ucuccugggucuccuuucuga

SEQ ID NO: 1370556 - RNA, 21 nt, Human
ugaggccuccugaauguggua

SEQ ID NO: 1370557 - RNA, 19 nt, Human
ugauaauggaaacagagac

SEQ ID NO: 1370558 - RNA, 21 nt, Human
ugccgguggcuuuggggcugg

SEQ ID NO: 1370559 - RNA, 19 nt, Human
ugcucaggccagcugggaa

SEQ ID NO: 1370560 - RNA, 20 nt, Human
ugcucaggccagcugggaac

SEQ ID NO: 1370561 - RNA, 18 nt, Human
ugcuucuaccuucaucuc

SEQ ID NO: 1370562 - RNA, 22 nt, Human
uggaggcugaugaggccaggag

SEQ ID NO: 1370563 - RNA, 24 nt, Human
uggaggcugaugaggccaggagca

SEQ ID NO: 1370564 - RNA, 18 nt, Human
uggauaggguguguccca

SEQ ID NO: 1370565 - RNA, 24 nt, Human
uggcaggcuggccuccugaggccu

SEQ ID NO: 1370566 - RNA, 19 nt, Human
uggcccaggcucuccuggg

SEQ ID NO: 1370567 - RNA, 19 nt, Human
uggcuuuggggcugggugg

SEQ ID NO: 1370568 - RNA, 19 nt, Human
uggcuuuggggcugggugg

SEQ ID NO: 1370569 - RNA, 24 nt, Human
ugggccccuccauccucgacacuc

SEQ ID NO: 1370570 - RNA, 21 nt, Human
uggggcccuucucuccaucga

SEQ ID NO: 1370571 - RNA, 18 nt, Human
ugggugggagacuugggg

SEQ ID NO: 1370572 - RNA, 19 nt, Human
ugguggcaggcccccugcu

SEQ ID NO: 1370573 - RNA, 18 nt, Human
uguccacacggaucugua

SEQ ID NO: 1370574 - RNA, 26 nt, Human
uguccacuuuccggcagcuucacaug

SEQ ID NO: 1370575 - RNA, 20 nt, Human
uuccuggggcaccgggcaau

SEQ ID NO: 1370576 - RNA, 20 nt, Human
uugaauguuaaaaggccaca

SEQ ID NO: 1370577 - RNA, 25 nt, Human
uuggggcugggugggcauacucuug

SEQ ID NO: 1370578 - RNA, 21 nt, Human
uuuggccagaguucugggugg

SEQ ID NO: 1370579 - RNA, 19 nt, Human
uuuggggcccuucucucca

SEQ ID NO: 1370580 - RNA, 22 nt, Human
uuuuacaaaaauuaaaaauguc

SEQ ID NO: 1370581 - RNA, 18 nt, Human
aagcggaagacuaaugac

SEQ ID NO: 1370582 - RNA, 18 nt, Human
aauaggagugaggaggca

SEQ ID NO: 1370583 - RNA, 20 nt, Human
acaaaggcaaagagaauagg

SEQ ID NO: 1370584 - RNA, 23 nt, Human
agacuuugacaugugugaaaaca

SEQ ID NO: 1370585 - RNA, 23 nt, Human
agcaauggaaaggaagugucaga

SEQ ID NO: 1370586 - RNA, 24 nt, Human
agccagcgucugggggguccucga

SEQ ID NO: 1370587 - RNA, 18 nt, Human
aggaaguggggaagaggg

SEQ ID NO: 1370588 - RNA, 22 nt, Human
aggcaaagagaauaggagugag

SEQ ID NO: 1370589 - RNA, 20 nt, Human
aggcaggaauaacgcugggu

SEQ ID NO: 1370590 - RNA, 19 nt, Human
aguggggaagaggcugcag

SEQ ID NO: 1370591 - RNA, 22 nt, Human
caaagacagcaucuuccuggaa

SEQ ID NO: 1370592 - RNA, 21 nt, Human
cacagccuagcuccuuccuuu

SEQ ID NO: 1370593 - RNA, 19 nt, Human
cacucccaggaagugggga

SEQ ID NO: 1370594 - RNA, 19 nt, Human
cagcaaugaacaaaaggaa

SEQ ID NO: 1370595 - RNA, 22 nt, Human
cagcgucuggggagaagaugac

SEQ ID NO: 1370596 - RNA, 19 nt, Human
cagucuguucaggccaagc

SEQ ID NO: 1370597 - RNA, 18 nt, Human
cauugugaccagacggga

SEQ ID NO: 1370598 - RNA, 19 nt, Human
cauuucaccuuucucagua

SEQ ID NO: 1370599 - RNA, 18 nt, Human
ccucugggugcugcugug

SEQ ID NO: 1370600 - RNA, 23 nt, Human
ccuguagaucauugugaccagac

SEQ ID NO: 1370601 - RNA, 18 nt, Human
ccuuugcacaggauggcu

SEQ ID NO: 1370602 - RNA, 24 nt, Human
ccuuugcacaggauggcucugcgg

SEQ ID NO: 1370603 - RNA, 19 nt, Human
cgcugggucacucccagga

SEQ ID NO: 1370604 - RNA, 20 nt, Human
cucuuccuuggcuuucuugg

SEQ ID NO: 1370605 - RNA, 23 nt, Human
gaagaggcugcagccaagaagaa

SEQ ID NO: 1370606 - RNA, 20 nt, Human
gcaaagagaauaggagugag

SEQ ID NO: 1370607 - RNA, 22 nt, Human
gcuuucuugguaacagcaauga

SEQ ID NO: 1370608 - RNA, 19 nt, Human
gggcaaacgacacaaguca

SEQ ID NO: 1370609 - RNA, 19 nt, Human
gggcuauaggggaaauagg

SEQ ID NO: 1370610 - RNA, 21 nt, Human
gucagucuguucaggccaagc

SEQ ID NO: 1370611 - RNA, 22 nt, Human
uaacagcaaugaacaaaaggaa

SEQ ID NO: 1370612 - RNA, 20 nt, Human
uaagcaucucucucaguuga

SEQ ID NO: 1370613 - RNA, 19 nt, Human
uacacaaaggcaaagagaa

SEQ ID NO: 1370614 - RNA, 21 nt, Human
uacacaaaggcaaagagaaua

SEQ ID NO: 1370615 - RNA, 20 nt, Human
ucccuagauagcuuucuucc

SEQ ID NO: 1370616 - RNA, 24 nt, Human
ucccuagauagcuuucuuccucuc

SEQ ID NO: 1370617 - RNA, 26 nt, Human
ucuguucaggccaagcaauggaaagg

SEQ ID NO: 1370618 - RNA, 18 nt, Human
ugacaugugugaaaacau

SEQ ID NO: 1370619 - RNA, 19 nt, Human
ugaggaggcaggaauaacg

SEQ ID NO: 1370620 - RNA, 19 nt, Human
ugauucuagaucucguccc

SEQ ID NO: 1370621 - RNA, 21 nt, Human
ugggucacucccaggaagugg

SEQ ID NO: 1370622 - RNA, 20 nt, Human
uuucaccuuucucaguaauc

SEQ ID NO: 1370623 - RNA, 23 nt, Human
uuucuugguaacagcaaugaaca

SEQ ID NO: 1370624 - RNA, 18 nt, Human
uuuuuuuuuuuuuuucug

SEQ ID NO: 1370625 - RNA, 19 nt, Human
uuuuuuuuuuuuuuucugu

SEQ ID NO: 1370626 - RNA, 24 nt, Human
aaucuccacccccagguucaggag

SEQ ID NO: 1370627 - RNA, 29 nt, Human
auccgguuacucccuuucccuuccccaag

SEQ ID NO: 1370628 - RNA, 19 nt, Human
cacagccaacacccuugcc

SEQ ID NO: 1370629 - RNA, 24 nt, Human
cacccccagguucaggagaugcuu

SEQ ID NO: 1370630 - RNA, 26 nt, Human
cacccuugccuucuguuuucuaaggg

SEQ ID NO: 1370631 - RNA, 24 nt, Human
caucugccccguuguuuacuaaca

SEQ ID NO: 1370632 - RNA, 25 nt, Human
cauuggaggcugcagcaugcagagg

SEQ ID NO: 1370633 - RNA, 20 nt, Human
ccaaccgauguucuuggauc

SEQ ID NO: 1370634 - RNA, 18 nt, Human
ccaaccgcagcuccugca

SEQ ID NO: 1370635 - RNA, 23 nt, Human
ccaaccgcagcuccugcagagug

SEQ ID NO: 1370636 - RNA, 21 nt, Human
ccaaugauaggaacacaauuu

SEQ ID NO: 1370637 - RNA, 20 nt, Human
ccaucuuuacucugaauguu

SEQ ID NO: 1370638 - RNA, 20 nt, Human
ccccagguucaggagaugcu

SEQ ID NO: 1370639 - RNA, 24 nt, Human
ccgguuacucccuuucccuucccc

SEQ ID NO: 1370640 - RNA, 18 nt, Human
cucccuuucccuucccca

SEQ ID NO: 1370641 - RNA, 21 nt, Human
cugaauguuaacaucugcccc

SEQ ID NO: 1370642 - RNA, 20 nt, Human
ggaggcugcagcaugcagag

SEQ ID NO: 1370643 - RNA, 22 nt, Human
gggaaagaggaauuuccaguau

SEQ ID NO: 1370644 - RNA, 18 nt, Human
guaacccuuugcguucug

SEQ ID NO: 1370645 - RNA, 23 nt, Human
guuuacuaacaauucaagacacc

SEQ ID NO: 1370646 - RNA, 21 nt, Human
ucaaucuccacccccagguuc

SEQ ID NO: 1370647 - RNA, 22 nt, Human
uccacagccaacacccuugccu

SEQ ID NO: 1370648 - RNA, 18 nt, Human
uccccaaccgcagcuccu

SEQ ID NO: 1370649 - RNA, 23 nt, Human
ugcauucugauucauaauugguc

SEQ ID NO: 1370650 - RNA, 24 nt, Human
uggaggcagcagcaaaaugcaaag

SEQ ID NO: 1370651 - RNA, 22 nt, Human
uuacucccuuucccuuccccaa

SEQ ID NO: 1370652 - RNA, 22 nt, Human
uucacguuagcaccguagucaa

SEQ ID NO: 1370653 - RNA, 21 nt, Human
uucauaauuggucccucaggg

SEQ ID NO: 1370654 - RNA, 18 nt, Human
uuccccaaccgcagcucc

SEQ ID NO: 1370655 - RNA, 20 nt, Human
uucccuuccccaaccgcagc

SEQ ID NO: 1370656 - RNA, 19 nt, Human
uuggcugguucacguuagc

SEQ ID NO: 1370657 - RNA, 19 nt, Human
uuuccacagccaacacccu

SEQ ID NO: 1370658 - RNA, 24 nt, Human
uuugccaucuuuacucugaauguu

SEQ ID NO: 1370659 - RNA, 24 nt, Human
aaagaauccaauaugagacccaaa

SEQ ID NO: 1370660 - RNA, 18 nt, Human
aacacggaagggacagau

SEQ ID NO: 1370661 - RNA, 23 nt, Human
acucagguccaaaaucuucagcc

SEQ ID NO: 1370662 - RNA, 20 nt, Human
agaaugcaaauguauauuca

SEQ ID NO: 1370663 - RNA, 21 nt, Human
agaaugcaaauguauauucau

SEQ ID NO: 1370664 - RNA, 21 nt, Human
agggcuuucuucagcuuaaaa

SEQ ID NO: 1370665 - RNA, 21 nt, Human
aucagcuucaguacuuacuag

SEQ ID NO: 1370666 - RNA, 25 nt, Human
caaauaacaauuaaauuaaauaaga

SEQ ID NO: 1370667 - RNA, 23 nt, Human
cagaaagaauccaauaugagacc

SEQ ID NO: 1370668 - RNA, 24 nt, Human
cagauagggagccggaaugugaca

SEQ ID NO: 1370669 - RNA, 26 nt, Human
caggcaucuguccaaauaucagcuuc

SEQ ID NO: 1370670 - RNA, 22 nt, Human
cauuugcauuuuaagagcauga

SEQ ID NO: 1370671 - RNA, 26 nt, Human
ccaauaugagacccaaaguuaccagu

SEQ ID NO: 1370672 - RNA, 20 nt, Human
ccacugaucccaaaagagca

SEQ ID NO: 1370673 - RNA, 23 nt, Human
cccagagaauacauggggcugcu

SEQ ID NO: 1370674 - RNA, 18 nt, Human
ccccaaagacaacuggcu

SEQ ID NO: 1370675 - RNA, 20 nt, Human
ccugcugagcuuucuuuccc

SEQ ID NO: 1370676 - RNA, 21 nt, Human
cuaaaaccugucuucccuaga

SEQ ID NO: 1370677 - RNA, 21 nt, Human
cuugcucuuuuugccuauagg

SEQ ID NO: 1370678 - RNA, 20 nt, Human
gacaacuggcuauaauuccc

SEQ ID NO: 1370679 - RNA, 23 nt, Human
gaucugaaguuagcuucaucaag

SEQ ID NO: 1370680 - RNA, 22 nt, Human
gcuugcucuuuuugccuauagg

SEQ ID NO: 1370681 - RNA, 20 nt, Human
ggguauccaggaagugagaa

SEQ ID NO: 1370682 - RNA, 27 nt, Human
uaaaaagaugaucaguggaaaaacugg

SEQ ID NO: 1370683 - RNA, 23 nt, Human
uaaagaaugcaaauguauauuca

SEQ ID NO: 1370684 - RNA, 22 nt, Human
uaacacaaauuuauugggugga

SEQ ID NO: 1370685 - RNA, 21 nt, Human
uaacuaccuuaagccucaggu

SEQ ID NO: 1370686 - RNA, 20 nt, Human
uaagccucagguucaucauc

SEQ ID NO: 1370687 - RNA, 21 nt, Human
uaccaguuccugcugagcuuu

SEQ ID NO: 1370688 - RNA, 20 nt, Human
uacuagcugagugaucugga

SEQ ID NO: 1370689 - RNA, 18 nt, Human
uaugagacccaaaguuac

SEQ ID NO: 1370690 - RNA, 22 nt, Human
uccaaauaucagcuucaguacu

SEQ ID NO: 1370691 - RNA, 24 nt, Human
ucccagagaauacauggggcugcu

SEQ ID NO: 1370692 - RNA, 21 nt, Human
uccccaaagacaacuggcuau

SEQ ID NO: 1370693 - RNA, 20 nt, Human
ucccuagacaccauugacug

SEQ ID NO: 1370694 - RNA, 21 nt, Human
uccucacaggguauccaggaa

SEQ ID NO: 1370695 - RNA, 22 nt, Human
ucuagcccacugaucccaaaag

SEQ ID NO: 1370696 - RNA, 22 nt, Human
ucuagcucugcaaguuucuguc

SEQ ID NO: 1370697 - RNA, 18 nt, Human
ucugcaaguuucugucgc

SEQ ID NO: 1370698 - RNA, 24 nt, Human
ucuucagcccacaucaaagacuuc

SEQ ID NO: 1370699 - RNA, 24 nt, Human
ugaaaaagucuccccaaagacaac

SEQ ID NO: 1370700 - RNA, 24 nt, Human
ugaaaagggacaaaaaaaggggua

SEQ ID NO: 1370701 - RNA, 21 nt, Human
ugaacaguguguguauagccu

SEQ ID NO: 1370702 - RNA, 24 nt, Human
ugacaaguggagcuuaauuugggu

SEQ ID NO: 1370703 - RNA, 22 nt, Human
ugagaagagguuucccauacaa

SEQ ID NO: 1370704 - RNA, 24 nt, Human
ugaucuggagcaauuaacuaccuu

SEQ ID NO: 1370705 - RNA, 18 nt, Human
uggagcaauuaacuaccg

SEQ ID NO: 1370706 - RNA, 20 nt, Human
uggagucaggcaucuguccc

SEQ ID NO: 1370707 - RNA, 20 nt, Human
uggcuugcucuuuuugccua

SEQ ID NO: 1370708 - RNA, 21 nt, Human
uuagugaggcaauaauaaugu

SEQ ID NO: 1370709 - RNA, 18 nt, Human
uucaucauuugcauuuua

SEQ ID NO: 1370710 - RNA, 19 nt, Human
uugggucuuuugauucuuu

SEQ ID NO: 1370711 - RNA, 24 nt, Human
uuuaucaucuuuggaucuucuuuu

SEQ ID NO: 1370712 - RNA, 23 nt, Human
uuucuauuugcuaaaaguaauug

SEQ ID NO: 1370713 - RNA, 19 nt, Human
aaagaacaggggagagucc

SEQ ID NO: 1370714 - RNA, 19 nt, Human
aaagugcugggauuacagg

SEQ ID NO: 1370715 - RNA, 24 nt, Human
aaagugcugggauuacaggcuuga

SEQ ID NO: 1370716 - RNA, 20 nt, Human
aaaugccagaggcggugacc

SEQ ID NO: 1370717 - RNA, 20 nt, Human
aaccaaagauccccgccggg

SEQ ID NO: 1370718 - RNA, 19 nt, Human
aaccuagaccaaucaaacc

SEQ ID NO: 1370719 - RNA, 20 nt, Human
aacuuggcucaugagcagaa

SEQ ID NO: 1370720 - RNA, 24 nt, Human
aagucgaggcugcagugagcugag

SEQ ID NO: 1370721 - RNA, 19 nt, Human
aagugcugggauuacaggc

SEQ ID NO: 1370722 - RNA, 19 nt, Human
aagugcugggauuacaggc

SEQ ID NO: 1370723 - RNA, 26 nt, Human
aagugcugggauuacaggcuugagcc

SEQ ID NO: 1370724 - RNA, 19 nt, Human
acaggguuucgccgugcua

SEQ ID NO: 1370725 - RNA, 20 nt, Human
acaggguuucgccgugcuag

SEQ ID NO: 1370726 - RNA, 19 nt, Human
acugggcuacguagcugaa

SEQ ID NO: 1370727 - RNA, 24 nt, Human
agacaggaggauuucuugagccca

SEQ ID NO: 1370728 - RNA, 18 nt, Human
agacaggguuucgccgug

SEQ ID NO: 1370729 - RNA, 19 nt, Human
agagacaggguuucgccgu

SEQ ID NO: 1370730 - RNA, 20 nt, Human
agccucucugccaagcugga

SEQ ID NO: 1370731 - RNA, 24 nt, Human
aggcacaguggcucacaucuguaa

SEQ ID NO: 1370732 - RNA, 18 nt, Human
aggcaggcggaucacuug

SEQ ID NO: 1370733 - RNA, 21 nt, Human
aggcaucacuauaguuuaaaa

SEQ ID NO: 1370734 - RNA, 19 nt, Human
aggcuggagugcaguggca

SEQ ID NO: 1370735 - RNA, 20 nt, Human
agucagccagaaaccucuga

SEQ ID NO: 1370736 - RNA, 23 nt, Human
agucgaggcugcagugagcugag

SEQ ID NO: 1370737 - RNA, 21 nt, Human
agugcaguggcacgaucggcu

SEQ ID NO: 1370738 - RNA, 22 nt, Human
agugcaguggcacgaucggcug

SEQ ID NO: 1370739 - RNA, 24 nt, Human
agugcugggauuacaggcuugagc

SEQ ID NO: 1370740 - RNA, 24 nt, Human
aguggcucacaucuguaauccugg

SEQ ID NO: 1370741 - RNA, 21 nt, Human
aucacagcuacucggaaggca

SEQ ID NO: 1370742 - RNA, 23 nt, Human
aucacuugagcccaggaguucaa

SEQ ID NO: 1370743 - RNA, 19 nt, Human
aucaugccacuguacucca

SEQ ID NO: 1370744 - RNA, 18 nt, Human
augccacuguacuccaac

SEQ ID NO: 1370745 - RNA, 21 nt, Human
caaaaagugcaccaggaaggc

SEQ ID NO: 1370746 - RNA, 24 nt, Human
caaagugcugggauuacaggcuug

SEQ ID NO: 1370747 - RNA, 18 nt, Human
caaccaaagauccccgcc

SEQ ID NO: 1370748 - RNA, 26 nt, Human
caaccuagaccaaucaaaccagaagc

SEQ ID NO: 1370749 - RNA, 24 nt, Human
cacaggcacacgccaccacaccca

SEQ ID NO: 1370750 - RNA, 24 nt, Human
cacaucuguaauccuggcauucug

SEQ ID NO: 1370751 - RNA, 21 nt, Human
caccaugccuggcccaucuga

SEQ ID NO: 1370752 - RNA, 24 nt, Human
caccucugccucccaaagugcugg

SEQ ID NO: 1370753 - RNA, 27 nt, Human
cacgaucggcugucugcaagcuccgcc

SEQ ID NO: 1370754 - RNA, 21 nt, Human
cagaacgacaaaugccagagg

SEQ ID NO: 1370755 - RNA, 23 nt, Human
cagaacgacaaaugccagaggcg

SEQ ID NO: 1370756 - RNA, 19 nt, Human
cagcaccaucagcaucgcc

SEQ ID NO: 1370757 - RNA, 27 nt, Human
cagccagaaaccucugauuccaccacg

SEQ ID NO: 1370758 - RNA, 28 nt, Human
cagccagaaaccucugauuccaccacgu

SEQ ID NO: 1370759 - RNA, 23 nt, Human
cagccucccgagcagcugggacc

SEQ ID NO: 1370760 - RNA, 18 nt, Human
caggagaagaccagggug

SEQ ID NO: 1370761 - RNA, 20 nt, Human
caggagaagaccagggugga

SEQ ID NO: 1370762 - RNA, 22 nt, Human
caggccauucuucugccucagc

SEQ ID NO: 1370763 - RNA, 24 nt, Human
caggcugcaaccuagaccaaucaa

SEQ ID NO: 1370764 - RNA, 24 nt, Human
caggguuucgccgugcuagccagg

SEQ ID NO: 1370765 - RNA, 24 nt, Human
caucuguaauccuggcauucuggg

SEQ ID NO: 1370766 - RNA, 19 nt, Human
ccaaagugcugggauuaca

SEQ ID NO: 1370767 - RNA, 22 nt, Human
ccaaagugcugggauuacaggc

SEQ ID NO: 1370768 - RNA, 23 nt, Human
ccaaagugcugggauuacaggcu

SEQ ID NO: 1370769 - RNA, 19 nt, Human
ccaaccaaagauccccgcc

SEQ ID NO: 1370770 - RNA, 22 nt, Human
ccaaucaaaccagaagcucugc

SEQ ID NO: 1370771 - RNA, 18 nt, Human
ccacuguacuccaaccuc

SEQ ID NO: 1370772 - RNA, 23 nt, Human
ccagaaaccucugauuccaccac

SEQ ID NO: 1370773 - RNA, 24 nt, Human
ccagaggcggugaccgcguccucu

SEQ ID NO: 1370774 - RNA, 20 nt, Human
ccagcgccgcaccgcgcacc

SEQ ID NO: 1370775 - RNA, 19 nt, Human
ccaggguggagagggaaaa

SEQ ID NO: 1370776 - RNA, 20 nt, Human
ccagugugaagccuaagugg

SEQ ID NO: 1370777 - RNA, 24 nt, Human
cccaaagugcugggauuacaggcu

SEQ ID NO: 1370778 - RNA, 19 nt, Human
ccccacccuagaccugcug

SEQ ID NO: 1370779 - RNA, 23 nt, Human
cccggguucaggccauucuucug

SEQ ID NO: 1370780 - RNA, 21 nt, Human
ccuccagcuuggcgacccagc

SEQ ID NO: 1370781 - RNA, 24 nt, Human
ccucccggguucaggccauucuuc

SEQ ID NO: 1370782 - RNA, 18 nt, Human
ccucucugccaagcugga

SEQ ID NO: 1370783 - RNA, 19 nt, Human
ccugguucaaagcacccac

SEQ ID NO: 1370784 - RNA, 19 nt, Human
ccuuuugacagaaucccca

SEQ ID NO: 1370785 - RNA, 21 nt, Human
cgccagcgccaaccaaagauc

SEQ ID NO: 1370786 - RNA, 24 nt, Human
cgccagcgccaaccaaagaucccc

SEQ ID NO: 1370787 - RNA, 23 nt, Human
cgccgggaaagccucucugccaa

SEQ ID NO: 1370788 - RNA, 24 nt, Human
cgccgugcuagccaggauggucuc

SEQ ID NO: 1370789 - RNA, 19 nt, Human
cgccucccggguucaggcc

SEQ ID NO: 1370790 - RNA, 24 nt, Human
cggaucacuugagcccaggaguuc

SEQ ID NO: 1370791 - RNA, 21 nt, Human
cguccagggaccagcaccauc

SEQ ID NO: 1370792 - RNA, 25 nt, Human
cgugauccgcccaccucugccuccc

SEQ ID NO: 1370793 - RNA, 23 nt, Human
cuaauuuuuuguauuuuuaguag

SEQ ID NO: 1370794 - RNA, 21 nt, Human
cucacaucuguaauccuggca

SEQ ID NO: 1370795 - RNA, 19 nt, Human
cuccaaccucuuucuuguc

SEQ ID NO: 1370796 - RNA, 22 nt, Human
cuccugaccucgugauccgccc

SEQ ID NO: 1370797 - RNA, 24 nt, Human
cucgcucugucgcccaggcuggag

SEQ ID NO: 1370798 - RNA, 20 nt, Human
cucugucgcccaggcuggag

SEQ ID NO: 1370799 - RNA, 21 nt, Human
cugcaagcuccgccucccggg

SEQ ID NO: 1370800 - RNA, 20 nt, Human
cugcagugagcugagaucau

SEQ ID NO: 1370801 - RNA, 21 nt, Human
cugcagugagcugagaucaug

SEQ ID NO: 1370802 - RNA, 23 nt, Human
cugccucagccucccgagcagcu

SEQ ID NO: 1370803 - RNA, 19 nt, Human
cuggcauucugggaggcca

SEQ ID NO: 1370804 - RNA, 22 nt, Human
gaccucgugauccgcccaccuc

SEQ ID NO: 1370805 - RNA, 21 nt, Human
gagacggagucucgcucuguc

SEQ ID NO: 1370806 - RNA, 24 nt, Human
gagcagcugggaccacaggcacac

SEQ ID NO: 1370807 - RNA, 24 nt, Human
gaggcugcagugagcugagaucaa

SEQ ID NO: 1370808 - RNA, 24 nt, Human
gaucacuugagcccaggaguucaa

SEQ ID NO: 1370809 - RNA, 18 nt, Human
gauuacaggcuugagcca

SEQ ID NO: 1370810 - RNA, 21 nt, Human
gauuacaggcuugagccacca

SEQ ID NO: 1370811 - RNA, 24 nt, Human
gauuacaggcuugagccaccaugc

SEQ ID NO: 1370812 - RNA, 24 nt, Human
gcccaggaagucgaggcugcagug

SEQ ID NO: 1370813 - RNA, 23 nt, Human
gcccaggcuggagugcaguggca

SEQ ID NO: 1370814 - RNA, 25 nt, Human
gccgugcuggaaaaggcggccacac

SEQ ID NO: 1370815 - RNA, 22 nt, Human
gcgcacccgcgccgccugcgcg

SEQ ID NO: 1370816 - RNA, 25 nt, Human
gcucugucgcccaggcuggagugca

SEQ ID NO: 1370817 - RNA, 19 nt, Human
gcuggagugcaguggcacg

SEQ ID NO: 1370818 - RNA, 23 nt, Human
ggaucacuugagcccaggaguuc

SEQ ID NO: 1370819 - RNA, 24 nt, Human
ggauuacaggcuugagccaccaug

SEQ ID NO: 1370820 - RNA, 20 nt, Human
ggucucgaucuccugaccuc

SEQ ID NO: 1370821 - RNA, 23 nt, Human
guagcugaaaagaacaggggaga

SEQ ID NO: 1370822 - RNA, 23 nt, Human
gucaggccccccacccuagaccu

SEQ ID NO: 1370823 - RNA, 18 nt, Human
guccagggaccagcacca

SEQ ID NO: 1370824 - RNA, 24 nt, Human
gugauccgcccaccucugccuccc

SEQ ID NO: 1370825 - RNA, 24 nt, Human
uaagacaccgccaggcaucacuau

SEQ ID NO: 1370826 - RNA, 21 nt, Human
uaaguggagaaccacugggcu

SEQ ID NO: 1370827 - RNA, 24 nt, Human
uaauuuuuuguauuuuuaguagag

SEQ ID NO: 1370828 - RNA, 18 nt, Human
uacaggagaagaccaggg

SEQ ID NO: 1370829 - RNA, 22 nt, Human
uacaggcuugagccaccaugcc

SEQ ID NO: 1370830 - RNA, 20 nt, Human
uaccuccagcuuggcgaccc

SEQ ID NO: 1370831 - RNA, 21 nt, Human
uacggugggcgccugccuaac

SEQ ID NO: 1370832 - RNA, 23 nt, Human
uagaccaaucaaaccagaagcuc

SEQ ID NO: 1370833 - RNA, 18 nt, Human
uagagacaggguuucgcc

SEQ ID NO: 1370834 - RNA, 21 nt, Human
uaguagagacaggguuucgcc

SEQ ID NO: 1370835 - RNA, 24 nt, Human
uaguagagacaggguuucgccgug

SEQ ID NO: 1370836 - RNA, 25 nt, Human
uaguagagacaggguuucgccgugc

SEQ ID NO: 1370837 - RNA, 23 nt, Human
ucacuugagcccaggaguucaag

SEQ ID NO: 1370838 - RNA, 25 nt, Human
ucaggccaggcacaguggcucacau

SEQ ID NO: 1370839 - RNA, 25 nt, Human
ucaggccauucuucugccucagccu

SEQ ID NO: 1370840 - RNA, 23 nt, Human
uccaccacguucuccaaaaagug

SEQ ID NO: 1370841 - RNA, 24 nt, Human
ucccaaagugcugggauuacaggc

SEQ ID NO: 1370842 - RNA, 23 nt, Human
ucccgagcagcugggaccacagg

SEQ ID NO: 1370843 - RNA, 24 nt, Human
ucccggguucaggccauucuucug

SEQ ID NO: 1370844 - RNA, 24 nt, Human
ucccuggaugauuccagugugaag

SEQ ID NO: 1370845 - RNA, 24 nt, Human
ucgcccaggcuggagugcaguggc

SEQ ID NO: 1370846 - RNA, 24 nt, Human
ucgccgugcuagccaggauggucu

SEQ ID NO: 1370847 - RNA, 24 nt, Human
ucgcucugucgcccaggcuggagu

SEQ ID NO: 1370848 - RNA, 19 nt, Human
ucucgcucugucgcccagg

SEQ ID NO: 1370849 - RNA, 22 nt, Human
ucucgcucugucgcccaggcug

SEQ ID NO: 1370850 - RNA, 23 nt, Human
ucucgcucugucgcccaggcugg

SEQ ID NO: 1370851 - RNA, 24 nt, Human
ucucgcucugucgcccaggcugga

SEQ ID NO: 1370852 - RNA, 26 nt, Human
ucucgcucugucgcccaggcuggagu

SEQ ID NO: 1370853 - RNA, 23 nt, Human
ucucucagacuuggguuugcagg

SEQ ID NO: 1370854 - RNA, 23 nt, Human
ucugccaagcuggaaagcgcuga

SEQ ID NO: 1370855 - RNA, 22 nt, Human
ucuggucugggcaugauggcau

SEQ ID NO: 1370856 - RNA, 24 nt, Human
ucugucgcccaggcuggagugcag

SEQ ID NO: 1370857 - RNA, 23 nt, Human
ugaccucgugauccgcccaccuc

SEQ ID NO: 1370858 - RNA, 22 nt, Human
ugagcugagaucaugccacugu

SEQ ID NO: 1370859 - RNA, 24 nt, Human
ugauccgcccaccucugccuccca

SEQ ID NO: 1370860 - RNA, 18 nt, Human
ugauuccaccacguucuc

SEQ ID NO: 1370861 - RNA, 21 nt, Human
ugcccaggcugcaaccuagac

SEQ ID NO: 1370862 - RNA, 24 nt, Human
ugccucagccucccgagcagcugg

SEQ ID NO: 1370863 - RNA, 18 nt, Human
ugcgaguaagacaccgcc

SEQ ID NO: 1370864 - RNA, 19 nt, Human
ugcuggaaaaggcggccac

SEQ ID NO: 1370865 - RNA, 20 nt, Human
uggagugcaguggcacgauc

SEQ ID NO: 1370866 - RNA, 21 nt, Human
uggagugcaguggcacgaucg

SEQ ID NO: 1370867 - RNA, 22 nt, Human
uggagugcaguggcacgaucgg

SEQ ID NO: 1370868 - RNA, 21 nt, Human
uggcauacaacugugaucaca

SEQ ID NO: 1370869 - RNA, 24 nt, Human
uggcauucugggaggccaaggcag

SEQ ID NO: 1370870 - RNA, 25 nt, Human
uggcauucugggaggccaaggcagg

SEQ ID NO: 1370871 - RNA, 19 nt, Human
uggcucacaucuguaaucc

SEQ ID NO: 1370872 - RNA, 24 nt, Human
uggcucacaucuguaauccuggca

SEQ ID NO: 1370873 - RNA, 21 nt, Human
ugggaccacaggcacacgcca

SEQ ID NO: 1370874 - RNA, 24 nt, Human
ugggaccacaggcacacgccacca

SEQ ID NO: 1370875 - RNA, 24 nt, Human
ugggaggccaaggcaggcggauca

SEQ ID NO: 1370876 - RNA, 18 nt, Human
ugggauuacaggcuugag

SEQ ID NO: 1370877 - RNA, 21 nt, Human
ugggauuacaggcuugagcca

SEQ ID NO: 1370878 - RNA, 22 nt, Human
ugggauuacaggcuugagccac

SEQ ID NO: 1370879 - RNA, 24 nt, Human
ugggauuacaggcuugagccacca

SEQ ID NO: 1370880 - RNA, 25 nt, Human
ugggauuacaggcuugagccaccau

SEQ ID NO: 1370881 - RNA, 20 nt, Human
ugguucaaagcacccaccga

SEQ ID NO: 1370882 - RNA, 22 nt, Human
ugugagacgugccgaaugucag

SEQ ID NO: 1370883 - RNA, 22 nt, Human
uuaguagagacaggguuucgcc

SEQ ID NO: 1370884 - RNA, 24 nt, Human
uuaguagagacaggguuucgccgu

SEQ ID NO: 1370885 - RNA, 25 nt, Human
uucaaagcacccaccgagucagcca

SEQ ID NO: 1370886 - RNA, 22 nt, Human
uuccugguucaaagcacccacc

SEQ ID NO: 1370887 - RNA, 22 nt, Human
uugagcccaggaguucaagacc

SEQ ID NO: 1370888 - RNA, 18 nt, Human
uuuaaaacucccuggaug

SEQ ID NO: 1370889 - RNA, 24 nt, Human
uuucuugagcccaggaagucgagg

SEQ ID NO: 1370890 - RNA, 22 nt, Human
uuucuuguccuuuccugguuca

SEQ ID NO: 1370891 - RNA, 24 nt, Human
uuucuuguccuuuccugguucaaa

SEQ ID NO: 1370892 - RNA, 22 nt, Human
uuuuguauuuuuaguagagaca

SEQ ID NO: 1370893 - RNA, 23 nt, Human
uuuuuaguagagacaggguuucg

SEQ ID NO: 1370894 - RNA, 24 nt, Human
uuuuuaguagagacaggguuucgc

SEQ ID NO: 1370895 - RNA, 21 nt, Human
uuuuuguauuuuuaguagaga

SEQ ID NO: 1370896 - RNA, 20 nt, Human
aacaggcuguagcuuuaggc

SEQ ID NO: 1370897 - RNA, 23 nt, Human
aagcuccccgagugagcaauucc

SEQ ID NO: 1370898 - RNA, 21 nt, Human
aauuccugucccuuuuaaggg

SEQ ID NO: 1370899 - RNA, 24 nt, Human
accagcuguucuaagaacuagagg

SEQ ID NO: 1370900 - RNA, 22 nt, Human
acuccugucucaagagccaagc

SEQ ID NO: 1370901 - RNA, 25 nt, Human
acucuaagggggugcgugugagagg

SEQ ID NO: 1370902 - RNA, 22 nt, Human
agaaggaagggguuuauucggc

SEQ ID NO: 1370903 - RNA, 23 nt, Human
agaaggaagggguuuauucggcc

SEQ ID NO: 1370904 - RNA, 21 nt, Human
agcuccccgagugagcaauuc

SEQ ID NO: 1370905 - RNA, 21 nt, Human
aggaagacugguuuucaaugu

SEQ ID NO: 1370906 - RNA, 24 nt, Human
agguccccaugacucaggucagga

SEQ ID NO: 1370907 - RNA, 22 nt, Human
auuaacacugaacagcaacaaa

SEQ ID NO: 1370908 - RNA, 20 nt, Human
auuugcucuuucugcaacau

SEQ ID NO: 1370909 - RNA, 18 nt, Human
caaaaacaacagcacuga

SEQ ID NO: 1370910 - RNA, 18 nt, Human
caacaaaaaagggugcgg

SEQ ID NO: 1370911 - RNA, 19 nt, Human
caacagcacugagacugcu

SEQ ID NO: 1370912 - RNA, 22 nt, Human
caacagcacugagacugcuguc

SEQ ID NO: 1370913 - RNA, 19 nt, Human
cagagccccugugccgcca

SEQ ID NO: 1370914 - RNA, 23 nt, Human
cagcacugagacugcuguccugg

SEQ ID NO: 1370915 - RNA, 19 nt, Human
cagugucugaugagagccc

SEQ ID NO: 1370916 - RNA, 21 nt, Human
caugacucaggucaggagcuc

SEQ ID NO: 1370917 - RNA, 21 nt, Human
cccaugacucaggucaggagc

SEQ ID NO: 1370918 - RNA, 19 nt, Human
cccugugccgccacacagc

SEQ ID NO: 1370919 - RNA, 18 nt, Human
ccugucaaaaacaacagc

SEQ ID NO: 1370920 - RNA, 24 nt, Human
ccugugaggcaggcauucugucgg

SEQ ID NO: 1370921 - RNA, 18 nt, Human
ccuuucugcccugggaug

SEQ ID NO: 1370922 - RNA, 23 nt, Human
cggggugggaggccuccugggca

SEQ ID NO: 1370923 - RNA, 18 nt, Human
cuacaguucacuggaggc

SEQ ID NO: 1370924 - RNA, 19 nt, Human
cucaagagccaagcucccc

SEQ ID NO: 1370925 - RNA, 22 nt, Human
cucaagagccaagcuccccgag

SEQ ID NO: 1370926 - RNA, 23 nt, Human
cucauaauauucaccaaaugaag

SEQ ID NO: 1370927 - RNA, 21 nt, Human
cuccuccaagggguuuccaaa

SEQ ID NO: 1370928 - RNA, 19 nt, Human
cugcaacaucuggcaucau

SEQ ID NO: 1370929 - RNA, 18 nt, Human
cugcaggcugaugccaug

SEQ ID NO: 1370930 - RNA, 19 nt, Human
cugcaggcugaugccaugu

SEQ ID NO: 1370931 - RNA, 21 nt, Human
cuggaggcuggaaaguccaag

SEQ ID NO: 1370932 - RNA, 18 nt, Human
cugucugcuuguggauuu

SEQ ID NO: 1370933 - RNA, 18 nt, Human
gaacuagaggaacaggcu

SEQ ID NO: 1370934 - RNA, 18 nt, Human
gacaagcucuccgggauc

SEQ ID NO: 1370935 - RNA, 27 nt, Human
gacuccugucucaagagccaagcuccc

SEQ ID NO: 1370936 - RNA, 18 nt, Human
gccugagagcucaguaac

SEQ ID NO: 1370937 - RNA, 18 nt, Human
gccugccuuggcugugga

SEQ ID NO: 1370938 - RNA, 21 nt, Human
gcuuguggauuucauuucugc

SEQ ID NO: 1370939 - RNA, 23 nt, Human
gggugggaggccuccugggcagg

SEQ ID NO: 1370940 - RNA, 22 nt, Human
guaauucgaucugaacaaaaca

SEQ ID NO: 1370941 - RNA, 21 nt, Human
gugagagggucgugaucgauu

SEQ ID NO: 1370942 - RNA, 20 nt, Human
ucauacgugucauuucucau

SEQ ID NO: 1370943 - RNA, 20 nt, Human
ucauugccugccuuggcugu

SEQ ID NO: 1370944 - RNA, 21 nt, Human
uccccgagugagcaauuccug

SEQ ID NO: 1370945 - RNA, 28 nt, Human
ucuguaaucgauaacauaaccggggucc

SEQ ID NO: 1370946 - RNA, 22 nt, Human
ugagacugcuguccuggugggu

SEQ ID NO: 1370947 - RNA, 19 nt, Human
ugagagcucauugccugcc

SEQ ID NO: 1370948 - RNA, 22 nt, Human
ugagcaauuccugucccuuuua

SEQ ID NO: 1370949 - RNA, 19 nt, Human
ugaugccauguggguggug

SEQ ID NO: 1370950 - RNA, 19 nt, Human
ugccaggggucucacccag

SEQ ID NO: 1370951 - RNA, 21 nt, Human
ugccaggggucucacccagcu

SEQ ID NO: 1370952 - RNA, 22 nt, Human
ugccauguggguggugcccucc

SEQ ID NO: 1370953 - RNA, 20 nt, Human
ugcccugggauguucucccu

SEQ ID NO: 1370954 - RNA, 21 nt, Human
uggaaggcuaugcaggagucu

SEQ ID NO: 1370955 - RNA, 20 nt, Human
uggcagaucuccuccaaggg

SEQ ID NO: 1370956 - RNA, 21 nt, Human
uggcaucauggaccacuucug

SEQ ID NO: 1370957 - RNA, 21 nt, Human
uggcaugcucuauguguccuc

SEQ ID NO: 1370958 - RNA, 20 nt, Human
uggcggauaaggggaaggcg

SEQ ID NO: 1370959 - RNA, 24 nt, Human
uggcuguggaauaggcccaugccg

SEQ ID NO: 1370960 - RNA, 21 nt, Human
ugugccgccacacagcccuua

SEQ ID NO: 1370961 - RNA, 20 nt, Human
uguggaauaggcccaugccg

SEQ ID NO: 1370962 - RNA, 23 nt, Human
uguggcagaucuccuccaagggg

SEQ ID NO: 1370963 - RNA, 19 nt, Human
uuagcguguugcacuguug

SEQ ID NO: 1370964 - RNA, 18 nt, Human
uuauuugcucuuucugca

SEQ ID NO: 1370965 - RNA, 18 nt, Human
uucagguccccaugacuc

SEQ ID NO: 1370966 - RNA, 18 nt, Human
uuccugucccuuuuaagg

SEQ ID NO: 1370967 - RNA, 22 nt, Human
uugcaaguaccugagagcucau

SEQ ID NO: 1370968 - RNA, 18 nt, Human
aaacaaaauagugauaac

SEQ ID NO: 1370969 - RNA, 22 nt, Human
aacacugaaaagccaaagucca

SEQ ID NO: 1370970 - RNA, 20 nt, Human
acacuguuuuguuggcuuua

SEQ ID NO: 1370971 - RNA, 19 nt, Human
accuaaagacaaaagaaag

SEQ ID NO: 1370972 - RNA, 20 nt, Human
accuaaagacaaaagaaagg

SEQ ID NO: 1370973 - RNA, 22 nt, Human
acgaccuuguuaccauauaugc

SEQ ID NO: 1370974 - RNA, 20 nt, Human
aggccgggugugguggcuca

SEQ ID NO: 1370975 - RNA, 22 nt, Human
aggccgggugugguggcucaca

SEQ ID NO: 1370976 - RNA, 21 nt, Human
auaagguauacauauuaaaac

SEQ ID NO: 1370977 - RNA, 18 nt, Human
auagaguaugcuuucaaa

SEQ ID NO: 1370978 - RNA, 18 nt, Human
aucaaguuuuuacuucau

SEQ ID NO: 1370979 - RNA, 24 nt, Human
aucacucuuuaggggaaaaaacac

SEQ ID NO: 1370980 - RNA, 22 nt, Human
caaaguccacccucuucuucuc

SEQ ID NO: 1370981 - RNA, 22 nt, Human
cauccaagacucuccuccucaa

SEQ ID NO: 1370982 - RNA, 24 nt, Human
ccuaaaccuaaagacaaaagaaag

SEQ ID NO: 1370983 - RNA, 23 nt, Human
ccucaauuugaaaccauguuuau

SEQ ID NO: 1370984 - RNA, 21 nt, Human
ccuccuaaaccuaaagacaaa

SEQ ID NO: 1370985 - RNA, 24 nt, Human
cugaggaugccugugccucugccc

SEQ ID NO: 1370986 - RNA, 21 nt, Human
cuucuucucucuuauuacucc

SEQ ID NO: 1370987 - RNA, 20 nt, Human
gaggaugccugugccucugc

SEQ ID NO: 1370988 - RNA, 18 nt, Human
gguggcucacaccuguaa

SEQ ID NO: 1370989 - RNA, 23 nt, Human
ggugugguggcucacaccuguaa

SEQ ID NO: 1370990 - RNA, 18 nt, Human
guagacuggauaugugaa

SEQ ID NO: 1370991 - RNA, 24 nt, Human
gugaaagcaaaugcacacgaccuu

SEQ ID NO: 1370992 - RNA, 18 nt, Human
gugugguggcucacaccu

SEQ ID NO: 1370993 - RNA, 22 nt, Human
uaaaacauacauccaagacucu

SEQ ID NO: 1370994 - RNA, 21 nt, Human
uagcauuuggcuagaggcaga

SEQ ID NO: 1370995 - RNA, 20 nt, Human
uaggauaaacauccaguauc

SEQ ID NO: 1370996 - RNA, 21 nt, Human
uagguccuagcuuuacuuucc

SEQ ID NO: 1370997 - RNA, 23 nt, Human
uauacauauuaaaacauacaucc

SEQ ID NO: 1370998 - RNA, 25 nt, Human
uaucuuaguaucuccuccuaaaccu

SEQ ID NO: 1370999 - RNA, 22 nt, Human
ucauuguauauaagccaaaaaa

SEQ ID NO: 1371000 - RNA, 18 nt, Human
uccaagacucuccuccuc

SEQ ID NO: 1371001 - RNA, 22 nt, Human
uccaagacucuccuccucaauu

SEQ ID NO: 1371002 - RNA, 23 nt, Human
uccaagacucuccuccucaauuu

SEQ ID NO: 1371003 - RNA, 23 nt, Human
uccuaaaccuaaagacaaaagaa

SEQ ID NO: 1371004 - RNA, 23 nt, Human
ucucuuauuacuccaaccaaacu

SEQ ID NO: 1371005 - RNA, 23 nt, Human
ucuucucauccucucacucauca

SEQ ID NO: 1371006 - RNA, 18 nt, Human
ugaaaagccaaaguccac

SEQ ID NO: 1371007 - RNA, 21 nt, Human
ugauuaccaacgaaaaacuaa

SEQ ID NO: 1371008 - RNA, 27 nt, Human
ugcccauaacuauauauagaguaugcu

SEQ ID NO: 1371009 - RNA, 19 nt, Human
uguuacacuguuuuguugg

SEQ ID NO: 1371010 - RNA, 20 nt, Human
uuacuggaccagguagacug

SEQ ID NO: 1371011 - RNA, 23 nt, Human
uuuaggggaaaaaacacugaaaa

SEQ ID NO: 1371012 - RNA, 23 nt, Human
uuucauagccacauauuaugugu

SEQ ID NO: 1371013 - RNA, 19 nt, Human
aacauggagaaaccccguc

SEQ ID NO: 1371014 - RNA, 20 nt, Human
aacauggagaaaccccgucu

SEQ ID NO: 1371015 - RNA, 21 nt, Human
accccgucuguacuaaaaaca

SEQ ID NO: 1371016 - RNA, 24 nt, Human
acccuuugcuugcucccauuguuu

SEQ ID NO: 1371017 - RNA, 24 nt, Human
accugaggucaggaguucgagacc

SEQ ID NO: 1371018 - RNA, 19 nt, Human
accuggcacaugaaacaca

SEQ ID NO: 1371019 - RNA, 24 nt, Human
acuggccgggugcaguggcucacg

SEQ ID NO: 1371020 - RNA, 23 nt, Human
agaucaccugaggucaggaguuc

SEQ ID NO: 1371021 - RNA, 24 nt, Human
aggcggagcuugcagugagcugag

SEQ ID NO: 1371022 - RNA, 21 nt, Human
aggugugguggccagcgccug

SEQ ID NO: 1371023 - RNA, 24 nt, Human
aggugugguggccagcgccuguag

SEQ ID NO: 1371024 - RNA, 24 nt, Human
aguggcucacgcccguaaucccag

SEQ ID NO: 1371025 - RNA, 21 nt, Human
aucaccugaggucaggaguuc

SEQ ID NO: 1371026 - RNA, 21 nt, Human
caccagggccuccgggccccc

SEQ ID NO: 1371027 - RNA, 21 nt, Human
caccagggccuccgggccccc

SEQ ID NO: 1371028 - RNA, 23 nt, Human
caccugaggucaggaguucgaga

SEQ ID NO: 1371029 - RNA, 22 nt, Human
cacgcccguaaucccagaacuc

SEQ ID NO: 1371030 - RNA, 24 nt, Human
cacgcccguaaucccagaacucug

SEQ ID NO: 1371031 - RNA, 24 nt, Human
cagaacucugggaggccggggcgg

SEQ ID NO: 1371032 - RNA, 24 nt, Human
cagaucaccugaggucaggaguuc

SEQ ID NO: 1371033 - RNA, 27 nt, Human
cagaucaccugaggucaggaguucgag

SEQ ID NO: 1371034 - RNA, 22 nt, Human
cagauggauuccuccuggccuc

SEQ ID NO: 1371035 - RNA, 24 nt, Human
cagccugaccaacauggagaaacc

SEQ ID NO: 1371036 - RNA, 19 nt, Human
caggaacaaagucuuauuc

SEQ ID NO: 1371037 - RNA, 18 nt, Human
ccaccagggccuccgggc

SEQ ID NO: 1371038 - RNA, 22 nt, Human
cccagaacucugggaggccggg

SEQ ID NO: 1371039 - RNA, 19 nt, Human
cccagggccaccagggccu

SEQ ID NO: 1371040 - RNA, 22 nt, Human
ccuccgggccccccaacugcac

SEQ ID NO: 1371041 - RNA, 23 nt, Human
ccugaccaacauggagaaacccc

SEQ ID NO: 1371042 - RNA, 24 nt, Human
ccugaccaacauggagaaaccccg

SEQ ID NO: 1371043 - RNA, 22 nt, Human
ccugaggucaggaguucgagac

SEQ ID NO: 1371044 - RNA, 21 nt, Human
ccuguagucccagcuacuugg

SEQ ID NO: 1371045 - RNA, 18 nt, Human
cgcccguaaucccagaac

SEQ ID NO: 1371046 - RNA, 23 nt, Human
cgcccguaaucccagaacucugg

SEQ ID NO: 1371047 - RNA, 24 nt, Human
cgcccguaaucccagaacucuggg

SEQ ID NO: 1371048 - RNA, 25 nt, Human
cgcccguaaucccagaacucuggga

SEQ ID NO: 1371049 - RNA, 23 nt, Human
cgccuguagucccagcuacuugg

SEQ ID NO: 1371050 - RNA, 24 nt, Human
cgccuguagucccagcuacuuggg

SEQ ID NO: 1371051 - RNA, 24 nt, Human
cgggcagaucaccugaggucagga

SEQ ID NO: 1371052 - RNA, 20 nt, Human
cggggcgggcagaucaccug

SEQ ID NO: 1371053 - RNA, 26 nt, Human
cggggcgggcagaucaccugagguca

SEQ ID NO: 1371054 - RNA, 20 nt, Human
cuacccuuugcuugcuccca

SEQ ID NO: 1371055 - RNA, 19 nt, Human
cucacgcccguaaucccag

SEQ ID NO: 1371056 - RNA, 22 nt, Human
cucacgcccguaaucccagaac

SEQ ID NO: 1371057 - RNA, 21 nt, Human
cuccgggccccccaacugcac

SEQ ID NO: 1371058 - RNA, 22 nt, Human
cuugcagugagcugagauugug

SEQ ID NO: 1371059 - RNA, 19 nt, Human
gaacaaagucuuauucaug

SEQ ID NO: 1371060 - RNA, 23 nt, Human
gagaccagccugaccaacaugga

SEQ ID NO: 1371061 - RNA, 21 nt, Human
gagcuugcagugagcugagau

SEQ ID NO: 1371062 - RNA, 23 nt, Human
gagcuugcagugagcugagauug

SEQ ID NO: 1371063 - RNA, 22 nt, Human
gagugcggcuucuguucagggc

SEQ ID NO: 1371064 - RNA, 23 nt, Human
gagugcggcuucuguucagggcu

SEQ ID NO: 1371065 - RNA, 24 nt, Human
gaucaccugaggucaggaguucga

SEQ ID NO: 1371066 - RNA, 22 nt, Human
gcugagccaggagaauggcgug

SEQ ID NO: 1371067 - RNA, 24 nt, Human
ggagcuugcagugagcugagauug

SEQ ID NO: 1371068 - RNA, 21 nt, Human
ggauaccuggcacaugaaaca

SEQ ID NO: 1371069 - RNA, 25 nt, Human
ggcagaucaccugaggucaggaguu

SEQ ID NO: 1371070 - RNA, 21 nt, Human
ggcgggcagaucaccugaggu

SEQ ID NO: 1371071 - RNA, 25 nt, Human
ggcgggcagaucaccugaggucagg

SEQ ID NO: 1371072 - RNA, 24 nt, Human
gggugcaguggcucacgcccguaa

SEQ ID NO: 1371073 - RNA, 24 nt, Human
gguggccagcgccuguagucccag

SEQ ID NO: 1371074 - RNA, 18 nt, Human
guuuucucagagaagagg

SEQ ID NO: 1371075 - RNA, 24 nt, Human
uaaccaggugugguggccagcgcc

SEQ ID NO: 1371076 - RNA, 23 nt, Human
uaguaaguccucuguaaauguuc

SEQ ID NO: 1371077 - RNA, 19 nt, Human
ucaauaccaugagaacagg

SEQ ID NO: 1371078 - RNA, 20 nt, Human
ucaccugaggucaggaguuc

SEQ ID NO: 1371079 - RNA, 19 nt, Human
uccaggccugacggaacuu

SEQ ID NO: 1371080 - RNA, 23 nt, Human
ugagccaggagaauggcgugaac

SEQ ID NO: 1371081 - RNA, 24 nt, Human
ugagccaggagaauggcgugaacc

SEQ ID NO: 1371082 - RNA, 21 nt, Human
uggcucacgcccguaauccca

SEQ ID NO: 1371083 - RNA, 22 nt, Human
uggcucacgcccguaaucccag

SEQ ID NO: 1371084 - RNA, 20 nt, Human
ugggaggccggggcgggcag

SEQ ID NO: 1371085 - RNA, 24 nt, Human
ugggaggccggggcgggcagauca

SEQ ID NO: 1371086 - RNA, 24 nt, Human
ugguggccagcgccuguaguccca

SEQ ID NO: 1371087 - RNA, 18 nt, Human
ugugguggccagcgccug

SEQ ID NO: 1371088 - RNA, 22 nt, Human
ugugguggccagcgccuguagu

SEQ ID NO: 1371089 - RNA, 25 nt, Human
uuaaccaggugugguggccagcgcc

SEQ ID NO: 1371090 - RNA, 19 nt, Human
uugcagugagcugagauug

SEQ ID NO: 1371091 - RNA, 22 nt, Human
uugcagugagcugagauugugu

SEQ ID NO: 1371092 - RNA, 18 nt, Human
aaaaagacaaacaaccaa

SEQ ID NO: 1371093 - RNA, 18 nt, Human
aaaacaguuuggcaguuu

SEQ ID NO: 1371094 - RNA, 19 nt, Human
aaagugcugggauuacagg

SEQ ID NO: 1371095 - RNA, 24 nt, Human
aaagugcugggauuacaggcaaga

SEQ ID NO: 1371096 - RNA, 22 nt, Human
aacagccaaaggaugggaacag

SEQ ID NO: 1371097 - RNA, 22 nt, Human
aacaugugacugcagcagccuu

SEQ ID NO: 1371098 - RNA, 18 nt, Human
aagugcugggauuacagg

SEQ ID NO: 1371099 - RNA, 19 nt, Human
aagugcugggauuacaggc

SEQ ID NO: 1371100 - RNA, 26 nt, Human
aagugcugggauuacaggcaagagcc

SEQ ID NO: 1371101 - RNA, 18 nt, Human
acaacucaacaaaaaaag

SEQ ID NO: 1371102 - RNA, 19 nt, Human
acaucauccccaagccaug

SEQ ID NO: 1371103 - RNA, 25 nt, Human
acccuguugcccaggauggucucaa

SEQ ID NO: 1371104 - RNA, 19 nt, Human
accuuccccagcaccaccc

SEQ ID NO: 1371105 - RNA, 25 nt, Human
accuuccccagcaccaccccacuag

SEQ ID NO: 1371106 - RNA, 22 nt, Human
acuaaaguccacuucauacauc

SEQ ID NO: 1371107 - RNA, 19 nt, Human
acuacaggaguaugccacc

SEQ ID NO: 1371108 - RNA, 20 nt, Human
acucagccuaucaaagugcu

SEQ ID NO: 1371109 - RNA, 18 nt, Human
agacaggcuacagugugg

SEQ ID NO: 1371110 - RNA, 19 nt, Human
agcccaucagagacagucc

SEQ ID NO: 1371111 - RNA, 23 nt, Human
agcugggacuacaggaguaugcc

SEQ ID NO: 1371112 - RNA, 22 nt, Human
aggucucacccuguugcccagg

SEQ ID NO: 1371113 - RNA, 18 nt, Human
aguagcugggacuacagg

SEQ ID NO: 1371114 - RNA, 20 nt, Human
aguagcugggacuacaggag

SEQ ID NO: 1371115 - RNA, 18 nt, Human
agucaaccuuccccagca

SEQ ID NO: 1371116 - RNA, 22 nt, Human
agugcaguggugcaaucaacag

SEQ ID NO: 1371117 - RNA, 24 nt, Human
agugcaguggugcaaucaacagcu

SEQ ID NO: 1371118 - RNA, 25 nt, Human
agugcaguggugcaaucaacagcuc

SEQ ID NO: 1371119 - RNA, 18 nt, Human
aucaacagcucaccacag

SEQ ID NO: 1371120 - RNA, 19 nt, Human
caaaaaaagacaaacaacc

SEQ ID NO: 1371121 - RNA, 22 nt, Human
caaacaaaaacuuguaaaugca

SEQ ID NO: 1371122 - RNA, 25 nt, Human
caaacuccugggcucaagucauccu

SEQ ID NO: 1371123 - RNA, 25 nt, Human
caaagccuuuuagucaaggccaccc

SEQ ID NO: 1371124 - RNA, 18 nt, Human
caaagugcugggauuaca

SEQ ID NO: 1371125 - RNA, 21 nt, Human
caaagugcugggauuacaggc

SEQ ID NO: 1371126 - RNA, 22 nt, Human
caaagugcugggauuacaggca

SEQ ID NO: 1371127 - RNA, 27 nt, Human
caaagugcugggauuacaggcaagagc

SEQ ID NO: 1371128 - RNA, 19 nt, Human
caacaaaaaaagacaaaca

SEQ ID NO: 1371129 - RNA, 22 nt, Human
caacaaaaaaagacaaacaacc

SEQ ID NO: 1371130 - RNA, 21 nt, Human
caaccuccgcuguacacagcu

SEQ ID NO: 1371131 - RNA, 18 nt, Human
caccccacuagcagccca

SEQ ID NO: 1371132 - RNA, 19 nt, Human
cacccuguugcccaggaug

SEQ ID NO: 1371133 - RNA, 22 nt, Human
cacccuguugcccaggaugguc

SEQ ID NO: 1371134 - RNA, 24 nt, Human
cacccuguugcccaggauggucuc

SEQ ID NO: 1371135 - RNA, 20 nt, Human
caccuuugacuuagaagaau

SEQ ID NO: 1371136 - RNA, 18 nt, Human
cacgcaggcuagagugcg

SEQ ID NO: 1371137 - RNA, 22 nt, Human
cacuauucacaacagccaaagg

SEQ ID NO: 1371138 - RNA, 23 nt, Human
cacugcacaacaagggaacuaaa

SEQ ID NO: 1371139 - RNA, 23 nt, Human
cacuucauacaucauccccaagc

SEQ ID NO: 1371140 - RNA, 18 nt, Human
cagcaguuccacuccugg

SEQ ID NO: 1371141 - RNA, 26 nt, Human
cagcccaucagagacaguccggcaac

SEQ ID NO: 1371142 - RNA, 24 nt, Human
cagcuucgaccuuccaagcucaag

SEQ ID NO: 1371143 - RNA, 18 nt, Human
caugugacugcagcagcc

SEQ ID NO: 1371144 - RNA, 24 nt, Human
ccagccucccacugacaaaaaggg

SEQ ID NO: 1371145 - RNA, 18 nt, Human
cccaaaggacugaaaaua

SEQ ID NO: 1371146 - RNA, 22 nt, Human
cccacugacaaaaagggacaaa

SEQ ID NO: 1371147 - RNA, 22 nt, Human
cccagcccagccucccacugac

SEQ ID NO: 1371148 - RNA, 22 nt, Human
ccccaagccaugugcccugggu

SEQ ID NO: 1371149 - RNA, 22 nt, Human
ccccagcaccaccccacuagca

SEQ ID NO: 1371150 - RNA, 28 nt, Human
ccucccacugacaaaaagggacaaaagu

SEQ ID NO: 1371151 - RNA, 19 nt, Human
ccuccucucccagcccagc

SEQ ID NO: 1371152 - RNA, 18 nt, Human
ccuggccuguccuaaggc

SEQ ID NO: 1371153 - RNA, 20 nt, Human
ccugggcucaagucauccuc

SEQ ID NO: 1371154 - RNA, 23 nt, Human
ccugggcucaagucauccuccug

SEQ ID NO: 1371155 - RNA, 31 nt, Human
cuaaggccauaaaaaggagucaaguacugag

SEQ ID NO: 1371156 - RNA, 19 nt, Human
cucaacaaaaaaagacaaa

SEQ ID NO: 1371157 - RNA, 19 nt, Human
cucaagcaauccucaugcc

SEQ ID NO: 1371158 - RNA, 19 nt, Human
cucaagucauccuccugac

SEQ ID NO: 1371159 - RNA, 23 nt, Human
cuccugggcucaagucauccucc

SEQ ID NO: 1371160 - RNA, 25 nt, Human
cuccugggcucaagucauccuccug

SEQ ID NO: 1371161 - RNA, 18 nt, Human
cuuccccagcaccacccu

SEQ ID NO: 1371162 - RNA, 24 nt, Human
gaaaagcaccugguugaaccaaag

SEQ ID NO: 1371163 - RNA, 26 nt, Human
gaaccaaagccuuuuagucaaggcca

SEQ ID NO: 1371164 - RNA, 23 nt, Human
gaccuuccaagcucaagcaaucc

SEQ ID NO: 1371165 - RNA, 26 nt, Human
gaguagcugggacuacaggaguaugc

SEQ ID NO: 1371166 - RNA, 18 nt, Human
gauuacaggcaagagcca

SEQ ID NO: 1371167 - RNA, 19 nt, Human
gauuacaggcaagagccac

SEQ ID NO: 1371168 - RNA, 23 nt, Human
gauuacaggcaagagccacugca

SEQ ID NO: 1371169 - RNA, 18 nt, Human
ggaagccaggaguuaagc

SEQ ID NO: 1371170 - RNA, 19 nt, Human
ggauaaacaaaauguggua

SEQ ID NO: 1371171 - RNA, 22 nt, Human
ggauuacaggcaagagccacug

SEQ ID NO: 1371172 - RNA, 25 nt, Human
gggaacagcacagggguccaucaac

SEQ ID NO: 1371173 - RNA, 25 nt, Human
gugacugcagcagccuuucuuuuag

SEQ ID NO: 1371174 - RNA, 21 nt, Human
uaaagagcacuuacaacucaa

SEQ ID NO: 1371175 - RNA, 23 nt, Human
uaaagcaccuuugacuuagaaga

SEQ ID NO: 1371176 - RNA, 18 nt, Human
uaacaugugacugcagca

SEQ ID NO: 1371177 - RNA, 21 nt, Human
uaacucagcaguuccacuccu

SEQ ID NO: 1371178 - RNA, 24 nt, Human
uaaggucucacccuguugcccagg

SEQ ID NO: 1371179 - RNA, 24 nt, Human
uacaggcaagagccacugcaccca

SEQ ID NO: 1371180 - RNA, 24 nt, Human
uacagugugguugugucacgcagg

SEQ ID NO: 1371181 - RNA, 18 nt, Human
uacccuauaacaugugac

SEQ ID NO: 1371182 - RNA, 19 nt, Human
uagagugcaguggugcaau

SEQ ID NO: 1371183 - RNA, 21 nt, Human
uagagugcaguggugcaauca

SEQ ID NO: 1371184 - RNA, 22 nt, Human
ucaaagugcugggauuacaggc

SEQ ID NO: 1371185 - RNA, 23 nt, Human
ucaaagugcugggauuacaggca

SEQ ID NO: 1371186 - RNA, 24 nt, Human
ucaacaaaaaaagacaaacaacca

SEQ ID NO: 1371187 - RNA, 24 nt, Human
ucaaguacugaugcaugcuacacc

SEQ ID NO: 1371188 - RNA, 25 nt, Human
ucaagucauccuccugacucagccu

SEQ ID NO: 1371189 - RNA, 21 nt, Human
uccaaaaaguuaaauguugaa

SEQ ID NO: 1371190 - RNA, 22 nt, Human
uccacuucauacaucaucccca

SEQ ID NO: 1371191 - RNA, 23 nt, Human
uccaucaacagauaaauggauaa

SEQ ID NO: 1371192 - RNA, 18 nt, Human
ucccagcccagccuccca

SEQ ID NO: 1371193 - RNA, 22 nt, Human
uccccaaaggacugaaaauagg

SEQ ID NO: 1371194 - RNA, 19 nt, Human
uccccaagccaugugcccu

SEQ ID NO: 1371195 - RNA, 27 nt, Human
uccccagcaccaccccacuagcagccc

SEQ ID NO: 1371196 - RNA, 21 nt, Human
uccucacucuccauuucuaca

SEQ ID NO: 1371197 - RNA, 21 nt, Human
uccugggcucaagucauccuc

SEQ ID NO: 1371198 - RNA, 24 nt, Human
uccugggcucaagucauccuccug

SEQ ID NO: 1371199 - RNA, 20 nt, Human
ucuacagugugcuguuccuu

SEQ ID NO: 1371200 - RNA, 23 nt, Human
ucucaaacuccugggcucaaguc

SEQ ID NO: 1371201 - RNA, 19 nt, Human
ucucacccuguugcccagg

SEQ ID NO: 1371202 - RNA, 20 nt, Human
ucucacccuguugcccagga

SEQ ID NO: 1371203 - RNA, 26 nt, Human
ucucacccuguugcccaggauggucu

SEQ ID NO: 1371204 - RNA, 27 nt, Human
ucucacccuguugcccaggauggucuc

SEQ ID NO: 1371205 - RNA, 19 nt, Human
ucucccagcccagccuccc

SEQ ID NO: 1371206 - RNA, 23 nt, Human
ucuggaguagcugggacuacagg

SEQ ID NO: 1371207 - RNA, 22 nt, Human
ucuuucuuucuuucuuugagac

SEQ ID NO: 1371208 - RNA, 20 nt, Human
ucuuucuuucuuugagacag

SEQ ID NO: 1371209 - RNA, 19 nt, Human
ucuuucuuucuuuucuuuc

SEQ ID NO: 1371210 - RNA, 24 nt, Human
ucuuugaagaagacacacaagugg

SEQ ID NO: 1371211 - RNA, 23 nt, Human
ugacaaaaagggacaaaaguccc

SEQ ID NO: 1371212 - RNA, 25 nt, Human
ugacaggaacguaaaauggugcaga

SEQ ID NO: 1371213 - RNA, 22 nt, Human
ugagcacaugaaaauauguaua

SEQ ID NO: 1371214 - RNA, 19 nt, Human
ugagcucugggccucuccc

SEQ ID NO: 1371215 - RNA, 19 nt, Human
ugcaaucaacagcucacca

SEQ ID NO: 1371216 - RNA, 28 nt, Human
ugcccaggauggucucaaacuccugggc

SEQ ID NO: 1371217 - RNA, 19 nt, Human
ugcccuggccuguccuaag

SEQ ID NO: 1371218 - RNA, 21 nt, Human
ugccucaaucucuggaguagc

SEQ ID NO: 1371219 - RNA, 24 nt, Human
ugccucaaucucuggaguagcugg

SEQ ID NO: 1371220 - RNA, 27 nt, Human
ugccuccucucccagcccagccuccca

SEQ ID NO: 1371221 - RNA, 22 nt, Human
ugcugggauuacaggcaagagc

SEQ ID NO: 1371222 - RNA, 18 nt, Human
uggaaaacaguuuggcag

SEQ ID NO: 1371223 - RNA, 22 nt, Human
ugggacuacaggaguaugccac

SEQ ID NO: 1371224 - RNA, 23 nt, Human
ugggacuacaggaguaugccacc

SEQ ID NO: 1371225 - RNA, 24 nt, Human
ugggacuacaggaguaugccaccg

SEQ ID NO: 1371226 - RNA, 22 nt, Human
ugggauuacaggcaagagccac

SEQ ID NO: 1371227 - RNA, 22 nt, Human
ugggauuacaggcaagagccac

SEQ ID NO: 1371228 - RNA, 24 nt, Human
ugggauuacaggcaagagccacug

SEQ ID NO: 1371229 - RNA, 24 nt, Human
ugggauuacaggcaagagccacug

SEQ ID NO: 1371230 - RNA, 22 nt, Human
ugucacgcaggcuagagugcag

SEQ ID NO: 1371231 - RNA, 22 nt, Human
uguccuaaggccauaaaaagga

SEQ ID NO: 1371232 - RNA, 22 nt, Human
ugugacugcagcagccuuucuu

SEQ ID NO: 1371233 - RNA, 19 nt, Human
ugugguaaaaugugggaua

SEQ ID NO: 1371234 - RNA, 24 nt, Human
ugugucacgcaggcuagagugcag

SEQ ID NO: 1371235 - RNA, 21 nt, Human
uguuccuugccuccucuccca

SEQ ID NO: 1371236 - RNA, 20 nt, Human
uuagucaaggccacccaugu

SEQ ID NO: 1371237 - RNA, 26 nt, Human
uuauagagauaaggucucacccuguu

SEQ ID NO: 1371238 - RNA, 20 nt, Human
uugagugacaggacuugggc

SEQ ID NO: 1371239 - RNA, 18 nt, Human
uuggcaguuuuccaaaaa

SEQ ID NO: 1371240 - RNA, 22 nt, Human
uuuccuuucccuaauucucaca

SEQ ID NO: 1371241 - RNA, 22 nt, Human
acacaugcaaagucucagaauc

SEQ ID NO: 1371242 - RNA, 23 nt, Human
acaucuccgcuuaauaucauaca

SEQ ID NO: 1371243 - RNA, 18 nt, Human
agaagacagaucgugaaa

SEQ ID NO: 1371244 - RNA, 20 nt, Human
agcagaagacagaucgugaa

SEQ ID NO: 1371245 - RNA, 22 nt, Human
aggaaggccauuucaggagaag

SEQ ID NO: 1371246 - RNA, 21 nt, Human
aggagaagggggaucaggagc

SEQ ID NO: 1371247 - RNA, 19 nt, Human
aguggcauuugcacuucau

SEQ ID NO: 1371248 - RNA, 21 nt, Human
auaaaaauacacacaccugga

SEQ ID NO: 1371249 - RNA, 24 nt, Human
augaacaaaugccacaucuccgcu

SEQ ID NO: 1371250 - RNA, 24 nt, Human
cagaacaacagcuugaugacagag

SEQ ID NO: 1371251 - RNA, 20 nt, Human
cagacuguggaggaacugga

SEQ ID NO: 1371252 - RNA, 19 nt, Human
cagcaaugaagaggaaaca

SEQ ID NO: 1371253 - RNA, 22 nt, Human
caggcaguggcauuugcacuuc

SEQ ID NO: 1371254 - RNA, 25 nt, Human
ccagcaaugaagaggaaacauggcc

SEQ ID NO: 1371255 - RNA, 18 nt, Human
ccugaaggaugauaagga

SEQ ID NO: 1371256 - RNA, 25 nt, Human
cuccagcaaugaagaggaaacaugg

SEQ ID NO: 1371257 - RNA, 18 nt, Human
gaccuggauuggcaggaa

SEQ ID NO: 1371258 - RNA, 21 nt, Human
ggagcagaguccagcagaaga

SEQ ID NO: 1371259 - RNA, 20 nt, Human
ggccauucagacuguggagg

SEQ ID NO: 1371260 - RNA, 21 nt, Human
ggccauucagacuguggagga

SEQ ID NO: 1371261 - RNA, 19 nt, Human
gggugaugcaaggagaagg

SEQ ID NO: 1371262 - RNA, 24 nt, Human
uaaaaauacacacaccuggaugac

SEQ ID NO: 1371263 - RNA, 21 nt, Human
uacauaaaaauacacacaccu

SEQ ID NO: 1371264 - RNA, 23 nt, Human
uacauaaaaauacacacaccugg

SEQ ID NO: 1371265 - RNA, 24 nt, Human
uaucuauugaugaacuucugcaca

SEQ ID NO: 1371266 - RNA, 27 nt, Human
ucaguccaggcaguggcaacgagaccc

SEQ ID NO: 1371267 - RNA, 22 nt, Human
ucugcacauacggaaaugcugg

SEQ ID NO: 1371268 - RNA, 19 nt, Human
uggcacauagucauuauau

SEQ ID NO: 1371269 - RNA, 22 nt, Human
uggcacauagucauuauaugua

SEQ ID NO: 1371270 - RNA, 20 nt, Human
uggcaggaauggggaggaaa

SEQ ID NO: 1371271 - RNA, 20 nt, Human
uggcaggaauggggaggaag

SEQ ID NO: 1371272 - RNA, 24 nt, Human
uggcaggaauggggaggaaggcca

SEQ ID NO: 1371273 - RNA, 19 nt, Human
uggcaggaauggggaggag

SEQ ID NO: 1371274 - RNA, 18 nt, Human
uggguguagggagacuuc

SEQ ID NO: 1371275 - RNA, 18 nt, Human
uugaugacagagcucuuu

SEQ ID NO: 1371276 - RNA, 19 nt, Human
aaagugcugggauuacaga

SEQ ID NO: 1371277 - RNA, 24 nt, Human
aaagugcugggauuacagauguga

SEQ ID NO: 1371278 - RNA, 26 nt, Human
aacuaguuuuauuuuuuguauuuuua

SEQ ID NO: 1371279 - RNA, 20 nt, Human
aaggugcugggauuauaggc

SEQ ID NO: 1371280 - RNA, 24 nt, Human
aaggugcugggauuauaggcgugu

SEQ ID NO: 1371281 - RNA, 24 nt, Human
aagugauccgcccgccucggccuc

SEQ ID NO: 1371282 - RNA, 18 nt, Human
aagugcugggauuacaga

SEQ ID NO: 1371283 - RNA, 21 nt, Human
acaaaacauacaaucucacaa

SEQ ID NO: 1371284 - RNA, 21 nt, Human
acacccuucuaacuaccaccc

SEQ ID NO: 1371285 - RNA, 18 nt, Human
accauguuggccaggcug

SEQ ID NO: 1371286 - RNA, 21 nt, Human
acccaggugaagaaacagaac

SEQ ID NO: 1371287 - RNA, 18 nt, Human
acgggguuucaccauguu

SEQ ID NO: 1371288 - RNA, 23 nt, Human
acgggguuucaccauguuggcca

SEQ ID NO: 1371289 - RNA, 24 nt, Human
acgggguuucaccauguuggccag

SEQ ID NO: 1371290 - RNA, 23 nt, Human
agaaccccuccaagugccucauu

SEQ ID NO: 1371291 - RNA, 20 nt, Human
agaaccccuccaagugccuu

SEQ ID NO: 1371292 - RNA, 22 nt, Human
agagacagggucuuguucuguc

SEQ ID NO: 1371293 - RNA, 20 nt, Human
agaggcucauguuuacucac

SEQ ID NO: 1371294 - RNA, 20 nt, Human
agguggagugcagugguguu

SEQ ID NO: 1371295 - RNA, 21 nt, Human
agugcagugguguucauagcu

SEQ ID NO: 1371296 - RNA, 22 nt, Human
agugcagugguguucauagcuc

SEQ ID NO: 1371297 - RNA, 22 nt, Human
auuuuuuguauuuuuaguagag

SEQ ID NO: 1371298 - RNA, 23 nt, Human
caaagguacaauuugaaauacgg

SEQ ID NO: 1371299 - RNA, 24 nt, Human
caaagugcugggauuacagaugug

SEQ ID NO: 1371300 - RNA, 24 nt, Human
caaggugcugggauuauaggcgug

SEQ ID NO: 1371301 - RNA, 19 nt, Human
cacaaugacaacuccuucc

SEQ ID NO: 1371302 - RNA, 21 nt, Human
caccauguuggccaggcuggu

SEQ ID NO: 1371303 - RNA, 24 nt, Human
caccauguuggccaggcuggucuc

SEQ ID NO: 1371304 - RNA, 27 nt, Human
caccauguuggccaggcuggucucaaa

SEQ ID NO: 1371305 - RNA, 25 nt, Human
caccauuuaaauaaauuuguugucu

SEQ ID NO: 1371306 - RNA, 18 nt, Human
cacccaggugaagaaaca

SEQ ID NO: 1371307 - RNA, 23 nt, Human
caccccagaaccccuccaagugc

SEQ ID NO: 1371308 - RNA, 26 nt, Human
caccccagaaccccuccaagugccuc

SEQ ID NO: 1371309 - RNA, 22 nt, Human
caccguccaccgugcccagccg

SEQ ID NO: 1371310 - RNA, 20 nt, Human
cacuacaguuuagugcaccu

SEQ ID NO: 1371311 - RNA, 23 nt, Human
cacugcaaucuugagcuccuggg

SEQ ID NO: 1371312 - RNA, 23 nt, Human
cagaaccccuccaagugccucau

SEQ ID NO: 1371313 - RNA, 20 nt, Human
caggcaccccagaaccccuc

SEQ ID NO: 1371314 - RNA, 24 nt, Human
cauguuggccaggcuggucucaaa

SEQ ID NO: 1371315 - RNA, 21 nt, Human
ccaaagugcugggauuacaga

SEQ ID NO: 1371316 - RNA, 22 nt, Human
ccaaagugcugggauuacagau

SEQ ID NO: 1371317 - RNA, 24 nt, Human
ccaaagugcugggauuacagaugu

SEQ ID NO: 1371318 - RNA, 22 nt, Human
ccaaggugcugggauuauaggc

SEQ ID NO: 1371319 - RNA, 24 nt, Human
ccaaggugcugggauuauaggcgu

SEQ ID NO: 1371320 - RNA, 27 nt, Human
ccagaaccccuccaagugccucaucac

SEQ ID NO: 1371321 - RNA, 18 nt, Human
ccugaccucaagugaucc

SEQ ID NO: 1371322 - RNA, 19 nt, Human
ccugaccucaagugauccg

SEQ ID NO: 1371323 - RNA, 22 nt, Human
ccugaccucaagugauccgccc

SEQ ID NO: 1371324 - RNA, 21 nt, Human
ccugggcucaggugaucuucc

SEQ ID NO: 1371325 - RNA, 18 nt, Human
cgcacgcgccguacuccg

SEQ ID NO: 1371326 - RNA, 19 nt, Human
cggaggauucgcaaucgcg

SEQ ID NO: 1371327 - RNA, 24 nt, Human
cgggguuucaccauguuggccagg

SEQ ID NO: 1371328 - RNA, 24 nt, Human
cucacugcaaucuugagcuccugg

SEQ ID NO: 1371329 - RNA, 26 nt, Human
cuccugaccucaagugauccgcccgc

SEQ ID NO: 1371330 - RNA, 23 nt, Human
cuccugggcucaggugaucuucc

SEQ ID NO: 1371331 - RNA, 20 nt, Human
cugacuguguuucuuuaugg

SEQ ID NO: 1371332 - RNA, 23 nt, Human
cugucuuagccucccaaggugcu

SEQ ID NO: 1371333 - RNA, 24 nt, Human
cugucuuagccucccaaggugcug

SEQ ID NO: 1371334 - RNA, 25 nt, Human
cuuccugucuuagccucccaaggug

SEQ ID NO: 1371335 - RNA, 24 nt, Human
gaacucgccaccauuauucccugg

SEQ ID NO: 1371336 - RNA, 22 nt, Human
gacacccuucuaacuaccaccc

SEQ ID NO: 1371337 - RNA, 24 nt, Human
gaccucaagugauccgcccgccuc

SEQ ID NO: 1371338 - RNA, 24 nt, Human
gagacgggguuucaccauguuggc

SEQ ID NO: 1371339 - RNA, 18 nt, Human
gauuacagaugugaggca

SEQ ID NO: 1371340 - RNA, 23 nt, Human
gccucggccucccaaagugcugg

SEQ ID NO: 1371341 - RNA, 23 nt, Human
gcuggucucaaacuccugaccuc

SEQ ID NO: 1371342 - RNA, 24 nt, Human
ggcuggucucaaacuccugaccuc

SEQ ID NO: 1371343 - RNA, 23 nt, Human
gggguuucaccauguuggccagg

SEQ ID NO: 1371344 - RNA, 23 nt, Human
guagagacgggguuucaccaugu

SEQ ID NO: 1371345 - RNA, 24 nt, Human
gugauccgcccgccucggccuccc

SEQ ID NO: 1371346 - RNA, 24 nt, Human
gugaucuuccugucuuagccuccc

SEQ ID NO: 1371347 - RNA, 20 nt, Human
gugcugggauuauaggcgug

SEQ ID NO: 1371348 - RNA, 23 nt, Human
gugguguucauagcucacugcaa

SEQ ID NO: 1371349 - RNA, 19 nt, Human
uaaugcuggugauggaacu

SEQ ID NO: 1371350 - RNA, 22 nt, Human
uagagacagggucuuguucugu

SEQ ID NO: 1371351 - RNA, 22 nt, Human
uagagacgggguuucaccaugu

SEQ ID NO: 1371352 - RNA, 24 nt, Human
uaguagagacgggguuucaccaug

SEQ ID NO: 1371353 - RNA, 26 nt, Human
uaguagagacgggguuucaccauguu

SEQ ID NO: 1371354 - RNA, 19 nt, Human
ucacuacaguuuagugcac

SEQ ID NO: 1371355 - RNA, 24 nt, Human
ucacugcaaucuugagcuccuggg

SEQ ID NO: 1371356 - RNA, 23 nt, Human
ucaucaaaaauauuucuuuugaa

SEQ ID NO: 1371357 - RNA, 18 nt, Human
ucccaaagugcugggauu

SEQ ID NO: 1371358 - RNA, 23 nt, Human
ucccaaagugcugggauuacaga

SEQ ID NO: 1371359 - RNA, 24 nt, Human
ucccaaggugcugggauuauaggc

SEQ ID NO: 1371360 - RNA, 18 nt, Human
ucggccucccaaagugcu

SEQ ID NO: 1371361 - RNA, 19 nt, Human
ucuuguucugucacacaag

SEQ ID NO: 1371362 - RNA, 20 nt, Human
ucuuguucugucacacaaga

SEQ ID NO: 1371363 - RNA, 21 nt, Human
ucuuguucugucacacaagaa

SEQ ID NO: 1371364 - RNA, 20 nt, Human
ugaaauacggggacacccuu

SEQ ID NO: 1371365 - RNA, 22 nt, Human
ugacaacuccuucccucuagaa

SEQ ID NO: 1371366 - RNA, 18 nt, Human
ugaccucaagugauccgc

SEQ ID NO: 1371367 - RNA, 24 nt, Human
ugaccucaagugauccgcccgccu

SEQ ID NO: 1371368 - RNA, 19 nt, Human
ugacuguguuucuuuaugg

SEQ ID NO: 1371369 - RNA, 18 nt, Human
ugcugggauuacagaugu

SEQ ID NO: 1371370 - RNA, 24 nt, Human
ugcugggauuacagaugugaggca

SEQ ID NO: 1371371 - RNA, 19 nt, Human
uggagugcagugguguuca

SEQ ID NO: 1371372 - RNA, 24 nt, Human
uggccaggcuggucucaaacuccu

SEQ ID NO: 1371373 - RNA, 18 nt, Human
ugggauuacagaugugag

SEQ ID NO: 1371374 - RNA, 19 nt, Human
ugggauuacagaugugagg

SEQ ID NO: 1371375 - RNA, 20 nt, Human
ugggauuacagaugugaggc

SEQ ID NO: 1371376 - RNA, 21 nt, Human
ugggauuacagaugugaggca

SEQ ID NO: 1371377 - RNA, 23 nt, Human
ugggauuacagaugugaggcacc

SEQ ID NO: 1371378 - RNA, 23 nt, Human
ugggauuacagaugugaggcacc

SEQ ID NO: 1371379 - RNA, 24 nt, Human
ugggauuacagaugugaggcaccg

SEQ ID NO: 1371380 - RNA, 21 nt, Human
ugggauuauaggcguguguca

SEQ ID NO: 1371381 - RNA, 21 nt, Human
ugggauuauaggcguguguca

SEQ ID NO: 1371382 - RNA, 24 nt, Human
ugggauuauaggcgugugucauug

SEQ ID NO: 1371383 - RNA, 24 nt, Human
ugggcucaggugaucuuccugucu

SEQ ID NO: 1371384 - RNA, 21 nt, Human
uguauuuuuaguagagacggg

SEQ ID NO: 1371385 - RNA, 19 nt, Human
ugucacacaagaacaagug

SEQ ID NO: 1371386 - RNA, 18 nt, Human
uuaguagagacgggguuu

SEQ ID NO: 1371387 - RNA, 22 nt, Human
uuaguagagacgggguuucacc

SEQ ID NO: 1371388 - RNA, 24 nt, Human
uuaguagagacgggguuucaccau

SEQ ID NO: 1371389 - RNA, 23 nt, Human
uuguauuuuuaguagagacgggg

SEQ ID NO: 1371390 - RNA, 21 nt, Human
uugucaggcaccccagaaccc

SEQ ID NO: 1371391 - RNA, 24 nt, Human
uuucaccauguuggccaggcuggu

SEQ ID NO: 1371392 - RNA, 24 nt, Human
uuuuuaguagagacgggguuucac

SEQ ID NO: 1371393 - RNA, 21 nt, Human
uuuuuguauuuuuaguagaga

SEQ ID NO: 1371394 - RNA, 24 nt, Human
uuuuuuguauuuuuaguagagacg

SEQ ID NO: 1371395 - RNA, 18 nt, Human
aaaagcaaacaaaacaga

SEQ ID NO: 1371396 - RNA, 21 nt, Human
aaacaaaacagauacguuccu

SEQ ID NO: 1371397 - RNA, 25 nt, Human
aaagcaaacaaaacagauacguucc

SEQ ID NO: 1371398 - RNA, 19 nt, Human
aaauccuccccaggacuuc

SEQ ID NO: 1371399 - RNA, 19 nt, Human
acaaaacagauacguuccu

SEQ ID NO: 1371400 - RNA, 22 nt, Human
acagcaaacagcccagaggccc

SEQ ID NO: 1371401 - RNA, 18 nt, Human
acagcccagaggccccaa

SEQ ID NO: 1371402 - RNA, 18 nt, Human
accgugcccuccagggag

SEQ ID NO: 1371403 - RNA, 24 nt, Human
accugggcaaaagcaaacaaaaca

SEQ ID NO: 1371404 - RNA, 19 nt, Human
acucggcucagcuccgcgg

SEQ ID NO: 1371405 - RNA, 22 nt, Human
agcaaacagcccagaggcccca

SEQ ID NO: 1371406 - RNA, 22 nt, Human
aggagucggaggcugcagggcu

SEQ ID NO: 1371407 - RNA, 25 nt, Human
auccuccccaggacuuccggcccac

SEQ ID NO: 1371408 - RNA, 21 nt, Human
cacagcaaacagcccagaggc

SEQ ID NO: 1371409 - RNA, 23 nt, Human
cacagcaaacagcccagaggccc

SEQ ID NO: 1371410 - RNA, 22 nt, Human
cagcaaacagcccagaggcccc

SEQ ID NO: 1371411 - RNA, 23 nt, Human
caggagucggaggcugcagggcu

SEQ ID NO: 1371412 - RNA, 21 nt, Human
ccauuccagccuccacucggc

SEQ ID NO: 1371413 - RNA, 20 nt, Human
cccacccuucuuccuacucc

SEQ ID NO: 1371414 - RNA, 20 nt, Human
ccccaggacuuccggcccac

SEQ ID NO: 1371415 - RNA, 21 nt, Human
ccgcccacgagccucacacua

SEQ ID NO: 1371416 - RNA, 19 nt, Human
ccucgagccaggcuggucc

SEQ ID NO: 1371417 - RNA, 19 nt, Human
cgcuuggcuccgcccacga

SEQ ID NO: 1371418 - RNA, 23 nt, Human
cggcggaaacccgagcccgaaca

SEQ ID NO: 1371419 - RNA, 23 nt, Human
cggcuuccucgagccaggcuggu

SEQ ID NO: 1371420 - RNA, 26 nt, Human
cuacuuccgaccuggcagucccuguc

SEQ ID NO: 1371421 - RNA, 22 nt, Human
cuccacagcaaacagcccagga

SEQ ID NO: 1371422 - RNA, 19 nt, Human
cuccacucggcucagcucc

SEQ ID NO: 1371423 - RNA, 24 nt, Human
cugcaucgccaucugcuggccgcg

SEQ ID NO: 1371424 - RNA, 18 nt, Human
cuguguguaaauccuccc

SEQ ID NO: 1371425 - RNA, 22 nt, Human
gagcccgaacagagggauccgg

SEQ ID NO: 1371426 - RNA, 21 nt, Human
gcaaaagcaaacaaaacagau

SEQ ID NO: 1371427 - RNA, 22 nt, Human
ggaaacccgagcccgaacagag

SEQ ID NO: 1371428 - RNA, 21 nt, Human
ggacuuccggcccaccagcuc

SEQ ID NO: 1371429 - RNA, 26 nt, Human
gugcagaugcucugcccaggccugcc

SEQ ID NO: 1371430 - RNA, 22 nt, Human
uccacagcaaacagcccagagg

SEQ ID NO: 1371431 - RNA, 18 nt, Human
ugcccaggccugcggaag

SEQ ID NO: 1371432 - RNA, 19 nt, Human
ugcccaggccugcggaagc

SEQ ID NO: 1371433 - RNA, 24 nt, Human
uuuauuguaacuuggaagcccacc

SEQ ID NO: 1371434 - RNA, 22 nt, Human
uuuuuuuuuuuuuuuuuggguu

SEQ ID NO: 1371435 - RNA, 23 nt, Human
uuuuuuuuuuuuuuuuuuugggu

SEQ ID NO: 1371436 - RNA, 24 nt, Human
uuuuuuuuuuuuuuuuuuuuuggg

SEQ ID NO: 1371437 - RNA, 20 nt, Human
aaaaggccagaaagaaaaca

SEQ ID NO: 1371438 - RNA, 22 nt, Human
aaacaaaagggggguaauauga

SEQ ID NO: 1371439 - RNA, 23 nt, Human
aaacaaaagggggguaauaugaa

SEQ ID NO: 1371440 - RNA, 22 nt, Human
aaagaaccccccccuuccccca

SEQ ID NO: 1371441 - RNA, 19 nt, Human
aaagccacaaaccacagaa

SEQ ID NO: 1371442 - RNA, 20 nt, Human
aaaggagcagucccacugca

SEQ ID NO: 1371443 - RNA, 18 nt, Human
aaaggcugaggaaccaaa

SEQ ID NO: 1371444 - RNA, 22 nt, Human
aacacacacauacacacacaca

SEQ ID NO: 1371445 - RNA, 24 nt, Human
aacaggcacugcauggcccgcagg

SEQ ID NO: 1371446 - RNA, 19 nt, Human
aaccaaagaaaacagggac

SEQ ID NO: 1371447 - RNA, 19 nt, Human
aacuaggccccaagccuga

SEQ ID NO: 1371448 - RNA, 24 nt, Human
aagaaaaagccacaaaccacagaa

SEQ ID NO: 1371449 - RNA, 19 nt, Human
aagaauccucuaucagguc

SEQ ID NO: 1371450 - RNA, 18 nt, Human
aaguaagacacagcaaga

SEQ ID NO: 1371451 - RNA, 19 nt, Human
aagugcccucugggcucag

SEQ ID NO: 1371452 - RNA, 21 nt, Human
acaaggcaguaacaguuccaa

SEQ ID NO: 1371453 - RNA, 24 nt, Human
acacacauacacacacacacacag

SEQ ID NO: 1371454 - RNA, 20 nt, Human
acagaaauuuuaaagaaccc

SEQ ID NO: 1371455 - RNA, 21 nt, Human
acagagcuucccuaucaaaga

SEQ ID NO: 1371456 - RNA, 20 nt, Human
acauaauaggauugcagggu

SEQ ID NO: 1371457 - RNA, 18 nt, Human
accaauggggagaugcag

SEQ ID NO: 1371458 - RNA, 18 nt, Human
accauagcagagcucuga

SEQ ID NO: 1371459 - RNA, 19 nt, Human
accgccaaaccgucucagc

SEQ ID NO: 1371460 - RNA, 23 nt, Human
accucggggcucccaccccuuua

SEQ ID NO: 1371461 - RNA, 21 nt, Human
acgcuaccagucucugcgaac

SEQ ID NO: 1371462 - RNA, 19 nt, Human
acuugauaauucuuuuucu

SEQ ID NO: 1371463 - RNA, 23 nt, Human
agaaagaaaacaguaauuucagg

SEQ ID NO: 1371464 - RNA, 20 nt, Human
agaaguagccacacuugacu

SEQ ID NO: 1371465 - RNA, 22 nt, Human
agaaucccaaacaagaauccuc

SEQ ID NO: 1371466 - RNA, 25 nt, Human
agacacagcaagagggcacacuagc

SEQ ID NO: 1371467 - RNA, 18 nt, Human
agccauaggggaaagggg

SEQ ID NO: 1371468 - RNA, 27 nt, Human
agcgauaggggcgacugcuccggaaag

SEQ ID NO: 1371469 - RNA, 22 nt, Human
aggagauucuggaggucuuucu

SEQ ID NO: 1371470 - RNA, 20 nt, Human
aggcagagggauuggacugu

SEQ ID NO: 1371471 - RNA, 18 nt, Human
aggcaguggucccugggc

SEQ ID NO: 1371472 - RNA, 18 nt, Human
aggcugugcagcuccucc

SEQ ID NO: 1371473 - RNA, 24 nt, Human
agguagguagggaaagggagaguu

SEQ ID NO: 1371474 - RNA, 19 nt, Human
aggugagcgcugcagcugc

SEQ ID NO: 1371475 - RNA, 19 nt, Human
auaaagcagcaccguuccc

SEQ ID NO: 1371476 - RNA, 23 nt, Human
caaaacaaaggacaguggugagc

SEQ ID NO: 1371477 - RNA, 21 nt, Human
caaaagggggguaauaugaac

SEQ ID NO: 1371478 - RNA, 27 nt, Human
caaagcagaaucccaaacaagaaucuu

SEQ ID NO: 1371479 - RNA, 19 nt, Human
caacaggauucugcacaca

SEQ ID NO: 1371480 - RNA, 18 nt, Human
caacugcaggagcagcga

SEQ ID NO: 1371481 - RNA, 23 nt, Human
caagagggcacacuagcaaagca

SEQ ID NO: 1371482 - RNA, 21 nt, Human
caaggaccaacuccauccccc

SEQ ID NO: 1371483 - RNA, 20 nt, Human
cacacacauacacacacaca

SEQ ID NO: 1371484 - RNA, 22 nt, Human
cacacacauacacacacacaca

SEQ ID NO: 1371485 - RNA, 26 nt, Human
cacacacauacacacacacacacacu

SEQ ID NO: 1371486 - RNA, 22 nt, Human
cacacauacacacacacacaca

SEQ ID NO: 1371487 - RNA, 21 nt, Human
cacugcauggcccgcaggcug

SEQ ID NO: 1371488 - RNA, 22 nt, Human
cacuugacugcccggugcaccu

SEQ ID NO: 1371489 - RNA, 24 nt, Human
cacuuuaaaaaaaggauuccuaaa

SEQ ID NO: 1371490 - RNA, 23 nt, Human
cagaaacaaaaaacaaaaggggg

SEQ ID NO: 1371491 - RNA, 18 nt, Human
cagagcuucccuaucaaa

SEQ ID NO: 1371492 - RNA, 20 nt, Human
cagaggucccugcuaccucc

SEQ ID NO: 1371493 - RNA, 24 nt, Human
cagcauaauacauccagacaugaa

SEQ ID NO: 1371494 - RNA, 24 nt, Human
cagcgauaggggcgacugcuccgg

SEQ ID NO: 1371495 - RNA, 19 nt, Human
caggaucuugcgcacaucc

SEQ ID NO: 1371496 - RNA, 20 nt, Human
caggcccauucccagguucu

SEQ ID NO: 1371497 - RNA, 30 nt, Human
cagguaauacacuuuaaaaaaaggauuccc

SEQ ID NO: 1371498 - RNA, 19 nt, Human
cauaaccgaauccucaacc

SEQ ID NO: 1371499 - RNA, 23 nt, Human
caugcgauaaugccaggcagugg

SEQ ID NO: 1371500 - RNA, 21 nt, Human
cauuugccaagccuaugccac

SEQ ID NO: 1371501 - RNA, 21 nt, Human
ccaaacucuaugguuuccuua

SEQ ID NO: 1371502 - RNA, 21 nt, Human
ccaaccaaagaaaacagggac

SEQ ID NO: 1371503 - RNA, 22 nt, Human
ccaagucacacccauggaccgg

SEQ ID NO: 1371504 - RNA, 22 nt, Human
ccacagaaauuuuaaagaaccc

SEQ ID NO: 1371505 - RNA, 22 nt, Human
ccaggagaaaaggccagaaaga

SEQ ID NO: 1371506 - RNA, 21 nt, Human
cccauucccagguucuccggg

SEQ ID NO: 1371507 - RNA, 18 nt, Human
cccccauaacacacacau

SEQ ID NO: 1371508 - RNA, 26 nt, Human
cccccccuucccccauaacacacaca

SEQ ID NO: 1371509 - RNA, 19 nt, Human
ccccccuucccccauaaac

SEQ ID NO: 1371510 - RNA, 21 nt, Human
ccucuaaccaggagaaaaggc

SEQ ID NO: 1371511 - RNA, 18 nt, Human
ccucugggcaccuguugg

SEQ ID NO: 1371512 - RNA, 21 nt, Human
ccugagcgauggccucuagcc

SEQ ID NO: 1371513 - RNA, 20 nt, Human
ccugcccagggcuucagagc

SEQ ID NO: 1371514 - RNA, 19 nt, Human
cggaggugagcgcugcagc

SEQ ID NO: 1371515 - RNA, 18 nt, Human
cggcaguauugaaaugga

SEQ ID NO: 1371516 - RNA, 27 nt, Human
cgggaagggagcaaagcgggaggcggc

SEQ ID NO: 1371517 - RNA, 21 nt, Human
cuagaggccuuucagugccca

SEQ ID NO: 1371518 - RNA, 22 nt, Human
cucaaagcagaaucccaaacaa

SEQ ID NO: 1371519 - RNA, 23 nt, Human
cucagaguaggaaaugaccgccc

SEQ ID NO: 1371520 - RNA, 20 nt, Human
cuccaucccccuguguguca

SEQ ID NO: 1371521 - RNA, 26 nt, Human
cuccugcacagccaugaugcucuucc

SEQ ID NO: 1371522 - RNA, 19 nt, Human
cuccuuuaccaucauccca

SEQ ID NO: 1371523 - RNA, 18 nt, Human
cucuccuuucuucauccu

SEQ ID NO: 1371524 - RNA, 22 nt, Human
cugacgaacuguaacguccaaa

SEQ ID NO: 1371525 - RNA, 18 nt, Human
cugaucaggcccauuccc

SEQ ID NO: 1371526 - RNA, 19 nt, Human
cugcccaaccaaagaaaac

SEQ ID NO: 1371527 - RNA, 18 nt, Human
cuggaauuccggagguga

SEQ ID NO: 1371528 - RNA, 19 nt, Human
cuggaggucuuucucugac

SEQ ID NO: 1371529 - RNA, 21 nt, Human
gaaaaagccacaaaccacagg

SEQ ID NO: 1371530 - RNA, 24 nt, Human
gaaaacagggacauucaacaggau

SEQ ID NO: 1371531 - RNA, 31 nt, Human
gaaauuuuaaagaaccccccccuucccccaa

SEQ ID NO: 1371532 - RNA, 19 nt, Human
gaccuuuucuucuugcugg

SEQ ID NO: 1371533 - RNA, 23 nt, Human
gaccuuuucuucuugcuggaguc

SEQ ID NO: 1371534 - RNA, 20 nt, Human
gaucaggacaacucuaggac

SEQ ID NO: 1371535 - RNA, 28 nt, Human
gaugcucuuccauacuucaguccugccc

SEQ ID NO: 1371536 - RNA, 18 nt, Human
gccagaaagaaaacagua

SEQ ID NO: 1371537 - RNA, 26 nt, Human
gcuaggccuuguccucaagucagcug

SEQ ID NO: 1371538 - RNA, 19 nt, Human
ggaggugggaagauacaac

SEQ ID NO: 1371539 - RNA, 23 nt, Human
ggaguauguacccucugggcacc

SEQ ID NO: 1371540 - RNA, 21 nt, Human
ggcagcaacacgucuggcucc

SEQ ID NO: 1371541 - RNA, 23 nt, Human
ggccagaaacaaaaaacaaaagg

SEQ ID NO: 1371542 - RNA, 24 nt, Human
ggccagaaagaaaacaguaauuuc

SEQ ID NO: 1371543 - RNA, 26 nt, Human
gggaagggagcaaagcgggaggcggc

SEQ ID NO: 1371544 - RNA, 20 nt, Human
gggcaaagauaucuccaaau

SEQ ID NO: 1371545 - RNA, 19 nt, Human
gggcaaggaagagggcucu

SEQ ID NO: 1371546 - RNA, 20 nt, Human
guccaaacuguccaagaagc

SEQ ID NO: 1371547 - RNA, 20 nt, Human
gugacucuuacuucccaucc

SEQ ID NO: 1371548 - RNA, 24 nt, Human
guggucccugggcaugcgauggug

SEQ ID NO: 1371549 - RNA, 25 nt, Human
guggucccugggcaugcgauggugg

SEQ ID NO: 1371550 - RNA, 27 nt, Human
uaaaaggaagguagguagggaaaggga

SEQ ID NO: 1371551 - RNA, 22 nt, Human
uaaagaaccccccccuuccccc

SEQ ID NO: 1371552 - RNA, 27 nt, Human
uaauaugaacaaaauacuacucaaaac

SEQ ID NO: 1371553 - RNA, 21 nt, Human
uaaucuguaacuaggccccaa

SEQ ID NO: 1371554 - RNA, 21 nt, Human
uacaagucaagggcaaagaua

SEQ ID NO: 1371555 - RNA, 20 nt, Human
uaccaucaucccacuuccaa

SEQ ID NO: 1371556 - RNA, 26 nt, Human
uagaggggccagaaacaaaaaacaaa

SEQ ID NO: 1371557 - RNA, 23 nt, Human
uaggaaaugaccgcccuacuaaa

SEQ ID NO: 1371558 - RNA, 22 nt, Human
uaggaaguaggccagagucuca

SEQ ID NO: 1371559 - RNA, 19 nt, Human
uaggacaaggcaguaacag

SEQ ID NO: 1371560 - RNA, 20 nt, Human
uaggacaaggcaguaacagu

SEQ ID NO: 1371561 - RNA, 20 nt, Human
uaggccccaagccugaucag

SEQ ID NO: 1371562 - RNA, 20 nt, Human
uaucuguauaggauggacua

SEQ ID NO: 1371563 - RNA, 22 nt, Human
uaugaacaaaauacuacucaaa

SEQ ID NO: 1371564 - RNA, 24 nt, Human
uaugcaaaaauaaaaaucuccaaa

SEQ ID NO: 1371565 - RNA, 21 nt, Human
uauggaagaaaaagccacaaa

SEQ ID NO: 1371566 - RNA, 23 nt, Human
uauguacccucugggcaccuguu

SEQ ID NO: 1371567 - RNA, 23 nt, Human
uauugagggcagcugaaagugcc

SEQ ID NO: 1371568 - RNA, 22 nt, Human
ucaacaggcacugcauggcccg

SEQ ID NO: 1371569 - RNA, 22 nt, Human
ucaauacacauaaucaagggaa

SEQ ID NO: 1371570 - RNA, 19 nt, Human
ucacccagccuccugggcc

SEQ ID NO: 1371571 - RNA, 20 nt, Human
ucagcgccucacccagccuc

SEQ ID NO: 1371572 - RNA, 20 nt, Human
ucagugcccaguccuccggc

SEQ ID NO: 1371573 - RNA, 20 nt, Human
uccaagacauuguuaggaag

SEQ ID NO: 1371574 - RNA, 20 nt, Human
uccagacaugaaucuugaag

SEQ ID NO: 1371575 - RNA, 31 nt, Human
ucccccauaacacacacauacacacacacag

SEQ ID NO: 1371576 - RNA, 23 nt, Human
ucccgcucaccucggggcuccca

SEQ ID NO: 1371577 - RNA, 21 nt, Human
ucccugcuaccuccccagggg

SEQ ID NO: 1371578 - RNA, 21 nt, Human
uccucaagucagcugaaucau

SEQ ID NO: 1371579 - RNA, 26 nt, Human
uccuuggcuccuagcacuaauccauu

SEQ ID NO: 1371580 - RNA, 23 nt, Human
ucgucuacaagucaagggcaaag

SEQ ID NO: 1371581 - RNA, 20 nt, Human
ucuaaccaggagaaaaggcc

SEQ ID NO: 1371582 - RNA, 26 nt, Human
ucuaggacaaggcaguaacaguucca

SEQ ID NO: 1371583 - RNA, 21 nt, Human
ucucagcgccucacccagccu

SEQ ID NO: 1371584 - RNA, 19 nt, Human
ucuccaaaacaaaggacag

SEQ ID NO: 1371585 - RNA, 21 nt, Human
ucuccugagcgauggccucua

SEQ ID NO: 1371586 - RNA, 19 nt, Human
ucuguaacuaggccccaag

SEQ ID NO: 1371587 - RNA, 21 nt, Human
ucuucuugcuggagucaaggc

SEQ ID NO: 1371588 - RNA, 18 nt, Human
ugaccugacuuaaggacc

SEQ ID NO: 1371589 - RNA, 19 nt, Human
ugacugcccggugcaccuc

SEQ ID NO: 1371590 - RNA, 21 nt, Human
ugagagaauggacaaggacca

SEQ ID NO: 1371591 - RNA, 18 nt, Human
ugagggcagcugaaagug

SEQ ID NO: 1371592 - RNA, 22 nt, Human
ugcaaaaauaaaaaucuccaaa

SEQ ID NO: 1371593 - RNA, 22 nt, Human
ugccaggcaguggucccugggc

SEQ ID NO: 1371594 - RNA, 24 nt, Human
ugcccaaccaaagaaaacagggac

SEQ ID NO: 1371595 - RNA, 23 nt, Human
ugcccagggcuucagagcuugcu

SEQ ID NO: 1371596 - RNA, 19 nt, Human
ugcuaggccuuguccucaa

SEQ ID NO: 1371597 - RNA, 23 nt, Human
uggaagaaaaagccacaaaccac

SEQ ID NO: 1371598 - RNA, 24 nt, Human
uggaagaaaaagccacaaaccaca

SEQ ID NO: 1371599 - RNA, 19 nt, Human
uggcuccuagcacuaaucc

SEQ ID NO: 1371600 - RNA, 26 nt, Human
ugggcacacaacugcucaccugugca

SEQ ID NO: 1371601 - RNA, 19 nt, Human
uggugacagucuggauguu

SEQ ID NO: 1371602 - RNA, 20 nt, Human
uggugacagucuggauguuc

SEQ ID NO: 1371603 - RNA, 18 nt, Human
uguccauuugccaagccu

SEQ ID NO: 1371604 - RNA, 21 nt, Human
ugucucagagaagcccauaac

SEQ ID NO: 1371605 - RNA, 21 nt, Human
uguggccuuucuccuuuacca

SEQ ID NO: 1371606 - RNA, 20 nt, Human
uucauaaacccucgcucagg

SEQ ID NO: 1371607 - RNA, 18 nt, Human
uucccggguugcgggccu

SEQ ID NO: 1371608 - RNA, 21 nt, Human
uucuccuuuaccaucauccca

SEQ ID NO: 1371609 - RNA, 26 nt, Human
uucuucauccucuuagaugucgucua

SEQ ID NO: 1371610 - RNA, 21 nt, Human
uugcgggccuuucagcugcgc

SEQ ID NO: 1371611 - RNA, 22 nt, Human
uuuaaagaaccccccccuuccc

SEQ ID NO: 1371612 - RNA, 24 nt, Human
uuuaaagaaccccccccuuccccc

SEQ ID NO: 1371613 - RNA, 22 nt, Human
uuugccaagccuaugccaccag

SEQ ID NO: 1371614 - RNA, 20 nt, Human
uuuuagcucuugccaagguu

SEQ ID NO: 1371615 - RNA, 28 nt, Human
aaagaacuacacaaauuccagauaccac

SEQ ID NO: 1371616 - RNA, 19 nt, Human
acaaauuccagauaccaca

SEQ ID NO: 1371617 - RNA, 20 nt, Human
accgguagcaccgcggagca

SEQ ID NO: 1371618 - RNA, 21 nt, Human
caaagaacuacacaaauucca

SEQ ID NO: 1371619 - RNA, 18 nt, Human
caccagccagagaggaac

SEQ ID NO: 1371620 - RNA, 19 nt, Human
cccaccagccagagaggaa

SEQ ID NO: 1371621 - RNA, 20 nt, Human
cccaccagccagagaggaac

SEQ ID NO: 1371622 - RNA, 22 nt, Human
cuugcagcccaccagccagaga

SEQ ID NO: 1371623 - RNA, 24 nt, Human
gacagggggcaaagaacuacacaa

SEQ ID NO: 1371624 - RNA, 18 nt, Human
ggcugugcgggcgggccc

SEQ ID NO: 1371625 - RNA, 18 nt, Human
gggcccuccgcuugcagc

SEQ ID NO: 1371626 - RNA, 23 nt, Human
uaccacacuugucaccgguagca

SEQ ID NO: 1371627 - RNA, 20 nt, Human
ugagacagggggcaaagaac

SEQ ID NO: 1371628 - RNA, 19 nt, Human
uggguagaaagaaaaaagc

SEQ ID NO: 1371629 - RNA, 22 nt, Human
uggguagaaagaaaaaagcugg

SEQ ID NO: 1371630 - RNA, 23 nt, Human
aaacaugcgagauaaacagagga

SEQ ID NO: 1371631 - RNA, 19 nt, Human
aagagggacaagccugcca

SEQ ID NO: 1371632 - RNA, 24 nt, Human
aaugcacaucuacugcuaaaugac

SEQ ID NO: 1371633 - RNA, 24 nt, Human
acuacaauauggauauguccuacc

SEQ ID NO: 1371634 - RNA, 25 nt, Human
agaaacauggagaagaaccgguacc

SEQ ID NO: 1371635 - RNA, 23 nt, Human
auaacacugacucccaagaauac

SEQ ID NO: 1371636 - RNA, 21 nt, Human
auagaauacucuucaguucua

SEQ ID NO: 1371637 - RNA, 28 nt, Human
caaaacucuccuaguaacagcauccucc

SEQ ID NO: 1371638 - RNA, 22 nt, Human
caaaauaauacucugcugaaac

SEQ ID NO: 1371639 - RNA, 18 nt, Human
cacaacacuuauuuguag

SEQ ID NO: 1371640 - RNA, 23 nt, Human
ccagacaccuugggaacuacaau

SEQ ID NO: 1371641 - RNA, 24 nt, Human
ccaucaccacaaauaccaagagua

SEQ ID NO: 1371642 - RNA, 25 nt, Human
ccuacaauaagcucgacauuaaaga

SEQ ID NO: 1371643 - RNA, 23 nt, Human
ccucccaucaccacaaauaccaa

SEQ ID NO: 1371644 - RNA, 20 nt, Human
cuagaaucucuuaggaaauu

SEQ ID NO: 1371645 - RNA, 23 nt, Human
gaagaacuauaaacugcuuagca

SEQ ID NO: 1371646 - RNA, 20 nt, Human
gcuacaauuuauugagcacu

SEQ ID NO: 1371647 - RNA, 20 nt, Human
gucuguguuuggaagauaaa

SEQ ID NO: 1371648 - RNA, 24 nt, Human
uaaauacauacacaguacucacaa

SEQ ID NO: 1371649 - RNA, 22 nt, Human
uaacacugacucccaagaauac

SEQ ID NO: 1371650 - RNA, 19 nt, Human
uaagacaguuugaagcaca

SEQ ID NO: 1371651 - RNA, 22 nt, Human
uaagcucgacauuaaagacuga

SEQ ID NO: 1371652 - RNA, 21 nt, Human
uacaaaauaauacucugcuga

SEQ ID NO: 1371653 - RNA, 24 nt, Human
uacacaguacucacaauagcccca

SEQ ID NO: 1371654 - RNA, 18 nt, Human
uacucuuugucaaacacu

SEQ ID NO: 1371655 - RNA, 22 nt, Human
uccaaagauguuuguccuggaa

SEQ ID NO: 1371656 - RNA, 19 nt, Human
uccacugcaguaucucaaa

SEQ ID NO: 1371657 - RNA, 20 nt, Human
uccuggauaacuuaaaaaaa

SEQ ID NO: 1371658 - RNA, 26 nt, Human
ucuacugcuaaaugacuacucucaaa

SEQ ID NO: 1371659 - RNA, 26 nt, Human
ucucauaauaaugcacaucuacugcu

SEQ ID NO: 1371660 - RNA, 24 nt, Human
ucuccuaguaacagcauccuccca

SEQ ID NO: 1371661 - RNA, 26 nt, Human
ugaaauagaaaucaauuuaagccccc

SEQ ID NO: 1371662 - RNA, 19 nt, Human
ugcuuagcagggagaaaac

SEQ ID NO: 1371663 - RNA, 18 nt, Human
uggauauguccuacccag

SEQ ID NO: 1371664 - RNA, 18 nt, Human
uggcauacauauacaaaa

SEQ ID NO: 1371665 - RNA, 26 nt, Human
uuaaaaguucucuaacucucaaccag

SEQ ID NO: 1371666 - RNA, 27 nt, Human
uuaauucuggagaaacauggagaagaa

SEQ ID NO: 1371667 - RNA, 20 nt, Human
uuugcuucaaguccugaagu

SEQ ID NO: 1371668 - RNA, 22 nt, Human
agcgcccccccagcuaccgccc

SEQ ID NO: 1371669 - RNA, 18 nt, Human
augcagccccuggguggg

SEQ ID NO: 1371670 - RNA, 27 nt, Human
caagccgagccccagggagccucgcaa

SEQ ID NO: 1371671 - RNA, 21 nt, Human
caccggggcccccgccaacaa

SEQ ID NO: 1371672 - RNA, 18 nt, Human
ccacaugcagccccuggg

SEQ ID NO: 1371673 - RNA, 19 nt, Human
ccaccccggcccgcgcccc

SEQ ID NO: 1371674 - RNA, 18 nt, Human
ccagggccgcgcuccaug

SEQ ID NO: 1371675 - RNA, 20 nt, Human
cccccagcuaccgccccaga

SEQ ID NO: 1371676 - RNA, 22 nt, Human
ccccccagcuaccgccccagac

SEQ ID NO: 1371677 - RNA, 24 nt, Human
ccccggcccgcgcccccgggcccc

SEQ ID NO: 1371678 - RNA, 23 nt, Human
ccccgggccccagggccgcgcuc

SEQ ID NO: 1371679 - RNA, 18 nt, Human
cccgccaacaacgccgcc

SEQ ID NO: 1371680 - RNA, 21 nt, Human
cccggcccgcgcccccgggcc

SEQ ID NO: 1371681 - RNA, 24 nt, Human
cccggccgcccgcccgugcguccg

SEQ ID NO: 1371682 - RNA, 19 nt, Human
cccugggucggggcggggu

SEQ ID NO: 1371683 - RNA, 20 nt, Human
ccgcgcccccgggccccagg

SEQ ID NO: 1371684 - RNA, 23 nt, Human
ccgcgcccccgggccccagggcc

SEQ ID NO: 1371685 - RNA, 19 nt, Human
ccggcccgcgcccccgggc

SEQ ID NO: 1371686 - RNA, 21 nt, Human
ccuggcccggcaggggagggg

SEQ ID NO: 1371687 - RNA, 21 nt, Human
cgccaacaacgccgcccggcc

SEQ ID NO: 1371688 - RNA, 26 nt, Human
cgcccccgggccccagggccgcgcuc

SEQ ID NO: 1371689 - RNA, 26 nt, Human
cgcccgggccgggccuccaccggggc

SEQ ID NO: 1371690 - RNA, 20 nt, Human
cggcaggggagggguggggu

SEQ ID NO: 1371691 - RNA, 23 nt, Human
cgggccgggccuccaccggggcc

SEQ ID NO: 1371692 - RNA, 24 nt, Human
cggggcgggguccccugggccgcc

SEQ ID NO: 1371693 - RNA, 20 nt, Human
cgggggccgccuuauugcug

SEQ ID NO: 1371694 - RNA, 23 nt, Human
cgggggccgccuuauugcugagg

SEQ ID NO: 1371695 - RNA, 23 nt, Human
cggggugagguccgggggccgcc

SEQ ID NO: 1371696 - RNA, 22 nt, Human
cggucccuccgcaccccugccc

SEQ ID NO: 1371697 - RNA, 19 nt, Human
cuccauggcucccggccgc

SEQ ID NO: 1371698 - RNA, 19 nt, Human
cugagguccggcugguugg

SEQ ID NO: 1371699 - RNA, 20 nt, Human
cugggccgcccggggggguc

SEQ ID NO: 1371700 - RNA, 21 nt, Human
gacagcagccccguuaggagg

SEQ ID NO: 1371701 - RNA, 18 nt, Human
gaggccagggcccagccc

SEQ ID NO: 1371702 - RNA, 20 nt, Human
gagggguggggugcuccgag

SEQ ID NO: 1371703 - RNA, 19 nt, Human
gcccccgggccccagggcc

SEQ ID NO: 1371704 - RNA, 18 nt, Human
gccgagccccagggagcc

SEQ ID NO: 1371705 - RNA, 24 nt, Human
gggaagcccaccccggcccgcgcc

SEQ ID NO: 1371706 - RNA, 18 nt, Human
ggggagggguggggugcu

SEQ ID NO: 1371707 - RNA, 18 nt, Human
ggucggggcggggucccc

SEQ ID NO: 1371708 - RNA, 23 nt, Human
guccgucggucccuccgcacccc

SEQ ID NO: 1371709 - RNA, 22 nt, Human
gugggggccggcgcggggugag

SEQ ID NO: 1371710 - RNA, 18 nt, Human
uccccugggccgcccggg

SEQ ID NO: 1371711 - RNA, 20 nt, Human
ugagguccgggggccgccuu

SEQ ID NO: 1371712 - RNA, 22 nt, Human
ugcugagguccggcugguuggg

SEQ ID NO: 1371713 - RNA, 20 nt, Human
uucacguauuuucuucuugc

SEQ ID NO: 1371714 - RNA, 25 nt, Human
aaacaaaacaucuugauuacuagaa

SEQ ID NO: 1371715 - RNA, 19 nt, Human
aaauagaguugaaguuuac

SEQ ID NO: 1371716 - RNA, 21 nt, Human
aacaccuagcuuuuaaaaaug

SEQ ID NO: 1371717 - RNA, 24 nt, Human
agagaaguguccauucauauccuu

SEQ ID NO: 1371718 - RNA, 22 nt, Human
aguguccauucauauccuuugc

SEQ ID NO: 1371719 - RNA, 18 nt, Human
caaauacuacacuuaaga

SEQ ID NO: 1371720 - RNA, 18 nt, Human
caaguaugacugucauaa

SEQ ID NO: 1371721 - RNA, 21 nt, Human
cauauacccaccaagcauccc

SEQ ID NO: 1371722 - RNA, 23 nt, Human
cauauacccaccaagcaucccuu

SEQ ID NO: 1371723 - RNA, 23 nt, Human
cauuaaaauacucaaaauuaaua

SEQ ID NO: 1371724 - RNA, 24 nt, Human
gccuauguuuugauaagguuguuu

SEQ ID NO: 1371725 - RNA, 27 nt, Human
uaaacaaaacaucuugauuacuagaag

SEQ ID NO: 1371726 - RNA, 21 nt, Human
uaaaugucuucuuuagagaag

SEQ ID NO: 1371727 - RNA, 19 nt, Human
uaaggcaaguaugacuguc

SEQ ID NO: 1371728 - RNA, 26 nt, Human
uaagguuguuuuuuuuuucuuguaaa

SEQ ID NO: 1371729 - RNA, 25 nt, Human
uacauuagcaaauuuaaacaaaaca

SEQ ID NO: 1371730 - RNA, 21 nt, Human
uaggaagcaauucauuuaaaa

SEQ ID NO: 1371731 - RNA, 24 nt, Human
uaguaagguauaauuuauauacag

SEQ ID NO: 1371732 - RNA, 22 nt, Human
ucccugaugauuagugauacug

SEQ ID NO: 1371733 - RNA, 24 nt, Human
ucugaguaagauaacaccuagcuu

SEQ ID NO: 1371734 - RNA, 18 nt, Human
ucuuccacagucucacua

SEQ ID NO: 1371735 - RNA, 23 nt, Human
ucuuuagagaaguguccauucau

SEQ ID NO: 1371736 - RNA, 22 nt, Human
ugcaaccaaauagaguugaagu

SEQ ID NO: 1371737 - RNA, 19 nt, Human
ugugaggguuccuucucuu

SEQ ID NO: 1371738 - RNA, 25 nt, Human
uguuuuguuuuccuaguaggaagca

SEQ ID NO: 1371739 - RNA, 19 nt, Human
uugauaagguuguuuuuuu

SEQ ID NO: 1371740 - RNA, 22 nt, Human
uuguaaauauguuuaaguuccu

SEQ ID NO: 1371741 - RNA, 23 nt, Human
uuuugauaagguuguuuuuuuuu

SEQ ID NO: 1371742 - RNA, 19 nt, Human
gguggcccuugucguggug

SEQ ID NO: 1371743 - RNA, 24 nt, Human
ugguggcccuugucgugguggccu

SEQ ID NO: 1371744 - RNA, 24 nt, Human
aaaaagaagauaaacauuugaaaa

SEQ ID NO: 1371745 - RNA, 25 nt, Human
aaacaaaaaggguauauaugcacag

SEQ ID NO: 1371746 - RNA, 21 nt, Human
aaacaaaguucuaagcacaug

SEQ ID NO: 1371747 - RNA, 20 nt, Human
aaaguagaaacaguguucac

SEQ ID NO: 1371748 - RNA, 18 nt, Human
aacaaaguucuaagcaca

SEQ ID NO: 1371749 - RNA, 21 nt, Human
aacaaaguucuaagcacaugg

SEQ ID NO: 1371750 - RNA, 26 nt, Human
aacuaaucuaugaugaaaacccccuc

SEQ ID NO: 1371751 - RNA, 24 nt, Human
aagccaaaaagaagauaaacauuu

SEQ ID NO: 1371752 - RNA, 21 nt, Human
aagcgauccuucugccuuagc

SEQ ID NO: 1371753 - RNA, 23 nt, Human
aaggaauuuuuuuuucagagaga

SEQ ID NO: 1371754 - RNA, 22 nt, Human
aaguagcugggacuauuaggcc

SEQ ID NO: 1371755 - RNA, 25 nt, Human
aaguagcugggacuauuaggcgugu

SEQ ID NO: 1371756 - RNA, 21 nt, Human
acaaaguucuaagcacauggc

SEQ ID NO: 1371757 - RNA, 24 nt, Human
acaacacagauuuaagagacaaaa

SEQ ID NO: 1371758 - RNA, 24 nt, Human
acuaagaaaaaauaaaaaagaaga

SEQ ID NO: 1371759 - RNA, 19 nt, Human
agaaaaaauaaaaaagaag

SEQ ID NO: 1371760 - RNA, 22 nt, Human
agacaaaaguagaaacagggga

SEQ ID NO: 1371761 - RNA, 19 nt, Human
agacaaaaguagaaacagu

SEQ ID NO: 1371762 - RNA, 22 nt, Human
agagacugugauuguaaaugug

SEQ ID NO: 1371763 - RNA, 18 nt, Human
agccuccaaaguagcugg

SEQ ID NO: 1371764 - RNA, 20 nt, Human
aggcgugugccaccacgccc

SEQ ID NO: 1371765 - RNA, 23 nt, Human
agugcaguggugcgaucuuggcu

SEQ ID NO: 1371766 - RNA, 24 nt, Human
agugcaguggugcgaucuuggcuc

SEQ ID NO: 1371767 - RNA, 23 nt, Human
aucuucacaaaaaugacacugaa

SEQ ID NO: 1371768 - RNA, 21 nt, Human
augaugaaaaccccugaaagu

SEQ ID NO: 1371769 - RNA, 22 nt, Human
auugcagugcaguggugcgauc

SEQ ID NO: 1371770 - RNA, 24 nt, Human
caaaaacaaaaaggguauauaugc

SEQ ID NO: 1371771 - RNA, 23 nt, Human
caaaguagcugggacuauuaggc

SEQ ID NO: 1371772 - RNA, 21 nt, Human
cacaaaaaugacacugaagau

SEQ ID NO: 1371773 - RNA, 24 nt, Human
cacaacacagauuuaagagacaaa

SEQ ID NO: 1371774 - RNA, 25 nt, Human
cacaacacagauuuaagagacaaaa

SEQ ID NO: 1371775 - RNA, 24 nt, Human
caccacgcccgguuaauuuuugua

SEQ ID NO: 1371776 - RNA, 18 nt, Human
cacuccguaacccagauu

SEQ ID NO: 1371777 - RNA, 23 nt, Human
cacugcaaccuccgucucccggg

SEQ ID NO: 1371778 - RNA, 22 nt, Human
caggaaaaaaaaugauuagaaa

SEQ ID NO: 1371779 - RNA, 19 nt, Human
caguggugcgaucuuggcu

SEQ ID NO: 1371780 - RNA, 26 nt, Human
ccaaaguagcugggacuauuaggcgu

SEQ ID NO: 1371781 - RNA, 19 nt, Human
ccauguuggcuaggcuggu

SEQ ID NO: 1371782 - RNA, 22 nt, Human
ccauguuggcuaggcuggucuc

SEQ ID NO: 1371783 - RNA, 19 nt, Human
cccacagaguuuaaccauc

SEQ ID NO: 1371784 - RNA, 21 nt, Human
cccacagaguuuaaccaucau

SEQ ID NO: 1371785 - RNA, 19 nt, Human
cccggguuuaagcgauccu

SEQ ID NO: 1371786 - RNA, 20 nt, Human
cccggguuuaagcgauccuu

SEQ ID NO: 1371787 - RNA, 18 nt, Human
cccucucuauaauagaac

SEQ ID NO: 1371788 - RNA, 26 nt, Human
ccuucugccuuagccuccaaaguagc

SEQ ID NO: 1371789 - RNA, 26 nt, Human
cuaagccaaaaagaagauaaacauuu

SEQ ID NO: 1371790 - RNA, 24 nt, Human
cucacugcaaccuccgucucccgg

SEQ ID NO: 1371791 - RNA, 23 nt, Human
cugcaaccuccgucucccggguu

SEQ ID NO: 1371792 - RNA, 24 nt, Human
cugcaaccuccgucucccggguuu

SEQ ID NO: 1371793 - RNA, 23 nt, Human
cugccuuagccuccaaaguagcu

SEQ ID NO: 1371794 - RNA, 24 nt, Human
cuuagccuccaaaguagcugggac

SEQ ID NO: 1371795 - RNA, 20 nt, Human
cuuugagcuugguuaaguga

SEQ ID NO: 1371796 - RNA, 18 nt, Human
gaggggggagaaaaucag

SEQ ID NO: 1371797 - RNA, 20 nt, Human
gauagaccggauuacuuucu

SEQ ID NO: 1371798 - RNA, 19 nt, Human
gcagcugaacuugacagga

SEQ ID NO: 1371799 - RNA, 19 nt, Human
gcagugcaguggugcgauc

SEQ ID NO: 1371800 - RNA, 18 nt, Human
gccauguuggcuaggcug

SEQ ID NO: 1371801 - RNA, 20 nt, Human
gccauguuggcuaggcuggu

SEQ ID NO: 1371802 - RNA, 21 nt, Human
gggauauauaucucugucucu

SEQ ID NO: 1371803 - RNA, 19 nt, Human
gggguuuugccauguuggc

SEQ ID NO: 1371804 - RNA, 23 nt, Human
gggguuuugccauguuggcuagg

SEQ ID NO: 1371805 - RNA, 23 nt, Human
guagaguugggguuuugccaugu

SEQ ID NO: 1371806 - RNA, 19 nt, Human
guagcugggacuauuaggc

SEQ ID NO: 1371807 - RNA, 20 nt, Human
uaacacaaaagucccuuaua

SEQ ID NO: 1371808 - RNA, 21 nt, Human
uaacacaaaagucccuuauaa

SEQ ID NO: 1371809 - RNA, 24 nt, Human
uaacacaaaagucccuuauaacuc

SEQ ID NO: 1371810 - RNA, 21 nt, Human
uaacagagaaacuaagccaaa

SEQ ID NO: 1371811 - RNA, 28 nt, Human
uaacagagaaacuaagccaaaaagaaga

SEQ ID NO: 1371812 - RNA, 22 nt, Human
uaagccaaaaagaagauaaaca

SEQ ID NO: 1371813 - RNA, 27 nt, Human
uaagcgauccuucugccuuagccucca

SEQ ID NO: 1371814 - RNA, 23 nt, Human
uaaugugggagaugggauauaua

SEQ ID NO: 1371815 - RNA, 22 nt, Human
uaauuuuuguauuguuaguaga

SEQ ID NO: 1371816 - RNA, 18 nt, Human
uaccaaaaacaaaaaggg

SEQ ID NO: 1371817 - RNA, 20 nt, Human
uagaauucgcacucuucauc

SEQ ID NO: 1371818 - RNA, 22 nt, Human
uagaguugggguuuugccaugu

SEQ ID NO: 1371819 - RNA, 23 nt, Human
uagccgcugugcagcugaacuug

SEQ ID NO: 1371820 - RNA, 24 nt, Human
uaguagaguugggguuuugccaug

SEQ ID NO: 1371821 - RNA, 25 nt, Human
uauacuaagaaaaaauaaaaaagaa

SEQ ID NO: 1371822 - RNA, 25 nt, Human
uauauccccaaaguuugaaaacaaa

SEQ ID NO: 1371823 - RNA, 24 nt, Human
ucacugcaaccuccgucucccggg

SEQ ID NO: 1371824 - RNA, 25 nt, Human
ucacugcaaccuccgucucccgggu

SEQ ID NO: 1371825 - RNA, 19 nt, Human
uccccaaaguuugaaaaca

SEQ ID NO: 1371826 - RNA, 20 nt, Human
ucccggguuuaagcgauccu

SEQ ID NO: 1371827 - RNA, 23 nt, Human
ucccggguuuaagcgauccuucu

SEQ ID NO: 1371828 - RNA, 24 nt, Human
uccguaacccagauugcagugcag

SEQ ID NO: 1371829 - RNA, 23 nt, Human
ucucacuccguaacccagauugc

SEQ ID NO: 1371830 - RNA, 24 nt, Human
ucucacuccguaacccagauugca

SEQ ID NO: 1371831 - RNA, 24 nt, Human
ucucccggguuuaagcgauccuuc

SEQ ID NO: 1371832 - RNA, 24 nt, Human
ugaaaugagcagagacuuuaggua

SEQ ID NO: 1371833 - RNA, 19 nt, Human
ugauuagagagacugugau

SEQ ID NO: 1371834 - RNA, 20 nt, Human
ugauuagagagacugugauu

SEQ ID NO: 1371835 - RNA, 21 nt, Human
ugcacaggaaaaaaaaugauu

SEQ ID NO: 1371836 - RNA, 24 nt, Human
ugcagugcaguggugcgaucuugg

SEQ ID NO: 1371837 - RNA, 23 nt, Human
ugcaguggugcgaucuuggcucc

SEQ ID NO: 1371838 - RNA, 24 nt, Human
ugccauguuggcuaggcuggucuc

SEQ ID NO: 1371839 - RNA, 18 nt, Human
uggaauaaaucuucacaa

SEQ ID NO: 1371840 - RNA, 24 nt, Human
uggcuaggcuggucucaaacuccu

SEQ ID NO: 1371841 - RNA, 23 nt, Human
uggcuuugagcuugguuaaguga

SEQ ID NO: 1371842 - RNA, 25 nt, Human
ugggacuauuaggcgugugccacca

SEQ ID NO: 1371843 - RNA, 23 nt, Human
ugggguuuugccauguuggcuag

SEQ ID NO: 1371844 - RNA, 24 nt, Human
ugggguuuugccauguuggcuagg

SEQ ID NO: 1371845 - RNA, 28 nt, Human
uguaacagagaaacuaagccaaaaagaa

SEQ ID NO: 1371846 - RNA, 18 nt, Human
uuaguagaguugggguuu

SEQ ID NO: 1371847 - RNA, 18 nt, Human
uuaguagaguugggguuu

SEQ ID NO: 1371848 - RNA, 18 nt, Human
uuaguagaguugggguuu

SEQ ID NO: 1371849 - RNA, 24 nt, Human
uuaguagaguugggguuuugccau

SEQ ID NO: 1371850 - RNA, 21 nt, Human
uucacaaaaaugacacugaag

SEQ ID NO: 1371851 - RNA, 18 nt, Human
uugaaagguuauuaaaug

SEQ ID NO: 1371852 - RNA, 24 nt, Human
uugccauguuggcuaggcuggucu

SEQ ID NO: 1371853 - RNA, 24 nt, Human
uugggguuuugccauguuggcuag

SEQ ID NO: 1371854 - RNA, 21 nt, Human
uuuuaccaaaaacaaaaaggg

SEQ ID NO: 1371855 - RNA, 23 nt, Human
uuuugccauguuggcuaggcugg

SEQ ID NO: 1371856 - RNA, 20 nt, Human
uuuuuguauuguuaguagag

SEQ ID NO: 1371857 - RNA, 21 nt, Human
aaagaaacaaaaacccucuga

SEQ ID NO: 1371858 - RNA, 19 nt, Human
acaauccagcaauccuacc

SEQ ID NO: 1371859 - RNA, 19 nt, Human
accagggaggagccagcug

SEQ ID NO: 1371860 - RNA, 21 nt, Human
acgcagccccaugaugcccaa

SEQ ID NO: 1371861 - RNA, 21 nt, Human
acgucagccguaugagggucc

SEQ ID NO: 1371862 - RNA, 20 nt, Human
agagcuccccgcgggcccuc

SEQ ID NO: 1371863 - RNA, 18 nt, Human
agcagaacaguaucccag

SEQ ID NO: 1371864 - RNA, 25 nt, Human
agcagccacaucacgcagccccaug

SEQ ID NO: 1371865 - RNA, 24 nt, Human
agccuggccgacagagugagaucc

SEQ ID NO: 1371866 - RNA, 24 nt, Human
aggagauaacgccuguagucccag

SEQ ID NO: 1371867 - RNA, 21 nt, Human
aggcagagcucagguggucac

SEQ ID NO: 1371868 - RNA, 25 nt, Human
aggcagagcucagguggucacgcgg

SEQ ID NO: 1371869 - RNA, 19 nt, Human
aggcagaucacaucaggga

SEQ ID NO: 1371870 - RNA, 18 nt, Human
aggcugagaugggaggau

SEQ ID NO: 1371871 - RNA, 24 nt, Human
aucaaaaugaccaaacaauccagc

SEQ ID NO: 1371872 - RNA, 19 nt, Human
augaugcacggauaaacac

SEQ ID NO: 1371873 - RNA, 21 nt, Human
auugcauuccagccuggccga

SEQ ID NO: 1371874 - RNA, 24 nt, Human
auugcauuccagccuggccgacag

SEQ ID NO: 1371875 - RNA, 21 nt, Human
caccauggugcagaccuuccg

SEQ ID NO: 1371876 - RNA, 23 nt, Human
caccucugucuuccugcugaggg

SEQ ID NO: 1371877 - RNA, 19 nt, Human
cacgacggagagaggccca

SEQ ID NO: 1371878 - RNA, 20 nt, Human
cacuucagaaaagccagggg

SEQ ID NO: 1371879 - RNA, 27 nt, Human
cagagugagaucccaucacagccuguu

SEQ ID NO: 1371880 - RNA, 22 nt, Human
cagcagcagaacaguaucccag

SEQ ID NO: 1371881 - RNA, 19 nt, Human
cagccacaucacgcagccc

SEQ ID NO: 1371882 - RNA, 20 nt, Human
cagccuggccgacagaguga

SEQ ID NO: 1371883 - RNA, 20 nt, Human
cagcucaaccccaugaacuc

SEQ ID NO: 1371884 - RNA, 19 nt, Human
cagcugaggaacacacagg

SEQ ID NO: 1371885 - RNA, 21 nt, Human
caggagaccaccugccaccac

SEQ ID NO: 1371886 - RNA, 21 nt, Human
cauaaagagcaugcaacccag

SEQ ID NO: 1371887 - RNA, 18 nt, Human
caucagggaaggacagca

SEQ ID NO: 1371888 - RNA, 22 nt, Human
cauuccagccuggccgacagag

SEQ ID NO: 1371889 - RNA, 24 nt, Human
cauuccagccuggccgacagagug

SEQ ID NO: 1371890 - RNA, 18 nt, Human
cauugcauuccagccugg

SEQ ID NO: 1371891 - RNA, 21 nt, Human
cauugcauuccagccuggccg

SEQ ID NO: 1371892 - RNA, 24 nt, Human
cauugcauuccagccuggccgaca

SEQ ID NO: 1371893 - RNA, 25 nt, Human
cauugcauuccagccuggccgacag

SEQ ID NO: 1371894 - RNA, 26 nt, Human
ccaccugccaccacuucagaaaagcc

SEQ ID NO: 1371895 - RNA, 22 nt, Human
ccagauccugcuacccaggaga

SEQ ID NO: 1371896 - RNA, 19 nt, Human
ccauugcauuccagccugg

SEQ ID NO: 1371897 - RNA, 20 nt, Human
ccauugcauuccagccuggc

SEQ ID NO: 1371898 - RNA, 24 nt, Human
ccauugcauuccagccuggccgac

SEQ ID NO: 1371899 - RNA, 24 nt, Human
cccaggcagaucacaucagggaag

SEQ ID NO: 1371900 - RNA, 20 nt, Human
cccugcacucuaggucugag

SEQ ID NO: 1371901 - RNA, 20 nt, Human
cccugcacucuaggucugag

SEQ ID NO: 1371902 - RNA, 18 nt, Human
ccggggccucugugcacc

SEQ ID NO: 1371903 - RNA, 20 nt, Human
ccucugugcaccauggugca

SEQ ID NO: 1371904 - RNA, 23 nt, Human
ccugcugaggggggcuucuccca

SEQ ID NO: 1371905 - RNA, 18 nt, Human
ccuguagucccagcuacu

SEQ ID NO: 1371906 - RNA, 22 nt, Human
ccuguagucccagcuacuucag

SEQ ID NO: 1371907 - RNA, 19 nt, Human
cgccuguagucccagcuac

SEQ ID NO: 1371908 - RNA, 25 nt, Human
cgggguggggagguugcacugagcc

SEQ ID NO: 1371909 - RNA, 23 nt, Human
cuccuuguccuuuccugcuccag

SEQ ID NO: 1371910 - RNA, 20 nt, Human
cugcacucuaggucugaggc

SEQ ID NO: 1371911 - RNA, 21 nt, Human
cugcacugccacgcuugcugc

SEQ ID NO: 1371912 - RNA, 22 nt, Human
cugcuacccaggagaccaccug

SEQ ID NO: 1371913 - RNA, 18 nt, Human
cuuuccucuuccucuucc

SEQ ID NO: 1371914 - RNA, 25 nt, Human
cuuucuggccucacccagcuccggg

SEQ ID NO: 1371915 - RNA, 24 nt, Human
cuuugcuuuccucuuccucuucca

SEQ ID NO: 1371916 - RNA, 18 nt, Human
gaaaagaaacaaaaaccc

SEQ ID NO: 1371917 - RNA, 18 nt, Human
gagccccaggcagaucac

SEQ ID NO: 1371918 - RNA, 18 nt, Human
gagcuaucugcacugcca

SEQ ID NO: 1371919 - RNA, 22 nt, Human
gagguugcacugagccaaguug

SEQ ID NO: 1371920 - RNA, 22 nt, Human
gcaauccuaccucugaguaugc

SEQ ID NO: 1371921 - RNA, 21 nt, Human
gcacauuccccgcugacccca

SEQ ID NO: 1371922 - RNA, 24 nt, Human
gcauuccagccuggccgacagagu

SEQ ID NO: 1371923 - RNA, 23 nt, Human
gcccagauccugcuacccaggag

SEQ ID NO: 1371924 - RNA, 20 nt, Human
gccccacuggugggucccug

SEQ ID NO: 1371925 - RNA, 21 nt, Human
ggaaggcaguuuuuccacaga

SEQ ID NO: 1371926 - RNA, 20 nt, Human
ggagguugcacugagccaag

SEQ ID NO: 1371927 - RNA, 23 nt, Human
ggagguugcacugagccaaguug

SEQ ID NO: 1371928 - RNA, 24 nt, Human
ggagguugcacugagccaaguugg

SEQ ID NO: 1371929 - RNA, 18 nt, Human
ggaugcaaacgauggagc

SEQ ID NO: 1371930 - RNA, 23 nt, Human
ggcguucccuuuaagcucugccc

SEQ ID NO: 1371931 - RNA, 18 nt, Human
ggggaucucccugcacuc

SEQ ID NO: 1371932 - RNA, 24 nt, Human
ggggcccaucccuggaugaaggag

SEQ ID NO: 1371933 - RNA, 19 nt, Human
ggugcagaccuuccaggcc

SEQ ID NO: 1371934 - RNA, 21 nt, Human
guggaaggcaguuuuuccaca

SEQ ID NO: 1371935 - RNA, 23 nt, Human
gugguauuuuuguugcuccacuu

SEQ ID NO: 1371936 - RNA, 19 nt, Human
uaaacacacugcaggagcc

SEQ ID NO: 1371937 - RNA, 18 nt, Human
uaagggaaguaagcagcc

SEQ ID NO: 1371938 - RNA, 23 nt, Human
uagcucagguacagauucagcag

SEQ ID NO: 1371939 - RNA, 19 nt, Human
uagcuccggacucagggga

SEQ ID NO: 1371940 - RNA, 19 nt, Human
ucacagaaggcagagcuca

SEQ ID NO: 1371941 - RNA, 21 nt, Human
ucagcgacucucuggugcccu

SEQ ID NO: 1371942 - RNA, 19 nt, Human
uccagccuggccgacagag

SEQ ID NO: 1371943 - RNA, 20 nt, Human
uccagccuggccgacagagu

SEQ ID NO: 1371944 - RNA, 23 nt, Human
uccagccuggccgacagagugag

SEQ ID NO: 1371945 - RNA, 24 nt, Human
uccagccuggccgacagagugaga

SEQ ID NO: 1371946 - RNA, 21 nt, Human
ucccagccccacugguggguc

SEQ ID NO: 1371947 - RNA, 24 nt, Human
ucccucgcaugcacaguucacagu

SEQ ID NO: 1371948 - RNA, 18 nt, Human
uccgugggaacgauucug

SEQ ID NO: 1371949 - RNA, 27 nt, Human
uccuaugaaugugcuggacccgccgcu

SEQ ID NO: 1371950 - RNA, 18 nt, Human
uccugcuacccaggagac

SEQ ID NO: 1371951 - RNA, 19 nt, Human
ugacuccuuugcuuuccuc

SEQ ID NO: 1371952 - RNA, 18 nt, Human
ugagaugggaggauuguu

SEQ ID NO: 1371953 - RNA, 20 nt, Human
ugcaaacgauggagcugcug

SEQ ID NO: 1371954 - RNA, 24 nt, Human
ugcauuccagccuggccgacagag

SEQ ID NO: 1371955 - RNA, 19 nt, Human
ugcccucgugaucagcagc

SEQ ID NO: 1371956 - RNA, 18 nt, Human
uggcgcugcugaucucac

SEQ ID NO: 1371957 - RNA, 20 nt, Human
uucccuuuaagcucugccca

SEQ ID NO: 1371958 - RNA, 19 nt, Human
uugaucucauaaagagcau

SEQ ID NO: 1371959 - RNA, 24 nt, Human
uuggcaccauugcauuccagccug

SEQ ID NO: 1371960 - RNA, 19 nt, Human
uuuuuuuuuuuuuuuugcc

SEQ ID NO: 1371961 - RNA, 18 nt, Human
uuuuuuuuuuuuuuuuug

SEQ ID NO: 1371962 - RNA, 20 nt, Human
aaagaucuggugguggagac

SEQ ID NO: 1371963 - RNA, 20 nt, Human
aagaagaacaaagagguugg

SEQ ID NO: 1371964 - RNA, 25 nt, Human
acggaacccagcgaaagugcacgcc

SEQ ID NO: 1371965 - RNA, 23 nt, Human
agaagaacaaagagguuggagag

SEQ ID NO: 1371966 - RNA, 22 nt, Human
agacaggaagaggaaaacagag

SEQ ID NO: 1371967 - RNA, 18 nt, Human
agagguuggagagggaac

SEQ ID NO: 1371968 - RNA, 26 nt, Human
aggaaagaaguacuccauaaagaaaa

SEQ ID NO: 1371969 - RNA, 21 nt, Human
aggcuguaagagcaccugagg

SEQ ID NO: 1371970 - RNA, 19 nt, Human
caccugagggggagguagg

SEQ ID NO: 1371971 - RNA, 24 nt, Human
caggaagaggaaaacagaggaaag

SEQ ID NO: 1371972 - RNA, 19 nt, Human
ccacggagaaagaucuggu

SEQ ID NO: 1371973 - RNA, 21 nt, Human
ccccgcccccuccccuccccg

SEQ ID NO: 1371974 - RNA, 18 nt, Human
cccugcggagacaggaac

SEQ ID NO: 1371975 - RNA, 18 nt, Human
ccugcggagacaggaacg

SEQ ID NO: 1371976 - RNA, 20 nt, Human
cggaacccagcgaaagugca

SEQ ID NO: 1371977 - RNA, 20 nt, Human
cgggagaacccugggcggcg

SEQ ID NO: 1371978 - RNA, 22 nt, Human
gaacaaagagguuggagaggga

SEQ ID NO: 1371979 - RNA, 21 nt, Human
gaacccagcagggcccuggcg

SEQ ID NO: 1371980 - RNA, 26 nt, Human
gcgggggcgggggugcgggcggcagu

SEQ ID NO: 1371981 - RNA, 19 nt, Human
ggagaaagaucugguggug

SEQ ID NO: 1371982 - RNA, 21 nt, Human
ggaggggagacaggaagagga

SEQ ID NO: 1371983 - RNA, 21 nt, Human
ggcaagaagaacaaagagguu

SEQ ID NO: 1371984 - RNA, 23 nt, Human
ggcaguggcgggagaacccuggg

SEQ ID NO: 1371985 - RNA, 18 nt, Human
ggcggcggcuguggaggc

SEQ ID NO: 1371986 - RNA, 22 nt, Human
gggaggggagacaggaagagga

SEQ ID NO: 1371987 - RNA, 18 nt, Human
gggcaagaagaacaaaga

SEQ ID NO: 1371988 - RNA, 19 nt, Human
gggcggcggcuguggaggc

SEQ ID NO: 1371989 - RNA, 21 nt, Human
gguuggagagggaacgggagc

SEQ ID NO: 1371990 - RNA, 21 nt, Human
uaagagcaccugagggggagg

SEQ ID NO: 1371991 - RNA, 19 nt, Human
uaagccccgcccccucccc

SEQ ID NO: 1371992 - RNA, 18 nt, Human
uacuccauaaagaaaacu

SEQ ID NO: 1371993 - RNA, 22 nt, Human
ucccucuagggaucgaacgccc

SEQ ID NO: 1371994 - RNA, 23 nt, Human
ucccucuagggaucgaacgcccu

SEQ ID NO: 1371995 - RNA, 18 nt, Human
ugaccccggguaagcccc

SEQ ID NO: 1371996 - RNA, 21 nt, Human
ugcggagacaggaacguggcg

SEQ ID NO: 1371997 - RNA, 21 nt, Human
uggagagggaacgggagccuc

SEQ ID NO: 1371998 - RNA, 23 nt, Human
ugggaggggagacaggaagagga

SEQ ID NO: 1371999 - RNA, 23 nt, Human
uguaagagcaccugagggggagg

SEQ ID NO: 1372000 - RNA, 18 nt, Human
uguggaggcgggcggccc

SEQ ID NO: 1372001 - RNA, 18 nt, Human
uuagcagaggaauccacg

SEQ ID NO: 1372002 - RNA, 20 nt, Human
uuuuuuuuuuuuuugggagg

SEQ ID NO: 1372003 - RNA, 24 nt, Human
uuuuuuuuuuuuuuuuugggaggg

SEQ ID NO: 1372004 - RNA, 26 nt, Human
uuuuuuuuuuuuuuuuuuuuuuuggg

SEQ ID NO: 1372005 - RNA, 18 nt, Human
aaacucaagucaaugcug

SEQ ID NO: 1372006 - RNA, 22 nt, Human
aaagaaacaaaauacagggugg

SEQ ID NO: 1372007 - RNA, 24 nt, Human
aaagugcugggauuacaggcguga

SEQ ID NO: 1372008 - RNA, 26 nt, Human
aagaaacaaaauacagggugggaaaa

SEQ ID NO: 1372009 - RNA, 18 nt, Human
aagucaauucaaacucaa

SEQ ID NO: 1372010 - RNA, 24 nt, Human
aagugaucuauuggucuuggccuc

SEQ ID NO: 1372011 - RNA, 19 nt, Human
aagugcugggauuacaggc

SEQ ID NO: 1372012 - RNA, 19 nt, Human
aagugcugggauuacaggc

SEQ ID NO: 1372013 - RNA, 26 nt, Human
aagugcugggauuacaggcgugagcc

SEQ ID NO: 1372014 - RNA, 25 nt, Human
agaaacaaaauacagggugggaaaa

SEQ ID NO: 1372015 - RNA, 23 nt, Human
agacugaagaccuugccacaauc

SEQ ID NO: 1372016 - RNA, 19 nt, Human
aggcuuugccacacucagu

SEQ ID NO: 1372017 - RNA, 27 nt, Human
agggugggaaaagugacucaugucugu

SEQ ID NO: 1372018 - RNA, 26 nt, Human
agucuggucucaaacuccugaccucc

SEQ ID NO: 1372019 - RNA, 24 nt, Human
caaagugcugggauuacaggcgug

SEQ ID NO: 1372020 - RNA, 21 nt, Human
cacuaaaggcuuugccacacu

SEQ ID NO: 1372021 - RNA, 21 nt, Human
cauaagaugaagcuagacuga

SEQ ID NO: 1372022 - RNA, 26 nt, Human
cauuauggauucuccaaugauuugaa

SEQ ID NO: 1372023 - RNA, 22 nt, Human
ccaaagugcugggauuacaggc

SEQ ID NO: 1372024 - RNA, 22 nt, Human
ccaaagugcugggauuacaggc

SEQ ID NO: 1372025 - RNA, 24 nt, Human
ccaaagugcugggauuacaggcgu

SEQ ID NO: 1372026 - RNA, 22 nt, Human
ccugaccucaagugaucuauug

SEQ ID NO: 1372027 - RNA, 21 nt, Human
cuaaaggcuuugccacacuca

SEQ ID NO: 1372028 - RNA, 21 nt, Human
cugaagaccuugccacacuga

SEQ ID NO: 1372029 - RNA, 20 nt, Human
cugaagacuuugugauaauc

SEQ ID NO: 1372030 - RNA, 19 nt, Human
cuuauaagguuucucucca

SEQ ID NO: 1372031 - RNA, 19 nt, Human
cuuguaagguuucucucca

SEQ ID NO: 1372032 - RNA, 19 nt, Human
cuuguaagguuucucucca

SEQ ID NO: 1372033 - RNA, 20 nt, Human
gaacugcaagguaugaacaa

SEQ ID NO: 1372034 - RNA, 21 nt, Human
gaagcuagacugaagaccuug

SEQ ID NO: 1372035 - RNA, 18 nt, Human
gauuacaggcgugagcca

SEQ ID NO: 1372036 - RNA, 20 nt, Human
gauuacaggcgugagccacc

SEQ ID NO: 1372037 - RNA, 24 nt, Human
gauuacaggcgugagccaccccgc

SEQ ID NO: 1372038 - RNA, 22 nt, Human
guaugaagucuccuguuuugca

SEQ ID NO: 1372039 - RNA, 19 nt, Human
gucuuggccucccaaagug

SEQ ID NO: 1372040 - RNA, 18 nt, Human
uaagaugaagcuagacug

SEQ ID NO: 1372041 - RNA, 22 nt, Human
uacaggcgugagccaccccgcc

SEQ ID NO: 1372042 - RNA, 23 nt, Human
uacaggcgugagccaccccgccu

SEQ ID NO: 1372043 - RNA, 20 nt, Human
uacagggugggaaaagugac

SEQ ID NO: 1372044 - RNA, 22 nt, Human
ucaaugcugaauugacucuaau

SEQ ID NO: 1372045 - RNA, 23 nt, Human
ucaaugcugaauugacucuaaug

SEQ ID NO: 1372046 - RNA, 18 nt, Human
ucacaaacucuuacauuu

SEQ ID NO: 1372047 - RNA, 24 nt, Human
ucccaaagugcugggauuacaggc

SEQ ID NO: 1372048 - RNA, 21 nt, Human
ucccuauaccauggauugccu

SEQ ID NO: 1372049 - RNA, 19 nt, Human
uccugcugcauucauuaca

SEQ ID NO: 1372050 - RNA, 20 nt, Human
ucuuggccucccaaagugcu

SEQ ID NO: 1372051 - RNA, 19 nt, Human
ugaccucaagugaucuauu

SEQ ID NO: 1372052 - RNA, 20 nt, Human
ugacugaaggucuugccaca

SEQ ID NO: 1372053 - RNA, 18 nt, Human
ugagccaccccgccuggc

SEQ ID NO: 1372054 - RNA, 22 nt, Human
ugccugauggugaauaaguguu

SEQ ID NO: 1372055 - RNA, 24 nt, Human
ugcugggauuacaggcgugagcca

SEQ ID NO: 1372056 - RNA, 24 nt, Human
uggccagucuggucucaaacuccu

SEQ ID NO: 1372057 - RNA, 18 nt, Human
uggccucccaaagugcug

SEQ ID NO: 1372058 - RNA, 18 nt, Human
ugggaaaagugacucaug

SEQ ID NO: 1372059 - RNA, 18 nt, Human
ugggauuacaggcgugag

SEQ ID NO: 1372060 - RNA, 19 nt, Human
ugggauuacaggcgugagc

SEQ ID NO: 1372061 - RNA, 21 nt, Human
ugggauuacaggcgugagcca

SEQ ID NO: 1372062 - RNA, 22 nt, Human
ugggauuacaggcgugagccac

SEQ ID NO: 1372063 - RNA, 23 nt, Human
ugggauuacaggcgugagccacc

SEQ ID NO: 1372064 - RNA, 23 nt, Human
ugggauuacaggcgugagccacc

SEQ ID NO: 1372065 - RNA, 24 nt, Human
ugggauuacaggcgugagccaccc

SEQ ID NO: 1372066 - RNA, 25 nt, Human
ugggauuacaggcgugagccacccc

SEQ ID NO: 1372067 - RNA, 21 nt, Human
uggugaauaaguguugacugc

SEQ ID NO: 1372068 - RNA, 22 nt, Human
ugucacauucuucacauuugua

SEQ ID NO: 1372069 - RNA, 23 nt, Human
ugucuguuggccagucuggucuc

SEQ ID NO: 1372070 - RNA, 21 nt, Human
ugugaaucacgcccaagauuc

SEQ ID NO: 1372071 - RNA, 19 nt, Human
uguuggccagucuggucuc

SEQ ID NO: 1372072 - RNA, 23 nt, Human
uuacacuuguaagguuucucucc

SEQ ID NO: 1372073 - RNA, 24 nt, Human
uucaaaaucucucauuauggauuc

SEQ ID NO: 1372074 - RNA, 24 nt, Human
uuguaagcuuucucuccaguauga

SEQ ID NO: 1372075 - RNA, 19 nt, Human
uuuguaagcuuucucucca

SEQ ID NO: 1372076 - RNA, 19 nt, Human
uuuguaagguuucucucca

SEQ ID NO: 1372077 - RNA, 19 nt, Human
uuuguaagguuucucucca

SEQ ID NO: 1372078 - RNA, 18 nt, Human
aaacagccugcuguuuuc

SEQ ID NO: 1372079 - RNA, 21 nt, Human
aaacagccugcuguuuucuga

SEQ ID NO: 1372080 - RNA, 21 nt, Human
aaacugagagcaucaccauuu

SEQ ID NO: 1372081 - RNA, 19 nt, Human
aaacugcagccaucacuca

SEQ ID NO: 1372082 - RNA, 19 nt, Human
aacauuauaacaaaagccu

SEQ ID NO: 1372083 - RNA, 26 nt, Human
aagcagcaggugaaaggaggucagga

SEQ ID NO: 1372084 - RNA, 21 nt, Human
acaguuucuguugggcuuuug

SEQ ID NO: 1372085 - RNA, 19 nt, Human
acccgggcacccgcacccc

SEQ ID NO: 1372086 - RNA, 19 nt, Human
agaagaucugagaaacagc

SEQ ID NO: 1372087 - RNA, 19 nt, Human
agagaaacugagagcauca

SEQ ID NO: 1372088 - RNA, 27 nt, Human
agccaggaaauagaugaaaagggaccc

SEQ ID NO: 1372089 - RNA, 24 nt, Human
agcuccgccccucacccgggcacc

SEQ ID NO: 1372090 - RNA, 19 nt, Human
agguaggucagaggauucu

SEQ ID NO: 1372091 - RNA, 20 nt, Human
agguauagaaggggcgugga

SEQ ID NO: 1372092 - RNA, 24 nt, Human
aggucagaggauucuuuuuauggc

SEQ ID NO: 1372093 - RNA, 21 nt, Human
aguucccagggcccccagaau

SEQ ID NO: 1372094 - RNA, 18 nt, Human
auggccaacuggaagaug

SEQ ID NO: 1372095 - RNA, 21 nt, Human
caaaagaggcauaaucuaaua

SEQ ID NO: 1372096 - RNA, 23 nt, Human
caccagacugggaggcugagggc

SEQ ID NO: 1372097 - RNA, 20 nt, Human
caccgcccagcccucgugcc

SEQ ID NO: 1372098 - RNA, 22 nt, Human
cagaauaguucaccaggcucca

SEQ ID NO: 1372099 - RNA, 18 nt, Human
cagaggauucuuuuuaug

SEQ ID NO: 1372100 - RNA, 22 nt, Human
cagcaggugaaaggaggucagg

SEQ ID NO: 1372101 - RNA, 18 nt, Human
caucaccauuucuucagu

SEQ ID NO: 1372102 - RNA, 21 nt, Human
caugaccuaaaaucagacaag

SEQ ID NO: 1372103 - RNA, 18 nt, Human
caugaggcuuuaguuagc

SEQ ID NO: 1372104 - RNA, 23 nt, Human
ccagagccugggguggaauacgg

SEQ ID NO: 1372105 - RNA, 20 nt, Human
cccaugaagcuuucuuaagg

SEQ ID NO: 1372106 - RNA, 22 nt, Human
cccccagcuccgccccucaccc

SEQ ID NO: 1372107 - RNA, 20 nt, Human
cccgcaccccaccgcccagc

SEQ ID NO: 1372108 - RNA, 23 nt, Human
cccgcaccccaccgcccagcccu

SEQ ID NO: 1372109 - RNA, 18 nt, Human
cccucgggaagaaagccc

SEQ ID NO: 1372110 - RNA, 20 nt, Human
cccucgggaagaaagcccgc

SEQ ID NO: 1372111 - RNA, 21 nt, Human
cccucgggaagaaagcccgcu

SEQ ID NO: 1372112 - RNA, 18 nt, Human
cccucgugccgcccucgg

SEQ ID NO: 1372113 - RNA, 23 nt, Human
ccgaagugcccaacauuauaaca

SEQ ID NO: 1372114 - RNA, 18 nt, Human
ccgcaccccaccgcccag

SEQ ID NO: 1372115 - RNA, 20 nt, Human
ccucgggaagaaagcccgcu

SEQ ID NO: 1372116 - RNA, 25 nt, Human
ccugucuacauuucuuccucucagg

SEQ ID NO: 1372117 - RNA, 21 nt, Human
cugcuguuuucugaggcccga

SEQ ID NO: 1372118 - RNA, 22 nt, Human
cuuccucucagguauggggcag

SEQ ID NO: 1372119 - RNA, 22 nt, Human
gaagcuuucuuaagggaaaaug

SEQ ID NO: 1372120 - RNA, 21 nt, Human
gaauacggucauggaccauac

SEQ ID NO: 1372121 - RNA, 18 nt, Human
gaggauucuuuuuauggc

SEQ ID NO: 1372122 - RNA, 18 nt, Human
gagggccuuccccgagcc

SEQ ID NO: 1372123 - RNA, 22 nt, Human
gauaucacaaaagauacagcug

SEQ ID NO: 1372124 - RNA, 18 nt, Human
gcaccaacuagaaccuag

SEQ ID NO: 1372125 - RNA, 23 nt, Human
gccuuccccgagccuuucugcug

SEQ ID NO: 1372126 - RNA, 18 nt, Human
gccuuggggagaaaaagc

SEQ ID NO: 1372127 - RNA, 19 nt, Human
gccuuuuauggagaccuca

SEQ ID NO: 1372128 - RNA, 18 nt, Human
gcgugccacuuugcaaag

SEQ ID NO: 1372129 - RNA, 19 nt, Human
gcugaagagaugcauaggg

SEQ ID NO: 1372130 - RNA, 22 nt, Human
gcugauagggaaggcagagaaa

SEQ ID NO: 1372131 - RNA, 21 nt, Human
ggaaauagaugaaaaccuauc

SEQ ID NO: 1372132 - RNA, 22 nt, Human
ggacaaaagaggcauaaucuaa

SEQ ID NO: 1372133 - RNA, 21 nt, Human
ggagccucccagagccugggg

SEQ ID NO: 1372134 - RNA, 24 nt, Human
ggcccccagaauaguucaccagga

SEQ ID NO: 1372135 - RNA, 19 nt, Human
ggcgugccacuuugcaaag

SEQ ID NO: 1372136 - RNA, 21 nt, Human
gggagccucccagagccuggg

SEQ ID NO: 1372137 - RNA, 19 nt, Human
ggggucucaugaccuaaaa

SEQ ID NO: 1372138 - RNA, 24 nt, Human
uagccugggccuauguuucuccca

SEQ ID NO: 1372139 - RNA, 18 nt, Human
uaguaugcuaacaagcag

SEQ ID NO: 1372140 - RNA, 22 nt, Human
uauaacaaaagccuaaaacaag

SEQ ID NO: 1372141 - RNA, 19 nt, Human
uaucacagaacccgaguuu

SEQ ID NO: 1372142 - RNA, 19 nt, Human
uauggccugccuuggggag

SEQ ID NO: 1372143 - RNA, 23 nt, Human
uauuauguuuauucauaauuuga

SEQ ID NO: 1372144 - RNA, 21 nt, Human
ucacccgggcacccgcacccc

SEQ ID NO: 1372145 - RNA, 20 nt, Human
uccgccccucacccgggcac

SEQ ID NO: 1372146 - RNA, 27 nt, Human
ucucccauaaauaaaggacagcagaga

SEQ ID NO: 1372147 - RNA, 21 nt, Human
ucucuaaaccugucuucuugg

SEQ ID NO: 1372148 - RNA, 24 nt, Human
ucuguugggcuuuuguaaacaaug

SEQ ID NO: 1372149 - RNA, 23 nt, Human
ucuuccucucagguauggggcag

SEQ ID NO: 1372150 - RNA, 18 nt, Human
ugaaaugggggucucaug

SEQ ID NO: 1372151 - RNA, 19 nt, Human
ugagaaacugcagccauca

SEQ ID NO: 1372152 - RNA, 19 nt, Human
ugaggcccgaagugcccaa

SEQ ID NO: 1372153 - RNA, 21 nt, Human
ugauugaagcauggacaacac

SEQ ID NO: 1372154 - RNA, 21 nt, Human
ugcauagggugagguauagaa

SEQ ID NO: 1372155 - RNA, 22 nt, Human
uggagaaaugggauuggacaaa

SEQ ID NO: 1372156 - RNA, 21 nt, Human
uggauagggaugauugaagca

SEQ ID NO: 1372157 - RNA, 25 nt, Human
uggcaugaggcuuuaguuagcccau

SEQ ID NO: 1372158 - RNA, 24 nt, Human
uguucuguucuccgaaagcucucu

SEQ ID NO: 1372159 - RNA, 19 nt, Human
uuauggagaccucauugga

SEQ ID NO: 1372160 - RNA, 20 nt, Human
uucucccauaaauaaaggac

SEQ ID NO: 1372161 - RNA, 18 nt, Human
uuuguaaacaaugaaaau

SEQ ID NO: 1372162 - RNA, 22 nt, Human
uuuuuauggccaacuggaagau

SEQ ID NO: 1372163 - RNA, 21 nt, Human
uuuuuuuuuuuuuuuccguuu

SEQ ID NO: 1372164 - RNA, 21 nt, Human
aaaccagcacuagaugugcaa

SEQ ID NO: 1372165 - RNA, 20 nt, Human
aaaguuucuagggcagcaug

SEQ ID NO: 1372166 - RNA, 23 nt, Human
aacccccacaagcacacacgcac

SEQ ID NO: 1372167 - RNA, 23 nt, Human
aaucuggccaucaaugcagccag

SEQ ID NO: 1372168 - RNA, 21 nt, Human
acaaaaguuucuagggcagca

SEQ ID NO: 1372169 - RNA, 23 nt, Human
acacacacucucucacagacaua

SEQ ID NO: 1372170 - RNA, 18 nt, Human
acacacuacccaaccccc

SEQ ID NO: 1372171 - RNA, 18 nt, Human
acacacuacccaaccccc

SEQ ID NO: 1372172 - RNA, 22 nt, Human
acacacucucucacagacauaa

SEQ ID NO: 1372173 - RNA, 23 nt, Human
acacgcacgcacacacacacaca

SEQ ID NO: 1372174 - RNA, 22 nt, Human
acacuacccaacccccacaagc

SEQ ID NO: 1372175 - RNA, 19 nt, Human
acgcacacacacacacaca

SEQ ID NO: 1372176 - RNA, 29 nt, Human
acgcacgcacacacacacacacacucucu

SEQ ID NO: 1372177 - RNA, 20 nt, Human
acugugcugacugagcacgg

SEQ ID NO: 1372178 - RNA, 22 nt, Human
agaauuaaaaacaaaaacaaac

SEQ ID NO: 1372179 - RNA, 24 nt, Human
agcccccuaaaauguacaaacuaa

SEQ ID NO: 1372180 - RNA, 20 nt, Human
agucaauggucaagacaguu

SEQ ID NO: 1372181 - RNA, 23 nt, Human
auuaaauaagcaaaagcaaaaau

SEQ ID NO: 1372182 - RNA, 23 nt, Human
caagagcaguauuuccaacaaag

SEQ ID NO: 1372183 - RNA, 19 nt, Human
cacacacacuacccaaccc

SEQ ID NO: 1372184 - RNA, 21 nt, Human
cacacacacuacccaaccccc

SEQ ID NO: 1372185 - RNA, 22 nt, Human
cacacacgcacgcacacacaca

SEQ ID NO: 1372186 - RNA, 20 nt, Human
cacacgcacgcacacacaca

SEQ ID NO: 1372187 - RNA, 23 nt, Human
caccgagaccagaauuaaaaaca

SEQ ID NO: 1372188 - RNA, 19 nt, Human
cagcagaacaccuuuuucu

SEQ ID NO: 1372189 - RNA, 21 nt, Human
cagcaugaauauaaaccaugu

SEQ ID NO: 1372190 - RNA, 20 nt, Human
cauagucaauggucaagaca

SEQ ID NO: 1372191 - RNA, 21 nt, Human
cauccaaugccugucggccac

SEQ ID NO: 1372192 - RNA, 23 nt, Human
caugguaaugaacuccaggaaga

SEQ ID NO: 1372193 - RNA, 22 nt, Human
cauuuacaaucacauccuguuc

SEQ ID NO: 1372194 - RNA, 23 nt, Human
ccaacccccacaagcacacacgc

SEQ ID NO: 1372195 - RNA, 19 nt, Human
ccacaagcacacacgcacg

SEQ ID NO: 1372196 - RNA, 33 nt, Human
ccccacaagcacacacgcacgcacacacacagu

SEQ ID NO: 1372197 - RNA, 28 nt, Human
cgcacacacacacacacacucucucaca

SEQ ID NO: 1372198 - RNA, 22 nt, Human
cuuccaucacugaaugaaaauc

SEQ ID NO: 1372199 - RNA, 18 nt, Human
cuuuucccagauccuuaa

SEQ ID NO: 1372200 - RNA, 28 nt, Human
gaaaauacacacacacuacccaaccccc

SEQ ID NO: 1372201 - RNA, 18 nt, Human
gaauuuauagacugugcu

SEQ ID NO: 1372202 - RNA, 25 nt, Human
gcacacacgcacgcacacacacaca

SEQ ID NO: 1372203 - RNA, 21 nt, Human
gcacacacgcacgcacacagu

SEQ ID NO: 1372204 - RNA, 25 nt, Human
gcacgcacacacacacacacacucu

SEQ ID NO: 1372205 - RNA, 18 nt, Human
ggcagcaugaauauaaac

SEQ ID NO: 1372206 - RNA, 19 nt, Human
gucagguuuacaauuguuc

SEQ ID NO: 1372207 - RNA, 19 nt, Human
uaagaaacugugucauagu

SEQ ID NO: 1372208 - RNA, 18 nt, Human
uaagcuaaggaaaacaua

SEQ ID NO: 1372209 - RNA, 20 nt, Human
uaagcuaaggaaaacauaca

SEQ ID NO: 1372210 - RNA, 22 nt, Human
uacacacacacuacccaacccc

SEQ ID NO: 1372211 - RNA, 24 nt, Human
uacacacacacuacccaaccccca

SEQ ID NO: 1372212 - RNA, 28 nt, Human
uacauaaaagaaaguuaauaaggacagu

SEQ ID NO: 1372213 - RNA, 30 nt, Human
uauuaaacuucuucucuuuucccagauccu

SEQ ID NO: 1372214 - RNA, 22 nt, Human
ucaagacaguucagcaagagca

SEQ ID NO: 1372215 - RNA, 22 nt, Human
ucaauggucaagacaguucagc

SEQ ID NO: 1372216 - RNA, 23 nt, Human
ucuagguucugcauccaaugccu

SEQ ID NO: 1372217 - RNA, 21 nt, Human
ucucucacagacauaaagagu

SEQ ID NO: 1372218 - RNA, 18 nt, Human
ugaaaccagcacuagaug

SEQ ID NO: 1372219 - RNA, 21 nt, Human
ugacagaacagguucugagga

SEQ ID NO: 1372220 - RNA, 23 nt, Human
ugagagacugagacucuuccagu

SEQ ID NO: 1372221 - RNA, 24 nt, Human
ugagagacugagacucuuccauca

SEQ ID NO: 1372222 - RNA, 23 nt, Human
ugauucaggaggucgaaggaaaa

SEQ ID NO: 1372223 - RNA, 21 nt, Human
uggaauaucaccauaagcuaa

SEQ ID NO: 1372224 - RNA, 20 nt, Human
uggcucuagguucugcaucc

SEQ ID NO: 1372225 - RNA, 24 nt, Human
uggcuuuuuuguuuguuuguuuua

SEQ ID NO: 1372226 - RNA, 22 nt, Human
ugggaguuucuccuuguuuuuu

SEQ ID NO: 1372227 - RNA, 20 nt, Human
uggucaagacaguucagcaa

SEQ ID NO: 1372228 - RNA, 18 nt, Human
uuaaagggagauccaaag

SEQ ID NO: 1372229 - RNA, 21 nt, Human
uuaaauuucugaaaccagcac

SEQ ID NO: 1372230 - RNA, 23 nt, Human
uuaaauuucugaaaccagcacua

SEQ ID NO: 1372231 - RNA, 22 nt, Human
uuaguacaugguaaugaacucc

SEQ ID NO: 1372232 - RNA, 21 nt, Human
uucauugggaguuucuccuug

SEQ ID NO: 1372233 - RNA, 24 nt, Human
uucugcucucuauggcuuuuuugu

SEQ ID NO: 1372234 - RNA, 26 nt, Human
uuuuuguuuguuuguuuuaaaauuuu

SEQ ID NO: 1372235 - RNA, 18 nt, Human
aaggccacagguggacug

SEQ ID NO: 1372236 - RNA, 22 nt, Human
aagguucuuguauucucacugc

SEQ ID NO: 1372237 - RNA, 20 nt, Human
accuagugcucccagacuca

SEQ ID NO: 1372238 - RNA, 21 nt, Human
accuugacucccagccagcuc

SEQ ID NO: 1372239 - RNA, 23 nt, Human
acucuacagacuggacaaggcca

SEQ ID NO: 1372240 - RNA, 24 nt, Human
acucugaguuccugagccccacaa

SEQ ID NO: 1372241 - RNA, 21 nt, Human
agacccgagggguggccuggu

SEQ ID NO: 1372242 - RNA, 21 nt, Human
agccuguugcuuuucagagaa

SEQ ID NO: 1372243 - RNA, 19 nt, Human
aggaaggaagggcaggcug

SEQ ID NO: 1372244 - RNA, 26 nt, Human
aggcaagaggugggaaggagggaccc

SEQ ID NO: 1372245 - RNA, 20 nt, Human
aggcaagaggugggaagggg

SEQ ID NO: 1372246 - RNA, 23 nt, Human
aggcaagaggugggaagggggac

SEQ ID NO: 1372247 - RNA, 19 nt, Human
aggccagggauggugggga

SEQ ID NO: 1372248 - RNA, 22 nt, Human
aggcuaccuggaaacccggaac

SEQ ID NO: 1372249 - RNA, 24 nt, Human
caccacguaggcuaccuggaaacc

SEQ ID NO: 1372250 - RNA, 18 nt, Human
cacgccugggucuccagg

SEQ ID NO: 1372251 - RNA, 19 nt, Human
cacguaggcuaccuggaaa

SEQ ID NO: 1372252 - RNA, 23 nt, Human
cagacuggacaaggccacaggug

SEQ ID NO: 1372253 - RNA, 25 nt, Human
cagagcucggccucucagagaccgc

SEQ ID NO: 1372254 - RNA, 22 nt, Human
cagggccaaggccgcugacacc

SEQ ID NO: 1372255 - RNA, 19 nt, Human
ccacagguggacuggaggc

SEQ ID NO: 1372256 - RNA, 22 nt, Human
ccaccaucuugccacccgggag

SEQ ID NO: 1372257 - RNA, 20 nt, Human
ccaggguccucaagggugug

SEQ ID NO: 1372258 - RNA, 22 nt, Human
cccugcaccuccagccauccac

SEQ ID NO: 1372259 - RNA, 18 nt, Human
ccucaagggggagacaga

SEQ ID NO: 1372260 - RNA, 21 nt, Human
ccucaagggggagacagaguc

SEQ ID NO: 1372261 - RNA, 21 nt, Human
ccucaaggguguggaggcaag

SEQ ID NO: 1372262 - RNA, 21 nt, Human
ccucaccucauguuccuccug

SEQ ID NO: 1372263 - RNA, 20 nt, Human
ccuccgggucccgcgccgcg

SEQ ID NO: 1372264 - RNA, 26 nt, Human
ccuccuggcccugcaccuccagccau

SEQ ID NO: 1372265 - RNA, 20 nt, Human
ccugcgcgccaccaucuugc

SEQ ID NO: 1372266 - RNA, 21 nt, Human
ccuggcccugcaccuccagcc

SEQ ID NO: 1372267 - RNA, 19 nt, Human
ccuguugcuuuucagagaa

SEQ ID NO: 1372268 - RNA, 21 nt, Human
ccuucacuccuggccugugug

SEQ ID NO: 1372269 - RNA, 22 nt, Human
cucagagaccgcugcaggcccu

SEQ ID NO: 1372270 - RNA, 27 nt, Human
cuccucuaggcacgccugggucuccag

SEQ ID NO: 1372271 - RNA, 25 nt, Human
cuccuggcccugcaccuccagccau

SEQ ID NO: 1372272 - RNA, 21 nt, Human
cugaagcacaagacccgaggg

SEQ ID NO: 1372273 - RNA, 24 nt, Human
cugcccaacuggauggaaaauaaa

SEQ ID NO: 1372274 - RNA, 21 nt, Human
cuucgaccuugacucccagcc

SEQ ID NO: 1372275 - RNA, 23 nt, Human
cuugacucccagccagcuccagc

SEQ ID NO: 1372276 - RNA, 22 nt, Human
cuuggcuucuggaacaccacgu

SEQ ID NO: 1372277 - RNA, 20 nt, Human
gacccgagggguggccuggu

SEQ ID NO: 1372278 - RNA, 19 nt, Human
gacuggaggcaggacaggc

SEQ ID NO: 1372279 - RNA, 22 nt, Human
gaggcaggacaggcucuccugc

SEQ ID NO: 1372280 - RNA, 18 nt, Human
gccacucuucacagggug

SEQ ID NO: 1372281 - RNA, 24 nt, Human
gcugaagcacaagacccgaggggu

SEQ ID NO: 1372282 - RNA, 18 nt, Human
ggaaggacaaguccuccu

SEQ ID NO: 1372283 - RNA, 19 nt, Human
ggacuggaggcaggacagg

SEQ ID NO: 1372284 - RNA, 21 nt, Human
ggcccaccuagccuuucccug

SEQ ID NO: 1372285 - RNA, 18 nt, Human
ggcuguuggacgcgaugg

SEQ ID NO: 1372286 - RNA, 26 nt, Human
gguguggaggcaagaggugggaagga

SEQ ID NO: 1372287 - RNA, 24 nt, Human
ucacauagagguagugagaagccu

SEQ ID NO: 1372288 - RNA, 19 nt, Human
ucagggccaaggccgcuga

SEQ ID NO: 1372289 - RNA, 21 nt, Human
uccaacuucaacaucugugac

SEQ ID NO: 1372290 - RNA, 23 nt, Human
uccugcgcgccaccaucuugcca

SEQ ID NO: 1372291 - RNA, 23 nt, Human
ucuaggcacgccugggucuccag

SEQ ID NO: 1372292 - RNA, 27 nt, Human
ucuccuggcuaauaauaaauauccagg

SEQ ID NO: 1372293 - RNA, 18 nt, Human
ucuguggacaccagcagg

SEQ ID NO: 1372294 - RNA, 21 nt, Human
ugaaaaaacuucgaccuugac

SEQ ID NO: 1372295 - RNA, 23 nt, Human
ugaggccagguggacuuggugcc

SEQ ID NO: 1372296 - RNA, 20 nt, Human
ugagggaaaaggaagcacag

SEQ ID NO: 1372297 - RNA, 23 nt, Human
uggaaaauaaaagguucuuguau

SEQ ID NO: 1372298 - RNA, 24 nt, Human
uggaaacccggaacuggcuuugga

SEQ ID NO: 1372299 - RNA, 18 nt, Human
uggaggaaggaagggcag

SEQ ID NO: 1372300 - RNA, 18 nt, Human
uucaacaucugugaccuc

SEQ ID NO: 1372301 - RNA, 24 nt, Human
uuccagggcugcuuucuccuggcu

SEQ ID NO: 1372302 - RNA, 18 nt, Human
uuucagagaacuugauug

SEQ ID NO: 1372303 - RNA, 19 nt, Human
uuugugaaugccacucuuc

SEQ ID NO: 1372304 - RNA, 22 nt, Human
uuugugaaugccacucuucaca

SEQ ID NO: 1372305 - RNA, 18 nt, Human
cagccuacagccucuccu

SEQ ID NO: 1372306 - RNA, 21 nt, Human
cagccuacagccucuccucag

SEQ ID NO: 1372307 - RNA, 18 nt, Human
caucgcauuugagccccc

SEQ ID NO: 1372308 - RNA, 25 nt, Human
cccgcgcgcguuaccguggcgaccg

SEQ ID NO: 1372309 - RNA, 20 nt, Human
ccucaggaggacagaggggg

SEQ ID NO: 1372310 - RNA, 26 nt, Human
cgacaggcacagccuacagccucucc

SEQ ID NO: 1372311 - RNA, 24 nt, Human
cuccucaggaggacagaggggguc

SEQ ID NO: 1372312 - RNA, 20 nt, Human
uaccguggcgaccgaggccc

SEQ ID NO: 1372313 - RNA, 23 nt, Human
ucaaagcacguugcaaacaaauc

SEQ ID NO: 1372314 - RNA, 21 nt, Human
accucccucuugggcuccagc

SEQ ID NO: 1372315 - RNA, 24 nt, Human
accuccuccucccccuccuuccug

SEQ ID NO: 1372316 - RNA, 21 nt, Human
agaggaagacgcuggacagug

SEQ ID NO: 1372317 - RNA, 22 nt, Human
agaggcucuggggcucagcuac

SEQ ID NO: 1372318 - RNA, 19 nt, Human
agcuucugcaccaggaaga

SEQ ID NO: 1372319 - RNA, 21 nt, Human
aggagccagggagggcagagc

SEQ ID NO: 1372320 - RNA, 19 nt, Human
aggcgugaugggaggaggg

SEQ ID NO: 1372321 - RNA, 20 nt, Human
aggcgugaugggaggagggg

SEQ ID NO: 1372322 - RNA, 19 nt, Human
aggggcucgggccugggcc

SEQ ID NO: 1372323 - RNA, 19 nt, Human
agguggcucugguaugggg

SEQ ID NO: 1372324 - RNA, 19 nt, Human
aucucuggcaccuccuccu

SEQ ID NO: 1372325 - RNA, 23 nt, Human
caccuccuccucccccuccuucc

SEQ ID NO: 1372326 - RNA, 19 nt, Human
cacggaaggcucccccucc

SEQ ID NO: 1372327 - RNA, 21 nt, Human
cacuugccucugcuucucccg

SEQ ID NO: 1372328 - RNA, 21 nt, Human
cagagcaggggcagaggaaga

SEQ ID NO: 1372329 - RNA, 22 nt, Human
cagagccuucccgcacagggcu

SEQ ID NO: 1372330 - RNA, 20 nt, Human
cagcagcagcuuauucagcg

SEQ ID NO: 1372331 - RNA, 21 nt, Human
caggagccagggagggcagag

SEQ ID NO: 1372332 - RNA, 19 nt, Human
caucaaggggauuucugcc

SEQ ID NO: 1372333 - RNA, 20 nt, Human
ccacgcacugggccacgguc

SEQ ID NO: 1372334 - RNA, 20 nt, Human
ccacuggucagagccugugu

SEQ ID NO: 1372335 - RNA, 25 nt, Human
ccagagccuucccgcacagggcuga

SEQ ID NO: 1372336 - RNA, 22 nt, Human
ccagcaccagggaaaaugcugg

SEQ ID NO: 1372337 - RNA, 18 nt, Human
ccccaaagguuagagucc

SEQ ID NO: 1372338 - RNA, 19 nt, Human
ccccucuuccugcuccucc

SEQ ID NO: 1372339 - RNA, 20 nt, Human
ccccucuuccugcuccuccu

SEQ ID NO: 1372340 - RNA, 19 nt, Human
ccccuggggaaacguccug

SEQ ID NO: 1372341 - RNA, 21 nt, Human
ccccuggggaaacguccugcu

SEQ ID NO: 1372342 - RNA, 20 nt, Human
ccgcugcccgccugcugcgc

SEQ ID NO: 1372343 - RNA, 25 nt, Human
ccggcagacccaggggcguuggacu

SEQ ID NO: 1372344 - RNA, 23 nt, Human
ccuccucccccuccuuccugggc

SEQ ID NO: 1372345 - RNA, 19 nt, Human
ccucugcuucucccggcug

SEQ ID NO: 1372346 - RNA, 18 nt, Human
ccugggcuccuucaccuc

SEQ ID NO: 1372347 - RNA, 20 nt, Human
ccugggcuccuucaccuccc

SEQ ID NO: 1372348 - RNA, 23 nt, Human
ccugggcuccuucaccucccucu

SEQ ID NO: 1372349 - RNA, 20 nt, Human
cgggaggggcgaugaaagug

SEQ ID NO: 1372350 - RNA, 18 nt, Human
cuaguccaggagccaggg

SEQ ID NO: 1372351 - RNA, 20 nt, Human
cuccuccucccccuccuucc

SEQ ID NO: 1372352 - RNA, 24 nt, Human
cucucgccccucuuccugcuccuc

SEQ ID NO: 1372353 - RNA, 22 nt, Human
cucuggcaccuccuccuccccc

SEQ ID NO: 1372354 - RNA, 26 nt, Human
cucuuggaucucuggcaccuccuccu

SEQ ID NO: 1372355 - RNA, 21 nt, Human
cugcgcucucgccccucuucc

SEQ ID NO: 1372356 - RNA, 20 nt, Human
cugcugcgcucucgccccuc

SEQ ID NO: 1372357 - RNA, 20 nt, Human
cugcuggcucuuccuuucuc

SEQ ID NO: 1372358 - RNA, 18 nt, Human
cuggaagccgggcucuag

SEQ ID NO: 1372359 - RNA, 21 nt, Human
cuggcucuuccuuucucuucc

SEQ ID NO: 1372360 - RNA, 19 nt, Human
cuucaaccucuuccugggc

SEQ ID NO: 1372361 - RNA, 19 nt, Human
cuugccucugcuucucccg

SEQ ID NO: 1372362 - RNA, 21 nt, Human
gagaggcucuggggcucagcu

SEQ ID NO: 1372363 - RNA, 20 nt, Human
gaggaggggcagggauggug

SEQ ID NO: 1372364 - RNA, 22 nt, Human
gauuucugccuggaaccgggag

SEQ ID NO: 1372365 - RNA, 22 nt, Human
gccucucuucacuuggggacuc

SEQ ID NO: 1372366 - RNA, 18 nt, Human
gccuuuguugaacagcuu

SEQ ID NO: 1372367 - RNA, 20 nt, Human
gcucagagggguggucagcu

SEQ ID NO: 1372368 - RNA, 23 nt, Human
gcucgggccugggccgcugcuuu

SEQ ID NO: 1372369 - RNA, 19 nt, Human
gcucuuccuuucucuucca

SEQ ID NO: 1372370 - RNA, 20 nt, Human
gcugaggauggggggcggcg

SEQ ID NO: 1372371 - RNA, 19 nt, Human
ggaggaggggcagggaugg

SEQ ID NO: 1372372 - RNA, 20 nt, Human
ggaggaggggcagggauggu

SEQ ID NO: 1372373 - RNA, 19 nt, Human
ggccgcaggggcuucuuca

SEQ ID NO: 1372374 - RNA, 19 nt, Human
ggcgcaggcgagugcggcc

SEQ ID NO: 1372375 - RNA, 21 nt, Human
ggcgcagucgucacuuccucg

SEQ ID NO: 1372376 - RNA, 23 nt, Human
ggcugcucucuagguccucccau

SEQ ID NO: 1372377 - RNA, 20 nt, Human
gggcgcaggcgagugcggcc

SEQ ID NO: 1372378 - RNA, 21 nt, Human
gggcucuaguccaggagccag

SEQ ID NO: 1372379 - RNA, 21 nt, Human
gggcuucuucagcagcagcuu

SEQ ID NO: 1372380 - RNA, 20 nt, Human
guccugcuggaagccgggcu

SEQ ID NO: 1372381 - RNA, 21 nt, Human
guccugcuggaagccgggcuc

SEQ ID NO: 1372382 - RNA, 21 nt, Human
guggggccgcaggggcuucuu

SEQ ID NO: 1372383 - RNA, 20 nt, Human
uagcucaaagcuccgcucag

SEQ ID NO: 1372384 - RNA, 20 nt, Human
uaguccggagcagcgugcga

SEQ ID NO: 1372385 - RNA, 21 nt, Human
uagugcccuucgugacuuccc

SEQ ID NO: 1372386 - RNA, 22 nt, Human
ucaccucccucuugggcuccag

SEQ ID NO: 1372387 - RNA, 22 nt, Human
uccacuggucagagccugugua

SEQ ID NO: 1372388 - RNA, 21 nt, Human
ucccauggcugccacaccaag

SEQ ID NO: 1372389 - RNA, 23 nt, Human
ucccuuggcuucuccgaggccug

SEQ ID NO: 1372390 - RNA, 19 nt, Human
uccuccucccccuccuucc

SEQ ID NO: 1372391 - RNA, 19 nt, Human
ucucccggcugcucucuag

SEQ ID NO: 1372392 - RNA, 19 nt, Human
ucucuggcaccuccuccuc

SEQ ID NO: 1372393 - RNA, 21 nt, Human
ucucuggcaccuccuccuccc

SEQ ID NO: 1372394 - RNA, 22 nt, Human
ucuuccugcuccuccuucucuu

SEQ ID NO: 1372395 - RNA, 19 nt, Human
ugaaguagaggccagagcc

SEQ ID NO: 1372396 - RNA, 21 nt, Human
ugaggggcucgggccugggcc

SEQ ID NO: 1372397 - RNA, 21 nt, Human
ugccuggaaccgggagcccac

SEQ ID NO: 1372398 - RNA, 20 nt, Human
ugcggccgauuuucaccugc

SEQ ID NO: 1372399 - RNA, 19 nt, Human
ugcucggaggggugcgggg

SEQ ID NO: 1372400 - RNA, 21 nt, Human
ugcuggaagccgggcucuagu

SEQ ID NO: 1372401 - RNA, 23 nt, Human
ugcuuugguuuccgcacggaagg

SEQ ID NO: 1372402 - RNA, 23 nt, Human
uggacagugaggucggacacugg

SEQ ID NO: 1372403 - RNA, 21 nt, Human
uggaucucuggcaccuccucc

SEQ ID NO: 1372404 - RNA, 26 nt, Human
uggcucgaugcucacugggguggccu

SEQ ID NO: 1372405 - RNA, 22 nt, Human
ugggaggaggggcagggauggu

SEQ ID NO: 1372406 - RNA, 19 nt, Human
ugggcuccuucaccucccu

SEQ ID NO: 1372407 - RNA, 18 nt, Human
uggggccgcaggggcuuc

SEQ ID NO: 1372408 - RNA, 19 nt, Human
ugguuggugccagcaccag

SEQ ID NO: 1372409 - RNA, 22 nt, Human
ugguuggugccagcaccaggga

SEQ ID NO: 1372410 - RNA, 18 nt, Human
uuagagucccauugcggc

SEQ ID NO: 1372411 - RNA, 21 nt, Human
uucaacagucgcccauccccu

SEQ ID NO: 1372412 - RNA, 23 nt, Human
uucccuuggcuucuccgaggccu

SEQ ID NO: 1372413 - RNA, 24 nt, Human
uuccugcuccuccuucucuuggau

SEQ ID NO: 1372414 - RNA, 24 nt, Human
uuccugggcuccuucaccucccuc

SEQ ID NO: 1372415 - RNA, 21 nt, Human
uugcggccgauuuucaccugc

SEQ ID NO: 1372416 - RNA, 22 nt, Human
uuggaucucuggcaccuccucc

SEQ ID NO: 1372417 - RNA, 25 nt, Human
aaaaaacagauauacauuucgagaa

SEQ ID NO: 1372418 - RNA, 24 nt, Human
aaagaacccauccaaucaacaugu

SEQ ID NO: 1372419 - RNA, 19 nt, Human
aaagcaggacuucgaccuu

SEQ ID NO: 1372420 - RNA, 19 nt, Human
aaaguccuuucugucaccu

SEQ ID NO: 1372421 - RNA, 24 nt, Human
aaagugcugggauuacaggcguga

SEQ ID NO: 1372422 - RNA, 26 nt, Human
aagcgauucucgugccucaggccccc

SEQ ID NO: 1372423 - RNA, 20 nt, Human
aaguagcugggacuauaggc

SEQ ID NO: 1372424 - RNA, 22 nt, Human
aaguagcugggacuauaggcau

SEQ ID NO: 1372425 - RNA, 24 nt, Human
aaguagcugggacuauaggcaugc

SEQ ID NO: 1372426 - RNA, 19 nt, Human
aagugcugggauuacaggc

SEQ ID NO: 1372427 - RNA, 19 nt, Human
aagugcugggauuacaggc

SEQ ID NO: 1372428 - RNA, 26 nt, Human
aagugcugggauuacaggcgugagcc

SEQ ID NO: 1372429 - RNA, 24 nt, Human
aauuuuuguauuuuaguagagaca

SEQ ID NO: 1372430 - RNA, 20 nt, Human
acaggguuucaccauauugg

SEQ ID NO: 1372431 - RNA, 24 nt, Human
acaggguuucaccauauuggccag

SEQ ID NO: 1372432 - RNA, 25 nt, Human
acucuguugcccaggcuggagugca

SEQ ID NO: 1372433 - RNA, 21 nt, Human
acugccaugacugagucaaau

SEQ ID NO: 1372434 - RNA, 19 nt, Human
agaaagcaggacuucgacc

SEQ ID NO: 1372435 - RNA, 22 nt, Human
agcaaaugggacuaucauaaga

SEQ ID NO: 1372436 - RNA, 22 nt, Human
agcgauucucgugccucaggcc

SEQ ID NO: 1372437 - RNA, 22 nt, Human
aggcuaagaagguucaagucug

SEQ ID NO: 1372438 - RNA, 19 nt, Human
aggcuggagugcaguggca

SEQ ID NO: 1372439 - RNA, 20 nt, Human
agggagcuugguuucggacc

SEQ ID NO: 1372440 - RNA, 20 nt, Human
agugcaguggcauaauuucg

SEQ ID NO: 1372441 - RNA, 24 nt, Human
agugcaguggcauaauuucggcuc

SEQ ID NO: 1372442 - RNA, 20 nt, Human
auaaguggugaagaacucca

SEQ ID NO: 1372443 - RNA, 22 nt, Human
aucccguuucucuugucuuuca

SEQ ID NO: 1372444 - RNA, 24 nt, Human
augauccaccugccucggccuccc

SEQ ID NO: 1372445 - RNA, 19 nt, Human
augggcuagauuuucagau

SEQ ID NO: 1372446 - RNA, 24 nt, Human
caaagugcugggauuacaggcgug

SEQ ID NO: 1372447 - RNA, 23 nt, Human
caaccuccaccucccgaauucaa

SEQ ID NO: 1372448 - RNA, 18 nt, Human
caccauauuggccaggau

SEQ ID NO: 1372449 - RNA, 22 nt, Human
caccauauuggccaggaugguc

SEQ ID NO: 1372450 - RNA, 24 nt, Human
caccauauuggccaggauggucuc

SEQ ID NO: 1372451 - RNA, 23 nt, Human
caccgggaagggagcuugguuuc

SEQ ID NO: 1372452 - RNA, 23 nt, Human
caccugccucggccucccaaagu

SEQ ID NO: 1372453 - RNA, 22 nt, Human
cacucuguugcccaggcuggag

SEQ ID NO: 1372454 - RNA, 21 nt, Human
cacugcaaccuccaccucccg

SEQ ID NO: 1372455 - RNA, 19 nt, Human
cagaaucuacuuggucucu

SEQ ID NO: 1372456 - RNA, 24 nt, Human
cagagucucacucuguugcccagg

SEQ ID NO: 1372457 - RNA, 21 nt, Human
caggcccccaaguagcuggga

SEQ ID NO: 1372458 - RNA, 24 nt, Human
caggguuucaccauauuggccagg

SEQ ID NO: 1372459 - RNA, 23 nt, Human
caugcaccaucaugcccagcuaa

SEQ ID NO: 1372460 - RNA, 21 nt, Human
caugcccagcuaauuuuugua

SEQ ID NO: 1372461 - RNA, 22 nt, Human
ccaaagugcugggauuacaggc

SEQ ID NO: 1372462 - RNA, 22 nt, Human
ccaaagugcugggauuacaggc

SEQ ID NO: 1372463 - RNA, 24 nt, Human
ccaaagugcugggauuacaggcgu

SEQ ID NO: 1372464 - RNA, 24 nt, Human
ccaccucccgaauucaagcgauuc

SEQ ID NO: 1372465 - RNA, 18 nt, Human
ccaggacauccuguccgc

SEQ ID NO: 1372466 - RNA, 19 nt, Human
cccaaguagcugggacuau

SEQ ID NO: 1372467 - RNA, 24 nt, Human
cccaaguagcugggacuauaggca

SEQ ID NO: 1372468 - RNA, 24 nt, Human
ccccaaguagcugggacuauaggc

SEQ ID NO: 1372469 - RNA, 21 nt, Human
ccguaagauccuggggcuccu

SEQ ID NO: 1372470 - RNA, 24 nt, Human
ccucucccaagcaagcagugaggu

SEQ ID NO: 1372471 - RNA, 20 nt, Human
ccugaaucacuuccagaaau

SEQ ID NO: 1372472 - RNA, 18 nt, Human
cuaugauccaccugccuc

SEQ ID NO: 1372473 - RNA, 24 nt, Human
cucacucuguugcccaggcuggag

SEQ ID NO: 1372474 - RNA, 24 nt, Human
cucacugcaaccuccaccucccga

SEQ ID NO: 1372475 - RNA, 23 nt, Human
cugcaaccuccaccucccgaauu

SEQ ID NO: 1372476 - RNA, 24 nt, Human
cugcaaccuccaccucccgaauuc

SEQ ID NO: 1372477 - RNA, 23 nt, Human
cugccucggccucccaaagugcu

SEQ ID NO: 1372478 - RNA, 19 nt, Human
cuggucuccucacaucgua

SEQ ID NO: 1372479 - RNA, 18 nt, Human
cuugaagcuguaacagau

SEQ ID NO: 1372480 - RNA, 22 nt, Human
cuugcugcugaauguccucaga

SEQ ID NO: 1372481 - RNA, 24 nt, Human
cuugcugcugaauguccucagacg

SEQ ID NO: 1372482 - RNA, 23 nt, Human
gaaguuuuaaaaaacagauauac

SEQ ID NO: 1372483 - RNA, 21 nt, Human
gaccuaugauccaccugccuc

SEQ ID NO: 1372484 - RNA, 21 nt, Human
gaccuaugauccaccugccuc

SEQ ID NO: 1372485 - RNA, 22 nt, Human
gagccaccaugcccggccccag

SEQ ID NO: 1372486 - RNA, 20 nt, Human
gaggggacaaucccaccauc

SEQ ID NO: 1372487 - RNA, 25 nt, Human
gauaaguggugaagaacuccaugaa

SEQ ID NO: 1372488 - RNA, 18 nt, Human
gauuacaggcgugagcca

SEQ ID NO: 1372489 - RNA, 21 nt, Human
gauuacaggcgugagccacca

SEQ ID NO: 1372490 - RNA, 24 nt, Human
gauuacaggcgugagccaccaugc

SEQ ID NO: 1372491 - RNA, 22 nt, Human
gcaaccuccaccucccgaauuc

SEQ ID NO: 1372492 - RNA, 22 nt, Human
gcccagcuaauuuuuguauuuu

SEQ ID NO: 1372493 - RNA, 24 nt, Human
gcccaggcuggagugcaguggcau

SEQ ID NO: 1372494 - RNA, 19 nt, Human
gcgugagccaccaugcccg

SEQ ID NO: 1372495 - RNA, 24 nt, Human
ggacuauaggcaugcaccaucaug

SEQ ID NO: 1372496 - RNA, 24 nt, Human
ggauuacaggcgugagccaccaug

SEQ ID NO: 1372497 - RNA, 20 nt, Human
gggagagggcaguccuggag

SEQ ID NO: 1372498 - RNA, 22 nt, Human
ggggagagggcaguccuggagg

SEQ ID NO: 1372499 - RNA, 19 nt, Human
ggggcugggaaguaaggaa

SEQ ID NO: 1372500 - RNA, 24 nt, Human
gguuucaccauauuggccaggaug

SEQ ID NO: 1372501 - RNA, 22 nt, Human
gucacaacugacugccaugacu

SEQ ID NO: 1372502 - RNA, 24 nt, Human
gugaggugugcauuguuagaggug

SEQ ID NO: 1372503 - RNA, 20 nt, Human
gugcauuguuagaggugcac

SEQ ID NO: 1372504 - RNA, 22 nt, Human
gugccucaggcccccaaguagc

SEQ ID NO: 1372505 - RNA, 19 nt, Human
uaaaaaacagauauacauu

SEQ ID NO: 1372506 - RNA, 21 nt, Human
uaacugcaaugauccuugggu

SEQ ID NO: 1372507 - RNA, 19 nt, Human
uaaguggugaagaacucca

SEQ ID NO: 1372508 - RNA, 23 nt, Human
uaauuuuuguauuuuaguagaga

SEQ ID NO: 1372509 - RNA, 23 nt, Human
uacaggcgugagccaccaugccc

SEQ ID NO: 1372510 - RNA, 20 nt, Human
uagaagguggggcugggaag

SEQ ID NO: 1372511 - RNA, 20 nt, Human
uagagacaggguuucaccau

SEQ ID NO: 1372512 - RNA, 19 nt, Human
uaguagagacaggguuuca

SEQ ID NO: 1372513 - RNA, 26 nt, Human
uaguagagacaggguuucaccauauu

SEQ ID NO: 1372514 - RNA, 19 nt, Human
uaucauaagagguauagaa

SEQ ID NO: 1372515 - RNA, 21 nt, Human
ucaaccaaaugggaacuccua

SEQ ID NO: 1372516 - RNA, 26 nt, Human
ucacauuggucuuuagacaaccuugg

SEQ ID NO: 1372517 - RNA, 24 nt, Human
ucaccauauuggccaggauggucu

SEQ ID NO: 1372518 - RNA, 24 nt, Human
ucacucuguugcccaggcuggagu

SEQ ID NO: 1372519 - RNA, 18 nt, Human
ucacugcaaccuccaccu

SEQ ID NO: 1372520 - RNA, 19 nt, Human
ucacugcaaccuccaccuc

SEQ ID NO: 1372521 - RNA, 22 nt, Human
ucacugcaaccuccaccucccg

SEQ ID NO: 1372522 - RNA, 26 nt, Human
ucacugcaaccuccaccucccgaauu

SEQ ID NO: 1372523 - RNA, 19 nt, Human
ucagauuuuaacagagaca

SEQ ID NO: 1372524 - RNA, 20 nt, Human
ucagcuggggauucugggaa

SEQ ID NO: 1372525 - RNA, 24 nt, Human
ucccaaagugcugggauuacaggc

SEQ ID NO: 1372526 - RNA, 21 nt, Human
ucccgaauucaagcgauucuc

SEQ ID NO: 1372527 - RNA, 18 nt, Human
ucggccucccaaagugcu

SEQ ID NO: 1372528 - RNA, 23 nt, Human
ucucacucuguugcccaggcugg

SEQ ID NO: 1372529 - RNA, 24 nt, Human
ucucacucuguugcccaggcugga

SEQ ID NO: 1372530 - RNA, 26 nt, Human
ucucacucuguugcccaggcuggagu

SEQ ID NO: 1372531 - RNA, 27 nt, Human
ucucacucuguugcccaggcuggagug

SEQ ID NO: 1372532 - RNA, 21 nt, Human
ucucuggucuccucacaucgu

SEQ ID NO: 1372533 - RNA, 24 nt, Human
ucucuggucuccucacaucguaaa

SEQ ID NO: 1372534 - RNA, 24 nt, Human
ucuguugcccaggcuggagugcag

SEQ ID NO: 1372535 - RNA, 23 nt, Human
ugaaaagcaaaugggacuaucau

SEQ ID NO: 1372536 - RNA, 18 nt, Human
ugagacagagucucacuc

SEQ ID NO: 1372537 - RNA, 22 nt, Human
ugagacagagucucacucuguu

SEQ ID NO: 1372538 - RNA, 18 nt, Human
ugcccaggcuggagugca

SEQ ID NO: 1372539 - RNA, 21 nt, Human
ugcccaggcuggagugcagug

SEQ ID NO: 1372540 - RNA, 22 nt, Human
ugcccaggcuggagugcagugg

SEQ ID NO: 1372541 - RNA, 24 nt, Human
ugcccaggcuggagugcaguggca

SEQ ID NO: 1372542 - RNA, 21 nt, Human
ugccucaggcccccaaguagc

SEQ ID NO: 1372543 - RNA, 24 nt, Human
ugccucaggcccccaaguagcugg

SEQ ID NO: 1372544 - RNA, 21 nt, Human
ugccucggccucccaaagugc

SEQ ID NO: 1372545 - RNA, 24 nt, Human
ugccucggccucccaaagugcugg

SEQ ID NO: 1372546 - RNA, 24 nt, Human
ugcugggauuacaggcgugagcca

SEQ ID NO: 1372547 - RNA, 23 nt, Human
uggagugcaguggcauaauuucg

SEQ ID NO: 1372548 - RNA, 24 nt, Human
uggagugcaguggcauaauuucgg

SEQ ID NO: 1372549 - RNA, 24 nt, Human
uggccaggauggucucgaucuuuu

SEQ ID NO: 1372550 - RNA, 21 nt, Human
ugggacuauaggcaugcacca

SEQ ID NO: 1372551 - RNA, 22 nt, Human
ugggacuauaggcaugcaccau

SEQ ID NO: 1372552 - RNA, 18 nt, Human
ugggauuacaggcgugag

SEQ ID NO: 1372553 - RNA, 22 nt, Human
ugggauuacaggcgugagccac

SEQ ID NO: 1372554 - RNA, 23 nt, Human
ugggauuacaggcgugagccacc

SEQ ID NO: 1372555 - RNA, 24 nt, Human
ugggauuacaggcgugagccacca

SEQ ID NO: 1372556 - RNA, 25 nt, Human
ugggauuacaggcgugagccaccau

SEQ ID NO: 1372557 - RNA, 19 nt, Human
uggguagagcagauucuuc

SEQ ID NO: 1372558 - RNA, 24 nt, Human
ugugcugucagaggggacaauccc

SEQ ID NO: 1372559 - RNA, 22 nt, Human
uguuagaggugcaccgggaagg

SEQ ID NO: 1372560 - RNA, 24 nt, Human
uuaguagagacaggguuucaccau

SEQ ID NO: 1372561 - RNA, 23 nt, Human
uucaagcgauucucgugccucag

SEQ ID NO: 1372562 - RNA, 21 nt, Human
uucucgugccucaggccccca

SEQ ID NO: 1372563 - RNA, 25 nt, Human
uucucgugccucaggcccccaagua

SEQ ID NO: 1372564 - RNA, 24 nt, Human
uugcccaggcuggagugcaguggc

SEQ ID NO: 1372565 - RNA, 22 nt, Human
uuggucuuuagacaaccuugga

SEQ ID NO: 1372566 - RNA, 19 nt, Human
uuucaccauauuggccagg

SEQ ID NO: 1372567 - RNA, 20 nt, Human
uuucaccauauuggccagga

SEQ ID NO: 1372568 - RNA, 19 nt, Human
uuucucuugucuuucaggc

SEQ ID NO: 1372569 - RNA, 23 nt, Human
uuuuaguagagacaggguuucac

SEQ ID NO: 1372570 - RNA, 19 nt, Human
uuuuuguauuuuaguagag

SEQ ID NO: 1372571 - RNA, 20 nt, Human
uuuuuuuuucugagacagag

SEQ ID NO: 1372572 - RNA, 26 nt, Human
uuuuuuuuuucugagacagagucuca

SEQ ID NO: 1372573 - RNA, 18 nt, Human
uuuuuuuuuuuuuuucug

SEQ ID NO: 1372574 - RNA, 21 nt, Human
aaagauuaagaaaaaccaagg

SEQ ID NO: 1372575 - RNA, 19 nt, Human
acaaaacauagugccauca

SEQ ID NO: 1372576 - RNA, 20 nt, Human
acuuuuuucuuuuuuucuuu

SEQ ID NO: 1372577 - RNA, 21 nt, Human
auacaaaacauagugccauca

SEQ ID NO: 1372578 - RNA, 23 nt, Human
auauagcaauaguuuucacaaga

SEQ ID NO: 1372579 - RNA, 21 nt, Human
aucagaaacuuagggauuuau

SEQ ID NO: 1372580 - RNA, 26 nt, Human
augaugaugcugacauaacuuuuuuc

SEQ ID NO: 1372581 - RNA, 23 nt, Human
caaauacacaaagauuaagaaaa

SEQ ID NO: 1372582 - RNA, 18 nt, Human
cagaaacuuagggauuua

SEQ ID NO: 1372583 - RNA, 21 nt, Human
cauugcacuuacaguaaauga

SEQ ID NO: 1372584 - RNA, 22 nt, Human
ccaguauucaugggucucuuuc

SEQ ID NO: 1372585 - RNA, 22 nt, Human
gcauauagcaauaguuuucaca

SEQ ID NO: 1372586 - RNA, 21 nt, Human
uaagaaaaaccaagggagcau

SEQ ID NO: 1372587 - RNA, 22 nt, Human
uagugccaucagcuuugucuaa

SEQ ID NO: 1372588 - RNA, 27 nt, Human
uauuuuguuguauuuuucaucuagagu

SEQ ID NO: 1372589 - RNA, 22 nt, Human
ugcaaauacacaaagauuaaga

SEQ ID NO: 1372590 - RNA, 20 nt, Human
uuuuucuuuuuuucuuucuu

SEQ ID NO: 1372591 - RNA, 23 nt, Human
aaccccagcccccuagguucugg

SEQ ID NO: 1372592 - RNA, 24 nt, Human
aagaaucugggggcuggcucagug

SEQ ID NO: 1372593 - RNA, 20 nt, Human
aagcacucagggaaauaggu

SEQ ID NO: 1372594 - RNA, 26 nt, Human
aagucucugacaugucuuuucaacuc

SEQ ID NO: 1372595 - RNA, 21 nt, Human
aaucugggggcuggcucagug

SEQ ID NO: 1372596 - RNA, 23 nt, Human
accacagccuggggcuggaagca

SEQ ID NO: 1372597 - RNA, 18 nt, Human
agccaaagaaucuggggg

SEQ ID NO: 1372598 - RNA, 20 nt, Human
agccauaggccucacucuac

SEQ ID NO: 1372599 - RNA, 25 nt, Human
agcuaaccccguguagauauuaugc

SEQ ID NO: 1372600 - RNA, 21 nt, Human
agcuggcagcaaccccagccc

SEQ ID NO: 1372601 - RNA, 23 nt, Human
agcugguagcagggacaggugcu

SEQ ID NO: 1372602 - RNA, 21 nt, Human
agcuguguucugaguuccacc

SEQ ID NO: 1372603 - RNA, 19 nt, Human
aggcagagguuucugugac

SEQ ID NO: 1372604 - RNA, 24 nt, Human
aggcagcaccacacccaggucugc

SEQ ID NO: 1372605 - RNA, 27 nt, Human
aggcaggaaucaaaauagaggggaccc

SEQ ID NO: 1372606 - RNA, 29 nt, Human
aggccuccagucgagcuggcagcaacccu

SEQ ID NO: 1372607 - RNA, 19 nt, Human
agggauugauccuggcuca

SEQ ID NO: 1372608 - RNA, 19 nt, Human
agugagguuuccucagucc

SEQ ID NO: 1372609 - RNA, 23 nt, Human
caaccccagcccccuagguucug

SEQ ID NO: 1372610 - RNA, 18 nt, Human
caccacacccaggucugc

SEQ ID NO: 1372611 - RNA, 21 nt, Human
caccuguacaauuccugcacu

SEQ ID NO: 1372612 - RNA, 19 nt, Human
cacucugcagccaaagaau

SEQ ID NO: 1372613 - RNA, 20 nt, Human
cagcaccacacccaggucug

SEQ ID NO: 1372614 - RNA, 20 nt, Human
cagcccccuagguucuggcc

SEQ ID NO: 1372615 - RNA, 21 nt, Human
cagccucuccuccccacacca

SEQ ID NO: 1372616 - RNA, 21 nt, Human
cagcgaagagaacauucaggu

SEQ ID NO: 1372617 - RNA, 19 nt, Human
cagggcagaggaacgugga

SEQ ID NO: 1372618 - RNA, 21 nt, Human
caggggcuuggaagauccuga

SEQ ID NO: 1372619 - RNA, 18 nt, Human
cauccucaggccgggagg

SEQ ID NO: 1372620 - RNA, 23 nt, Human
cauuagggaauuuuucaguagga

SEQ ID NO: 1372621 - RNA, 21 nt, Human
cauuuaucugcagaggcccug

SEQ ID NO: 1372622 - RNA, 22 nt, Human
cauuucaaguaccaacugcuuu

SEQ ID NO: 1372623 - RNA, 20 nt, Human
ccagggcagaggaacgugga

SEQ ID NO: 1372624 - RNA, 19 nt, Human
ccaggucucagccugugcu

SEQ ID NO: 1372625 - RNA, 19 nt, Human
ccccagcccccuagguucu

SEQ ID NO: 1372626 - RNA, 21 nt, Human
cccccuggacucaacaggggc

SEQ ID NO: 1372627 - RNA, 23 nt, Human
ccuggggcuggaagcaggccucc

SEQ ID NO: 1372628 - RNA, 21 nt, Human
ccuucauccucaggccgggag

SEQ ID NO: 1372629 - RNA, 27 nt, Human
cgagcuggcagcaaccccagcccccua

SEQ ID NO: 1372630 - RNA, 18 nt, Human
cgggaagggagggugugu

SEQ ID NO: 1372631 - RNA, 26 nt, Human
cguggacccagcgaugucagccucuc

SEQ ID NO: 1372632 - RNA, 19 nt, Human
cugacacugagaaacuggg

SEQ ID NO: 1372633 - RNA, 20 nt, Human
cugaggcugcaucagggucc

SEQ ID NO: 1372634 - RNA, 27 nt, Human
cuggaaguuacucugccugacuccuag

SEQ ID NO: 1372635 - RNA, 21 nt, Human
cuggcagcaaccccagccccc

SEQ ID NO: 1372636 - RNA, 20 nt, Human
cuggcgggaagggagggugu

SEQ ID NO: 1372637 - RNA, 18 nt, Human
gacccagcgaugucagcc

SEQ ID NO: 1372638 - RNA, 20 nt, Human
gagcccccuucauccucagg

SEQ ID NO: 1372639 - RNA, 21 nt, Human
gaggcuggggaaaggcaggaa

SEQ ID NO: 1372640 - RNA, 20 nt, Human
gagguuucugugaccuaaaa

SEQ ID NO: 1372641 - RNA, 25 nt, Human
gauuaaguaaaauagauuccucaaa

SEQ ID NO: 1372642 - RNA, 23 nt, Human
gcagagguuucugugaccuaaaa

SEQ ID NO: 1372643 - RNA, 19 nt, Human
gcagccccagccucccugu

SEQ ID NO: 1372644 - RNA, 18 nt, Human
gccccagccucccugugu

SEQ ID NO: 1372645 - RNA, 21 nt, Human
gccuggggcuggaagcaggcc

SEQ ID NO: 1372646 - RNA, 26 nt, Human
ggagaaaucagcccaaacucuggcgg

SEQ ID NO: 1372647 - RNA, 20 nt, Human
ggcucagaaauggugagcag

SEQ ID NO: 1372648 - RNA, 22 nt, Human
gggaggagauugaagucucuga

SEQ ID NO: 1372649 - RNA, 25 nt, Human
ggguguguguuugucuaaauaguuu

SEQ ID NO: 1372650 - RNA, 20 nt, Human
gucugugggagccugucugg

SEQ ID NO: 1372651 - RNA, 22 nt, Human
gugggaagcucucaguuccugc

SEQ ID NO: 1372652 - RNA, 19 nt, Human
uaaaagggcgcuaccugug

SEQ ID NO: 1372653 - RNA, 23 nt, Human
uagcagggacaggugcugggugg

SEQ ID NO: 1372654 - RNA, 20 nt, Human
ucaauuccucccaggucuca

SEQ ID NO: 1372655 - RNA, 18 nt, Human
ucagaucugugggugaca

SEQ ID NO: 1372656 - RNA, 18 nt, Human
ucagcacaggcucagagc

SEQ ID NO: 1372657 - RNA, 21 nt, Human
ucccugugugucucaugcccc

SEQ ID NO: 1372658 - RNA, 19 nt, Human
uccuaggugccaaggaguc

SEQ ID NO: 1372659 - RNA, 19 nt, Human
uccucaguccauacauggc

SEQ ID NO: 1372660 - RNA, 20 nt, Human
uccugggagcagccccagcc

SEQ ID NO: 1372661 - RNA, 20 nt, Human
uccugggagcagccccagcc

SEQ ID NO: 1372662 - RNA, 23 nt, Human
ucugcagccaaagaaucuggggg

SEQ ID NO: 1372663 - RNA, 19 nt, Human
ucuugugagccugcuuccu

SEQ ID NO: 1372664 - RNA, 22 nt, Human
ugaaaucugugaggccccucac

SEQ ID NO: 1372665 - RNA, 23 nt, Human
ugacuccuaggugccaaggaguc

SEQ ID NO: 1372666 - RNA, 23 nt, Human
ugagaaacugggugucucuggga

SEQ ID NO: 1372667 - RNA, 22 nt, Human
ugagaccagggauugauccugg

SEQ ID NO: 1372668 - RNA, 19 nt, Human
ugcaucaggguccuuggcc

SEQ ID NO: 1372669 - RNA, 19 nt, Human
ugcuggggaggagaggugg

SEQ ID NO: 1372670 - RNA, 21 nt, Human
ugcugggugggaagcucucag

SEQ ID NO: 1372671 - RNA, 18 nt, Human
ugcuuccuuuuccaagaa

SEQ ID NO: 1372672 - RNA, 18 nt, Human
uggaagauccugaggcug

SEQ ID NO: 1372673 - RNA, 21 nt, Human
uggaauaugucaucugugaca

SEQ ID NO: 1372674 - RNA, 22 nt, Human
uggacucaacaggggcuuggaa

SEQ ID NO: 1372675 - RNA, 18 nt, Human
uggcagcaaccccagccc

SEQ ID NO: 1372676 - RNA, 23 nt, Human
uggccaaaauucacacuggaagu

SEQ ID NO: 1372677 - RNA, 24 nt, Human
uggccaaaauucacacuggaaguu

SEQ ID NO: 1372678 - RNA, 18 nt, Human
uggccaggccacucugca

SEQ ID NO: 1372679 - RNA, 18 nt, Human
uggcucaccuggagugug

SEQ ID NO: 1372680 - RNA, 18 nt, Human
uggcucagugccaggcag

SEQ ID NO: 1372681 - RNA, 19 nt, Human
uggggaggagaggugggcu

SEQ ID NO: 1372682 - RNA, 19 nt, Human
ugucagccucuccucccca

SEQ ID NO: 1372683 - RNA, 19 nt, Human
ugugagccugcuuccuggg

SEQ ID NO: 1372684 - RNA, 18 nt, Human
ugugugaguuggccaggc

SEQ ID NO: 1372685 - RNA, 24 nt, Human
uguguguuugucuaaauaguuugg

SEQ ID NO: 1372686 - RNA, 20 nt, Human
uguguucccuccuuuaaccu

SEQ ID NO: 1372687 - RNA, 24 nt, Human
uuaaagccaccaaaggcauuuucc

SEQ ID NO: 1372688 - RNA, 18 nt, Human
uucacccccaucuaagug

SEQ ID NO: 1372689 - RNA, 24 nt, Human
uugauccuggcucaccuggagugu

SEQ ID NO: 1372690 - RNA, 19 nt, Human
uuggaagauccugaggcug

SEQ ID NO: 1372691 - RNA, 18 nt, Human
uuggucagccgcccuccu

SEQ ID NO: 1372692 - RNA, 18 nt, Human
uuuggcgcuuggucagcc

SEQ ID NO: 1372693 - RNA, 27 nt, Human
uuuuccagcaaccuuuaacauccuggg

SEQ ID NO: 1372694 - RNA, 20 nt, Human
aaaaagcaacaagaguuuaa

SEQ ID NO: 1372695 - RNA, 21 nt, Human
aaaacaaugucagucauuuuc

SEQ ID NO: 1372696 - RNA, 21 nt, Human
aaggcggccgccggcaccugc

SEQ ID NO: 1372697 - RNA, 19 nt, Human
aagugcugcuccaccaagc

SEQ ID NO: 1372698 - RNA, 24 nt, Human
agaaagacugggcuggggcagcua

SEQ ID NO: 1372699 - RNA, 19 nt, Human
agaaagagccaccgccucc

SEQ ID NO: 1372700 - RNA, 18 nt, Human
agaggaagaaaagucugg

SEQ ID NO: 1372701 - RNA, 18 nt, Human
agcacacaccuccucuuc

SEQ ID NO: 1372702 - RNA, 21 nt, Human
aggguaucuuuuaaaaguuuu

SEQ ID NO: 1372703 - RNA, 21 nt, Human
aguggacagagggcagggccu

SEQ ID NO: 1372704 - RNA, 21 nt, Human
aucucugggagaugaggcgcc

SEQ ID NO: 1372705 - RNA, 22 nt, Human
caacuccuccugcccggcggcc

SEQ ID NO: 1372706 - RNA, 26 nt, Human
cacguccuuccacgcgacugacucau

SEQ ID NO: 1372707 - RNA, 21 nt, Human
cacucuaacauagaggacagg

SEQ ID NO: 1372708 - RNA, 19 nt, Human
cagcuuaaccacagcucca

SEQ ID NO: 1372709 - RNA, 26 nt, Human
caguaaaugugcuucugaugcacucu

SEQ ID NO: 1372710 - RNA, 19 nt, Human
caguggagaaagugcgagg

SEQ ID NO: 1372711 - RNA, 26 nt, Human
cccaaacuaugucgagaggaagaaaa

SEQ ID NO: 1372712 - RNA, 21 nt, Human
ccccaaacuaugucgagagga

SEQ ID NO: 1372713 - RNA, 25 nt, Human
cccuucacacuccaaguuggaacag

SEQ ID NO: 1372714 - RNA, 24 nt, Human
ccucuuggcuacacacccaagacu

SEQ ID NO: 1372715 - RNA, 27 nt, Human
ccugacccauggccccaggcuaagggc

SEQ ID NO: 1372716 - RNA, 18 nt, Human
ccuggcugcuccagggag

SEQ ID NO: 1372717 - RNA, 19 nt, Human
ccugggcacgugggaaugu

SEQ ID NO: 1372718 - RNA, 20 nt, Human
cgacugccgcucccacuccc

SEQ ID NO: 1372719 - RNA, 18 nt, Human
cuacacacccaagacucc

SEQ ID NO: 1372720 - RNA, 22 nt, Human
cuccucuuggcuacacacccaa

SEQ ID NO: 1372721 - RNA, 23 nt, Human
cugauaaaggcaucguccuccuc

SEQ ID NO: 1372722 - RNA, 20 nt, Human
gaacgaguugaggcgucccc

SEQ ID NO: 1372723 - RNA, 24 nt, Human
gagagcaauucuuauccagaaauc

SEQ ID NO: 1372724 - RNA, 22 nt, Human
gagcaauucuuauccagaaauc

SEQ ID NO: 1372725 - RNA, 26 nt, Human
gccacgcuccacguccuuccacgcga

SEQ ID NO: 1372726 - RNA, 23 nt, Human
gcccuuggcuguccucggggcca

SEQ ID NO: 1372727 - RNA, 21 nt, Human
gccuggcugcuccagggagca

SEQ ID NO: 1372728 - RNA, 21 nt, Human
gcguucuccucaauaucuucc

SEQ ID NO: 1372729 - RNA, 18 nt, Human
gcucugggggucuagggc

SEQ ID NO: 1372730 - RNA, 22 nt, Human
gcuuaaccacagcuccaaacgc

SEQ ID NO: 1372731 - RNA, 20 nt, Human
ggcagggccucucuguucuc

SEQ ID NO: 1372732 - RNA, 19 nt, Human
gggaccucugcagcugcuc

SEQ ID NO: 1372733 - RNA, 20 nt, Human
gggcagcuagggauucucgc

SEQ ID NO: 1372734 - RNA, 18 nt, Human
gggcagggccucucuguu

SEQ ID NO: 1372735 - RNA, 19 nt, Human
gguggaggaugucaaacug

SEQ ID NO: 1372736 - RNA, 24 nt, Human
gugaaugccggggagaaagacugg

SEQ ID NO: 1372737 - RNA, 23 nt, Human
gugcuugaggaguccauagcuca

SEQ ID NO: 1372738 - RNA, 21 nt, Human
guggcgggguggcagacggca

SEQ ID NO: 1372739 - RNA, 23 nt, Human
uaagaaagagccaccgccuccuu

SEQ ID NO: 1372740 - RNA, 22 nt, Human
uauccagaaaucaucuagaaau

SEQ ID NO: 1372741 - RNA, 28 nt, Human
uauccagaaaucaucuagaaauaauuuu

SEQ ID NO: 1372742 - RNA, 25 nt, Human
ucagacacuugcacauucacacacc

SEQ ID NO: 1372743 - RNA, 21 nt, Human
ucagcuuaaccacagcuccaa

SEQ ID NO: 1372744 - RNA, 21 nt, Human
ucauacagacugucccaguaa

SEQ ID NO: 1372745 - RNA, 24 nt, Human
ucauacagacugucccaguaagcc

SEQ ID NO: 1372746 - RNA, 18 nt, Human
uccaccaagcugagaaga

SEQ ID NO: 1372747 - RNA, 24 nt, Human
uccagggucuccaaggaagaucuc

SEQ ID NO: 1372748 - RNA, 24 nt, Human
uccauagcucauggcuccucuugg

SEQ ID NO: 1372749 - RNA, 18 nt, Human
ucccagcuggcaaacgcc

SEQ ID NO: 1372750 - RNA, 21 nt, Human
ucccagcuggcaaacgccuca

SEQ ID NO: 1372751 - RNA, 22 nt, Human
uccccaaacuaugucgagagga

SEQ ID NO: 1372752 - RNA, 19 nt, Human
uccccuugguggguaggag

SEQ ID NO: 1372753 - RNA, 22 nt, Human
ucccggagcccaaaaaggcggc

SEQ ID NO: 1372754 - RNA, 20 nt, Human
ucccugagugaacgaguuga

SEQ ID NO: 1372755 - RNA, 18 nt, Human
ucuccaaggaagaucucu

SEQ ID NO: 1372756 - RNA, 25 nt, Human
ucuccaaggaagaucucugggagau

SEQ ID NO: 1372757 - RNA, 19 nt, Human
ucuguaaagggcgggacug

SEQ ID NO: 1372758 - RNA, 21 nt, Human
ucuuggcuacacacccaagac

SEQ ID NO: 1372759 - RNA, 21 nt, Human
ugagaagaaauggcccuuggc

SEQ ID NO: 1372760 - RNA, 20 nt, Human
ugccgcucccacucccgggg

SEQ ID NO: 1372761 - RNA, 21 nt, Human
ugcucgaaggcgcuggugcug

SEQ ID NO: 1372762 - RNA, 22 nt, Human
ugcucgaaggcgcuggugcugc

SEQ ID NO: 1372763 - RNA, 18 nt, Human
uggcaaacgccucaaaca

SEQ ID NO: 1372764 - RNA, 18 nt, Human
uggcacacucuuugacac

SEQ ID NO: 1372765 - RNA, 19 nt, Human
uggcgggguggcagacggc

SEQ ID NO: 1372766 - RNA, 20 nt, Human
ugggugaaccugagagaguu

SEQ ID NO: 1372767 - RNA, 21 nt, Human
uggugcugccgcccuggccug

SEQ ID NO: 1372768 - RNA, 27 nt, Human
uguaaagggcgggacuggcucuggggg

SEQ ID NO: 1372769 - RNA, 23 nt, Human
uguuaagaaagagccaccgccuc

SEQ ID NO: 1372770 - RNA, 24 nt, Human
uguuaagaaagagccaccgccucc

SEQ ID NO: 1372771 - RNA, 20 nt, Human
uucacacacccacacgcccc

SEQ ID NO: 1372772 - RNA, 23 nt, Human
uucacacacccacacgccccagg

SEQ ID NO: 1372773 - RNA, 18 nt, Human
uuccaguaguaaguaagu

SEQ ID NO: 1372774 - RNA, 19 nt, Human
uucuuauccagaaaucauc

SEQ ID NO: 1372775 - RNA, 22 nt, Human
uucuuuauccccuuggugggua

SEQ ID NO: 1372776 - RNA, 22 nt, Human
ccacggcaaggcugcgaacaca

SEQ ID NO: 1372777 - RNA, 21 nt, Human
aaaaagggagacauccagagc

SEQ ID NO: 1372778 - RNA, 25 nt, Human
aaacagacaugcaaguaggagagau

SEQ ID NO: 1372779 - RNA, 23 nt, Human
aaagugcugggauuacaggcaua

SEQ ID NO: 1372780 - RNA, 19 nt, Human
aacaagggaagacaaccau

SEQ ID NO: 1372781 - RNA, 19 nt, Human
aagugcugggauuacaggc

SEQ ID NO: 1372782 - RNA, 21 nt, Human
aagugcugggauuacaggcau

SEQ ID NO: 1372783 - RNA, 26 nt, Human
aagugcugggauuacaggcauaagcc

SEQ ID NO: 1372784 - RNA, 20 nt, Human
aauccuucccuuuuuuuuuu

SEQ ID NO: 1372785 - RNA, 19 nt, Human
aauggagggaccggcugga

SEQ ID NO: 1372786 - RNA, 21 nt, Human
acaaaaagggagacauccaga

SEQ ID NO: 1372787 - RNA, 25 nt, Human
acaaaaagggagacauccagagcug

SEQ ID NO: 1372788 - RNA, 21 nt, Human
acaauaugaaaucagugcacc

SEQ ID NO: 1372789 - RNA, 23 nt, Human
accuacucccuguucauacacgc

SEQ ID NO: 1372790 - RNA, 23 nt, Human
accucagccucccaaagugcugg

SEQ ID NO: 1372791 - RNA, 22 nt, Human
acugucuuuucauccaugagaa

SEQ ID NO: 1372792 - RNA, 19 nt, Human
agccaccacaccuggccua

SEQ ID NO: 1372793 - RNA, 22 nt, Human
agccaccacaccuggccuauac

SEQ ID NO: 1372794 - RNA, 24 nt, Human
aggugaucugcccaccucagccuc

SEQ ID NO: 1372795 - RNA, 19 nt, Human
agugcaguggugugaucuc

SEQ ID NO: 1372796 - RNA, 20 nt, Human
agugcaguggugugaucucg

SEQ ID NO: 1372797 - RNA, 23 nt, Human
agugcaguggugugaucucggcu

SEQ ID NO: 1372798 - RNA, 24 nt, Human
agugcaguggugugaucucggcuc

SEQ ID NO: 1372799 - RNA, 25 nt, Human
auuuuguuuccuuauacuucucuca

SEQ ID NO: 1372800 - RNA, 24 nt, Human
caaagugcugggauuacaggcaua

SEQ ID NO: 1372801 - RNA, 27 nt, Human
caaguguuucucaugccuuagccuccc

SEQ ID NO: 1372802 - RNA, 20 nt, Human
cacugcaaccuccaccuccc

SEQ ID NO: 1372803 - RNA, 21 nt, Human
cacuuauggaaaauagaaccu

SEQ ID NO: 1372804 - RNA, 21 nt, Human
cagccuuguucuuuuugcuca

SEQ ID NO: 1372805 - RNA, 23 nt, Human
ccaaagugcugggauuacaggca

SEQ ID NO: 1372806 - RNA, 24 nt, Human
ccaaagugcugggauuacaggcau

SEQ ID NO: 1372807 - RNA, 23 nt, Human
ccacaaaaagggagacauccaga

SEQ ID NO: 1372808 - RNA, 20 nt, Human
ccauauuuuucuucuugcag

SEQ ID NO: 1372809 - RNA, 24 nt, Human
cccaaagugcugggauuacaggca

SEQ ID NO: 1372810 - RNA, 18 nt, Human
cccaaguaguugggauua

SEQ ID NO: 1372811 - RNA, 20 nt, Human
cccaaguaguugggauuacu

SEQ ID NO: 1372812 - RNA, 24 nt, Human
ccccuggcuggagugcaguggugu

SEQ ID NO: 1372813 - RNA, 19 nt, Human
cccucccucccuuccuucc

SEQ ID NO: 1372814 - RNA, 22 nt, Human
cccucccucccuuccuuccgga

SEQ ID NO: 1372815 - RNA, 19 nt, Human
cccuccuuuccuuccuuuc

SEQ ID NO: 1372816 - RNA, 23 nt, Human
cccugauaauuauacuucucuca

SEQ ID NO: 1372817 - RNA, 22 nt, Human
cccuggcuggagugcaguggug

SEQ ID NO: 1372818 - RNA, 24 nt, Human
ccugaccucaggugaucugcccac

SEQ ID NO: 1372819 - RNA, 20 nt, Human
ccuuccuuuccuuuccuuuc

SEQ ID NO: 1372820 - RNA, 22 nt, Human
ccuuuccuuuccuuucccuccc

SEQ ID NO: 1372821 - RNA, 23 nt, Human
cgcccuccccuuuugaaauccuu

SEQ ID NO: 1372822 - RNA, 20 nt, Human
cgcucuauccccuggcugga

SEQ ID NO: 1372823 - RNA, 22 nt, Human
cuauacugucuuuucauccaug

SEQ ID NO: 1372824 - RNA, 24 nt, Human
cucacugcaaccuccaccucccag

SEQ ID NO: 1372825 - RNA, 23 nt, Human
cuuagccucccaaguaguuggga

SEQ ID NO: 1372826 - RNA, 18 nt, Human
cuuuccuuccuuuccuuu

SEQ ID NO: 1372827 - RNA, 23 nt, Human
cuuuuuuuuuuuuuuuuuuuggg

SEQ ID NO: 1372828 - RNA, 24 nt, Human
gaccucaggugaucugcccaccuc

SEQ ID NO: 1372829 - RNA, 19 nt, Human
gagaauuuugucaagagcu

SEQ ID NO: 1372830 - RNA, 24 nt, Human
gaugucaccccugguggccaagcu

SEQ ID NO: 1372831 - RNA, 18 nt, Human
gauuacaggcauaagcca

SEQ ID NO: 1372832 - RNA, 21 nt, Human
gauuacaggcauaagccacca

SEQ ID NO: 1372833 - RNA, 18 nt, Human
gcaaccuccaccucccag

SEQ ID NO: 1372834 - RNA, 22 nt, Human
gcaaccuccaccucccaguuuc

SEQ ID NO: 1372835 - RNA, 23 nt, Human
gcuggccucgaacuccugaccuc

SEQ ID NO: 1372836 - RNA, 19 nt, Human
ggauuacaggcauaagcca

SEQ ID NO: 1372837 - RNA, 18 nt, Human
ggccaagcuguaaaauuu

SEQ ID NO: 1372838 - RNA, 20 nt, Human
ggcggguuccccugauaauu

SEQ ID NO: 1372839 - RNA, 24 nt, Human
ggcuggccucgaacuccugaccuc

SEQ ID NO: 1372840 - RNA, 19 nt, Human
ggguauuuuguuuccuuau

SEQ ID NO: 1372841 - RNA, 18 nt, Human
gggucaggcaaaaagagc

SEQ ID NO: 1372842 - RNA, 18 nt, Human
ggucugggguaaggagcu

SEQ ID NO: 1372843 - RNA, 22 nt, Human
ggucugggguaaggagcugggg

SEQ ID NO: 1372844 - RNA, 24 nt, Human
gugaucugcccaccucagccuccc

SEQ ID NO: 1372845 - RNA, 19 nt, Human
guucgggugggcaucaugg

SEQ ID NO: 1372846 - RNA, 22 nt, Human
guuucucaugccuuagccuccc

SEQ ID NO: 1372847 - RNA, 24 nt, Human
uaacagcgauuuuuagggaacaag

SEQ ID NO: 1372848 - RNA, 19 nt, Human
uaacuguacaaauugauug

SEQ ID NO: 1372849 - RNA, 19 nt, Human
uaaggucugacugccugca

SEQ ID NO: 1372850 - RNA, 24 nt, Human
uaauacuuuuauaauuucuuaugc

SEQ ID NO: 1372851 - RNA, 22 nt, Human
uacaggcauaagccaccacacc

SEQ ID NO: 1372852 - RNA, 23 nt, Human
uagaauaacagcgauuuuuaggg

SEQ ID NO: 1372853 - RNA, 22 nt, Human
uaguaaagacaugguuucgcca

SEQ ID NO: 1372854 - RNA, 18 nt, Human
uauaguguggagccagga

SEQ ID NO: 1372855 - RNA, 20 nt, Human
uauaguguggagccaggaac

SEQ ID NO: 1372856 - RNA, 19 nt, Human
uauggaaaauagaaccucc

SEQ ID NO: 1372857 - RNA, 19 nt, Human
ucacugcaaccuccaccuc

SEQ ID NO: 1372858 - RNA, 23 nt, Human
ucacugcaaccuccaccucccag

SEQ ID NO: 1372859 - RNA, 24 nt, Human
ucacugcaaccuccaccucccagu

SEQ ID NO: 1372860 - RNA, 27 nt, Human
ucacugcaaccuccaccucccaguuuc

SEQ ID NO: 1372861 - RNA, 18 nt, Human
ucagccucccaaagugcu

SEQ ID NO: 1372862 - RNA, 30 nt, Human
ucauacacgcccuccccuuuugaaauccuu

SEQ ID NO: 1372863 - RNA, 22 nt, Human
uccacaaaaagggagacaucca

SEQ ID NO: 1372864 - RNA, 28 nt, Human
uccagagcugaagaguuuucccugagaa

SEQ ID NO: 1372865 - RNA, 19 nt, Human
uccaugagaaacauaacac

SEQ ID NO: 1372866 - RNA, 24 nt, Human
ucccaaagugcugggauuacaggc

SEQ ID NO: 1372867 - RNA, 24 nt, Human
uccccuggcuggagugcaguggug

SEQ ID NO: 1372868 - RNA, 18 nt, Human
ucccuuuuuuuuuuuuuu

SEQ ID NO: 1372869 - RNA, 18 nt, Human
ucccuuuuuuuuuuuuuu

SEQ ID NO: 1372870 - RNA, 19 nt, Human
uccuuccggacaaggguug

SEQ ID NO: 1372871 - RNA, 18 nt, Human
uccuuucccucccucccu

SEQ ID NO: 1372872 - RNA, 24 nt, Human
ucgccaggcuggccucgaacuccu

SEQ ID NO: 1372873 - RNA, 20 nt, Human
ucucgcucuauccccuggcu

SEQ ID NO: 1372874 - RNA, 23 nt, Human
ucucgcucuauccccuggcugga

SEQ ID NO: 1372875 - RNA, 21 nt, Human
ucugcccaccucagccuccca

SEQ ID NO: 1372876 - RNA, 21 nt, Human
ucugguagugugaugcuucca

SEQ ID NO: 1372877 - RNA, 19 nt, Human
ugaacaacugcauauggug

SEQ ID NO: 1372878 - RNA, 18 nt, Human
ugaccucaggugaucugc

SEQ ID NO: 1372879 - RNA, 20 nt, Human
ugaccucaggugaucugccc

SEQ ID NO: 1372880 - RNA, 21 nt, Human
ugaccucaggugaucugccca

SEQ ID NO: 1372881 - RNA, 24 nt, Human
ugaccucaggugaucugcccaccu

SEQ ID NO: 1372882 - RNA, 18 nt, Human
ugagacagagucucgcuc

SEQ ID NO: 1372883 - RNA, 22 nt, Human
ugagacagagucucgcucuauc

SEQ ID NO: 1372884 - RNA, 19 nt, Human
ugagguucgggugggcauc

SEQ ID NO: 1372885 - RNA, 24 nt, Human
ugaucugcccaccucagccuccca

SEQ ID NO: 1372886 - RNA, 22 nt, Human
ugcaguggugugaucucggcuc

SEQ ID NO: 1372887 - RNA, 20 nt, Human
ugccuuagccucccaaguag

SEQ ID NO: 1372888 - RNA, 20 nt, Human
ugccuuagccucccaaguag

SEQ ID NO: 1372889 - RNA, 27 nt, Human
ugcugggauuacaggcauaagccacca

SEQ ID NO: 1372890 - RNA, 24 nt, Human
uggaaaauagaaccuccguugaaa

SEQ ID NO: 1372891 - RNA, 19 nt, Human
uggagccaggaacccaagg

SEQ ID NO: 1372892 - RNA, 19 nt, Human
uggagugcaguggugugau

SEQ ID NO: 1372893 - RNA, 23 nt, Human
uggagugcaguggugugaucucg

SEQ ID NO: 1372894 - RNA, 24 nt, Human
uggagugcaguggugugaucucgg

SEQ ID NO: 1372895 - RNA, 20 nt, Human
uggccucgaacuccugaccu

SEQ ID NO: 1372896 - RNA, 23 nt, Human
uggcuggagugcaguggugugau

SEQ ID NO: 1372897 - RNA, 18 nt, Human
ugggauuacaggcauaag

SEQ ID NO: 1372898 - RNA, 22 nt, Human
ugggauuacaggcauaagccac

SEQ ID NO: 1372899 - RNA, 24 nt, Human
ugggauuacaggcauaagccacca

SEQ ID NO: 1372900 - RNA, 24 nt, Human
ugggauuacaggcauaagccacca

SEQ ID NO: 1372901 - RNA, 20 nt, Human
uguucauacacgcccucccc

SEQ ID NO: 1372902 - RNA, 23 nt, Human
uucaaguguuucucaugccuuag

SEQ ID NO: 1372903 - RNA, 23 nt, Human
uucauggacauuuaucaguuccc

SEQ ID NO: 1372904 - RNA, 27 nt, Human
uucgcucccucccuccuuuccuuccuu

SEQ ID NO: 1372905 - RNA, 18 nt, Human
uucucagccggccaacac

SEQ ID NO: 1372906 - RNA, 19 nt, Human
uugagacagagucucgcuc

SEQ ID NO: 1372907 - RNA, 19 nt, Human
uugcucaggguugcuuugg

SEQ ID NO: 1372908 - RNA, 21 nt, Human
uuucauggacauuuaucaguu

SEQ ID NO: 1372909 - RNA, 22 nt, Human
uuucgcucccucccuccuuucc

SEQ ID NO: 1372910 - RNA, 26 nt, Human
uuucgcucccucccuccuuuccuucc

SEQ ID NO: 1372911 - RNA, 22 nt, Human
uuuuaugguucuguauauauuu

SEQ ID NO: 1372912 - RNA, 20 nt, Human
uuuuuuuuuuugagacagag

SEQ ID NO: 1372913 - RNA, 25 nt, Human
uuuuuuuuuuuugagacagagucuc

SEQ ID NO: 1372914 - RNA, 21 nt, Human
aaaugagugccuucccaccug

SEQ ID NO: 1372915 - RNA, 20 nt, Human
aaggugccagggaaccagua

SEQ ID NO: 1372916 - RNA, 24 nt, Human
acuguucaucuccucuuucuuucc

SEQ ID NO: 1372917 - RNA, 25 nt, Human
agaauucugacaucacucacagucc

SEQ ID NO: 1372918 - RNA, 24 nt, Human
aggcaccuuccaguucucccucac

SEQ ID NO: 1372919 - RNA, 23 nt, Human
aucacacaccaguuuccuugauc

SEQ ID NO: 1372920 - RNA, 22 nt, Human
cacaguccugcaggcaccuucc

SEQ ID NO: 1372921 - RNA, 18 nt, Human
caccagaacaccgcagcg

SEQ ID NO: 1372922 - RNA, 21 nt, Human
cagaagaugccgagucucgac

SEQ ID NO: 1372923 - RNA, 24 nt, Human
cagcaaacuccgacgaggcaacau

SEQ ID NO: 1372924 - RNA, 23 nt, Human
ccucuaagauacuuggacuucug

SEQ ID NO: 1372925 - RNA, 21 nt, Human
cgcagcggauacuugcacgcc

SEQ ID NO: 1372926 - RNA, 23 nt, Human
cucacggaacacaugguaguaac

SEQ ID NO: 1372927 - RNA, 19 nt, Human
cucgacugcccaugucacg

SEQ ID NO: 1372928 - RNA, 24 nt, Human
cucuacaguuacaagguguuugcc

SEQ ID NO: 1372929 - RNA, 18 nt, Human
cuugagaauaaaaagaag

SEQ ID NO: 1372930 - RNA, 18 nt, Human
gaagaaucacacaccagu

SEQ ID NO: 1372931 - RNA, 22 nt, Human
gagaauaaaaagaaguccuguu

SEQ ID NO: 1372932 - RNA, 19 nt, Human
gaugaaacacaggacuugg

SEQ ID NO: 1372933 - RNA, 23 nt, Human
gccagccucuccacucuagcacc

SEQ ID NO: 1372934 - RNA, 20 nt, Human
gguaaauaaucaggccuuuu

SEQ ID NO: 1372935 - RNA, 20 nt, Human
uagcaccagaacaccgcagc

SEQ ID NO: 1372936 - RNA, 21 nt, Human
ucaggccggauucucaccaug

SEQ ID NO: 1372937 - RNA, 24 nt, Human
uccaacaucacuggugauaauucc

SEQ ID NO: 1372938 - RNA, 23 nt, Human
uccacaagugaccucugcacuga

SEQ ID NO: 1372939 - RNA, 24 nt, Human
uccacucuagcaccagaacaccgc

SEQ ID NO: 1372940 - RNA, 21 nt, Human
ucuccugucaucaccagcaaa

SEQ ID NO: 1372941 - RNA, 29 nt, Human
ucuccugucaucaccagcaaacuccgacu

SEQ ID NO: 1372942 - RNA, 21 nt, Human
ucuuucuuuccuuggcuauuu

SEQ ID NO: 1372943 - RNA, 21 nt, Human
ugagaauaaaaagaaguccug

SEQ ID NO: 1372944 - RNA, 23 nt, Human
ugagugccuucccaccuggucuc

SEQ ID NO: 1372945 - RNA, 23 nt, Human
ugaucguaguagcuuugcagaau

SEQ ID NO: 1372946 - RNA, 19 nt, Human
ugcaggcaccuuccaguuc

SEQ ID NO: 1372947 - RNA, 24 nt, Human
ugccacucuacgcucuacaguuac

SEQ ID NO: 1372948 - RNA, 24 nt, Human
uggcuauuucuguuuccucuaaga

SEQ ID NO: 1372949 - RNA, 22 nt, Human
uggguccugggauccuauggga

SEQ ID NO: 1372950 - RNA, 19 nt, Human
uuuuuuuuuuuuuuuuuaa

SEQ ID NO: 1372951 - RNA, 22 nt, Human
ccagucugccggcccggccccu

SEQ ID NO: 1372952 - RNA, 22 nt, Human
ugcgucgcccaccagcaccagc

SEQ ID NO: 1372953 - RNA, 21 nt, Human
aaauaaguggaaucaauaaua

SEQ ID NO: 1372954 - RNA, 24 nt, Human
accccugguucucacucaggcggu

SEQ ID NO: 1372955 - RNA, 21 nt, Human
agaccccugguucucacucag

SEQ ID NO: 1372956 - RNA, 18 nt, Human
aguggaaucaauaauacc

SEQ ID NO: 1372957 - RNA, 20 nt, Human
aguggaaucaauaauaccaa

SEQ ID NO: 1372958 - RNA, 25 nt, Human
caugccccagacucuccuuggaggu

SEQ ID NO: 1372959 - RNA, 21 nt, Human
ccaugccccagacucuccuug

SEQ ID NO: 1372960 - RNA, 20 nt, Human
ccccaugccccagacucucc

SEQ ID NO: 1372961 - RNA, 24 nt, Human
cccccaugccccagacucuccuug

SEQ ID NO: 1372962 - RNA, 21 nt, Human
cuggcagccccccaugcccca

SEQ ID NO: 1372963 - RNA, 21 nt, Human
gccccagacucuccuuggagg

SEQ ID NO: 1372964 - RNA, 21 nt, Human
gcuggugcaggcuugacaagg

SEQ ID NO: 1372965 - RNA, 20 nt, Human
gggcaagagcggggaaugag

SEQ ID NO: 1372966 - RNA, 26 nt, Human
uaauaccaaaaagccaaauuauuuaa

SEQ ID NO: 1372967 - RNA, 21 nt, Human
uaccaaaaagccaaauuauuu

SEQ ID NO: 1372968 - RNA, 22 nt, Human
ucuucacuucaccacuggccuc

SEQ ID NO: 1372969 - RNA, 20 nt, Human
ucuugcccaacccuggcagg

SEQ ID NO: 1372970 - RNA, 22 nt, Human
ugacaagggcaagagcggggaa

SEQ ID NO: 1372971 - RNA, 23 nt, Human
ugacaagggcaagagcggggaau

SEQ ID NO: 1372972 - RNA, 21 nt, Human
uggaaucaauaauaccaaaaa

SEQ ID NO: 1372973 - RNA, 20 nt, Human
uggacccauuggagcagcag

SEQ ID NO: 1372974 - RNA, 19 nt, Human
uggagcagcagaguugaag

SEQ ID NO: 1372975 - RNA, 18 nt, Human
uuuacaaaauaaguggaa

SEQ ID NO: 1372976 - RNA, 22 nt, Human
uuuuacaaaauaaguggaauca

SEQ ID NO: 1372977 - RNA, 24 nt, Human
aaacagccucugcagauucagggc

SEQ ID NO: 1372978 - RNA, 22 nt, Human
aaagcugaugaagaaaccacaa

SEQ ID NO: 1372979 - RNA, 23 nt, Human
aacuucacuccucugagccucug

SEQ ID NO: 1372980 - RNA, 21 nt, Human
aagcacccggugccugggaug

SEQ ID NO: 1372981 - RNA, 20 nt, Human
acccggugccugggaugcug

SEQ ID NO: 1372982 - RNA, 20 nt, Human
accuggacacaaaacuuaag

SEQ ID NO: 1372983 - RNA, 24 nt, Human
accuguggaagccagagcuggccc

SEQ ID NO: 1372984 - RNA, 18 nt, Human
acugcagccuccgccucc

SEQ ID NO: 1372985 - RNA, 23 nt, Human
acugcagccuccgccuccugguu

SEQ ID NO: 1372986 - RNA, 23 nt, Human
aggcaggagggagagugcagcuc

SEQ ID NO: 1372987 - RNA, 25 nt, Human
aggcuggagugcaguggcacaaucu

SEQ ID NO: 1372988 - RNA, 23 nt, Human
aggcuugaaaacugaauuuaacc

SEQ ID NO: 1372989 - RNA, 21 nt, Human
agggcuggaggcugaggggcc

SEQ ID NO: 1372990 - RNA, 23 nt, Human
aguagcugggauuacaggcacau

SEQ ID NO: 1372991 - RNA, 21 nt, Human
agugcaguggcacaaucucag

SEQ ID NO: 1372992 - RNA, 24 nt, Human
agugcaguggcacaaucucagcuc

SEQ ID NO: 1372993 - RNA, 23 nt, Human
auccuuuuuccuccugccuucuc

SEQ ID NO: 1372994 - RNA, 22 nt, Human
caaacacagaacccugucuccc

SEQ ID NO: 1372995 - RNA, 22 nt, Human
caacuucccagauucaaauccu

SEQ ID NO: 1372996 - RNA, 18 nt, Human
cacaggagaccaagaugg

SEQ ID NO: 1372997 - RNA, 21 nt, Human
caccgcagcaaacacagaacc

SEQ ID NO: 1372998 - RNA, 24 nt, Human
cagagcuggcccaggccacaccau

SEQ ID NO: 1372999 - RNA, 20 nt, Human
cagccuccugaguagcuggg

SEQ ID NO: 1373000 - RNA, 22 nt, Human
cagccuuugcuccuuaaucaga

SEQ ID NO: 1373001 - RNA, 22 nt, Human
caggaaggcaacuucacuccuc

SEQ ID NO: 1373002 - RNA, 21 nt, Human
cauuuauguuagggcuggagg

SEQ ID NO: 1373003 - RNA, 20 nt, Human
ccagaagcacccggugccug

SEQ ID NO: 1373004 - RNA, 19 nt, Human
ccgcagcaaacacagaacc

SEQ ID NO: 1373005 - RNA, 23 nt, Human
ccgcagcaaacacagaacccugu

SEQ ID NO: 1373006 - RNA, 25 nt, Human
ccgccuccugguucaagcaauucuu

SEQ ID NO: 1373007 - RNA, 22 nt, Human
ccuagcucaucacuuucaugcu

SEQ ID NO: 1373008 - RNA, 18 nt, Human
ccuccugccuucuccucc

SEQ ID NO: 1373009 - RNA, 23 nt, Human
ccuccugccuucuccucccuuca

SEQ ID NO: 1373010 - RNA, 23 nt, Human
ccuccugguucaagcaauucucc

SEQ ID NO: 1373011 - RNA, 24 nt, Human
ccuccuguaucuuuacagggguug

SEQ ID NO: 1373012 - RNA, 23 nt, Human
ccugaguagcugggauuacaggc

SEQ ID NO: 1373013 - RNA, 24 nt, Human
ccugaguagcugggauuacaggca

SEQ ID NO: 1373014 - RNA, 19 nt, Human
ccugguucaagcaauucuc

SEQ ID NO: 1373015 - RNA, 22 nt, Human
ccugguucaagcaauucuccug

SEQ ID NO: 1373016 - RNA, 23 nt, Human
cggcugaggcaggagggagagug

SEQ ID NO: 1373017 - RNA, 24 nt, Human
cguucuguugcccaggcuggagug

SEQ ID NO: 1373018 - RNA, 18 nt, Human
cuagagcccaacuuccca

SEQ ID NO: 1373019 - RNA, 24 nt, Human
cucacugcagccuccgccuccugg

SEQ ID NO: 1373020 - RNA, 18 nt, Human
cuccaaugcccuggaccu

SEQ ID NO: 1373021 - RNA, 27 nt, Human
cuccauagggaaaacugcagccaacuu

SEQ ID NO: 1373022 - RNA, 24 nt, Human
cucguucuguugcccaggcuggag

SEQ ID NO: 1373023 - RNA, 24 nt, Human
cugaauuuaaccgacauuuauguu

SEQ ID NO: 1373024 - RNA, 23 nt, Human
cugagccucugguuccucaucug

SEQ ID NO: 1373025 - RNA, 23 nt, Human
cugaguagcugggauuacaggca

SEQ ID NO: 1373026 - RNA, 23 nt, Human
cugugucagccuccugaguagcu

SEQ ID NO: 1373027 - RNA, 19 nt, Human
cuguugcccaggcuggagu

SEQ ID NO: 1373028 - RNA, 19 nt, Human
gaaaacugcagccagaagc

SEQ ID NO: 1373029 - RNA, 21 nt, Human
gaagaaaccacaggagaccaa

SEQ ID NO: 1373030 - RNA, 25 nt, Human
gaguagcugggauuacaggcacaug

SEQ ID NO: 1373031 - RNA, 21 nt, Human
gcaaacacagaacccugucuc

SEQ ID NO: 1373032 - RNA, 25 nt, Human
gcaguacaguguggcagaagggccc

SEQ ID NO: 1373033 - RNA, 19 nt, Human
gcccaggcuggagugcagu

SEQ ID NO: 1373034 - RNA, 20 nt, Human
gcccaggcuggagugcagug

SEQ ID NO: 1373035 - RNA, 19 nt, Human
gcuggagugcaguggcaca

SEQ ID NO: 1373036 - RNA, 24 nt, Human
ggaaaacugcagccagaagcaccc

SEQ ID NO: 1373037 - RNA, 20 nt, Human
ggccuuguguaaaugugccc

SEQ ID NO: 1373038 - RNA, 23 nt, Human
ggcucugggcuucucgccuuggg

SEQ ID NO: 1373039 - RNA, 23 nt, Human
ggcucugggcuucucgggagagc

SEQ ID NO: 1373040 - RNA, 23 nt, Human
ggcuggaggcugaggggccucca

SEQ ID NO: 1373041 - RNA, 21 nt, Human
gggcaucuugagaaacagccu

SEQ ID NO: 1373042 - RNA, 24 nt, Human
guaaaaaaaaagcugaugaagaaa

SEQ ID NO: 1373043 - RNA, 18 nt, Human
guagcugggauuacaggc

SEQ ID NO: 1373044 - RNA, 18 nt, Human
gucgaggccuccaaugcc

SEQ ID NO: 1373045 - RNA, 18 nt, Human
guggggcagagugacucc

SEQ ID NO: 1373046 - RNA, 20 nt, Human
gugucagccuccugaguagc

SEQ ID NO: 1373047 - RNA, 22 nt, Human
gugucagccuccugaguagcug

SEQ ID NO: 1373048 - RNA, 19 nt, Human
uaagacggaccccggcuga

SEQ ID NO: 1373049 - RNA, 22 nt, Human
uagggaaaacugcagccagaag

SEQ ID NO: 1373050 - RNA, 19 nt, Human
ucacugcagccuccgccuc

SEQ ID NO: 1373051 - RNA, 23 nt, Human
ucacugcagccuccgccuccugg

SEQ ID NO: 1373052 - RNA, 24 nt, Human
ucacugcagccuccgccuccuggu

SEQ ID NO: 1373053 - RNA, 27 nt, Human
ucacugcagccuccgccuccugguuca

SEQ ID NO: 1373054 - RNA, 20 nt, Human
ucagccuccugaguagcugg

SEQ ID NO: 1373055 - RNA, 19 nt, Human
ucaucacuuucaugcugug

SEQ ID NO: 1373056 - RNA, 22 nt, Human
uccauagggaaaacugcagcca

SEQ ID NO: 1373057 - RNA, 23 nt, Human
uccgccuccugguucaagcaauu

SEQ ID NO: 1373058 - RNA, 19 nt, Human
uccuccugccuucuccucc

SEQ ID NO: 1373059 - RNA, 24 nt, Human
uccugaguagcugggauuacaggc

SEQ ID NO: 1373060 - RNA, 20 nt, Human
uccugccuucuccucccuuc

SEQ ID NO: 1373061 - RNA, 23 nt, Human
uccugguucaagcaauucuccug

SEQ ID NO: 1373062 - RNA, 22 nt, Human
ucuccaugggccauuuggaggc

SEQ ID NO: 1373063 - RNA, 23 nt, Human
ucuccucccuucaccgcagcaaa

SEQ ID NO: 1373064 - RNA, 23 nt, Human
ucucguucuguugcccaggcugg

SEQ ID NO: 1373065 - RNA, 24 nt, Human
ucucguucuguugcccaggcugga

SEQ ID NO: 1373066 - RNA, 18 nt, Human
ucuguugcccaggcugga

SEQ ID NO: 1373067 - RNA, 24 nt, Human
ucuguugcccaggcuggagugcag

SEQ ID NO: 1373068 - RNA, 24 nt, Human
ugaagaaaccacaggagaccaaga

SEQ ID NO: 1373069 - RNA, 24 nt, Human
ugaccucaggaaggcaacuucacu

SEQ ID NO: 1373070 - RNA, 18 nt, Human
ugagacagagucucguuc

SEQ ID NO: 1373071 - RNA, 22 nt, Human
ugagacagagucucguucuguu

SEQ ID NO: 1373072 - RNA, 23 nt, Human
ugcagccagaagcacccggugcc

SEQ ID NO: 1373073 - RNA, 18 nt, Human
ugcccaggcuggagugca

SEQ ID NO: 1373074 - RNA, 21 nt, Human
ugcccaggcuggagugcagug

SEQ ID NO: 1373075 - RNA, 22 nt, Human
ugcccaggcuggagugcagugg

SEQ ID NO: 1373076 - RNA, 24 nt, Human
ugcccaggcuggagugcaguggca

SEQ ID NO: 1373077 - RNA, 22 nt, Human
ugcccuggaccaucuacugcuc

SEQ ID NO: 1373078 - RNA, 23 nt, Human
ugcccuggaccaucuacugcucu

SEQ ID NO: 1373079 - RNA, 22 nt, Human
ugcccuggaggugccacccagu

SEQ ID NO: 1373080 - RNA, 19 nt, Human
ugccugggaugcuggaguc

SEQ ID NO: 1373081 - RNA, 27 nt, Human
ugcuaagacggaccccggcugaggcag

SEQ ID NO: 1373082 - RNA, 22 nt, Human
ugcuggagacagagccauucac

SEQ ID NO: 1373083 - RNA, 21 nt, Human
uggaagccagagcuggcccag

SEQ ID NO: 1373084 - RNA, 18 nt, Human
uggacacaaaacuuaagc

SEQ ID NO: 1373085 - RNA, 18 nt, Human
uggaggcugaggggccuc

SEQ ID NO: 1373086 - RNA, 18 nt, Human
uggagugcaguggcacaa

SEQ ID NO: 1373087 - RNA, 23 nt, Human
uggagugcaguggcacaaucuca

SEQ ID NO: 1373088 - RNA, 24 nt, Human
uggagugcaguggcacaaucucag

SEQ ID NO: 1373089 - RNA, 23 nt, Human
uggcacaaucucagcucacugca

SEQ ID NO: 1373090 - RNA, 25 nt, Human
uggcagaaggcaguacagucuggcu

SEQ ID NO: 1373091 - RNA, 23 nt, Human
uggccagaaauccagccuuugcu

SEQ ID NO: 1373092 - RNA, 23 nt, Human
uggcccaggccacaccaugacgg

SEQ ID NO: 1373093 - RNA, 19 nt, Human
uggcucugggcuucucgcc

SEQ ID NO: 1373094 - RNA, 21 nt, Human
ugggauuacaggcacaugcca

SEQ ID NO: 1373095 - RNA, 22 nt, Human
ugggauuacaggcacaugccac

SEQ ID NO: 1373096 - RNA, 23 nt, Human
ugggauuacaggcacaugccaca

SEQ ID NO: 1373097 - RNA, 18 nt, Human
ugggguuugauggagaga

SEQ ID NO: 1373098 - RNA, 25 nt, Human
ugugcacuggggcgaugaugcugug

SEQ ID NO: 1373099 - RNA, 19 nt, Human
uguggccagaaauccagcc

SEQ ID NO: 1373100 - RNA, 20 nt, Human
uguggccagaaauccagccc

SEQ ID NO: 1373101 - RNA, 21 nt, Human
uuacaggggucaggcccuccu

SEQ ID NO: 1373102 - RNA, 24 nt, Human
uuccaaacugcuaagacggacccc

SEQ ID NO: 1373103 - RNA, 18 nt, Human
uuugcuccuuaaucagac

SEQ ID NO: 1373104 - RNA, 23 nt, Human
uuuucuuuuuuuuuuuuuuuggg

SEQ ID NO: 1373105 - RNA, 20 nt, Human
uuuuuuuuuuugagacagag

SEQ ID NO: 1373106 - RNA, 25 nt, Human
uuuuuuuuuuuugagacagagucuc

SEQ ID NO: 1373107 - RNA, 22 nt, Human
aaaaaccaccaacaacaccccc

SEQ ID NO: 1373108 - RNA, 24 nt, Human
aaacagccucugcagauucagggc

SEQ ID NO: 1373109 - RNA, 22 nt, Human
aaagcugaugaagaaaccacaa

SEQ ID NO: 1373110 - RNA, 19 nt, Human
aacaacacccccagaaacc

SEQ ID NO: 1373111 - RNA, 21 nt, Human
aacacccccagaaaccccacc

SEQ ID NO: 1373112 - RNA, 22 nt, Human
aaccagaauugggucaggaaca

SEQ ID NO: 1373113 - RNA, 24 nt, Human
aaccagcuuuuuaaguuucuccac

SEQ ID NO: 1373114 - RNA, 23 nt, Human
aacuucacuccucugagccucug

SEQ ID NO: 1373115 - RNA, 20 nt, Human
aagaagagaaaguccgacca

SEQ ID NO: 1373116 - RNA, 18 nt, Human
aagcuuccuugcuugcca

SEQ ID NO: 1373117 - RNA, 18 nt, Human
aaguuucuccacuacaga

SEQ ID NO: 1373118 - RNA, 26 nt, Human
aaucuuguucaucuuuaaaauuccac

SEQ ID NO: 1373119 - RNA, 20 nt, Human
aauugggucaggaacacuga

SEQ ID NO: 1373120 - RNA, 22 nt, Human
acaccacgcccaccaccacgau

SEQ ID NO: 1373121 - RNA, 20 nt, Human
acaggcaaaucaccccccuu

SEQ ID NO: 1373122 - RNA, 26 nt, Human
accaccaacaacacccccagaaaccc

SEQ ID NO: 1373123 - RNA, 22 nt, Human
accaggagauaaaaaccaccaa

SEQ ID NO: 1373124 - RNA, 18 nt, Human
accccccuuucugaccca

SEQ ID NO: 1373125 - RNA, 20 nt, Human
acccggugccugggaugcug

SEQ ID NO: 1373126 - RNA, 24 nt, Human
accuguggaagccagagcuggccc

SEQ ID NO: 1373127 - RNA, 18 nt, Human
acugcagccuccgccucc

SEQ ID NO: 1373128 - RNA, 21 nt, Human
agacaggugguccaugucccu

SEQ ID NO: 1373129 - RNA, 23 nt, Human
agagugaggacacaucuuucugu

SEQ ID NO: 1373130 - RNA, 18 nt, Human
agcuucucagcaaccucc

SEQ ID NO: 1373131 - RNA, 19 nt, Human
agcuucucagcaaccuccu

SEQ ID NO: 1373132 - RNA, 23 nt, Human
aggagaaagccucucugggccua

SEQ ID NO: 1373133 - RNA, 27 nt, Human
aggagauaaaaaccaccaacaacaccc

SEQ ID NO: 1373134 - RNA, 19 nt, Human
aggcaaaucaccccccuuu

SEQ ID NO: 1373135 - RNA, 23 nt, Human
aggcaggagggagagugcagcuc

SEQ ID NO: 1373136 - RNA, 25 nt, Human
aggcuggagugcaguggcacaaucu

SEQ ID NO: 1373137 - RNA, 23 nt, Human
aggcuugaaaacugaauuuaacc

SEQ ID NO: 1373138 - RNA, 21 nt, Human
agggcuggaggcugaggggcc

SEQ ID NO: 1373139 - RNA, 23 nt, Human
aguagcugggauuacaggcacau

SEQ ID NO: 1373140 - RNA, 21 nt, Human
aguccaugaaagcucccccca

SEQ ID NO: 1373141 - RNA, 21 nt, Human
agugcaguggcacaaucucag

SEQ ID NO: 1373142 - RNA, 20 nt, Human
aguguauaaagugaggagaa

SEQ ID NO: 1373143 - RNA, 19 nt, Human
auccacacugaauguaaag

SEQ ID NO: 1373144 - RNA, 23 nt, Human
auccuuuuuccuccugccuucuc

SEQ ID NO: 1373145 - RNA, 24 nt, Human
aucuuguucaucuuuaaaauucca

SEQ ID NO: 1373146 - RNA, 19 nt, Human
augcacuugggucuuggaa

SEQ ID NO: 1373147 - RNA, 24 nt, Human
augucccuucucccucauugucaa

SEQ ID NO: 1373148 - RNA, 22 nt, Human
caaacacagaacccugucuccc

SEQ ID NO: 1373149 - RNA, 18 nt, Human
caaagucaaacuaggaac

SEQ ID NO: 1373150 - RNA, 23 nt, Human
caacaacacccccagaaacccca

SEQ ID NO: 1373151 - RNA, 22 nt, Human
caacuucccagauucaaauccu

SEQ ID NO: 1373152 - RNA, 22 nt, Human
caagggacugaaugugaaacca

SEQ ID NO: 1373153 - RNA, 18 nt, Human
cacagcggcaaguccagc

SEQ ID NO: 1373154 - RNA, 21 nt, Human
cacccccagaaaccccaccua

SEQ ID NO: 1373155 - RNA, 21 nt, Human
caccgcagcaaacacagaacc

SEQ ID NO: 1373156 - RNA, 19 nt, Human
caccuauuaccaguaaccc

SEQ ID NO: 1373157 - RNA, 22 nt, Human
caccuggacacaaaacuuaagc

SEQ ID NO: 1373158 - RNA, 22 nt, Human
cagacaggugguccaugucccu

SEQ ID NO: 1373159 - RNA, 24 nt, Human
cagagcuggcccaggccacaccau

SEQ ID NO: 1373160 - RNA, 20 nt, Human
cagcccagccuccacccugc

SEQ ID NO: 1373161 - RNA, 20 nt, Human
cagccuccugaguagcuggg

SEQ ID NO: 1373162 - RNA, 22 nt, Human
cagccuuugcuccuuaaucaga

SEQ ID NO: 1373163 - RNA, 20 nt, Human
cagcuugaccacaacauggg

SEQ ID NO: 1373164 - RNA, 22 nt, Human
caggaaggcaacuucacuccuc

SEQ ID NO: 1373165 - RNA, 22 nt, Human
ccaacaacacccccagaaaccc

SEQ ID NO: 1373166 - RNA, 19 nt, Human
ccacaggagaccaagaugg

SEQ ID NO: 1373167 - RNA, 25 nt, Human
ccaccagcaagcgaucaucaaauca

SEQ ID NO: 1373168 - RNA, 24 nt, Human
ccacgcccaccaccacgauguucc

SEQ ID NO: 1373169 - RNA, 18 nt, Human
ccacugccuggcacaucu

SEQ ID NO: 1373170 - RNA, 21 nt, Human
ccacugccuggcacaucuagc

SEQ ID NO: 1373171 - RNA, 21 nt, Human
ccagaagcacccggugccugg

SEQ ID NO: 1373172 - RNA, 21 nt, Human
ccagcccagccuccacccugc

SEQ ID NO: 1373173 - RNA, 22 nt, Human
ccagcccagccuccacccugcc

SEQ ID NO: 1373174 - RNA, 24 nt, Human
ccauagggaaaacugcagccaacu

SEQ ID NO: 1373175 - RNA, 19 nt, Human
ccauggugucgcugcagcc

SEQ ID NO: 1373176 - RNA, 22 nt, Human
cccaccuucaagaugccuggac

SEQ ID NO: 1373177 - RNA, 22 nt, Human
cccagcccagccuccacccugc

SEQ ID NO: 1373178 - RNA, 19 nt, Human
cccaggcuggagugcagug

SEQ ID NO: 1373179 - RNA, 25 nt, Human
ccccagaaaccccaccuauuaccag

SEQ ID NO: 1373180 - RNA, 24 nt, Human
ccccagcaccccacgcccuagguu

SEQ ID NO: 1373181 - RNA, 25 nt, Human
ccccagcaccccacgcccuagguuc

SEQ ID NO: 1373182 - RNA, 18 nt, Human
cccccaucaugggcagcu

SEQ ID NO: 1373183 - RNA, 23 nt, Human
ccccuggucaaaacuccugguuc

SEQ ID NO: 1373184 - RNA, 20 nt, Human
cccuggaccaucuacugcuc

SEQ ID NO: 1373185 - RNA, 19 nt, Human
ccgcagcaaacacagaacc

SEQ ID NO: 1373186 - RNA, 23 nt, Human
ccgcagcaaacacagaacccugu

SEQ ID NO: 1373187 - RNA, 26 nt, Human
ccgccuccugguucaagcaauucuuu

SEQ ID NO: 1373188 - RNA, 22 nt, Human
ccuagcucaucacuuucaugcu

SEQ ID NO: 1373189 - RNA, 18 nt, Human
ccucagagaagaaacagc

SEQ ID NO: 1373190 - RNA, 18 nt, Human
ccuccugccuucuccucc

SEQ ID NO: 1373191 - RNA, 22 nt, Human
ccuccugccuucuccucccuuc

SEQ ID NO: 1373192 - RNA, 23 nt, Human
ccuccugguucaagcaauucucc

SEQ ID NO: 1373193 - RNA, 19 nt, Human
ccucugaaggccuugcccc

SEQ ID NO: 1373194 - RNA, 23 nt, Human
ccugaguagcugggauuacaggc

SEQ ID NO: 1373195 - RNA, 24 nt, Human
ccugaguagcugggauuacaggca

SEQ ID NO: 1373196 - RNA, 18 nt, Human
ccugccuucuccucccuu

SEQ ID NO: 1373197 - RNA, 19 nt, Human
ccugguucaagcaauucuc

SEQ ID NO: 1373198 - RNA, 22 nt, Human
ccugguucaagcaauucuccug

SEQ ID NO: 1373199 - RNA, 24 nt, Human
ccugugucagccuccugaguagcu

SEQ ID NO: 1373200 - RNA, 21 nt, Human
cgaccaggagauaaaaaccac

SEQ ID NO: 1373201 - RNA, 26 nt, Human
cgcggcuaacuccccagcccagccuc

SEQ ID NO: 1373202 - RNA, 24 nt, Human
cgcugcugccgcugccgcugcggg

SEQ ID NO: 1373203 - RNA, 24 nt, Human
cguucuguugcccaggcuggagug

SEQ ID NO: 1373204 - RNA, 21 nt, Human
cuacgugccaagccucacccc

SEQ ID NO: 1373205 - RNA, 18 nt, Human
cuagagcccaacuuccca

SEQ ID NO: 1373206 - RNA, 30 nt, Human
cuaguaauccuauuaacauggcggcuuccc

SEQ ID NO: 1373207 - RNA, 24 nt, Human
cucacugcagccuccgccuccugg

SEQ ID NO: 1373208 - RNA, 18 nt, Human
cuccaaugcccuggaccu

SEQ ID NO: 1373209 - RNA, 18 nt, Human
cuccccagcccagccucc

SEQ ID NO: 1373210 - RNA, 20 nt, Human
cucccucauugucaaggguc

SEQ ID NO: 1373211 - RNA, 24 nt, Human
cuccugguucaagcaauucuccug

SEQ ID NO: 1373212 - RNA, 24 nt, Human
cucguucuguugcccaggcuggag

SEQ ID NO: 1373213 - RNA, 22 nt, Human
cucuccucuucuuaaaaagaag

SEQ ID NO: 1373214 - RNA, 22 nt, Human
cugaagaguccacugccuggca

SEQ ID NO: 1373215 - RNA, 24 nt, Human
cugaauuuaaccgacauuuauguu

SEQ ID NO: 1373216 - RNA, 24 nt, Human
cugacccauccguugguccccugg

SEQ ID NO: 1373217 - RNA, 23 nt, Human
cugagccucugguuccucaucug

SEQ ID NO: 1373218 - RNA, 23 nt, Human
cugaguagcugggauuacaggca

SEQ ID NO: 1373219 - RNA, 25 nt, Human
cuggccauuggcagccgcguggaca

SEQ ID NO: 1373220 - RNA, 20 nt, Human
cugggaccuuucccacucua

SEQ ID NO: 1373221 - RNA, 24 nt, Human
cugguucuagaacacaggggucac

SEQ ID NO: 1373222 - RNA, 18 nt, Human
cuuguucaucuuuaaaau

SEQ ID NO: 1373223 - RNA, 19 nt, Human
gaaaacugcagccagaagc

SEQ ID NO: 1373224 - RNA, 21 nt, Human
gaagaaaccacaggagaccaa

SEQ ID NO: 1373225 - RNA, 18 nt, Human
gaccacagcggcaagucc

SEQ ID NO: 1373226 - RNA, 19 nt, Human
gaccaggagauaaaaaccc

SEQ ID NO: 1373227 - RNA, 21 nt, Human
gagacagagucucguucuguu

SEQ ID NO: 1373228 - RNA, 18 nt, Human
gagcuuccuaaccagcuu

SEQ ID NO: 1373229 - RNA, 22 nt, Human
gaggugagugagcccccuucug

SEQ ID NO: 1373230 - RNA, 25 nt, Human
gaguagcugggauuacaggcacaug

SEQ ID NO: 1373231 - RNA, 21 nt, Human
gcaaacacagaacccugucuc

SEQ ID NO: 1373232 - RNA, 24 nt, Human
gcagcuucucagcaaccuccucag

SEQ ID NO: 1373233 - RNA, 25 nt, Human
gcaguacaguguggcagaagggccc

SEQ ID NO: 1373234 - RNA, 19 nt, Human
gccgcugcgggucagccgc

SEQ ID NO: 1373235 - RNA, 19 nt, Human
gccuugggaaggugugggg

SEQ ID NO: 1373236 - RNA, 20 nt, Human
gcggcuuccagggaagagug

SEQ ID NO: 1373237 - RNA, 19 nt, Human
gcuggagugcaguggcaca

SEQ ID NO: 1373238 - RNA, 20 nt, Human
gcuggcccuggccauuggcc

SEQ ID NO: 1373239 - RNA, 24 nt, Human
ggaaaacugcagccagaagcaccc

SEQ ID NO: 1373240 - RNA, 19 nt, Human
ggcagagagcucagugagc

SEQ ID NO: 1373241 - RNA, 23 nt, Human
ggcagagagcucagugagcugag

SEQ ID NO: 1373242 - RNA, 20 nt, Human
ggccuuguguaaaugugccc

SEQ ID NO: 1373243 - RNA, 23 nt, Human
ggcucugggcuucucgccuuggg

SEQ ID NO: 1373244 - RNA, 23 nt, Human
ggcucugggcuucucgggagagc

SEQ ID NO: 1373245 - RNA, 18 nt, Human
ggcugaggcaggagggag

SEQ ID NO: 1373246 - RNA, 23 nt, Human
ggcuggaggcugaggggccucca

SEQ ID NO: 1373247 - RNA, 21 nt, Human
ggcuggcccuggccauuggca

SEQ ID NO: 1373248 - RNA, 21 nt, Human
gggaugcugccuugggaaggu

SEQ ID NO: 1373249 - RNA, 22 nt, Human
gggcagcuucucagcaaccucc

SEQ ID NO: 1373250 - RNA, 20 nt, Human
gggcugagcagcgagcgucc

SEQ ID NO: 1373251 - RNA, 20 nt, Human
gggggugggggugggggugg

SEQ ID NO: 1373252 - RNA, 22 nt, Human
gggggugggggugggggugguu

SEQ ID NO: 1373253 - RNA, 18 nt, Human
guagcugggauuacaggc

SEQ ID NO: 1373254 - RNA, 18 nt, Human
gucagguucuuuugcacu

SEQ ID NO: 1373255 - RNA, 18 nt, Human
gucgaggccuccaaugcc

SEQ ID NO: 1373256 - RNA, 19 nt, Human
gucugguggcaaaggugcc

SEQ ID NO: 1373257 - RNA, 22 nt, Human
gugaucgguaagaacuggcagc

SEQ ID NO: 1373258 - RNA, 18 nt, Human
guggggcagagugacucc

SEQ ID NO: 1373259 - RNA, 20 nt, Human
gugucagccuccugaguagc

SEQ ID NO: 1373260 - RNA, 22 nt, Human
gugucagccuccugaguagcug

SEQ ID NO: 1373261 - RNA, 19 nt, Human
guguggggggugggggugg

SEQ ID NO: 1373262 - RNA, 23 nt, Human
guucuagaacacaggagaagcca

SEQ ID NO: 1373263 - RNA, 18 nt, Human
guucuguugcccaggcug

SEQ ID NO: 1373264 - RNA, 24 nt, Human
uaaaaacaagacacacgagugauu

SEQ ID NO: 1373265 - RNA, 19 nt, Human
uaaaauuccacgauuccuc

SEQ ID NO: 1373266 - RNA, 19 nt, Human
uaacuccccagcccagccu

SEQ ID NO: 1373267 - RNA, 19 nt, Human
uaagacggaccccggcuga

SEQ ID NO: 1373268 - RNA, 21 nt, Human
uacuuccaugucuucugacuc

SEQ ID NO: 1373269 - RNA, 24 nt, Human
uagcaagacggcgucguuggagga

SEQ ID NO: 1373270 - RNA, 22 nt, Human
uagggaaaacugcagccagaag

SEQ ID NO: 1373271 - RNA, 24 nt, Human
ucaaggauccccaaucugcccucu

SEQ ID NO: 1373272 - RNA, 21 nt, Human
ucaccccccuuucugacccau

SEQ ID NO: 1373273 - RNA, 19 nt, Human
ucacugcagccuccgccuc

SEQ ID NO: 1373274 - RNA, 23 nt, Human
ucacugcagccuccgccuccugg

SEQ ID NO: 1373275 - RNA, 24 nt, Human
ucacugcagccuccgccuccuggu

SEQ ID NO: 1373276 - RNA, 26 nt, Human
ucacugcagccuccgccuccugguuc

SEQ ID NO: 1373277 - RNA, 20 nt, Human
ucagccuccugaguagcugg

SEQ ID NO: 1373278 - RNA, 19 nt, Human
ucaucacuuucaugcugug

SEQ ID NO: 1373279 - RNA, 24 nt, Human
uccacaaaccugccuggugaccac

SEQ ID NO: 1373280 - RNA, 22 nt, Human
uccauagggaaaacugcagcca

SEQ ID NO: 1373281 - RNA, 19 nt, Human
uccaugaaagcucccccca

SEQ ID NO: 1373282 - RNA, 21 nt, Human
uccauggugucgcugcagcca

SEQ ID NO: 1373283 - RNA, 21 nt, Human
uccccagcccagccuccaccc

SEQ ID NO: 1373284 - RNA, 25 nt, Human
uccccccaucaugggcagcugcgcg

SEQ ID NO: 1373285 - RNA, 24 nt, Human
uccgaccaggagauaaaaaccacc

SEQ ID NO: 1373286 - RNA, 23 nt, Human
uccgccuccugguucaagcaauu

SEQ ID NO: 1373287 - RNA, 19 nt, Human
uccuccacaaaccugccug

SEQ ID NO: 1373288 - RNA, 24 nt, Human
uccugaguagcugggauuacaggc

SEQ ID NO: 1373289 - RNA, 27 nt, Human
ucgcugcugccgcugccgcugcgggaa

SEQ ID NO: 1373290 - RNA, 24 nt, Human
ucguucuguugcccaggcuggagu

SEQ ID NO: 1373291 - RNA, 18 nt, Human
ucuccacuacagagggug

SEQ ID NO: 1373292 - RNA, 23 nt, Human
ucuccucccuucaccgcagcaaa

SEQ ID NO: 1373293 - RNA, 20 nt, Human
ucucgcacccaccuucaaga

SEQ ID NO: 1373294 - RNA, 23 nt, Human
ucucguucuguugcccaggcugg

SEQ ID NO: 1373295 - RNA, 24 nt, Human
ucucguucuguugcccaggcugga

SEQ ID NO: 1373296 - RNA, 21 nt, Human
ucucugggcuucuggcuccag

SEQ ID NO: 1373297 - RNA, 18 nt, Human
ucuguugcccaggcugga

SEQ ID NO: 1373298 - RNA, 24 nt, Human
ucuguugcccaggcuggagugcag

SEQ ID NO: 1373299 - RNA, 20 nt, Human
ucuuaaaaagaagagaaagg

SEQ ID NO: 1373300 - RNA, 18 nt, Human
ucuuccggcuggcccugg

SEQ ID NO: 1373301 - RNA, 25 nt, Human
ugaaaccagaauugggucaggaaca

SEQ ID NO: 1373302 - RNA, 24 nt, Human
ugaagaaaccacaggagaccaaga

SEQ ID NO: 1373303 - RNA, 22 nt, Human
ugacagaugugaucgguaagaa

SEQ ID NO: 1373304 - RNA, 23 nt, Human
ugacccauccguugaauaauuca

SEQ ID NO: 1373305 - RNA, 24 nt, Human
ugaccucaggaaggcaacuucacu

SEQ ID NO: 1373306 - RNA, 23 nt, Human
ugagcaggcacugucuggagcca

SEQ ID NO: 1373307 - RNA, 19 nt, Human
ugcacucgugaccuccccu

SEQ ID NO: 1373308 - RNA, 23 nt, Human
ugcagccagaagcacccggugcc

SEQ ID NO: 1373309 - RNA, 22 nt, Human
ugcaguggcacaaucucagcuc

SEQ ID NO: 1373310 - RNA, 18 nt, Human
ugccaggaccccagaugc

SEQ ID NO: 1373311 - RNA, 27 nt, Human
ugccagugauuccaggaauuccagaca

SEQ ID NO: 1373312 - RNA, 18 nt, Human
ugcccaggcuggagugca

SEQ ID NO: 1373313 - RNA, 22 nt, Human
ugcccaggcuggagugcagugg

SEQ ID NO: 1373314 - RNA, 24 nt, Human
ugcccaggcuggagugcaguggca

SEQ ID NO: 1373315 - RNA, 21 nt, Human
ugccccagcaccccacgcccu

SEQ ID NO: 1373316 - RNA, 22 nt, Human
ugcccuggaggugccacccagu

SEQ ID NO: 1373317 - RNA, 23 nt, Human
ugccuggacauucuccugagggc

SEQ ID NO: 1373318 - RNA, 18 nt, Human
ugccuggcacaucuagcu

SEQ ID NO: 1373319 - RNA, 19 nt, Human
ugccugggaugcuggaguc

SEQ ID NO: 1373320 - RNA, 18 nt, Human
ugccuugggaaggugugg

SEQ ID NO: 1373321 - RNA, 27 nt, Human
ugcuaagacggaccccggcugaggcag

SEQ ID NO: 1373322 - RNA, 22 nt, Human
ugcuggagacagagccauucac

SEQ ID NO: 1373323 - RNA, 21 nt, Human
uggaagccagagcuggcccag

SEQ ID NO: 1373324 - RNA, 18 nt, Human
uggacacaaaacuuaagc

SEQ ID NO: 1373325 - RNA, 18 nt, Human
uggaggcugaggggccuc

SEQ ID NO: 1373326 - RNA, 18 nt, Human
uggagugcaguggcacaa

SEQ ID NO: 1373327 - RNA, 23 nt, Human
uggagugcaguggcacaaucuca

SEQ ID NO: 1373328 - RNA, 24 nt, Human
uggagugcaguggcacaaucucag

SEQ ID NO: 1373329 - RNA, 24 nt, Human
uggcacaaucucagcucacugcag

SEQ ID NO: 1373330 - RNA, 24 nt, Human
uggcagaaggcaguacagucuggc

SEQ ID NO: 1373331 - RNA, 22 nt, Human
uggcagccgcguggacauuggc

SEQ ID NO: 1373332 - RNA, 23 nt, Human
uggccagaaauccagccuuugcu

SEQ ID NO: 1373333 - RNA, 23 nt, Human
uggcccaggccacaccaugacgg

SEQ ID NO: 1373334 - RNA, 19 nt, Human
uggcucugggcuucucgcc

SEQ ID NO: 1373335 - RNA, 20 nt, Human
ugggaugcugccuugggaag

SEQ ID NO: 1373336 - RNA, 21 nt, Human
ugggauuacaggcacaugcca

SEQ ID NO: 1373337 - RNA, 22 nt, Human
ugggauuacaggcacaugccac

SEQ ID NO: 1373338 - RNA, 23 nt, Human
ugggauuacaggcacaugccaca

SEQ ID NO: 1373339 - RNA, 19 nt, Human
ugggcgaguccaugaaagc

SEQ ID NO: 1373340 - RNA, 19 nt, Human
uggggcagagagcucagug

SEQ ID NO: 1373341 - RNA, 19 nt, Human
ugggggguggggguggggg

SEQ ID NO: 1373342 - RNA, 21 nt, Human
uggggggugggggugggggug

SEQ ID NO: 1373343 - RNA, 21 nt, Human
ugggggugggggugguuccug

SEQ ID NO: 1373344 - RNA, 18 nt, Human
ugggguuugauggagaga

SEQ ID NO: 1373345 - RNA, 21 nt, Human
ugguucuagaacacaggagaa

SEQ ID NO: 1373346 - RNA, 25 nt, Human
ugugcacuggggcgaugaugcugug

SEQ ID NO: 1373347 - RNA, 20 nt, Human
uguggccagaaauccagccc

SEQ ID NO: 1373348 - RNA, 18 nt, Human
uguggggggugggggugg

SEQ ID NO: 1373349 - RNA, 19 nt, Human
ugugggggguggggguggg

SEQ ID NO: 1373350 - RNA, 22 nt, Human
uguggggggugggggugggggu

SEQ ID NO: 1373351 - RNA, 19 nt, Human
uuaaggaaguggcuugggc

SEQ ID NO: 1373352 - RNA, 21 nt, Human
uuacaggggucaggcccuccu

SEQ ID NO: 1373353 - RNA, 20 nt, Human
uucacgcacaccgcggcuaa

SEQ ID NO: 1373354 - RNA, 24 nt, Human
uucacgcacaccgcggcuaacucc

SEQ ID NO: 1373355 - RNA, 24 nt, Human
uuccaaacugcuaagacggacccc

SEQ ID NO: 1373356 - RNA, 20 nt, Human
uuccucagagaagaaacagc

SEQ ID NO: 1373357 - RNA, 19 nt, Human
uucugggaccuuucccacu

SEQ ID NO: 1373358 - RNA, 19 nt, Human
uucuguuccgacuccucca

SEQ ID NO: 1373359 - RNA, 24 nt, Human
uugcccaggcuggagugcaguggc

SEQ ID NO: 1373360 - RNA, 20 nt, Human
uugggaagguguggggggug

SEQ ID NO: 1373361 - RNA, 23 nt, Human
uuucaaagucaaacuaggaacau

SEQ ID NO: 1373362 - RNA, 20 nt, Human
uuugcaguguauaaagugag

SEQ ID NO: 1373363 - RNA, 18 nt, Human
uuugcuccuuaaucagac

SEQ ID NO: 1373364 - RNA, 21 nt, Human
aaaaaaaggagaacaacaaaa

SEQ ID NO: 1373365 - RNA, 23 nt, Human
aaaaaaaggagaacaacaaaaaa

SEQ ID NO: 1373366 - RNA, 23 nt, Human
aaaaaggagaacaacaaaaaauc

SEQ ID NO: 1373367 - RNA, 24 nt, Human
aaaaaggagaacaacaaaaaaucc

SEQ ID NO: 1373368 - RNA, 18 nt, Human
aaagcuggcauccucuaa

SEQ ID NO: 1373369 - RNA, 21 nt, Human
aacaaaaaauccaacaacagc

SEQ ID NO: 1373370 - RNA, 20 nt, Human
aacaucguuccuggaggagg

SEQ ID NO: 1373371 - RNA, 18 nt, Human
aaccgaucuaaaacuucu

SEQ ID NO: 1373372 - RNA, 18 nt, Human
aaccgaucuaaaacuucu

SEQ ID NO: 1373373 - RNA, 19 nt, Human
aacucgcuucuaccuucag

SEQ ID NO: 1373374 - RNA, 18 nt, Human
aagaaggcauauuaaaac

SEQ ID NO: 1373375 - RNA, 21 nt, Human
aagcuccaaacaucguuccug

SEQ ID NO: 1373376 - RNA, 22 nt, Human
aaggcauauuaaaacuucugag

SEQ ID NO: 1373377 - RNA, 19 nt, Human
acaaaaaaaggagaacaac

SEQ ID NO: 1373378 - RNA, 22 nt, Human
acaaaaaauccaacaacagcug

SEQ ID NO: 1373379 - RNA, 20 nt, Human
acaacagcugcacauaccac

SEQ ID NO: 1373380 - RNA, 19 nt, Human
accaguucccauggaaaac

SEQ ID NO: 1373381 - RNA, 25 nt, Human
acuacaauuccauuaaacuucaauu

SEQ ID NO: 1373382 - RNA, 21 nt, Human
agguagggcugagggguagca

SEQ ID NO: 1373383 - RNA, 18 nt, Human
agucagggucuugaugug

SEQ ID NO: 1373384 - RNA, 22 nt, Human
aucuuuuauugcuauugcccau

SEQ ID NO: 1373385 - RNA, 21 nt, Human
auuaaaacuucugaguucuga

SEQ ID NO: 1373386 - RNA, 24 nt, Human
auuaguccagaaagcguuucacca

SEQ ID NO: 1373387 - RNA, 22 nt, Human
cacaacucugcguagcuccucc

SEQ ID NO: 1373388 - RNA, 25 nt, Human
cacauuuaaacuaccaggaucaucu

SEQ ID NO: 1373389 - RNA, 20 nt, Human
caccaaguuuuuucucucuu

SEQ ID NO: 1373390 - RNA, 22 nt, Human
cacuuguucuuuccauacuuca

SEQ ID NO: 1373391 - RNA, 20 nt, Human
ccacaaaaaaaggagaacaa

SEQ ID NO: 1373392 - RNA, 21 nt, Human
ccacuggaaacaauggaccac

SEQ ID NO: 1373393 - RNA, 18 nt, Human
ccuccaggaccagcccca

SEQ ID NO: 1373394 - RNA, 24 nt, Human
ccuccaggaccagccccagguagg

SEQ ID NO: 1373395 - RNA, 23 nt, Human
ccuccauagcgcgaaggcugcuc

SEQ ID NO: 1373396 - RNA, 21 nt, Human
ccuucagaaugugggguuggg

SEQ ID NO: 1373397 - RNA, 21 nt, Human
cuccauagcgcgaaggcugcu

SEQ ID NO: 1373398 - RNA, 21 nt, Human
cuccuccaggaccagccccag

SEQ ID NO: 1373399 - RNA, 19 nt, Human
cuggcuuucgugaaguuga

SEQ ID NO: 1373400 - RNA, 19 nt, Human
gacccagugucagaaggag

SEQ ID NO: 1373401 - RNA, 25 nt, Human
gagauuguauccuuuuagaaauauc

SEQ ID NO: 1373402 - RNA, 22 nt, Human
gaggaagagcugaaucaggaua

SEQ ID NO: 1373403 - RNA, 20 nt, Human
gaggaauaaagccggggcca

SEQ ID NO: 1373404 - RNA, 19 nt, Human
gcauauuaaaacuucugag

SEQ ID NO: 1373405 - RNA, 23 nt, Human
gcugcacauaccaccaguuccca

SEQ ID NO: 1373406 - RNA, 21 nt, Human
ggaaacaucauccuauggucc

SEQ ID NO: 1373407 - RNA, 25 nt, Human
ggagaacaacaaaaaauccaacaac

SEQ ID NO: 1373408 - RNA, 21 nt, Human
ggagguugggggaaaagaggu

SEQ ID NO: 1373409 - RNA, 25 nt, Human
gggcaccuuguguccacuggaaaca

SEQ ID NO: 1373410 - RNA, 20 nt, Human
gggguugggguaaaauccag

SEQ ID NO: 1373411 - RNA, 21 nt, Human
guagugcugccacaacucugc

SEQ ID NO: 1373412 - RNA, 18 nt, Human
guugggguaaaauccagg

SEQ ID NO: 1373413 - RNA, 23 nt, Human
guuuuuucucucuucccacauaa

SEQ ID NO: 1373414 - RNA, 25 nt, Human
uaaccgaucuaaaacuucuccacaa

SEQ ID NO: 1373415 - RNA, 21 nt, Human
uacuuaaacugaaaaugagau

SEQ ID NO: 1373416 - RNA, 26 nt, Human
uaguggauuccauuucugaaggcauu

SEQ ID NO: 1373417 - RNA, 23 nt, Human
uauugcccaucguucuucagucg

SEQ ID NO: 1373418 - RNA, 19 nt, Human
uccacuggaaacaauggac

SEQ ID NO: 1373419 - RNA, 20 nt, Human
ucccacauaaagccgacucc

SEQ ID NO: 1373420 - RNA, 18 nt, Human
uccuccaggaccagcccc

SEQ ID NO: 1373421 - RNA, 19 nt, Human
ucuaaagaugacucuacuu

SEQ ID NO: 1373422 - RNA, 23 nt, Human
ucuaucagaauuagaauaaaauc

SEQ ID NO: 1373423 - RNA, 20 nt, Human
ucuggauguucaguagcagg

SEQ ID NO: 1373424 - RNA, 24 nt, Human
ucuuuuauugcuauugcccaucgu

SEQ ID NO: 1373425 - RNA, 25 nt, Human
ugaauaaggcuaaauuuuucaagua

SEQ ID NO: 1373426 - RNA, 24 nt, Human
ugagaaaaguguaaucacuuaagu

SEQ ID NO: 1373427 - RNA, 24 nt, Human
ugauuggagcaagagguggaggaa

SEQ ID NO: 1373428 - RNA, 20 nt, Human
ugauuuuggcuucagcuauu

SEQ ID NO: 1373429 - RNA, 24 nt, Human
uggacagauguuucucauugcaaa

SEQ ID NO: 1373430 - RNA, 19 nt, Human
uggaggagguugggggaaa

SEQ ID NO: 1373431 - RNA, 26 nt, Human
uggaggagguugggggaaaagagguc

SEQ ID NO: 1373432 - RNA, 18 nt, Human
uggaugaaaguaaggagg

SEQ ID NO: 1373433 - RNA, 24 nt, Human
ugguggaccugggaaaucccuugg

SEQ ID NO: 1373434 - RNA, 24 nt, Human
ugucagaaggagcucugugaggau

SEQ ID NO: 1373435 - RNA, 23 nt, Human
uguggaggaagagcugaaucagg

SEQ ID NO: 1373436 - RNA, 19 nt, Human
uuagaauaaaaucugucuu

SEQ ID NO: 1373437 - RNA, 21 nt, Human
uuagaauaaaaucugucuucc

SEQ ID NO: 1373438 - RNA, 22 nt, Human
uucgugcuucugcuaccgccuu

SEQ ID NO: 1373439 - RNA, 22 nt, Human
uugcagaugauuuuggcuucag

SEQ ID NO: 1373440 - RNA, 19 nt, Human
uuggagcaagagguggagg

SEQ ID NO: 1373441 - RNA, 20 nt, Human
uugggguaaaauccaggucu

SEQ ID NO: 1373442 - RNA, 25 nt, Human
uuuggagucuucaaauguuauuuuc

SEQ ID NO: 1373443 - RNA, 23 nt, Human
aaaaauucccuaacugcaguguc

SEQ ID NO: 1373444 - RNA, 20 nt, Human
aaccaagccacccagcucgg

SEQ ID NO: 1373445 - RNA, 22 nt, Human
aaccaagccacccagcucggcc

SEQ ID NO: 1373446 - RNA, 20 nt, Human
aacucccauccagcagccuc

SEQ ID NO: 1373447 - RNA, 19 nt, Human
aagcagcuugcgaucuugg

SEQ ID NO: 1373448 - RNA, 24 nt, Human
aagcagcuugcgaucuuggccucc

SEQ ID NO: 1373449 - RNA, 20 nt, Human
aagccacccagcucggccag

SEQ ID NO: 1373450 - RNA, 22 nt, Human
accaagccacccagcucggcca

SEQ ID NO: 1373451 - RNA, 22 nt, Human
acccuggguccacccucccaau

SEQ ID NO: 1373452 - RNA, 26 nt, Human
agcucugcggccccaaaacacucccc

SEQ ID NO: 1373453 - RNA, 21 nt, Human
agcugcucgcagccgcgggcg

SEQ ID NO: 1373454 - RNA, 24 nt, Human
aggcagcggcucggcgggcagcgc

SEQ ID NO: 1373455 - RNA, 21 nt, Human
agucccuggugcacacaaccc

SEQ ID NO: 1373456 - RNA, 20 nt, Human
aucgccaccgugugcgugag

SEQ ID NO: 1373457 - RNA, 22 nt, Human
augacccuggguccacccuccc

SEQ ID NO: 1373458 - RNA, 23 nt, Human
caaacccgacgcgcccuccgccu

SEQ ID NO: 1373459 - RNA, 19 nt, Human
cacaacccugaagagcggc

SEQ ID NO: 1373460 - RNA, 19 nt, Human
cacccagcucggccagaag

SEQ ID NO: 1373461 - RNA, 20 nt, Human
cacgcagauagaccucccac

SEQ ID NO: 1373462 - RNA, 19 nt, Human
cagagugacucccugggcu

SEQ ID NO: 1373463 - RNA, 19 nt, Human
cagcggcgcggcgugcgca

SEQ ID NO: 1373464 - RNA, 19 nt, Human
cagcggcucggcgggcagc

SEQ ID NO: 1373465 - RNA, 21 nt, Human
cagcggcucggcgggcagcgc

SEQ ID NO: 1373466 - RNA, 22 nt, Human
cagcuuucagccgcccaacugg

SEQ ID NO: 1373467 - RNA, 19 nt, Human
caggagcggaggcagcggc

SEQ ID NO: 1373468 - RNA, 20 nt, Human
caucuaacggaaggguuggu

SEQ ID NO: 1373469 - RNA, 19 nt, Human
ccacacguccggcgccagg

SEQ ID NO: 1373470 - RNA, 21 nt, Human
cccaccccgcgcccggccgcc

SEQ ID NO: 1373471 - RNA, 23 nt, Human
cccauccagcagccucccugccc

SEQ ID NO: 1373472 - RNA, 18 nt, Human
ccccaaaacacuccccuc

SEQ ID NO: 1373473 - RNA, 22 nt, Human
ccccgaaggcccaccccgcgcc

SEQ ID NO: 1373474 - RNA, 24 nt, Human
ccccgcacugagcgugccucccag

SEQ ID NO: 1373475 - RNA, 18 nt, Human
ccccuccagcuuucagcc

SEQ ID NO: 1373476 - RNA, 20 nt, Human
cccgcaaacucccauccagc

SEQ ID NO: 1373477 - RNA, 23 nt, Human
cccgcacugagcgugccucccag

SEQ ID NO: 1373478 - RNA, 23 nt, Human
cccgcugcgccuccagcccgccc

SEQ ID NO: 1373479 - RNA, 22 nt, Human
cccuacgcagacuccucccucc

SEQ ID NO: 1373480 - RNA, 24 nt, Human
cccuccgccuccccgaaggcccac

SEQ ID NO: 1373481 - RNA, 22 nt, Human
cccugggcuccuggcugacccc

SEQ ID NO: 1373482 - RNA, 21 nt, Human
ccgcaaacucccauccagcag

SEQ ID NO: 1373483 - RNA, 26 nt, Human
ccgcccagugacucugcuccagcugc

SEQ ID NO: 1373484 - RNA, 21 nt, Human
ccgcggguccccugguagccc

SEQ ID NO: 1373485 - RNA, 22 nt, Human
ccgcugcgccuccagcccgccc

SEQ ID NO: 1373486 - RNA, 23 nt, Human
ccggcccccccucgagccagaga

SEQ ID NO: 1373487 - RNA, 18 nt, Human
ccggccgccuucacgugc

SEQ ID NO: 1373488 - RNA, 21 nt, Human
ccuccagcccgccccgcugug

SEQ ID NO: 1373489 - RNA, 26 nt, Human
ccuccgccuccccgaaggcccacccc

SEQ ID NO: 1373490 - RNA, 25 nt, Human
ccuccugccgcaccuucugcagguc

SEQ ID NO: 1373491 - RNA, 21 nt, Human
ccugaaaugccuccugcacgg

SEQ ID NO: 1373492 - RNA, 23 nt, Human
ccugacagcugcgcuuggcugcu

SEQ ID NO: 1373493 - RNA, 20 nt, Human
ccugagcuccucgcaggcgu

SEQ ID NO: 1373494 - RNA, 25 nt, Human
ccugcagcaccucggggaccucggc

SEQ ID NO: 1373495 - RNA, 20 nt, Human
cgcaccgccuccucccagug

SEQ ID NO: 1373496 - RNA, 18 nt, Human
cgcagggugguggccucc

SEQ ID NO: 1373497 - RNA, 21 nt, Human
cgccagaaaagccuuuucaaa

SEQ ID NO: 1373498 - RNA, 23 nt, Human
cgccuccgacgccagaaaagccu

SEQ ID NO: 1373499 - RNA, 18 nt, Human
cgcgcgagcuccuggagg

SEQ ID NO: 1373500 - RNA, 18 nt, Human
cgcgugcagauucgcagg

SEQ ID NO: 1373501 - RNA, 23 nt, Human
cgcucuccagucgggcccacacg

SEQ ID NO: 1373502 - RNA, 20 nt, Human
cggcccccccucgagccaga

SEQ ID NO: 1373503 - RNA, 20 nt, Human
cgggcagcgccagccccggg

SEQ ID NO: 1373504 - RNA, 22 nt, Human
cggggcgcccaggaagucagga

SEQ ID NO: 1373505 - RNA, 21 nt, Human
cucccaucuaacggaaggguu

SEQ ID NO: 1373506 - RNA, 20 nt, Human
cucccugggcuccuggcuga

SEQ ID NO: 1373507 - RNA, 20 nt, Human
cugaggaugcguccgcaccu

SEQ ID NO: 1373508 - RNA, 24 nt, Human
cugcagcaccucggggaccucggc

SEQ ID NO: 1373509 - RNA, 26 nt, Human
cugcagguggccgucaccaggggcuu

SEQ ID NO: 1373510 - RNA, 20 nt, Human
cugcuccagcugcaagaugc

SEQ ID NO: 1373511 - RNA, 22 nt, Human
cugggccacggcgcuguggaag

SEQ ID NO: 1373512 - RNA, 21 nt, Human
cuucucagccccugcucccgg

SEQ ID NO: 1373513 - RNA, 25 nt, Human
cuucuggaagcugcagguggccguc

SEQ ID NO: 1373514 - RNA, 19 nt, Human
gaaccuggagagaagacug

SEQ ID NO: 1373515 - RNA, 24 nt, Human
gacgccccuucucagccccugcuc

SEQ ID NO: 1373516 - RNA, 18 nt, Human
gagcgugccucccagccc

SEQ ID NO: 1373517 - RNA, 24 nt, Human
gcacugagcgugccucccagcccc

SEQ ID NO: 1373518 - RNA, 18 nt, Human
gcagcggcucggcgggca

SEQ ID NO: 1373519 - RNA, 23 nt, Human
gcccgauaggcagcauugagagc

SEQ ID NO: 1373520 - RNA, 21 nt, Human
gcccugaagcaagugcuucug

SEQ ID NO: 1373521 - RNA, 21 nt, Human
gccuccaggaagcugguguag

SEQ ID NO: 1373522 - RNA, 23 nt, Human
gcggaggcagcggcucggcgggc

SEQ ID NO: 1373523 - RNA, 23 nt, Human
gcuucgccgcaccgccuccuccc

SEQ ID NO: 1373524 - RNA, 20 nt, Human
ggaccucggcggccgcccag

SEQ ID NO: 1373525 - RNA, 20 nt, Human
ggccgcggguccccugguag

SEQ ID NO: 1373526 - RNA, 18 nt, Human
ggggggagaagggugggc

SEQ ID NO: 1373527 - RNA, 20 nt, Human
gguagcccccgcugcgccuc

SEQ ID NO: 1373528 - RNA, 18 nt, Human
uauggacguccauggaca

SEQ ID NO: 1373529 - RNA, 18 nt, Human
uccauggacagcggcgcc

SEQ ID NO: 1373530 - RNA, 19 nt, Human
ucccauccagcagccuccc

SEQ ID NO: 1373531 - RNA, 19 nt, Human
uccccgaaggcccaccccg

SEQ ID NO: 1373532 - RNA, 23 nt, Human
uccccgaaggcccaccccgcgcc

SEQ ID NO: 1373533 - RNA, 18 nt, Human
uccccgauuuccccccgc

SEQ ID NO: 1373534 - RNA, 22 nt, Human
uccccugguagcccccgcugcg

SEQ ID NO: 1373535 - RNA, 22 nt, Human
ucccuagcugcgcgaugacccu

SEQ ID NO: 1373536 - RNA, 18 nt, Human
uccugcacggcugcuccu

SEQ ID NO: 1373537 - RNA, 19 nt, Human
uccugcgucagccaguccc

SEQ ID NO: 1373538 - RNA, 18 nt, Human
ucgccgcaccgccuccuc

SEQ ID NO: 1373539 - RNA, 20 nt, Human
ucgccgcaccgccuccuccc

SEQ ID NO: 1373540 - RNA, 24 nt, Human
ucgggcccacacguccggcgccag

SEQ ID NO: 1373541 - RNA, 20 nt, Human
ucggggggagaagggugggc

SEQ ID NO: 1373542 - RNA, 25 nt, Human
ucuccagcuccucuuggggggccgc

SEQ ID NO: 1373543 - RNA, 22 nt, Human
ucuccagcuccucuuggguucc

SEQ ID NO: 1373544 - RNA, 24 nt, Human
ucugcucuucacuuucagacugga

SEQ ID NO: 1373545 - RNA, 21 nt, Human
ucuucacuuucagacuggagg

SEQ ID NO: 1373546 - RNA, 22 nt, Human
ugaaaugccuccugcacggcug

SEQ ID NO: 1373547 - RNA, 21 nt, Human
ugaacagacgccccuucucag

SEQ ID NO: 1373548 - RNA, 21 nt, Human
ugacccuggguccacccuccc

SEQ ID NO: 1373549 - RNA, 30 nt, Human
ugacucccugggcuccuggcugacccccuc

SEQ ID NO: 1373550 - RNA, 20 nt, Human
ugagcuccucgcaggcguug

SEQ ID NO: 1373551 - RNA, 20 nt, Human
ugauguaggcgcccaggugc

SEQ ID NO: 1373552 - RNA, 21 nt, Human
ugcaagaugcugucgaagcag

SEQ ID NO: 1373553 - RNA, 23 nt, Human
ugccguagacguuggcggcccag

SEQ ID NO: 1373554 - RNA, 22 nt, Human
ugcgugaggcuugaacagacgc

SEQ ID NO: 1373555 - RNA, 24 nt, Human
ugcgugaggcuugaacagacgccc

SEQ ID NO: 1373556 - RNA, 19 nt, Human
uggccuccagcuccgcgga

SEQ ID NO: 1373557 - RNA, 22 nt, Human
uggccugacagcugcgcuuggc

SEQ ID NO: 1373558 - RNA, 19 nt, Human
uggcugacccccacugacc

SEQ ID NO: 1373559 - RNA, 25 nt, Human
ugggacuggauaggaauucguucug

SEQ ID NO: 1373560 - RNA, 22 nt, Human
uggguuccugggaaccuggaga

SEQ ID NO: 1373561 - RNA, 19 nt, Human
ugguagaggcccugcagca

SEQ ID NO: 1373562 - RNA, 19 nt, Human
ugguggccuccagcuccgc

SEQ ID NO: 1373563 - RNA, 18 nt, Human
uucucagccccugcuccc

SEQ ID NO: 1373564 - RNA, 23 nt, Human
uucucagccccugcucccgggcc

SEQ ID NO: 1373565 - RNA, 24 nt, Human
aaagugcugggguuacagguguga

SEQ ID NO: 1373566 - RNA, 24 nt, Human
aagcuggucucgagccgugacaca

SEQ ID NO: 1373567 - RNA, 19 nt, Human
aaguagcugggauuacagg

SEQ ID NO: 1373568 - RNA, 26 nt, Human
aagugcugggguuacaggugugagcc

SEQ ID NO: 1373569 - RNA, 19 nt, Human
acaggcgcccgccaccacg

SEQ ID NO: 1373570 - RNA, 24 nt, Human
accauguuggccaagcuggucucg

SEQ ID NO: 1373571 - RNA, 18 nt, Human
acuuccacaacaagggau

SEQ ID NO: 1373572 - RNA, 22 nt, Human
agacuaccuuccaccaccacuu

SEQ ID NO: 1373573 - RNA, 24 nt, Human
agcgauucuccugccucagccucc

SEQ ID NO: 1373574 - RNA, 24 nt, Human
agcuccgcccaccacaccaacgcu

SEQ ID NO: 1373575 - RNA, 24 nt, Human
agcuggucucgagcuccugaccuc

SEQ ID NO: 1373576 - RNA, 20 nt, Human
aggcgcccgccaccacgccu

SEQ ID NO: 1373577 - RNA, 23 nt, Human
aguagcugggauuacaggcgccc

SEQ ID NO: 1373578 - RNA, 19 nt, Human
agugauccacccaccucag

SEQ ID NO: 1373579 - RNA, 20 nt, Human
agugcaguggcgggaucucg

SEQ ID NO: 1373580 - RNA, 23 nt, Human
agugcaguggcgggaucucggcu

SEQ ID NO: 1373581 - RNA, 24 nt, Human
agugcaguggcgggaucucggcuc

SEQ ID NO: 1373582 - RNA, 24 nt, Human
caaagugcugggguuacaggugug

SEQ ID NO: 1373583 - RNA, 22 nt, Human
caagcgauucuccugccucagc

SEQ ID NO: 1373584 - RNA, 27 nt, Human
caagcgauucuccugccucagccuccc

SEQ ID NO: 1373585 - RNA, 19 nt, Human
caagugauccacccaccuc

SEQ ID NO: 1373586 - RNA, 21 nt, Human
cacagaggacuccagaagcca

SEQ ID NO: 1373587 - RNA, 18 nt, Human
caccacuugcaucuguca

SEQ ID NO: 1373588 - RNA, 21 nt, Human
caccauguuggccaagcuggu

SEQ ID NO: 1373589 - RNA, 24 nt, Human
caccauguuggccaagcuggucuc

SEQ ID NO: 1373590 - RNA, 22 nt, Human
cacccaccucagccucccaaag

SEQ ID NO: 1373591 - RNA, 23 nt, Human
cacccaccucagccucccaaagu

SEQ ID NO: 1373592 - RNA, 24 nt, Human
caccucagccucccaaagugcugg

SEQ ID NO: 1373593 - RNA, 24 nt, Human
caccugggcuggagugcaguggcg

SEQ ID NO: 1373594 - RNA, 21 nt, Human
cagaggacuccagaagccagg

SEQ ID NO: 1373595 - RNA, 23 nt, Human
cauguuggccaagcuggucucga

SEQ ID NO: 1373596 - RNA, 20 nt, Human
ccaaagugcugggguuacag

SEQ ID NO: 1373597 - RNA, 21 nt, Human
ccaaagugcugggguuacagg

SEQ ID NO: 1373598 - RNA, 24 nt, Human
ccaaagugcugggguuacaggugu

SEQ ID NO: 1373599 - RNA, 22 nt, Human
ccaaguagcugggauuacaggc

SEQ ID NO: 1373600 - RNA, 26 nt, Human
ccacccaccucagccucccaaagugc

SEQ ID NO: 1373601 - RNA, 23 nt, Human
cccaaguagcugggauuacaggc

SEQ ID NO: 1373602 - RNA, 23 nt, Human
cccaaguagcugggauuacaggc

SEQ ID NO: 1373603 - RNA, 24 nt, Human
ccgccucccagauucaagcgauuc

SEQ ID NO: 1373604 - RNA, 24 nt, Human
ccucccagauucaagcgauucucc

SEQ ID NO: 1373605 - RNA, 24 nt, Human
ccugaccucaagugauccacccac

SEQ ID NO: 1373606 - RNA, 23 nt, Human
ccugccucagccucccaaguagc

SEQ ID NO: 1373607 - RNA, 25 nt, Human
ccuuccaccaccacuugcaucuguc

SEQ ID NO: 1373608 - RNA, 24 nt, Human
cgcucugucaccugggcuggagug

SEQ ID NO: 1373609 - RNA, 24 nt, Human
cucaagugauccacccaccucagc

SEQ ID NO: 1373610 - RNA, 22 nt, Human
cucacagaggacuccagaagcc

SEQ ID NO: 1373611 - RNA, 24 nt, Human
cucagccucccaaguagcugggau

SEQ ID NO: 1373612 - RNA, 24 nt, Human
cucgcucugucaccugggcuggag

SEQ ID NO: 1373613 - RNA, 23 nt, Human
cucugucaccugggcuggagugc

SEQ ID NO: 1373614 - RNA, 24 nt, Human
cugcaaucuccgccucccagauuc

SEQ ID NO: 1373615 - RNA, 23 nt, Human
cugccucagccucccaaguagcu

SEQ ID NO: 1373616 - RNA, 24 nt, Human
gaccucaagugauccacccaccuc

SEQ ID NO: 1373617 - RNA, 19 nt, Human
gagccgccgaggccggcca

SEQ ID NO: 1373618 - RNA, 19 nt, Human
gagcgaccugagggcaaca

SEQ ID NO: 1373619 - RNA, 18 nt, Human
gauuacaggcgcccgcca

SEQ ID NO: 1373620 - RNA, 22 nt, Human
gcaaucuccgccucccagauuc

SEQ ID NO: 1373621 - RNA, 20 nt, Human
gccaagcuggucucgagcuc

SEQ ID NO: 1373622 - RNA, 24 nt, Human
gccuggcuaauuuuuuuguauuuu

SEQ ID NO: 1373623 - RNA, 24 nt, Human
gcgauucuccugccucagccuccc

SEQ ID NO: 1373624 - RNA, 24 nt, Human
ggcuggagugcaguggcgggaucu

SEQ ID NO: 1373625 - RNA, 19 nt, Human
ggucucgagcuccugaccu

SEQ ID NO: 1373626 - RNA, 23 nt, Human
guagagacgggggcucaccaugu

SEQ ID NO: 1373627 - RNA, 18 nt, Human
guagcugggauuacaggc

SEQ ID NO: 1373628 - RNA, 24 nt, Human
gugauccacccaccucagccuccc

SEQ ID NO: 1373629 - RNA, 22 nt, Human
uacaggcgcccgccaccacgcc

SEQ ID NO: 1373630 - RNA, 22 nt, Human
uagagacgggggcucaccaugu

SEQ ID NO: 1373631 - RNA, 24 nt, Human
uaguagagacgggggcucaccaug

SEQ ID NO: 1373632 - RNA, 21 nt, Human
ucacagaggacuccagaagcc

SEQ ID NO: 1373633 - RNA, 22 nt, Human
ucaccugggcuggagugcagug

SEQ ID NO: 1373634 - RNA, 18 nt, Human
ucacugcaaucuccgccu

SEQ ID NO: 1373635 - RNA, 19 nt, Human
ucacugcaaucuccgccuc

SEQ ID NO: 1373636 - RNA, 23 nt, Human
ucacugcaaucuccgccucccag

SEQ ID NO: 1373637 - RNA, 24 nt, Human
ucacugcaaucuccgccucccaga

SEQ ID NO: 1373638 - RNA, 18 nt, Human
ucagccucccaaagugcu

SEQ ID NO: 1373639 - RNA, 20 nt, Human
ucagccucccaaagugcugg

SEQ ID NO: 1373640 - RNA, 18 nt, Human
ucagccucccaaguagcu

SEQ ID NO: 1373641 - RNA, 20 nt, Human
ucagccucccaaguagcugg

SEQ ID NO: 1373642 - RNA, 18 nt, Human
uccaccaccacuugcauc

SEQ ID NO: 1373643 - RNA, 21 nt, Human
uccacccaccucagccuccca

SEQ ID NO: 1373644 - RNA, 19 nt, Human
uccaugaacaccgcuccau

SEQ ID NO: 1373645 - RNA, 23 nt, Human
ucccaaagugcugggguuacagg

SEQ ID NO: 1373646 - RNA, 24 nt, Human
ucccaaguagcugggauuacaggc

SEQ ID NO: 1373647 - RNA, 21 nt, Human
ucccagauucaagcgauucuc

SEQ ID NO: 1373648 - RNA, 24 nt, Human
ucccagauucaagcgauucuccug

SEQ ID NO: 1373649 - RNA, 18 nt, Human
uccgcgcccgggagcgac

SEQ ID NO: 1373650 - RNA, 24 nt, Human
ucgcucugucaccugggcuggagu

SEQ ID NO: 1373651 - RNA, 26 nt, Human
ucuccugccucagccucccaaguagc

SEQ ID NO: 1373652 - RNA, 18 nt, Human
ucucgcucugucaccugg

SEQ ID NO: 1373653 - RNA, 19 nt, Human
ucucgcucugucaccuggg

SEQ ID NO: 1373654 - RNA, 22 nt, Human
ucucgcucugucaccugggcug

SEQ ID NO: 1373655 - RNA, 23 nt, Human
ucucgcucugucaccugggcugg

SEQ ID NO: 1373656 - RNA, 24 nt, Human
ucucgcucugucaccugggcugga

SEQ ID NO: 1373657 - RNA, 22 nt, Human
ugagauggagucucgcucuguc

SEQ ID NO: 1373658 - RNA, 24 nt, Human
ugauccacccaccucagccuccca

SEQ ID NO: 1373659 - RNA, 24 nt, Human
ugccucagccucccaaguagcugg

SEQ ID NO: 1373660 - RNA, 23 nt, Human
uggagugcaguggcgggaucucg

SEQ ID NO: 1373661 - RNA, 24 nt, Human
uggagugcaguggcgggaucucgg

SEQ ID NO: 1373662 - RNA, 24 nt, Human
uggccaagcuggucucgagcuccu

SEQ ID NO: 1373663 - RNA, 21 nt, Human
ugggauuacaggcgcccgcca

SEQ ID NO: 1373664 - RNA, 22 nt, Human
ugggauuacaggcgcccgccac

SEQ ID NO: 1373665 - RNA, 24 nt, Human
ugggauuacaggcgcccgccacca

SEQ ID NO: 1373666 - RNA, 22 nt, Human
ugggguuacaggugugagccgc

SEQ ID NO: 1373667 - RNA, 23 nt, Human
ugggguuacaggugugagccgcc

SEQ ID NO: 1373668 - RNA, 21 nt, Human
ugucaccugggcuggagugca

SEQ ID NO: 1373669 - RNA, 24 nt, Human
uuaguagagacgggggcucaccau

SEQ ID NO: 1373670 - RNA, 21 nt, Human
uucaagcgauucuccugccuc

SEQ ID NO: 1373671 - RNA, 23 nt, Human
uucaagcgauucuccugccucag

SEQ ID NO: 1373672 - RNA, 24 nt, Human
uucaagcgauucuccugccucagc

SEQ ID NO: 1373673 - RNA, 20 nt, Human
uuccguguccgcgcccggga

SEQ ID NO: 1373674 - RNA, 20 nt, Human
uuuuuguauuuuaguagaga

SEQ ID NO: 1373675 - RNA, 20 nt, Human
uuuuuuguauuuuaguagag

SEQ ID NO: 1373676 - RNA, 24 nt, Human
uuuuuuuguauuuuaguagagacg

SEQ ID NO: 1373677 - RNA, 25 nt, Human
uuuuuuuuuuuugagauggagucuc

SEQ ID NO: 1373678 - RNA, 21 nt, Human
aacaaauuuaauucuguucca

SEQ ID NO: 1373679 - RNA, 23 nt, Human
aacauagagagcaguggaagaga

SEQ ID NO: 1373680 - RNA, 22 nt, Human
aagagacaggagagauaugcca

SEQ ID NO: 1373681 - RNA, 22 nt, Human
aagaucccaagacuucuaccaa

SEQ ID NO: 1373682 - RNA, 18 nt, Human
aaguguaauacaggcagg

SEQ ID NO: 1373683 - RNA, 22 nt, Human
agaaagucuucauuuaaaacau

SEQ ID NO: 1373684 - RNA, 22 nt, Human
agacaggagagauaugccagaa

SEQ ID NO: 1373685 - RNA, 21 nt, Human
agagccuugucuccucuccuc

SEQ ID NO: 1373686 - RNA, 22 nt, Human
agagccuugucuccucuccucc

SEQ ID NO: 1373687 - RNA, 23 nt, Human
agcaguggaagagacaggagaga

SEQ ID NO: 1373688 - RNA, 21 nt, Human
aggaaggaggcaacaacagga

SEQ ID NO: 1373689 - RNA, 24 nt, Human
auguggcccuguagagagcuggaa

SEQ ID NO: 1373690 - RNA, 22 nt, Human
auuuaaaacauuccucccaucc

SEQ ID NO: 1373691 - RNA, 19 nt, Human
caggagagauaugccagaa

SEQ ID NO: 1373692 - RNA, 21 nt, Human
ccagagccuugucuccucucc

SEQ ID NO: 1373693 - RNA, 21 nt, Human
ccagccccaaagaagaggaag

SEQ ID NO: 1373694 - RNA, 18 nt, Human
cccauggcaagaucccaa

SEQ ID NO: 1373695 - RNA, 21 nt, Human
cccauggcaagaucccaagac

SEQ ID NO: 1373696 - RNA, 18 nt, Human
cuccucuccuccacuccc

SEQ ID NO: 1373697 - RNA, 18 nt, Human
cuggaccggcuguccaga

SEQ ID NO: 1373698 - RNA, 22 nt, Human
cuguuccagccccaaagaagag

SEQ ID NO: 1373699 - RNA, 25 nt, Human
gagagcaguggaagagaccgguacc

SEQ ID NO: 1373700 - RNA, 19 nt, Human
gagcaguggaagagacagg

SEQ ID NO: 1373701 - RNA, 21 nt, Human
gagcaguggaagagacaggag

SEQ ID NO: 1373702 - RNA, 18 nt, Human
gaggacagaggagagaga

SEQ ID NO: 1373703 - RNA, 23 nt, Human
gccuugucuccucuccuccacuc

SEQ ID NO: 1373704 - RNA, 20 nt, Human
gggaaagagaaagucuucau

SEQ ID NO: 1373705 - RNA, 19 nt, Human
ggggacucugucccauggc

SEQ ID NO: 1373706 - RNA, 20 nt, Human
uagagagcuggaacaugaug

SEQ ID NO: 1373707 - RNA, 28 nt, Human
uaggaaggaggcaacaacaggaaccuug

SEQ ID NO: 1373708 - RNA, 24 nt, Human
uccagccccaaagaagaggaagga

SEQ ID NO: 1373709 - RNA, 22 nt, Human
uccucuccuccacucccuguug

SEQ ID NO: 1373710 - RNA, 24 nt, Human
uccuuuagcaauaaauacugaacu

SEQ ID NO: 1373711 - RNA, 23 nt, Human
ugaggacagaggagagagaagag

SEQ ID NO: 1373712 - RNA, 19 nt, Human
ugaggcuuaggaaggaggc

SEQ ID NO: 1373713 - RNA, 19 nt, Human
ugccagaagaguauguggc

SEQ ID NO: 1373714 - RNA, 22 nt, Human
uggaagagacaggagagauaug

SEQ ID NO: 1373715 - RNA, 21 nt, Human
ugucuccucuccuccacuccc

SEQ ID NO: 1373716 - RNA, 20 nt, Human
uuaaaacauagagagcagug

SEQ ID NO: 1373717 - RNA, 20 nt, Human
aacacggugaaaccucgucu

SEQ ID NO: 1373718 - RNA, 21 nt, Human
aacacggugaaaccucgucuc

SEQ ID NO: 1373719 - RNA, 24 nt, Human
aauggcaugaaccugggaggugga

SEQ ID NO: 1373720 - RNA, 19 nt, Human
acaaaaacaaaaauccaga

SEQ ID NO: 1373721 - RNA, 18 nt, Human
acacggugaaaccucguc

SEQ ID NO: 1373722 - RNA, 19 nt, Human
acacggugaaaccucgucu

SEQ ID NO: 1373723 - RNA, 24 nt, Human
accucgucucuacuaaaaauacaa

SEQ ID NO: 1373724 - RNA, 26 nt, Human
acgcaggcagaucacgaggccgggag

SEQ ID NO: 1373725 - RNA, 21 nt, Human
acugcacucccgccugggcgg

SEQ ID NO: 1373726 - RNA, 24 nt, Human
acugcacucccgccugggcggcag

SEQ ID NO: 1373727 - RNA, 26 nt, Human
acugcacucccgccugggcggcagag

SEQ ID NO: 1373728 - RNA, 21 nt, Human
acuuaaguucuacugccuguu

SEQ ID NO: 1373729 - RNA, 18 nt, Human
agcacuuugggaggccga

SEQ ID NO: 1373730 - RNA, 23 nt, Human
agccaggcgugguggcaggugcc

SEQ ID NO: 1373731 - RNA, 19 nt, Human
aggcagaucacgaggccgg

SEQ ID NO: 1373732 - RNA, 21 nt, Human
aggcaggagaauggcaugaac

SEQ ID NO: 1373733 - RNA, 22 nt, Human
aggcaggagaauggcaugaacc

SEQ ID NO: 1373734 - RNA, 24 nt, Human
aggcaggagaauggcaugaaccug

SEQ ID NO: 1373735 - RNA, 19 nt, Human
aggcugaggcaggagaaug

SEQ ID NO: 1373736 - RNA, 19 nt, Human
aucaugccacugccacugg

SEQ ID NO: 1373737 - RNA, 21 nt, Human
caagacuccgucucaaaaaaa

SEQ ID NO: 1373738 - RNA, 24 nt, Human
cacaucuauaaucccagcacuuug

SEQ ID NO: 1373739 - RNA, 23 nt, Human
cacugcacucccgccugggcggc

SEQ ID NO: 1373740 - RNA, 24 nt, Human
cacugcacucccgccugggcggca

SEQ ID NO: 1373741 - RNA, 19 nt, Human
cagagcaagacuccgucuc

SEQ ID NO: 1373742 - RNA, 23 nt, Human
cagagcaagacuccgucucaaaa

SEQ ID NO: 1373743 - RNA, 18 nt, Human
cagcacuuugggaggccg

SEQ ID NO: 1373744 - RNA, 24 nt, Human
cagcacuuugggaggccgacgcag

SEQ ID NO: 1373745 - RNA, 24 nt, Human
cagcuacucgggaggcugaggcag

SEQ ID NO: 1373746 - RNA, 19 nt, Human
caguaggccgggcgcggug

SEQ ID NO: 1373747 - RNA, 23 nt, Human
caucuauaaucccagcacuuugg

SEQ ID NO: 1373748 - RNA, 20 nt, Human
ccacugcacucccgccuggg

SEQ ID NO: 1373749 - RNA, 21 nt, Human
ccacugcacucccgccugggc

SEQ ID NO: 1373750 - RNA, 24 nt, Human
ccacugcacucccgccugggcggc

SEQ ID NO: 1373751 - RNA, 18 nt, Human
cccccgcaaugaaggauc

SEQ ID NO: 1373752 - RNA, 21 nt, Human
ccuggcuaacacggugaaacc

SEQ ID NO: 1373753 - RNA, 24 nt, Human
ccuggcuaacacggugaaaccucg

SEQ ID NO: 1373754 - RNA, 22 nt, Human
ccugggcggcagagcaagacuc

SEQ ID NO: 1373755 - RNA, 21 nt, Human
ccuguagucccagcuacucgg

SEQ ID NO: 1373756 - RNA, 24 nt, Human
cgccugggcggcagagcaagacuc

SEQ ID NO: 1373757 - RNA, 18 nt, Human
cggacucccggcucgcgu

SEQ ID NO: 1373758 - RNA, 21 nt, Human
cuauaaucccagcacuuuggg

SEQ ID NO: 1373759 - RNA, 18 nt, Human
cucaaaaaaaaaaaaaaa

SEQ ID NO: 1373760 - RNA, 24 nt, Human
cucacaucuauaaucccagcacuu

SEQ ID NO: 1373761 - RNA, 19 nt, Human
cuccgucucaaaaaaaaaa

SEQ ID NO: 1373762 - RNA, 18 nt, Human
cuggcuaacacggugaaa

SEQ ID NO: 1373763 - RNA, 19 nt, Human
gaaaccucgucucuacuaa

SEQ ID NO: 1373764 - RNA, 18 nt, Human
gauaucaugccacugcca

SEQ ID NO: 1373765 - RNA, 24 nt, Human
gccacugcacucccgccugggcgg

SEQ ID NO: 1373766 - RNA, 19 nt, Human
gcuaacacggugaaaccuc

SEQ ID NO: 1373767 - RNA, 21 nt, Human
ggagcuuauagugagcugaua

SEQ ID NO: 1373768 - RNA, 21 nt, Human
ggagguggagcuuauagugag

SEQ ID NO: 1373769 - RNA, 24 nt, Human
ggcagagcaagacuccgucucaaa

SEQ ID NO: 1373770 - RNA, 21 nt, Human
ggcucacaucuauaaucccag

SEQ ID NO: 1373771 - RNA, 24 nt, Human
gggcgcgguggcucacaucuauaa

SEQ ID NO: 1373772 - RNA, 24 nt, Human
guaggccgggcgcgguggcucaca

SEQ ID NO: 1373773 - RNA, 20 nt, Human
guggagcuuauagugagcug

SEQ ID NO: 1373774 - RNA, 24 nt, Human
uaacacggugaaaccucgucucua

SEQ ID NO: 1373775 - RNA, 19 nt, Human
uaauuuuccuccacauccc

SEQ ID NO: 1373776 - RNA, 20 nt, Human
ucaaaaaaaaaaaaaaaaaa

SEQ ID NO: 1373777 - RNA, 21 nt, Human
ucaaaaaaaaaaaaaaaaaaa

SEQ ID NO: 1373778 - RNA, 24 nt, Human
ucaaaaaaaaaaaaaaaaaaagau

SEQ ID NO: 1373779 - RNA, 24 nt, Human
ucacgaggccgggagauugagacc

SEQ ID NO: 1373780 - RNA, 23 nt, Human
uccgucucaaaaaaaaaaaaaaa

SEQ ID NO: 1373781 - RNA, 22 nt, Human
uccuccacaucccccgcaauga

SEQ ID NO: 1373782 - RNA, 22 nt, Human
ucucuacuaaaaauacaaaaaa

SEQ ID NO: 1373783 - RNA, 24 nt, Human
ugagaccauccuggcuaacacggu

SEQ ID NO: 1373784 - RNA, 24 nt, Human
ugaggcaggagaauggcaugaacc

SEQ ID NO: 1373785 - RNA, 24 nt, Human
ugaggcaggagaauggcaugaacc

SEQ ID NO: 1373786 - RNA, 24 nt, Human
ugauacaacaaaguuaagggaaga

SEQ ID NO: 1373787 - RNA, 23 nt, Human
ugccuguagucccagcuacucgg

SEQ ID NO: 1373788 - RNA, 24 nt, Human
ugccuguagucccagcuacucggg

SEQ ID NO: 1373789 - RNA, 22 nt, Human
uggcucacaucuauaaucccag

SEQ ID NO: 1373790 - RNA, 24 nt, Human
uggcucacaucuauaaucccagca

SEQ ID NO: 1373791 - RNA, 24 nt, Human
ugggaggccgacgcaggcagauca

SEQ ID NO: 1373792 - RNA, 24 nt, Human
ugggagguggagcuuauagugagc

SEQ ID NO: 1373793 - RNA, 24 nt, Human
ugguggcaggugccuguaguccca

SEQ ID NO: 1373794 - RNA, 21 nt, Human
uuacaaaaacaaaaauccaga

SEQ ID NO: 1373795 - RNA, 22 nt, Human
aaaaaaaaaaaaaaggaaagaa

SEQ ID NO: 1373796 - RNA, 19 nt, Human
aaaaaaucagaacaaaacu

SEQ ID NO: 1373797 - RNA, 25 nt, Human
aaaagaaaaucagguuuuaacaaaa

SEQ ID NO: 1373798 - RNA, 18 nt, Human
aaacuaauuuauuauagu

SEQ ID NO: 1373799 - RNA, 21 nt, Human
aacacagacuggaagccuaga

SEQ ID NO: 1373800 - RNA, 24 nt, Human
aaccaaacacagacuggaagccua

SEQ ID NO: 1373801 - RNA, 22 nt, Human
aauguggauacuacaaaagaaa

SEQ ID NO: 1373802 - RNA, 23 nt, Human
acaaaaaaaaaaaaaaggaaaga

SEQ ID NO: 1373803 - RNA, 22 nt, Human
acaacaaaaaaaaaaaaaagga

SEQ ID NO: 1373804 - RNA, 23 nt, Human
acugcaacuagcaagaacuauaa

SEQ ID NO: 1373805 - RNA, 21 nt, Human
agacuaacacgggucuaagca

SEQ ID NO: 1373806 - RNA, 20 nt, Human
agcacaacaacuaaaauaaa

SEQ ID NO: 1373807 - RNA, 19 nt, Human
aguacuauuuaaaauacag

SEQ ID NO: 1373808 - RNA, 21 nt, Human
auaaaaaccaaacacagacug

SEQ ID NO: 1373809 - RNA, 18 nt, Human
auaaagcaaaaacgucuu

SEQ ID NO: 1373810 - RNA, 21 nt, Human
auauacauauuucuauugccu

SEQ ID NO: 1373811 - RNA, 23 nt, Human
auauauucauauauauauacaca

SEQ ID NO: 1373812 - RNA, 22 nt, Human
auaugaaccacccucccacugc

SEQ ID NO: 1373813 - RNA, 24 nt, Human
auucauuguuuaaaggcaaacauu

SEQ ID NO: 1373814 - RNA, 22 nt, Human
caacaaaaaaaaaaaaaaggaa

SEQ ID NO: 1373815 - RNA, 22 nt, Human
caauauauucauauauauauac

SEQ ID NO: 1373816 - RNA, 23 nt, Human
cagaaggggucaugcuacuggua

SEQ ID NO: 1373817 - RNA, 23 nt, Human
caguacuauuuaaaauacagaaa

SEQ ID NO: 1373818 - RNA, 19 nt, Human
ccguccucuccacucugcc

SEQ ID NO: 1373819 - RNA, 19 nt, Human
cuacugguaaaagcacagg

SEQ ID NO: 1373820 - RNA, 23 nt, Human
cuagcaaagucaaaaauacaaaa

SEQ ID NO: 1373821 - RNA, 18 nt, Human
cugccacaaacuagcaaa

SEQ ID NO: 1373822 - RNA, 24 nt, Human
gcaugggauacaacaauacaccuu

SEQ ID NO: 1373823 - RNA, 22 nt, Human
gcuuuuuggaggacaaaguacu

SEQ ID NO: 1373824 - RNA, 22 nt, Human
ggaggacaaaguacuuucuacg

SEQ ID NO: 1373825 - RNA, 19 nt, Human
gucuacuaaagauaaaaag

SEQ ID NO: 1373826 - RNA, 19 nt, Human
uaaaaagcaacaugcuaca

SEQ ID NO: 1373827 - RNA, 25 nt, Human
uaacuauuacaacaaaaaaaaaaaa

SEQ ID NO: 1373828 - RNA, 19 nt, Human
uacacacgcauugugugug

SEQ ID NO: 1373829 - RNA, 19 nt, Human
uaccagaagcaaaauaucc

SEQ ID NO: 1373830 - RNA, 25 nt, Human
uagaacagcauuauugaguuuagca

SEQ ID NO: 1373831 - RNA, 21 nt, Human
uagcaagaacuauaaaugaua

SEQ ID NO: 1373832 - RNA, 25 nt, Human
uagcacaacaacuaaaauaaaauaa

SEQ ID NO: 1373833 - RNA, 28 nt, Human
uauaauaacaaucauaauaaugauaaga

SEQ ID NO: 1373834 - RNA, 21 nt, Human
uauacacacgcauugugugug

SEQ ID NO: 1373835 - RNA, 22 nt, Human
uauacacacgcauuguguguga

SEQ ID NO: 1373836 - RNA, 21 nt, Human
uauauacacacgcauugugug

SEQ ID NO: 1373837 - RNA, 18 nt, Human
uauauauauacacacgca

SEQ ID NO: 1373838 - RNA, 24 nt, Human
uauaugaauauauugguguauaua

SEQ ID NO: 1373839 - RNA, 19 nt, Human
ucaacuaacaucauucaac

SEQ ID NO: 1373840 - RNA, 18 nt, Human
ucuucaacuuguucacuu

SEQ ID NO: 1373841 - RNA, 20 nt, Human
ugaaauauccacccguccuc

SEQ ID NO: 1373842 - RNA, 20 nt, Human
ugauaagaauaaaaaccaaa

SEQ ID NO: 1373843 - RNA, 25 nt, Human
ugauaagaauaaaaaccaaacacag

SEQ ID NO: 1373844 - RNA, 24 nt, Human
ugauuuauuuugguaguuguuuuu

SEQ ID NO: 1373845 - RNA, 18 nt, Human
ugccacacagauauagag

SEQ ID NO: 1373846 - RNA, 25 nt, Human
ugccacacagauauagagacuaaca

SEQ ID NO: 1373847 - RNA, 19 nt, Human
ugcgauacgcuauacuaaa

SEQ ID NO: 1373848 - RNA, 23 nt, Human
uggauacuacaaaagaaaaucag

SEQ ID NO: 1373849 - RNA, 20 nt, Human
uggaugugaaaaauauuacc

SEQ ID NO: 1373850 - RNA, 22 nt, Human
ugugugaguauauaugaauaua

SEQ ID NO: 1373851 - RNA, 18 nt, Human
uguucuaaaaaaucagaa

SEQ ID NO: 1373852 - RNA, 24 nt, Human
uguucuaaaaaaucagaacaaaac

SEQ ID NO: 1373853 - RNA, 18 nt, Human
uuaaaggcaaacauucaa

SEQ ID NO: 1373854 - RNA, 23 nt, Human
uucauauauauauacacacgcau

SEQ ID NO: 1373855 - RNA, 20 nt, Human
uucuaagccucuuuaacuau

SEQ ID NO: 1373856 - RNA, 30 nt, Human; identical to SEQ ID NO: 794184

SEQ ID NO: 1373857 - RNA, 25 nt, Human
uuuuauggaugugaaaaauauuacc

SEQ ID NO: 1373858 - RNA, 19 nt, Human
aagccccaggccugcucag

SEQ ID NO: 1373859 - RNA, 19 nt, Human
agccccaggccugcucagc

SEQ ID NO: 1373860 - RNA, 24 nt, Human
aggacggcccaucuaugccuguag

SEQ ID NO: 1373861 - RNA, 19 nt, Human
aggagcuuccucccgggaa

SEQ ID NO: 1373862 - RNA, 19 nt, Human
aggcccccgacccaugacc

SEQ ID NO: 1373863 - RNA, 22 nt, Human
aggcccccgacccaugaccugc

SEQ ID NO: 1373864 - RNA, 27 nt, Human
aggcccccgacccaugaccugcccagg

SEQ ID NO: 1373865 - RNA, 19 nt, Human
agggacauagaaccaagcc

SEQ ID NO: 1373866 - RNA, 24 nt, Human
auuggagagggucgcagcgaggag

SEQ ID NO: 1373867 - RNA, 19 nt, Human
caagccccaggccugcuca

SEQ ID NO: 1373868 - RNA, 23 nt, Human
caagggaaacaaaaggacggccc

SEQ ID NO: 1373869 - RNA, 24 nt, Human
cagcagggaauggcccucucuggc

SEQ ID NO: 1373870 - RNA, 19 nt, Human
cccaugaccugcccagugu

SEQ ID NO: 1373871 - RNA, 20 nt, Human
cccccgacccaugaccugcc

SEQ ID NO: 1373872 - RNA, 20 nt, Human
ccuggcacggggaggccccc

SEQ ID NO: 1373873 - RNA, 21 nt, Human
ccuggcacggggaggcccccg

SEQ ID NO: 1373874 - RNA, 18 nt, Human
cgggaagaugagguagca

SEQ ID NO: 1373875 - RNA, 25 nt, Human
cucucuggccucucuggggagagau

SEQ ID NO: 1373876 - RNA, 19 nt, Human
cucuggccucucuggcccc

SEQ ID NO: 1373877 - RNA, 23 nt, Human
gcaccugggacugccucagaggc

SEQ ID NO: 1373878 - RNA, 24 nt, Human
gcagcagggaauggcccucucugg

SEQ ID NO: 1373879 - RNA, 18 nt, Human
ggaaacaaaaggacggcc

SEQ ID NO: 1373880 - RNA, 21 nt, Human
guguguggccgcagagucucc

SEQ ID NO: 1373881 - RNA, 19 nt, Human
uaacaagggaaacaaaagg

SEQ ID NO: 1373882 - RNA, 20 nt, Human
uaacaagggaaacaaaagga

SEQ ID NO: 1373883 - RNA, 23 nt, Human
uagaaccaagccccaggccugcu

SEQ ID NO: 1373884 - RNA, 27 nt, Human
ucagggcagcagggaauggcccucucu

SEQ ID NO: 1373885 - RNA, 19 nt, Human
ucccuggcacggggaggcc

SEQ ID NO: 1373886 - RNA, 23 nt, Human
ucccuggcacggggaggcccccg

SEQ ID NO: 1373887 - RNA, 23 nt, Human
ucuguguguuuaaggcgugcuug

SEQ ID NO: 1373888 - RNA, 19 nt, Human
ugaaggagcuuccucccgg

SEQ ID NO: 1373889 - RNA, 21 nt, Human
ugaccugcccagugucauguc

SEQ ID NO: 1373890 - RNA, 20 nt, Human
ugccucagaggcccaggcag

SEQ ID NO: 1373891 - RNA, 21 nt, Human
ugccucagaggcccaggcagu

SEQ ID NO: 1373892 - RNA, 21 nt, Human
ugccuguagcccaggcguagg

SEQ ID NO: 1373893 - RNA, 18 nt, Human
ugcuugcauguugugugu

SEQ ID NO: 1373894 - RNA, 28 nt, Human
uguguggccgcagagucucccuccccuc

SEQ ID NO: 1373895 - RNA, 18 nt, Human
uguugggccggugugaga

SEQ ID NO: 1373896 - RNA, 19 nt, Human
aaaaaaagccaaucacaaa

SEQ ID NO: 1373897 - RNA, 28 nt, Human
aaaaaaccaaagcaaacaacuggaaaau

SEQ ID NO: 1373898 - RNA, 19 nt, Human
aaaaauguggagaaacugg

SEQ ID NO: 1373899 - RNA, 21 nt, Human
aaaauaacaagcguuggcaaa

SEQ ID NO: 1373900 - RNA, 18 nt, Human
aaacaaacuaccccacac

SEQ ID NO: 1373901 - RNA, 24 nt, Human
aaaccaaagcaaacaacuggaaaa

SEQ ID NO: 1373902 - RNA, 19 nt, Human
aaagaacugcaaugcaaca

SEQ ID NO: 1373903 - RNA, 21 nt, Human
aaaugcuuuuuaacaaggauu

SEQ ID NO: 1373904 - RNA, 23 nt, Human
aacaacaaacaaccaauuaaaau

SEQ ID NO: 1373905 - RNA, 20 nt, Human
aacacaauuaaaaaaaugaa

SEQ ID NO: 1373906 - RNA, 19 nt, Human
acaccauuaauuagggaaa

SEQ ID NO: 1373907 - RNA, 23 nt, Human
acaccauuaauuagggaaaugaa

SEQ ID NO: 1373908 - RNA, 23 nt, Human
acuacaucaaacuuuaaaacucc

SEQ ID NO: 1373909 - RNA, 18 nt, Human
acuagcaaaaaaccaaag

SEQ ID NO: 1373910 - RNA, 18 nt, Human
agaaacaaacuaccccac

SEQ ID NO: 1373911 - RNA, 18 nt, Human
agaauaaaacaggggaaa

SEQ ID NO: 1373912 - RNA, 23 nt, Human
agacagaaaguagaaugggggac

SEQ ID NO: 1373913 - RNA, 21 nt, Human
agacagaaaguagaaugguga

SEQ ID NO: 1373914 - RNA, 19 nt, Human
agagugagaaggcaaccua

SEQ ID NO: 1373915 - RNA, 23 nt, Human
agcaaacaacuggaaaauaacaa

SEQ ID NO: 1373916 - RNA, 20 nt, Human
aggcaacaaagccaaaauag

SEQ ID NO: 1373917 - RNA, 26 nt, Human
agggaaaaaaagccaaucacaaaaaa

SEQ ID NO: 1373918 - RNA, 22 nt, Human
agugagaaggcaaccuauagaa

SEQ ID NO: 1373919 - RNA, 23 nt, Human
auaugcaaaagaauaaaguugga

SEQ ID NO: 1373920 - RNA, 22 nt, Human
augaugccaagggaaaaaaagc

SEQ ID NO: 1373921 - RNA, 23 nt, Human
caaaaaaccaaagcaaacaacug

SEQ ID NO: 1373922 - RNA, 26 nt, Human
caaaacuuauuccaaaaauacgguaa

SEQ ID NO: 1373923 - RNA, 23 nt, Human
caaaagcacaggcaacaaagcca

SEQ ID NO: 1373924 - RNA, 20 nt, Human
caauagccagcauuauucac

SEQ ID NO: 1373925 - RNA, 20 nt, Human
caaugcaacaacaacaaaca

SEQ ID NO: 1373926 - RNA, 23 nt, Human
caaugcaacaacaacaaacaacc

SEQ ID NO: 1373927 - RNA, 24 nt, Human
cacaggcaacaaagccaaaauaga

SEQ ID NO: 1373928 - RNA, 22 nt, Human
caccaugggugauccugaggac

SEQ ID NO: 1373929 - RNA, 18 nt, Human
cagaaaguagaaugguga

SEQ ID NO: 1373930 - RNA, 23 nt, Human
caugacaggcccuggugugugau

SEQ ID NO: 1373931 - RNA, 20 nt, Human
cauuggauuuggcaaugauu

SEQ ID NO: 1373932 - RNA, 21 nt, Human
ccaaaaggaggaagcaacaca

SEQ ID NO: 1373933 - RNA, 18 nt, Human
cccccaucccuccacccc

SEQ ID NO: 1373934 - RNA, 19 nt, Human
cccucccccaucccuccac

SEQ ID NO: 1373935 - RNA, 23 nt, Human
cuccuaaugcuaucccuccccca

SEQ ID NO: 1373936 - RNA, 18 nt, Human
cugcaaugcaacaacaac

SEQ ID NO: 1373937 - RNA, 18 nt, Human
cuggguauauacccaaaa

SEQ ID NO: 1373938 - RNA, 20 nt, Human
gaaaaaaugcuaaacaccau

SEQ ID NO: 1373939 - RNA, 25 nt, Human
gaauagagagcucagaaacaaacuu

SEQ ID NO: 1373940 - RNA, 18 nt, Human
gacaggcccuggugugug

SEQ ID NO: 1373941 - RNA, 21 nt, Human
gcacaggcaacaaagccaaaa

SEQ ID NO: 1373942 - RNA, 22 nt, Human
ggaaaaaaagccaaucacaaaa

SEQ ID NO: 1373943 - RNA, 18 nt, Human
gggcggagggggaggugg

SEQ ID NO: 1373944 - RNA, 23 nt, Human
ggugauccugaggacaugaugcc

SEQ ID NO: 1373945 - RNA, 18 nt, Human
guuggcaaaaauguggag

SEQ ID NO: 1373946 - RNA, 21 nt, Human
uaaaacucucagaauaaaaca

SEQ ID NO: 1373947 - RNA, 24 nt, Human
uaaaaugaauuaaagaccuaaaug

SEQ ID NO: 1373948 - RNA, 18 nt, Human
uaaacuggacuacaucaa

SEQ ID NO: 1373949 - RNA, 21 nt, Human
uacaaauggucuaacaaacac

SEQ ID NO: 1373950 - RNA, 22 nt, Human
uacccaaaagaauugaaagcag

SEQ ID NO: 1373951 - RNA, 21 nt, Human
uaccuagaguagucaaauuca

SEQ ID NO: 1373952 - RNA, 22 nt, Human
uaccuagaguagucaaauucau

SEQ ID NO: 1373953 - RNA, 22 nt, Human
uacuagcaaaaaaccaaagcaa

SEQ ID NO: 1373954 - RNA, 23 nt, Human
uacuagcaaaaaaccaaagcaaa

SEQ ID NO: 1373955 - RNA, 19 nt, Human
uagcagcauuauucacaau

SEQ ID NO: 1373956 - RNA, 21 nt, Human
uagccaaaaggaggaagcaac

SEQ ID NO: 1373957 - RNA, 26 nt, Human
uaggauggcuacuagcaaaaaaccaa

SEQ ID NO: 1373958 - RNA, 23 nt, Human
uaguugacacuacuaaacugugc

SEQ ID NO: 1373959 - RNA, 22 nt, Human
uauacaaauggucuaacaaaca

SEQ ID NO: 1373960 - RNA, 23 nt, Human
uauacaaauggucuaacaaacac

SEQ ID NO: 1373961 - RNA, 25 nt, Human
uaugcaaaagaauaaaguuggaccc

SEQ ID NO: 1373962 - RNA, 26 nt, Human
ucaaaaggaagaaaauucugacacaa

SEQ ID NO: 1373963 - RNA, 18 nt, Human
ucaacagagugagaaggc

SEQ ID NO: 1373964 - RNA, 19 nt, Human
uccaaggaagauauacaaa

SEQ ID NO: 1373965 - RNA, 22 nt, Human
uccauaugcaaaagaauaaagu

SEQ ID NO: 1373966 - RNA, 18 nt, Human
ucccccaucccuccaccc

SEQ ID NO: 1373967 - RNA, 23 nt, Human
ucccccaucccuccaccccauga

SEQ ID NO: 1373968 - RNA, 25 nt, Human
uccuaaugcuaucccucccccaucc

SEQ ID NO: 1373969 - RNA, 27 nt, Human
ucuaacaaacaccugaaaaaaugcuaa

SEQ ID NO: 1373970 - RNA, 23 nt, Human
ucuccuaaugcuaucccuccccc

SEQ ID NO: 1373971 - RNA, 19 nt, Human
ucuggguauauacccaaaa

SEQ ID NO: 1373972 - RNA, 21 nt, Human
ugaaaaaaugcuaaacaccau

SEQ ID NO: 1373973 - RNA, 22 nt, Human
ugaaaccaaaagcacaggcaac

SEQ ID NO: 1373974 - RNA, 24 nt, Human
ugaaaccaaaagcacaggcaacaa

SEQ ID NO: 1373975 - RNA, 21 nt, Human
ugacacaugguacaccauggg

SEQ ID NO: 1373976 - RNA, 23 nt, Human
ugagaccauccaguggggaaagu

SEQ ID NO: 1373977 - RNA, 22 nt, Human
ugaugccaagggaaaaaaagcc

SEQ ID NO: 1373978 - RNA, 24 nt, Human
ugaugccaagggaaaaaaagccaa

SEQ ID NO: 1373979 - RNA, 25 nt, Human
ugcaacaacaacaaacaaccaauua

SEQ ID NO: 1373980 - RNA, 20 nt, Human
ugcaauagcuaaagcuauaa

SEQ ID NO: 1373981 - RNA, 21 nt, Human
ugccaagggaaaaaaagccaa

SEQ ID NO: 1373982 - RNA, 18 nt, Human
uggagaaacuggaacucu

SEQ ID NO: 1373983 - RNA, 18 nt, Human
uguauauuuuaacacaau

SEQ ID NO: 1373984 - RNA, 19 nt, Human
uguauauuuuaacacaauu

SEQ ID NO: 1373985 - RNA, 22 nt, Human
ugugcauuauugauagaaaagu

SEQ ID NO: 1373986 - RNA, 22 nt, Human
uguggagaaacuggaacucuug

SEQ ID NO: 1373987 - RNA, 20 nt, Human
uuaaagaccuaaaugcaaua

SEQ ID NO: 1373988 - RNA, 21 nt, Human
uuaauggguauaagguuucac

SEQ ID NO: 1373989 - RNA, 26 nt, Human
uuacguauaucuccuaaugcuauccc

SEQ ID NO: 1373990 - RNA, 18 nt, Human
uucaaccuucaaaaggaa

SEQ ID NO: 1373991 - RNA, 23 nt, Human
uuucaacaaauagugcugggaag

SEQ ID NO: 1373992 - RNA, 22 nt, Human
aucuauccaaagcccaaccucu

SEQ ID NO: 1373993 - RNA, 18 nt, Human
ccucaaucuaacaugcua

SEQ ID NO: 1373994 - RNA, 19 nt, Human
ucuuuuuuaugaaacaagg

SEQ ID NO: 1373995 - RNA, 18 nt, Human
ugaccggacccaggaguc

SEQ ID NO: 1373996 - RNA, 27 nt, Human
ugucuaucuauccaaagcccaaccucu

SEQ ID NO: 1373997 - RNA, 19 nt, Human
auauacaugaaaagauuug

SEQ ID NO: 1373998 - RNA, 19 nt, Human
ccagcagcgggacccgcag

SEQ ID NO: 1373999 - RNA, 23 nt, Human
ccgcaguagggguaaugcuccag

SEQ ID NO: 1374000 - RNA, 20 nt, Human
cgcugccagcagcgggaccc

SEQ ID NO: 1374001 - RNA, 21 nt, Human
gcaguagggguaaugcuccag

SEQ ID NO: 1374002 - RNA, 21 nt, Human
aaaaacaaaguuuugcccaca

SEQ ID NO: 1374003 - RNA, 21 nt, Human
aaaaccaaaguacucugcugg

SEQ ID NO: 1374004 - RNA, 25 nt, Human
aaacaaaaacaaaguuuugcccaca
